United States Patent 7,691,997 (FUNCTIONAL AND HYPERFUNCTIONAL SIRNA) - sequence listing, part 38

SEQ ID NO: 1543665 - RNA, 19 nt, Homo sapiens
ggacaccgauaugcuaaau

SEQ ID NO: 1543666 - RNA, 19 nt, Homo sapiens
gcaggacaccgauaugcua

SEQ ID NO: 1543667 - RNA, 19 nt, Homo sapiens
gaaaggacagggcucugaa

SEQ ID NO: 1543668 - RNA, 19 nt, Homo sapiens
gcucaaggcagacagcaaa

SEQ ID NO: 1543669 - RNA, 19 nt, Homo sapiens
ggagugcagucccugagau

SEQ ID NO: 1543670 - RNA, 19 nt, Homo sapiens
gcacaggcagcuacagaga

SEQ ID NO: 1543671 - RNA, 19 nt, Homo sapiens
ccgauaugcuaaauaccua

SEQ ID NO: 1543672 - RNA, 19 nt, Homo sapiens
gggagagcaucgccacaga

SEQ ID NO: 1543673 - RNA, 19 nt, Homo sapiens
acaccgauaugcuaaauac

SEQ ID NO: 1543674 - RNA, 19 nt, Homo sapiens
acaggcagcuacagagaga

SEQ ID NO: 1543675 - RNA, 19 nt, Homo sapiens
caaggcagacagcaaagaa

SEQ ID NO: 1543676 - RNA, 19 nt, Homo sapiens
gaacggggcugcucaagcu

SEQ ID NO: 1543677 - RNA, 19 nt, Homo sapiens
gaaggagggcugguuguca

SEQ ID NO: 1543678 - RNA, 19 nt, Homo sapiens
ggaagacaagggccaagga

SEQ ID NO: 1543679 - RNA, 19 nt, Homo sapiens
gagugcagucccugagaua

SEQ ID NO: 1543680 - RNA, 19 nt, Homo sapiens
gugcagucccugagauaaa

SEQ ID NO: 1543681 - RNA, 19 nt, Homo sapiens
cgggauacgaugaaacuuu

SEQ ID NO: 1543682 - RNA, 19 nt, Homo sapiens
ucucagaggaggagcaauu

SEQ ID NO: 1543683 - RNA, 19 nt, Homo sapiens
gaucacuucccgcuucuuc

SEQ ID NO: 1543684 - RNA, 19 nt, Homo sapiens
gagggcugguugucagaga

SEQ ID NO: 1543685 - RNA, 19 nt, Homo sapiens
aagcugcccuggaagacuu

SEQ ID NO: 1543686 - RNA, 19 nt, Homo sapiens
caugggaccuggagaagcu

SEQ ID NO: 1543687 - RNA, 19 nt, Homo sapiens
ugaagagucugaagaucac

SEQ ID NO: 1543688 - RNA, 19 nt, Homo sapiens
gaccgucucucaggacaag

SEQ ID NO: 1543689 - RNA, 19 nt, Homo sapiens
uaaucgcaccuuccacaaa

SEQ ID NO: 1543690 - RNA, 19 nt, Homo sapiens
cccaaaagcugcccuggaa

SEQ ID NO: 1543691 - RNA, 19 nt, Homo sapiens
gacaauggaggaagacaag

SEQ ID NO: 1543692 - RNA, 19 nt, Homo sapiens
cauggcugcugcuggaaga

SEQ ID NO: 1543693 - RNA, 19 nt, Homo sapiens
ggaauggaaaggccuaugc

SEQ ID NO: 1543694 - RNA, 19 nt, Homo sapiens
uaaauaccuaccaacaguu

SEQ ID NO: 1543695 - RNA, 19 nt, Homo sapiens
caggacaccgauaugcuaa

SEQ ID NO: 1543696 - RNA, 19 nt, Homo sapiens
cugaagagucugaagauca

SEQ ID NO: 1543697 - RNA, 19 nt, Homo sapiens
gcuaaauaccuaccaacag

SEQ ID NO: 1543698 - RNA, 19 nt, Homo sapiens
aaucgcaccuuccacaaac

SEQ ID NO: 1543699 - RNA, 19 nt, Homo sapiens
cgacaauggaggaagacaa

SEQ ID NO: 1543700 - RNA, 19 nt, Homo sapiens
ggagagcaucgccacagau

SEQ ID NO: 1543701 - RNA, 19 nt, Homo sapiens
agaaaggacagggcucuga

SEQ ID NO: 1543702 - RNA, 19 nt, Homo sapiens
ggccaugggaccuggagaa

SEQ ID NO: 1543703 - RNA, 19 nt, Homo sapiens
uaugcuaaauaccuaccaa

SEQ ID NO: 1543704 - RNA, 19 nt, Homo sapiens
cuccaucccuacuggcaaa

SEQ ID NO: 1543705 - RNA, 19 nt, Homo sapiens
gauggugugccaaaucaag

SEQ ID NO: 1543706 - RNA, 19 nt, Homo sapiens
aggcgacaauggaggaaga

SEQ ID NO: 1543707 - RNA, 19 nt, Homo sapiens
gacaccgauaugcuaaaua

SEQ ID NO: 1543708 - RNA, 19 nt, Homo sapiens
ggugauggugugccaaauc

SEQ ID NO: 1543709 - RNA, 19 nt, Homo sapiens
caaaagcugcccuggaaga

SEQ ID NO: 1543710 - RNA, 19 nt, Homo sapiens
gggcugguugucagagaaa

SEQ ID NO: 1543711 - RNA, 19 nt, Homo sapiens
aggacucccugcagaagga

SEQ ID NO: 1543712 - RNA, 19 nt, Homo sapiens
cugccaaccucccuaaucg

SEQ ID NO: 1543713 - RNA, 19 nt, Homo sapiens
gaucucagaggaggagcaa

SEQ ID NO: 1543714 - RNA, 19 nt, Homo sapiens
gcaagaauaugauaccuaa

SEQ ID NO: 1543715 - RNA, 19 nt, Homo sapiens
caaaguaucuuguggcaaa

SEQ ID NO: 1543716 - RNA, 19 nt, Homo sapiens
cuucagagcugcauucuuu

SEQ ID NO: 1543717 - RNA, 19 nt, Homo sapiens
caaaggugcucuugcauug

SEQ ID NO: 1543718 - RNA, 19 nt, Homo sapiens
caauggaacuuucuaugaa

SEQ ID NO: 1543719 - RNA, 19 nt, Homo sapiens
gaagaucucaguucucaaa

SEQ ID NO: 1543720 - RNA, 19 nt, Homo sapiens
agaggaaccugaaauguuu

SEQ ID NO: 1543721 - RNA, 19 nt, Homo sapiens
uaacaaaggcacagcauuu

SEQ ID NO: 1543722 - RNA, 19 nt, Homo sapiens
gcacugagaauaugaccua

SEQ ID NO: 1543723 - RNA, 19 nt, Homo sapiens
gacaauggucugcaacuua

SEQ ID NO: 1543724 - RNA, 19 nt, Homo sapiens
gagaggaaccugaaauguu

SEQ ID NO: 1543725 - RNA, 19 nt, Homo sapiens
gcucaucagucucuguaaa

SEQ ID NO: 1543726 - RNA, 19 nt, Homo sapiens
gauggugccugauuuguuc

SEQ ID NO: 1543727 - RNA, 19 nt, Homo sapiens
gacaauaacacaaaggaaa

SEQ ID NO: 1543728 - RNA, 19 nt, Homo sapiens
ugacaaaggugcucuugca

SEQ ID NO: 1543729 - RNA, 19 nt, Homo sapiens
ggacaauggucugcaacuu

SEQ ID NO: 1543730 - RNA, 19 nt, Homo sapiens
caaccugugugucucugua

SEQ ID NO: 1543731 - RNA, 19 nt, Homo sapiens
guacugcccacaauaugua

SEQ ID NO: 1543732 - RNA, 19 nt, Homo sapiens
gugagcaaguuacucuuaa

SEQ ID NO: 1543733 - RNA, 19 nt, Homo sapiens
ucaauggaacuuucuauga

SEQ ID NO: 1543734 - RNA, 19 nt, Homo sapiens
guaaauauugguugcagaa

SEQ ID NO: 1543735 - RNA, 19 nt, Homo sapiens
ucaguaggccuaaauguug

SEQ ID NO: 1543736 - RNA, 19 nt, Homo sapiens
acacacacacacagaaaua

SEQ ID NO: 1543737 - RNA, 19 nt, Homo sapiens
gcgaaccauuuccuacauu

SEQ ID NO: 1543738 - RNA, 19 nt, Homo sapiens
agcaauggcuugugaguga

SEQ ID NO: 1543739 - RNA, 19 nt, Homo sapiens
gaagacauaugcacaaaag

SEQ ID NO: 1543740 - RNA, 19 nt, Homo sapiens
ucaucagucucuguaaaua

SEQ ID NO: 1543741 - RNA, 19 nt, Homo sapiens
ggaguauguuuacaagaca

SEQ ID NO: 1543742 - RNA, 19 nt, Homo sapiens
ggccacagcugccguuucu

SEQ ID NO: 1543743 - RNA, 19 nt, Homo sapiens
gagcgucucuuuucuguug

SEQ ID NO: 1543744 - RNA, 19 nt, Homo sapiens
acacacacacagaaauaua

SEQ ID NO: 1543745 - RNA, 19 nt, Homo sapiens
acaauggucugcaacuuag

SEQ ID NO: 1543746 - RNA, 19 nt, Homo sapiens
cuaggauggugccugauuu

SEQ ID NO: 1543747 - RNA, 19 nt, Homo sapiens
gcaaggguaagcccaaaga

SEQ ID NO: 1543748 - RNA, 19 nt, Homo sapiens
guuauuggcuacagcuuca

SEQ ID NO: 1543749 - RNA, 19 nt, Homo sapiens
aaucacaaguugcaagaau

SEQ ID NO: 1543750 - RNA, 19 nt, Homo sapiens
gcucucaaguagaacauca

SEQ ID NO: 1543751 - RNA, 19 nt, Homo sapiens
gauucuuucugaacaauag

SEQ ID NO: 1543752 - RNA, 19 nt, Homo sapiens
gaagugagcgucucuuuuc

SEQ ID NO: 1543753 - RNA, 19 nt, Homo sapiens
acaagaggccagauccuuu

SEQ ID NO: 1543754 - RNA, 19 nt, Homo sapiens
gagaaggagcaguuggaaa

SEQ ID NO: 1543755 - RNA, 19 nt, Homo sapiens
uaugcucgcugccgaucua

SEQ ID NO: 1543756 - RNA, 19 nt, Homo sapiens
ggauggugccugauuuguu

SEQ ID NO: 1543757 - RNA, 19 nt, Homo sapiens
gggaagugagcgucucuuu

SEQ ID NO: 1543758 - RNA, 19 nt, Homo sapiens
ccagugauguggcuuucug

SEQ ID NO: 1543759 - RNA, 19 nt, Homo sapiens
cgaaccauuuccuacauuc

SEQ ID NO: 1543760 - RNA, 19 nt, Homo sapiens
ccaaagccagcaacacuau

SEQ ID NO: 1543761 - RNA, 19 nt, Homo sapiens
ucacaaguugcaagaauau

SEQ ID NO: 1543762 - RNA, 19 nt, Homo sapiens
ccacagcugccguuucuuc

SEQ ID NO: 1543763 - RNA, 19 nt, Homo sapiens
caacagacagacucaugug

SEQ ID NO: 1543764 - RNA, 19 nt, Homo sapiens
ccuaaauguugcuccaaga

SEQ ID NO: 1543765 - RNA, 19 nt, Homo sapiens
caaagccagcaacacuaua

SEQ ID NO: 1543766 - RNA, 19 nt, Homo sapiens
uggaagacauaugcacaaa

SEQ ID NO: 1543767 - RNA, 19 nt, Homo sapiens
caaagagugcugggaagaa

SEQ ID NO: 1543768 - RNA, 19 nt, Homo sapiens
gccaugagcgggacgagaa

SEQ ID NO: 1543769 - RNA, 19 nt, Homo sapiens
gggcucaucagucucugua

SEQ ID NO: 1543770 - RNA, 19 nt, Homo sapiens
gcgagaggaaccugaaaug

SEQ ID NO: 1543771 - RNA, 19 nt, Homo sapiens
ggagaaggagcaguuggaa

SEQ ID NO: 1543772 - RNA, 19 nt, Homo sapiens
ggacuccuggaacugauuu

SEQ ID NO: 1543773 - RNA, 19 nt, Homo sapiens
cugagaauaugaccuaugg

SEQ ID NO: 1543774 - RNA, 19 nt, Homo sapiens
acaaguugcaagaauauga

SEQ ID NO: 1543775 - RNA, 19 nt, Homo sapiens
ucaaguagaacaucaggau

SEQ ID NO: 1543776 - RNA, 19 nt, Homo sapiens
gguggacaauggucugcaa

SEQ ID NO: 1543777 - RNA, 19 nt, Homo sapiens
aaggauguaugaaauugug

SEQ ID NO: 1543778 - RNA, 19 nt, Homo sapiens
aaauguugcuccaagaucu

SEQ ID NO: 1543779 - RNA, 19 nt, Homo sapiens
acaaaggugcucuugcauu

SEQ ID NO: 1543780 - RNA, 19 nt, Homo sapiens
gaguauguuuacaagacaa

SEQ ID NO: 1543781 - RNA, 19 nt, Homo sapiens
auacauuucuggacuaugc

SEQ ID NO: 1543782 - RNA, 19 nt, Homo sapiens
caugcuaccuaccgucaau

SEQ ID NO: 1543783 - RNA, 19 nt, Homo sapiens
ggaacuuucuaugaaugug

SEQ ID NO: 1543784 - RNA, 19 nt, Homo sapiens
acagagugguggacaaugg

SEQ ID NO: 1543785 - RNA, 19 nt, Homo sapiens
gaaccauuuccuacauuca

SEQ ID NO: 1543786 - RNA, 19 nt, Homo sapiens
uccuacaaaucuacacuuu

SEQ ID NO: 1543787 - RNA, 19 nt, Homo sapiens
cgcugccgaucuaaaguua

SEQ ID NO: 1543788 - RNA, 19 nt, Homo sapiens
uaccuaccgucaaugaaga

SEQ ID NO: 1543789 - RNA, 19 nt, Homo sapiens
cagcugccguuucuucuac

SEQ ID NO: 1543790 - RNA, 19 nt, Homo sapiens
acacacacacacacagaaa

SEQ ID NO: 1543791 - RNA, 19 nt, Homo sapiens
gagucucuguccuacaaau

SEQ ID NO: 1543792 - RNA, 19 nt, Homo sapiens
caucagucucuguaaauau

SEQ ID NO: 1543793 - RNA, 19 nt, Homo sapiens
aucaggaugugcucaaauu

SEQ ID NO: 1543794 - RNA, 19 nt, Homo sapiens
acaagacaauaacacaaag

SEQ ID NO: 1543795 - RNA, 19 nt, Homo sapiens
gggauucuuucugaacaau

SEQ ID NO: 1543796 - RNA, 19 nt, Homo sapiens
cugcagcacugagaauaug

SEQ ID NO: 1543797 - RNA, 19 nt, Homo sapiens
ccaaagagugcugggaaga

SEQ ID NO: 1543798 - RNA, 19 nt, Homo sapiens
caacauggaugcuuuucag

SEQ ID NO: 1543799 - RNA, 19 nt, Homo sapiens
cagggcugcaucauaauuu

SEQ ID NO: 1543800 - RNA, 19 nt, Homo sapiens
ugaaaauacuccccuggaa

SEQ ID NO: 1543801 - RNA, 19 nt, Homo sapiens
ucacauguuuucacuguau

SEQ ID NO: 1543802 - RNA, 19 nt, Homo sapiens
aucacaaguugcaagaaua

SEQ ID NO: 1543803 - RNA, 19 nt, Homo sapiens
uggaguauguuuacaagac

SEQ ID NO: 1543804 - RNA, 19 nt, Homo sapiens
ccuaacguaucaccagcaa

SEQ ID NO: 1543805 - RNA, 19 nt, Homo sapiens
gaugaugagacgacaaugg

SEQ ID NO: 1543806 - RNA, 19 nt, Homo sapiens
ggcccagucucagauucua

SEQ ID NO: 1543807 - RNA, 19 nt, Homo sapiens
ucucuguccuacaaaucua

SEQ ID NO: 1543808 - RNA, 19 nt, Homo sapiens
gaagcucucaaguagaaca

SEQ ID NO: 1543809 - RNA, 19 nt, Homo sapiens
gcucaauggaacuuucuau

SEQ ID NO: 1543810 - RNA, 19 nt, Homo sapiens
ggauucuuucugaacaaua

SEQ ID NO: 1543811 - RNA, 19 nt, Homo sapiens
agugagcaaguuacucuua

SEQ ID NO: 1543812 - RNA, 19 nt, Homo sapiens
gguacugcccacaauaugu

SEQ ID NO: 1543813 - RNA, 19 nt, Homo sapiens
gcugcauucuuuccaccaa

SEQ ID NO: 1543814 - RNA, 19 nt, Homo sapiens
gaagagauuuccaaccauu

SEQ ID NO: 1543815 - RNA, 19 nt, Homo sapiens
uaaccaagauugacaacua

SEQ ID NO: 1543816 - RNA, 19 nt, Homo sapiens
ccaccgaccugaaguauga

SEQ ID NO: 1543817 - RNA, 19 nt, Homo sapiens
caaagcagcagccaaguuu

SEQ ID NO: 1543818 - RNA, 19 nt, Homo sapiens
gaagaugauugagcaaaug

SEQ ID NO: 1543819 - RNA, 19 nt, Homo sapiens
ccacagagccucccauaau

SEQ ID NO: 1543820 - RNA, 19 nt, Homo sapiens
aaagaaacucccagauuua

SEQ ID NO: 1543821 - RNA, 19 nt, Homo sapiens
aaaagaaacucccagauuu

SEQ ID NO: 1543822 - RNA, 19 nt, Homo sapiens
gcagccaaguuuccacgua

SEQ ID NO: 1543823 - RNA, 19 nt, Homo sapiens
gaacuugaaggguguauuc

SEQ ID NO: 1543824 - RNA, 19 nt, Homo sapiens
gaaaagaaacucccagauu

SEQ ID NO: 1543825 - RNA, 19 nt, Homo sapiens
gcacuugacuaugguguuc

SEQ ID NO: 1543826 - RNA, 19 nt, Homo sapiens
gaacuaccuugaccugaac

SEQ ID NO: 1543827 - RNA, 19 nt, Homo sapiens
acuacacucugcuggauua

SEQ ID NO: 1543828 - RNA, 19 nt, Homo sapiens
gaagucaaagcgcuaaaug

SEQ ID NO: 1543829 - RNA, 19 nt, Homo sapiens
ucaaagcgcuaaccaacca

SEQ ID NO: 1543830 - RNA, 19 nt, Homo sapiens
ccacacaaauucuuauucg

SEQ ID NO: 1543831 - RNA, 19 nt, Homo sapiens
agaacuaccuugaccugaa

SEQ ID NO: 1543832 - RNA, 19 nt, Homo sapiens
caacuacacucugcuggau

SEQ ID NO: 1543833 - RNA, 19 nt, Homo sapiens
ugaagaugauugagcaaau

SEQ ID NO: 1543834 - RNA, 19 nt, Homo sapiens
ccgaagagauuuccaacca

SEQ ID NO: 1543835 - RNA, 19 nt, Homo sapiens
gcaacuccaugcucuacau

SEQ ID NO: 1543836 - RNA, 19 nt, Homo sapiens
gcagcaacauugaggucuu

SEQ ID NO: 1543837 - RNA, 19 nt, Homo sapiens
cauaaucaaucuacaacca

SEQ ID NO: 1543838 - RNA, 19 nt, Homo sapiens
ggucugaaccugauaagca

SEQ ID NO: 1543839 - RNA, 19 nt, Homo sapiens
acauugaggucuugagguu

SEQ ID NO: 1543840 - RNA, 19 nt, Homo sapiens
guucugagucucuugaauu

SEQ ID NO: 1543841 - RNA, 19 nt, Homo sapiens
cauccucucagaccauuua

SEQ ID NO: 1543842 - RNA, 19 nt, Homo sapiens
cccugaagcuccaagauug

SEQ ID NO: 1543843 - RNA, 19 nt, Homo sapiens
ucagagggcacuugacuau

SEQ ID NO: 1543844 - RNA, 19 nt, Homo sapiens
cagccaaguuuccacguau

SEQ ID NO: 1543845 - RNA, 19 nt, Homo sapiens
cacagagccucccauaauc

SEQ ID NO: 1543846 - RNA, 19 nt, Homo sapiens
aauauucuaucguccauuc

SEQ ID NO: 1543847 - RNA, 19 nt, Homo sapiens
cagaaauuacugagaacua

SEQ ID NO: 1543848 - RNA, 19 nt, Homo sapiens
cuccagaaauuacugagaa

SEQ ID NO: 1543849 - RNA, 19 nt, Homo sapiens
aagaaacucccagauuuaa

SEQ ID NO: 1543850 - RNA, 19 nt, Homo sapiens
uugaaguucuugaggguuu

SEQ ID NO: 1543851 - RNA, 19 nt, Homo sapiens
caauccacacaaauucuua

SEQ ID NO: 1543852 - RNA, 19 nt, Homo sapiens
gaacagauuccgccuugcu

SEQ ID NO: 1543853 - RNA, 19 nt, Homo sapiens
cgccgaguauuucuuuaaa

SEQ ID NO: 1543854 - RNA, 19 nt, Homo sapiens
agagggcacuugacuaugg

SEQ ID NO: 1543855 - RNA, 19 nt, Homo sapiens
gaaucaaagcgcuaaccaa

SEQ ID NO: 1543856 - RNA, 19 nt, Homo sapiens
caaauaccucauuggcuuu

SEQ ID NO: 1543857 - RNA, 19 nt, Homo sapiens
gauuuaagcgguucugagu

SEQ ID NO: 1543858 - RNA, 19 nt, Homo sapiens
uaugaaacauccucaaagc

SEQ ID NO: 1543859 - RNA, 19 nt, Homo sapiens
uaucguccauucuucacuu

SEQ ID NO: 1543860 - RNA, 19 nt, Homo sapiens
cagcaacauugaggucuug

SEQ ID NO: 1543861 - RNA, 19 nt, Homo sapiens
gagaaacccauuuuaaaga

SEQ ID NO: 1543862 - RNA, 19 nt, Homo sapiens
uacuuuaccgguaucauua

SEQ ID NO: 1543863 - RNA, 19 nt, Homo sapiens
gaaacucccagauuuaagc

SEQ ID NO: 1543864 - RNA, 19 nt, Homo sapiens
caagcuggaaugaagauga

SEQ ID NO: 1543865 - RNA, 19 nt, Homo sapiens
cuuuaaaucugcguccuuu

SEQ ID NO: 1543866 - RNA, 19 nt, Homo sapiens
uauugcaagugaagucaaa

SEQ ID NO: 1543867 - RNA, 19 nt, Homo sapiens
cuacuuuaccgguaucauu

SEQ ID NO: 1543868 - RNA, 19 nt, Homo sapiens
acauuggaaucgccgagua

SEQ ID NO: 1543869 - RNA, 19 nt, Homo sapiens
uuacugagaacuaccuuga

SEQ ID NO: 1543870 - RNA, 19 nt, Homo sapiens
ggccacagagccucccaua

SEQ ID NO: 1543871 - RNA, 19 nt, Homo sapiens
guccuuugcucauuucaca

SEQ ID NO: 1543872 - RNA, 19 nt, Homo sapiens
agaaauuacugagaacuac

SEQ ID NO: 1543873 - RNA, 19 nt, Homo sapiens
ggagaaacccauuuuaaag

SEQ ID NO: 1543874 - RNA, 19 nt, Homo sapiens
ggguucgagucuccacuuu

SEQ ID NO: 1543875 - RNA, 19 nt, Homo sapiens
ucaaagcagcagccaaguu

SEQ ID NO: 1543876 - RNA, 19 nt, Homo sapiens
gagucuacuuuaccgguau

SEQ ID NO: 1543877 - RNA, 19 nt, Homo sapiens
cgaagagauuuccaaccau

SEQ ID NO: 1543878 - RNA, 19 nt, Homo sapiens
gaccugaaguaugaaacau

SEQ ID NO: 1543879 - RNA, 19 nt, Homo sapiens
ucaguguucuguauaacuc

SEQ ID NO: 1543880 - RNA, 19 nt, Homo sapiens
cauuuacccuggaaucaag

SEQ ID NO: 1543881 - RNA, 19 nt, Homo sapiens
guaugaaacauccucaaag

SEQ ID NO: 1543882 - RNA, 19 nt, Homo sapiens
uguccaauccacacaaauu

SEQ ID NO: 1543883 - RNA, 19 nt, Homo sapiens
cugcguccuuugcucauuu

SEQ ID NO: 1543884 - RNA, 19 nt, Homo sapiens
cugagucucuugaauuucu

SEQ ID NO: 1543885 - RNA, 19 nt, Homo sapiens
uucugagucucuugaauuu

SEQ ID NO: 1543886 - RNA, 19 nt, Homo sapiens
ugacuaugguguucaagcu

SEQ ID NO: 1543887 - RNA, 19 nt, Homo sapiens
caacgugcucucccggauu

SEQ ID NO: 1543888 - RNA, 19 nt, Homo sapiens
gagccaugcccacgucuca

SEQ ID NO: 1543889 - RNA, 19 nt, Homo sapiens
cuugaaggguguauucuac

SEQ ID NO: 1543890 - RNA, 19 nt, Homo sapiens
uugcugagcccauggagaa

SEQ ID NO: 1543891 - RNA, 19 nt, Homo sapiens
ggaaucaaagcgcuaacca

SEQ ID NO: 1543892 - RNA, 19 nt, Homo sapiens
auugaggucuugagguuug

SEQ ID NO: 1543893 - RNA, 19 nt, Homo sapiens
cagcugggguuuucaaugu

SEQ ID NO: 1543894 - RNA, 19 nt, Homo sapiens
uuuaagcgguucugagucu

SEQ ID NO: 1543895 - RNA, 19 nt, Homo sapiens
aagcuggaaugaagaugau

SEQ ID NO: 1543896 - RNA, 19 nt, Homo sapiens
ccaauccacacaaauucuu

SEQ ID NO: 1543897 - RNA, 19 nt, Homo sapiens
cuacaaccaggcaauuuca

SEQ ID NO: 1543898 - RNA, 19 nt, Homo sapiens
gagccucccauaaucaauc

SEQ ID NO: 1543899 - RNA, 19 nt, Homo sapiens
ugaggaucauggccacaga

SEQ ID NO: 1543900 - RNA, 19 nt, Homo sapiens
aacgugcucucccggauug

SEQ ID NO: 1543901 - RNA, 19 nt, Homo sapiens
caacuccaugcucuacauu

SEQ ID NO: 1543902 - RNA, 19 nt, Homo sapiens
gcuggaaugaagaugauug

SEQ ID NO: 1543903 - RNA, 19 nt, Homo sapiens
acacucugcuggauuacuc

SEQ ID NO: 1543904 - RNA, 19 nt, Homo sapiens
ucauuauccuaacccgaaa

SEQ ID NO: 1543905 - RNA, 19 nt, Homo sapiens
aguguuggccugguuauuu

SEQ ID NO: 1543906 - RNA, 19 nt, Homo sapiens
gccaugcccacgucucauu

SEQ ID NO: 1543907 - RNA, 19 nt, Homo sapiens
guucuugaggguuuccuuu

SEQ ID NO: 1543908 - RNA, 19 nt, Homo sapiens
uggaaucgccgaguauuuc

SEQ ID NO: 1543909 - RNA, 19 nt, Homo sapiens
uaccuugaccugaacuuga

SEQ ID NO: 1543910 - RNA, 19 nt, Homo sapiens
aggaggggcugaucuguuu

SEQ ID NO: 1543911 - RNA, 19 nt, Homo sapiens
cagauuccgccuugcuuug

SEQ ID NO: 1543912 - RNA, 19 nt, Homo sapiens
ucaaggcaaggauuacuca

SEQ ID NO: 1543913 - RNA, 19 nt, Homo sapiens
aaucgccgaguauuucuuu

SEQ ID NO: 1543914 - RNA, 19 nt, Homo sapiens
uaaagaaacugaagaguga

SEQ ID NO: 1543915 - RNA, 19 nt, Homo sapiens
ggaagaagcuauugcaaug

SEQ ID NO: 1543916 - RNA, 19 nt, Homo sapiens
gaauguuccucaaguauuu

SEQ ID NO: 1543917 - RNA, 19 nt, Homo sapiens
ggacagaauuauauaguug

SEQ ID NO: 1543918 - RNA, 19 nt, Homo sapiens
gcuauugacuucacaguaa

SEQ ID NO: 1543919 - RNA, 19 nt, Homo sapiens
gaagaagaaacuacgauua

SEQ ID NO: 1543920 - RNA, 19 nt, Homo sapiens
gacacuggguuauauaaua

SEQ ID NO: 1543921 - RNA, 19 nt, Homo sapiens
gaagauggauuagaucgaa

SEQ ID NO: 1543922 - RNA, 19 nt, Homo sapiens
ggccagaacuugcauuauu

SEQ ID NO: 1543923 - RNA, 19 nt, Homo sapiens
uaaaugugcugguuaguug

SEQ ID NO: 1543924 - RNA, 19 nt, Homo sapiens
gcaguuauuuggucucuga

SEQ ID NO: 1543925 - RNA, 19 nt, Homo sapiens
gaauagggauuugcuuuau

SEQ ID NO: 1543926 - RNA, 19 nt, Homo sapiens
gaaagcaaaguuaaaggua

SEQ ID NO: 1543927 - RNA, 19 nt, Homo sapiens
aagcuaauguguaagguua

SEQ ID NO: 1543928 - RNA, 19 nt, Homo sapiens
ucacagcacuuuagaauac

SEQ ID NO: 1543929 - RNA, 19 nt, Homo sapiens
gccagaacuugcauuauuu

SEQ ID NO: 1543930 - RNA, 19 nt, Homo sapiens
gggauuugcuuuauguauu

SEQ ID NO: 1543931 - RNA, 19 nt, Homo sapiens
guagauuacuuguuaggaa

SEQ ID NO: 1543932 - RNA, 19 nt, Homo sapiens
cuuaugugcuuucuacuua

SEQ ID NO: 1543933 - RNA, 19 nt, Homo sapiens
guaugcaacuguaguggua

SEQ ID NO: 1543934 - RNA, 19 nt, Homo sapiens
aaaccucaguguaacuuua

SEQ ID NO: 1543935 - RNA, 19 nt, Homo sapiens
caacuuagagcauguuuau

SEQ ID NO: 1543936 - RNA, 19 nt, Homo sapiens
gcuauagaacccuuuaaua

SEQ ID NO: 1543937 - RNA, 19 nt, Homo sapiens
ggaccucucuccuuugugu

SEQ ID NO: 1543938 - RNA, 19 nt, Homo sapiens
ucagcuaacucuacagaaa

SEQ ID NO: 1543939 - RNA, 19 nt, Homo sapiens
aaagaaaguuggaaugcaa

SEQ ID NO: 1543940 - RNA, 19 nt, Homo sapiens
gacagugcauucuaugaaa

SEQ ID NO: 1543941 - RNA, 19 nt, Homo sapiens
gaaagccuccaauaugaaa

SEQ ID NO: 1543942 - RNA, 19 nt, Homo sapiens
cuugaaaccucagaaauaa

SEQ ID NO: 1543943 - RNA, 19 nt, Homo sapiens
gaaacuuacagaacacuuu

SEQ ID NO: 1543944 - RNA, 19 nt, Homo sapiens
uaagagagacuggucauuu

SEQ ID NO: 1543945 - RNA, 19 nt, Homo sapiens
cuguguagauuacuuguua

SEQ ID NO: 1543946 - RNA, 19 nt, Homo sapiens
ggauuugcuuuauguauuc

SEQ ID NO: 1543947 - RNA, 19 nt, Homo sapiens
uuacuagacucauaagaga

SEQ ID NO: 1543948 - RNA, 19 nt, Homo sapiens
caacagacuuaacacuugu

SEQ ID NO: 1543949 - RNA, 19 nt, Homo sapiens
gauggaaccucugaaaaua

SEQ ID NO: 1543950 - RNA, 19 nt, Homo sapiens
ccaauggaaagcaaaguua

SEQ ID NO: 1543951 - RNA, 19 nt, Homo sapiens
auagcuaucuccauacuaa

SEQ ID NO: 1543952 - RNA, 19 nt, Homo sapiens
cauaaagcguugugggaaa

SEQ ID NO: 1543953 - RNA, 19 nt, Homo sapiens
caggagacaugaaauuuua

SEQ ID NO: 1543954 - RNA, 19 nt, Homo sapiens
aaacuacgauuaccagaca

SEQ ID NO: 1543955 - RNA, 19 nt, Homo sapiens
acaacagacuuaacacuug

SEQ ID NO: 1543956 - RNA, 19 nt, Homo sapiens
guugaaccaucuuauaaug

SEQ ID NO: 1543957 - RNA, 19 nt, Homo sapiens
cagcaagccuguguagauu

SEQ ID NO: 1543958 - RNA, 19 nt, Homo sapiens
gcagcaagccuguguagau

SEQ ID NO: 1543959 - RNA, 19 nt, Homo sapiens
gguaauaaucaacccauaa

SEQ ID NO: 1543960 - RNA, 19 nt, Homo sapiens
cuaaagagauuuucagcua

SEQ ID NO: 1543961 - RNA, 19 nt, Homo sapiens
uaagauggaguacuaagaa

SEQ ID NO: 1543962 - RNA, 19 nt, Homo sapiens
gaguaauugucaagugaaa

SEQ ID NO: 1543963 - RNA, 19 nt, Homo sapiens
gaauuuaguuaccaguuac

SEQ ID NO: 1543964 - RNA, 19 nt, Homo sapiens
ucacaguaaucaguaguuu

SEQ ID NO: 1543965 - RNA, 19 nt, Homo sapiens
cugcuuacauguuuaaaga

SEQ ID NO: 1543966 - RNA, 19 nt, Homo sapiens
ggucaaaguauccuuguug

SEQ ID NO: 1543967 - RNA, 19 nt, Homo sapiens
augaaagccuccaauauga

SEQ ID NO: 1543968 - RNA, 19 nt, Homo sapiens
ccagaacuugcauuauuua

SEQ ID NO: 1543969 - RNA, 19 nt, Homo sapiens
gacaggagacaugaaauuu

SEQ ID NO: 1543970 - RNA, 19 nt, Homo sapiens
ccaaagcacaaggaauuua

SEQ ID NO: 1543971 - RNA, 19 nt, Homo sapiens
gaaauaaaauucccaacag

SEQ ID NO: 1543972 - RNA, 19 nt, Homo sapiens
uuacaaaugcucacucuga

SEQ ID NO: 1543973 - RNA, 19 nt, Homo sapiens
gaaauaauggaagaagcua

SEQ ID NO: 1543974 - RNA, 19 nt, Homo sapiens
agaauagggauuugcuuua

SEQ ID NO: 1543975 - RNA, 19 nt, Homo sapiens
gcaagccuguguagauuac

SEQ ID NO: 1543976 - RNA, 19 nt, Homo sapiens
caaaaccucuucaguccua

SEQ ID NO: 1543977 - RNA, 19 nt, Homo sapiens
guucuggucuguuggaugu

SEQ ID NO: 1543978 - RNA, 19 nt, Homo sapiens
acacgacagugcauucuau

SEQ ID NO: 1543979 - RNA, 19 nt, Homo sapiens
aaugaaagccuccaauaug

SEQ ID NO: 1543980 - RNA, 19 nt, Homo sapiens
caguugaaccaucuuauaa

SEQ ID NO: 1543981 - RNA, 19 nt, Homo sapiens
gaagcuauugcaaugguaa

SEQ ID NO: 1543982 - RNA, 19 nt, Homo sapiens
cuacacaaccaagcaguua

SEQ ID NO: 1543983 - RNA, 19 nt, Homo sapiens
ugaagacuccuccgaagaa

SEQ ID NO: 1543984 - RNA, 19 nt, Homo sapiens
ggaaagcaaaguuaaaggu

SEQ ID NO: 1543985 - RNA, 19 nt, Homo sapiens
gaaaauggucacucaguuu

SEQ ID NO: 1543986 - RNA, 19 nt, Homo sapiens
uaaacucucuacuaauugg

SEQ ID NO: 1543987 - RNA, 19 nt, Homo sapiens
gcuaauaaccaaauuugca

SEQ ID NO: 1543988 - RNA, 19 nt, Homo sapiens
cgacagugcauucuaugaa

SEQ ID NO: 1543989 - RNA, 19 nt, Homo sapiens
ucaguugaaccaucuuaua

SEQ ID NO: 1543990 - RNA, 19 nt, Homo sapiens
ugacaggagacaugaaauu

SEQ ID NO: 1543991 - RNA, 19 nt, Homo sapiens
caaagcacaaggaauuuau

SEQ ID NO: 1543992 - RNA, 19 nt, Homo sapiens
aauguuaccugcacacuag

SEQ ID NO: 1543993 - RNA, 19 nt, Homo sapiens
gcagcuauagaacccuuua

SEQ ID NO: 1543994 - RNA, 19 nt, Homo sapiens
ccacuuacaugccuuuuga

SEQ ID NO: 1543995 - RNA, 19 nt, Homo sapiens
caauggaaagcaaaguuaa

SEQ ID NO: 1543996 - RNA, 19 nt, Homo sapiens
gaaacuacacaaccaagca

SEQ ID NO: 1543997 - RNA, 19 nt, Homo sapiens
gaaacugaagagugagaaa

SEQ ID NO: 1543998 - RNA, 19 nt, Homo sapiens
aaauaugggucaaaguauc

SEQ ID NO: 1543999 - RNA, 19 nt, Homo sapiens
uauauuugcugcugugaca

SEQ ID NO: 1544000 - RNA, 19 nt, Homo sapiens
ugacacacuccuacuauug

SEQ ID NO: 1544001 - RNA, 19 nt, Homo sapiens
gugacacacuccuacuauu

SEQ ID NO: 1544002 - RNA, 19 nt, Homo sapiens
gcaaccaaucaaaguuuaa

SEQ ID NO: 1544003 - RNA, 19 nt, Homo sapiens
ggugaaagcaacccuuaug

SEQ ID NO: 1544004 - RNA, 19 nt, Homo sapiens
aagggaaacuuacagaaca

SEQ ID NO: 1544005 - RNA, 19 nt, Homo sapiens
gcaacuuagagcauguuua

SEQ ID NO: 1544006 - RNA, 19 nt, Homo sapiens
ucuguuggauguuauguau

SEQ ID NO: 1544007 - RNA, 19 nt, Homo sapiens
ggucuugaauagauuuaca

SEQ ID NO: 1544008 - RNA, 19 nt, Homo sapiens
gacacacuccuacuauuga

SEQ ID NO: 1544009 - RNA, 19 nt, Homo sapiens
gaagaaacuacgauuacca

SEQ ID NO: 1544010 - RNA, 19 nt, Homo sapiens
cgaagaagaaacuacgauu

SEQ ID NO: 1544011 - RNA, 19 nt, Homo sapiens
gcaagaaguugggguuuau

SEQ ID NO: 1544012 - RNA, 19 nt, Homo sapiens
gaaagaucuggaacacuga

SEQ ID NO: 1544013 - RNA, 19 nt, Homo sapiens
aaaugaaagccuccaauau

SEQ ID NO: 1544014 - RNA, 19 nt, Homo sapiens
gaagcuauuucaaguguua

SEQ ID NO: 1544015 - RNA, 19 nt, Homo sapiens
caaagaagcucauuaccuu

SEQ ID NO: 1544016 - RNA, 19 nt, Homo sapiens
gaagaggaagcuauuauua

SEQ ID NO: 1544017 - RNA, 19 nt, Homo sapiens
gaaagguucuguuggauuc

SEQ ID NO: 1544018 - RNA, 19 nt, Homo sapiens
gaucaugccuggaagaaau

SEQ ID NO: 1544019 - RNA, 19 nt, Homo sapiens
ggaaacagaugugucagaa

SEQ ID NO: 1544020 - RNA, 19 nt, Homo sapiens
gaaaauggaugaaagcaaa

SEQ ID NO: 1544021 - RNA, 19 nt, Homo sapiens
gcaagucucucuaaguugu

SEQ ID NO: 1544022 - RNA, 19 nt, Homo sapiens
caaagucccaugaauuaua

SEQ ID NO: 1544023 - RNA, 19 nt, Homo sapiens
gcaauguacagucuaauuu

SEQ ID NO: 1544024 - RNA, 19 nt, Homo sapiens
ugaauccacuucugcauuu

SEQ ID NO: 1544025 - RNA, 19 nt, Homo sapiens
uaagauugcucccaaagug

SEQ ID NO: 1544026 - RNA, 19 nt, Homo sapiens
ggauggccuugaagucuua

SEQ ID NO: 1544027 - RNA, 19 nt, Homo sapiens
ggacucuccuuaccauuug

SEQ ID NO: 1544028 - RNA, 19 nt, Homo sapiens
ggacaagcaucugacuuug

SEQ ID NO: 1544029 - RNA, 19 nt, Homo sapiens
aaacagaugugucagaagu

SEQ ID NO: 1544030 - RNA, 19 nt, Homo sapiens
ccugugaguucuccaguua

SEQ ID NO: 1544031 - RNA, 19 nt, Homo sapiens
aaauacagcugugaccaua

SEQ ID NO: 1544032 - RNA, 19 nt, Homo sapiens
ucucuucacucucaaauga

SEQ ID NO: 1544033 - RNA, 19 nt, Homo sapiens
gaacagacugaucaacuga

SEQ ID NO: 1544034 - RNA, 19 nt, Homo sapiens
gauagcagccaucaagaaa

SEQ ID NO: 1544035 - RNA, 19 nt, Homo sapiens
ucacaggaauagaaucuga

SEQ ID NO: 1544036 - RNA, 19 nt, Homo sapiens
caagagaaggcuaugcaua

SEQ ID NO: 1544037 - RNA, 19 nt, Homo sapiens
gcagaugacccucaagaga

SEQ ID NO: 1544038 - RNA, 19 nt, Homo sapiens
cagaacacacgacuuauaa

SEQ ID NO: 1544039 - RNA, 19 nt, Homo sapiens
ggagauagcagccaucaag

SEQ ID NO: 1544040 - RNA, 19 nt, Homo sapiens
ccaccacugucuuucuaua

SEQ ID NO: 1544041 - RNA, 19 nt, Homo sapiens
cugaucaacugaagacuaa

SEQ ID NO: 1544042 - RNA, 19 nt, Homo sapiens
gaaaagggauggugaaaac

SEQ ID NO: 1544043 - RNA, 19 nt, Homo sapiens
uccaaagucccaugaauua

SEQ ID NO: 1544044 - RNA, 19 nt, Homo sapiens
cuuaagaggucaaggcauu

SEQ ID NO: 1544045 - RNA, 19 nt, Homo sapiens
gauaggcaaugauuacagu

SEQ ID NO: 1544046 - RNA, 19 nt, Homo sapiens
gagauaaacccacucuugu

SEQ ID NO: 1544047 - RNA, 19 nt, Homo sapiens
ugaaagaacagacugauca

SEQ ID NO: 1544048 - RNA, 19 nt, Homo sapiens
gcacugcagcucuucauau

SEQ ID NO: 1544049 - RNA, 19 nt, Homo sapiens
gaaagcaaauauacuucag

SEQ ID NO: 1544050 - RNA, 19 nt, Homo sapiens
gaacuucucacaggaauag

SEQ ID NO: 1544051 - RNA, 19 nt, Homo sapiens
gcaggaggauuugccuuau

SEQ ID NO: 1544052 - RNA, 19 nt, Homo sapiens
ucagaacacacgacuuaua

SEQ ID NO: 1544053 - RNA, 19 nt, Homo sapiens
uaucagaacauucagacua

SEQ ID NO: 1544054 - RNA, 19 nt, Homo sapiens
ccaagcagcugagauuaca

SEQ ID NO: 1544055 - RNA, 19 nt, Homo sapiens
uagaagcuauuucaagugu

SEQ ID NO: 1544056 - RNA, 19 nt, Homo sapiens
aggcaagucucucuaaguu

SEQ ID NO: 1544057 - RNA, 19 nt, Homo sapiens
gaaagaacagacugaucaa

SEQ ID NO: 1544058 - RNA, 19 nt, Homo sapiens
gccaaggucaaguucauua

SEQ ID NO: 1544059 - RNA, 19 nt, Homo sapiens
gaucucaaaugccgacagu

SEQ ID NO: 1544060 - RNA, 19 nt, Homo sapiens
uuucagaacacacgacuua

SEQ ID NO: 1544061 - RNA, 19 nt, Homo sapiens
gcuugaagauguuaaagag

SEQ ID NO: 1544062 - RNA, 19 nt, Homo sapiens
aacaaucguuggugacuuu

SEQ ID NO: 1544063 - RNA, 19 nt, Homo sapiens
gagcggaaccucuuuggau

SEQ ID NO: 1544064 - RNA, 19 nt, Homo sapiens
cucaaguucuucuuacaua

SEQ ID NO: 1544065 - RNA, 19 nt, Homo sapiens
ucaccaaccucucagaaag

SEQ ID NO: 1544066 - RNA, 19 nt, Homo sapiens
ccugauuucucuaagauug

SEQ ID NO: 1544067 - RNA, 19 nt, Homo sapiens
ucagcucacugcaaccuuu

SEQ ID NO: 1544068 - RNA, 19 nt, Homo sapiens
aaaccacgccugagucaaa

SEQ ID NO: 1544069 - RNA, 19 nt, Homo sapiens
cagaugacccucaagagaa

SEQ ID NO: 1544070 - RNA, 19 nt, Homo sapiens
ggaugugccuuuggauuuc

SEQ ID NO: 1544071 - RNA, 19 nt, Homo sapiens
gaagcucauuaccuugcua

SEQ ID NO: 1544072 - RNA, 19 nt, Homo sapiens
cggagaauaucaauuugga

SEQ ID NO: 1544073 - RNA, 19 nt, Homo sapiens
gugaaacccucccagagau

SEQ ID NO: 1544074 - RNA, 19 nt, Homo sapiens
ugaaaaugcugccaacaaa

SEQ ID NO: 1544075 - RNA, 19 nt, Homo sapiens
cuuauaagcaggaggauuu

SEQ ID NO: 1544076 - RNA, 19 nt, Homo sapiens
aaccagagcuauuguuaca

SEQ ID NO: 1544077 - RNA, 19 nt, Homo sapiens
ggaccucucucagauuaag

SEQ ID NO: 1544078 - RNA, 19 nt, Homo sapiens
caccuucucuucacucuca

SEQ ID NO: 1544079 - RNA, 19 nt, Homo sapiens
guacauauccaccaagaac

SEQ ID NO: 1544080 - RNA, 19 nt, Homo sapiens
cauaguacauauccaccaa

SEQ ID NO: 1544081 - RNA, 19 nt, Homo sapiens
ucucaaaugccgacaguuu

SEQ ID NO: 1544082 - RNA, 19 nt, Homo sapiens
gccuuuggauuucaagauu

SEQ ID NO: 1544083 - RNA, 19 nt, Homo sapiens
cacugcagcucuucauauu

SEQ ID NO: 1544084 - RNA, 19 nt, Homo sapiens
gaaauacagcugugaccau

SEQ ID NO: 1544085 - RNA, 19 nt, Homo sapiens
gccuugaagucuuaaauca

SEQ ID NO: 1544086 - RNA, 19 nt, Homo sapiens
gcaagauugggaauucaaa

SEQ ID NO: 1544087 - RNA, 19 nt, Homo sapiens
acagcaauguacagucuaa

SEQ ID NO: 1544088 - RNA, 19 nt, Homo sapiens
gaagacuaaaguacaagaa

SEQ ID NO: 1544089 - RNA, 19 nt, Homo sapiens
uaaacccacucuugugcaa

SEQ ID NO: 1544090 - RNA, 19 nt, Homo sapiens
caggcaacacguucaaaua

SEQ ID NO: 1544091 - RNA, 19 nt, Homo sapiens
gucaagcauuucugauauu

SEQ ID NO: 1544092 - RNA, 19 nt, Homo sapiens
agucaagcauuucugauau

SEQ ID NO: 1544093 - RNA, 19 nt, Homo sapiens
uaagauaggcaaugauuac

SEQ ID NO: 1544094 - RNA, 19 nt, Homo sapiens
ggggaccucucucagauua

SEQ ID NO: 1544095 - RNA, 19 nt, Homo sapiens
gaacacacgacuuauaagc

SEQ ID NO: 1544096 - RNA, 19 nt, Homo sapiens
agaaccagagcuauuguua

SEQ ID NO: 1544097 - RNA, 19 nt, Homo sapiens
ccucaacuaucagaacauu

SEQ ID NO: 1544098 - RNA, 19 nt, Homo sapiens
ugaagaggaagcuauuauu

SEQ ID NO: 1544099 - RNA, 19 nt, Homo sapiens
aggagacgcuucuaaguca

SEQ ID NO: 1544100 - RNA, 19 nt, Homo sapiens
agauuaagauaggcaauga

SEQ ID NO: 1544101 - RNA, 19 nt, Homo sapiens
aggaggauuugccuuauga

SEQ ID NO: 1544102 - RNA, 19 nt, Homo sapiens
cugagaaacagaaucauuu

SEQ ID NO: 1544103 - RNA, 19 nt, Homo sapiens
gauuucuacuuaugcaaga

SEQ ID NO: 1544104 - RNA, 19 nt, Homo sapiens
acaagcaucugacuuugca

SEQ ID NO: 1544105 - RNA, 19 nt, Homo sapiens
gaauagcacacagugaaga

SEQ ID NO: 1544106 - RNA, 19 nt, Homo sapiens
caacugaagacuaaaguac

SEQ ID NO: 1544107 - RNA, 19 nt, Homo sapiens
cauagcagaugacccucaa

SEQ ID NO: 1544108 - RNA, 19 nt, Homo sapiens
gauuagaagcuauuucaag

SEQ ID NO: 1544109 - RNA, 19 nt, Homo sapiens
gcagggacaccuugaacug

SEQ ID NO: 1544110 - RNA, 19 nt, Homo sapiens
caaauacggccaaggucaa

SEQ ID NO: 1544111 - RNA, 19 nt, Homo sapiens
gaacaaaccccaggacuca

SEQ ID NO: 1544112 - RNA, 19 nt, Homo sapiens
agugagacuuguggaaaua

SEQ ID NO: 1544113 - RNA, 19 nt, Homo sapiens
ccacugucuuucuauacuu

SEQ ID NO: 1544114 - RNA, 19 nt, Homo sapiens
ggagaaauccaucaacaaa

SEQ ID NO: 1544115 - RNA, 19 nt, Homo sapiens
gauaguggcugaaauggau

SEQ ID NO: 1544116 - RNA, 19 nt, Homo sapiens
gagcaguggugacaagauu

SEQ ID NO: 1544117 - RNA, 19 nt, Homo sapiens
gcauguacaucuuuaaguc

SEQ ID NO: 1544118 - RNA, 19 nt, Homo sapiens
acaaaggauuggcgagaua

SEQ ID NO: 1544119 - RNA, 19 nt, Homo sapiens
cagagcauguacaucuuua

SEQ ID NO: 1544120 - RNA, 19 nt, Homo sapiens
ccucgcagcuccagaaguu

SEQ ID NO: 1544121 - RNA, 19 nt, Homo sapiens
gauggaacucugguuauua

SEQ ID NO: 1544122 - RNA, 19 nt, Homo sapiens
gaacucugguuauuauggu

SEQ ID NO: 1544123 - RNA, 19 nt, Homo sapiens
cagcacagacuauuucuug

SEQ ID NO: 1544124 - RNA, 19 nt, Homo sapiens
gugcagaccuuggccagaa

SEQ ID NO: 1544125 - RNA, 19 nt, Homo sapiens
gcagagcauguacaucuuu

SEQ ID NO: 1544126 - RNA, 19 nt, Homo sapiens
ggauugaggccuagagaga

SEQ ID NO: 1544127 - RNA, 19 nt, Homo sapiens
ccaaagugcugggauuaca

SEQ ID NO: 1544128 - RNA, 19 nt, Homo sapiens
gugaagcugugggcuguaa

SEQ ID NO: 1544129 - RNA, 19 nt, Homo sapiens
gagaagugguacacaagag

SEQ ID NO: 1544130 - RNA, 19 nt, Homo sapiens
ggagaagugguacacaaga

SEQ ID NO: 1544131 - RNA, 19 nt, Homo sapiens
cgagauaguggcugaaaug

SEQ ID NO: 1544132 - RNA, 19 nt, Homo sapiens
agauggaacucugguuauu

SEQ ID NO: 1544133 - RNA, 19 nt, Homo sapiens
ccucauccauggagaagug

SEQ ID NO: 1544134 - RNA, 19 nt, Homo sapiens
ccaggauggucucgauuuc

SEQ ID NO: 1544135 - RNA, 19 nt, Homo sapiens
gugcagagcauguacaucu

SEQ ID NO: 1544136 - RNA, 19 nt, Homo sapiens
ccggagaaauccaucaaca

SEQ ID NO: 1544137 - RNA, 19 nt, Homo sapiens
gggcagcacagacuauuuc

SEQ ID NO: 1544138 - RNA, 19 nt, Homo sapiens
caacagggaggucuugucu

SEQ ID NO: 1544139 - RNA, 19 nt, Homo sapiens
gcacagacuauuucuugag

SEQ ID NO: 1544140 - RNA, 19 nt, Homo sapiens
gggcuucccuaagaucuuc

SEQ ID NO: 1544141 - RNA, 19 nt, Homo sapiens
gcgagauaguggcugaaau

SEQ ID NO: 1544142 - RNA, 19 nt, Homo sapiens
auggaacucugguuauuau

SEQ ID NO: 1544143 - RNA, 19 nt, Homo sapiens
gccaggauggucucgauuu

SEQ ID NO: 1544144 - RNA, 19 nt, Homo sapiens
ccuccaaagugcugggauu

SEQ ID NO: 1544145 - RNA, 19 nt, Homo sapiens
cagcugaacugcccuuucc

SEQ ID NO: 1544146 - RNA, 19 nt, Homo sapiens
ggauaacagccucuuugug

SEQ ID NO: 1544147 - RNA, 19 nt, Homo sapiens
gagcauguacaucuuuaag

SEQ ID NO: 1544148 - RNA, 19 nt, Homo sapiens
gcgagcagcugggacuaca

SEQ ID NO: 1544149 - RNA, 19 nt, Homo sapiens
ggaacucugguuauuaugg

SEQ ID NO: 1544150 - RNA, 19 nt, Homo sapiens
ucacucuccucuccucuca

SEQ ID NO: 1544151 - RNA, 19 nt, Homo sapiens
ggacgccuccuuccuguac

SEQ ID NO: 1544152 - RNA, 19 nt, Homo sapiens
gggauaacagccucuuugu

SEQ ID NO: 1544153 - RNA, 19 nt, Homo sapiens
gaggauugaggccuagaga

SEQ ID NO: 1544154 - RNA, 19 nt, Homo sapiens
gcgccaggccuacacuuuc

SEQ ID NO: 1544155 - RNA, 19 nt, Homo sapiens
cgggauaacagccucuuug

SEQ ID NO: 1544156 - RNA, 19 nt, Homo sapiens
ugguguuaguuaucgaaua

SEQ ID NO: 1544157 - RNA, 19 nt, Homo sapiens
ccacugccgcacagaauuc

SEQ ID NO: 1544158 - RNA, 19 nt, Homo sapiens
gagaaauccaucaacaaaa

SEQ ID NO: 1544159 - RNA, 19 nt, Homo sapiens
agaauucuccacccaggaa

SEQ ID NO: 1544160 - RNA, 19 nt, Homo sapiens
cugacccucucacagcaua

SEQ ID NO: 1544161 - RNA, 19 nt, Homo sapiens
uagccaggauggucucgau

SEQ ID NO: 1544162 - RNA, 19 nt, Homo sapiens
caucacacacuccuucaag

SEQ ID NO: 1544163 - RNA, 19 nt, Homo sapiens
ccuggucccuccggagaaa

SEQ ID NO: 1544164 - RNA, 19 nt, Homo sapiens
acucuccucuccucucaga

SEQ ID NO: 1544165 - RNA, 19 nt, Homo sapiens
ggcaggcguuccucagagu

SEQ ID NO: 1544166 - RNA, 19 nt, Homo sapiens
gcuggaaggauucuugucu

SEQ ID NO: 1544167 - RNA, 19 nt, Homo sapiens
ccucuccucucagauggaa

SEQ ID NO: 1544168 - RNA, 19 nt, Homo sapiens
cggagaaauccaucaacaa

SEQ ID NO: 1544169 - RNA, 19 nt, Homo sapiens
auucgauucuucuuugaga

SEQ ID NO: 1544170 - RNA, 19 nt, Homo sapiens
ggccaugcaacaaaggauu

SEQ ID NO: 1544171 - RNA, 19 nt, Homo sapiens
gcaacagggaggucuuguc

SEQ ID NO: 1544172 - RNA, 19 nt, Homo sapiens
agauucgauucuucuuuga

SEQ ID NO: 1544173 - RNA, 19 nt, Homo sapiens
auggagaagugguacacaa

SEQ ID NO: 1544174 - RNA, 19 nt, Homo sapiens
caaaggauuggcgagauag

SEQ ID NO: 1544175 - RNA, 19 nt, Homo sapiens
gccaugcaacaaaggauug

SEQ ID NO: 1544176 - RNA, 19 nt, Homo sapiens
gaagcugugggcuguaaac

SEQ ID NO: 1544177 - RNA, 19 nt, Homo sapiens
gcagcacagacuauuucuu

SEQ ID NO: 1544178 - RNA, 19 nt, Homo sapiens
ggugcuggaaggauucuug

SEQ ID NO: 1544179 - RNA, 19 nt, Homo sapiens
gaagaugacuuaguggaua

SEQ ID NO: 1544180 - RNA, 19 nt, Homo sapiens
uaaagaugcuucccaagua

SEQ ID NO: 1544181 - RNA, 19 nt, Homo sapiens
gaacaagucuggugaaggu

SEQ ID NO: 1544182 - RNA, 19 nt, Homo sapiens
guauagagcuuaaggcauu

SEQ ID NO: 1544183 - RNA, 19 nt, Homo sapiens
gugauuaccuucauacuuu

SEQ ID NO: 1544184 - RNA, 19 nt, Homo sapiens
ggaauuggaucuacuagug

SEQ ID NO: 1544185 - RNA, 19 nt, Homo sapiens
gcuaaugaaugcucaaauu

SEQ ID NO: 1544186 - RNA, 19 nt, Homo sapiens
gaaagcaaauuacauccaa

SEQ ID NO: 1544187 - RNA, 19 nt, Homo sapiens
gaaguuaacacaaugguuu

SEQ ID NO: 1544188 - RNA, 19 nt, Homo sapiens
gguagaaugucaagauuug

SEQ ID NO: 1544189 - RNA, 19 nt, Homo sapiens
gguagggaauguuuauuaa

SEQ ID NO: 1544190 - RNA, 19 nt, Homo sapiens
guagauagaugguauagag

SEQ ID NO: 1544191 - RNA, 19 nt, Homo sapiens
gaauagcgaucaaguuaca

SEQ ID NO: 1544192 - RNA, 19 nt, Homo sapiens
caacuggaauguuaagcua

SEQ ID NO: 1544193 - RNA, 19 nt, Homo sapiens
uaaauucacuugccucuca

SEQ ID NO: 1544194 - RNA, 19 nt, Homo sapiens
guucuagaguucuguauaa

SEQ ID NO: 1544195 - RNA, 19 nt, Homo sapiens
gggaauauuucaacauguu

SEQ ID NO: 1544196 - RNA, 19 nt, Homo sapiens
agucauauguuucggaaua

SEQ ID NO: 1544197 - RNA, 19 nt, Homo sapiens
ccaaguagauagaugguau

SEQ ID NO: 1544198 - RNA, 19 nt, Homo sapiens
ggaaggaaauaugcaaugu

SEQ ID NO: 1544199 - RNA, 19 nt, Homo sapiens
gagcuucauucauaaguug

SEQ ID NO: 1544200 - RNA, 19 nt, Homo sapiens
aaucucaguuccucaaaua

SEQ ID NO: 1544201 - RNA, 19 nt, Homo sapiens
uuaccuagauucaagauga

SEQ ID NO: 1544202 - RNA, 19 nt, Homo sapiens
aaagaugcuucccaaguaa

SEQ ID NO: 1544203 - RNA, 19 nt, Homo sapiens
gaauauuucccaugcguuu

SEQ ID NO: 1544204 - RNA, 19 nt, Homo sapiens
gaauguaucuaguaaagcu

SEQ ID NO: 1544205 - RNA, 19 nt, Homo sapiens
ggaaagggaugaagaugcu

SEQ ID NO: 1544206 - RNA, 19 nt, Homo sapiens
ggucucagguuuugaaaua

SEQ ID NO: 1544207 - RNA, 19 nt, Homo sapiens
gugcagguauuguauguga

SEQ ID NO: 1544208 - RNA, 19 nt, Homo sapiens
ccaaccagguguagagauu

SEQ ID NO: 1544209 - RNA, 19 nt, Homo sapiens
gagcugugauuccucuaaa

SEQ ID NO: 1544210 - RNA, 19 nt, Homo sapiens
guucaaaggcuaucuguug

SEQ ID NO: 1544211 - RNA, 19 nt, Homo sapiens
caaauaugcagcaaagauu

SEQ ID NO: 1544212 - RNA, 19 nt, Homo sapiens
cggaauaccauaagaauga

SEQ ID NO: 1544213 - RNA, 19 nt, Homo sapiens
guagacaaacuucaggaua

SEQ ID NO: 1544214 - RNA, 19 nt, Homo sapiens
ugaagguucuggaguuuga

SEQ ID NO: 1544215 - RNA, 19 nt, Homo sapiens
gcaagcauguguuugugau

SEQ ID NO: 1544216 - RNA, 19 nt, Homo sapiens
ccagugaagugcuuacaau

SEQ ID NO: 1544217 - RNA, 19 nt, Homo sapiens
ucaaaggacugaugcuaca

SEQ ID NO: 1544218 - RNA, 19 nt, Homo sapiens
cucagcaacuggaauguua

SEQ ID NO: 1544219 - RNA, 19 nt, Homo sapiens
aggaaggaauguaauauug

SEQ ID NO: 1544220 - RNA, 19 nt, Homo sapiens
guguagagauuaccaggaa

SEQ ID NO: 1544221 - RNA, 19 nt, Homo sapiens
cuacugaaauuucuuaggu

SEQ ID NO: 1544222 - RNA, 19 nt, Homo sapiens
gcaaagauuacaccaagau

SEQ ID NO: 1544223 - RNA, 19 nt, Homo sapiens
caaaggcuaucuguuggaa

SEQ ID NO: 1544224 - RNA, 19 nt, Homo sapiens
caagaugaauagcgaucaa

SEQ ID NO: 1544225 - RNA, 19 nt, Homo sapiens
ggagucagauuaacuucca

SEQ ID NO: 1544226 - RNA, 19 nt, Homo sapiens
gcagguagaaugucaagau

SEQ ID NO: 1544227 - RNA, 19 nt, Homo sapiens
ggagcuucauucauaaguu

SEQ ID NO: 1544228 - RNA, 19 nt, Homo sapiens
gaaucuucaugccaggaua

SEQ ID NO: 1544229 - RNA, 19 nt, Homo sapiens
gaaggaaagggaugaagau

SEQ ID NO: 1544230 - RNA, 19 nt, Homo sapiens
gauacuaggcaagaauaua

SEQ ID NO: 1544231 - RNA, 19 nt, Homo sapiens
gaaggaaauaugcaauguu

SEQ ID NO: 1544232 - RNA, 19 nt, Homo sapiens
ucaaguguuuggaauguau

SEQ ID NO: 1544233 - RNA, 19 nt, Homo sapiens
ggugaagguucuggaguuu

SEQ ID NO: 1544234 - RNA, 19 nt, Homo sapiens
ggacagugauucgaacaag

SEQ ID NO: 1544235 - RNA, 19 nt, Homo sapiens
gaaaauggccaauuaaugg

SEQ ID NO: 1544236 - RNA, 19 nt, Homo sapiens
ucacuuugcaucuuaguuu

SEQ ID NO: 1544237 - RNA, 19 nt, Homo sapiens
uaagagcgaucccuuugca

SEQ ID NO: 1544238 - RNA, 19 nt, Homo sapiens
cagguagaaugucaagauu

SEQ ID NO: 1544239 - RNA, 19 nt, Homo sapiens
acacagccauuaccuagau

SEQ ID NO: 1544240 - RNA, 19 nt, Homo sapiens
gcacagggaaaucucaguu

SEQ ID NO: 1544241 - RNA, 19 nt, Homo sapiens
gagauaguccugaaagcaa

SEQ ID NO: 1544242 - RNA, 19 nt, Homo sapiens
ggaagcccuuucagcaaga

SEQ ID NO: 1544243 - RNA, 19 nt, Homo sapiens
auguggagcuucauucaua

SEQ ID NO: 1544244 - RNA, 19 nt, Homo sapiens
ccucaaauaugcagcaaag

SEQ ID NO: 1544245 - RNA, 19 nt, Homo sapiens
gugaagugcuuacaauuuu

SEQ ID NO: 1544246 - RNA, 19 nt, Homo sapiens
caauuaaugguccuguaua

SEQ ID NO: 1544247 - RNA, 19 nt, Homo sapiens
cguaucaucuggcauuuua

SEQ ID NO: 1544248 - RNA, 19 nt, Homo sapiens
augaauagcgaucaaguua

SEQ ID NO: 1544249 - RNA, 19 nt, Homo sapiens
gauagaugguauagagcuu

SEQ ID NO: 1544250 - RNA, 19 nt, Homo sapiens
gccauuaccuagauucaag

SEQ ID NO: 1544251 - RNA, 19 nt, Homo sapiens
gagcaguccucagggauca

SEQ ID NO: 1544252 - RNA, 19 nt, Homo sapiens
uagacaaacuucaggauac

SEQ ID NO: 1544253 - RNA, 19 nt, Homo sapiens
gccaauuaaugguccugua

SEQ ID NO: 1544254 - RNA, 19 nt, Homo sapiens
guguuugagucauauguuu

SEQ ID NO: 1544255 - RNA, 19 nt, Homo sapiens
ggugcuggcuggugggauu

SEQ ID NO: 1544256 - RNA, 19 nt, Homo sapiens
ccucagggaucaucaugga

SEQ ID NO: 1544257 - RNA, 19 nt, Homo sapiens
ggaauaccauaagaaugau

SEQ ID NO: 1544258 - RNA, 19 nt, Homo sapiens
uagaugguauagagcuuaa

SEQ ID NO: 1544259 - RNA, 19 nt, Homo sapiens
gcaggaaggaauguaauau

SEQ ID NO: 1544260 - RNA, 19 nt, Homo sapiens
ucuggaagaugacuuagug

SEQ ID NO: 1544261 - RNA, 19 nt, Homo sapiens
gcugugauuccucuaaauu

SEQ ID NO: 1544262 - RNA, 19 nt, Homo sapiens
ugagggaacacauaccuaa

SEQ ID NO: 1544263 - RNA, 19 nt, Homo sapiens
uaaugguccuguauaagug

SEQ ID NO: 1544264 - RNA, 19 nt, Homo sapiens
gguaauguuucuguucuuc

SEQ ID NO: 1544265 - RNA, 19 nt, Homo sapiens
uaaagugacccagggaauu

SEQ ID NO: 1544266 - RNA, 19 nt, Homo sapiens
uggaauguaucuaguaaag

SEQ ID NO: 1544267 - RNA, 19 nt, Homo sapiens
gcugugaaguggagauagu

SEQ ID NO: 1544268 - RNA, 19 nt, Homo sapiens
ugaagguuauucuggaaga

SEQ ID NO: 1544269 - RNA, 19 nt, Homo sapiens
ugagcaguauuacaccuuu

SEQ ID NO: 1544270 - RNA, 19 nt, Homo sapiens
gagaaggguagacaaacuu

SEQ ID NO: 1544271 - RNA, 19 nt, Homo sapiens
aaagugacccagggaauuu

SEQ ID NO: 1544272 - RNA, 19 nt, Homo sapiens
ucaaauaugcagcaaagau

SEQ ID NO: 1544273 - RNA, 19 nt, Homo sapiens
gaaaucucaguuccucaaa

SEQ ID NO: 1544274 - RNA, 19 nt, Homo sapiens
uauaagagcgaucccuuug

SEQ ID NO: 1544275 - RNA, 19 nt, Homo sapiens
caaaaggaauucgaagauu

SEQ ID NO: 1544276 - RNA, 19 nt, Homo sapiens
gaugaauagcgaucaaguu

SEQ ID NO: 1544277 - RNA, 19 nt, Homo sapiens
aacagaaaauggccaauua

SEQ ID NO: 1544278 - RNA, 19 nt, Homo sapiens
ggaagaugacuuaguggau

SEQ ID NO: 1544279 - RNA, 19 nt, Homo sapiens
gaacuggacugcauauuag

SEQ ID NO: 1544280 - RNA, 19 nt, Homo sapiens
ggacacgucuccaugauau

SEQ ID NO: 1544281 - RNA, 19 nt, Homo sapiens
gaaagcaagucucaucaga

SEQ ID NO: 1544282 - RNA, 19 nt, Homo sapiens
ccauuugccuuguaaguua

SEQ ID NO: 1544283 - RNA, 19 nt, Homo sapiens
acacauacaugcauaggua

SEQ ID NO: 1544284 - RNA, 19 nt, Homo sapiens
ugaaguaccucacccauga

SEQ ID NO: 1544285 - RNA, 19 nt, Homo sapiens
ccacaugcaucauuauuau

SEQ ID NO: 1544286 - RNA, 19 nt, Homo sapiens
aagcaagacuguucacuaa

SEQ ID NO: 1544287 - RNA, 19 nt, Homo sapiens
gaaacaagaugcugagacu

SEQ ID NO: 1544288 - RNA, 19 nt, Homo sapiens
gcaagacuguucacuaaag

SEQ ID NO: 1544289 - RNA, 19 nt, Homo sapiens
gccauacaguguucaauaa

SEQ ID NO: 1544290 - RNA, 19 nt, Homo sapiens
gaguaggacuggucugauu

SEQ ID NO: 1544291 - RNA, 19 nt, Homo sapiens
ugaacuggacugcauauua

SEQ ID NO: 1544292 - RNA, 19 nt, Homo sapiens
gaagagagggugaaagagu

SEQ ID NO: 1544293 - RNA, 19 nt, Homo sapiens
ccacaagcguuaucaucaa

SEQ ID NO: 1544294 - RNA, 19 nt, Homo sapiens
gaacugagagagagagaau

SEQ ID NO: 1544295 - RNA, 19 nt, Homo sapiens
gggcuguguuugcucuuua

SEQ ID NO: 1544296 - RNA, 19 nt, Homo sapiens
gcauagguauccugugugu

SEQ ID NO: 1544297 - RNA, 19 nt, Homo sapiens
caucuacccucuucucgaa

SEQ ID NO: 1544298 - RNA, 19 nt, Homo sapiens
ggauugguuuaaaggauuu

SEQ ID NO: 1544299 - RNA, 19 nt, Homo sapiens
guuccucuguucccaguua

SEQ ID NO: 1544300 - RNA, 19 nt, Homo sapiens
caagacuguucacuaaaga

SEQ ID NO: 1544301 - RNA, 19 nt, Homo sapiens
aaaguaauauucccugcuu

SEQ ID NO: 1544302 - RNA, 19 nt, Homo sapiens
guucccaguuaaaguaaua

SEQ ID NO: 1544303 - RNA, 19 nt, Homo sapiens
ggaaggagcacaggaaaca

SEQ ID NO: 1544304 - RNA, 19 nt, Homo sapiens
ucacugacccuaugauuuc

SEQ ID NO: 1544305 - RNA, 19 nt, Homo sapiens
aauagaaggucuugauaca

SEQ ID NO: 1544306 - RNA, 19 nt, Homo sapiens
gccaacggcuucccaagug

SEQ ID NO: 1544307 - RNA, 19 nt, Homo sapiens
caaguaagcaagacuguuc

SEQ ID NO: 1544308 - RNA, 19 nt, Homo sapiens
ccugauggaugauacaaga

SEQ ID NO: 1544309 - RNA, 19 nt, Homo sapiens
gcuuaaaugugcuaugaag

SEQ ID NO: 1544310 - RNA, 19 nt, Homo sapiens
ugucuuacacgcugaguua

SEQ ID NO: 1544311 - RNA, 19 nt, Homo sapiens
uaagcaagacuguucacua

SEQ ID NO: 1544312 - RNA, 19 nt, Homo sapiens
ugaacacccuccuaaguca

SEQ ID NO: 1544313 - RNA, 19 nt, Homo sapiens
uagaaggucuugauacaac

SEQ ID NO: 1544314 - RNA, 19 nt, Homo sapiens
gcaagaugccauacagugu

SEQ ID NO: 1544315 - RNA, 19 nt, Homo sapiens
cacaagcguuaucaucaaa

SEQ ID NO: 1544316 - RNA, 19 nt, Homo sapiens
gucaacacauacaugcaua

SEQ ID NO: 1544317 - RNA, 19 nt, Homo sapiens
gaaauggaaaggugguaau

SEQ ID NO: 1544318 - RNA, 19 nt, Homo sapiens
caggagcuguuuggucuaa

SEQ ID NO: 1544319 - RNA, 19 nt, Homo sapiens
ggacugcauauuaguuuau

SEQ ID NO: 1544320 - RNA, 19 nt, Homo sapiens
guauggaagugucuuaagg

SEQ ID NO: 1544321 - RNA, 19 nt, Homo sapiens
gauggaugauacaagaaau

SEQ ID NO: 1544322 - RNA, 19 nt, Homo sapiens
caagaugccauacaguguu

SEQ ID NO: 1544323 - RNA, 19 nt, Homo sapiens
gcaacaucaucgucaccaa

SEQ ID NO: 1544324 - RNA, 19 nt, Homo sapiens
ccugagcagugacaccuuu

SEQ ID NO: 1544325 - RNA, 19 nt, Homo sapiens
aggcuuaaaugugcuauga

SEQ ID NO: 1544326 - RNA, 19 nt, Homo sapiens
uaaggacacgucuccauga

SEQ ID NO: 1544327 - RNA, 19 nt, Homo sapiens
gaagcuucacuuuggauga

SEQ ID NO: 1544328 - RNA, 19 nt, Homo sapiens
guguccacaugcaucauua

SEQ ID NO: 1544329 - RNA, 19 nt, Homo sapiens
uccagaagcuucacuuugg

SEQ ID NO: 1544330 - RNA, 19 nt, Homo sapiens
ccagaagcuucacuuugga

SEQ ID NO: 1544331 - RNA, 19 nt, Homo sapiens
uggauugguuuaaaggauu

SEQ ID NO: 1544332 - RNA, 19 nt, Homo sapiens
uaucccauuugccuuguaa

SEQ ID NO: 1544333 - RNA, 19 nt, Homo sapiens
gagcacaggaaacaagaug

SEQ ID NO: 1544334 - RNA, 19 nt, Homo sapiens
ucuuucccguugaguauua

SEQ ID NO: 1544335 - RNA, 19 nt, Homo sapiens
caucaugguacuuugcuuu

SEQ ID NO: 1544336 - RNA, 19 nt, Homo sapiens
gauuaucauucuugagucu

SEQ ID NO: 1544337 - RNA, 19 nt, Homo sapiens
cgacugucauguuccacaa

SEQ ID NO: 1544338 - RNA, 19 nt, Homo sapiens
uuaaagauccaccgacugu

SEQ ID NO: 1544339 - RNA, 19 nt, Homo sapiens
uggacugcauauuaguuua

SEQ ID NO: 1544340 - RNA, 19 nt, Homo sapiens
agacgcaucugacaugaac

SEQ ID NO: 1544341 - RNA, 19 nt, Homo sapiens
acacgucuccaugauauuu

SEQ ID NO: 1544342 - RNA, 19 nt, Homo sapiens
ugccauacaguguucaaua

SEQ ID NO: 1544343 - RNA, 19 nt, Homo sapiens
uguuaaugcuggauugguu

SEQ ID NO: 1544344 - RNA, 19 nt, Homo sapiens
gccacaagcguuaucauca

SEQ ID NO: 1544345 - RNA, 19 nt, Homo sapiens
gagguuacacagcaggaaa

SEQ ID NO: 1544346 - RNA, 19 nt, Homo sapiens
ggaaaggugguaauuuuga

SEQ ID NO: 1544347 - RNA, 19 nt, Homo sapiens
ugaggacucuguggagaug

SEQ ID NO: 1544348 - RNA, 19 nt, Homo sapiens
gagguagccagucaacaga

SEQ ID NO: 1544349 - RNA, 19 nt, Homo sapiens
guuccgagguagccaguca

SEQ ID NO: 1544350 - RNA, 19 nt, Homo sapiens
gaaauuguuacuuccuagu

SEQ ID NO: 1544351 - RNA, 19 nt, Homo sapiens
guacuuugcuuuuguuucu

SEQ ID NO: 1544352 - RNA, 19 nt, Homo sapiens
cugaagagagggugaaaga

SEQ ID NO: 1544353 - RNA, 19 nt, Homo sapiens
ugauacaaccgacauuuua

SEQ ID NO: 1544354 - RNA, 19 nt, Homo sapiens
ugccagcgcuuccuauucu

SEQ ID NO: 1544355 - RNA, 19 nt, Homo sapiens
agagagagaauaaccuguu

SEQ ID NO: 1544356 - RNA, 19 nt, Homo sapiens
acugagagagagagaauaa

SEQ ID NO: 1544357 - RNA, 19 nt, Homo sapiens
uaacccaccggaaaucaga

SEQ ID NO: 1544358 - RNA, 19 nt, Homo sapiens
gaugccagcgcuuccuauu

SEQ ID NO: 1544359 - RNA, 19 nt, Homo sapiens
cauccagcucuuaugaaua

SEQ ID NO: 1544360 - RNA, 19 nt, Homo sapiens
aaagauccaccgacuguca

SEQ ID NO: 1544361 - RNA, 19 nt, Homo sapiens
augcauagguauccugugu

SEQ ID NO: 1544362 - RNA, 19 nt, Homo sapiens
gaggcaucaugguacuuug

SEQ ID NO: 1544363 - RNA, 19 nt, Homo sapiens
ccuccgagccugaagaugu

SEQ ID NO: 1544364 - RNA, 19 nt, Homo sapiens
uauaagggcuguguuugcu

SEQ ID NO: 1544365 - RNA, 19 nt, Homo sapiens
gguagccagucaacagaag

SEQ ID NO: 1544366 - RNA, 19 nt, Homo sapiens
uccacaugcaucauuauua

SEQ ID NO: 1544367 - RNA, 19 nt, Homo sapiens
guaggacuggucugauuau

SEQ ID NO: 1544368 - RNA, 19 nt, Homo sapiens
ccuguuagacccauagguu

SEQ ID NO: 1544369 - RNA, 19 nt, Homo sapiens
ggagcuguuuggucuaaaa

SEQ ID NO: 1544370 - RNA, 19 nt, Homo sapiens
gggcaucaccgugcaguuc

SEQ ID NO: 1544371 - RNA, 19 nt, Homo sapiens
uaauagaaggucuugauac

SEQ ID NO: 1544372 - RNA, 19 nt, Homo sapiens
gcuccagaagcuucacuuu

SEQ ID NO: 1544373 - RNA, 19 nt, Homo sapiens
ucuguucccaguuaaagua

SEQ ID NO: 1544374 - RNA, 19 nt, Homo sapiens
ugauggaugauacaagaaa

SEQ ID NO: 1544375 - RNA, 19 nt, Homo sapiens
guuauggcgcagaagauuu

SEQ ID NO: 1544376 - RNA, 19 nt, Homo sapiens
acaugaggacugcgucuuu

SEQ ID NO: 1544377 - RNA, 19 nt, Homo sapiens
cuucugaacacccuccuaa

SEQ ID NO: 1544378 - RNA, 19 nt, Homo sapiens
ugaaauggaaaggugguaa

SEQ ID NO: 1544379 - RNA, 19 nt, Homo sapiens
gcacucagcuuccauguuc

SEQ ID NO: 1544380 - RNA, 19 nt, Homo sapiens
uaaguucuuucccaaguua

SEQ ID NO: 1544381 - RNA, 19 nt, Homo sapiens
ggguagagguggugauuga

SEQ ID NO: 1544382 - RNA, 19 nt, Homo sapiens
gaacgggacuggcccuucu

SEQ ID NO: 1544383 - RNA, 19 nt, Homo sapiens
gauggccacuucaguauuc

SEQ ID NO: 1544384 - RNA, 19 nt, Homo sapiens
gaaaugacccuggcaucaa

SEQ ID NO: 1544385 - RNA, 19 nt, Homo sapiens
ccucugcacuuucuauuug

SEQ ID NO: 1544386 - RNA, 19 nt, Homo sapiens
ggacuagcuuggucacuca

SEQ ID NO: 1544387 - RNA, 19 nt, Homo sapiens
caagggagguguuguacuc

SEQ ID NO: 1544388 - RNA, 19 nt, Homo sapiens
gaugaucacugggaacaug

SEQ ID NO: 1544389 - RNA, 19 nt, Homo sapiens
gaagaagagagaaagcaaa

SEQ ID NO: 1544390 - RNA, 19 nt, Homo sapiens
caucgcagccgucgucuuu

SEQ ID NO: 1544391 - RNA, 19 nt, Homo sapiens
ggaaaugacccuggcauca

SEQ ID NO: 1544392 - RNA, 19 nt, Homo sapiens
caacguggccacacccauu

SEQ ID NO: 1544393 - RNA, 19 nt, Homo sapiens
acacucaucuucaucaucu

SEQ ID NO: 1544394 - RNA, 19 nt, Homo sapiens
aaagggaaccuggaaauga

SEQ ID NO: 1544395 - RNA, 19 nt, Homo sapiens
gcaaguacuguuuccauuc

SEQ ID NO: 1544396 - RNA, 19 nt, Homo sapiens
cauguucucuggcucauag

SEQ ID NO: 1544397 - RNA, 19 nt, Homo sapiens
ggugugugcuuucuuugug

SEQ ID NO: 1544398 - RNA, 19 nt, Homo sapiens
aaggagcucuggcggauga

SEQ ID NO: 1544399 - RNA, 19 nt, Homo sapiens
cauuggcucucgcaagauu

SEQ ID NO: 1544400 - RNA, 19 nt, Homo sapiens
guacuggguaugaucauga

SEQ ID NO: 1544401 - RNA, 19 nt, Homo sapiens
ugacagaggucuucauccu

SEQ ID NO: 1544402 - RNA, 19 nt, Homo sapiens
ccaccuuccugcacaugaa

SEQ ID NO: 1544403 - RNA, 19 nt, Homo sapiens
gcucaaagggaaccuggaa

SEQ ID NO: 1544404 - RNA, 19 nt, Homo sapiens
cgaaggacguccaccaacu

SEQ ID NO: 1544405 - RNA, 19 nt, Homo sapiens
gaaggacguccaccaacug

SEQ ID NO: 1544406 - RNA, 19 nt, Homo sapiens
gacucuaccuggaacugaa

SEQ ID NO: 1544407 - RNA, 19 nt, Homo sapiens
cugaaucacuggcgauaca

SEQ ID NO: 1544408 - RNA, 19 nt, Homo sapiens
caaagggaaccuggaaaug

SEQ ID NO: 1544409 - RNA, 19 nt, Homo sapiens
ucaaagggaaccuggaaau

SEQ ID NO: 1544410 - RNA, 19 nt, Homo sapiens
cuaaguucuuucccaaguu

SEQ ID NO: 1544411 - RNA, 19 nt, Homo sapiens
caacuucuccaucccauac

SEQ ID NO: 1544412 - RNA, 19 nt, Homo sapiens
cugggagccuguuaucauu

SEQ ID NO: 1544413 - RNA, 19 nt, Homo sapiens
gacagaggucuucauccua

SEQ ID NO: 1544414 - RNA, 19 nt, Homo sapiens
gcugggagccuguuaucau

SEQ ID NO: 1544415 - RNA, 19 nt, Homo sapiens
aaaugacccuggcaucaag

SEQ ID NO: 1544416 - RNA, 19 nt, Homo sapiens
ugcaaguacuguuuccauu

SEQ ID NO: 1544417 - RNA, 19 nt, Homo sapiens
acuggugugugcuuucuuu

SEQ ID NO: 1544418 - RNA, 19 nt, Homo sapiens
caaguacuguuuccauucc

SEQ ID NO: 1544419 - RNA, 19 nt, Homo sapiens
ggacucuaccuggaacuga

SEQ ID NO: 1544420 - RNA, 19 nt, Homo sapiens
cuucauugccucccuggua

SEQ ID NO: 1544421 - RNA, 19 nt, Homo sapiens
gaucccugauggccacuuc

SEQ ID NO: 1544422 - RNA, 19 nt, Homo sapiens
gagaagaagagagaaagca

SEQ ID NO: 1544423 - RNA, 19 nt, Homo sapiens
caaguuagagaagaagaga

SEQ ID NO: 1544424 - RNA, 19 nt, Homo sapiens
ugggaggccucaucuugga

SEQ ID NO: 1544425 - RNA, 19 nt, Homo sapiens
aaagaagagaggaaaguuc

SEQ ID NO: 1544426 - RNA, 19 nt, Homo sapiens
ggacguccaccaacugaac

SEQ ID NO: 1544427 - RNA, 19 nt, Homo sapiens
acuaaguucuuucccaagu

SEQ ID NO: 1544428 - RNA, 19 nt, Homo sapiens
gguacuggguaugaucaug

SEQ ID NO: 1544429 - RNA, 19 nt, Homo sapiens
gcuuggcacugggcuccua

SEQ ID NO: 1544430 - RNA, 19 nt, Homo sapiens
uuagagaagaagagagaaa

SEQ ID NO: 1544431 - RNA, 19 nt, Homo sapiens
ccacuggugugugcuuucu

SEQ ID NO: 1544432 - RNA, 19 nt, Homo sapiens
agaagaagagagaaagcaa

SEQ ID NO: 1544433 - RNA, 19 nt, Homo sapiens
aucauuggcucucgcaaga

SEQ ID NO: 1544434 - RNA, 19 nt, Homo sapiens
ggugacagaggucuucauc

SEQ ID NO: 1544435 - RNA, 19 nt, Homo sapiens
ugugggaggccucaucuug

SEQ ID NO: 1544436 - RNA, 19 nt, Homo sapiens
ucacacucaucuucaucau

SEQ ID NO: 1544437 - RNA, 19 nt, Homo sapiens
gggagccuguuaucauugc

SEQ ID NO: 1544438 - RNA, 19 nt, Homo sapiens
ugccugucauguccucuaa

SEQ ID NO: 1544439 - RNA, 19 nt, Homo sapiens
guagagguggugauugagu

SEQ ID NO: 1544440 - RNA, 19 nt, Homo sapiens
gagcucuggcggaugauca

SEQ ID NO: 1544441 - RNA, 19 nt, Homo sapiens
aagggaaccuggaaaugac

SEQ ID NO: 1544442 - RNA, 19 nt, Homo sapiens
ucaucuucaucaucuucua

SEQ ID NO: 1544443 - RNA, 19 nt, Homo sapiens
cgacgaaguccagccacaa

SEQ ID NO: 1544444 - RNA, 19 nt, Homo sapiens
ugggcgaccucaucaccuu

SEQ ID NO: 1544445 - RNA, 19 nt, Homo sapiens
gcuuggucacucaacauuu

SEQ ID NO: 1544446 - RNA, 19 nt, Homo sapiens
caucuucaucaucuucuau

SEQ ID NO: 1544447 - RNA, 19 nt, Homo sapiens
ucgcagccgucgucuuugg

SEQ ID NO: 1544448 - RNA, 19 nt, Homo sapiens
gccagagcaacgaaaguga

SEQ ID NO: 1544449 - RNA, 19 nt, Homo sapiens
gagaaucacucaacaguaa

SEQ ID NO: 1544450 - RNA, 19 nt, Homo sapiens
cuacacaguugaacaauua

SEQ ID NO: 1544451 - RNA, 19 nt, Homo sapiens
caucugaccucccuucuua

SEQ ID NO: 1544452 - RNA, 19 nt, Homo sapiens
gaaaggaaauagaaagaga

SEQ ID NO: 1544453 - RNA, 19 nt, Homo sapiens
gcaaauggacacagucuua

SEQ ID NO: 1544454 - RNA, 19 nt, Homo sapiens
gaaggccucucucaucuga

SEQ ID NO: 1544455 - RNA, 19 nt, Homo sapiens
caaauguucuggaugauga

SEQ ID NO: 1544456 - RNA, 19 nt, Homo sapiens
ggccagaggugugaaguua

SEQ ID NO: 1544457 - RNA, 19 nt, Homo sapiens
ggaaauagaaagagaagaa

SEQ ID NO: 1544458 - RNA, 19 nt, Homo sapiens
gcgaugacauguugggaua

SEQ ID NO: 1544459 - RNA, 19 nt, Homo sapiens
gaaaagcuuugaagaauga

SEQ ID NO: 1544460 - RNA, 19 nt, Homo sapiens
caacauugaugaugaaacu

SEQ ID NO: 1544461 - RNA, 19 nt, Homo sapiens
guuaaagagucucaugauu

SEQ ID NO: 1544462 - RNA, 19 nt, Homo sapiens
guuaugaaguggacacaaa

SEQ ID NO: 1544463 - RNA, 19 nt, Homo sapiens
guacaauaguugaugucua

SEQ ID NO: 1544464 - RNA, 19 nt, Homo sapiens
cagcugugguuauauugua

SEQ ID NO: 1544465 - RNA, 19 nt, Homo sapiens
ugaaguggacacaaaguua

SEQ ID NO: 1544466 - RNA, 19 nt, Homo sapiens
cagcaacuguaaucucaaa

SEQ ID NO: 1544467 - RNA, 19 nt, Homo sapiens
ccagaggugugaaguuaga

SEQ ID NO: 1544468 - RNA, 19 nt, Homo sapiens
cgagaaacaguaauauuug

SEQ ID NO: 1544469 - RNA, 19 nt, Homo sapiens
ggacuuuaaaucugucuuu

SEQ ID NO: 1544470 - RNA, 19 nt, Homo sapiens
guugaugucuacacaguug

SEQ ID NO: 1544471 - RNA, 19 nt, Homo sapiens
ugccucagauguaagaaua

SEQ ID NO: 1544472 - RNA, 19 nt, Homo sapiens
gcacguucguucuaucaca

SEQ ID NO: 1544473 - RNA, 19 nt, Homo sapiens
gagaaacaguaauauuugc

SEQ ID NO: 1544474 - RNA, 19 nt, Homo sapiens
gggaaaagcuuugaagaau

SEQ ID NO: 1544475 - RNA, 19 nt, Homo sapiens
ccuagcaacuguaaacugu

SEQ ID NO: 1544476 - RNA, 19 nt, Homo sapiens
guaaaugaagcaucuaaca

SEQ ID NO: 1544477 - RNA, 19 nt, Homo sapiens
gaugacauguugggauaau

SEQ ID NO: 1544478 - RNA, 19 nt, Homo sapiens
gaaacagagucgucuuuug

SEQ ID NO: 1544479 - RNA, 19 nt, Homo sapiens
ccucagauguaagaauaaa

SEQ ID NO: 1544480 - RNA, 19 nt, Homo sapiens
ggaaaagcuuugaagaaug

SEQ ID NO: 1544481 - RNA, 19 nt, Homo sapiens
uacaauaguugaugucuac

SEQ ID NO: 1544482 - RNA, 19 nt, Homo sapiens
caaauggacacagucuuaa

SEQ ID NO: 1544483 - RNA, 19 nt, Homo sapiens
ucuaacaugugcacaacuu

SEQ ID NO: 1544484 - RNA, 19 nt, Homo sapiens
aaaugaagcaucuaacaug

SEQ ID NO: 1544485 - RNA, 19 nt, Homo sapiens
caacuccuagcaacuguaa

SEQ ID NO: 1544486 - RNA, 19 nt, Homo sapiens
aggaguggauugaaaauua

SEQ ID NO: 1544487 - RNA, 19 nt, Homo sapiens
aaaucugucuuucucaguu

SEQ ID NO: 1544488 - RNA, 19 nt, Homo sapiens
aagcuaacauucugcugaa

SEQ ID NO: 1544489 - RNA, 19 nt, Homo sapiens
aauauuugccucagaugua

SEQ ID NO: 1544490 - RNA, 19 nt, Homo sapiens
ugacauguugggauaauga

SEQ ID NO: 1544491 - RNA, 19 nt, Homo sapiens
ccagauauaccagaagcua

SEQ ID NO: 1544492 - RNA, 19 nt, Homo sapiens
gccacgagaaacaguaaua

SEQ ID NO: 1544493 - RNA, 19 nt, Homo sapiens
gaaguggacacaaaguuac

SEQ ID NO: 1544494 - RNA, 19 nt, Homo sapiens
aaugaagcaucuaacaugu

SEQ ID NO: 1544495 - RNA, 19 nt, Homo sapiens
aaaguuuguuccaguuaug

SEQ ID NO: 1544496 - RNA, 19 nt, Homo sapiens
guaaaaguuuguuccaguu

SEQ ID NO: 1544497 - RNA, 19 nt, Homo sapiens
uaauccagauauaccagaa

SEQ ID NO: 1544498 - RNA, 19 nt, Homo sapiens
gagcaaggaguggauugaa

SEQ ID NO: 1544499 - RNA, 19 nt, Homo sapiens
ugggugacauuguugcaaa

SEQ ID NO: 1544500 - RNA, 19 nt, Homo sapiens
gaaggccuccuacugucuu

SEQ ID NO: 1544501 - RNA, 19 nt, Homo sapiens
uuagaaggccuccuacugu

SEQ ID NO: 1544502 - RNA, 19 nt, Homo sapiens
cuucauuccuguagucuca

SEQ ID NO: 1544503 - RNA, 19 nt, Homo sapiens
cauccuuuaugccuacauu

SEQ ID NO: 1544504 - RNA, 19 nt, Homo sapiens
gaaaagcugauccuuccua

SEQ ID NO: 1544505 - RNA, 19 nt, Homo sapiens
ucuacacaguugaacaauu

SEQ ID NO: 1544506 - RNA, 19 nt, Homo sapiens
gcaaggaguggauugaaaa

SEQ ID NO: 1544507 - RNA, 19 nt, Homo sapiens
gggcugcacguucguucua

SEQ ID NO: 1544508 - RNA, 19 nt, Homo sapiens
aaucugucuuucucaguuu

SEQ ID NO: 1544509 - RNA, 19 nt, Homo sapiens
auauuugccucagauguaa

SEQ ID NO: 1544510 - RNA, 19 nt, Homo sapiens
agcaaggaguggauugaaa

SEQ ID NO: 1544511 - RNA, 19 nt, Homo sapiens
gcaucuaacaugugcacaa

SEQ ID NO: 1544512 - RNA, 19 nt, Homo sapiens
uguucuggaugaugaaauu

SEQ ID NO: 1544513 - RNA, 19 nt, Homo sapiens
aguaauauuugccucagau

SEQ ID NO: 1544514 - RNA, 19 nt, Homo sapiens
aagcugauccuuccuaugg

SEQ ID NO: 1544515 - RNA, 19 nt, Homo sapiens
cugaaggccucucucaucu

SEQ ID NO: 1544516 - RNA, 19 nt, Homo sapiens
gacuuuaaaucugucuuuc

SEQ ID NO: 1544517 - RNA, 19 nt, Homo sapiens
guaguucgaaauagauguu

SEQ ID NO: 1544518 - RNA, 19 nt, Homo sapiens
aauaguugaugucuacaca

SEQ ID NO: 1544519 - RNA, 19 nt, Homo sapiens
cacgagaaacaguaauauu

SEQ ID NO: 1544520 - RNA, 19 nt, Homo sapiens
gaaaaggccagagguguga

SEQ ID NO: 1544521 - RNA, 19 nt, Homo sapiens
ggugaacauguuucuagaa

SEQ ID NO: 1544522 - RNA, 19 nt, Homo sapiens
gauguuccagcugugguua

SEQ ID NO: 1544523 - RNA, 19 nt, Homo sapiens
cagauauaccagaagcuaa

SEQ ID NO: 1544524 - RNA, 19 nt, Homo sapiens
gagccaaaauacuuuacaa

SEQ ID NO: 1544525 - RNA, 19 nt, Homo sapiens
acacaggcacccuucauuc

SEQ ID NO: 1544526 - RNA, 19 nt, Homo sapiens
uuccagcugugguuauauu

SEQ ID NO: 1544527 - RNA, 19 nt, Homo sapiens
caacuaauccagauauacc

SEQ ID NO: 1544528 - RNA, 19 nt, Homo sapiens
gaggauuauuaacgugcuu

SEQ ID NO: 1544529 - RNA, 19 nt, Homo sapiens
ccacgagaaacaguaauau

SEQ ID NO: 1544530 - RNA, 19 nt, Homo sapiens
caacuucagaccggagaaa

SEQ ID NO: 1544531 - RNA, 19 nt, Homo sapiens
cuacugaggcaagcagaaa

SEQ ID NO: 1544532 - RNA, 19 nt, Homo sapiens
caucuaacaugugcacaac

SEQ ID NO: 1544533 - RNA, 19 nt, Homo sapiens
uguuccagcugugguuaua

SEQ ID NO: 1544534 - RNA, 19 nt, Homo sapiens
caaaaguaguucgaaauag

SEQ ID NO: 1544535 - RNA, 19 nt, Homo sapiens
gaugaugaaauugacaguu

SEQ ID NO: 1544536 - RNA, 19 nt, Homo sapiens
gcaacuccuagcaacugua

SEQ ID NO: 1544537 - RNA, 19 nt, Homo sapiens
guggugaacauguuucuag

SEQ ID NO: 1544538 - RNA, 19 nt, Homo sapiens
gaacucuggaaaaguauaa

SEQ ID NO: 1544539 - RNA, 19 nt, Homo sapiens
uuugaacucuggaaaagua

SEQ ID NO: 1544540 - RNA, 19 nt, Homo sapiens
uaguugaugucuacacagu

SEQ ID NO: 1544541 - RNA, 19 nt, Homo sapiens
uuaguguacucucgugcaa

SEQ ID NO: 1544542 - RNA, 19 nt, Homo sapiens
ggaguggauugaaaauuag

SEQ ID NO: 1544543 - RNA, 19 nt, Homo sapiens
cuuuaaaucugucuuucuc

SEQ ID NO: 1544544 - RNA, 19 nt, Homo sapiens
gcuugcagcugugaaaucg

SEQ ID NO: 1544545 - RNA, 19 nt, Homo sapiens
ggagagccaaaauacuuua

SEQ ID NO: 1544546 - RNA, 19 nt, Homo sapiens
gaugccacgagaaacagua

SEQ ID NO: 1544547 - RNA, 19 nt, Homo sapiens
gggugacauuguugcaaau

SEQ ID NO: 1544548 - RNA, 19 nt, Homo sapiens
uauaccagaagcuaacauu

SEQ ID NO: 1544549 - RNA, 19 nt, Homo sapiens
guagggagcuuaccuguga

SEQ ID NO: 1544550 - RNA, 19 nt, Homo sapiens
gcaaguggccgcagugcua

SEQ ID NO: 1544551 - RNA, 19 nt, Homo sapiens
uaacucgucuggccuuuga

SEQ ID NO: 1544552 - RNA, 19 nt, Homo sapiens
caagaaggcuuugcuuaag

SEQ ID NO: 1544553 - RNA, 19 nt, Homo sapiens
gacgguggcuggugccuuu

SEQ ID NO: 1544554 - RNA, 19 nt, Homo sapiens
gagcuuaccugugauugug

SEQ ID NO: 1544555 - RNA, 19 nt, Homo sapiens
ggaguuccuuccuguguau

SEQ ID NO: 1544556 - RNA, 19 nt, Homo sapiens
acaagaaggcuuugcuuaa

SEQ ID NO: 1544557 - RNA, 19 nt, Homo sapiens
ccacugcucuggccaaugg

SEQ ID NO: 1544558 - RNA, 19 nt, Homo sapiens
gaucagccaggaagaguuu

SEQ ID NO: 1544559 - RNA, 19 nt, Homo sapiens
caucucugcuccuguuuga

SEQ ID NO: 1544560 - RNA, 19 nt, Homo sapiens
ucucagcccugcagcauug

SEQ ID NO: 1544561 - RNA, 19 nt, Homo sapiens
agaaggcuuugcuuaaguu

SEQ ID NO: 1544562 - RNA, 19 nt, Homo sapiens
caccgaaugugaguuugua

SEQ ID NO: 1544563 - RNA, 19 nt, Homo sapiens
gaacuucucccuccaugac

SEQ ID NO: 1544564 - RNA, 19 nt, Homo sapiens
ccaaccgccugcuguacaa

SEQ ID NO: 1544565 - RNA, 19 nt, Homo sapiens
caacaagaaggcuuugcuu

SEQ ID NO: 1544566 - RNA, 19 nt, Homo sapiens
gugcaugaguuacaucucu

SEQ ID NO: 1544567 - RNA, 19 nt, Homo sapiens
ccugugaccugcccaaagu

SEQ ID NO: 1544568 - RNA, 19 nt, Homo sapiens
gcaccucccagacaccaaa

SEQ ID NO: 1544569 - RNA, 19 nt, Homo sapiens
gcuguccgcuggcuaugug

SEQ ID NO: 1544570 - RNA, 19 nt, Homo sapiens
cagcuucaggagccaauua

SEQ ID NO: 1544571 - RNA, 19 nt, Homo sapiens
ggaaacucuucagcaccua

SEQ ID NO: 1544572 - RNA, 19 nt, Homo sapiens
aacaagaaggcuuugcuua

SEQ ID NO: 1544573 - RNA, 19 nt, Homo sapiens
ucaaguggccggucuuagu

SEQ ID NO: 1544574 - RNA, 19 nt, Homo sapiens
gagugcuucuggccuuuau

SEQ ID NO: 1544575 - RNA, 19 nt, Homo sapiens
uggaguuccuuccugugua

SEQ ID NO: 1544576 - RNA, 19 nt, Homo sapiens
aagaaggcuuugcuuaagu

SEQ ID NO: 1544577 - RNA, 19 nt, Homo sapiens
caaguggccggucuuagug

SEQ ID NO: 1544578 - RNA, 19 nt, Homo sapiens
caaugggacugugcaagca

SEQ ID NO: 1544579 - RNA, 19 nt, Homo sapiens
aggcuuugcuuaaguucaa

SEQ ID NO: 1544580 - RNA, 19 nt, Homo sapiens
uuggagcccuucuucgauu

SEQ ID NO: 1544581 - RNA, 19 nt, Homo sapiens
ggcacaggcucugggcauu

SEQ ID NO: 1544582 - RNA, 19 nt, Homo sapiens
gcuaacucgucuggccuuu

SEQ ID NO: 1544583 - RNA, 19 nt, Homo sapiens
gaagguggcguuggaacca

SEQ ID NO: 1544584 - RNA, 19 nt, Homo sapiens
ggcugaagguggcguugga

SEQ ID NO: 1544585 - RNA, 19 nt, Homo sapiens
ggagcuuaccugugauugu

SEQ ID NO: 1544586 - RNA, 19 nt, Homo sapiens
gcacaggcucugggcauuc

SEQ ID NO: 1544587 - RNA, 19 nt, Homo sapiens
ggauggaggaagacugugu

SEQ ID NO: 1544588 - RNA, 19 nt, Homo sapiens
agauguggcccuugcacua

SEQ ID NO: 1544589 - RNA, 19 nt, Homo sapiens
ggccggagucgaaugauca

SEQ ID NO: 1544590 - RNA, 19 nt, Homo sapiens
ggccgcagugcuauucuuu

SEQ ID NO: 1544591 - RNA, 19 nt, Homo sapiens
caaaccaggagccuucauc

SEQ ID NO: 1544592 - RNA, 19 nt, Homo sapiens
gucccgagcugagaaccuu

SEQ ID NO: 1544593 - RNA, 19 nt, Homo sapiens
ccacacuccacuuucuuug

SEQ ID NO: 1544594 - RNA, 19 nt, Homo sapiens
caagcagaagggagacuga

SEQ ID NO: 1544595 - RNA, 19 nt, Homo sapiens
ccaggccggagucgaauga

SEQ ID NO: 1544596 - RNA, 19 nt, Homo sapiens
guuccaacaagaaggcuuu

SEQ ID NO: 1544597 - RNA, 19 nt, Homo sapiens
gcaagcacccaagcagaag

SEQ ID NO: 1544598 - RNA, 19 nt, Homo sapiens
gaaugaucagccaggaaga

SEQ ID NO: 1544599 - RNA, 19 nt, Homo sapiens
cauuguggauguggaguuc

SEQ ID NO: 1544600 - RNA, 19 nt, Homo sapiens
cauuggagcccuucuucga

SEQ ID NO: 1544601 - RNA, 19 nt, Homo sapiens
acacuccacuuucuuugac

SEQ ID NO: 1544602 - RNA, 19 nt, Homo sapiens
ucucugcuccuguuugaau

SEQ ID NO: 1544603 - RNA, 19 nt, Homo sapiens
gauguggcccuugcacuag

SEQ ID NO: 1544604 - RNA, 19 nt, Homo sapiens
cacccucuaugccaacaau

SEQ ID NO: 1544605 - RNA, 19 nt, Homo sapiens
gcauuguggauguggaguu

SEQ ID NO: 1544606 - RNA, 19 nt, Homo sapiens
caggauggaggaagacugu

SEQ ID NO: 1544607 - RNA, 19 nt, Homo sapiens
uugguggacuuccgagaug

SEQ ID NO: 1544608 - RNA, 19 nt, Homo sapiens
cgagugcuucuggccuuua

SEQ ID NO: 1544609 - RNA, 19 nt, Homo sapiens
ggacuuaaauuuggcuuga

SEQ ID NO: 1544610 - RNA, 19 nt, Homo sapiens
caaacaagguccuggaaga

SEQ ID NO: 1544611 - RNA, 19 nt, Homo sapiens
ggacauagacaaugacuuc

SEQ ID NO: 1544612 - RNA, 19 nt, Homo sapiens
auacaacacuggcaaagaa

SEQ ID NO: 1544613 - RNA, 19 nt, Homo sapiens
gaagaccuuugcaaacaga

SEQ ID NO: 1544614 - RNA, 19 nt, Homo sapiens
caucggacauagacaauga

SEQ ID NO: 1544615 - RNA, 19 nt, Homo sapiens
cagaagaccuuugcaaaca

SEQ ID NO: 1544616 - RNA, 19 nt, Homo sapiens
ccucaaagguggucucuca

SEQ ID NO: 1544617 - RNA, 19 nt, Homo sapiens
ggaaagccauggcggaucu

SEQ ID NO: 1544618 - RNA, 19 nt, Homo sapiens
acaagguccuggaagauaa

SEQ ID NO: 1544619 - RNA, 19 nt, Homo sapiens
gaauuaaggcaauccagaa

SEQ ID NO: 1544620 - RNA, 19 nt, Homo sapiens
cuacugggauucuaacaga

SEQ ID NO: 1544621 - RNA, 19 nt, Homo sapiens
ugaugcagcuugauaaaca

SEQ ID NO: 1544622 - RNA, 19 nt, Homo sapiens
gacaaagcuucuaggcaaa

SEQ ID NO: 1544623 - RNA, 19 nt, Homo sapiens
ugaaauguuugcugagaug

SEQ ID NO: 1544624 - RNA, 19 nt, Homo sapiens
gauccgugguucugaaaug

SEQ ID NO: 1544625 - RNA, 19 nt, Homo sapiens
gccaucaucuccagggaaa

SEQ ID NO: 1544626 - RNA, 19 nt, Homo sapiens
ggacuaauugcccucauug

SEQ ID NO: 1544627 - RNA, 19 nt, Homo sapiens
gggacuaauugcccucauu

SEQ ID NO: 1544628 - RNA, 19 nt, Homo sapiens
gcggaucuguccugcaaga

SEQ ID NO: 1544629 - RNA, 19 nt, Homo sapiens
ucuguaagguugcaaacaa

SEQ ID NO: 1544630 - RNA, 19 nt, Homo sapiens
guacagaagaccuuugcaa

SEQ ID NO: 1544631 - RNA, 19 nt, Homo sapiens
gagcuaaguucuauaaaag

SEQ ID NO: 1544632 - RNA, 19 nt, Homo sapiens
gaagucgggcagagacauu

SEQ ID NO: 1544633 - RNA, 19 nt, Homo sapiens
aagguggucucucagcuuu

SEQ ID NO: 1544634 - RNA, 19 nt, Homo sapiens
cagagagaauuaaggcaau

SEQ ID NO: 1544635 - RNA, 19 nt, Homo sapiens
caaugaagccucaccuaca

SEQ ID NO: 1544636 - RNA, 19 nt, Homo sapiens
uaucauugcucgagcuaag

SEQ ID NO: 1544637 - RNA, 19 nt, Homo sapiens
cgagcuaaguucuauaaaa

SEQ ID NO: 1544638 - RNA, 19 nt, Homo sapiens
gaugcagcuugauaaacaa

SEQ ID NO: 1544639 - RNA, 19 nt, Homo sapiens
uggcggaucuguccugcaa

SEQ ID NO: 1544640 - RNA, 19 nt, Homo sapiens
caacacuggcaaagaaaug

SEQ ID NO: 1544641 - RNA, 19 nt, Homo sapiens
caaagaagucgggcagaga

SEQ ID NO: 1544642 - RNA, 19 nt, Homo sapiens
ccacaggggacuuaaauuu

SEQ ID NO: 1544643 - RNA, 19 nt, Homo sapiens
uuacgugaauguguuguau

SEQ ID NO: 1544644 - RNA, 19 nt, Homo sapiens
gucaggaauugaagcgauu

SEQ ID NO: 1544645 - RNA, 19 nt, Homo sapiens
gcaaacagugugaugaacu

SEQ ID NO: 1544646 - RNA, 19 nt, Homo sapiens
aaugaagccucaccuacau

SEQ ID NO: 1544647 - RNA, 19 nt, Homo sapiens
uacagaagaccuuugcaaa

SEQ ID NO: 1544648 - RNA, 19 nt, Homo sapiens
gguggucucucagcuuuua

SEQ ID NO: 1544649 - RNA, 19 nt, Homo sapiens
ccgugguucugaaauguuu

SEQ ID NO: 1544650 - RNA, 19 nt, Homo sapiens
ucugaaauguuugcugaga

SEQ ID NO: 1544651 - RNA, 19 nt, Homo sapiens
gaugcaaacagugugauga

SEQ ID NO: 1544652 - RNA, 19 nt, Homo sapiens
gguccuggaagauaagauu

SEQ ID NO: 1544653 - RNA, 19 nt, Homo sapiens
gauaucauugcucgagcua

SEQ ID NO: 1544654 - RNA, 19 nt, Homo sapiens
gcuugaugcagcuugauaa

SEQ ID NO: 1544655 - RNA, 19 nt, Homo sapiens
cauaaaaccuuaccagacu

SEQ ID NO: 1544656 - RNA, 19 nt, Homo sapiens
aacaagguccuggaagaua

SEQ ID NO: 1544657 - RNA, 19 nt, Homo sapiens
gcucauaccccuucaguca

SEQ ID NO: 1544658 - RNA, 19 nt, Homo sapiens
ucucucagcuuuuaaguca

SEQ ID NO: 1544659 - RNA, 19 nt, Homo sapiens
agacucugaucaaagaagu

SEQ ID NO: 1544660 - RNA, 19 nt, Homo sapiens
cgggauccgugguucugaa

SEQ ID NO: 1544661 - RNA, 19 nt, Homo sapiens
acuuaaauuuggcuugaug

SEQ ID NO: 1544662 - RNA, 19 nt, Homo sapiens
cguggacccugcugucauc

SEQ ID NO: 1544663 - RNA, 19 nt, Homo sapiens
uugcugagauggauuugag

SEQ ID NO: 1544664 - RNA, 19 nt, Homo sapiens
aaacaagguccuggaagau

SEQ ID NO: 1544665 - RNA, 19 nt, Homo sapiens
gcagcuugauaaacaaacg

SEQ ID NO: 1544666 - RNA, 19 nt, Homo sapiens
ggcuugaugcagcuugaua

SEQ ID NO: 1544667 - RNA, 19 nt, Homo sapiens
guuauccuccgugguguuu

SEQ ID NO: 1544668 - RNA, 19 nt, Homo sapiens
aaacagagaggggagauuu

SEQ ID NO: 1544669 - RNA, 19 nt, Homo sapiens
ugagggccauaaaaccuua

SEQ ID NO: 1544670 - RNA, 19 nt, Homo sapiens
aauuaaggcaauccagaaa

SEQ ID NO: 1544671 - RNA, 19 nt, Homo sapiens
acagaagaccuuugcaaac

SEQ ID NO: 1544672 - RNA, 19 nt, Homo sapiens
ugucaucgcagccaucauc

SEQ ID NO: 1544673 - RNA, 19 nt, Homo sapiens
gcuuuuaagucaggaauug

SEQ ID NO: 1544674 - RNA, 19 nt, Homo sapiens
agaagaccuuugcaaacag

SEQ ID NO: 1544675 - RNA, 19 nt, Homo sapiens
gggauccgugguucugaaa

SEQ ID NO: 1544676 - RNA, 19 nt, Homo sapiens
ggacaaagcacuauauaua

SEQ ID NO: 1544677 - RNA, 19 nt, Homo sapiens
gaagaugacugaagaguau

SEQ ID NO: 1544678 - RNA, 19 nt, Homo sapiens
gaagggagcuguucugaug

SEQ ID NO: 1544679 - RNA, 19 nt, Homo sapiens
gaagaaagcacaauuauuc

SEQ ID NO: 1544680 - RNA, 19 nt, Homo sapiens
ggaccaagguuaauaaaug

SEQ ID NO: 1544681 - RNA, 19 nt, Homo sapiens
acacaugccuuguauauuu

SEQ ID NO: 1544682 - RNA, 19 nt, Homo sapiens
gaagaagucugaauaugug

SEQ ID NO: 1544683 - RNA, 19 nt, Homo sapiens
agaaugcuguggucaauua

SEQ ID NO: 1544684 - RNA, 19 nt, Homo sapiens
ggacaaggcacaagaagaa

SEQ ID NO: 1544685 - RNA, 19 nt, Homo sapiens
gaaguacuguguaaagaug

SEQ ID NO: 1544686 - RNA, 19 nt, Homo sapiens
gcaccuaacuuaugugagu

SEQ ID NO: 1544687 - RNA, 19 nt, Homo sapiens
ucaagaagaugacugaaga

SEQ ID NO: 1544688 - RNA, 19 nt, Homo sapiens
uaaucuagcccacuuaaua

SEQ ID NO: 1544689 - RNA, 19 nt, Homo sapiens
gaagaaugcuguggucaau

SEQ ID NO: 1544690 - RNA, 19 nt, Homo sapiens
gaccaagguuaauaaauga

SEQ ID NO: 1544691 - RNA, 19 nt, Homo sapiens
gagcaucaauuucauaugg

SEQ ID NO: 1544692 - RNA, 19 nt, Homo sapiens
gaacaaaguuagggagcaa

SEQ ID NO: 1544693 - RNA, 19 nt, Homo sapiens
gaaggaccaagguuaauaa

SEQ ID NO: 1544694 - RNA, 19 nt, Homo sapiens
ucucauccguuaucucuua

SEQ ID NO: 1544695 - RNA, 19 nt, Homo sapiens
gcucuaaagugugugauuu

SEQ ID NO: 1544696 - RNA, 19 nt, Homo sapiens
guaagggauuugaaugaaa

SEQ ID NO: 1544697 - RNA, 19 nt, Homo sapiens
agaagacucugauauguug

SEQ ID NO: 1544698 - RNA, 19 nt, Homo sapiens
gcacaauuauucccaaucu

SEQ ID NO: 1544699 - RNA, 19 nt, Homo sapiens
ggaagaaagcacaauuauu

SEQ ID NO: 1544700 - RNA, 19 nt, Homo sapiens
ggaaauugccauauguuga

SEQ ID NO: 1544701 - RNA, 19 nt, Homo sapiens
caacauuaguagccuuaaa

SEQ ID NO: 1544702 - RNA, 19 nt, Homo sapiens
gagauuacaggaccagaua

SEQ ID NO: 1544703 - RNA, 19 nt, Homo sapiens
gagcaaaccaguaaccuau

SEQ ID NO: 1544704 - RNA, 19 nt, Homo sapiens
gagauccuaugggaaauuu

SEQ ID NO: 1544705 - RNA, 19 nt, Homo sapiens
cuuaauagaugccaauuca

SEQ ID NO: 1544706 - RNA, 19 nt, Homo sapiens
gaaguggcauagucuagug

SEQ ID NO: 1544707 - RNA, 19 nt, Homo sapiens
gcagcuagagauuuauaua

SEQ ID NO: 1544708 - RNA, 19 nt, Homo sapiens
caccacaccuagcuccuua

SEQ ID NO: 1544709 - RNA, 19 nt, Homo sapiens
gcacaugccaccacaccua

SEQ ID NO: 1544710 - RNA, 19 nt, Homo sapiens
gaaauugccauauguugau

SEQ ID NO: 1544711 - RNA, 19 nt, Homo sapiens
aaagaagacucugauaugu

SEQ ID NO: 1544712 - RNA, 19 nt, Homo sapiens
ccaguggacucccugcuuu

SEQ ID NO: 1544713 - RNA, 19 nt, Homo sapiens
acaagaagaagucugaaua

SEQ ID NO: 1544714 - RNA, 19 nt, Homo sapiens
uguggcagcuagagauuua

SEQ ID NO: 1544715 - RNA, 19 nt, Homo sapiens
ugaguucccuauuuccaua

SEQ ID NO: 1544716 - RNA, 19 nt, Homo sapiens
ccagagauccuaugggaaa

SEQ ID NO: 1544717 - RNA, 19 nt, Homo sapiens
gacagcagguccuuaacuu

SEQ ID NO: 1544718 - RNA, 19 nt, Homo sapiens
ggaaauggaggccuucaga

SEQ ID NO: 1544719 - RNA, 19 nt, Homo sapiens
guaaacacaaugguucuua

SEQ ID NO: 1544720 - RNA, 19 nt, Homo sapiens
uaacagaggauccuacaau

SEQ ID NO: 1544721 - RNA, 19 nt, Homo sapiens
gaacaaguaagggauuuga

SEQ ID NO: 1544722 - RNA, 19 nt, Homo sapiens
ucaauaaucccuugcuuug

SEQ ID NO: 1544723 - RNA, 19 nt, Homo sapiens
gaaagaaaugucccucgaa

SEQ ID NO: 1544724 - RNA, 19 nt, Homo sapiens
ccucauaucugaaagugau

SEQ ID NO: 1544725 - RNA, 19 nt, Homo sapiens
ggaagaggaggcugaaaug

SEQ ID NO: 1544726 - RNA, 19 nt, Homo sapiens
gaacaccagauccucauau

SEQ ID NO: 1544727 - RNA, 19 nt, Homo sapiens
ugccauauguugauacaaa

SEQ ID NO: 1544728 - RNA, 19 nt, Homo sapiens
agaggaggcugaaaugaug

SEQ ID NO: 1544729 - RNA, 19 nt, Homo sapiens
guuaaauguugacugcuaa

SEQ ID NO: 1544730 - RNA, 19 nt, Homo sapiens
caagaagaagucugaauau

SEQ ID NO: 1544731 - RNA, 19 nt, Homo sapiens
gcuagagauuuauauagga

SEQ ID NO: 1544732 - RNA, 19 nt, Homo sapiens
agacucaacugcuaugugu

SEQ ID NO: 1544733 - RNA, 19 nt, Homo sapiens
gguagaggcugcccgaagu

SEQ ID NO: 1544734 - RNA, 19 nt, Homo sapiens
uagaauugcuaaagccauu

SEQ ID NO: 1544735 - RNA, 19 nt, Homo sapiens
acacgcaccucugcuagua

SEQ ID NO: 1544736 - RNA, 19 nt, Homo sapiens
ccaagaauguggugaucga

SEQ ID NO: 1544737 - RNA, 19 nt, Homo sapiens
ugacacaugccuuguauau

SEQ ID NO: 1544738 - RNA, 19 nt, Homo sapiens
gcaugauacuaggcaauuu

SEQ ID NO: 1544739 - RNA, 19 nt, Homo sapiens
gcuaucaucuauuaaaugc

SEQ ID NO: 1544740 - RNA, 19 nt, Homo sapiens
gcaucaauuucauaugguu

SEQ ID NO: 1544741 - RNA, 19 nt, Homo sapiens
gcuggaaauugccauaugu

SEQ ID NO: 1544742 - RNA, 19 nt, Homo sapiens
gaacauagagaaggaccaa

SEQ ID NO: 1544743 - RNA, 19 nt, Homo sapiens
gaagaggaggcugaaauga

SEQ ID NO: 1544744 - RNA, 19 nt, Homo sapiens
ccagacagcagguccuuaa

SEQ ID NO: 1544745 - RNA, 19 nt, Homo sapiens
acagaggauccuacaauua

SEQ ID NO: 1544746 - RNA, 19 nt, Homo sapiens
uagagaaggaccaagguua

SEQ ID NO: 1544747 - RNA, 19 nt, Homo sapiens
caugauacuaggcaauuua

SEQ ID NO: 1544748 - RNA, 19 nt, Homo sapiens
gaaaagaagacucugauau

SEQ ID NO: 1544749 - RNA, 19 nt, Homo sapiens
acacaaugguucuuacugu

SEQ ID NO: 1544750 - RNA, 19 nt, Homo sapiens
ggacuuugaggcacuugua

SEQ ID NO: 1544751 - RNA, 19 nt, Homo sapiens
uaaagccauuggucugaaa

SEQ ID NO: 1544752 - RNA, 19 nt, Homo sapiens
gaaguguuuggccacauua

SEQ ID NO: 1544753 - RNA, 19 nt, Homo sapiens
guggaagaaagcacaauua

SEQ ID NO: 1544754 - RNA, 19 nt, Homo sapiens
gugaguugcucuaaagugu

SEQ ID NO: 1544755 - RNA, 19 nt, Homo sapiens
gacgagaacauagaaguuu

SEQ ID NO: 1544756 - RNA, 19 nt, Homo sapiens
gcaaaccaguaaccuaugc

SEQ ID NO: 1544757 - RNA, 19 nt, Homo sapiens
ggagcaaaccaguaaccua

SEQ ID NO: 1544758 - RNA, 19 nt, Homo sapiens
ccaggugaauccaugagaa

SEQ ID NO: 1544759 - RNA, 19 nt, Homo sapiens
guucuuacuguuuccauua

SEQ ID NO: 1544760 - RNA, 19 nt, Homo sapiens
gagcuacuccuucacacaa

SEQ ID NO: 1544761 - RNA, 19 nt, Homo sapiens
uaguguaaauggacuuuga

SEQ ID NO: 1544762 - RNA, 19 nt, Homo sapiens
ggucauaaaguuuguaucu

SEQ ID NO: 1544763 - RNA, 19 nt, Homo sapiens
uauccucccucacucauug

SEQ ID NO: 1544764 - RNA, 19 nt, Homo sapiens
acaccuagcuccuuacaac

SEQ ID NO: 1544765 - RNA, 19 nt, Homo sapiens
gcucugugccuaugucuug

SEQ ID NO: 1544766 - RNA, 19 nt, Homo sapiens
aaauuaaucuagcccacuu

SEQ ID NO: 1544767 - RNA, 19 nt, Homo sapiens
aauauccacuugagaguau

SEQ ID NO: 1544768 - RNA, 19 nt, Homo sapiens
gacuaaaggugacccucuu

SEQ ID NO: 1544769 - RNA, 19 nt, Homo sapiens
agaagaagucugaauaugu

SEQ ID NO: 1544770 - RNA, 19 nt, Homo sapiens
gcagugacgagaacauaga

SEQ ID NO: 1544771 - RNA, 19 nt, Homo sapiens
ucucugcucuucaaccauu

SEQ ID NO: 1544772 - RNA, 19 nt, Homo sapiens
gggaagaggaggcugaaau

SEQ ID NO: 1544773 - RNA, 19 nt, Homo sapiens
acacuaaacaugauugaug

SEQ ID NO: 1544774 - RNA, 19 nt, Homo sapiens
cucccucacucauugauua

SEQ ID NO: 1544775 - RNA, 19 nt, Homo sapiens
aagaagaagucugaauaug

SEQ ID NO: 1544776 - RNA, 19 nt, Homo sapiens
ccaaauggguguaauaaua

SEQ ID NO: 1544777 - RNA, 19 nt, Homo sapiens
caaagucgaucuugagaga

SEQ ID NO: 1544778 - RNA, 19 nt, Homo sapiens
gcacagaacggauauaauc

SEQ ID NO: 1544779 - RNA, 19 nt, Homo sapiens
gcucagcucuuuccaucua

SEQ ID NO: 1544780 - RNA, 19 nt, Homo sapiens
gaaaucagcauuccagguu

SEQ ID NO: 1544781 - RNA, 19 nt, Homo sapiens
gaacggauauaaucagucu

SEQ ID NO: 1544782 - RNA, 19 nt, Homo sapiens
uuagaaaccuugacucuga

SEQ ID NO: 1544783 - RNA, 19 nt, Homo sapiens
gguauuaauugcagggaua

SEQ ID NO: 1544784 - RNA, 19 nt, Homo sapiens
gaaccucagugcaugcaaa

SEQ ID NO: 1544785 - RNA, 19 nt, Homo sapiens
gagaaacacuggcauggau

SEQ ID NO: 1544786 - RNA, 19 nt, Homo sapiens
caacagcagugacgcauuc

SEQ ID NO: 1544787 - RNA, 19 nt, Homo sapiens
caauagaggugacugagau

SEQ ID NO: 1544788 - RNA, 19 nt, Homo sapiens
ugagagaccuggccacaug

SEQ ID NO: 1544789 - RNA, 19 nt, Homo sapiens
gaagaagacucgggagaag

SEQ ID NO: 1544790 - RNA, 19 nt, Homo sapiens
aaauacaccugccauguga

SEQ ID NO: 1544791 - RNA, 19 nt, Homo sapiens
gagaagaugaacaacauuu

SEQ ID NO: 1544792 - RNA, 19 nt, Homo sapiens
caauacccauagucaauuu

SEQ ID NO: 1544793 - RNA, 19 nt, Homo sapiens
cguaagggauguccuaaga

SEQ ID NO: 1544794 - RNA, 19 nt, Homo sapiens
acagacagcugccaucaga

SEQ ID NO: 1544795 - RNA, 19 nt, Homo sapiens
gaauugggccacagaggua

SEQ ID NO: 1544796 - RNA, 19 nt, Homo sapiens
gaaaggccaccgacaucua

SEQ ID NO: 1544797 - RNA, 19 nt, Homo sapiens
gagcacagaacggauauaa

SEQ ID NO: 1544798 - RNA, 19 nt, Homo sapiens
ugaugaaacugaugcuuga

SEQ ID NO: 1544799 - RNA, 19 nt, Homo sapiens
gaaggcagcccgaauaaac

SEQ ID NO: 1544800 - RNA, 19 nt, Homo sapiens
gaaacacuggcauggauuu

SEQ ID NO: 1544801 - RNA, 19 nt, Homo sapiens
ugaggcaucuggagacuga

SEQ ID NO: 1544802 - RNA, 19 nt, Homo sapiens
gaauaaaccccugauguua

SEQ ID NO: 1544803 - RNA, 19 nt, Homo sapiens
cagcgagacuaaagacaaa

SEQ ID NO: 1544804 - RNA, 19 nt, Homo sapiens
gcacuacuaagaaugcuaa

SEQ ID NO: 1544805 - RNA, 19 nt, Homo sapiens
gcuagaaugugccuuaguc

SEQ ID NO: 1544806 - RNA, 19 nt, Homo sapiens
gcauggauuugcacuagga

SEQ ID NO: 1544807 - RNA, 19 nt, Homo sapiens
ggcagaugcuggacauuug

SEQ ID NO: 1544808 - RNA, 19 nt, Homo sapiens
agagagagccacuuacaaa

SEQ ID NO: 1544809 - RNA, 19 nt, Homo sapiens
ggaauuauuuagucuuugc

SEQ ID NO: 1544810 - RNA, 19 nt, Homo sapiens
ggaaugacaacacggagaa

SEQ ID NO: 1544811 - RNA, 19 nt, Homo sapiens
ccaagucuguccugucuuc

SEQ ID NO: 1544812 - RNA, 19 nt, Homo sapiens
gaaaccaccuucaaaagug

SEQ ID NO: 1544813 - RNA, 19 nt, Homo sapiens
gcaaauacaccugccaugu

SEQ ID NO: 1544814 - RNA, 19 nt, Homo sapiens
ggaagauucaggagaaaga

SEQ ID NO: 1544815 - RNA, 19 nt, Homo sapiens
ggcucaaacuguagucuuu

SEQ ID NO: 1544816 - RNA, 19 nt, Homo sapiens
gaaguggacaacacaguga

SEQ ID NO: 1544817 - RNA, 19 nt, Homo sapiens
gaugacaacaauacccaua

SEQ ID NO: 1544818 - RNA, 19 nt, Homo sapiens
ggagagaacaggacuaugc

SEQ ID NO: 1544819 - RNA, 19 nt, Homo sapiens
cugcuuggcucaaacugua

SEQ ID NO: 1544820 - RNA, 19 nt, Homo sapiens
ggaagccagguauuaauug

SEQ ID NO: 1544821 - RNA, 19 nt, Homo sapiens
acagaaggcagcccgaaua

SEQ ID NO: 1544822 - RNA, 19 nt, Homo sapiens
gggaagccagguauuaauu

SEQ ID NO: 1544823 - RNA, 19 nt, Homo sapiens
caaauacaccugccaugug

SEQ ID NO: 1544824 - RNA, 19 nt, Homo sapiens
gggcagaugcuggacauuu

SEQ ID NO: 1544825 - RNA, 19 nt, Homo sapiens
ccuauaacuugcuuuacuu

SEQ ID NO: 1544826 - RNA, 19 nt, Homo sapiens
gaaucauccugucccaugu

SEQ ID NO: 1544827 - RNA, 19 nt, Homo sapiens
gcacguagaguagggagaa

SEQ ID NO: 1544828 - RNA, 19 nt, Homo sapiens
ucuuauagcuaccuucaug

SEQ ID NO: 1544829 - RNA, 19 nt, Homo sapiens
gaggguuccuggccaccua

SEQ ID NO: 1544830 - RNA, 19 nt, Homo sapiens
gggaaaauccuauaacuug

SEQ ID NO: 1544831 - RNA, 19 nt, Homo sapiens
gaagccagguauuaauugc

SEQ ID NO: 1544832 - RNA, 19 nt, Homo sapiens
cagggacucucuuccuuug

SEQ ID NO: 1544833 - RNA, 19 nt, Homo sapiens
uguggaagauucaggagaa

SEQ ID NO: 1544834 - RNA, 19 nt, Homo sapiens
ggaagaaguggacaacaca

SEQ ID NO: 1544835 - RNA, 19 nt, Homo sapiens
cauucaagauucucauaga

SEQ ID NO: 1544836 - RNA, 19 nt, Homo sapiens
caacaauacccauagucaa

SEQ ID NO: 1544837 - RNA, 19 nt, Homo sapiens
agaggugacugagauugua

SEQ ID NO: 1544838 - RNA, 19 nt, Homo sapiens
gggacucucuuccuuugga

SEQ ID NO: 1544839 - RNA, 19 nt, Homo sapiens
gaggagaaaccaccuucaa

SEQ ID NO: 1544840 - RNA, 19 nt, Homo sapiens
ugaagaaugagaagucuga

SEQ ID NO: 1544841 - RNA, 19 nt, Homo sapiens
gaugggcucugcauguaag

SEQ ID NO: 1544842 - RNA, 19 nt, Homo sapiens
uggaugggcucugcaugua

SEQ ID NO: 1544843 - RNA, 19 nt, Homo sapiens
ggaggugucugugggaaag

SEQ ID NO: 1544844 - RNA, 19 nt, Homo sapiens
cagaaggcagcccgaauaa

SEQ ID NO: 1544845 - RNA, 19 nt, Homo sapiens
ucagagcucucccugucaa

SEQ ID NO: 1544846 - RNA, 19 nt, Homo sapiens
ggagaaaccaccuucaaaa

SEQ ID NO: 1544847 - RNA, 19 nt, Homo sapiens
ggacugugaagaaugagaa

SEQ ID NO: 1544848 - RNA, 19 nt, Homo sapiens
gcaccacgccaccaucuuc

SEQ ID NO: 1544849 - RNA, 19 nt, Homo sapiens
ugacaacaauacccauagu

SEQ ID NO: 1544850 - RNA, 19 nt, Homo sapiens
gcagaugcuggacauuuga

SEQ ID NO: 1544851 - RNA, 19 nt, Homo sapiens
caaauggguguaauaauac

SEQ ID NO: 1544852 - RNA, 19 nt, Homo sapiens
auagcuaccuucaugcaaa

SEQ ID NO: 1544853 - RNA, 19 nt, Homo sapiens
gcaggaccaucgccacucu

SEQ ID NO: 1544854 - RNA, 19 nt, Homo sapiens
cuaaggagaagaugaacaa

SEQ ID NO: 1544855 - RNA, 19 nt, Homo sapiens
cuacuaaggagaagaugaa

SEQ ID NO: 1544856 - RNA, 19 nt, Homo sapiens
ccuugacucugaugcuuaa

SEQ ID NO: 1544857 - RNA, 19 nt, Homo sapiens
gaucaugcagcuucucuca

SEQ ID NO: 1544858 - RNA, 19 nt, Homo sapiens
ugacauaacagcagagucu

SEQ ID NO: 1544859 - RNA, 19 nt, Homo sapiens
gaugaacaacauuuccauu

SEQ ID NO: 1544860 - RNA, 19 nt, Homo sapiens
ccaaggugacguugaaaga

SEQ ID NO: 1544861 - RNA, 19 nt, Homo sapiens
gcagugacgcauucaagau

SEQ ID NO: 1544862 - RNA, 19 nt, Homo sapiens
agacugagaaagaaucaaa

SEQ ID NO: 1544863 - RNA, 19 nt, Homo sapiens
guccauggcuuuuguuuga

SEQ ID NO: 1544864 - RNA, 19 nt, Homo sapiens
ggucuacugcugauuucua

SEQ ID NO: 1544865 - RNA, 19 nt, Homo sapiens
gaucaagaaacucaucauc

SEQ ID NO: 1544866 - RNA, 19 nt, Homo sapiens
cagaacggauauaaucagu

SEQ ID NO: 1544867 - RNA, 19 nt, Homo sapiens
uggcuuggaugacaacaau

SEQ ID NO: 1544868 - RNA, 19 nt, Homo sapiens
caccugauaugcagugcuu

SEQ ID NO: 1544869 - RNA, 19 nt, Homo sapiens
gauuugcacuaggauguau

SEQ ID NO: 1544870 - RNA, 19 nt, Homo sapiens
ggagaaacacuggcaugga

SEQ ID NO: 1544871 - RNA, 19 nt, Homo sapiens
gaagauucaggagaaagaa

SEQ ID NO: 1544872 - RNA, 19 nt, Homo sapiens
aggagaagaugaacaacau

SEQ ID NO: 1544873 - RNA, 19 nt, Homo sapiens
cuaccaaauggguguaaua

SEQ ID NO: 1544874 - RNA, 19 nt, Homo sapiens
ggaggccucuggagaagac

SEQ ID NO: 1544875 - RNA, 19 nt, Homo sapiens
gcuggaggccucuggagaa

SEQ ID NO: 1544876 - RNA, 19 nt, Homo sapiens
ggaaggagcuguuugacaa

SEQ ID NO: 1544877 - RNA, 19 nt, Homo sapiens
caacaaacaccacuucuua

SEQ ID NO: 1544878 - RNA, 19 nt, Homo sapiens
ggaguaagaagaggauuaa

SEQ ID NO: 1544879 - RNA, 19 nt, Homo sapiens
aaacaccacuucuuacaca

SEQ ID NO: 1544880 - RNA, 19 nt, Homo sapiens
acucugggcuggguuauug

SEQ ID NO: 1544881 - RNA, 19 nt, Homo sapiens
uggcuugccuuggcucuuu

SEQ ID NO: 1544882 - RNA, 19 nt, Homo sapiens
ccaacaaacaccacuucuu

SEQ ID NO: 1544883 - RNA, 19 nt, Homo sapiens
uggaguaagaagaggauua

SEQ ID NO: 1544884 - RNA, 19 nt, Homo sapiens
acaaacaccacuucuuaca

SEQ ID NO: 1544885 - RNA, 19 nt, Homo sapiens
gggaaggagcuguuugaca

SEQ ID NO: 1544886 - RNA, 19 nt, Homo sapiens
uugcuuaauuacuggguuu

SEQ ID NO: 1544887 - RNA, 19 nt, Homo sapiens
gcuggguuauugcuagcuu

SEQ ID NO: 1544888 - RNA, 19 nt, Homo sapiens
gaaggagcuguuugacaag

SEQ ID NO: 1544889 - RNA, 19 nt, Homo sapiens
ugacaaggccaacaaacac

SEQ ID NO: 1544890 - RNA, 19 nt, Homo sapiens
uaaagaguuggaguaagaa

SEQ ID NO: 1544891 - RNA, 19 nt, Homo sapiens
ugagcucccuuuugcuuaa

SEQ ID NO: 1544892 - RNA, 19 nt, Homo sapiens
ggccaacaaacaccacuuc

SEQ ID NO: 1544893 - RNA, 19 nt, Homo sapiens
ggagaaagauuaaggauca

SEQ ID NO: 1544894 - RNA, 19 nt, Homo sapiens
uaacagcgccucuuugaua

SEQ ID NO: 1544895 - RNA, 19 nt, Homo sapiens
gaagggacucuguguauua

SEQ ID NO: 1544896 - RNA, 19 nt, Homo sapiens
guuaaagacugaacgguua

SEQ ID NO: 1544897 - RNA, 19 nt, Homo sapiens
gagaagaacagaccgauuu

SEQ ID NO: 1544898 - RNA, 19 nt, Homo sapiens
gaacaugauuucaaacaag

SEQ ID NO: 1544899 - RNA, 19 nt, Homo sapiens
gacgagaugucacaguaua

SEQ ID NO: 1544900 - RNA, 19 nt, Homo sapiens
ggacaaggccucugugaau

SEQ ID NO: 1544901 - RNA, 19 nt, Homo sapiens
gauggcaccuugaaaguga

SEQ ID NO: 1544902 - RNA, 19 nt, Homo sapiens
ggaaacccaggaauauuua

SEQ ID NO: 1544903 - RNA, 19 nt, Homo sapiens
uaaaggaaacccaggaaua

SEQ ID NO: 1544904 - RNA, 19 nt, Homo sapiens
gaaaggagcagcaaacaag

SEQ ID NO: 1544905 - RNA, 19 nt, Homo sapiens
cauugugucuggauaaaua

SEQ ID NO: 1544906 - RNA, 19 nt, Homo sapiens
uaacuggucuagcaacauu

SEQ ID NO: 1544907 - RNA, 19 nt, Homo sapiens
aagcagagcuagucuauuc

SEQ ID NO: 1544908 - RNA, 19 nt, Homo sapiens
cagcuacacuuaauuaugu

SEQ ID NO: 1544909 - RNA, 19 nt, Homo sapiens
gcuacaaacuuucucuuau

SEQ ID NO: 1544910 - RNA, 19 nt, Homo sapiens
agacauguauuuccuuuga

SEQ ID NO: 1544911 - RNA, 19 nt, Homo sapiens
ggaagggacucuguguauu

SEQ ID NO: 1544912 - RNA, 19 nt, Homo sapiens
gcauggcgcugccggauau

SEQ ID NO: 1544913 - RNA, 19 nt, Homo sapiens
gaaagaaucauggauacaa

SEQ ID NO: 1544914 - RNA, 19 nt, Homo sapiens
ugaccuaacuuaauuguag

SEQ ID NO: 1544915 - RNA, 19 nt, Homo sapiens
ggaaagccauccuaaacuc

SEQ ID NO: 1544916 - RNA, 19 nt, Homo sapiens
guaaaucuuugcuaaguag

SEQ ID NO: 1544917 - RNA, 19 nt, Homo sapiens
ugaccaaguuguuuaaaug

SEQ ID NO: 1544918 - RNA, 19 nt, Homo sapiens
gaacagaccgauuugaaag

SEQ ID NO: 1544919 - RNA, 19 nt, Homo sapiens
acuaucaucuggccacuua

SEQ ID NO: 1544920 - RNA, 19 nt, Homo sapiens
ccacguggcuacuuguuug

SEQ ID NO: 1544921 - RNA, 19 nt, Homo sapiens
guaugaagccugugaagaa

SEQ ID NO: 1544922 - RNA, 19 nt, Homo sapiens
cuacaaacuuucucuuaug

SEQ ID NO: 1544923 - RNA, 19 nt, Homo sapiens
ggaucaggauugcaugaaa

SEQ ID NO: 1544924 - RNA, 19 nt, Homo sapiens
gcacgaagauacuuguuuu

SEQ ID NO: 1544925 - RNA, 19 nt, Homo sapiens
gcacagagccaagaagaau

SEQ ID NO: 1544926 - RNA, 19 nt, Homo sapiens
ccucgaacaugauuucaaa

SEQ ID NO: 1544927 - RNA, 19 nt, Homo sapiens
gccagagacuugugaaaga

SEQ ID NO: 1544928 - RNA, 19 nt, Homo sapiens
ccaguaagguucuacauac

SEQ ID NO: 1544929 - RNA, 19 nt, Homo sapiens
ugacaucuuugguuuauag

SEQ ID NO: 1544930 - RNA, 19 nt, Homo sapiens
gcagaaucagcuacacuua

SEQ ID NO: 1544931 - RNA, 19 nt, Homo sapiens
ugaguacgauucaguaugu

SEQ ID NO: 1544932 - RNA, 19 nt, Homo sapiens
uaauguaacuggucuagca

SEQ ID NO: 1544933 - RNA, 19 nt, Homo sapiens
gaauauuuaccugguguua

SEQ ID NO: 1544934 - RNA, 19 nt, Homo sapiens
agaaucagcuacacuuaau

SEQ ID NO: 1544935 - RNA, 19 nt, Homo sapiens
ucacagcucuuuucuauug

SEQ ID NO: 1544936 - RNA, 19 nt, Homo sapiens
ccacugaccaucugcuuaa

SEQ ID NO: 1544937 - RNA, 19 nt, Homo sapiens
caaacuuucucuuaugcaa

SEQ ID NO: 1544938 - RNA, 19 nt, Homo sapiens
gaaaggacaaggccucugu

SEQ ID NO: 1544939 - RNA, 19 nt, Homo sapiens
ccaaguuguuuaaauggaa

SEQ ID NO: 1544940 - RNA, 19 nt, Homo sapiens
ggugacagaucucuaagca

SEQ ID NO: 1544941 - RNA, 19 nt, Homo sapiens
gaucaggauugcaugaaag

SEQ ID NO: 1544942 - RNA, 19 nt, Homo sapiens
ccacuuagauuauuaucac

SEQ ID NO: 1544943 - RNA, 19 nt, Homo sapiens
gacaaggccucugugaaug

SEQ ID NO: 1544944 - RNA, 19 nt, Homo sapiens
ccagagacuugugaaagaa

SEQ ID NO: 1544945 - RNA, 19 nt, Homo sapiens
agcaagcaauggauaauaa

SEQ ID NO: 1544946 - RNA, 19 nt, Homo sapiens
gcgccucuuugauagguua

SEQ ID NO: 1544947 - RNA, 19 nt, Homo sapiens
cgaacaugauuucaaacaa

SEQ ID NO: 1544948 - RNA, 19 nt, Homo sapiens
gauggacaguugacagaau

SEQ ID NO: 1544949 - RNA, 19 nt, Homo sapiens
gggacucuguguauuauuc

SEQ ID NO: 1544950 - RNA, 19 nt, Homo sapiens
ggacacaggguuacuugga

SEQ ID NO: 1544951 - RNA, 19 nt, Homo sapiens
uaccugguguuacauuuaa

SEQ ID NO: 1544952 - RNA, 19 nt, Homo sapiens
gcagcagguuaaagacuga

SEQ ID NO: 1544953 - RNA, 19 nt, Homo sapiens
ggacauuagcuuuugauua

SEQ ID NO: 1544954 - RNA, 19 nt, Homo sapiens
gcaauaguccuugguacuu

SEQ ID NO: 1544955 - RNA, 19 nt, Homo sapiens
cugcuaaaguaaagccuua

SEQ ID NO: 1544956 - RNA, 19 nt, Homo sapiens
gcagagcuagucuauucua

SEQ ID NO: 1544957 - RNA, 19 nt, Homo sapiens
uguuagggauuucgaguuu

SEQ ID NO: 1544958 - RNA, 19 nt, Homo sapiens
cuaauggucugggugauug

SEQ ID NO: 1544959 - RNA, 19 nt, Homo sapiens
uauagagccugcagucuca

SEQ ID NO: 1544960 - RNA, 19 nt, Homo sapiens
uaaaguaaagccuuaagug

SEQ ID NO: 1544961 - RNA, 19 nt, Homo sapiens
ccucuucucucaucucaug

SEQ ID NO: 1544962 - RNA, 19 nt, Homo sapiens
uaugaagccugugaagaaa

SEQ ID NO: 1544963 - RNA, 19 nt, Homo sapiens
cagaaucagcuacacuuaa

SEQ ID NO: 1544964 - RNA, 19 nt, Homo sapiens
ggaugucugcugugacuaa

SEQ ID NO: 1544965 - RNA, 19 nt, Homo sapiens
acacagaagggcaguauga

SEQ ID NO: 1544966 - RNA, 19 nt, Homo sapiens
gugcaaaucaugacacaga

SEQ ID NO: 1544967 - RNA, 19 nt, Homo sapiens
gaaaacacagugccaguaa

SEQ ID NO: 1544968 - RNA, 19 nt, Homo sapiens
aguaaagccuuaagugugu

SEQ ID NO: 1544969 - RNA, 19 nt, Homo sapiens
gaagaacagaccgauuuga

SEQ ID NO: 1544970 - RNA, 19 nt, Homo sapiens
cauacuggauguggaguuu

SEQ ID NO: 1544971 - RNA, 19 nt, Homo sapiens
cuuagucucuguuaaugaa

SEQ ID NO: 1544972 - RNA, 19 nt, Homo sapiens
gcuuaaaccugucaaaaga

SEQ ID NO: 1544973 - RNA, 19 nt, Homo sapiens
aaaggaaacccaggaauau

SEQ ID NO: 1544974 - RNA, 19 nt, Homo sapiens
ugucugcugugacuaauau

SEQ ID NO: 1544975 - RNA, 19 nt, Homo sapiens
gccaguaagguucuacaua

SEQ ID NO: 1544976 - RNA, 19 nt, Homo sapiens
gggacaacgugcugcuuau

SEQ ID NO: 1544977 - RNA, 19 nt, Homo sapiens
ucugugacaucuuugguuu

SEQ ID NO: 1544978 - RNA, 19 nt, Homo sapiens
ucaacaaucgcacaacaaa

SEQ ID NO: 1544979 - RNA, 19 nt, Homo sapiens
gugaaagaaucauggauac

SEQ ID NO: 1544980 - RNA, 19 nt, Homo sapiens
gaucgauggauuacaugua

SEQ ID NO: 1544981 - RNA, 19 nt, Homo sapiens
gaugaagggugugaucgau

SEQ ID NO: 1544982 - RNA, 19 nt, Homo sapiens
ggaucacacugaccuugga

SEQ ID NO: 1544983 - RNA, 19 nt, Homo sapiens
guucuuaccugcggguuau

SEQ ID NO: 1544984 - RNA, 19 nt, Homo sapiens
gugauuggaugguuugagu

SEQ ID NO: 1544985 - RNA, 19 nt, Homo sapiens
gcaagccccucgaacauga

SEQ ID NO: 1544986 - RNA, 19 nt, Homo sapiens
gcuaauccaugagcagugu

SEQ ID NO: 1544987 - RNA, 19 nt, Homo sapiens
ccaggcgucuguaccgaaa

SEQ ID NO: 1544988 - RNA, 19 nt, Homo sapiens
agaaucaaaucaucaagca

SEQ ID NO: 1544989 - RNA, 19 nt, Homo sapiens
uagcugcguuggagaauca

SEQ ID NO: 1544990 - RNA, 19 nt, Homo sapiens
gugaccaaguuguuuaaau

SEQ ID NO: 1544991 - RNA, 19 nt, Homo sapiens
guauucauauccucuuauc

SEQ ID NO: 1544992 - RNA, 19 nt, Homo sapiens
gcuacuuguuugugugauu

SEQ ID NO: 1544993 - RNA, 19 nt, Homo sapiens
caaccuagcuccaaguuua

SEQ ID NO: 1544994 - RNA, 19 nt, Homo sapiens
gaacaaggaucuagugaga

SEQ ID NO: 1544995 - RNA, 19 nt, Homo sapiens
ggaaauccaugcauaguuu

SEQ ID NO: 1544996 - RNA, 19 nt, Homo sapiens
guaaagcacuccucaguaa

SEQ ID NO: 1544997 - RNA, 19 nt, Homo sapiens
gaauuaggaugguggaaua

SEQ ID NO: 1544998 - RNA, 19 nt, Homo sapiens
ucagaacacucuccuaaua

SEQ ID NO: 1544999 - RNA, 19 nt, Homo sapiens
gaacuuagcaacacuauau

SEQ ID NO: 1545000 - RNA, 19 nt, Homo sapiens
gaaagguuaucagaaguua

SEQ ID NO: 1545001 - RNA, 19 nt, Homo sapiens
gcaacacuauauugaguua

SEQ ID NO: 1545002 - RNA, 19 nt, Homo sapiens
ccacauaguuggaaguaaa

SEQ ID NO: 1545003 - RNA, 19 nt, Homo sapiens
guaagcugcugaacaagua

SEQ ID NO: 1545004 - RNA, 19 nt, Homo sapiens
gaugguaccuuauggcaaa

SEQ ID NO: 1545005 - RNA, 19 nt, Homo sapiens
gaaaugaaggcagaaauaa

SEQ ID NO: 1545006 - RNA, 19 nt, Homo sapiens
gaaacaagcuauacauucg

SEQ ID NO: 1545007 - RNA, 19 nt, Homo sapiens
gaacucagcucugcaccaa

SEQ ID NO: 1545008 - RNA, 19 nt, Homo sapiens
ggacuuccauggcuucuga

SEQ ID NO: 1545009 - RNA, 19 nt, Homo sapiens
gaacaaagacacaacauac

SEQ ID NO: 1545010 - RNA, 19 nt, Homo sapiens
caaccucccugaaccuuaa

SEQ ID NO: 1545011 - RNA, 19 nt, Homo sapiens
gaucucaucucucaucugu

SEQ ID NO: 1545012 - RNA, 19 nt, Homo sapiens
gauauucucugaaagcaau

SEQ ID NO: 1545013 - RNA, 19 nt, Homo sapiens
ccacccaucucaucacuuu

SEQ ID NO: 1545014 - RNA, 19 nt, Homo sapiens
aaaggaaacucaagucuca

SEQ ID NO: 1545015 - RNA, 19 nt, Homo sapiens
gaaggcagaaauaaagaua

SEQ ID NO: 1545016 - RNA, 19 nt, Homo sapiens
ggaaucaaguuaaguaggu

SEQ ID NO: 1545017 - RNA, 19 nt, Homo sapiens
auaaauaccugcagggauu

SEQ ID NO: 1545018 - RNA, 19 nt, Homo sapiens
gagcaggacugaaggagau

SEQ ID NO: 1545019 - RNA, 19 nt, Homo sapiens
acugauagcucucgucgua

SEQ ID NO: 1545020 - RNA, 19 nt, Homo sapiens
gcauugauguggugaacaa

SEQ ID NO: 1545021 - RNA, 19 nt, Homo sapiens
cgaaaugaaggcagaaaua

SEQ ID NO: 1545022 - RNA, 19 nt, Homo sapiens
ucagaaagguuaucagaag

SEQ ID NO: 1545023 - RNA, 19 nt, Homo sapiens
ggagaagagugaggagaaa

SEQ ID NO: 1545024 - RNA, 19 nt, Homo sapiens
ccaacgagacagaaaguua

SEQ ID NO: 1545025 - RNA, 19 nt, Homo sapiens
agacuuagacucccacaua

SEQ ID NO: 1545026 - RNA, 19 nt, Homo sapiens
cgugaucccuccuguuuaa

SEQ ID NO: 1545027 - RNA, 19 nt, Homo sapiens
ggaauuugguagagacgaa

SEQ ID NO: 1545028 - RNA, 19 nt, Homo sapiens
gcgaccaguuguguuauua

SEQ ID NO: 1545029 - RNA, 19 nt, Homo sapiens
gaagaccaccuguguugaa

SEQ ID NO: 1545030 - RNA, 19 nt, Homo sapiens
guaggaagccauacacuga

SEQ ID NO: 1545031 - RNA, 19 nt, Homo sapiens
cgagugauaccuacuuaua

SEQ ID NO: 1545032 - RNA, 19 nt, Homo sapiens
gaaggaggauguaauucca

SEQ ID NO: 1545033 - RNA, 19 nt, Homo sapiens
caaauuccaccacuuacua

SEQ ID NO: 1545034 - RNA, 19 nt, Homo sapiens
aaacgucaaugauuucuuc

SEQ ID NO: 1545035 - RNA, 19 nt, Homo sapiens
gcagauguuuggccuuuca

SEQ ID NO: 1545036 - RNA, 19 nt, Homo sapiens
ggucacagguuacacagau

SEQ ID NO: 1545037 - RNA, 19 nt, Homo sapiens
acacuuauuuccacauuga

SEQ ID NO: 1545038 - RNA, 19 nt, Homo sapiens
caacgagacagaaaguuaa

SEQ ID NO: 1545039 - RNA, 19 nt, Homo sapiens
uaccaaagcuuuaucuaag

SEQ ID NO: 1545040 - RNA, 19 nt, Homo sapiens
uuacacagaugccaagaga

SEQ ID NO: 1545041 - RNA, 19 nt, Homo sapiens
uagcagaaggcaagaaaua

SEQ ID NO: 1545042 - RNA, 19 nt, Homo sapiens
ugaaagcaaugagaacaaa

SEQ ID NO: 1545043 - RNA, 19 nt, Homo sapiens
ggaggugggugaagcacuu

SEQ ID NO: 1545044 - RNA, 19 nt, Homo sapiens
ggucagggauggcaugcaa

SEQ ID NO: 1545045 - RNA, 19 nt, Homo sapiens
uaaagucauuccaguccua

SEQ ID NO: 1545046 - RNA, 19 nt, Homo sapiens
aaacucaagucucaccauu

SEQ ID NO: 1545047 - RNA, 19 nt, Homo sapiens
caaacuagaccucaggauu

SEQ ID NO: 1545048 - RNA, 19 nt, Homo sapiens
ucaaagcaguaauaucuuc

SEQ ID NO: 1545049 - RNA, 19 nt, Homo sapiens
ggcaagaaauaacuaagau

SEQ ID NO: 1545050 - RNA, 19 nt, Homo sapiens
gaaggcaagaaauaacuaa

SEQ ID NO: 1545051 - RNA, 19 nt, Homo sapiens
cgaagagugucucaaguuc

SEQ ID NO: 1545052 - RNA, 19 nt, Homo sapiens
ggagucugguggaagauga

SEQ ID NO: 1545053 - RNA, 19 nt, Homo sapiens
guaauuccaucauauacuc

SEQ ID NO: 1545054 - RNA, 19 nt, Homo sapiens
acaagcugcuccugaauga

SEQ ID NO: 1545055 - RNA, 19 nt, Homo sapiens
gcacuucggcucuggaguu

SEQ ID NO: 1545056 - RNA, 19 nt, Homo sapiens
acagugaguuggucaaaug

SEQ ID NO: 1545057 - RNA, 19 nt, Homo sapiens
ggacugaagcaccaaccua

SEQ ID NO: 1545058 - RNA, 19 nt, Homo sapiens
gaagacugcacaacuccua

SEQ ID NO: 1545059 - RNA, 19 nt, Homo sapiens
caaaugcuccugacagugu

SEQ ID NO: 1545060 - RNA, 19 nt, Homo sapiens
ugaaggagauagagacaca

SEQ ID NO: 1545061 - RNA, 19 nt, Homo sapiens
aaacuagaccucaggauug

SEQ ID NO: 1545062 - RNA, 19 nt, Homo sapiens
guggagaccuucaagaaag

SEQ ID NO: 1545063 - RNA, 19 nt, Homo sapiens
cagaacacucuccuaauaa

SEQ ID NO: 1545064 - RNA, 19 nt, Homo sapiens
cauggaggauugccuguga

SEQ ID NO: 1545065 - RNA, 19 nt, Homo sapiens
gagugauaccuacuuauaa

SEQ ID NO: 1545066 - RNA, 19 nt, Homo sapiens
caccacaucacacuuauuu

SEQ ID NO: 1545067 - RNA, 19 nt, Homo sapiens
gcuggagucugguggaaga

SEQ ID NO: 1545068 - RNA, 19 nt, Homo sapiens
gaagaucgcaagucagagu

SEQ ID NO: 1545069 - RNA, 19 nt, Homo sapiens
uuaccgaguuugaguuuga

SEQ ID NO: 1545070 - RNA, 19 nt, Homo sapiens
ccacauugaccacauaguu

SEQ ID NO: 1545071 - RNA, 19 nt, Homo sapiens
cagcaccacaucacacuua

SEQ ID NO: 1545072 - RNA, 19 nt, Homo sapiens
gaaugaaagcagcccguaa

SEQ ID NO: 1545073 - RNA, 19 nt, Homo sapiens
caaguagggcugccagaaa

SEQ ID NO: 1545074 - RNA, 19 nt, Homo sapiens
gaugagaccccacacuuua

SEQ ID NO: 1545075 - RNA, 19 nt, Homo sapiens
gaucugagcaggacugaag

SEQ ID NO: 1545076 - RNA, 19 nt, Homo sapiens
ccacauugcaaucaaacua

SEQ ID NO: 1545077 - RNA, 19 nt, Homo sapiens
ucacacuuauuuccacauu

SEQ ID NO: 1545078 - RNA, 19 nt, Homo sapiens
aaacacugaugccaugaug

SEQ ID NO: 1545079 - RNA, 19 nt, Homo sapiens
cuaccaaagcuuuaucuaa

SEQ ID NO: 1545080 - RNA, 19 nt, Homo sapiens
gcgaauuuguggaggcauu

SEQ ID NO: 1545081 - RNA, 19 nt, Homo sapiens
ccaauuaaguuguauuucc

SEQ ID NO: 1545082 - RNA, 19 nt, Homo sapiens
gaaagcaggaaagaucaaa

SEQ ID NO: 1545083 - RNA, 19 nt, Homo sapiens
ggacuacaacaccagguuu

SEQ ID NO: 1545084 - RNA, 19 nt, Homo sapiens
cauaguuucuucaccaugu

SEQ ID NO: 1545085 - RNA, 19 nt, Homo sapiens
ucaaggaggagaagaguga

SEQ ID NO: 1545086 - RNA, 19 nt, Homo sapiens
gaggauugccugugaggaa

SEQ ID NO: 1545087 - RNA, 19 nt, Homo sapiens
guaacagcuucucaaccua

SEQ ID NO: 1545088 - RNA, 19 nt, Homo sapiens
caucauauacucucucugu

SEQ ID NO: 1545089 - RNA, 19 nt, Homo sapiens
guaguguccuuacaagcuu

SEQ ID NO: 1545090 - RNA, 19 nt, Homo sapiens
ugaaacaagcuauacauuc

SEQ ID NO: 1545091 - RNA, 19 nt, Homo sapiens
aagcagauguuuggccuuu

SEQ ID NO: 1545092 - RNA, 19 nt, Homo sapiens
cccguaagcugcugaacaa

SEQ ID NO: 1545093 - RNA, 19 nt, Homo sapiens
ccagugaccugcacauaua

SEQ ID NO: 1545094 - RNA, 19 nt, Homo sapiens
gcaccauugugauauguua

SEQ ID NO: 1545095 - RNA, 19 nt, Homo sapiens
caagucagcuuucaccauu

SEQ ID NO: 1545096 - RNA, 19 nt, Homo sapiens
gcacucaggugaaauaaac

SEQ ID NO: 1545097 - RNA, 19 nt, Homo sapiens
ccaccaacgugcugcuuua

SEQ ID NO: 1545098 - RNA, 19 nt, Homo sapiens
ggagugcaguggcaugauu

SEQ ID NO: 1545099 - RNA, 19 nt, Homo sapiens
caccaugccuggcucauuu

SEQ ID NO: 1545100 - RNA, 19 nt, Homo sapiens
ggaaugcaguugugagauc

SEQ ID NO: 1545101 - RNA, 19 nt, Homo sapiens
acauagaacucaaucgaaa

SEQ ID NO: 1545102 - RNA, 19 nt, Homo sapiens
agaauugccugcagacaaa

SEQ ID NO: 1545103 - RNA, 19 nt, Homo sapiens
ccagauuucuuucuccaaa

SEQ ID NO: 1545104 - RNA, 19 nt, Homo sapiens
gaauguacuuugugagauc

SEQ ID NO: 1545105 - RNA, 19 nt, Homo sapiens
gaaaauagccuuaacugau

SEQ ID NO: 1545106 - RNA, 19 nt, Homo sapiens
cacgaugccuagcuaauuu

SEQ ID NO: 1545107 - RNA, 19 nt, Homo sapiens
ccaauuaugcacuucauuu

SEQ ID NO: 1545108 - RNA, 19 nt, Homo sapiens
gagaauguacuuugugaga

SEQ ID NO: 1545109 - RNA, 19 nt, Homo sapiens
gaagaaaugagaagucaag

SEQ ID NO: 1545110 - RNA, 19 nt, Homo sapiens
ggccugaaguuacugaaga

SEQ ID NO: 1545111 - RNA, 19 nt, Homo sapiens
cacccuaacugaucaaugu

SEQ ID NO: 1545112 - RNA, 19 nt, Homo sapiens
gauaauccaccacccuuug

SEQ ID NO: 1545113 - RNA, 19 nt, Homo sapiens
ccaaaccuguaagaacuaa

SEQ ID NO: 1545114 - RNA, 19 nt, Homo sapiens
guuaucuccugaacacuuu

SEQ ID NO: 1545115 - RNA, 19 nt, Homo sapiens
gucaaggacucucuuaaag

SEQ ID NO: 1545116 - RNA, 19 nt, Homo sapiens
guaauccucccacccuuaa

SEQ ID NO: 1545117 - RNA, 19 nt, Homo sapiens
ccaaagugcugggauuaca

SEQ ID NO: 1545118 - RNA, 19 nt, Homo sapiens
gcacauucaagucagcuuu

SEQ ID NO: 1545119 - RNA, 19 nt, Homo sapiens
ugacauugcaccauuguga

SEQ ID NO: 1545120 - RNA, 19 nt, Homo sapiens
agccuuaacugaugacauu

SEQ ID NO: 1545121 - RNA, 19 nt, Homo sapiens
ccuguaagaacuaaugaua

SEQ ID NO: 1545122 - RNA, 19 nt, Homo sapiens
gaagauccacagaagugaa

SEQ ID NO: 1545123 - RNA, 19 nt, Homo sapiens
gaacucaaucgaaaugaag

SEQ ID NO: 1545124 - RNA, 19 nt, Homo sapiens
gaaggguacccgaagaaau

SEQ ID NO: 1545125 - RNA, 19 nt, Homo sapiens
ccucuggguucaagcaauu

SEQ ID NO: 1545126 - RNA, 19 nt, Homo sapiens
ccgaagaaaugagaaguca

SEQ ID NO: 1545127 - RNA, 19 nt, Homo sapiens
gggccaccuucaucuguuu

SEQ ID NO: 1545128 - RNA, 19 nt, Homo sapiens
ccacgaugccuagcuaauu

SEQ ID NO: 1545129 - RNA, 19 nt, Homo sapiens
uggcuaggcuggucucugu

SEQ ID NO: 1545130 - RNA, 19 nt, Homo sapiens
cggaguagcugggauuaca

SEQ ID NO: 1545131 - RNA, 19 nt, Homo sapiens
agaacucaaucgaaaugaa

SEQ ID NO: 1545132 - RNA, 19 nt, Homo sapiens
gaauaauaguggcaaaaug

SEQ ID NO: 1545133 - RNA, 19 nt, Homo sapiens
aaaauagccuuaacugaug

SEQ ID NO: 1545134 - RNA, 19 nt, Homo sapiens
cugaugacauugcaccauu

SEQ ID NO: 1545135 - RNA, 19 nt, Homo sapiens
acagaaggguacccgaaga

SEQ ID NO: 1545136 - RNA, 19 nt, Homo sapiens
aaauagccuuaacugauga

SEQ ID NO: 1545137 - RNA, 19 nt, Homo sapiens
gaaugcaguugugagaucu

SEQ ID NO: 1545138 - RNA, 19 nt, Homo sapiens
uugagaauguacuuuguga

SEQ ID NO: 1545139 - RNA, 19 nt, Homo sapiens
cagauggccugaaguuacu

SEQ ID NO: 1545140 - RNA, 19 nt, Homo sapiens
ccagauggccugaaguuac

SEQ ID NO: 1545141 - RNA, 19 nt, Homo sapiens
cagaauugccugcagacaa

SEQ ID NO: 1545142 - RNA, 19 nt, Homo sapiens
gauguacuggcccuuugua

SEQ ID NO: 1545143 - RNA, 19 nt, Homo sapiens
cugaguagcugggauuaca

SEQ ID NO: 1545144 - RNA, 19 nt, Homo sapiens
caccaggcccagcugauuu

SEQ ID NO: 1545145 - RNA, 19 nt, Homo sapiens
uuacauagaacucaaucga

SEQ ID NO: 1545146 - RNA, 19 nt, Homo sapiens
aaggguacccgaagaaaug

SEQ ID NO: 1545147 - RNA, 19 nt, Homo sapiens
ugaugacauugcaccauug

SEQ ID NO: 1545148 - RNA, 19 nt, Homo sapiens
uuguacagcugaccaacuu

SEQ ID NO: 1545149 - RNA, 19 nt, Homo sapiens
guacagcugaccaacuuca

SEQ ID NO: 1545150 - RNA, 19 nt, Homo sapiens
ugaaguuacugaagaucca

SEQ ID NO: 1545151 - RNA, 19 nt, Homo sapiens
caagcuaagccaucauauc

SEQ ID NO: 1545152 - RNA, 19 nt, Homo sapiens
ccuguucuagucugaaaua

SEQ ID NO: 1545153 - RNA, 19 nt, Homo sapiens
cgaguggauugauguacug

SEQ ID NO: 1545154 - RNA, 19 nt, Homo sapiens
gguuaucuccugaacacuu

SEQ ID NO: 1545155 - RNA, 19 nt, Homo sapiens
acccuuugcugacuccuuu

SEQ ID NO: 1545156 - RNA, 19 nt, Homo sapiens
acugaucaauguacuuugu

SEQ ID NO: 1545157 - RNA, 19 nt, Homo sapiens
acauugcaccauugugaua

SEQ ID NO: 1545158 - RNA, 19 nt, Homo sapiens
cagaaggguacccgaagaa

SEQ ID NO: 1545159 - RNA, 19 nt, Homo sapiens
uguaauccucccacccuua

SEQ ID NO: 1545160 - RNA, 19 nt, Homo sapiens
gagugcaguggcaugauuu

SEQ ID NO: 1545161 - RNA, 19 nt, Homo sapiens
aaaccuguaagaacuaaug

SEQ ID NO: 1545162 - RNA, 19 nt, Homo sapiens
agaauguacuuugugagau

SEQ ID NO: 1545163 - RNA, 19 nt, Homo sapiens
cugaagauccacagaagug

SEQ ID NO: 1545164 - RNA, 19 nt, Homo sapiens
uuacugaagauccacagaa

SEQ ID NO: 1545165 - RNA, 19 nt, Homo sapiens
gaccuuccacgccaacuuc

SEQ ID NO: 1545166 - RNA, 19 nt, Homo sapiens
gaagugaaaauagccuuaa

SEQ ID NO: 1545167 - RNA, 19 nt, Homo sapiens
ugcgucagccucccaagua

SEQ ID NO: 1545168 - RNA, 19 nt, Homo sapiens
gggcagaugaaguuuuaua

SEQ ID NO: 1545169 - RNA, 19 nt, Homo sapiens
ggucucggccuucuauguc

SEQ ID NO: 1545170 - RNA, 19 nt, Homo sapiens
ucaauguacuuuguaaucc

SEQ ID NO: 1545171 - RNA, 19 nt, Homo sapiens
gaugacauugcaccauugu

SEQ ID NO: 1545172 - RNA, 19 nt, Homo sapiens
uaugucgaguggauugaug

SEQ ID NO: 1545173 - RNA, 19 nt, Homo sapiens
gccugaaguuacugaagau

SEQ ID NO: 1545174 - RNA, 19 nt, Homo sapiens
cugccacgaugccuagcua

SEQ ID NO: 1545175 - RNA, 19 nt, Homo sapiens
gcgucagccucccaaguag

SEQ ID NO: 1545176 - RNA, 19 nt, Homo sapiens
ucaaggacucucuuaaagg

SEQ ID NO: 1545177 - RNA, 19 nt, Homo sapiens
caauguacuuuguaauccu

SEQ ID NO: 1545178 - RNA, 19 nt, Homo sapiens
ccacagaagugaaaauagc

SEQ ID NO: 1545179 - RNA, 19 nt, Homo sapiens
uacugaagauccacagaag

SEQ ID NO: 1545180 - RNA, 19 nt, Homo sapiens
cauagaacucaaucgaaau

SEQ ID NO: 1545181 - RNA, 19 nt, Homo sapiens
ccuugagaauguacuuugu

SEQ ID NO: 1545182 - RNA, 19 nt, Homo sapiens
ggugacggcacauucaagu

SEQ ID NO: 1545183 - RNA, 19 nt, Homo sapiens
ucuuaaagggaccacauuu

SEQ ID NO: 1545184 - RNA, 19 nt, Homo sapiens
ccaccaugccuggcucauu

SEQ ID NO: 1545185 - RNA, 19 nt, Homo sapiens
ugccucauccuucggagua

SEQ ID NO: 1545186 - RNA, 19 nt, Homo sapiens
ccaggauggucuugaucuc

SEQ ID NO: 1545187 - RNA, 19 nt, Homo sapiens
ugauaauccaccacccuuu

SEQ ID NO: 1545188 - RNA, 19 nt, Homo sapiens
gaccaacuucagccuuguu

SEQ ID NO: 1545189 - RNA, 19 nt, Homo sapiens
cccagugaccugcacauau

SEQ ID NO: 1545190 - RNA, 19 nt, Homo sapiens
ucuccuggguucaaacgau

SEQ ID NO: 1545191 - RNA, 19 nt, Homo sapiens
uugaucuccugaccgcaua

SEQ ID NO: 1545192 - RNA, 19 nt, Homo sapiens
acaccaggcccagcugauu

SEQ ID NO: 1545193 - RNA, 19 nt, Homo sapiens
gccacucgcucccagauua

SEQ ID NO: 1545194 - RNA, 19 nt, Homo sapiens
gcccaagacugacugacua

SEQ ID NO: 1545195 - RNA, 19 nt, Homo sapiens
cagcccagccugagaaaua

SEQ ID NO: 1545196 - RNA, 19 nt, Homo sapiens
gaucaugaccaccuacuau

SEQ ID NO: 1545197 - RNA, 19 nt, Homo sapiens
gcagaaugaggaaagguuu

SEQ ID NO: 1545198 - RNA, 19 nt, Homo sapiens
gaggacgauuugcggaauu

SEQ ID NO: 1545199 - RNA, 19 nt, Homo sapiens
ggcagacccugaagacuca

SEQ ID NO: 1545200 - RNA, 19 nt, Homo sapiens
gggagggucaucauuguga

SEQ ID NO: 1545201 - RNA, 19 nt, Homo sapiens
guacuucugccucuggauu

SEQ ID NO: 1545202 - RNA, 19 nt, Homo sapiens
aaccguagauguugcuguu

SEQ ID NO: 1545203 - RNA, 19 nt, Homo sapiens
ccuaugggcugauccugau

SEQ ID NO: 1545204 - RNA, 19 nt, Homo sapiens
ugccaacagugcuuuauca

SEQ ID NO: 1545205 - RNA, 19 nt, Homo sapiens
gaagacguuugaggacgau

SEQ ID NO: 1545206 - RNA, 19 nt, Homo sapiens
cagccugccuccauguuca

SEQ ID NO: 1545207 - RNA, 19 nt, Homo sapiens
ggaauuccaaguccacuac

SEQ ID NO: 1545208 - RNA, 19 nt, Homo sapiens
ucgcugcccuggucaagug

SEQ ID NO: 1545209 - RNA, 19 nt, Homo sapiens
cuccuuggguuaacgugua

SEQ ID NO: 1545210 - RNA, 19 nt, Homo sapiens
ugaggacgauuugcggaau

SEQ ID NO: 1545211 - RNA, 19 nt, Homo sapiens
guguggaaccguagauguu

SEQ ID NO: 1545212 - RNA, 19 nt, Homo sapiens
ccugggcccuguuaucagu

SEQ ID NO: 1545213 - RNA, 19 nt, Homo sapiens
ggacgcuccuuggguuaac

SEQ ID NO: 1545214 - RNA, 19 nt, Homo sapiens
ccguagauguugcuguuac

SEQ ID NO: 1545215 - RNA, 19 nt, Homo sapiens
gguguggaaccguagaugu

SEQ ID NO: 1545216 - RNA, 19 nt, Homo sapiens
cagcaccucgagccggaua

SEQ ID NO: 1545217 - RNA, 19 nt, Homo sapiens
ccaaauaacucucuucuaa

SEQ ID NO: 1545218 - RNA, 19 nt, Homo sapiens
ucacaucucuugacaguua

SEQ ID NO: 1545219 - RNA, 19 nt, Homo sapiens
gaaggaagcugcagucaug

SEQ ID NO: 1545220 - RNA, 19 nt, Homo sapiens
caacaggcauuaaauauug

SEQ ID NO: 1545221 - RNA, 19 nt, Homo sapiens
ggacucaggucaaauuuau

SEQ ID NO: 1545222 - RNA, 19 nt, Homo sapiens
aaagggagauaaagcauua

SEQ ID NO: 1545223 - RNA, 19 nt, Homo sapiens
cuagauagguuguuugaaa

SEQ ID NO: 1545224 - RNA, 19 nt, Homo sapiens
gaggaaggcuaaguuuaua

SEQ ID NO: 1545225 - RNA, 19 nt, Homo sapiens
ggacuugggucucgaaaca

SEQ ID NO: 1545226 - RNA, 19 nt, Homo sapiens
ggaaggcuaaguuuauaua

SEQ ID NO: 1545227 - RNA, 19 nt, Homo sapiens
aaacagggauuuaaguauc

SEQ ID NO: 1545228 - RNA, 19 nt, Homo sapiens
uuaaguaucuccucucuag

SEQ ID NO: 1545229 - RNA, 19 nt, Homo sapiens
gaaacagggauuuaaguau

SEQ ID NO: 1545230 - RNA, 19 nt, Homo sapiens
ggagauaaagcauuaguuc

SEQ ID NO: 1545231 - RNA, 19 nt, Homo sapiens
gguggaaucuguggucaaa

SEQ ID NO: 1545232 - RNA, 19 nt, Homo sapiens
gaaagaggccaucguguac

SEQ ID NO: 1545233 - RNA, 19 nt, Homo sapiens
gcagaggaaggcuaaguuu

SEQ ID NO: 1545234 - RNA, 19 nt, Homo sapiens
auacaaaugucaagugugu

SEQ ID NO: 1545235 - RNA, 19 nt, Homo sapiens
ugaaacagggauuuaagua

SEQ ID NO: 1545236 - RNA, 19 nt, Homo sapiens
agaaagaggccaucgugua

SEQ ID NO: 1545237 - RNA, 19 nt, Homo sapiens
gaggugauguuccaaagca

SEQ ID NO: 1545238 - RNA, 19 nt, Homo sapiens
caaagcagaggaaggcuaa

SEQ ID NO: 1545239 - RNA, 19 nt, Homo sapiens
gaaaucuaacgucuacauu

SEQ ID NO: 1545240 - RNA, 19 nt, Homo sapiens
ugaauuacaccuugcauau

SEQ ID NO: 1545241 - RNA, 19 nt, Homo sapiens
gcaccagauuucagcuuau

SEQ ID NO: 1545242 - RNA, 19 nt, Homo sapiens
aacagaaccuucaauaaag

SEQ ID NO: 1545243 - RNA, 19 nt, Homo sapiens
caccuugcauguauucaaa

SEQ ID NO: 1545244 - RNA, 19 nt, Homo sapiens
cagaggaaggcuaaguuua

SEQ ID NO: 1545245 - RNA, 19 nt, Homo sapiens
uuaaccaccuugcauguau

SEQ ID NO: 1545246 - RNA, 19 nt, Homo sapiens
aauuacaccuugcauauca

SEQ ID NO: 1545247 - RNA, 19 nt, Homo sapiens
cuuaugggaugcuuugauu

SEQ ID NO: 1545248 - RNA, 19 nt, Homo sapiens
ugacuuacaacaggcauua

SEQ ID NO: 1545249 - RNA, 19 nt, Homo sapiens
cugggacacuuccuguuua

SEQ ID NO: 1545250 - RNA, 19 nt, Homo sapiens
ccucacaucucuugacagu

SEQ ID NO: 1545251 - RNA, 19 nt, Homo sapiens
cuacguagcagucauguca

SEQ ID NO: 1545252 - RNA, 19 nt, Homo sapiens
uaacucuucuacauaagug

SEQ ID NO: 1545253 - RNA, 19 nt, Homo sapiens
guucauaggacaguuauau

SEQ ID NO: 1545254 - RNA, 19 nt, Homo sapiens
gcaguauauucuucagugu

SEQ ID NO: 1545255 - RNA, 19 nt, Homo sapiens
gcagccaggcguucguuaa

SEQ ID NO: 1545256 - RNA, 19 nt, Homo sapiens
uaaccaccuugcauguauu

SEQ ID NO: 1545257 - RNA, 19 nt, Homo sapiens
gagauaaagcauuaguuca

SEQ ID NO: 1545258 - RNA, 19 nt, Homo sapiens
aagaggccaucguguacua

SEQ ID NO: 1545259 - RNA, 19 nt, Homo sapiens
agaggaaggcuaaguuuau

SEQ ID NO: 1545260 - RNA, 19 nt, Homo sapiens
ggcauuaaauauuguuugg

SEQ ID NO: 1545261 - RNA, 19 nt, Homo sapiens
gucuugauccuccaaauaa

SEQ ID NO: 1545262 - RNA, 19 nt, Homo sapiens
ugcgcuagcauaagaauua

SEQ ID NO: 1545263 - RNA, 19 nt, Homo sapiens
cuugacaguuaaagccuua

SEQ ID NO: 1545264 - RNA, 19 nt, Homo sapiens
caugagagaagaagcaaug

SEQ ID NO: 1545265 - RNA, 19 nt, Homo sapiens
ugugugcgcuagcauaaga

SEQ ID NO: 1545266 - RNA, 19 nt, Homo sapiens
acaccgccuuguauuguuu

SEQ ID NO: 1545267 - RNA, 19 nt, Homo sapiens
caagaggugauguuccaaa

SEQ ID NO: 1545268 - RNA, 19 nt, Homo sapiens
acagaaccuucaauaaagu

SEQ ID NO: 1545269 - RNA, 19 nt, Homo sapiens
gcauaucacacucuugaca

SEQ ID NO: 1545270 - RNA, 19 nt, Homo sapiens
ucaaguguguauagugcaa

SEQ ID NO: 1545271 - RNA, 19 nt, Homo sapiens
uaacaaaauugaggacuug

SEQ ID NO: 1545272 - RNA, 19 nt, Homo sapiens
gugaauuacaccuugcaua

SEQ ID NO: 1545273 - RNA, 19 nt, Homo sapiens
ucucugggcucgaaccaau

SEQ ID NO: 1545274 - RNA, 19 nt, Homo sapiens
cgccuuguauuguuuguug

SEQ ID NO: 1545275 - RNA, 19 nt, Homo sapiens
gaauuacaccuugcauauc

SEQ ID NO: 1545276 - RNA, 19 nt, Homo sapiens
acucuaggaugacugauuc

SEQ ID NO: 1545277 - RNA, 19 nt, Homo sapiens
aagcaccuuucaagcagua

SEQ ID NO: 1545278 - RNA, 19 nt, Homo sapiens
acaaaugucaaguguguau

SEQ ID NO: 1545279 - RNA, 19 nt, Homo sapiens
agcaccagauuucagcuua

SEQ ID NO: 1545280 - RNA, 19 nt, Homo sapiens
gcaccuuucaagcaguaua

SEQ ID NO: 1545281 - RNA, 19 nt, Homo sapiens
ccacaccgccuuguauugu

SEQ ID NO: 1545282 - RNA, 19 nt, Homo sapiens
aaccuucaauaaaguggua

SEQ ID NO: 1545283 - RNA, 19 nt, Homo sapiens
caccagauuucagcuuaug

SEQ ID NO: 1545284 - RNA, 19 nt, Homo sapiens
gagcaugagagaagaagca

SEQ ID NO: 1545285 - RNA, 19 nt, Homo sapiens
gaagacauguaccccugaa

SEQ ID NO: 1545286 - RNA, 19 nt, Homo sapiens
ugucuugauccuccaaaua

SEQ ID NO: 1545287 - RNA, 19 nt, Homo sapiens
gaaccaauacaagcaccuu

SEQ ID NO: 1545288 - RNA, 19 nt, Homo sapiens
gcuccacaccgccuuguau

SEQ ID NO: 1545289 - RNA, 19 nt, Homo sapiens
cagccaggcguucguuaaa

SEQ ID NO: 1545290 - RNA, 19 nt, Homo sapiens
guacuacguagcagucaug

SEQ ID NO: 1545291 - RNA, 19 nt, Homo sapiens
ggccaucguguacuacgua

SEQ ID NO: 1545292 - RNA, 19 nt, Homo sapiens
guuucuagauagguuguuu

SEQ ID NO: 1545293 - RNA, 19 nt, Homo sapiens
cacuuauacucuaggauga

SEQ ID NO: 1545294 - RNA, 19 nt, Homo sapiens
uuugaaaucuaacgucuac

SEQ ID NO: 1545295 - RNA, 19 nt, Homo sapiens
uugcauguauucaaaugug

SEQ ID NO: 1545296 - RNA, 19 nt, Homo sapiens
auaucacacucuugacauu

SEQ ID NO: 1545297 - RNA, 19 nt, Homo sapiens
ccaauacaagcaccuuuca

SEQ ID NO: 1545298 - RNA, 19 nt, Homo sapiens
cagcuuaugggaugcuuug

SEQ ID NO: 1545299 - RNA, 19 nt, Homo sapiens
cccugaagauagagaaaga

SEQ ID NO: 1545300 - RNA, 19 nt, Homo sapiens
gagcugcccggaagacauc

SEQ ID NO: 1545301 - RNA, 19 nt, Homo sapiens
caaaugucaaguguguaua

SEQ ID NO: 1545302 - RNA, 19 nt, Homo sapiens
ucacacucuugacauuugu

SEQ ID NO: 1545303 - RNA, 19 nt, Homo sapiens
uugcauaucacacucuuga

SEQ ID NO: 1545304 - RNA, 19 nt, Homo sapiens
gcucgaaccaauacaagca

SEQ ID NO: 1545305 - RNA, 19 nt, Homo sapiens
gcagcgugcaucagcaaga

SEQ ID NO: 1545306 - RNA, 19 nt, Homo sapiens
ccaagacgcaagaccacuu

SEQ ID NO: 1545307 - RNA, 19 nt, Homo sapiens
ugaaaucuaacgucuacau

SEQ ID NO: 1545308 - RNA, 19 nt, Homo sapiens
gcauguauucaaauguguu

SEQ ID NO: 1545309 - RNA, 19 nt, Homo sapiens
uaucacacucuugacauuu

SEQ ID NO: 1545310 - RNA, 19 nt, Homo sapiens
ucaaggcccagucccaaga

SEQ ID NO: 1545311 - RNA, 19 nt, Homo sapiens
uuaguucauaggacaguua

SEQ ID NO: 1545312 - RNA, 19 nt, Homo sapiens
cacaccgccuuguauuguu

SEQ ID NO: 1545313 - RNA, 19 nt, Homo sapiens
gggagauaaagcauuaguu

SEQ ID NO: 1545314 - RNA, 19 nt, Homo sapiens
guggcugcauuuaggagaa

SEQ ID NO: 1545315 - RNA, 19 nt, Homo sapiens
gccuggcaagggugaauua

SEQ ID NO: 1545316 - RNA, 19 nt, Homo sapiens
gagcaagggaaaauuuaaa

SEQ ID NO: 1545317 - RNA, 19 nt, Homo sapiens
ggaggcacccugcuuauua

SEQ ID NO: 1545318 - RNA, 19 nt, Homo sapiens
gaggcacccugcuuauuaa

SEQ ID NO: 1545319 - RNA, 19 nt, Homo sapiens
agagaagcauguugacuuu

SEQ ID NO: 1545320 - RNA, 19 nt, Homo sapiens
gagagaagcauguugacuu

SEQ ID NO: 1545321 - RNA, 19 nt, Homo sapiens
gcagggagagacuggguaa

SEQ ID NO: 1545322 - RNA, 19 nt, Homo sapiens
ccacugacuucgcagagau

SEQ ID NO: 1545323 - RNA, 19 nt, Homo sapiens
caacagggccauggaggaa

SEQ ID NO: 1545324 - RNA, 19 nt, Homo sapiens
cauggaggcacccugcuua

SEQ ID NO: 1545325 - RNA, 19 nt, Homo sapiens
aaaacacacuggcucauuu

SEQ ID NO: 1545326 - RNA, 19 nt, Homo sapiens
cagcaugggugggcagaga

SEQ ID NO: 1545327 - RNA, 19 nt, Homo sapiens
ggucgccgguacacacuga

SEQ ID NO: 1545328 - RNA, 19 nt, Homo sapiens
uuaaagcucucaccuucca

SEQ ID NO: 1545329 - RNA, 19 nt, Homo sapiens
gggcagacuccucucagaa

SEQ ID NO: 1545330 - RNA, 19 nt, Homo sapiens
ggacuucauccaguacauu

SEQ ID NO: 1545331 - RNA, 19 nt, Homo sapiens
aggaggacuucauccagua

SEQ ID NO: 1545332 - RNA, 19 nt, Homo sapiens
cagguaccguucugcaguu

SEQ ID NO: 1545333 - RNA, 19 nt, Homo sapiens
gcacgcuggugguguuguc

SEQ ID NO: 1545334 - RNA, 19 nt, Homo sapiens
caagggcaacuuuccugaa

SEQ ID NO: 1545335 - RNA, 19 nt, Homo sapiens
gcucagggucaaugcaaga

SEQ ID NO: 1545336 - RNA, 19 nt, Homo sapiens
ccacugggaggcugggaaa

SEQ ID NO: 1545337 - RNA, 19 nt, Homo sapiens
cacacuggcucauuuuaaa

SEQ ID NO: 1545338 - RNA, 19 nt, Homo sapiens
ccacagcucagggucaaug

SEQ ID NO: 1545339 - RNA, 19 nt, Homo sapiens
gcauggaggcacccugcuu

SEQ ID NO: 1545340 - RNA, 19 nt, Homo sapiens
ccggagagaagcauguuga

SEQ ID NO: 1545341 - RNA, 19 nt, Homo sapiens
aagggcaacuuuccugaag

SEQ ID NO: 1545342 - RNA, 19 nt, Homo sapiens
gacuucauccaguacauug

SEQ ID NO: 1545343 - RNA, 19 nt, Homo sapiens
gccacugacuucgcagaga

SEQ ID NO: 1545344 - RNA, 19 nt, Homo sapiens
agaagaccaccaccaccua

SEQ ID NO: 1545345 - RNA, 19 nt, Homo sapiens
ccucacgucugugcacugu

SEQ ID NO: 1545346 - RNA, 19 nt, Homo sapiens
gaggauggcgcugguacug

SEQ ID NO: 1545347 - RNA, 19 nt, Homo sapiens
ggagggaagcagggagaga

SEQ ID NO: 1545348 - RNA, 19 nt, Homo sapiens
cgccacagcucagggucaa

SEQ ID NO: 1545349 - RNA, 19 nt, Homo sapiens
gcagagaccuggguaauug

SEQ ID NO: 1545350 - RNA, 19 nt, Homo sapiens
gaagcagagaccuggguaa

SEQ ID NO: 1545351 - RNA, 19 nt, Homo sapiens
ggagaggaacagacacuca

SEQ ID NO: 1545352 - RNA, 19 nt, Homo sapiens
caaggcaagccaguucuuu

SEQ ID NO: 1545353 - RNA, 19 nt, Homo sapiens
gggcaaggcaagccaguuc

SEQ ID NO: 1545354 - RNA, 19 nt, Homo sapiens
gcgagugggaggugaguga

SEQ ID NO: 1545355 - RNA, 19 nt, Homo sapiens
gcaaggcaagccaguucuu

SEQ ID NO: 1545356 - RNA, 19 nt, Homo sapiens
ccaguucuuugggcugaug

SEQ ID NO: 1545357 - RNA, 19 nt, Homo sapiens
ggguaauuguggccuugga

SEQ ID NO: 1545358 - RNA, 19 nt, Homo sapiens
guaaagaccuacaagauaa

SEQ ID NO: 1545359 - RNA, 19 nt, Homo sapiens
gaaagcggcuauagagauu

SEQ ID NO: 1545360 - RNA, 19 nt, Homo sapiens
gguaaagaccuacaagaua

SEQ ID NO: 1545361 - RNA, 19 nt, Homo sapiens
guaccaacauguuaauuuc

SEQ ID NO: 1545362 - RNA, 19 nt, Homo sapiens
gcuaacaagugcugguaaa

SEQ ID NO: 1545363 - RNA, 19 nt, Homo sapiens
gaaggcaaauuagaacaau

SEQ ID NO: 1545364 - RNA, 19 nt, Homo sapiens
ucacuacuguggacuugua

SEQ ID NO: 1545365 - RNA, 19 nt, Homo sapiens
caacugggacgcugauauu

SEQ ID NO: 1545366 - RNA, 19 nt, Homo sapiens
ggaaagcggcuauagagau

SEQ ID NO: 1545367 - RNA, 19 nt, Homo sapiens
guagcuggaaggcaaauua

SEQ ID NO: 1545368 - RNA, 19 nt, Homo sapiens
caacgccuaugaagauuuc

SEQ ID NO: 1545369 - RNA, 19 nt, Homo sapiens
gaaucacuauccugacaga

SEQ ID NO: 1545370 - RNA, 19 nt, Homo sapiens
gaaauucucaugggcaaga

SEQ ID NO: 1545371 - RNA, 19 nt, Homo sapiens
gaagacaaucgcaguggaa

SEQ ID NO: 1545372 - RNA, 19 nt, Homo sapiens
ugaaggccuuggacaauau

SEQ ID NO: 1545373 - RNA, 19 nt, Homo sapiens
gaccacauuuccagaagga

SEQ ID NO: 1545374 - RNA, 19 nt, Homo sapiens
uaauucaagucccaacuau

SEQ ID NO: 1545375 - RNA, 19 nt, Homo sapiens
gaucacuacuguggacuug

SEQ ID NO: 1545376 - RNA, 19 nt, Homo sapiens
uguacuaccuggaggauga

SEQ ID NO: 1545377 - RNA, 19 nt, Homo sapiens
ggaaggcaaauuagaacaa

SEQ ID NO: 1545378 - RNA, 19 nt, Homo sapiens
agacuuaaguaccaacaug

SEQ ID NO: 1545379 - RNA, 19 nt, Homo sapiens
guaauucaagucccaacua

SEQ ID NO: 1545380 - RNA, 19 nt, Homo sapiens
uccaaggccuacagauaua

SEQ ID NO: 1545381 - RNA, 19 nt, Homo sapiens
ggcuaaagacggaagauuu

SEQ ID NO: 1545382 - RNA, 19 nt, Homo sapiens
ugaguuccgugaucuuuau

SEQ ID NO: 1545383 - RNA, 19 nt, Homo sapiens
cugaaggccuuggacaaua

SEQ ID NO: 1545384 - RNA, 19 nt, Homo sapiens
agacagagcaaauuagaau

SEQ ID NO: 1545385 - RNA, 19 nt, Homo sapiens
guagacagagcaaauuaga

SEQ ID NO: 1545386 - RNA, 19 nt, Homo sapiens
ccagaaggcuuacuuuuca

SEQ ID NO: 1545387 - RNA, 19 nt, Homo sapiens
gaucuuuauucgugacaga

SEQ ID NO: 1545388 - RNA, 19 nt, Homo sapiens
caaggaaagcggcuauaga

SEQ ID NO: 1545389 - RNA, 19 nt, Homo sapiens
uagaaucacuauccugaca

SEQ ID NO: 1545390 - RNA, 19 nt, Homo sapiens
caggauacaucgacuaugc

SEQ ID NO: 1545391 - RNA, 19 nt, Homo sapiens
gcuggaaggcaaauuagaa

SEQ ID NO: 1545392 - RNA, 19 nt, Homo sapiens
gccuacagauauaagcuuu

SEQ ID NO: 1545393 - RNA, 19 nt, Homo sapiens
uaacaagugcugguaaaga

SEQ ID NO: 1545394 - RNA, 19 nt, Homo sapiens
gcagccaggugacaacucu

SEQ ID NO: 1545395 - RNA, 19 nt, Homo sapiens
ugaaagagcucagcaaaag

SEQ ID NO: 1545396 - RNA, 19 nt, Homo sapiens
ucaagugauugccgauaau

SEQ ID NO: 1545397 - RNA, 19 nt, Homo sapiens
ggacgcugauauugcuguu

SEQ ID NO: 1545398 - RNA, 19 nt, Homo sapiens
cuauagagauugcaagacu

SEQ ID NO: 1545399 - RNA, 19 nt, Homo sapiens
ccgagggacuggagagaga

SEQ ID NO: 1545400 - RNA, 19 nt, Homo sapiens
cagaaggaagacuuaagua

SEQ ID NO: 1545401 - RNA, 19 nt, Homo sapiens
gcaaggaaagcggcuauag

SEQ ID NO: 1545402 - RNA, 19 nt, Homo sapiens
gacagagcaaauuagaaua

SEQ ID NO: 1545403 - RNA, 19 nt, Homo sapiens
cuuaaguaccaacauguua

SEQ ID NO: 1545404 - RNA, 19 nt, Homo sapiens
cgauaauccagaaggcuua

SEQ ID NO: 1545405 - RNA, 19 nt, Homo sapiens
ccaacauguuaauuuccua

SEQ ID NO: 1545406 - RNA, 19 nt, Homo sapiens
ccagaaggaagacuuaagu

SEQ ID NO: 1545407 - RNA, 19 nt, Homo sapiens
gcugauauugcuguuagua

SEQ ID NO: 1545408 - RNA, 19 nt, Homo sapiens
caaaagacgcuaacaagug

SEQ ID NO: 1545409 - RNA, 19 nt, Homo sapiens
aaggaagacuuaaguacca

SEQ ID NO: 1545410 - RNA, 19 nt, Homo sapiens
ccguagacagagcaaauua

SEQ ID NO: 1545411 - RNA, 19 nt, Homo sapiens
cuuccaaggccuacagaua

SEQ ID NO: 1545412 - RNA, 19 nt, Homo sapiens
gcaaugagagaagaagaca

SEQ ID NO: 1545413 - RNA, 19 nt, Homo sapiens
ugacggcccuggcaaugag

SEQ ID NO: 1545414 - RNA, 19 nt, Homo sapiens
ggccgaggauaccgcaaug

SEQ ID NO: 1545415 - RNA, 19 nt, Homo sapiens
gaaggccuuggacaauauu

SEQ ID NO: 1545416 - RNA, 19 nt, Homo sapiens
gcugaaggccuuggacaau

SEQ ID NO: 1545417 - RNA, 19 nt, Homo sapiens
gcuaaagacggaagauuuu

SEQ ID NO: 1545418 - RNA, 19 nt, Homo sapiens
uaauaaaugagcccuguag

SEQ ID NO: 1545419 - RNA, 19 nt, Homo sapiens
ucacuauccugacagaacu

SEQ ID NO: 1545420 - RNA, 19 nt, Homo sapiens
aauaaauuccguagacaga

SEQ ID NO: 1545421 - RNA, 19 nt, Homo sapiens
ccaggugacaacucuacua

SEQ ID NO: 1545422 - RNA, 19 nt, Homo sapiens
acucgcagaucacuacugu

SEQ ID NO: 1545423 - RNA, 19 nt, Homo sapiens
aaugagagaagaagacaau

SEQ ID NO: 1545424 - RNA, 19 nt, Homo sapiens
uugcaagacuggcugaaag

SEQ ID NO: 1545425 - RNA, 19 nt, Homo sapiens
acgcugauauugcuguuag

SEQ ID NO: 1545426 - RNA, 19 nt, Homo sapiens
ccaaggccuacagauauaa

SEQ ID NO: 1545427 - RNA, 19 nt, Homo sapiens
gacggaagauuuugaaguc

SEQ ID NO: 1545428 - RNA, 19 nt, Homo sapiens
gacuaugcccacaggcuaa

SEQ ID NO: 1545429 - RNA, 19 nt, Homo sapiens
cuacuguggacuuguacua

SEQ ID NO: 1545430 - RNA, 19 nt, Homo sapiens
gaagacuuaaguaccaaca

SEQ ID NO: 1545431 - RNA, 19 nt, Homo sapiens
agucccaacuaucaaguga

SEQ ID NO: 1545432 - RNA, 19 nt, Homo sapiens
gcaaaagacgcuaacaagu

SEQ ID NO: 1545433 - RNA, 19 nt, Homo sapiens
aaggaaagcggcuauagag

SEQ ID NO: 1545434 - RNA, 19 nt, Homo sapiens
auucaagucccaacuauca

SEQ ID NO: 1545435 - RNA, 19 nt, Homo sapiens
uuccaaggccuacagauau

SEQ ID NO: 1545436 - RNA, 19 nt, Homo sapiens
aacaagugcugguaaagac

SEQ ID NO: 1545437 - RNA, 19 nt, Homo sapiens
gggcaagagauaucaggau

SEQ ID NO: 1545438 - RNA, 19 nt, Homo sapiens
ugguaaagaccuacaagau

SEQ ID NO: 1545439 - RNA, 19 nt, Homo sapiens
gacuggagagagagugaaa

SEQ ID NO: 1545440 - RNA, 19 nt, Homo sapiens
agaaggaagacuuaaguac

SEQ ID NO: 1545441 - RNA, 19 nt, Homo sapiens
ucaacgccuaugaagauuu

SEQ ID NO: 1545442 - RNA, 19 nt, Homo sapiens
gaaagagcucagcaaaaga

SEQ ID NO: 1545443 - RNA, 19 nt, Homo sapiens
ggacuggagagagagugaa

SEQ ID NO: 1545444 - RNA, 19 nt, Homo sapiens
cggaagauuuugaagucua

SEQ ID NO: 1545445 - RNA, 19 nt, Homo sapiens
gaaaguacgucacaucaua

SEQ ID NO: 1545446 - RNA, 19 nt, Homo sapiens
ggaaggagcuggagaaucu

SEQ ID NO: 1545447 - RNA, 19 nt, Homo sapiens
ggaaggagcuggagaaucu

SEQ ID NO: 1545448 - RNA, 19 nt, Homo sapiens
ggaaggagcuggagaaucu

SEQ ID NO: 1545449 - RNA, 19 nt, Homo sapiens
gaagguaacaaucaucuaa

SEQ ID NO: 1545450 - RNA, 19 nt, Homo sapiens
gagauggacuggagaguga

SEQ ID NO: 1545451 - RNA, 19 nt, Homo sapiens
ggaagagguugcugagauu

SEQ ID NO: 1545452 - RNA, 19 nt, Homo sapiens
caacauccaugccuucuca

SEQ ID NO: 1545453 - RNA, 19 nt, Homo sapiens
gaucuuggcugaacuaagg

SEQ ID NO: 1545454 - RNA, 19 nt, Homo sapiens
ugaaguaucugcaaaugga

SEQ ID NO: 1545455 - RNA, 19 nt, Homo sapiens
ggaagagguugcucagguu

SEQ ID NO: 1545456 - RNA, 19 nt, Homo sapiens
ucacugagcucacgcuuca

SEQ ID NO: 1545457 - RNA, 19 nt, Homo sapiens
aaacagacaccaucaguga

SEQ ID NO: 1545458 - RNA, 19 nt, Homo sapiens
ucacacagcaacagcaaua

SEQ ID NO: 1545459 - RNA, 19 nt, Homo sapiens
ggagacaggugcagaugag

SEQ ID NO: 1545460 - RNA, 19 nt, Homo sapiens
gagaaugaguacauaagca

SEQ ID NO: 1545461 - RNA, 19 nt, Homo sapiens
cagagcagcuucaaguugu

SEQ ID NO: 1545462 - RNA, 19 nt, Homo sapiens
gcagagcagcuucaaguug

SEQ ID NO: 1545463 - RNA, 19 nt, Homo sapiens
gcaauaaggagcugaagca

SEQ ID NO: 1545464 - RNA, 19 nt, Homo sapiens
caaguggcauggcagauuc

SEQ ID NO: 1545465 - RNA, 19 nt, Homo sapiens
ugagucaccugaaccaaga

SEQ ID NO: 1545466 - RNA, 19 nt, Homo sapiens
ggagaaaugggaccagaga

SEQ ID NO: 1545467 - RNA, 19 nt, Homo sapiens
ggacaaacagacaccauca

SEQ ID NO: 1545468 - RNA, 19 nt, Homo sapiens
aagcaggccaccaaauuua

SEQ ID NO: 1545469 - RNA, 19 nt, Homo sapiens
cagagcaggugcacacguu

SEQ ID NO: 1545470 - RNA, 19 nt, Homo sapiens
gcugaaguaucugcaaaug

SEQ ID NO: 1545471 - RNA, 19 nt, Homo sapiens
cagcaaagccuggagaaau

SEQ ID NO: 1545472 - RNA, 19 nt, Homo sapiens
gcuucaaguuguacugauu

SEQ ID NO: 1545473 - RNA, 19 nt, Homo sapiens
aaagcaggccaccaaauuu

SEQ ID NO: 1545474 - RNA, 19 nt, Homo sapiens
ggaaagccgagccuugaga

SEQ ID NO: 1545475 - RNA, 19 nt, Homo sapiens
uacaggagcuggagacgau

SEQ ID NO: 1545476 - RNA, 19 nt, Homo sapiens
uggaguggcugaaguaucu

SEQ ID NO: 1545477 - RNA, 19 nt, Homo sapiens
gcaggccaccaaauuuaaa

SEQ ID NO: 1545478 - RNA, 19 nt, Homo sapiens
gagagcaagaugaagguaa

SEQ ID NO: 1545479 - RNA, 19 nt, Homo sapiens
ccagaacccugcugaugag

SEQ ID NO: 1545480 - RNA, 19 nt, Homo sapiens
agaaugagcggguggagaa

SEQ ID NO: 1545481 - RNA, 19 nt, Homo sapiens
gaacgaagagcaggaagag

SEQ ID NO: 1545482 - RNA, 19 nt, Homo sapiens
aggcagggaugcaguguga

SEQ ID NO: 1545483 - RNA, 19 nt, Homo sapiens
gcagaugaggugaagauca

SEQ ID NO: 1545484 - RNA, 19 nt, Homo sapiens
gcaagaugaagguaacaau

SEQ ID NO: 1545485 - RNA, 19 nt, Homo sapiens
gaaaagaguagcagagaug

SEQ ID NO: 1545486 - RNA, 19 nt, Homo sapiens
aggaagagguugcugagau

SEQ ID NO: 1545487 - RNA, 19 nt, Homo sapiens
uguggagccugaacaagaa

SEQ ID NO: 1545488 - RNA, 19 nt, Homo sapiens
gcacagcaugagucgagua

SEQ ID NO: 1545489 - RNA, 19 nt, Homo sapiens
gcaggagaacucagcuuug

SEQ ID NO: 1545490 - RNA, 19 nt, Homo sapiens
gagagcaguaugccgagua

SEQ ID NO: 1545491 - RNA, 19 nt, Homo sapiens
caggagaacucagcuuugg

SEQ ID NO: 1545492 - RNA, 19 nt, Homo sapiens
agcaaagccuggagaaaug

SEQ ID NO: 1545493 - RNA, 19 nt, Homo sapiens
ugagucgccugaaccaaga

SEQ ID NO: 1545494 - RNA, 19 nt, Homo sapiens
ugagucgccugaacgaaga

SEQ ID NO: 1545495 - RNA, 19 nt, Homo sapiens
gccagccacugucagcaaa

SEQ ID NO: 1545496 - RNA, 19 nt, Homo sapiens
gcccgcagguggcauuuua

SEQ ID NO: 1545497 - RNA, 19 nt, Homo sapiens
aggaggagaugaaggugaa

SEQ ID NO: 1545498 - RNA, 19 nt, Homo sapiens
gcacaggcaguuauuucug

SEQ ID NO: 1545499 - RNA, 19 nt, Homo sapiens
gagacgaucuuggcugaac

SEQ ID NO: 1545500 - RNA, 19 nt, Homo sapiens
cugcagagccgcuuuaugg

SEQ ID NO: 1545501 - RNA, 19 nt, Homo sapiens
ccagaaacacgaacugaag

SEQ ID NO: 1545502 - RNA, 19 nt, Homo sapiens
gagagagugcacagcauga

SEQ ID NO: 1545503 - RNA, 19 nt, Homo sapiens
caagaugaagguaacaauc

SEQ ID NO: 1545504 - RNA, 19 nt, Homo sapiens
ggaaaguacgucacaucau

SEQ ID NO: 1545505 - RNA, 19 nt, Homo sapiens
gaggaaaguacgucacauc

SEQ ID NO: 1545506 - RNA, 19 nt, Homo sapiens
gagaggaaaguacgucaca

SEQ ID NO: 1545507 - RNA, 19 nt, Homo sapiens
gaagagguugcugagauug

SEQ ID NO: 1545508 - RNA, 19 nt, Homo sapiens
caaguuguacugauugaca

SEQ ID NO: 1545509 - RNA, 19 nt, Homo sapiens
uggcugaaguaucugcaaa

SEQ ID NO: 1545510 - RNA, 19 nt, Homo sapiens
ggagcaagaggagaaguug

SEQ ID NO: 1545511 - RNA, 19 nt, Homo sapiens
gagcaggugcacacguuga

SEQ ID NO: 1545512 - RNA, 19 nt, Homo sapiens
ggacaaggaggagaugaag

SEQ ID NO: 1545513 - RNA, 19 nt, Homo sapiens
gagcaggcacagcuacaug

SEQ ID NO: 1545514 - RNA, 19 nt, Homo sapiens
guggaaagccgagccuuga

SEQ ID NO: 1545515 - RNA, 19 nt, Homo sapiens
gaaccaagagcaggaagag

SEQ ID NO: 1545516 - RNA, 19 nt, Homo sapiens
gaaccaagagcaggaagag

SEQ ID NO: 1545517 - RNA, 19 nt, Homo sapiens
cagcaugagucgaguacag

SEQ ID NO: 1545518 - RNA, 19 nt, Homo sapiens
aaaauaagaccccuaucua

SEQ ID NO: 1545519 - RNA, 19 nt, Homo sapiens
guguggagccugaacaaga

SEQ ID NO: 1545520 - RNA, 19 nt, Homo sapiens
ccgggagaaugaguacaua

SEQ ID NO: 1545521 - RNA, 19 nt, Homo sapiens
gacaccauuucaccugaga

SEQ ID NO: 1545522 - RNA, 19 nt, Homo sapiens
cagacacccuuaugcucuu

SEQ ID NO: 1545523 - RNA, 19 nt, Homo sapiens
gaaccagugcugaggucuu

SEQ ID NO: 1545524 - RNA, 19 nt, Homo sapiens
gaaucuggcaggacagcuu

SEQ ID NO: 1545525 - RNA, 19 nt, Homo sapiens
gaaucuggcaggacagcuu

SEQ ID NO: 1545526 - RNA, 19 nt, Homo sapiens
cccagaacccugcugauga

SEQ ID NO: 1545527 - RNA, 19 nt, Homo sapiens
gaagcagaaccaguagcua

SEQ ID NO: 1545528 - RNA, 19 nt, Homo sapiens
cagaaacacgaacugaaga

SEQ ID NO: 1545529 - RNA, 19 nt, Homo sapiens
ggaacgaccguaccaccau

SEQ ID NO: 1545530 - RNA, 19 nt, Homo sapiens
ggagagcaagaugaaggua

SEQ ID NO: 1545531 - RNA, 19 nt, Homo sapiens
gcccguucauccuguguau

SEQ ID NO: 1545532 - RNA, 19 nt, Homo sapiens
ugauggaguggcugaagua

SEQ ID NO: 1545533 - RNA, 19 nt, Homo sapiens
ugcuggagcuugaguggaa

SEQ ID NO: 1545534 - RNA, 19 nt, Homo sapiens
agagguugcugagauuguu

SEQ ID NO: 1545535 - RNA, 19 nt, Homo sapiens
aagaugaagguaacaauca

SEQ ID NO: 1545536 - RNA, 19 nt, Homo sapiens
gcccagaacccugcugaug

SEQ ID NO: 1545537 - RNA, 19 nt, Homo sapiens
caauaggugcacccucuga

SEQ ID NO: 1545538 - RNA, 19 nt, Homo sapiens
ggaagcagaaccaguagcu

SEQ ID NO: 1545539 - RNA, 19 nt, Homo sapiens
ucagguuguuggagcaaga

SEQ ID NO: 1545540 - RNA, 19 nt, Homo sapiens
gggcuugagucaccugaac

SEQ ID NO: 1545541 - RNA, 19 nt, Homo sapiens
uaagaccccuaucuaguga

SEQ ID NO: 1545542 - RNA, 19 nt, Homo sapiens
gugauggaguggcugaagu

SEQ ID NO: 1545543 - RNA, 19 nt, Homo sapiens
aaauggagagagagcagua

SEQ ID NO: 1545544 - RNA, 19 nt, Homo sapiens
agagcagcuucaaguugua

SEQ ID NO: 1545545 - RNA, 19 nt, Homo sapiens
ggacacaucugcaucaaau

SEQ ID NO: 1545546 - RNA, 19 nt, Homo sapiens
ggaggaagcugaggaguga

SEQ ID NO: 1545547 - RNA, 19 nt, Homo sapiens
guacucaccucagcaucua

SEQ ID NO: 1545548 - RNA, 19 nt, Homo sapiens
cacgagggcugcagaguga

SEQ ID NO: 1545549 - RNA, 19 nt, Homo sapiens
aaagauacguacaauuugg

SEQ ID NO: 1545550 - RNA, 19 nt, Homo sapiens
ucaaauccaucacaaagac

SEQ ID NO: 1545551 - RNA, 19 nt, Homo sapiens
gcaagaguccagauuaugc

SEQ ID NO: 1545552 - RNA, 19 nt, Homo sapiens
gcuccugccucugugauga

SEQ ID NO: 1545553 - RNA, 19 nt, Homo sapiens
caucaaauccaucacaaag

SEQ ID NO: 1545554 - RNA, 19 nt, Homo sapiens
gagcugcccaggucuucua

SEQ ID NO: 1545555 - RNA, 19 nt, Homo sapiens
gcccaggucuucuauaucc

SEQ ID NO: 1545556 - RNA, 19 nt, Homo sapiens
aaagcaaaguggacacauc

SEQ ID NO: 1545557 - RNA, 19 nt, Homo sapiens
gaggugggaagaucacuug

SEQ ID NO: 1545558 - RNA, 19 nt, Homo sapiens
gcaucaaauccaucacaaa

SEQ ID NO: 1545559 - RNA, 19 nt, Homo sapiens
aggcaagaguccagauuau

SEQ ID NO: 1545560 - RNA, 19 nt, Homo sapiens
cacuugaggucaggaguuu

SEQ ID NO: 1545561 - RNA, 19 nt, Homo sapiens
cgucaaauauaucguuacu

SEQ ID NO: 1545562 - RNA, 19 nt, Homo sapiens
cugcccaggucuucuauau

SEQ ID NO: 1545563 - RNA, 19 nt, Homo sapiens
ccucagacgccaucaacaa

SEQ ID NO: 1545564 - RNA, 19 nt, Homo sapiens
aaggcaagaguccagauua

SEQ ID NO: 1545565 - RNA, 19 nt, Homo sapiens
agaggcaccuagacucaug

SEQ ID NO: 1545566 - RNA, 19 nt, Homo sapiens
ucacaaagacggccuucca

SEQ ID NO: 1545567 - RNA, 19 nt, Homo sapiens
guaauggguuuagcugcau

SEQ ID NO: 1545568 - RNA, 19 nt, Homo sapiens
gagaaacaccccacaaauc

SEQ ID NO: 1545569 - RNA, 19 nt, Homo sapiens
cuaggccgguaauggguuu

SEQ ID NO: 1545570 - RNA, 19 nt, Homo sapiens
gaguccagauuaugcaaac

SEQ ID NO: 1545571 - RNA, 19 nt, Homo sapiens
caucgucaaauauaucguu

SEQ ID NO: 1545572 - RNA, 19 nt, Homo sapiens
ggcaagaguccagauuaug

SEQ ID NO: 1545573 - RNA, 19 nt, Homo sapiens
gaacaccagggcagcacau

SEQ ID NO: 1545574 - RNA, 19 nt, Homo sapiens
cgguuucccuccacucgaa

SEQ ID NO: 1545575 - RNA, 19 nt, Homo sapiens
ucagaggcaccuagacuca

SEQ ID NO: 1545576 - RNA, 19 nt, Homo sapiens
gucaggaguuugagaccau

SEQ ID NO: 1545577 - RNA, 19 nt, Homo sapiens
aaaggcaagaguccagauu

SEQ ID NO: 1545578 - RNA, 19 nt, Homo sapiens
acaggucgccaucagcaaa

SEQ ID NO: 1545579 - RNA, 19 nt, Homo sapiens
caagaguccagauuaugca

SEQ ID NO: 1545580 - RNA, 19 nt, Homo sapiens
ucacuugaggucaggaguu

SEQ ID NO: 1545581 - RNA, 19 nt, Homo sapiens
cgucacaggucgccaucag

SEQ ID NO: 1545582 - RNA, 19 nt, Homo sapiens
ugcaucaaauccaucacaa

SEQ ID NO: 1545583 - RNA, 19 nt, Homo sapiens
guggacacaucugcaucaa

SEQ ID NO: 1545584 - RNA, 19 nt, Homo sapiens
agaaacaccccacaaauca

SEQ ID NO: 1545585 - RNA, 19 nt, Homo sapiens
aaagacggccuuccagacu

SEQ ID NO: 1545586 - RNA, 19 nt, Homo sapiens
gaaagaggacucacaguua

SEQ ID NO: 1545587 - RNA, 19 nt, Homo sapiens
ccacacagcuuguucguuu

SEQ ID NO: 1545588 - RNA, 19 nt, Homo sapiens
ucagauaccuggguuauuu

SEQ ID NO: 1545589 - RNA, 19 nt, Homo sapiens
gaaaggauauucugguaca

SEQ ID NO: 1545590 - RNA, 19 nt, Homo sapiens
gggaagaccugaaguuuua

SEQ ID NO: 1545591 - RNA, 19 nt, Homo sapiens
caacggugaugacauguuu

SEQ ID NO: 1545592 - RNA, 19 nt, Homo sapiens
cgagagcccuggaaaguuu

SEQ ID NO: 1545593 - RNA, 19 nt, Homo sapiens
gggcauuagugcaauauaa

SEQ ID NO: 1545594 - RNA, 19 nt, Homo sapiens
caaagaagaguaucagaaa

SEQ ID NO: 1545595 - RNA, 19 nt, Homo sapiens
ggaaugcaguagcaaagaa

SEQ ID NO: 1545596 - RNA, 19 nt, Homo sapiens
ggaaagaggacucacaguu

SEQ ID NO: 1545597 - RNA, 19 nt, Homo sapiens
ugacugaaguuccagcuuu

SEQ ID NO: 1545598 - RNA, 19 nt, Homo sapiens
uaugaucucugcagcauuu

SEQ ID NO: 1545599 - RNA, 19 nt, Homo sapiens
gaacucaucauucuucaga

SEQ ID NO: 1545600 - RNA, 19 nt, Homo sapiens
gagagaggaucagguguuu

SEQ ID NO: 1545601 - RNA, 19 nt, Homo sapiens
gcaaagaagaguaucagaa

SEQ ID NO: 1545602 - RNA, 19 nt, Homo sapiens
cagaauacgugaugccaaa

SEQ ID NO: 1545603 - RNA, 19 nt, Homo sapiens
ucagucgucuguauuuaua

SEQ ID NO: 1545604 - RNA, 19 nt, Homo sapiens
ggaccauguuuccuucuaa

SEQ ID NO: 1545605 - RNA, 19 nt, Homo sapiens
ugaagaauguaaagacuug

SEQ ID NO: 1545606 - RNA, 19 nt, Homo sapiens
aaacggauuugcaggaauu

SEQ ID NO: 1545607 - RNA, 19 nt, Homo sapiens
gacugaaguuccagcuuua

SEQ ID NO: 1545608 - RNA, 19 nt, Homo sapiens
gaaaggagaaugucuaagg

SEQ ID NO: 1545609 - RNA, 19 nt, Homo sapiens
caagaaagggaccauguuu

SEQ ID NO: 1545610 - RNA, 19 nt, Homo sapiens
gaaaugagucggccgugaa

SEQ ID NO: 1545611 - RNA, 19 nt, Homo sapiens
ugacauguuugcaaccuuu

SEQ ID NO: 1545612 - RNA, 19 nt, Homo sapiens
gaccauaccaugacaaguu

SEQ ID NO: 1545613 - RNA, 19 nt, Homo sapiens
gagaaugucuaagggaaga

SEQ ID NO: 1545614 - RNA, 19 nt, Homo sapiens
aaaugaagcugguugcaau

SEQ ID NO: 1545615 - RNA, 19 nt, Homo sapiens
cuaaaguucugcuaaagau

SEQ ID NO: 1545616 - RNA, 19 nt, Homo sapiens
gcauauaaugugcugauuu

SEQ ID NO: 1545617 - RNA, 19 nt, Homo sapiens
cagagugugcgaaauaaua

SEQ ID NO: 1545618 - RNA, 19 nt, Homo sapiens
gaaggaaugcaguagcaaa

SEQ ID NO: 1545619 - RNA, 19 nt, Homo sapiens
aaagaggacucacaguuag

SEQ ID NO: 1545620 - RNA, 19 nt, Homo sapiens
cuugauaccuauuagcuaa

SEQ ID NO: 1545621 - RNA, 19 nt, Homo sapiens
ccucuacgcucuugguuug

SEQ ID NO: 1545622 - RNA, 19 nt, Homo sapiens
uaagcagcauuacaagaaa

SEQ ID NO: 1545623 - RNA, 19 nt, Homo sapiens
gaugaaaggagaaugucua

SEQ ID NO: 1545624 - RNA, 19 nt, Homo sapiens
ccaagcuggcgaacuauua

SEQ ID NO: 1545625 - RNA, 19 nt, Homo sapiens
gaaaugaagcugguugcaa

SEQ ID NO: 1545626 - RNA, 19 nt, Homo sapiens
gaaacggauuugcaggaau

SEQ ID NO: 1545627 - RNA, 19 nt, Homo sapiens
guucagucgucuguauuua

SEQ ID NO: 1545628 - RNA, 19 nt, Homo sapiens
cuaaugagacacugaauau

SEQ ID NO: 1545629 - RNA, 19 nt, Homo sapiens
gcagaaaggguaagagaag

SEQ ID NO: 1545630 - RNA, 19 nt, Homo sapiens
aguccaagcuggcgaacua

SEQ ID NO: 1545631 - RNA, 19 nt, Homo sapiens
gacaugaucucggaaugga

SEQ ID NO: 1545632 - RNA, 19 nt, Homo sapiens
ggguuggagucaucagaua

SEQ ID NO: 1545633 - RNA, 19 nt, Homo sapiens
gcuggugguugcuuucaaa

SEQ ID NO: 1545634 - RNA, 19 nt, Homo sapiens
ggagagaggaucagguguu

SEQ ID NO: 1545635 - RNA, 19 nt, Homo sapiens
gguuugaagacauuuguua

SEQ ID NO: 1545636 - RNA, 19 nt, Homo sapiens
ccuauuagcuaaaguucug

SEQ ID NO: 1545637 - RNA, 19 nt, Homo sapiens
guacagaugaagaugacua

SEQ ID NO: 1545638 - RNA, 19 nt, Homo sapiens
aaagaucauuucagagugu

SEQ ID NO: 1545639 - RNA, 19 nt, Homo sapiens
gaccaugacugaaguucca

SEQ ID NO: 1545640 - RNA, 19 nt, Homo sapiens
gcuguucagucgucuguau

SEQ ID NO: 1545641 - RNA, 19 nt, Homo sapiens
gcaauggcacaucgugauu

SEQ ID NO: 1545642 - RNA, 19 nt, Homo sapiens
aaaggugauucuuggguuu

SEQ ID NO: 1545643 - RNA, 19 nt, Homo sapiens
uugaaaggauauucuggua

SEQ ID NO: 1545644 - RNA, 19 nt, Homo sapiens
gcuaaaguucugcuaaaga

SEQ ID NO: 1545645 - RNA, 19 nt, Homo sapiens
ugaaacggauuugcaggaa

SEQ ID NO: 1545646 - RNA, 19 nt, Homo sapiens
aaugagacacugaauauug

SEQ ID NO: 1545647 - RNA, 19 nt, Homo sapiens
gggaccauguuuccuucua

SEQ ID NO: 1545648 - RNA, 19 nt, Homo sapiens
gacgccagauuccgugaaa

SEQ ID NO: 1545649 - RNA, 19 nt, Homo sapiens
caagcuggcgaacuauuaa

SEQ ID NO: 1545650 - RNA, 19 nt, Homo sapiens
ggaauuuuaucggcucuua

SEQ ID NO: 1545651 - RNA, 19 nt, Homo sapiens
gaccauguuuccuucuaau

SEQ ID NO: 1545652 - RNA, 19 nt, Homo sapiens
ucaaagaagauaacacugu

SEQ ID NO: 1545653 - RNA, 19 nt, Homo sapiens
gcacaucgugauucugaga

SEQ ID NO: 1545654 - RNA, 19 nt, Homo sapiens
uaaaguucaggcauccuua

SEQ ID NO: 1545655 - RNA, 19 nt, Homo sapiens
gaucagguguuuucagguu

SEQ ID NO: 1545656 - RNA, 19 nt, Homo sapiens
gugcugguaugauuuaucu

SEQ ID NO: 1545657 - RNA, 19 nt, Homo sapiens
ggaucuaaaucucacaaac

SEQ ID NO: 1545658 - RNA, 19 nt, Homo sapiens
uaaucaguaucaucagcua

SEQ ID NO: 1545659 - RNA, 19 nt, Homo sapiens
gggcuacuacugggcauua

SEQ ID NO: 1545660 - RNA, 19 nt, Homo sapiens
aaaguucugcuaaagauga

SEQ ID NO: 1545661 - RNA, 19 nt, Homo sapiens
gcccaaauccagcagaaga

SEQ ID NO: 1545662 - RNA, 19 nt, Homo sapiens
gccaaaaguucuucgguuu

SEQ ID NO: 1545663 - RNA, 19 nt, Homo sapiens
augagacacugaauauuga

SEQ ID NO: 1545664 - RNA, 19 nt, Homo sapiens
ucaagaggaugccuaugag

SEQ ID NO: 1545665 - RNA, 19 nt, Homo sapiens
caauaccaaucuagagagu

SEQ ID NO: 1545666 - RNA, 19 nt, Homo sapiens
aaagaagaguaucagaaag

SEQ ID NO: 1545667 - RNA, 19 nt, Homo sapiens
uaagggaagaccugaaguu

SEQ ID NO: 1545668 - RNA, 19 nt, Homo sapiens
ggcgaacuauuaagcuguu

SEQ ID NO: 1545669 - RNA, 19 nt, Homo sapiens
aagaagaguaucagaaaga

SEQ ID NO: 1545670 - RNA, 19 nt, Homo sapiens
gcaguagcaaagaagagua

SEQ ID NO: 1545671 - RNA, 19 nt, Homo sapiens
gaucuaaaucucacaaacu

SEQ ID NO: 1545672 - RNA, 19 nt, Homo sapiens
gugaguuaccagacuguua

SEQ ID NO: 1545673 - RNA, 19 nt, Homo sapiens
gacccuugguuauggagaa

SEQ ID NO: 1545674 - RNA, 19 nt, Homo sapiens
gacaagcaguuccaaaaug

SEQ ID NO: 1545675 - RNA, 19 nt, Homo sapiens
uggguuauuuccaggcaua

SEQ ID NO: 1545676 - RNA, 19 nt, Homo sapiens
cuaaaucucacaaacuaug

SEQ ID NO: 1545677 - RNA, 19 nt, Homo sapiens
gcucuuacagguugaaauc

SEQ ID NO: 1545678 - RNA, 19 nt, Homo sapiens
uucaggaccucuccaagaa

SEQ ID NO: 1545679 - RNA, 19 nt, Homo sapiens
ccauguuuccuucuaauga

SEQ ID NO: 1545680 - RNA, 19 nt, Homo sapiens
guucugcuaaagaugauua

SEQ ID NO: 1545681 - RNA, 19 nt, Homo sapiens
acuguuaugucuuucagaa

SEQ ID NO: 1545682 - RNA, 19 nt, Homo sapiens
uuaaaggcauugaccuaca

SEQ ID NO: 1545683 - RNA, 19 nt, Homo sapiens
ucuaaugagacacugaaua

SEQ ID NO: 1545684 - RNA, 19 nt, Homo sapiens
ugaguuaccagacuguuau

SEQ ID NO: 1545685 - RNA, 19 nt, Homo sapiens
ugagcucgauuguguucaa

SEQ ID NO: 1545686 - RNA, 19 nt, Homo sapiens
ucuaagaacugcucucuaa

SEQ ID NO: 1545687 - RNA, 19 nt, Homo sapiens
gcauggaucuaaggauuua

SEQ ID NO: 1545688 - RNA, 19 nt, Homo sapiens
ucagggcucuucucaaaua

SEQ ID NO: 1545689 - RNA, 19 nt, Homo sapiens
gcagaaaacuggugucuuu

SEQ ID NO: 1545690 - RNA, 19 nt, Homo sapiens
guaaggagaugauacuuca

SEQ ID NO: 1545691 - RNA, 19 nt, Homo sapiens
gaaacccugucucuacuaa

SEQ ID NO: 1545692 - RNA, 19 nt, Homo sapiens
gaaccagauucgaaguaua

SEQ ID NO: 1545693 - RNA, 19 nt, Homo sapiens
gaacuggaaggcuaugaua

SEQ ID NO: 1545694 - RNA, 19 nt, Homo sapiens
cauaaagucuguugccauu

SEQ ID NO: 1545695 - RNA, 19 nt, Homo sapiens
aaacaacaaucaccuuaga

SEQ ID NO: 1545696 - RNA, 19 nt, Homo sapiens
gagccgagaucaugccauu

SEQ ID NO: 1545697 - RNA, 19 nt, Homo sapiens
gaaacccugucucuacuga

SEQ ID NO: 1545698 - RNA, 19 nt, Homo sapiens
gaaccaacugggagcauua

SEQ ID NO: 1545699 - RNA, 19 nt, Homo sapiens
gcaggcagaucacgagguu

SEQ ID NO: 1545700 - RNA, 19 nt, Homo sapiens
ugauggaucucucuaagaa

SEQ ID NO: 1545701 - RNA, 19 nt, Homo sapiens
agacaagguucucuucaaa

SEQ ID NO: 1545702 - RNA, 19 nt, Homo sapiens
ggaaggcuaugauaaguac

SEQ ID NO: 1545703 - RNA, 19 nt, Homo sapiens
gaugauacuucaggagauu

SEQ ID NO: 1545704 - RNA, 19 nt, Homo sapiens
augcaacacuuguaagaua

SEQ ID NO: 1545705 - RNA, 19 nt, Homo sapiens
uuucagggcucuucucaaa

SEQ ID NO: 1545706 - RNA, 19 nt, Homo sapiens
gaauguggcugagucaaag

SEQ ID NO: 1545707 - RNA, 19 nt, Homo sapiens
cagcagaccucuaagaacu

SEQ ID NO: 1545708 - RNA, 19 nt, Homo sapiens
gcagugagccgagauuaug

SEQ ID NO: 1545709 - RNA, 19 nt, Homo sapiens
ggaauguggcugagucaaa

SEQ ID NO: 1545710 - RNA, 19 nt, Homo sapiens
gcaacucucugcccucaag

SEQ ID NO: 1545711 - RNA, 19 nt, Homo sapiens
ugacuguucugccugauga

SEQ ID NO: 1545712 - RNA, 19 nt, Homo sapiens
ggaaccaacugggagcauu

SEQ ID NO: 1545713 - RNA, 19 nt, Homo sapiens
gagcugccgucuaccuuug

SEQ ID NO: 1545714 - RNA, 19 nt, Homo sapiens
gcuccgcgcucauguggaa

SEQ ID NO: 1545715 - RNA, 19 nt, Homo sapiens
aggcugcgguagcaaauua

SEQ ID NO: 1545716 - RNA, 19 nt, Homo sapiens
gcagugagccgagaucaug

SEQ ID NO: 1545717 - RNA, 19 nt, Homo sapiens
caucauuaguuuggcuuua

SEQ ID NO: 1545718 - RNA, 19 nt, Homo sapiens
uaaagaaacuucgagaacu

SEQ ID NO: 1545719 - RNA, 19 nt, Homo sapiens
gugaaguucuccaggacua

SEQ ID NO: 1545720 - RNA, 19 nt, Homo sapiens
cuaaacaacaaucaccuua

SEQ ID NO: 1545721 - RNA, 19 nt, Homo sapiens
auggaaaccuuacaggaua

SEQ ID NO: 1545722 - RNA, 19 nt, Homo sapiens
uggcauggaucuaaggauu

SEQ ID NO: 1545723 - RNA, 19 nt, Homo sapiens
uagaaccucuguuggaaug

SEQ ID NO: 1545724 - RNA, 19 nt, Homo sapiens
aaagaaacuucgagaacug

SEQ ID NO: 1545725 - RNA, 19 nt, Homo sapiens
gaggaaacccugucucuac

SEQ ID NO: 1545726 - RNA, 19 nt, Homo sapiens
gucaaagccuccuguuguu

SEQ ID NO: 1545727 - RNA, 19 nt, Homo sapiens
ugacuuagaaccucuguug

SEQ ID NO: 1545728 - RNA, 19 nt, Homo sapiens
ucucagaucucagugaaga

SEQ ID NO: 1545729 - RNA, 19 nt, Homo sapiens
cuaaccaaauuaccuauca

SEQ ID NO: 1545730 - RNA, 19 nt, Homo sapiens
gacucugucucaaauuaaa

SEQ ID NO: 1545731 - RNA, 19 nt, Homo sapiens
acuggugucuuucagcuua

SEQ ID NO: 1545732 - RNA, 19 nt, Homo sapiens
auaaaugugugacuguuug

SEQ ID NO: 1545733 - RNA, 19 nt, Homo sapiens
caccacagcuugagauuuu

SEQ ID NO: 1545734 - RNA, 19 nt, Homo sapiens
gaaccucuguuggaaugug

SEQ ID NO: 1545735 - RNA, 19 nt, Homo sapiens
auaaguacauggagagguu

SEQ ID NO: 1545736 - RNA, 19 nt, Homo sapiens
gacuuuaggauguacauaa

SEQ ID NO: 1545737 - RNA, 19 nt, Homo sapiens
uagacaagguucucuucaa

SEQ ID NO: 1545738 - RNA, 19 nt, Homo sapiens
acaggauacugacuuagaa

SEQ ID NO: 1545739 - RNA, 19 nt, Homo sapiens
uauugcaggugccuuauug

SEQ ID NO: 1545740 - RNA, 19 nt, Homo sapiens
gcaggagaauugcuugaac

SEQ ID NO: 1545741 - RNA, 19 nt, Homo sapiens
gugagaggcuggcauggau

SEQ ID NO: 1545742 - RNA, 19 nt, Homo sapiens
cuuacaggauacugacuua

SEQ ID NO: 1545743 - RNA, 19 nt, Homo sapiens
guauaugcaacacuuguaa

SEQ ID NO: 1545744 - RNA, 19 nt, Homo sapiens
ucacagccaccaagaagaa

SEQ ID NO: 1545745 - RNA, 19 nt, Homo sapiens
gaacaacaacaaacugacu

SEQ ID NO: 1545746 - RNA, 19 nt, Homo sapiens
cagagcauccucagugauu

SEQ ID NO: 1545747 - RNA, 19 nt, Homo sapiens
cuagagacgcuaagccuaa

SEQ ID NO: 1545748 - RNA, 19 nt, Homo sapiens
ugcaacacuuguaagauaa

SEQ ID NO: 1545749 - RNA, 19 nt, Homo sapiens
gcaggagaaucgcuugaac

SEQ ID NO: 1545750 - RNA, 19 nt, Homo sapiens
ggaaacccugucucuacua

SEQ ID NO: 1545751 - RNA, 19 nt, Homo sapiens
gacuguuugucuugauuaa

SEQ ID NO: 1545752 - RNA, 19 nt, Homo sapiens
gcaccuggaugugauggau

SEQ ID NO: 1545753 - RNA, 19 nt, Homo sapiens
uaucaagcuuacucucuga

SEQ ID NO: 1545754 - RNA, 19 nt, Homo sapiens
ugcagaagcugacgagcaa

SEQ ID NO: 1545755 - RNA, 19 nt, Homo sapiens
ggugaaacccugucucuac

SEQ ID NO: 1545756 - RNA, 19 nt, Homo sapiens
ccuauaaucccagcacuuu

SEQ ID NO: 1545757 - RNA, 19 nt, Homo sapiens
cuacuaaccaaauuaccua

SEQ ID NO: 1545758 - RNA, 19 nt, Homo sapiens
ggugcugccugguaacaga

SEQ ID NO: 1545759 - RNA, 19 nt, Homo sapiens
ccaggacuauggaaaccuu

SEQ ID NO: 1545760 - RNA, 19 nt, Homo sapiens
gcaacacuuguaagauaaa

SEQ ID NO: 1545761 - RNA, 19 nt, Homo sapiens
gcuguguguucuuccguuu

SEQ ID NO: 1545762 - RNA, 19 nt, Homo sapiens
caaccagaaucagauaucu

SEQ ID NO: 1545763 - RNA, 19 nt, Homo sapiens
guguguuggugcaugcuua

SEQ ID NO: 1545764 - RNA, 19 nt, Homo sapiens
caaggcggguggcucacuu

SEQ ID NO: 1545765 - RNA, 19 nt, Homo sapiens
guucuuccguuucuuccuu

SEQ ID NO: 1545766 - RNA, 19 nt, Homo sapiens
cuuagaaccucuguuggaa

SEQ ID NO: 1545767 - RNA, 19 nt, Homo sapiens
ucuaagaaccagauucgaa

SEQ ID NO: 1545768 - RNA, 19 nt, Homo sapiens
uagagacgcuaagccuaaa

SEQ ID NO: 1545769 - RNA, 19 nt, Homo sapiens
ggcuaggaguucaagacua

SEQ ID NO: 1545770 - RNA, 19 nt, Homo sapiens
cauaaaugugugacuguuu

SEQ ID NO: 1545771 - RNA, 19 nt, Homo sapiens
agaaccagauucgaaguau

SEQ ID NO: 1545772 - RNA, 19 nt, Homo sapiens
cgccuuugcugauaggaaa

SEQ ID NO: 1545773 - RNA, 19 nt, Homo sapiens
aaaauuagcuggguguguu

SEQ ID NO: 1545774 - RNA, 19 nt, Homo sapiens
gccauuccaucucuguguu

SEQ ID NO: 1545775 - RNA, 19 nt, Homo sapiens
gcucuucucaaauaagcua

SEQ ID NO: 1545776 - RNA, 19 nt, Homo sapiens
caaagccuccuguuguugu

SEQ ID NO: 1545777 - RNA, 19 nt, Homo sapiens
gagccucucugggaaccaa

SEQ ID NO: 1545778 - RNA, 19 nt, Homo sapiens
ucugguaaccuuucccuuu

SEQ ID NO: 1545779 - RNA, 19 nt, Homo sapiens
gugaaacccugucucuacu

SEQ ID NO: 1545780 - RNA, 19 nt, Homo sapiens
guuggugcaugcuuauaau

SEQ ID NO: 1545781 - RNA, 19 nt, Homo sapiens
gugacuguuugucuugauu

SEQ ID NO: 1545782 - RNA, 19 nt, Homo sapiens
gcuaugauaaguacaugga

SEQ ID NO: 1545783 - RNA, 19 nt, Homo sapiens
aacccugucucuacugaaa

SEQ ID NO: 1545784 - RNA, 19 nt, Homo sapiens
ugacuguuugucuugauua

SEQ ID NO: 1545785 - RNA, 19 nt, Homo sapiens
uaaagucuguugccauucc

SEQ ID NO: 1545786 - RNA, 19 nt, Homo sapiens
gauauccagugacaucuaa

SEQ ID NO: 1545787 - RNA, 19 nt, Homo sapiens
caaaguucguuacaucaaa

SEQ ID NO: 1545788 - RNA, 19 nt, Homo sapiens
gaagagaaagaacaagaaa

SEQ ID NO: 1545789 - RNA, 19 nt, Homo sapiens
ugacaguguucaaguuaaa

SEQ ID NO: 1545790 - RNA, 19 nt, Homo sapiens
ggauguaugugacaguguu

SEQ ID NO: 1545791 - RNA, 19 nt, Homo sapiens
cagaggaagucacuaaauc

SEQ ID NO: 1545792 - RNA, 19 nt, Homo sapiens
ggaauuguaacacauauca

SEQ ID NO: 1545793 - RNA, 19 nt, Homo sapiens
ccagaugccugugggaauu

SEQ ID NO: 1545794 - RNA, 19 nt, Homo sapiens
ggaagagaaagaacaagaa

SEQ ID NO: 1545795 - RNA, 19 nt, Homo sapiens
cagaaucuuucccaacuug

SEQ ID NO: 1545796 - RNA, 19 nt, Homo sapiens
ccagugacaucuaacuuuc

SEQ ID NO: 1545797 - RNA, 19 nt, Homo sapiens
gaccacauccucauagaga

SEQ ID NO: 1545798 - RNA, 19 nt, Homo sapiens
caacgaccacauccucaua

SEQ ID NO: 1545799 - RNA, 19 nt, Homo sapiens
aaagugauauccagugaca

SEQ ID NO: 1545800 - RNA, 19 nt, Homo sapiens
ggugggagguuucuaggau

SEQ ID NO: 1545801 - RNA, 19 nt, Homo sapiens
acacauaucauuccaaagu

SEQ ID NO: 1545802 - RNA, 19 nt, Homo sapiens
cagcugaccuggccgagau

SEQ ID NO: 1545803 - RNA, 19 nt, Homo sapiens
uaacuuucauggauguaug

SEQ ID NO: 1545804 - RNA, 19 nt, Homo sapiens
ggaaccagacgcagaggaa

SEQ ID NO: 1545805 - RNA, 19 nt, Homo sapiens
gugacaguguucaaguuaa

SEQ ID NO: 1545806 - RNA, 19 nt, Homo sapiens
caaaagugauauccaguga

SEQ ID NO: 1545807 - RNA, 19 nt, Homo sapiens
ggaaccggccacagaagaa

SEQ ID NO: 1545808 - RNA, 19 nt, Homo sapiens
gaggaggacucagauaucg

SEQ ID NO: 1545809 - RNA, 19 nt, Homo sapiens
cagaggaaccggccacaga

SEQ ID NO: 1545810 - RNA, 19 nt, Homo sapiens
cacauaucauuccaaaguu

SEQ ID NO: 1545811 - RNA, 19 nt, Homo sapiens
ggaugaagaggcccaagau

SEQ ID NO: 1545812 - RNA, 19 nt, Homo sapiens
ccagaaucuuucccaacuu

SEQ ID NO: 1545813 - RNA, 19 nt, Homo sapiens
gcagaggugaagccaagaa

SEQ ID NO: 1545814 - RNA, 19 nt, Homo sapiens
auagagaaccgucaacuca

SEQ ID NO: 1545815 - RNA, 19 nt, Homo sapiens
ggaggaagaggaggaggaa

SEQ ID NO: 1545816 - RNA, 19 nt, Homo sapiens
acaucuaacuuucauggau

SEQ ID NO: 1545817 - RNA, 19 nt, Homo sapiens
ccaaaguucguuacaucaa

SEQ ID NO: 1545818 - RNA, 19 nt, Homo sapiens
ugugacaguguucaaguua

SEQ ID NO: 1545819 - RNA, 19 nt, Homo sapiens
gugggagguuucuaggauu

SEQ ID NO: 1545820 - RNA, 19 nt, Homo sapiens
ccagaggaagucacuaaau

SEQ ID NO: 1545821 - RNA, 19 nt, Homo sapiens
acauaucauuccaaaguuc

SEQ ID NO: 1545822 - RNA, 19 nt, Homo sapiens
cgaggaagagaaagaacaa

SEQ ID NO: 1545823 - RNA, 19 nt, Homo sapiens
gugggaauuguaacacaua

SEQ ID NO: 1545824 - RNA, 19 nt, Homo sapiens
gaugaagaggcccaagaug

SEQ ID NO: 1545825 - RNA, 19 nt, Homo sapiens
gggaugaagaggcccaaga

SEQ ID NO: 1545826 - RNA, 19 nt, Homo sapiens
ccgaggaggacucagauau

SEQ ID NO: 1545827 - RNA, 19 nt, Homo sapiens
uuccaaaguucguuacauc

SEQ ID NO: 1545828 - RNA, 19 nt, Homo sapiens
gcgaggaagagaaagaaca

SEQ ID NO: 1545829 - RNA, 19 nt, Homo sapiens
cgaggaggacucagauauc

SEQ ID NO: 1545830 - RNA, 19 nt, Homo sapiens
gaggaagucacuaaaucuc

SEQ ID NO: 1545831 - RNA, 19 nt, Homo sapiens
cuuagggugucgucugaga

SEQ ID NO: 1545832 - RNA, 19 nt, Homo sapiens
ucucagaggaggccacaga

SEQ ID NO: 1545833 - RNA, 19 nt, Homo sapiens
agaggaaccggccacagaa

SEQ ID NO: 1545834 - RNA, 19 nt, Homo sapiens
agacucuuauucccucaau

SEQ ID NO: 1545835 - RNA, 19 nt, Homo sapiens
uccagugacaucuaacuuu

SEQ ID NO: 1545836 - RNA, 19 nt, Homo sapiens
caaggugaagaacuccaaa

SEQ ID NO: 1545837 - RNA, 19 nt, Homo sapiens
ccucaguggucaccgucuu

SEQ ID NO: 1545838 - RNA, 19 nt, Homo sapiens
ggaagaggaggaggaagag

SEQ ID NO: 1545839 - RNA, 19 nt, Homo sapiens
cagaggugaagccaagaaa

SEQ ID NO: 1545840 - RNA, 19 nt, Homo sapiens
aggaagaggaggaggaaga

SEQ ID NO: 1545841 - RNA, 19 nt, Homo sapiens
aaaacaaggugaagaacuc

SEQ ID NO: 1545842 - RNA, 19 nt, Homo sapiens
ugggagguuucuaggauuc

SEQ ID NO: 1545843 - RNA, 19 nt, Homo sapiens
ugauauccagugacaucua

SEQ ID NO: 1545844 - RNA, 19 nt, Homo sapiens
ugggaauuguaacacauau

SEQ ID NO: 1545845 - RNA, 19 nt, Homo sapiens
aggaagagaaagaacaaga

SEQ ID NO: 1545846 - RNA, 19 nt, Homo sapiens
ugaagaggcccaagaugcu

SEQ ID NO: 1545847 - RNA, 19 nt, Homo sapiens
agaggaggccacagaggaa

SEQ ID NO: 1545848 - RNA, 19 nt, Homo sapiens
gaaucuuucccaacuuguc

SEQ ID NO: 1545849 - RNA, 19 nt, Homo sapiens
cagccuuggugggagguuu

SEQ ID NO: 1545850 - RNA, 19 nt, Homo sapiens
accagaaucuuucccaacu

SEQ ID NO: 1545851 - RNA, 19 nt, Homo sapiens
gaaagaaguugugugcaua

SEQ ID NO: 1545852 - RNA, 19 nt, Homo sapiens
gaaguugugugcauaucuu

SEQ ID NO: 1545853 - RNA, 19 nt, Homo sapiens
gcacagaagaacagaaaga

SEQ ID NO: 1545854 - RNA, 19 nt, Homo sapiens
gggaagaauuggauacauc

SEQ ID NO: 1545855 - RNA, 19 nt, Homo sapiens
gaucauuccaagucuauuu

SEQ ID NO: 1545856 - RNA, 19 nt, Homo sapiens
gaaacuucauccagcuaug

SEQ ID NO: 1545857 - RNA, 19 nt, Homo sapiens
agaaagaaguugugugcau

SEQ ID NO: 1545858 - RNA, 19 nt, Homo sapiens
gaaggaggcagcacagcuu

SEQ ID NO: 1545859 - RNA, 19 nt, Homo sapiens
gaacagaaagaaguugugu

SEQ ID NO: 1545860 - RNA, 19 nt, Homo sapiens
gcaagguggucaucaucuc

SEQ ID NO: 1545861 - RNA, 19 nt, Homo sapiens
cagaagaacagaaagaagu

SEQ ID NO: 1545862 - RNA, 19 nt, Homo sapiens
ggagaggaaguaagcauca

SEQ ID NO: 1545863 - RNA, 19 nt, Homo sapiens
gcaaauucagguauaucuu

SEQ ID NO: 1545864 - RNA, 19 nt, Homo sapiens
aauuuacccuugacauuug

SEQ ID NO: 1545865 - RNA, 19 nt, Homo sapiens
caagaugagccauuaaguc

SEQ ID NO: 1545866 - RNA, 19 nt, Homo sapiens
ggaaacuucauccagcuau

SEQ ID NO: 1545867 - RNA, 19 nt, Homo sapiens
gaagaacagaaagaaguug

SEQ ID NO: 1545868 - RNA, 19 nt, Homo sapiens
ggaagaauuggauacaucu

SEQ ID NO: 1545869 - RNA, 19 nt, Homo sapiens
guugugugcauaucuuuaa

SEQ ID NO: 1545870 - RNA, 19 nt, Homo sapiens
caacauccucccugugcuu

SEQ ID NO: 1545871 - RNA, 19 nt, Homo sapiens
gacaaccacauaccaggaa

SEQ ID NO: 1545872 - RNA, 19 nt, Homo sapiens
ccaaccaccagaacccuuu

SEQ ID NO: 1545873 - RNA, 19 nt, Homo sapiens
uuacagcagcaacauuaaa

SEQ ID NO: 1545874 - RNA, 19 nt, Homo sapiens
auccagcuaugucugauuu

SEQ ID NO: 1545875 - RNA, 19 nt, Homo sapiens
agaagaacagaaagaaguu

SEQ ID NO: 1545876 - RNA, 19 nt, Homo sapiens
ccaucuauaucaccuggau

SEQ ID NO: 1545877 - RNA, 19 nt, Homo sapiens
gggaucauuccaagucuau

SEQ ID NO: 1545878 - RNA, 19 nt, Homo sapiens
ucacaagaugagccauuaa

SEQ ID NO: 1545879 - RNA, 19 nt, Homo sapiens
ucaccuggaucaccaacca

SEQ ID NO: 1545880 - RNA, 19 nt, Homo sapiens
auuuacagcagcaacauua

SEQ ID NO: 1545881 - RNA, 19 nt, Homo sapiens
aucacaagaugagccauua

SEQ ID NO: 1545882 - RNA, 19 nt, Homo sapiens
aaccagcccugccaacauc

SEQ ID NO: 1545883 - RNA, 19 nt, Homo sapiens
ggugguggaugcagagacu

SEQ ID NO: 1545884 - RNA, 19 nt, Homo sapiens
aaagaaguugugugcauau

SEQ ID NO: 1545885 - RNA, 19 nt, Homo sapiens
cacagaagaacagaaagaa

SEQ ID NO: 1545886 - RNA, 19 nt, Homo sapiens
caucaccucaggcacagaa

SEQ ID NO: 1545887 - RNA, 19 nt, Homo sapiens
caagggcagcaucacaaga

SEQ ID NO: 1545888 - RNA, 19 nt, Homo sapiens
cuugacauuuggaaacuuc

SEQ ID NO: 1545889 - RNA, 19 nt, Homo sapiens
aggcacagaagaacagaaa

SEQ ID NO: 1545890 - RNA, 19 nt, Homo sapiens
caucagcaacuagaacguu

SEQ ID NO: 1545891 - RNA, 19 nt, Homo sapiens
uaaaccagcccugccaaca

SEQ ID NO: 1545892 - RNA, 19 nt, Homo sapiens
caccucaggcacagaagaa

SEQ ID NO: 1545893 - RNA, 19 nt, Homo sapiens
gaucaccaaccaccagaac

SEQ ID NO: 1545894 - RNA, 19 nt, Homo sapiens
gcagacagcuacaguauga

SEQ ID NO: 1545895 - RNA, 19 nt, Homo sapiens
gaagaaggccuacgaguug

SEQ ID NO: 1545896 - RNA, 19 nt, Homo sapiens
gauauucucuguuaugguu

SEQ ID NO: 1545897 - RNA, 19 nt, Homo sapiens
caaaguaaguggcuucaug

SEQ ID NO: 1545898 - RNA, 19 nt, Homo sapiens
gaagauggaaagcaaagua

SEQ ID NO: 1545899 - RNA, 19 nt, Homo sapiens
ccacaucacuucuguuaca

SEQ ID NO: 1545900 - RNA, 19 nt, Homo sapiens
ugaagaagauggaaagcaa

SEQ ID NO: 1545901 - RNA, 19 nt, Homo sapiens
gaucaaaucggccaaccua

SEQ ID NO: 1545902 - RNA, 19 nt, Homo sapiens
gcaguuagaugguguuugc

SEQ ID NO: 1545903 - RNA, 19 nt, Homo sapiens
gcaccacaguuguuucuag

SEQ ID NO: 1545904 - RNA, 19 nt, Homo sapiens
uaugguucgucaugaauua

SEQ ID NO: 1545905 - RNA, 19 nt, Homo sapiens
gucagucacuuucuauauu

SEQ ID NO: 1545906 - RNA, 19 nt, Homo sapiens
gaaccgagguacuacuuuu

SEQ ID NO: 1545907 - RNA, 19 nt, Homo sapiens
gaaggccuacagacacuua

SEQ ID NO: 1545908 - RNA, 19 nt, Homo sapiens
caugaaggccauaaacuuu

SEQ ID NO: 1545909 - RNA, 19 nt, Homo sapiens
caccagcgcuuucccucua

SEQ ID NO: 1545910 - RNA, 19 nt, Homo sapiens
uggaacuucuggaguguua

SEQ ID NO: 1545911 - RNA, 19 nt, Homo sapiens
cagaaaaccuggaggaauu

SEQ ID NO: 1545912 - RNA, 19 nt, Homo sapiens
uagaugguguuugcaauuu

SEQ ID NO: 1545913 - RNA, 19 nt, Homo sapiens
acacuuaggucauuacaac

SEQ ID NO: 1545914 - RNA, 19 nt, Homo sapiens
ucauaaacgugcugaguca

SEQ ID NO: 1545915 - RNA, 19 nt, Homo sapiens
gaagaagauggaaagcaaa

SEQ ID NO: 1545916 - RNA, 19 nt, Homo sapiens
gcccagaccuguuuguucu

SEQ ID NO: 1545917 - RNA, 19 nt, Homo sapiens
ugaagaaggccuacgaguu

SEQ ID NO: 1545918 - RNA, 19 nt, Homo sapiens
gcagcuccguucauuaagu

SEQ ID NO: 1545919 - RNA, 19 nt, Homo sapiens
cggcagcuccguucauuaa

SEQ ID NO: 1545920 - RNA, 19 nt, Homo sapiens
gaugguguuugcaauuuua

SEQ ID NO: 1545921 - RNA, 19 nt, Homo sapiens
ccacaguuguuucuagagu

SEQ ID NO: 1545922 - RNA, 19 nt, Homo sapiens
ccacagcaccacaguuguu

SEQ ID NO: 1545923 - RNA, 19 nt, Homo sapiens
gcauccaaauguacuucaa

SEQ ID NO: 1545924 - RNA, 19 nt, Homo sapiens
gaugcugcguccuugaaga

SEQ ID NO: 1545925 - RNA, 19 nt, Homo sapiens
caccacaguuguuucuaga

SEQ ID NO: 1545926 - RNA, 19 nt, Homo sapiens
aaaguaaguggcuucauga

SEQ ID NO: 1545927 - RNA, 19 nt, Homo sapiens
acagacacuuaggucauua

SEQ ID NO: 1545928 - RNA, 19 nt, Homo sapiens
caaaagcggagcaaaauga

SEQ ID NO: 1545929 - RNA, 19 nt, Homo sapiens
cagaaauaccggcagauau

SEQ ID NO: 1545930 - RNA, 19 nt, Homo sapiens
acagaaauaccggcagaua

SEQ ID NO: 1545931 - RNA, 19 nt, Homo sapiens
ggauaucgucaccaucuga

SEQ ID NO: 1545932 - RNA, 19 nt, Homo sapiens
gagaaccgagguacuacuu

SEQ ID NO: 1545933 - RNA, 19 nt, Homo sapiens
ccuacgaguugaucaaauc

SEQ ID NO: 1545934 - RNA, 19 nt, Homo sapiens
ugaaaugcauggagaucuc

SEQ ID NO: 1545935 - RNA, 19 nt, Homo sapiens
gagcgaggacugcauccaa

SEQ ID NO: 1545936 - RNA, 19 nt, Homo sapiens
guuucuagaguccaauuua

SEQ ID NO: 1545937 - RNA, 19 nt, Homo sapiens
gcacaguugcaguuagaug

SEQ ID NO: 1545938 - RNA, 19 nt, Homo sapiens
aaagaaaggaagagcaguu

SEQ ID NO: 1545939 - RNA, 19 nt, Homo sapiens
uacagacacuuaggucauu

SEQ ID NO: 1545940 - RNA, 19 nt, Homo sapiens
aaaauugcgugacugagua

SEQ ID NO: 1545941 - RNA, 19 nt, Homo sapiens
gaacuucuggaguguuauc

SEQ ID NO: 1545942 - RNA, 19 nt, Homo sapiens
gauggaaagcaaaguaagu

SEQ ID NO: 1545943 - RNA, 19 nt, Homo sapiens
cagccuuucccaaaucaua

SEQ ID NO: 1545944 - RNA, 19 nt, Homo sapiens
caguauaguguuaugauug

SEQ ID NO: 1545945 - RNA, 19 nt, Homo sapiens
agacagcuacaguaugaaa

SEQ ID NO: 1545946 - RNA, 19 nt, Homo sapiens
gcccguuucucuuuaccuu

SEQ ID NO: 1545947 - RNA, 19 nt, Homo sapiens
guuagaugguguuugcaau

SEQ ID NO: 1545948 - RNA, 19 nt, Homo sapiens
gccgagagccagcaagaug

SEQ ID NO: 1545949 - RNA, 19 nt, Homo sapiens
gagcugaugcuggaacuuc

SEQ ID NO: 1545950 - RNA, 19 nt, Homo sapiens
gaggacugcauccaaaugu

SEQ ID NO: 1545951 - RNA, 19 nt, Homo sapiens
ccaaaggagaaccgaggua

SEQ ID NO: 1545952 - RNA, 19 nt, Homo sapiens
agccacaucacuucuguua

SEQ ID NO: 1545953 - RNA, 19 nt, Homo sapiens
ggacugcauccaaauguac

SEQ ID NO: 1545954 - RNA, 19 nt, Homo sapiens
cuagggaaaucggaguuug

SEQ ID NO: 1545955 - RNA, 19 nt, Homo sapiens
guccacagcaccacaguug

SEQ ID NO: 1545956 - RNA, 19 nt, Homo sapiens
guccgugguuggcacauug

SEQ ID NO: 1545957 - RNA, 19 nt, Homo sapiens
guacaugaaggccauaaac

SEQ ID NO: 1545958 - RNA, 19 nt, Homo sapiens
gcacauugccgucuuuccu

SEQ ID NO: 1545959 - RNA, 19 nt, Homo sapiens
uccauuagccugucaguca

SEQ ID NO: 1545960 - RNA, 19 nt, Homo sapiens
ugaauuaauggacgaacuu

SEQ ID NO: 1545961 - RNA, 19 nt, Homo sapiens
aaggagaaccgagguacua

SEQ ID NO: 1545962 - RNA, 19 nt, Homo sapiens
gaaaauugcgugacugagu

SEQ ID NO: 1545963 - RNA, 19 nt, Homo sapiens
guuacaguauaguguuaug

SEQ ID NO: 1545964 - RNA, 19 nt, Homo sapiens
caccugcccguuucucuuu

SEQ ID NO: 1545965 - RNA, 19 nt, Homo sapiens
gaaaggaagagcaguucac

SEQ ID NO: 1545966 - RNA, 19 nt, Homo sapiens
ugaggaaggccuacagaca

SEQ ID NO: 1545967 - RNA, 19 nt, Homo sapiens
ccucaagccuggauaucgu

SEQ ID NO: 1545968 - RNA, 19 nt, Homo sapiens
acaugaaggccauaaacuu

SEQ ID NO: 1545969 - RNA, 19 nt, Homo sapiens
ggccacagccacaucacuu

SEQ ID NO: 1545970 - RNA, 19 nt, Homo sapiens
aagaaggccuacgaguuga

SEQ ID NO: 1545971 - RNA, 19 nt, Homo sapiens
cagcuccguucauuaaguc

SEQ ID NO: 1545972 - RNA, 19 nt, Homo sapiens
aaaccuggaggaauuugaa

SEQ ID NO: 1545973 - RNA, 19 nt, Homo sapiens
aggacugcauccaaaugua

SEQ ID NO: 1545974 - RNA, 19 nt, Homo sapiens
aagauggaaagcaaaguaa

SEQ ID NO: 1545975 - RNA, 19 nt, Homo sapiens
gccugucagucacuuucua

SEQ ID NO: 1545976 - RNA, 19 nt, Homo sapiens
cuucagcccagaccuguuu

SEQ ID NO: 1545977 - RNA, 19 nt, Homo sapiens
agacugaggaggaagacaa

SEQ ID NO: 1545978 - RNA, 19 nt, Homo sapiens
guuacccgcaguucacuuu

SEQ ID NO: 1545979 - RNA, 19 nt, Homo sapiens
ccguuucucuuuaccuuuc

SEQ ID NO: 1545980 - RNA, 19 nt, Homo sapiens
gaccugaagaagauggaaa

SEQ ID NO: 1545981 - RNA, 19 nt, Homo sapiens
uguuaugguucgucaugaa

SEQ ID NO: 1545982 - RNA, 19 nt, Homo sapiens
uuagaugguguuugcaauu

SEQ ID NO: 1545983 - RNA, 19 nt, Homo sapiens
gguccgugguuggcacauu

SEQ ID NO: 1545984 - RNA, 19 nt, Homo sapiens
ugucagucacuuucuauau

SEQ ID NO: 1545985 - RNA, 19 nt, Homo sapiens
gaauuaauggacgaacuuc

SEQ ID NO: 1545986 - RNA, 19 nt, Homo sapiens
gcuggaacuucuggagugu

SEQ ID NO: 1545987 - RNA, 19 nt, Homo sapiens
ccaccagucccauuauugg

SEQ ID NO: 1545988 - RNA, 19 nt, Homo sapiens
gugcagggcccagaugugu

SEQ ID NO: 1545989 - RNA, 19 nt, Homo sapiens
ggacaaaaggcaaagaaag

SEQ ID NO: 1545990 - RNA, 19 nt, Homo sapiens
ugaaggccauaaacuuugc

SEQ ID NO: 1545991 - RNA, 19 nt, Homo sapiens
gguucgucaugaauuaaug

SEQ ID NO: 1545992 - RNA, 19 nt, Homo sapiens
agcgaggacugcauccaaa

SEQ ID NO: 1545993 - RNA, 19 nt, Homo sapiens
cagcuacaguaugaaaaua

SEQ ID NO: 1545994 - RNA, 19 nt, Homo sapiens
gaaagcugcucuucaauga

SEQ ID NO: 1545995 - RNA, 19 nt, Homo sapiens
gcaaggaacuuaucaaacu

SEQ ID NO: 1545996 - RNA, 19 nt, Homo sapiens
gaauuaagcuuuacaugag

SEQ ID NO: 1545997 - RNA, 19 nt, Homo sapiens
gcaagcagguuaacaagga

SEQ ID NO: 1545998 - RNA, 19 nt, Homo sapiens
gaaauccaguacuuuggua

SEQ ID NO: 1545999 - RNA, 19 nt, Homo sapiens
gaaagagguuuacccacuu

SEQ ID NO: 1546000 - RNA, 19 nt, Homo sapiens
cuacuuuggugcuaaauaa

SEQ ID NO: 1546001 - RNA, 19 nt, Homo sapiens
gaacaugccaucaaacugu

SEQ ID NO: 1546002 - RNA, 19 nt, Homo sapiens
cagaaaagcugaaucaauu

SEQ ID NO: 1546003 - RNA, 19 nt, Homo sapiens
gauuucagcuguucuacuu

SEQ ID NO: 1546004 - RNA, 19 nt, Homo sapiens
cgaauuaagcuuuacauga

SEQ ID NO: 1546005 - RNA, 19 nt, Homo sapiens
aagaagaacugacauugga

SEQ ID NO: 1546006 - RNA, 19 nt, Homo sapiens
cagagacacuuaugacaga

SEQ ID NO: 1546007 - RNA, 19 nt, Homo sapiens
aaccaaaucugugaaguuu

SEQ ID NO: 1546008 - RNA, 19 nt, Homo sapiens
cgucuuggauucagaacua

SEQ ID NO: 1546009 - RNA, 19 nt, Homo sapiens
gcaaauauacuucgaaagc

SEQ ID NO: 1546010 - RNA, 19 nt, Homo sapiens
gcccuaggcucucaauaug

SEQ ID NO: 1546011 - RNA, 19 nt, Homo sapiens
acagugggauuaucagaaa

SEQ ID NO: 1546012 - RNA, 19 nt, Homo sapiens
agacuuguguugagguuaa

SEQ ID NO: 1546013 - RNA, 19 nt, Homo sapiens
gcccaaaucuguguaaugg

SEQ ID NO: 1546014 - RNA, 19 nt, Homo sapiens
ccuacuaacuaaagaagaa

SEQ ID NO: 1546015 - RNA, 19 nt, Homo sapiens
guagaugcuucaccuccua

SEQ ID NO: 1546016 - RNA, 19 nt, Homo sapiens
caaggaacuuaucaaacuu

SEQ ID NO: 1546017 - RNA, 19 nt, Homo sapiens
gaauuaccagagacacuua

SEQ ID NO: 1546018 - RNA, 19 nt, Homo sapiens
gccaguugguggaauauga

SEQ ID NO: 1546019 - RNA, 19 nt, Homo sapiens
gacaauaacugagggaacu

SEQ ID NO: 1546020 - RNA, 19 nt, Homo sapiens
uaaagaagaacugacauug

SEQ ID NO: 1546021 - RNA, 19 nt, Homo sapiens
ugagaaggcuacuuugucu

SEQ ID NO: 1546022 - RNA, 19 nt, Homo sapiens
guccugaauucuauuggua

SEQ ID NO: 1546023 - RNA, 19 nt, Homo sapiens
ccaacuaugucaucaguac

SEQ ID NO: 1546024 - RNA, 19 nt, Homo sapiens
ggacacagaccucauuagg

SEQ ID NO: 1546025 - RNA, 19 nt, Homo sapiens
gcaaacauugugaaucuca

SEQ ID NO: 1546026 - RNA, 19 nt, Homo sapiens
aauccuaucugguccuuga

SEQ ID NO: 1546027 - RNA, 19 nt, Homo sapiens
gagcacgucuucaggaacu

SEQ ID NO: 1546028 - RNA, 19 nt, Homo sapiens
caaccaaaucugugaaguu

SEQ ID NO: 1546029 - RNA, 19 nt, Homo sapiens
cagcaaggaacuuaucaaa

SEQ ID NO: 1546030 - RNA, 19 nt, Homo sapiens
gaagugauggcuacagcaa

SEQ ID NO: 1546031 - RNA, 19 nt, Homo sapiens
uccaaggguuguaacauuu

SEQ ID NO: 1546032 - RNA, 19 nt, Homo sapiens
ucacauagacccucagaag

SEQ ID NO: 1546033 - RNA, 19 nt, Homo sapiens
augcugagauucaagcuaa

SEQ ID NO: 1546034 - RNA, 19 nt, Homo sapiens
uaacaagacccugauggaa

SEQ ID NO: 1546035 - RNA, 19 nt, Homo sapiens
gccaagcgauucugauucu

SEQ ID NO: 1546036 - RNA, 19 nt, Homo sapiens
caaggguuguaacauuuga

SEQ ID NO: 1546037 - RNA, 19 nt, Homo sapiens
ugagauugcuguaaaugag

SEQ ID NO: 1546038 - RNA, 19 nt, Homo sapiens
aggcagagcuuugcaagug

SEQ ID NO: 1546039 - RNA, 19 nt, Homo sapiens
cgaaagcugcucuucaaug

SEQ ID NO: 1546040 - RNA, 19 nt, Homo sapiens
ugagacaaauauuccaugu

SEQ ID NO: 1546041 - RNA, 19 nt, Homo sapiens
cugaauaaaugaugugaag

SEQ ID NO: 1546042 - RNA, 19 nt, Homo sapiens
acaagacccugauggaaag

SEQ ID NO: 1546043 - RNA, 19 nt, Homo sapiens
caacauggugggugcuauu

SEQ ID NO: 1546044 - RNA, 19 nt, Homo sapiens
aaacuugacucuugcucau

SEQ ID NO: 1546045 - RNA, 19 nt, Homo sapiens
cacuuuaaaugcugagauu

SEQ ID NO: 1546046 - RNA, 19 nt, Homo sapiens
cuccaaggguuguaacauu

SEQ ID NO: 1546047 - RNA, 19 nt, Homo sapiens
uuaaaggguugaagguugu

SEQ ID NO: 1546048 - RNA, 19 nt, Homo sapiens
gacguaaacaucacauaga

SEQ ID NO: 1546049 - RNA, 19 nt, Homo sapiens
gaaguccugaauucuauug

SEQ ID NO: 1546050 - RNA, 19 nt, Homo sapiens
gccugccugucccuaauua

SEQ ID NO: 1546051 - RNA, 19 nt, Homo sapiens
caaauggacauggccaauu

SEQ ID NO: 1546052 - RNA, 19 nt, Homo sapiens
cucaugagauugcuguaaa

SEQ ID NO: 1546053 - RNA, 19 nt, Homo sapiens
cugauguucugaauaaaug

SEQ ID NO: 1546054 - RNA, 19 nt, Homo sapiens
cauuagagauccagcacau

SEQ ID NO: 1546055 - RNA, 19 nt, Homo sapiens
uugaaggcaugaacaaaga

SEQ ID NO: 1546056 - RNA, 19 nt, Homo sapiens
ggccaacuaugucaucagu

SEQ ID NO: 1546057 - RNA, 19 nt, Homo sapiens
cuaaagaagaacugacauu

SEQ ID NO: 1546058 - RNA, 19 nt, Homo sapiens
caacaaacaaguguaugga

SEQ ID NO: 1546059 - RNA, 19 nt, Homo sapiens
cuauugguauucagacuug

SEQ ID NO: 1546060 - RNA, 19 nt, Homo sapiens
ggaggugcugagacaaaua

SEQ ID NO: 1546061 - RNA, 19 nt, Homo sapiens
gcaaccaaaucugugaagu

SEQ ID NO: 1546062 - RNA, 19 nt, Homo sapiens
gacucuugcucaugagauu

SEQ ID NO: 1546063 - RNA, 19 nt, Homo sapiens
uaacugagggaacugaugu

SEQ ID NO: 1546064 - RNA, 19 nt, Homo sapiens
aguauuagcccaaaucugu

SEQ ID NO: 1546065 - RNA, 19 nt, Homo sapiens
caaauauacuucgaaagcu

SEQ ID NO: 1546066 - RNA, 19 nt, Homo sapiens
uacaugagaaggcuacuuu

SEQ ID NO: 1546067 - RNA, 19 nt, Homo sapiens
ggcagagcuuugcaaguga

SEQ ID NO: 1546068 - RNA, 19 nt, Homo sapiens
uguaacauuugaugaagug

SEQ ID NO: 1546069 - RNA, 19 nt, Homo sapiens
ucagaagacguaaacauca

SEQ ID NO: 1546070 - RNA, 19 nt, Homo sapiens
ccaguccacuuccauugau

SEQ ID NO: 1546071 - RNA, 19 nt, Homo sapiens
ggaaauccaguacuuuggu

SEQ ID NO: 1546072 - RNA, 19 nt, Homo sapiens
caaacauugugaaucucaa

SEQ ID NO: 1546073 - RNA, 19 nt, Homo sapiens
cauggugggugcuauuaca

SEQ ID NO: 1546074 - RNA, 19 nt, Homo sapiens
uggcuucgcucagugacua

SEQ ID NO: 1546075 - RNA, 19 nt, Homo sapiens
acacacacaucacauagac

SEQ ID NO: 1546076 - RNA, 19 nt, Homo sapiens
aacaagacccugauggaaa

SEQ ID NO: 1546077 - RNA, 19 nt, Homo sapiens
gaaggcaugaacaaagaga

SEQ ID NO: 1546078 - RNA, 19 nt, Homo sapiens
gaauaugagagaaccaagu

SEQ ID NO: 1546079 - RNA, 19 nt, Homo sapiens
gaggugcugagacaaauau

SEQ ID NO: 1546080 - RNA, 19 nt, Homo sapiens
gguuguaacauuugaugaa

SEQ ID NO: 1546081 - RNA, 19 nt, Homo sapiens
gaagacacacacaucacau

SEQ ID NO: 1546082 - RNA, 19 nt, Homo sapiens
aaauccagcucuccugcuu

SEQ ID NO: 1546083 - RNA, 19 nt, Homo sapiens
uucgaaagcugcucuucaa

SEQ ID NO: 1546084 - RNA, 19 nt, Homo sapiens
ggacgucuuggauucagaa

SEQ ID NO: 1546085 - RNA, 19 nt, Homo sapiens
gcucaugagauugcuguaa

SEQ ID NO: 1546086 - RNA, 19 nt, Homo sapiens
cagccaagcgauucugauu

SEQ ID NO: 1546087 - RNA, 19 nt, Homo sapiens
ugacauuggacgagagauu

SEQ ID NO: 1546088 - RNA, 19 nt, Homo sapiens
augcaaacauugugaaucu

SEQ ID NO: 1546089 - RNA, 19 nt, Homo sapiens
uuguugggcuggugaguuu

SEQ ID NO: 1546090 - RNA, 19 nt, Homo sapiens
gguauucagacuuguguug

SEQ ID NO: 1546091 - RNA, 19 nt, Homo sapiens
ccugaauucuauugguauu

SEQ ID NO: 1546092 - RNA, 19 nt, Homo sapiens
gcaaaaugcccuucaaugg

SEQ ID NO: 1546093 - RNA, 19 nt, Homo sapiens
uuucagcuguucuacuuga

SEQ ID NO: 1546094 - RNA, 19 nt, Homo sapiens
uaaagaauguggcaaauca

SEQ ID NO: 1546095 - RNA, 19 nt, Homo sapiens
caacauaagagaacucaua

SEQ ID NO: 1546096 - RNA, 19 nt, Homo sapiens
gaacauaagagaauucaug

SEQ ID NO: 1546097 - RNA, 19 nt, Homo sapiens
ugucacaucuuacugaaua

SEQ ID NO: 1546098 - RNA, 19 nt, Homo sapiens
gagaaacucuacacaugaa

SEQ ID NO: 1546099 - RNA, 19 nt, Homo sapiens
ucagagaguuuguacuuaa

SEQ ID NO: 1546100 - RNA, 19 nt, Homo sapiens
cuacaaaugugaagaaugu

SEQ ID NO: 1546101 - RNA, 19 nt, Homo sapiens
cuacaaaugugaagaaugu

SEQ ID NO: 1546102 - RNA, 19 nt, Homo sapiens
gaaaugguauuggugagaa

SEQ ID NO: 1546103 - RNA, 19 nt, Homo sapiens
gagagaaacccuacaaaug

SEQ ID NO: 1546104 - RNA, 19 nt, Homo sapiens
ggagagaaacccuacauau

SEQ ID NO: 1546105 - RNA, 19 nt, Homo sapiens
gauaagauauacuggagau

SEQ ID NO: 1546106 - RNA, 19 nt, Homo sapiens
ggagagaaacccuacauau

SEQ ID NO: 1546107 - RNA, 19 nt, Homo sapiens
gcacaugauagcauuuaua

SEQ ID NO: 1546108 - RNA, 19 nt, Homo sapiens
gcaacucaaucuguucuaa

SEQ ID NO: 1546109 - RNA, 19 nt, Homo sapiens
ccacaacucuuacgacaca

SEQ ID NO: 1546110 - RNA, 19 nt, Homo sapiens
gagaaacccuacaaaugug

SEQ ID NO: 1546111 - RNA, 19 nt, Homo sapiens
gagaaacccuacauaugug

SEQ ID NO: 1546112 - RNA, 19 nt, Homo sapiens
gagagaaacccuacauaug

SEQ ID NO: 1546113 - RNA, 19 nt, Homo sapiens
gagagaaacccuacauaug

SEQ ID NO: 1546114 - RNA, 19 nt, Homo sapiens
gagaaacccuacacaugug

SEQ ID NO: 1546115 - RNA, 19 nt, Homo sapiens
gagagaaacccuacacaug

SEQ ID NO: 1546116 - RNA, 19 nt, Homo sapiens
gguccucaauucuuacuaa

SEQ ID NO: 1546117 - RNA, 19 nt, Homo sapiens
aaacaguccucacacuuga

SEQ ID NO: 1546118 - RNA, 19 nt, Homo sapiens
cuacaagugugaagaaugu

SEQ ID NO: 1546119 - RNA, 19 nt, Homo sapiens
ggagagaaacccuacaaau

SEQ ID NO: 1546120 - RNA, 19 nt, Homo sapiens
uaagagaaaugguauuggu

SEQ ID NO: 1546121 - RNA, 19 nt, Homo sapiens
ccaaugcucauaucucuuu

SEQ ID NO: 1546122 - RNA, 19 nt, Homo sapiens
ccucacaccuuacuaaaca

SEQ ID NO: 1546123 - RNA, 19 nt, Homo sapiens
uagauaaacccuacaaaug

SEQ ID NO: 1546124 - RNA, 19 nt, Homo sapiens
cuacucauguguuacuaaa

SEQ ID NO: 1546125 - RNA, 19 nt, Homo sapiens
cuuauuaacuacccagaaa

SEQ ID NO: 1546126 - RNA, 19 nt, Homo sapiens
agagaaacccuacauaugu

SEQ ID NO: 1546127 - RNA, 19 nt, Homo sapiens
gcaaaccugcauaaucgua

SEQ ID NO: 1546128 - RNA, 19 nt, Homo sapiens
agagaaacccuacaaaugu

SEQ ID NO: 1546129 - RNA, 19 nt, Homo sapiens
ccucaacccuuaauuuaca

SEQ ID NO: 1546130 - RNA, 19 nt, Homo sapiens
agagaaacccuacauaugu

SEQ ID NO: 1546131 - RNA, 19 nt, Homo sapiens
acacauaagagaauccaua

SEQ ID NO: 1546132 - RNA, 19 nt, Homo sapiens
gaauguggcaaugucuuua

SEQ ID NO: 1546133 - RNA, 19 nt, Homo sapiens
cgaagaauguggcaauguc

SEQ ID NO: 1546134 - RNA, 19 nt, Homo sapiens
ccucaauucuuacuaaaca

SEQ ID NO: 1546135 - RNA, 19 nt, Homo sapiens
aaccaauccucaacccuua

SEQ ID NO: 1546136 - RNA, 19 nt, Homo sapiens
gaacucauacuggaggaaa

SEQ ID NO: 1546137 - RNA, 19 nt, Homo sapiens
uaaacaguccucacacuug

SEQ ID NO: 1546138 - RNA, 19 nt, Homo sapiens
ccucagacuuugcuaaaca

SEQ ID NO: 1546139 - RNA, 19 nt, Homo sapiens
uaucagagaguuuguacuu

SEQ ID NO: 1546140 - RNA, 19 nt, Homo sapiens
gaagaaugugggagccuuu

SEQ ID NO: 1546141 - RNA, 19 nt, Homo sapiens
agauaaacccuacaaaugu

SEQ ID NO: 1546142 - RNA, 19 nt, Homo sapiens
ggaaaauccuuuaauaggu

SEQ ID NO: 1546143 - RNA, 19 nt, Homo sapiens
cauaagagaauucauacug

SEQ ID NO: 1546144 - RNA, 19 nt, Homo sapiens
gcaaaaccuuuaaccaaug

SEQ ID NO: 1546145 - RNA, 19 nt, Homo sapiens
cagaaaaccccuaggaaua

SEQ ID NO: 1546146 - RNA, 19 nt, Homo sapiens
acgccuaacucaacacaaa

SEQ ID NO: 1546147 - RNA, 19 nt, Homo sapiens
gaaaaccccuaggaauauu

SEQ ID NO: 1546148 - RNA, 19 nt, Homo sapiens
caacucaaucuguucuaaa

SEQ ID NO: 1546149 - RNA, 19 nt, Homo sapiens
caaccuuccucaacauaag

SEQ ID NO: 1546150 - RNA, 19 nt, Homo sapiens
ccucaacccuuaauguaca

SEQ ID NO: 1546151 - RNA, 19 nt, Homo sapiens
agagaaacccuacacaugu

SEQ ID NO: 1546152 - RNA, 19 nt, Homo sapiens
ggagagaaacccuacacau

SEQ ID NO: 1546153 - RNA, 19 nt, Homo sapiens
uaccacauccucagacuuu

SEQ ID NO: 1546154 - RNA, 19 nt, Homo sapiens
aaaugcuugucacaucuua

SEQ ID NO: 1546155 - RNA, 19 nt, Homo sapiens
cauaagagaacucauacug

SEQ ID NO: 1546156 - RNA, 19 nt, Homo sapiens
cauaagagaauccauacug

SEQ ID NO: 1546157 - RNA, 19 nt, Homo sapiens
cauaagagaaaugguauug

SEQ ID NO: 1546158 - RNA, 19 nt, Homo sapiens
caacucuuacgacacauaa

SEQ ID NO: 1546159 - RNA, 19 nt, Homo sapiens
ucauaucucuuugcacaug

SEQ ID NO: 1546160 - RNA, 19 nt, Homo sapiens
ucaaaugcuugucacaucu

SEQ ID NO: 1546161 - RNA, 19 nt, Homo sapiens
cagagaguuuguacuuaau

SEQ ID NO: 1546162 - RNA, 19 nt, Homo sapiens
cuaaauaucagagaguuug

SEQ ID NO: 1546163 - RNA, 19 nt, Homo sapiens
ccucacacuugaauaaaca

SEQ ID NO: 1546164 - RNA, 19 nt, Homo sapiens
ccuuuaaaguguuugcaaa

SEQ ID NO: 1546165 - RNA, 19 nt, Homo sapiens
gguccucacaccuuacuaa

SEQ ID NO: 1546166 - RNA, 19 nt, Homo sapiens
gaaauucuacaagugugaa

SEQ ID NO: 1546167 - RNA, 19 nt, Homo sapiens
uuuaauagguccacaacuc

SEQ ID NO: 1546168 - RNA, 19 nt, Homo sapiens
agacuuugcuaaacauaag

SEQ ID NO: 1546169 - RNA, 19 nt, Homo sapiens
acucgguccucacaccuua

SEQ ID NO: 1546170 - RNA, 19 nt, Homo sapiens
ggcaaaaccuuuaaccaau

SEQ ID NO: 1546171 - RNA, 19 nt, Homo sapiens
uaagucuuccucagucuuu

SEQ ID NO: 1546172 - RNA, 19 nt, Homo sapiens
caaaccugcauaaucguaa

SEQ ID NO: 1546173 - RNA, 19 nt, Homo sapiens
ggaaaagccuucaaaugcu

SEQ ID NO: 1546174 - RNA, 19 nt, Homo sapiens
guccucaacccuuaaugua

SEQ ID NO: 1546175 - RNA, 19 nt, Homo sapiens
cauaagagaauucauacag

SEQ ID NO: 1546176 - RNA, 19 nt, Homo sapiens
ucacaccuuacuaaacaua

SEQ ID NO: 1546177 - RNA, 19 nt, Homo sapiens
gaauucauacuggagagaa

SEQ ID NO: 1546178 - RNA, 19 nt, Homo sapiens
aauugguccucaacccuua

SEQ ID NO: 1546179 - RNA, 19 nt, Homo sapiens
gaauucauacuggagagaa

SEQ ID NO: 1546180 - RNA, 19 nt, Homo sapiens
aaugccuacucauguguua

SEQ ID NO: 1546181 - RNA, 19 nt, Homo sapiens
gauagcauuuauacuugag

SEQ ID NO: 1546182 - RNA, 19 nt, Homo sapiens
aauagguccacaacucuua

SEQ ID NO: 1546183 - RNA, 19 nt, Homo sapiens
aaccaaugcucauaucucu

SEQ ID NO: 1546184 - RNA, 19 nt, Homo sapiens
gcagaaaaccccuaggaau

SEQ ID NO: 1546185 - RNA, 19 nt, Homo sapiens
ccaaccuuccucaacauaa

SEQ ID NO: 1546186 - RNA, 19 nt, Homo sapiens
guaaagaauguggcaaauc

SEQ ID NO: 1546187 - RNA, 19 nt, Homo sapiens
ccauuaaugccuacucaug

SEQ ID NO: 1546188 - RNA, 19 nt, Homo sapiens
guccucaauucuuacuaaa

SEQ ID NO: 1546189 - RNA, 19 nt, Homo sapiens
gaauucaugccagagagaa

SEQ ID NO: 1546190 - RNA, 19 nt, Homo sapiens
gaauucaugcuggagagaa

SEQ ID NO: 1546191 - RNA, 19 nt, Homo sapiens
aagugguccucaucccuua

SEQ ID NO: 1546192 - RNA, 19 nt, Homo sapiens
aauccucaacccuuaauuu

SEQ ID NO: 1546193 - RNA, 19 nt, Homo sapiens
gugggagccuuuaagucuu

SEQ ID NO: 1546194 - RNA, 19 nt, Homo sapiens
gcucuaagaucuucuauuu

SEQ ID NO: 1546195 - RNA, 19 nt, Homo sapiens
ggaaagcucuaagaucuuc

SEQ ID NO: 1546196 - RNA, 19 nt, Homo sapiens
ccagagaaccaaacagaaa

SEQ ID NO: 1546197 - RNA, 19 nt, Homo sapiens
gagagaagauugucauucc

SEQ ID NO: 1546198 - RNA, 19 nt, Homo sapiens
ccuggaggcuuaugugaaa

SEQ ID NO: 1546199 - RNA, 19 nt, Homo sapiens
ccacguggcuugggaacuu

SEQ ID NO: 1546200 - RNA, 19 nt, Homo sapiens
gaagaagaccugggccaaa

SEQ ID NO: 1546201 - RNA, 19 nt, Homo sapiens
gcagagggcccaggugauu

SEQ ID NO: 1546202 - RNA, 19 nt, Homo sapiens
caauggacacgucaacuuu

SEQ ID NO: 1546203 - RNA, 19 nt, Homo sapiens
ggugacaugugccacuuug

SEQ ID NO: 1546204 - RNA, 19 nt, Homo sapiens
ugaggauggucuuuauuug

SEQ ID NO: 1546205 - RNA, 19 nt, Homo sapiens
gugaggauggucuuuauuu

SEQ ID NO: 1546206 - RNA, 19 nt, Homo sapiens
caucaaagacaucuacuuc

SEQ ID NO: 1546207 - RNA, 19 nt, Homo sapiens
caucgggccugaggaguuu

SEQ ID NO: 1546208 - RNA, 19 nt, Homo sapiens
gaaagugagagcccagaga

SEQ ID NO: 1546209 - RNA, 19 nt, Homo sapiens
gucuuuauuuggcuucuua

SEQ ID NO: 1546210 - RNA, 19 nt, Homo sapiens
gggaauuucugcaacuaca

SEQ ID NO: 1546211 - RNA, 19 nt, Homo sapiens
agaagauugucauuccuuu

SEQ ID NO: 1546212 - RNA, 19 nt, Homo sapiens
gagcaagacgccagcauca

SEQ ID NO: 1546213 - RNA, 19 nt, Homo sapiens
gggcccaggugauugaguu

SEQ ID NO: 1546214 - RNA, 19 nt, Homo sapiens
gagauggcccugcccagaa

SEQ ID NO: 1546215 - RNA, 19 nt, Homo sapiens
caacuucaacucccucaug

SEQ ID NO: 1546216 - RNA, 19 nt, Homo sapiens
gaaagauggaaagcucuaa

SEQ ID NO: 1546217 - RNA, 19 nt, Homo sapiens
gacaucuacuuccugaaug

SEQ ID NO: 1546218 - RNA, 19 nt, Homo sapiens
cagaaaggccagagcaaga

SEQ ID NO: 1546219 - RNA, 19 nt, Homo sapiens
cagugaggauggucuuuau

SEQ ID NO: 1546220 - RNA, 19 nt, Homo sapiens
gagaagauugucauuccuu

SEQ ID NO: 1546221 - RNA, 19 nt, Homo sapiens
aggcuuaugugaaaugguu

SEQ ID NO: 1546222 - RNA, 19 nt, Homo sapiens
gaacgcgucagcaggacaa

SEQ ID NO: 1546223 - RNA, 19 nt, Homo sapiens
gaaaggccagagcaagaga

SEQ ID NO: 1546224 - RNA, 19 nt, Homo sapiens
gauggaaagcucuaagauc

SEQ ID NO: 1546225 - RNA, 19 nt, Homo sapiens
gcccagagaaccaaacaga

SEQ ID NO: 1546226 - RNA, 19 nt, Homo sapiens
ucaaagacaucuacuuccu

SEQ ID NO: 1546227 - RNA, 19 nt, Homo sapiens
gauugucauuccuuucuuc

SEQ ID NO: 1546228 - RNA, 19 nt, Homo sapiens
gaccuugcuuggugacaug

SEQ ID NO: 1546229 - RNA, 19 nt, Homo sapiens
gggaguucaucaccuggaa

SEQ ID NO: 1546230 - RNA, 19 nt, Homo sapiens
auggaaagcucuaagaucu

SEQ ID NO: 1546231 - RNA, 19 nt, Homo sapiens
ucagugaggauggucuuua

SEQ ID NO: 1546232 - RNA, 19 nt, Homo sapiens
ccaauggacacgucaacuu

SEQ ID NO: 1546233 - RNA, 19 nt, Homo sapiens
gaagauugucauuccuuuc

SEQ ID NO: 1546234 - RNA, 19 nt, Homo sapiens
agauggcccugcccagaaa

SEQ ID NO: 1546235 - RNA, 19 nt, Homo sapiens
gcagcugacccacguggaa

SEQ ID NO: 1546236 - RNA, 19 nt, Homo sapiens
ccgacaagcccaucuccua

SEQ ID NO: 1546237 - RNA, 19 nt, Homo sapiens
aggacaaacuggacacaug

SEQ ID NO: 1546238 - RNA, 19 nt, Homo sapiens
gacgaggcauaccggaaga

SEQ ID NO: 1546239 - RNA, 19 nt, Homo sapiens
aaagugagagcccagagaa

SEQ ID NO: 1546240 - RNA, 19 nt, Homo sapiens
acaucuacuuccugaauga

SEQ ID NO: 1546241 - RNA, 19 nt, Homo sapiens
ucagccugcucaucaaaga

SEQ ID NO: 1546242 - RNA, 19 nt, Homo sapiens
gaagaccugggccaaagug

SEQ ID NO: 1546243 - RNA, 19 nt, Homo sapiens
gaggauggucuuuauuugg

SEQ ID NO: 1546244 - RNA, 19 nt, Homo sapiens
ccaaccgccuucccaaugg

SEQ ID NO: 1546245 - RNA, 19 nt, Homo sapiens
aagaagaccugggccaaag

SEQ ID NO: 1546246 - RNA, 19 nt, Homo sapiens
caacaucggcaacuucaac

SEQ ID NO: 1546247 - RNA, 19 nt, Homo sapiens
agacaucuacuuccugaau

SEQ ID NO: 1546248 - RNA, 19 nt, Homo sapiens
ugauugaguucuucaucga

SEQ ID NO: 1546249 - RNA, 19 nt, Homo sapiens
caaccgccuucccaaugga

SEQ ID NO: 1546250 - RNA, 19 nt, Homo sapiens
gccaaccgccuucccaaug

SEQ ID NO: 1546251 - RNA, 19 nt, Homo sapiens
ggacacauggaguuacagu

SEQ ID NO: 1546252 - RNA, 19 nt, Homo sapiens
gggcacaggagaccuuuua

SEQ ID NO: 1546253 - RNA, 19 nt, Homo sapiens
gcuaccugguggcaacuga

SEQ ID NO: 1546254 - RNA, 19 nt, Homo sapiens
caggaagagucgacuaucg

SEQ ID NO: 1546255 - RNA, 19 nt, Homo sapiens
ggagugucccuucgagcaa

SEQ ID NO: 1546256 - RNA, 19 nt, Homo sapiens
guucaucaccuggaaacaa

SEQ ID NO: 1546257 - RNA, 19 nt, Homo sapiens
ucgacuaucgggcaccuua

SEQ ID NO: 1546258 - RNA, 19 nt, Homo sapiens
gcaugccagccaagaagaa

SEQ ID NO: 1546259 - RNA, 19 nt, Homo sapiens
cuuguaaacucuagucacu

SEQ ID NO: 1546260 - RNA, 19 nt, Homo sapiens
acugcaagcucgagaccuu

SEQ ID NO: 1546261 - RNA, 19 nt, Homo sapiens
agaaagauggaaagcucua

SEQ ID NO: 1546262 - RNA, 19 nt, Homo sapiens
gcaucacccacuaccugua

SEQ ID NO: 1546263 - RNA, 19 nt, Homo sapiens
cgagagaagauugucauuc

SEQ ID NO: 1546264 - RNA, 19 nt, Homo sapiens
ggaguucaucaccuggaaa

SEQ ID NO: 1546265 - RNA, 19 nt, Homo sapiens
gcucaucaaagacaucuac

SEQ ID NO: 1546266 - RNA, 19 nt, Homo sapiens
guccaggccuuugugaaca

SEQ ID NO: 1546267 - RNA, 19 nt, Homo sapiens
ccacagcagccgagagaag

SEQ ID NO: 1546268 - RNA, 19 nt, Homo sapiens
caaccuggaggcuuaugug

SEQ ID NO: 1546269 - RNA, 19 nt, Homo sapiens
acauggaguuacagugugu

SEQ ID NO: 1546270 - RNA, 19 nt, Homo sapiens
ccaggugauugaguucuuc

SEQ ID NO: 1546271 - RNA, 19 nt, Homo sapiens
gacaagcccaucuccuaca

SEQ ID NO: 1546272 - RNA, 19 nt, Homo sapiens
ggaggcuuaugugaaaugg

SEQ ID NO: 1546273 - RNA, 19 nt, Homo sapiens
gcacaugccuuggggacau

SEQ ID NO: 1546274 - RNA, 19 nt, Homo sapiens
ggaguuuguccaggccuuu

SEQ ID NO: 1546275 - RNA, 19 nt, Homo sapiens
cgacuaucgggcaccuuaa

SEQ ID NO: 1546276 - RNA, 19 nt, Homo sapiens
ucuccaggcugaagaagac

SEQ ID NO: 1546277 - RNA, 19 nt, Homo sapiens
gcacaggagaccuuuuaug

SEQ ID NO: 1546278 - RNA, 19 nt, Homo sapiens
ccacagggagcuccuuggu

SEQ ID NO: 1546279 - RNA, 19 nt, Homo sapiens
gcaaccuggaggcuuaugu

SEQ ID NO: 1546280 - RNA, 19 nt, Homo sapiens
gcuucaacaucggcaacuu

SEQ ID NO: 1546281 - RNA, 19 nt, Homo sapiens
agagauggcuuauagcuua

SEQ ID NO: 1546282 - RNA, 19 nt, Homo sapiens
ggacaaauauguagaugau

SEQ ID NO: 1546283 - RNA, 19 nt, Homo sapiens
gacaaucaguguauguuua

SEQ ID NO: 1546284 - RNA, 19 nt, Homo sapiens
gcuuauagcuuacugaaga

SEQ ID NO: 1546285 - RNA, 19 nt, Homo sapiens
gagugaagcuuugaaguuu

SEQ ID NO: 1546286 - RNA, 19 nt, Homo sapiens
uaagaaagcuaguggacaa

SEQ ID NO: 1546287 - RNA, 19 nt, Homo sapiens
uuacagagauggcuuauag

SEQ ID NO: 1546288 - RNA, 19 nt, Homo sapiens
agagugaaguggacaaaua

SEQ ID NO: 1546289 - RNA, 19 nt, Homo sapiens
gaagaaccagaaagcauua

SEQ ID NO: 1546290 - RNA, 19 nt, Homo sapiens
ggaacacuuucaucaguuu

SEQ ID NO: 1546291 - RNA, 19 nt, Homo sapiens
ugacauacuccaagaauaa

SEQ ID NO: 1546292 - RNA, 19 nt, Homo sapiens
gcgaauauuugauaccuau

SEQ ID NO: 1546293 - RNA, 19 nt, Homo sapiens
ccagaaagcauuauguauu

SEQ ID NO: 1546294 - RNA, 19 nt, Homo sapiens
gaaagcuaguggacaauca

SEQ ID NO: 1546295 - RNA, 19 nt, Homo sapiens
uagugaagcucaucagauu

SEQ ID NO: 1546296 - RNA, 19 nt, Homo sapiens
gcagugggcugaaauuggu

SEQ ID NO: 1546297 - RNA, 19 nt, Homo sapiens
auaaacagcuguauuugga

SEQ ID NO: 1546298 - RNA, 19 nt, Homo sapiens
acuguuaucuugucuauga

SEQ ID NO: 1546299 - RNA, 19 nt, Homo sapiens
gaaguuaaacgcuagaauc

SEQ ID NO: 1546300 - RNA, 19 nt, Homo sapiens
ggacaaucaguguauguuu

SEQ ID NO: 1546301 - RNA, 19 nt, Homo sapiens
guuuggaacuugggacuua

SEQ ID NO: 1546302 - RNA, 19 nt, Homo sapiens
acacuguucuccaaaggua

SEQ ID NO: 1546303 - RNA, 19 nt, Homo sapiens
guauaaaucauccacugua

SEQ ID NO: 1546304 - RNA, 19 nt, Homo sapiens
guauuuggauguagaaagu

SEQ ID NO: 1546305 - RNA, 19 nt, Homo sapiens
gaauugcagcgaauauuug

SEQ ID NO: 1546306 - RNA, 19 nt, Homo sapiens
ggccauaugauucugauaa

SEQ ID NO: 1546307 - RNA, 19 nt, Homo sapiens
uaaccuuguuccugguaua

SEQ ID NO: 1546308 - RNA, 19 nt, Homo sapiens
gaaccagaaagcauuaugu

SEQ ID NO: 1546309 - RNA, 19 nt, Homo sapiens
gaaguuucaucucuauaac

SEQ ID NO: 1546310 - RNA, 19 nt, Homo sapiens
ggaaucaaucuuacagaga

SEQ ID NO: 1546311 - RNA, 19 nt, Homo sapiens
ugaauugcagcgaauauuu

SEQ ID NO: 1546312 - RNA, 19 nt, Homo sapiens
cugauaaccuacagcauga

SEQ ID NO: 1546313 - RNA, 19 nt, Homo sapiens
ugaaguggacaaauaugua

SEQ ID NO: 1546314 - RNA, 19 nt, Homo sapiens
acaaaggacacacaggaua

SEQ ID NO: 1546315 - RNA, 19 nt, Homo sapiens
gggcauacuuggguuaauc

SEQ ID NO: 1546316 - RNA, 19 nt, Homo sapiens
gcuuuggaaucuucuaaug

SEQ ID NO: 1546317 - RNA, 19 nt, Homo sapiens
ucaugaagcuuuggaaucu

SEQ ID NO: 1546318 - RNA, 19 nt, Homo sapiens
gaaguggacaaauauguag

SEQ ID NO: 1546319 - RNA, 19 nt, Homo sapiens
gugaugaucccaagacaga

SEQ ID NO: 1546320 - RNA, 19 nt, Homo sapiens
ggaugccaguuuuaaaaua

SEQ ID NO: 1546321 - RNA, 19 nt, Homo sapiens
gaaaauuccuugacauacu

SEQ ID NO: 1546322 - RNA, 19 nt, Homo sapiens
uaccuuauccuuccaaaga

SEQ ID NO: 1546323 - RNA, 19 nt, Homo sapiens
caauggaacacuuucauca

SEQ ID NO: 1546324 - RNA, 19 nt, Homo sapiens
ugcaauaguuggaaucaau

SEQ ID NO: 1546325 - RNA, 19 nt, Homo sapiens
guucuucuaugggcacuuu

SEQ ID NO: 1546326 - RNA, 19 nt, Homo sapiens
gaugaaauggcuauuacga

SEQ ID NO: 1546327 - RNA, 19 nt, Homo sapiens
auacuuggguuaaucaauc

SEQ ID NO: 1546328 - RNA, 19 nt, Homo sapiens
ggaaaaggccauaugauuc

SEQ ID NO: 1546329 - RNA, 19 nt, Homo sapiens
aaauaugcaugaagaugug

SEQ ID NO: 1546330 - RNA, 19 nt, Homo sapiens
gaaggcgacacauguuguu

SEQ ID NO: 1546331 - RNA, 19 nt, Homo sapiens
uaaaucauccacuguaucu

SEQ ID NO: 1546332 - RNA, 19 nt, Homo sapiens
agaagaaccagaaagcauu

SEQ ID NO: 1546333 - RNA, 19 nt, Homo sapiens
gaagcucaucagauucuuu

SEQ ID NO: 1546334 - RNA, 19 nt, Homo sapiens
gauagaaaauuccuugaca

SEQ ID NO: 1546335 - RNA, 19 nt, Homo sapiens
caaaggacacacaggauag

SEQ ID NO: 1546336 - RNA, 19 nt, Homo sapiens
cugaucaauuacacucuua

SEQ ID NO: 1546337 - RNA, 19 nt, Homo sapiens
gaagaagaaccagaaagca

SEQ ID NO: 1546338 - RNA, 19 nt, Homo sapiens
gaagagugaagcuuugaag

SEQ ID NO: 1546339 - RNA, 19 nt, Homo sapiens
gcaugaagaugugcuuacu

SEQ ID NO: 1546340 - RNA, 19 nt, Homo sapiens
gagugaaguggacaaauau

SEQ ID NO: 1546341 - RNA, 19 nt, Homo sapiens
ggauuguaauguagcacuu

SEQ ID NO: 1546342 - RNA, 19 nt, Homo sapiens
auagagagaaguuucauga

SEQ ID NO: 1546343 - RNA, 19 nt, Homo sapiens
aaauggcuauuacgacaga

SEQ ID NO: 1546344 - RNA, 19 nt, Homo sapiens
uccacuguaucuucuauuu

SEQ ID NO: 1546345 - RNA, 19 nt, Homo sapiens
agagugaagcuuugaaguu

SEQ ID NO: 1546346 - RNA, 19 nt, Homo sapiens
gaauaagguuuuacagaag

SEQ ID NO: 1546347 - RNA, 19 nt, Homo sapiens
acagaugacugggaagugu

SEQ ID NO: 1546348 - RNA, 19 nt, Homo sapiens
ugagaaggaugccaguuuu

SEQ ID NO: 1546349 - RNA, 19 nt, Homo sapiens
gauuguaauguagcacuua

SEQ ID NO: 1546350 - RNA, 19 nt, Homo sapiens
uggaacacuuucaucaguu

SEQ ID NO: 1546351 - RNA, 19 nt, Homo sapiens
uaccaacaauggaacacuu

SEQ ID NO: 1546352 - RNA, 19 nt, Homo sapiens
cuauguaggugcacaaagg

SEQ ID NO: 1546353 - RNA, 19 nt, Homo sapiens
uggaugaaauggcuauuac

SEQ ID NO: 1546354 - RNA, 19 nt, Homo sapiens
cacuguaucuucuauuucu

SEQ ID NO: 1546355 - RNA, 19 nt, Homo sapiens
cauccacuguaucuucuau

SEQ ID NO: 1546356 - RNA, 19 nt, Homo sapiens
uugcagcgaauauuugaua

SEQ ID NO: 1546357 - RNA, 19 nt, Homo sapiens
caauuuguauagagagaag

SEQ ID NO: 1546358 - RNA, 19 nt, Homo sapiens
caacaauggaacacuuuca

SEQ ID NO: 1546359 - RNA, 19 nt, Homo sapiens
cacauguuguucagaguga

SEQ ID NO: 1546360 - RNA, 19 nt, Homo sapiens
uugacauacuccaagaaua

SEQ ID NO: 1546361 - RNA, 19 nt, Homo sapiens
uuuauacacuguucuccaa

SEQ ID NO: 1546362 - RNA, 19 nt, Homo sapiens
gcaauaguuggaaucaauc

SEQ ID NO: 1546363 - RNA, 19 nt, Homo sapiens
uguagaaagugugaggaaa

SEQ ID NO: 1546364 - RNA, 19 nt, Homo sapiens
gaauauuaacccugagaag

SEQ ID NO: 1546365 - RNA, 19 nt, Homo sapiens
aaccagaaagcauuaugua

SEQ ID NO: 1546366 - RNA, 19 nt, Homo sapiens
cagauucuuucccguucaa

SEQ ID NO: 1546367 - RNA, 19 nt, Homo sapiens
gaaaaggccauaugauucu

SEQ ID NO: 1546368 - RNA, 19 nt, Homo sapiens
gaagaaguuaaacgcuaga

SEQ ID NO: 1546369 - RNA, 19 nt, Homo sapiens
ccuacagcaugaagagcua

SEQ ID NO: 1546370 - RNA, 19 nt, Homo sapiens
gguuauaaacagcuguauu

SEQ ID NO: 1546371 - RNA, 19 nt, Homo sapiens
gaaggaugccaguuuuaaa

SEQ ID NO: 1546372 - RNA, 19 nt, Homo sapiens
ggacacacaggauagaaaa

SEQ ID NO: 1546373 - RNA, 19 nt, Homo sapiens
caagcagugggcugaaauu

SEQ ID NO: 1546374 - RNA, 19 nt, Homo sapiens
cugagaaggaugccaguuu

SEQ ID NO: 1546375 - RNA, 19 nt, Homo sapiens
ccaaagauccccucuguag

SEQ ID NO: 1546376 - RNA, 19 nt, Homo sapiens
gcuaguggacaaucagugu

SEQ ID NO: 1546377 - RNA, 19 nt, Homo sapiens
ugugggaguucuucuaugg

SEQ ID NO: 1546378 - RNA, 19 nt, Homo sapiens
cagaaggcgacacauguug

SEQ ID NO: 1546379 - RNA, 19 nt, Homo sapiens
gagaaggaugccaguuuua

SEQ ID NO: 1546380 - RNA, 19 nt, Homo sapiens
uuacagaaggcgacacaug

SEQ ID NO: 1546381 - RNA, 19 nt, Homo sapiens
caaguaagccugcuaagua

SEQ ID NO: 1546382 - RNA, 19 nt, Homo sapiens
uaagaaagcugucguuaag

SEQ ID NO: 1546383 - RNA, 19 nt, Homo sapiens
caagaagggcuuuaagaaa

SEQ ID NO: 1546384 - RNA, 19 nt, Homo sapiens
cgggagagcuggcuaaaca

SEQ ID NO: 1546385 - RNA, 19 nt, Homo sapiens
ccaagaagggcuuuaagaa

SEQ ID NO: 1546386 - RNA, 19 nt, Homo sapiens
ggagaguuauucuauuuac

SEQ ID NO: 1546387 - RNA, 19 nt, Homo sapiens
aaguaagccugcuaaguaa

SEQ ID NO: 1546388 - RNA, 19 nt, Homo sapiens
guacaccagcuccaaguaa

SEQ ID NO: 1546389 - RNA, 19 nt, Homo sapiens
agcaagcgcuccaccauuu

SEQ ID NO: 1546390 - RNA, 19 nt, Homo sapiens
gugcuaccauuuccaagaa

SEQ ID NO: 1546391 - RNA, 19 nt, Homo sapiens
gagcgaggcaucacguuug

SEQ ID NO: 1546392 - RNA, 19 nt, Homo sapiens
cuaaacaugcugugucuga

SEQ ID NO: 1546393 - RNA, 19 nt, Homo sapiens
acacuggcaucucuucgaa

SEQ ID NO: 1546394 - RNA, 19 nt, Homo sapiens
ggagagcuggcuaaacaug

SEQ ID NO: 1546395 - RNA, 19 nt, Homo sapiens
caucacguuuggcucacua

SEQ ID NO: 1546396 - RNA, 19 nt, Homo sapiens
agaaagcugucguuaagac

SEQ ID NO: 1546397 - RNA, 19 nt, Homo sapiens
ggaggugucaucuaaaggu

SEQ ID NO: 1546398 - RNA, 19 nt, Homo sapiens
cuaaaggugcuaccauuuc

SEQ ID NO: 1546399 - RNA, 19 nt, Homo sapiens
ugauaucuuugagcguaua

SEQ ID NO: 1546400 - RNA, 19 nt, Homo sapiens
cuaaguaaacgucauuucu

SEQ ID NO: 1546401 - RNA, 19 nt, Homo sapiens
uaaaggugcuaccauuucc

SEQ ID NO: 1546402 - RNA, 19 nt, Homo sapiens
ggcuaaacaugcugugucu

SEQ ID NO: 1546403 - RNA, 19 nt, Homo sapiens
ucuaaaggugcuaccauuu

SEQ ID NO: 1546404 - RNA, 19 nt, Homo sapiens
ccggaggugucaucuaaag

SEQ ID NO: 1546405 - RNA, 19 nt, Homo sapiens
ccaaguaagccugcuaagu

SEQ ID NO: 1546406 - RNA, 19 nt, Homo sapiens
ggugcuaccauuuccaaga

SEQ ID NO: 1546407 - RNA, 19 nt, Homo sapiens
cagcaagcgcuccaccauu

SEQ ID NO: 1546408 - RNA, 19 nt, Homo sapiens
cgagcgaggcaucacguuu

SEQ ID NO: 1546409 - RNA, 19 nt, Homo sapiens
cgucauuucuaacccaaag

SEQ ID NO: 1546410 - RNA, 19 nt, Homo sapiens
gcuaaguaaacgucauuuc

SEQ ID NO: 1546411 - RNA, 19 nt, Homo sapiens
gcaagcgcuccaccauuuc

SEQ ID NO: 1546412 - RNA, 19 nt, Homo sapiens
uuuaagaaagcugucguua

SEQ ID NO: 1546413 - RNA, 19 nt, Homo sapiens
guaagccugcuaaguaaac

SEQ ID NO: 1546414 - RNA, 19 nt, Homo sapiens
uacaccagcuccaaguaag

SEQ ID NO: 1546415 - RNA, 19 nt, Homo sapiens
uccaagaagggcuuuaaga

SEQ ID NO: 1546416 - RNA, 19 nt, Homo sapiens
guaaacgucauuucuaacc

SEQ ID NO: 1546417 - RNA, 19 nt, Homo sapiens
gaaauaagacagacagaua

SEQ ID NO: 1546418 - RNA, 19 nt, Homo sapiens
gaacgaaaguauuacauug

SEQ ID NO: 1546419 - RNA, 19 nt, Homo sapiens
gcauuucucuucagcauua

SEQ ID NO: 1546420 - RNA, 19 nt, Homo sapiens
gaacuaccuuagcaauuua

SEQ ID NO: 1546421 - RNA, 19 nt, Homo sapiens
ccaaagaaaugaucacuga

SEQ ID NO: 1546422 - RNA, 19 nt, Homo sapiens
cagcaaaucuacacacuaa

SEQ ID NO: 1546423 - RNA, 19 nt, Homo sapiens
gaaagcaaauggauaucaa

SEQ ID NO: 1546424 - RNA, 19 nt, Homo sapiens
caagggugcuguugguuua

SEQ ID NO: 1546425 - RNA, 19 nt, Homo sapiens
uaaagaaucucaggaagaa

SEQ ID NO: 1546426 - RNA, 19 nt, Homo sapiens
gagaugggcuuaccaggaa

SEQ ID NO: 1546427 - RNA, 19 nt, Homo sapiens
gcauagauauucuucauca

SEQ ID NO: 1546428 - RNA, 19 nt, Homo sapiens
gaacaaggcauagauauuc

SEQ ID NO: 1546429 - RNA, 19 nt, Homo sapiens
caacaaagauaccggaaca

SEQ ID NO: 1546430 - RNA, 19 nt, Homo sapiens
ugaacuaccuuagcaauuu

SEQ ID NO: 1546431 - RNA, 19 nt, Homo sapiens
gagaggaucugaagguaau

SEQ ID NO: 1546432 - RNA, 19 nt, Homo sapiens
ggacuaugauugauaaagu

SEQ ID NO: 1546433 - RNA, 19 nt, Homo sapiens
gaacaaugcauuucucuuc

SEQ ID NO: 1546434 - RNA, 19 nt, Homo sapiens
ggacaaaugcauacaaaug

SEQ ID NO: 1546435 - RNA, 19 nt, Homo sapiens
gcaaagauuuacuuaacug

SEQ ID NO: 1546436 - RNA, 19 nt, Homo sapiens
gaugggaccugauggagaa

SEQ ID NO: 1546437 - RNA, 19 nt, Homo sapiens
caaaggaacucagggagaa

SEQ ID NO: 1546438 - RNA, 19 nt, Homo sapiens
gaagauacucagacaaauu

SEQ ID NO: 1546439 - RNA, 19 nt, Homo sapiens
ggugauacacuaccucuua

SEQ ID NO: 1546440 - RNA, 19 nt, Homo sapiens
gaacagacuuccuccuaag

SEQ ID NO: 1546441 - RNA, 19 nt, Homo sapiens
gggcagccguuuacaauau

SEQ ID NO: 1546442 - RNA, 19 nt, Homo sapiens
gaacuuccuucauuuacug

SEQ ID NO: 1546443 - RNA, 19 nt, Homo sapiens
caagaaagcaaauggauau

SEQ ID NO: 1546444 - RNA, 19 nt, Homo sapiens
ugaaauugcugcuguuuua

SEQ ID NO: 1546445 - RNA, 19 nt, Homo sapiens
gagagaggaucugaaggua

SEQ ID NO: 1546446 - RNA, 19 nt, Homo sapiens
ucaaggccuuucuggauua

SEQ ID NO: 1546447 - RNA, 19 nt, Homo sapiens
gcuaugaaacugagcuuua

SEQ ID NO: 1546448 - RNA, 19 nt, Homo sapiens
gcaaaagcauuccaaauau

SEQ ID NO: 1546449 - RNA, 19 nt, Homo sapiens
gaggauacauuuacugaag

SEQ ID NO: 1546450 - RNA, 19 nt, Homo sapiens
ggaauaguaugucaguuag

SEQ ID NO: 1546451 - RNA, 19 nt, Homo sapiens
ggauaucaaugcugcuauu

SEQ ID NO: 1546452 - RNA, 19 nt, Homo sapiens
gauaucaagaucucaguua

SEQ ID NO: 1546453 - RNA, 19 nt, Homo sapiens
guucagaccuuugauucua

SEQ ID NO: 1546454 - RNA, 19 nt, Homo sapiens
gggcuuaccaggaauuaua

SEQ ID NO: 1546455 - RNA, 19 nt, Homo sapiens
gaaacugagcuuuaugauu

SEQ ID NO: 1546456 - RNA, 19 nt, Homo sapiens
gaaaauagcuaugaaacug

SEQ ID NO: 1546457 - RNA, 19 nt, Homo sapiens
caagauggcagcuggcaua

SEQ ID NO: 1546458 - RNA, 19 nt, Homo sapiens
gcagauggcauuucaggaa

SEQ ID NO: 1546459 - RNA, 19 nt, Homo sapiens
gggauuaccuggucaugug

SEQ ID NO: 1546460 - RNA, 19 nt, Homo sapiens
ggaaagaaggugaauuuua

SEQ ID NO: 1546461 - RNA, 19 nt, Homo sapiens
uaacuggucugucacuguu

SEQ ID NO: 1546462 - RNA, 19 nt, Homo sapiens
ucagaugacugcaagauuc

SEQ ID NO: 1546463 - RNA, 19 nt, Homo sapiens
gauaucagguccuaaaggu

SEQ ID NO: 1546464 - RNA, 19 nt, Homo sapiens
ggaacaagguauacaaggu

SEQ ID NO: 1546465 - RNA, 19 nt, Homo sapiens
ggagaucaaggaaauauug

SEQ ID NO: 1546466 - RNA, 19 nt, Homo sapiens
acaaggaauuccaggauuu

SEQ ID NO: 1546467 - RNA, 19 nt, Homo sapiens
gugcacugcuucugucuaa

SEQ ID NO: 1546468 - RNA, 19 nt, Homo sapiens
uagaguaacuggucuguca

SEQ ID NO: 1546469 - RNA, 19 nt, Homo sapiens
acaaggugcuuauggcuuu

SEQ ID NO: 1546470 - RNA, 19 nt, Homo sapiens
ccaggaaccuaaucaacuu

SEQ ID NO: 1546471 - RNA, 19 nt, Homo sapiens
ggacaaagaggaucaagag

SEQ ID NO: 1546472 - RNA, 19 nt, Homo sapiens
gaacaaggaauuccaggau

SEQ ID NO: 1546473 - RNA, 19 nt, Homo sapiens
ccacagcaaaccacacuua

SEQ ID NO: 1546474 - RNA, 19 nt, Homo sapiens
gaucaaggccuuucuggau

SEQ ID NO: 1546475 - RNA, 19 nt, Homo sapiens
caagaacaaggcauagaua

SEQ ID NO: 1546476 - RNA, 19 nt, Homo sapiens
gcagccguuuacaauauua

SEQ ID NO: 1546477 - RNA, 19 nt, Homo sapiens
gcaaaccacacuuaaccua

SEQ ID NO: 1546478 - RNA, 19 nt, Homo sapiens
caucucagcuuucuuagag

SEQ ID NO: 1546479 - RNA, 19 nt, Homo sapiens
ugaccacagugaagagaua

SEQ ID NO: 1546480 - RNA, 19 nt, Homo sapiens
uggcagagaagguauaaua

SEQ ID NO: 1546481 - RNA, 19 nt, Homo sapiens
caacuacaguguucaugau

SEQ ID NO: 1546482 - RNA, 19 nt, Homo sapiens
gagcaauacuggcuaaugc

SEQ ID NO: 1546483 - RNA, 19 nt, Homo sapiens
guaauaaagcauuggcuaa

SEQ ID NO: 1546484 - RNA, 19 nt, Homo sapiens
gcaaauggauaucaaugcu

SEQ ID NO: 1546485 - RNA, 19 nt, Homo sapiens
uggcuuaccuggagaaguu

SEQ ID NO: 1546486 - RNA, 19 nt, Homo sapiens
acauggaaauccugguuua

SEQ ID NO: 1546487 - RNA, 19 nt, Homo sapiens
cuaacgaacucauggaaau

SEQ ID NO: 1546488 - RNA, 19 nt, Homo sapiens
gacaauaucacacaacaug

SEQ ID NO: 1546489 - RNA, 19 nt, Homo sapiens
ggaagauacucagacaaau

SEQ ID NO: 1546490 - RNA, 19 nt, Homo sapiens
gauggcagcuggcauaagg

SEQ ID NO: 1546491 - RNA, 19 nt, Homo sapiens
uaucaaugcugcuauucaa

SEQ ID NO: 1546492 - RNA, 19 nt, Homo sapiens
uggaaacccuggagaaaga

SEQ ID NO: 1546493 - RNA, 19 nt, Homo sapiens
ggagaagaaggaccaauug

SEQ ID NO: 1546494 - RNA, 19 nt, Homo sapiens
aaaccaaagugucucaaug

SEQ ID NO: 1546495 - RNA, 19 nt, Homo sapiens
gggauggaauggccagauu

SEQ ID NO: 1546496 - RNA, 19 nt, Homo sapiens
aaaaggagaucaaggaaaa

SEQ ID NO: 1546497 - RNA, 19 nt, Homo sapiens
gagaauucccuagaacuaa

SEQ ID NO: 1546498 - RNA, 19 nt, Homo sapiens
agaacagacuuccuccuaa

SEQ ID NO: 1546499 - RNA, 19 nt, Homo sapiens
gaaguucagaccuuugauu

SEQ ID NO: 1546500 - RNA, 19 nt, Homo sapiens
acagacagauacagucauu

SEQ ID NO: 1546501 - RNA, 19 nt, Homo sapiens
auggagagcuaccagaaua

SEQ ID NO: 1546502 - RNA, 19 nt, Homo sapiens
ccaagaaagcaaauggaua

SEQ ID NO: 1546503 - RNA, 19 nt, Homo sapiens
agaauucccuagaacuaaa

SEQ ID NO: 1546504 - RNA, 19 nt, Homo sapiens
aagaaggucuccagggaaa

SEQ ID NO: 1546505 - RNA, 19 nt, Homo sapiens
gaaguugggaugacuggaa

SEQ ID NO: 1546506 - RNA, 19 nt, Homo sapiens
aaucaaagccagcacauug

SEQ ID NO: 1546507 - RNA, 19 nt, Homo sapiens
aagcauuggcuaaaucuua

SEQ ID NO: 1546508 - RNA, 19 nt, Homo sapiens
gccaggaccuaaaggagaa

SEQ ID NO: 1546509 - RNA, 19 nt, Homo sapiens
gggagagucuggucugcaa

SEQ ID NO: 1546510 - RNA, 19 nt, Homo sapiens
ugauaagggucucaaagga

SEQ ID NO: 1546511 - RNA, 19 nt, Homo sapiens
aaggaaagaaggugaauuu

SEQ ID NO: 1546512 - RNA, 19 nt, Homo sapiens
ggcaaaagcauuccaaaua

SEQ ID NO: 1546513 - RNA, 19 nt, Homo sapiens
ccaaagugucucaauguuu

SEQ ID NO: 1546514 - RNA, 19 nt, Homo sapiens
ugacagguuuccaaggauu

SEQ ID NO: 1546515 - RNA, 19 nt, Homo sapiens
auacaaugcuugaaaugga

SEQ ID NO: 1546516 - RNA, 19 nt, Homo sapiens
gaacaccagauaucaagau

SEQ ID NO: 1546517 - RNA, 19 nt, Homo sapiens
ccacuucucugccaaagau

SEQ ID NO: 1546518 - RNA, 19 nt, Homo sapiens
ccaagccucuucuuacuuc

SEQ ID NO: 1546519 - RNA, 19 nt, Homo sapiens
caagcaagcagacauuuau

SEQ ID NO: 1546520 - RNA, 19 nt, Homo sapiens
ucauaggccuggaguuuau

SEQ ID NO: 1546521 - RNA, 19 nt, Homo sapiens
ucaccaagauccugcaugu

SEQ ID NO: 1546522 - RNA, 19 nt, Homo sapiens
ccaagcaagcagacauuua

SEQ ID NO: 1546523 - RNA, 19 nt, Homo sapiens
ggagagggccaacaacugu

SEQ ID NO: 1546524 - RNA, 19 nt, Homo sapiens
gcaggauucuucccaugga

SEQ ID NO: 1546525 - RNA, 19 nt, Homo sapiens
ggucuggaaugcaaaguca

SEQ ID NO: 1546526 - RNA, 19 nt, Homo sapiens
ccacguggcuggcauugca

SEQ ID NO: 1546527 - RNA, 19 nt, Homo sapiens
caagcagacauuuaucuuu

SEQ ID NO: 1546528 - RNA, 19 nt, Homo sapiens
caagggaagggcacgguua

SEQ ID NO: 1546529 - RNA, 19 nt, Homo sapiens
gggcugagcuuuaaaaugg

SEQ ID NO: 1546530 - RNA, 19 nt, Homo sapiens
gcaagcagacauuuaucuu

SEQ ID NO: 1546531 - RNA, 19 nt, Homo sapiens
ggagugagccaggcaguga

SEQ ID NO: 1546532 - RNA, 19 nt, Homo sapiens
ccugauuaauggaggcuua

SEQ ID NO: 1546533 - RNA, 19 nt, Homo sapiens
caaggaggcaggauucuuc

SEQ ID NO: 1546534 - RNA, 19 nt, Homo sapiens
ggcagagacugauccacuu

SEQ ID NO: 1546535 - RNA, 19 nt, Homo sapiens
ucaccgacuucgagaaugu

SEQ ID NO: 1546536 - RNA, 19 nt, Homo sapiens
gggcauuucaccauucaaa

SEQ ID NO: 1546537 - RNA, 19 nt, Homo sapiens
ccucauaggccuggaguuu

SEQ ID NO: 1546538 - RNA, 19 nt, Homo sapiens
ucacuggccuggcggagau

SEQ ID NO: 1546539 - RNA, 19 nt, Homo sapiens
gaacacagaccaggaagcu

SEQ ID NO: 1546540 - RNA, 19 nt, Homo sapiens
cccaggagcuccagugaca

SEQ ID NO: 1546541 - RNA, 19 nt, Homo sapiens
gagggugucuacgccauug

SEQ ID NO: 1546542 - RNA, 19 nt, Homo sapiens
ggacgaugccugccucuac

SEQ ID NO: 1546543 - RNA, 19 nt, Homo sapiens
ggagcuggccuugaaguug

SEQ ID NO: 1546544 - RNA, 19 nt, Homo sapiens
uguccucucuguugccuuu

SEQ ID NO: 1546545 - RNA, 19 nt, Homo sapiens
gcauuucaccauucaaaca

SEQ ID NO: 1546546 - RNA, 19 nt, Homo sapiens
gaguugaggcagagacuga

SEQ ID NO: 1546547 - RNA, 19 nt, Homo sapiens
ccaaggauccguggagguu

SEQ ID NO: 1546548 - RNA, 19 nt, Homo sapiens
ggggauaccucaccaagau

SEQ ID NO: 1546549 - RNA, 19 nt, Homo sapiens
ugacagccguugccaucug

SEQ ID NO: 1546550 - RNA, 19 nt, Homo sapiens
agauugggcuggcucugaa

SEQ ID NO: 1546551 - RNA, 19 nt, Homo sapiens
uaauggaggcuuagcuuuc

SEQ ID NO: 1546552 - RNA, 19 nt, Homo sapiens
gcagaaugacuuuuauuga

SEQ ID NO: 1546553 - RNA, 19 nt, Homo sapiens
gcagccugguggaggugua

SEQ ID NO: 1546554 - RNA, 19 nt, Homo sapiens
cggcugggcuccucauuuu

SEQ ID NO: 1546555 - RNA, 19 nt, Homo sapiens
gauccugcaugucuuccau

SEQ ID NO: 1546556 - RNA, 19 nt, Homo sapiens
gcagccuccuugccuggaa

SEQ ID NO: 1546557 - RNA, 19 nt, Homo sapiens
gguuagcggcacccucaua

SEQ ID NO: 1546558 - RNA, 19 nt, Homo sapiens
ggucaccgacuucgagaau

SEQ ID NO: 1546559 - RNA, 19 nt, Homo sapiens
cagccaacccgcuccacua

SEQ ID NO: 1546560 - RNA, 19 nt, Homo sapiens
ccagcuaacuguggagaag

SEQ ID NO: 1546561 - RNA, 19 nt, Homo sapiens
gcagagacugauccacuuc

SEQ ID NO: 1546562 - RNA, 19 nt, Homo sapiens
gcgcccugcuccugaacuu

SEQ ID NO: 1546563 - RNA, 19 nt, Homo sapiens
gcaggaacugagccagaaa

SEQ ID NO: 1546564 - RNA, 19 nt, Homo sapiens
ccaccaaggaggcaggauu

SEQ ID NO: 1546565 - RNA, 19 nt, Homo sapiens
caacugcagcguccacaca

SEQ ID NO: 1546566 - RNA, 19 nt, Homo sapiens
acaccagcauacagaguga

SEQ ID NO: 1546567 - RNA, 19 nt, Homo sapiens
uggcggagaugcuucuaag

SEQ ID NO: 1546568 - RNA, 19 nt, Homo sapiens
gacgaugccugccucuacu

SEQ ID NO: 1546569 - RNA, 19 nt, Homo sapiens
cuagacaccagcauacaga

SEQ ID NO: 1546570 - RNA, 19 nt, Homo sapiens
gggagagggccaacaacug

SEQ ID NO: 1546571 - RNA, 19 nt, Homo sapiens
gagccagaaacgcagauug

SEQ ID NO: 1546572 - RNA, 19 nt, Homo sapiens
caccuuuacucugcucuau

SEQ ID NO: 1546573 - RNA, 19 nt, Homo sapiens
ugcuggagcuggccuugaa

SEQ ID NO: 1546574 - RNA, 19 nt, Homo sapiens
cagaaugacuuuuauugag

SEQ ID NO: 1546575 - RNA, 19 nt, Homo sapiens
uuaaaaugguuccgacuug

SEQ ID NO: 1546576 - RNA, 19 nt, Homo sapiens
gacaggccagcaaguguga

SEQ ID NO: 1546577 - RNA, 19 nt, Homo sapiens
ggucauggucaccgacuuc

SEQ ID NO: 1546578 - RNA, 19 nt, Homo sapiens
gccagcugcucccaaugug

SEQ ID NO: 1546579 - RNA, 19 nt, Homo sapiens
ggacccgcuuccacagaca

SEQ ID NO: 1546580 - RNA, 19 nt, Homo sapiens
uuaauggaggcuuagcuuu

SEQ ID NO: 1546581 - RNA, 19 nt, Homo sapiens
gcccucaucuccagcuaac

SEQ ID NO: 1546582 - RNA, 19 nt, Homo sapiens
gauccacuucucugccaaa

SEQ ID NO: 1546583 - RNA, 19 nt, Homo sapiens
ugucuuccauggccuucuu

SEQ ID NO: 1546584 - RNA, 19 nt, Homo sapiens
gcuagcaacacccaaaggu

SEQ ID NO: 1546585 - RNA, 19 nt, Homo sapiens
guacagccgcguccucaac

SEQ ID NO: 1546586 - RNA, 19 nt, Homo sapiens
cagagugaccaccgggaaa

SEQ ID NO: 1546587 - RNA, 19 nt, Homo sapiens
caacuuuucuagaccuguu

SEQ ID NO: 1546588 - RNA, 19 nt, Homo sapiens
cgucgaggcgcucaugguu

SEQ ID NO: 1546589 - RNA, 19 nt, Homo sapiens
gccaagccucuucuuacuu

SEQ ID NO: 1546590 - RNA, 19 nt, Homo sapiens
ucuccuagacaccagcaua

SEQ ID NO: 1546591 - RNA, 19 nt, Homo sapiens
gaaccacagccaccuucca

SEQ ID NO: 1546592 - RNA, 19 nt, Homo sapiens
ccuuuacucugcucuaugc

SEQ ID NO: 1546593 - RNA, 19 nt, Homo sapiens
aauggaggcuuagcuuucu

SEQ ID NO: 1546594 - RNA, 19 nt, Homo sapiens
ccaaggaggcaggauucuu

SEQ ID NO: 1546595 - RNA, 19 nt, Homo sapiens
gggcuggggcugagcuuua

SEQ ID NO: 1546596 - RNA, 19 nt, Homo sapiens
cucauaggccuggaguuua

SEQ ID NO: 1546597 - RNA, 19 nt, Homo sapiens
caggaagcucggugaguga

SEQ ID NO: 1546598 - RNA, 19 nt, Homo sapiens
cccagagcaucccguggaa

SEQ ID NO: 1546599 - RNA, 19 nt, Homo sapiens
agcaggaacugagccagaa

SEQ ID NO: 1546600 - RNA, 19 nt, Homo sapiens
ggauucuucccauggauag

SEQ ID NO: 1546601 - RNA, 19 nt, Homo sapiens
caccaaggaggcaggauuc

SEQ ID NO: 1546602 - RNA, 19 nt, Homo sapiens
gaagaaaugccucagcuua

SEQ ID NO: 1546603 - RNA, 19 nt, Homo sapiens
acaaagaggugaaggagua

SEQ ID NO: 1546604 - RNA, 19 nt, Homo sapiens
caacuauacucaugauguu

SEQ ID NO: 1546605 - RNA, 19 nt, Homo sapiens
ggcaaaugcugaauauucu

SEQ ID NO: 1546606 - RNA, 19 nt, Homo sapiens
gcauuuggcuguuucuacu

SEQ ID NO: 1546607 - RNA, 19 nt, Homo sapiens
gcaaguagugauuggagaa

SEQ ID NO: 1546608 - RNA, 19 nt, Homo sapiens
ugacaacuauacucaugau

SEQ ID NO: 1546609 - RNA, 19 nt, Homo sapiens
uugaaaagcugguaaaaga

SEQ ID NO: 1546610 - RNA, 19 nt, Homo sapiens
gaaaugccucagcuuacaa

SEQ ID NO: 1546611 - RNA, 19 nt, Homo sapiens
agaaaugccucagcuuaca

SEQ ID NO: 1546612 - RNA, 19 nt, Homo sapiens
uggcaaaugcugaauauuc

SEQ ID NO: 1546613 - RNA, 19 nt, Homo sapiens
ggcccucugugguuaaaga

SEQ ID NO: 1546614 - RNA, 19 nt, Homo sapiens
guucaggcccucugugguu

SEQ ID NO: 1546615 - RNA, 19 nt, Homo sapiens
uauauucugcggccuguuu

SEQ ID NO: 1546616 - RNA, 19 nt, Homo sapiens
acugacaacuauacucaug

SEQ ID NO: 1546617 - RNA, 19 nt, Homo sapiens
acuggcaaaugcugaauau

SEQ ID NO: 1546618 - RNA, 19 nt, Homo sapiens
gguuaaagacuguauccau

SEQ ID NO: 1546619 - RNA, 19 nt, Homo sapiens
acaacuauacucaugaugu

SEQ ID NO: 1546620 - RNA, 19 nt, Homo sapiens
acacugacaacuauacuca

SEQ ID NO: 1546621 - RNA, 19 nt, Homo sapiens
gcaacccgcuaggccuuca

SEQ ID NO: 1546622 - RNA, 19 nt, Homo sapiens
ucaaggagggacuggcaaa

SEQ ID NO: 1546623 - RNA, 19 nt, Homo sapiens
gaaaagcugguaaaagaca

SEQ ID NO: 1546624 - RNA, 19 nt, Homo sapiens
uaaagacuguauccaugcu

SEQ ID NO: 1546625 - RNA, 19 nt, Homo sapiens
cccgagaacaccuauauuc

SEQ ID NO: 1546626 - RNA, 19 nt, Homo sapiens
caugaagaaaucugaacuu

SEQ ID NO: 1546627 - RNA, 19 nt, Homo sapiens
caguuuauucugcguugua

SEQ ID NO: 1546628 - RNA, 19 nt, Homo sapiens
cuacugaaugaaucuuuga

SEQ ID NO: 1546629 - RNA, 19 nt, Homo sapiens
guagugauuggagaacaaa

SEQ ID NO: 1546630 - RNA, 19 nt, Homo sapiens
gacuggcaaaugcugaaua

SEQ ID NO: 1546631 - RNA, 19 nt, Homo sapiens
acuacugaaugaaucuuug

SEQ ID NO: 1546632 - RNA, 19 nt, Homo sapiens
gguggugcaaguagugauu

SEQ ID NO: 1546633 - RNA, 19 nt, Homo sapiens
gaccaugaagaaaucugaa

SEQ ID NO: 1546634 - RNA, 19 nt, Homo sapiens
ugaccaugaagaaaucuga

SEQ ID NO: 1546635 - RNA, 19 nt, Homo sapiens
uucaggcccucugugguua

SEQ ID NO: 1546636 - RNA, 19 nt, Homo sapiens
aguagugauuggagaacaa

SEQ ID NO: 1546637 - RNA, 19 nt, Homo sapiens
caaaaugguggugcaagua

SEQ ID NO: 1546638 - RNA, 19 nt, Homo sapiens
gcugacacugacaacuaua

SEQ ID NO: 1546639 - RNA, 19 nt, Homo sapiens
ugcugacacugacaacuau

SEQ ID NO: 1546640 - RNA, 19 nt, Homo sapiens
aggagggacuggcaaaugc

SEQ ID NO: 1546641 - RNA, 19 nt, Homo sapiens
gaacagugcuacaaaucaa

SEQ ID NO: 1546642 - RNA, 19 nt, Homo sapiens
gcaaaucuguggucauaug

SEQ ID NO: 1546643 - RNA, 19 nt, Homo sapiens
uagcaaaucuguggucaua

SEQ ID NO: 1546644 - RNA, 19 nt, Homo sapiens
caacauaucacuauuggaa

SEQ ID NO: 1546645 - RNA, 19 nt, Homo sapiens
gcagaaggccucccacaaa

SEQ ID NO: 1546646 - RNA, 19 nt, Homo sapiens
gauauacucuucgagaauu

SEQ ID NO: 1546647 - RNA, 19 nt, Homo sapiens
ggaaggaggugauguucug

SEQ ID NO: 1546648 - RNA, 19 nt, Homo sapiens
gaagaagaaccauacuauu

SEQ ID NO: 1546649 - RNA, 19 nt, Homo sapiens
ucacagagacgacaagaaa

SEQ ID NO: 1546650 - RNA, 19 nt, Homo sapiens
ggaagauugugcccaaguu

SEQ ID NO: 1546651 - RNA, 19 nt, Homo sapiens
cauaugagcauuuaucuug

SEQ ID NO: 1546652 - RNA, 19 nt, Homo sapiens
ugaagaauggcaagaaaua

SEQ ID NO: 1546653 - RNA, 19 nt, Homo sapiens
ggguaaagcccaacuggua

SEQ ID NO: 1546654 - RNA, 19 nt, Homo sapiens
ggauaauggugaagcaaga

SEQ ID NO: 1546655 - RNA, 19 nt, Homo sapiens
guaacaagcacaccaaaga

SEQ ID NO: 1546656 - RNA, 19 nt, Homo sapiens
gaggugauguucugauuag

SEQ ID NO: 1546657 - RNA, 19 nt, Homo sapiens
guacacaacuugagcaaaa

SEQ ID NO: 1546658 - RNA, 19 nt, Homo sapiens
ggcagaaggugaagaggaa

SEQ ID NO: 1546659 - RNA, 19 nt, Homo sapiens
gccaauguguuaggauaua

SEQ ID NO: 1546660 - RNA, 19 nt, Homo sapiens
gaggccaaauucccaguaa

SEQ ID NO: 1546661 - RNA, 19 nt, Homo sapiens
ggaggccucaggaaacuua

SEQ ID NO: 1546662 - RNA, 19 nt, Homo sapiens
aaacaucuguacacaacuu

SEQ ID NO: 1546663 - RNA, 19 nt, Homo sapiens
ggaggugauguucugauua

SEQ ID NO: 1546664 - RNA, 19 nt, Homo sapiens
gaaagaggagucagcaaca

SEQ ID NO: 1546665 - RNA, 19 nt, Homo sapiens
ucaggaaacuuacaaucau

SEQ ID NO: 1546666 - RNA, 19 nt, Homo sapiens
ggauuaggccucaucauca

SEQ ID NO: 1546667 - RNA, 19 nt, Homo sapiens
gagacuggcauggauauaa

SEQ ID NO: 1546668 - RNA, 19 nt, Homo sapiens
gaagaauggcaagaaauau

SEQ ID NO: 1546669 - RNA, 19 nt, Homo sapiens
uaucaaagguugguuagca

SEQ ID NO: 1546670 - RNA, 19 nt, Homo sapiens
ggaacagugcuacaaauca

SEQ ID NO: 1546671 - RNA, 19 nt, Homo sapiens
guggucauaugagcauuua

SEQ ID NO: 1546672 - RNA, 19 nt, Homo sapiens
gcaaggagaccaauaucca

SEQ ID NO: 1546673 - RNA, 19 nt, Homo sapiens
uaacaagcacaccaaagaa

SEQ ID NO: 1546674 - RNA, 19 nt, Homo sapiens
ccugaagaauggcaagaaa

SEQ ID NO: 1546675 - RNA, 19 nt, Homo sapiens
ucacccaccucaucaggaa

SEQ ID NO: 1546676 - RNA, 19 nt, Homo sapiens
gaagauugugcccaaguug

SEQ ID NO: 1546677 - RNA, 19 nt, Homo sapiens
aagcagugaugauaaugaa

SEQ ID NO: 1546678 - RNA, 19 nt, Homo sapiens
gauuaggccucaucaucau

SEQ ID NO: 1546679 - RNA, 19 nt, Homo sapiens
agaagaagaaccauacuau

SEQ ID NO: 1546680 - RNA, 19 nt, Homo sapiens
gauauaagaagaagaacca

SEQ ID NO: 1546681 - RNA, 19 nt, Homo sapiens
aaauugagcuggcaaaaga

SEQ ID NO: 1546682 - RNA, 19 nt, Homo sapiens
gcaacaaggucaaaacauc

SEQ ID NO: 1546683 - RNA, 19 nt, Homo sapiens
gaaagcucuuccuccucua

SEQ ID NO: 1546684 - RNA, 19 nt, Homo sapiens
uggcauggauauaagaaga

SEQ ID NO: 1546685 - RNA, 19 nt, Homo sapiens
cacaagcagugaugauaau

SEQ ID NO: 1546686 - RNA, 19 nt, Homo sapiens
ggauauacucuucgagaau

SEQ ID NO: 1546687 - RNA, 19 nt, Homo sapiens
aagcccaacugguaucaaa

SEQ ID NO: 1546688 - RNA, 19 nt, Homo sapiens
gugauguucugauuagugu

SEQ ID NO: 1546689 - RNA, 19 nt, Homo sapiens
caggaaacuuacaaucaug

SEQ ID NO: 1546690 - RNA, 19 nt, Homo sapiens
gggauuaggccucaucauc

SEQ ID NO: 1546691 - RNA, 19 nt, Homo sapiens
caaaacaucuguacacaac

SEQ ID NO: 1546692 - RNA, 19 nt, Homo sapiens
ggucauaugagcauuuauc

SEQ ID NO: 1546693 - RNA, 19 nt, Homo sapiens
aaacacagcagaccaaacu

SEQ ID NO: 1546694 - RNA, 19 nt, Homo sapiens
agaagaaccauacuauuag

SEQ ID NO: 1546695 - RNA, 19 nt, Homo sapiens
gguaaagcccaacugguau

SEQ ID NO: 1546696 - RNA, 19 nt, Homo sapiens
aaagaggagucagcaacaa

SEQ ID NO: 1546697 - RNA, 19 nt, Homo sapiens
cagaaggccucccacaaaa

SEQ ID NO: 1546698 - RNA, 19 nt, Homo sapiens
caagcagugaugauaauga

SEQ ID NO: 1546699 - RNA, 19 nt, Homo sapiens
gauguucugauuaguguug

SEQ ID NO: 1546700 - RNA, 19 nt, Homo sapiens
uaucaaggacugucuguag

SEQ ID NO: 1546701 - RNA, 19 nt, Homo sapiens
gaagcaagacaaugaaagc

SEQ ID NO: 1546702 - RNA, 19 nt, Homo sapiens
aaucaagguuuaccgagau

SEQ ID NO: 1546703 - RNA, 19 nt, Homo sapiens
ugcuacaaaucaagguuua

SEQ ID NO: 1546704 - RNA, 19 nt, Homo sapiens
caaaucuguggucauauga

SEQ ID NO: 1546705 - RNA, 19 nt, Homo sapiens
ccagaucacccaccucauc

SEQ ID NO: 1546706 - RNA, 19 nt, Homo sapiens
cauacuggauaauggugaa

SEQ ID NO: 1546707 - RNA, 19 nt, Homo sapiens
acagagacgacaagaaaga

SEQ ID NO: 1546708 - RNA, 19 nt, Homo sapiens
gcauggauauaagaagaag

SEQ ID NO: 1546709 - RNA, 19 nt, Homo sapiens
agacuggcauggauauaag

SEQ ID NO: 1546710 - RNA, 19 nt, Homo sapiens
acauaucacuauuggaaca

SEQ ID NO: 1546711 - RNA, 19 nt, Homo sapiens
guuaggauauacucuucga

SEQ ID NO: 1546712 - RNA, 19 nt, Homo sapiens
gaagaggaaggaggugaug

SEQ ID NO: 1546713 - RNA, 19 nt, Homo sapiens
ggaaaagacauuaauugug

SEQ ID NO: 1546714 - RNA, 19 nt, Homo sapiens
uuacagcuuuugcaacaua

SEQ ID NO: 1546715 - RNA, 19 nt, Homo sapiens
aagaagaagaaccauacua

SEQ ID NO: 1546716 - RNA, 19 nt, Homo sapiens
gaauggcaagaaauauaug

SEQ ID NO: 1546717 - RNA, 19 nt, Homo sapiens
aaagguugguuagcaaauc

SEQ ID NO: 1546718 - RNA, 19 nt, Homo sapiens
gcagugaugauaaugaaaa

SEQ ID NO: 1546719 - RNA, 19 nt, Homo sapiens
ggccaaauucccaguaaca

SEQ ID NO: 1546720 - RNA, 19 nt, Homo sapiens
aggauauacucuucgagaa

SEQ ID NO: 1546721 - RNA, 19 nt, Homo sapiens
augccaauguguuaggaua

SEQ ID NO: 1546722 - RNA, 19 nt, Homo sapiens
aggaggugauguucugauu

SEQ ID NO: 1546723 - RNA, 19 nt, Homo sapiens
cauuaauugugacgugaug

SEQ ID NO: 1546724 - RNA, 19 nt, Homo sapiens
aaucauggcagaaggugaa

SEQ ID NO: 1546725 - RNA, 19 nt, Homo sapiens
uuuaaucccugaggccaaa

SEQ ID NO: 1546726 - RNA, 19 nt, Homo sapiens
guguuaggauauacucuuc

SEQ ID NO: 1546727 - RNA, 19 nt, Homo sapiens
ucaaagguugguuagcaaa

SEQ ID NO: 1546728 - RNA, 19 nt, Homo sapiens
cauuuuggcuggaagauug

SEQ ID NO: 1546729 - RNA, 19 nt, Homo sapiens
ggugaagcaagacaaugaa

SEQ ID NO: 1546730 - RNA, 19 nt, Homo sapiens
ggugauguucugauuagug

SEQ ID NO: 1546731 - RNA, 19 nt, Homo sapiens
gaaggaggugauguucuga

SEQ ID NO: 1546732 - RNA, 19 nt, Homo sapiens
caaagguugguuagcaaau

SEQ ID NO: 1546733 - RNA, 19 nt, Homo sapiens
guaaagcccaacugguauc

SEQ ID NO: 1546734 - RNA, 19 nt, Homo sapiens
aacaagcacaccaaagaaa

SEQ ID NO: 1546735 - RNA, 19 nt, Homo sapiens
ccaaauucccaguaacaag

SEQ ID NO: 1546736 - RNA, 19 nt, Homo sapiens
gugcuacaaaucaagguuu

SEQ ID NO: 1546737 - RNA, 19 nt, Homo sapiens
uugcuguacuuaucaagga

SEQ ID NO: 1546738 - RNA, 19 nt, Homo sapiens
gugaagcaagacaaugaaa

SEQ ID NO: 1546739 - RNA, 19 nt, Homo sapiens
gagacgacaagaaagaagu

SEQ ID NO: 1546740 - RNA, 19 nt, Homo sapiens
gcaaaacacagcagaccaa

SEQ ID NO: 1546741 - RNA, 19 nt, Homo sapiens
uaacaaggcugccauuuaa

SEQ ID NO: 1546742 - RNA, 19 nt, Homo sapiens
caagaagugugcaauauuu

SEQ ID NO: 1546743 - RNA, 19 nt, Homo sapiens
gcaaaucaaugccaauguu

SEQ ID NO: 1546744 - RNA, 19 nt, Homo sapiens
ccuaaaggcuugugaauau

SEQ ID NO: 1546745 - RNA, 19 nt, Homo sapiens
gccaagaucucaaggcuuu

SEQ ID NO: 1546746 - RNA, 19 nt, Homo sapiens
cuacaauucucacuguuua

SEQ ID NO: 1546747 - RNA, 19 nt, Homo sapiens
caucuuagcuuucacuugu

SEQ ID NO: 1546748 - RNA, 19 nt, Homo sapiens
cuaauaggcuuguucuuug

SEQ ID NO: 1546749 - RNA, 19 nt, Homo sapiens
gacaagaagugugcaauau

SEQ ID NO: 1546750 - RNA, 19 nt, Homo sapiens
gagaguaguugcaccauca

SEQ ID NO: 1546751 - RNA, 19 nt, Homo sapiens
ggaaaacucuccauuaugu

SEQ ID NO: 1546752 - RNA, 19 nt, Homo sapiens
guaguugcaccaucaauua

SEQ ID NO: 1546753 - RNA, 19 nt, Homo sapiens
agaggagacuuacugaaua

SEQ ID NO: 1546754 - RNA, 19 nt, Homo sapiens
gaauauacaagucuacuga

SEQ ID NO: 1546755 - RNA, 19 nt, Homo sapiens
gaggagacuuacugaauau

SEQ ID NO: 1546756 - RNA, 19 nt, Homo sapiens
ggaauuugauagucauugu

SEQ ID NO: 1546757 - RNA, 19 nt, Homo sapiens
gaugaaguauguauguaug

SEQ ID NO: 1546758 - RNA, 19 nt, Homo sapiens
caauaugucuugugaugau

SEQ ID NO: 1546759 - RNA, 19 nt, Homo sapiens
caaaucaaugccaauguua

SEQ ID NO: 1546760 - RNA, 19 nt, Homo sapiens
gaggaaaacucuccauuau

SEQ ID NO: 1546761 - RNA, 19 nt, Homo sapiens
gagaggagacuuacugaau

SEQ ID NO: 1546762 - RNA, 19 nt, Homo sapiens
guaaauagcaaaucaaugc

SEQ ID NO: 1546763 - RNA, 19 nt, Homo sapiens
gauuaccuguguuucagua

SEQ ID NO: 1546764 - RNA, 19 nt, Homo sapiens
ucuuugaacugcagcaaua

SEQ ID NO: 1546765 - RNA, 19 nt, Homo sapiens
uuaacaaggcugccauuua

SEQ ID NO: 1546766 - RNA, 19 nt, Homo sapiens
aaacagaaccucauucagu

SEQ ID NO: 1546767 - RNA, 19 nt, Homo sapiens
gugccuggccucuuuaaua

SEQ ID NO: 1546768 - RNA, 19 nt, Homo sapiens
cagcaacuauugugguuau

SEQ ID NO: 1546769 - RNA, 19 nt, Homo sapiens
uaccuguguuucaguauua

SEQ ID NO: 1546770 - RNA, 19 nt, Homo sapiens
aauuauagcugcucgaugu

SEQ ID NO: 1546771 - RNA, 19 nt, Homo sapiens
cuaaaggcuugugaauaua

SEQ ID NO: 1546772 - RNA, 19 nt, Homo sapiens
ugccuggccucuuuaauaa

SEQ ID NO: 1546773 - RNA, 19 nt, Homo sapiens
aaacauuggauucagcuua

SEQ ID NO: 1546774 - RNA, 19 nt, Homo sapiens
gcaauauuuaccuggauua

SEQ ID NO: 1546775 - RNA, 19 nt, Homo sapiens
ugggauugcuguaaauauu

SEQ ID NO: 1546776 - RNA, 19 nt, Homo sapiens
gcagaugaaguauguaugu

SEQ ID NO: 1546777 - RNA, 19 nt, Homo sapiens
cauuaucagugcuuuggua

SEQ ID NO: 1546778 - RNA, 19 nt, Homo sapiens
ugacaagaagugugcaaua

SEQ ID NO: 1546779 - RNA, 19 nt, Homo sapiens
cuucagauccugcaaauau

SEQ ID NO: 1546780 - RNA, 19 nt, Homo sapiens
cagaauacaauaugucuug

SEQ ID NO: 1546781 - RNA, 19 nt, Homo sapiens
caccgugccuggccucuuu

SEQ ID NO: 1546782 - RNA, 19 nt, Homo sapiens
cagaugaaguauguaugua

SEQ ID NO: 1546783 - RNA, 19 nt, Homo sapiens
gaauaagugauacagcaaa

SEQ ID NO: 1546784 - RNA, 19 nt, Homo sapiens
caaugacaaucuucacuca

SEQ ID NO: 1546785 - RNA, 19 nt, Homo sapiens
gaggguauucuauauauuc

SEQ ID NO: 1546786 - RNA, 19 nt, Homo sapiens
gcaaacuacuguaaauagc

SEQ ID NO: 1546787 - RNA, 19 nt, Homo sapiens
aacagaaccucauucaguu

SEQ ID NO: 1546788 - RNA, 19 nt, Homo sapiens
ccuggccucuuuaauaauu

SEQ ID NO: 1546789 - RNA, 19 nt, Homo sapiens
gccuggaacugguuaauag

SEQ ID NO: 1546790 - RNA, 19 nt, Homo sapiens
cgaguuguaucccugauuc

SEQ ID NO: 1546791 - RNA, 19 nt, Homo sapiens
ggagacuuacugaauauau

SEQ ID NO: 1546792 - RNA, 19 nt, Homo sapiens
guagguaaauaugugcauu

SEQ ID NO: 1546793 - RNA, 19 nt, Homo sapiens
agagaguguuaaugacaua

SEQ ID NO: 1546794 - RNA, 19 nt, Homo sapiens
guuuagagaguguuaauga

SEQ ID NO: 1546795 - RNA, 19 nt, Homo sapiens
ucuaauaggcuuguucuuu

SEQ ID NO: 1546796 - RNA, 19 nt, Homo sapiens
cuuaagaggguauucuaua

SEQ ID NO: 1546797 - RNA, 19 nt, Homo sapiens
guuaaugacauacugugua

SEQ ID NO: 1546798 - RNA, 19 nt, Homo sapiens
uaucagugcuuugguacuu

SEQ ID NO: 1546799 - RNA, 19 nt, Homo sapiens
gggauugcuguaaauauuu

SEQ ID NO: 1546800 - RNA, 19 nt, Homo sapiens
caccaugcccagcuaauuu

SEQ ID NO: 1546801 - RNA, 19 nt, Homo sapiens
gcuauuaugugugccuuuc

SEQ ID NO: 1546802 - RNA, 19 nt, Homo sapiens
guuaauagacccugagaca

SEQ ID NO: 1546803 - RNA, 19 nt, Homo sapiens
ugugugccuuucauucuua

SEQ ID NO: 1546804 - RNA, 19 nt, Homo sapiens
ggaauacacaagagaguag

SEQ ID NO: 1546805 - RNA, 19 nt, Homo sapiens
uaauagacccugagacaca

SEQ ID NO: 1546806 - RNA, 19 nt, Homo sapiens
gauggugacucauuaucag

SEQ ID NO: 1546807 - RNA, 19 nt, Homo sapiens
cuauugggauugcuguaaa

SEQ ID NO: 1546808 - RNA, 19 nt, Homo sapiens
cauaauagccgcauguacu

SEQ ID NO: 1546809 - RNA, 19 nt, Homo sapiens
aaaauagccuuucuucgaa

SEQ ID NO: 1546810 - RNA, 19 nt, Homo sapiens
uaaaauagccuuucuucga

SEQ ID NO: 1546811 - RNA, 19 nt, Homo sapiens
gacggagucucgcucuguu

SEQ ID NO: 1546812 - RNA, 19 nt, Homo sapiens
uaaaccagauauugaacuc

SEQ ID NO: 1546813 - RNA, 19 nt, Homo sapiens
ccacagcucuuuaaaacug

SEQ ID NO: 1546814 - RNA, 19 nt, Homo sapiens
ucagauccugcaaauauuu

SEQ ID NO: 1546815 - RNA, 19 nt, Homo sapiens
aaaccuaggccucauguuc

SEQ ID NO: 1546816 - RNA, 19 nt, Homo sapiens
uguauugucugggaauuug

SEQ ID NO: 1546817 - RNA, 19 nt, Homo sapiens
acaagaagugugcaauauu

SEQ ID NO: 1546818 - RNA, 19 nt, Homo sapiens
aauagccuuucuucgaaua

SEQ ID NO: 1546819 - RNA, 19 nt, Homo sapiens
gcaacuauugugguuauau

SEQ ID NO: 1546820 - RNA, 19 nt, Homo sapiens
gaacuccagcaacuauugu

SEQ ID NO: 1546821 - RNA, 19 nt, Homo sapiens
cauguucaaugacaaucuu

SEQ ID NO: 1546822 - RNA, 19 nt, Homo sapiens
gccuuucauucuuacauuu

SEQ ID NO: 1546823 - RNA, 19 nt, Homo sapiens
uagcagcaacugacaagaa

SEQ ID NO: 1546824 - RNA, 19 nt, Homo sapiens
ucacaucauuauggaauca

SEQ ID NO: 1546825 - RNA, 19 nt, Homo sapiens
ggaguggugccagaaacua

SEQ ID NO: 1546826 - RNA, 19 nt, Homo sapiens
guggcacgaucuuggcuuu

SEQ ID NO: 1546827 - RNA, 19 nt, Homo sapiens
gaugauacaggaaaacuaa

SEQ ID NO: 1546828 - RNA, 19 nt, Homo sapiens
agaaacagaaccucauuca

SEQ ID NO: 1546829 - RNA, 19 nt, Homo sapiens
guacuucagauccugcaaa

SEQ ID NO: 1546830 - RNA, 19 nt, Homo sapiens
uuaccuguguuucaguauu

SEQ ID NO: 1546831 - RNA, 19 nt, Homo sapiens
uguaauuggucauccuaug

SEQ ID NO: 1546832 - RNA, 19 nt, Homo sapiens
uuaccuggauuaucuugau

SEQ ID NO: 1546833 - RNA, 19 nt, Homo sapiens
agccgcauguacuauaaua

SEQ ID NO: 1546834 - RNA, 19 nt, Homo sapiens
guaaaggucauagcagcaa

SEQ ID NO: 1546835 - RNA, 19 nt, Homo sapiens
gcacgaucuuggcuuucug

SEQ ID NO: 1546836 - RNA, 19 nt, Homo sapiens
cuaaucauacugcaggaaa

SEQ ID NO: 1546837 - RNA, 19 nt, Homo sapiens
guugcaccaucaauuauag

SEQ ID NO: 1546838 - RNA, 19 nt, Homo sapiens
cuuguucuuugcuggaaua

SEQ ID NO: 1546839 - RNA, 19 nt, Homo sapiens
auaauagccgcauguacua

SEQ ID NO: 1546840 - RNA, 19 nt, Homo sapiens
ugaggaaaacucuccauua

SEQ ID NO: 1546841 - RNA, 19 nt, Homo sapiens
gaaggaaacugcauucaga

SEQ ID NO: 1546842 - RNA, 19 nt, Homo sapiens
caacagcucuggagaagaa

SEQ ID NO: 1546843 - RNA, 19 nt, Homo sapiens
ucacagacaucccaacaua

SEQ ID NO: 1546844 - RNA, 19 nt, Homo sapiens
gcaaacagaccacccaaua

SEQ ID NO: 1546845 - RNA, 19 nt, Homo sapiens
gaaagaacgucucauacug

SEQ ID NO: 1546846 - RNA, 19 nt, Homo sapiens
guuaugagauuccuuauga

SEQ ID NO: 1546847 - RNA, 19 nt, Homo sapiens
uaacaguccuccagaaauu

SEQ ID NO: 1546848 - RNA, 19 nt, Homo sapiens
gagcaggacuuuacuuuca

SEQ ID NO: 1546849 - RNA, 19 nt, Homo sapiens
gaaaugucguguagugaaa

SEQ ID NO: 1546850 - RNA, 19 nt, Homo sapiens
gaaagcacuuccuguauuc

SEQ ID NO: 1546851 - RNA, 19 nt, Homo sapiens
aagcacaggucaugaaaua

SEQ ID NO: 1546852 - RNA, 19 nt, Homo sapiens
caaaugagcgugucagaaa

SEQ ID NO: 1546853 - RNA, 19 nt, Homo sapiens
gaacuaugcuugggaaaca

SEQ ID NO: 1546854 - RNA, 19 nt, Homo sapiens
ugaaagcacuuccuguauu

SEQ ID NO: 1546855 - RNA, 19 nt, Homo sapiens
cuacguaacuuucuguuga

SEQ ID NO: 1546856 - RNA, 19 nt, Homo sapiens
ucacuggacugaaaugaaa

SEQ ID NO: 1546857 - RNA, 19 nt, Homo sapiens
gcaagcaguuaccaucaaa

SEQ ID NO: 1546858 - RNA, 19 nt, Homo sapiens
gaaauacaguccucuaucg

SEQ ID NO: 1546859 - RNA, 19 nt, Homo sapiens
caucaaaggcagcauauuu

SEQ ID NO: 1546860 - RNA, 19 nt, Homo sapiens
gucaagagauguccaaaug

SEQ ID NO: 1546861 - RNA, 19 nt, Homo sapiens
gaagauaugucagcucaag

SEQ ID NO: 1546862 - RNA, 19 nt, Homo sapiens
ccaagaugcucauauaaca

SEQ ID NO: 1546863 - RNA, 19 nt, Homo sapiens
ggacaaagaugagcauggu

SEQ ID NO: 1546864 - RNA, 19 nt, Homo sapiens
uaguagagcuuguuuagga

SEQ ID NO: 1546865 - RNA, 19 nt, Homo sapiens
ggaagaauucacaagauaa

SEQ ID NO: 1546866 - RNA, 19 nt, Homo sapiens
gcagccaaauccaguauau

SEQ ID NO: 1546867 - RNA, 19 nt, Homo sapiens
aagaagauguuccaaguga

SEQ ID NO: 1546868 - RNA, 19 nt, Homo sapiens
gcacaggucaugaaauaga

SEQ ID NO: 1546869 - RNA, 19 nt, Homo sapiens
gcagguagcauucaaaaua

SEQ ID NO: 1546870 - RNA, 19 nt, Homo sapiens
ugaagaagauguuccaagu

SEQ ID NO: 1546871 - RNA, 19 nt, Homo sapiens
ugagauuccuuaugaaguu

SEQ ID NO: 1546872 - RNA, 19 nt, Homo sapiens
gauugaagguggagagaga

SEQ ID NO: 1546873 - RNA, 19 nt, Homo sapiens
caagagauguccaaaugca

SEQ ID NO: 1546874 - RNA, 19 nt, Homo sapiens
ucagaaaugucguguagug

SEQ ID NO: 1546875 - RNA, 19 nt, Homo sapiens
gauuggaaauuaugcaguu

SEQ ID NO: 1546876 - RNA, 19 nt, Homo sapiens
cucuaaaucuucacucuua

SEQ ID NO: 1546877 - RNA, 19 nt, Homo sapiens
gaaacuguucucucucuaa

SEQ ID NO: 1546878 - RNA, 19 nt, Homo sapiens
ugagaaacguacacuauca

SEQ ID NO: 1546879 - RNA, 19 nt, Homo sapiens
gagaugauaggcuggauuu

SEQ ID NO: 1546880 - RNA, 19 nt, Homo sapiens
gaaaagagaagagaugaua

SEQ ID NO: 1546881 - RNA, 19 nt, Homo sapiens
gggaaacaaggcagaaaua

SEQ ID NO: 1546882 - RNA, 19 nt, Homo sapiens
aggaagaauucacaagaua

SEQ ID NO: 1546883 - RNA, 19 nt, Homo sapiens
aaacuguucucucucuaaa

SEQ ID NO: 1546884 - RNA, 19 nt, Homo sapiens
uaacaaacgcagcaugaaa

SEQ ID NO: 1546885 - RNA, 19 nt, Homo sapiens
caugaggccuuauccagaa

SEQ ID NO: 1546886 - RNA, 19 nt, Homo sapiens
uaaauaucaugaggccuua

SEQ ID NO: 1546887 - RNA, 19 nt, Homo sapiens
gcaggacuuuacuuucaaa

SEQ ID NO: 1546888 - RNA, 19 nt, Homo sapiens
acagacaucccaacauaua

SEQ ID NO: 1546889 - RNA, 19 nt, Homo sapiens
ggaaagaacgucucauacu

SEQ ID NO: 1546890 - RNA, 19 nt, Homo sapiens
agagagaaccuguggagua

SEQ ID NO: 1546891 - RNA, 19 nt, Homo sapiens
gaaggaagcacaggucaug

SEQ ID NO: 1546892 - RNA, 19 nt, Homo sapiens
aguccaagaugcucauaua

SEQ ID NO: 1546893 - RNA, 19 nt, Homo sapiens
gaaacaaggcagaaauaca

SEQ ID NO: 1546894 - RNA, 19 nt, Homo sapiens
uaaagcagguagcauucaa

SEQ ID NO: 1546895 - RNA, 19 nt, Homo sapiens
gcuaauagagcaggacuuu

SEQ ID NO: 1546896 - RNA, 19 nt, Homo sapiens
gcuuuaaguucuauggaaa

SEQ ID NO: 1546897 - RNA, 19 nt, Homo sapiens
gagagaaccuguggaguac

SEQ ID NO: 1546898 - RNA, 19 nt, Homo sapiens
caaauccaguauauaagga

SEQ ID NO: 1546899 - RNA, 19 nt, Homo sapiens
augaagcgcuggguaaaua

SEQ ID NO: 1546900 - RNA, 19 nt, Homo sapiens
caaggaagaauucacaaga

SEQ ID NO: 1546901 - RNA, 19 nt, Homo sapiens
gaaacguacacuaucauug

SEQ ID NO: 1546902 - RNA, 19 nt, Homo sapiens
gaaccuucuuacaaucauu

SEQ ID NO: 1546903 - RNA, 19 nt, Homo sapiens
uaugucagcucaaggauca

SEQ ID NO: 1546904 - RNA, 19 nt, Homo sapiens
ggaaacugcauucagagaa

SEQ ID NO: 1546905 - RNA, 19 nt, Homo sapiens
cagcuugaacguuguauuu

SEQ ID NO: 1546906 - RNA, 19 nt, Homo sapiens
ggcagcauauuuccaauuc

SEQ ID NO: 1546907 - RNA, 19 nt, Homo sapiens
gagaagaagaacucaauca

SEQ ID NO: 1546908 - RNA, 19 nt, Homo sapiens
gcagaaauacaguccucua

SEQ ID NO: 1546909 - RNA, 19 nt, Homo sapiens
guugaaagcacuuccugua

SEQ ID NO: 1546910 - RNA, 19 nt, Homo sapiens
ccaacucuaucauaaguca

SEQ ID NO: 1546911 - RNA, 19 nt, Homo sapiens
ggacagcaaguauguagau

SEQ ID NO: 1546912 - RNA, 19 nt, Homo sapiens
ggaagcacaggucaugaaa

SEQ ID NO: 1546913 - RNA, 19 nt, Homo sapiens
gagauuccuuaugaaguuu

SEQ ID NO: 1546914 - RNA, 19 nt, Homo sapiens
uagauaagcugucgaaaau

SEQ ID NO: 1546915 - RNA, 19 nt, Homo sapiens
cuuauuggccugcuuuaua

SEQ ID NO: 1546916 - RNA, 19 nt, Homo sapiens
uauaacaagugcccaagug

SEQ ID NO: 1546917 - RNA, 19 nt, Homo sapiens
uuucugcucugaguauuua

SEQ ID NO: 1546918 - RNA, 19 nt, Homo sapiens
ugucagaaaugucguguag

SEQ ID NO: 1546919 - RNA, 19 nt, Homo sapiens
cugagaugauuggaaauua

SEQ ID NO: 1546920 - RNA, 19 nt, Homo sapiens
gaauacaguacaaggaaga

SEQ ID NO: 1546921 - RNA, 19 nt, Homo sapiens
gagaaccuguggaguacau

SEQ ID NO: 1546922 - RNA, 19 nt, Homo sapiens
gaacgucucauacugacau

SEQ ID NO: 1546923 - RNA, 19 nt, Homo sapiens
caggacagguggcaacuca

SEQ ID NO: 1546924 - RNA, 19 nt, Homo sapiens
guacaaggaagaauucaca

SEQ ID NO: 1546925 - RNA, 19 nt, Homo sapiens
gugcaaacaaguauucauu

SEQ ID NO: 1546926 - RNA, 19 nt, Homo sapiens
agucauaucuaauggugaa

SEQ ID NO: 1546927 - RNA, 19 nt, Homo sapiens
uagaauaagcaagcaguua

SEQ ID NO: 1546928 - RNA, 19 nt, Homo sapiens
gaagaagaacucaaucacu

SEQ ID NO: 1546929 - RNA, 19 nt, Homo sapiens
gauaggcuggauuucuuua

SEQ ID NO: 1546930 - RNA, 19 nt, Homo sapiens
ggaagacuaucagcagaag

SEQ ID NO: 1546931 - RNA, 19 nt, Homo sapiens
ggcugugacucccaaauga

SEQ ID NO: 1546932 - RNA, 19 nt, Homo sapiens
uaugaagacuauccaguuc

SEQ ID NO: 1546933 - RNA, 19 nt, Homo sapiens
aaagaacgucucauacuga

SEQ ID NO: 1546934 - RNA, 19 nt, Homo sapiens
cucaaucacuggacugaaa

SEQ ID NO: 1546935 - RNA, 19 nt, Homo sapiens
aaacagaccacccaauaca

SEQ ID NO: 1546936 - RNA, 19 nt, Homo sapiens
uggcucaguuccagaaauu

SEQ ID NO: 1546937 - RNA, 19 nt, Homo sapiens
uaaagaaacagagagcaaa

SEQ ID NO: 1546938 - RNA, 19 nt, Homo sapiens
ggacagguggcaacucaug

SEQ ID NO: 1546939 - RNA, 19 nt, Homo sapiens
caucuucgcagcuuccuaa

SEQ ID NO: 1546940 - RNA, 19 nt, Homo sapiens
gaagauguuccaagugaca

SEQ ID NO: 1546941 - RNA, 19 nt, Homo sapiens
cuaaagaccuuaaccaaua

SEQ ID NO: 1546942 - RNA, 19 nt, Homo sapiens
guagacagcugauauguuu

SEQ ID NO: 1546943 - RNA, 19 nt, Homo sapiens
ggacuugguuugcauauaa

SEQ ID NO: 1546944 - RNA, 19 nt, Homo sapiens
ggauaugaauucccuguua

SEQ ID NO: 1546945 - RNA, 19 nt, Homo sapiens
gaaaggggaucaucuauuu

SEQ ID NO: 1546946 - RNA, 19 nt, Homo sapiens
ggacauggcuaaagaccuu

SEQ ID NO: 1546947 - RNA, 19 nt, Homo sapiens
ggacaacccuugaaaucau

SEQ ID NO: 1546948 - RNA, 19 nt, Homo sapiens
ugaaugauguuccugcuuu

SEQ ID NO: 1546949 - RNA, 19 nt, Homo sapiens
gagacacgcuuuacacguu

SEQ ID NO: 1546950 - RNA, 19 nt, Homo sapiens
gaagacugccaaauacaua

SEQ ID NO: 1546951 - RNA, 19 nt, Homo sapiens
ggaagaauguuucacuuac

SEQ ID NO: 1546952 - RNA, 19 nt, Homo sapiens
caaauggucaguuguagua

SEQ ID NO: 1546953 - RNA, 19 nt, Homo sapiens
ugaauucccuguuaguuga

SEQ ID NO: 1546954 - RNA, 19 nt, Homo sapiens
caacugauguuacugucuu

SEQ ID NO: 1546955 - RNA, 19 nt, Homo sapiens
caagaauguuugcauccua

SEQ ID NO: 1546956 - RNA, 19 nt, Homo sapiens
gcaguggucugguaucaag

SEQ ID NO: 1546957 - RNA, 19 nt, Homo sapiens
ucauagaaguucaguauag

SEQ ID NO: 1546958 - RNA, 19 nt, Homo sapiens
caucacaaauccaagaaug

SEQ ID NO: 1546959 - RNA, 19 nt, Homo sapiens
caagagcuuucugauguuu

SEQ ID NO: 1546960 - RNA, 19 nt, Homo sapiens
guauagcucuuuccuucaa

SEQ ID NO: 1546961 - RNA, 19 nt, Homo sapiens
guaagaguaucguaugcaa

SEQ ID NO: 1546962 - RNA, 19 nt, Homo sapiens
uaacguuggucauuucaau

SEQ ID NO: 1546963 - RNA, 19 nt, Homo sapiens
gaagaacuuggagacauua

SEQ ID NO: 1546964 - RNA, 19 nt, Homo sapiens
caucaucucauucacauuu

SEQ ID NO: 1546965 - RNA, 19 nt, Homo sapiens
gaaaucauguaacguuggu

SEQ ID NO: 1546966 - RNA, 19 nt, Homo sapiens
gauaugaauucccuguuag

SEQ ID NO: 1546967 - RNA, 19 nt, Homo sapiens
ccagugaauuguuggauau

SEQ ID NO: 1546968 - RNA, 19 nt, Homo sapiens
caucaguuguugaguuaaa

SEQ ID NO: 1546969 - RNA, 19 nt, Homo sapiens
ucaggaguguauuacuuua

SEQ ID NO: 1546970 - RNA, 19 nt, Homo sapiens
agaagaacuuggagacauu

SEQ ID NO: 1546971 - RNA, 19 nt, Homo sapiens
gcacuugcaacugauguua

SEQ ID NO: 1546972 - RNA, 19 nt, Homo sapiens
ugaauaaguccaucucaaa

SEQ ID NO: 1546973 - RNA, 19 nt, Homo sapiens
gcucuuuccuucaaauuca

SEQ ID NO: 1546974 - RNA, 19 nt, Homo sapiens
gguacacuguuacuugaaa

SEQ ID NO: 1546975 - RNA, 19 nt, Homo sapiens
cuacuuguauucuagaaga

SEQ ID NO: 1546976 - RNA, 19 nt, Homo sapiens
gaacuuggagacauuaaca

SEQ ID NO: 1546977 - RNA, 19 nt, Homo sapiens
cauuugaucuggauggauu

SEQ ID NO: 1546978 - RNA, 19 nt, Homo sapiens
ugaagacuauaucuccuuu

SEQ ID NO: 1546979 - RNA, 19 nt, Homo sapiens
gaaccacagcuuuauuaug

SEQ ID NO: 1546980 - RNA, 19 nt, Homo sapiens
guucaggaguguauuacuu

SEQ ID NO: 1546981 - RNA, 19 nt, Homo sapiens
ggaccaauguuuugugaaa

SEQ ID NO: 1546982 - RNA, 19 nt, Homo sapiens
aaccacagcuuuauuaugg

SEQ ID NO: 1546983 - RNA, 19 nt, Homo sapiens
gcuguuaucugugaagaau

SEQ ID NO: 1546984 - RNA, 19 nt, Homo sapiens
gcacgcaggacauggcuaa

SEQ ID NO: 1546985 - RNA, 19 nt, Homo sapiens
gaccuugguucugugauuu

SEQ ID NO: 1546986 - RNA, 19 nt, Homo sapiens
cauguaacguuggucauuu

SEQ ID NO: 1546987 - RNA, 19 nt, Homo sapiens
caaaggagguucaaaaugg

SEQ ID NO: 1546988 - RNA, 19 nt, Homo sapiens
uagcaucaguuguugaguu

SEQ ID NO: 1546989 - RNA, 19 nt, Homo sapiens
cagguacacuguuacuuga

SEQ ID NO: 1546990 - RNA, 19 nt, Homo sapiens
cauccuaaaugcuaguuug

SEQ ID NO: 1546991 - RNA, 19 nt, Homo sapiens
ccacuuguauaugcacuaa

SEQ ID NO: 1546992 - RNA, 19 nt, Homo sapiens
ggagaccguuaucuguuga

SEQ ID NO: 1546993 - RNA, 19 nt, Homo sapiens
ccaagaguagucaaauuaa

SEQ ID NO: 1546994 - RNA, 19 nt, Homo sapiens
aaagguuggugucagguaa

SEQ ID NO: 1546995 - RNA, 19 nt, Homo sapiens
ugaaagcuuugaagacuag

SEQ ID NO: 1546996 - RNA, 19 nt, Homo sapiens
uaacauuacggaccaggua

SEQ ID NO: 1546997 - RNA, 19 nt, Homo sapiens
caagaguagucaaauuaag

SEQ ID NO: 1546998 - RNA, 19 nt, Homo sapiens
uccaagaguagucaaauua

SEQ ID NO: 1546999 - RNA, 19 nt, Homo sapiens
ggugucagguaaugcauau

SEQ ID NO: 1547000 - RNA, 19 nt, Homo sapiens
aaacuuggguauucaugga

SEQ ID NO: 1547001 - RNA, 19 nt, Homo sapiens
gagacacuguucagaagau

SEQ ID NO: 1547002 - RNA, 19 nt, Homo sapiens
aaauucaacuagagccuuu

SEQ ID NO: 1547003 - RNA, 19 nt, Homo sapiens
gaaguucaguauaguacgu

SEQ ID NO: 1547004 - RNA, 19 nt, Homo sapiens
gaccuuaaccaauagcaaa

SEQ ID NO: 1547005 - RNA, 19 nt, Homo sapiens
uaaagaccuuaaccaauag

SEQ ID NO: 1547006 - RNA, 19 nt, Homo sapiens
gaccuacagugacuuaaag

SEQ ID NO: 1547007 - RNA, 19 nt, Homo sapiens
gaccucagucauauaauuu

SEQ ID NO: 1547008 - RNA, 19 nt, Homo sapiens
aagaauguuugcauccuaa

SEQ ID NO: 1547009 - RNA, 19 nt, Homo sapiens
gcuuuauuaugguccuuua

SEQ ID NO: 1547010 - RNA, 19 nt, Homo sapiens
guuaaaggccuaaaguuca

SEQ ID NO: 1547011 - RNA, 19 nt, Homo sapiens
caaaauggaagacuguuua

SEQ ID NO: 1547012 - RNA, 19 nt, Homo sapiens
gaacaggagaugagcaaag

SEQ ID NO: 1547013 - RNA, 19 nt, Homo sapiens
gcuaaagaccuuaaccaau

SEQ ID NO: 1547014 - RNA, 19 nt, Homo sapiens
gaggguaccuuuguauuuu

SEQ ID NO: 1547015 - RNA, 19 nt, Homo sapiens
ggccggaguuucagaagga

SEQ ID NO: 1547016 - RNA, 19 nt, Homo sapiens
ucaauuggaugcugcucaa

SEQ ID NO: 1547017 - RNA, 19 nt, Homo sapiens
auauuucucuguccacuuu

SEQ ID NO: 1547018 - RNA, 19 nt, Homo sapiens
cagagacacuguucagaag

SEQ ID NO: 1547019 - RNA, 19 nt, Homo sapiens
gugaauuguuggauaugaa

SEQ ID NO: 1547020 - RNA, 19 nt, Homo sapiens
aaauaccagugaauuguug

SEQ ID NO: 1547021 - RNA, 19 nt, Homo sapiens
uaugcaagcucucuguaug

SEQ ID NO: 1547022 - RNA, 19 nt, Homo sapiens
ugaggguaccuuuguauuu

SEQ ID NO: 1547023 - RNA, 19 nt, Homo sapiens
gcaaggcaaguuuacauca

SEQ ID NO: 1547024 - RNA, 19 nt, Homo sapiens
guauagaccagcaaacuuc

SEQ ID NO: 1547025 - RNA, 19 nt, Homo sapiens
gaacuacuuguauucuaga

SEQ ID NO: 1547026 - RNA, 19 nt, Homo sapiens
ggucugguaucaagagcuu

SEQ ID NO: 1547027 - RNA, 19 nt, Homo sapiens
cauugaggguugcagaauu

SEQ ID NO: 1547028 - RNA, 19 nt, Homo sapiens
cuaaugucaugacccaauu

SEQ ID NO: 1547029 - RNA, 19 nt, Homo sapiens
ugaccuugguucugugauu

SEQ ID NO: 1547030 - RNA, 19 nt, Homo sapiens
agcaucaguuguugaguua

SEQ ID NO: 1547031 - RNA, 19 nt, Homo sapiens
uauauugaguccacguuug

SEQ ID NO: 1547032 - RNA, 19 nt, Homo sapiens
ucaagagcuuucugauguu

SEQ ID NO: 1547033 - RNA, 19 nt, Homo sapiens
aaaguucaggaguguauua

SEQ ID NO: 1547034 - RNA, 19 nt, Homo sapiens
gaacauaccaagaaaauac

SEQ ID NO: 1547035 - RNA, 19 nt, Homo sapiens
ugagaagaguguacuugug

SEQ ID NO: 1547036 - RNA, 19 nt, Homo sapiens
gaaacgaacaggagaugag

SEQ ID NO: 1547037 - RNA, 19 nt, Homo sapiens
ugacccaauuuguguuauu

SEQ ID NO: 1547038 - RNA, 19 nt, Homo sapiens
gggaaugguuuucaaagaa

SEQ ID NO: 1547039 - RNA, 19 nt, Homo sapiens
gacaacccuugaaaucaug

SEQ ID NO: 1547040 - RNA, 19 nt, Homo sapiens
cauuuaagagguugucuaa

SEQ ID NO: 1547041 - RNA, 19 nt, Homo sapiens
ggagaugaauccuuaauaa

SEQ ID NO: 1547042 - RNA, 19 nt, Homo sapiens
gaaauccagucucuacuua

SEQ ID NO: 1547043 - RNA, 19 nt, Homo sapiens
gagaaggccuuuaucuaua

SEQ ID NO: 1547044 - RNA, 19 nt, Homo sapiens
gcaaagauguugagaagga

SEQ ID NO: 1547045 - RNA, 19 nt, Homo sapiens
gugaacagcuccaacuuua

SEQ ID NO: 1547046 - RNA, 19 nt, Homo sapiens
ggaaauccuugaacucuaa

SEQ ID NO: 1547047 - RNA, 19 nt, Homo sapiens
gaaaugggcugucuuacca

SEQ ID NO: 1547048 - RNA, 19 nt, Homo sapiens
gaagguacauauaacagaa

SEQ ID NO: 1547049 - RNA, 19 nt, Homo sapiens
gcagugaugcuucauauuu

SEQ ID NO: 1547050 - RNA, 19 nt, Homo sapiens
ccacugugcuuaccaaauu

SEQ ID NO: 1547051 - RNA, 19 nt, Homo sapiens
ggaaauccuucauauacaa

SEQ ID NO: 1547052 - RNA, 19 nt, Homo sapiens
ggaccugcaugaauuguuu

SEQ ID NO: 1547053 - RNA, 19 nt, Homo sapiens
caacaaagacguuacaaau

SEQ ID NO: 1547054 - RNA, 19 nt, Homo sapiens
gaagagcccuagcaauugu

SEQ ID NO: 1547055 - RNA, 19 nt, Homo sapiens
gagaaaggccuuaugaaug

SEQ ID NO: 1547056 - RNA, 19 nt, Homo sapiens
acaaagacguuacaaaugu

SEQ ID NO: 1547057 - RNA, 19 nt, Homo sapiens
gaccuuugauucuccuuua

SEQ ID NO: 1547058 - RNA, 19 nt, Homo sapiens
gaugccagauuuauuugua

SEQ ID NO: 1547059 - RNA, 19 nt, Homo sapiens
gaacagcuccaacuuuaug

SEQ ID NO: 1547060 - RNA, 19 nt, Homo sapiens
cagaagagcccuagcaauu

SEQ ID NO: 1547061 - RNA, 19 nt, Homo sapiens
gcugggaccugcaugaauu

SEQ ID NO: 1547062 - RNA, 19 nt, Homo sapiens
gcagagaauucacacuaga

SEQ ID NO: 1547063 - RNA, 19 nt, Homo sapiens
gagagaaacacaucagaaa

SEQ ID NO: 1547064 - RNA, 19 nt, Homo sapiens
gaaauucacccucauacau

SEQ ID NO: 1547065 - RNA, 19 nt, Homo sapiens
gaaaucauuccuccauaaa

SEQ ID NO: 1547066 - RNA, 19 nt, Homo sapiens
ggagagaggccuuaugugu

SEQ ID NO: 1547067 - RNA, 19 nt, Homo sapiens
agagaaaggucuuaugugu

SEQ ID NO: 1547068 - RNA, 19 nt, Homo sapiens
aaaggugccuguaucauga

SEQ ID NO: 1547069 - RNA, 19 nt, Homo sapiens
gaaagcaggauuugagaga

SEQ ID NO: 1547070 - RNA, 19 nt, Homo sapiens
guaugaaugugguaaaugu

SEQ ID NO: 1547071 - RNA, 19 nt, Homo sapiens
ggaaagccuucaucuccaa

SEQ ID NO: 1547072 - RNA, 19 nt, Homo sapiens
agaaagggcuuaugaaugc

SEQ ID NO: 1547073 - RNA, 19 nt, Homo sapiens
caauauaugugggaaauca

SEQ ID NO: 1547074 - RNA, 19 nt, Homo sapiens
gcucaaaggugccuguauc

SEQ ID NO: 1547075 - RNA, 19 nt, Homo sapiens
gagaaagggcuuaugaaug

SEQ ID NO: 1547076 - RNA, 19 nt, Homo sapiens
ggagaaagggcuuaugaau

SEQ ID NO: 1547077 - RNA, 19 nt, Homo sapiens
gagccaaggucgcgccauu

SEQ ID NO: 1547078 - RNA, 19 nt, Homo sapiens
gggaagcuuucuagagauu

SEQ ID NO: 1547079 - RNA, 19 nt, Homo sapiens
gcaccagccucauucaaca

SEQ ID NO: 1547080 - RNA, 19 nt, Homo sapiens
caucauaugugggaaauca

SEQ ID NO: 1547081 - RNA, 19 nt, Homo sapiens
ggagaaaggccuuaugagu

SEQ ID NO: 1547082 - RNA, 19 nt, Homo sapiens
gaaaucauuccgccacaaa

SEQ ID NO: 1547083 - RNA, 19 nt, Homo sapiens
cugaaggacugaauuggua

SEQ ID NO: 1547084 - RNA, 19 nt, Homo sapiens
gaacaccagagaacccaua

SEQ ID NO: 1547085 - RNA, 19 nt, Homo sapiens
gaacaccagagaacccaua

SEQ ID NO: 1547086 - RNA, 19 nt, Homo sapiens
gggaaauccuugaacucua

SEQ ID NO: 1547087 - RNA, 19 nt, Homo sapiens
ggccaggacuccaaagcua

SEQ ID NO: 1547088 - RNA, 19 nt, Homo sapiens
caugugaccuuugaggaua

SEQ ID NO: 1547089 - RNA, 19 nt, Homo sapiens
ugagaaggccuuuaucuau

SEQ ID NO: 1547090 - RNA, 19 nt, Homo sapiens
guggaaccauuuaucuuaa

SEQ ID NO: 1547091 - RNA, 19 nt, Homo sapiens
gagauuacuuguacuuucu

SEQ ID NO: 1547092 - RNA, 19 nt, Homo sapiens
gcauaucacuaguugaaag

SEQ ID NO: 1547093 - RNA, 19 nt, Homo sapiens
ggagagaggccuuauaacu

SEQ ID NO: 1547094 - RNA, 19 nt, Homo sapiens
ggauauugcuguguacuuc

SEQ ID NO: 1547095 - RNA, 19 nt, Homo sapiens
agaacugucuguaugguuu

SEQ ID NO: 1547096 - RNA, 19 nt, Homo sapiens
cacaaaaccuucuaucuuu

SEQ ID NO: 1547097 - RNA, 19 nt, Homo sapiens
gcacugaaggacugaauug

SEQ ID NO: 1547098 - RNA, 19 nt, Homo sapiens
gggaaauccuucauauaca

SEQ ID NO: 1547099 - RNA, 19 nt, Homo sapiens
uuacaaaugugagcaaguu

SEQ ID NO: 1547100 - RNA, 19 nt, Homo sapiens
aaggagagguagaugcaua

SEQ ID NO: 1547101 - RNA, 19 nt, Homo sapiens
uuuguggacucauaacuua

SEQ ID NO: 1547102 - RNA, 19 nt, Homo sapiens
caacagacacuaccaugug

SEQ ID NO: 1547103 - RNA, 19 nt, Homo sapiens
aaacacuucuuaagcauca

SEQ ID NO: 1547104 - RNA, 19 nt, Homo sapiens
agggagaccuuucaacaaa

SEQ ID NO: 1547105 - RNA, 19 nt, Homo sapiens
ggagagaaacacaucagaa

SEQ ID NO: 1547106 - RNA, 19 nt, Homo sapiens
caacacacaucgucagcau

SEQ ID NO: 1547107 - RNA, 19 nt, Homo sapiens
gcagagcugugugguccua

SEQ ID NO: 1547108 - RNA, 19 nt, Homo sapiens
gauauucccucucccacau

SEQ ID NO: 1547109 - RNA, 19 nt, Homo sapiens
gagagaggccuuauaacug

SEQ ID NO: 1547110 - RNA, 19 nt, Homo sapiens
gaaugugggaaaugcuuua

SEQ ID NO: 1547111 - RNA, 19 nt, Homo sapiens
agaaaggccuuaugaaugc

SEQ ID NO: 1547112 - RNA, 19 nt, Homo sapiens
gaacugucuguaugguuua

SEQ ID NO: 1547113 - RNA, 19 nt, Homo sapiens
guggagagaggccuuauaa

SEQ ID NO: 1547114 - RNA, 19 nt, Homo sapiens
gagaauucauacuggagaa

SEQ ID NO: 1547115 - RNA, 19 nt, Homo sapiens
caaauacucacuuguggaa

SEQ ID NO: 1547116 - RNA, 19 nt, Homo sapiens
guugaugccagauuuauuu

SEQ ID NO: 1547117 - RNA, 19 nt, Homo sapiens
caccagaagguacauauaa

SEQ ID NO: 1547118 - RNA, 19 nt, Homo sapiens
gcaccagaagguacauaua

SEQ ID NO: 1547119 - RNA, 19 nt, Homo sapiens
gagaaaagccguaugaaug

SEQ ID NO: 1547120 - RNA, 19 nt, Homo sapiens
caauguaugugggaaauca

SEQ ID NO: 1547121 - RNA, 19 nt, Homo sapiens
gagaacccauaaugcagaa

SEQ ID NO: 1547122 - RNA, 19 nt, Homo sapiens
caaaggugccuguaucaug

SEQ ID NO: 1547123 - RNA, 19 nt, Homo sapiens
caaagacguuacaaaugug

SEQ ID NO: 1547124 - RNA, 19 nt, Homo sapiens
acacacaucgucagcauaa

SEQ ID NO: 1547125 - RNA, 19 nt, Homo sapiens
uacuauggcuucaugguuu

SEQ ID NO: 1547126 - RNA, 19 nt, Homo sapiens
ccaaaggugcauccagaua

SEQ ID NO: 1547127 - RNA, 19 nt, Homo sapiens
gggaaagccuucaacaaaa

SEQ ID NO: 1547128 - RNA, 19 nt, Homo sapiens
ugggaaagccuucaacaaa

SEQ ID NO: 1547129 - RNA, 19 nt, Homo sapiens
caaagaauccauacuagag

SEQ ID NO: 1547130 - RNA, 19 nt, Homo sapiens
cagcagagaauucacacua

SEQ ID NO: 1547131 - RNA, 19 nt, Homo sapiens
gcagggagaccuuucaaca

SEQ ID NO: 1547132 - RNA, 19 nt, Homo sapiens
ccaggacaguggagagaaa

SEQ ID NO: 1547133 - RNA, 19 nt, Homo sapiens
cauguuaucucaguaagug

SEQ ID NO: 1547134 - RNA, 19 nt, Homo sapiens
uuuaagaacugucuguaug

SEQ ID NO: 1547135 - RNA, 19 nt, Homo sapiens
ccaguuaggaauuaucuuu

SEQ ID NO: 1547136 - RNA, 19 nt, Homo sapiens
caccaaagaauccauacua

SEQ ID NO: 1547137 - RNA, 19 nt, Homo sapiens
ccaaacaaacacuucuuaa

SEQ ID NO: 1547138 - RNA, 19 nt, Homo sapiens
gagcaccagagaauucaua

SEQ ID NO: 1547139 - RNA, 19 nt, Homo sapiens
agagaggccuuaugugugu

SEQ ID NO: 1547140 - RNA, 19 nt, Homo sapiens
caccuugccuuccagauau

SEQ ID NO: 1547141 - RNA, 19 nt, Homo sapiens
gaagauagcuccacugaca

SEQ ID NO: 1547142 - RNA, 19 nt, Homo sapiens
gcacagauacucuauauga

SEQ ID NO: 1547143 - RNA, 19 nt, Homo sapiens
ggauguggcuuuccucaua

SEQ ID NO: 1547144 - RNA, 19 nt, Homo sapiens
gaaguuauaucugcucuuu

SEQ ID NO: 1547145 - RNA, 19 nt, Homo sapiens
ggaagugacuauuugguuu

SEQ ID NO: 1547146 - RNA, 19 nt, Homo sapiens
gagauguucuugggaauua

SEQ ID NO: 1547147 - RNA, 19 nt, Homo sapiens
gagagaauauucgaaauga

SEQ ID NO: 1547148 - RNA, 19 nt, Homo sapiens
ugaaacagcuacugauuug

SEQ ID NO: 1547149 - RNA, 19 nt, Homo sapiens
gaaaccaacucuuuagaca

SEQ ID NO: 1547150 - RNA, 19 nt, Homo sapiens
ggaacuauaucaucagguu

SEQ ID NO: 1547151 - RNA, 19 nt, Homo sapiens
uaaccucagugcuugauua

SEQ ID NO: 1547152 - RNA, 19 nt, Homo sapiens
gagguacugugguaaauga

SEQ ID NO: 1547153 - RNA, 19 nt, Homo sapiens
gaagugacuauuugguuua

SEQ ID NO: 1547154 - RNA, 19 nt, Homo sapiens
gaagacaucaguaagaaga

SEQ ID NO: 1547155 - RNA, 19 nt, Homo sapiens
gaagaaauuucagcucuag

SEQ ID NO: 1547156 - RNA, 19 nt, Homo sapiens
gacgugccaucaacaaaua

SEQ ID NO: 1547157 - RNA, 19 nt, Homo sapiens
ugaaagcucugcacaguuc

SEQ ID NO: 1547158 - RNA, 19 nt, Homo sapiens
caauggaagugacuauuug

SEQ ID NO: 1547159 - RNA, 19 nt, Homo sapiens
gaggaugccuguagacuca

SEQ ID NO: 1547160 - RNA, 19 nt, Homo sapiens
gagaauacauaaaccagau

SEQ ID NO: 1547161 - RNA, 19 nt, Homo sapiens
cuaggaauaucuucuacua

SEQ ID NO: 1547162 - RNA, 19 nt, Homo sapiens
caagccauuuguccauuua

SEQ ID NO: 1547163 - RNA, 19 nt, Homo sapiens
ccuguagacucaucaauuu

SEQ ID NO: 1547164 - RNA, 19 nt, Homo sapiens
gcaaaagaauuacggaaaa

SEQ ID NO: 1547165 - RNA, 19 nt, Homo sapiens
cauagaugcuucccaaaga

SEQ ID NO: 1547166 - RNA, 19 nt, Homo sapiens
ugacaaaccaggaaugauu

SEQ ID NO: 1547167 - RNA, 19 nt, Homo sapiens
ggagugaagacaucaguaa

SEQ ID NO: 1547168 - RNA, 19 nt, Homo sapiens
gauuggaacuauaucauca

SEQ ID NO: 1547169 - RNA, 19 nt, Homo sapiens
ccacugaccuccaccuuag

SEQ ID NO: 1547170 - RNA, 19 nt, Homo sapiens
gaagugaugaguuuaagga

SEQ ID NO: 1547171 - RNA, 19 nt, Homo sapiens
gagaauauucgaaaugaug

SEQ ID NO: 1547172 - RNA, 19 nt, Homo sapiens
ucucugggcucuacacgua

SEQ ID NO: 1547173 - RNA, 19 nt, Homo sapiens
gugaagacaucaguaagaa

SEQ ID NO: 1547174 - RNA, 19 nt, Homo sapiens
gaggagagaauauucgaaa

SEQ ID NO: 1547175 - RNA, 19 nt, Homo sapiens
aagcacagauacucuauau

SEQ ID NO: 1547176 - RNA, 19 nt, Homo sapiens
ugauguaucugccuguaaa

SEQ ID NO: 1547177 - RNA, 19 nt, Homo sapiens
aaaccgaccuauaagaguu

SEQ ID NO: 1547178 - RNA, 19 nt, Homo sapiens
aaccaacucuuuagacaaa

SEQ ID NO: 1547179 - RNA, 19 nt, Homo sapiens
gaacaaucauaguaauggu

SEQ ID NO: 1547180 - RNA, 19 nt, Homo sapiens
acaaauaucccaccgaaga

SEQ ID NO: 1547181 - RNA, 19 nt, Homo sapiens
gauacaaggucaucauagg

SEQ ID NO: 1547182 - RNA, 19 nt, Homo sapiens
ccucagugcuugauuacuu

SEQ ID NO: 1547183 - RNA, 19 nt, Homo sapiens
gaugguuuccaauuuguua

SEQ ID NO: 1547184 - RNA, 19 nt, Homo sapiens
ggagagaauauucgaaaug

SEQ ID NO: 1547185 - RNA, 19 nt, Homo sapiens
ucaaggcuacgucauauuu

SEQ ID NO: 1547186 - RNA, 19 nt, Homo sapiens
ucaaggcuacuccauauuu

SEQ ID NO: 1547187 - RNA, 19 nt, Homo sapiens
ugucaaggcuacuccauau

SEQ ID NO: 1547188 - RNA, 19 nt, Homo sapiens
gaugauguaucugccugua

SEQ ID NO: 1547189 - RNA, 19 nt, Homo sapiens
uauagaacauggugaagau

SEQ ID NO: 1547190 - RNA, 19 nt, Homo sapiens
caaggcuacuccauauuug

SEQ ID NO: 1547191 - RNA, 19 nt, Homo sapiens
aguaggaagugaugaguuu

SEQ ID NO: 1547192 - RNA, 19 nt, Homo sapiens
uagcagugauugucuucua

SEQ ID NO: 1547193 - RNA, 19 nt, Homo sapiens
cuacugauuugaugcagaa

SEQ ID NO: 1547194 - RNA, 19 nt, Homo sapiens
gcuauaugccuaacacuga

SEQ ID NO: 1547195 - RNA, 19 nt, Homo sapiens
caacaucuccuuguauuag

SEQ ID NO: 1547196 - RNA, 19 nt, Homo sapiens
gacaaaccaggaaugauuu

SEQ ID NO: 1547197 - RNA, 19 nt, Homo sapiens
gcaaugaaagacaaggaaa

SEQ ID NO: 1547198 - RNA, 19 nt, Homo sapiens
cugagaaacuggcaaugaa

SEQ ID NO: 1547199 - RNA, 19 nt, Homo sapiens
aagaagaccugacaaacca

SEQ ID NO: 1547200 - RNA, 19 nt, Homo sapiens
ccacugacauguauaaucc

SEQ ID NO: 1547201 - RNA, 19 nt, Homo sapiens
agaagaaauuucagcucua

SEQ ID NO: 1547202 - RNA, 19 nt, Homo sapiens
agagaacgguggcacagaa

SEQ ID NO: 1547203 - RNA, 19 nt, Homo sapiens
ggaaaccgaccuauaagag

SEQ ID NO: 1547204 - RNA, 19 nt, Homo sapiens
gaagauacaaggucaucau

SEQ ID NO: 1547205 - RNA, 19 nt, Homo sapiens
ucaagccauuuguccauuu

SEQ ID NO: 1547206 - RNA, 19 nt, Homo sapiens
cuucauuggccaagaauua

SEQ ID NO: 1547207 - RNA, 19 nt, Homo sapiens
gauacagcuugggagaaua

SEQ ID NO: 1547208 - RNA, 19 nt, Homo sapiens
gugaugaguuuaaggaagu

SEQ ID NO: 1547209 - RNA, 19 nt, Homo sapiens
aaugaugguuuccaauuug

SEQ ID NO: 1547210 - RNA, 19 nt, Homo sapiens
cagcuugggagaauacaua

SEQ ID NO: 1547211 - RNA, 19 nt, Homo sapiens
gaaauggaagcuacagaca

SEQ ID NO: 1547212 - RNA, 19 nt, Homo sapiens
caagccagauuggaacuau

SEQ ID NO: 1547213 - RNA, 19 nt, Homo sapiens
ugaaacaucaucuccaaga

SEQ ID NO: 1547214 - RNA, 19 nt, Homo sapiens
agaaccagaucauacuuau

SEQ ID NO: 1547215 - RNA, 19 nt, Homo sapiens
gaagaaccagaucauacuu

SEQ ID NO: 1547216 - RNA, 19 nt, Homo sapiens
gcagaaauugcaagucuca

SEQ ID NO: 1547217 - RNA, 19 nt, Homo sapiens
gcacaguucaggcaucaau

SEQ ID NO: 1547218 - RNA, 19 nt, Homo sapiens
uagcuccacugacauguau

SEQ ID NO: 1547219 - RNA, 19 nt, Homo sapiens
gcucuacacguaaggauga

SEQ ID NO: 1547220 - RNA, 19 nt, Homo sapiens
ucugaagcaucuuaccuaa

SEQ ID NO: 1547221 - RNA, 19 nt, Homo sapiens
ccugggauauaugaaauaa

SEQ ID NO: 1547222 - RNA, 19 nt, Homo sapiens
gaacuauaucaucagguuu

SEQ ID NO: 1547223 - RNA, 19 nt, Homo sapiens
gaacccacaagccagauug

SEQ ID NO: 1547224 - RNA, 19 nt, Homo sapiens
gaaaccgaccuauaagagu

SEQ ID NO: 1547225 - RNA, 19 nt, Homo sapiens
uguuagagguacuguggua

SEQ ID NO: 1547226 - RNA, 19 nt, Homo sapiens
ugauacagcuugggagaau

SEQ ID NO: 1547227 - RNA, 19 nt, Homo sapiens
aaagaagaaccagaucaua

SEQ ID NO: 1547228 - RNA, 19 nt, Homo sapiens
acaauggaagugacuauuu

SEQ ID NO: 1547229 - RNA, 19 nt, Homo sapiens
ccaauuuguuacugagcua

SEQ ID NO: 1547230 - RNA, 19 nt, Homo sapiens
gaaaagcacagauacucua

SEQ ID NO: 1547231 - RNA, 19 nt, Homo sapiens
gcagugauugucuucuaaa

SEQ ID NO: 1547232 - RNA, 19 nt, Homo sapiens
gacccuaacauuucaucua

SEQ ID NO: 1547233 - RNA, 19 nt, Homo sapiens
cauagugauucauacucua

SEQ ID NO: 1547234 - RNA, 19 nt, Homo sapiens
agacaucugaagcaucuua

SEQ ID NO: 1547235 - RNA, 19 nt, Homo sapiens
ggaacaaucauaguaaugg

SEQ ID NO: 1547236 - RNA, 19 nt, Homo sapiens
uggcgaaaccaacucuuua

SEQ ID NO: 1547237 - RNA, 19 nt, Homo sapiens
gaaacaucaucuccaagac

SEQ ID NO: 1547238 - RNA, 19 nt, Homo sapiens
caguauacaccaaaugaaa

SEQ ID NO: 1547239 - RNA, 19 nt, Homo sapiens
ggaauuugauuugguuacu

SEQ ID NO: 1547240 - RNA, 19 nt, Homo sapiens
caauguagcaagagauaau

SEQ ID NO: 1547241 - RNA, 19 nt, Homo sapiens
gaccacagcugauauuuaa

SEQ ID NO: 1547242 - RNA, 19 nt, Homo sapiens
ucaagaggcuuuccagauu

SEQ ID NO: 1547243 - RNA, 19 nt, Homo sapiens
ggaaauaacagacaacaug

SEQ ID NO: 1547244 - RNA, 19 nt, Homo sapiens
ggaagaguguaaucaaugu

SEQ ID NO: 1547245 - RNA, 19 nt, Homo sapiens
gaaauaacagacaacauga

SEQ ID NO: 1547246 - RNA, 19 nt, Homo sapiens
ggaccacagcugauauuua

SEQ ID NO: 1547247 - RNA, 19 nt, Homo sapiens
cagcugauauuuaauggaa

SEQ ID NO: 1547248 - RNA, 19 nt, Homo sapiens
ccaaaggacuagaaaauaa

SEQ ID NO: 1547249 - RNA, 19 nt, Homo sapiens
uauauugccucacugguuu

SEQ ID NO: 1547250 - RNA, 19 nt, Homo sapiens
gcaucacucucaugaaaug

SEQ ID NO: 1547251 - RNA, 19 nt, Homo sapiens
caagaggcuuuccagauug

SEQ ID NO: 1547252 - RNA, 19 nt, Homo sapiens
gcaaugagacaccaaagga

SEQ ID NO: 1547253 - RNA, 19 nt, Homo sapiens
cugcaucacucucaugaaa

SEQ ID NO: 1547254 - RNA, 19 nt, Homo sapiens
gcugauauuuaauggaaga

SEQ ID NO: 1547255 - RNA, 19 nt, Homo sapiens
ugaaauggcugagaaaauu

SEQ ID NO: 1547256 - RNA, 19 nt, Homo sapiens
agaguuaccuacaaggaaa

SEQ ID NO: 1547257 - RNA, 19 nt, Homo sapiens
ccacagcugauauuuaaug

SEQ ID NO: 1547258 - RNA, 19 nt, Homo sapiens
uaacagacaacaugagcaa

SEQ ID NO: 1547259 - RNA, 19 nt, Homo sapiens
aagcggaguuucuucuuug

SEQ ID NO: 1547260 - RNA, 19 nt, Homo sapiens
uggcauuuguggaauauug

SEQ ID NO: 1547261 - RNA, 19 nt, Homo sapiens
acaaggaaauaacagacaa

SEQ ID NO: 1547262 - RNA, 19 nt, Homo sapiens
agaggaggauguucucaga

SEQ ID NO: 1547263 - RNA, 19 nt, Homo sapiens
aaauugagggcuauugaaa

SEQ ID NO: 1547264 - RNA, 19 nt, Homo sapiens
gaaaauugagggcuauuga

SEQ ID NO: 1547265 - RNA, 19 nt, Homo sapiens
gaggaccacagcugauauu

SEQ ID NO: 1547266 - RNA, 19 nt, Homo sapiens
gaagaguguaaucaauguu

SEQ ID NO: 1547267 - RNA, 19 nt, Homo sapiens
ugcuguaucuguggacuua

SEQ ID NO: 1547268 - RNA, 19 nt, Homo sapiens
acaccagaguuaccuacaa

SEQ ID NO: 1547269 - RNA, 19 nt, Homo sapiens
ggaggaccacagcugauau

SEQ ID NO: 1547270 - RNA, 19 nt, Homo sapiens
caccagaguuaccuacaag

SEQ ID NO: 1547271 - RNA, 19 nt, Homo sapiens
cuugucgacuagccaguua

SEQ ID NO: 1547272 - RNA, 19 nt, Homo sapiens
gcaccuugccuccaugucu

SEQ ID NO: 1547273 - RNA, 19 nt, Homo sapiens
gagcauccacuaaaauuau

SEQ ID NO: 1547274 - RNA, 19 nt, Homo sapiens
cagaguuaccuacaaggaa

SEQ ID NO: 1547275 - RNA, 19 nt, Homo sapiens
cagacaacaugagcaaugg

SEQ ID NO: 1547276 - RNA, 19 nt, Homo sapiens
acagacaacaugagcaaug

SEQ ID NO: 1547277 - RNA, 19 nt, Homo sapiens
uggaagaguguaaucaaug

SEQ ID NO: 1547278 - RNA, 19 nt, Homo sapiens
cuguaucuguggacuuauu

SEQ ID NO: 1547279 - RNA, 19 nt, Homo sapiens
ggaauauugugugccaaaa

SEQ ID NO: 1547280 - RNA, 19 nt, Homo sapiens
gagcauucccugcaucacu

SEQ ID NO: 1547281 - RNA, 19 nt, Homo sapiens
gaggcaaugagacaccaaa

SEQ ID NO: 1547282 - RNA, 19 nt, Homo sapiens
ccagaguuaccuacaagga

SEQ ID NO: 1547283 - RNA, 19 nt, Homo sapiens
ccaugucucucgcgugcau

SEQ ID NO: 1547284 - RNA, 19 nt, Homo sapiens
gaaaacuuccucccuauac

SEQ ID NO: 1547285 - RNA, 19 nt, Homo sapiens
ucgacuagccaguuaugaa

SEQ ID NO: 1547286 - RNA, 19 nt, Homo sapiens
gacaccaaaggacuagaaa

SEQ ID NO: 1547287 - RNA, 19 nt, Homo sapiens
uggaggaccacagcugaua

SEQ ID NO: 1547288 - RNA, 19 nt, Homo sapiens
aagaggcuuuccagauugu

SEQ ID NO: 1547289 - RNA, 19 nt, Homo sapiens
acugguuucuccacccuuu

SEQ ID NO: 1547290 - RNA, 19 nt, Homo sapiens
agacaccaaaggacuagaa

SEQ ID NO: 1547291 - RNA, 19 nt, Homo sapiens
gaaauggcugagaaaauug

SEQ ID NO: 1547292 - RNA, 19 nt, Homo sapiens
ucucagaaagggagcauuc

SEQ ID NO: 1547293 - RNA, 19 nt, Homo sapiens
cgacuagccaguuaugaac

SEQ ID NO: 1547294 - RNA, 19 nt, Homo sapiens
uaauggaagaguguaauca

SEQ ID NO: 1547295 - RNA, 19 nt, Homo sapiens
cuggcucacuugucgacua

SEQ ID NO: 1547296 - RNA, 19 nt, Homo sapiens
uggaauauugugugccaaa

SEQ ID NO: 1547297 - RNA, 19 nt, Homo sapiens
ggaggcagcugaccaauga

SEQ ID NO: 1547298 - RNA, 19 nt, Homo sapiens
agaaguacgucaaggagaa

SEQ ID NO: 1547299 - RNA, 19 nt, Homo sapiens
gccaagaggagcaauaaga

SEQ ID NO: 1547300 - RNA, 19 nt, Homo sapiens
gagccaagaggagcaauaa

SEQ ID NO: 1547301 - RNA, 19 nt, Homo sapiens
caagaggagcaauaagaaa

SEQ ID NO: 1547302 - RNA, 19 nt, Homo sapiens
ccaagaggagcaauaagaa

SEQ ID NO: 1547303 - RNA, 19 nt, Homo sapiens
gggccguccugcucuauga

SEQ ID NO: 1547304 - RNA, 19 nt, Homo sapiens
gcaaggaggccagguaguc

SEQ ID NO: 1547305 - RNA, 19 nt, Homo sapiens
caucucaccugcugguaca

SEQ ID NO: 1547306 - RNA, 19 nt, Homo sapiens
ggucccagaugccuacagu

SEQ ID NO: 1547307 - RNA, 19 nt, Homo sapiens
gcacaccgaggucccagau

SEQ ID NO: 1547308 - RNA, 19 nt, Homo sapiens
gaccugaaggcccaucuca

SEQ ID NO: 1547309 - RNA, 19 nt, Homo sapiens
uguaaggacacucaucugu

SEQ ID NO: 1547310 - RNA, 19 nt, Homo sapiens
ggaaaucagugaaauauug

SEQ ID NO: 1547311 - RNA, 19 nt, Homo sapiens
caaggaaugugaaauguua

SEQ ID NO: 1547312 - RNA, 19 nt, Homo sapiens
gcagauaacuuaagcuuuc

SEQ ID NO: 1547313 - RNA, 19 nt, Homo sapiens
gaaaguggcugcagugaca

SEQ ID NO: 1547314 - RNA, 19 nt, Homo sapiens
aagaauagcuugucagaaa

SEQ ID NO: 1547315 - RNA, 19 nt, Homo sapiens
gagcugagaugucuaaagu

SEQ ID NO: 1547316 - RNA, 19 nt, Homo sapiens
gaacuucaacagacaauuu

SEQ ID NO: 1547317 - RNA, 19 nt, Homo sapiens
ucacaggaaugguaaauau

SEQ ID NO: 1547318 - RNA, 19 nt, Homo sapiens
agacaaccauuucuaguaa

SEQ ID NO: 1547319 - RNA, 19 nt, Homo sapiens
ggaaggagcugagaugucu

SEQ ID NO: 1547320 - RNA, 19 nt, Homo sapiens
gaggacacauuaacucuga

SEQ ID NO: 1547321 - RNA, 19 nt, Homo sapiens
uaauggaacuggagaguga

SEQ ID NO: 1547322 - RNA, 19 nt, Homo sapiens
aaacuuggacgguaacuua

SEQ ID NO: 1547323 - RNA, 19 nt, Homo sapiens
cgagaaauagccaauguua

SEQ ID NO: 1547324 - RNA, 19 nt, Homo sapiens
uuaagaaucugguugaaga

SEQ ID NO: 1547325 - RNA, 19 nt, Homo sapiens
ccacauuugucauuugaaa

SEQ ID NO: 1547326 - RNA, 19 nt, Homo sapiens
caaagaaagacaaccauuu

SEQ ID NO: 1547327 - RNA, 19 nt, Homo sapiens
gaacuucagacuuuacaaa

SEQ ID NO: 1547328 - RNA, 19 nt, Homo sapiens
agagacacuucuucaaaua

SEQ ID NO: 1547329 - RNA, 19 nt, Homo sapiens
gcugagaugucuaaaguca

SEQ ID NO: 1547330 - RNA, 19 nt, Homo sapiens
gaaacucccuucgagaaau

SEQ ID NO: 1547331 - RNA, 19 nt, Homo sapiens
caacuauacucacgaagau

SEQ ID NO: 1547332 - RNA, 19 nt, Homo sapiens
ggaaagagaaauugagaau

SEQ ID NO: 1547333 - RNA, 19 nt, Homo sapiens
guagaaaacccacaauuua

SEQ ID NO: 1547334 - RNA, 19 nt, Homo sapiens
caacagacaauuuaucuuc

SEQ ID NO: 1547335 - RNA, 19 nt, Homo sapiens
gauauggccauuguaaaua

SEQ ID NO: 1547336 - RNA, 19 nt, Homo sapiens
cacaaucucucauacagaa

SEQ ID NO: 1547337 - RNA, 19 nt, Homo sapiens
aaacucccuucgagaaaua

SEQ ID NO: 1547338 - RNA, 19 nt, Homo sapiens
gaugacauuugccauucua

SEQ ID NO: 1547339 - RNA, 19 nt, Homo sapiens
gacgguaacuuaaaugaag

SEQ ID NO: 1547340 - RNA, 19 nt, Homo sapiens
ccaagacacuucauucagu

SEQ ID NO: 1547341 - RNA, 19 nt, Homo sapiens
gaacucucaagcaucauua

SEQ ID NO: 1547342 - RNA, 19 nt, Homo sapiens
guauagaaauggaagcaau

SEQ ID NO: 1547343 - RNA, 19 nt, Homo sapiens
agacagaacucucaagcau

SEQ ID NO: 1547344 - RNA, 19 nt, Homo sapiens
agaguacuauucagucuaa

SEQ ID NO: 1547345 - RNA, 19 nt, Homo sapiens
gacaaauuauggaaagaga

SEQ ID NO: 1547346 - RNA, 19 nt, Homo sapiens
acagaacucucaagcauca

SEQ ID NO: 1547347 - RNA, 19 nt, Homo sapiens
ggaagaggaugaaguugac

SEQ ID NO: 1547348 - RNA, 19 nt, Homo sapiens
cguccaagauccuaaauuc

SEQ ID NO: 1547349 - RNA, 19 nt, Homo sapiens
aaagaaagccagcuagaga

SEQ ID NO: 1547350 - RNA, 19 nt, Homo sapiens
ugaaaccucuuaucuuuac

SEQ ID NO: 1547351 - RNA, 19 nt, Homo sapiens
gaacuaugcauaucuaacu

SEQ ID NO: 1547352 - RNA, 19 nt, Homo sapiens
uaacugaacuaugcauauc

SEQ ID NO: 1547353 - RNA, 19 nt, Homo sapiens
uaauuguacugcuaacuga

SEQ ID NO: 1547354 - RNA, 19 nt, Homo sapiens
ccaauauucuguugauaca

SEQ ID NO: 1547355 - RNA, 19 nt, Homo sapiens
aaagugauauggccauugu

SEQ ID NO: 1547356 - RNA, 19 nt, Homo sapiens
gagaaauagccaauguuaa

SEQ ID NO: 1547357 - RNA, 19 nt, Homo sapiens
ugacaacuauacucacgaa

SEQ ID NO: 1547358 - RNA, 19 nt, Homo sapiens
gggauaccuuggaauuuga

SEQ ID NO: 1547359 - RNA, 19 nt, Homo sapiens
gaauagcuugucagaaauu

SEQ ID NO: 1547360 - RNA, 19 nt, Homo sapiens
gaaugaguauagaaaugga

SEQ ID NO: 1547361 - RNA, 19 nt, Homo sapiens
gauggaagcauuagaucaa

SEQ ID NO: 1547362 - RNA, 19 nt, Homo sapiens
gaaagacaaagaaagacaa

SEQ ID NO: 1547363 - RNA, 19 nt, Homo sapiens
gaaagccagcuagagauaa

SEQ ID NO: 1547364 - RNA, 19 nt, Homo sapiens
gaaaaccaauauucuguug

SEQ ID NO: 1547365 - RNA, 19 nt, Homo sapiens
gggaagaggaugaaguuga

SEQ ID NO: 1547366 - RNA, 19 nt, Homo sapiens
ggauuugccuacagagaau

SEQ ID NO: 1547367 - RNA, 19 nt, Homo sapiens
cuucggauuugaaagguua

SEQ ID NO: 1547368 - RNA, 19 nt, Homo sapiens
ccagacaaauuauggaaag

SEQ ID NO: 1547369 - RNA, 19 nt, Homo sapiens
gagacacuucuucaaauaa

SEQ ID NO: 1547370 - RNA, 19 nt, Homo sapiens
uaaagucacccacauuugu

SEQ ID NO: 1547371 - RNA, 19 nt, Homo sapiens
cuacagagaaucaagaaga

SEQ ID NO: 1547372 - RNA, 19 nt, Homo sapiens
ggaaucauuucaggcuuug

SEQ ID NO: 1547373 - RNA, 19 nt, Homo sapiens
auaaugaggcgcuauauau

SEQ ID NO: 1547374 - RNA, 19 nt, Homo sapiens
ccucaagauugcuaagaaa

SEQ ID NO: 1547375 - RNA, 19 nt, Homo sapiens
gcaaggaaugugaaauguu

SEQ ID NO: 1547376 - RNA, 19 nt, Homo sapiens
aaagcucacuuggaaauga

SEQ ID NO: 1547377 - RNA, 19 nt, Homo sapiens
ggaagcauuagaucaacua

SEQ ID NO: 1547378 - RNA, 19 nt, Homo sapiens
gauguucacaggaauggua

SEQ ID NO: 1547379 - RNA, 19 nt, Homo sapiens
cauaaugaggcgcuauaua

SEQ ID NO: 1547380 - RNA, 19 nt, Homo sapiens
gacaaccauuucuaguaaa

SEQ ID NO: 1547381 - RNA, 19 nt, Homo sapiens
gggaaacugugucaaaauu

SEQ ID NO: 1547382 - RNA, 19 nt, Homo sapiens
aaacacaccagcuucuaaa

SEQ ID NO: 1547383 - RNA, 19 nt, Homo sapiens
agaaauggaagcaaugaaa

SEQ ID NO: 1547384 - RNA, 19 nt, Homo sapiens
uaaagaaauucccaucacu

SEQ ID NO: 1547385 - RNA, 19 nt, Homo sapiens
gaauuagaggcauuaguga

SEQ ID NO: 1547386 - RNA, 19 nt, Homo sapiens
gccauucuaucaaacaaau

SEQ ID NO: 1547387 - RNA, 19 nt, Homo sapiens
gucucaagcugauacagua

SEQ ID NO: 1547388 - RNA, 19 nt, Homo sapiens
ucaagcugauacaguaauu

SEQ ID NO: 1547389 - RNA, 19 nt, Homo sapiens
uaaugaggcgcuauauauu

SEQ ID NO: 1547390 - RNA, 19 nt, Homo sapiens
caaccuugaaacaacauua

SEQ ID NO: 1547391 - RNA, 19 nt, Homo sapiens
gaagaauacagcaaagagu

SEQ ID NO: 1547392 - RNA, 19 nt, Homo sapiens
guacuauucagucuaaguu

SEQ ID NO: 1547393 - RNA, 19 nt, Homo sapiens
gaagaaaagaguacuauuc

SEQ ID NO: 1547394 - RNA, 19 nt, Homo sapiens
guacuuacagaauuaccua

SEQ ID NO: 1547395 - RNA, 19 nt, Homo sapiens
ggacgguaacuuaaaugaa

SEQ ID NO: 1547396 - RNA, 19 nt, Homo sapiens
gcugggaauuucagaagau

SEQ ID NO: 1547397 - RNA, 19 nt, Homo sapiens
auucaaaccuaccaaucua

SEQ ID NO: 1547398 - RNA, 19 nt, Homo sapiens
uacagagaaucaagaagaa

SEQ ID NO: 1547399 - RNA, 19 nt, Homo sapiens
ucacccacauuugucauuu

SEQ ID NO: 1547400 - RNA, 19 nt, Homo sapiens
uagacuuacugaagacaaa

SEQ ID NO: 1547401 - RNA, 19 nt, Homo sapiens
aaagccagcuagagauaau

SEQ ID NO: 1547402 - RNA, 19 nt, Homo sapiens
agaaagccagcuagagaua

SEQ ID NO: 1547403 - RNA, 19 nt, Homo sapiens
ucgaaugaguauagaaaug

SEQ ID NO: 1547404 - RNA, 19 nt, Homo sapiens
ggcaaggaaugugaaaugu

SEQ ID NO: 1547405 - RNA, 19 nt, Homo sapiens
gaaauuggcaaggaaugug

SEQ ID NO: 1547406 - RNA, 19 nt, Homo sapiens
uggaaucauuucaggcuuu

SEQ ID NO: 1547407 - RNA, 19 nt, Homo sapiens
acaaacugauccagauguu

SEQ ID NO: 1547408 - RNA, 19 nt, Homo sapiens
caguaauucuggauaaauc

SEQ ID NO: 1547409 - RNA, 19 nt, Homo sapiens
gauacaguaauucuggaua

SEQ ID NO: 1547410 - RNA, 19 nt, Homo sapiens
caacguggccuacaaagua

SEQ ID NO: 1547411 - RNA, 19 nt, Homo sapiens
gaaccaacguggccuacaa

SEQ ID NO: 1547412 - RNA, 19 nt, Homo sapiens
guaaaccgcauuucuguaa

SEQ ID NO: 1547413 - RNA, 19 nt, Homo sapiens
caaaguaaaccgcauuucu

SEQ ID NO: 1547414 - RNA, 19 nt, Homo sapiens
ccagaaagaacaccgaguu

SEQ ID NO: 1547415 - RNA, 19 nt, Homo sapiens
uaaaccgcauuucuguaaa

SEQ ID NO: 1547416 - RNA, 19 nt, Homo sapiens
uguguccgcugcaucauuu

SEQ ID NO: 1547417 - RNA, 19 nt, Homo sapiens
cucagaagaucuccagaaa

SEQ ID NO: 1547418 - RNA, 19 nt, Homo sapiens
cgacaggccugaagaucgu

SEQ ID NO: 1547419 - RNA, 19 nt, Homo sapiens
caagcgaccucucugaaaa

SEQ ID NO: 1547420 - RNA, 19 nt, Homo sapiens
gcaccgacuuguccaucga

SEQ ID NO: 1547421 - RNA, 19 nt, Homo sapiens
ccaagcgaccucucugaaa

SEQ ID NO: 1547422 - RNA, 19 nt, Homo sapiens
uggaggacguggauuggaa

SEQ ID NO: 1547423 - RNA, 19 nt, Homo sapiens
aggccgagcugcagaacuu

SEQ ID NO: 1547424 - RNA, 19 nt, Homo sapiens
aaaguaaaccgcauuucug

SEQ ID NO: 1547425 - RNA, 19 nt, Homo sapiens
cagaagaucuccagaaaac

SEQ ID NO: 1547426 - RNA, 19 nt, Homo sapiens
cagcagggacucagaagau

SEQ ID NO: 1547427 - RNA, 19 nt, Homo sapiens
cgaccucucugaaaacauu

SEQ ID NO: 1547428 - RNA, 19 nt, Homo sapiens
guucgggugugccggaaga

SEQ ID NO: 1547429 - RNA, 19 nt, Homo sapiens
aacguggccuacaaaguaa

SEQ ID NO: 1547430 - RNA, 19 nt, Homo sapiens
ggacugucggcuccagaaa

SEQ ID NO: 1547431 - RNA, 19 nt, Homo sapiens
cuacaaaguaaaccgcauu

SEQ ID NO: 1547432 - RNA, 19 nt, Homo sapiens
acugucggcuccagaaaga

SEQ ID NO: 1547433 - RNA, 19 nt, Homo sapiens
agaagcugauccaggaguu

SEQ ID NO: 1547434 - RNA, 19 nt, Homo sapiens
caagaggagcucccacagu

SEQ ID NO: 1547435 - RNA, 19 nt, Homo sapiens
gcagaaccagguccagaag

SEQ ID NO: 1547436 - RNA, 19 nt, Homo sapiens
gagaaguucguccgcaucu

SEQ ID NO: 1547437 - RNA, 19 nt, Homo sapiens
cccaaccucuucaccaaca

SEQ ID NO: 1547438 - RNA, 19 nt, Homo sapiens
ggaguugaaggaacagaag

SEQ ID NO: 1547439 - RNA, 19 nt, Homo sapiens
agaaacuccugcagaacca

SEQ ID NO: 1547440 - RNA, 19 nt, Homo sapiens
gacccgcaguuggcucuug

SEQ ID NO: 1547441 - RNA, 19 nt, Homo sapiens
aaaccgcauuucuguaaaa

SEQ ID NO: 1547442 - RNA, 19 nt, Homo sapiens
cuacagcagggacucagaa

SEQ ID NO: 1547443 - RNA, 19 nt, Homo sapiens
gcggugggccauccagaau

SEQ ID NO: 1547444 - RNA, 19 nt, Homo sapiens
gaagcugauccaggaguug

SEQ ID NO: 1547445 - RNA, 19 nt, Homo sapiens
uccaggaguugaaggaaca

SEQ ID NO: 1547446 - RNA, 19 nt, Homo sapiens
uacaaaguaaaccgcauuu

SEQ ID NO: 1547447 - RNA, 19 nt, Homo sapiens
ggacccaagcgaccucucu

SEQ ID NO: 1547448 - RNA, 19 nt, Homo sapiens
aaguaaaccgcauuucugu

SEQ ID NO: 1547449 - RNA, 19 nt, Homo sapiens
cugaagaucguggcuguga

SEQ ID NO: 1547450 - RNA, 19 nt, Homo sapiens
gcagggacucagaagaucu

SEQ ID NO: 1547451 - RNA, 19 nt, Homo sapiens
agaaccagguccagaagcu

SEQ ID NO: 1547452 - RNA, 19 nt, Homo sapiens
gauccaggaguugaaggaa

SEQ ID NO: 1547453 - RNA, 19 nt, Homo sapiens
ggaaauagccuucaacaga

SEQ ID NO: 1547454 - RNA, 19 nt, Homo sapiens
gcaagaagucguaugcuua

SEQ ID NO: 1547455 - RNA, 19 nt, Homo sapiens
agucaaagcugcaggaaua

SEQ ID NO: 1547456 - RNA, 19 nt, Homo sapiens
caaauuggcuggguagaaa

SEQ ID NO: 1547457 - RNA, 19 nt, Homo sapiens
gugaaacgcuccaugaauu

SEQ ID NO: 1547458 - RNA, 19 nt, Homo sapiens
agacagaccugccgacauu

SEQ ID NO: 1547459 - RNA, 19 nt, Homo sapiens
ggaaguacuuuauaaccuu

SEQ ID NO: 1547460 - RNA, 19 nt, Homo sapiens
ccagacaggugaugugaaa

SEQ ID NO: 1547461 - RNA, 19 nt, Homo sapiens
gacaggugaugugaaauua

SEQ ID NO: 1547462 - RNA, 19 nt, Homo sapiens
gaacuugacugaggugcaa

SEQ ID NO: 1547463 - RNA, 19 nt, Homo sapiens
gaagauauuucacaguucu

SEQ ID NO: 1547464 - RNA, 19 nt, Homo sapiens
cuuaagagcuguugaacuu

SEQ ID NO: 1547465 - RNA, 19 nt, Homo sapiens
cagaagaaaugucaagaau

SEQ ID NO: 1547466 - RNA, 19 nt, Homo sapiens
uaagaguccuuucacauug

SEQ ID NO: 1547467 - RNA, 19 nt, Homo sapiens
ucaauuuguugccguaaua

SEQ ID NO: 1547468 - RNA, 19 nt, Homo sapiens
gacagaggguucuuuaaau

SEQ ID NO: 1547469 - RNA, 19 nt, Homo sapiens
aggcauaggugcaggguua

SEQ ID NO: 1547470 - RNA, 19 nt, Homo sapiens
gaggaucggucuuauucaa

SEQ ID NO: 1547471 - RNA, 19 nt, Homo sapiens
cacgacaccuggcuaauuu

SEQ ID NO: 1547472 - RNA, 19 nt, Homo sapiens
gagacaaagugaagugguu

SEQ ID NO: 1547473 - RNA, 19 nt, Homo sapiens
uaaagaaacugagacaaag

SEQ ID NO: 1547474 - RNA, 19 nt, Homo sapiens
cuggaagaguuaccaauua

SEQ ID NO: 1547475 - RNA, 19 nt, Homo sapiens
accaauaguugccuuguua

SEQ ID NO: 1547476 - RNA, 19 nt, Homo sapiens
gauaccugguuguuauaua

SEQ ID NO: 1547477 - RNA, 19 nt, Homo sapiens
caauggguguaauuucaua

SEQ ID NO: 1547478 - RNA, 19 nt, Homo sapiens
ggaggauucugaaggaguu

SEQ ID NO: 1547479 - RNA, 19 nt, Homo sapiens
ggagugcagugguauaauc

SEQ ID NO: 1547480 - RNA, 19 nt, Homo sapiens
gccaauggguguaauuuca

SEQ ID NO: 1547481 - RNA, 19 nt, Homo sapiens
ugacagaggguucuuuaaa

SEQ ID NO: 1547482 - RNA, 19 nt, Homo sapiens
gagaggaucggucuuauuc

SEQ ID NO: 1547483 - RNA, 19 nt, Homo sapiens
cuaaagaaacugagacaaa

SEQ ID NO: 1547484 - RNA, 19 nt, Homo sapiens
uaaauaccaucuuguacga

SEQ ID NO: 1547485 - RNA, 19 nt, Homo sapiens
uuaauuggguggaagauug

SEQ ID NO: 1547486 - RNA, 19 nt, Homo sapiens
gagaccaccuguugcaaga

SEQ ID NO: 1547487 - RNA, 19 nt, Homo sapiens
gauauuuggugugccuaua

SEQ ID NO: 1547488 - RNA, 19 nt, Homo sapiens
caacacagagagcaacuuu

SEQ ID NO: 1547489 - RNA, 19 nt, Homo sapiens
gcagugaaacgcuccauga

SEQ ID NO: 1547490 - RNA, 19 nt, Homo sapiens
caacccagcagacuucuuu

SEQ ID NO: 1547491 - RNA, 19 nt, Homo sapiens
ggaauacagaugaaucaaa

SEQ ID NO: 1547492 - RNA, 19 nt, Homo sapiens
caugggaacugggacauuu

SEQ ID NO: 1547493 - RNA, 19 nt, Homo sapiens
ggaggaguuuguaagaaug

SEQ ID NO: 1547494 - RNA, 19 nt, Homo sapiens
guucuucuuucccaacaua

SEQ ID NO: 1547495 - RNA, 19 nt, Homo sapiens
gcagagaaaguuguaugua

SEQ ID NO: 1547496 - RNA, 19 nt, Homo sapiens
gaagaaaauugcugcuuug

SEQ ID NO: 1547497 - RNA, 19 nt, Homo sapiens
aaaggcaguugaagaagaa

SEQ ID NO: 1547498 - RNA, 19 nt, Homo sapiens
gcagacuucuuugagauug

SEQ ID NO: 1547499 - RNA, 19 nt, Homo sapiens
agaaauugauccugauguu

SEQ ID NO: 1547500 - RNA, 19 nt, Homo sapiens
acagaggguucuuuaaaug

SEQ ID NO: 1547501 - RNA, 19 nt, Homo sapiens
cagaauguacugaauugua

SEQ ID NO: 1547502 - RNA, 19 nt, Homo sapiens
aaaaugggcucagcaguua

SEQ ID NO: 1547503 - RNA, 19 nt, Homo sapiens
ggcaagaagucguaugcuu

SEQ ID NO: 1547504 - RNA, 19 nt, Homo sapiens
gaagaguuaccaauuagug

SEQ ID NO: 1547505 - RNA, 19 nt, Homo sapiens
gagccaguauucuaucaug

SEQ ID NO: 1547506 - RNA, 19 nt, Homo sapiens
uguuaaaggucccuggaua

SEQ ID NO: 1547507 - RNA, 19 nt, Homo sapiens
agaaagagauucauauucc

SEQ ID NO: 1547508 - RNA, 19 nt, Homo sapiens
gauuacaggcuccauuaaa

SEQ ID NO: 1547509 - RNA, 19 nt, Homo sapiens
cugaguagcugggacuaua

SEQ ID NO: 1547510 - RNA, 19 nt, Homo sapiens
ggagugcaauggcaugauc

SEQ ID NO: 1547511 - RNA, 19 nt, Homo sapiens
caucaucuaccaguaaaua

SEQ ID NO: 1547512 - RNA, 19 nt, Homo sapiens
uaagagcuguugaacuugu

SEQ ID NO: 1547513 - RNA, 19 nt, Homo sapiens
cagagaaaguuguauguac

SEQ ID NO: 1547514 - RNA, 19 nt, Homo sapiens
gauuuccuguggcagcuua

SEQ ID NO: 1547515 - RNA, 19 nt, Homo sapiens
ucacauugccuuugauuuc

SEQ ID NO: 1547516 - RNA, 19 nt, Homo sapiens
cacaaaagguucuguauau

SEQ ID NO: 1547517 - RNA, 19 nt, Homo sapiens
gcaaaaggcaguugaagaa

SEQ ID NO: 1547518 - RNA, 19 nt, Homo sapiens
caaggaggaacuaaagaaa

SEQ ID NO: 1547519 - RNA, 19 nt, Homo sapiens
ggaucggucuuauucaauc

SEQ ID NO: 1547520 - RNA, 19 nt, Homo sapiens
gaugugggcaguucuguga

SEQ ID NO: 1547521 - RNA, 19 nt, Homo sapiens
gggcgaauauuuauguucu

SEQ ID NO: 1547522 - RNA, 19 nt, Homo sapiens
ccagcagacuucuuugaga

SEQ ID NO: 1547523 - RNA, 19 nt, Homo sapiens
gcagauggaggaguuugua

SEQ ID NO: 1547524 - RNA, 19 nt, Homo sapiens
gauaccacuuucucuccua

SEQ ID NO: 1547525 - RNA, 19 nt, Homo sapiens
gauguucuuuggauucaau

SEQ ID NO: 1547526 - RNA, 19 nt, Homo sapiens
caagugauccucccaccuu

SEQ ID NO: 1547527 - RNA, 19 nt, Homo sapiens
gguggaagauugggcaaga

SEQ ID NO: 1547528 - RNA, 19 nt, Homo sapiens
caacuuaaacuagcagaga

SEQ ID NO: 1547529 - RNA, 19 nt, Homo sapiens
cagcagacuucuuugagau

SEQ ID NO: 1547530 - RNA, 19 nt, Homo sapiens
gagauucauauuccuguaa

SEQ ID NO: 1547531 - RNA, 19 nt, Homo sapiens
cuuauucaaucuaggcaua

SEQ ID NO: 1547532 - RNA, 19 nt, Homo sapiens
gccaucaucuaccaguaaa

SEQ ID NO: 1547533 - RNA, 19 nt, Homo sapiens
gaaucaaauuguuggucuu

SEQ ID NO: 1547534 - RNA, 19 nt, Homo sapiens
gaaagagauucauauuccu

SEQ ID NO: 1547535 - RNA, 19 nt, Homo sapiens
caguaaauaccaucuugua

SEQ ID NO: 1547536 - RNA, 19 nt, Homo sapiens
gcuggaagaguuaccaauu

SEQ ID NO: 1547537 - RNA, 19 nt, Homo sapiens
gaccaccuguugcaagaug

SEQ ID NO: 1547538 - RNA, 19 nt, Homo sapiens
gauggaggaguuuguaaga

SEQ ID NO: 1547539 - RNA, 19 nt, Homo sapiens
uuaagaguccuuucacauu

SEQ ID NO: 1547540 - RNA, 19 nt, Homo sapiens
ugacuugcuuguauauugu

SEQ ID NO: 1547541 - RNA, 19 nt, Homo sapiens
ccauugagccaguauucua

SEQ ID NO: 1547542 - RNA, 19 nt, Homo sapiens
ggacacaagccacaauuuu

SEQ ID NO: 1547543 - RNA, 19 nt, Homo sapiens
gaaauuaaccaugggaacu

SEQ ID NO: 1547544 - RNA, 19 nt, Homo sapiens
ccagcaaucagccauguuu

SEQ ID NO: 1547545 - RNA, 19 nt, Homo sapiens
gcgaauauuuauguucugu

SEQ ID NO: 1547546 - RNA, 19 nt, Homo sapiens
cugacuugcuuguauauug

SEQ ID NO: 1547547 - RNA, 19 nt, Homo sapiens
ccaguauucuaucauggaa

SEQ ID NO: 1547548 - RNA, 19 nt, Homo sapiens
ggguguaauuucauaggaa

SEQ ID NO: 1547549 - RNA, 19 nt, Homo sapiens
uggaggaguuuguaagaau

SEQ ID NO: 1547550 - RNA, 19 nt, Homo sapiens
gguagaaauugauccugau

SEQ ID NO: 1547551 - RNA, 19 nt, Homo sapiens
ugagggaaagggaauuuaa

SEQ ID NO: 1547552 - RNA, 19 nt, Homo sapiens
ccacgacaccuggcuaauu

SEQ ID NO: 1547553 - RNA, 19 nt, Homo sapiens
gaucgugucugaugucauu

SEQ ID NO: 1547554 - RNA, 19 nt, Homo sapiens
gaaugaagcuggcugagau

SEQ ID NO: 1547555 - RNA, 19 nt, Homo sapiens
ggacugacuucgagacauu

SEQ ID NO: 1547556 - RNA, 19 nt, Homo sapiens
gcaagcagcugaagaaucg

SEQ ID NO: 1547557 - RNA, 19 nt, Homo sapiens
gcucuaaucuguuuguguu

SEQ ID NO: 1547558 - RNA, 19 nt, Homo sapiens
gaauuggagugguggagua

SEQ ID NO: 1547559 - RNA, 19 nt, Homo sapiens
gcaauaaaccagaaccaaa

SEQ ID NO: 1547560 - RNA, 19 nt, Homo sapiens
gaaggcaucucagugaaga

SEQ ID NO: 1547561 - RNA, 19 nt, Homo sapiens
ggcagaagcucuccaggaa

SEQ ID NO: 1547562 - RNA, 19 nt, Homo sapiens
ggaauuucaucauguccaa

SEQ ID NO: 1547563 - RNA, 19 nt, Homo sapiens
caaagagaccuaugggauu

SEQ ID NO: 1547564 - RNA, 19 nt, Homo sapiens
aaagagaccuaugggauug

SEQ ID NO: 1547565 - RNA, 19 nt, Homo sapiens
ggaaaucucacguccacuu

SEQ ID NO: 1547566 - RNA, 19 nt, Homo sapiens
gaucagggugccuuucuuu

SEQ ID NO: 1547567 - RNA, 19 nt, Homo sapiens
gaagcuggcugagaucaag

SEQ ID NO: 1547568 - RNA, 19 nt, Homo sapiens
agacagagguggagcucaa

SEQ ID NO: 1547569 - RNA, 19 nt, Homo sapiens
gaaccacgaagaaugcauu

SEQ ID NO: 1547570 - RNA, 19 nt, Homo sapiens
cagagacgcuguugaaacu

SEQ ID NO: 1547571 - RNA, 19 nt, Homo sapiens
gggagguggucuacuuuau

SEQ ID NO: 1547572 - RNA, 19 nt, Homo sapiens
ggucgugacucccgcucua

SEQ ID NO: 1547573 - RNA, 19 nt, Homo sapiens
acagacagcuggaguggau

SEQ ID NO: 1547574 - RNA, 19 nt, Homo sapiens
gcacacagacugcguucga

SEQ ID NO: 1547575 - RNA, 19 nt, Homo sapiens
gaucucggaggagcaauua

SEQ ID NO: 1547576 - RNA, 19 nt, Homo sapiens
gggacuaugagauucuuua

SEQ ID NO: 1547577 - RNA, 19 nt, Homo sapiens
ggaaacagggugucuuugg

SEQ ID NO: 1547578 - RNA, 19 nt, Homo sapiens
acuaugagauucuuuacug

SEQ ID NO: 1547579 - RNA, 19 nt, Homo sapiens
gagagaucgugucugaugu

SEQ ID NO: 1547580 - RNA, 19 nt, Homo sapiens
ggaaugaagcuggcugaga

SEQ ID NO: 1547581 - RNA, 19 nt, Homo sapiens
ucuauaguguuuccaguga

SEQ ID NO: 1547582 - RNA, 19 nt, Homo sapiens
aacgugaucuacaucuaua

SEQ ID NO: 1547583 - RNA, 19 nt, Homo sapiens
caacgugaucuacaucuau

SEQ ID NO: 1547584 - RNA, 19 nt, Homo sapiens
gagaucaagaguacaaaug

SEQ ID NO: 1547585 - RNA, 19 nt, Homo sapiens
cagcuggaguggauaagga

SEQ ID NO: 1547586 - RNA, 19 nt, Homo sapiens
caauaaaccagaaccaaag

SEQ ID NO: 1547587 - RNA, 19 nt, Homo sapiens
gcacccagacggagacaga

SEQ ID NO: 1547588 - RNA, 19 nt, Homo sapiens
cugaagggcuuggcucuga

SEQ ID NO: 1547589 - RNA, 19 nt, Homo sapiens
gagguggucuacuuuaucg

SEQ ID NO: 1547590 - RNA, 19 nt, Homo sapiens
caaggacgccagcaucuuc

SEQ ID NO: 1547591 - RNA, 19 nt, Homo sapiens
gaucaagaguacaaaugac

SEQ ID NO: 1547592 - RNA, 19 nt, Homo sapiens
ggaucagggugccuuucuu

SEQ ID NO: 1547593 - RNA, 19 nt, Homo sapiens
gguuguaccuggccauugg

SEQ ID NO: 1547594 - RNA, 19 nt, Homo sapiens
uggcugagaucaagaguac

SEQ ID NO: 1547595 - RNA, 19 nt, Homo sapiens
gguccaaggaugggaauuu

SEQ ID NO: 1547596 - RNA, 19 nt, Homo sapiens
acaacgugaucuacaucua

SEQ ID NO: 1547597 - RNA, 19 nt, Homo sapiens
guuuaucccuugcuuugug

SEQ ID NO: 1547598 - RNA, 19 nt, Homo sapiens
gcugagaucaagaguacaa

SEQ ID NO: 1547599 - RNA, 19 nt, Homo sapiens
cagggugccuuucuuugug

SEQ ID NO: 1547600 - RNA, 19 nt, Homo sapiens
gaaaucucacguccacuuc

SEQ ID NO: 1547601 - RNA, 19 nt, Homo sapiens
cagagacccucagccuuga

SEQ ID NO: 1547602 - RNA, 19 nt, Homo sapiens
ugaucuacaucuauagugu

SEQ ID NO: 1547603 - RNA, 19 nt, Homo sapiens
agagagaucgugucugaug

SEQ ID NO: 1547604 - RNA, 19 nt, Homo sapiens
gcugaagaaucgcuaugag

SEQ ID NO: 1547605 - RNA, 19 nt, Homo sapiens
uauaguguuuccagugaug

SEQ ID NO: 1547606 - RNA, 19 nt, Homo sapiens
gagaucgugucugauguca

SEQ ID NO: 1547607 - RNA, 19 nt, Homo sapiens
ggagguggucuacuuuauc

SEQ ID NO: 1547608 - RNA, 19 nt, Homo sapiens
gcaggagauggaacuggua

SEQ ID NO: 1547609 - RNA, 19 nt, Homo sapiens
gagccuagcgggacccaau

SEQ ID NO: 1547610 - RNA, 19 nt, Homo sapiens
gaucuacaucuauaguguu

SEQ ID NO: 1547611 - RNA, 19 nt, Homo sapiens
gcaaggacgccagcaucuu

SEQ ID NO: 1547612 - RNA, 19 nt, Homo sapiens
ggagauggaacugguaaag

SEQ ID NO: 1547613 - RNA, 19 nt, Homo sapiens
guccaaggaugggaauuuc

SEQ ID NO: 1547614 - RNA, 19 nt, Homo sapiens
uggaaggcaucucagugaa

SEQ ID NO: 1547615 - RNA, 19 nt, Homo sapiens
gcacacaccccucccagaa

SEQ ID NO: 1547616 - RNA, 19 nt, Homo sapiens
acucagagacgcuguugaa

SEQ ID NO: 1547617 - RNA, 19 nt, Homo sapiens
gccauugguucccaugaca

SEQ ID NO: 1547618 - RNA, 19 nt, Homo sapiens
gcucaugaagguucuaucu

SEQ ID NO: 1547619 - RNA, 19 nt, Homo sapiens
cagggugucuuugggaaau

SEQ ID NO: 1547620 - RNA, 19 nt, Homo sapiens
ccggaaacagggugucuuu

SEQ ID NO: 1547621 - RNA, 19 nt, Homo sapiens
ccuccucccucgacguuug

SEQ ID NO: 1547622 - RNA, 19 nt, Homo sapiens
ggaaggcaucucagugaag

SEQ ID NO: 1547623 - RNA, 19 nt, Homo sapiens
agaucaagaguacaaauga

SEQ ID NO: 1547624 - RNA, 19 nt, Homo sapiens
ggacucagagacgcuguug

SEQ ID NO: 1547625 - RNA, 19 nt, Homo sapiens
caauuuggaaggcaucuca

SEQ ID NO: 1547626 - RNA, 19 nt, Homo sapiens
gcggagcccuucagauucc

SEQ ID NO: 1547627 - RNA, 19 nt, Homo sapiens
gaguggauaaggauggaaa

SEQ ID NO: 1547628 - RNA, 19 nt, Homo sapiens
agacagcuggaguggauaa

SEQ ID NO: 1547629 - RNA, 19 nt, Homo sapiens
cauucccgaucgcgcauuu

SEQ ID NO: 1547630 - RNA, 19 nt, Homo sapiens
agguggagcucaagucauc

SEQ ID NO: 1547631 - RNA, 19 nt, Homo sapiens
ccagugauggugccaaauc

SEQ ID NO: 1547632 - RNA, 19 nt, Homo sapiens
ggaucucggaggagcaauu

SEQ ID NO: 1547633 - RNA, 19 nt, Homo sapiens
acacagagaccagagagau

SEQ ID NO: 1547634 - RNA, 19 nt, Homo sapiens
caggagauggaacugguaa

SEQ ID NO: 1547635 - RNA, 19 nt, Homo sapiens
uguugaaacugcaggagau

SEQ ID NO: 1547636 - RNA, 19 nt, Homo sapiens
gacucccgcucuaaucugu

SEQ ID NO: 1547637 - RNA, 19 nt, Homo sapiens
ggacuaugagauucuuuac

SEQ ID NO: 1547638 - RNA, 19 nt, Homo sapiens
gaccagagagaucgugucu

SEQ ID NO: 1547639 - RNA, 19 nt, Homo sapiens
caucgucaccagugggaaa

SEQ ID NO: 1547640 - RNA, 19 nt, Homo sapiens
ucagggugccuuucuuugu

SEQ ID NO: 1547641 - RNA, 19 nt, Homo sapiens
ggcaauaaaccagaaccaa

SEQ ID NO: 1547642 - RNA, 19 nt, Homo sapiens
cuucaucacucaucuugac

SEQ ID NO: 1547643 - RNA, 19 nt, Homo sapiens
ugccaaauccagccgcuuu

SEQ ID NO: 1547644 - RNA, 19 nt, Homo sapiens
aaaggcagcccuggcagaa

SEQ ID NO: 1547645 - RNA, 19 nt, Homo sapiens
ccugugugguggugcugua

SEQ ID NO: 1547646 - RNA, 19 nt, Homo sapiens
ccaaggaugggaauuucau

SEQ ID NO: 1547647 - RNA, 19 nt, Homo sapiens
ggaggugguugguuuugga

SEQ ID NO: 1547648 - RNA, 19 nt, Homo sapiens
cuacaucuauaguguuucc

SEQ ID NO: 1547649 - RNA, 19 nt, Homo sapiens
aaguuuaucccuugcuuug

SEQ ID NO: 1547650 - RNA, 19 nt, Homo sapiens
ucagagacgcuguugaaac

SEQ ID NO: 1547651 - RNA, 19 nt, Homo sapiens
uagcgggacccaaucugaa

SEQ ID NO: 1547652 - RNA, 19 nt, Homo sapiens
gguucuaucuucgccuugu

SEQ ID NO: 1547653 - RNA, 19 nt, Homo sapiens
ccaaggaucugaagaggaa

SEQ ID NO: 1547654 - RNA, 19 nt, Homo sapiens
agaagaagcucaagagaga

SEQ ID NO: 1547655 - RNA, 19 nt, Homo sapiens
uagaaagacugaccuugua

SEQ ID NO: 1547656 - RNA, 19 nt, Homo sapiens
agaaggacauugacuuuga

SEQ ID NO: 1547657 - RNA, 19 nt, Homo sapiens
gaagcuacuuguaacuaga

SEQ ID NO: 1547658 - RNA, 19 nt, Homo sapiens
caaggcaucucuucucagu

SEQ ID NO: 1547659 - RNA, 19 nt, Homo sapiens
cagcaucacuuaccagaag

SEQ ID NO: 1547660 - RNA, 19 nt, Homo sapiens
caaaugaccaucaccaaca

SEQ ID NO: 1547661 - RNA, 19 nt, Homo sapiens
ggacauugacuuugacaca

SEQ ID NO: 1547662 - RNA, 19 nt, Homo sapiens
ccagaaggacauugacuuu

SEQ ID NO: 1547663 - RNA, 19 nt, Homo sapiens
ugugucagcugcagaagaa

SEQ ID NO: 1547664 - RNA, 19 nt, Homo sapiens
ugaagcacagcaucacuua

SEQ ID NO: 1547665 - RNA, 19 nt, Homo sapiens
gcaagaccguguugaagcu

SEQ ID NO: 1547666 - RNA, 19 nt, Homo sapiens
gcaucacgaccucuccuua

SEQ ID NO: 1547667 - RNA, 19 nt, Homo sapiens
uuaaggaguucauguugga

SEQ ID NO: 1547668 - RNA, 19 nt, Homo sapiens
ccaaugcacugggcuguuc

SEQ ID NO: 1547669 - RNA, 19 nt, Homo sapiens
gauuaaggaguucauguug

SEQ ID NO: 1547670 - RNA, 19 nt, Homo sapiens
ucuaccagcuccaggcuaa

SEQ ID NO: 1547671 - RNA, 19 nt, Homo sapiens
ggaccacagggcucucaua

SEQ ID NO: 1547672 - RNA, 19 nt, Homo sapiens
agagagaagucgagaagca

SEQ ID NO: 1547673 - RNA, 19 nt, Homo sapiens
caagagagaagucgagaag

SEQ ID NO: 1547674 - RNA, 19 nt, Homo sapiens
gcagaagaagcucaagaga

SEQ ID NO: 1547675 - RNA, 19 nt, Homo sapiens
cccaaacccuucaggaaau

SEQ ID NO: 1547676 - RNA, 19 nt, Homo sapiens
aagacuaucugauuaaggu

SEQ ID NO: 1547677 - RNA, 19 nt, Homo sapiens
gaaggacauugacuuugac

SEQ ID NO: 1547678 - RNA, 19 nt, Homo sapiens
ugaagcuacuuguaacuag

SEQ ID NO: 1547679 - RNA, 19 nt, Homo sapiens
acuuguaacuagaccauuu

SEQ ID NO: 1547680 - RNA, 19 nt, Homo sapiens
uuucccagcuugaccauga

SEQ ID NO: 1547681 - RNA, 19 nt, Homo sapiens
cuagaaagacugaccuugu

SEQ ID NO: 1547682 - RNA, 19 nt, Homo sapiens
ccaaacccuucaggaaaug

SEQ ID NO: 1547683 - RNA, 19 nt, Homo sapiens
guguugaagcuacuuguaa

SEQ ID NO: 1547684 - RNA, 19 nt, Homo sapiens
ucuccaagcucgaucugau

SEQ ID NO: 1547685 - RNA, 19 nt, Homo sapiens
caagcucgaucugauuaag

SEQ ID NO: 1547686 - RNA, 19 nt, Homo sapiens
ugaagacuaucugauuaag

SEQ ID NO: 1547687 - RNA, 19 nt, Homo sapiens
uccagugccugucuaccua

SEQ ID NO: 1547688 - RNA, 19 nt, Homo sapiens
gugccugucuaccuauguu

SEQ ID NO: 1547689 - RNA, 19 nt, Homo sapiens
gaccacagggcucucauag

SEQ ID NO: 1547690 - RNA, 19 nt, Homo sapiens
aggcaucucuucucagucu

SEQ ID NO: 1547691 - RNA, 19 nt, Homo sapiens
gaagaagcucaagagagaa

SEQ ID NO: 1547692 - RNA, 19 nt, Homo sapiens
cuaccuauguuugaugcuu

SEQ ID NO: 1547693 - RNA, 19 nt, Homo sapiens
ugauuaaggaguucauguu

SEQ ID NO: 1547694 - RNA, 19 nt, Homo sapiens
uccaagcucgaucugauua

SEQ ID NO: 1547695 - RNA, 19 nt, Homo sapiens
aagcaauccuggugacaag

SEQ ID NO: 1547696 - RNA, 19 nt, Homo sapiens
gaccaugagcuucuucaag

SEQ ID NO: 1547697 - RNA, 19 nt, Homo sapiens
ggaccaguggcucagaaga

SEQ ID NO: 1547698 - RNA, 19 nt, Homo sapiens
aaaugaccaucaccaacau

SEQ ID NO: 1547699 - RNA, 19 nt, Homo sapiens
ucacuuaccagaaggacau

SEQ ID NO: 1547700 - RNA, 19 nt, Homo sapiens
caagcaauccuggugacaa

SEQ ID NO: 1547701 - RNA, 19 nt, Homo sapiens
ucaggaacaguuugcaaga

SEQ ID NO: 1547702 - RNA, 19 nt, Homo sapiens
caaaauggagacuguaaga

SEQ ID NO: 1547703 - RNA, 19 nt, Homo sapiens
cagcagcagcuauaaugau

SEQ ID NO: 1547704 - RNA, 19 nt, Homo sapiens
gcucacggaacccaaagug

SEQ ID NO: 1547705 - RNA, 19 nt, Homo sapiens
cagaaggacauugacuuug

SEQ ID NO: 1547706 - RNA, 19 nt, Homo sapiens
gcucaggaacaguuugcaa

SEQ ID NO: 1547707 - RNA, 19 nt, Homo sapiens
cugcucggcuacaugcaaa

SEQ ID NO: 1547708 - RNA, 19 nt, Homo sapiens
ccagcagcagcuauaauga

SEQ ID NO: 1547709 - RNA, 19 nt, Homo sapiens
cacaccagcagcagcuaua

SEQ ID NO: 1547710 - RNA, 19 nt, Homo sapiens
gaagacuaucugauuaagg

SEQ ID NO: 1547711 - RNA, 19 nt, Homo sapiens
uucaggaaauguccaagga

SEQ ID NO: 1547712 - RNA, 19 nt, Homo sapiens
ucgaucugauuaaggaguu

SEQ ID NO: 1547713 - RNA, 19 nt, Homo sapiens
acauugacuuugacacaca

SEQ ID NO: 1547714 - RNA, 19 nt, Homo sapiens
ggaguucauguuggacaaa

SEQ ID NO: 1547715 - RNA, 19 nt, Homo sapiens
gaguggcucaggaacaguu

SEQ ID NO: 1547716 - RNA, 19 nt, Homo sapiens
cagcagcuauaaugaucag

SEQ ID NO: 1547717 - RNA, 19 nt, Homo sapiens
gagaagucgagaagcacaa

SEQ ID NO: 1547718 - RNA, 19 nt, Homo sapiens
gcuccaggcuaagcagaag

SEQ ID NO: 1547719 - RNA, 19 nt, Homo sapiens
gacaaaauggagacuguaa

SEQ ID NO: 1547720 - RNA, 19 nt, Homo sapiens
ccaagcucgaucugauuaa

SEQ ID NO: 1547721 - RNA, 19 nt, Homo sapiens
gcucucauagccucaagau

SEQ ID NO: 1547722 - RNA, 19 nt, Homo sapiens
aggccacggugaagcacua

SEQ ID NO: 1547723 - RNA, 19 nt, Homo sapiens
agcagcagcuauaaugauc

SEQ ID NO: 1547724 - RNA, 19 nt, Homo sapiens
ucuccuguccuccugcaua

SEQ ID NO: 1547725 - RNA, 19 nt, Homo sapiens
aaauggagacuguaagacu

SEQ ID NO: 1547726 - RNA, 19 nt, Homo sapiens
aacccuggcuuccaaggau

SEQ ID NO: 1547727 - RNA, 19 nt, Homo sapiens
uucaaggcaucucuucuca

SEQ ID NO: 1547728 - RNA, 19 nt, Homo sapiens
caagauagcugccuagaau

SEQ ID NO: 1547729 - RNA, 19 nt, Homo sapiens
guaccgcacuuuauaauuu

SEQ ID NO: 1547730 - RNA, 19 nt, Homo sapiens
gaagaaugauugauuguca

SEQ ID NO: 1547731 - RNA, 19 nt, Homo sapiens
gaacaugugauuagaauga

SEQ ID NO: 1547732 - RNA, 19 nt, Homo sapiens
ggaaggaguuguuauucuu

SEQ ID NO: 1547733 - RNA, 19 nt, Homo sapiens
gaaacuggaaguaaugaua

SEQ ID NO: 1547734 - RNA, 19 nt, Homo sapiens
gaaggcuacuuaacaugua

SEQ ID NO: 1547735 - RNA, 19 nt, Homo sapiens
caccaaagguuaugaagaa

SEQ ID NO: 1547736 - RNA, 19 nt, Homo sapiens
gaagagaaagucugugauu

SEQ ID NO: 1547737 - RNA, 19 nt, Homo sapiens
gaaaguguuugcuaaaugg

SEQ ID NO: 1547738 - RNA, 19 nt, Homo sapiens
cagagaagcgcaugaguua

SEQ ID NO: 1547739 - RNA, 19 nt, Homo sapiens
gaucgauccuccugcauuu

SEQ ID NO: 1547740 - RNA, 19 nt, Homo sapiens
gaaaugcccacucaaagaa

SEQ ID NO: 1547741 - RNA, 19 nt, Homo sapiens
ugacucugcuaguaauuua

SEQ ID NO: 1547742 - RNA, 19 nt, Homo sapiens
gaucuugccgcaucacuua

SEQ ID NO: 1547743 - RNA, 19 nt, Homo sapiens
caacuggacugugaccuuu

SEQ ID NO: 1547744 - RNA, 19 nt, Homo sapiens
caacuucaacacuguaaua

SEQ ID NO: 1547745 - RNA, 19 nt, Homo sapiens
ugacaacugugaccuaaga

SEQ ID NO: 1547746 - RNA, 19 nt, Homo sapiens
gauggugacucugcuagua

SEQ ID NO: 1547747 - RNA, 19 nt, Homo sapiens
gagaugaugguaaugauaa

SEQ ID NO: 1547748 - RNA, 19 nt, Homo sapiens
gagaugagugugaugaaua

SEQ ID NO: 1547749 - RNA, 19 nt, Homo sapiens
uaacuggaauugagaugaa

SEQ ID NO: 1547750 - RNA, 19 nt, Homo sapiens
acucguugcucauuaaaua

SEQ ID NO: 1547751 - RNA, 19 nt, Homo sapiens
cauaguguaucaguuguua

SEQ ID NO: 1547752 - RNA, 19 nt, Homo sapiens
ugaugaauuuccacucuua

SEQ ID NO: 1547753 - RNA, 19 nt, Homo sapiens
gaaaaguccccuaccauua

SEQ ID NO: 1547754 - RNA, 19 nt, Homo sapiens
aaagacaguugguaucuau

SEQ ID NO: 1547755 - RNA, 19 nt, Homo sapiens
ggaaaugaaggcagagaaa

SEQ ID NO: 1547756 - RNA, 19 nt, Homo sapiens
gagagguccugccguggua

SEQ ID NO: 1547757 - RNA, 19 nt, Homo sapiens
gaaggugggaaaugagaua

SEQ ID NO: 1547758 - RNA, 19 nt, Homo sapiens
ugaagugaauuucccauug

SEQ ID NO: 1547759 - RNA, 19 nt, Homo sapiens
caagguguguuucuccaaa

SEQ ID NO: 1547760 - RNA, 19 nt, Homo sapiens
gccagaaggugggaaauga

SEQ ID NO: 1547761 - RNA, 19 nt, Homo sapiens
cuacguaccgcacuuuaua

SEQ ID NO: 1547762 - RNA, 19 nt, Homo sapiens
ggagaugaugguaaugaua

SEQ ID NO: 1547763 - RNA, 19 nt, Homo sapiens
gaagagaugagugugauga

SEQ ID NO: 1547764 - RNA, 19 nt, Homo sapiens
ggacgccuguuauggcauu

SEQ ID NO: 1547765 - RNA, 19 nt, Homo sapiens
aaauauacgugaccacaga

SEQ ID NO: 1547766 - RNA, 19 nt, Homo sapiens
gaagugaauuucccauugc

SEQ ID NO: 1547767 - RNA, 19 nt, Homo sapiens
guuguucccuuaugcaauu

SEQ ID NO: 1547768 - RNA, 19 nt, Homo sapiens
gaaggaguuguuauucuuu

SEQ ID NO: 1547769 - RNA, 19 nt, Homo sapiens
caacauccaacaacacaaa

SEQ ID NO: 1547770 - RNA, 19 nt, Homo sapiens
caaagguuaugaagaagau

SEQ ID NO: 1547771 - RNA, 19 nt, Homo sapiens
guacaaaguggauaccauu

SEQ ID NO: 1547772 - RNA, 19 nt, Homo sapiens
uaauggagaugaugguaau

SEQ ID NO: 1547773 - RNA, 19 nt, Homo sapiens
ggugagcuaucauuaaagu

SEQ ID NO: 1547774 - RNA, 19 nt, Homo sapiens
aaaugaaggcagagaaaua

SEQ ID NO: 1547775 - RNA, 19 nt, Homo sapiens
uaacugaacaugugauuag

SEQ ID NO: 1547776 - RNA, 19 nt, Homo sapiens
ggaccuuuccgcaauauga

SEQ ID NO: 1547777 - RNA, 19 nt, Homo sapiens
ucagaaggcuacuuaacau

SEQ ID NO: 1547778 - RNA, 19 nt, Homo sapiens
ccuaagaaaugggaagauu

SEQ ID NO: 1547779 - RNA, 19 nt, Homo sapiens
caugacaacugugaccuaa

SEQ ID NO: 1547780 - RNA, 19 nt, Homo sapiens
agaaaguguuugcuaaaug

SEQ ID NO: 1547781 - RNA, 19 nt, Homo sapiens
aagaguagcugagaauuca

SEQ ID NO: 1547782 - RNA, 19 nt, Homo sapiens
ggucauuguucuguuauau

SEQ ID NO: 1547783 - RNA, 19 nt, Homo sapiens
cuucaacacuguaauaaca

SEQ ID NO: 1547784 - RNA, 19 nt, Homo sapiens
cauguaagauaccaacuuc

SEQ ID NO: 1547785 - RNA, 19 nt, Homo sapiens
caacugugaugcugaugau

SEQ ID NO: 1547786 - RNA, 19 nt, Homo sapiens
gaaaagaaaguguuugcua

SEQ ID NO: 1547787 - RNA, 19 nt, Homo sapiens
cuaagaaaugggaagauua

SEQ ID NO: 1547788 - RNA, 19 nt, Homo sapiens
gaagcacaggauaauauuu

SEQ ID NO: 1547789 - RNA, 19 nt, Homo sapiens
uauacucguugcucauuaa

SEQ ID NO: 1547790 - RNA, 19 nt, Homo sapiens
gauaaagacaacaacaaug

SEQ ID NO: 1547791 - RNA, 19 nt, Homo sapiens
uaaguauuauggugagcua

SEQ ID NO: 1547792 - RNA, 19 nt, Homo sapiens
gaaaugaaggcagagaaau

SEQ ID NO: 1547793 - RNA, 19 nt, Homo sapiens
guaaccaguugaucucugu

SEQ ID NO: 1547794 - RNA, 19 nt, Homo sapiens
gaucuguaauuuggucauu

SEQ ID NO: 1547795 - RNA, 19 nt, Homo sapiens
gccauugccuaauuaacaa

SEQ ID NO: 1547796 - RNA, 19 nt, Homo sapiens
gaaggccagugacaugaca

SEQ ID NO: 1547797 - RNA, 19 nt, Homo sapiens
caagaagcacaggauaaua

SEQ ID NO: 1547798 - RNA, 19 nt, Homo sapiens
ucuacgggaugauaaauga

SEQ ID NO: 1547799 - RNA, 19 nt, Homo sapiens
gaugaaggccagugacaug

SEQ ID NO: 1547800 - RNA, 19 nt, Homo sapiens
aaacucaggucagaugguu

SEQ ID NO: 1547801 - RNA, 19 nt, Homo sapiens
ccuacucucuucugcaauu

SEQ ID NO: 1547802 - RNA, 19 nt, Homo sapiens
guugagugcuaaauauuuc

SEQ ID NO: 1547803 - RNA, 19 nt, Homo sapiens
uaaaugacaccuacugcaa

SEQ ID NO: 1547804 - RNA, 19 nt, Homo sapiens
guugguaucuauccgaaug

SEQ ID NO: 1547805 - RNA, 19 nt, Homo sapiens
guaauuuggucauuguucu

SEQ ID NO: 1547806 - RNA, 19 nt, Homo sapiens
gaacaaggaagagaugagu

SEQ ID NO: 1547807 - RNA, 19 nt, Homo sapiens
agacagaaggguauagaaa

SEQ ID NO: 1547808 - RNA, 19 nt, Homo sapiens
gccaagaagcacaggauaa

SEQ ID NO: 1547809 - RNA, 19 nt, Homo sapiens
gucauagguuuaucacuga

SEQ ID NO: 1547810 - RNA, 19 nt, Homo sapiens
gaguuacugugauggaguu

SEQ ID NO: 1547811 - RNA, 19 nt, Homo sapiens
gaauuucccauugcuacua

SEQ ID NO: 1547812 - RNA, 19 nt, Homo sapiens
agauagaaaugcccacuca

SEQ ID NO: 1547813 - RNA, 19 nt, Homo sapiens
gagcuaaugauagauagaa

SEQ ID NO: 1547814 - RNA, 19 nt, Homo sapiens
acacgugugguucuauuua

SEQ ID NO: 1547815 - RNA, 19 nt, Homo sapiens
gcucuacuugcuaauauuu

SEQ ID NO: 1547816 - RNA, 19 nt, Homo sapiens
ccauugggcuauugucugu

SEQ ID NO: 1547817 - RNA, 19 nt, Homo sapiens
caggauuacuugacuaucu

SEQ ID NO: 1547818 - RNA, 19 nt, Homo sapiens
ccaucuuucuacaguauuu

SEQ ID NO: 1547819 - RNA, 19 nt, Homo sapiens
caaaguggauaccauucuc

SEQ ID NO: 1547820 - RNA, 19 nt, Homo sapiens
gccacaauaacaacaauaa

SEQ ID NO: 1547821 - RNA, 19 nt, Homo sapiens
gguugagugcuaaauauuu

SEQ ID NO: 1547822 - RNA, 19 nt, Homo sapiens
caacugugaccuaagaaau

SEQ ID NO: 1547823 - RNA, 19 nt, Homo sapiens
gaggaugguugugcucaug

SEQ ID NO: 1547824 - RNA, 19 nt, Homo sapiens
gcgcaugaguuacugugau

SEQ ID NO: 1547825 - RNA, 19 nt, Homo sapiens
agaaaugcccacucaaaga

SEQ ID NO: 1547826 - RNA, 19 nt, Homo sapiens
ucaauauucacacccauaa

SEQ ID NO: 1547827 - RNA, 19 nt, Homo sapiens
gacaacaggaggaaaugaa

SEQ ID NO: 1547828 - RNA, 19 nt, Homo sapiens
gggaagauuugcacaauaa

SEQ ID NO: 1547829 - RNA, 19 nt, Homo sapiens
cuacagauauugcagauuu

SEQ ID NO: 1547830 - RNA, 19 nt, Homo sapiens
ggaauaaacuagcuaagac

SEQ ID NO: 1547831 - RNA, 19 nt, Homo sapiens
aagcaugugucaagcauua

SEQ ID NO: 1547832 - RNA, 19 nt, Homo sapiens
aaugguagcuucaccuaua

SEQ ID NO: 1547833 - RNA, 19 nt, Homo sapiens
uauccagucugcaaucuua

SEQ ID NO: 1547834 - RNA, 19 nt, Homo sapiens
ggaaauguagcaguuguua

SEQ ID NO: 1547835 - RNA, 19 nt, Homo sapiens
ccaacugccucuaugcaua

SEQ ID NO: 1547836 - RNA, 19 nt, Homo sapiens
ggccaucaauguucuguuu

SEQ ID NO: 1547837 - RNA, 19 nt, Homo sapiens
gaaucagacuacagauauu

SEQ ID NO: 1547838 - RNA, 19 nt, Homo sapiens
uacaucagcugugcuaaua

SEQ ID NO: 1547839 - RNA, 19 nt, Homo sapiens
ggaagacaguguaaaagua

SEQ ID NO: 1547840 - RNA, 19 nt, Homo sapiens
cuaaagcucugcuagacaa

SEQ ID NO: 1547841 - RNA, 19 nt, Homo sapiens
caagcuguguuauauaaug

SEQ ID NO: 1547842 - RNA, 19 nt, Homo sapiens
cgauggagaucuauuagga

SEQ ID NO: 1547843 - RNA, 19 nt, Homo sapiens
caucauuacuccauuaaca

SEQ ID NO: 1547844 - RNA, 19 nt, Homo sapiens
ccugguguguggaauaaua

SEQ ID NO: 1547845 - RNA, 19 nt, Homo sapiens
gugauuaaacugcagauaa

SEQ ID NO: 1547846 - RNA, 19 nt, Homo sapiens
guuguuagaucauauacug

SEQ ID NO: 1547847 - RNA, 19 nt, Homo sapiens
gaagaacaagaacauaugu

SEQ ID NO: 1547848 - RNA, 19 nt, Homo sapiens
ggaguuaaguugcuuucca

SEQ ID NO: 1547849 - RNA, 19 nt, Homo sapiens
gguugaagccguuguuauu

SEQ ID NO: 1547850 - RNA, 19 nt, Homo sapiens
gaagaagcaaguacagaug

SEQ ID NO: 1547851 - RNA, 19 nt, Homo sapiens
gcugguugcucguggauug

SEQ ID NO: 1547852 - RNA, 19 nt, Homo sapiens
caucccagcuucucauaau

SEQ ID NO: 1547853 - RNA, 19 nt, Homo sapiens
agacugaagagcauuauaa

SEQ ID NO: 1547854 - RNA, 19 nt, Homo sapiens
ccaagaaucagacuacaga

SEQ ID NO: 1547855 - RNA, 19 nt, Homo sapiens
aauggaagaugacaaugaa

SEQ ID NO: 1547856 - RNA, 19 nt, Homo sapiens
gaguuaaguugcuuuccaa

SEQ ID NO: 1547857 - RNA, 19 nt, Homo sapiens
gcuggguuauugcuucaua

SEQ ID NO: 1547858 - RNA, 19 nt, Homo sapiens
gagccagucuccaagaauc

SEQ ID NO: 1547859 - RNA, 19 nt, Homo sapiens
ggaagaugacaaugaaaga

SEQ ID NO: 1547860 - RNA, 19 nt, Homo sapiens
cgacagcugauacaaguuu

SEQ ID NO: 1547861 - RNA, 19 nt, Homo sapiens
acucauugcucuuucugua

SEQ ID NO: 1547862 - RNA, 19 nt, Homo sapiens
gcaaucuuauguccuauac

SEQ ID NO: 1547863 - RNA, 19 nt, Homo sapiens
gcaguuguuagaucauaua

SEQ ID NO: 1547864 - RNA, 19 nt, Homo sapiens
uauaagagccgauggagau

SEQ ID NO: 1547865 - RNA, 19 nt, Homo sapiens
cuauuuaucuuugcccuuu

SEQ ID NO: 1547866 - RNA, 19 nt, Homo sapiens
cagagagaauucuacaugu

SEQ ID NO: 1547867 - RNA, 19 nt, Homo sapiens
gguuauugcuucauauagu

SEQ ID NO: 1547868 - RNA, 19 nt, Homo sapiens
cuacaugucauugugaaua

SEQ ID NO: 1547869 - RNA, 19 nt, Homo sapiens
gagagaauucuacauguca

SEQ ID NO: 1547870 - RNA, 19 nt, Homo sapiens
ggaccacgaugggcauuca

SEQ ID NO: 1547871 - RNA, 19 nt, Homo sapiens
caauggaagaugacaauga

SEQ ID NO: 1547872 - RNA, 19 nt, Homo sapiens
caaguuccauggcaaacau

SEQ ID NO: 1547873 - RNA, 19 nt, Homo sapiens
ggagaucuauuaggauuuu

SEQ ID NO: 1547874 - RNA, 19 nt, Homo sapiens
cagcugugcuaauaggauu

SEQ ID NO: 1547875 - RNA, 19 nt, Homo sapiens
uguauggguuggcuucuuu

SEQ ID NO: 1547876 - RNA, 19 nt, Homo sapiens
cauaauacuugcugcucuu

SEQ ID NO: 1547877 - RNA, 19 nt, Homo sapiens
uagcaguuguuagaucaua

SEQ ID NO: 1547878 - RNA, 19 nt, Homo sapiens
gaauaauagugcucaccau

SEQ ID NO: 1547879 - RNA, 19 nt, Homo sapiens
ucucagcaguguaggguuu

SEQ ID NO: 1547880 - RNA, 19 nt, Homo sapiens
cauugugaauaguagguua

SEQ ID NO: 1547881 - RNA, 19 nt, Homo sapiens
agaaucagacuacagauau

SEQ ID NO: 1547882 - RNA, 19 nt, Homo sapiens
ugggaagauuugcacaaua

SEQ ID NO: 1547883 - RNA, 19 nt, Homo sapiens
uggcuucuuuaucuuguua

SEQ ID NO: 1547884 - RNA, 19 nt, Homo sapiens
aaccaucauuacuccauua

SEQ ID NO: 1547885 - RNA, 19 nt, Homo sapiens
gcaggugucgcgagaguug

SEQ ID NO: 1547886 - RNA, 19 nt, Homo sapiens
ggaauuggagcaggaaaug

SEQ ID NO: 1547887 - RNA, 19 nt, Homo sapiens
cuuauugucuccaucuuga

SEQ ID NO: 1547888 - RNA, 19 nt, Homo sapiens
cauauagucuuggccaaau

SEQ ID NO: 1547889 - RNA, 19 nt, Homo sapiens
ggaaguggagcccggauuc

SEQ ID NO: 1547890 - RNA, 19 nt, Homo sapiens
ucugcaaucuuauguccua

SEQ ID NO: 1547891 - RNA, 19 nt, Homo sapiens
aaauguagcaguuguuaga

SEQ ID NO: 1547892 - RNA, 19 nt, Homo sapiens
caaaugguagcuucaccua

SEQ ID NO: 1547893 - RNA, 19 nt, Homo sapiens
guagugaugauguccauau

SEQ ID NO: 1547894 - RNA, 19 nt, Homo sapiens
caacugccucuaugcauau

SEQ ID NO: 1547895 - RNA, 19 nt, Homo sapiens
uaacagagagaauucuaca

SEQ ID NO: 1547896 - RNA, 19 nt, Homo sapiens
uguaagauaugggaggauu

SEQ ID NO: 1547897 - RNA, 19 nt, Homo sapiens
gaaaccaucauuacuccau

SEQ ID NO: 1547898 - RNA, 19 nt, Homo sapiens
gugacucuauuuaucuuug

SEQ ID NO: 1547899 - RNA, 19 nt, Homo sapiens
caugggaugugauuaaacu

SEQ ID NO: 1547900 - RNA, 19 nt, Homo sapiens
acagagagaauucuacaug

SEQ ID NO: 1547901 - RNA, 19 nt, Homo sapiens
uggguuggcuucuuuaucu

SEQ ID NO: 1547902 - RNA, 19 nt, Homo sapiens
gauccuugccauacuaaga

SEQ ID NO: 1547903 - RNA, 19 nt, Homo sapiens
ugaagaacaagaacauaug

SEQ ID NO: 1547904 - RNA, 19 nt, Homo sapiens
aagaaucagacuacagaua

SEQ ID NO: 1547905 - RNA, 19 nt, Homo sapiens
gcuaagacugugauggaaa

SEQ ID NO: 1547906 - RNA, 19 nt, Homo sapiens
agaagcaaguacagaugaa

SEQ ID NO: 1547907 - RNA, 19 nt, Homo sapiens
caggaaauguagcaguugu

SEQ ID NO: 1547908 - RNA, 19 nt, Homo sapiens
gguagcuucaccuauauuu

SEQ ID NO: 1547909 - RNA, 19 nt, Homo sapiens
aaucuuauguccuauacuc

SEQ ID NO: 1547910 - RNA, 19 nt, Homo sapiens
gugggaagauuugcacaau

SEQ ID NO: 1547911 - RNA, 19 nt, Homo sapiens
aaaccaucauuacuccauu

SEQ ID NO: 1547912 - RNA, 19 nt, Homo sapiens
gcagauaaacauguauaca

SEQ ID NO: 1547913 - RNA, 19 nt, Homo sapiens
aagcucugcuagacaauug

SEQ ID NO: 1547914 - RNA, 19 nt, Homo sapiens
guucaucagccaaguguau

SEQ ID NO: 1547915 - RNA, 19 nt, Homo sapiens
caucagcugugcuaauagg

SEQ ID NO: 1547916 - RNA, 19 nt, Homo sapiens
guugaagccguuguuauuu

SEQ ID NO: 1547917 - RNA, 19 nt, Homo sapiens
ugaagaagcaaguacagau

SEQ ID NO: 1547918 - RNA, 19 nt, Homo sapiens
agagagaauucuacauguc

SEQ ID NO: 1547919 - RNA, 19 nt, Homo sapiens
gacuacagauauugcagau

SEQ ID NO: 1547920 - RNA, 19 nt, Homo sapiens
gugagccagucuccaagaa

SEQ ID NO: 1547921 - RNA, 19 nt, Homo sapiens
uagcuaagacugugaugga

SEQ ID NO: 1547922 - RNA, 19 nt, Homo sapiens
aagagaacaucguguggau

SEQ ID NO: 1547923 - RNA, 19 nt, Homo sapiens
gagacugaagagcauuaua

SEQ ID NO: 1547924 - RNA, 19 nt, Homo sapiens
uguagcaguuguuagauca

SEQ ID NO: 1547925 - RNA, 19 nt, Homo sapiens
gagaauucuacaugucauu

SEQ ID NO: 1547926 - RNA, 19 nt, Homo sapiens
guuaacagcaucuggaagu

SEQ ID NO: 1547927 - RNA, 19 nt, Homo sapiens
ggaggacucaucguuguau

SEQ ID NO: 1547928 - RNA, 19 nt, Homo sapiens
gcaguuaccuguggucauu

SEQ ID NO: 1547929 - RNA, 19 nt, Homo sapiens
ccacgcagguguaccauga

SEQ ID NO: 1547930 - RNA, 19 nt, Homo sapiens
cugagaagaugcagauuaa

SEQ ID NO: 1547931 - RNA, 19 nt, Homo sapiens
ggaggaggcugagaagaug

SEQ ID NO: 1547932 - RNA, 19 nt, Homo sapiens
gcugagaagaugcagauua

SEQ ID NO: 1547933 - RNA, 19 nt, Homo sapiens
gagaagaugcagauuaaau

SEQ ID NO: 1547934 - RNA, 19 nt, Homo sapiens
ggaaguggaagccuaagaa

SEQ ID NO: 1547935 - RNA, 19 nt, Homo sapiens
gaagggaggaggcugagaa

SEQ ID NO: 1547936 - RNA, 19 nt, Homo sapiens
ggacuuaucuacucuucac

SEQ ID NO: 1547937 - RNA, 19 nt, Homo sapiens
ggaggaaguggaagccuaa

SEQ ID NO: 1547938 - RNA, 19 nt, Homo sapiens
acaaagggcaggagaagaa

SEQ ID NO: 1547939 - RNA, 19 nt, Homo sapiens
ggaguuccuucccuuucaa

SEQ ID NO: 1547940 - RNA, 19 nt, Homo sapiens
gccacagccucuuggauga

SEQ ID NO: 1547941 - RNA, 19 nt, Homo sapiens
ugacgcagaagcacaaauu

SEQ ID NO: 1547942 - RNA, 19 nt, Homo sapiens
gggaggaggcugagaagau

SEQ ID NO: 1547943 - RNA, 19 nt, Homo sapiens
ccugaaggccucucacaaa

SEQ ID NO: 1547944 - RNA, 19 nt, Homo sapiens
ccgaugaucuggccugaag

SEQ ID NO: 1547945 - RNA, 19 nt, Homo sapiens
gaaguggaagccuaagaau

SEQ ID NO: 1547946 - RNA, 19 nt, Homo sapiens
ccucuuggaugauguccuu

SEQ ID NO: 1547947 - RNA, 19 nt, Homo sapiens
acucuucacuuuccugaug

SEQ ID NO: 1547948 - RNA, 19 nt, Homo sapiens
cggcugcgcuucaccaagu

SEQ ID NO: 1547949 - RNA, 19 nt, Homo sapiens
cuuaucuacucuucacuuu

SEQ ID NO: 1547950 - RNA, 19 nt, Homo sapiens
gcuccugccucccaaaguc

SEQ ID NO: 1547951 - RNA, 19 nt, Homo sapiens
gcgagggcaugcaccugaa

SEQ ID NO: 1547952 - RNA, 19 nt, Homo sapiens
ggaaggccaccagcuauca

SEQ ID NO: 1547953 - RNA, 19 nt, Homo sapiens
cugaaggccucucacaaag

SEQ ID NO: 1547954 - RNA, 19 nt, Homo sapiens
gagcucgaguggcacaucu

SEQ ID NO: 1547955 - RNA, 19 nt, Homo sapiens
acgagggccuggacgacua

SEQ ID NO: 1547956 - RNA, 19 nt, Homo sapiens
uaucuacucuucacuuucc

SEQ ID NO: 1547957 - RNA, 19 nt, Homo sapiens
ucacuuuccugaugaucca

SEQ ID NO: 1547958 - RNA, 19 nt, Homo sapiens
gcccuugcuucucccauca

SEQ ID NO: 1547959 - RNA, 19 nt, Homo sapiens
acacggugcuggcgcugau

SEQ ID NO: 1547960 - RNA, 19 nt, Homo sapiens
gcuccgauggcuaccugua

SEQ ID NO: 1547961 - RNA, 19 nt, Homo sapiens
cgcagaagcacaaauugga

SEQ ID NO: 1547962 - RNA, 19 nt, Homo sapiens
gaugcagauuaaauaaagg

SEQ ID NO: 1547963 - RNA, 19 nt, Homo sapiens
ccgagugauuguuguccaa

SEQ ID NO: 1547964 - RNA, 19 nt, Homo sapiens
uuagaugcccgagugauug

SEQ ID NO: 1547965 - RNA, 19 nt, Homo sapiens
ucacaaagggcaggagaag

SEQ ID NO: 1547966 - RNA, 19 nt, Homo sapiens
cuuagaugcccgagugauu

SEQ ID NO: 1547967 - RNA, 19 nt, Homo sapiens
ugggcagggugcucucuga

SEQ ID NO: 1547968 - RNA, 19 nt, Homo sapiens
cacagccucuuggaugaug

SEQ ID NO: 1547969 - RNA, 19 nt, Homo sapiens
gcagauauuugaacaguuu

SEQ ID NO: 1547970 - RNA, 19 nt, Homo sapiens
gaucagagguuccgacuug

SEQ ID NO: 1547971 - RNA, 19 nt, Homo sapiens
gaaaggaccaggagcauuu

SEQ ID NO: 1547972 - RNA, 19 nt, Homo sapiens
gaaagcagauauuugaaca

SEQ ID NO: 1547973 - RNA, 19 nt, Homo sapiens
ggagaaagaauuacacaaa

SEQ ID NO: 1547974 - RNA, 19 nt, Homo sapiens
guaacaaucucaaggcauu

SEQ ID NO: 1547975 - RNA, 19 nt, Homo sapiens
ggauuacuguuucauauug

SEQ ID NO: 1547976 - RNA, 19 nt, Homo sapiens
gaggauuacuguuucauau

SEQ ID NO: 1547977 - RNA, 19 nt, Homo sapiens
gaacgaaagcagauauuug

SEQ ID NO: 1547978 - RNA, 19 nt, Homo sapiens
guggaucacuuacagguuu

SEQ ID NO: 1547979 - RNA, 19 nt, Homo sapiens
gucgaucccuuaauuguuu

SEQ ID NO: 1547980 - RNA, 19 nt, Homo sapiens
ggaccacguuuaaggaguu

SEQ ID NO: 1547981 - RNA, 19 nt, Homo sapiens
gagccgggauggagacaaa

SEQ ID NO: 1547982 - RNA, 19 nt, Homo sapiens
ucucaucaccuuuguauaa

SEQ ID NO: 1547983 - RNA, 19 nt, Homo sapiens
gcauuugugucaucaccua

SEQ ID NO: 1547984 - RNA, 19 nt, Homo sapiens
auacgucgaucccuuaauu

SEQ ID NO: 1547985 - RNA, 19 nt, Homo sapiens
gcggagaccucaacaggau

SEQ ID NO: 1547986 - RNA, 19 nt, Homo sapiens
ccacaucucugcccuucug

SEQ ID NO: 1547987 - RNA, 19 nt, Homo sapiens
uuaaggaguuugcagagaa

SEQ ID NO: 1547988 - RNA, 19 nt, Homo sapiens
ggaacgaaagcagauauuu

SEQ ID NO: 1547989 - RNA, 19 nt, Homo sapiens
uaaggaguuugcagagaaa

SEQ ID NO: 1547990 - RNA, 19 nt, Homo sapiens
ggaagaccaagaugugaaa

SEQ ID NO: 1547991 - RNA, 19 nt, Homo sapiens
ccaaagaagaauucaagaa

SEQ ID NO: 1547992 - RNA, 19 nt, Homo sapiens
gcagggagccguguugguu

SEQ ID NO: 1547993 - RNA, 19 nt, Homo sapiens
ggaacgggagccucuguaa

SEQ ID NO: 1547994 - RNA, 19 nt, Homo sapiens
agagaaaucuaaagugucu

SEQ ID NO: 1547995 - RNA, 19 nt, Homo sapiens
ucucagaggauuacuguuu

SEQ ID NO: 1547996 - RNA, 19 nt, Homo sapiens
caacagggaagaccaagau

SEQ ID NO: 1547997 - RNA, 19 nt, Homo sapiens
gcccggaguuugcaugaga

SEQ ID NO: 1547998 - RNA, 19 nt, Homo sapiens
gaccuuggcacccaucaaa

SEQ ID NO: 1547999 - RNA, 19 nt, Homo sapiens
gggagccucuguaacaauc

SEQ ID NO: 1548000 - RNA, 19 nt, Homo sapiens
agaguuugaugcauuucua

SEQ ID NO: 1548001 - RNA, 19 nt, Homo sapiens
uaagaaacgggacaaggaa

SEQ ID NO: 1548002 - RNA, 19 nt, Homo sapiens
gcugcuagccaaagaagaa

SEQ ID NO: 1548003 - RNA, 19 nt, Homo sapiens
gacgggcgaugaccgaguu

SEQ ID NO: 1548004 - RNA, 19 nt, Homo sapiens
ccaccgguccuacuucaaa

SEQ ID NO: 1548005 - RNA, 19 nt, Homo sapiens
gugauacgucgaucccuua

SEQ ID NO: 1548006 - RNA, 19 nt, Homo sapiens
auucagaguuugaugcauu

SEQ ID NO: 1548007 - RNA, 19 nt, Homo sapiens
aacgaaagcagauauuuga

SEQ ID NO: 1548008 - RNA, 19 nt, Homo sapiens
gaccucaacaggaucauug

SEQ ID NO: 1548009 - RNA, 19 nt, Homo sapiens
gaccguggaucacuuacag

SEQ ID NO: 1548010 - RNA, 19 nt, Homo sapiens
caauaggguuuucaucauu

SEQ ID NO: 1548011 - RNA, 19 nt, Homo sapiens
gcaauaggguuuucaucau

SEQ ID NO: 1548012 - RNA, 19 nt, Homo sapiens
gaggaacgaaagcagauau

SEQ ID NO: 1548013 - RNA, 19 nt, Homo sapiens
gggaagaccaagaugugaa

SEQ ID NO: 1548014 - RNA, 19 nt, Homo sapiens
caacgaugcaccugucugu

SEQ ID NO: 1548015 - RNA, 19 nt, Homo sapiens
gcaaaucaaguagcugugu

SEQ ID NO: 1548016 - RNA, 19 nt, Homo sapiens
uaccugggagaaagaauua

SEQ ID NO: 1548017 - RNA, 19 nt, Homo sapiens
gcaaagagagaggacaaag

SEQ ID NO: 1548018 - RNA, 19 nt, Homo sapiens
ucaaggcauuugugucauc

SEQ ID NO: 1548019 - RNA, 19 nt, Homo sapiens
gggaaaaguuggauagaca

SEQ ID NO: 1548020 - RNA, 19 nt, Homo sapiens
uauugaagcucucucuuuu

SEQ ID NO: 1548021 - RNA, 19 nt, Homo sapiens
uuaagaaacgggacaagga

SEQ ID NO: 1548022 - RNA, 19 nt, Homo sapiens
aagcagauauuugaacagu

SEQ ID NO: 1548023 - RNA, 19 nt, Homo sapiens
caaggcauuugugucauca

SEQ ID NO: 1548024 - RNA, 19 nt, Homo sapiens
gaagcucucucuuuuguac

SEQ ID NO: 1548025 - RNA, 19 nt, Homo sapiens
ucagaggauuacuguuuca

SEQ ID NO: 1548026 - RNA, 19 nt, Homo sapiens
gaaaaugagaugaguuugu

SEQ ID NO: 1548027 - RNA, 19 nt, Homo sapiens
cagaggaggcaaagagaga

SEQ ID NO: 1548028 - RNA, 19 nt, Homo sapiens
ucucaaggcauuuguguca

SEQ ID NO: 1548029 - RNA, 19 nt, Homo sapiens
gaccacguuuaaggaguuu

SEQ ID NO: 1548030 - RNA, 19 nt, Homo sapiens
gaggacaaaggcacaagga

SEQ ID NO: 1548031 - RNA, 19 nt, Homo sapiens
ggaguuugcaugagauuuu

SEQ ID NO: 1548032 - RNA, 19 nt, Homo sapiens
gaacgggagccucuguaac

SEQ ID NO: 1548033 - RNA, 19 nt, Homo sapiens
gaguuugaugcauuucuaa

SEQ ID NO: 1548034 - RNA, 19 nt, Homo sapiens
agaggauuacuguuucaua

SEQ ID NO: 1548035 - RNA, 19 nt, Homo sapiens
ggacucaacguggauacau

SEQ ID NO: 1548036 - RNA, 19 nt, Homo sapiens
ggagaccucaacaggauca

SEQ ID NO: 1548037 - RNA, 19 nt, Homo sapiens
cucaucaccuuuguauaaa

SEQ ID NO: 1548038 - RNA, 19 nt, Homo sapiens
aaaaugagaugaguuugug

SEQ ID NO: 1548039 - RNA, 19 nt, Homo sapiens
ggaguuugcagagaaauac

SEQ ID NO: 1548040 - RNA, 19 nt, Homo sapiens
uaaauugcugcuagccaaa

SEQ ID NO: 1548041 - RNA, 19 nt, Homo sapiens
cagggaagaccaagaugug

SEQ ID NO: 1548042 - RNA, 19 nt, Homo sapiens
cuaggucucagucucguuu

SEQ ID NO: 1548043 - RNA, 19 nt, Homo sapiens
caggauucccgcaguguug

SEQ ID NO: 1548044 - RNA, 19 nt, Homo sapiens
cugaaaaccuuugugaauu

SEQ ID NO: 1548045 - RNA, 19 nt, Homo sapiens
auauugaagcucucucuuu

SEQ ID NO: 1548046 - RNA, 19 nt, Homo sapiens
ggacaaggaaaacagacua

SEQ ID NO: 1548047 - RNA, 19 nt, Homo sapiens
ccaggaccacguuuaagga

SEQ ID NO: 1548048 - RNA, 19 nt, Homo sapiens
gagacaaagaagacaagga

SEQ ID NO: 1548049 - RNA, 19 nt, Homo sapiens
gcuggcaaaucaaguagcu

SEQ ID NO: 1548050 - RNA, 19 nt, Homo sapiens
gcuguuugguggccauucu

SEQ ID NO: 1548051 - RNA, 19 nt, Homo sapiens
gacucaacguggauacauc

SEQ ID NO: 1548052 - RNA, 19 nt, Homo sapiens
caaagagagaggacaaagg

SEQ ID NO: 1548053 - RNA, 19 nt, Homo sapiens
ggauggagacaaagaagac

SEQ ID NO: 1548054 - RNA, 19 nt, Homo sapiens
gggauggagacaaagaaga

SEQ ID NO: 1548055 - RNA, 19 nt, Homo sapiens
agugacaacugugagcauu

SEQ ID NO: 1548056 - RNA, 19 nt, Homo sapiens
uuucugaguagcagcaaua

SEQ ID NO: 1548057 - RNA, 19 nt, Homo sapiens
guacauucagaguuugaug

SEQ ID NO: 1548058 - RNA, 19 nt, Homo sapiens
cgaaagcagauauuugaac

SEQ ID NO: 1548059 - RNA, 19 nt, Homo sapiens
gcuaucuccugcucaacuc

SEQ ID NO: 1548060 - RNA, 19 nt, Homo sapiens
gggagaaagaauuacacaa

SEQ ID NO: 1548061 - RNA, 19 nt, Homo sapiens
cuaccugggagaaagaauu

SEQ ID NO: 1548062 - RNA, 19 nt, Homo sapiens
ucucugcccuucugcucuu

SEQ ID NO: 1548063 - RNA, 19 nt, Homo sapiens
ugucaucaccuaagacgau

SEQ ID NO: 1548064 - RNA, 19 nt, Homo sapiens
guucucagaggauuacugu

SEQ ID NO: 1548065 - RNA, 19 nt, Homo sapiens
gcuagccaaagaagaauuc

SEQ ID NO: 1548066 - RNA, 19 nt, Homo sapiens
gaaaaguuggauagacaaa

SEQ ID NO: 1548067 - RNA, 19 nt, Homo sapiens
agaagcccauggaccugaa

SEQ ID NO: 1548068 - RNA, 19 nt, Homo sapiens
ccgcaguguugaggaauuc

SEQ ID NO: 1548069 - RNA, 19 nt, Homo sapiens
ggacuuaacuccauugauu

SEQ ID NO: 1548070 - RNA, 19 nt, Homo sapiens
gagcagagaugaagaaagu

SEQ ID NO: 1548071 - RNA, 19 nt, Homo sapiens
gggcauaacucuaaccaaa

SEQ ID NO: 1548072 - RNA, 19 nt, Homo sapiens
agacuugacuugcagauua

SEQ ID NO: 1548073 - RNA, 19 nt, Homo sapiens
gagaagccuuuguuguuua

SEQ ID NO: 1548074 - RNA, 19 nt, Homo sapiens
gaacaucccaguuauauca

SEQ ID NO: 1548075 - RNA, 19 nt, Homo sapiens
ugaauuugcuguguguuua

SEQ ID NO: 1548076 - RNA, 19 nt, Homo sapiens
gcagauagcccucucuuag

SEQ ID NO: 1548077 - RNA, 19 nt, Homo sapiens
gaagaaagucccuaugcaa

SEQ ID NO: 1548078 - RNA, 19 nt, Homo sapiens
gcuguguguuuauaacuua

SEQ ID NO: 1548079 - RNA, 19 nt, Homo sapiens
uaaagaauccaacaacuga

SEQ ID NO: 1548080 - RNA, 19 nt, Homo sapiens
agagaagccuuuguuguuu

SEQ ID NO: 1548081 - RNA, 19 nt, Homo sapiens
cagagaagccuuuguuguu

SEQ ID NO: 1548082 - RNA, 19 nt, Homo sapiens
gaagaaaacuuugaacauc

SEQ ID NO: 1548083 - RNA, 19 nt, Homo sapiens
gaagagagcagagaugaag

SEQ ID NO: 1548084 - RNA, 19 nt, Homo sapiens
ugacauaaagcaucaaaga

SEQ ID NO: 1548085 - RNA, 19 nt, Homo sapiens
caacacaggcagccaagaa

SEQ ID NO: 1548086 - RNA, 19 nt, Homo sapiens
ccaagaagcuaaaagaaga

SEQ ID NO: 1548087 - RNA, 19 nt, Homo sapiens
gacuugacuugcagauuaa

SEQ ID NO: 1548088 - RNA, 19 nt, Homo sapiens
ccuauaguguccaucuuaa

SEQ ID NO: 1548089 - RNA, 19 nt, Homo sapiens
gcaccaagacccgcucgua

SEQ ID NO: 1548090 - RNA, 19 nt, Homo sapiens
gaaaauaugguugcuguuu

SEQ ID NO: 1548091 - RNA, 19 nt, Homo sapiens
uggcaagguuguagccuaa

SEQ ID NO: 1548092 - RNA, 19 nt, Homo sapiens
ccucuggcuuucuauaauu

SEQ ID NO: 1548093 - RNA, 19 nt, Homo sapiens
ugaagaaagucccuaugca

SEQ ID NO: 1548094 - RNA, 19 nt, Homo sapiens
ggaggcagagcaacgcuuu

SEQ ID NO: 1548095 - RNA, 19 nt, Homo sapiens
agaagccuuuguuguuuaa

SEQ ID NO: 1548096 - RNA, 19 nt, Homo sapiens
uaugguugcuguuuaagug

SEQ ID NO: 1548097 - RNA, 19 nt, Homo sapiens
gcaagguuguagccuaaag

SEQ ID NO: 1548098 - RNA, 19 nt, Homo sapiens
uaagauauguuuggaccau

SEQ ID NO: 1548099 - RNA, 19 nt, Homo sapiens
aaaugaaacugcugauaac

SEQ ID NO: 1548100 - RNA, 19 nt, Homo sapiens
cauaaagaauccaacaacu

SEQ ID NO: 1548101 - RNA, 19 nt, Homo sapiens
cuaugcaacuucccucuau

SEQ ID NO: 1548102 - RNA, 19 nt, Homo sapiens
gcauaacucuaaccaaaau

SEQ ID NO: 1548103 - RNA, 19 nt, Homo sapiens
uaucagagaagccuuuguu

SEQ ID NO: 1548104 - RNA, 19 nt, Homo sapiens
cagauuaaguuaucaacac

SEQ ID NO: 1548105 - RNA, 19 nt, Homo sapiens
gagauuuccugcagagacu

SEQ ID NO: 1548106 - RNA, 19 nt, Homo sapiens
ggaagugucagccagagau

SEQ ID NO: 1548107 - RNA, 19 nt, Homo sapiens
gaaaaugaaacugcugaua

SEQ ID NO: 1548108 - RNA, 19 nt, Homo sapiens
gaagugucagccagagauu

SEQ ID NO: 1548109 - RNA, 19 nt, Homo sapiens
gacauaaagcaucaaagau

SEQ ID NO: 1548110 - RNA, 19 nt, Homo sapiens
gaauuugcuguguguuuau

SEQ ID NO: 1548111 - RNA, 19 nt, Homo sapiens
gcucaucacuuuuguaggu

SEQ ID NO: 1548112 - RNA, 19 nt, Homo sapiens
ccucaagaaucugauguuc

SEQ ID NO: 1548113 - RNA, 19 nt, Homo sapiens
gggcaucgcgcucaaguac

SEQ ID NO: 1548114 - RNA, 19 nt, Homo sapiens
gcaacuucccucuaucaca

SEQ ID NO: 1548115 - RNA, 19 nt, Homo sapiens
gcagauuaaguuaucaaca

SEQ ID NO: 1548116 - RNA, 19 nt, Homo sapiens
ucagagaagccuuuguugu

SEQ ID NO: 1548117 - RNA, 19 nt, Homo sapiens
ccagggcucuaucgccaau

SEQ ID NO: 1548118 - RNA, 19 nt, Homo sapiens
gaccauaaagaauccaaca

SEQ ID NO: 1548119 - RNA, 19 nt, Homo sapiens
aagaagagagcagagauga

SEQ ID NO: 1548120 - RNA, 19 nt, Homo sapiens
acuuugaacaucccaguua

SEQ ID NO: 1548121 - RNA, 19 nt, Homo sapiens
gaugcugaauuugcugugu

SEQ ID NO: 1548122 - RNA, 19 nt, Homo sapiens
uaagugaugcugaauuugc

SEQ ID NO: 1548123 - RNA, 19 nt, Homo sapiens
gaugaagaaagucccuaug

SEQ ID NO: 1548124 - RNA, 19 nt, Homo sapiens
gagagcagagaugaagaaa

SEQ ID NO: 1548125 - RNA, 19 nt, Homo sapiens
cuaggacgccugcagauag

SEQ ID NO: 1548126 - RNA, 19 nt, Homo sapiens
caggacccauggcggauuc

SEQ ID NO: 1548127 - RNA, 19 nt, Homo sapiens
ucacgauggaacagauuaa

SEQ ID NO: 1548128 - RNA, 19 nt, Homo sapiens
gaauccaacaacugaagau

SEQ ID NO: 1548129 - RNA, 19 nt, Homo sapiens
ccauaaagaauccaacaac

SEQ ID NO: 1548130 - RNA, 19 nt, Homo sapiens
ccuaggacgccugcagaua

SEQ ID NO: 1548131 - RNA, 19 nt, Homo sapiens
aaagaagagagcagagaug

SEQ ID NO: 1548132 - RNA, 19 nt, Homo sapiens
aagccuuuguuguuuaaug

SEQ ID NO: 1548133 - RNA, 19 nt, Homo sapiens
agagagcagagaugaagaa

SEQ ID NO: 1548134 - RNA, 19 nt, Homo sapiens
uaaaagggccaauaaacug

SEQ ID NO: 1548135 - RNA, 19 nt, Homo sapiens
uccuauaguguccaucuua

SEQ ID NO: 1548136 - RNA, 19 nt, Homo sapiens
auaaagaauccaacaacug

SEQ ID NO: 1548137 - RNA, 19 nt, Homo sapiens
gagacuugacuugcagauu

SEQ ID NO: 1548138 - RNA, 19 nt, Homo sapiens
uugaacaucccaguuauau

SEQ ID NO: 1548139 - RNA, 19 nt, Homo sapiens
cugaauuugcuguguguuu

SEQ ID NO: 1548140 - RNA, 19 nt, Homo sapiens
guuuaucuccuuaugcaau

SEQ ID NO: 1548141 - RNA, 19 nt, Homo sapiens
gcaggacccauggcggauu

SEQ ID NO: 1548142 - RNA, 19 nt, Homo sapiens
gucacgauggaacagauua

SEQ ID NO: 1548143 - RNA, 19 nt, Homo sapiens
ucaaguacggugucacgau

SEQ ID NO: 1548144 - RNA, 19 nt, Homo sapiens
ucccaguccucaagaaucu

SEQ ID NO: 1548145 - RNA, 19 nt, Homo sapiens
gcgcucaaguacgguguca

SEQ ID NO: 1548146 - RNA, 19 nt, Homo sapiens
cuucuggauuccuauagug

SEQ ID NO: 1548147 - RNA, 19 nt, Homo sapiens
gacuuaacuccauugauuc

SEQ ID NO: 1548148 - RNA, 19 nt, Homo sapiens
cuuugaacaucccaguuau

SEQ ID NO: 1548149 - RNA, 19 nt, Homo sapiens
uuaguucccucuggcuuuc

SEQ ID NO: 1548150 - RNA, 19 nt, Homo sapiens
aauaaaggaggcagagcaa

SEQ ID NO: 1548151 - RNA, 19 nt, Homo sapiens
gcacauggauagaaauuua

SEQ ID NO: 1548152 - RNA, 19 nt, Homo sapiens
gaagugauauugccauuga

SEQ ID NO: 1548153 - RNA, 19 nt, Homo sapiens
gagaugcacucauuuaaau

SEQ ID NO: 1548154 - RNA, 19 nt, Homo sapiens
aguaauaucugcagaauga

SEQ ID NO: 1548155 - RNA, 19 nt, Homo sapiens
ccuaacagcugcuaugaaa

SEQ ID NO: 1548156 - RNA, 19 nt, Homo sapiens
ccacaugguucucuucaaa

SEQ ID NO: 1548157 - RNA, 19 nt, Homo sapiens
cagaaugaaugcagucuuu

SEQ ID NO: 1548158 - RNA, 19 nt, Homo sapiens
ugacaacuguuacuagaaa

SEQ ID NO: 1548159 - RNA, 19 nt, Homo sapiens
ggacuuaaaugaaauugag

SEQ ID NO: 1548160 - RNA, 19 nt, Homo sapiens
cagcugcuaugaaauuaua

SEQ ID NO: 1548161 - RNA, 19 nt, Homo sapiens
ucaaagauguaaacugcua

SEQ ID NO: 1548162 - RNA, 19 nt, Homo sapiens
caccauaugugauaacaaa

SEQ ID NO: 1548163 - RNA, 19 nt, Homo sapiens
uaacagcugcuaugaaauu

SEQ ID NO: 1548164 - RNA, 19 nt, Homo sapiens
gaagauacaacucaacaau

SEQ ID NO: 1548165 - RNA, 19 nt, Homo sapiens
gcuacuacauguacauuga

SEQ ID NO: 1548166 - RNA, 19 nt, Homo sapiens
aaauaggucuugcagguuu

SEQ ID NO: 1548167 - RNA, 19 nt, Homo sapiens
gagaaacucccacuuccua

SEQ ID NO: 1548168 - RNA, 19 nt, Homo sapiens
aagcugaaaucaccuuuaa

SEQ ID NO: 1548169 - RNA, 19 nt, Homo sapiens
uacgagcacugauugaaua

SEQ ID NO: 1548170 - RNA, 19 nt, Homo sapiens
cgaggaguaucaauaagaa

SEQ ID NO: 1548171 - RNA, 19 nt, Homo sapiens
gcaaugcuaccuucuuuau

SEQ ID NO: 1548172 - RNA, 19 nt, Homo sapiens
agagcacccuccuucauua

SEQ ID NO: 1548173 - RNA, 19 nt, Homo sapiens
uggacagucuuaacaauuu

SEQ ID NO: 1548174 - RNA, 19 nt, Homo sapiens
caacaaucaucaggauauu

SEQ ID NO: 1548175 - RNA, 19 nt, Homo sapiens
gcugaaaucaccuuuaaga

SEQ ID NO: 1548176 - RNA, 19 nt, Homo sapiens
ucugaggacuuaaaugaaa

SEQ ID NO: 1548177 - RNA, 19 nt, Homo sapiens
agauacaacucaacaauca

SEQ ID NO: 1548178 - RNA, 19 nt, Homo sapiens
gaaauacaggcuacugguu

SEQ ID NO: 1548179 - RNA, 19 nt, Homo sapiens
ccauaccucucuucaauca

SEQ ID NO: 1548180 - RNA, 19 nt, Homo sapiens
aaccauaccucucuucaau

SEQ ID NO: 1548181 - RNA, 19 nt, Homo sapiens
gcugaguguuuaucugaaa

SEQ ID NO: 1548182 - RNA, 19 nt, Homo sapiens
caaggguaagucaguauua

SEQ ID NO: 1548183 - RNA, 19 nt, Homo sapiens
uaugacaacuguuacuaga

SEQ ID NO: 1548184 - RNA, 19 nt, Homo sapiens
auacauacccagcaacuuu

SEQ ID NO: 1548185 - RNA, 19 nt, Homo sapiens
ugaacuaccuuugaaguca

SEQ ID NO: 1548186 - RNA, 19 nt, Homo sapiens
aaugcuaccuucuuuauuc

SEQ ID NO: 1548187 - RNA, 19 nt, Homo sapiens
ggaagaagacagugaagag

SEQ ID NO: 1548188 - RNA, 19 nt, Homo sapiens
gagcacauggauagaaauu

SEQ ID NO: 1548189 - RNA, 19 nt, Homo sapiens
gugaauguauugggagaaa

SEQ ID NO: 1548190 - RNA, 19 nt, Homo sapiens
gcacccuccuucauuacuu

SEQ ID NO: 1548191 - RNA, 19 nt, Homo sapiens
auaccucucuucaaucaaa

SEQ ID NO: 1548192 - RNA, 19 nt, Homo sapiens
ugaaaucaccuuuaagaag

SEQ ID NO: 1548193 - RNA, 19 nt, Homo sapiens
gauauucugaggacuuaaa

SEQ ID NO: 1548194 - RNA, 19 nt, Homo sapiens
cugcucaucuucagagaaa

SEQ ID NO: 1548195 - RNA, 19 nt, Homo sapiens
aggcaaugcuaccuucuuu

SEQ ID NO: 1548196 - RNA, 19 nt, Homo sapiens
ggguaagucaguauuaauu

SEQ ID NO: 1548197 - RNA, 19 nt, Homo sapiens
gagaggcaacaccagauaa

SEQ ID NO: 1548198 - RNA, 19 nt, Homo sapiens
guggagaaauggaagauac

SEQ ID NO: 1548199 - RNA, 19 nt, Homo sapiens
cgagcaagaugaauguaca

SEQ ID NO: 1548200 - RNA, 19 nt, Homo sapiens
aaauacaggcuacugguuu

SEQ ID NO: 1548201 - RNA, 19 nt, Homo sapiens
ucaacaaucaucaggauau

SEQ ID NO: 1548202 - RNA, 19 nt, Homo sapiens
gaguaucaauaagaaguga

SEQ ID NO: 1548203 - RNA, 19 nt, Homo sapiens
guacauuuacucaggagaa

SEQ ID NO: 1548204 - RNA, 19 nt, Homo sapiens
aaggguaagucaguauuaa

SEQ ID NO: 1548205 - RNA, 19 nt, Homo sapiens
cauaugugauaacaaagga

SEQ ID NO: 1548206 - RNA, 19 nt, Homo sapiens
uugcauaugacaacuguua

SEQ ID NO: 1548207 - RNA, 19 nt, Homo sapiens
ggaugacauuacaauacaa

SEQ ID NO: 1548208 - RNA, 19 nt, Homo sapiens
ucaguaauaucugcagaau

SEQ ID NO: 1548209 - RNA, 19 nt, Homo sapiens
gagcacugauugaauacag

SEQ ID NO: 1548210 - RNA, 19 nt, Homo sapiens
ugccauugaugauguuaaa

SEQ ID NO: 1548211 - RNA, 19 nt, Homo sapiens
caagcugaaaucaccuuua

SEQ ID NO: 1548212 - RNA, 19 nt, Homo sapiens
ugaagccauucgaggagua

SEQ ID NO: 1548213 - RNA, 19 nt, Homo sapiens
uggaugacauuacaauaca

SEQ ID NO: 1548214 - RNA, 19 nt, Homo sapiens
gaagaagacagugaagagu

SEQ ID NO: 1548215 - RNA, 19 nt, Homo sapiens
aggauauucugaggacuua

SEQ ID NO: 1548216 - RNA, 19 nt, Homo sapiens
aggcaacaccagauaauuu

SEQ ID NO: 1548217 - RNA, 19 nt, Homo sapiens
ccaaagggagaucacacua

SEQ ID NO: 1548218 - RNA, 19 nt, Homo sapiens
acacaaagggcacaaucaa

SEQ ID NO: 1548219 - RNA, 19 nt, Homo sapiens
ggacagucuuaacaauuuu

SEQ ID NO: 1548220 - RNA, 19 nt, Homo sapiens
aaacacugcuugaccuuuu

SEQ ID NO: 1548221 - RNA, 19 nt, Homo sapiens
aaagggagaucacacuacu

SEQ ID NO: 1548222 - RNA, 19 nt, Homo sapiens
gaucugcauuggauuuacu

SEQ ID NO: 1548223 - RNA, 19 nt, Homo sapiens
ggaagauacaacucaacaa

SEQ ID NO: 1548224 - RNA, 19 nt, Homo sapiens
ugagaggcaacaccagaua

SEQ ID NO: 1548225 - RNA, 19 nt, Homo sapiens
cagauauacuaaacugcuu

SEQ ID NO: 1548226 - RNA, 19 nt, Homo sapiens
ccuuugaacuaccuuugaa

SEQ ID NO: 1548227 - RNA, 19 nt, Homo sapiens
uagagcacccuccuucauu

SEQ ID NO: 1548228 - RNA, 19 nt, Homo sapiens
aagaagugauauugccauu

SEQ ID NO: 1548229 - RNA, 19 nt, Homo sapiens
gaaacucccacuuccuaca

SEQ ID NO: 1548230 - RNA, 19 nt, Homo sapiens
aacagcugcuaugaaauua

SEQ ID NO: 1548231 - RNA, 19 nt, Homo sapiens
guccaaggguaagucagua

SEQ ID NO: 1548232 - RNA, 19 nt, Homo sapiens
aaggaucuuucaugaaugu

SEQ ID NO: 1548233 - RNA, 19 nt, Homo sapiens
aaugcagucuuucaugcua

SEQ ID NO: 1548234 - RNA, 19 nt, Homo sapiens
ggagaaauggaagauacaa

SEQ ID NO: 1548235 - RNA, 19 nt, Homo sapiens
gauauugccauugaugaug

SEQ ID NO: 1548236 - RNA, 19 nt, Homo sapiens
ucaggcagauauacuaaac

SEQ ID NO: 1548237 - RNA, 19 nt, Homo sapiens
cagguuuccuuuugaauuu

SEQ ID NO: 1548238 - RNA, 19 nt, Homo sapiens
gaggcaacaccagauaauu

SEQ ID NO: 1548239 - RNA, 19 nt, Homo sapiens
ggcaaugcuaccuucuuua

SEQ ID NO: 1548240 - RNA, 19 nt, Homo sapiens
uuaaaucugcauucaguga

SEQ ID NO: 1548241 - RNA, 19 nt, Homo sapiens
cacaaagggcacaaucaaa

SEQ ID NO: 1548242 - RNA, 19 nt, Homo sapiens
guacacaaagggcacaauc

SEQ ID NO: 1548243 - RNA, 19 nt, Homo sapiens
gaaauggaagauacaacuc

SEQ ID NO: 1548244 - RNA, 19 nt, Homo sapiens
uugggaagcugcucaucuu

SEQ ID NO: 1548245 - RNA, 19 nt, Homo sapiens
aaaggaagaagacagugaa

SEQ ID NO: 1548246 - RNA, 19 nt, Homo sapiens
ggucuugcagguuuccuuu

SEQ ID NO: 1548247 - RNA, 19 nt, Homo sapiens
cauaugacaacuguuacua

SEQ ID NO: 1548248 - RNA, 19 nt, Homo sapiens
cacccuccuucauuacuuu

SEQ ID NO: 1548249 - RNA, 19 nt, Homo sapiens
aggcagauauacuaaacug

SEQ ID NO: 1548250 - RNA, 19 nt, Homo sapiens
gacaacuguuacuagaaau

SEQ ID NO: 1548251 - RNA, 19 nt, Homo sapiens
gaagagaaauguguaaaga

SEQ ID NO: 1548252 - RNA, 19 nt, Homo sapiens
gcaguagaauaaagucuua

SEQ ID NO: 1548253 - RNA, 19 nt, Homo sapiens
cauaaugacuguuuggaua

SEQ ID NO: 1548254 - RNA, 19 nt, Homo sapiens
ccauggcucugaagaauaa

SEQ ID NO: 1548255 - RNA, 19 nt, Homo sapiens
aaauaugccuccuuacgua

SEQ ID NO: 1548256 - RNA, 19 nt, Homo sapiens
gaaaauggauggcaguaga

SEQ ID NO: 1548257 - RNA, 19 nt, Homo sapiens
uugcaaauaugccuccuua

SEQ ID NO: 1548258 - RNA, 19 nt, Homo sapiens
cuacggaccugcaggaaau

SEQ ID NO: 1548259 - RNA, 19 nt, Homo sapiens
cauagaagcccacaacgaa

SEQ ID NO: 1548260 - RNA, 19 nt, Homo sapiens
ucacuuugcuucuuuacug

SEQ ID NO: 1548261 - RNA, 19 nt, Homo sapiens
caacugcaauauuuguaug

SEQ ID NO: 1548262 - RNA, 19 nt, Homo sapiens
gaucuugggucuguguuug

SEQ ID NO: 1548263 - RNA, 19 nt, Homo sapiens
guaaagaaccucugcaaaa

SEQ ID NO: 1548264 - RNA, 19 nt, Homo sapiens
gagcuucaacugcaauauu

SEQ ID NO: 1548265 - RNA, 19 nt, Homo sapiens
ucuacacucuugccugaua

SEQ ID NO: 1548266 - RNA, 19 nt, Homo sapiens
gggcaaaccagugcaaauu

SEQ ID NO: 1548267 - RNA, 19 nt, Homo sapiens
gcagacagccuuuaaucca

SEQ ID NO: 1548268 - RNA, 19 nt, Homo sapiens
agacagccuuuaauccauu

SEQ ID NO: 1548269 - RNA, 19 nt, Homo sapiens
gcaaagauggcuaaagcau

SEQ ID NO: 1548270 - RNA, 19 nt, Homo sapiens
acucuugccugauaccuaa

SEQ ID NO: 1548271 - RNA, 19 nt, Homo sapiens
gacccacacuuuauagaca

SEQ ID NO: 1548272 - RNA, 19 nt, Homo sapiens
ggcaaaccagugcaaauuu

SEQ ID NO: 1548273 - RNA, 19 nt, Homo sapiens
ucacugacccacacuuuau

SEQ ID NO: 1548274 - RNA, 19 nt, Homo sapiens
uaucaucacuuugcuucuu

SEQ ID NO: 1548275 - RNA, 19 nt, Homo sapiens
agagaaauguguaaagaac

SEQ ID NO: 1548276 - RNA, 19 nt, Homo sapiens
caacgaauggcguggcaaa

SEQ ID NO: 1548277 - RNA, 19 nt, Homo sapiens
ugccugauaccuaaauuua

SEQ ID NO: 1548278 - RNA, 19 nt, Homo sapiens
gagagcaccucagcagaca

SEQ ID NO: 1548279 - RNA, 19 nt, Homo sapiens
gcaaauaugccuccuuacg

SEQ ID NO: 1548280 - RNA, 19 nt, Homo sapiens
cgaauggcguggcaaaguc

SEQ ID NO: 1548281 - RNA, 19 nt, Homo sapiens
gcauagaagcccacaacga

SEQ ID NO: 1548282 - RNA, 19 nt, Homo sapiens
ggauggcaguagaauaaag

SEQ ID NO: 1548283 - RNA, 19 nt, Homo sapiens
uaacuuaucaucacuuugc

SEQ ID NO: 1548284 - RNA, 19 nt, Homo sapiens
uaaaugcuaugcagcuuuu

SEQ ID NO: 1548285 - RNA, 19 nt, Homo sapiens
ugaaucuucuacacucuug

SEQ ID NO: 1548286 - RNA, 19 nt, Homo sapiens
gguauaaugaaacccaauu

SEQ ID NO: 1548287 - RNA, 19 nt, Homo sapiens
cagugcaaauuugaacaua

SEQ ID NO: 1548288 - RNA, 19 nt, Homo sapiens
caaauaugccuccuuacgu

SEQ ID NO: 1548289 - RNA, 19 nt, Homo sapiens
gcaguugcaauguguccua

SEQ ID NO: 1548290 - RNA, 19 nt, Homo sapiens
auagacaacugcauagaag

SEQ ID NO: 1548291 - RNA, 19 nt, Homo sapiens
ucaucacuuugcuucuuua

SEQ ID NO: 1548292 - RNA, 19 nt, Homo sapiens
ccauuacggcuugguauaa

SEQ ID NO: 1548293 - RNA, 19 nt, Homo sapiens
cugguuagguggaauaaag

SEQ ID NO: 1548294 - RNA, 19 nt, Homo sapiens
cagcagacagccuuuaauc

SEQ ID NO: 1548295 - RNA, 19 nt, Homo sapiens
agcuucaacugcaauauuu

SEQ ID NO: 1548296 - RNA, 19 nt, Homo sapiens
gccauuacggcuugguaua

SEQ ID NO: 1548297 - RNA, 19 nt, Homo sapiens
acaccaagacaugccauua

SEQ ID NO: 1548298 - RNA, 19 nt, Homo sapiens
uagguggaauaaagucauu

SEQ ID NO: 1548299 - RNA, 19 nt, Homo sapiens
uauagacaacugcauagaa

SEQ ID NO: 1548300 - RNA, 19 nt, Homo sapiens
caucacugacccacacuuu

SEQ ID NO: 1548301 - RNA, 19 nt, Homo sapiens
cuaugcagcuuuugaauau

SEQ ID NO: 1548302 - RNA, 19 nt, Homo sapiens
cagcuuagguuuucuucuu

SEQ ID NO: 1548303 - RNA, 19 nt, Homo sapiens
cagacagccuuuaauccau

SEQ ID NO: 1548304 - RNA, 19 nt, Homo sapiens
uauaaaugcuaugcagcuu

SEQ ID NO: 1548305 - RNA, 19 nt, Homo sapiens
auggauggcaguagaauaa

SEQ ID NO: 1548306 - RNA, 19 nt, Homo sapiens
uuaugucgguugugcaguu

SEQ ID NO: 1548307 - RNA, 19 nt, Homo sapiens
auaaagucauucacaccaa

SEQ ID NO: 1548308 - RNA, 19 nt, Homo sapiens
caaaagaagagaaaugugu

SEQ ID NO: 1548309 - RNA, 19 nt, Homo sapiens
gaauggcguggcaaaguca

SEQ ID NO: 1548310 - RNA, 19 nt, Homo sapiens
uagaagcccacaacgaaug

SEQ ID NO: 1548311 - RNA, 19 nt, Homo sapiens
uggccauuauacacaguua

SEQ ID NO: 1548312 - RNA, 19 nt, Homo sapiens
uggagaaaauaucugguua

SEQ ID NO: 1548313 - RNA, 19 nt, Homo sapiens
ugauuugggauaaagguuu

SEQ ID NO: 1548314 - RNA, 19 nt, Homo sapiens
gauggcaguagaauaaagu

SEQ ID NO: 1548315 - RNA, 19 nt, Homo sapiens
cuuuauagacaacugcaua

SEQ ID NO: 1548316 - RNA, 19 nt, Homo sapiens
gccugauaccuaaauuuaa

SEQ ID NO: 1548317 - RNA, 19 nt, Homo sapiens
uuuaauccauucagcuuag

SEQ ID NO: 1548318 - RNA, 19 nt, Homo sapiens
uguaaagaaccucugcaaa

SEQ ID NO: 1548319 - RNA, 19 nt, Homo sapiens
gcuaugcagcuuuugaaua

SEQ ID NO: 1548320 - RNA, 19 nt, Homo sapiens
uuauggaucuugggucugu

SEQ ID NO: 1548321 - RNA, 19 nt, Homo sapiens
cggccgacaugaaauacau

SEQ ID NO: 1548322 - RNA, 19 nt, Homo sapiens
ggcaguagaauaaagucuu

SEQ ID NO: 1548323 - RNA, 19 nt, Homo sapiens
ggaucuugggucuguguuu

SEQ ID NO: 1548324 - RNA, 19 nt, Homo sapiens
gacagccuuuaauccauuc

SEQ ID NO: 1548325 - RNA, 19 nt, Homo sapiens
ugcaauguguccuaaccuu

SEQ ID NO: 1548326 - RNA, 19 nt, Homo sapiens
caguugcaauguguccuaa

SEQ ID NO: 1548327 - RNA, 19 nt, Homo sapiens
uaucugguuagguggaaua

SEQ ID NO: 1548328 - RNA, 19 nt, Homo sapiens
agaaauguguaaagaaccu

SEQ ID NO: 1548329 - RNA, 19 nt, Homo sapiens
gagaaaauaucugguuagg

SEQ ID NO: 1548330 - RNA, 19 nt, Homo sapiens
cacuuugcuucuuuacuga

SEQ ID NO: 1548331 - RNA, 19 nt, Homo sapiens
uuccauggcucugaagaau

SEQ ID NO: 1548332 - RNA, 19 nt, Homo sapiens
gccacuacaucuuccaaaa

SEQ ID NO: 1548333 - RNA, 19 nt, Homo sapiens
uuacggcuugguauaauga

SEQ ID NO: 1548334 - RNA, 19 nt, Homo sapiens
gggagcuucaacugcaaua

SEQ ID NO: 1548335 - RNA, 19 nt, Homo sapiens
uacaugauuugggauaaag

SEQ ID NO: 1548336 - RNA, 19 nt, Homo sapiens
aaaccagugcaaauuugaa

SEQ ID NO: 1548337 - RNA, 19 nt, Homo sapiens
guguaaagaaccucugcaa

SEQ ID NO: 1548338 - RNA, 19 nt, Homo sapiens
agaagagaaauguguaaag

SEQ ID NO: 1548339 - RNA, 19 nt, Homo sapiens
uuacguaagaggagaaucu

SEQ ID NO: 1548340 - RNA, 19 nt, Homo sapiens
cacugacccacacuuuaua

SEQ ID NO: 1548341 - RNA, 19 nt, Homo sapiens
guagaaaccuugaaacuuu

SEQ ID NO: 1548342 - RNA, 19 nt, Homo sapiens
ggagguagcugaacagaug

SEQ ID NO: 1548343 - RNA, 19 nt, Homo sapiens
gcaauucgcuuuauaacca

SEQ ID NO: 1548344 - RNA, 19 nt, Homo sapiens
gaaagaagcagcagaaaca

SEQ ID NO: 1548345 - RNA, 19 nt, Homo sapiens
aaagagagcugcuguggaa

SEQ ID NO: 1548346 - RNA, 19 nt, Homo sapiens
guaguaaucuuguucaugu

SEQ ID NO: 1548347 - RNA, 19 nt, Homo sapiens
caaagaagucucaguagua

SEQ ID NO: 1548348 - RNA, 19 nt, Homo sapiens
caaauagccuggaugauuc

SEQ ID NO: 1548349 - RNA, 19 nt, Homo sapiens
gaaagaagagaauagauga

SEQ ID NO: 1548350 - RNA, 19 nt, Homo sapiens
gcgaagaucuuggcugaaa

SEQ ID NO: 1548351 - RNA, 19 nt, Homo sapiens
ggagagagaggaauugaaa

SEQ ID NO: 1548352 - RNA, 19 nt, Homo sapiens
aaagaagucucaguaguaa

SEQ ID NO: 1548353 - RNA, 19 nt, Homo sapiens
uaacaguccuggccaagaa

SEQ ID NO: 1548354 - RNA, 19 nt, Homo sapiens
uuccugaacuucucuauua

SEQ ID NO: 1548355 - RNA, 19 nt, Homo sapiens
guaacuguauuccuaggua

SEQ ID NO: 1548356 - RNA, 19 nt, Homo sapiens
caaggacucuuucguguca

SEQ ID NO: 1548357 - RNA, 19 nt, Homo sapiens
ucaaauagccuggaugauu

SEQ ID NO: 1548358 - RNA, 19 nt, Homo sapiens
ugacaaacuuucaacauca

SEQ ID NO: 1548359 - RNA, 19 nt, Homo sapiens
caccuucuguugacaaaua

SEQ ID NO: 1548360 - RNA, 19 nt, Homo sapiens
gaaaucaaauagccuggau

SEQ ID NO: 1548361 - RNA, 19 nt, Homo sapiens
gagaaagccaugauugaaa

SEQ ID NO: 1548362 - RNA, 19 nt, Homo sapiens
gagaagagcaacaaggaaa

SEQ ID NO: 1548363 - RNA, 19 nt, Homo sapiens
gcagaaagaagcagcagaa

SEQ ID NO: 1548364 - RNA, 19 nt, Homo sapiens
ggaaagcaguaucaagaag

SEQ ID NO: 1548365 - RNA, 19 nt, Homo sapiens
cccaagagauccagugaaa

SEQ ID NO: 1548366 - RNA, 19 nt, Homo sapiens
gagcuguuguugaaagaaa

SEQ ID NO: 1548367 - RNA, 19 nt, Homo sapiens
gagauuggccaaagaaaga

SEQ ID NO: 1548368 - RNA, 19 nt, Homo sapiens
gacccaguaugucacuuua

SEQ ID NO: 1548369 - RNA, 19 nt, Homo sapiens
ggaaagcggagaaagagaa

SEQ ID NO: 1548370 - RNA, 19 nt, Homo sapiens
ccaagaaacuccucucaac

SEQ ID NO: 1548371 - RNA, 19 nt, Homo sapiens
gaagagaauagaugaaauc

SEQ ID NO: 1548372 - RNA, 19 nt, Homo sapiens
caaagaaagacgagaagaa

SEQ ID NO: 1548373 - RNA, 19 nt, Homo sapiens
gagcugcuguggaagagaa

SEQ ID NO: 1548374 - RNA, 19 nt, Homo sapiens
cauagugacccucugaaua

SEQ ID NO: 1548375 - RNA, 19 nt, Homo sapiens
caaauacagcaucccuuua

SEQ ID NO: 1548376 - RNA, 19 nt, Homo sapiens
ggguuaaaguaguaaguuu

SEQ ID NO: 1548377 - RNA, 19 nt, Homo sapiens
caagagaaagccaugauug

SEQ ID NO: 1548378 - RNA, 19 nt, Homo sapiens
guaugugucucuacucaau

SEQ ID NO: 1548379 - RNA, 19 nt, Homo sapiens
gcauauucguguauacaug

SEQ ID NO: 1548380 - RNA, 19 nt, Homo sapiens
aaauacagcaucccuuuaa

SEQ ID NO: 1548381 - RNA, 19 nt, Homo sapiens
aggaggagcuguuguugaa

SEQ ID NO: 1548382 - RNA, 19 nt, Homo sapiens
gagaaggaagaacaagaua

SEQ ID NO: 1548383 - RNA, 19 nt, Homo sapiens
ccaugucuguccucguuua

SEQ ID NO: 1548384 - RNA, 19 nt, Homo sapiens
aagauaggcuggagagaga

SEQ ID NO: 1548385 - RNA, 19 nt, Homo sapiens
aaagaaagacgagaagaaa

SEQ ID NO: 1548386 - RNA, 19 nt, Homo sapiens
auacucaacuugcacugua

SEQ ID NO: 1548387 - RNA, 19 nt, Homo sapiens
uaaagcacuuccugaacuu

SEQ ID NO: 1548388 - RNA, 19 nt, Homo sapiens
ggagagaaagaagagaaua

SEQ ID NO: 1548389 - RNA, 19 nt, Homo sapiens
auagugacccucugaauaa

SEQ ID NO: 1548390 - RNA, 19 nt, Homo sapiens
gcagagauuggccaaagaa

SEQ ID NO: 1548391 - RNA, 19 nt, Homo sapiens
ggaaguuaaugguguggau

SEQ ID NO: 1548392 - RNA, 19 nt, Homo sapiens
gacaaacuuucaacaucaa

SEQ ID NO: 1548393 - RNA, 19 nt, Homo sapiens
gugacaaacuuucaacauc

SEQ ID NO: 1548394 - RNA, 19 nt, Homo sapiens
auacaaagaagucucagua

SEQ ID NO: 1548395 - RNA, 19 nt, Homo sapiens
gcuggaucccaaauuauua

SEQ ID NO: 1548396 - RNA, 19 nt, Homo sapiens
guaaagcugcugauaguca

SEQ ID NO: 1548397 - RNA, 19 nt, Homo sapiens
ggaugugaguccuguuuca

SEQ ID NO: 1548398 - RNA, 19 nt, Homo sapiens
gaggagcuguuguugaaag

SEQ ID NO: 1548399 - RNA, 19 nt, Homo sapiens
ggagaaggaagaacaagau

SEQ ID NO: 1548400 - RNA, 19 nt, Homo sapiens
gagcaccacuggccauugg

SEQ ID NO: 1548401 - RNA, 19 nt, Homo sapiens
acaaagaagucucaguagu

SEQ ID NO: 1548402 - RNA, 19 nt, Homo sapiens
uacagcaucccuuuaauaa

SEQ ID NO: 1548403 - RNA, 19 nt, Homo sapiens
gaaaucaugaagagaacaa

SEQ ID NO: 1548404 - RNA, 19 nt, Homo sapiens
gagaggaagcccuagagaa

SEQ ID NO: 1548405 - RNA, 19 nt, Homo sapiens
auuauuagcucggaaugua

SEQ ID NO: 1548406 - RNA, 19 nt, Homo sapiens
gaaagaagaccccaaagug

SEQ ID NO: 1548407 - RNA, 19 nt, Homo sapiens
caggagauguugggaaaga

SEQ ID NO: 1548408 - RNA, 19 nt, Homo sapiens
uuacagccagcuacauuua

SEQ ID NO: 1548409 - RNA, 19 nt, Homo sapiens
uaaagcugcugauagucaa

SEQ ID NO: 1548410 - RNA, 19 nt, Homo sapiens
aaacuccucucaacaccuu

SEQ ID NO: 1548411 - RNA, 19 nt, Homo sapiens
ggaccucucagcccaacua

SEQ ID NO: 1548412 - RNA, 19 nt, Homo sapiens
gagaggaauugaaaagaaa

SEQ ID NO: 1548413 - RNA, 19 nt, Homo sapiens
gaaggaagaacaagauagg

SEQ ID NO: 1548414 - RNA, 19 nt, Homo sapiens
uauuggaucuugggaguuu

SEQ ID NO: 1548415 - RNA, 19 nt, Homo sapiens
ccguaaagcugcugauagu

SEQ ID NO: 1548416 - RNA, 19 nt, Homo sapiens
acaaauacagcaucccuuu

SEQ ID NO: 1548417 - RNA, 19 nt, Homo sapiens
cagauuaugcugcagauug

SEQ ID NO: 1548418 - RNA, 19 nt, Homo sapiens
ggaaagauucauaauucug

SEQ ID NO: 1548419 - RNA, 19 nt, Homo sapiens
ggacccaguaugucacuuu

SEQ ID NO: 1548420 - RNA, 19 nt, Homo sapiens
ucuguucucuuaugcauau

SEQ ID NO: 1548421 - RNA, 19 nt, Homo sapiens
gguagaaaccuugaaacuu

SEQ ID NO: 1548422 - RNA, 19 nt, Homo sapiens
agaaagacgagaagaaaga

SEQ ID NO: 1548423 - RNA, 19 nt, Homo sapiens
agauuaugcugcagauuga

SEQ ID NO: 1548424 - RNA, 19 nt, Homo sapiens
aaagcuacaucuacgucua

SEQ ID NO: 1548425 - RNA, 19 nt, Homo sapiens
ugaauaaacgccugucuuc

SEQ ID NO: 1548426 - RNA, 19 nt, Homo sapiens
gcgugcaggugguugguuu

SEQ ID NO: 1548427 - RNA, 19 nt, Homo sapiens
caacuugcacuguauaucu

SEQ ID NO: 1548428 - RNA, 19 nt, Homo sapiens
caaaguuggagcacauaaa

SEQ ID NO: 1548429 - RNA, 19 nt, Homo sapiens
gccaagacaugcccaagag

SEQ ID NO: 1548430 - RNA, 19 nt, Homo sapiens
gaagaagaaagcuacaucu

SEQ ID NO: 1548431 - RNA, 19 nt, Homo sapiens
gaaacauugagaagaagaa

SEQ ID NO: 1548432 - RNA, 19 nt, Homo sapiens
uuaaggguuuggaaagauu

SEQ ID NO: 1548433 - RNA, 19 nt, Homo sapiens
guaaugauuucuguucucu

SEQ ID NO: 1548434 - RNA, 19 nt, Homo sapiens
ggaaggaagucaaaacagu

SEQ ID NO: 1548435 - RNA, 19 nt, Homo sapiens
auacagcaucccuuuaaua

SEQ ID NO: 1548436 - RNA, 19 nt, Homo sapiens
cagaugagaggcagagauu

SEQ ID NO: 1548437 - RNA, 19 nt, Homo sapiens
gaagaaagaagaccccaaa

SEQ ID NO: 1548438 - RNA, 19 nt, Homo sapiens
aaaggaagcggcaggaaga

SEQ ID NO: 1548439 - RNA, 19 nt, Homo sapiens
caacagauccuggagaaac

SEQ ID NO: 1548440 - RNA, 19 nt, Homo sapiens
aggagagacuggagagaaa

SEQ ID NO: 1548441 - RNA, 19 nt, Homo sapiens
ggguguagcuucuccuuua

SEQ ID NO: 1548442 - RNA, 19 nt, Homo sapiens
ggaacuggaugucgaagaa

SEQ ID NO: 1548443 - RNA, 19 nt, Homo sapiens
gacaggaaauagaucuuua

SEQ ID NO: 1548444 - RNA, 19 nt, Homo sapiens
cgaagaagaugaagagauc

SEQ ID NO: 1548445 - RNA, 19 nt, Homo sapiens
ccauuaagaugaagagcua

SEQ ID NO: 1548446 - RNA, 19 nt, Homo sapiens
gcgcuaugguuaagaguuu

SEQ ID NO: 1548447 - RNA, 19 nt, Homo sapiens
caaccgggcuucacaucaa

SEQ ID NO: 1548448 - RNA, 19 nt, Homo sapiens
gaccugccuuccaccauua

SEQ ID NO: 1548449 - RNA, 19 nt, Homo sapiens
guucaaaucuaccucacuu

SEQ ID NO: 1548450 - RNA, 19 nt, Homo sapiens
cgaagaagagguugucauu

SEQ ID NO: 1548451 - RNA, 19 nt, Homo sapiens
gcucaggagugccagaaga

SEQ ID NO: 1548452 - RNA, 19 nt, Homo sapiens
ggacaggaaauagaucuuu

SEQ ID NO: 1548453 - RNA, 19 nt, Homo sapiens
gaaccuguguccuuaacca

SEQ ID NO: 1548454 - RNA, 19 nt, Homo sapiens
ucacaucaauggucaggau

SEQ ID NO: 1548455 - RNA, 19 nt, Homo sapiens
gaaccacaggacaauauga

SEQ ID NO: 1548456 - RNA, 19 nt, Homo sapiens
cuaguaagcaguagaguug

SEQ ID NO: 1548457 - RNA, 19 nt, Homo sapiens
ugaggugacuacacuaugu

SEQ ID NO: 1548458 - RNA, 19 nt, Homo sapiens
gaucugaaccacaggacaa

SEQ ID NO: 1548459 - RNA, 19 nt, Homo sapiens
ugaccugccuuccaccauu

SEQ ID NO: 1548460 - RNA, 19 nt, Homo sapiens
uacggaaccuguguccuua

SEQ ID NO: 1548461 - RNA, 19 nt, Homo sapiens
ccacaggacaauaugacua

SEQ ID NO: 1548462 - RNA, 19 nt, Homo sapiens
aaaucuaccucacuuccuu

SEQ ID NO: 1548463 - RNA, 19 nt, Homo sapiens
ggcaggaagugcaaagaca

SEQ ID NO: 1548464 - RNA, 19 nt, Homo sapiens
ccacagucaugucagcaau

SEQ ID NO: 1548465 - RNA, 19 nt, Homo sapiens
gaagaagagguugucauuc

SEQ ID NO: 1548466 - RNA, 19 nt, Homo sapiens
caguagaguugggaucuga

SEQ ID NO: 1548467 - RNA, 19 nt, Homo sapiens
ccuguugcauugcugaauu

SEQ ID NO: 1548468 - RNA, 19 nt, Homo sapiens
gcaaucaagaggccugaau

SEQ ID NO: 1548469 - RNA, 19 nt, Homo sapiens
gcacccuucuggagaucuu

SEQ ID NO: 1548470 - RNA, 19 nt, Homo sapiens
cuacggaaccuguguccuu

SEQ ID NO: 1548471 - RNA, 19 nt, Homo sapiens
gcuaguaagcaguagaguu

SEQ ID NO: 1548472 - RNA, 19 nt, Homo sapiens
agaagagacugcugguagu

SEQ ID NO: 1548473 - RNA, 19 nt, Homo sapiens
ggaugucgaagaagaugaa

SEQ ID NO: 1548474 - RNA, 19 nt, Homo sapiens
aaacuucacaggcuagaau

SEQ ID NO: 1548475 - RNA, 19 nt, Homo sapiens
uuaaugccauggaauaaac

SEQ ID NO: 1548476 - RNA, 19 nt, Homo sapiens
uaaggucccguagcuagua

SEQ ID NO: 1548477 - RNA, 19 nt, Homo sapiens
aggcuagaauggugaaaug

SEQ ID NO: 1548478 - RNA, 19 nt, Homo sapiens
guuaaugccauggaauaaa

SEQ ID NO: 1548479 - RNA, 19 nt, Homo sapiens
gguuaaugccauggaauaa

SEQ ID NO: 1548480 - RNA, 19 nt, Homo sapiens
gaugucugcugggaugaug

SEQ ID NO: 1548481 - RNA, 19 nt, Homo sapiens
aagaugcgaugggcaauca

SEQ ID NO: 1548482 - RNA, 19 nt, Homo sapiens
ccagggagcccaaacaaaa

SEQ ID NO: 1548483 - RNA, 19 nt, Homo sapiens
gcaguagaguugggaucug

SEQ ID NO: 1548484 - RNA, 19 nt, Homo sapiens
caucaauggucaggaucuu

SEQ ID NO: 1548485 - RNA, 19 nt, Homo sapiens
gagauccccuuucuuagug

SEQ ID NO: 1548486 - RNA, 19 nt, Homo sapiens
agagaucccguucgacuug

SEQ ID NO: 1548487 - RNA, 19 nt, Homo sapiens
gaauggugaaaugaccuua

SEQ ID NO: 1548488 - RNA, 19 nt, Homo sapiens
gaguacccauccucguuca

SEQ ID NO: 1548489 - RNA, 19 nt, Homo sapiens
aaaacuugcugagagcuua

SEQ ID NO: 1548490 - RNA, 19 nt, Homo sapiens
ucagcacccuucuggagau

SEQ ID NO: 1548491 - RNA, 19 nt, Homo sapiens
ggugaggugacuacacuau

SEQ ID NO: 1548492 - RNA, 19 nt, Homo sapiens
ugguuaaugccauggaaua

SEQ ID NO: 1548493 - RNA, 19 nt, Homo sapiens
uggugcagccaaagaauaa

SEQ ID NO: 1548494 - RNA, 19 nt, Homo sapiens
cuucuggagaucuuaauuu

SEQ ID NO: 1548495 - RNA, 19 nt, Homo sapiens
ggaugggguucacgaagaa

SEQ ID NO: 1548496 - RNA, 19 nt, Homo sapiens
gggaugggguucacgaaga

SEQ ID NO: 1548497 - RNA, 19 nt, Homo sapiens
ccucauaagcuguaaacuc

SEQ ID NO: 1548498 - RNA, 19 nt, Homo sapiens
aucccacccuuguaucaua

SEQ ID NO: 1548499 - RNA, 19 nt, Homo sapiens
uauucugccucucaugguu

SEQ ID NO: 1548500 - RNA, 19 nt, Homo sapiens
gaugaagagcuaaaacuug

SEQ ID NO: 1548501 - RNA, 19 nt, Homo sapiens
ccuugaugguggaggagua

SEQ ID NO: 1548502 - RNA, 19 nt, Homo sapiens
ucaauggucaggaucuugu

SEQ ID NO: 1548503 - RNA, 19 nt, Homo sapiens
gguguagcuucuccuuuac

SEQ ID NO: 1548504 - RNA, 19 nt, Homo sapiens
cuuccaccauuaagaugaa

SEQ ID NO: 1548505 - RNA, 19 nt, Homo sapiens
gaggacaggaaauagaucu

SEQ ID NO: 1548506 - RNA, 19 nt, Homo sapiens
acacuaugucccucuaaga

SEQ ID NO: 1548507 - RNA, 19 nt, Homo sapiens
ucacuuccuucugcaucaa

SEQ ID NO: 1548508 - RNA, 19 nt, Homo sapiens
caaucaagaggccugaauc

SEQ ID NO: 1548509 - RNA, 19 nt, Homo sapiens
cugaaccacaggacaauau

SEQ ID NO: 1548510 - RNA, 19 nt, Homo sapiens
gcuaagagcugaacagaua

SEQ ID NO: 1548511 - RNA, 19 nt, Homo sapiens
gcaguuagcugaugccaua

SEQ ID NO: 1548512 - RNA, 19 nt, Homo sapiens
gaaaggagcuacccacuuc

SEQ ID NO: 1548513 - RNA, 19 nt, Homo sapiens
gaaaggagcuacccacugu

SEQ ID NO: 1548514 - RNA, 19 nt, Homo sapiens
gaacuccuguccucaagua

SEQ ID NO: 1548515 - RNA, 19 nt, Homo sapiens
guagcaagguggaaagaua

SEQ ID NO: 1548516 - RNA, 19 nt, Homo sapiens
gaugaaaucccuccaggua

SEQ ID NO: 1548517 - RNA, 19 nt, Homo sapiens
ccacugugcuggccuaauu

SEQ ID NO: 1548518 - RNA, 19 nt, Homo sapiens
ugccauagcuguuaucaaa

SEQ ID NO: 1548519 - RNA, 19 nt, Homo sapiens
uauggaagaucuacaugua

SEQ ID NO: 1548520 - RNA, 19 nt, Homo sapiens
ccacgagacuuaacauuuc

SEQ ID NO: 1548521 - RNA, 19 nt, Homo sapiens
ccacuuaccugcucuugug

SEQ ID NO: 1548522 - RNA, 19 nt, Homo sapiens
gaaaccaaacauugagaua

SEQ ID NO: 1548523 - RNA, 19 nt, Homo sapiens
gcuguacuguugcucaaua

SEQ ID NO: 1548524 - RNA, 19 nt, Homo sapiens
gaaggaagaaagagaaaga

SEQ ID NO: 1548525 - RNA, 19 nt, Homo sapiens
gcacagaccaugccacuca

SEQ ID NO: 1548526 - RNA, 19 nt, Homo sapiens
gaagaagacggaaggaaga

SEQ ID NO: 1548527 - RNA, 19 nt, Homo sapiens
gcaaguucauccuuauuca

SEQ ID NO: 1548528 - RNA, 19 nt, Homo sapiens
gaacagauaucaggaugac

SEQ ID NO: 1548529 - RNA, 19 nt, Homo sapiens
ugaaaucccuccagguaga

SEQ ID NO: 1548530 - RNA, 19 nt, Homo sapiens
caugggaucuugcuauguu

SEQ ID NO: 1548531 - RNA, 19 nt, Homo sapiens
uagcacagaugaugaaauc

SEQ ID NO: 1548532 - RNA, 19 nt, Homo sapiens
gacuuaacauuucagauga

SEQ ID NO: 1548533 - RNA, 19 nt, Homo sapiens
gucaugagcauaguuauua

SEQ ID NO: 1548534 - RNA, 19 nt, Homo sapiens
gugcuggccuaauuaauau

SEQ ID NO: 1548535 - RNA, 19 nt, Homo sapiens
cagcacacccaguuaauuu

SEQ ID NO: 1548536 - RNA, 19 nt, Homo sapiens
cuuagugacuugcugauaa

SEQ ID NO: 1548537 - RNA, 19 nt, Homo sapiens
ucaaacaauugcuucaguu

SEQ ID NO: 1548538 - RNA, 19 nt, Homo sapiens
agacuggagugagaacuua

SEQ ID NO: 1548539 - RNA, 19 nt, Homo sapiens
gacaggauccuagaaauug

SEQ ID NO: 1548540 - RNA, 19 nt, Homo sapiens
ccugcaagcuguacuguug

SEQ ID NO: 1548541 - RNA, 19 nt, Homo sapiens
gacaugggaucuugcuaug

SEQ ID NO: 1548542 - RNA, 19 nt, Homo sapiens
uuaguuggcuuuucaguua

SEQ ID NO: 1548543 - RNA, 19 nt, Homo sapiens
gaaugaggauaagaugaga

SEQ ID NO: 1548544 - RNA, 19 nt, Homo sapiens
gcugggagcugagcagaug

SEQ ID NO: 1548545 - RNA, 19 nt, Homo sapiens
gcagagggguccuugguaa

SEQ ID NO: 1548546 - RNA, 19 nt, Homo sapiens
cacugugggucuucucuua

SEQ ID NO: 1548547 - RNA, 19 nt, Homo sapiens
aaacaucccaggacagauu

SEQ ID NO: 1548548 - RNA, 19 nt, Homo sapiens
ggccagggcuguacacucu

SEQ ID NO: 1548549 - RNA, 19 nt, Homo sapiens
gugcuaagauuacaaccau

SEQ ID NO: 1548550 - RNA, 19 nt, Homo sapiens
gaagguagcaagguggaaa

SEQ ID NO: 1548551 - RNA, 19 nt, Homo sapiens
uagauggguucacugcuuu

SEQ ID NO: 1548552 - RNA, 19 nt, Homo sapiens
gcuaagauuacaaccauga

SEQ ID NO: 1548553 - RNA, 19 nt, Homo sapiens
uauaugacaugggaucuug

SEQ ID NO: 1548554 - RNA, 19 nt, Homo sapiens
gaaaagcauuaucaacaga

SEQ ID NO: 1548555 - RNA, 19 nt, Homo sapiens
gaagcugcgugacuuuuaa

SEQ ID NO: 1548556 - RNA, 19 nt, Homo sapiens
caauguuucucucccauca

SEQ ID NO: 1548557 - RNA, 19 nt, Homo sapiens
ugacaggauccuagaaauu

SEQ ID NO: 1548558 - RNA, 19 nt, Homo sapiens
auagcucacuguagccuua

SEQ ID NO: 1548559 - RNA, 19 nt, Homo sapiens
ggccaucccugcugugcuu

SEQ ID NO: 1548560 - RNA, 19 nt, Homo sapiens
uuagugacuugcugauaaa

SEQ ID NO: 1548561 - RNA, 19 nt, Homo sapiens
gagaagcucgggaauucaa

SEQ ID NO: 1548562 - RNA, 19 nt, Homo sapiens
gcugaugccauagcuguua

SEQ ID NO: 1548563 - RNA, 19 nt, Homo sapiens
gcagagaggaguuauuugc

SEQ ID NO: 1548564 - RNA, 19 nt, Homo sapiens
gagcccagccuuugaguca

SEQ ID NO: 1548565 - RNA, 19 nt, Homo sapiens
cauugucccucccugaauu

SEQ ID NO: 1548566 - RNA, 19 nt, Homo sapiens
agacuuaacauuucagaug

SEQ ID NO: 1548567 - RNA, 19 nt, Homo sapiens
ugugcuggccuaauuaaua

SEQ ID NO: 1548568 - RNA, 19 nt, Homo sapiens
aaguaauccuccugccuua

SEQ ID NO: 1548569 - RNA, 19 nt, Homo sapiens
gcugauaaacacagaaugu

SEQ ID NO: 1548570 - RNA, 19 nt, Homo sapiens
uuagauggguucacugcuu

SEQ ID NO: 1548571 - RNA, 19 nt, Homo sapiens
agcauuaucuguagcaguu

SEQ ID NO: 1548572 - RNA, 19 nt, Homo sapiens
ucgcagggcucauuauguc

SEQ ID NO: 1548573 - RNA, 19 nt, Homo sapiens
guaccagcacacccaguua

SEQ ID NO: 1548574 - RNA, 19 nt, Homo sapiens
aucaagagguggaaucuga

SEQ ID NO: 1548575 - RNA, 19 nt, Homo sapiens
ccagccauguagacucuuu

SEQ ID NO: 1548576 - RNA, 19 nt, Homo sapiens
ggagaagcguccagaugac

SEQ ID NO: 1548577 - RNA, 19 nt, Homo sapiens
caaacaauugcuucaguug

SEQ ID NO: 1548578 - RNA, 19 nt, Homo sapiens
gaagacggaaggaagaaag

SEQ ID NO: 1548579 - RNA, 19 nt, Homo sapiens
aauguagggugugcucaua

SEQ ID NO: 1548580 - RNA, 19 nt, Homo sapiens
gaagugaagcugcgugacu

SEQ ID NO: 1548581 - RNA, 19 nt, Homo sapiens
uaccugcucuugugcaaug

SEQ ID NO: 1548582 - RNA, 19 nt, Homo sapiens
caagguggaaagauaagaa

SEQ ID NO: 1548583 - RNA, 19 nt, Homo sapiens
uagcaagguggaaagauaa

SEQ ID NO: 1548584 - RNA, 19 nt, Homo sapiens
gaucgcagggcucauuaug

SEQ ID NO: 1548585 - RNA, 19 nt, Homo sapiens
gcuguacacucuacuaagc

SEQ ID NO: 1548586 - RNA, 19 nt, Homo sapiens
ccauagcuguuaucaaagg

SEQ ID NO: 1548587 - RNA, 19 nt, Homo sapiens
gcaccucuuugccuuaaaa

SEQ ID NO: 1548588 - RNA, 19 nt, Homo sapiens
aagcaccucuuugccuuaa

SEQ ID NO: 1548589 - RNA, 19 nt, Homo sapiens
gcacccacucugauucuga

SEQ ID NO: 1548590 - RNA, 19 nt, Homo sapiens
gggcuguacacucuacuaa

SEQ ID NO: 1548591 - RNA, 19 nt, Homo sapiens
ugacaugggaucuugcuau

SEQ ID NO: 1548592 - RNA, 19 nt, Homo sapiens
aaacaauugcuucaguuga

SEQ ID NO: 1548593 - RNA, 19 nt, Homo sapiens
caucugagcccagccuuug

SEQ ID NO: 1548594 - RNA, 19 nt, Homo sapiens
ucuugcaaguucauccuua

SEQ ID NO: 1548595 - RNA, 19 nt, Homo sapiens
cagccacugugaaaccaaa

SEQ ID NO: 1548596 - RNA, 19 nt, Homo sapiens
acaggauccuagaaauuga

SEQ ID NO: 1548597 - RNA, 19 nt, Homo sapiens
caugacaggauccuagaaa

SEQ ID NO: 1548598 - RNA, 19 nt, Homo sapiens
aaaguuagcacagaugaug

SEQ ID NO: 1548599 - RNA, 19 nt, Homo sapiens
cagaugauuuaaagauugg

SEQ ID NO: 1548600 - RNA, 19 nt, Homo sapiens
gaaaacaucccaggacaga

SEQ ID NO: 1548601 - RNA, 19 nt, Homo sapiens
cugcagagaggaguuauuu

SEQ ID NO: 1548602 - RNA, 19 nt, Homo sapiens
gacaggcucccgaguggaa

SEQ ID NO: 1548603 - RNA, 19 nt, Homo sapiens
ccacucugauucugaagca

SEQ ID NO: 1548604 - RNA, 19 nt, Homo sapiens
gcuggccuaauuaauauuu

SEQ ID NO: 1548605 - RNA, 19 nt, Homo sapiens
ucuggccucuuauucauga

SEQ ID NO: 1548606 - RNA, 19 nt, Homo sapiens
ggaauguaccagccacugu

SEQ ID NO: 1548607 - RNA, 19 nt, Homo sapiens
caacagaaugaggauaaga

SEQ ID NO: 1548608 - RNA, 19 nt, Homo sapiens
gagcuacccacuucagauc

SEQ ID NO: 1548609 - RNA, 19 nt, Homo sapiens
gggaucgcagggcucauua

SEQ ID NO: 1548610 - RNA, 19 nt, Homo sapiens
gugcaaggcgaacgucuuc

SEQ ID NO: 1548611 - RNA, 19 nt, Homo sapiens
gaagaagagucuacaagaa

SEQ ID NO: 1548612 - RNA, 19 nt, Homo sapiens
uagaggaacucacauuuaa

SEQ ID NO: 1548613 - RNA, 19 nt, Homo sapiens
agaagaagauggccuauga

SEQ ID NO: 1548614 - RNA, 19 nt, Homo sapiens
ggaggaagacgcauaauga

SEQ ID NO: 1548615 - RNA, 19 nt, Homo sapiens
caacugauaucucugaugu

SEQ ID NO: 1548616 - RNA, 19 nt, Homo sapiens
gauccgggcucucaucaaa

SEQ ID NO: 1548617 - RNA, 19 nt, Homo sapiens
ugagcaagcugacuauaaa

SEQ ID NO: 1548618 - RNA, 19 nt, Homo sapiens
ccacaagguuccagaaaga

SEQ ID NO: 1548619 - RNA, 19 nt, Homo sapiens
ccagaagaguuaacuauuc

SEQ ID NO: 1548620 - RNA, 19 nt, Homo sapiens
ucaaacggcugaaggagaa

SEQ ID NO: 1548621 - RNA, 19 nt, Homo sapiens
caagaaaccugagaucuac

SEQ ID NO: 1548622 - RNA, 19 nt, Homo sapiens
caaaguccaucaccaaagu

SEQ ID NO: 1548623 - RNA, 19 nt, Homo sapiens
uugcugaaauugccaaaua

SEQ ID NO: 1548624 - RNA, 19 nt, Homo sapiens
gagaagauguugaggaaaa

SEQ ID NO: 1548625 - RNA, 19 nt, Homo sapiens
cagaagaguuaacuauuca

SEQ ID NO: 1548626 - RNA, 19 nt, Homo sapiens
gcagcaacaugguccaaga

SEQ ID NO: 1548627 - RNA, 19 nt, Homo sapiens
gaaauugccaaauaaguca

SEQ ID NO: 1548628 - RNA, 19 nt, Homo sapiens
ucaagaaaccugagaucua

SEQ ID NO: 1548629 - RNA, 19 nt, Homo sapiens
ugagaacccagaagaguua

SEQ ID NO: 1548630 - RNA, 19 nt, Homo sapiens
auacuuaucuuccgugaau

SEQ ID NO: 1548631 - RNA, 19 nt, Homo sapiens
gcaacaugguccaagaguu

SEQ ID NO: 1548632 - RNA, 19 nt, Homo sapiens
gggcugcugucucuaaaga

SEQ ID NO: 1548633 - RNA, 19 nt, Homo sapiens
cuagaggaacucacauuua

SEQ ID NO: 1548634 - RNA, 19 nt, Homo sapiens
ucaaagagguacaucaaac

SEQ ID NO: 1548635 - RNA, 19 nt, Homo sapiens
guacugcuacuucaagaaa

SEQ ID NO: 1548636 - RNA, 19 nt, Homo sapiens
caacaugguccaagaguuc

SEQ ID NO: 1548637 - RNA, 19 nt, Homo sapiens
uacagacacugaucaagaa

SEQ ID NO: 1548638 - RNA, 19 nt, Homo sapiens
cagagaaagugaaguacga

SEQ ID NO: 1548639 - RNA, 19 nt, Homo sapiens
ccaaugagcaagcugacua

SEQ ID NO: 1548640 - RNA, 19 nt, Homo sapiens
gcaccuaagaccaauguga

SEQ ID NO: 1548641 - RNA, 19 nt, Homo sapiens
gcuagaggaacucacauuu

SEQ ID NO: 1548642 - RNA, 19 nt, Homo sapiens
cugagaagauguugaggaa

SEQ ID NO: 1548643 - RNA, 19 nt, Homo sapiens
ggcacgaccuguaugauca

SEQ ID NO: 1548644 - RNA, 19 nt, Homo sapiens
gcuaccagaugccaaagga

SEQ ID NO: 1548645 - RNA, 19 nt, Homo sapiens
aggaagcagucaucucuuu

SEQ ID NO: 1548646 - RNA, 19 nt, Homo sapiens
acgcaucagugacaaguuu

SEQ ID NO: 1548647 - RNA, 19 nt, Homo sapiens
gcacuggcacgaccuguau

SEQ ID NO: 1548648 - RNA, 19 nt, Homo sapiens
gagucuacaagaaacauua

SEQ ID NO: 1548649 - RNA, 19 nt, Homo sapiens
aagaagagucuacaagaaa

SEQ ID NO: 1548650 - RNA, 19 nt, Homo sapiens
ugaagaagagucuacaaga

SEQ ID NO: 1548651 - RNA, 19 nt, Homo sapiens
ggacuuacuagaugcagaa

SEQ ID NO: 1548652 - RNA, 19 nt, Homo sapiens
gaggaagacgcauaaugaa

SEQ ID NO: 1548653 - RNA, 19 nt, Homo sapiens
ucaagaagucguccaguga

SEQ ID NO: 1548654 - RNA, 19 nt, Homo sapiens
cuacagacacugaucaaga

SEQ ID NO: 1548655 - RNA, 19 nt, Homo sapiens
caaaguaggccaaaagaaa

SEQ ID NO: 1548656 - RNA, 19 nt, Homo sapiens
uaucuuccgugaauaaaca

SEQ ID NO: 1548657 - RNA, 19 nt, Homo sapiens
gaagaagauggccuaugaa

SEQ ID NO: 1548658 - RNA, 19 nt, Homo sapiens
gagaggaugagcaguucua

SEQ ID NO: 1548659 - RNA, 19 nt, Homo sapiens
gauccgcaguccacaagug

SEQ ID NO: 1548660 - RNA, 19 nt, Homo sapiens
ccauugggcuggaacagau

SEQ ID NO: 1548661 - RNA, 19 nt, Homo sapiens
caucaaagagguacaucaa

SEQ ID NO: 1548662 - RNA, 19 nt, Homo sapiens
ggaaagggaggcugagaag

SEQ ID NO: 1548663 - RNA, 19 nt, Homo sapiens
ccagagaggaugagcaguu

SEQ ID NO: 1548664 - RNA, 19 nt, Homo sapiens
ggaagcagucaucucuuug

SEQ ID NO: 1548665 - RNA, 19 nt, Homo sapiens
caagaagucguccagugaa

SEQ ID NO: 1548666 - RNA, 19 nt, Homo sapiens
guacaucaaacccacauca

SEQ ID NO: 1548667 - RNA, 19 nt, Homo sapiens
gggcuacgaauggcucuua

SEQ ID NO: 1548668 - RNA, 19 nt, Homo sapiens
guccagagaaagugaagua

SEQ ID NO: 1548669 - RNA, 19 nt, Homo sapiens
gcaaaguccaucaccaaag

SEQ ID NO: 1548670 - RNA, 19 nt, Homo sapiens
ggaggcagcauccgagcaa

SEQ ID NO: 1548671 - RNA, 19 nt, Homo sapiens
aaagggaggcugagaagau

SEQ ID NO: 1548672 - RNA, 19 nt, Homo sapiens
ugaaauugccaaauaaguc

SEQ ID NO: 1548673 - RNA, 19 nt, Homo sapiens
agaguuaacuauucaagac

SEQ ID NO: 1548674 - RNA, 19 nt, Homo sapiens
gaagaguuaacuauucaag

SEQ ID NO: 1548675 - RNA, 19 nt, Homo sapiens
aggcagagcccacaagguu

SEQ ID NO: 1548676 - RNA, 19 nt, Homo sapiens
cauccuggguugccugaau

SEQ ID NO: 1548677 - RNA, 19 nt, Homo sapiens
cagagaggaugagcaguuc

SEQ ID NO: 1548678 - RNA, 19 nt, Homo sapiens
ccugaaguggcaaagauua

SEQ ID NO: 1548679 - RNA, 19 nt, Homo sapiens
aagaagauggccuaugaaa

SEQ ID NO: 1548680 - RNA, 19 nt, Homo sapiens
ccaccaggcugugaagaag

SEQ ID NO: 1548681 - RNA, 19 nt, Homo sapiens
caacugaugaacccagaug

SEQ ID NO: 1548682 - RNA, 19 nt, Homo sapiens
ucaggaggaagacgcauaa

SEQ ID NO: 1548683 - RNA, 19 nt, Homo sapiens
gaaagggaggcugagaaga

SEQ ID NO: 1548684 - RNA, 19 nt, Homo sapiens
ccacuugcuccuggacuua

SEQ ID NO: 1548685 - RNA, 19 nt, Homo sapiens
ccaggaagcagucaucucu

SEQ ID NO: 1548686 - RNA, 19 nt, Homo sapiens
uagaccagcuguguucuuc

SEQ ID NO: 1548687 - RNA, 19 nt, Homo sapiens
gauuaagggaacucacaaa

SEQ ID NO: 1548688 - RNA, 19 nt, Homo sapiens
gaagagucuacaagaaaca

SEQ ID NO: 1548689 - RNA, 19 nt, Homo sapiens
gaagcagucaucucuuugg

SEQ ID NO: 1548690 - RNA, 19 nt, Homo sapiens
gaccagcuguguucuucca

SEQ ID NO: 1548691 - RNA, 19 nt, Homo sapiens
agacacugaucaagaaguc

SEQ ID NO: 1548692 - RNA, 19 nt, Homo sapiens
guacuacagacacugauca

SEQ ID NO: 1548693 - RNA, 19 nt, Homo sapiens
ugcugaaauugccaaauaa

SEQ ID NO: 1548694 - RNA, 19 nt, Homo sapiens
agccaaggaucaagaaaca

SEQ ID NO: 1548695 - RNA, 19 nt, Homo sapiens
caccuaagaccaaugugaa

SEQ ID NO: 1548696 - RNA, 19 nt, Homo sapiens
guauaugaggcaccuaaga

SEQ ID NO: 1548697 - RNA, 19 nt, Homo sapiens
agaagagucuacaagaaac

SEQ ID NO: 1548698 - RNA, 19 nt, Homo sapiens
ggaugaaggcacuuaggau

SEQ ID NO: 1548699 - RNA, 19 nt, Homo sapiens
gaccaaagaacucagaaaa

SEQ ID NO: 1548700 - RNA, 19 nt, Homo sapiens
gaugcgauccaggcccuua

SEQ ID NO: 1548701 - RNA, 19 nt, Homo sapiens
gaugccaaaggaagaguuu

SEQ ID NO: 1548702 - RNA, 19 nt, Homo sapiens
gaagucguccagugaagca

SEQ ID NO: 1548703 - RNA, 19 nt, Homo sapiens
gaaaaugagagaugacugu

SEQ ID NO: 1548704 - RNA, 19 nt, Homo sapiens
ccgacucccucccugaaga

SEQ ID NO: 1548705 - RNA, 19 nt, Homo sapiens
gaaacauuaauccuuugug

SEQ ID NO: 1548706 - RNA, 19 nt, Homo sapiens
gguggaggcacaacugaug

SEQ ID NO: 1548707 - RNA, 19 nt, Homo sapiens
ggucaaaggauggagacuu

SEQ ID NO: 1548708 - RNA, 19 nt, Homo sapiens
ugagagaugacuguaggua

SEQ ID NO: 1548709 - RNA, 19 nt, Homo sapiens
ccggguccuugcugaaauu

SEQ ID NO: 1548710 - RNA, 19 nt, Homo sapiens
gagaagaagauggccuaug

SEQ ID NO: 1548711 - RNA, 19 nt, Homo sapiens
gaauaugguucaaggcuuu

SEQ ID NO: 1548712 - RNA, 19 nt, Homo sapiens
ucagaaauccagacaauua

SEQ ID NO: 1548713 - RNA, 19 nt, Homo sapiens
ugaaaugccuccagauauu

SEQ ID NO: 1548714 - RNA, 19 nt, Homo sapiens
ugucaaacuuggucaauua

SEQ ID NO: 1548715 - RNA, 19 nt, Homo sapiens
ggaggaagaagacauuaua

SEQ ID NO: 1548716 - RNA, 19 nt, Homo sapiens
uaaucaagcuugcuacaaa

SEQ ID NO: 1548717 - RNA, 19 nt, Homo sapiens
aagaagggcugccauguuu

SEQ ID NO: 1548718 - RNA, 19 nt, Homo sapiens
gaaaugccuccagauauua

SEQ ID NO: 1548719 - RNA, 19 nt, Homo sapiens
ggaagaagacauuauacaa

SEQ ID NO: 1548720 - RNA, 19 nt, Homo sapiens
gcaaugcuuuguuaucaga

SEQ ID NO: 1548721 - RNA, 19 nt, Homo sapiens
gcaugcaguuucugaauau

SEQ ID NO: 1548722 - RNA, 19 nt, Homo sapiens
acaaauagauguccugaag

SEQ ID NO: 1548723 - RNA, 19 nt, Homo sapiens
uagaagaguugguacagaa

SEQ ID NO: 1548724 - RNA, 19 nt, Homo sapiens
caaacuuggucaauuaugu

SEQ ID NO: 1548725 - RNA, 19 nt, Homo sapiens
guaacucgaucauggaaga

SEQ ID NO: 1548726 - RNA, 19 nt, Homo sapiens
gcaagcacaucuagaagag

SEQ ID NO: 1548727 - RNA, 19 nt, Homo sapiens
caacugcuguuaccaugga

SEQ ID NO: 1548728 - RNA, 19 nt, Homo sapiens
ggaagauuauucuaaguac

SEQ ID NO: 1548729 - RNA, 19 nt, Homo sapiens
guucauacuugccuguaaa

SEQ ID NO: 1548730 - RNA, 19 nt, Homo sapiens
caugaaaugccuccagaua

SEQ ID NO: 1548731 - RNA, 19 nt, Homo sapiens
ccacauguccagaauauuc

SEQ ID NO: 1548732 - RNA, 19 nt, Homo sapiens
gcugggaccucagaaaguu

SEQ ID NO: 1548733 - RNA, 19 nt, Homo sapiens
ccucagaaauccagacaau

SEQ ID NO: 1548734 - RNA, 19 nt, Homo sapiens
caguggcaaugcuuuguua

SEQ ID NO: 1548735 - RNA, 19 nt, Homo sapiens
gcuaagagauaugaaggau

SEQ ID NO: 1548736 - RNA, 19 nt, Homo sapiens
aagucgagauggcugauua

SEQ ID NO: 1548737 - RNA, 19 nt, Homo sapiens
aggaugguauggacaauaa

SEQ ID NO: 1548738 - RNA, 19 nt, Homo sapiens
caagaagggcugccauguu

SEQ ID NO: 1548739 - RNA, 19 nt, Homo sapiens
gaugauaccgcacccauag

SEQ ID NO: 1548740 - RNA, 19 nt, Homo sapiens
cauggaagauuauucuaag

SEQ ID NO: 1548741 - RNA, 19 nt, Homo sapiens
aagcacaucuagaagaguu

SEQ ID NO: 1548742 - RNA, 19 nt, Homo sapiens
gaucauaccaacugcuguu

SEQ ID NO: 1548743 - RNA, 19 nt, Homo sapiens
ugccauaauugcagaauau

SEQ ID NO: 1548744 - RNA, 19 nt, Homo sapiens
aaacacccguggaggaaga

SEQ ID NO: 1548745 - RNA, 19 nt, Homo sapiens
gaagcugggaccucagaaa

SEQ ID NO: 1548746 - RNA, 19 nt, Homo sapiens
acaauaaucacaacuggaa

SEQ ID NO: 1548747 - RNA, 19 nt, Homo sapiens
gaucauggaagauuauucu

SEQ ID NO: 1548748 - RNA, 19 nt, Homo sapiens
caucaguggcuuaaagaaa

SEQ ID NO: 1548749 - RNA, 19 nt, Homo sapiens
ugaaggcauugcuaagaga

SEQ ID NO: 1548750 - RNA, 19 nt, Homo sapiens
uggcaaugcuuuguuauca

SEQ ID NO: 1548751 - RNA, 19 nt, Homo sapiens
ccagugcacccaaggaauu

SEQ ID NO: 1548752 - RNA, 19 nt, Homo sapiens
acaaagaucauaccaacug

SEQ ID NO: 1548753 - RNA, 19 nt, Homo sapiens
gaaggaugguauggacaau

SEQ ID NO: 1548754 - RNA, 19 nt, Homo sapiens
aaucaucaguggcuuaaag

SEQ ID NO: 1548755 - RNA, 19 nt, Homo sapiens
acucgaucauggaagauua

SEQ ID NO: 1548756 - RNA, 19 nt, Homo sapiens
gagaagaccaagucgagau

SEQ ID NO: 1548757 - RNA, 19 nt, Homo sapiens
uaaaucaucaguggcuuaa

SEQ ID NO: 1548758 - RNA, 19 nt, Homo sapiens
gguucauacuugccuguaa

SEQ ID NO: 1548759 - RNA, 19 nt, Homo sapiens
ugccacauguccagaauau

SEQ ID NO: 1548760 - RNA, 19 nt, Homo sapiens
uagauguccugaaggcauu

SEQ ID NO: 1548761 - RNA, 19 nt, Homo sapiens
uaucaggccagacuucgua

SEQ ID NO: 1548762 - RNA, 19 nt, Homo sapiens
gcaagaagggcugccaugu

SEQ ID NO: 1548763 - RNA, 19 nt, Homo sapiens
aaccaccguucaaacauuu

SEQ ID NO: 1548764 - RNA, 19 nt, Homo sapiens
uuuccuaggucaguuuaua

SEQ ID NO: 1548765 - RNA, 19 nt, Homo sapiens
caagcuugcuacaaagauc

SEQ ID NO: 1548766 - RNA, 19 nt, Homo sapiens
caaggaauuuucugucuau

SEQ ID NO: 1548767 - RNA, 19 nt, Homo sapiens
cuaaaucaucaguggcuua

SEQ ID NO: 1548768 - RNA, 19 nt, Homo sapiens
agcaugcaguuucugaaua

SEQ ID NO: 1548769 - RNA, 19 nt, Homo sapiens
ccauggagcacaucucaga

SEQ ID NO: 1548770 - RNA, 19 nt, Homo sapiens
caggcaagcacaucuagaa

SEQ ID NO: 1548771 - RNA, 19 nt, Homo sapiens
gaccucagaaaguuauaaa

SEQ ID NO: 1548772 - RNA, 19 nt, Homo sapiens
gaauugggagugggaagaa

SEQ ID NO: 1548773 - RNA, 19 nt, Homo sapiens
cuccagauauuauucuuca

SEQ ID NO: 1548774 - RNA, 19 nt, Homo sapiens
gguucaaggcuuuauaaau

SEQ ID NO: 1548775 - RNA, 19 nt, Homo sapiens
cagaaauccagacaauuau

SEQ ID NO: 1548776 - RNA, 19 nt, Homo sapiens
ggaagaaaaccucaaagug

SEQ ID NO: 1548777 - RNA, 19 nt, Homo sapiens
gcacccauaggaauugaga

SEQ ID NO: 1548778 - RNA, 19 nt, Homo sapiens
cuagaagaguugguacaga

SEQ ID NO: 1548779 - RNA, 19 nt, Homo sapiens
ggcaagcacaucuagaaga

SEQ ID NO: 1548780 - RNA, 19 nt, Homo sapiens
ggaccucagaaaguuauaa

SEQ ID NO: 1548781 - RNA, 19 nt, Homo sapiens
ccggaugucuacccuggaa

SEQ ID NO: 1548782 - RNA, 19 nt, Homo sapiens
uuuagaaacugggaucaug

SEQ ID NO: 1548783 - RNA, 19 nt, Homo sapiens
guacuggcaugggauaggu

SEQ ID NO: 1548784 - RNA, 19 nt, Homo sapiens
gugucaaacuuggucaauu

SEQ ID NO: 1548785 - RNA, 19 nt, Homo sapiens
gagauaugaaggaugguau

SEQ ID NO: 1548786 - RNA, 19 nt, Homo sapiens
gacuucguaugccuaaaga

SEQ ID NO: 1548787 - RNA, 19 nt, Homo sapiens
gaugguauggacaauaauc

SEQ ID NO: 1548788 - RNA, 19 nt, Homo sapiens
gcauugcuaagagauauga

SEQ ID NO: 1548789 - RNA, 19 nt, Homo sapiens
uaaagaaggaaagccagaa

SEQ ID NO: 1548790 - RNA, 19 nt, Homo sapiens
ccaaggaauuuucugucua

SEQ ID NO: 1548791 - RNA, 19 nt, Homo sapiens
ugaaggaugguauggacaa

SEQ ID NO: 1548792 - RNA, 19 nt, Homo sapiens
cuaaagagcaacuggaacu

SEQ ID NO: 1548793 - RNA, 19 nt, Homo sapiens
aaucaagcuugcuacaaag

SEQ ID NO: 1548794 - RNA, 19 nt, Homo sapiens
gaaggcauugcuaagagau

SEQ ID NO: 1548795 - RNA, 19 nt, Homo sapiens
cagauguuccucagaaauc

SEQ ID NO: 1548796 - RNA, 19 nt, Homo sapiens
uguccagaauauucaagaa

SEQ ID NO: 1548797 - RNA, 19 nt, Homo sapiens
acacugacuuuucuucuug

SEQ ID NO: 1548798 - RNA, 19 nt, Homo sapiens
cuuggucaauuauguacuu

SEQ ID NO: 1548799 - RNA, 19 nt, Homo sapiens
agaaacacccguggaggaa

SEQ ID NO: 1548800 - RNA, 19 nt, Homo sapiens
guauggacaauaaucacaa

SEQ ID NO: 1548801 - RNA, 19 nt, Homo sapiens
cgaaaauccugaugcgaau

SEQ ID NO: 1548802 - RNA, 19 nt, Homo sapiens
gaggaagaagacauuauac

SEQ ID NO: 1548803 - RNA, 19 nt, Homo sapiens
cagcaugcaguuucugaau

SEQ ID NO: 1548804 - RNA, 19 nt, Homo sapiens
uuagaaacugggaucauga

SEQ ID NO: 1548805 - RNA, 19 nt, Homo sapiens
guugagagaagaccaaguc

SEQ ID NO: 1548806 - RNA, 19 nt, Homo sapiens
caacuggaacacccaugga

SEQ ID NO: 1548807 - RNA, 19 nt, Homo sapiens
aggcauugcuaagagauau

SEQ ID NO: 1548808 - RNA, 19 nt, Homo sapiens
ucaguggcuuaaagaaaca

SEQ ID NO: 1548809 - RNA, 19 nt, Homo sapiens
aagagcaacuggaacuuuu

SEQ ID NO: 1548810 - RNA, 19 nt, Homo sapiens
gccuaaagagcaacuggaa

SEQ ID NO: 1548811 - RNA, 19 nt, Homo sapiens
gguacuggcugaaggaaua

SEQ ID NO: 1548812 - RNA, 19 nt, Homo sapiens
gagggagccuugagccuuu

SEQ ID NO: 1548813 - RNA, 19 nt, Homo sapiens
cagaaugacuugggucuug

SEQ ID NO: 1548814 - RNA, 19 nt, Homo sapiens
uguccgaacucuccaauga

SEQ ID NO: 1548815 - RNA, 19 nt, Homo sapiens
acaaggaccuaggacauuu

SEQ ID NO: 1548816 - RNA, 19 nt, Homo sapiens
gcacacugcuucagacacu

SEQ ID NO: 1548817 - RNA, 19 nt, Homo sapiens
ggagugcguugugggaauu

SEQ ID NO: 1548818 - RNA, 19 nt, Homo sapiens
uuaauaaucuccccaguuu

SEQ ID NO: 1548819 - RNA, 19 nt, Homo sapiens
gagagcaccuagccuucuu

SEQ ID NO: 1548820 - RNA, 19 nt, Homo sapiens
gcucccagguggaccauga

SEQ ID NO: 1548821 - RNA, 19 nt, Homo sapiens
ggacagguggauaguaaau

SEQ ID NO: 1548822 - RNA, 19 nt, Homo sapiens
uggaagcgcuaccacauca

SEQ ID NO: 1548823 - RNA, 19 nt, Homo sapiens
gggcaucuacccugcaauu

SEQ ID NO: 1548824 - RNA, 19 nt, Homo sapiens
acagguggauaguaaauca

SEQ ID NO: 1548825 - RNA, 19 nt, Homo sapiens
cgaacucuccaaugacuaa

SEQ ID NO: 1548826 - RNA, 19 nt, Homo sapiens
gcuaacagcugggccacau

SEQ ID NO: 1548827 - RNA, 19 nt, Homo sapiens
gaaaccccgucucuacuaa

SEQ ID NO: 1548828 - RNA, 19 nt, Homo sapiens
gagcauggacagguggaua

SEQ ID NO: 1548829 - RNA, 19 nt, Homo sapiens
gacaaggaccuaggacauu

SEQ ID NO: 1548830 - RNA, 19 nt, Homo sapiens
cagaggcugggaagaaaua

SEQ ID NO: 1548831 - RNA, 19 nt, Homo sapiens
gggcaucgcaagaagagaa

SEQ ID NO: 1548832 - RNA, 19 nt, Homo sapiens
ggaggaggcagagccauga

SEQ ID NO: 1548833 - RNA, 19 nt, Homo sapiens
auggacagguggauaguaa

SEQ ID NO: 1548834 - RNA, 19 nt, Homo sapiens
gcaagaagagaagcacaga

SEQ ID NO: 1548835 - RNA, 19 nt, Homo sapiens
ucauuucccugugcauauu

SEQ ID NO: 1548836 - RNA, 19 nt, Homo sapiens
ggagcccugucucacuuga

SEQ ID NO: 1548837 - RNA, 19 nt, Homo sapiens
cgaggcaggcggaucauga

SEQ ID NO: 1548838 - RNA, 19 nt, Homo sapiens
uuucauuccuugguccuua

SEQ ID NO: 1548839 - RNA, 19 nt, Homo sapiens
gggagugcguugugggaau

SEQ ID NO: 1548840 - RNA, 19 nt, Homo sapiens
uggagaccauccuggcuaa

SEQ ID NO: 1548841 - RNA, 19 nt, Homo sapiens
cgucaggguuuggcaagaa

SEQ ID NO: 1548842 - RNA, 19 nt, Homo sapiens
gcucugcugugugacuuug

SEQ ID NO: 1548843 - RNA, 19 nt, Homo sapiens
cagacugugcguuugcuua

SEQ ID NO: 1548844 - RNA, 19 nt, Homo sapiens
ccagagggcaucgcaagaa

SEQ ID NO: 1548845 - RNA, 19 nt, Homo sapiens
gaucaugaggucaggagau

SEQ ID NO: 1548846 - RNA, 19 nt, Homo sapiens
uaacagcugggccacaugu

SEQ ID NO: 1548847 - RNA, 19 nt, Homo sapiens
ccuguaaucccagcacuuu

SEQ ID NO: 1548848 - RNA, 19 nt, Homo sapiens
ggaauaggcugggguagag

SEQ ID NO: 1548849 - RNA, 19 nt, Homo sapiens
gucaggguuuggcaagaaa

SEQ ID NO: 1548850 - RNA, 19 nt, Homo sapiens
gcccagaucccugcucaug

SEQ ID NO: 1548851 - RNA, 19 nt, Homo sapiens
gugccuaacccaggacuuu

SEQ ID NO: 1548852 - RNA, 19 nt, Homo sapiens
caagaagagaagcacagaa

SEQ ID NO: 1548853 - RNA, 19 nt, Homo sapiens
cagagggcaucgcaagaag

SEQ ID NO: 1548854 - RNA, 19 nt, Homo sapiens
ugacaaggaccuaggacau

SEQ ID NO: 1548855 - RNA, 19 nt, Homo sapiens
gagcaccuagccuucuuug

SEQ ID NO: 1548856 - RNA, 19 nt, Homo sapiens
cuucucagauucccuccuu

SEQ ID NO: 1548857 - RNA, 19 nt, Homo sapiens
gaagcgcuaccacaucaag

SEQ ID NO: 1548858 - RNA, 19 nt, Homo sapiens
agagucugcugcugucugu

SEQ ID NO: 1548859 - RNA, 19 nt, Homo sapiens
cgagggccguguacacucu

SEQ ID NO: 1548860 - RNA, 19 nt, Homo sapiens
gcuggaagcgcuaccacau

SEQ ID NO: 1548861 - RNA, 19 nt, Homo sapiens
uuaguuaagaguccuguug

SEQ ID NO: 1548862 - RNA, 19 nt, Homo sapiens
ccggaugccucgucuugca

SEQ ID NO: 1548863 - RNA, 19 nt, Homo sapiens
aagaagagaagcacagaag

SEQ ID NO: 1548864 - RNA, 19 nt, Homo sapiens
gagaccauccuggcuaaca

SEQ ID NO: 1548865 - RNA, 19 nt, Homo sapiens
gccaagaggacgaggaucu

SEQ ID NO: 1548866 - RNA, 19 nt, Homo sapiens
ccucauuucccugugcaua

SEQ ID NO: 1548867 - RNA, 19 nt, Homo sapiens
guagagggcacuuuuggaa

SEQ ID NO: 1548868 - RNA, 19 nt, Homo sapiens
gugcccagacugugcguuu

SEQ ID NO: 1548869 - RNA, 19 nt, Homo sapiens
gcugugugacuuugagguu

SEQ ID NO: 1548870 - RNA, 19 nt, Homo sapiens
agcccugucucacuugauu

SEQ ID NO: 1548871 - RNA, 19 nt, Homo sapiens
cugggaagaaauaauguuu

SEQ ID NO: 1548872 - RNA, 19 nt, Homo sapiens
gcugggaagaaauaauguu

SEQ ID NO: 1548873 - RNA, 19 nt, Homo sapiens
uuggagcccugucucacuu

SEQ ID NO: 1548874 - RNA, 19 nt, Homo sapiens
ggacuugugcacaucuuuu

SEQ ID NO: 1548875 - RNA, 19 nt, Homo sapiens
gcagaaugacuugggucuu

SEQ ID NO: 1548876 - RNA, 19 nt, Homo sapiens
gagggcaucgcaagaagag

SEQ ID NO: 1548877 - RNA, 19 nt, Homo sapiens
caugaggucaggagaugga

SEQ ID NO: 1548878 - RNA, 19 nt, Homo sapiens
ugccaggacuugugcacau

SEQ ID NO: 1548879 - RNA, 19 nt, Homo sapiens
ccugggagccuagaucuca

SEQ ID NO: 1548880 - RNA, 19 nt, Homo sapiens
cugcucgccucccuucaga

SEQ ID NO: 1548881 - RNA, 19 nt, Homo sapiens
gcaggacucagagcaugga

SEQ ID NO: 1548882 - RNA, 19 nt, Homo sapiens
gugccgaggcuacgcaugu

SEQ ID NO: 1548883 - RNA, 19 nt, Homo sapiens
ggacauccuagcuccuucu

SEQ ID NO: 1548884 - RNA, 19 nt, Homo sapiens
ggcaggagagacacucaga

SEQ ID NO: 1548885 - RNA, 19 nt, Homo sapiens
ugcccugucuucaguggaa

SEQ ID NO: 1548886 - RNA, 19 nt, Homo sapiens
ggaaguagauuucgauaua

SEQ ID NO: 1548887 - RNA, 19 nt, Homo sapiens
aagaagagcucacaagaua

SEQ ID NO: 1548888 - RNA, 19 nt, Homo sapiens
acaaacagcucaucauuaa

SEQ ID NO: 1548889 - RNA, 19 nt, Homo sapiens
caugaacccuugaagauua

SEQ ID NO: 1548890 - RNA, 19 nt, Homo sapiens
gcaaaugccugguucugaa

SEQ ID NO: 1548891 - RNA, 19 nt, Homo sapiens
gcuauaagguucagaauca

SEQ ID NO: 1548892 - RNA, 19 nt, Homo sapiens
gaacaaacagcucaucauu

SEQ ID NO: 1548893 - RNA, 19 nt, Homo sapiens
cacagaagcuggaaagaaa

SEQ ID NO: 1548894 - RNA, 19 nt, Homo sapiens
ggaaauaagagaauccauu

SEQ ID NO: 1548895 - RNA, 19 nt, Homo sapiens
gacauacccuucaucuauu

SEQ ID NO: 1548896 - RNA, 19 nt, Homo sapiens
gaaauucuacccacaugaa

SEQ ID NO: 1548897 - RNA, 19 nt, Homo sapiens
gaagaaccuuuaaccaucu

SEQ ID NO: 1548898 - RNA, 19 nt, Homo sapiens
ggaaagagaagacacagau

SEQ ID NO: 1548899 - RNA, 19 nt, Homo sapiens
agacauacccuucaucuau

SEQ ID NO: 1548900 - RNA, 19 nt, Homo sapiens
gagaagacacagauucauu

SEQ ID NO: 1548901 - RNA, 19 nt, Homo sapiens
guauugaucucuccuucuu

SEQ ID NO: 1548902 - RNA, 19 nt, Homo sapiens
aguaacaacucaagagaaa

SEQ ID NO: 1548903 - RNA, 19 nt, Homo sapiens
gcacagagccaacauuacu

SEQ ID NO: 1548904 - RNA, 19 nt, Homo sapiens
gaaguagauuucgauauag

SEQ ID NO: 1548905 - RNA, 19 nt, Homo sapiens
ggcacuggcuugaaccuaa

SEQ ID NO: 1548906 - RNA, 19 nt, Homo sapiens
cuaaauuuaugcuggguuu

SEQ ID NO: 1548907 - RNA, 19 nt, Homo sapiens
ggaggaccaugaaaugauc

SEQ ID NO: 1548908 - RNA, 19 nt, Homo sapiens
gcaggaggaccaugaaaug

SEQ ID NO: 1548909 - RNA, 19 nt, Homo sapiens
gugcacagagccaacauua

SEQ ID NO: 1548910 - RNA, 19 nt, Homo sapiens
uaaagaagagcucacaaga

SEQ ID NO: 1548911 - RNA, 19 nt, Homo sapiens
ucuaauaguuggcaccauu

SEQ ID NO: 1548912 - RNA, 19 nt, Homo sapiens
ggacugcugcucuuuguau

SEQ ID NO: 1548913 - RNA, 19 nt, Homo sapiens
caaaggcacuggcuugaac

SEQ ID NO: 1548914 - RNA, 19 nt, Homo sapiens
gaaggacuacuuuggcauu

SEQ ID NO: 1548915 - RNA, 19 nt, Homo sapiens
caccagaguuugagcaguu

SEQ ID NO: 1548916 - RNA, 19 nt, Homo sapiens
gaagacacagauucauuug

SEQ ID NO: 1548917 - RNA, 19 nt, Homo sapiens
gaaagagaagacacagauu

SEQ ID NO: 1548918 - RNA, 19 nt, Homo sapiens
acauacccuucaucuauua

SEQ ID NO: 1548919 - RNA, 19 nt, Homo sapiens
uaaaggaaguagauuucga

SEQ ID NO: 1548920 - RNA, 19 nt, Homo sapiens
aaagggcaguuucucauug

SEQ ID NO: 1548921 - RNA, 19 nt, Homo sapiens
caacaggcacaacaacauu

SEQ ID NO: 1548922 - RNA, 19 nt, Homo sapiens
gugggaaaguugccaaaga

SEQ ID NO: 1548923 - RNA, 19 nt, Homo sapiens
cuaaugagcauccugagaa

SEQ ID NO: 1548924 - RNA, 19 nt, Homo sapiens
agacacagauucauuugag

SEQ ID NO: 1548925 - RNA, 19 nt, Homo sapiens
cuaaagaggagaacauuuc

SEQ ID NO: 1548926 - RNA, 19 nt, Homo sapiens
gcucaucauuaacauggaa

SEQ ID NO: 1548927 - RNA, 19 nt, Homo sapiens
aaacagcucaucauuaaca

SEQ ID NO: 1548928 - RNA, 19 nt, Homo sapiens
auucacagcugcaggcuuu

SEQ ID NO: 1548929 - RNA, 19 nt, Homo sapiens
ccuugaagauuaaagaaga

SEQ ID NO: 1548930 - RNA, 19 nt, Homo sapiens
ccauacaccaugugcuuua

SEQ ID NO: 1548931 - RNA, 19 nt, Homo sapiens
acuaagggcuauauucaau

SEQ ID NO: 1548932 - RNA, 19 nt, Homo sapiens
agaagacacagauucauuu

SEQ ID NO: 1548933 - RNA, 19 nt, Homo sapiens
agauugacaugcucuuuga

SEQ ID NO: 1548934 - RNA, 19 nt, Homo sapiens
ucucugaacuaguguacaa

SEQ ID NO: 1548935 - RNA, 19 nt, Homo sapiens
agaauuacaucagugaguu

SEQ ID NO: 1548936 - RNA, 19 nt, Homo sapiens
guuccuuacucauaauuga

SEQ ID NO: 1548937 - RNA, 19 nt, Homo sapiens
gagauugacaugcucuuug

SEQ ID NO: 1548938 - RNA, 19 nt, Homo sapiens
caaugcuagugauuucuuu

SEQ ID NO: 1548939 - RNA, 19 nt, Homo sapiens
caaagggcaguuucucauu

SEQ ID NO: 1548940 - RNA, 19 nt, Homo sapiens
ccacaugaacccuugaaga

SEQ ID NO: 1548941 - RNA, 19 nt, Homo sapiens
auaguuggcaccauuauaa

SEQ ID NO: 1548942 - RNA, 19 nt, Homo sapiens
ugacuaagggcuauauuca

SEQ ID NO: 1548943 - RNA, 19 nt, Homo sapiens
guuaaucucucacgugacu

SEQ ID NO: 1548944 - RNA, 19 nt, Homo sapiens
aaccaucucugaacuagug

SEQ ID NO: 1548945 - RNA, 19 nt, Homo sapiens
gggugaggguguuccauug

SEQ ID NO: 1548946 - RNA, 19 nt, Homo sapiens
aacaaacagcucaucauua

SEQ ID NO: 1548947 - RNA, 19 nt, Homo sapiens
gaauuacaucagugaguuu

SEQ ID NO: 1548948 - RNA, 19 nt, Homo sapiens
gaccacaucugcaacuacu

SEQ ID NO: 1548949 - RNA, 19 nt, Homo sapiens
gcccaccaguugcugaauu

SEQ ID NO: 1548950 - RNA, 19 nt, Homo sapiens
ucacagaagcuggaaagaa

SEQ ID NO: 1548951 - RNA, 19 nt, Homo sapiens
uaacaacucaagagaaagu

SEQ ID NO: 1548952 - RNA, 19 nt, Homo sapiens
gcaguucccacuccuugaa

SEQ ID NO: 1548953 - RNA, 19 nt, Homo sapiens
gagcucacaagauaccuuu

SEQ ID NO: 1548954 - RNA, 19 nt, Homo sapiens
uaacaaguccaucuucaag

SEQ ID NO: 1548955 - RNA, 19 nt, Homo sapiens
gaaccuaacaaguccaucu

SEQ ID NO: 1548956 - RNA, 19 nt, Homo sapiens
gcaaaggcacuggcuugaa

SEQ ID NO: 1548957 - RNA, 19 nt, Homo sapiens
ucagugaguuugagauuuu

SEQ ID NO: 1548958 - RNA, 19 nt, Homo sapiens
augagcauccugagaauua

SEQ ID NO: 1548959 - RNA, 19 nt, Homo sapiens
gugaaauucuacccacaug

SEQ ID NO: 1548960 - RNA, 19 nt, Homo sapiens
acauuggacugaauuagau

SEQ ID NO: 1548961 - RNA, 19 nt, Homo sapiens
ggagucagguauugaucuc

SEQ ID NO: 1548962 - RNA, 19 nt, Homo sapiens
cuucuaggcuugaguugga

SEQ ID NO: 1548963 - RNA, 19 nt, Homo sapiens
gguguuccauugccuaaag

SEQ ID NO: 1548964 - RNA, 19 nt, Homo sapiens
uaaugagcauccugagaau

SEQ ID NO: 1548965 - RNA, 19 nt, Homo sapiens
ccuaacaaguccaucuuca

SEQ ID NO: 1548966 - RNA, 19 nt, Homo sapiens
accaaugccuauacaacua

SEQ ID NO: 1548967 - RNA, 19 nt, Homo sapiens
uugagcaguuucacuauga

SEQ ID NO: 1548968 - RNA, 19 nt, Homo sapiens
ggaggccaguuccaagauc

SEQ ID NO: 1548969 - RNA, 19 nt, Homo sapiens
cuaccugggugccuguauu

SEQ ID NO: 1548970 - RNA, 19 nt, Homo sapiens
ccaaugccuauacaacuaa

SEQ ID NO: 1548971 - RNA, 19 nt, Homo sapiens
cauaauucacugcacuuaa

SEQ ID NO: 1548972 - RNA, 19 nt, Homo sapiens
ucaugaaguuaaucucuca

SEQ ID NO: 1548973 - RNA, 19 nt, Homo sapiens
aaagagaagacacagauuc

SEQ ID NO: 1548974 - RNA, 19 nt, Homo sapiens
cuagugaagaggaagauaa

SEQ ID NO: 1548975 - RNA, 19 nt, Homo sapiens
cgauauagugggaaaguug

SEQ ID NO: 1548976 - RNA, 19 nt, Homo sapiens
caagagaaaguuguugaau

SEQ ID NO: 1548977 - RNA, 19 nt, Homo sapiens
cagguguuccuuacucaua

SEQ ID NO: 1548978 - RNA, 19 nt, Homo sapiens
caagauaccuuuuauaccu

SEQ ID NO: 1548979 - RNA, 19 nt, Homo sapiens
acaaguccaucuucaagca

SEQ ID NO: 1548980 - RNA, 19 nt, Homo sapiens
cauucugacuggccauauu

SEQ ID NO: 1548981 - RNA, 19 nt, Homo sapiens
cccaccaguugcugaauuu

SEQ ID NO: 1548982 - RNA, 19 nt, Homo sapiens
cacaugaacccuugaagau

SEQ ID NO: 1548983 - RNA, 19 nt, Homo sapiens
ggcuugaguuggaaagaga

SEQ ID NO: 1548984 - RNA, 19 nt, Homo sapiens
ccagcugccugcaaacauc

SEQ ID NO: 1548985 - RNA, 19 nt, Homo sapiens
caucagugaguuugagauu

SEQ ID NO: 1548986 - RNA, 19 nt, Homo sapiens
gaagaacgcuauuuauuug

SEQ ID NO: 1548987 - RNA, 19 nt, Homo sapiens
gaauauggcugcccucuga

SEQ ID NO: 1548988 - RNA, 19 nt, Homo sapiens
gcacacagauggccacauu

SEQ ID NO: 1548989 - RNA, 19 nt, Homo sapiens
gaauguagauuaugagaga

SEQ ID NO: 1548990 - RNA, 19 nt, Homo sapiens
ggaaaucuaucaaugcuau

SEQ ID NO: 1548991 - RNA, 19 nt, Homo sapiens
gaaggaacauuauuuacug

SEQ ID NO: 1548992 - RNA, 19 nt, Homo sapiens
gguguugggucaauuauuu

SEQ ID NO: 1548993 - RNA, 19 nt, Homo sapiens
gcacagacauggaagucaa

SEQ ID NO: 1548994 - RNA, 19 nt, Homo sapiens
ucacacaacugauucauuc

SEQ ID NO: 1548995 - RNA, 19 nt, Homo sapiens
gaacaagcauaguaucuac

SEQ ID NO: 1548996 - RNA, 19 nt, Homo sapiens
uaaaggagauuagaggaaa

SEQ ID NO: 1548997 - RNA, 19 nt, Homo sapiens
ugaagaagaacgcuauuua

SEQ ID NO: 1548998 - RNA, 19 nt, Homo sapiens
gaagaagaacgcuauuuau

SEQ ID NO: 1548999 - RNA, 19 nt, Homo sapiens
gauaauggcuauguuaaag

SEQ ID NO: 1549000 - RNA, 19 nt, Homo sapiens
gaagcaaauuucauagugu

SEQ ID NO: 1549001 - RNA, 19 nt, Homo sapiens
gaugauaauggcuauguua

SEQ ID NO: 1549002 - RNA, 19 nt, Homo sapiens
gcuguuggcugugaugaua

SEQ ID NO: 1549003 - RNA, 19 nt, Homo sapiens
uuaaagacguugaagcaaa

SEQ ID NO: 1549004 - RNA, 19 nt, Homo sapiens
gaugauggcacaauacaaa

SEQ ID NO: 1549005 - RNA, 19 nt, Homo sapiens
gauccauucuucuuaaguu

SEQ ID NO: 1549006 - RNA, 19 nt, Homo sapiens
ucacaaaccucaaagaaaa

SEQ ID NO: 1549007 - RNA, 19 nt, Homo sapiens
gucaugagauuuccuuuga

SEQ ID NO: 1549008 - RNA, 19 nt, Homo sapiens
guacaucuggucaaacaua

SEQ ID NO: 1549009 - RNA, 19 nt, Homo sapiens
ugacagauauggagaccuu

SEQ ID NO: 1549010 - RNA, 19 nt, Homo sapiens
uaccugaaauuccugguua

SEQ ID NO: 1549011 - RNA, 19 nt, Homo sapiens
uaaagacguugaagcaaau

SEQ ID NO: 1549012 - RNA, 19 nt, Homo sapiens
ggaagaagaagcaccuuug

SEQ ID NO: 1549013 - RNA, 19 nt, Homo sapiens
cagagugccuccagacauu

SEQ ID NO: 1549014 - RNA, 19 nt, Homo sapiens
ggacucagaucgucuaucc

SEQ ID NO: 1549015 - RNA, 19 nt, Homo sapiens
ggaacaagcauaguaucua

SEQ ID NO: 1549016 - RNA, 19 nt, Homo sapiens
gacaaaagaugaugcacua

SEQ ID NO: 1549017 - RNA, 19 nt, Homo sapiens
guauagcuuucacaacaaa

SEQ ID NO: 1549018 - RNA, 19 nt, Homo sapiens
caauacaaauacaggacua

SEQ ID NO: 1549019 - RNA, 19 nt, Homo sapiens
gauacucuauguacucuca

SEQ ID NO: 1549020 - RNA, 19 nt, Homo sapiens
acacuggucuguauguuau

SEQ ID NO: 1549021 - RNA, 19 nt, Homo sapiens
aauauaagcucguaguagu

SEQ ID NO: 1549022 - RNA, 19 nt, Homo sapiens
acaagagagucaugagauu

SEQ ID NO: 1549023 - RNA, 19 nt, Homo sapiens
aaguauagcuuucacaaca

SEQ ID NO: 1549024 - RNA, 19 nt, Homo sapiens
uaaguuugccagauuagua

SEQ ID NO: 1549025 - RNA, 19 nt, Homo sapiens
guaguugcaucugcuguuu

SEQ ID NO: 1549026 - RNA, 19 nt, Homo sapiens
ugauugaacuuaacaagca

SEQ ID NO: 1549027 - RNA, 19 nt, Homo sapiens
gaguguggcucaugugauc

SEQ ID NO: 1549028 - RNA, 19 nt, Homo sapiens
gggaggaauuguaaaucuu

SEQ ID NO: 1549029 - RNA, 19 nt, Homo sapiens
ccagaaguacuauuaaguu

SEQ ID NO: 1549030 - RNA, 19 nt, Homo sapiens
gugcagauccugaugaguu

SEQ ID NO: 1549031 - RNA, 19 nt, Homo sapiens
gaggauuuauagacgauau

SEQ ID NO: 1549032 - RNA, 19 nt, Homo sapiens
gcacagagugguuguuuac

SEQ ID NO: 1549033 - RNA, 19 nt, Homo sapiens
uaaguuagaguaugaagga

SEQ ID NO: 1549034 - RNA, 19 nt, Homo sapiens
caaaagguguuccaaauag

SEQ ID NO: 1549035 - RNA, 19 nt, Homo sapiens
cgacagaauugcguuguuc

SEQ ID NO: 1549036 - RNA, 19 nt, Homo sapiens
uaacaagcaccucccacua

SEQ ID NO: 1549037 - RNA, 19 nt, Homo sapiens
ggcacagagugguuguuua

SEQ ID NO: 1549038 - RNA, 19 nt, Homo sapiens
caagagagucaugagauuu

SEQ ID NO: 1549039 - RNA, 19 nt, Homo sapiens
uuaaguacaucuggucaaa

SEQ ID NO: 1549040 - RNA, 19 nt, Homo sapiens
ucaaugcuaucaaaugaca

SEQ ID NO: 1549041 - RNA, 19 nt, Homo sapiens
gaccauaccugaaauuccu

SEQ ID NO: 1549042 - RNA, 19 nt, Homo sapiens
cagagugguuguuuacaug

SEQ ID NO: 1549043 - RNA, 19 nt, Homo sapiens
agggaugacuauagcuuua

SEQ ID NO: 1549044 - RNA, 19 nt, Homo sapiens
ccacuaacagcccaaacua

SEQ ID NO: 1549045 - RNA, 19 nt, Homo sapiens
ggacauggaaaucuaucaa

SEQ ID NO: 1549046 - RNA, 19 nt, Homo sapiens
caggauuacugcuauggaa

SEQ ID NO: 1549047 - RNA, 19 nt, Homo sapiens
ggaacauuauuuacugagu

SEQ ID NO: 1549048 - RNA, 19 nt, Homo sapiens
gcaccucccacuagaagaa

SEQ ID NO: 1549049 - RNA, 19 nt, Homo sapiens
aaagacaaaugcccauaca

SEQ ID NO: 1549050 - RNA, 19 nt, Homo sapiens
ggacaaauuacacaacaag

SEQ ID NO: 1549051 - RNA, 19 nt, Homo sapiens
cagcauuauucaugaaguu

SEQ ID NO: 1549052 - RNA, 19 nt, Homo sapiens
uuacccagcuuaucacugu

SEQ ID NO: 1549053 - RNA, 19 nt, Homo sapiens
uaguaggcaucaccaaauu

SEQ ID NO: 1549054 - RNA, 19 nt, Homo sapiens
ggaugacuauagcuuuaau

SEQ ID NO: 1549055 - RNA, 19 nt, Homo sapiens
cagaucgucuauccagaaa

SEQ ID NO: 1549056 - RNA, 19 nt, Homo sapiens
caucuggucaaacauauuu

SEQ ID NO: 1549057 - RNA, 19 nt, Homo sapiens
acaacaagagcauucauuu

SEQ ID NO: 1549058 - RNA, 19 nt, Homo sapiens
ugacagcauuauucaugaa

SEQ ID NO: 1549059 - RNA, 19 nt, Homo sapiens
cacaacugauucauucaaa

SEQ ID NO: 1549060 - RNA, 19 nt, Homo sapiens
gcauauagagaaacagugu

SEQ ID NO: 1549061 - RNA, 19 nt, Homo sapiens
agagacauuuggacugauu

SEQ ID NO: 1549062 - RNA, 19 nt, Homo sapiens
ggagugugccagaaacuug

SEQ ID NO: 1549063 - RNA, 19 nt, Homo sapiens
aggcuugacuucacagaaa

SEQ ID NO: 1549064 - RNA, 19 nt, Homo sapiens
gagagaauaucugauuacu

SEQ ID NO: 1549065 - RNA, 19 nt, Homo sapiens
acaagcaccucccacuaga

SEQ ID NO: 1549066 - RNA, 19 nt, Homo sapiens
agacaaaugcccauacaug

SEQ ID NO: 1549067 - RNA, 19 nt, Homo sapiens
ucuuaaguuugccagauua

SEQ ID NO: 1549068 - RNA, 19 nt, Homo sapiens
uaacaacuuuacccagcuu

SEQ ID NO: 1549069 - RNA, 19 nt, Homo sapiens
acauggaaaucuaucaaug

SEQ ID NO: 1549070 - RNA, 19 nt, Homo sapiens
ucggauccauucuucuuaa

SEQ ID NO: 1549071 - RNA, 19 nt, Homo sapiens
ccacgugguagucaauuaa

SEQ ID NO: 1549072 - RNA, 19 nt, Homo sapiens
gauuagaggaaaccaaguu

SEQ ID NO: 1549073 - RNA, 19 nt, Homo sapiens
guaguaggcaucaccaaau

SEQ ID NO: 1549074 - RNA, 19 nt, Homo sapiens
ucucauacuugcuuucugu

SEQ ID NO: 1549075 - RNA, 19 nt, Homo sapiens
caugagauuuccuuugaag

SEQ ID NO: 1549076 - RNA, 19 nt, Homo sapiens
cccaagacuuuacauuaga

SEQ ID NO: 1549077 - RNA, 19 nt, Homo sapiens
ggaggaauuguaaaucuuc

SEQ ID NO: 1549078 - RNA, 19 nt, Homo sapiens
cuauagaguuagacauuuc

SEQ ID NO: 1549079 - RNA, 19 nt, Homo sapiens
gguagcuucuuuccucuuc

SEQ ID NO: 1549080 - RNA, 19 nt, Homo sapiens
auagagacauuuggacuga

SEQ ID NO: 1549081 - RNA, 19 nt, Homo sapiens
agucauaucugaggcauca

SEQ ID NO: 1549082 - RNA, 19 nt, Homo sapiens
ccaagacuuuacauuagau

SEQ ID NO: 1549083 - RNA, 19 nt, Homo sapiens
ucccaagacuuuacauuag

SEQ ID NO: 1549084 - RNA, 19 nt, Homo sapiens
auuaaaggcuaaaggaaga

SEQ ID NO: 1549085 - RNA, 19 nt, Homo sapiens
uggaauuacuggcauuuca

SEQ ID NO: 1549086 - RNA, 19 nt, Homo sapiens
ugucaugaauguccaguaa

SEQ ID NO: 1549087 - RNA, 19 nt, Homo sapiens
gacaugcugugacccguuu

SEQ ID NO: 1549088 - RNA, 19 nt, Homo sapiens
gcacaucucauucugucau

SEQ ID NO: 1549089 - RNA, 19 nt, Homo sapiens
gugagauccugucugcauu

SEQ ID NO: 1549090 - RNA, 19 nt, Homo sapiens
caagcugugcucugaguuu

SEQ ID NO: 1549091 - RNA, 19 nt, Homo sapiens
ggcaagcugugcucugagu

SEQ ID NO: 1549092 - RNA, 19 nt, Homo sapiens
ggugagauccugucugcau

SEQ ID NO: 1549093 - RNA, 19 nt, Homo sapiens
ucaugaauguccaguaaaa

SEQ ID NO: 1549094 - RNA, 19 nt, Homo sapiens
gcaggcacccuccuuugca

SEQ ID NO: 1549095 - RNA, 19 nt, Homo sapiens
ccagcugggaagacaguua

SEQ ID NO: 1549096 - RNA, 19 nt, Homo sapiens
cagcuuugcccacguggaa

SEQ ID NO: 1549097 - RNA, 19 nt, Homo sapiens
cugagaagcugggccacuu

SEQ ID NO: 1549098 - RNA, 19 nt, Homo sapiens
ccagaggaaagucaagaug

SEQ ID NO: 1549099 - RNA, 19 nt, Homo sapiens
gcucugaguuucggguucu

SEQ ID NO: 1549100 - RNA, 19 nt, Homo sapiens
gaccagaggaaagucaaga

SEQ ID NO: 1549101 - RNA, 19 nt, Homo sapiens
gggugacuguggcuugugu

SEQ ID NO: 1549102 - RNA, 19 nt, Homo sapiens
cugcggcucugcugaaugg

SEQ ID NO: 1549103 - RNA, 19 nt, Homo sapiens
auggcuacguguacaagua

SEQ ID NO: 1549104 - RNA, 19 nt, Homo sapiens
agggcaagcugugcucuga

SEQ ID NO: 1549105 - RNA, 19 nt, Homo sapiens
ugagggaaaggaucacaga

SEQ ID NO: 1549106 - RNA, 19 nt, Homo sapiens
cagcugggaagacaguuau

SEQ ID NO: 1549107 - RNA, 19 nt, Homo sapiens
ucauuucccacaucuucua

SEQ ID NO: 1549108 - RNA, 19 nt, Homo sapiens
aaccugcaccucaauguga

SEQ ID NO: 1549109 - RNA, 19 nt, Homo sapiens
guaaccugcaccucaaugu

SEQ ID NO: 1549110 - RNA, 19 nt, Homo sapiens
ugucauuucccacaucuuc

SEQ ID NO: 1549111 - RNA, 19 nt, Homo sapiens
agaggaaagucaagaugcu

SEQ ID NO: 1549112 - RNA, 19 nt, Homo sapiens
uaaccugcaccucaaugug

SEQ ID NO: 1549113 - RNA, 19 nt, Homo sapiens
ggugcaagagaguccguuu

SEQ ID NO: 1549114 - RNA, 19 nt, Homo sapiens
ggguucugcuccuacaaag

SEQ ID NO: 1549115 - RNA, 19 nt, Homo sapiens
aagcugugcucugaguuuc

SEQ ID NO: 1549116 - RNA, 19 nt, Homo sapiens
gaacuggaccaccaugaua

SEQ ID NO: 1549117 - RNA, 19 nt, Homo sapiens
ggacauagcaaacaaggaa

SEQ ID NO: 1549118 - RNA, 19 nt, Homo sapiens
gaaauuucauguguggaua

SEQ ID NO: 1549119 - RNA, 19 nt, Homo sapiens
ggaccagcguggcaacaua

SEQ ID NO: 1549120 - RNA, 19 nt, Homo sapiens
gaacagagagaacuaugug

SEQ ID NO: 1549121 - RNA, 19 nt, Homo sapiens
cgagaacgguuacacauca

SEQ ID NO: 1549122 - RNA, 19 nt, Homo sapiens
ggaccaccaugauaaagga

SEQ ID NO: 1549123 - RNA, 19 nt, Homo sapiens
ggccagacguccaguauca

SEQ ID NO: 1549124 - RNA, 19 nt, Homo sapiens
acaaggaaauuucaugugu

SEQ ID NO: 1549125 - RNA, 19 nt, Homo sapiens
uaccuuaacuguggacaua

SEQ ID NO: 1549126 - RNA, 19 nt, Homo sapiens
caacuggagaccaucuuua

SEQ ID NO: 1549127 - RNA, 19 nt, Homo sapiens
gagaccaucuuuagcaucu

SEQ ID NO: 1549128 - RNA, 19 nt, Homo sapiens
cgacgccgaguauguguua

SEQ ID NO: 1549129 - RNA, 19 nt, Homo sapiens
ggucaucgacgccgaguau

SEQ ID NO: 1549130 - RNA, 19 nt, Homo sapiens
gacaggagaauuuauauac

SEQ ID NO: 1549131 - RNA, 19 nt, Homo sapiens
cauaauagaguuucugaca

SEQ ID NO: 1549132 - RNA, 19 nt, Homo sapiens
gcaguucucauacuccuau

SEQ ID NO: 1549133 - RNA, 19 nt, Homo sapiens
ggaaauuucauguguggau

SEQ ID NO: 1549134 - RNA, 19 nt, Homo sapiens
gaacaccaaguacaaacug

SEQ ID NO: 1549135 - RNA, 19 nt, Homo sapiens
cuacguguauggagcauuc

SEQ ID NO: 1549136 - RNA, 19 nt, Homo sapiens
ccaccaugauaaaggaauu

SEQ ID NO: 1549137 - RNA, 19 nt, Homo sapiens
gaucacuugugcccaggaa

SEQ ID NO: 1549138 - RNA, 19 nt, Homo sapiens
caaacaaggaaauuucaug

SEQ ID NO: 1549139 - RNA, 19 nt, Homo sapiens
cagaugggaacaccaagua

SEQ ID NO: 1549140 - RNA, 19 nt, Homo sapiens
ccgaggaccugcacguguu

SEQ ID NO: 1549141 - RNA, 19 nt, Homo sapiens
caagacaauuacagcuuca

SEQ ID NO: 1549142 - RNA, 19 nt, Homo sapiens
aaagaaagccaccaugucu

SEQ ID NO: 1549143 - RNA, 19 nt, Homo sapiens
gaccagcguggcaacauaa

SEQ ID NO: 1549144 - RNA, 19 nt, Homo sapiens
ggagucgucauccuacuga

SEQ ID NO: 1549145 - RNA, 19 nt, Homo sapiens
gagauggaaggaucacuug

SEQ ID NO: 1549146 - RNA, 19 nt, Homo sapiens
ucacaacuguaaccucaag

SEQ ID NO: 1549147 - RNA, 19 nt, Homo sapiens
gccaccaugucuaccuuaa

SEQ ID NO: 1549148 - RNA, 19 nt, Homo sapiens
ggaacagagagaacuaugu

SEQ ID NO: 1549149 - RNA, 19 nt, Homo sapiens
gaauugacugcuucguuga

SEQ ID NO: 1549150 - RNA, 19 nt, Homo sapiens
cagcuggaauugacugcuu

SEQ ID NO: 1549151 - RNA, 19 nt, Homo sapiens
caggagaauuuauauacag

SEQ ID NO: 1549152 - RNA, 19 nt, Homo sapiens
ucacuuccaguuuaaagaa

SEQ ID NO: 1549153 - RNA, 19 nt, Homo sapiens
gcuguccucuccucgucua

SEQ ID NO: 1549154 - RNA, 19 nt, Homo sapiens
gauggaaggaucacuugug

SEQ ID NO: 1549155 - RNA, 19 nt, Homo sapiens
uagcaaacaaggaaauuuc

SEQ ID NO: 1549156 - RNA, 19 nt, Homo sapiens
uaaagaaagccaccauguc

SEQ ID NO: 1549157 - RNA, 19 nt, Homo sapiens
ccaaguacaaacuggauau

SEQ ID NO: 1549158 - RNA, 19 nt, Homo sapiens
ucugacaggagaauuuaua

SEQ ID NO: 1549159 - RNA, 19 nt, Homo sapiens
acagcaaaccagaucauuu

SEQ ID NO: 1549160 - RNA, 19 nt, Homo sapiens
ucacuugugcccaggaauu

SEQ ID NO: 1549161 - RNA, 19 nt, Homo sapiens
caaacuggauauuuuccua

SEQ ID NO: 1549162 - RNA, 19 nt, Homo sapiens
cagcaaaccagaucauuuu

SEQ ID NO: 1549163 - RNA, 19 nt, Homo sapiens
gacaauuacagcuucauca

SEQ ID NO: 1549164 - RNA, 19 nt, Homo sapiens
gcaacauaauagaguuucu

SEQ ID NO: 1549165 - RNA, 19 nt, Homo sapiens
caccaugucuaccuuaacu

SEQ ID NO: 1549166 - RNA, 19 nt, Homo sapiens
ccguuuggcuggccuacaa

SEQ ID NO: 1549167 - RNA, 19 nt, Homo sapiens
acuguaaccucaagcacuu

SEQ ID NO: 1549168 - RNA, 19 nt, Homo sapiens
gaccaucuuuagcaucuac

SEQ ID NO: 1549169 - RNA, 19 nt, Homo sapiens
ggacagcaaaccagaucau

SEQ ID NO: 1549170 - RNA, 19 nt, Homo sapiens
gcaaacaaggaaauuucau

SEQ ID NO: 1549171 - RNA, 19 nt, Homo sapiens
uaacuguggacauagcaaa

SEQ ID NO: 1549172 - RNA, 19 nt, Homo sapiens
ugacccugcaagacaauua

SEQ ID NO: 1549173 - RNA, 19 nt, Homo sapiens
uuaaagaaagccaccaugu

SEQ ID NO: 1549174 - RNA, 19 nt, Homo sapiens
cagcguggcaacauaauag

SEQ ID NO: 1549175 - RNA, 19 nt, Homo sapiens
gaugggaacaccaaguaca

SEQ ID NO: 1549176 - RNA, 19 nt, Homo sapiens
gaacgguuacacaucagau

SEQ ID NO: 1549177 - RNA, 19 nt, Homo sapiens
cgagauggaaggaucacuu

SEQ ID NO: 1549178 - RNA, 19 nt, Homo sapiens
uuucauguguggauaucaa

SEQ ID NO: 1549179 - RNA, 19 nt, Homo sapiens
guggcaacauaauagaguu

SEQ ID NO: 1549180 - RNA, 19 nt, Homo sapiens
gaucgucauccagaacaaa

SEQ ID NO: 1549181 - RNA, 19 nt, Homo sapiens
ccacugucgacacugauuu

SEQ ID NO: 1549182 - RNA, 19 nt, Homo sapiens
ccagcguggcaacauaaua

SEQ ID NO: 1549183 - RNA, 19 nt, Homo sapiens
gccgcaggaucaagaagug

SEQ ID NO: 1549184 - RNA, 19 nt, Homo sapiens
cacaauggcuuuuaugucu

SEQ ID NO: 1549185 - RNA, 19 nt, Homo sapiens
guccucuccucgucuacua

SEQ ID NO: 1549186 - RNA, 19 nt, Homo sapiens
aagccacugucgacacuga

SEQ ID NO: 1549187 - RNA, 19 nt, Homo sapiens
ucaagccacugucgacacu

SEQ ID NO: 1549188 - RNA, 19 nt, Homo sapiens
gcaggaccgacuccaacuu

SEQ ID NO: 1549189 - RNA, 19 nt, Homo sapiens
caaguacaaacuggauauu

SEQ ID NO: 1549190 - RNA, 19 nt, Homo sapiens
ucaacuggagaccaucuuu

SEQ ID NO: 1549191 - RNA, 19 nt, Homo sapiens
gacagcaaaccagaucauu

SEQ ID NO: 1549192 - RNA, 19 nt, Homo sapiens
ccagacguccaguaucaga

SEQ ID NO: 1549193 - RNA, 19 nt, Homo sapiens
caauuacagcuucaucauc

SEQ ID NO: 1549194 - RNA, 19 nt, Homo sapiens
caacauaauagaguuucug

SEQ ID NO: 1549195 - RNA, 19 nt, Homo sapiens
guaccucccagccgcagaa

SEQ ID NO: 1549196 - RNA, 19 nt, Homo sapiens
gagaacgguuacacaucag

SEQ ID NO: 1549197 - RNA, 19 nt, Homo sapiens
ugguggagcuguggcgaaa

SEQ ID NO: 1549198 - RNA, 19 nt, Homo sapiens
cauagcaaacaaggaaauu

SEQ ID NO: 1549199 - RNA, 19 nt, Homo sapiens
aagaaagccaccaugucua

SEQ ID NO: 1549200 - RNA, 19 nt, Homo sapiens
cacuuccaguuuaaagaaa

SEQ ID NO: 1549201 - RNA, 19 nt, Homo sapiens
ucuuuagcaucuacgugua

SEQ ID NO: 1549202 - RNA, 19 nt, Homo sapiens
ggaacaccaaguacaaacu

SEQ ID NO: 1549203 - RNA, 19 nt, Homo sapiens
agaaagccaccaugucuac

SEQ ID NO: 1549204 - RNA, 19 nt, Homo sapiens
uguauaccauugacaugca

SEQ ID NO: 1549205 - RNA, 19 nt, Homo sapiens
ccccuugucuucaaauaaa

SEQ ID NO: 1549206 - RNA, 19 nt, Homo sapiens
cguccaguaucagaucuug

SEQ ID NO: 1549207 - RNA, 19 nt, Homo sapiens
caucaucgagaaggaauuc

SEQ ID NO: 1549208 - RNA, 19 nt, Homo sapiens
auugacugcuucguugaua

SEQ ID NO: 1549209 - RNA, 19 nt, Homo sapiens
uggaauugacugcuucguu

SEQ ID NO: 1549210 - RNA, 19 nt, Homo sapiens
caucgacgccgaguaugug

SEQ ID NO: 1549211 - RNA, 19 nt, Homo sapiens
acuaugacacccuauggaa

SEQ ID NO: 1549212 - RNA, 19 nt, Homo sapiens
ccugauuccucuggugaug

SEQ ID NO: 1549213 - RNA, 19 nt, Homo sapiens
gacauagcaaacaaggaaa

SEQ ID NO: 1549214 - RNA, 19 nt, Homo sapiens
caggaccgacuccaacuuc

SEQ ID NO: 1549215 - RNA, 19 nt, Homo sapiens
guacaaacuggauauuuuc

SEQ ID NO: 1549216 - RNA, 19 nt, Homo sapiens
ugaagaagcuaaugaagaa

SEQ ID NO: 1549217 - RNA, 19 nt, Homo sapiens
gaagacauaugcugagguu

SEQ ID NO: 1549218 - RNA, 19 nt, Homo sapiens
ggugagaacuuuauuguca

SEQ ID NO: 1549219 - RNA, 19 nt, Homo sapiens
gaacuuuggucaccugcuu

SEQ ID NO: 1549220 - RNA, 19 nt, Homo sapiens
ccacagagcccaagaagug

SEQ ID NO: 1549221 - RNA, 19 nt, Homo sapiens
gauggaaauugacucguuu

SEQ ID NO: 1549222 - RNA, 19 nt, Homo sapiens
gggaugggcugauggaaau

SEQ ID NO: 1549223 - RNA, 19 nt, Homo sapiens
ccagugacauauauagaaa

SEQ ID NO: 1549224 - RNA, 19 nt, Homo sapiens
ggaggaggauaccaagaga

SEQ ID NO: 1549225 - RNA, 19 nt, Homo sapiens
caaggaagauggaguuggu

SEQ ID NO: 1549226 - RNA, 19 nt, Homo sapiens
aaacauaaaucaggcuaga

SEQ ID NO: 1549227 - RNA, 19 nt, Homo sapiens
agagagaggugcccaagga

SEQ ID NO: 1549228 - RNA, 19 nt, Homo sapiens
aaucaaagccugcacaaga

SEQ ID NO: 1549229 - RNA, 19 nt, Homo sapiens
gaaccugacauuucgagaa

SEQ ID NO: 1549230 - RNA, 19 nt, Homo sapiens
cagaguagcugauauugac

SEQ ID NO: 1549231 - RNA, 19 nt, Homo sapiens
ggugggauguauagagaaa

SEQ ID NO: 1549232 - RNA, 19 nt, Homo sapiens
gcaaacuaauccucuucuu

SEQ ID NO: 1549233 - RNA, 19 nt, Homo sapiens
guaaggauccaucuguuug

SEQ ID NO: 1549234 - RNA, 19 nt, Homo sapiens
gggaacauaagaaguuuaa

SEQ ID NO: 1549235 - RNA, 19 nt, Homo sapiens
ggacuuucaguuuauguaa

SEQ ID NO: 1549236 - RNA, 19 nt, Homo sapiens
gaucccaguuuauccuuug

SEQ ID NO: 1549237 - RNA, 19 nt, Homo sapiens
gcacucaaacagaauaaau

SEQ ID NO: 1549238 - RNA, 19 nt, Homo sapiens
gguucuggaugaaaucuuu

SEQ ID NO: 1549239 - RNA, 19 nt, Homo sapiens
caccauaucuuacuucacu

SEQ ID NO: 1549240 - RNA, 19 nt, Homo sapiens
uggaugaaaucuuugcaaa

SEQ ID NO: 1549241 - RNA, 19 nt, Homo sapiens
gcagaguagcugauauuga

SEQ ID NO: 1549242 - RNA, 19 nt, Homo sapiens
gcacuucugugugucuuuc

SEQ ID NO: 1549243 - RNA, 19 nt, Homo sapiens
caaacuaauccucuucuug

SEQ ID NO: 1549244 - RNA, 19 nt, Homo sapiens
ggagaagaacugccagguu

SEQ ID NO: 1549245 - RNA, 19 nt, Homo sapiens
gguaaggauccaucuguuu

SEQ ID NO: 1549246 - RNA, 19 nt, Homo sapiens
gaacauaagaaguuuaacg

SEQ ID NO: 1549247 - RNA, 19 nt, Homo sapiens
gugaagaagcuaaugaaga

SEQ ID NO: 1549248 - RNA, 19 nt, Homo sapiens
gaagauggaguuggugaug

SEQ ID NO: 1549249 - RNA, 19 nt, Homo sapiens
ugauggaaauugacucguu

SEQ ID NO: 1549250 - RNA, 19 nt, Homo sapiens
gugggcaccugucuuguga

SEQ ID NO: 1549251 - RNA, 19 nt, Homo sapiens
ccacuucuaugccauggau

SEQ ID NO: 1549252 - RNA, 19 nt, Homo sapiens
guaccagcccagugacaua

SEQ ID NO: 1549253 - RNA, 19 nt, Homo sapiens
gagaggugcccaaggaaga

SEQ ID NO: 1549254 - RNA, 19 nt, Homo sapiens
caguuuauccuuugagauu

SEQ ID NO: 1549255 - RNA, 19 nt, Homo sapiens
ggguaaggauccaucuguu

SEQ ID NO: 1549256 - RNA, 19 nt, Homo sapiens
gacauaugcugagguuuua

SEQ ID NO: 1549257 - RNA, 19 nt, Homo sapiens
ccucggacuuucaguuuau

SEQ ID NO: 1549258 - RNA, 19 nt, Homo sapiens
ccuuugagauucagcagaa

SEQ ID NO: 1549259 - RNA, 19 nt, Homo sapiens
ggauuucaaccacuucuau

SEQ ID NO: 1549260 - RNA, 19 nt, Homo sapiens
augaagaaguggucuguga

SEQ ID NO: 1549261 - RNA, 19 nt, Homo sapiens
ucaaacgccucgccaggau

SEQ ID NO: 1549262 - RNA, 19 nt, Homo sapiens
gaccaaacccaagcuauca

SEQ ID NO: 1549263 - RNA, 19 nt, Homo sapiens
cacaggccaccauaucuua

SEQ ID NO: 1549264 - RNA, 19 nt, Homo sapiens
guucauaggcuggcacuga

SEQ ID NO: 1549265 - RNA, 19 nt, Homo sapiens
acaagugugcgcaaacuaa

SEQ ID NO: 1549266 - RNA, 19 nt, Homo sapiens
gcugggauccgcuacuuug

SEQ ID NO: 1549267 - RNA, 19 nt, Homo sapiens
ggaucuccuuggugaagaa

SEQ ID NO: 1549268 - RNA, 19 nt, Homo sapiens
gguuugugguucuggauga

SEQ ID NO: 1549269 - RNA, 19 nt, Homo sapiens
cgacuacucccaauucaca

SEQ ID NO: 1549270 - RNA, 19 nt, Homo sapiens
cggcugcacuucugugugu

SEQ ID NO: 1549271 - RNA, 19 nt, Homo sapiens
ugagaacuuuauugucaga

SEQ ID NO: 1549272 - RNA, 19 nt, Homo sapiens
acauuucggugagaacuuu

SEQ ID NO: 1549273 - RNA, 19 nt, Homo sapiens
ggucugggaugggcugaug

SEQ ID NO: 1549274 - RNA, 19 nt, Homo sapiens
gaaaggcauuuuggaaaga

SEQ ID NO: 1549275 - RNA, 19 nt, Homo sapiens
caauacgacuacucccaau

SEQ ID NO: 1549276 - RNA, 19 nt, Homo sapiens
caggaggccuuuggaaaca

SEQ ID NO: 1549277 - RNA, 19 nt, Homo sapiens
ggagaucuacuucauccau

SEQ ID NO: 1549278 - RNA, 19 nt, Homo sapiens
ccagcccagugacauauau

SEQ ID NO: 1549279 - RNA, 19 nt, Homo sapiens
gaacucugugggagaagaa

SEQ ID NO: 1549280 - RNA, 19 nt, Homo sapiens
ugugagugcuaguggguaa

SEQ ID NO: 1549281 - RNA, 19 nt, Homo sapiens
ccaaacccaagcuaucaaa

SEQ ID NO: 1549282 - RNA, 19 nt, Homo sapiens
acagggaugcuagcaguua

SEQ ID NO: 1549283 - RNA, 19 nt, Homo sapiens
gggcaccugucuugugagu

SEQ ID NO: 1549284 - RNA, 19 nt, Homo sapiens
caucggaggucugcaaugc

SEQ ID NO: 1549285 - RNA, 19 nt, Homo sapiens
gcgcgcaccuguguaugga

SEQ ID NO: 1549286 - RNA, 19 nt, Homo sapiens
gagcugggacugagcagau

SEQ ID NO: 1549287 - RNA, 19 nt, Homo sapiens
ugggauguauagagaaaga

SEQ ID NO: 1549288 - RNA, 19 nt, Homo sapiens
aucaaagccugcacaagaa

SEQ ID NO: 1549289 - RNA, 19 nt, Homo sapiens
ccugcaguguggaaaguuu

SEQ ID NO: 1549290 - RNA, 19 nt, Homo sapiens
gaagaaguggucugugacu

SEQ ID NO: 1549291 - RNA, 19 nt, Homo sapiens
ucacaggccaccauaucuu

SEQ ID NO: 1549292 - RNA, 19 nt, Homo sapiens
guauagagaaagacaccaa

SEQ ID NO: 1549293 - RNA, 19 nt, Homo sapiens
ucaaagccugcacaagaaa

SEQ ID NO: 1549294 - RNA, 19 nt, Homo sapiens
ggaggccuuuggaaacaag

SEQ ID NO: 1549295 - RNA, 19 nt, Homo sapiens
guuuauccuuugagauuca

SEQ ID NO: 1549296 - RNA, 19 nt, Homo sapiens
cgaacucugugggagaaga

SEQ ID NO: 1549297 - RNA, 19 nt, Homo sapiens
gcugggacugagcagauua

SEQ ID NO: 1549298 - RNA, 19 nt, Homo sapiens
ggcaagcgucgcccugaaa

SEQ ID NO: 1549299 - RNA, 19 nt, Homo sapiens
guucacaggccaccauauc

SEQ ID NO: 1549300 - RNA, 19 nt, Homo sapiens
gcccaaggaagauggaguu

SEQ ID NO: 1549301 - RNA, 19 nt, Homo sapiens
gagagaggugcccaaggaa

SEQ ID NO: 1549302 - RNA, 19 nt, Homo sapiens
caagugugcgcaaacuaau

SEQ ID NO: 1549303 - RNA, 19 nt, Homo sapiens
ugagacccaucacaaaugc

SEQ ID NO: 1549304 - RNA, 19 nt, Homo sapiens
gcuacuggguggaugaaaa

SEQ ID NO: 1549305 - RNA, 19 nt, Homo sapiens
gcccugaaacguccacaga

SEQ ID NO: 1549306 - RNA, 19 nt, Homo sapiens
aguagcugauauugacaua

SEQ ID NO: 1549307 - RNA, 19 nt, Homo sapiens
gccaccauaucuuacuuca

SEQ ID NO: 1549308 - RNA, 19 nt, Homo sapiens
gugcaacauuucggugaga

SEQ ID NO: 1549309 - RNA, 19 nt, Homo sapiens
agauggaguuggugaugug

SEQ ID NO: 1549310 - RNA, 19 nt, Homo sapiens
agcagaagauccugaugga

SEQ ID NO: 1549311 - RNA, 19 nt, Homo sapiens
gcgugugucuuccaaacca

SEQ ID NO: 1549312 - RNA, 19 nt, Homo sapiens
gcaaucccaggcucacaug

SEQ ID NO: 1549313 - RNA, 19 nt, Homo sapiens
ggguuucccuggcacucaa

SEQ ID NO: 1549314 - RNA, 19 nt, Homo sapiens
gcaggcaugucuguacacu

SEQ ID NO: 1549315 - RNA, 19 nt, Homo sapiens
agaagcuaaugaagaagug

SEQ ID NO: 1549316 - RNA, 19 nt, Homo sapiens
agaaucagcugcacaauua

SEQ ID NO: 1549317 - RNA, 19 nt, Homo sapiens
gacaagaaauucacaguca

SEQ ID NO: 1549318 - RNA, 19 nt, Homo sapiens
caauuagguuguugucaua

SEQ ID NO: 1549319 - RNA, 19 nt, Homo sapiens
ccaaggagcucccauuucu

SEQ ID NO: 1549320 - RNA, 19 nt, Homo sapiens
ggcaggaccagaacaauua

SEQ ID NO: 1549321 - RNA, 19 nt, Homo sapiens
gggcagcucuccaaucuca

SEQ ID NO: 1549322 - RNA, 19 nt, Homo sapiens
gaggacgccuugagcauga

SEQ ID NO: 1549323 - RNA, 19 nt, Homo sapiens
gcaaagcgggucccauuga

SEQ ID NO: 1549324 - RNA, 19 nt, Homo sapiens
gaaauucacagucaaguac

SEQ ID NO: 1549325 - RNA, 19 nt, Homo sapiens
ggaagaaucagcugcacaa

SEQ ID NO: 1549326 - RNA, 19 nt, Homo sapiens
agaaacacaugggcuauga

SEQ ID NO: 1549327 - RNA, 19 nt, Homo sapiens
gcagaccacuuccagacau

SEQ ID NO: 1549328 - RNA, 19 nt, Homo sapiens
gcaccgcagccuugccuua

SEQ ID NO: 1549329 - RNA, 19 nt, Homo sapiens
cagcaaagcgggucccauu

SEQ ID NO: 1549330 - RNA, 19 nt, Homo sapiens
aggaagaaaucacuggaaa

SEQ ID NO: 1549331 - RNA, 19 nt, Homo sapiens
cacccaaccuguucaccua

SEQ ID NO: 1549332 - RNA, 19 nt, Homo sapiens
gggcaggaccagaacaauu

SEQ ID NO: 1549333 - RNA, 19 nt, Homo sapiens
caaggaaagcccaugauca

SEQ ID NO: 1549334 - RNA, 19 nt, Homo sapiens
ugaggaaccugagcagaug

SEQ ID NO: 1549335 - RNA, 19 nt, Homo sapiens
ggauaugaaggaagaauca

SEQ ID NO: 1549336 - RNA, 19 nt, Homo sapiens
ucaaguacccacagaacaa

SEQ ID NO: 1549337 - RNA, 19 nt, Homo sapiens
ccaccgaugacaagaaauu

SEQ ID NO: 1549338 - RNA, 19 nt, Homo sapiens
gcaggaccagaacaauuaa

SEQ ID NO: 1549339 - RNA, 19 nt, Homo sapiens
ggcccuaccuucugaccaa

SEQ ID NO: 1549340 - RNA, 19 nt, Homo sapiens
ccagccuucuccucucaua

SEQ ID NO: 1549341 - RNA, 19 nt, Homo sapiens
caaagcgggucccauugag

SEQ ID NO: 1549342 - RNA, 19 nt, Homo sapiens
ucaacuccaucuccaagga

SEQ ID NO: 1549343 - RNA, 19 nt, Homo sapiens
acaagaaauucacagucaa

SEQ ID NO: 1549344 - RNA, 19 nt, Homo sapiens
guacgagugcaacauaugu

SEQ ID NO: 1549345 - RNA, 19 nt, Homo sapiens
caugaucaccagaguaaug

SEQ ID NO: 1549346 - RNA, 19 nt, Homo sapiens
accauggucuucuaacuga

SEQ ID NO: 1549347 - RNA, 19 nt, Homo sapiens
cauggcaucuccagcaaag

SEQ ID NO: 1549348 - RNA, 19 nt, Homo sapiens
agaaauucacagucaagua

SEQ ID NO: 1549349 - RNA, 19 nt, Homo sapiens
cccaugaucaccagaguaa

SEQ ID NO: 1549350 - RNA, 19 nt, Homo sapiens
uuauggcgguggcaucuga

SEQ ID NO: 1549351 - RNA, 19 nt, Homo sapiens
aagaaucagcugcacaauu

SEQ ID NO: 1549352 - RNA, 19 nt, Homo sapiens
gcccagccuucuccucuca

SEQ ID NO: 1549353 - RNA, 19 nt, Homo sapiens
caagaaauucacagucaag

SEQ ID NO: 1549354 - RNA, 19 nt, Homo sapiens
gagaaacacaugggcuaug

SEQ ID NO: 1549355 - RNA, 19 nt, Homo sapiens
ggcauggcaucuccagcaa

SEQ ID NO: 1549356 - RNA, 19 nt, Homo sapiens
cuccaccgaugacaagaaa

SEQ ID NO: 1549357 - RNA, 19 nt, Homo sapiens
gaagaaaucacuggaaaag

SEQ ID NO: 1549358 - RNA, 19 nt, Homo sapiens
ccuguacgagugcaacaua

SEQ ID NO: 1549359 - RNA, 19 nt, Homo sapiens
aaagaagaauggcaaaauc

SEQ ID NO: 1549360 - RNA, 19 nt, Homo sapiens
ccaagccucuggccaagcu

SEQ ID NO: 1549361 - RNA, 19 nt, Homo sapiens
ccaaggaaagcccaugauc

SEQ ID NO: 1549362 - RNA, 19 nt, Homo sapiens
ggcgguggcaucugagaaa

SEQ ID NO: 1549363 - RNA, 19 nt, Homo sapiens
caccaccgcugcagaacag

SEQ ID NO: 1549364 - RNA, 19 nt, Homo sapiens
aaacacaugggcuaugaca

SEQ ID NO: 1549365 - RNA, 19 nt, Homo sapiens
ggaagaaaucacuggaaaa

SEQ ID NO: 1549366 - RNA, 19 nt, Homo sapiens
acaaggacaagcugggaaa

SEQ ID NO: 1549367 - RNA, 19 nt, Homo sapiens
acagucaaguacccacaga

SEQ ID NO: 1549368 - RNA, 19 nt, Homo sapiens
gaagaaucagcugcacaau

SEQ ID NO: 1549369 - RNA, 19 nt, Homo sapiens
gggaaagcaagagcaguga

SEQ ID NO: 1549370 - RNA, 19 nt, Homo sapiens
cagaccacuuccagacaug

SEQ ID NO: 1549371 - RNA, 19 nt, Homo sapiens
uggccugccuugcccaaug

SEQ ID NO: 1549372 - RNA, 19 nt, Homo sapiens
gcauggcaucuccagcaaa

SEQ ID NO: 1549373 - RNA, 19 nt, Homo sapiens
caggaagaaaucacuggaa

SEQ ID NO: 1549374 - RNA, 19 nt, Homo sapiens
gcagcucuccaaucucaag

SEQ ID NO: 1549375 - RNA, 19 nt, Homo sapiens
aagcgggucccauugaguu

SEQ ID NO: 1549376 - RNA, 19 nt, Homo sapiens
gggaaaacagccagaaaga

SEQ ID NO: 1549377 - RNA, 19 nt, Homo sapiens
gcccaugaucaccagagua

SEQ ID NO: 1549378 - RNA, 19 nt, Homo sapiens
augccuagccugcugauga

SEQ ID NO: 1549379 - RNA, 19 nt, Homo sapiens
ccuaccuucugaccaaugu

SEQ ID NO: 1549380 - RNA, 19 nt, Homo sapiens
gaaagugucccauucauua

SEQ ID NO: 1549381 - RNA, 19 nt, Homo sapiens
ccaaagcucuaaauucguu

SEQ ID NO: 1549382 - RNA, 19 nt, Homo sapiens
ggagggagccugcuguaaa

SEQ ID NO: 1549383 - RNA, 19 nt, Homo sapiens
gcagagagcggauguuugu

SEQ ID NO: 1549384 - RNA, 19 nt, Homo sapiens
gcacaucggacaucaaaga

SEQ ID NO: 1549385 - RNA, 19 nt, Homo sapiens
ugacacugcuucuaaacuu

SEQ ID NO: 1549386 - RNA, 19 nt, Homo sapiens
gagcacaucggacaucaaa

SEQ ID NO: 1549387 - RNA, 19 nt, Homo sapiens
gaacaaaccaagaaaugag

SEQ ID NO: 1549388 - RNA, 19 nt, Homo sapiens
caucggacaucaaagaaau

SEQ ID NO: 1549389 - RNA, 19 nt, Homo sapiens
gcugaacacucccgucuca

SEQ ID NO: 1549390 - RNA, 19 nt, Homo sapiens
ggaaagugucccauucauu

SEQ ID NO: 1549391 - RNA, 19 nt, Homo sapiens
gaaaccagcccuccgaaca

SEQ ID NO: 1549392 - RNA, 19 nt, Homo sapiens
guucugagcuggcauuguc

SEQ ID NO: 1549393 - RNA, 19 nt, Homo sapiens
gagagcggauguuugugaa

SEQ ID NO: 1549394 - RNA, 19 nt, Homo sapiens
gagggagccugcuguaaag

SEQ ID NO: 1549395 - RNA, 19 nt, Homo sapiens
ccacagugcugaggaagga

SEQ ID NO: 1549396 - RNA, 19 nt, Homo sapiens
ggacugcugugggucuuga

SEQ ID NO: 1549397 - RNA, 19 nt, Homo sapiens
ucaaguaguaggacucuaa

SEQ ID NO: 1549398 - RNA, 19 nt, Homo sapiens
gugcuacugugcagaaaga

SEQ ID NO: 1549399 - RNA, 19 nt, Homo sapiens
gcugaggaaugcuucugaa

SEQ ID NO: 1549400 - RNA, 19 nt, Homo sapiens
gaaguucugagcuggcauu

SEQ ID NO: 1549401 - RNA, 19 nt, Homo sapiens
ugccaaagcucuaaauucg

SEQ ID NO: 1549402 - RNA, 19 nt, Homo sapiens
aaccagcccuccgaacaua

SEQ ID NO: 1549403 - RNA, 19 nt, Homo sapiens
gacacugcuucuaaacuug

SEQ ID NO: 1549404 - RNA, 19 nt, Homo sapiens
ggagaggaaacguguagga

SEQ ID NO: 1549405 - RNA, 19 nt, Homo sapiens
caagaacaaaccaagaaau

SEQ ID NO: 1549406 - RNA, 19 nt, Homo sapiens
ccugagauguggugcuuuc

SEQ ID NO: 1549407 - RNA, 19 nt, Homo sapiens
gcccuccgaacauaaauaa

SEQ ID NO: 1549408 - RNA, 19 nt, Homo sapiens
aagaacaaaccaagaaaug

SEQ ID NO: 1549409 - RNA, 19 nt, Homo sapiens
ucaagaacaaaccaagaaa

SEQ ID NO: 1549410 - RNA, 19 nt, Homo sapiens
agugucccauucauuauaa

SEQ ID NO: 1549411 - RNA, 19 nt, Homo sapiens
gcacaugacgcaggcuuca

SEQ ID NO: 1549412 - RNA, 19 nt, Homo sapiens
cgggacagauucucacagu

SEQ ID NO: 1549413 - RNA, 19 nt, Homo sapiens
cagcaauacagaauuacaa

SEQ ID NO: 1549414 - RNA, 19 nt, Homo sapiens
agaacaaaccaagaaauga

SEQ ID NO: 1549415 - RNA, 19 nt, Homo sapiens
gcaauacagaauuacaaca

SEQ ID NO: 1549416 - RNA, 19 nt, Homo sapiens
agagagcggauguuuguga

SEQ ID NO: 1549417 - RNA, 19 nt, Homo sapiens
aaacuccgugcaucccuua

SEQ ID NO: 1549418 - RNA, 19 nt, Homo sapiens
ucuugacacugcuucuaaa

SEQ ID NO: 1549419 - RNA, 19 nt, Homo sapiens
cuacugugcagaaagagaa

SEQ ID NO: 1549420 - RNA, 19 nt, Homo sapiens
uguaggacccgcugaggaa

SEQ ID NO: 1549421 - RNA, 19 nt, Homo sapiens
uugugaagcuccucuugga

SEQ ID NO: 1549422 - RNA, 19 nt, Homo sapiens
gggagggagccugcuguaa

SEQ ID NO: 1549423 - RNA, 19 nt, Homo sapiens
ggucuugacacugcuucua

SEQ ID NO: 1549424 - RNA, 19 nt, Homo sapiens
ggaauccauuuucaaguag

SEQ ID NO: 1549425 - RNA, 19 nt, Homo sapiens
aaagugucccauucauuau

SEQ ID NO: 1549426 - RNA, 19 nt, Homo sapiens
aagugucccauucauuaua

SEQ ID NO: 1549427 - RNA, 19 nt, Homo sapiens
ccagcccuccgaacauaaa

SEQ ID NO: 1549428 - RNA, 19 nt, Homo sapiens
gaaugucaauuuuccaaac

SEQ ID NO: 1549429 - RNA, 19 nt, Homo sapiens
acacugcuucuaaacuuga

SEQ ID NO: 1549430 - RNA, 19 nt, Homo sapiens
gucuugacacugcuucuaa

SEQ ID NO: 1549431 - RNA, 19 nt, Homo sapiens
ggucuaguauccccacaga

SEQ ID NO: 1549432 - RNA, 19 nt, Homo sapiens
cucaagaacaaaccaagaa

SEQ ID NO: 1549433 - RNA, 19 nt, Homo sapiens
gcccgugaguccuugaaac

SEQ ID NO: 1549434 - RNA, 19 nt, Homo sapiens
gaacugagacugaguauuc

SEQ ID NO: 1549435 - RNA, 19 nt, Homo sapiens
gcagaacacucaagagaug

SEQ ID NO: 1549436 - RNA, 19 nt, Homo sapiens
gaaagaaugucaucuacuc

SEQ ID NO: 1549437 - RNA, 19 nt, Homo sapiens
gaacaacaccauuugagaa

SEQ ID NO: 1549438 - RNA, 19 nt, Homo sapiens
gaggauaauuugccuaaug

SEQ ID NO: 1549439 - RNA, 19 nt, Homo sapiens
caacagccacguccacuua

SEQ ID NO: 1549440 - RNA, 19 nt, Homo sapiens
gcuauacccucaucaauca

SEQ ID NO: 1549441 - RNA, 19 nt, Homo sapiens
cgaggaagcuuuacucauc

SEQ ID NO: 1549442 - RNA, 19 nt, Homo sapiens
caaagucccuccagcuuau

SEQ ID NO: 1549443 - RNA, 19 nt, Homo sapiens
ccuacugacuuccaauuua

SEQ ID NO: 1549444 - RNA, 19 nt, Homo sapiens
caacaccauuugagaaaga

SEQ ID NO: 1549445 - RNA, 19 nt, Homo sapiens
cccauggucugguuaguua

SEQ ID NO: 1549446 - RNA, 19 nt, Homo sapiens
ccaguaugcuaaauagaaa

SEQ ID NO: 1549447 - RNA, 19 nt, Homo sapiens
gcucagagaggauaauuug

SEQ ID NO: 1549448 - RNA, 19 nt, Homo sapiens
cagacaauguuaagaagaa

SEQ ID NO: 1549449 - RNA, 19 nt, Homo sapiens
ugucugggaucuucuuaua

SEQ ID NO: 1549450 - RNA, 19 nt, Homo sapiens
cagaaucuccucucacuuu

SEQ ID NO: 1549451 - RNA, 19 nt, Homo sapiens
ggacugagaggaugggaaa

SEQ ID NO: 1549452 - RNA, 19 nt, Homo sapiens
gcucuaggccagauguuua

SEQ ID NO: 1549453 - RNA, 19 nt, Homo sapiens
gaaagcccucugcaauaua

SEQ ID NO: 1549454 - RNA, 19 nt, Homo sapiens
agaaagcccucugcaauau

SEQ ID NO: 1549455 - RNA, 19 nt, Homo sapiens
gaagaguacuaugagaaug

SEQ ID NO: 1549456 - RNA, 19 nt, Homo sapiens
gagaugccuuggaauguga

SEQ ID NO: 1549457 - RNA, 19 nt, Homo sapiens
uagaaagcccucugcaaua

SEQ ID NO: 1549458 - RNA, 19 nt, Homo sapiens
ucugggaucuucuuauaaa

SEQ ID NO: 1549459 - RNA, 19 nt, Homo sapiens
cagcuuaucucccacaaca

SEQ ID NO: 1549460 - RNA, 19 nt, Homo sapiens
ugaaguggcuggacuagca

SEQ ID NO: 1549461 - RNA, 19 nt, Homo sapiens
gagaggauaauuugccuaa

SEQ ID NO: 1549462 - RNA, 19 nt, Homo sapiens
cagaggagcugugcuauac

SEQ ID NO: 1549463 - RNA, 19 nt, Homo sapiens
gaggaagcuuuacucauca

SEQ ID NO: 1549464 - RNA, 19 nt, Homo sapiens
gaacuucucaugccucaca

SEQ ID NO: 1549465 - RNA, 19 nt, Homo sapiens
cuacaugguuuggagagua

SEQ ID NO: 1549466 - RNA, 19 nt, Homo sapiens
cccagaagaugaauaugaa

SEQ ID NO: 1549467 - RNA, 19 nt, Homo sapiens
caucagacaauguuaagaa

SEQ ID NO: 1549468 - RNA, 19 nt, Homo sapiens
gagccugauuuccuacuga

SEQ ID NO: 1549469 - RNA, 19 nt, Homo sapiens
aaagcccucugcaauauau

SEQ ID NO: 1549470 - RNA, 19 nt, Homo sapiens
aggauaauuugccuaauga

SEQ ID NO: 1549471 - RNA, 19 nt, Homo sapiens
acaaagucccuccagcuua

SEQ ID NO: 1549472 - RNA, 19 nt, Homo sapiens
cagcagaacacucaagaga

SEQ ID NO: 1549473 - RNA, 19 nt, Homo sapiens
cuacugacuuccaauuuag

SEQ ID NO: 1549474 - RNA, 19 nt, Homo sapiens
gggaucuucuuauaaagug

SEQ ID NO: 1549475 - RNA, 19 nt, Homo sapiens
gcagagcaugguuuguaua

SEQ ID NO: 1549476 - RNA, 19 nt, Homo sapiens
gcugaagaguacuaugaga

SEQ ID NO: 1549477 - RNA, 19 nt, Homo sapiens
cauuaaaguuaguggcaaa

SEQ ID NO: 1549478 - RNA, 19 nt, Homo sapiens
agacaauuaugccaucaga

SEQ ID NO: 1549479 - RNA, 19 nt, Homo sapiens
gaguauucacuucuacaua

SEQ ID NO: 1549480 - RNA, 19 nt, Homo sapiens
aaacagagaacauccagau

SEQ ID NO: 1549481 - RNA, 19 nt, Homo sapiens
ucucuaaagucacgaggaa

SEQ ID NO: 1549482 - RNA, 19 nt, Homo sapiens
uauaaaguguucccaugau

SEQ ID NO: 1549483 - RNA, 19 nt, Homo sapiens
gagacugaguauucacuuc

SEQ ID NO: 1549484 - RNA, 19 nt, Homo sapiens
gaggaacugagacugagua

SEQ ID NO: 1549485 - RNA, 19 nt, Homo sapiens
gugucuaagucaugucuuu

SEQ ID NO: 1549486 - RNA, 19 nt, Homo sapiens
guuuagcaccaacaaauaa

SEQ ID NO: 1549487 - RNA, 19 nt, Homo sapiens
ucucaugccucacagaauc

SEQ ID NO: 1549488 - RNA, 19 nt, Homo sapiens
caugaucauucucuaaagu

SEQ ID NO: 1549489 - RNA, 19 nt, Homo sapiens
gacugaguauucacuucua

SEQ ID NO: 1549490 - RNA, 19 nt, Homo sapiens
gcuuuacucaucauacuaa

SEQ ID NO: 1549491 - RNA, 19 nt, Homo sapiens
guauucacuucuacauaug

SEQ ID NO: 1549492 - RNA, 19 nt, Homo sapiens
ugagaauguucccugcaaa

SEQ ID NO: 1549493 - RNA, 19 nt, Homo sapiens
ucagaggagcugugcuaua

SEQ ID NO: 1549494 - RNA, 19 nt, Homo sapiens
ccauuuauccugaacaaca

SEQ ID NO: 1549495 - RNA, 19 nt, Homo sapiens
cacagaaucuccucucacu

SEQ ID NO: 1549496 - RNA, 19 nt, Homo sapiens
ugaacaacaccauuugaga

SEQ ID NO: 1549497 - RNA, 19 nt, Homo sapiens
gcugagagacccagagagu

SEQ ID NO: 1549498 - RNA, 19 nt, Homo sapiens
auagaaagcccucugcaau

SEQ ID NO: 1549499 - RNA, 19 nt, Homo sapiens
ggacuagcauuuguuuagc

SEQ ID NO: 1549500 - RNA, 19 nt, Homo sapiens
ccuuggagaucccguaauc

SEQ ID NO: 1549501 - RNA, 19 nt, Homo sapiens
ggaagcuuuacucaucaua

SEQ ID NO: 1549502 - RNA, 19 nt, Homo sapiens
ugaagaguacuaugagaau

SEQ ID NO: 1549503 - RNA, 19 nt, Homo sapiens
uaaaguguucccaugauca

SEQ ID NO: 1549504 - RNA, 19 nt, Homo sapiens
gcuggacuagcauuuguuu

SEQ ID NO: 1549505 - RNA, 19 nt, Homo sapiens
agagaugccuuggaaugug

SEQ ID NO: 1549506 - RNA, 19 nt, Homo sapiens
gggcucugcucuucugucu

SEQ ID NO: 1549507 - RNA, 19 nt, Homo sapiens
gagaaagagguaaccaucu

SEQ ID NO: 1549508 - RNA, 19 nt, Homo sapiens
cugcagagcaugguuugua

SEQ ID NO: 1549509 - RNA, 19 nt, Homo sapiens
cccaguaugcuaaauagaa

SEQ ID NO: 1549510 - RNA, 19 nt, Homo sapiens
acaauuaugccaucagaca

SEQ ID NO: 1549511 - RNA, 19 nt, Homo sapiens
uaagacaauuaugccauca

SEQ ID NO: 1549512 - RNA, 19 nt, Homo sapiens
agacucaguuuucccauuu

SEQ ID NO: 1549513 - RNA, 19 nt, Homo sapiens
gcaaaagccaaaaucuaaa

SEQ ID NO: 1549514 - RNA, 19 nt, Homo sapiens
gcaacagccacguccacuu

SEQ ID NO: 1549515 - RNA, 19 nt, Homo sapiens
gagaauguucccugcaaag

SEQ ID NO: 1549516 - RNA, 19 nt, Homo sapiens
ggagccugauuuccuacug

SEQ ID NO: 1549517 - RNA, 19 nt, Homo sapiens
uuuggagccugauuuccua

SEQ ID NO: 1549518 - RNA, 19 nt, Homo sapiens
uuacucaucauacuaagug

SEQ ID NO: 1549519 - RNA, 19 nt, Homo sapiens
aacaacaccauuugagaaa

SEQ ID NO: 1549520 - RNA, 19 nt, Homo sapiens
gcagggaugggacacaaag

SEQ ID NO: 1549521 - RNA, 19 nt, Homo sapiens
gacuagcauuuguuuagca

SEQ ID NO: 1549522 - RNA, 19 nt, Homo sapiens
cuacauaugccuucuacag

SEQ ID NO: 1549523 - RNA, 19 nt, Homo sapiens
aaucaucggguucucugua

SEQ ID NO: 1549524 - RNA, 19 nt, Homo sapiens
uuaauuuggagccugauuu

SEQ ID NO: 1549525 - RNA, 19 nt, Homo sapiens
gcaaagccccaaacagaga

SEQ ID NO: 1549526 - RNA, 19 nt, Homo sapiens
uacaugguuuggagaguau

SEQ ID NO: 1549527 - RNA, 19 nt, Homo sapiens
agaguacuaugagaauguu

SEQ ID NO: 1549528 - RNA, 19 nt, Homo sapiens
cugagaggaugggaaauuc

SEQ ID NO: 1549529 - RNA, 19 nt, Homo sapiens
ugaucauucucuaaaguca

SEQ ID NO: 1549530 - RNA, 19 nt, Homo sapiens
ccaugaucauucucuaaag

SEQ ID NO: 1549531 - RNA, 19 nt, Homo sapiens
uuauaaaguguucccauga

SEQ ID NO: 1549532 - RNA, 19 nt, Homo sapiens
aaccauuuauccugaacaa

SEQ ID NO: 1549533 - RNA, 19 nt, Homo sapiens
uauaccacaagcccucuua

SEQ ID NO: 1549534 - RNA, 19 nt, Homo sapiens
gaccaaagaugaacuacua

SEQ ID NO: 1549535 - RNA, 19 nt, Homo sapiens
uaacagacuucccaaauuu

SEQ ID NO: 1549536 - RNA, 19 nt, Homo sapiens
gaagaucuccuuuaacuuu

SEQ ID NO: 1549537 - RNA, 19 nt, Homo sapiens
guacuaagacugaguguua

SEQ ID NO: 1549538 - RNA, 19 nt, Homo sapiens
ggauaaugcuggccauaua

SEQ ID NO: 1549539 - RNA, 19 nt, Homo sapiens
gcagcaacguuucacauaa

SEQ ID NO: 1549540 - RNA, 19 nt, Homo sapiens
gaaauuacauaaccugaag

SEQ ID NO: 1549541 - RNA, 19 nt, Homo sapiens
ccagagcacuucacauaaa

SEQ ID NO: 1549542 - RNA, 19 nt, Homo sapiens
gacagaagguuacaggaaa

SEQ ID NO: 1549543 - RNA, 19 nt, Homo sapiens
ucacauaaacauccaguua

SEQ ID NO: 1549544 - RNA, 19 nt, Homo sapiens
guccagagaugaagauaaa

SEQ ID NO: 1549545 - RNA, 19 nt, Homo sapiens
aaacagaacccacuaacaa

SEQ ID NO: 1549546 - RNA, 19 nt, Homo sapiens
gaucagauucucccacuuu

SEQ ID NO: 1549547 - RNA, 19 nt, Homo sapiens
agaaagaacucggcaguga

SEQ ID NO: 1549548 - RNA, 19 nt, Homo sapiens
ccacaaugcugggcaacua

SEQ ID NO: 1549549 - RNA, 19 nt, Homo sapiens
cuaacagacuucccaaauu

SEQ ID NO: 1549550 - RNA, 19 nt, Homo sapiens
ggaaaucaguccgcaggaa

SEQ ID NO: 1549551 - RNA, 19 nt, Homo sapiens
gcuauggacuugccagaug

SEQ ID NO: 1549552 - RNA, 19 nt, Homo sapiens
aagaagaucuccuuuaacu

SEQ ID NO: 1549553 - RNA, 19 nt, Homo sapiens
gaagaaacagagauacaug

SEQ ID NO: 1549554 - RNA, 19 nt, Homo sapiens
uaaggcccauucuuuauug

SEQ ID NO: 1549555 - RNA, 19 nt, Homo sapiens
cagaauguaccuuuacuaa

SEQ ID NO: 1549556 - RNA, 19 nt, Homo sapiens
cuuugcagcucaucauuua

SEQ ID NO: 1549557 - RNA, 19 nt, Homo sapiens
uacauaaccugaagacaga

SEQ ID NO: 1549558 - RNA, 19 nt, Homo sapiens
uuacuaaggcccauucuuu

SEQ ID NO: 1549559 - RNA, 19 nt, Homo sapiens
ggacacugaugaugaggau

SEQ ID NO: 1549560 - RNA, 19 nt, Homo sapiens
caaagaugaacuacuauga

SEQ ID NO: 1549561 - RNA, 19 nt, Homo sapiens
ccuaaaccauuucuagcua

SEQ ID NO: 1549562 - RNA, 19 nt, Homo sapiens
cuacuugccucuaaaauaa

SEQ ID NO: 1549563 - RNA, 19 nt, Homo sapiens
acagugugauuucuucuaa

SEQ ID NO: 1549564 - RNA, 19 nt, Homo sapiens
gaaagaacucggcagugaa

SEQ ID NO: 1549565 - RNA, 19 nt, Homo sapiens
gaaacagagauacauguga

SEQ ID NO: 1549566 - RNA, 19 nt, Homo sapiens
ggaaucugcuuugcucuca

SEQ ID NO: 1549567 - RNA, 19 nt, Homo sapiens
uuaccagaauguaccuuua

SEQ ID NO: 1549568 - RNA, 19 nt, Homo sapiens
gcucaucauuuaccagaau

SEQ ID NO: 1549569 - RNA, 19 nt, Homo sapiens
gaacucugagcucaaacua

SEQ ID NO: 1549570 - RNA, 19 nt, Homo sapiens
gcgauauccugaacguuug

SEQ ID NO: 1549571 - RNA, 19 nt, Homo sapiens
gaaacagaacccacuaaca

SEQ ID NO: 1549572 - RNA, 19 nt, Homo sapiens
gaaaagaaccgaccugaca

SEQ ID NO: 1549573 - RNA, 19 nt, Homo sapiens
acaauucaguucagauuuc

SEQ ID NO: 1549574 - RNA, 19 nt, Homo sapiens
gcacugcgauauccugaac

SEQ ID NO: 1549575 - RNA, 19 nt, Homo sapiens
auagagaugcgccugauua

SEQ ID NO: 1549576 - RNA, 19 nt, Homo sapiens
gagaugcgccugauuaggu

SEQ ID NO: 1549577 - RNA, 19 nt, Homo sapiens
gaagauguuagaaauaugg

SEQ ID NO: 1549578 - RNA, 19 nt, Homo sapiens
ccuggaugcugaagauaaa

SEQ ID NO: 1549579 - RNA, 19 nt, Homo sapiens
gggcagagcacuagaaugc

SEQ ID NO: 1549580 - RNA, 19 nt, Homo sapiens
gauuaggucucaggaguca

SEQ ID NO: 1549581 - RNA, 19 nt, Homo sapiens
guuuaacgcgaacuauuua

SEQ ID NO: 1549582 - RNA, 19 nt, Homo sapiens
cagcaacguuucacauaag

SEQ ID NO: 1549583 - RNA, 19 nt, Homo sapiens
gagcucaaacuacuuagga

SEQ ID NO: 1549584 - RNA, 19 nt, Homo sapiens
gcacaggcuggaacucuga

SEQ ID NO: 1549585 - RNA, 19 nt, Homo sapiens
uuaagaaacaggaggcuaa

SEQ ID NO: 1549586 - RNA, 19 nt, Homo sapiens
aaagaacucggcagugaaa

SEQ ID NO: 1549587 - RNA, 19 nt, Homo sapiens
ggcagcaacguuucacaua

SEQ ID NO: 1549588 - RNA, 19 nt, Homo sapiens
cgaaguugauguucauuuu

SEQ ID NO: 1549589 - RNA, 19 nt, Homo sapiens
gcaggccuccgaaggguuu

SEQ ID NO: 1549590 - RNA, 19 nt, Homo sapiens
uacuaaggcccauucuuua

SEQ ID NO: 1549591 - RNA, 19 nt, Homo sapiens
gggcagccguguuccaaag

SEQ ID NO: 1549592 - RNA, 19 nt, Homo sapiens
ucagaacagugacaugaag

SEQ ID NO: 1549593 - RNA, 19 nt, Homo sapiens
cuucuaagauguuucuauc

SEQ ID NO: 1549594 - RNA, 19 nt, Homo sapiens
gcucaaacuacuuaggauu

SEQ ID NO: 1549595 - RNA, 19 nt, Homo sapiens
cuaccgaaguugauguuca

SEQ ID NO: 1549596 - RNA, 19 nt, Homo sapiens
ccugaacguuugaagaaau

SEQ ID NO: 1549597 - RNA, 19 nt, Homo sapiens
ccaaauuuccaguguugaa

SEQ ID NO: 1549598 - RNA, 19 nt, Homo sapiens
ucccaaauuuccaguguug

SEQ ID NO: 1549599 - RNA, 19 nt, Homo sapiens
uaaaccauuucuagcuaug

SEQ ID NO: 1549600 - RNA, 19 nt, Homo sapiens
cuaaaccauuucuagcuau

SEQ ID NO: 1549601 - RNA, 19 nt, Homo sapiens
caccucuacuugccucuaa

SEQ ID NO: 1549602 - RNA, 19 nt, Homo sapiens
cuaaggcccauucuuuauu

SEQ ID NO: 1549603 - RNA, 19 nt, Homo sapiens
gauaaugcuggccauauag

SEQ ID NO: 1549604 - RNA, 19 nt, Homo sapiens
ggauuuccaccacagugua

SEQ ID NO: 1549605 - RNA, 19 nt, Homo sapiens
agacagaagguuacaggaa

SEQ ID NO: 1549606 - RNA, 19 nt, Homo sapiens
gcaggaacacgaguaggaa

SEQ ID NO: 1549607 - RNA, 19 nt, Homo sapiens
uugaucaacuguacuaaca

SEQ ID NO: 1549608 - RNA, 19 nt, Homo sapiens
gacugaguguuauuuagau

SEQ ID NO: 1549609 - RNA, 19 nt, Homo sapiens
cugaacguuugaagaaauu

SEQ ID NO: 1549610 - RNA, 19 nt, Homo sapiens
ccuuuggccuaaaccauuu

SEQ ID NO: 1549611 - RNA, 19 nt, Homo sapiens
ggacugggcagagcacuag

SEQ ID NO: 1549612 - RNA, 19 nt, Homo sapiens
aaagcgggauggcugguau

SEQ ID NO: 1549613 - RNA, 19 nt, Homo sapiens
acacugaugaugaggauga

SEQ ID NO: 1549614 - RNA, 19 nt, Homo sapiens
cuauggacuugccagauga

SEQ ID NO: 1549615 - RNA, 19 nt, Homo sapiens
ccaaagaugaacuacuaug

SEQ ID NO: 1549616 - RNA, 19 nt, Homo sapiens
guucaugaccgucucuaug

SEQ ID NO: 1549617 - RNA, 19 nt, Homo sapiens
ccuaagcgguuuggaaucu

SEQ ID NO: 1549618 - RNA, 19 nt, Homo sapiens
agacugaguguuauuuaga

SEQ ID NO: 1549619 - RNA, 19 nt, Homo sapiens
gcccugaagauguuagaaa

SEQ ID NO: 1549620 - RNA, 19 nt, Homo sapiens
guguugaauuugaaugaga

SEQ ID NO: 1549621 - RNA, 19 nt, Homo sapiens
guaauaaugguacuaagac

SEQ ID NO: 1549622 - RNA, 19 nt, Homo sapiens
ccgaaggguuuaccugaca

SEQ ID NO: 1549623 - RNA, 19 nt, Homo sapiens
ucugagcucaaacuacuua

SEQ ID NO: 1549624 - RNA, 19 nt, Homo sapiens
acuaugaccaugcggauuu

SEQ ID NO: 1549625 - RNA, 19 nt, Homo sapiens
auccagagcacuucacaua

SEQ ID NO: 1549626 - RNA, 19 nt, Homo sapiens
guaggaacaccagggauga

SEQ ID NO: 1549627 - RNA, 19 nt, Homo sapiens
uauuguggaucccagaaga

SEQ ID NO: 1549628 - RNA, 19 nt, Homo sapiens
ccugaagauguuagaaaua

SEQ ID NO: 1549629 - RNA, 19 nt, Homo sapiens
ucucagaguucaaaguuuu

SEQ ID NO: 1549630 - RNA, 19 nt, Homo sapiens
acggagagaccaaagauga

SEQ ID NO: 1549631 - RNA, 19 nt, Homo sapiens
ugcgauauccugaacguuu

SEQ ID NO: 1549632 - RNA, 19 nt, Homo sapiens
gaccugacagugugauuuc

SEQ ID NO: 1549633 - RNA, 19 nt, Homo sapiens
guucaaaguuuuacuccaa

SEQ ID NO: 1549634 - RNA, 19 nt, Homo sapiens
gguaagcgcucaucauuaa

SEQ ID NO: 1549635 - RNA, 19 nt, Homo sapiens
gaaugagccuuguaauaua

SEQ ID NO: 1549636 - RNA, 19 nt, Homo sapiens
cgugaaagcucugaaauua

SEQ ID NO: 1549637 - RNA, 19 nt, Homo sapiens
gcaaguuccuccuaagaua

SEQ ID NO: 1549638 - RNA, 19 nt, Homo sapiens
ggaaugagccuuguaauau

SEQ ID NO: 1549639 - RNA, 19 nt, Homo sapiens
gaaaguaucacucaguuga

SEQ ID NO: 1549640 - RNA, 19 nt, Homo sapiens
caacuuugcuccuacuauu

SEQ ID NO: 1549641 - RNA, 19 nt, Homo sapiens
ucaguucccuguuucaaua

SEQ ID NO: 1549642 - RNA, 19 nt, Homo sapiens
gauccaaucugguacaguu

SEQ ID NO: 1549643 - RNA, 19 nt, Homo sapiens
gcaguggccugauaagaug

SEQ ID NO: 1549644 - RNA, 19 nt, Homo sapiens
ggaaccaacgucacucuua

SEQ ID NO: 1549645 - RNA, 19 nt, Homo sapiens
caacgucacucuuacuugu

SEQ ID NO: 1549646 - RNA, 19 nt, Homo sapiens
gcaugggugugccuucaua

SEQ ID NO: 1549647 - RNA, 19 nt, Homo sapiens
ggacauuuauggaauuaca

SEQ ID NO: 1549648 - RNA, 19 nt, Homo sapiens
cugaaccggucaaguauua

SEQ ID NO: 1549649 - RNA, 19 nt, Homo sapiens
ggacaauauuuggacauuu

SEQ ID NO: 1549650 - RNA, 19 nt, Homo sapiens
caacauacacccagaacaa

SEQ ID NO: 1549651 - RNA, 19 nt, Homo sapiens
ggacuacagccuccagaua

SEQ ID NO: 1549652 - RNA, 19 nt, Homo sapiens
aaaguccuaucaccuaaua

SEQ ID NO: 1549653 - RNA, 19 nt, Homo sapiens
ccagagugaucaaguuaaa

SEQ ID NO: 1549654 - RNA, 19 nt, Homo sapiens
aagagucaauccacauuua

SEQ ID NO: 1549655 - RNA, 19 nt, Homo sapiens
aaacgaauauugcagugaa

SEQ ID NO: 1549656 - RNA, 19 nt, Homo sapiens
caagauccauucucacugu

SEQ ID NO: 1549657 - RNA, 19 nt, Homo sapiens
cauacacuaucucuaagua

SEQ ID NO: 1549658 - RNA, 19 nt, Homo sapiens
gugaucaaguuaaaccaua

SEQ ID NO: 1549659 - RNA, 19 nt, Homo sapiens
gaaccaacgucacucuuac

SEQ ID NO: 1549660 - RNA, 19 nt, Homo sapiens
gaauguagaugugacagau

SEQ ID NO: 1549661 - RNA, 19 nt, Homo sapiens
caaguuaaaccauacacua

SEQ ID NO: 1549662 - RNA, 19 nt, Homo sapiens
gcugauggcuggauccaau

SEQ ID NO: 1549663 - RNA, 19 nt, Homo sapiens
ggccaacaaggaauuauua

SEQ ID NO: 1549664 - RNA, 19 nt, Homo sapiens
gauccucgaguuucaauuu

SEQ ID NO: 1549665 - RNA, 19 nt, Homo sapiens
ugaaagcucugaaauuacu

SEQ ID NO: 1549666 - RNA, 19 nt, Homo sapiens
ccucuuaacccuccaagua

SEQ ID NO: 1549667 - RNA, 19 nt, Homo sapiens
ggugugccuucauacaaua

SEQ ID NO: 1549668 - RNA, 19 nt, Homo sapiens
ggauggacaugaugcuguu

SEQ ID NO: 1549669 - RNA, 19 nt, Homo sapiens
ucuguagaauugcucauua

SEQ ID NO: 1549670 - RNA, 19 nt, Homo sapiens
gaugaucgccuucuguaga

SEQ ID NO: 1549671 - RNA, 19 nt, Homo sapiens
cugcuucucuuuccuguaa

SEQ ID NO: 1549672 - RNA, 19 nt, Homo sapiens
acaaaguccuaucaccuaa

SEQ ID NO: 1549673 - RNA, 19 nt, Homo sapiens
gaaagggcacaaaguccua

SEQ ID NO: 1549674 - RNA, 19 nt, Homo sapiens
gugcuuagguguuauuugg

SEQ ID NO: 1549675 - RNA, 19 nt, Homo sapiens
aaaccagagugaucaaguu

SEQ ID NO: 1549676 - RNA, 19 nt, Homo sapiens
gcucuucaauggccaacaa

SEQ ID NO: 1549677 - RNA, 19 nt, Homo sapiens
gaaccggucaaguauuauu

SEQ ID NO: 1549678 - RNA, 19 nt, Homo sapiens
caauccacauuuacaaaga

SEQ ID NO: 1549679 - RNA, 19 nt, Homo sapiens
ggacgcaguggccugauaa

SEQ ID NO: 1549680 - RNA, 19 nt, Homo sapiens
gcaauacaagcauucaguu

SEQ ID NO: 1549681 - RNA, 19 nt, Homo sapiens
gcuuagguguuauuuggaa

SEQ ID NO: 1549682 - RNA, 19 nt, Homo sapiens
gagcacuucggcaauuaua

SEQ ID NO: 1549683 - RNA, 19 nt, Homo sapiens
cggcggugcuuagguguua

SEQ ID NO: 1549684 - RNA, 19 nt, Homo sapiens
gcacaguccacucaaagga

SEQ ID NO: 1549685 - RNA, 19 nt, Homo sapiens
uacauuaccuugugaagca

SEQ ID NO: 1549686 - RNA, 19 nt, Homo sapiens
gggaugaucgccuucugua

SEQ ID NO: 1549687 - RNA, 19 nt, Homo sapiens
aaugcgagccugccucuua

SEQ ID NO: 1549688 - RNA, 19 nt, Homo sapiens
uggcugaaccggucaagua

SEQ ID NO: 1549689 - RNA, 19 nt, Homo sapiens
gugaugagagacaauuuaa

SEQ ID NO: 1549690 - RNA, 19 nt, Homo sapiens
gcauucaguucccuguuuc

SEQ ID NO: 1549691 - RNA, 19 nt, Homo sapiens
caggagcacuucggcaauu

SEQ ID NO: 1549692 - RNA, 19 nt, Homo sapiens
ccauacacguguucuguuc

SEQ ID NO: 1549693 - RNA, 19 nt, Homo sapiens
caccuaauauuacaagagu

SEQ ID NO: 1549694 - RNA, 19 nt, Homo sapiens
uaacgaaggagcuauugga

SEQ ID NO: 1549695 - RNA, 19 nt, Homo sapiens
aaccauacacuaucucuaa

SEQ ID NO: 1549696 - RNA, 19 nt, Homo sapiens
ccagaugugaggaaaguaa

SEQ ID NO: 1549697 - RNA, 19 nt, Homo sapiens
cgggagcgcugauguucuu

SEQ ID NO: 1549698 - RNA, 19 nt, Homo sapiens
aaccagagccuuucauuuc

SEQ ID NO: 1549699 - RNA, 19 nt, Homo sapiens
uaagcgcucaucauuaauu

SEQ ID NO: 1549700 - RNA, 19 nt, Homo sapiens
cacaaaguccuaucaccua

SEQ ID NO: 1549701 - RNA, 19 nt, Homo sapiens
guuaaaccauacacuaucu

SEQ ID NO: 1549702 - RNA, 19 nt, Homo sapiens
acaacaugauggucagaaa

SEQ ID NO: 1549703 - RNA, 19 nt, Homo sapiens
aggaaugagccuuguaaua

SEQ ID NO: 1549704 - RNA, 19 nt, Homo sapiens
cuuuaaggcugcaauacaa

SEQ ID NO: 1549705 - RNA, 19 nt, Homo sapiens
gugccuucauacaauaaua

SEQ ID NO: 1549706 - RNA, 19 nt, Homo sapiens
gggugugccuucauacaau

SEQ ID NO: 1549707 - RNA, 19 nt, Homo sapiens
gguugcaggcuguaguuua

SEQ ID NO: 1549708 - RNA, 19 nt, Homo sapiens
gcaguacacauuguccuuu

SEQ ID NO: 1549709 - RNA, 19 nt, Homo sapiens
aaagcagcgugggauauaa

SEQ ID NO: 1549710 - RNA, 19 nt, Homo sapiens
ccagagccuuucauuucuu

SEQ ID NO: 1549711 - RNA, 19 nt, Homo sapiens
guagcagaccaaucucuaa

SEQ ID NO: 1549712 - RNA, 19 nt, Homo sapiens
guauguagcagaccaaucu

SEQ ID NO: 1549713 - RNA, 19 nt, Homo sapiens
caaugggguuugagaauuu

SEQ ID NO: 1549714 - RNA, 19 nt, Homo sapiens
gauauucagguuucaggaa

SEQ ID NO: 1549715 - RNA, 19 nt, Homo sapiens
guagaauugcucauuaugu

SEQ ID NO: 1549716 - RNA, 19 nt, Homo sapiens
guacagcccaguauggaau

SEQ ID NO: 1549717 - RNA, 19 nt, Homo sapiens
gaugugucauucccagaug

SEQ ID NO: 1549718 - RNA, 19 nt, Homo sapiens
aaaccagagccuuucauuu

SEQ ID NO: 1549719 - RNA, 19 nt, Homo sapiens
guccuaucaccuaauauua

SEQ ID NO: 1549720 - RNA, 19 nt, Homo sapiens
ucaggaaugagccuuguaa

SEQ ID NO: 1549721 - RNA, 19 nt, Homo sapiens
gccuucagauuauuucuuc

SEQ ID NO: 1549722 - RNA, 19 nt, Homo sapiens
gcagaccaaucucuaaaau

SEQ ID NO: 1549723 - RNA, 19 nt, Homo sapiens
aagcgcucaucauuaauuu

SEQ ID NO: 1549724 - RNA, 19 nt, Homo sapiens
ccuaucaccuaauauuaca

SEQ ID NO: 1549725 - RNA, 19 nt, Homo sapiens
acaguccacucaaaggauu

SEQ ID NO: 1549726 - RNA, 19 nt, Homo sapiens
uaagagucaauccacauuu

SEQ ID NO: 1549727 - RNA, 19 nt, Homo sapiens
gugaagcaguacacauugu

SEQ ID NO: 1549728 - RNA, 19 nt, Homo sapiens
gcugguaccuuguguugac

SEQ ID NO: 1549729 - RNA, 19 nt, Homo sapiens
gcgcucaucauuaauuuua

SEQ ID NO: 1549730 - RNA, 19 nt, Homo sapiens
gcucugaaauuacuuuuag

SEQ ID NO: 1549731 - RNA, 19 nt, Homo sapiens
gucaguggauccucgaguu

SEQ ID NO: 1549732 - RNA, 19 nt, Homo sapiens
guacaaaggagagaagaag

SEQ ID NO: 1549733 - RNA, 19 nt, Homo sapiens
ugacaucucaaaugauaug

SEQ ID NO: 1549734 - RNA, 19 nt, Homo sapiens
gaagcgaggugaaagaaug

SEQ ID NO: 1549735 - RNA, 19 nt, Homo sapiens
gggaacaaaugcauagaaa

SEQ ID NO: 1549736 - RNA, 19 nt, Homo sapiens
gcagguggguucuugaugu

SEQ ID NO: 1549737 - RNA, 19 nt, Homo sapiens
uaacauacagcacuuagaa

SEQ ID NO: 1549738 - RNA, 19 nt, Homo sapiens
ucaaugacacggcaaagua

SEQ ID NO: 1549739 - RNA, 19 nt, Homo sapiens
gcccaugucugcgauguaa

SEQ ID NO: 1549740 - RNA, 19 nt, Homo sapiens
gcuauaacgagguaacaua

SEQ ID NO: 1549741 - RNA, 19 nt, Homo sapiens
gaauuauggugacgguaga

SEQ ID NO: 1549742 - RNA, 19 nt, Homo sapiens
gaagaaggugauucagauu

SEQ ID NO: 1549743 - RNA, 19 nt, Homo sapiens
gaacugagaacaccagcau

SEQ ID NO: 1549744 - RNA, 19 nt, Homo sapiens
gaauggcgcuccguugagu

SEQ ID NO: 1549745 - RNA, 19 nt, Homo sapiens
caaaugaagcgaggugaaa

SEQ ID NO: 1549746 - RNA, 19 nt, Homo sapiens
gagguaacauacagcacuu

SEQ ID NO: 1549747 - RNA, 19 nt, Homo sapiens
caaugacacggcaaaguaa

SEQ ID NO: 1549748 - RNA, 19 nt, Homo sapiens
gggaauggcgcuccguuga

SEQ ID NO: 1549749 - RNA, 19 nt, Homo sapiens
cggaagagcccaggauauu

SEQ ID NO: 1549750 - RNA, 19 nt, Homo sapiens
agaaggugauucagauuca

SEQ ID NO: 1549751 - RNA, 19 nt, Homo sapiens
gcauacaugggaacaaaug

SEQ ID NO: 1549752 - RNA, 19 nt, Homo sapiens
cagagcagguggguucuug

SEQ ID NO: 1549753 - RNA, 19 nt, Homo sapiens
ugaaucagcguuagcaugu

SEQ ID NO: 1549754 - RNA, 19 nt, Homo sapiens
ggaagagcccaggauauuc

SEQ ID NO: 1549755 - RNA, 19 nt, Homo sapiens
gguggguucuugaugucua

SEQ ID NO: 1549756 - RNA, 19 nt, Homo sapiens
gaagagcccaggauauucg

SEQ ID NO: 1549757 - RNA, 19 nt, Homo sapiens
ugacccagaauaacacuaa

SEQ ID NO: 1549758 - RNA, 19 nt, Homo sapiens
cgguagaaauggacuggaa

SEQ ID NO: 1549759 - RNA, 19 nt, Homo sapiens
caaaguaaaacccaaauga

SEQ ID NO: 1549760 - RNA, 19 nt, Homo sapiens
uagccgguaucuacugaaa

SEQ ID NO: 1549761 - RNA, 19 nt, Homo sapiens
ugauucagauucagacaca

SEQ ID NO: 1549762 - RNA, 19 nt, Homo sapiens
gcaaaacugcaccacguua

SEQ ID NO: 1549763 - RNA, 19 nt, Homo sapiens
uaacaguucccuccucaca

SEQ ID NO: 1549764 - RNA, 19 nt, Homo sapiens
caaaaucaauagccgguau

SEQ ID NO: 1549765 - RNA, 19 nt, Homo sapiens
agacugcuaaugcuacuaa

SEQ ID NO: 1549766 - RNA, 19 nt, Homo sapiens
gagcaacgcacagcacauc

SEQ ID NO: 1549767 - RNA, 19 nt, Homo sapiens
ggaagcaggaaggaacuga

SEQ ID NO: 1549768 - RNA, 19 nt, Homo sapiens
gccgguaucuacugaaacu

SEQ ID NO: 1549769 - RNA, 19 nt, Homo sapiens
aauagccgguaucuacuga

SEQ ID NO: 1549770 - RNA, 19 nt, Homo sapiens
cggcggucaucauuuauuc

SEQ ID NO: 1549771 - RNA, 19 nt, Homo sapiens
acauacagcacuuagaaga

SEQ ID NO: 1549772 - RNA, 19 nt, Homo sapiens
cuaaugcuacuaacaguuc

SEQ ID NO: 1549773 - RNA, 19 nt, Homo sapiens
aaacgggcauuucccaaaa

SEQ ID NO: 1549774 - RNA, 19 nt, Homo sapiens
gaugucuacucugcaugaa

SEQ ID NO: 1549775 - RNA, 19 nt, Homo sapiens
ccaaaugaagcgaggugaa

SEQ ID NO: 1549776 - RNA, 19 nt, Homo sapiens
augcauacaugggaacaaa

SEQ ID NO: 1549777 - RNA, 19 nt, Homo sapiens
ccucacagggucgcuauaa

SEQ ID NO: 1549778 - RNA, 19 nt, Homo sapiens
gcacagcggagccaaaaug

SEQ ID NO: 1549779 - RNA, 19 nt, Homo sapiens
agaaauggacuggaagguu

SEQ ID NO: 1549780 - RNA, 19 nt, Homo sapiens
gaaucagcguuagcaugug

SEQ ID NO: 1549781 - RNA, 19 nt, Homo sapiens
ggccugacccagaauaaca

SEQ ID NO: 1549782 - RNA, 19 nt, Homo sapiens
gcuaaugcuacuaacaguu

SEQ ID NO: 1549783 - RNA, 19 nt, Homo sapiens
aagacggccugacccagaa

SEQ ID NO: 1549784 - RNA, 19 nt, Homo sapiens
gagcagguggguucuugau

SEQ ID NO: 1549785 - RNA, 19 nt, Homo sapiens
gagcccaugucugcgaugu

SEQ ID NO: 1549786 - RNA, 19 nt, Homo sapiens
cggaggaugggcaggauuu

SEQ ID NO: 1549787 - RNA, 19 nt, Homo sapiens
gcgccuaacggcagggauu

SEQ ID NO: 1549788 - RNA, 19 nt, Homo sapiens
gaaggugauucagauucag

SEQ ID NO: 1549789 - RNA, 19 nt, Homo sapiens
cgaagaggaugggaaaaug

SEQ ID NO: 1549790 - RNA, 19 nt, Homo sapiens
cauuuauucuuggcgcuaa

SEQ ID NO: 1549791 - RNA, 19 nt, Homo sapiens
guaacauacagcacuuaga

SEQ ID NO: 1549792 - RNA, 19 nt, Homo sapiens
gcggucaucauuuauucuu

SEQ ID NO: 1549793 - RNA, 19 nt, Homo sapiens
caacgcacagcacaucaca

SEQ ID NO: 1549794 - RNA, 19 nt, Homo sapiens
ggaauggcgcuccguugag

SEQ ID NO: 1549795 - RNA, 19 nt, Homo sapiens
gacccagaauaacacuaau

SEQ ID NO: 1549796 - RNA, 19 nt, Homo sapiens
gccaagaccugcgccuaac

SEQ ID NO: 1549797 - RNA, 19 nt, Homo sapiens
gguaacauacagcacuuag

SEQ ID NO: 1549798 - RNA, 19 nt, Homo sapiens
uauggugacgguagaaaug

SEQ ID NO: 1549799 - RNA, 19 nt, Homo sapiens
gcaggaaggaacugagaac

SEQ ID NO: 1549800 - RNA, 19 nt, Homo sapiens
ugaugucuacucugcauga

SEQ ID NO: 1549801 - RNA, 19 nt, Homo sapiens
ugccaagaccugcgccuaa

SEQ ID NO: 1549802 - RNA, 19 nt, Homo sapiens
gggucgcuauaacgaggua

SEQ ID NO: 1549803 - RNA, 19 nt, Homo sapiens
ucagacacaggaauuaugg

SEQ ID NO: 1549804 - RNA, 19 nt, Homo sapiens
cagguggguucuugauguc

SEQ ID NO: 1549805 - RNA, 19 nt, Homo sapiens
caugggaacaaaugcauag

SEQ ID NO: 1549806 - RNA, 19 nt, Homo sapiens
ggaacaaaugcauagaaaa

SEQ ID NO: 1549807 - RNA, 19 nt, Homo sapiens
cagcggagccaaaauguau

SEQ ID NO: 1549808 - RNA, 19 nt, Homo sapiens
caauagccgguaucuacug

SEQ ID NO: 1549809 - RNA, 19 nt, Homo sapiens
auaacgagguaacauacag

SEQ ID NO: 1549810 - RNA, 19 nt, Homo sapiens
gcacagaguuuaauugaaa

SEQ ID NO: 1549811 - RNA, 19 nt, Homo sapiens
gcacaaaucagucguguua

SEQ ID NO: 1549812 - RNA, 19 nt, Homo sapiens
gaagaaauguggaacugaa

SEQ ID NO: 1549813 - RNA, 19 nt, Homo sapiens
gaauauaaguugcuucaug

SEQ ID NO: 1549814 - RNA, 19 nt, Homo sapiens
gauagaagaugaagaagga

SEQ ID NO: 1549815 - RNA, 19 nt, Homo sapiens
caaagugugugaauuauga

SEQ ID NO: 1549816 - RNA, 19 nt, Homo sapiens
gcacaugauucaccaauau

SEQ ID NO: 1549817 - RNA, 19 nt, Homo sapiens
ggucuucaguucuuacuua

SEQ ID NO: 1549818 - RNA, 19 nt, Homo sapiens
guacauguaucucugaauu

SEQ ID NO: 1549819 - RNA, 19 nt, Homo sapiens
gcacacagguucuaaugga

SEQ ID NO: 1549820 - RNA, 19 nt, Homo sapiens
gaaaugaaauaaccagcaa

SEQ ID NO: 1549821 - RNA, 19 nt, Homo sapiens
ucaaucagcucaugaagaa

SEQ ID NO: 1549822 - RNA, 19 nt, Homo sapiens
gagcuuucauguacauuua

SEQ ID NO: 1549823 - RNA, 19 nt, Homo sapiens
ccacagagcaauagaauuu

SEQ ID NO: 1549824 - RNA, 19 nt, Homo sapiens
gaccacaucucacaaagaa

SEQ ID NO: 1549825 - RNA, 19 nt, Homo sapiens
agacagaaauccagaauau

SEQ ID NO: 1549826 - RNA, 19 nt, Homo sapiens
ugaguaggcuuauaccaua

SEQ ID NO: 1549827 - RNA, 19 nt, Homo sapiens
ggagaaccuuucagcauuu

SEQ ID NO: 1549828 - RNA, 19 nt, Homo sapiens
gaaaucacauuaucaaggu

SEQ ID NO: 1549829 - RNA, 19 nt, Homo sapiens
gaaaggaguauuacauuga

SEQ ID NO: 1549830 - RNA, 19 nt, Homo sapiens
gaagaaggaauauaaguug

SEQ ID NO: 1549831 - RNA, 19 nt, Homo sapiens
ggacugugcugaaucucua

SEQ ID NO: 1549832 - RNA, 19 nt, Homo sapiens
ugaaauugcugaauaagga

SEQ ID NO: 1549833 - RNA, 19 nt, Homo sapiens
gcacgagucuuugaccuuu

SEQ ID NO: 1549834 - RNA, 19 nt, Homo sapiens
guaaagugguguuagugua

SEQ ID NO: 1549835 - RNA, 19 nt, Homo sapiens
gcaacaaacuggcaagcuu

SEQ ID NO: 1549836 - RNA, 19 nt, Homo sapiens
cagcaucucuacagcuuua

SEQ ID NO: 1549837 - RNA, 19 nt, Homo sapiens
uggaagagcuaaauaaaug

SEQ ID NO: 1549838 - RNA, 19 nt, Homo sapiens
gaaaggucuucaguucuua

SEQ ID NO: 1549839 - RNA, 19 nt, Homo sapiens
gaaggacugucaccucuau

SEQ ID NO: 1549840 - RNA, 19 nt, Homo sapiens
acaaagaaaucucguaugu

SEQ ID NO: 1549841 - RNA, 19 nt, Homo sapiens
gcacaucgacagcuaguuu

SEQ ID NO: 1549842 - RNA, 19 nt, Homo sapiens
ggaagaggaugaagaugau

SEQ ID NO: 1549843 - RNA, 19 nt, Homo sapiens
uaccauaacuuuacaccua

SEQ ID NO: 1549844 - RNA, 19 nt, Homo sapiens
ggcccaugcuuauaauuua

SEQ ID NO: 1549845 - RNA, 19 nt, Homo sapiens
gaacaggagucuuuugaaa

SEQ ID NO: 1549846 - RNA, 19 nt, Homo sapiens
caacggaacaggagucuuu

SEQ ID NO: 1549847 - RNA, 19 nt, Homo sapiens
aaagaaaucucguaugucu

SEQ ID NO: 1549848 - RNA, 19 nt, Homo sapiens
ggagaaaucgcaguaaauu

SEQ ID NO: 1549849 - RNA, 19 nt, Homo sapiens
guaaacaguuaacuccaaa

SEQ ID NO: 1549850 - RNA, 19 nt, Homo sapiens
gcaguaauacaacuccuua

SEQ ID NO: 1549851 - RNA, 19 nt, Homo sapiens
gaugauagaagaugaagaa

SEQ ID NO: 1549852 - RNA, 19 nt, Homo sapiens
caaggucacuguccagcua

SEQ ID NO: 1549853 - RNA, 19 nt, Homo sapiens
gaagaggauauaugugaua

SEQ ID NO: 1549854 - RNA, 19 nt, Homo sapiens
gggaaagaauuacaaggaa

SEQ ID NO: 1549855 - RNA, 19 nt, Homo sapiens
gaaccuaucaucauaagug

SEQ ID NO: 1549856 - RNA, 19 nt, Homo sapiens
ggaagaaggaauauaaguu

SEQ ID NO: 1549857 - RNA, 19 nt, Homo sapiens
aaagagaggcugucaauug

SEQ ID NO: 1549858 - RNA, 19 nt, Homo sapiens
cgaaaggaguauuacauug

SEQ ID NO: 1549859 - RNA, 19 nt, Homo sapiens
agaauuaacucuucagcuu

SEQ ID NO: 1549860 - RNA, 19 nt, Homo sapiens
acaguuaacuccaaauaga

SEQ ID NO: 1549861 - RNA, 19 nt, Homo sapiens
gagaaccuuucagcauuua

SEQ ID NO: 1549862 - RNA, 19 nt, Homo sapiens
cacagaagcuccauuaagu

SEQ ID NO: 1549863 - RNA, 19 nt, Homo sapiens
agagaaaggucuucaguuc

SEQ ID NO: 1549864 - RNA, 19 nt, Homo sapiens
gaaauggcccagcguuuga

SEQ ID NO: 1549865 - RNA, 19 nt, Homo sapiens
guacugcguucagaauuaa

SEQ ID NO: 1549866 - RNA, 19 nt, Homo sapiens
ugaaacggaugcugaaaug

SEQ ID NO: 1549867 - RNA, 19 nt, Homo sapiens
aauaaggaguagcuuguua

SEQ ID NO: 1549868 - RNA, 19 nt, Homo sapiens
ggaccuccaucucguaaug

SEQ ID NO: 1549869 - RNA, 19 nt, Homo sapiens
gccagaagcuaguaagaga

SEQ ID NO: 1549870 - RNA, 19 nt, Homo sapiens
uccaugagcuucaaagaaa

SEQ ID NO: 1549871 - RNA, 19 nt, Homo sapiens
gcaggcauucauauuauua

SEQ ID NO: 1549872 - RNA, 19 nt, Homo sapiens
gcagaacaggauauaguua

SEQ ID NO: 1549873 - RNA, 19 nt, Homo sapiens
gucugaaacucuacuauaa

SEQ ID NO: 1549874 - RNA, 19 nt, Homo sapiens
ggugaaauguuagaagauu

SEQ ID NO: 1549875 - RNA, 19 nt, Homo sapiens
gaagagacuguugguauuu

SEQ ID NO: 1549876 - RNA, 19 nt, Homo sapiens
ggcaagauguauuagauau

SEQ ID NO: 1549877 - RNA, 19 nt, Homo sapiens
gaaauaaccagcaacuaca

SEQ ID NO: 1549878 - RNA, 19 nt, Homo sapiens
gauguaccaccuucuaaua

SEQ ID NO: 1549879 - RNA, 19 nt, Homo sapiens
uaagagagguaauguguac

SEQ ID NO: 1549880 - RNA, 19 nt, Homo sapiens
uuguaaagcugaugaauug

SEQ ID NO: 1549881 - RNA, 19 nt, Homo sapiens
caaagaaagaugugauuga

SEQ ID NO: 1549882 - RNA, 19 nt, Homo sapiens
gaaagaauuacaaggaaga

SEQ ID NO: 1549883 - RNA, 19 nt, Homo sapiens
gaaacaaacacaucagcaa

SEQ ID NO: 1549884 - RNA, 19 nt, Homo sapiens
ggcagcagcuucauuggaa

SEQ ID NO: 1549885 - RNA, 19 nt, Homo sapiens
ccaccuaccuugcgugaug

SEQ ID NO: 1549886 - RNA, 19 nt, Homo sapiens
gcugagagaaguaucuaua

SEQ ID NO: 1549887 - RNA, 19 nt, Homo sapiens
uaacuaauuuggagaaguc

SEQ ID NO: 1549888 - RNA, 19 nt, Homo sapiens
ugauaaagcuguugcuaca

SEQ ID NO: 1549889 - RNA, 19 nt, Homo sapiens
gcacuucaauggaucucuu

SEQ ID NO: 1549890 - RNA, 19 nt, Homo sapiens
aagaaggacugguggauga

SEQ ID NO: 1549891 - RNA, 19 nt, Homo sapiens
guggaggucugcaaagaaa

SEQ ID NO: 1549892 - RNA, 19 nt, Homo sapiens
gcaguugcuugguggaauu

SEQ ID NO: 1549893 - RNA, 19 nt, Homo sapiens
ggucugaaacucuacuaua

SEQ ID NO: 1549894 - RNA, 19 nt, Homo sapiens
gaaggcccaugcuuauaau

SEQ ID NO: 1549895 - RNA, 19 nt, Homo sapiens
gaaaucucguaugucuuua

SEQ ID NO: 1549896 - RNA, 19 nt, Homo sapiens
gaauaugcaugaggacaga

SEQ ID NO: 1549897 - RNA, 19 nt, Homo sapiens
gaaggaauauaaguugcuu

SEQ ID NO: 1549898 - RNA, 19 nt, Homo sapiens
caaauggaagagcuaaaua

SEQ ID NO: 1549899 - RNA, 19 nt, Homo sapiens
cagcagaauuguacagaga

SEQ ID NO: 1549900 - RNA, 19 nt, Homo sapiens
uggaagagcugcugacauc

SEQ ID NO: 1549901 - RNA, 19 nt, Homo sapiens
gagcaacucugaucaucuc

SEQ ID NO: 1549902 - RNA, 19 nt, Homo sapiens
gaaccagugucaacaagag

SEQ ID NO: 1549903 - RNA, 19 nt, Homo sapiens
uaacugauguugcuauguc

SEQ ID NO: 1549904 - RNA, 19 nt, Homo sapiens
agaaaucgcaguaaauuga

SEQ ID NO: 1549905 - RNA, 19 nt, Homo sapiens
caggagaaaucgcaguaaa

SEQ ID NO: 1549906 - RNA, 19 nt, Homo sapiens
ggaagaggauauaugugau

SEQ ID NO: 1549907 - RNA, 19 nt, Homo sapiens
ugacagcugugaaagaaau

SEQ ID NO: 1549908 - RNA, 19 nt, Homo sapiens
agaagagacuguugguauu

SEQ ID NO: 1549909 - RNA, 19 nt, Homo sapiens
cauggaagaaggaauauaa

SEQ ID NO: 1549910 - RNA, 19 nt, Homo sapiens
gaagagacauccugaccaa

SEQ ID NO: 1549911 - RNA, 19 nt, Homo sapiens
agacacagcuggcagaaau

SEQ ID NO: 1549912 - RNA, 19 nt, Homo sapiens
gugcuguccugcuuuauuu

SEQ ID NO: 1549913 - RNA, 19 nt, Homo sapiens
caacagugugcaaguaaua

SEQ ID NO: 1549914 - RNA, 19 nt, Homo sapiens
gaccaacagugugcaagua

SEQ ID NO: 1549915 - RNA, 19 nt, Homo sapiens
cagacgaccugcaguggua

SEQ ID NO: 1549916 - RNA, 19 nt, Homo sapiens
ggacaagaccgaacugcuu

SEQ ID NO: 1549917 - RNA, 19 nt, Homo sapiens
uugaacagcugaagauuga

SEQ ID NO: 1549918 - RNA, 19 nt, Homo sapiens
ggcaaggacucacuucuuc

SEQ ID NO: 1549919 - RNA, 19 nt, Homo sapiens
ggaacgaaaugaggaacuu

SEQ ID NO: 1549920 - RNA, 19 nt, Homo sapiens
aaccaaaccuucaaugaga

SEQ ID NO: 1549921 - RNA, 19 nt, Homo sapiens
gacgugcuguccugcuuua

SEQ ID NO: 1549922 - RNA, 19 nt, Homo sapiens
gaaccaaaccuucaaugag

SEQ ID NO: 1549923 - RNA, 19 nt, Homo sapiens
gggaagcgccucuauggaa

SEQ ID NO: 1549924 - RNA, 19 nt, Homo sapiens
gaacagcugaagauugaga

SEQ ID NO: 1549925 - RNA, 19 nt, Homo sapiens
uggaggagcugaagaagca

SEQ ID NO: 1549926 - RNA, 19 nt, Homo sapiens
gcagaggcgugaggcagaa

SEQ ID NO: 1549927 - RNA, 19 nt, Homo sapiens
gcagcaaggugaccaacag

SEQ ID NO: 1549928 - RNA, 19 nt, Homo sapiens
gaacgaaaugaggaacuuu

SEQ ID NO: 1549929 - RNA, 19 nt, Homo sapiens
gaugagaagagucugcaaa

SEQ ID NO: 1549930 - RNA, 19 nt, Homo sapiens
uaccuucguugcuauuaaa

SEQ ID NO: 1549931 - RNA, 19 nt, Homo sapiens
gcaaggugaccaacagugu

SEQ ID NO: 1549932 - RNA, 19 nt, Homo sapiens
ccagaucgaugagaagagu

SEQ ID NO: 1549933 - RNA, 19 nt, Homo sapiens
uuaccuucguugcuauuaa

SEQ ID NO: 1549934 - RNA, 19 nt, Homo sapiens
ccaacagugugcaaguaau

SEQ ID NO: 1549935 - RNA, 19 nt, Homo sapiens
gaagaucagggaggccaaa

SEQ ID NO: 1549936 - RNA, 19 nt, Homo sapiens
agagacauccugaccaaga

SEQ ID NO: 1549937 - RNA, 19 nt, Homo sapiens
agcagagccuggugcauuu

SEQ ID NO: 1549938 - RNA, 19 nt, Homo sapiens
aagcagagccuggugcauu

SEQ ID NO: 1549939 - RNA, 19 nt, Homo sapiens
uaauaacccacgugaagga

SEQ ID NO: 1549940 - RNA, 19 nt, Homo sapiens
agaaccaaaccuucaauga

SEQ ID NO: 1549941 - RNA, 19 nt, Homo sapiens
gagaaccaaaccuucaaug

SEQ ID NO: 1549942 - RNA, 19 nt, Homo sapiens
agaagcagguggugaugca

SEQ ID NO: 1549943 - RNA, 19 nt, Homo sapiens
ucaagaagcagguggugau

SEQ ID NO: 1549944 - RNA, 19 nt, Homo sapiens
ucccagcgcuacaaccuau

SEQ ID NO: 1549945 - RNA, 19 nt, Homo sapiens
gaaaauugaggaacgaaau

SEQ ID NO: 1549946 - RNA, 19 nt, Homo sapiens
cagggucugcuucuuauug

SEQ ID NO: 1549947 - RNA, 19 nt, Homo sapiens
cccagggucugcuucuuau

SEQ ID NO: 1549948 - RNA, 19 nt, Homo sapiens
gagaagagucugcaaaaca

SEQ ID NO: 1549949 - RNA, 19 nt, Homo sapiens
ggacggacaacaucagacu

SEQ ID NO: 1549950 - RNA, 19 nt, Homo sapiens
gaggaacuuuuaaaacuuc

SEQ ID NO: 1549951 - RNA, 19 nt, Homo sapiens
gaccagaucgaugagaaga

SEQ ID NO: 1549952 - RNA, 19 nt, Homo sapiens
gggaggaagaggacaagga

SEQ ID NO: 1549953 - RNA, 19 nt, Homo sapiens
gagacauccugaccaagac

SEQ ID NO: 1549954 - RNA, 19 nt, Homo sapiens
aagccuuucucccuucuug

SEQ ID NO: 1549955 - RNA, 19 nt, Homo sapiens
gaccaggaucgaugaggaa

SEQ ID NO: 1549956 - RNA, 19 nt, Homo sapiens
ccaaaccuucaaugagaaa

SEQ ID NO: 1549957 - RNA, 19 nt, Homo sapiens
ccgaggagguccagaagcu

SEQ ID NO: 1549958 - RNA, 19 nt, Homo sapiens
ggagagggauggggaagga

SEQ ID NO: 1549959 - RNA, 19 nt, Homo sapiens
ccaccacgcuagccucacu

SEQ ID NO: 1549960 - RNA, 19 nt, Homo sapiens
aguaauaacccacgugaag

SEQ ID NO: 1549961 - RNA, 19 nt, Homo sapiens
augggcagcugucggauga

SEQ ID NO: 1549962 - RNA, 19 nt, Homo sapiens
caggaucgaugaggaagag

SEQ ID NO: 1549963 - RNA, 19 nt, Homo sapiens
uaacccacgugaaggaaaa

SEQ ID NO: 1549964 - RNA, 19 nt, Homo sapiens
gcugaagauugagaaccaa

SEQ ID NO: 1549965 - RNA, 19 nt, Homo sapiens
gguccgaggagguccagaa

SEQ ID NO: 1549966 - RNA, 19 nt, Homo sapiens
agggucugcuucuuauuga

SEQ ID NO: 1549967 - RNA, 19 nt, Homo sapiens
ugcgagagguggagcagau

SEQ ID NO: 1549968 - RNA, 19 nt, Homo sapiens
aaaggccugugucauuugg

SEQ ID NO: 1549969 - RNA, 19 nt, Homo sapiens
uugaccagaucgaugagaa

SEQ ID NO: 1549970 - RNA, 19 nt, Homo sapiens
cuauggaagggacgaguuu

SEQ ID NO: 1549971 - RNA, 19 nt, Homo sapiens
aaauugaggaacgaaauga

SEQ ID NO: 1549972 - RNA, 19 nt, Homo sapiens
cacgcuagccucacuuugu

SEQ ID NO: 1549973 - RNA, 19 nt, Homo sapiens
gaagaaaagguggacaaga

SEQ ID NO: 1549974 - RNA, 19 nt, Homo sapiens
aagcguaccugcgccaucu

SEQ ID NO: 1549975 - RNA, 19 nt, Homo sapiens
accaaaccuucaaugagaa

SEQ ID NO: 1549976 - RNA, 19 nt, Homo sapiens
uccaggcacucaagaagca

SEQ ID NO: 1549977 - RNA, 19 nt, Homo sapiens
accuauaccugcagcacaa

SEQ ID NO: 1549978 - RNA, 19 nt, Homo sapiens
aggaggagacgcagagaga

SEQ ID NO: 1549979 - RNA, 19 nt, Homo sapiens
caagaagcagguggugaug

SEQ ID NO: 1549980 - RNA, 19 nt, Homo sapiens
gaaggacuuucacaaauaa

SEQ ID NO: 1549981 - RNA, 19 nt, Homo sapiens
gcaaaacagugauuacuua

SEQ ID NO: 1549982 - RNA, 19 nt, Homo sapiens
gagaaggacuuucacaaau

SEQ ID NO: 1549983 - RNA, 19 nt, Homo sapiens
ucagugagcuggugaaaga

SEQ ID NO: 1549984 - RNA, 19 nt, Homo sapiens
agaaggacuuucacaaaua

SEQ ID NO: 1549985 - RNA, 19 nt, Homo sapiens
ugaguuacuuccugucuua

SEQ ID NO: 1549986 - RNA, 19 nt, Homo sapiens
ggaagaagaggaagaguug

SEQ ID NO: 1549987 - RNA, 19 nt, Homo sapiens
gauacgagcccuucucuga

SEQ ID NO: 1549988 - RNA, 19 nt, Homo sapiens
gaaagucgcgcuugguuag

SEQ ID NO: 1549989 - RNA, 19 nt, Homo sapiens
gagcagguuuggagcaaga

SEQ ID NO: 1549990 - RNA, 19 nt, Homo sapiens
ggcaggagcccacaacuga

SEQ ID NO: 1549991 - RNA, 19 nt, Homo sapiens
gaccuuauuuucccucuua

SEQ ID NO: 1549992 - RNA, 19 nt, Homo sapiens
aaacugagcaggcagaaau

SEQ ID NO: 1549993 - RNA, 19 nt, Homo sapiens
gagaggcgcuagauuuggu

SEQ ID NO: 1549994 - RNA, 19 nt, Homo sapiens
ggaccgcgguguuguguac

SEQ ID NO: 1549995 - RNA, 19 nt, Homo sapiens
gagaaagucgcgcuugguu

SEQ ID NO: 1549996 - RNA, 19 nt, Homo sapiens
gcgggcaacuuccuguuug

SEQ ID NO: 1549997 - RNA, 19 nt, Homo sapiens
gaaugggucaguccgguuu

SEQ ID NO: 1549998 - RNA, 19 nt, Homo sapiens
cacgggagguggugauuga

SEQ ID NO: 1549999 - RNA, 19 nt, Homo sapiens
agagaaggacuuucacaaa

SEQ ID NO: 1550000 - RNA, 19 nt, Homo sapiens
aggaagaguuggaggaaga

SEQ ID NO: 1550001 - RNA, 19 nt, Homo sapiens
gagcagccuccgggacuua

SEQ ID NO: 1550002 - RNA, 19 nt, Homo sapiens
ccgggaagccuccaaauuc

SEQ ID NO: 1550003 - RNA, 19 nt, Homo sapiens
acgcaaggcuagagaagga

SEQ ID NO: 1550004 - RNA, 19 nt, Homo sapiens
cggcccaaguucaccguua

SEQ ID NO: 1550005 - RNA, 19 nt, Homo sapiens
caacguggcagcgcgcuuu

SEQ ID NO: 1550006 - RNA, 19 nt, Homo sapiens
gaucugcaggucuggauga

SEQ ID NO: 1550007 - RNA, 19 nt, Homo sapiens
agaaagucgcgcuugguua

SEQ ID NO: 1550008 - RNA, 19 nt, Homo sapiens
ggucaagggccucaucauc

SEQ ID NO: 1550009 - RNA, 19 nt, Homo sapiens
gaacgugguggccuucgau

SEQ ID NO: 1550010 - RNA, 19 nt, Homo sapiens
ugagcaaagagaaacauuu

SEQ ID NO: 1550011 - RNA, 19 nt, Homo sapiens
gacuggauuugcucugaga

SEQ ID NO: 1550012 - RNA, 19 nt, Homo sapiens
ucaagggccucaucaucca

SEQ ID NO: 1550013 - RNA, 19 nt, Homo sapiens
gcgcuugguuagucuuaca

SEQ ID NO: 1550014 - RNA, 19 nt, Homo sapiens
uggccucgguggagaugua

SEQ ID NO: 1550015 - RNA, 19 nt, Homo sapiens
ggccuucgauguguacaau

SEQ ID NO: 1550016 - RNA, 19 nt, Homo sapiens
uuggagaggcgcuagauuu

SEQ ID NO: 1550017 - RNA, 19 nt, Homo sapiens
ggcugucgcuuuccaugga

SEQ ID NO: 1550018 - RNA, 19 nt, Homo sapiens
cuuccugucuuacugcaaa

SEQ ID NO: 1550019 - RNA, 19 nt, Homo sapiens
uuaaaguguuucccuaggu

SEQ ID NO: 1550020 - RNA, 19 nt, Homo sapiens
uagagaaggacuuucacaa

SEQ ID NO: 1550021 - RNA, 19 nt, Homo sapiens
caagagccacacccaggaa

SEQ ID NO: 1550022 - RNA, 19 nt, Homo sapiens
cgagagggagggagagguu

SEQ ID NO: 1550023 - RNA, 19 nt, Homo sapiens
uacgaccgcuucugcuaug

SEQ ID NO: 1550024 - RNA, 19 nt, Homo sapiens
gugcuccagugacuacuuc

SEQ ID NO: 1550025 - RNA, 19 nt, Homo sapiens
ccuucgauguguacaauca

SEQ ID NO: 1550026 - RNA, 19 nt, Homo sapiens
gcacgggagguggugauug

SEQ ID NO: 1550027 - RNA, 19 nt, Homo sapiens
gcuacugggccuggcguua

SEQ ID NO: 1550028 - RNA, 19 nt, Homo sapiens
gaccgagggcagcgaauuc

SEQ ID NO: 1550029 - RNA, 19 nt, Homo sapiens
gagcugagaaugggagaca

SEQ ID NO: 1550030 - RNA, 19 nt, Homo sapiens
uggagaggcgcuagauuug

SEQ ID NO: 1550031 - RNA, 19 nt, Homo sapiens
ggcacacuguacagaguug

SEQ ID NO: 1550032 - RNA, 19 nt, Homo sapiens
guuacuuccugucuuacug

SEQ ID NO: 1550033 - RNA, 19 nt, Homo sapiens
gguggucacggcccaaguu

SEQ ID NO: 1550034 - RNA, 19 nt, Homo sapiens
ggagaaagucgcgcuuggu

SEQ ID NO: 1550035 - RNA, 19 nt, Homo sapiens
gcagccuccgggacuuaua

SEQ ID NO: 1550036 - RNA, 19 nt, Homo sapiens
ccucuuacaguuaaagugu

SEQ ID NO: 1550037 - RNA, 19 nt, Homo sapiens
uagaaggcuauaugaauca

SEQ ID NO: 1550038 - RNA, 19 nt, Homo sapiens
aagguuaacaggcaaacaa

SEQ ID NO: 1550039 - RNA, 19 nt, Homo sapiens
ccgguuuccuuccgcaaug

SEQ ID NO: 1550040 - RNA, 19 nt, Homo sapiens
gcgcagccuuacgcagcua

SEQ ID NO: 1550041 - RNA, 19 nt, Homo sapiens
cugcuggacuucaucuaca

SEQ ID NO: 1550042 - RNA, 19 nt, Homo sapiens
ggcuagagaaggacuuuca

SEQ ID NO: 1550043 - RNA, 19 nt, Homo sapiens
cggcagucguggaaaccaa

SEQ ID NO: 1550044 - RNA, 19 nt, Homo sapiens
ggagaggcgcuagauuugg

SEQ ID NO: 1550045 - RNA, 19 nt, Homo sapiens
gugguggccuucgaugugu

SEQ ID NO: 1550046 - RNA, 19 nt, Homo sapiens
caucugcgccgucggacau

SEQ ID NO: 1550047 - RNA, 19 nt, Homo sapiens
agaaggcuauaugaaucaa

SEQ ID NO: 1550048 - RNA, 19 nt, Homo sapiens
ggccuugagcaaagagaaa

SEQ ID NO: 1550049 - RNA, 19 nt, Homo sapiens
cauccaggcccucaacuac

SEQ ID NO: 1550050 - RNA, 19 nt, Homo sapiens
gcucugugggcgcuacuug

SEQ ID NO: 1550051 - RNA, 19 nt, Homo sapiens
cugccuggcugucgcuuuc

SEQ ID NO: 1550052 - RNA, 19 nt, Homo sapiens
cuacgaccgcuucugcuau

SEQ ID NO: 1550053 - RNA, 19 nt, Homo sapiens
ccuacgaccgcuucugcua

SEQ ID NO: 1550054 - RNA, 19 nt, Homo sapiens
ggcccaaguucaccguuac

SEQ ID NO: 1550055 - RNA, 19 nt, Homo sapiens
gcacaugacucccuaguuu

SEQ ID NO: 1550056 - RNA, 19 nt, Homo sapiens
gagacaggcacaaauauua

SEQ ID NO: 1550057 - RNA, 19 nt, Homo sapiens
gagccaauccucacuuuaa

SEQ ID NO: 1550058 - RNA, 19 nt, Homo sapiens
gaaccacauuuaacgucua

SEQ ID NO: 1550059 - RNA, 19 nt, Homo sapiens
uaccuacgguuuacuagua

SEQ ID NO: 1550060 - RNA, 19 nt, Homo sapiens
ggaauuaccuacgguuuac

SEQ ID NO: 1550061 - RNA, 19 nt, Homo sapiens
ugaguaagaaucagaauug

SEQ ID NO: 1550062 - RNA, 19 nt, Homo sapiens
gcgagccaauccucacuuu

SEQ ID NO: 1550063 - RNA, 19 nt, Homo sapiens
gcgaagcgcugcauuuuau

SEQ ID NO: 1550064 - RNA, 19 nt, Homo sapiens
caggaacacaaauucauua

SEQ ID NO: 1550065 - RNA, 19 nt, Homo sapiens
ucagaagccuggcaagaca

SEQ ID NO: 1550066 - RNA, 19 nt, Homo sapiens
ucuccaaccucacauccua

SEQ ID NO: 1550067 - RNA, 19 nt, Homo sapiens
cauuaaauccucacaacuu

SEQ ID NO: 1550068 - RNA, 19 nt, Homo sapiens
uaaauccucacaacuuuga

SEQ ID NO: 1550069 - RNA, 19 nt, Homo sapiens
gaguguuacugcuguacuu

SEQ ID NO: 1550070 - RNA, 19 nt, Homo sapiens
uaacgucuauguggugugu

SEQ ID NO: 1550071 - RNA, 19 nt, Homo sapiens
gaguaagaaucagaauugu

SEQ ID NO: 1550072 - RNA, 19 nt, Homo sapiens
ccaggaacacaaauucauu

SEQ ID NO: 1550073 - RNA, 19 nt, Homo sapiens
ugagacaggcacaaauauu

SEQ ID NO: 1550074 - RNA, 19 nt, Homo sapiens
acacugagacccacagguu

SEQ ID NO: 1550075 - RNA, 19 nt, Homo sapiens
gaggaauuaccuacgguuu

SEQ ID NO: 1550076 - RNA, 19 nt, Homo sapiens
guuauugccaugaguaaga

SEQ ID NO: 1550077 - RNA, 19 nt, Homo sapiens
aggaauuaccuacgguuua

SEQ ID NO: 1550078 - RNA, 19 nt, Homo sapiens
guccugcccuagagucuga

SEQ ID NO: 1550079 - RNA, 19 nt, Homo sapiens
guuuacuagugaggaauua

SEQ ID NO: 1550080 - RNA, 19 nt, Homo sapiens
agccaauccucacuuuaaa

SEQ ID NO: 1550081 - RNA, 19 nt, Homo sapiens
caaccucacauccuacuag

SEQ ID NO: 1550082 - RNA, 19 nt, Homo sapiens
aagcuuuccuguccucgaa

SEQ ID NO: 1550083 - RNA, 19 nt, Homo sapiens
gauucuaacugcacaugac

SEQ ID NO: 1550084 - RNA, 19 nt, Homo sapiens
ggucagaagccuggcaaga

SEQ ID NO: 1550085 - RNA, 19 nt, Homo sapiens
agacaggcacaaauauuau

SEQ ID NO: 1550086 - RNA, 19 nt, Homo sapiens
uaugugguguguagguuau

SEQ ID NO: 1550087 - RNA, 19 nt, Homo sapiens
cgaccgguccgugaaauga

SEQ ID NO: 1550088 - RNA, 19 nt, Homo sapiens
aggcacaaauauuaucugu

SEQ ID NO: 1550089 - RNA, 19 nt, Homo sapiens
guguuacugcuguacuuua

SEQ ID NO: 1550090 - RNA, 19 nt, Homo sapiens
cgagccaauccucacuuua

SEQ ID NO: 1550091 - RNA, 19 nt, Homo sapiens
gacgaccgguccgugaaau

SEQ ID NO: 1550092 - RNA, 19 nt, Homo sapiens
ccucacauccuacuagucu

SEQ ID NO: 1550093 - RNA, 19 nt, Homo sapiens
acucauaguuaggucagaa

SEQ ID NO: 1550094 - RNA, 19 nt, Homo sapiens
ugacccgaaccacauuuaa

SEQ ID NO: 1550095 - RNA, 19 nt, Homo sapiens
gcgcggaggaaacucauag

SEQ ID NO: 1550096 - RNA, 19 nt, Homo sapiens
guagguuauugccaugagu

SEQ ID NO: 1550097 - RNA, 19 nt, Homo sapiens
aaccacauuuaacgucuau

SEQ ID NO: 1550098 - RNA, 19 nt, Homo sapiens
ggauucuaacugcacauga

SEQ ID NO: 1550099 - RNA, 19 nt, Homo sapiens
ucacauccuacuagucuuc

SEQ ID NO: 1550100 - RNA, 19 nt, Homo sapiens
cggcaacgccagcauacga

SEQ ID NO: 1550101 - RNA, 19 nt, Homo sapiens
cuaguaaggaacacugaga

SEQ ID NO: 1550102 - RNA, 19 nt, Homo sapiens
uuauugccaugaguaagaa

SEQ ID NO: 1550103 - RNA, 19 nt, Homo sapiens
uagguuauugccaugagua

SEQ ID NO: 1550104 - RNA, 19 nt, Homo sapiens
gacaggcacaaauauuauc

SEQ ID NO: 1550105 - RNA, 19 nt, Homo sapiens
uauaccaggaacacaaauu

SEQ ID NO: 1550106 - RNA, 19 nt, Homo sapiens
uguuacugcuguacuuuag

SEQ ID NO: 1550107 - RNA, 19 nt, Homo sapiens
cuaugugguguguagguua

SEQ ID NO: 1550108 - RNA, 19 nt, Homo sapiens
uggcaagacaagggaauuu

SEQ ID NO: 1550109 - RNA, 19 nt, Homo sapiens
caucagagcuggugcguaa

SEQ ID NO: 1550110 - RNA, 19 nt, Homo sapiens
gaggaggacuucaucgaaa

SEQ ID NO: 1550111 - RNA, 19 nt, Homo sapiens
gcaaacaucucccucuucu

SEQ ID NO: 1550112 - RNA, 19 nt, Homo sapiens
caacuucccugacaucauc

SEQ ID NO: 1550113 - RNA, 19 nt, Homo sapiens
ucaaggugcugagguauaa

SEQ ID NO: 1550114 - RNA, 19 nt, Homo sapiens
cagagucaaugcaguauga

SEQ ID NO: 1550115 - RNA, 19 nt, Homo sapiens
gagacauacuccauugaaa

SEQ ID NO: 1550116 - RNA, 19 nt, Homo sapiens
gagaagacccugcgcaugu

SEQ ID NO: 1550117 - RNA, 19 nt, Homo sapiens
gcugagacauacuccauug

SEQ ID NO: 1550118 - RNA, 19 nt, Homo sapiens
caagaucgcugagacauac

SEQ ID NO: 1550119 - RNA, 19 nt, Homo sapiens
gccguaaccucaaccguuu

SEQ ID NO: 1550120 - RNA, 19 nt, Homo sapiens
caggugagcuuguacaaca

SEQ ID NO: 1550121 - RNA, 19 nt, Homo sapiens
gcaguggcuuccucucaaa

SEQ ID NO: 1550122 - RNA, 19 nt, Homo sapiens
gaacagcaugggcaaaguu

SEQ ID NO: 1550123 - RNA, 19 nt, Homo sapiens
agaaugaccucuuccagau

SEQ ID NO: 1550124 - RNA, 19 nt, Homo sapiens
cuacacaaguucacuguca

SEQ ID NO: 1550125 - RNA, 19 nt, Homo sapiens
gcaccaaccaugcugacua

SEQ ID NO: 1550126 - RNA, 19 nt, Homo sapiens
ggacgaggcagacggcauu

SEQ ID NO: 1550127 - RNA, 19 nt, Homo sapiens
ucaagcacaugaugcagaa

SEQ ID NO: 1550128 - RNA, 19 nt, Homo sapiens
gcaaggaauuccagaagcu

SEQ ID NO: 1550129 - RNA, 19 nt, Homo sapiens
gccagcagauccucuucua

SEQ ID NO: 1550130 - RNA, 19 nt, Homo sapiens
gccgugagcucgacuucaa

SEQ ID NO: 1550131 - RNA, 19 nt, Homo sapiens
gagaaggagcuuucaagga

SEQ ID NO: 1550132 - RNA, 19 nt, Homo sapiens
gcucagcacuguggcauca

SEQ ID NO: 1550133 - RNA, 19 nt, Homo sapiens
ggucagggaagacuccaua

SEQ ID NO: 1550134 - RNA, 19 nt, Homo sapiens
caaauucaagggcaucaaa

SEQ ID NO: 1550135 - RNA, 19 nt, Homo sapiens
gagcccaggugagcuugua

SEQ ID NO: 1550136 - RNA, 19 nt, Homo sapiens
aaagcuacaucuccuacaa

SEQ ID NO: 1550137 - RNA, 19 nt, Homo sapiens
ccucuucucucccuuacuu

SEQ ID NO: 1550138 - RNA, 19 nt, Homo sapiens
gaagaucgcguggacacuu

SEQ ID NO: 1550139 - RNA, 19 nt, Homo sapiens
gaaaggccgagcccucuau

SEQ ID NO: 1550140 - RNA, 19 nt, Homo sapiens
gcucuuuccugccucuuau

SEQ ID NO: 1550141 - RNA, 19 nt, Homo sapiens
agaagacccugcgcaugua

SEQ ID NO: 1550142 - RNA, 19 nt, Homo sapiens
agacagagucaaugcagua

SEQ ID NO: 1550143 - RNA, 19 nt, Homo sapiens
gacaucauccaucuacaaa

SEQ ID NO: 1550144 - RNA, 19 nt, Homo sapiens
ccacaaaacagaccaaauu

SEQ ID NO: 1550145 - RNA, 19 nt, Homo sapiens
gcaguguggugggccguaa

SEQ ID NO: 1550146 - RNA, 19 nt, Homo sapiens
gauccuuccuguugcacaa

SEQ ID NO: 1550147 - RNA, 19 nt, Homo sapiens
ggcaguggcuuccucucaa

SEQ ID NO: 1550148 - RNA, 19 nt, Homo sapiens
gacaagggccugccagaca

SEQ ID NO: 1550149 - RNA, 19 nt, Homo sapiens
cccaagauccuuccuguug

SEQ ID NO: 1550150 - RNA, 19 nt, Homo sapiens
gauucuggccuguguggua

SEQ ID NO: 1550151 - RNA, 19 nt, Homo sapiens
aaacaucucccucuucucu

SEQ ID NO: 1550152 - RNA, 19 nt, Homo sapiens
cacuuugacuggcucuaua

SEQ ID NO: 1550153 - RNA, 19 nt, Homo sapiens
ccaagaucgcugagacaua

SEQ ID NO: 1550154 - RNA, 19 nt, Homo sapiens
ugaggaggaugaugaugau

SEQ ID NO: 1550155 - RNA, 19 nt, Homo sapiens
ggaugcugcuccuugaauc

SEQ ID NO: 1550156 - RNA, 19 nt, Homo sapiens
ugacaugccugcucuucag

SEQ ID NO: 1550157 - RNA, 19 nt, Homo sapiens
gccgagcccucuaugacuu

SEQ ID NO: 1550158 - RNA, 19 nt, Homo sapiens
caagauccuuccuguugca

SEQ ID NO: 1550159 - RNA, 19 nt, Homo sapiens
ggaacagcaugggcaaagu

SEQ ID NO: 1550160 - RNA, 19 nt, Homo sapiens
ccuggccacugcugccuua

SEQ ID NO: 1550161 - RNA, 19 nt, Homo sapiens
aaggagagccaacgcauga

SEQ ID NO: 1550162 - RNA, 19 nt, Homo sapiens
cugagcagcccaagaauga

SEQ ID NO: 1550163 - RNA, 19 nt, Homo sapiens
gagcuggugcguaaacaug

SEQ ID NO: 1550164 - RNA, 19 nt, Homo sapiens
uucaaggccuucaguaaga

SEQ ID NO: 1550165 - RNA, 19 nt, Homo sapiens
ggacuugcaggacguggaa

SEQ ID NO: 1550166 - RNA, 19 nt, Homo sapiens
gaugaugacugggaugacu

SEQ ID NO: 1550167 - RNA, 19 nt, Homo sapiens
ucucaaaagugacuguaua

SEQ ID NO: 1550168 - RNA, 19 nt, Homo sapiens
agaagacucucaaaaguga

SEQ ID NO: 1550169 - RNA, 19 nt, Homo sapiens
cauagaguaggcaacauuu

SEQ ID NO: 1550170 - RNA, 19 nt, Homo sapiens
agacauacuccauugaaau

SEQ ID NO: 1550171 - RNA, 19 nt, Homo sapiens
ccauagaguaggcaacauu

SEQ ID NO: 1550172 - RNA, 19 nt, Homo sapiens
uagaagggaccacagcauu

SEQ ID NO: 1550173 - RNA, 19 nt, Homo sapiens
gcccagccauggcacugaa

SEQ ID NO: 1550174 - RNA, 19 nt, Homo sapiens
ucaaggccuucaguaagaa

SEQ ID NO: 1550175 - RNA, 19 nt, Homo sapiens
aagaucgcguggacacuuu

SEQ ID NO: 1550176 - RNA, 19 nt, Homo sapiens
cgaggaggacuucaucgaa

SEQ ID NO: 1550177 - RNA, 19 nt, Homo sapiens
ugagacauacuccauugaa

SEQ ID NO: 1550178 - RNA, 19 nt, Homo sapiens
ggaggaugaugaugaugac

SEQ ID NO: 1550179 - RNA, 19 nt, Homo sapiens
uaugacugauguuuaagug

SEQ ID NO: 1550180 - RNA, 19 nt, Homo sapiens
ugacaucauccaucuacaa

SEQ ID NO: 1550181 - RNA, 19 nt, Homo sapiens
caaaacagaccaaauucaa

SEQ ID NO: 1550182 - RNA, 19 nt, Homo sapiens
gcuuugaggaggaugauga

SEQ ID NO: 1550183 - RNA, 19 nt, Homo sapiens
ccuggaugcugcuccuuga

SEQ ID NO: 1550184 - RNA, 19 nt, Homo sapiens
cagcaugggcaaaguuaug

SEQ ID NO: 1550185 - RNA, 19 nt, Homo sapiens
gaagacccugcgcauguau

SEQ ID NO: 1550186 - RNA, 19 nt, Homo sapiens
gaaugaccucuuccagaug

SEQ ID NO: 1550187 - RNA, 19 nt, Homo sapiens
ccucaacagugccauuucu

SEQ ID NO: 1550188 - RNA, 19 nt, Homo sapiens
gaugacaagcaguggaaga

SEQ ID NO: 1550189 - RNA, 19 nt, Homo sapiens
ucagcugccuggaugacaa

SEQ ID NO: 1550190 - RNA, 19 nt, Homo sapiens
ugggaaaccuaagaggaaa

SEQ ID NO: 1550191 - RNA, 19 nt, Homo sapiens
gcaguguuuugaagaauga

SEQ ID NO: 1550192 - RNA, 19 nt, Homo sapiens
ccaccgagcaccaggacuu

SEQ ID NO: 1550193 - RNA, 19 nt, Homo sapiens
uauuugaguucaccagcaa

SEQ ID NO: 1550194 - RNA, 19 nt, Homo sapiens
gugacuguauauuugaguu

SEQ ID NO: 1550195 - RNA, 19 nt, Homo sapiens
ggccaucucccuccuguag

SEQ ID NO: 1550196 - RNA, 19 nt, Homo sapiens
caccaaccaugcugacuac

SEQ ID NO: 1550197 - RNA, 19 nt, Homo sapiens
gggagaaggagcuuucaag

SEQ ID NO: 1550198 - RNA, 19 nt, Homo sapiens
gacuguauauuugaguuca

SEQ ID NO: 1550199 - RNA, 19 nt, Homo sapiens
agacacagacagagucaau

SEQ ID NO: 1550200 - RNA, 19 nt, Homo sapiens
uauaaccgccugcuacaca

SEQ ID NO: 1550201 - RNA, 19 nt, Homo sapiens
uaaccucaaccguuucuca

SEQ ID NO: 1550202 - RNA, 19 nt, Homo sapiens
ggucagacacagacagagu

SEQ ID NO: 1550203 - RNA, 19 nt, Homo sapiens
cgacuucaagcacaugaug

SEQ ID NO: 1550204 - RNA, 19 nt, Homo sapiens
ucagcacuguggcaucaga

SEQ ID NO: 1550205 - RNA, 19 nt, Homo sapiens
gggcaguggcuuccucuca

SEQ ID NO: 1550206 - RNA, 19 nt, Homo sapiens
gggcggagaaggaugagau

SEQ ID NO: 1550207 - RNA, 19 nt, Homo sapiens
acccugugcucucccagua

SEQ ID NO: 1550208 - RNA, 19 nt, Homo sapiens
ggagagccaacgcaugagu

SEQ ID NO: 1550209 - RNA, 19 nt, Homo sapiens
guacauagcucaagugaug

SEQ ID NO: 1550210 - RNA, 19 nt, Homo sapiens
gcuagaagaucauuacuuu

SEQ ID NO: 1550211 - RNA, 19 nt, Homo sapiens
gaacagacaacuccagaua

SEQ ID NO: 1550212 - RNA, 19 nt, Homo sapiens
gaaagaauguacacacaga

SEQ ID NO: 1550213 - RNA, 19 nt, Homo sapiens
gaaagaaguugaccuccuu

SEQ ID NO: 1550214 - RNA, 19 nt, Homo sapiens
caaagcaacugaaacuuga

SEQ ID NO: 1550215 - RNA, 19 nt, Homo sapiens
uaucaacacugguaacuaa

SEQ ID NO: 1550216 - RNA, 19 nt, Homo sapiens
gaauagaaaucgccuuuua

SEQ ID NO: 1550217 - RNA, 19 nt, Homo sapiens
uaacauccauuuccuaaga

SEQ ID NO: 1550218 - RNA, 19 nt, Homo sapiens
gagcaaggauggagagguu

SEQ ID NO: 1550219 - RNA, 19 nt, Homo sapiens
acacauacaugcacacaaa

SEQ ID NO: 1550220 - RNA, 19 nt, Homo sapiens
gguggaaucccaauuguua

SEQ ID NO: 1550221 - RNA, 19 nt, Homo sapiens
aaaccuccauuuaguguua

SEQ ID NO: 1550222 - RNA, 19 nt, Homo sapiens
accaagagcuuuacaaauu

SEQ ID NO: 1550223 - RNA, 19 nt, Homo sapiens
ggagauggagcccaacuua

SEQ ID NO: 1550224 - RNA, 19 nt, Homo sapiens
gaaaugacaagauugagaa

SEQ ID NO: 1550225 - RNA, 19 nt, Homo sapiens
gaacagaagugcagcuacu

SEQ ID NO: 1550226 - RNA, 19 nt, Homo sapiens
cgaacuggcuccacacaaa

SEQ ID NO: 1550227 - RNA, 19 nt, Homo sapiens
gcaaagcaacugaaacuug

SEQ ID NO: 1550228 - RNA, 19 nt, Homo sapiens
gaggaguacugaucagaaa

SEQ ID NO: 1550229 - RNA, 19 nt, Homo sapiens
ccagauaaauguugacugu

SEQ ID NO: 1550230 - RNA, 19 nt, Homo sapiens
gcccacagcuugauauuca

SEQ ID NO: 1550231 - RNA, 19 nt, Homo sapiens
gcucagcugugguucuuaa

SEQ ID NO: 1550232 - RNA, 19 nt, Homo sapiens
gggaaaggauucacucugu

SEQ ID NO: 1550233 - RNA, 19 nt, Homo sapiens
ggucaccgcucucuggaaa

SEQ ID NO: 1550234 - RNA, 19 nt, Homo sapiens
acagacaacuccagauaaa

SEQ ID NO: 1550235 - RNA, 19 nt, Homo sapiens
guacaaauccaauuacugu

SEQ ID NO: 1550236 - RNA, 19 nt, Homo sapiens
gacaauaggaugaauagaa

SEQ ID NO: 1550237 - RNA, 19 nt, Homo sapiens
ccacauaagagaugcauuu

SEQ ID NO: 1550238 - RNA, 19 nt, Homo sapiens
caagagggauaucuaguca

SEQ ID NO: 1550239 - RNA, 19 nt, Homo sapiens
gcugauauguuuaguucaa

SEQ ID NO: 1550240 - RNA, 19 nt, Homo sapiens
agacagacaucucagaguu

SEQ ID NO: 1550241 - RNA, 19 nt, Homo sapiens
aaucagaggugguaagaug

SEQ ID NO: 1550242 - RNA, 19 nt, Homo sapiens
gaaugaauccgucugcuau

SEQ ID NO: 1550243 - RNA, 19 nt, Homo sapiens
uaacaaguccuuacaaagu

SEQ ID NO: 1550244 - RNA, 19 nt, Homo sapiens
gacacaaccucgagaugaa

SEQ ID NO: 1550245 - RNA, 19 nt, Homo sapiens
ggacacaaccucgagauga

SEQ ID NO: 1550246 - RNA, 19 nt, Homo sapiens
cagcugauauguuuaguuc

SEQ ID NO: 1550247 - RNA, 19 nt, Homo sapiens
gaaaucgccuuuuacauau

SEQ ID NO: 1550248 - RNA, 19 nt, Homo sapiens
ggaaucaacacucacugua

SEQ ID NO: 1550249 - RNA, 19 nt, Homo sapiens
gaaaaugacuguggugcua

SEQ ID NO: 1550250 - RNA, 19 nt, Homo sapiens
gauaaaacuuugugccaua

SEQ ID NO: 1550251 - RNA, 19 nt, Homo sapiens
gagaaaagcccgaagaauu

SEQ ID NO: 1550252 - RNA, 19 nt, Homo sapiens
ggaaaugacaagauugaga

SEQ ID NO: 1550253 - RNA, 19 nt, Homo sapiens
ccaagagcuuuacaaauuc

SEQ ID NO: 1550254 - RNA, 19 nt, Homo sapiens
gauagcugcaccuuucuua

SEQ ID NO: 1550255 - RNA, 19 nt, Homo sapiens
auacacagcaucuaguuua

SEQ ID NO: 1550256 - RNA, 19 nt, Homo sapiens
guugaagucugaaguuaau

SEQ ID NO: 1550257 - RNA, 19 nt, Homo sapiens
gaaccuauucagcccauuu

SEQ ID NO: 1550258 - RNA, 19 nt, Homo sapiens
ggaaugaauccgucugcua

SEQ ID NO: 1550259 - RNA, 19 nt, Homo sapiens
aacaaguccuuacaaagua

SEQ ID NO: 1550260 - RNA, 19 nt, Homo sapiens
caucacaguugguuguuau

SEQ ID NO: 1550261 - RNA, 19 nt, Homo sapiens
gaggaaaugacaagauuga

SEQ ID NO: 1550262 - RNA, 19 nt, Homo sapiens
gaaagccgguuaacaucca

SEQ ID NO: 1550263 - RNA, 19 nt, Homo sapiens
gaauuagcgugaccuccaa

SEQ ID NO: 1550264 - RNA, 19 nt, Homo sapiens
uaaauuuaguggaccaaga

SEQ ID NO: 1550265 - RNA, 19 nt, Homo sapiens
guaccaagagcuuuacaaa

SEQ ID NO: 1550266 - RNA, 19 nt, Homo sapiens
ucccauugcuuccuacuaa

SEQ ID NO: 1550267 - RNA, 19 nt, Homo sapiens
ugugauagcugcaccuuuc

SEQ ID NO: 1550268 - RNA, 19 nt, Homo sapiens
gguauccauucuccuagua

SEQ ID NO: 1550269 - RNA, 19 nt, Homo sapiens
ggaauaccauaguccagau

SEQ ID NO: 1550270 - RNA, 19 nt, Homo sapiens
cauaucaugccuuuguuua

SEQ ID NO: 1550271 - RNA, 19 nt, Homo sapiens
ggaaaccucgggacucuau

SEQ ID NO: 1550272 - RNA, 19 nt, Homo sapiens
ucucagaguucaucaggaa

SEQ ID NO: 1550273 - RNA, 19 nt, Homo sapiens
cagaauaacaacaaucuug

SEQ ID NO: 1550274 - RNA, 19 nt, Homo sapiens
gaaacuuggccaccauuug

SEQ ID NO: 1550275 - RNA, 19 nt, Homo sapiens
gugccauaauccuaauuua

SEQ ID NO: 1550276 - RNA, 19 nt, Homo sapiens
gaauguaugccaaaugcaa

SEQ ID NO: 1550277 - RNA, 19 nt, Homo sapiens
uuaaugguauggagcauga

SEQ ID NO: 1550278 - RNA, 19 nt, Homo sapiens
aaagggaagccauaaauau

SEQ ID NO: 1550279 - RNA, 19 nt, Homo sapiens
gauagaaagggauacuuga

SEQ ID NO: 1550280 - RNA, 19 nt, Homo sapiens
uuucuuaacucacuacaga

SEQ ID NO: 1550281 - RNA, 19 nt, Homo sapiens
gaggaggaauggcuuugug

SEQ ID NO: 1550282 - RNA, 19 nt, Homo sapiens
gauaaauguugacuguaca

SEQ ID NO: 1550283 - RNA, 19 nt, Homo sapiens
cagugcauguuacagaaua

SEQ ID NO: 1550284 - RNA, 19 nt, Homo sapiens
aauguugacuguacacuga

SEQ ID NO: 1550285 - RNA, 19 nt, Homo sapiens
guuguuaugucuccuuaga

SEQ ID NO: 1550286 - RNA, 19 nt, Homo sapiens
gaaauuacaguugaaccuu

SEQ ID NO: 1550287 - RNA, 19 nt, Homo sapiens
cagcguccuuuaccuguuu

SEQ ID NO: 1550288 - RNA, 19 nt, Homo sapiens
gcagguaaacagcugauau

SEQ ID NO: 1550289 - RNA, 19 nt, Homo sapiens
gaugacaauaggaugaaua

SEQ ID NO: 1550290 - RNA, 19 nt, Homo sapiens
guaguacuuugaaucauag

SEQ ID NO: 1550291 - RNA, 19 nt, Homo sapiens
agaaaagcccgaagaauua

SEQ ID NO: 1550292 - RNA, 19 nt, Homo sapiens
cugaggaaaugacaagauu

SEQ ID NO: 1550293 - RNA, 19 nt, Homo sapiens
gcagagacggcucagaaga

SEQ ID NO: 1550294 - RNA, 19 nt, Homo sapiens
guuaacauccauuuccuaa

SEQ ID NO: 1550295 - RNA, 19 nt, Homo sapiens
gcaucuaguuuauccaaag

SEQ ID NO: 1550296 - RNA, 19 nt, Homo sapiens
gagauggagcccaacuuaa

SEQ ID NO: 1550297 - RNA, 19 nt, Homo sapiens
cuaaagaggacaacaggaa

SEQ ID NO: 1550298 - RNA, 19 nt, Homo sapiens
gugaaagaauguacacaca

SEQ ID NO: 1550299 - RNA, 19 nt, Homo sapiens
uagcgugaccuccaaagua

SEQ ID NO: 1550300 - RNA, 19 nt, Homo sapiens
ccaguugggccacaucuuu

SEQ ID NO: 1550301 - RNA, 19 nt, Homo sapiens
agaaaucgccuuuuacaua

SEQ ID NO: 1550302 - RNA, 19 nt, Homo sapiens
gauguuuacagcacagaua

SEQ ID NO: 1550303 - RNA, 19 nt, Homo sapiens
uaagaugccuuuggcuugu

SEQ ID NO: 1550304 - RNA, 19 nt, Homo sapiens
guaauuuccaacacacaua

SEQ ID NO: 1550305 - RNA, 19 nt, Homo sapiens
ugacuguggugcuagaaga

SEQ ID NO: 1550306 - RNA, 19 nt, Homo sapiens
ggucgaacacugguacaua

SEQ ID NO: 1550307 - RNA, 19 nt, Homo sapiens
ucaucgagcucuaucaaca

SEQ ID NO: 1550308 - RNA, 19 nt, Homo sapiens
gaaaugcuacaguuuaugc

SEQ ID NO: 1550309 - RNA, 19 nt, Homo sapiens
gaagaaaucugguagguau

SEQ ID NO: 1550310 - RNA, 19 nt, Homo sapiens
ccucacacauccuguauua

SEQ ID NO: 1550311 - RNA, 19 nt, Homo sapiens
gaaucuggauacaucuuua

SEQ ID NO: 1550312 - RNA, 19 nt, Homo sapiens
gaggaaauuucaacuguga

SEQ ID NO: 1550313 - RNA, 19 nt, Homo sapiens
ggauuuaccuccacuuuag

SEQ ID NO: 1550314 - RNA, 19 nt, Homo sapiens
gaaagggccauaaauguug

SEQ ID NO: 1550315 - RNA, 19 nt, Homo sapiens
gaaggagggauuacauuaa

SEQ ID NO: 1550316 - RNA, 19 nt, Homo sapiens
gguaugcugugucuuauug

SEQ ID NO: 1550317 - RNA, 19 nt, Homo sapiens
gaccagaugacucuaguua

SEQ ID NO: 1550318 - RNA, 19 nt, Homo sapiens
ggccaacaauacaggauua

SEQ ID NO: 1550319 - RNA, 19 nt, Homo sapiens
gagaaauuguuaaguggaa

SEQ ID NO: 1550320 - RNA, 19 nt, Homo sapiens
aaagaaggcugcuaguuca

SEQ ID NO: 1550321 - RNA, 19 nt, Homo sapiens
gaaauugaaucuggauaca

SEQ ID NO: 1550322 - RNA, 19 nt, Homo sapiens
ggauaaaccaacagaaauu

SEQ ID NO: 1550323 - RNA, 19 nt, Homo sapiens
uaacaugacauacaacuug

SEQ ID NO: 1550324 - RNA, 19 nt, Homo sapiens
gccaagauauuuagcaugu

SEQ ID NO: 1550325 - RNA, 19 nt, Homo sapiens
uaaagaaagugcaaugucu

SEQ ID NO: 1550326 - RNA, 19 nt, Homo sapiens
ccagcagucuugcccuuua

SEQ ID NO: 1550327 - RNA, 19 nt, Homo sapiens
gaaaugaccagaugacucu

SEQ ID NO: 1550328 - RNA, 19 nt, Homo sapiens
gccagaaucuuaguaaaug

SEQ ID NO: 1550329 - RNA, 19 nt, Homo sapiens
aagcugagacuuacaauaa

SEQ ID NO: 1550330 - RNA, 19 nt, Homo sapiens
uaccuccacuuuaguaaua

SEQ ID NO: 1550331 - RNA, 19 nt, Homo sapiens
ugaaggagggauuacauua

SEQ ID NO: 1550332 - RNA, 19 nt, Homo sapiens
aaucagaaaugaccagaug

SEQ ID NO: 1550333 - RNA, 19 nt, Homo sapiens
gaagcugagacuuacaaua

SEQ ID NO: 1550334 - RNA, 19 nt, Homo sapiens
ugauaacucugggagauaa

SEQ ID NO: 1550335 - RNA, 19 nt, Homo sapiens
gugguuugcuaucucuuua

SEQ ID NO: 1550336 - RNA, 19 nt, Homo sapiens
cagguaacaugacauacaa

SEQ ID NO: 1550337 - RNA, 19 nt, Homo sapiens
ucacacauccuguauuaug

SEQ ID NO: 1550338 - RNA, 19 nt, Homo sapiens
ugacucaccauaacauuaa

SEQ ID NO: 1550339 - RNA, 19 nt, Homo sapiens
gaaaagcagugaagaacga

SEQ ID NO: 1550340 - RNA, 19 nt, Homo sapiens
guauucaucuucuucuuca

SEQ ID NO: 1550341 - RNA, 19 nt, Homo sapiens
gggauuuaccuccacuuua

SEQ ID NO: 1550342 - RNA, 19 nt, Homo sapiens
ugaaagggccauaaauguu

SEQ ID NO: 1550343 - RNA, 19 nt, Homo sapiens
acacagggagaaauuguua

SEQ ID NO: 1550344 - RNA, 19 nt, Homo sapiens
uguuuaggcugcaauguuu

SEQ ID NO: 1550345 - RNA, 19 nt, Homo sapiens
aggauucccuuauaaagaa

SEQ ID NO: 1550346 - RNA, 19 nt, Homo sapiens
acaaucggguggccuauau

SEQ ID NO: 1550347 - RNA, 19 nt, Homo sapiens
cauaagaaacacaguaaga

SEQ ID NO: 1550348 - RNA, 19 nt, Homo sapiens
gaaucagacaguaaggaua

SEQ ID NO: 1550349 - RNA, 19 nt, Homo sapiens
gaaagcuccaugucagaaa

SEQ ID NO: 1550350 - RNA, 19 nt, Homo sapiens
aaugagaacuggaagaaag

SEQ ID NO: 1550351 - RNA, 19 nt, Homo sapiens
gauaaaccaacagaaauug

SEQ ID NO: 1550352 - RNA, 19 nt, Homo sapiens
gaaggcugcuaguucaagu

SEQ ID NO: 1550353 - RNA, 19 nt, Homo sapiens
gaaagauguauucugaaga

SEQ ID NO: 1550354 - RNA, 19 nt, Homo sapiens
gaaaagaagaaaucuggua

SEQ ID NO: 1550355 - RNA, 19 nt, Homo sapiens
gcugaauuguuuacuagga

SEQ ID NO: 1550356 - RNA, 19 nt, Homo sapiens
gcugagacuuacaauaaca

SEQ ID NO: 1550357 - RNA, 19 nt, Homo sapiens
ucaaaacccuuacucugua

SEQ ID NO: 1550358 - RNA, 19 nt, Homo sapiens
ggcuuuggcugaauuugaa

SEQ ID NO: 1550359 - RNA, 19 nt, Homo sapiens
gaacuugauagcuaaagau

SEQ ID NO: 1550360 - RNA, 19 nt, Homo sapiens
gagcuuagugucaucuuug

SEQ ID NO: 1550361 - RNA, 19 nt, Homo sapiens
cagaauagugugccuuuga

SEQ ID NO: 1550362 - RNA, 19 nt, Homo sapiens
caauagcaauggcgagauc

SEQ ID NO: 1550363 - RNA, 19 nt, Homo sapiens
caacaauacaggauuaucu

SEQ ID NO: 1550364 - RNA, 19 nt, Homo sapiens
gugaaagggccauaaaugu

SEQ ID NO: 1550365 - RNA, 19 nt, Homo sapiens
gacaguaaggauaguuuaa

SEQ ID NO: 1550366 - RNA, 19 nt, Homo sapiens
acauaaaucuucugaaagc

SEQ ID NO: 1550367 - RNA, 19 nt, Homo sapiens
gcaguucuucugauucuga

SEQ ID NO: 1550368 - RNA, 19 nt, Homo sapiens
gaaaucugguagguauuca

SEQ ID NO: 1550369 - RNA, 19 nt, Homo sapiens
ccugguaugcugugucuua

SEQ ID NO: 1550370 - RNA, 19 nt, Homo sapiens
gcugucauaugcugcuuug

SEQ ID NO: 1550371 - RNA, 19 nt, Homo sapiens
gcagaauagugugccuuug

SEQ ID NO: 1550372 - RNA, 19 nt, Homo sapiens
agauggaacugagaaagaa

SEQ ID NO: 1550373 - RNA, 19 nt, Homo sapiens
uauaugaacccaauagcaa

SEQ ID NO: 1550374 - RNA, 19 nt, Homo sapiens
ugcaaugucugaggaaauu

SEQ ID NO: 1550375 - RNA, 19 nt, Homo sapiens
caugucuacugcugaauug

SEQ ID NO: 1550376 - RNA, 19 nt, Homo sapiens
cuugauagcuaaagauucu

SEQ ID NO: 1550377 - RNA, 19 nt, Homo sapiens
ccagagaaacagccauuug

SEQ ID NO: 1550378 - RNA, 19 nt, Homo sapiens
gaagaaaagcagugaagaa

SEQ ID NO: 1550379 - RNA, 19 nt, Homo sapiens
ggaaaacggagaaagaaaa

SEQ ID NO: 1550380 - RNA, 19 nt, Homo sapiens
cagcaguucuucugauucu

SEQ ID NO: 1550381 - RNA, 19 nt, Homo sapiens
ugaacuugauagcuaaaga

SEQ ID NO: 1550382 - RNA, 19 nt, Homo sapiens
cucuuuagcuagcagaaua

SEQ ID NO: 1550383 - RNA, 19 nt, Homo sapiens
cagaaucagaguauauuga

SEQ ID NO: 1550384 - RNA, 19 nt, Homo sapiens
ccucaugucuacugcugaa

SEQ ID NO: 1550385 - RNA, 19 nt, Homo sapiens
ggacacaguagccaugcuu

SEQ ID NO: 1550386 - RNA, 19 nt, Homo sapiens
gaaacacaguaagaagaag

SEQ ID NO: 1550387 - RNA, 19 nt, Homo sapiens
agggagaaauuguuaagug

SEQ ID NO: 1550388 - RNA, 19 nt, Homo sapiens
gaaugagaacuggaagaaa

SEQ ID NO: 1550389 - RNA, 19 nt, Homo sapiens
ccaagauauuuagcaugua

SEQ ID NO: 1550390 - RNA, 19 nt, Homo sapiens
aaggauaaaccaacagaaa

SEQ ID NO: 1550391 - RNA, 19 nt, Homo sapiens
cugaggaaauuucaacugu

SEQ ID NO: 1550392 - RNA, 19 nt, Homo sapiens
ggauucccuuauaaagaaa

SEQ ID NO: 1550393 - RNA, 19 nt, Homo sapiens
agaaacacaguaagaagaa

SEQ ID NO: 1550394 - RNA, 19 nt, Homo sapiens
gaggauaagaaacaaggaa

SEQ ID NO: 1550395 - RNA, 19 nt, Homo sapiens
aaucagguaacaugacaua

SEQ ID NO: 1550396 - RNA, 19 nt, Homo sapiens
gucuacugcugaauuguuu

SEQ ID NO: 1550397 - RNA, 19 nt, Homo sapiens
ccucacucuugcugucuua

SEQ ID NO: 1550398 - RNA, 19 nt, Homo sapiens
caggauucccuuauaaaga

SEQ ID NO: 1550399 - RNA, 19 nt, Homo sapiens
ugaaugagaacuggaagaa

SEQ ID NO: 1550400 - RNA, 19 nt, Homo sapiens
auauugaagcugagacuua

SEQ ID NO: 1550401 - RNA, 19 nt, Homo sapiens
cauaugcugcuuugaguga

SEQ ID NO: 1550402 - RNA, 19 nt, Homo sapiens
caauacaggauuaucugaa

SEQ ID NO: 1550403 - RNA, 19 nt, Homo sapiens
ugagcuuagugucaucuuu

SEQ ID NO: 1550404 - RNA, 19 nt, Homo sapiens
gauccucacacauccugua

SEQ ID NO: 1550405 - RNA, 19 nt, Homo sapiens
agaauagugugccuuugau

SEQ ID NO: 1550406 - RNA, 19 nt, Homo sapiens
aauugaaucuggauacauc

SEQ ID NO: 1550407 - RNA, 19 nt, Homo sapiens
gaacuggaagaaagaacug

SEQ ID NO: 1550408 - RNA, 19 nt, Homo sapiens
agacaguaaggauaguuua

SEQ ID NO: 1550409 - RNA, 19 nt, Homo sapiens
gaacaaagauacagcagaa

SEQ ID NO: 1550410 - RNA, 19 nt, Homo sapiens
gaucauaguucacuguauu

SEQ ID NO: 1550411 - RNA, 19 nt, Homo sapiens
ggaaaugcgucuauaauac

SEQ ID NO: 1550412 - RNA, 19 nt, Homo sapiens
gaaacacuccucuacauuu

SEQ ID NO: 1550413 - RNA, 19 nt, Homo sapiens
uaacaagaaucuggcauuu

SEQ ID NO: 1550414 - RNA, 19 nt, Homo sapiens
gagagagacccaaacuuua

SEQ ID NO: 1550415 - RNA, 19 nt, Homo sapiens
gaagaggaagagacacuua

SEQ ID NO: 1550416 - RNA, 19 nt, Homo sapiens
uggcauuucucuucaguua

SEQ ID NO: 1550417 - RNA, 19 nt, Homo sapiens
ggaaauaagaccuuuaaag

SEQ ID NO: 1550418 - RNA, 19 nt, Homo sapiens
gaagaaagagauagaauac

SEQ ID NO: 1550419 - RNA, 19 nt, Homo sapiens
caucuaacccuuuaacaaa

SEQ ID NO: 1550420 - RNA, 19 nt, Homo sapiens
ccaaauaaaucuccaugag

SEQ ID NO: 1550421 - RNA, 19 nt, Homo sapiens
gaauaaagaaagggucaua

SEQ ID NO: 1550422 - RNA, 19 nt, Homo sapiens
gcauuucucuucaguuauc

SEQ ID NO: 1550423 - RNA, 19 nt, Homo sapiens
gcagggagcagaaugaaug

SEQ ID NO: 1550424 - RNA, 19 nt, Homo sapiens
gaagacggcaugacuccua

SEQ ID NO: 1550425 - RNA, 19 nt, Homo sapiens
gggaaacacuccucuacau

SEQ ID NO: 1550426 - RNA, 19 nt, Homo sapiens
aaaugcaucuaacccuuua

SEQ ID NO: 1550427 - RNA, 19 nt, Homo sapiens
agagacaucuggccaaguu

SEQ ID NO: 1550428 - RNA, 19 nt, Homo sapiens
ggaaacacuccucuacauu

SEQ ID NO: 1550429 - RNA, 19 nt, Homo sapiens
caacuuaaaugcaucuaac

SEQ ID NO: 1550430 - RNA, 19 nt, Homo sapiens
gcuaugcccauccaaauaa

SEQ ID NO: 1550431 - RNA, 19 nt, Homo sapiens
agagagagacccaaacuuu

SEQ ID NO: 1550432 - RNA, 19 nt, Homo sapiens
gaaaauaaacuucgguuga

SEQ ID NO: 1550433 - RNA, 19 nt, Homo sapiens
ugaggagacuucauaacaa

SEQ ID NO: 1550434 - RNA, 19 nt, Homo sapiens
ggacugaauugcgucaaau

SEQ ID NO: 1550435 - RNA, 19 nt, Homo sapiens
aaacuucgguugauaaacu

SEQ ID NO: 1550436 - RNA, 19 nt, Homo sapiens
gaagaauuccugccuaucu

SEQ ID NO: 1550437 - RNA, 19 nt, Homo sapiens
ccaccaagcugcuagugau

SEQ ID NO: 1550438 - RNA, 19 nt, Homo sapiens
gaggagacuucauaacaag

SEQ ID NO: 1550439 - RNA, 19 nt, Homo sapiens
ggaggaagauguggucgau

SEQ ID NO: 1550440 - RNA, 19 nt, Homo sapiens
uaauggaaaugcgucuaua

SEQ ID NO: 1550441 - RNA, 19 nt, Homo sapiens
uaaugugacuguaauugga

SEQ ID NO: 1550442 - RNA, 19 nt, Homo sapiens
gcaagagagaguuugguuu

SEQ ID NO: 1550443 - RNA, 19 nt, Homo sapiens
ggucuaggaaguauuguuu

SEQ ID NO: 1550444 - RNA, 19 nt, Homo sapiens
caacaucuuugcccuggau

SEQ ID NO: 1550445 - RNA, 19 nt, Homo sapiens
gaaaccaacccugcaauca

SEQ ID NO: 1550446 - RNA, 19 nt, Homo sapiens
agaaagagauagaauacag

SEQ ID NO: 1550447 - RNA, 19 nt, Homo sapiens
uggaaaugcgucuauaaua

SEQ ID NO: 1550448 - RNA, 19 nt, Homo sapiens
gcaguggugugaucauagu

SEQ ID NO: 1550449 - RNA, 19 nt, Homo sapiens
gcaucuaacccuuuaacaa

SEQ ID NO: 1550450 - RNA, 19 nt, Homo sapiens
ucaaagagaagcuccaguu

SEQ ID NO: 1550451 - RNA, 19 nt, Homo sapiens
ggaacgugauggaaguguu

SEQ ID NO: 1550452 - RNA, 19 nt, Homo sapiens
gugcaguggugugaucaua

SEQ ID NO: 1550453 - RNA, 19 nt, Homo sapiens
ccaaaggugugagaaaaua

SEQ ID NO: 1550454 - RNA, 19 nt, Homo sapiens
gaaaugcgucuauaauacu

SEQ ID NO: 1550455 - RNA, 19 nt, Homo sapiens
gguagagacuagaguucuu

SEQ ID NO: 1550456 - RNA, 19 nt, Homo sapiens
aagagaagcuccaguuguc

SEQ ID NO: 1550457 - RNA, 19 nt, Homo sapiens
ggagcagaaugaauguguu

SEQ ID NO: 1550458 - RNA, 19 nt, Homo sapiens
cacaacgccuggcuaaguu

SEQ ID NO: 1550459 - RNA, 19 nt, Homo sapiens
caccucagccucccaagua

SEQ ID NO: 1550460 - RNA, 19 nt, Homo sapiens
gaaaacggccucaaagaug

SEQ ID NO: 1550461 - RNA, 19 nt, Homo sapiens
ggagugcaguggcgugauc

SEQ ID NO: 1550462 - RNA, 19 nt, Homo sapiens
gagagugaagaaagagaua

SEQ ID NO: 1550463 - RNA, 19 nt, Homo sapiens
agccugagauggagaguuu

SEQ ID NO: 1550464 - RNA, 19 nt, Homo sapiens
uaucuaagggcauuaaaga

SEQ ID NO: 1550465 - RNA, 19 nt, Homo sapiens
cuuggaagcccuagagaua

SEQ ID NO: 1550466 - RNA, 19 nt, Homo sapiens
gaacuuggaagcccuagag

SEQ ID NO: 1550467 - RNA, 19 nt, Homo sapiens
gaaucuggcauuucucuuc

SEQ ID NO: 1550468 - RNA, 19 nt, Homo sapiens
ggagaaaccaacccugcaa

SEQ ID NO: 1550469 - RNA, 19 nt, Homo sapiens
uaaaugcaucuaacccuuu

SEQ ID NO: 1550470 - RNA, 19 nt, Homo sapiens
ggagacuucauaacaagaa

SEQ ID NO: 1550471 - RNA, 19 nt, Homo sapiens
ugauggaaguguucagaga

SEQ ID NO: 1550472 - RNA, 19 nt, Homo sapiens
cuaaagcacugggauuaca

SEQ ID NO: 1550473 - RNA, 19 nt, Homo sapiens
ggauaucgaguccugaaga

SEQ ID NO: 1550474 - RNA, 19 nt, Homo sapiens
caaagagaagcuccaguug

SEQ ID NO: 1550475 - RNA, 19 nt, Homo sapiens
ccaggaggcagaucaaaga

SEQ ID NO: 1550476 - RNA, 19 nt, Homo sapiens
auaguucacuguauucuca

SEQ ID NO: 1550477 - RNA, 19 nt, Homo sapiens
gaaaugccuaccugagaga

SEQ ID NO: 1550478 - RNA, 19 nt, Homo sapiens
guucagagaggaagaggaa

SEQ ID NO: 1550479 - RNA, 19 nt, Homo sapiens
aagaucaaguucaagaaga

SEQ ID NO: 1550480 - RNA, 19 nt, Homo sapiens
gagcagaaugaauguguug

SEQ ID NO: 1550481 - RNA, 19 nt, Homo sapiens
cauaagaaugcaacccuaa

SEQ ID NO: 1550482 - RNA, 19 nt, Homo sapiens
ccacaacgccuggcuaagu

SEQ ID NO: 1550483 - RNA, 19 nt, Homo sapiens
guaauggaaaugcgucuau

SEQ ID NO: 1550484 - RNA, 19 nt, Homo sapiens
ucaaagacaaggagcauca

SEQ ID NO: 1550485 - RNA, 19 nt, Homo sapiens
agaucaaguucaagaagaa

SEQ ID NO: 1550486 - RNA, 19 nt, Homo sapiens
ucuuugcccuggauaauga

SEQ ID NO: 1550487 - RNA, 19 nt, Homo sapiens
uaauacuccugccugagaa

SEQ ID NO: 1550488 - RNA, 19 nt, Homo sapiens
ucucauuccuggucaacuu

SEQ ID NO: 1550489 - RNA, 19 nt, Homo sapiens
gcgucaaauucauauguug

SEQ ID NO: 1550490 - RNA, 19 nt, Homo sapiens
aagaaagggucauaugcau

SEQ ID NO: 1550491 - RNA, 19 nt, Homo sapiens
acaccuggcuuauuuugua

SEQ ID NO: 1550492 - RNA, 19 nt, Homo sapiens
gggugcagcugaugaagag

SEQ ID NO: 1550493 - RNA, 19 nt, Homo sapiens
gcagaagugggcagaggaa

SEQ ID NO: 1550494 - RNA, 19 nt, Homo sapiens
ucaagaagaacaaagauac

SEQ ID NO: 1550495 - RNA, 19 nt, Homo sapiens
aaacacuccucuacauuuu

SEQ ID NO: 1550496 - RNA, 19 nt, Homo sapiens
guagagacuagaguucuuu

SEQ ID NO: 1550497 - RNA, 19 nt, Homo sapiens
uggaagcccuagagauaau

SEQ ID NO: 1550498 - RNA, 19 nt, Homo sapiens
ggcuaugcccauccaaaua

SEQ ID NO: 1550499 - RNA, 19 nt, Homo sapiens
gccgugggaugacgaugaa

SEQ ID NO: 1550500 - RNA, 19 nt, Homo sapiens
caagagagaguuugguuuu

SEQ ID NO: 1550501 - RNA, 19 nt, Homo sapiens
uuacaggcgugcaccacaa

SEQ ID NO: 1550502 - RNA, 19 nt, Homo sapiens
uaagaccuuuaaagaagug

SEQ ID NO: 1550503 - RNA, 19 nt, Homo sapiens
gaaggucucagucucuuac

SEQ ID NO: 1550504 - RNA, 19 nt, Homo sapiens
gagagaguuugguuuuaaa

SEQ ID NO: 1550505 - RNA, 19 nt, Homo sapiens
ugcccuggauaaugacuua

SEQ ID NO: 1550506 - RNA, 19 nt, Homo sapiens
uaaagaaagggucauaugc

SEQ ID NO: 1550507 - RNA, 19 nt, Homo sapiens
aagcugcuagugauaguua

SEQ ID NO: 1550508 - RNA, 19 nt, Homo sapiens
gcagaggaacgugauggaa

SEQ ID NO: 1550509 - RNA, 19 nt, Homo sapiens
gaagacgacucccuguaug

SEQ ID NO: 1550510 - RNA, 19 nt, Homo sapiens
ggagaggacugcacacaca

SEQ ID NO: 1550511 - RNA, 19 nt, Homo sapiens
ccaaggcccugcagcugua

SEQ ID NO: 1550512 - RNA, 19 nt, Homo sapiens
ggaggaggaugaagacaca

SEQ ID NO: 1550513 - RNA, 19 nt, Homo sapiens
gaagcagcaugcccaggaa

SEQ ID NO: 1550514 - RNA, 19 nt, Homo sapiens
ggacacugaugcugaccuu

SEQ ID NO: 1550515 - RNA, 19 nt, Homo sapiens
guacaaugguggagugagu

SEQ ID NO: 1550516 - RNA, 19 nt, Homo sapiens
ggacaggcccucagaagca

SEQ ID NO: 1550517 - RNA, 19 nt, Homo sapiens
gccagccugucccucauua

SEQ ID NO: 1550518 - RNA, 19 nt, Homo sapiens
ucucuuagccugagccuuu

SEQ ID NO: 1550519 - RNA, 19 nt, Homo sapiens
gagaugagcauuuuguuuu

SEQ ID NO: 1550520 - RNA, 19 nt, Homo sapiens
ugaggaggauggugacaga

SEQ ID NO: 1550521 - RNA, 19 nt, Homo sapiens
gagccuuucucccaaguuc

SEQ ID NO: 1550522 - RNA, 19 nt, Homo sapiens
gagccgagauccaccugau

SEQ ID NO: 1550523 - RNA, 19 nt, Homo sapiens
ggagugaguacgcuguaaa

SEQ ID NO: 1550524 - RNA, 19 nt, Homo sapiens
ccucagugcugccaucugu

SEQ ID NO: 1550525 - RNA, 19 nt, Homo sapiens
gaggagcggcuauggcauu

SEQ ID NO: 1550526 - RNA, 19 nt, Homo sapiens
cugcguaggucucaggauu

SEQ ID NO: 1550527 - RNA, 19 nt, Homo sapiens
ugaagacgacucccuguau

SEQ ID NO: 1550528 - RNA, 19 nt, Homo sapiens
gagcacauccagaaagaag

SEQ ID NO: 1550529 - RNA, 19 nt, Homo sapiens
uugagccucuuuccugaua

SEQ ID NO: 1550530 - RNA, 19 nt, Homo sapiens
ccaccagacccgagcagua

SEQ ID NO: 1550531 - RNA, 19 nt, Homo sapiens
gaggugagcgcuacauugg

SEQ ID NO: 1550532 - RNA, 19 nt, Homo sapiens
ggacauacggggaaauuga

SEQ ID NO: 1550533 - RNA, 19 nt, Homo sapiens
ccgagugccugcagaagau

SEQ ID NO: 1550534 - RNA, 19 nt, Homo sapiens
gagcggcuauggcauugag

SEQ ID NO: 1550535 - RNA, 19 nt, Homo sapiens
gaaagcugcuccggacacu

SEQ ID NO: 1550536 - RNA, 19 nt, Homo sapiens
caucuucaaugaccccuua

SEQ ID NO: 1550537 - RNA, 19 nt, Homo sapiens
aguacaagcugcccaugga

SEQ ID NO: 1550538 - RNA, 19 nt, Homo sapiens
guuacgagcacauccagaa

SEQ ID NO: 1550539 - RNA, 19 nt, Homo sapiens
ccugauccgugacaugaug

SEQ ID NO: 1550540 - RNA, 19 nt, Homo sapiens
ggaugaagacacagagaca

SEQ ID NO: 1550541 - RNA, 19 nt, Homo sapiens
gugaguacgcuguaaagga

SEQ ID NO: 1550542 - RNA, 19 nt, Homo sapiens
ccacuagcccaucuucaau

SEQ ID NO: 1550543 - RNA, 19 nt, Homo sapiens
gccacuagcccaucuucaa

SEQ ID NO: 1550544 - RNA, 19 nt, Homo sapiens
acuagcccaucuucaauga

SEQ ID NO: 1550545 - RNA, 19 nt, Homo sapiens
acgagcacauccagaaaga

SEQ ID NO: 1550546 - RNA, 19 nt, Homo sapiens
ugacgagcaaucagaggua

SEQ ID NO: 1550547 - RNA, 19 nt, Homo sapiens
ggagaugagcauuuuguuu

SEQ ID NO: 1550548 - RNA, 19 nt, Homo sapiens
gcauccuccucucugaaga

SEQ ID NO: 1550549 - RNA, 19 nt, Homo sapiens
caccugauccgugacauga

SEQ ID NO: 1550550 - RNA, 19 nt, Homo sapiens
gcugcgaguugccuuagag

SEQ ID NO: 1550551 - RNA, 19 nt, Homo sapiens
gcaggacaggcccucagaa

SEQ ID NO: 1550552 - RNA, 19 nt, Homo sapiens
ucuaccugcugcuucauga

SEQ ID NO: 1550553 - RNA, 19 nt, Homo sapiens
gaugaagacacagagacaa

SEQ ID NO: 1550554 - RNA, 19 nt, Homo sapiens
aagcugcuccggacacuga

SEQ ID NO: 1550555 - RNA, 19 nt, Homo sapiens
ggacagugugggcaguaug

SEQ ID NO: 1550556 - RNA, 19 nt, Homo sapiens
gcguaggucucaggauuac

SEQ ID NO: 1550557 - RNA, 19 nt, Homo sapiens
gcacauccagaaagaagac

SEQ ID NO: 1550558 - RNA, 19 nt, Homo sapiens
gaccugcugccacuucuca

SEQ ID NO: 1550559 - RNA, 19 nt, Homo sapiens
gaggaugaagacacagaga

SEQ ID NO: 1550560 - RNA, 19 nt, Homo sapiens
gaggacagugugggcagua

SEQ ID NO: 1550561 - RNA, 19 nt, Homo sapiens
gugcugccaucuguacaau

SEQ ID NO: 1550562 - RNA, 19 nt, Homo sapiens
caugaggcugcaccgcuua

SEQ ID NO: 1550563 - RNA, 19 nt, Homo sapiens
uggagugaguacgcuguaa

SEQ ID NO: 1550564 - RNA, 19 nt, Homo sapiens
uggaggagaugagcauuuu

SEQ ID NO: 1550565 - RNA, 19 nt, Homo sapiens
gggcauccuccucucugaa

SEQ ID NO: 1550566 - RNA, 19 nt, Homo sapiens
ccaccgagugccugcagaa

SEQ ID NO: 1550567 - RNA, 19 nt, Homo sapiens
gagugaguacgcuguaaag

SEQ ID NO: 1550568 - RNA, 19 nt, Homo sapiens
agaggugagcgcuacauug

SEQ ID NO: 1550569 - RNA, 19 nt, Homo sapiens
gaaagaacauccucagcua

SEQ ID NO: 1550570 - RNA, 19 nt, Homo sapiens
gcaaaugucugaccuggaa

SEQ ID NO: 1550571 - RNA, 19 nt, Homo sapiens
ggaaggaggugaggaaugg

SEQ ID NO: 1550572 - RNA, 19 nt, Homo sapiens
ccaaaggccuggcuacaag

SEQ ID NO: 1550573 - RNA, 19 nt, Homo sapiens
gagcuugggucccugaaca

SEQ ID NO: 1550574 - RNA, 19 nt, Homo sapiens
gaaaugggaaggaucagau

SEQ ID NO: 1550575 - RNA, 19 nt, Homo sapiens
ggaaggaucagauaugacu

SEQ ID NO: 1550576 - RNA, 19 nt, Homo sapiens
gucauucacccaauaaauu

SEQ ID NO: 1550577 - RNA, 19 nt, Homo sapiens
ugggaaggaucagauauga

SEQ ID NO: 1550578 - RNA, 19 nt, Homo sapiens
caagggagacuggccauug

SEQ ID NO: 1550579 - RNA, 19 nt, Homo sapiens
gagccugauuguccugaga

SEQ ID NO: 1550580 - RNA, 19 nt, Homo sapiens
ucacgugguuccgagauga

SEQ ID NO: 1550581 - RNA, 19 nt, Homo sapiens
gugagucccgugugucaua

SEQ ID NO: 1550582 - RNA, 19 nt, Homo sapiens
cgaggucccuggcaguugu

SEQ ID NO: 1550583 - RNA, 19 nt, Homo sapiens
ugggacaucuuccgacaug

SEQ ID NO: 1550584 - RNA, 19 nt, Homo sapiens
gggcagcaccgucuauuac

SEQ ID NO: 1550585 - RNA, 19 nt, Homo sapiens
gcccacacauacccucuuc

SEQ ID NO: 1550586 - RNA, 19 nt, Homo sapiens
gcagcaccgucuauuacca

SEQ ID NO: 1550587 - RNA, 19 nt, Homo sapiens
ugagaaaugggaaggauca

SEQ ID NO: 1550588 - RNA, 19 nt, Homo sapiens
guuccgagaugaggugguu

SEQ ID NO: 1550589 - RNA, 19 nt, Homo sapiens
agaccucacugcucagauc

SEQ ID NO: 1550590 - RNA, 19 nt, Homo sapiens
ccuucgggcuggauucuau

SEQ ID NO: 1550591 - RNA, 19 nt, Homo sapiens
cacugucauucacccaaua

SEQ ID NO: 1550592 - RNA, 19 nt, Homo sapiens
aaaugggaaggaucagaua

SEQ ID NO: 1550593 - RNA, 19 nt, Homo sapiens
ccacacauacccucuucug

SEQ ID NO: 1550594 - RNA, 19 nt, Homo sapiens
cugauuguccugagaaaug

SEQ ID NO: 1550595 - RNA, 19 nt, Homo sapiens
gggaaggaggugaggaaug

SEQ ID NO: 1550596 - RNA, 19 nt, Homo sapiens
ugagauucguacccuggaa

SEQ ID NO: 1550597 - RNA, 19 nt, Homo sapiens
ucagauaugacuccuccuu

SEQ ID NO: 1550598 - RNA, 19 nt, Homo sapiens
uaccagggcaaaugucuga

SEQ ID NO: 1550599 - RNA, 19 nt, Homo sapiens
gcaucuacgugugcagagu

SEQ ID NO: 1550600 - RNA, 19 nt, Homo sapiens
acacugucauucacccaau

SEQ ID NO: 1550601 - RNA, 19 nt, Homo sapiens
cagggaggcaagcauuuga

SEQ ID NO: 1550602 - RNA, 19 nt, Homo sapiens
gaccaaaggccuggcuaca

SEQ ID NO: 1550603 - RNA, 19 nt, Homo sapiens
ccugagaaaugggaaggau

SEQ ID NO: 1550604 - RNA, 19 nt, Homo sapiens
cagggaaggaggugaggaa

SEQ ID NO: 1550605 - RNA, 19 nt, Homo sapiens
ggcuggugguggagaaaga

SEQ ID NO: 1550606 - RNA, 19 nt, Homo sapiens
aaaggccuggcuacaagua

SEQ ID NO: 1550607 - RNA, 19 nt, Homo sapiens
gggaggcaagcauuugaug

SEQ ID NO: 1550608 - RNA, 19 nt, Homo sapiens
ugggcagcaccgucuauua

SEQ ID NO: 1550609 - RNA, 19 nt, Homo sapiens
gccugauuguccugagaaa

SEQ ID NO: 1550610 - RNA, 19 nt, Homo sapiens
ucagggaggcaagcauuug

SEQ ID NO: 1550611 - RNA, 19 nt, Homo sapiens
aagggagacuggccauugg

SEQ ID NO: 1550612 - RNA, 19 nt, Homo sapiens
gaacuacucuucauguaua

SEQ ID NO: 1550613 - RNA, 19 nt, Homo sapiens
ggaacaagauuaugcauga

SEQ ID NO: 1550614 - RNA, 19 nt, Homo sapiens
gcucaucucuccacaaauu

SEQ ID NO: 1550615 - RNA, 19 nt, Homo sapiens
gauaggaacuaguauauuc

SEQ ID NO: 1550616 - RNA, 19 nt, Homo sapiens
aaagaucgcugguguguuu

SEQ ID NO: 1550617 - RNA, 19 nt, Homo sapiens
ggacuucgguggaguaaug

SEQ ID NO: 1550618 - RNA, 19 nt, Homo sapiens
gcauugagcuuaaucugaa

SEQ ID NO: 1550619 - RNA, 19 nt, Homo sapiens
ggacagauuuacuacguuu

SEQ ID NO: 1550620 - RNA, 19 nt, Homo sapiens
ggacaaccaugaaaucugu

SEQ ID NO: 1550621 - RNA, 19 nt, Homo sapiens
ggaccagaauuacaaauau

SEQ ID NO: 1550622 - RNA, 19 nt, Homo sapiens
gaagugagagauguuauua

SEQ ID NO: 1550623 - RNA, 19 nt, Homo sapiens
gaacuggacagauuuacua

SEQ ID NO: 1550624 - RNA, 19 nt, Homo sapiens
gggaugaccuucuggauau

SEQ ID NO: 1550625 - RNA, 19 nt, Homo sapiens
gaugggcgcuugugugauu

SEQ ID NO: 1550626 - RNA, 19 nt, Homo sapiens
ggaacaugguggaugauaa

SEQ ID NO: 1550627 - RNA, 19 nt, Homo sapiens
gaaguucucuccuugaaag

SEQ ID NO: 1550628 - RNA, 19 nt, Homo sapiens
gaggaaaguuguucgagaa

SEQ ID NO: 1550629 - RNA, 19 nt, Homo sapiens
gagcugagccgguuucuga

SEQ ID NO: 1550630 - RNA, 19 nt, Homo sapiens
gcacuuauguauuucuguu

SEQ ID NO: 1550631 - RNA, 19 nt, Homo sapiens
ucucaaagcuuccuucaga

SEQ ID NO: 1550632 - RNA, 19 nt, Homo sapiens
gaacaugguggaugauaaa

SEQ ID NO: 1550633 - RNA, 19 nt, Homo sapiens
gaagaacuggacagauuua

SEQ ID NO: 1550634 - RNA, 19 nt, Homo sapiens
gcauguggcucaagaagug

SEQ ID NO: 1550635 - RNA, 19 nt, Homo sapiens
gcaccuacuuugcagauug

SEQ ID NO: 1550636 - RNA, 19 nt, Homo sapiens
caauugaggacaacaaaua

SEQ ID NO: 1550637 - RNA, 19 nt, Homo sapiens
gagcuucuuuaucauagua

SEQ ID NO: 1550638 - RNA, 19 nt, Homo sapiens
ggaguaauggacauauuua

SEQ ID NO: 1550639 - RNA, 19 nt, Homo sapiens
gccagccucuugauuguua

SEQ ID NO: 1550640 - RNA, 19 nt, Homo sapiens
gagaagacagugaaauaaa

SEQ ID NO: 1550641 - RNA, 19 nt, Homo sapiens
caagagcgcaggucacuaa

SEQ ID NO: 1550642 - RNA, 19 nt, Homo sapiens
gauuucaccugcauuagaa

SEQ ID NO: 1550643 - RNA, 19 nt, Homo sapiens
gcauuuccaugauguuuga

SEQ ID NO: 1550644 - RNA, 19 nt, Homo sapiens
gggauuuacuggauauauu

SEQ ID NO: 1550645 - RNA, 19 nt, Homo sapiens
gauaugguguuugggauuu

SEQ ID NO: 1550646 - RNA, 19 nt, Homo sapiens
gagcauuccggauuuauuu

SEQ ID NO: 1550647 - RNA, 19 nt, Homo sapiens
cggcagagaugauagcaaa

SEQ ID NO: 1550648 - RNA, 19 nt, Homo sapiens
ggugaagacuggaacaaga

SEQ ID NO: 1550649 - RNA, 19 nt, Homo sapiens
uauggcagauggcuuauuu

SEQ ID NO: 1550650 - RNA, 19 nt, Homo sapiens
gaacuacuacucguaauug

SEQ ID NO: 1550651 - RNA, 19 nt, Homo sapiens
gauuauggcagauggcuua

SEQ ID NO: 1550652 - RNA, 19 nt, Homo sapiens
gcaagaagaggaacucaga

SEQ ID NO: 1550653 - RNA, 19 nt, Homo sapiens
caacuuagaacuugaugaa

SEQ ID NO: 1550654 - RNA, 19 nt, Homo sapiens
ggagguggcuuuuacagua

SEQ ID NO: 1550655 - RNA, 19 nt, Homo sapiens
ccacccagauguuucauga

SEQ ID NO: 1550656 - RNA, 19 nt, Homo sapiens
gugaagaacguguuuauug

SEQ ID NO: 1550657 - RNA, 19 nt, Homo sapiens
gaucuucgccacuuucaaa

SEQ ID NO: 1550658 - RNA, 19 nt, Homo sapiens
guaauggaccaaacucuaa

SEQ ID NO: 1550659 - RNA, 19 nt, Homo sapiens
ccacaaauucgaacuacua

SEQ ID NO: 1550660 - RNA, 19 nt, Homo sapiens
gcauggaccuugaagaucu

SEQ ID NO: 1550661 - RNA, 19 nt, Homo sapiens
gaagaggaacucagagaga

SEQ ID NO: 1550662 - RNA, 19 nt, Homo sapiens
uugaagaacuggacagauu

SEQ ID NO: 1550663 - RNA, 19 nt, Homo sapiens
uaagauuucaccugcauua

SEQ ID NO: 1550664 - RNA, 19 nt, Homo sapiens
aauguaaccuggaauaguu

SEQ ID NO: 1550665 - RNA, 19 nt, Homo sapiens
gaaugcauauacuuacaug

SEQ ID NO: 1550666 - RNA, 19 nt, Homo sapiens
uaagaggacaaucgcauua

SEQ ID NO: 1550667 - RNA, 19 nt, Homo sapiens
gauaagccacuguucauug

SEQ ID NO: 1550668 - RNA, 19 nt, Homo sapiens
aaaggaaagugcaagaaga

SEQ ID NO: 1550669 - RNA, 19 nt, Homo sapiens
uagcucaucucuccacaaa

SEQ ID NO: 1550670 - RNA, 19 nt, Homo sapiens
gagauaggaacuaguauau

SEQ ID NO: 1550671 - RNA, 19 nt, Homo sapiens
ggaugucaauguagaugaa

SEQ ID NO: 1550672 - RNA, 19 nt, Homo sapiens
ggaggaaggacaaccauga

SEQ ID NO: 1550673 - RNA, 19 nt, Homo sapiens
cagcagcagucgugcagua

SEQ ID NO: 1550674 - RNA, 19 nt, Homo sapiens
acagugagauauagaaaug

SEQ ID NO: 1550675 - RNA, 19 nt, Homo sapiens
ggaccaaacucuaaaugcu

SEQ ID NO: 1550676 - RNA, 19 nt, Homo sapiens
gaacguguuuauugcuguu

SEQ ID NO: 1550677 - RNA, 19 nt, Homo sapiens
gaagacuggaacaagauua

SEQ ID NO: 1550678 - RNA, 19 nt, Homo sapiens
gcagauugcugaguaugug

SEQ ID NO: 1550679 - RNA, 19 nt, Homo sapiens
gaagacagugaaauaaaga

SEQ ID NO: 1550680 - RNA, 19 nt, Homo sapiens
cuacagguguuugaaauug

SEQ ID NO: 1550681 - RNA, 19 nt, Homo sapiens
ccaauaagccauucagugu

SEQ ID NO: 1550682 - RNA, 19 nt, Homo sapiens
ggacacgaaugccaacagu

SEQ ID NO: 1550683 - RNA, 19 nt, Homo sapiens
uaacaggcaugcaaauuuu

SEQ ID NO: 1550684 - RNA, 19 nt, Homo sapiens
gaaaacauguaacgcuaaa

SEQ ID NO: 1550685 - RNA, 19 nt, Homo sapiens
gaguacaguuucaacaaau

SEQ ID NO: 1550686 - RNA, 19 nt, Homo sapiens
uacaguggcuuuaaugaga

SEQ ID NO: 1550687 - RNA, 19 nt, Homo sapiens
ggauuuauuuccgauuuga

SEQ ID NO: 1550688 - RNA, 19 nt, Homo sapiens
uuagguggaugucaaugua

SEQ ID NO: 1550689 - RNA, 19 nt, Homo sapiens
ucagucaacuuacgguuug

SEQ ID NO: 1550690 - RNA, 19 nt, Homo sapiens
gcgcuugugugauuguauu

SEQ ID NO: 1550691 - RNA, 19 nt, Homo sapiens
gaaagugcaagaagaggaa

SEQ ID NO: 1550692 - RNA, 19 nt, Homo sapiens
aagagaagacagugaaaua

SEQ ID NO: 1550693 - RNA, 19 nt, Homo sapiens
gaagaccuaaagaagcuua

SEQ ID NO: 1550694 - RNA, 19 nt, Homo sapiens
ggaguuugguuguauuuac

SEQ ID NO: 1550695 - RNA, 19 nt, Homo sapiens
ugaaaucugucgugugcaa

SEQ ID NO: 1550696 - RNA, 19 nt, Homo sapiens
gaaggacaaccaugaaauc

SEQ ID NO: 1550697 - RNA, 19 nt, Homo sapiens
cuucgccacuuucaaauaa

SEQ ID NO: 1550698 - RNA, 19 nt, Homo sapiens
gaagaaaccgauacgaucu

SEQ ID NO: 1550699 - RNA, 19 nt, Homo sapiens
ggaagugagagauguuauu

SEQ ID NO: 1550700 - RNA, 19 nt, Homo sapiens
cuugugagcuugauauuuc

SEQ ID NO: 1550701 - RNA, 19 nt, Homo sapiens
gagagaaccacccauacuu

SEQ ID NO: 1550702 - RNA, 19 nt, Homo sapiens
caacaaauacaucgaccaa

SEQ ID NO: 1550703 - RNA, 19 nt, Homo sapiens
caaagcuuccuucagauuu

SEQ ID NO: 1550704 - RNA, 19 nt, Homo sapiens
uuaaaugcauggaccuuga

SEQ ID NO: 1550705 - RNA, 19 nt, Homo sapiens
gggaauguaaccuggaaua

SEQ ID NO: 1550706 - RNA, 19 nt, Homo sapiens
ggaaggacaaccaugaaau

SEQ ID NO: 1550707 - RNA, 19 nt, Homo sapiens
cgagggagcagcuggagua

SEQ ID NO: 1550708 - RNA, 19 nt, Homo sapiens
uauggaacaugguggauga

SEQ ID NO: 1550709 - RNA, 19 nt, Homo sapiens
caaaugcggacaccaaaga

SEQ ID NO: 1550710 - RNA, 19 nt, Homo sapiens
uaaaugcugugggacauau

SEQ ID NO: 1550711 - RNA, 19 nt, Homo sapiens
guaguucggcugauuaaga

SEQ ID NO: 1550712 - RNA, 19 nt, Homo sapiens
ggaaacauuuagagaacaa

SEQ ID NO: 1550713 - RNA, 19 nt, Homo sapiens
gcuaacauuuggaaacauu

SEQ ID NO: 1550714 - RNA, 19 nt, Homo sapiens
cagcaucccugacuuuguu

SEQ ID NO: 1550715 - RNA, 19 nt, Homo sapiens
gaaacagcaucccugacuu

SEQ ID NO: 1550716 - RNA, 19 nt, Homo sapiens
caaccaggauagaagauca

SEQ ID NO: 1550717 - RNA, 19 nt, Homo sapiens
ugagagaccuggauuugca

SEQ ID NO: 1550718 - RNA, 19 nt, Homo sapiens
ccucagcucuucacaguca

SEQ ID NO: 1550719 - RNA, 19 nt, Homo sapiens
caacuccucuaaauuuguc

SEQ ID NO: 1550720 - RNA, 19 nt, Homo sapiens
caggauagaagaucaguug

SEQ ID NO: 1550721 - RNA, 19 nt, Homo sapiens
aaacagcaucccugacuuu

SEQ ID NO: 1550722 - RNA, 19 nt, Homo sapiens
ggguuaacaugcagauugu

SEQ ID NO: 1550723 - RNA, 19 nt, Homo sapiens
gcugagagaccuggauuug

SEQ ID NO: 1550724 - RNA, 19 nt, Homo sapiens
gguguucucugcugagucu

SEQ ID NO: 1550725 - RNA, 19 nt, Homo sapiens
ggauagaagaucaguugug

SEQ ID NO: 1550726 - RNA, 19 nt, Homo sapiens
gcagagagaggugauaguc

SEQ ID NO: 1550727 - RNA, 19 nt, Homo sapiens
guaugccugugugagaaua

SEQ ID NO: 1550728 - RNA, 19 nt, Homo sapiens
guuaugggaucccuuucug

SEQ ID NO: 1550729 - RNA, 19 nt, Homo sapiens
gguuugccaucgaaggaaa

SEQ ID NO: 1550730 - RNA, 19 nt, Homo sapiens
cagccagguuguagaaaca

SEQ ID NO: 1550731 - RNA, 19 nt, Homo sapiens
gcaaucagacagcucacau

SEQ ID NO: 1550732 - RNA, 19 nt, Homo sapiens
guguaugccugugugagaa

SEQ ID NO: 1550733 - RNA, 19 nt, Homo sapiens
gaccugcuccuuccugcuu

SEQ ID NO: 1550734 - RNA, 19 nt, Homo sapiens
ccucucuccuuuggguuua

SEQ ID NO: 1550735 - RNA, 19 nt, Homo sapiens
aaagguacaagcugagaga

SEQ ID NO: 1550736 - RNA, 19 nt, Homo sapiens
ugccucagcucuucacagu

SEQ ID NO: 1550737 - RNA, 19 nt, Homo sapiens
cugcuaacauuuggaaaca

SEQ ID NO: 1550738 - RNA, 19 nt, Homo sapiens
ccagccagguuguagaaac

SEQ ID NO: 1550739 - RNA, 19 nt, Homo sapiens
gcucacauggacccaaguu

SEQ ID NO: 1550740 - RNA, 19 nt, Homo sapiens
uauuuuggcugcuaacauu

SEQ ID NO: 1550741 - RNA, 19 nt, Homo sapiens
caagacaagaaacaaacug

SEQ ID NO: 1550742 - RNA, 19 nt, Homo sapiens
ugaaaggucuccccaaagg

SEQ ID NO: 1550743 - RNA, 19 nt, Homo sapiens
caugagggaccuggaaaug

SEQ ID NO: 1550744 - RNA, 19 nt, Homo sapiens
agaaacagcaucccugacu

SEQ ID NO: 1550745 - RNA, 19 nt, Homo sapiens
uucaacuccucuaaauuug

SEQ ID NO: 1550746 - RNA, 19 nt, Homo sapiens
uuggaaacauuuagagaac

SEQ ID NO: 1550747 - RNA, 19 nt, Homo sapiens
gagccagccagguuguaga

SEQ ID NO: 1550748 - RNA, 19 nt, Homo sapiens
ccaaagguacaagcugaga

SEQ ID NO: 1550749 - RNA, 19 nt, Homo sapiens
ucucugcugagucugguua

SEQ ID NO: 1550750 - RNA, 19 nt, Homo sapiens
gccaugagggaccuggaaa

SEQ ID NO: 1550751 - RNA, 19 nt, Homo sapiens
gaagacaaaggcccaaaua

SEQ ID NO: 1550752 - RNA, 19 nt, Homo sapiens
ggagagaaaugaagacauc

SEQ ID NO: 1550753 - RNA, 19 nt, Homo sapiens
gaagaaaggagagaaauga

SEQ ID NO: 1550754 - RNA, 19 nt, Homo sapiens
ucaaugagcucacagaagu

SEQ ID NO: 1550755 - RNA, 19 nt, Homo sapiens
gaaaggcagccaagaugua

SEQ ID NO: 1550756 - RNA, 19 nt, Homo sapiens
gaaaggagagaaaugaaga

SEQ ID NO: 1550757 - RNA, 19 nt, Homo sapiens
cgaaauggcugaagugcau

SEQ ID NO: 1550758 - RNA, 19 nt, Homo sapiens
gggaaucagaguauauuua

SEQ ID NO: 1550759 - RNA, 19 nt, Homo sapiens
gaagaagaaaggagagaaa

SEQ ID NO: 1550760 - RNA, 19 nt, Homo sapiens
agagguggcuucagaaaug

SEQ ID NO: 1550761 - RNA, 19 nt, Homo sapiens
uaacagugccagcuucuuu

SEQ ID NO: 1550762 - RNA, 19 nt, Homo sapiens
cagacaagcuggagacugu

SEQ ID NO: 1550763 - RNA, 19 nt, Homo sapiens
ggacacaguggccaucaaa

SEQ ID NO: 1550764 - RNA, 19 nt, Homo sapiens
gagaggauaagaagaagaa

SEQ ID NO: 1550765 - RNA, 19 nt, Homo sapiens
cagccaagauguacacaga

SEQ ID NO: 1550766 - RNA, 19 nt, Homo sapiens
gugaaggaguaaugggaua

SEQ ID NO: 1550767 - RNA, 19 nt, Homo sapiens
caccgaggaugaauaaaug

SEQ ID NO: 1550768 - RNA, 19 nt, Homo sapiens
gggcuacccucauuucaca

SEQ ID NO: 1550769 - RNA, 19 nt, Homo sapiens
agaaugaggccaagaagaa

SEQ ID NO: 1550770 - RNA, 19 nt, Homo sapiens
ggaaccagacaaucucgua

SEQ ID NO: 1550771 - RNA, 19 nt, Homo sapiens
ugacaccgaggaugaauaa

SEQ ID NO: 1550772 - RNA, 19 nt, Homo sapiens
cagcagacaucaagcucaa

SEQ ID NO: 1550773 - RNA, 19 nt, Homo sapiens
gauaagaagaagaagaaga

SEQ ID NO: 1550774 - RNA, 19 nt, Homo sapiens
gcacguggugggcaucuuu

SEQ ID NO: 1550775 - RNA, 19 nt, Homo sapiens
agaagaagaagaagaagaa

SEQ ID NO: 1550776 - RNA, 19 nt, Homo sapiens
agaagaagaagaagaagaa

SEQ ID NO: 1550777 - RNA, 19 nt, Homo sapiens
aaaugaugcucgcugacua

SEQ ID NO: 1550778 - RNA, 19 nt, Homo sapiens
acacagagcuaaggccaau

SEQ ID NO: 1550779 - RNA, 19 nt, Homo sapiens
caggagaggauaagaagaa

SEQ ID NO: 1550780 - RNA, 19 nt, Homo sapiens
gcgaaaggcagccaagaug

SEQ ID NO: 1550781 - RNA, 19 nt, Homo sapiens
caccgucccucugcagaua

SEQ ID NO: 1550782 - RNA, 19 nt, Homo sapiens
cacaguggccaucaaagua

SEQ ID NO: 1550783 - RNA, 19 nt, Homo sapiens
gcuagagggugccggaaag

SEQ ID NO: 1550784 - RNA, 19 nt, Homo sapiens
aaguagagguggcuucaga

SEQ ID NO: 1550785 - RNA, 19 nt, Homo sapiens
gccaagauguacacagaca

SEQ ID NO: 1550786 - RNA, 19 nt, Homo sapiens
ccagggcccuagaagauca

SEQ ID NO: 1550787 - RNA, 19 nt, Homo sapiens
ggaaagagagcuggagucu

SEQ ID NO: 1550788 - RNA, 19 nt, Homo sapiens
gcacgaaauggcugaagug

SEQ ID NO: 1550789 - RNA, 19 nt, Homo sapiens
ggauggcaguggcugugaa

SEQ ID NO: 1550790 - RNA, 19 nt, Homo sapiens
cagaggcuguggucagaga

SEQ ID NO: 1550791 - RNA, 19 nt, Homo sapiens
agaagaagaagaagaagga

SEQ ID NO: 1550792 - RNA, 19 nt, Homo sapiens
guagagguggcuucagaaa

SEQ ID NO: 1550793 - RNA, 19 nt, Homo sapiens
uagaggaggaugagaagaa

SEQ ID NO: 1550794 - RNA, 19 nt, Homo sapiens
gaggauaagaagaagaaga

SEQ ID NO: 1550795 - RNA, 19 nt, Homo sapiens
gggcuccucuugggaauca

SEQ ID NO: 1550796 - RNA, 19 nt, Homo sapiens
gaagaaugaggccaagaag

SEQ ID NO: 1550797 - RNA, 19 nt, Homo sapiens
acaucaagcucaaggcaau

SEQ ID NO: 1550798 - RNA, 19 nt, Homo sapiens
guuggacucugagcucauu

SEQ ID NO: 1550799 - RNA, 19 nt, Homo sapiens
ccaaggagacagugguguu

SEQ ID NO: 1550800 - RNA, 19 nt, Homo sapiens
gcucaagggaguaaguaga

SEQ ID NO: 1550801 - RNA, 19 nt, Homo sapiens
guaaugggauaugggguua

SEQ ID NO: 1550802 - RNA, 19 nt, Homo sapiens
caguggcugugaaggagua

SEQ ID NO: 1550803 - RNA, 19 nt, Homo sapiens
agaagaaugaggccaagaa

SEQ ID NO: 1550804 - RNA, 19 nt, Homo sapiens
cuucuaccauuucccacua

SEQ ID NO: 1550805 - RNA, 19 nt, Homo sapiens
gcagcuuccucuucuacca

SEQ ID NO: 1550806 - RNA, 19 nt, Homo sapiens
agaagaagaaggacagugu

SEQ ID NO: 1550807 - RNA, 19 nt, Homo sapiens
cccgguaccugcagcgaaa

SEQ ID NO: 1550808 - RNA, 19 nt, Homo sapiens
acaccgaggaugaauaaau

SEQ ID NO: 1550809 - RNA, 19 nt, Homo sapiens
gcaggaaccagacaaucuc

SEQ ID NO: 1550810 - RNA, 19 nt, Homo sapiens
aggauaagaagaagaagaa

SEQ ID NO: 1550811 - RNA, 19 nt, Homo sapiens
gaaggaguaaugggauaug

SEQ ID NO: 1550812 - RNA, 19 nt, Homo sapiens
cgaaaggcagccaagaugu

SEQ ID NO: 1550813 - RNA, 19 nt, Homo sapiens
guaaguagagguggcuuca

SEQ ID NO: 1550814 - RNA, 19 nt, Homo sapiens
ggcacgaaauggcugaagu

SEQ ID NO: 1550815 - RNA, 19 nt, Homo sapiens
agaggaggaugagaagaau

SEQ ID NO: 1550816 - RNA, 19 nt, Homo sapiens
agaagaaaggagagaaaug

SEQ ID NO: 1550817 - RNA, 19 nt, Homo sapiens
gaaugaggccaagaagaag

SEQ ID NO: 1550818 - RNA, 19 nt, Homo sapiens
ucaaaguagaggaggauga

SEQ ID NO: 1550819 - RNA, 19 nt, Homo sapiens
ggagaggauaagaagaaga

SEQ ID NO: 1550820 - RNA, 19 nt, Homo sapiens
gaagucccaggagaggaua

SEQ ID NO: 1550821 - RNA, 19 nt, Homo sapiens
caagauguacacagacaag

SEQ ID NO: 1550822 - RNA, 19 nt, Homo sapiens
agacaaaggcccaaauagc

SEQ ID NO: 1550823 - RNA, 19 nt, Homo sapiens
ggcaggaaccagacaaucu

SEQ ID NO: 1550824 - RNA, 19 nt, Homo sapiens
gccuaggcuuggcuccuuu

SEQ ID NO: 1550825 - RNA, 19 nt, Homo sapiens
caaaguagaggaggaugag

SEQ ID NO: 1550826 - RNA, 19 nt, Homo sapiens
acacaguggccaucaaagu

SEQ ID NO: 1550827 - RNA, 19 nt, Homo sapiens
gcugugcugugucuucaac

SEQ ID NO: 1550828 - RNA, 19 nt, Homo sapiens
gagguggcuucagaaaugg

SEQ ID NO: 1550829 - RNA, 19 nt, Homo sapiens
aggaggaugagaagaauga

SEQ ID NO: 1550830 - RNA, 19 nt, Homo sapiens
gaagaagaagaagaagaag

SEQ ID NO: 1550831 - RNA, 19 nt, Homo sapiens
gaagaagaagaagaagaag

SEQ ID NO: 1550832 - RNA, 19 nt, Homo sapiens
gcagcaggagggacucugu

SEQ ID NO: 1550833 - RNA, 19 nt, Homo sapiens
aagaagaagaagaagaaga

SEQ ID NO: 1550834 - RNA, 19 nt, Homo sapiens
cgaggaugaauaaaugaug

SEQ ID NO: 1550835 - RNA, 19 nt, Homo sapiens
aagaagaagaagaagaaga

SEQ ID NO: 1550836 - RNA, 19 nt, Homo sapiens
gaucacagcagggccuucu

SEQ ID NO: 1550837 - RNA, 19 nt, Homo sapiens
cagcucaagggaguaagua

SEQ ID NO: 1550838 - RNA, 19 nt, Homo sapiens
aagaaaggagagaaaugaa

SEQ ID NO: 1550839 - RNA, 19 nt, Homo sapiens
caguggccaucaaaguaga

SEQ ID NO: 1550840 - RNA, 19 nt, Homo sapiens
caaggagacagugguguuc

SEQ ID NO: 1550841 - RNA, 19 nt, Homo sapiens
ucaucacgcugugcugugu

SEQ ID NO: 1550842 - RNA, 19 nt, Homo sapiens
caggcauguuggacucuga

SEQ ID NO: 1550843 - RNA, 19 nt, Homo sapiens
gaagaagaagaaggacagu

SEQ ID NO: 1550844 - RNA, 19 nt, Homo sapiens
ucccagggcccuagaagau

SEQ ID NO: 1550845 - RNA, 19 nt, Homo sapiens
gagaagaaugaggccaaga

SEQ ID NO: 1550846 - RNA, 19 nt, Homo sapiens
ggaaacaucugcuggauaa

SEQ ID NO: 1550847 - RNA, 19 nt, Homo sapiens
gcaaacacuugacaaauaa

SEQ ID NO: 1550848 - RNA, 19 nt, Homo sapiens
ggaaggaauuguuacuuga

SEQ ID NO: 1550849 - RNA, 19 nt, Homo sapiens
uuuaagaggucucauagua

SEQ ID NO: 1550850 - RNA, 19 nt, Homo sapiens
caacacauauucagacaca

SEQ ID NO: 1550851 - RNA, 19 nt, Homo sapiens
agcaaacacuugacaaaua

SEQ ID NO: 1550852 - RNA, 19 nt, Homo sapiens
gucaaagaauguaccaaua

SEQ ID NO: 1550853 - RNA, 19 nt, Homo sapiens
caaagaauguaccaauaag

SEQ ID NO: 1550854 - RNA, 19 nt, Homo sapiens
ugacaggaaggaauuguua

SEQ ID NO: 1550855 - RNA, 19 nt, Homo sapiens
ggacaacagcaaacacuug

SEQ ID NO: 1550856 - RNA, 19 nt, Homo sapiens
uaagaggucucauaguagu

SEQ ID NO: 1550857 - RNA, 19 nt, Homo sapiens
gauaugacaggaaggaauu

SEQ ID NO: 1550858 - RNA, 19 nt, Homo sapiens
gaagaagagccaccaguca

SEQ ID NO: 1550859 - RNA, 19 nt, Homo sapiens
gaaagccaaaugucaaaga

SEQ ID NO: 1550860 - RNA, 19 nt, Homo sapiens
gaaggaauuguuacuugaa

SEQ ID NO: 1550861 - RNA, 19 nt, Homo sapiens
guacggugcuacugucugu

SEQ ID NO: 1550862 - RNA, 19 nt, Homo sapiens
gguagaauuuggcugugaa

SEQ ID NO: 1550863 - RNA, 19 nt, Homo sapiens
ggaauuguuacuugaagaa

SEQ ID NO: 1550864 - RNA, 19 nt, Homo sapiens
aaagccaaaugucaaagaa

SEQ ID NO: 1550865 - RNA, 19 nt, Homo sapiens
acacauauucagacacaua

SEQ ID NO: 1550866 - RNA, 19 nt, Homo sapiens
gcugggaaauguuuaagag

SEQ ID NO: 1550867 - RNA, 19 nt, Homo sapiens
gaauuuggcugugaaucca

SEQ ID NO: 1550868 - RNA, 19 nt, Homo sapiens
gacaacacauauucagaca

SEQ ID NO: 1550869 - RNA, 19 nt, Homo sapiens
uaggaacaccagucuauuu

SEQ ID NO: 1550870 - RNA, 19 nt, Homo sapiens
gaauguaccaauaaguguu

SEQ ID NO: 1550871 - RNA, 19 nt, Homo sapiens
aggaaggaauuguuacuug

SEQ ID NO: 1550872 - RNA, 19 nt, Homo sapiens
gacaacagcaaacacuuga

SEQ ID NO: 1550873 - RNA, 19 nt, Homo sapiens
gggaaagccaaaugucaaa

SEQ ID NO: 1550874 - RNA, 19 nt, Homo sapiens
gcucaugacauucuucugu

SEQ ID NO: 1550875 - RNA, 19 nt, Homo sapiens
cgaaaccaguggagauuac

SEQ ID NO: 1550876 - RNA, 19 nt, Homo sapiens
gaagagccaccagucaaau

SEQ ID NO: 1550877 - RNA, 19 nt, Homo sapiens
ccaaaugucaaagaaugua

SEQ ID NO: 1550878 - RNA, 19 nt, Homo sapiens
guaccaauaaguguucuaa

SEQ ID NO: 1550879 - RNA, 19 nt, Homo sapiens
caacagcaaacacuugaca

SEQ ID NO: 1550880 - RNA, 19 nt, Homo sapiens
agccaaaugucaaagaaug

SEQ ID NO: 1550881 - RNA, 19 nt, Homo sapiens
accaauaaguguucuaaag

SEQ ID NO: 1550882 - RNA, 19 nt, Homo sapiens
caacuccaacaucuucaaa

SEQ ID NO: 1550883 - RNA, 19 nt, Homo sapiens
ugggagaaaugaggaagaa

SEQ ID NO: 1550884 - RNA, 19 nt, Homo sapiens
cucaugacauucuucugua

SEQ ID NO: 1550885 - RNA, 19 nt, Homo sapiens
cauauggucagccucauga

SEQ ID NO: 1550886 - RNA, 19 nt, Homo sapiens
ggagaaaugaggaagaaaa

SEQ ID NO: 1550887 - RNA, 19 nt, Homo sapiens
acugagagcuggacaacag

SEQ ID NO: 1550888 - RNA, 19 nt, Homo sapiens
gaccuauuguggaaacauc

SEQ ID NO: 1550889 - RNA, 19 nt, Homo sapiens
gaaaugaggaagaaaagau

SEQ ID NO: 1550890 - RNA, 19 nt, Homo sapiens
cagcaaacacuugacaaau

SEQ ID NO: 1550891 - RNA, 19 nt, Homo sapiens
agaagagccaccagucaaa

SEQ ID NO: 1550892 - RNA, 19 nt, Homo sapiens
aaauaauccuucugacaac

SEQ ID NO: 1550893 - RNA, 19 nt, Homo sapiens
acagcaaacacuugacaaa

SEQ ID NO: 1550894 - RNA, 19 nt, Homo sapiens
aagaauguaccaauaagug

SEQ ID NO: 1550895 - RNA, 19 nt, Homo sapiens
aagagccaccagucaaaua

SEQ ID NO: 1550896 - RNA, 19 nt, Homo sapiens
ccucaugaagcucuggaua

SEQ ID NO: 1550897 - RNA, 19 nt, Homo sapiens
ugugugggcugggaaaugu

SEQ ID NO: 1550898 - RNA, 19 nt, Homo sapiens
cuuuauaugucugguagaa

SEQ ID NO: 1550899 - RNA, 19 nt, Homo sapiens
ccaccagucaaauagguuu

SEQ ID NO: 1550900 - RNA, 19 nt, Homo sapiens
aagaagagccaccagucaa

SEQ ID NO: 1550901 - RNA, 19 nt, Homo sapiens
ugucaaagaauguaccaau

SEQ ID NO: 1550902 - RNA, 19 nt, Homo sapiens
guggaaacaucugcuggau

SEQ ID NO: 1550903 - RNA, 19 nt, Homo sapiens
ccaauaaguguucuaaagc

SEQ ID NO: 1550904 - RNA, 19 nt, Homo sapiens
aaagauaugacaggaagga

SEQ ID NO: 1550905 - RNA, 19 nt, Homo sapiens
ucgaaaccaguggagauua

SEQ ID NO: 1550906 - RNA, 19 nt, Homo sapiens
uggaaacaucugcuggaua

SEQ ID NO: 1550907 - RNA, 19 nt, Homo sapiens
gaagaaugcuggggaaagc

SEQ ID NO: 1550908 - RNA, 19 nt, Homo sapiens
uuuaggaacaccagucuau

SEQ ID NO: 1550909 - RNA, 19 nt, Homo sapiens
uuaagaggucucauaguag

SEQ ID NO: 1550910 - RNA, 19 nt, Homo sapiens
acaugcugcuggaccuauu

SEQ ID NO: 1550911 - RNA, 19 nt, Homo sapiens
cuucugacaacacauauuc

SEQ ID NO: 1550912 - RNA, 19 nt, Homo sapiens
aaacaucugcuggauaaac

SEQ ID NO: 1550913 - RNA, 19 nt, Homo sapiens
aagcagcgacugggaagaa

SEQ ID NO: 1550914 - RNA, 19 nt, Homo sapiens
aggaauuguuacuugaaga

SEQ ID NO: 1550915 - RNA, 19 nt, Homo sapiens
ugucugugcugggagaaau

SEQ ID NO: 1550916 - RNA, 19 nt, Homo sapiens
aaccaguggagauuacuaa

SEQ ID NO: 1550917 - RNA, 19 nt, Homo sapiens
aaaccaguggagauuacua

SEQ ID NO: 1550918 - RNA, 19 nt, Homo sapiens
ggaaagccaaaugucaaag

SEQ ID NO: 1550919 - RNA, 19 nt, Homo sapiens
aaggaauuguuacuugaag

SEQ ID NO: 1550920 - RNA, 19 nt, Homo sapiens
caaauaaacugcuacauca

SEQ ID NO: 1550921 - RNA, 19 nt, Homo sapiens
ggaaacaucugcuuagaca

SEQ ID NO: 1550922 - RNA, 19 nt, Homo sapiens
gcagacaccuucagaguau

SEQ ID NO: 1550923 - RNA, 19 nt, Homo sapiens
gagaaaagguguacuaaaa

SEQ ID NO: 1550924 - RNA, 19 nt, Homo sapiens
ggguacagccuccauauaa

SEQ ID NO: 1550925 - RNA, 19 nt, Homo sapiens
gaacuuaacccaaauacac

SEQ ID NO: 1550926 - RNA, 19 nt, Homo sapiens
guucaucucuggaguugug

SEQ ID NO: 1550927 - RNA, 19 nt, Homo sapiens
ugccagaacuuaacccaaa

SEQ ID NO: 1550928 - RNA, 19 nt, Homo sapiens
gguaaccuuucugcuauuu

SEQ ID NO: 1550929 - RNA, 19 nt, Homo sapiens
ccauauaaguacugugaga

SEQ ID NO: 1550930 - RNA, 19 nt, Homo sapiens
gcugguaaccuuucugcua

SEQ ID NO: 1550931 - RNA, 19 nt, Homo sapiens
ucaaauaaacugcuacauc

SEQ ID NO: 1550932 - RNA, 19 nt, Homo sapiens
ggaagcuucuggaacaaag

SEQ ID NO: 1550933 - RNA, 19 nt, Homo sapiens
ucaaugaucaucuguagug

SEQ ID NO: 1550934 - RNA, 19 nt, Homo sapiens
ggaaaagacuugccuucug

SEQ ID NO: 1550935 - RNA, 19 nt, Homo sapiens
gaccuacuguggaaacauc

SEQ ID NO: 1550936 - RNA, 19 nt, Homo sapiens
aauaaugacuuguguacgu

SEQ ID NO: 1550937 - RNA, 19 nt, Homo sapiens
uaacccaaauacacacaga

SEQ ID NO: 1550938 - RNA, 19 nt, Homo sapiens
gguacagccuccauauaag

SEQ ID NO: 1550939 - RNA, 19 nt, Homo sapiens
acacagagagcaccaugaa

SEQ ID NO: 1550940 - RNA, 19 nt, Homo sapiens
acugugggcugaaggauga

SEQ ID NO: 1550941 - RNA, 19 nt, Homo sapiens
gcuauuuccuugaccucuu

SEQ ID NO: 1550942 - RNA, 19 nt, Homo sapiens
guggaaacaucugcuuaga

SEQ ID NO: 1550943 - RNA, 19 nt, Homo sapiens
cugguaaccuuucugcuau

SEQ ID NO: 1550944 - RNA, 19 nt, Homo sapiens
guacagccuccauauaagu

SEQ ID NO: 1550945 - RNA, 19 nt, Homo sapiens
ucucaaugaucaucuguag

SEQ ID NO: 1550946 - RNA, 19 nt, Homo sapiens
cugggaagcuucuggaaca

SEQ ID NO: 1550947 - RNA, 19 nt, Homo sapiens
ccagaacuuaacccaaaua

SEQ ID NO: 1550948 - RNA, 19 nt, Homo sapiens
cuauuuccuugaccucuuu

SEQ ID NO: 1550949 - RNA, 19 nt, Homo sapiens
gaagagccccuuaaaucaa

SEQ ID NO: 1550950 - RNA, 19 nt, Homo sapiens
caucuguaguggcagcaaa

SEQ ID NO: 1550951 - RNA, 19 nt, Homo sapiens
ggcucuagcugguaaccuu

SEQ ID NO: 1550952 - RNA, 19 nt, Homo sapiens
gccagaacuuaacccaaau

SEQ ID NO: 1550953 - RNA, 19 nt, Homo sapiens
caacgaagagccccuuaaa

SEQ ID NO: 1550954 - RNA, 19 nt, Homo sapiens
gauaugauaagagaaacug

SEQ ID NO: 1550955 - RNA, 19 nt, Homo sapiens
uaaaaggccagacaaaaga

SEQ ID NO: 1550956 - RNA, 19 nt, Homo sapiens
aaacaucugcuuagacaac

SEQ ID NO: 1550957 - RNA, 19 nt, Homo sapiens
ugacuuguguacguccaaa

SEQ ID NO: 1550958 - RNA, 19 nt, Homo sapiens
gcugccuacuuccuucuug

SEQ ID NO: 1550959 - RNA, 19 nt, Homo sapiens
uguguacguccaaaucaua

SEQ ID NO: 1550960 - RNA, 19 nt, Homo sapiens
caaugcagacaccuucaga

SEQ ID NO: 1550961 - RNA, 19 nt, Homo sapiens
uaaccuuucugcuauuucc

SEQ ID NO: 1550962 - RNA, 19 nt, Homo sapiens
caucuggucuaagaagagu

SEQ ID NO: 1550963 - RNA, 19 nt, Homo sapiens
aagaucccuuucuagauau

SEQ ID NO: 1550964 - RNA, 19 nt, Homo sapiens
gggaagcuucuggaacaaa

SEQ ID NO: 1550965 - RNA, 19 nt, Homo sapiens
gcucuagcugguaaccuuu

SEQ ID NO: 1550966 - RNA, 19 nt, Homo sapiens
cacuggcucuagcugguaa

SEQ ID NO: 1550967 - RNA, 19 nt, Homo sapiens
ggacacccacuggcucuag

SEQ ID NO: 1550968 - RNA, 19 nt, Homo sapiens
cauauaaguacugugagaa

SEQ ID NO: 1550969 - RNA, 19 nt, Homo sapiens
uacagccuccauauaagua

SEQ ID NO: 1550970 - RNA, 19 nt, Homo sapiens
ugcagacaccuucagagua

SEQ ID NO: 1550971 - RNA, 19 nt, Homo sapiens
gucagccaguuacuacaga

SEQ ID NO: 1550972 - RNA, 19 nt, Homo sapiens
agaagagugcugccuacuu

SEQ ID NO: 1550973 - RNA, 19 nt, Homo sapiens
cgaagagccccuuaaauca

SEQ ID NO: 1550974 - RNA, 19 nt, Homo sapiens
gaagcuucuggaacaaaga

SEQ ID NO: 1550975 - RNA, 19 nt, Homo sapiens
ucacuacugugggcugaag

SEQ ID NO: 1550976 - RNA, 19 nt, Homo sapiens
ucuauuggccgaucacuac

SEQ ID NO: 1550977 - RNA, 19 nt, Homo sapiens
ccccuuaaaucaaugcuaa

SEQ ID NO: 1550978 - RNA, 19 nt, Homo sapiens
gaaacaucugcuuagacaa

SEQ ID NO: 1550979 - RNA, 19 nt, Homo sapiens
cuccauauaaguacuguga

SEQ ID NO: 1550980 - RNA, 19 nt, Homo sapiens
uggguacagccuccauaua

SEQ ID NO: 1550981 - RNA, 19 nt, Homo sapiens
ggacagggaagucuuauuu

SEQ ID NO: 1550982 - RNA, 19 nt, Homo sapiens
ccuuauauauucccuguua

SEQ ID NO: 1550983 - RNA, 19 nt, Homo sapiens
gaacugaggagacucuuug

SEQ ID NO: 1550984 - RNA, 19 nt, Homo sapiens
acacagaacugacaccaau

SEQ ID NO: 1550985 - RNA, 19 nt, Homo sapiens
cuguuaagcuucaucagua

SEQ ID NO: 1550986 - RNA, 19 nt, Homo sapiens
gugcugacgugcaucguuu

SEQ ID NO: 1550987 - RNA, 19 nt, Homo sapiens
uauauucccuguuaagcuu

SEQ ID NO: 1550988 - RNA, 19 nt, Homo sapiens
ggaacgccuucuccaucua

SEQ ID NO: 1550989 - RNA, 19 nt, Homo sapiens
caucagauuucaucacagu

SEQ ID NO: 1550990 - RNA, 19 nt, Homo sapiens
caacggaacugaggagacu

SEQ ID NO: 1550991 - RNA, 19 nt, Homo sapiens
gaugauguuuuccuacuuu

SEQ ID NO: 1550992 - RNA, 19 nt, Homo sapiens
ucaaacaucagauuucauc

SEQ ID NO: 1550993 - RNA, 19 nt, Homo sapiens
ugucaaacaucagauuuca

SEQ ID NO: 1550994 - RNA, 19 nt, Homo sapiens
ccaucuacauccucaacuu

SEQ ID NO: 1550995 - RNA, 19 nt, Homo sapiens
ggacgcgucugagguggau

SEQ ID NO: 1550996 - RNA, 19 nt, Homo sapiens
ugucagcgguggugugugu

SEQ ID NO: 1550997 - RNA, 19 nt, Homo sapiens
ggaacugaggagacucuuu

SEQ ID NO: 1550998 - RNA, 19 nt, Homo sapiens
acagucgcguggcugauuu

SEQ ID NO: 1550999 - RNA, 19 nt, Homo sapiens
ggugucaaacaucagauuu

SEQ ID NO: 1551000 - RNA, 19 nt, Homo sapiens
uuauguggcuuccuguuca

SEQ ID NO: 1551001 - RNA, 19 nt, Homo sapiens
gauucugcuuggugucaaa

SEQ ID NO: 1551002 - RNA, 19 nt, Homo sapiens
aacaucagauuucaucaca

SEQ ID NO: 1551003 - RNA, 19 nt, Homo sapiens
gugcaucguuucccuuguc

SEQ ID NO: 1551004 - RNA, 19 nt, Homo sapiens
gacaggaaacgcaguugug

SEQ ID NO: 1551005 - RNA, 19 nt, Homo sapiens
gaccauccugcucacagua

SEQ ID NO: 1551006 - RNA, 19 nt, Homo sapiens
ucucaaccuuggacacaga

SEQ ID NO: 1551007 - RNA, 19 nt, Homo sapiens
gcaggaacgccuucuccau

SEQ ID NO: 1551008 - RNA, 19 nt, Homo sapiens
cugaggagacucuuugcua

SEQ ID NO: 1551009 - RNA, 19 nt, Homo sapiens
ggagacucuuugcuacaag

SEQ ID NO: 1551010 - RNA, 19 nt, Homo sapiens
gaagucuuauuuugucaug

SEQ ID NO: 1551011 - RNA, 19 nt, Homo sapiens
caucuacauccucaacuug

SEQ ID NO: 1551012 - RNA, 19 nt, Homo sapiens
gaggagacucuuugcuaca

SEQ ID NO: 1551013 - RNA, 19 nt, Homo sapiens
gaacgccuucuccaucuac

SEQ ID NO: 1551014 - RNA, 19 nt, Homo sapiens
gugccaaccccaucauuua

SEQ ID NO: 1551015 - RNA, 19 nt, Homo sapiens
acagggaagucuuauuuug

SEQ ID NO: 1551016 - RNA, 19 nt, Homo sapiens
gcaggccugagcuuucuga

SEQ ID NO: 1551017 - RNA, 19 nt, Homo sapiens
ucuauccugugaugauguu

SEQ ID NO: 1551018 - RNA, 19 nt, Homo sapiens
aauccucuauccugugaug

SEQ ID NO: 1551019 - RNA, 19 nt, Homo sapiens
aaaauccucuauccuguga

SEQ ID NO: 1551020 - RNA, 19 nt, Homo sapiens
aggagacucuuugcuacaa

SEQ ID NO: 1551021 - RNA, 19 nt, Homo sapiens
ugaccauccugcucacagu

SEQ ID NO: 1551022 - RNA, 19 nt, Homo sapiens
cguggacagggaagucuua

SEQ ID NO: 1551023 - RNA, 19 nt, Homo sapiens
gcccuuuggcauucaguuu

SEQ ID NO: 1551024 - RNA, 19 nt, Homo sapiens
uguuaagcuucaucaguau

SEQ ID NO: 1551025 - RNA, 19 nt, Homo sapiens
acagaacugacaccaauca

SEQ ID NO: 1551026 - RNA, 19 nt, Homo sapiens
ugucauguucaucuaguuu

SEQ ID NO: 1551027 - RNA, 19 nt, Homo sapiens
ucacaguacuggucuuccu

SEQ ID NO: 1551028 - RNA, 19 nt, Homo sapiens
ccucuauccugugaugaug

SEQ ID NO: 1551029 - RNA, 19 nt, Homo sapiens
gcugacaggaaacgcaguu

SEQ ID NO: 1551030 - RNA, 19 nt, Homo sapiens
guuauguggcuuccuguuc

SEQ ID NO: 1551031 - RNA, 19 nt, Homo sapiens
gaaagcagcuguuauaauu

SEQ ID NO: 1551032 - RNA, 19 nt, Homo sapiens
gaagaaagcagcuguuaua

SEQ ID NO: 1551033 - RNA, 19 nt, Homo sapiens
acacaaagcuucuaucgua

SEQ ID NO: 1551034 - RNA, 19 nt, Homo sapiens
gaaacgagcugcagccauu

SEQ ID NO: 1551035 - RNA, 19 nt, Homo sapiens
gaagauggaugauaaggaa

SEQ ID NO: 1551036 - RNA, 19 nt, Homo sapiens
gaagagaacagaaucauuu

SEQ ID NO: 1551037 - RNA, 19 nt, Homo sapiens
gaaaggcucggcaguauua

SEQ ID NO: 1551038 - RNA, 19 nt, Homo sapiens
gaaacaugcuucaauucua

SEQ ID NO: 1551039 - RNA, 19 nt, Homo sapiens
gaacagggcuucacuuggu

SEQ ID NO: 1551040 - RNA, 19 nt, Homo sapiens
gcacagggcugcuacuuuc

SEQ ID NO: 1551041 - RNA, 19 nt, Homo sapiens
uaacaugucuuucaucaga

SEQ ID NO: 1551042 - RNA, 19 nt, Homo sapiens
gagaagagauaacauggaa

SEQ ID NO: 1551043 - RNA, 19 nt, Homo sapiens
agagaaagcugcaagaauu

SEQ ID NO: 1551044 - RNA, 19 nt, Homo sapiens
gcaccaggcugccauuauu

SEQ ID NO: 1551045 - RNA, 19 nt, Homo sapiens
gaggauaccuuguccgaaa

SEQ ID NO: 1551046 - RNA, 19 nt, Homo sapiens
cgaaguagguccaaaguug

SEQ ID NO: 1551047 - RNA, 19 nt, Homo sapiens
gaagacauuugaagaguau

SEQ ID NO: 1551048 - RNA, 19 nt, Homo sapiens
gaugaacgcuggaaggaaa

SEQ ID NO: 1551049 - RNA, 19 nt, Homo sapiens
caaauacaauuccagauga

SEQ ID NO: 1551050 - RNA, 19 nt, Homo sapiens
caugaacacuucuuaauga

SEQ ID NO: 1551051 - RNA, 19 nt, Homo sapiens
gaaacaccaagcuauauua

SEQ ID NO: 1551052 - RNA, 19 nt, Homo sapiens
gaagacugaugguaaagaa

SEQ ID NO: 1551053 - RNA, 19 nt, Homo sapiens
ugaaaguucuagcaucuua

SEQ ID NO: 1551054 - RNA, 19 nt, Homo sapiens
gcauuggcgugcuuauuua

SEQ ID NO: 1551055 - RNA, 19 nt, Homo sapiens
gagaagauauuccacuaga

SEQ ID NO: 1551056 - RNA, 19 nt, Homo sapiens
ugagaaagcuguaacugaa

SEQ ID NO: 1551057 - RNA, 19 nt, Homo sapiens
gcaugaaggucaagaaugu

SEQ ID NO: 1551058 - RNA, 19 nt, Homo sapiens
cagaugagguuacaaagaa

SEQ ID NO: 1551059 - RNA, 19 nt, Homo sapiens
gaagaagacagcaauuaaa

SEQ ID NO: 1551060 - RNA, 19 nt, Homo sapiens
caacaacgacagaaauaua

SEQ ID NO: 1551061 - RNA, 19 nt, Homo sapiens
ggagagaauaguaaacuua

SEQ ID NO: 1551062 - RNA, 19 nt, Homo sapiens
gagauaacauggaagaaau

SEQ ID NO: 1551063 - RNA, 19 nt, Homo sapiens
ucaaagagccuauaaacuu

SEQ ID NO: 1551064 - RNA, 19 nt, Homo sapiens
gcgggaaucuuguaucaaa

SEQ ID NO: 1551065 - RNA, 19 nt, Homo sapiens
ugaauuggcuguuguccua

SEQ ID NO: 1551066 - RNA, 19 nt, Homo sapiens
guauggaagucaucagaua

SEQ ID NO: 1551067 - RNA, 19 nt, Homo sapiens
aaauagggcugcaucagua

SEQ ID NO: 1551068 - RNA, 19 nt, Homo sapiens
caaagcuucuaucguaaua

SEQ ID NO: 1551069 - RNA, 19 nt, Homo sapiens
gagaaaggcucggcaguau

SEQ ID NO: 1551070 - RNA, 19 nt, Homo sapiens
aagagcagcugcacuauuu

SEQ ID NO: 1551071 - RNA, 19 nt, Homo sapiens
gaugacaguucucuggaua

SEQ ID NO: 1551072 - RNA, 19 nt, Homo sapiens
gcaauaagucgucuucaaa

SEQ ID NO: 1551073 - RNA, 19 nt, Homo sapiens
guauagagauggucaugaa

SEQ ID NO: 1551074 - RNA, 19 nt, Homo sapiens
gcaauuaucauucagagaa

SEQ ID NO: 1551075 - RNA, 19 nt, Homo sapiens
ggagagcacacaaagaaua

SEQ ID NO: 1551076 - RNA, 19 nt, Homo sapiens
gauauagagccaagaaaua

SEQ ID NO: 1551077 - RNA, 19 nt, Homo sapiens
gaagauuuguucagcagaa

SEQ ID NO: 1551078 - RNA, 19 nt, Homo sapiens
cgacagaaauauaagaaga

SEQ ID NO: 1551079 - RNA, 19 nt, Homo sapiens
gauaauugcuguuacaucu

SEQ ID NO: 1551080 - RNA, 19 nt, Homo sapiens
ggauauuucccuuaacuua

SEQ ID NO: 1551081 - RNA, 19 nt, Homo sapiens
gaagcuaggcgguuaauug

SEQ ID NO: 1551082 - RNA, 19 nt, Homo sapiens
guaauaaaguugcagacaa

SEQ ID NO: 1551083 - RNA, 19 nt, Homo sapiens
gaaaucugcugcuuugauc

SEQ ID NO: 1551084 - RNA, 19 nt, Homo sapiens
caggauauuucuagucaua

SEQ ID NO: 1551085 - RNA, 19 nt, Homo sapiens
guaaggaccagaauaguuu

SEQ ID NO: 1551086 - RNA, 19 nt, Homo sapiens
gaagcaguguuaucauuau

SEQ ID NO: 1551087 - RNA, 19 nt, Homo sapiens
gagcauuucugucugcaaa

SEQ ID NO: 1551088 - RNA, 19 nt, Homo sapiens
uuacagaggcuuuaaagua

SEQ ID NO: 1551089 - RNA, 19 nt, Homo sapiens
gcacagaacauauauuaca

SEQ ID NO: 1551090 - RNA, 19 nt, Homo sapiens
gcaaagggcugcaguucuc

SEQ ID NO: 1551091 - RNA, 19 nt, Homo sapiens
aagcauaucugaaaggaaa

SEQ ID NO: 1551092 - RNA, 19 nt, Homo sapiens
uggaauaccugcuaugauu

SEQ ID NO: 1551093 - RNA, 19 nt, Homo sapiens
gaagcuuuguccaaguuua

SEQ ID NO: 1551094 - RNA, 19 nt, Homo sapiens
uaagagacguccaauacuu

SEQ ID NO: 1551095 - RNA, 19 nt, Homo sapiens
acaccaagcuauauuacua

SEQ ID NO: 1551096 - RNA, 19 nt, Homo sapiens
gaaaagagcugcuaucacu

SEQ ID NO: 1551097 - RNA, 19 nt, Homo sapiens
caaagcaccuacagaaugu

SEQ ID NO: 1551098 - RNA, 19 nt, Homo sapiens
uacagaagauggaugauaa

SEQ ID NO: 1551099 - RNA, 19 nt, Homo sapiens
gaagacauauucaacacau

SEQ ID NO: 1551100 - RNA, 19 nt, Homo sapiens
gaaacaaacacguaaacaa

SEQ ID NO: 1551101 - RNA, 19 nt, Homo sapiens
cuacaaagcauaucugaaa

SEQ ID NO: 1551102 - RNA, 19 nt, Homo sapiens
caaagaaggccgaguaaga

SEQ ID NO: 1551103 - RNA, 19 nt, Homo sapiens
cgagcaagauuacaagaaa

SEQ ID NO: 1551104 - RNA, 19 nt, Homo sapiens
guagaauggucacaagaaa

SEQ ID NO: 1551105 - RNA, 19 nt, Homo sapiens
gggccaaaguugauuauga

SEQ ID NO: 1551106 - RNA, 19 nt, Homo sapiens
gaagucaaauuacuacagu

SEQ ID NO: 1551107 - RNA, 19 nt, Homo sapiens
acagaaggguuucaaauau

SEQ ID NO: 1551108 - RNA, 19 nt, Homo sapiens
gaaagagacuuguguucag

SEQ ID NO: 1551109 - RNA, 19 nt, Homo sapiens
caaagacacucugcuguga

SEQ ID NO: 1551110 - RNA, 19 nt, Homo sapiens
caaagcagcagucacuaua

SEQ ID NO: 1551111 - RNA, 19 nt, Homo sapiens
gguauagaaugcauaaaga

SEQ ID NO: 1551112 - RNA, 19 nt, Homo sapiens
gagaaagcugcaagaauua

SEQ ID NO: 1551113 - RNA, 19 nt, Homo sapiens
caacuguucuucaacuuug

SEQ ID NO: 1551114 - RNA, 19 nt, Homo sapiens
gaagagauaacauggaaga

SEQ ID NO: 1551115 - RNA, 19 nt, Homo sapiens
gaguaucauucucaaagua

SEQ ID NO: 1551116 - RNA, 19 nt, Homo sapiens
gagcaacaguaguuucuau

SEQ ID NO: 1551117 - RNA, 19 nt, Homo sapiens
gaagauuccucucucucaa

SEQ ID NO: 1551118 - RNA, 19 nt, Homo sapiens
gaaagcagaugagguuaca

SEQ ID NO: 1551119 - RNA, 19 nt, Homo sapiens
cuucagagcuauacaaaga

SEQ ID NO: 1551120 - RNA, 19 nt, Homo sapiens
cagaaggguuucaaauauu

SEQ ID NO: 1551121 - RNA, 19 nt, Homo sapiens
ggccaaaguugauuaugaa

SEQ ID NO: 1551122 - RNA, 19 nt, Homo sapiens
caacaguaguuucuauuca

SEQ ID NO: 1551123 - RNA, 19 nt, Homo sapiens
gaacauauagagcugcaaa

SEQ ID NO: 1551124 - RNA, 19 nt, Homo sapiens
guacaaagcaucacuuaca

SEQ ID NO: 1551125 - RNA, 19 nt, Homo sapiens
guuugugccuucuauaaua

SEQ ID NO: 1551126 - RNA, 19 nt, Homo sapiens
uuacaaaucuugccguaga

SEQ ID NO: 1551127 - RNA, 19 nt, Homo sapiens
aaacagauauucccagaca

SEQ ID NO: 1551128 - RNA, 19 nt, Homo sapiens
acacaaagccaaauacauu

SEQ ID NO: 1551129 - RNA, 19 nt, Homo sapiens
cagaauaguuucaagacuu

SEQ ID NO: 1551130 - RNA, 19 nt, Homo sapiens
cagaagcaguguuaucauu

SEQ ID NO: 1551131 - RNA, 19 nt, Homo sapiens
ggacauggcugauaaagaa

SEQ ID NO: 1551132 - RNA, 19 nt, Homo sapiens
aaacaaagcuuucuucaga

SEQ ID NO: 1551133 - RNA, 19 nt, Homo sapiens
gaagauacacagaaaguua

SEQ ID NO: 1551134 - RNA, 19 nt, Homo sapiens
guagaacgcucagaaauuu

SEQ ID NO: 1551135 - RNA, 19 nt, Homo sapiens
caaaggagcugaagcaugu

SEQ ID NO: 1551136 - RNA, 19 nt, Homo sapiens
gaagaagauuccaaagaaa

SEQ ID NO: 1551137 - RNA, 19 nt, Homo sapiens
ccagugaccuuucaucuuu

SEQ ID NO: 1551138 - RNA, 19 nt, Homo sapiens
ugaagaagauuccaaagaa

SEQ ID NO: 1551139 - RNA, 19 nt, Homo sapiens
gaaagaugauucugaaaca

SEQ ID NO: 1551140 - RNA, 19 nt, Homo sapiens
ggaagagacugacacaaga

SEQ ID NO: 1551141 - RNA, 19 nt, Homo sapiens
gaagaaucaucaacaaaga

SEQ ID NO: 1551142 - RNA, 19 nt, Homo sapiens
ccagacacuucccuuauua

SEQ ID NO: 1551143 - RNA, 19 nt, Homo sapiens
gaaggcaaaucaauagaga

SEQ ID NO: 1551144 - RNA, 19 nt, Homo sapiens
gagaagaacaaacagaaua

SEQ ID NO: 1551145 - RNA, 19 nt, Homo sapiens
caacacagcucccgaugau

SEQ ID NO: 1551146 - RNA, 19 nt, Homo sapiens
ggaaaagacugaaaagaaa

SEQ ID NO: 1551147 - RNA, 19 nt, Homo sapiens
gaaaggagaaagaaagaaa

SEQ ID NO: 1551148 - RNA, 19 nt, Homo sapiens
gaaaccauaacuucucuua

SEQ ID NO: 1551149 - RNA, 19 nt, Homo sapiens
gagcuucacucuucugaga

SEQ ID NO: 1551150 - RNA, 19 nt, Homo sapiens
agacugagcuucacucuuc

SEQ ID NO: 1551151 - RNA, 19 nt, Homo sapiens
caaggaauguugaagagaa

SEQ ID NO: 1551152 - RNA, 19 nt, Homo sapiens
gguauugaccgaauuauuu

SEQ ID NO: 1551153 - RNA, 19 nt, Homo sapiens
cagaggacauggcugauaa

SEQ ID NO: 1551154 - RNA, 19 nt, Homo sapiens
ggaaggaaguggcaacaca

SEQ ID NO: 1551155 - RNA, 19 nt, Homo sapiens
ggagaaagaaagaaagaaa

SEQ ID NO: 1551156 - RNA, 19 nt, Homo sapiens
ggacuuagaagaaucauca

SEQ ID NO: 1551157 - RNA, 19 nt, Homo sapiens
gaaguuguaacgucugaua

SEQ ID NO: 1551158 - RNA, 19 nt, Homo sapiens
gaaacaacauuagacaaca

SEQ ID NO: 1551159 - RNA, 19 nt, Homo sapiens
gagugaagauacacagaaa

SEQ ID NO: 1551160 - RNA, 19 nt, Homo sapiens
ggaguccgcaucucaauaa

SEQ ID NO: 1551161 - RNA, 19 nt, Homo sapiens
cgacgacaguccauuggua

SEQ ID NO: 1551162 - RNA, 19 nt, Homo sapiens
gcaaguagaacgcucagaa

SEQ ID NO: 1551163 - RNA, 19 nt, Homo sapiens
ggaguaguguggacuuaga

SEQ ID NO: 1551164 - RNA, 19 nt, Homo sapiens
cacagaaaguuaaagauga

SEQ ID NO: 1551165 - RNA, 19 nt, Homo sapiens
gaagagaggcuuuuaagaa

SEQ ID NO: 1551166 - RNA, 19 nt, Homo sapiens
caaaccauaucuuuacuca

SEQ ID NO: 1551167 - RNA, 19 nt, Homo sapiens
gcaaaucacuuggcaacuc

SEQ ID NO: 1551168 - RNA, 19 nt, Homo sapiens
gacaacaaguccucaaauc

SEQ ID NO: 1551169 - RNA, 19 nt, Homo sapiens
ccuaaagccgccagaauua

SEQ ID NO: 1551170 - RNA, 19 nt, Homo sapiens
gagauuacgucagaugaug

SEQ ID NO: 1551171 - RNA, 19 nt, Homo sapiens
cagcuaagaaacaacauua

SEQ ID NO: 1551172 - RNA, 19 nt, Homo sapiens
caaauugucugugaaacau

SEQ ID NO: 1551173 - RNA, 19 nt, Homo sapiens
gaagagaagaacaaacaga

SEQ ID NO: 1551174 - RNA, 19 nt, Homo sapiens
gagaauguucguaaagaaa

SEQ ID NO: 1551175 - RNA, 19 nt, Homo sapiens
gaaacagcaauaugaagaa

SEQ ID NO: 1551176 - RNA, 19 nt, Homo sapiens
caaaucacuuggcaacuca

SEQ ID NO: 1551177 - RNA, 19 nt, Homo sapiens
gccaguuucugaauauauu

SEQ ID NO: 1551178 - RNA, 19 nt, Homo sapiens
ugaaacaccacauuugaaa

SEQ ID NO: 1551179 - RNA, 19 nt, Homo sapiens
aaggagagauuacgucaga

SEQ ID NO: 1551180 - RNA, 19 nt, Homo sapiens
gauagauucugauguggau

SEQ ID NO: 1551181 - RNA, 19 nt, Homo sapiens
ggaaugaaaggaaauuauc

SEQ ID NO: 1551182 - RNA, 19 nt, Homo sapiens
aaaggugauuguaugcaua

SEQ ID NO: 1551183 - RNA, 19 nt, Homo sapiens
gagaaaggagaaagaaaga

SEQ ID NO: 1551184 - RNA, 19 nt, Homo sapiens
agaaagcugugcaugaguu

SEQ ID NO: 1551185 - RNA, 19 nt, Homo sapiens
ugagaauguucguaaagaa

SEQ ID NO: 1551186 - RNA, 19 nt, Homo sapiens
guccgcaucucaauaagaa

SEQ ID NO: 1551187 - RNA, 19 nt, Homo sapiens
ccacaaaccauaucuuuac

SEQ ID NO: 1551188 - RNA, 19 nt, Homo sapiens
uuacagacaucacaguuag

SEQ ID NO: 1551189 - RNA, 19 nt, Homo sapiens
acacuucccuuauuacaca

SEQ ID NO: 1551190 - RNA, 19 nt, Homo sapiens
cagaugagaauguucguaa

SEQ ID NO: 1551191 - RNA, 19 nt, Homo sapiens
aaagccaguuucugaauau

SEQ ID NO: 1551192 - RNA, 19 nt, Homo sapiens
uaagaaggcaaaucaauag

SEQ ID NO: 1551193 - RNA, 19 nt, Homo sapiens
gcuagggcuucaacagaaa

SEQ ID NO: 1551194 - RNA, 19 nt, Homo sapiens
aaagcaaagucaacaaaca

SEQ ID NO: 1551195 - RNA, 19 nt, Homo sapiens
cgaaaagcaucuaaagaaa

SEQ ID NO: 1551196 - RNA, 19 nt, Homo sapiens
uaaagccgccagaauuaaa

SEQ ID NO: 1551197 - RNA, 19 nt, Homo sapiens
gcaugcguauguccacaaa

SEQ ID NO: 1551198 - RNA, 19 nt, Homo sapiens
aauaagaaccagcuaagaa

SEQ ID NO: 1551199 - RNA, 19 nt, Homo sapiens
caacagaaacaucaaaugc

SEQ ID NO: 1551200 - RNA, 19 nt, Homo sapiens
ccucaaaucaggaauguug

SEQ ID NO: 1551201 - RNA, 19 nt, Homo sapiens
acaaagcuuucuucagaug

SEQ ID NO: 1551202 - RNA, 19 nt, Homo sapiens
cagaaaagcacacuuaaaa

SEQ ID NO: 1551203 - RNA, 19 nt, Homo sapiens
gaacggaaaguuuuagaaa

SEQ ID NO: 1551204 - RNA, 19 nt, Homo sapiens
caacgacgacaguccauug

SEQ ID NO: 1551205 - RNA, 19 nt, Homo sapiens
acacagcucccgaugauga

SEQ ID NO: 1551206 - RNA, 19 nt, Homo sapiens
caaguagaacgcucagaaa

SEQ ID NO: 1551207 - RNA, 19 nt, Homo sapiens
ggucaaggcaggaguagug

SEQ ID NO: 1551208 - RNA, 19 nt, Homo sapiens
cccaaagucugaagaguuc

SEQ ID NO: 1551209 - RNA, 19 nt, Homo sapiens
acaccaagccugcguauca

SEQ ID NO: 1551210 - RNA, 19 nt, Homo sapiens
uaaaggugauuguaugcau

SEQ ID NO: 1551211 - RNA, 19 nt, Homo sapiens
cauaacuucucuuaaccaa

SEQ ID NO: 1551212 - RNA, 19 nt, Homo sapiens
gaaagcugugcaugaguuu

SEQ ID NO: 1551213 - RNA, 19 nt, Homo sapiens
caacaaacaaagcuuucuu

SEQ ID NO: 1551214 - RNA, 19 nt, Homo sapiens
gagaaagguuuaaaaguag

SEQ ID NO: 1551215 - RNA, 19 nt, Homo sapiens
aaaccagacacuucccuua

SEQ ID NO: 1551216 - RNA, 19 nt, Homo sapiens
ugaaaagccuacuuaagaa

SEQ ID NO: 1551217 - RNA, 19 nt, Homo sapiens
aaacagaaaagcacacuua

SEQ ID NO: 1551218 - RNA, 19 nt, Homo sapiens
caggaguaguguggacuua

SEQ ID NO: 1551219 - RNA, 19 nt, Homo sapiens
gaaaacagaaagcagaaaa

SEQ ID NO: 1551220 - RNA, 19 nt, Homo sapiens
augaugagcuuacuguaga

SEQ ID NO: 1551221 - RNA, 19 nt, Homo sapiens
ggagagauuacgucagaug

SEQ ID NO: 1551222 - RNA, 19 nt, Homo sapiens
ccacugauacuaguacuga

SEQ ID NO: 1551223 - RNA, 19 nt, Homo sapiens
caaaugccaagaccaguga

SEQ ID NO: 1551224 - RNA, 19 nt, Homo sapiens
gcaacacagcucccgauga

SEQ ID NO: 1551225 - RNA, 19 nt, Homo sapiens
gaucaaccacacauucaga

SEQ ID NO: 1551226 - RNA, 19 nt, Homo sapiens
acauaggaaugaaaggaaa

SEQ ID NO: 1551227 - RNA, 19 nt, Homo sapiens
aaaccugcccggagacuuu

SEQ ID NO: 1551228 - RNA, 19 nt, Homo sapiens
caaagaaacccuuaaaaca

SEQ ID NO: 1551229 - RNA, 19 nt, Homo sapiens
agaaacagcaauaugaaga

SEQ ID NO: 1551230 - RNA, 19 nt, Homo sapiens
caacaaguccucaaaucag

SEQ ID NO: 1551231 - RNA, 19 nt, Homo sapiens
ggaaucugcuggcaccuua

SEQ ID NO: 1551232 - RNA, 19 nt, Homo sapiens
gccauccucugcuauauua

SEQ ID NO: 1551233 - RNA, 19 nt, Homo sapiens
gaggguggcugucugcaaa

SEQ ID NO: 1551234 - RNA, 19 nt, Homo sapiens
ggaaacagaagcaaucaga

SEQ ID NO: 1551235 - RNA, 19 nt, Homo sapiens
gagcugcaguguucugaau

SEQ ID NO: 1551236 - RNA, 19 nt, Homo sapiens
cauggugucugcuuaaugu

SEQ ID NO: 1551237 - RNA, 19 nt, Homo sapiens
aaacucaacugucccaucu

SEQ ID NO: 1551238 - RNA, 19 nt, Homo sapiens
gugcugggauuacagaaug

SEQ ID NO: 1551239 - RNA, 19 nt, Homo sapiens
agagagcccucaccaggaa

SEQ ID NO: 1551240 - RNA, 19 nt, Homo sapiens
aggcugagcugcaguguuc

SEQ ID NO: 1551241 - RNA, 19 nt, Homo sapiens
ggagacugcuggugaacuc

SEQ ID NO: 1551242 - RNA, 19 nt, Homo sapiens
ccaaagugcugggauuaca

SEQ ID NO: 1551243 - RNA, 19 nt, Homo sapiens
gaaacagaagcaaucagaa

SEQ ID NO: 1551244 - RNA, 19 nt, Homo sapiens
gaagagugccuggcucaug

SEQ ID NO: 1551245 - RNA, 19 nt, Homo sapiens
caacugugaggaauaaaug

SEQ ID NO: 1551246 - RNA, 19 nt, Homo sapiens
gcaccuuaaucuuggacuu

SEQ ID NO: 1551247 - RNA, 19 nt, Homo sapiens
uuucuugccuggaguugua

SEQ ID NO: 1551248 - RNA, 19 nt, Homo sapiens
cagaagcaaucagaaggaa

SEQ ID NO: 1551249 - RNA, 19 nt, Homo sapiens
gaccuugcuuucuguuuca

SEQ ID NO: 1551250 - RNA, 19 nt, Homo sapiens
caucaucagcagagacuuu

SEQ ID NO: 1551251 - RNA, 19 nt, Homo sapiens
uuccaaagcuuccgcaauc

SEQ ID NO: 1551252 - RNA, 19 nt, Homo sapiens
gaagcaaucagaaggaaac

SEQ ID NO: 1551253 - RNA, 19 nt, Homo sapiens
gcugcaguguucugaauag

SEQ ID NO: 1551254 - RNA, 19 nt, Homo sapiens
gaggaauaaauguauguug

SEQ ID NO: 1551255 - RNA, 19 nt, Homo sapiens
agaccuugcuuucuguuuc

SEQ ID NO: 1551256 - RNA, 19 nt, Homo sapiens
gcuauauuauccugaagag

SEQ ID NO: 1551257 - RNA, 19 nt, Homo sapiens
ccacugaaacugcucuugu

SEQ ID NO: 1551258 - RNA, 19 nt, Homo sapiens
uaucaagccagauuucaug

SEQ ID NO: 1551259 - RNA, 19 nt, Homo sapiens
aaacagaagcaaucagaag

SEQ ID NO: 1551260 - RNA, 19 nt, Homo sapiens
uuguggaacuugaauucua

SEQ ID NO: 1551261 - RNA, 19 nt, Homo sapiens
caaagcuuccgcaaucuca

SEQ ID NO: 1551262 - RNA, 19 nt, Homo sapiens
cuggagaccuugcuuucug

SEQ ID NO: 1551263 - RNA, 19 nt, Homo sapiens
guccgaggcaccacuguuu

SEQ ID NO: 1551264 - RNA, 19 nt, Homo sapiens
gaugaccucccgcugacaa

SEQ ID NO: 1551265 - RNA, 19 nt, Homo sapiens
guuguaguccucaucauca

SEQ ID NO: 1551266 - RNA, 19 nt, Homo sapiens
gaggcaccacuguuucuug

SEQ ID NO: 1551267 - RNA, 19 nt, Homo sapiens
ccccaucgcuccacugaaa

SEQ ID NO: 1551268 - RNA, 19 nt, Homo sapiens
gagaccuugcuuucuguuu

SEQ ID NO: 1551269 - RNA, 19 nt, Homo sapiens
ucugcuauauuauccugaa

SEQ ID NO: 1551270 - RNA, 19 nt, Homo sapiens
gugccauccucugcuauau

SEQ ID NO: 1551271 - RNA, 19 nt, Homo sapiens
gcuccaggcugcggauuuu

SEQ ID NO: 1551272 - RNA, 19 nt, Homo sapiens
uagccaggauggucucgau

SEQ ID NO: 1551273 - RNA, 19 nt, Homo sapiens
ggaguuguagacgggauuu

SEQ ID NO: 1551274 - RNA, 19 nt, Homo sapiens
cacugaaacugcucuuguc

SEQ ID NO: 1551275 - RNA, 19 nt, Homo sapiens
gcucggaggcagagaaagg

SEQ ID NO: 1551276 - RNA, 19 nt, Homo sapiens
uggugucugcuuaauguua

SEQ ID NO: 1551277 - RNA, 19 nt, Homo sapiens
gcuccaccuuccaaagcuu

SEQ ID NO: 1551278 - RNA, 19 nt, Homo sapiens
ugugaggaauaaauguaug

SEQ ID NO: 1551279 - RNA, 19 nt, Homo sapiens
ccuguauccgugccuguua

SEQ ID NO: 1551280 - RNA, 19 nt, Homo sapiens
gaaucugcuggcaccuuaa

SEQ ID NO: 1551281 - RNA, 19 nt, Homo sapiens
ucaacugucccaucucuac

SEQ ID NO: 1551282 - RNA, 19 nt, Homo sapiens
acucaacugucccaucucu

SEQ ID NO: 1551283 - RNA, 19 nt, Homo sapiens
aggguuaauuggaguuuua

SEQ ID NO: 1551284 - RNA, 19 nt, Homo sapiens
gacuccaccucucccuuca

SEQ ID NO: 1551285 - RNA, 19 nt, Homo sapiens
uguggaacuugaauucuac

SEQ ID NO: 1551286 - RNA, 19 nt, Homo sapiens
aaagugcugggauuacaga

SEQ ID NO: 1551287 - RNA, 19 nt, Homo sapiens
cucaccgucuccaccguua

SEQ ID NO: 1551288 - RNA, 19 nt, Homo sapiens
gagcuccaccuuccaaagc

SEQ ID NO: 1551289 - RNA, 19 nt, Homo sapiens
gcuccaagcucauccguuu

SEQ ID NO: 1551290 - RNA, 19 nt, Homo sapiens
guacauuucuguucauuuc

SEQ ID NO: 1551291 - RNA, 19 nt, Homo sapiens
caacugugcuauucaugaa

SEQ ID NO: 1551292 - RNA, 19 nt, Homo sapiens
uagcagaccucacuucaca

SEQ ID NO: 1551293 - RNA, 19 nt, Homo sapiens
gguaagagccgaccacaag

SEQ ID NO: 1551294 - RNA, 19 nt, Homo sapiens
gaugguuuguguugggaua

SEQ ID NO: 1551295 - RNA, 19 nt, Homo sapiens
cagaugcuccuggguauua

SEQ ID NO: 1551296 - RNA, 19 nt, Homo sapiens
gaagucaggaguacauuuc

SEQ ID NO: 1551297 - RNA, 19 nt, Homo sapiens
gaaggcacaugaggacaau

SEQ ID NO: 1551298 - RNA, 19 nt, Homo sapiens
aggcucaacuggcagaaua

SEQ ID NO: 1551299 - RNA, 19 nt, Homo sapiens
gcacuguccucuguguuug

SEQ ID NO: 1551300 - RNA, 19 nt, Homo sapiens
cagagcagccugaagguaa

SEQ ID NO: 1551301 - RNA, 19 nt, Homo sapiens
ggagagcugugaugaccau

SEQ ID NO: 1551302 - RNA, 19 nt, Homo sapiens
caucugcacuguccucugu

SEQ ID NO: 1551303 - RNA, 19 nt, Homo sapiens
uuaaagcccucaagucucu

SEQ ID NO: 1551304 - RNA, 19 nt, Homo sapiens
gaaggucuauaccagaaac

SEQ ID NO: 1551305 - RNA, 19 nt, Homo sapiens
ggacaaugaaggucuauac

SEQ ID NO: 1551306 - RNA, 19 nt, Homo sapiens
gagcugugaugaccauucu

SEQ ID NO: 1551307 - RNA, 19 nt, Homo sapiens
ggaaggcacaugaggacaa

SEQ ID NO: 1551308 - RNA, 19 nt, Homo sapiens
ucaacuggcagaauaaaga

SEQ ID NO: 1551309 - RNA, 19 nt, Homo sapiens
agaccucacuucacaguca

SEQ ID NO: 1551310 - RNA, 19 nt, Homo sapiens
gaguacauuucuguucauu

SEQ ID NO: 1551311 - RNA, 19 nt, Homo sapiens
gcagauucccggacacugu

SEQ ID NO: 1551312 - RNA, 19 nt, Homo sapiens
ggaguacauuucuguucau

SEQ ID NO: 1551313 - RNA, 19 nt, Homo sapiens
ugaggacaaugaaggucua

SEQ ID NO: 1551314 - RNA, 19 nt, Homo sapiens
cauuaaagcccucaagucu

SEQ ID NO: 1551315 - RNA, 19 nt, Homo sapiens
ucucacaccuuccugaucu

SEQ ID NO: 1551316 - RNA, 19 nt, Homo sapiens
gcuccuggguauuauucuu

SEQ ID NO: 1551317 - RNA, 19 nt, Homo sapiens
gcagaauaaagaucucaau

SEQ ID NO: 1551318 - RNA, 19 nt, Homo sapiens
cuaccaagccaucaucaug

SEQ ID NO: 1551319 - RNA, 19 nt, Homo sapiens
ccuggaggcccacauuaaa

SEQ ID NO: 1551320 - RNA, 19 nt, Homo sapiens
ucauuucaguccuggaguu

SEQ ID NO: 1551321 - RNA, 19 nt, Homo sapiens
aggaguacauuucuguuca

SEQ ID NO: 1551322 - RNA, 19 nt, Homo sapiens
gcacaugaggacaaugaag

SEQ ID NO: 1551323 - RNA, 19 nt, Homo sapiens
gcaugcagccauccugauc

SEQ ID NO: 1551324 - RNA, 19 nt, Homo sapiens
ugaagucaggaguacauuu

SEQ ID NO: 1551325 - RNA, 19 nt, Homo sapiens
gcagaccucacuucacagu

SEQ ID NO: 1551326 - RNA, 19 nt, Homo sapiens
augaaggucuauaccagaa

SEQ ID NO: 1551327 - RNA, 19 nt, Homo sapiens
gcacuguguccuaugaagu

SEQ ID NO: 1551328 - RNA, 19 nt, Homo sapiens
cuucugggaugcugacugu

SEQ ID NO: 1551329 - RNA, 19 nt, Homo sapiens
cuauccagcuuacccacuu

SEQ ID NO: 1551330 - RNA, 19 nt, Homo sapiens
uauuguuucugguuucuuc

SEQ ID NO: 1551331 - RNA, 19 nt, Homo sapiens
caacuggcagaauaaagau

SEQ ID NO: 1551332 - RNA, 19 nt, Homo sapiens
gcucaacuggcagaauaaa

SEQ ID NO: 1551333 - RNA, 19 nt, Homo sapiens
caagccaucaucaugcuau

SEQ ID NO: 1551334 - RNA, 19 nt, Homo sapiens
acaacugugcuauucauga

SEQ ID NO: 1551335 - RNA, 19 nt, Homo sapiens
gugaagaggcaggcacuga

SEQ ID NO: 1551336 - RNA, 19 nt, Homo sapiens
uguggucugugccuccuuu

SEQ ID NO: 1551337 - RNA, 19 nt, Homo sapiens
cauccgcacuguguccuau

SEQ ID NO: 1551338 - RNA, 19 nt, Homo sapiens
uaacucgcauccgcacugu

SEQ ID NO: 1551339 - RNA, 19 nt, Homo sapiens
ugcuauggaugauugcaaa

SEQ ID NO: 1551340 - RNA, 19 nt, Homo sapiens
gucugugccuccuuuccua

SEQ ID NO: 1551341 - RNA, 19 nt, Homo sapiens
ccugagugcuauccagcuu

SEQ ID NO: 1551342 - RNA, 19 nt, Homo sapiens
acaccuuccugaucugcuu

SEQ ID NO: 1551343 - RNA, 19 nt, Homo sapiens
ccuaugaagucaggaguac

SEQ ID NO: 1551344 - RNA, 19 nt, Homo sapiens
ugagugcuauccagcuuac

SEQ ID NO: 1551345 - RNA, 19 nt, Homo sapiens
aaauaggggugaugguuug

SEQ ID NO: 1551346 - RNA, 19 nt, Homo sapiens
caaaauaggggugaugguu

SEQ ID NO: 1551347 - RNA, 19 nt, Homo sapiens
ucugaccaaugccuucguu

SEQ ID NO: 1551348 - RNA, 19 nt, Homo sapiens
caggaguacauuucuguuc

SEQ ID NO: 1551349 - RNA, 19 nt, Homo sapiens
gaaaggcgaugaagaaguu

SEQ ID NO: 1551350 - RNA, 19 nt, Homo sapiens
gcagaaaggcgaugaagaa

SEQ ID NO: 1551351 - RNA, 19 nt, Homo sapiens
gcacugggcugcagaaagg

SEQ ID NO: 1551352 - RNA, 19 nt, Homo sapiens
gcaacuaugugguggagaa

SEQ ID NO: 1551353 - RNA, 19 nt, Homo sapiens
ggacggaggugcacgaagu

SEQ ID NO: 1551354 - RNA, 19 nt, Homo sapiens
gaggauggcuucuucuauc

SEQ ID NO: 1551355 - RNA, 19 nt, Homo sapiens
ggcacacgcucuuggaaua

SEQ ID NO: 1551356 - RNA, 19 nt, Homo sapiens
ugaccaaguucacccagua

SEQ ID NO: 1551357 - RNA, 19 nt, Homo sapiens
ggaccucgcauuaaaguau

SEQ ID NO: 1551358 - RNA, 19 nt, Homo sapiens
gaccucgcauuaaaguauu

SEQ ID NO: 1551359 - RNA, 19 nt, Homo sapiens
uggagaaggugcccgagaa

SEQ ID NO: 1551360 - RNA, 19 nt, Homo sapiens
cgcaugaccuggcaaagga

SEQ ID NO: 1551361 - RNA, 19 nt, Homo sapiens
gauggcuucuucuaucuca

SEQ ID NO: 1551362 - RNA, 19 nt, Homo sapiens
aagugaagcugcgcaacua

SEQ ID NO: 1551363 - RNA, 19 nt, Homo sapiens
ggccaguuaucucuccaaa

SEQ ID NO: 1551364 - RNA, 19 nt, Homo sapiens
gaagugaagcugcgcaacu

SEQ ID NO: 1551365 - RNA, 19 nt, Homo sapiens
ggcucaaccugaccaaguu

SEQ ID NO: 1551366 - RNA, 19 nt, Homo sapiens
gcgaugaagaaguuugaaa

SEQ ID NO: 1551367 - RNA, 19 nt, Homo sapiens
ccaagguguuccuaagcuu

SEQ ID NO: 1551368 - RNA, 19 nt, Homo sapiens
gcacacgcucuuggaauau

SEQ ID NO: 1551369 - RNA, 19 nt, Homo sapiens
guccgaggauggcuucuuc

SEQ ID NO: 1551370 - RNA, 19 nt, Homo sapiens
ucaaccaggcccucaaaga

SEQ ID NO: 1551371 - RNA, 19 nt, Homo sapiens
cagccacccuccaguccaa

SEQ ID NO: 1551372 - RNA, 19 nt, Homo sapiens
caaccaggcccucaaagac

SEQ ID NO: 1551373 - RNA, 19 nt, Homo sapiens
ccaguuaucucuccaaaac

SEQ ID NO: 1551374 - RNA, 19 nt, Homo sapiens
ccaggguggcuuuguggua

SEQ ID NO: 1551375 - RNA, 19 nt, Homo sapiens
gcgacagacuccaguacag

SEQ ID NO: 1551376 - RNA, 19 nt, Homo sapiens
gaugaagaaguuugaaagg

SEQ ID NO: 1551377 - RNA, 19 nt, Homo sapiens
gcgcgaggagcacauugaa

SEQ ID NO: 1551378 - RNA, 19 nt, Homo sapiens
cgaggauggcuucuucuau

SEQ ID NO: 1551379 - RNA, 19 nt, Homo sapiens
gggcucaaccugaccaagu

SEQ ID NO: 1551380 - RNA, 19 nt, Homo sapiens
uguccgggcuugugcuguu

SEQ ID NO: 1551381 - RNA, 19 nt, Homo sapiens
ggaggugcacgaagugaag

SEQ ID NO: 1551382 - RNA, 19 nt, Homo sapiens
cagaacacgggcuggauug

SEQ ID NO: 1551383 - RNA, 19 nt, Homo sapiens
ucaccuaccgggaccagaa

SEQ ID NO: 1551384 - RNA, 19 nt, Homo sapiens
cgaugaagaaguuugaaag

SEQ ID NO: 1551385 - RNA, 19 nt, Homo sapiens
ggagaaggugcccgagaag

SEQ ID NO: 1551386 - RNA, 19 nt, Homo sapiens
ggaaucugaaggugcugaa

SEQ ID NO: 1551387 - RNA, 19 nt, Homo sapiens
gacacaaggucaccauccu

SEQ ID NO: 1551388 - RNA, 19 nt, Homo sapiens
ugaagcugcgcaacuaugu

SEQ ID NO: 1551389 - RNA, 19 nt, Homo sapiens
ucgacgacguggcggcauu

SEQ ID NO: 1551390 - RNA, 19 nt, Homo sapiens
ccacucgcccgaagacauc

SEQ ID NO: 1551391 - RNA, 19 nt, Homo sapiens
ccaagaccccuucgagaaa

SEQ ID NO: 1551392 - RNA, 19 nt, Homo sapiens
gaagcugcgcaacuaugug

SEQ ID NO: 1551393 - RNA, 19 nt, Homo sapiens
ccgaggauggcuucuucua

SEQ ID NO: 1551394 - RNA, 19 nt, Homo sapiens
gugaagcugcgcaacuaug

SEQ ID NO: 1551395 - RNA, 19 nt, Homo sapiens
gaaaggcgaugaagaaguu

SEQ ID NO: 1551396 - RNA, 19 nt, Homo sapiens
ggacaaagccaccaucauu

SEQ ID NO: 1551397 - RNA, 19 nt, Homo sapiens
caacacauuuggugacuaa

SEQ ID NO: 1551398 - RNA, 19 nt, Homo sapiens
gagaagagguaagcgguua

SEQ ID NO: 1551399 - RNA, 19 nt, Homo sapiens
gcagaaaggcgaugaagaa

SEQ ID NO: 1551400 - RNA, 19 nt, Homo sapiens
gcacugggcugcagaaagg

SEQ ID NO: 1551401 - RNA, 19 nt, Homo sapiens
gcaacuaugugguggagaa

SEQ ID NO: 1551402 - RNA, 19 nt, Homo sapiens
ggacggaggugcacgaagu

SEQ ID NO: 1551403 - RNA, 19 nt, Homo sapiens
gaggauggcuucuucuauc

SEQ ID NO: 1551404 - RNA, 19 nt, Homo sapiens
ggcacacgcucuuggaaua

SEQ ID NO: 1551405 - RNA, 19 nt, Homo sapiens
caaauggccuuuccuuaag

SEQ ID NO: 1551406 - RNA, 19 nt, Homo sapiens
gaaaggcaguuggagaaga

SEQ ID NO: 1551407 - RNA, 19 nt, Homo sapiens
acaaauggccuuuccuuaa

SEQ ID NO: 1551408 - RNA, 19 nt, Homo sapiens
gaacuuggcaucucugauc

SEQ ID NO: 1551409 - RNA, 19 nt, Homo sapiens
ggagagcgcaggcgugaaa

SEQ ID NO: 1551410 - RNA, 19 nt, Homo sapiens
ugaccaaguucacccagua

SEQ ID NO: 1551411 - RNA, 19 nt, Homo sapiens
gaaucaagguccagagaag

SEQ ID NO: 1551412 - RNA, 19 nt, Homo sapiens
ggaccucgcauuaaaguau

SEQ ID NO: 1551413 - RNA, 19 nt, Homo sapiens
gacaaauggccuuuccuua

SEQ ID NO: 1551414 - RNA, 19 nt, Homo sapiens
ggacaucccagcuggaguu

SEQ ID NO: 1551415 - RNA, 19 nt, Homo sapiens
cagagaagguggaggaauc

SEQ ID NO: 1551416 - RNA, 19 nt, Homo sapiens
gcccaacgaugacuucugu

SEQ ID NO: 1551417 - RNA, 19 nt, Homo sapiens
ggccucggcugaagaaaga

SEQ ID NO: 1551418 - RNA, 19 nt, Homo sapiens
uuccuuaaguuccucauua

SEQ ID NO: 1551419 - RNA, 19 nt, Homo sapiens
ggccaugggugcugagaga

SEQ ID NO: 1551420 - RNA, 19 nt, Homo sapiens
gacuaaauuuggaaucaga

SEQ ID NO: 1551421 - RNA, 19 nt, Homo sapiens
uggcaucucugaucuaaca

SEQ ID NO: 1551422 - RNA, 19 nt, Homo sapiens
gggaaaggcaguuggagaa

SEQ ID NO: 1551423 - RNA, 19 nt, Homo sapiens
guccugggcuaaccauaaa

SEQ ID NO: 1551424 - RNA, 19 nt, Homo sapiens
ggaagaaaauacacagaug

SEQ ID NO: 1551425 - RNA, 19 nt, Homo sapiens
gaccucgcauuaaaguauu

SEQ ID NO: 1551426 - RNA, 19 nt, Homo sapiens
caucccagcuggaguucaa

SEQ ID NO: 1551427 - RNA, 19 nt, Homo sapiens
uggagaaggugcccgagaa

SEQ ID NO: 1551428 - RNA, 19 nt, Homo sapiens
cgcaugaccuggcaaagga

SEQ ID NO: 1551429 - RNA, 19 nt, Homo sapiens
gauggcuucuucuaucuca

SEQ ID NO: 1551430 - RNA, 19 nt, Homo sapiens
cauaugaagacaacacauu

SEQ ID NO: 1551431 - RNA, 19 nt, Homo sapiens
gacaaagccaccaucauuc

SEQ ID NO: 1551432 - RNA, 19 nt, Homo sapiens
gugacuaaauuuggaauca

SEQ ID NO: 1551433 - RNA, 19 nt, Homo sapiens
aagugaagcugcgcaacua

SEQ ID NO: 1551434 - RNA, 19 nt, Homo sapiens
cuaacaagggcaccacuaa

SEQ ID NO: 1551435 - RNA, 19 nt, Homo sapiens
ggccaguuaucucuccaaa

SEQ ID NO: 1551436 - RNA, 19 nt, Homo sapiens
gaagugaagcugcgcaacu

SEQ ID NO: 1551437 - RNA, 19 nt, Homo sapiens
ggcucaaccugaccaaguu

SEQ ID NO: 1551438 - RNA, 19 nt, Homo sapiens
caaccuucaucccuucugu

SEQ ID NO: 1551439 - RNA, 19 nt, Homo sapiens
gcgaugaagaaguuugaaa

SEQ ID NO: 1551440 - RNA, 19 nt, Homo sapiens
ccaagguguuccuaagcuu

SEQ ID NO: 1551441 - RNA, 19 nt, Homo sapiens
gcacacgcucuuggaauau

SEQ ID NO: 1551442 - RNA, 19 nt, Homo sapiens
ugacaaauggccuuuccuu

SEQ ID NO: 1551443 - RNA, 19 nt, Homo sapiens
guccgaggauggcuucuuc

SEQ ID NO: 1551444 - RNA, 19 nt, Homo sapiens
ccaccaucauucaccuuga

SEQ ID NO: 1551445 - RNA, 19 nt, Homo sapiens
ggaaucagaggcuuuuaaa

SEQ ID NO: 1551446 - RNA, 19 nt, Homo sapiens
guuaggagacugaaucaag

SEQ ID NO: 1551447 - RNA, 19 nt, Homo sapiens
aaaggcaguuggagaagag

SEQ ID NO: 1551448 - RNA, 19 nt, Homo sapiens
ucaaccaggcccucaaaga

SEQ ID NO: 1551449 - RNA, 19 nt, Homo sapiens
acaaagccaccaucauuca

SEQ ID NO: 1551450 - RNA, 19 nt, Homo sapiens
cuuggcaucucugaucuaa

SEQ ID NO: 1551451 - RNA, 19 nt, Homo sapiens
cagccacccuccaguccaa

SEQ ID NO: 1551452 - RNA, 19 nt, Homo sapiens
caaccaggcccucaaagac

SEQ ID NO: 1551453 - RNA, 19 nt, Homo sapiens
ccaguuaucucuccaaaac

SEQ ID NO: 1551454 - RNA, 19 nt, Homo sapiens
ccaggguggcuuuguggua

SEQ ID NO: 1551455 - RNA, 19 nt, Homo sapiens
gcgacagacuccaguacag

SEQ ID NO: 1551456 - RNA, 19 nt, Homo sapiens
gcacaugcccaacgaugac

SEQ ID NO: 1551457 - RNA, 19 nt, Homo sapiens
gaugaagaaguuugaaagg

SEQ ID NO: 1551458 - RNA, 19 nt, Homo sapiens
ucaggaacuuggcaucucu

SEQ ID NO: 1551459 - RNA, 19 nt, Homo sapiens
gcgcgaggagcacauugaa

SEQ ID NO: 1551460 - RNA, 19 nt, Homo sapiens
cgaggauggcuucuucuau

SEQ ID NO: 1551461 - RNA, 19 nt, Homo sapiens
gcaguuggagaagagguaa

SEQ ID NO: 1551462 - RNA, 19 nt, Homo sapiens
gggcucaaccugaccaagu

SEQ ID NO: 1551463 - RNA, 19 nt, Homo sapiens
gacaacacauuuggugacu

SEQ ID NO: 1551464 - RNA, 19 nt, Homo sapiens
uguccgggcuugugcuguu

SEQ ID NO: 1551465 - RNA, 19 nt, Homo sapiens
ggaggugcacgaagugaag

SEQ ID NO: 1551466 - RNA, 19 nt, Homo sapiens
cagaacacgggcuggauug

SEQ ID NO: 1551467 - RNA, 19 nt, Homo sapiens
ucaccuaccgggaccagaa

SEQ ID NO: 1551468 - RNA, 19 nt, Homo sapiens
gaagaaaauacacagaugu

SEQ ID NO: 1551469 - RNA, 19 nt, Homo sapiens
gcaccacuaacaaggacaa

SEQ ID NO: 1551470 - RNA, 19 nt, Homo sapiens
uaugaagacaacacauuug

SEQ ID NO: 1551471 - RNA, 19 nt, Homo sapiens
ugaaucaagguccagagaa

SEQ ID NO: 1551472 - RNA, 19 nt, Homo sapiens
aaauggccuuuccuuaagu

SEQ ID NO: 1551473 - RNA, 19 nt, Homo sapiens
cgaugaagaaguuugaaag

SEQ ID NO: 1551474 - RNA, 19 nt, Homo sapiens
ggagaaggugcccgagaag

SEQ ID NO: 1551475 - RNA, 19 nt, Homo sapiens
uguccugggcuaaccauaa

SEQ ID NO: 1551476 - RNA, 19 nt, Homo sapiens
caagggcaccacuaacaag

SEQ ID NO: 1551477 - RNA, 19 nt, Homo sapiens
ggaaaggcaguuggagaag

SEQ ID NO: 1551478 - RNA, 19 nt, Homo sapiens
ggaaucugaaggugcugaa

SEQ ID NO: 1551479 - RNA, 19 nt, Homo sapiens
gacacaaggucaccauccu

SEQ ID NO: 1551480 - RNA, 19 nt, Homo sapiens
acaagggcaccacuaacaa

SEQ ID NO: 1551481 - RNA, 19 nt, Homo sapiens
ugaagcugcgcaacuaugu

SEQ ID NO: 1551482 - RNA, 19 nt, Homo sapiens
ucgacgacguggcggcauu

SEQ ID NO: 1551483 - RNA, 19 nt, Homo sapiens
ccacucgcccgaagacauc

SEQ ID NO: 1551484 - RNA, 19 nt, Homo sapiens
gaagcugcgcaacuaugug

SEQ ID NO: 1551485 - RNA, 19 nt, Homo sapiens
ccaagaccccuucgagaaa

SEQ ID NO: 1551486 - RNA, 19 nt, Homo sapiens
ucccaguccugacaaaugg

SEQ ID NO: 1551487 - RNA, 19 nt, Homo sapiens
ccgaggauggcuucuucua

SEQ ID NO: 1551488 - RNA, 19 nt, Homo sapiens
gugaagcugcgcaacuaug

SEQ ID NO: 1551489 - RNA, 19 nt, Homo sapiens
ccacuaacaaggacaaagc

SEQ ID NO: 1551490 - RNA, 19 nt, Homo sapiens
aacaagggcaccacuaaca

SEQ ID NO: 1551491 - RNA, 19 nt, Homo sapiens
uaacaagggcaccacuaac

SEQ ID NO: 1551492 - RNA, 19 nt, Homo sapiens
ugacuaaauuuggaaucag

SEQ ID NO: 1551493 - RNA, 19 nt, Homo sapiens
ggcaguuggagaagaggua

SEQ ID NO: 1551494 - RNA, 19 nt, Homo sapiens
acaacacauuuggugacua

SEQ ID NO: 1551495 - RNA, 19 nt, Homo sapiens
gggaagaucuuugccuuug

SEQ ID NO: 1551496 - RNA, 19 nt, Homo sapiens
caagggugcuaguguauga

SEQ ID NO: 1551497 - RNA, 19 nt, Homo sapiens
gcacaccgccuugcacaua

SEQ ID NO: 1551498 - RNA, 19 nt, Homo sapiens
agacagaucugcaugaaca

SEQ ID NO: 1551499 - RNA, 19 nt, Homo sapiens
ggaagaucuuugccuuuga

SEQ ID NO: 1551500 - RNA, 19 nt, Homo sapiens
gacaagguuucuccuauca

SEQ ID NO: 1551501 - RNA, 19 nt, Homo sapiens
ggccaagggugcuagugua

SEQ ID NO: 1551502 - RNA, 19 nt, Homo sapiens
guaguuauuucaagagaca

SEQ ID NO: 1551503 - RNA, 19 nt, Homo sapiens
gaaccaagggaagaucuuu

SEQ ID NO: 1551504 - RNA, 19 nt, Homo sapiens
gaccugcuccguuuaugua

SEQ ID NO: 1551505 - RNA, 19 nt, Homo sapiens
ucacuuggcugcucuucug

SEQ ID NO: 1551506 - RNA, 19 nt, Homo sapiens
cucaagaccugcuccguuu

SEQ ID NO: 1551507 - RNA, 19 nt, Homo sapiens
gaagaucuuugccuuugac

SEQ ID NO: 1551508 - RNA, 19 nt, Homo sapiens
gcuaguguaugaguuguug

SEQ ID NO: 1551509 - RNA, 19 nt, Homo sapiens
caaagcaucagcaccagaa

SEQ ID NO: 1551510 - RNA, 19 nt, Homo sapiens
caggcgagguguugaguug

SEQ ID NO: 1551511 - RNA, 19 nt, Homo sapiens
uguaugaguuguugggaaa

SEQ ID NO: 1551512 - RNA, 19 nt, Homo sapiens
cuucuucguugcuguaauu

SEQ ID NO: 1551513 - RNA, 19 nt, Homo sapiens
gagcagcugggauuaugaa

SEQ ID NO: 1551514 - RNA, 19 nt, Homo sapiens
cuucguugcuguaauugaa

SEQ ID NO: 1551515 - RNA, 19 nt, Homo sapiens
agacaagguuucuccuauc

SEQ ID NO: 1551516 - RNA, 19 nt, Homo sapiens
caauaaagaccagucacuu

SEQ ID NO: 1551517 - RNA, 19 nt, Homo sapiens
ccucccagcugccucgauu

SEQ ID NO: 1551518 - RNA, 19 nt, Homo sapiens
gcaauaaagaccagucacu

SEQ ID NO: 1551519 - RNA, 19 nt, Homo sapiens
caagaccugcuccguuuau

SEQ ID NO: 1551520 - RNA, 19 nt, Homo sapiens
aauaaagaccagucacuug

SEQ ID NO: 1551521 - RNA, 19 nt, Homo sapiens
cagccucgaugacuuacga

SEQ ID NO: 1551522 - RNA, 19 nt, Homo sapiens
ccagcugccucgauuugug

SEQ ID NO: 1551523 - RNA, 19 nt, Homo sapiens
ugccggagcugcugguguu

SEQ ID NO: 1551524 - RNA, 19 nt, Homo sapiens
ccaauggaaggcucuguug

SEQ ID NO: 1551525 - RNA, 19 nt, Homo sapiens
gccaggaggagaaugaaga

SEQ ID NO: 1551526 - RNA, 19 nt, Homo sapiens
gcaugaacacccacuguac

SEQ ID NO: 1551527 - RNA, 19 nt, Homo sapiens
gaagaaccaagggaagauc

SEQ ID NO: 1551528 - RNA, 19 nt, Homo sapiens
ucaagaccugcuccguuua

SEQ ID NO: 1551529 - RNA, 19 nt, Homo sapiens
cugagcagcugggauuaug

SEQ ID NO: 1551530 - RNA, 19 nt, Homo sapiens
ccguuuauguaguuauuuc

SEQ ID NO: 1551531 - RNA, 19 nt, Homo sapiens
agagaaagaagagagcaaa

SEQ ID NO: 1551532 - RNA, 19 nt, Homo sapiens
gcaugaggaccuguuggaa

SEQ ID NO: 1551533 - RNA, 19 nt, Homo sapiens
uaauugaacgggucgagau

SEQ ID NO: 1551534 - RNA, 19 nt, Homo sapiens
gcaacuuccagaacgugaa

SEQ ID NO: 1551535 - RNA, 19 nt, Homo sapiens
cuucugagcagcugggauu

SEQ ID NO: 1551536 - RNA, 19 nt, Homo sapiens
cugcuccguuuauguaguu

SEQ ID NO: 1551537 - RNA, 19 nt, Homo sapiens
gaacgugaagcagcuguac

SEQ ID NO: 1551538 - RNA, 19 nt, Homo sapiens
augaggaccuguuggaagu

SEQ ID NO: 1551539 - RNA, 19 nt, Homo sapiens
ggugcuaguguaugaguug

SEQ ID NO: 1551540 - RNA, 19 nt, Homo sapiens
gccaagggugcuaguguau

SEQ ID NO: 1551541 - RNA, 19 nt, Homo sapiens
ucugugggauaucucauca

SEQ ID NO: 1551542 - RNA, 19 nt, Homo sapiens
gguguacuccagcaacuuc

SEQ ID NO: 1551543 - RNA, 19 nt, Homo sapiens
gccaauggaaggcucuguu

SEQ ID NO: 1551544 - RNA, 19 nt, Homo sapiens
ggcaugaggaccuguugga

SEQ ID NO: 1551545 - RNA, 19 nt, Homo sapiens
gggaagaucuuugccuuug

SEQ ID NO: 1551546 - RNA, 19 nt, Homo sapiens
caagggugcuaguguauga

SEQ ID NO: 1551547 - RNA, 19 nt, Homo sapiens
gcacaccgccuugcacaua

SEQ ID NO: 1551548 - RNA, 19 nt, Homo sapiens
agacagaucugcaugaaca

SEQ ID NO: 1551549 - RNA, 19 nt, Homo sapiens
ggaagaucuuugccuuuga

SEQ ID NO: 1551550 - RNA, 19 nt, Homo sapiens
gacaagguuucuccuauca

SEQ ID NO: 1551551 - RNA, 19 nt, Homo sapiens
ggccaagggugcuagugua

SEQ ID NO: 1551552 - RNA, 19 nt, Homo sapiens
guaguuauuucaagagaca

SEQ ID NO: 1551553 - RNA, 19 nt, Homo sapiens
gaaccaagggaagaucuuu

SEQ ID NO: 1551554 - RNA, 19 nt, Homo sapiens
gaccugcuccguuuaugua

SEQ ID NO: 1551555 - RNA, 19 nt, Homo sapiens
ucacuuggcugcucuucug

SEQ ID NO: 1551556 - RNA, 19 nt, Homo sapiens
cucaagaccugcuccguuu

SEQ ID NO: 1551557 - RNA, 19 nt, Homo sapiens
gaagaucuuugccuuugac

SEQ ID NO: 1551558 - RNA, 19 nt, Homo sapiens
gcuaguguaugaguuguug

SEQ ID NO: 1551559 - RNA, 19 nt, Homo sapiens
caaagcaucagcaccagaa

SEQ ID NO: 1551560 - RNA, 19 nt, Homo sapiens
caggcgagguguugaguug

SEQ ID NO: 1551561 - RNA, 19 nt, Homo sapiens
uguaugaguuguugggaaa

SEQ ID NO: 1551562 - RNA, 19 nt, Homo sapiens
cuucuucguugcuguaauu

SEQ ID NO: 1551563 - RNA, 19 nt, Homo sapiens
gagcagcugggauuaugaa

SEQ ID NO: 1551564 - RNA, 19 nt, Homo sapiens
cuucguugcuguaauugaa

SEQ ID NO: 1551565 - RNA, 19 nt, Homo sapiens
agacaagguuucuccuauc

SEQ ID NO: 1551566 - RNA, 19 nt, Homo sapiens
caauaaagaccagucacuu

SEQ ID NO: 1551567 - RNA, 19 nt, Homo sapiens
ccucccagcugccucgauu

SEQ ID NO: 1551568 - RNA, 19 nt, Homo sapiens
gcaauaaagaccagucacu

SEQ ID NO: 1551569 - RNA, 19 nt, Homo sapiens
caagaccugcuccguuuau

SEQ ID NO: 1551570 - RNA, 19 nt, Homo sapiens
aauaaagaccagucacuug

SEQ ID NO: 1551571 - RNA, 19 nt, Homo sapiens
cagccucgaugacuuacga

SEQ ID NO: 1551572 - RNA, 19 nt, Homo sapiens
ccagcugccucgauuugug

SEQ ID NO: 1551573 - RNA, 19 nt, Homo sapiens
ugccggagcugcugguguu

SEQ ID NO: 1551574 - RNA, 19 nt, Homo sapiens
ccaauggaaggcucuguug

SEQ ID NO: 1551575 - RNA, 19 nt, Homo sapiens
gccaggaggagaaugaaga

SEQ ID NO: 1551576 - RNA, 19 nt, Homo sapiens
gcaugaacacccacuguac

SEQ ID NO: 1551577 - RNA, 19 nt, Homo sapiens
gaagaaccaagggaagauc

SEQ ID NO: 1551578 - RNA, 19 nt, Homo sapiens
ucaagaccugcuccguuua

SEQ ID NO: 1551579 - RNA, 19 nt, Homo sapiens
cugagcagcugggauuaug

SEQ ID NO: 1551580 - RNA, 19 nt, Homo sapiens
ccguuuauguaguuauuuc

SEQ ID NO: 1551581 - RNA, 19 nt, Homo sapiens
agagaaagaagagagcaaa

SEQ ID NO: 1551582 - RNA, 19 nt, Homo sapiens
gcaugaggaccuguuggaa

SEQ ID NO: 1551583 - RNA, 19 nt, Homo sapiens
uaauugaacgggucgagau

SEQ ID NO: 1551584 - RNA, 19 nt, Homo sapiens
gcaacuuccagaacgugaa

SEQ ID NO: 1551585 - RNA, 19 nt, Homo sapiens
cuucugagcagcugggauu

SEQ ID NO: 1551586 - RNA, 19 nt, Homo sapiens
cugcuccguuuauguaguu

SEQ ID NO: 1551587 - RNA, 19 nt, Homo sapiens
gaacgugaagcagcuguac

SEQ ID NO: 1551588 - RNA, 19 nt, Homo sapiens
augaggaccuguuggaagu

SEQ ID NO: 1551589 - RNA, 19 nt, Homo sapiens
ggugcuaguguaugaguug

SEQ ID NO: 1551590 - RNA, 19 nt, Homo sapiens
gccaagggugcuaguguau

SEQ ID NO: 1551591 - RNA, 19 nt, Homo sapiens
ucugugggauaucucauca

SEQ ID NO: 1551592 - RNA, 19 nt, Homo sapiens
gguguacuccagcaacuuc

SEQ ID NO: 1551593 - RNA, 19 nt, Homo sapiens
gccaauggaaggcucuguu

SEQ ID NO: 1551594 - RNA, 19 nt, Homo sapiens
ggcaugaggaccuguugga

SEQ ID NO: 1551595 - RNA, 19 nt, Homo sapiens
cggcucgucuacuccaugu

SEQ ID NO: 1551596 - RNA, 19 nt, Homo sapiens
gcaagucgcucaccugaaa

SEQ ID NO: 1551597 - RNA, 19 nt, Homo sapiens
gaaaugagugcuaguguau

SEQ ID NO: 1551598 - RNA, 19 nt, Homo sapiens
gggaagaucuuugccuuug

SEQ ID NO: 1551599 - RNA, 19 nt, Homo sapiens
gcacaccgccuugcacaua

SEQ ID NO: 1551600 - RNA, 19 nt, Homo sapiens
agacagaucugcaugaaca

SEQ ID NO: 1551601 - RNA, 19 nt, Homo sapiens
ugaaaugagugcuagugua

SEQ ID NO: 1551602 - RNA, 19 nt, Homo sapiens
ggaagaucuuugccuuuga

SEQ ID NO: 1551603 - RNA, 19 nt, Homo sapiens
gacaagguuucuccuauca

SEQ ID NO: 1551604 - RNA, 19 nt, Homo sapiens
guaguuauuucaagagaca

SEQ ID NO: 1551605 - RNA, 19 nt, Homo sapiens
gaaccaagggaagaucuuu

SEQ ID NO: 1551606 - RNA, 19 nt, Homo sapiens
gaccugcuccguuuaugua

SEQ ID NO: 1551607 - RNA, 19 nt, Homo sapiens
ucacuuggcugcucuucug

SEQ ID NO: 1551608 - RNA, 19 nt, Homo sapiens
ggucagcgcuuugucaucu

SEQ ID NO: 1551609 - RNA, 19 nt, Homo sapiens
aaugagugcuaguguauga

SEQ ID NO: 1551610 - RNA, 19 nt, Homo sapiens
cucaagaccugcuccguuu

SEQ ID NO: 1551611 - RNA, 19 nt, Homo sapiens
gaagaucuuugccuuugac

SEQ ID NO: 1551612 - RNA, 19 nt, Homo sapiens
gcuaguguaugaguuguug

SEQ ID NO: 1551613 - RNA, 19 nt, Homo sapiens
caaagcaucagcaccagaa

SEQ ID NO: 1551614 - RNA, 19 nt, Homo sapiens
caggcgagguguugaguug

SEQ ID NO: 1551615 - RNA, 19 nt, Homo sapiens
uguaugaguuguugggaaa

SEQ ID NO: 1551616 - RNA, 19 nt, Homo sapiens
cuucuucguugcuguaauu

SEQ ID NO: 1551617 - RNA, 19 nt, Homo sapiens
gagcagcugggauuaugaa

SEQ ID NO: 1551618 - RNA, 19 nt, Homo sapiens
cuucguugcuguaauugaa

SEQ ID NO: 1551619 - RNA, 19 nt, Homo sapiens
agacaagguuucuccuauc

SEQ ID NO: 1551620 - RNA, 19 nt, Homo sapiens
caauaaagaccagucacuu

SEQ ID NO: 1551621 - RNA, 19 nt, Homo sapiens
ccucccagcugccucgauu

SEQ ID NO: 1551622 - RNA, 19 nt, Homo sapiens
gcaauaaagaccagucacu

SEQ ID NO: 1551623 - RNA, 19 nt, Homo sapiens
caagaccugcuccguuuau

SEQ ID NO: 1551624 - RNA, 19 nt, Homo sapiens
aauaaagaccagucacuug

SEQ ID NO: 1551625 - RNA, 19 nt, Homo sapiens
cagccucgaugacuuacga

SEQ ID NO: 1551626 - RNA, 19 nt, Homo sapiens
ccagcugccucgauuugug

SEQ ID NO: 1551627 - RNA, 19 nt, Homo sapiens
ugccggagcugcugguguu

SEQ ID NO: 1551628 - RNA, 19 nt, Homo sapiens
ccaauggaaggcucuguug

SEQ ID NO: 1551629 - RNA, 19 nt, Homo sapiens
gccaggaggagaaugaaga

SEQ ID NO: 1551630 - RNA, 19 nt, Homo sapiens
gcaugaacacccacuguac

SEQ ID NO: 1551631 - RNA, 19 nt, Homo sapiens
gaagaaccaagggaagauc

SEQ ID NO: 1551632 - RNA, 19 nt, Homo sapiens
ucaagaccugcuccguuua

SEQ ID NO: 1551633 - RNA, 19 nt, Homo sapiens
cugagcagcugggauuaug

SEQ ID NO: 1551634 - RNA, 19 nt, Homo sapiens
ccguuuauguaguuauuuc

SEQ ID NO: 1551635 - RNA, 19 nt, Homo sapiens
agagaaagaagagagcaaa

SEQ ID NO: 1551636 - RNA, 19 nt, Homo sapiens
gcaugaggaccuguuggaa

SEQ ID NO: 1551637 - RNA, 19 nt, Homo sapiens
uaauugaacgggucgagau

SEQ ID NO: 1551638 - RNA, 19 nt, Homo sapiens
cuucugagcagcugggauu

SEQ ID NO: 1551639 - RNA, 19 nt, Homo sapiens
cugcuccguuuauguaguu

SEQ ID NO: 1551640 - RNA, 19 nt, Homo sapiens
gcaacuuccagaacgugaa

SEQ ID NO: 1551641 - RNA, 19 nt, Homo sapiens
gaacgugaagcagcuguac

SEQ ID NO: 1551642 - RNA, 19 nt, Homo sapiens
augaggaccuguuggaagu

SEQ ID NO: 1551643 - RNA, 19 nt, Homo sapiens
ucugugggauaucucauca

SEQ ID NO: 1551644 - RNA, 19 nt, Homo sapiens
gguguacuccagcaacuuc

SEQ ID NO: 1551645 - RNA, 19 nt, Homo sapiens
gagugcuaguguaugaguu

SEQ ID NO: 1551646 - RNA, 19 nt, Homo sapiens
ggcaugaggaccuguugga

SEQ ID NO: 1551647 - RNA, 19 nt, Homo sapiens
gccaauggaaggcucuguu

SEQ ID NO: 1551648 - RNA, 19 nt, Homo sapiens
uggcucgggugagauggua

SEQ ID NO: 1551649 - RNA, 19 nt, Homo sapiens
gacuuucgcuuaacucuuu

SEQ ID NO: 1551650 - RNA, 19 nt, Homo sapiens
gcacaccgccuugcacaua

SEQ ID NO: 1551651 - RNA, 19 nt, Homo sapiens
agacagaucugcaugaaca

SEQ ID NO: 1551652 - RNA, 19 nt, Homo sapiens
caucuaacaucuacauuuc

SEQ ID NO: 1551653 - RNA, 19 nt, Homo sapiens
gaccuggagucaucuguuu

SEQ ID NO: 1551654 - RNA, 19 nt, Homo sapiens
ggaagaucuuugccuuuga

SEQ ID NO: 1551655 - RNA, 19 nt, Homo sapiens
ccugggcccuuuaaauaua

SEQ ID NO: 1551656 - RNA, 19 nt, Homo sapiens
aaggaugacuuucgcuuaa

SEQ ID NO: 1551657 - RNA, 19 nt, Homo sapiens
gcuuagaccuggagucauc

SEQ ID NO: 1551658 - RNA, 19 nt, Homo sapiens
caaaaguucuccucuguga

SEQ ID NO: 1551659 - RNA, 19 nt, Homo sapiens
ucacuuggcugcucuucug

SEQ ID NO: 1551660 - RNA, 19 nt, Homo sapiens
gaagaucuuugccuuugac

SEQ ID NO: 1551661 - RNA, 19 nt, Homo sapiens
caaagcaucagcaccagaa

SEQ ID NO: 1551662 - RNA, 19 nt, Homo sapiens
gaaaagggaagaaugugua

SEQ ID NO: 1551663 - RNA, 19 nt, Homo sapiens
gcacaucuaacaucuacau

SEQ ID NO: 1551664 - RNA, 19 nt, Homo sapiens
ucuuaguucugacacuuua

SEQ ID NO: 1551665 - RNA, 19 nt, Homo sapiens
cuucuucguugcuguaauu

SEQ ID NO: 1551666 - RNA, 19 nt, Homo sapiens
ggucuuaguucugacacuu

SEQ ID NO: 1551667 - RNA, 19 nt, Homo sapiens
aggaagaucuuugccuuug

SEQ ID NO: 1551668 - RNA, 19 nt, Homo sapiens
uauuguguguccuggcuua

SEQ ID NO: 1551669 - RNA, 19 nt, Homo sapiens
cuucguugcuguaauugaa

SEQ ID NO: 1551670 - RNA, 19 nt, Homo sapiens
ccaggccaguuaccucuga

SEQ ID NO: 1551671 - RNA, 19 nt, Homo sapiens
acccugggcccuuuaaaua

SEQ ID NO: 1551672 - RNA, 19 nt, Homo sapiens
caauaaagaccagucacuu

SEQ ID NO: 1551673 - RNA, 19 nt, Homo sapiens
gcaauaaagaccagucacu

SEQ ID NO: 1551674 - RNA, 19 nt, Homo sapiens
aauaaagaccagucacuug

SEQ ID NO: 1551675 - RNA, 19 nt, Homo sapiens
ugccggagcugcugguguu

SEQ ID NO: 1551676 - RNA, 19 nt, Homo sapiens
uaaugaaggcugaaaggau

SEQ ID NO: 1551677 - RNA, 19 nt, Homo sapiens
guaggcaagaggaauagaa

SEQ ID NO: 1551678 - RNA, 19 nt, Homo sapiens
ggaugacuuucgcuuaacu

SEQ ID NO: 1551679 - RNA, 19 nt, Homo sapiens
uggcacaucuaacaucuac

SEQ ID NO: 1551680 - RNA, 19 nt, Homo sapiens
gguacuggcacaucuaaca

SEQ ID NO: 1551681 - RNA, 19 nt, Homo sapiens
cgggugagauggugagaag

SEQ ID NO: 1551682 - RNA, 19 nt, Homo sapiens
uggcuuaaccugcauguuc

SEQ ID NO: 1551683 - RNA, 19 nt, Homo sapiens
guaaugaaggcugaaagga

SEQ ID NO: 1551684 - RNA, 19 nt, Homo sapiens
gccaggaggagaaugaaga

SEQ ID NO: 1551685 - RNA, 19 nt, Homo sapiens
gcaugaacacccacuguac

SEQ ID NO: 1551686 - RNA, 19 nt, Homo sapiens
gacccugggcccuuuaaau

SEQ ID NO: 1551687 - RNA, 19 nt, Homo sapiens
ucuaacaucuacauuucuc

SEQ ID NO: 1551688 - RNA, 19 nt, Homo sapiens
aaaguucuccucugugaag

SEQ ID NO: 1551689 - RNA, 19 nt, Homo sapiens
cagcuuagaccuggaguca

SEQ ID NO: 1551690 - RNA, 19 nt, Homo sapiens
agagaaagaagagagcaaa

SEQ ID NO: 1551691 - RNA, 19 nt, Homo sapiens
ggcuuaaccugcauguucu

SEQ ID NO: 1551692 - RNA, 19 nt, Homo sapiens
uaggcaagaggaauagaaa

SEQ ID NO: 1551693 - RNA, 19 nt, Homo sapiens
gccuuucaguggguaauga

SEQ ID NO: 1551694 - RNA, 19 nt, Homo sapiens
caucuacauuucucuagcu

SEQ ID NO: 1551695 - RNA, 19 nt, Homo sapiens
uaggaagaucuuugccuuu

SEQ ID NO: 1551696 - RNA, 19 nt, Homo sapiens
auaggcuguuucaauauug

SEQ ID NO: 1551697 - RNA, 19 nt, Homo sapiens
gguaaugaaggcugaaagg

SEQ ID NO: 1551698 - RNA, 19 nt, Homo sapiens
guacuggcacaucuaacau

SEQ ID NO: 1551699 - RNA, 19 nt, Homo sapiens
ccacugcaggugugagaug

SEQ ID NO: 1551700 - RNA, 19 nt, Homo sapiens
gcaggugugagauguggau

SEQ ID NO: 1551701 - RNA, 19 nt, Homo sapiens
agagguccacagcagcuua

SEQ ID NO: 1551702 - RNA, 19 nt, Homo sapiens
gugagauguggaucccuua

SEQ ID NO: 1551703 - RNA, 19 nt, Homo sapiens
gguauuugccccaagcuaa

SEQ ID NO: 1551704 - RNA, 19 nt, Homo sapiens
gaaauugcaggcugaacuu

SEQ ID NO: 1551705 - RNA, 19 nt, Homo sapiens
ggaaggagugcuuggagaa

SEQ ID NO: 1551706 - RNA, 19 nt, Homo sapiens
gagaagcccgauggaaauu

SEQ ID NO: 1551707 - RNA, 19 nt, Homo sapiens
ggaaauugcaggcugaacu

SEQ ID NO: 1551708 - RNA, 19 nt, Homo sapiens
gaagcccgauggaaauugc

SEQ ID NO: 1551709 - RNA, 19 nt, Homo sapiens
ugagaagcccgauggaaau

SEQ ID NO: 1551710 - RNA, 19 nt, Homo sapiens
gaaggagugcuuggagaau

SEQ ID NO: 1551711 - RNA, 19 nt, Homo sapiens
aggagugcuuggagaauga

SEQ ID NO: 1551712 - RNA, 19 nt, Homo sapiens
gcaggaaggagugcuugga

SEQ ID NO: 1551713 - RNA, 19 nt, Homo sapiens
aaggagugcuuggagaaug

SEQ ID NO: 1551714 - RNA, 19 nt, Homo sapiens
augagaagcccgauggaaa

SEQ ID NO: 1551715 - RNA, 19 nt, Homo sapiens
gaaugagaagcccgaugga

SEQ ID NO: 1551716 - RNA, 19 nt, Homo sapiens
ucuauuugcuauguucuuc

SEQ ID NO: 1551717 - RNA, 19 nt, Homo sapiens
ggacagaagugcccuagaa

SEQ ID NO: 1551718 - RNA, 19 nt, Homo sapiens
gaucauaucucugcaguga

SEQ ID NO: 1551719 - RNA, 19 nt, Homo sapiens
cgaagacgcugaagaagaa

SEQ ID NO: 1551720 - RNA, 19 nt, Homo sapiens
gauggaaacuucuauggaa

SEQ ID NO: 1551721 - RNA, 19 nt, Homo sapiens
ugaagacuguuccaaguua

SEQ ID NO: 1551722 - RNA, 19 nt, Homo sapiens
gaagauaaaccaccaaaca

SEQ ID NO: 1551723 - RNA, 19 nt, Homo sapiens
gaaauggccuacacugaca

SEQ ID NO: 1551724 - RNA, 19 nt, Homo sapiens
ggaaauaaaguucuucuuc

SEQ ID NO: 1551725 - RNA, 19 nt, Homo sapiens
gaaaagaugucuccacuuc

SEQ ID NO: 1551726 - RNA, 19 nt, Homo sapiens
ucaaucaccuuaaccagaa

SEQ ID NO: 1551727 - RNA, 19 nt, Homo sapiens
caggcaaagucauuaauaa

SEQ ID NO: 1551728 - RNA, 19 nt, Homo sapiens
ggaagaagaugaggacaag

SEQ ID NO: 1551729 - RNA, 19 nt, Homo sapiens
ggauagcucucuuccugaa

SEQ ID NO: 1551730 - RNA, 19 nt, Homo sapiens
ggagagacuugcaugaauc

SEQ ID NO: 1551731 - RNA, 19 nt, Homo sapiens
gaugaagacuguuccaagu

SEQ ID NO: 1551732 - RNA, 19 nt, Homo sapiens
gugacuaucccuuugauua

SEQ ID NO: 1551733 - RNA, 19 nt, Homo sapiens
ccagauguuucaauuggua

SEQ ID NO: 1551734 - RNA, 19 nt, Homo sapiens
ccauggacuuuagaaauua

SEQ ID NO: 1551735 - RNA, 19 nt, Homo sapiens
ggagaguggagcauuguua

SEQ ID NO: 1551736 - RNA, 19 nt, Homo sapiens
ggaggagaguggagcauug

SEQ ID NO: 1551737 - RNA, 19 nt, Homo sapiens
gaccugaccagucuauaua

SEQ ID NO: 1551738 - RNA, 19 nt, Homo sapiens
gaaagugggacauaugaug

SEQ ID NO: 1551739 - RNA, 19 nt, Homo sapiens
uaccaggaguggauuauaa

SEQ ID NO: 1551740 - RNA, 19 nt, Homo sapiens
ccgcgcagcugaugaacua

SEQ ID NO: 1551741 - RNA, 19 nt, Homo sapiens
acacagggaugaucuacuu

SEQ ID NO: 1551742 - RNA, 19 nt, Homo sapiens
ccugaaaucuaagacuuua

SEQ ID NO: 1551743 - RNA, 19 nt, Homo sapiens
agagauccaucccagcuua

SEQ ID NO: 1551744 - RNA, 19 nt, Homo sapiens
gggagagacuugcaugaau

SEQ ID NO: 1551745 - RNA, 19 nt, Homo sapiens
uuaccuaagucuucaguuu

SEQ ID NO: 1551746 - RNA, 19 nt, Homo sapiens
auaaagauuugcggcauua

SEQ ID NO: 1551747 - RNA, 19 nt, Homo sapiens
ggucauugcugaagaagag

SEQ ID NO: 1551748 - RNA, 19 nt, Homo sapiens
cgagcaacauuaaggcuuu

SEQ ID NO: 1551749 - RNA, 19 nt, Homo sapiens
ggaaaucacacaaacaagu

SEQ ID NO: 1551750 - RNA, 19 nt, Homo sapiens
gucaaggccuucagaaaga

SEQ ID NO: 1551751 - RNA, 19 nt, Homo sapiens
ggacaagggagcuauuaau

SEQ ID NO: 1551752 - RNA, 19 nt, Homo sapiens
gaaaccaggcaaagucauu

SEQ ID NO: 1551753 - RNA, 19 nt, Homo sapiens
gaaacccgagcaacauuaa

SEQ ID NO: 1551754 - RNA, 19 nt, Homo sapiens
gaauuuaacacaucuccaa

SEQ ID NO: 1551755 - RNA, 19 nt, Homo sapiens
agauagaccugaugaguuc

SEQ ID NO: 1551756 - RNA, 19 nt, Homo sapiens
gagauagaccugaugaguu

SEQ ID NO: 1551757 - RNA, 19 nt, Homo sapiens
gaugcagaaucucaaagaa

SEQ ID NO: 1551758 - RNA, 19 nt, Homo sapiens
acacaaggaaucacacaua

SEQ ID NO: 1551759 - RNA, 19 nt, Homo sapiens
gcugauguaccauugcuua

SEQ ID NO: 1551760 - RNA, 19 nt, Homo sapiens
caaguccucuuugauaaug

SEQ ID NO: 1551761 - RNA, 19 nt, Homo sapiens
ccuagaaggugaaauugga

SEQ ID NO: 1551762 - RNA, 19 nt, Homo sapiens
caccaaacaccaaagauuu

SEQ ID NO: 1551763 - RNA, 19 nt, Homo sapiens
guuauccacuuccugauga

SEQ ID NO: 1551764 - RNA, 19 nt, Homo sapiens
caaguuacaaccaaacaaa

SEQ ID NO: 1551765 - RNA, 19 nt, Homo sapiens
gacauaugauggaaacuuc

SEQ ID NO: 1551766 - RNA, 19 nt, Homo sapiens
uugcaugucuuguaaauca

SEQ ID NO: 1551767 - RNA, 19 nt, Homo sapiens
gcaguaauuucaguuguag

SEQ ID NO: 1551768 - RNA, 19 nt, Homo sapiens
gacaacugcugcucgaaau

SEQ ID NO: 1551769 - RNA, 19 nt, Homo sapiens
gauguaccauugcuuaucu

SEQ ID NO: 1551770 - RNA, 19 nt, Homo sapiens
cuaaagcaguuuccaguag

SEQ ID NO: 1551771 - RNA, 19 nt, Homo sapiens
gaaauugggucuucaaaac

SEQ ID NO: 1551772 - RNA, 19 nt, Homo sapiens
ggagugcaauggcaugauc

SEQ ID NO: 1551773 - RNA, 19 nt, Homo sapiens
uccauggacuuuagaaauu

SEQ ID NO: 1551774 - RNA, 19 nt, Homo sapiens
ucauaucucugcagugaau

SEQ ID NO: 1551775 - RNA, 19 nt, Homo sapiens
gggagcagcugagaaagau

SEQ ID NO: 1551776 - RNA, 19 nt, Homo sapiens
ggaccugaccagucuauau

SEQ ID NO: 1551777 - RNA, 19 nt, Homo sapiens
gaugaguuccuacaaguga

SEQ ID NO: 1551778 - RNA, 19 nt, Homo sapiens
ucagcaagauggaaagaau

SEQ ID NO: 1551779 - RNA, 19 nt, Homo sapiens
ggacauaugauggaaacuu

SEQ ID NO: 1551780 - RNA, 19 nt, Homo sapiens
gauagucaguggugucaag

SEQ ID NO: 1551781 - RNA, 19 nt, Homo sapiens
ugacuaucccuuugauuaa

SEQ ID NO: 1551782 - RNA, 19 nt, Homo sapiens
agacaucaauggcaacugu

SEQ ID NO: 1551783 - RNA, 19 nt, Homo sapiens
ggaguggauuauaauuuca

SEQ ID NO: 1551784 - RNA, 19 nt, Homo sapiens
ccaggcaaagucauuaaua

SEQ ID NO: 1551785 - RNA, 19 nt, Homo sapiens
ccugaccagucuauauaua

SEQ ID NO: 1551786 - RNA, 19 nt, Homo sapiens
uccaguaggugcugaugua

SEQ ID NO: 1551787 - RNA, 19 nt, Homo sapiens
gugcagaauuuaacacauc

SEQ ID NO: 1551788 - RNA, 19 nt, Homo sapiens
gacaagggagcuauuaaug

SEQ ID NO: 1551789 - RNA, 19 nt, Homo sapiens
gaggacaagggagcuauua

SEQ ID NO: 1551790 - RNA, 19 nt, Homo sapiens
aaagauggcagaauucaug

SEQ ID NO: 1551791 - RNA, 19 nt, Homo sapiens
uaacggucauugcugaaga

SEQ ID NO: 1551792 - RNA, 19 nt, Homo sapiens
guugaacugucucaugcua

SEQ ID NO: 1551793 - RNA, 19 nt, Homo sapiens
gaaaucacacaaacaaguc

SEQ ID NO: 1551794 - RNA, 19 nt, Homo sapiens
ggccauaaaugagccuauu

SEQ ID NO: 1551795 - RNA, 19 nt, Homo sapiens
gaaguuuggaggccauaaa

SEQ ID NO: 1551796 - RNA, 19 nt, Homo sapiens
ggacagaaggugaaaauga

SEQ ID NO: 1551797 - RNA, 19 nt, Homo sapiens
gcacaaugggauuugguuu

SEQ ID NO: 1551798 - RNA, 19 nt, Homo sapiens
ugaccaaauuguugaaauc

SEQ ID NO: 1551799 - RNA, 19 nt, Homo sapiens
ccaccaaacaccaaagauu

SEQ ID NO: 1551800 - RNA, 19 nt, Homo sapiens
gcuaaagcaguuuccagua

SEQ ID NO: 1551801 - RNA, 19 nt, Homo sapiens
gcccuaugauguugucuug

SEQ ID NO: 1551802 - RNA, 19 nt, Homo sapiens
ugauggaauuccuguuaaa

SEQ ID NO: 1551803 - RNA, 19 nt, Homo sapiens
ggagauagaccugaugagu

SEQ ID NO: 1551804 - RNA, 19 nt, Homo sapiens
ccucuuugauaaugaguuu

SEQ ID NO: 1551805 - RNA, 19 nt, Homo sapiens
guuagaaagugggacauau

SEQ ID NO: 1551806 - RNA, 19 nt, Homo sapiens
ugaaacccgagcaacauua

SEQ ID NO: 1551807 - RNA, 19 nt, Homo sapiens
gaaaguuggagaucauauc

SEQ ID NO: 1551808 - RNA, 19 nt, Homo sapiens
ucucaggccuucauuucaa

SEQ ID NO: 1551809 - RNA, 19 nt, Homo sapiens
cagcaagugaucagagaua

SEQ ID NO: 1551810 - RNA, 19 nt, Homo sapiens
ugaagacugugaagaugga

SEQ ID NO: 1551811 - RNA, 19 nt, Homo sapiens
cgcaguaauuucaguugua

SEQ ID NO: 1551812 - RNA, 19 nt, Homo sapiens
gaaauggccauguguuacu

SEQ ID NO: 1551813 - RNA, 19 nt, Homo sapiens
uaaagggaaaucacacaaa

SEQ ID NO: 1551814 - RNA, 19 nt, Homo sapiens
gcaagugagcagagaguau

SEQ ID NO: 1551815 - RNA, 19 nt, Homo sapiens
gaaccuacacaaggaauca

SEQ ID NO: 1551816 - RNA, 19 nt, Homo sapiens
gauggcagaauucauguug

SEQ ID NO: 1551817 - RNA, 19 nt, Homo sapiens
ggacagaagugcccuagaa

SEQ ID NO: 1551818 - RNA, 19 nt, Homo sapiens
gaucauaucucugcaguga

SEQ ID NO: 1551819 - RNA, 19 nt, Homo sapiens
cgaagacgcugaagaagaa

SEQ ID NO: 1551820 - RNA, 19 nt, Homo sapiens
gauggaaacuucuauggaa

SEQ ID NO: 1551821 - RNA, 19 nt, Homo sapiens
ugaagacuguuccaaguua

SEQ ID NO: 1551822 - RNA, 19 nt, Homo sapiens
gaacuaaugugcguugaug

SEQ ID NO: 1551823 - RNA, 19 nt, Homo sapiens
ggaagagaguggagcauug

SEQ ID NO: 1551824 - RNA, 19 nt, Homo sapiens
gaagauaaaccaccaaaca

SEQ ID NO: 1551825 - RNA, 19 nt, Homo sapiens
gaaauggccuacacugaca

SEQ ID NO: 1551826 - RNA, 19 nt, Homo sapiens
ggaaauaaaguucuucuuc

SEQ ID NO: 1551827 - RNA, 19 nt, Homo sapiens
gaaaagaugucuccacuuc

SEQ ID NO: 1551828 - RNA, 19 nt, Homo sapiens
caggcaaagucauuaauaa

SEQ ID NO: 1551829 - RNA, 19 nt, Homo sapiens
ggaagaagaugaggacaag

SEQ ID NO: 1551830 - RNA, 19 nt, Homo sapiens
ggauagcucucuuccugaa

SEQ ID NO: 1551831 - RNA, 19 nt, Homo sapiens
guugaacugucucaugaua

SEQ ID NO: 1551832 - RNA, 19 nt, Homo sapiens
ggagagacuugcaugaauc

SEQ ID NO: 1551833 - RNA, 19 nt, Homo sapiens
gaugaagacuguuccaagu

SEQ ID NO: 1551834 - RNA, 19 nt, Homo sapiens
gugacuaucccuuugauua

SEQ ID NO: 1551835 - RNA, 19 nt, Homo sapiens
ccagauguuucaauuggua

SEQ ID NO: 1551836 - RNA, 19 nt, Homo sapiens
ccauggacuuuagaaauua

SEQ ID NO: 1551837 - RNA, 19 nt, Homo sapiens
gaccugaccagucuauaua

SEQ ID NO: 1551838 - RNA, 19 nt, Homo sapiens
gaaagugggacauaugaug

SEQ ID NO: 1551839 - RNA, 19 nt, Homo sapiens
uaccaggaguggauuauaa

SEQ ID NO: 1551840 - RNA, 19 nt, Homo sapiens
ccgcgcagcugaugaacua

SEQ ID NO: 1551841 - RNA, 19 nt, Homo sapiens
acacagggaugaucuacuu

SEQ ID NO: 1551842 - RNA, 19 nt, Homo sapiens
ccugaaaucuaagacuuua

SEQ ID NO: 1551843 - RNA, 19 nt, Homo sapiens
agagauccaucccagcuua

SEQ ID NO: 1551844 - RNA, 19 nt, Homo sapiens
ggacaaggaagcuauuaau

SEQ ID NO: 1551845 - RNA, 19 nt, Homo sapiens
gggagagacuugcaugaau

SEQ ID NO: 1551846 - RNA, 19 nt, Homo sapiens
uuaccuaagucuucaguuu

SEQ ID NO: 1551847 - RNA, 19 nt, Homo sapiens
auaaagauuugcggcauua

SEQ ID NO: 1551848 - RNA, 19 nt, Homo sapiens
ggucauugcugaagaagag

SEQ ID NO: 1551849 - RNA, 19 nt, Homo sapiens
cgagcaacauuaaggcuuu

SEQ ID NO: 1551850 - RNA, 19 nt, Homo sapiens
ggaaaucacacaaacaagu

SEQ ID NO: 1551851 - RNA, 19 nt, Homo sapiens
gaaaccaggcaaagucauu

SEQ ID NO: 1551852 - RNA, 19 nt, Homo sapiens
gaaacccgagcaacauuaa

SEQ ID NO: 1551853 - RNA, 19 nt, Homo sapiens
gaauuuaacacaucuccaa

SEQ ID NO: 1551854 - RNA, 19 nt, Homo sapiens
agauagaccugaugaguuc

SEQ ID NO: 1551855 - RNA, 19 nt, Homo sapiens
gagauagaccugaugaguu

SEQ ID NO: 1551856 - RNA, 19 nt, Homo sapiens
gaugcagaaucucaaagaa

SEQ ID NO: 1551857 - RNA, 19 nt, Homo sapiens
acacaaggaaucacacaua

SEQ ID NO: 1551858 - RNA, 19 nt, Homo sapiens
gcugauguaccauugcuua

SEQ ID NO: 1551859 - RNA, 19 nt, Homo sapiens
caaguccucuuugauaaug

SEQ ID NO: 1551860 - RNA, 19 nt, Homo sapiens
ccuagaaggugaaauugga

SEQ ID NO: 1551861 - RNA, 19 nt, Homo sapiens
caccaaacaccaaagauuu

SEQ ID NO: 1551862 - RNA, 19 nt, Homo sapiens
guuauccacuuccugauga

SEQ ID NO: 1551863 - RNA, 19 nt, Homo sapiens
caaguuacaaccaaacaaa

SEQ ID NO: 1551864 - RNA, 19 nt, Homo sapiens
gacauaugauggaaacuuc

SEQ ID NO: 1551865 - RNA, 19 nt, Homo sapiens
uugcaugucuuguaaauca

SEQ ID NO: 1551866 - RNA, 19 nt, Homo sapiens
gcaguaauuucaguuguag

SEQ ID NO: 1551867 - RNA, 19 nt, Homo sapiens
gacaacugcugcuccaaau

SEQ ID NO: 1551868 - RNA, 19 nt, Homo sapiens
guugauggaauuccuguua

SEQ ID NO: 1551869 - RNA, 19 nt, Homo sapiens
gauguaccauugcuuaucu

SEQ ID NO: 1551870 - RNA, 19 nt, Homo sapiens
cuaaagcaguuuccaguag

SEQ ID NO: 1551871 - RNA, 19 nt, Homo sapiens
gaaauugggucuucaaaac

SEQ ID NO: 1551872 - RNA, 19 nt, Homo sapiens
uccauggacuuuagaaauu

SEQ ID NO: 1551873 - RNA, 19 nt, Homo sapiens
ucauaucucugcagugaau

SEQ ID NO: 1551874 - RNA, 19 nt, Homo sapiens
gggagcagcugagaaagau

SEQ ID NO: 1551875 - RNA, 19 nt, Homo sapiens
ggaccugaccagucuauau

SEQ ID NO: 1551876 - RNA, 19 nt, Homo sapiens
gaugaguuccuacaaguga

SEQ ID NO: 1551877 - RNA, 19 nt, Homo sapiens
ucagcaagauggaaagaau

SEQ ID NO: 1551878 - RNA, 19 nt, Homo sapiens
ggacauaugauggaaacuu

SEQ ID NO: 1551879 - RNA, 19 nt, Homo sapiens
gauagucaguggugucaag

SEQ ID NO: 1551880 - RNA, 19 nt, Homo sapiens
ugacuaucccuuugauuaa

SEQ ID NO: 1551881 - RNA, 19 nt, Homo sapiens
agacaucaauggcaacugu

SEQ ID NO: 1551882 - RNA, 19 nt, Homo sapiens
ggaguggauuauaauuuca

SEQ ID NO: 1551883 - RNA, 19 nt, Homo sapiens
ccaggcaaagucauuaaua

SEQ ID NO: 1551884 - RNA, 19 nt, Homo sapiens
ccugaccagucuauauaua

SEQ ID NO: 1551885 - RNA, 19 nt, Homo sapiens
uccaguaggugcugaugua

SEQ ID NO: 1551886 - RNA, 19 nt, Homo sapiens
gugcagaauuuaacacauc

SEQ ID NO: 1551887 - RNA, 19 nt, Homo sapiens
aaagauggcagaauucaug

SEQ ID NO: 1551888 - RNA, 19 nt, Homo sapiens
uaacggucauugcugaaga

SEQ ID NO: 1551889 - RNA, 19 nt, Homo sapiens
gaaaucacacaaacaaguc

SEQ ID NO: 1551890 - RNA, 19 nt, Homo sapiens
ggccauaaaugagccuauu

SEQ ID NO: 1551891 - RNA, 19 nt, Homo sapiens
gaaguuuggaggccauaaa

SEQ ID NO: 1551892 - RNA, 19 nt, Homo sapiens
ggacagaaggugaaaauga

SEQ ID NO: 1551893 - RNA, 19 nt, Homo sapiens
gcacaaugggauuugguuu

SEQ ID NO: 1551894 - RNA, 19 nt, Homo sapiens
ccaccaaacaccaaagauu

SEQ ID NO: 1551895 - RNA, 19 nt, Homo sapiens
gcuaaagcaguuuccagua

SEQ ID NO: 1551896 - RNA, 19 nt, Homo sapiens
ggagagaggcauucugagu

SEQ ID NO: 1551897 - RNA, 19 nt, Homo sapiens
gcccuaugauguugucuug

SEQ ID NO: 1551898 - RNA, 19 nt, Homo sapiens
ugauggaauuccuguuaaa

SEQ ID NO: 1551899 - RNA, 19 nt, Homo sapiens
ggagauagaccugaugagu

SEQ ID NO: 1551900 - RNA, 19 nt, Homo sapiens
ccucuuugauaaugaguuu

SEQ ID NO: 1551901 - RNA, 19 nt, Homo sapiens
guuagaaagugggacauau

SEQ ID NO: 1551902 - RNA, 19 nt, Homo sapiens
ugaaacccgagcaacauua

SEQ ID NO: 1551903 - RNA, 19 nt, Homo sapiens
gaaaguuggagaucauauc

SEQ ID NO: 1551904 - RNA, 19 nt, Homo sapiens
ucucaggccuucauuucaa

SEQ ID NO: 1551905 - RNA, 19 nt, Homo sapiens
cagcaagugaucagagaua

SEQ ID NO: 1551906 - RNA, 19 nt, Homo sapiens
ugaagacugugaagaugga

SEQ ID NO: 1551907 - RNA, 19 nt, Homo sapiens
cgcaguaauuucaguugua

SEQ ID NO: 1551908 - RNA, 19 nt, Homo sapiens
uaaagggaaaucacacaaa

SEQ ID NO: 1551909 - RNA, 19 nt, Homo sapiens
gcaagugagcagagaguau

SEQ ID NO: 1551910 - RNA, 19 nt, Homo sapiens
gaaaaucgggacacacuuu

SEQ ID NO: 1551911 - RNA, 19 nt, Homo sapiens
gaaccuacacaaggaauca

SEQ ID NO: 1551912 - RNA, 19 nt, Homo sapiens
gauggcagaauucauguug

SEQ ID NO: 1551913 - RNA, 19 nt, Homo sapiens
gggaaauggccuacacuga

SEQ ID NO: 1551914 - RNA, 19 nt, Homo sapiens
gacaaggaagcuauuaaug

SEQ ID NO: 1551915 - RNA, 19 nt, Homo sapiens
gaagagaguggagcauugu

SEQ ID NO: 1551916 - RNA, 19 nt, Homo sapiens
gugaccagauuguugaaau

SEQ ID NO: 1551917 - RNA, 19 nt, Homo sapiens
ugaaggagcugggaaguaa

SEQ ID NO: 1551918 - RNA, 19 nt, Homo sapiens
gccaaucccuucauuucaa

SEQ ID NO: 1551919 - RNA, 19 nt, Homo sapiens
ccaggaaucugccaugagu

SEQ ID NO: 1551920 - RNA, 19 nt, Homo sapiens
ggagaaagucagauucaca

SEQ ID NO: 1551921 - RNA, 19 nt, Homo sapiens
aaagucagauucacagcau

SEQ ID NO: 1551922 - RNA, 19 nt, Homo sapiens
caaccuaaagagacccuaa

SEQ ID NO: 1551923 - RNA, 19 nt, Homo sapiens
gugaugggcaaaccaauug

SEQ ID NO: 1551924 - RNA, 19 nt, Homo sapiens
gcagugaugggcaaaccaa

SEQ ID NO: 1551925 - RNA, 19 nt, Homo sapiens
gcccagccuugaagacaga

SEQ ID NO: 1551926 - RNA, 19 nt, Homo sapiens
cuccugaccuacaaaguug

SEQ ID NO: 1551927 - RNA, 19 nt, Homo sapiens
cuccauagcuggcuuugag

SEQ ID NO: 1551928 - RNA, 19 nt, Homo sapiens
cagcaugacagagauuuga

SEQ ID NO: 1551929 - RNA, 19 nt, Homo sapiens
ggccaaucccuucauuuca

SEQ ID NO: 1551930 - RNA, 19 nt, Homo sapiens
cuuccuggcuuguauuuac

SEQ ID NO: 1551931 - RNA, 19 nt, Homo sapiens
gcucgcgucacuucuaaug

SEQ ID NO: 1551932 - RNA, 19 nt, Homo sapiens
gauucaggcucgcgucacu

SEQ ID NO: 1551933 - RNA, 19 nt, Homo sapiens
gggaaucggaacccucaga

SEQ ID NO: 1551934 - RNA, 19 nt, Homo sapiens
gcgcaaggcacgcagugau

SEQ ID NO: 1551935 - RNA, 19 nt, Homo sapiens
cugagccacuccugaccua

SEQ ID NO: 1551936 - RNA, 19 nt, Homo sapiens
ucccuucauuucaaccuaa

SEQ ID NO: 1551937 - RNA, 19 nt, Homo sapiens
cggccaaucccuucauuuc

SEQ ID NO: 1551938 - RNA, 19 nt, Homo sapiens
aggcucgcgucacuucuaa

SEQ ID NO: 1551939 - RNA, 19 nt, Homo sapiens
ccaaucccuucauuucaac

SEQ ID NO: 1551940 - RNA, 19 nt, Homo sapiens
gagcugggaaguaaguucu

SEQ ID NO: 1551941 - RNA, 19 nt, Homo sapiens
gagccacuccugaccuaca

SEQ ID NO: 1551942 - RNA, 19 nt, Homo sapiens
ucauuucaaccuaaagaga

SEQ ID NO: 1551943 - RNA, 19 nt, Homo sapiens
caacccucauccaggaauc

SEQ ID NO: 1551944 - RNA, 19 nt, Homo sapiens
ucuggcuccucuccucuuu

SEQ ID NO: 1551945 - RNA, 19 nt, Homo sapiens
aagagacccuaagcagaga

SEQ ID NO: 1551946 - RNA, 19 nt, Homo sapiens
ggagcugggaaguaaguuc

SEQ ID NO: 1551947 - RNA, 19 nt, Homo sapiens
gccaugagcggccucuaag

SEQ ID NO: 1551948 - RNA, 19 nt, Homo sapiens
gcaugacagagauuugaca

SEQ ID NO: 1551949 - RNA, 19 nt, Homo sapiens
ucacagcaugacagagauu

SEQ ID NO: 1551950 - RNA, 19 nt, Homo sapiens
cggaggagcucaagaaguu

SEQ ID NO: 1551951 - RNA, 19 nt, Homo sapiens
ggaggcgggucaaggcaaa

SEQ ID NO: 1551952 - RNA, 19 nt, Homo sapiens
gcgcaccagucgcguaaga

SEQ ID NO: 1551953 - RNA, 19 nt, Homo sapiens
cucaagaaguucaagauga

SEQ ID NO: 1551954 - RNA, 19 nt, Homo sapiens
gcaccugucauuuauucuu

SEQ ID NO: 1551955 - RNA, 19 nt, Homo sapiens
gcucaagaaguucaagaug

SEQ ID NO: 1551956 - RNA, 19 nt, Homo sapiens
guaaugcaacgccugugaa

SEQ ID NO: 1551957 - RNA, 19 nt, Homo sapiens
cugcaccugucauuuauuc

SEQ ID NO: 1551958 - RNA, 19 nt, Homo sapiens
gcgaggccauccugaaggu

SEQ ID NO: 1551959 - RNA, 19 nt, Homo sapiens
gcugagccaugggaacgaa

SEQ ID NO: 1551960 - RNA, 19 nt, Homo sapiens
aaauauucauggcagacuu

SEQ ID NO: 1551961 - RNA, 19 nt, Homo sapiens
gcaccagucgcguaagaca

SEQ ID NO: 1551962 - RNA, 19 nt, Homo sapiens
gcgcucgggcagcuagaua

SEQ ID NO: 1551963 - RNA, 19 nt, Homo sapiens
caccugucauuuauucuuc

SEQ ID NO: 1551964 - RNA, 19 nt, Homo sapiens
auucauggcagacuuuaaa

SEQ ID NO: 1551965 - RNA, 19 nt, Homo sapiens
acaagcuggucgccuccua

SEQ ID NO: 1551966 - RNA, 19 nt, Homo sapiens
caccggaggagcucaagaa

SEQ ID NO: 1551967 - RNA, 19 nt, Homo sapiens
gcuggucgccuccuacuac

SEQ ID NO: 1551968 - RNA, 19 nt, Homo sapiens
gagcucaagaaguucaaga

SEQ ID NO: 1551969 - RNA, 19 nt, Homo sapiens
gaggagcucaagaaguuca

SEQ ID NO: 1551970 - RNA, 19 nt, Homo sapiens
uuccacugcccaauaaaua

SEQ ID NO: 1551971 - RNA, 19 nt, Homo sapiens
ggucaaggcaaaaggagua

SEQ ID NO: 1551972 - RNA, 19 nt, Homo sapiens
cccugcaccugucauuuau

SEQ ID NO: 1551973 - RNA, 19 nt, Homo sapiens
ucguggaccucaccgacaa

SEQ ID NO: 1551974 - RNA, 19 nt, Homo sapiens
uccugaaggugcuggagaa

SEQ ID NO: 1551975 - RNA, 19 nt, Homo sapiens
gagaaagaacugacugaaa

SEQ ID NO: 1551976 - RNA, 19 nt, Homo sapiens
acacagcacucucuaguca

SEQ ID NO: 1551977 - RNA, 19 nt, Homo sapiens
agaaagaacugacugaaac

SEQ ID NO: 1551978 - RNA, 19 nt, Homo sapiens
ccaauuccauuuccaagau

SEQ ID NO: 1551979 - RNA, 19 nt, Homo sapiens
agaacugacugaaacguuu

SEQ ID NO: 1551980 - RNA, 19 nt, Homo sapiens
gaaauugagccacuuccuu

SEQ ID NO: 1551981 - RNA, 19 nt, Homo sapiens
gcacacagcacucucuagu

SEQ ID NO: 1551982 - RNA, 19 nt, Homo sapiens
ugacagcgaugaauuagcu

SEQ ID NO: 1551983 - RNA, 19 nt, Homo sapiens
ggcaguggcuguugguuuc

SEQ ID NO: 1551984 - RNA, 19 nt, Homo sapiens
cauaacagcgucagagaga

SEQ ID NO: 1551985 - RNA, 19 nt, Homo sapiens
gaacugacugaaacguuug

SEQ ID NO: 1551986 - RNA, 19 nt, Homo sapiens
uaacagcgucagagagaaa

SEQ ID NO: 1551987 - RNA, 19 nt, Homo sapiens
uaaaccuggucaccugaaa

SEQ ID NO: 1551988 - RNA, 19 nt, Homo sapiens
gagagaaagaacugacuga

SEQ ID NO: 1551989 - RNA, 19 nt, Homo sapiens
gaaggaaaagucacgauaa

SEQ ID NO: 1551990 - RNA, 19 nt, Homo sapiens
uccaagauuuccaugguuu

SEQ ID NO: 1551991 - RNA, 19 nt, Homo sapiens
caauuccauuuccaagauu

SEQ ID NO: 1551992 - RNA, 19 nt, Homo sapiens
cagugacagcgaugaauua

SEQ ID NO: 1551993 - RNA, 19 nt, Homo sapiens
cguuugagaugaagaaagu

SEQ ID NO: 1551994 - RNA, 19 nt, Homo sapiens
cugaaacguuugagaugaa

SEQ ID NO: 1551995 - RNA, 19 nt, Homo sapiens
uguguucccuuacccauau

SEQ ID NO: 1551996 - RNA, 19 nt, Homo sapiens
ccaagauuuccaugguuua

SEQ ID NO: 1551997 - RNA, 19 nt, Homo sapiens
aaaguucuccuccugauca

SEQ ID NO: 1551998 - RNA, 19 nt, Homo sapiens
ugacugaaacguuugagau

SEQ ID NO: 1551999 - RNA, 19 nt, Homo sapiens
acagcacucucuagucaau

SEQ ID NO: 1552000 - RNA, 19 nt, Homo sapiens
acugaaacguuugagauga

SEQ ID NO: 1552001 - RNA, 19 nt, Homo sapiens
cuggucaccugaaauugaa

SEQ ID NO: 1552002 - RNA, 19 nt, Homo sapiens
ucagugacagcgaugaauu

SEQ ID NO: 1552003 - RNA, 19 nt, Homo sapiens
gaaaguucuccuccugauc

SEQ ID NO: 1552004 - RNA, 19 nt, Homo sapiens
gacugaaacguuugagaug

SEQ ID NO: 1552005 - RNA, 19 nt, Homo sapiens
gcuguugguuucccagucu

SEQ ID NO: 1552006 - RNA, 19 nt, Homo sapiens
ccuggucaccugaaauuga

SEQ ID NO: 1552007 - RNA, 19 nt, Homo sapiens
agacguaauuuuccuauuc

SEQ ID NO: 1552008 - RNA, 19 nt, Homo sapiens
aaggaaaagucacgauaaa

SEQ ID NO: 1552009 - RNA, 19 nt, Homo sapiens
gaaaaguaaacaagaagga

SEQ ID NO: 1552010 - RNA, 19 nt, Homo sapiens
gaaagaacugacugaaacg

SEQ ID NO: 1552011 - RNA, 19 nt, Homo sapiens
aaacguuugagaugaagaa

SEQ ID NO: 1552012 - RNA, 19 nt, Homo sapiens
ccaccaauuccauuuccaa

SEQ ID NO: 1552013 - RNA, 19 nt, Homo sapiens
ccugaucacagccaucuug

SEQ ID NO: 1552014 - RNA, 19 nt, Homo sapiens
uuuccaugguuuagacgua

SEQ ID NO: 1552015 - RNA, 19 nt, Homo sapiens
caagaccaggaacgagaaa

SEQ ID NO: 1552016 - RNA, 19 nt, Homo sapiens
ucaagaccaggaacgagaa

SEQ ID NO: 1552017 - RNA, 19 nt, Homo sapiens
caagauuuccaugguuuag

SEQ ID NO: 1552018 - RNA, 19 nt, Homo sapiens
agcacucucuagucaauau

SEQ ID NO: 1552019 - RNA, 19 nt, Homo sapiens
aaccuggucaccugaaauu

SEQ ID NO: 1552020 - RNA, 19 nt, Homo sapiens
cgucagagagaaagaacug

SEQ ID NO: 1552021 - RNA, 19 nt, Homo sapiens
uggcaguggcuguugguuu

SEQ ID NO: 1552022 - RNA, 19 nt, Homo sapiens
agagaaagaacugacugaa

SEQ ID NO: 1552023 - RNA, 19 nt, Homo sapiens
ccacuuccaccaauuccau

SEQ ID NO: 1552024 - RNA, 19 nt, Homo sapiens
gaauuagcuucaggguuuu

SEQ ID NO: 1552025 - RNA, 19 nt, Homo sapiens
ugaaacguuugagaugaag

SEQ ID NO: 1552026 - RNA, 19 nt, Homo sapiens
gaauauacgucacgagaaa

SEQ ID NO: 1552027 - RNA, 19 nt, Homo sapiens
ugacaagaccuacauguua

SEQ ID NO: 1552028 - RNA, 19 nt, Homo sapiens
guaaacaacuaccaaggaa

SEQ ID NO: 1552029 - RNA, 19 nt, Homo sapiens
gaaaugauguuuggagaca

SEQ ID NO: 1552030 - RNA, 19 nt, Homo sapiens
ggaccuauacaacagauua

SEQ ID NO: 1552031 - RNA, 19 nt, Homo sapiens
cagaaagaauugauccuaa

SEQ ID NO: 1552032 - RNA, 19 nt, Homo sapiens
cacggaaccuaaugaaaua

SEQ ID NO: 1552033 - RNA, 19 nt, Homo sapiens
gagaauuaauugccuuguu

SEQ ID NO: 1552034 - RNA, 19 nt, Homo sapiens
cuaaugaaauaucccagua

SEQ ID NO: 1552035 - RNA, 19 nt, Homo sapiens
acacgagacuuuaccauga

SEQ ID NO: 1552036 - RNA, 19 nt, Homo sapiens
caacagaucauauagauac

SEQ ID NO: 1552037 - RNA, 19 nt, Homo sapiens
ggaagcaguuugugagaag

SEQ ID NO: 1552038 - RNA, 19 nt, Homo sapiens
ccagagaacagauuaaguu

SEQ ID NO: 1552039 - RNA, 19 nt, Homo sapiens
gaaacacuaucuucuacca

SEQ ID NO: 1552040 - RNA, 19 nt, Homo sapiens
guacacaaguggaauaaaa

SEQ ID NO: 1552041 - RNA, 19 nt, Homo sapiens
gcugaagaguggcaagaaa

SEQ ID NO: 1552042 - RNA, 19 nt, Homo sapiens
ucacucaacugcuguuugu

SEQ ID NO: 1552043 - RNA, 19 nt, Homo sapiens
ggaguuaaauuuggaugau

SEQ ID NO: 1552044 - RNA, 19 nt, Homo sapiens
aguaaugccuucuagcuuu

SEQ ID NO: 1552045 - RNA, 19 nt, Homo sapiens
cggcggauguggagaaauu

SEQ ID NO: 1552046 - RNA, 19 nt, Homo sapiens
gacaagaccuacauguuac

SEQ ID NO: 1552047 - RNA, 19 nt, Homo sapiens
gaaucugacuggacaccuu

SEQ ID NO: 1552048 - RNA, 19 nt, Homo sapiens
ucacggaaccuaaugaaau

SEQ ID NO: 1552049 - RNA, 19 nt, Homo sapiens
ccauaugauuggaccuaua

SEQ ID NO: 1552050 - RNA, 19 nt, Homo sapiens
uaaaggaagcaguuuguga

SEQ ID NO: 1552051 - RNA, 19 nt, Homo sapiens
uaaaguggccugugcugaa

SEQ ID NO: 1552052 - RNA, 19 nt, Homo sapiens
guuaagauguguaaacaac

SEQ ID NO: 1552053 - RNA, 19 nt, Homo sapiens
gcaugggucuggcuuugga

SEQ ID NO: 1552054 - RNA, 19 nt, Homo sapiens
caacugcuguuuguacugu

SEQ ID NO: 1552055 - RNA, 19 nt, Homo sapiens
gaaagccagagaacagauu

SEQ ID NO: 1552056 - RNA, 19 nt, Homo sapiens
gaaccuuacuuggagaauc

SEQ ID NO: 1552057 - RNA, 19 nt, Homo sapiens
caugaaacacuaucuucua

SEQ ID NO: 1552058 - RNA, 19 nt, Homo sapiens
ugaaugacacgagacuuua

SEQ ID NO: 1552059 - RNA, 19 nt, Homo sapiens
cuacagaugcguuaagaug

SEQ ID NO: 1552060 - RNA, 19 nt, Homo sapiens
ggagaaauuagccgaugaa

SEQ ID NO: 1552061 - RNA, 19 nt, Homo sapiens
cagaucauauagauacaga

SEQ ID NO: 1552062 - RNA, 19 nt, Homo sapiens
aaacaacuaccaaggaaug

SEQ ID NO: 1552063 - RNA, 19 nt, Homo sapiens
gaacacuccaaagagguua

SEQ ID NO: 1552064 - RNA, 19 nt, Homo sapiens
gaagcuaauauuuccagaa

SEQ ID NO: 1552065 - RNA, 19 nt, Homo sapiens
gcguuaagauguguaaaca

SEQ ID NO: 1552066 - RNA, 19 nt, Homo sapiens
cuggacaccuuggcuauuu

SEQ ID NO: 1552067 - RNA, 19 nt, Homo sapiens
ccagaaagaauugauccua

SEQ ID NO: 1552068 - RNA, 19 nt, Homo sapiens
cagcaugggucuggcuuug

SEQ ID NO: 1552069 - RNA, 19 nt, Homo sapiens
ugaugugugugucucauga

SEQ ID NO: 1552070 - RNA, 19 nt, Homo sapiens
aaaguacacaaguggaaua

SEQ ID NO: 1552071 - RNA, 19 nt, Homo sapiens
gugagaagcuaauauuucc

SEQ ID NO: 1552072 - RNA, 19 nt, Homo sapiens
gauacaacauauacucacu

SEQ ID NO: 1552073 - RNA, 19 nt, Homo sapiens
caauaaaggaagcaguuug

SEQ ID NO: 1552074 - RNA, 19 nt, Homo sapiens
gugcuuaucagaaugaaug

SEQ ID NO: 1552075 - RNA, 19 nt, Homo sapiens
cagagaacagauuaaguuu

SEQ ID NO: 1552076 - RNA, 19 nt, Homo sapiens
guaccuacaacagaucaua

SEQ ID NO: 1552077 - RNA, 19 nt, Homo sapiens
gggucuggcuuuggaauug

SEQ ID NO: 1552078 - RNA, 19 nt, Homo sapiens
ccaggaggagguuaaugua

SEQ ID NO: 1552079 - RNA, 19 nt, Homo sapiens
gaccucagcaguagugaug

SEQ ID NO: 1552080 - RNA, 19 nt, Homo sapiens
gauuggaccuauacaacag

SEQ ID NO: 1552081 - RNA, 19 nt, Homo sapiens
cagcaguagugaugugugu

SEQ ID NO: 1552082 - RNA, 19 nt, Homo sapiens
gaucguuacaggcagguuu

SEQ ID NO: 1552083 - RNA, 19 nt, Homo sapiens
ccaagacccacaucaugaa

SEQ ID NO: 1552084 - RNA, 19 nt, Homo sapiens
gguccugccucagccauga

SEQ ID NO: 1552085 - RNA, 19 nt, Homo sapiens
acagaugcguuaagaugug

SEQ ID NO: 1552086 - RNA, 19 nt, Homo sapiens
ggagacaacguuuuaagaa

SEQ ID NO: 1552087 - RNA, 19 nt, Homo sapiens
agaaagaauugauccuaac

SEQ ID NO: 1552088 - RNA, 19 nt, Homo sapiens
ugaguucaaugcuacagau

SEQ ID NO: 1552089 - RNA, 19 nt, Homo sapiens
ggucuggcuuuggaauuga

SEQ ID NO: 1552090 - RNA, 19 nt, Homo sapiens
caggaggagguuaauguaa

SEQ ID NO: 1552091 - RNA, 19 nt, Homo sapiens
gccgaugaauuacauaugc

SEQ ID NO: 1552092 - RNA, 19 nt, Homo sapiens
gaguaaugccuucuagcuu

SEQ ID NO: 1552093 - RNA, 19 nt, Homo sapiens
ugccaucucucccugaaau

SEQ ID NO: 1552094 - RNA, 19 nt, Homo sapiens
gagacaacguuuuaagaau

SEQ ID NO: 1552095 - RNA, 19 nt, Homo sapiens
aaagccagagaacagauua

SEQ ID NO: 1552096 - RNA, 19 nt, Homo sapiens
ucacauucauauuccagau

SEQ ID NO: 1552097 - RNA, 19 nt, Homo sapiens
ccaauaaaggaagcaguuu

SEQ ID NO: 1552098 - RNA, 19 nt, Homo sapiens
cuacauguuacgagaauau

SEQ ID NO: 1552099 - RNA, 19 nt, Homo sapiens
cuacaacagaucauauaga

SEQ ID NO: 1552100 - RNA, 19 nt, Homo sapiens
caaguggaauaaaauguga

SEQ ID NO: 1552101 - RNA, 19 nt, Homo sapiens
uaacccagcagacucacaa

SEQ ID NO: 1552102 - RNA, 19 nt, Homo sapiens
guaaugccuucuagcuuuu

SEQ ID NO: 1552103 - RNA, 19 nt, Homo sapiens
guuucaagccugaguguga

SEQ ID NO: 1552104 - RNA, 19 nt, Homo sapiens
uggagaaauuagccgauga

SEQ ID NO: 1552105 - RNA, 19 nt, Homo sapiens
ccaaggaaugcuuaaagug

SEQ ID NO: 1552106 - RNA, 19 nt, Homo sapiens
gagcacagucugcauucau

SEQ ID NO: 1552107 - RNA, 19 nt, Homo sapiens
gcaguagugaugugugugu

SEQ ID NO: 1552108 - RNA, 19 nt, Homo sapiens
caccuuggcuauuuguaag

SEQ ID NO: 1552109 - RNA, 19 nt, Homo sapiens
ugaauuacauaugccaucu

SEQ ID NO: 1552110 - RNA, 19 nt, Homo sapiens
cuccaaagagguuauuaaa

SEQ ID NO: 1552111 - RNA, 19 nt, Homo sapiens
caacuaccaaggaaugcuu

SEQ ID NO: 1552112 - RNA, 19 nt, Homo sapiens
acaggcagguuucacucaa

SEQ ID NO: 1552113 - RNA, 19 nt, Homo sapiens
acaccuuggcuauuuguaa

SEQ ID NO: 1552114 - RNA, 19 nt, Homo sapiens
gcacagucugcauucauca

SEQ ID NO: 1552115 - RNA, 19 nt, Homo sapiens
ugugagaagcuaauauuuc

SEQ ID NO: 1552116 - RNA, 19 nt, Homo sapiens
ugucuucacauucauauuc

SEQ ID NO: 1552117 - RNA, 19 nt, Homo sapiens
ggacaccuuggcuauuugu

SEQ ID NO: 1552118 - RNA, 19 nt, Homo sapiens
guccaagacccacaucaug

SEQ ID NO: 1552119 - RNA, 19 nt, Homo sapiens
uccaagacccacaucauga

SEQ ID NO: 1552120 - RNA, 19 nt, Homo sapiens
cagagcagccaccgggauu

SEQ ID NO: 1552121 - RNA, 19 nt, Homo sapiens
caaugcuacagaugcguua

SEQ ID NO: 1552122 - RNA, 19 nt, Homo sapiens
caucaugaaacacuaucuu

SEQ ID NO: 1552123 - RNA, 19 nt, Homo sapiens
uguacugucugucuucaca

SEQ ID NO: 1552124 - RNA, 19 nt, Homo sapiens
aauaaaggaagcaguuugu

SEQ ID NO: 1552125 - RNA, 19 nt, Homo sapiens
gaaugacacgagacuuuac

SEQ ID NO: 1552126 - RNA, 19 nt, Homo sapiens
cuaaugagcucuaguguua

SEQ ID NO: 1552127 - RNA, 19 nt, Homo sapiens
caaguaugcugucaaauua

SEQ ID NO: 1552128 - RNA, 19 nt, Homo sapiens
gaaaggacacguuauguua

SEQ ID NO: 1552129 - RNA, 19 nt, Homo sapiens
guucacagcugccauauaa

SEQ ID NO: 1552130 - RNA, 19 nt, Homo sapiens
ggacugaauucuacuauug

SEQ ID NO: 1552131 - RNA, 19 nt, Homo sapiens
ucauagaucugccuuauaa

SEQ ID NO: 1552132 - RNA, 19 nt, Homo sapiens
gaagaaguuuggagaauug

SEQ ID NO: 1552133 - RNA, 19 nt, Homo sapiens
gaauuugucuuccuauuga

SEQ ID NO: 1552134 - RNA, 19 nt, Homo sapiens
gagaaucacuuguuaguuc

SEQ ID NO: 1552135 - RNA, 19 nt, Homo sapiens
gauaauacauaccucauga

SEQ ID NO: 1552136 - RNA, 19 nt, Homo sapiens
ggaauacugugaacacuga

SEQ ID NO: 1552137 - RNA, 19 nt, Homo sapiens
gcaauaacaugaggauaaa

SEQ ID NO: 1552138 - RNA, 19 nt, Homo sapiens
uaaaagggcuucaagaaua

SEQ ID NO: 1552139 - RNA, 19 nt, Homo sapiens
ccaauuugcuauuuccuua

SEQ ID NO: 1552140 - RNA, 19 nt, Homo sapiens
ggaagaggauucaguaaca

SEQ ID NO: 1552141 - RNA, 19 nt, Homo sapiens
gaagcaaugugauuauaug

SEQ ID NO: 1552142 - RNA, 19 nt, Homo sapiens
ggaagaaguuuggagaauu

SEQ ID NO: 1552143 - RNA, 19 nt, Homo sapiens
agaaagaccuugacuacuu

SEQ ID NO: 1552144 - RNA, 19 nt, Homo sapiens
uaggguaaguggcuaauua

SEQ ID NO: 1552145 - RNA, 19 nt, Homo sapiens
auacauaccucaugaaaga

SEQ ID NO: 1552146 - RNA, 19 nt, Homo sapiens
gcaguuagguguacaugug

SEQ ID NO: 1552147 - RNA, 19 nt, Homo sapiens
gaaagaccuugacuacuuc

SEQ ID NO: 1552148 - RNA, 19 nt, Homo sapiens
gaaacgagcuuuugaggaa

SEQ ID NO: 1552149 - RNA, 19 nt, Homo sapiens
ccagagagauugaaaauuu

SEQ ID NO: 1552150 - RNA, 19 nt, Homo sapiens
gaucaaagccacacccaaa

SEQ ID NO: 1552151 - RNA, 19 nt, Homo sapiens
ucuuaugucuccucuauua

SEQ ID NO: 1552152 - RNA, 19 nt, Homo sapiens
gguugaaacuuguuaaaug

SEQ ID NO: 1552153 - RNA, 19 nt, Homo sapiens
ggaagaguacuacagauuu

SEQ ID NO: 1552154 - RNA, 19 nt, Homo sapiens
gaaguaggacugaauucua

SEQ ID NO: 1552155 - RNA, 19 nt, Homo sapiens
guaggguaauucacaguua

SEQ ID NO: 1552156 - RNA, 19 nt, Homo sapiens
uuacagagcaguuucauuu

SEQ ID NO: 1552157 - RNA, 19 nt, Homo sapiens
guguuaaacuaccugauua

SEQ ID NO: 1552158 - RNA, 19 nt, Homo sapiens
gguaaguggcuaauuauaa

SEQ ID NO: 1552159 - RNA, 19 nt, Homo sapiens
gacaugaaauacauacuga

SEQ ID NO: 1552160 - RNA, 19 nt, Homo sapiens
caaauuacacaccauguuu

SEQ ID NO: 1552161 - RNA, 19 nt, Homo sapiens
gcaaugugauuauaugaag

SEQ ID NO: 1552162 - RNA, 19 nt, Homo sapiens
cagcuuggauuacuaaguu

SEQ ID NO: 1552163 - RNA, 19 nt, Homo sapiens
caaagaguaaggcagauua

SEQ ID NO: 1552164 - RNA, 19 nt, Homo sapiens
ggccagaugagcuaaauua

SEQ ID NO: 1552165 - RNA, 19 nt, Homo sapiens
gucaaaggauuuaauguug

SEQ ID NO: 1552166 - RNA, 19 nt, Homo sapiens
uggcauaaaugguaucaaa

SEQ ID NO: 1552167 - RNA, 19 nt, Homo sapiens
gaauucaguugggcaauga

SEQ ID NO: 1552168 - RNA, 19 nt, Homo sapiens
ugaauuaacuagacugcaa

SEQ ID NO: 1552169 - RNA, 19 nt, Homo sapiens
ugugaacacugaacuaauu

SEQ ID NO: 1552170 - RNA, 19 nt, Homo sapiens
gaugaagucuccucaaagg

SEQ ID NO: 1552171 - RNA, 19 nt, Homo sapiens
uaauauuucucccuacuug

SEQ ID NO: 1552172 - RNA, 19 nt, Homo sapiens
gcacaacuguaacccuguu

SEQ ID NO: 1552173 - RNA, 19 nt, Homo sapiens
uuacaaguaugcugucaaa

SEQ ID NO: 1552174 - RNA, 19 nt, Homo sapiens
gcagguucaugcaaauauu

SEQ ID NO: 1552175 - RNA, 19 nt, Homo sapiens
caucaugcauucauccaaa

SEQ ID NO: 1552176 - RNA, 19 nt, Homo sapiens
gcauaaccuuggcuugauu

SEQ ID NO: 1552177 - RNA, 19 nt, Homo sapiens
ccuauuaucuuguacuuuc

SEQ ID NO: 1552178 - RNA, 19 nt, Homo sapiens
gaauccaacugccaacaau

SEQ ID NO: 1552179 - RNA, 19 nt, Homo sapiens
guauacuaguuccuacuua

SEQ ID NO: 1552180 - RNA, 19 nt, Homo sapiens
caacugacuuagugauaga

SEQ ID NO: 1552181 - RNA, 19 nt, Homo sapiens
cauaaguacuuuccauguu

SEQ ID NO: 1552182 - RNA, 19 nt, Homo sapiens
gagauucuuuccauauguu

SEQ ID NO: 1552183 - RNA, 19 nt, Homo sapiens
gccauuaagcuauuucaua

SEQ ID NO: 1552184 - RNA, 19 nt, Homo sapiens
gauuucaacugacuuagug

SEQ ID NO: 1552185 - RNA, 19 nt, Homo sapiens
ugacuucuacguucaguua

SEQ ID NO: 1552186 - RNA, 19 nt, Homo sapiens
gcauaaaugguaucaaaga

SEQ ID NO: 1552187 - RNA, 19 nt, Homo sapiens
ucagagagauauuuguuuc

SEQ ID NO: 1552188 - RNA, 19 nt, Homo sapiens
uaaauuaccacuugccauu

SEQ ID NO: 1552189 - RNA, 19 nt, Homo sapiens
gaagggcccuagcaguguu

SEQ ID NO: 1552190 - RNA, 19 nt, Homo sapiens
gaagaguacuacagauuuu

SEQ ID NO: 1552191 - RNA, 19 nt, Homo sapiens
guauaucuccuuuggcaua

SEQ ID NO: 1552192 - RNA, 19 nt, Homo sapiens
gaacuaauuauuccugugu

SEQ ID NO: 1552193 - RNA, 19 nt, Homo sapiens
uuacaagcaugaaggauau

SEQ ID NO: 1552194 - RNA, 19 nt, Homo sapiens
uaucguggguugaaacuug

SEQ ID NO: 1552195 - RNA, 19 nt, Homo sapiens
gcuuuaaacuggagagaau

SEQ ID NO: 1552196 - RNA, 19 nt, Homo sapiens
gaaguagaaauccuaaguu

SEQ ID NO: 1552197 - RNA, 19 nt, Homo sapiens
gaucugccuuauaaacauu

SEQ ID NO: 1552198 - RNA, 19 nt, Homo sapiens
ggaauucaguugggcaaug

SEQ ID NO: 1552199 - RNA, 19 nt, Homo sapiens
uauaggagauuuccaccuu

SEQ ID NO: 1552200 - RNA, 19 nt, Homo sapiens
gacaucugcuuguggguaa

SEQ ID NO: 1552201 - RNA, 19 nt, Homo sapiens
uaacugagcccucuauuuu

SEQ ID NO: 1552202 - RNA, 19 nt, Homo sapiens
gagggauucugaugugcua

SEQ ID NO: 1552203 - RNA, 19 nt, Homo sapiens
caaguuugcacacaaguaa

SEQ ID NO: 1552204 - RNA, 19 nt, Homo sapiens
aaacugcuaucucuaauac

SEQ ID NO: 1552205 - RNA, 19 nt, Homo sapiens
gaaguuuggagaauugaaa

SEQ ID NO: 1552206 - RNA, 19 nt, Homo sapiens
ucacugacauucuuuagag

SEQ ID NO: 1552207 - RNA, 19 nt, Homo sapiens
acaaguaugcugucaaauu

SEQ ID NO: 1552208 - RNA, 19 nt, Homo sapiens
ggaaugaggaagaaguuug

SEQ ID NO: 1552209 - RNA, 19 nt, Homo sapiens
ccuaauggcauaaauggua

SEQ ID NO: 1552210 - RNA, 19 nt, Homo sapiens
gacaacagguuauugaacu

SEQ ID NO: 1552211 - RNA, 19 nt, Homo sapiens
ugaaaucccuguuuugaaa

SEQ ID NO: 1552212 - RNA, 19 nt, Homo sapiens
ccagauugucuacauauaa

SEQ ID NO: 1552213 - RNA, 19 nt, Homo sapiens
gugcuguccuuccacauuu

SEQ ID NO: 1552214 - RNA, 19 nt, Homo sapiens
gaaggucagagagauauuu

SEQ ID NO: 1552215 - RNA, 19 nt, Homo sapiens
ggaaguagaaauccuaagu

SEQ ID NO: 1552216 - RNA, 19 nt, Homo sapiens
cauacagguuggcuaauga

SEQ ID NO: 1552217 - RNA, 19 nt, Homo sapiens
guugggcaaugauaacuuu

SEQ ID NO: 1552218 - RNA, 19 nt, Homo sapiens
ggauuauacugauguucuu

SEQ ID NO: 1552219 - RNA, 19 nt, Homo sapiens
gugauuauaugaagagaca

SEQ ID NO: 1552220 - RNA, 19 nt, Homo sapiens
guaugaagcaaugugauua

SEQ ID NO: 1552221 - RNA, 19 nt, Homo sapiens
uaagaaaggacacguuaug

SEQ ID NO: 1552222 - RNA, 19 nt, Homo sapiens
gccuugaucuuucauuaga

SEQ ID NO: 1552223 - RNA, 19 nt, Homo sapiens
ccagaugagcuaaauuaaa

SEQ ID NO: 1552224 - RNA, 19 nt, Homo sapiens
gcuauaagcuuggccacau

SEQ ID NO: 1552225 - RNA, 19 nt, Homo sapiens
gaagaggauucaguaacau

SEQ ID NO: 1552226 - RNA, 19 nt, Homo sapiens
gagcagagauggcaccuuu

SEQ ID NO: 1552227 - RNA, 19 nt, Homo sapiens
ggaccaggguugucaauuu

SEQ ID NO: 1552228 - RNA, 19 nt, Homo sapiens
gcacuuggaugacuuauuc

SEQ ID NO: 1552229 - RNA, 19 nt, Homo sapiens
uuaaugagcccuuguauuu

SEQ ID NO: 1552230 - RNA, 19 nt, Homo sapiens
gaacagaaagugagagguu

SEQ ID NO: 1552231 - RNA, 19 nt, Homo sapiens
ggccaaagacuguguauuu

SEQ ID NO: 1552232 - RNA, 19 nt, Homo sapiens
ggaaaguggucuccucuuc

SEQ ID NO: 1552233 - RNA, 19 nt, Homo sapiens
gaucucgggucaucucaaa

SEQ ID NO: 1552234 - RNA, 19 nt, Homo sapiens
gcacuuggcugaggaagca

SEQ ID NO: 1552235 - RNA, 19 nt, Homo sapiens
gcaacgagauggugcuaca

SEQ ID NO: 1552236 - RNA, 19 nt, Homo sapiens
cagaaccugugacguuuaa

SEQ ID NO: 1552237 - RNA, 19 nt, Homo sapiens
ggaagggugucaacaagag

SEQ ID NO: 1552238 - RNA, 19 nt, Homo sapiens
gcagagauggcaccuuuga

SEQ ID NO: 1552239 - RNA, 19 nt, Homo sapiens
gaccaggguugucaauuuc

SEQ ID NO: 1552240 - RNA, 19 nt, Homo sapiens
cacaggaucuucacccaaa

SEQ ID NO: 1552241 - RNA, 19 nt, Homo sapiens
ggacacagacagugaggaa

SEQ ID NO: 1552242 - RNA, 19 nt, Homo sapiens
ggaacaucauggccaaaga

SEQ ID NO: 1552243 - RNA, 19 nt, Homo sapiens
gcgagugucuuucuuugau

SEQ ID NO: 1552244 - RNA, 19 nt, Homo sapiens
gauucuggaugccaauaaa

SEQ ID NO: 1552245 - RNA, 19 nt, Homo sapiens
aaacauccauugccgaaca

SEQ ID NO: 1552246 - RNA, 19 nt, Homo sapiens
cccaggagcugaagacaga

SEQ ID NO: 1552247 - RNA, 19 nt, Homo sapiens
ggaaccacgggacauauuu

SEQ ID NO: 1552248 - RNA, 19 nt, Homo sapiens
ccaggaucgucuuuaauga

SEQ ID NO: 1552249 - RNA, 19 nt, Homo sapiens
gcccggagaucaaagacuu

SEQ ID NO: 1552250 - RNA, 19 nt, Homo sapiens
gaaggucaucuaccaguga

SEQ ID NO: 1552251 - RNA, 19 nt, Homo sapiens
gccaaagacuguguauuuc

SEQ ID NO: 1552252 - RNA, 19 nt, Homo sapiens
cguccaggaucgucuuuaa

SEQ ID NO: 1552253 - RNA, 19 nt, Homo sapiens
ggaaggaauccacggcauu

SEQ ID NO: 1552254 - RNA, 19 nt, Homo sapiens
agacuucuuugucaucauu

SEQ ID NO: 1552255 - RNA, 19 nt, Homo sapiens
gaaagccucgccuccagaa

SEQ ID NO: 1552256 - RNA, 19 nt, Homo sapiens
ccacgggacauauuucuga

SEQ ID NO: 1552257 - RNA, 19 nt, Homo sapiens
gcaugugggacccucguua

SEQ ID NO: 1552258 - RNA, 19 nt, Homo sapiens
gagagguuguagcacauug

SEQ ID NO: 1552259 - RNA, 19 nt, Homo sapiens
gcacgaaggccgagagcau

SEQ ID NO: 1552260 - RNA, 19 nt, Homo sapiens
uggagaaguuugaggaaga

SEQ ID NO: 1552261 - RNA, 19 nt, Homo sapiens
gcuacaguuucuugccuuu

SEQ ID NO: 1552262 - RNA, 19 nt, Homo sapiens
gagcaaaacagacacauga

SEQ ID NO: 1552263 - RNA, 19 nt, Homo sapiens
uaucguggcugugguggaa

SEQ ID NO: 1552264 - RNA, 19 nt, Homo sapiens
caaugaccaugaggacaaa

SEQ ID NO: 1552265 - RNA, 19 nt, Homo sapiens
ccaaagacuguguauuuca

SEQ ID NO: 1552266 - RNA, 19 nt, Homo sapiens
ggacggaccgguaauuagg

SEQ ID NO: 1552267 - RNA, 19 nt, Homo sapiens
caucauggccaaagacugu

SEQ ID NO: 1552268 - RNA, 19 nt, Homo sapiens
cgagauggugcuacaguuu

SEQ ID NO: 1552269 - RNA, 19 nt, Homo sapiens
gcgggucggucuccuagau

SEQ ID NO: 1552270 - RNA, 19 nt, Homo sapiens
gcugguauuauaucuguuu

SEQ ID NO: 1552271 - RNA, 19 nt, Homo sapiens
gaaccacgggacauauuuc

SEQ ID NO: 1552272 - RNA, 19 nt, Homo sapiens
uggcugaccugugcacuug

SEQ ID NO: 1552273 - RNA, 19 nt, Homo sapiens
ucaaugaccaugaggacaa

SEQ ID NO: 1552274 - RNA, 19 nt, Homo sapiens
cuacaucaaugaccaugag

SEQ ID NO: 1552275 - RNA, 19 nt, Homo sapiens
ucuuugaguuugugcuuaa

SEQ ID NO: 1552276 - RNA, 19 nt, Homo sapiens
gguggugaguggagacaug

SEQ ID NO: 1552277 - RNA, 19 nt, Homo sapiens
caaagacuguguauuucac

SEQ ID NO: 1552278 - RNA, 19 nt, Homo sapiens
ucaacaagaggaucaccua

SEQ ID NO: 1552279 - RNA, 19 nt, Homo sapiens
gccagccgcucaucuccaa

SEQ ID NO: 1552280 - RNA, 19 nt, Homo sapiens
ggucggccacccugcauuu

SEQ ID NO: 1552281 - RNA, 19 nt, Homo sapiens
ggagaaguuugaggaagag

SEQ ID NO: 1552282 - RNA, 19 nt, Homo sapiens
ccacggcauuccagugugu

SEQ ID NO: 1552283 - RNA, 19 nt, Homo sapiens
ggaauucuucggaucuuca

SEQ ID NO: 1552284 - RNA, 19 nt, Homo sapiens
guaccugcauccagcuuag

SEQ ID NO: 1552285 - RNA, 19 nt, Homo sapiens
ccgccucucugcagccuuu

SEQ ID NO: 1552286 - RNA, 19 nt, Homo sapiens
gggaaccacgggacauauu

SEQ ID NO: 1552287 - RNA, 19 nt, Homo sapiens
guauuucaccuuccaguuc

SEQ ID NO: 1552288 - RNA, 19 nt, Homo sapiens
gccaguaccucgaguucuc

SEQ ID NO: 1552289 - RNA, 19 nt, Homo sapiens
cagcuucggucaccucucu

SEQ ID NO: 1552290 - RNA, 19 nt, Homo sapiens
gagugucuuucuuugaugu

SEQ ID NO: 1552291 - RNA, 19 nt, Homo sapiens
gcgugaaggucaucuacca

SEQ ID NO: 1552292 - RNA, 19 nt, Homo sapiens
ccacuaaacacgccaaggu

SEQ ID NO: 1552293 - RNA, 19 nt, Homo sapiens
ggacugccgaggaacauca

SEQ ID NO: 1552294 - RNA, 19 nt, Homo sapiens
cguuaucgcuguugcucaa

SEQ ID NO: 1552295 - RNA, 19 nt, Homo sapiens
agagauggcaccuuugaug

SEQ ID NO: 1552296 - RNA, 19 nt, Homo sapiens
gagauggugcuacaguuuc

SEQ ID NO: 1552297 - RNA, 19 nt, Homo sapiens
cagccggacucuccuaucu

SEQ ID NO: 1552298 - RNA, 19 nt, Homo sapiens
ggagguacugucagagguu

SEQ ID NO: 1552299 - RNA, 19 nt, Homo sapiens
guccagaucucgggucauc

SEQ ID NO: 1552300 - RNA, 19 nt, Homo sapiens
gaacaucauggccaaagac

SEQ ID NO: 1552301 - RNA, 19 nt, Homo sapiens
cacaggaguucccguugga

SEQ ID NO: 1552302 - RNA, 19 nt, Homo sapiens
gcucaucuccaaggccuuu

SEQ ID NO: 1552303 - RNA, 19 nt, Homo sapiens
guuuaacccucagaaggaa

SEQ ID NO: 1552304 - RNA, 19 nt, Homo sapiens
gggaagggugucaacaaga

SEQ ID NO: 1552305 - RNA, 19 nt, Homo sapiens
gagacucccugcugcucau

SEQ ID NO: 1552306 - RNA, 19 nt, Homo sapiens
aaaguggucuccucuucca

SEQ ID NO: 1552307 - RNA, 19 nt, Homo sapiens
uuggaugacuuauucuuca

SEQ ID NO: 1552308 - RNA, 19 nt, Homo sapiens
gcucuggugcugccaucua

SEQ ID NO: 1552309 - RNA, 19 nt, Homo sapiens
gcuugagggugacguccuu

SEQ ID NO: 1552310 - RNA, 19 nt, Homo sapiens
ucgccgaguucuuugaguu

SEQ ID NO: 1552311 - RNA, 19 nt, Homo sapiens
caccaucggcuugcaguuu

SEQ ID NO: 1552312 - RNA, 19 nt, Homo sapiens
gguccaagcccggagauca

SEQ ID NO: 1552313 - RNA, 19 nt, Homo sapiens
acccgaacgucaucuguga

SEQ ID NO: 1552314 - RNA, 19 nt, Homo sapiens
aaagugagagguuguagca

SEQ ID NO: 1552315 - RNA, 19 nt, Homo sapiens
uacaguuucuugccuuuag

SEQ ID NO: 1552316 - RNA, 19 nt, Homo sapiens
gagauucuggaugccaaua

SEQ ID NO: 1552317 - RNA, 19 nt, Homo sapiens
cgagugucuuucuuugaug

SEQ ID NO: 1552318 - RNA, 19 nt, Homo sapiens
ucccuaaaccacccucaua

SEQ ID NO: 1552319 - RNA, 19 nt, Homo sapiens
gaagggaagggugucaaca

SEQ ID NO: 1552320 - RNA, 19 nt, Homo sapiens
ccaaggccuuugagaucau

SEQ ID NO: 1552321 - RNA, 19 nt, Homo sapiens
gggucggucuccuagauca

SEQ ID NO: 1552322 - RNA, 19 nt, Homo sapiens
gagcgcuggucauuuugua

SEQ ID NO: 1552323 - RNA, 19 nt, Homo sapiens
acaagaggaucaccuacac

SEQ ID NO: 1552324 - RNA, 19 nt, Homo sapiens
gccgaguucuuugaguuug

SEQ ID NO: 1552325 - RNA, 19 nt, Homo sapiens
ggucguggcaacugaauac

SEQ ID NO: 1552326 - RNA, 19 nt, Homo sapiens
caaaguaacugcuguaauc

SEQ ID NO: 1552327 - RNA, 19 nt, Homo sapiens
gaacuuaaaccucuuugua

SEQ ID NO: 1552328 - RNA, 19 nt, Homo sapiens
gcaagaagcugagaacaug

SEQ ID NO: 1552329 - RNA, 19 nt, Homo sapiens
gaagaugacgauagaauuu

SEQ ID NO: 1552330 - RNA, 19 nt, Homo sapiens
gagagaaguuucagcagaa

SEQ ID NO: 1552331 - RNA, 19 nt, Homo sapiens
gaacaggaaauuagaucua

SEQ ID NO: 1552332 - RNA, 19 nt, Homo sapiens
cagagaagaugacgauaga

SEQ ID NO: 1552333 - RNA, 19 nt, Homo sapiens
ggucagugcucgcaauguu

SEQ ID NO: 1552334 - RNA, 19 nt, Homo sapiens
caaggcaacaucauaagua

SEQ ID NO: 1552335 - RNA, 19 nt, Homo sapiens
aaacuaagcagaagaaauc

SEQ ID NO: 1552336 - RNA, 19 nt, Homo sapiens
caauaagagucacgaaauc

SEQ ID NO: 1552337 - RNA, 19 nt, Homo sapiens
ggaaaugaauacggcagaa

SEQ ID NO: 1552338 - RNA, 19 nt, Homo sapiens
acucagagcugucauccuu

SEQ ID NO: 1552339 - RNA, 19 nt, Homo sapiens
gcaccugggaguuccaaua

SEQ ID NO: 1552340 - RNA, 19 nt, Homo sapiens
gggaggagacucugaauuc

SEQ ID NO: 1552341 - RNA, 19 nt, Homo sapiens
uaaagaagauagagaagcu

SEQ ID NO: 1552342 - RNA, 19 nt, Homo sapiens
guucuuauguucacugugu

SEQ ID NO: 1552343 - RNA, 19 nt, Homo sapiens
acacaaggcaacaucauaa

SEQ ID NO: 1552344 - RNA, 19 nt, Homo sapiens
aaagaacccugcccuugga

SEQ ID NO: 1552345 - RNA, 19 nt, Homo sapiens
gagaagaugacgauagaau

SEQ ID NO: 1552346 - RNA, 19 nt, Homo sapiens
cgacggaggucagcagaga

SEQ ID NO: 1552347 - RNA, 19 nt, Homo sapiens
uggagagacuggauugaaa

SEQ ID NO: 1552348 - RNA, 19 nt, Homo sapiens
gaacacacaaggcaacauc

SEQ ID NO: 1552349 - RNA, 19 nt, Homo sapiens
caagucggcugaauuucug

SEQ ID NO: 1552350 - RNA, 19 nt, Homo sapiens
gaaaugaauacggcagaaa

SEQ ID NO: 1552351 - RNA, 19 nt, Homo sapiens
gaagcaaacuaagcagaag

SEQ ID NO: 1552352 - RNA, 19 nt, Homo sapiens
ucagagcugucauccuuga

SEQ ID NO: 1552353 - RNA, 19 nt, Homo sapiens
ccaauaagagucacgaaau

SEQ ID NO: 1552354 - RNA, 19 nt, Homo sapiens
gcagagaagaugacgauag

SEQ ID NO: 1552355 - RNA, 19 nt, Homo sapiens
cugaauuucugaugguuaa

SEQ ID NO: 1552356 - RNA, 19 nt, Homo sapiens
gagcugucauccuugauuc

SEQ ID NO: 1552357 - RNA, 19 nt, Homo sapiens
gaacauggagagagagaag

SEQ ID NO: 1552358 - RNA, 19 nt, Homo sapiens
acugauggaugaggaaaua

SEQ ID NO: 1552359 - RNA, 19 nt, Homo sapiens
cuacuucauugcauuguau

SEQ ID NO: 1552360 - RNA, 19 nt, Homo sapiens
cauccuugauucagauauu

SEQ ID NO: 1552361 - RNA, 19 nt, Homo sapiens
ccugggaguuccaauaaga

SEQ ID NO: 1552362 - RNA, 19 nt, Homo sapiens
aggagacucugaauucuga

SEQ ID NO: 1552363 - RNA, 19 nt, Homo sapiens
ggaggagacucugaauucu

SEQ ID NO: 1552364 - RNA, 19 nt, Homo sapiens
gaagcaggagguacuauag

SEQ ID NO: 1552365 - RNA, 19 nt, Homo sapiens
gcaauguucuuauguucac

SEQ ID NO: 1552366 - RNA, 19 nt, Homo sapiens
ucacgaaauccacaaagaa

SEQ ID NO: 1552367 - RNA, 19 nt, Homo sapiens
gguuaaagaagauagagaa

SEQ ID NO: 1552368 - RNA, 19 nt, Homo sapiens
ggagagacuggauugaaau

SEQ ID NO: 1552369 - RNA, 19 nt, Homo sapiens
uaacugcuguaaucagaag

SEQ ID NO: 1552370 - RNA, 19 nt, Homo sapiens
cuucagauuugguguuaga

SEQ ID NO: 1552371 - RNA, 19 nt, Homo sapiens
gucacgaaauccacaaaga

SEQ ID NO: 1552372 - RNA, 19 nt, Homo sapiens
gagguacuauagagagcaa

SEQ ID NO: 1552373 - RNA, 19 nt, Homo sapiens
caaacuaagcagaagaaau

SEQ ID NO: 1552374 - RNA, 19 nt, Homo sapiens
gcucaaaguaacugcugua

SEQ ID NO: 1552375 - RNA, 19 nt, Homo sapiens
ggaaauuagaucuacuuca

SEQ ID NO: 1552376 - RNA, 19 nt, Homo sapiens
ggcaacaucauaaguagga

SEQ ID NO: 1552377 - RNA, 19 nt, Homo sapiens
gagcaaagauucuaaaacc

SEQ ID NO: 1552378 - RNA, 19 nt, Homo sapiens
aguaacugcuguaaucaga

SEQ ID NO: 1552379 - RNA, 19 nt, Homo sapiens
caccugggaguuccaauaa

SEQ ID NO: 1552380 - RNA, 19 nt, Homo sapiens
cugagaacauggagagaga

SEQ ID NO: 1552381 - RNA, 19 nt, Homo sapiens
agaaggcucugaagcaaac

SEQ ID NO: 1552382 - RNA, 19 nt, Homo sapiens
ugaagcaaacuaagcagaa

SEQ ID NO: 1552383 - RNA, 19 nt, Homo sapiens
agaagcaggagguacuaua

SEQ ID NO: 1552384 - RNA, 19 nt, Homo sapiens
ggaguuccaauaagaguca

SEQ ID NO: 1552385 - RNA, 19 nt, Homo sapiens
gaauacggcagaaauuacu

SEQ ID NO: 1552386 - RNA, 19 nt, Homo sapiens
ccuugcagcucaccaacaa

SEQ ID NO: 1552387 - RNA, 19 nt, Homo sapiens
cuacagaaggcacuggaaa

SEQ ID NO: 1552388 - RNA, 19 nt, Homo sapiens
gcugaauuucugaugguua

SEQ ID NO: 1552389 - RNA, 19 nt, Homo sapiens
cacacaaggcaacaucaua

SEQ ID NO: 1552390 - RNA, 19 nt, Homo sapiens
gcaggagguacuauagaga

SEQ ID NO: 1552391 - RNA, 19 nt, Homo sapiens
gaucuacuucauugcauug

SEQ ID NO: 1552392 - RNA, 19 nt, Homo sapiens
agaagaugacgauagaauu

SEQ ID NO: 1552393 - RNA, 19 nt, Homo sapiens
ccagaucucucagcauguc

SEQ ID NO: 1552394 - RNA, 19 nt, Homo sapiens
gagcaguccagaucucuca

SEQ ID NO: 1552395 - RNA, 19 nt, Homo sapiens
caacaucauaaguaggaaa

SEQ ID NO: 1552396 - RNA, 19 nt, Homo sapiens
uggauacucuugcucaaag

SEQ ID NO: 1552397 - RNA, 19 nt, Homo sapiens
cagcagagaagaugacgau

SEQ ID NO: 1552398 - RNA, 19 nt, Homo sapiens
cggcagaaauuacuuugac

SEQ ID NO: 1552399 - RNA, 19 nt, Homo sapiens
gauuugguguuagaacuca

SEQ ID NO: 1552400 - RNA, 19 nt, Homo sapiens
cauuagaacaggaaauuag

SEQ ID NO: 1552401 - RNA, 19 nt, Homo sapiens
ccauuagaacaggaaauua

SEQ ID NO: 1552402 - RNA, 19 nt, Homo sapiens
ccaaagaucucagaaaacu

SEQ ID NO: 1552403 - RNA, 19 nt, Homo sapiens
ccaagucggcugaauuucu

SEQ ID NO: 1552404 - RNA, 19 nt, Homo sapiens
ucgcaauguucuuauguuc

SEQ ID NO: 1552405 - RNA, 19 nt, Homo sapiens
cuauagagagcaaagauuc

SEQ ID NO: 1552406 - RNA, 19 nt, Homo sapiens
gaagauagagaagcuacag

SEQ ID NO: 1552407 - RNA, 19 nt, Homo sapiens
gagaacauggagagagaga

SEQ ID NO: 1552408 - RNA, 19 nt, Homo sapiens
gcaacaucauaaguaggaa

SEQ ID NO: 1552409 - RNA, 19 nt, Homo sapiens
ugcauuguauggaggauga

SEQ ID NO: 1552410 - RNA, 19 nt, Homo sapiens
ggcaagaagcugagaacau

SEQ ID NO: 1552411 - RNA, 19 nt, Homo sapiens
agauagagaagcuacagaa

SEQ ID NO: 1552412 - RNA, 19 nt, Homo sapiens
cagauuugguguuagaacu

SEQ ID NO: 1552413 - RNA, 19 nt, Homo sapiens
augaauacggcagaaauua

SEQ ID NO: 1552414 - RNA, 19 nt, Homo sapiens
gcaaacuaagcagaagaaa

SEQ ID NO: 1552415 - RNA, 19 nt, Homo sapiens
ggauacucuugcucaaagu

SEQ ID NO: 1552416 - RNA, 19 nt, Homo sapiens
uaauucugcuuggaaguuc

SEQ ID NO: 1552417 - RNA, 19 nt, Homo sapiens
uaacaugagcaguccagau

SEQ ID NO: 1552418 - RNA, 19 nt, Homo sapiens
gaggagacucugaauucug

SEQ ID NO: 1552419 - RNA, 19 nt, Homo sapiens
aaaugaauacggcagaaau

SEQ ID NO: 1552420 - RNA, 19 nt, Homo sapiens
aaggcaacaucauaaguag

SEQ ID NO: 1552421 - RNA, 19 nt, Homo sapiens
ucaggucagugcucgcaau

SEQ ID NO: 1552422 - RNA, 19 nt, Homo sapiens
ucuacuucauugcauugua

SEQ ID NO: 1552423 - RNA, 19 nt, Homo sapiens
gaggucagcagagaagaug

SEQ ID NO: 1552424 - RNA, 19 nt, Homo sapiens
ugauggaugaggaaauaaa

SEQ ID NO: 1552425 - RNA, 19 nt, Homo sapiens
gauagagaagcuacagaag

SEQ ID NO: 1552426 - RNA, 19 nt, Homo sapiens
gaaggaagguuugcugaaa

SEQ ID NO: 1552427 - RNA, 19 nt, Homo sapiens
ggaagaccauggauauuga

SEQ ID NO: 1552428 - RNA, 19 nt, Homo sapiens
ggaagaagauugagaccau

SEQ ID NO: 1552429 - RNA, 19 nt, Homo sapiens
gaagagaauuacccagaga

SEQ ID NO: 1552430 - RNA, 19 nt, Homo sapiens
uaaccaagauuaacuaugg

SEQ ID NO: 1552431 - RNA, 19 nt, Homo sapiens
ggaaaccucugguagaagu

SEQ ID NO: 1552432 - RNA, 19 nt, Homo sapiens
cgacaacaccuauagcuuu

SEQ ID NO: 1552433 - RNA, 19 nt, Homo sapiens
gcccaacccugaugauuau

SEQ ID NO: 1552434 - RNA, 19 nt, Homo sapiens
gacaacaccuauagcuuug

SEQ ID NO: 1552435 - RNA, 19 nt, Homo sapiens
ggacaucggcuucggaguu

SEQ ID NO: 1552436 - RNA, 19 nt, Homo sapiens
ggagaugacagauguucua

SEQ ID NO: 1552437 - RNA, 19 nt, Homo sapiens
cagaggugauccagaagua

SEQ ID NO: 1552438 - RNA, 19 nt, Homo sapiens
cagagacccuggccaaguu

SEQ ID NO: 1552439 - RNA, 19 nt, Homo sapiens
gacaucggcuucggaguuu

SEQ ID NO: 1552440 - RNA, 19 nt, Homo sapiens
cgugaaagcuaccaaacug

SEQ ID NO: 1552441 - RNA, 19 nt, Homo sapiens
gguggcaguucucaucuga

SEQ ID NO: 1552442 - RNA, 19 nt, Homo sapiens
ccaaauguuuaaccaagau

SEQ ID NO: 1552443 - RNA, 19 nt, Homo sapiens
ugaggacacucgcaggaaa

SEQ ID NO: 1552444 - RNA, 19 nt, Homo sapiens
acgagggcaugcagaaaua

SEQ ID NO: 1552445 - RNA, 19 nt, Homo sapiens
ggaaggaagguuugcugaa

SEQ ID NO: 1552446 - RNA, 19 nt, Homo sapiens
gcaugcagaaauaugauaa

SEQ ID NO: 1552447 - RNA, 19 nt, Homo sapiens
caucacaccaaguggaaua

SEQ ID NO: 1552448 - RNA, 19 nt, Homo sapiens
gagaaaacguccaggaugu

SEQ ID NO: 1552449 - RNA, 19 nt, Homo sapiens
cagagaggcuagggaagaa

SEQ ID NO: 1552450 - RNA, 19 nt, Homo sapiens
caacccugaugauuauuuc

SEQ ID NO: 1552451 - RNA, 19 nt, Homo sapiens
gggaccaggugaagacuca

SEQ ID NO: 1552452 - RNA, 19 nt, Homo sapiens
gcaggaaaauuauuguguu

SEQ ID NO: 1552453 - RNA, 19 nt, Homo sapiens
gaaagcuaccaaacuguuc

SEQ ID NO: 1552454 - RNA, 19 nt, Homo sapiens
ggguugcucuucucaguca

SEQ ID NO: 1552455 - RNA, 19 nt, Homo sapiens
caacaccuauagcuuuguc

SEQ ID NO: 1552456 - RNA, 19 nt, Homo sapiens
cuggaaaccucugguagaa

SEQ ID NO: 1552457 - RNA, 19 nt, Homo sapiens
gcagagacccuggccaagu

SEQ ID NO: 1552458 - RNA, 19 nt, Homo sapiens
gaugauuauuuccuucuac

SEQ ID NO: 1552459 - RNA, 19 nt, Homo sapiens
ugaagccauuccugaguga

SEQ ID NO: 1552460 - RNA, 19 nt, Homo sapiens
cggaagaccauggauauug

SEQ ID NO: 1552461 - RNA, 19 nt, Homo sapiens
ugcccaacccugaugauua

SEQ ID NO: 1552462 - RNA, 19 nt, Homo sapiens
ugaaagcuaccaaacuguu

SEQ ID NO: 1552463 - RNA, 19 nt, Homo sapiens
gagcgcauccugcaugagu

SEQ ID NO: 1552464 - RNA, 19 nt, Homo sapiens
gacgagggcaugcagaaau

SEQ ID NO: 1552465 - RNA, 19 nt, Homo sapiens
gacacucgcaggaaaauua

SEQ ID NO: 1552466 - RNA, 19 nt, Homo sapiens
agugugaccugcagacaga

SEQ ID NO: 1552467 - RNA, 19 nt, Homo sapiens
gcagaagucggaggcuuug

SEQ ID NO: 1552468 - RNA, 19 nt, Homo sapiens
gugagcgcauccugcauga

SEQ ID NO: 1552469 - RNA, 19 nt, Homo sapiens
ccaacccugaugauuauuu

SEQ ID NO: 1552470 - RNA, 19 nt, Homo sapiens
uaacuggaaggaagguuug

SEQ ID NO: 1552471 - RNA, 19 nt, Homo sapiens
cugaaacacuucuggaaac

SEQ ID NO: 1552472 - RNA, 19 nt, Homo sapiens
gagaggcuagggaagaaga

SEQ ID NO: 1552473 - RNA, 19 nt, Homo sapiens
cccaaauguuuaaccaaga

SEQ ID NO: 1552474 - RNA, 19 nt, Homo sapiens
ccaagaugagggacuguga

SEQ ID NO: 1552475 - RNA, 19 nt, Homo sapiens
cuacccagccagcgcuaua

SEQ ID NO: 1552476 - RNA, 19 nt, Homo sapiens
ccaaguggaauacgagauc

SEQ ID NO: 1552477 - RNA, 19 nt, Homo sapiens
uacauggaguuccggaaga

SEQ ID NO: 1552478 - RNA, 19 nt, Homo sapiens
gacugaaacacuucuggaa

SEQ ID NO: 1552479 - RNA, 19 nt, Homo sapiens
gaggugauccagaaguaca

SEQ ID NO: 1552480 - RNA, 19 nt, Homo sapiens
guucucagguggcaguucu

SEQ ID NO: 1552481 - RNA, 19 nt, Homo sapiens
ggcaugcagaaauaugaua

SEQ ID NO: 1552482 - RNA, 19 nt, Homo sapiens
guccuacgcuucgacaaca

SEQ ID NO: 1552483 - RNA, 19 nt, Homo sapiens
ugaugauauuugacuguga

SEQ ID NO: 1552484 - RNA, 19 nt, Homo sapiens
acagagaggcuagggaaga

SEQ ID NO: 1552485 - RNA, 19 nt, Homo sapiens
ugacaucauugggccacuu

SEQ ID NO: 1552486 - RNA, 19 nt, Homo sapiens
acccagagacccugaaguu

SEQ ID NO: 1552487 - RNA, 19 nt, Homo sapiens
gccugggacugaaacacuu

SEQ ID NO: 1552488 - RNA, 19 nt, Homo sapiens
gcuauaacgcccacauggu

SEQ ID NO: 1552489 - RNA, 19 nt, Homo sapiens
gugagggccugggacugaa

SEQ ID NO: 1552490 - RNA, 19 nt, Homo sapiens
gagggcaugcagaaauaug

SEQ ID NO: 1552491 - RNA, 19 nt, Homo sapiens
ucagguggcaguucucauc

SEQ ID NO: 1552492 - RNA, 19 nt, Homo sapiens
caggaaaauuauuguguug

SEQ ID NO: 1552493 - RNA, 19 nt, Homo sapiens
acugaaacacuucuggaaa

SEQ ID NO: 1552494 - RNA, 19 nt, Homo sapiens
uugaccauauccuugauug

SEQ ID NO: 1552495 - RNA, 19 nt, Homo sapiens
caucgugaaagcuaccaaa

SEQ ID NO: 1552496 - RNA, 19 nt, Homo sapiens
gaccugcucaagaccaaga

SEQ ID NO: 1552497 - RNA, 19 nt, Homo sapiens
caggggagaugacagaugu

SEQ ID NO: 1552498 - RNA, 19 nt, Homo sapiens
cacccugacugacccagau

SEQ ID NO: 1552499 - RNA, 19 nt, Homo sapiens
gggcuacaaccucaugaag

SEQ ID NO: 1552500 - RNA, 19 nt, Homo sapiens
ggcuagggaagaagauuga

SEQ ID NO: 1552501 - RNA, 19 nt, Homo sapiens
cacaccaaguggaauacga

SEQ ID NO: 1552502 - RNA, 19 nt, Homo sapiens
gggaaauaacuggaaggaa

SEQ ID NO: 1552503 - RNA, 19 nt, Homo sapiens
ccccagaggugauccagaa

SEQ ID NO: 1552504 - RNA, 19 nt, Homo sapiens
guucuuuggccuccuugaa

SEQ ID NO: 1552505 - RNA, 19 nt, Homo sapiens
ggacagaacuugaaagaga

SEQ ID NO: 1552506 - RNA, 19 nt, Homo sapiens
uggaagagcugaacaagua

SEQ ID NO: 1552507 - RNA, 19 nt, Homo sapiens
cagcauuucuggcacguua

SEQ ID NO: 1552508 - RNA, 19 nt, Homo sapiens
ccaauaacuugcauuucua

SEQ ID NO: 1552509 - RNA, 19 nt, Homo sapiens
gagcccaggugcacgguua

SEQ ID NO: 1552510 - RNA, 19 nt, Homo sapiens
caagguggcugaacagauc

SEQ ID NO: 1552511 - RNA, 19 nt, Homo sapiens
gcucauagaccgcaacuug

SEQ ID NO: 1552512 - RNA, 19 nt, Homo sapiens
cgauaucgcucucugucua

SEQ ID NO: 1552513 - RNA, 19 nt, Homo sapiens
gcgaauacgugacgauauc

SEQ ID NO: 1552514 - RNA, 19 nt, Homo sapiens
gacagaacuugaaagagaa

SEQ ID NO: 1552515 - RNA, 19 nt, Homo sapiens
ccauagccgucuacucuuu

SEQ ID NO: 1552516 - RNA, 19 nt, Homo sapiens
aaacacaauuugagaguca

SEQ ID NO: 1552517 - RNA, 19 nt, Homo sapiens
gagagaaggucgguugcuu

SEQ ID NO: 1552518 - RNA, 19 nt, Homo sapiens
guauuggguuucuauguga

SEQ ID NO: 1552519 - RNA, 19 nt, Homo sapiens
gaccauagccgucuacucu

SEQ ID NO: 1552520 - RNA, 19 nt, Homo sapiens
gcagcaugcuauuccacua

SEQ ID NO: 1552521 - RNA, 19 nt, Homo sapiens
cacggaaggucuugucaaa

SEQ ID NO: 1552522 - RNA, 19 nt, Homo sapiens
ugaggaugaugacgacuuu

SEQ ID NO: 1552523 - RNA, 19 nt, Homo sapiens
gagcagagguacguguaug

SEQ ID NO: 1552524 - RNA, 19 nt, Homo sapiens
ucuacaagcuccucuacaa

SEQ ID NO: 1552525 - RNA, 19 nt, Homo sapiens
gggcaccacucccagcauu

SEQ ID NO: 1552526 - RNA, 19 nt, Homo sapiens
gaaauccgacuucaacaag

SEQ ID NO: 1552527 - RNA, 19 nt, Homo sapiens
uaaaugagcccaggcauag

SEQ ID NO: 1552528 - RNA, 19 nt, Homo sapiens
cccaauaacuugcauuucu

SEQ ID NO: 1552529 - RNA, 19 nt, Homo sapiens
agacaaaucagcucauaga

SEQ ID NO: 1552530 - RNA, 19 nt, Homo sapiens
gggaauguguccacuuugg

SEQ ID NO: 1552531 - RNA, 19 nt, Homo sapiens
ggaaacacaauuugagagu

SEQ ID NO: 1552532 - RNA, 19 nt, Homo sapiens
ugccuuguuuguaauguua

SEQ ID NO: 1552533 - RNA, 19 nt, Homo sapiens
gccauugguucucaaacuu

SEQ ID NO: 1552534 - RNA, 19 nt, Homo sapiens
gaugacgacuuugagacaa

SEQ ID NO: 1552535 - RNA, 19 nt, Homo sapiens
cauugguucucaaacuuaa

SEQ ID NO: 1552536 - RNA, 19 nt, Homo sapiens
gaacuugaaagagaagaug

SEQ ID NO: 1552537 - RNA, 19 nt, Homo sapiens
uaaggaaggaucagcauca

SEQ ID NO: 1552538 - RNA, 19 nt, Homo sapiens
acagggagcuaggccauug

SEQ ID NO: 1552539 - RNA, 19 nt, Homo sapiens
cugggaauguguccacuuu

SEQ ID NO: 1552540 - RNA, 19 nt, Homo sapiens
acgguuagcuucacagcaa

SEQ ID NO: 1552541 - RNA, 19 nt, Homo sapiens
ccauugguucucaaacuua

SEQ ID NO: 1552542 - RNA, 19 nt, Homo sapiens
gcccaggcauagaggacua

SEQ ID NO: 1552543 - RNA, 19 nt, Homo sapiens
gaugaugacgacuuugaga

SEQ ID NO: 1552544 - RNA, 19 nt, Homo sapiens
gcaugcuauuccacuauga

SEQ ID NO: 1552545 - RNA, 19 nt, Homo sapiens
uguauuggguuucuaugug

SEQ ID NO: 1552546 - RNA, 19 nt, Homo sapiens
gggcgaauacgugacgaua

SEQ ID NO: 1552547 - RNA, 19 nt, Homo sapiens
gcauuuagggacagaacuu

SEQ ID NO: 1552548 - RNA, 19 nt, Homo sapiens
ugggagacccggacaugua

SEQ ID NO: 1552549 - RNA, 19 nt, Homo sapiens
gaucaucaacccauuuggu

SEQ ID NO: 1552550 - RNA, 19 nt, Homo sapiens
ggccauugguucucaaacu

SEQ ID NO: 1552551 - RNA, 19 nt, Homo sapiens
gcuaggccauugguucuca

SEQ ID NO: 1552552 - RNA, 19 nt, Homo sapiens
auaaaugagcccaggcaua

SEQ ID NO: 1552553 - RNA, 19 nt, Homo sapiens
uggacgaaauguaccagaa

SEQ ID NO: 1552554 - RNA, 19 nt, Homo sapiens
caacccauuuggugaggau

SEQ ID NO: 1552555 - RNA, 19 nt, Homo sapiens
caggaaacacaauuugaga

SEQ ID NO: 1552556 - RNA, 19 nt, Homo sapiens
ccgcugagaaggaccagua

SEQ ID NO: 1552557 - RNA, 19 nt, Homo sapiens
caauuugagagucauguga

SEQ ID NO: 1552558 - RNA, 19 nt, Homo sapiens
gcaccacucccagcauuuc

SEQ ID NO: 1552559 - RNA, 19 nt, Homo sapiens
gaaagagaagauggcgaaa

SEQ ID NO: 1552560 - RNA, 19 nt, Homo sapiens
gcagaccucauucccuugu

SEQ ID NO: 1552561 - RNA, 19 nt, Homo sapiens
cuugaaggccagagcauuu

SEQ ID NO: 1552562 - RNA, 19 nt, Homo sapiens
gguggacgcagguuucaug

SEQ ID NO: 1552563 - RNA, 19 nt, Homo sapiens
gagcuaggccauugguucu

SEQ ID NO: 1552564 - RNA, 19 nt, Homo sapiens
cugcaguucuucuucuaug

SEQ ID NO: 1552565 - RNA, 19 nt, Homo sapiens
ccgcucagcagaccucauu

SEQ ID NO: 1552566 - RNA, 19 nt, Homo sapiens
gugaugcugugcugcuugu

SEQ ID NO: 1552567 - RNA, 19 nt, Homo sapiens
ucccuuguccuuuguauug

SEQ ID NO: 1552568 - RNA, 19 nt, Homo sapiens
ugccaaaccucagaagcuu

SEQ ID NO: 1552569 - RNA, 19 nt, Homo sapiens
cucauucccuuguccuuug

SEQ ID NO: 1552570 - RNA, 19 nt, Homo sapiens
ggacgaaauguaccagaac

SEQ ID NO: 1552571 - RNA, 19 nt, Homo sapiens
cagaucaucaacccauuug

SEQ ID NO: 1552572 - RNA, 19 nt, Homo sapiens
ccaagugcagcaugcuauu

SEQ ID NO: 1552573 - RNA, 19 nt, Homo sapiens
ccaggaaacacaauuugag

SEQ ID NO: 1552574 - RNA, 19 nt, Homo sapiens
cugccagccagcucuauua

SEQ ID NO: 1552575 - RNA, 19 nt, Homo sapiens
cgaaauguaccagaaccuu

SEQ ID NO: 1552576 - RNA, 19 nt, Homo sapiens
uugcauuucuaacaaguuc

SEQ ID NO: 1552577 - RNA, 19 nt, Homo sapiens
gcauuucuggcacguuaga

SEQ ID NO: 1552578 - RNA, 19 nt, Homo sapiens
ggagcagagguacguguau

SEQ ID NO: 1552579 - RNA, 19 nt, Homo sapiens
ugacccaggagcagaggua

SEQ ID NO: 1552580 - RNA, 19 nt, Homo sapiens
gccaagugcagcaugcuau

SEQ ID NO: 1552581 - RNA, 19 nt, Homo sapiens
uuucauacacucucaaagu

SEQ ID NO: 1552582 - RNA, 19 nt, Homo sapiens
acagaucaucaacccauuu

SEQ ID NO: 1552583 - RNA, 19 nt, Homo sapiens
gccgucuacucuuucuuug

SEQ ID NO: 1552584 - RNA, 19 nt, Homo sapiens
acaaguaccgagccaagug

SEQ ID NO: 1552585 - RNA, 19 nt, Homo sapiens
uaacaaguucccaggugau

SEQ ID NO: 1552586 - RNA, 19 nt, Homo sapiens
cggaaggucuugucaaaag

SEQ ID NO: 1552587 - RNA, 19 nt, Homo sapiens
ucucaaacuuaaggaagga

SEQ ID NO: 1552588 - RNA, 19 nt, Homo sapiens
ggaauguguccacuuuggu

SEQ ID NO: 1552589 - RNA, 19 nt, Homo sapiens
uugaaggccagagcauuua

SEQ ID NO: 1552590 - RNA, 19 nt, Homo sapiens
gagacaaaucagcucauag

SEQ ID NO: 1552591 - RNA, 19 nt, Homo sapiens
cagcaugcuauuccacuau

SEQ ID NO: 1552592 - RNA, 19 nt, Homo sapiens
gcaucuacaagcuccucua

SEQ ID NO: 1552593 - RNA, 19 nt, Homo sapiens
guccaggaaacacaauuug

SEQ ID NO: 1552594 - RNA, 19 nt, Homo sapiens
cagcaucacggaaggucuu

SEQ ID NO: 1552595 - RNA, 19 nt, Homo sapiens
aagagaagauggcgaaaag

SEQ ID NO: 1552596 - RNA, 19 nt, Homo sapiens
uuucuggcacguuagauuu

SEQ ID NO: 1552597 - RNA, 19 nt, Homo sapiens
caaacuuaaggaaggauca

SEQ ID NO: 1552598 - RNA, 19 nt, Homo sapiens
uggcugaacagaucaucaa

SEQ ID NO: 1552599 - RNA, 19 nt, Homo sapiens
ggcucaagguggcugaaca

SEQ ID NO: 1552600 - RNA, 19 nt, Homo sapiens
gagccugaaauccgacuuc

SEQ ID NO: 1552601 - RNA, 19 nt, Homo sapiens
ggacggagcucaccaacug

SEQ ID NO: 1552602 - RNA, 19 nt, Homo sapiens
gcacauugacuuucuguug

SEQ ID NO: 1552603 - RNA, 19 nt, Homo sapiens
gcaaagaacaaccugaaga

SEQ ID NO: 1552604 - RNA, 19 nt, Homo sapiens
gaacgagagugaaagaaac

SEQ ID NO: 1552605 - RNA, 19 nt, Homo sapiens
gcaaagcgggucagaagaa

SEQ ID NO: 1552606 - RNA, 19 nt, Homo sapiens
agacacaguuucucuuuga

SEQ ID NO: 1552607 - RNA, 19 nt, Homo sapiens
gaaaaccucucuucauaug

SEQ ID NO: 1552608 - RNA, 19 nt, Homo sapiens
uaacuugacuuucaugaac

SEQ ID NO: 1552609 - RNA, 19 nt, Homo sapiens
acaugcagcuuuacgagua

SEQ ID NO: 1552610 - RNA, 19 nt, Homo sapiens
gaacauucaaccucaaguu

SEQ ID NO: 1552611 - RNA, 19 nt, Homo sapiens
caaagaacaaccugaagaa

SEQ ID NO: 1552612 - RNA, 19 nt, Homo sapiens
gggauccagugucacguua

SEQ ID NO: 1552613 - RNA, 19 nt, Homo sapiens
cacauugacuuucuguuga

SEQ ID NO: 1552614 - RNA, 19 nt, Homo sapiens
gagcaggcacauugacuuu

SEQ ID NO: 1552615 - RNA, 19 nt, Homo sapiens
uggaaaaccucucuucaua

SEQ ID NO: 1552616 - RNA, 19 nt, Homo sapiens
acaccaggaauuucuauua

SEQ ID NO: 1552617 - RNA, 19 nt, Homo sapiens
aaaccucucuucauaugug

SEQ ID NO: 1552618 - RNA, 19 nt, Homo sapiens
gcaggcacauugacuuucu

SEQ ID NO: 1552619 - RNA, 19 nt, Homo sapiens
gcauugaggaucuaaacuu

SEQ ID NO: 1552620 - RNA, 19 nt, Homo sapiens
agaacaaccugaagaacau

SEQ ID NO: 1552621 - RNA, 19 nt, Homo sapiens
ccuacaaccuggcuaacaa

SEQ ID NO: 1552622 - RNA, 19 nt, Homo sapiens
gcaccuacaaccuggcuaa

SEQ ID NO: 1552623 - RNA, 19 nt, Homo sapiens
ccaggaauuucuauuacau

SEQ ID NO: 1552624 - RNA, 19 nt, Homo sapiens
ucauaugugugauggaaga

SEQ ID NO: 1552625 - RNA, 19 nt, Homo sapiens
gcuauaacuugacuuucau

SEQ ID NO: 1552626 - RNA, 19 nt, Homo sapiens
uggagaagcugagccauuc

SEQ ID NO: 1552627 - RNA, 19 nt, Homo sapiens
ugaacgagagugaaagaaa

SEQ ID NO: 1552628 - RNA, 19 nt, Homo sapiens
cauugaggaucuaaacuuc

SEQ ID NO: 1552629 - RNA, 19 nt, Homo sapiens
ggugcucacucuccucuuc

SEQ ID NO: 1552630 - RNA, 19 nt, Homo sapiens
ugcuauaacuugacuuuca

SEQ ID NO: 1552631 - RNA, 19 nt, Homo sapiens
caccaggaauuucuauuac

SEQ ID NO: 1552632 - RNA, 19 nt, Homo sapiens
ggacugucaccgaggacua

SEQ ID NO: 1552633 - RNA, 19 nt, Homo sapiens
gugcaaagaacaaccugaa

SEQ ID NO: 1552634 - RNA, 19 nt, Homo sapiens
cuucauaugugugauggaa

SEQ ID NO: 1552635 - RNA, 19 nt, Homo sapiens
guuacgggauccaguguca

SEQ ID NO: 1552636 - RNA, 19 nt, Homo sapiens
ggaggaagaggaggaggaa

SEQ ID NO: 1552637 - RNA, 19 nt, Homo sapiens
gcugcuauaacuugacuuu

SEQ ID NO: 1552638 - RNA, 19 nt, Homo sapiens
caaagcgggucagaagaag

SEQ ID NO: 1552639 - RNA, 19 nt, Homo sapiens
uaaacuuccuggacaugca

SEQ ID NO: 1552640 - RNA, 19 nt, Homo sapiens
cuucuaacguggagaucaa

SEQ ID NO: 1552641 - RNA, 19 nt, Homo sapiens
cuucguggauuucaacauc

SEQ ID NO: 1552642 - RNA, 19 nt, Homo sapiens
ccagaggaagacacaguuu

SEQ ID NO: 1552643 - RNA, 19 nt, Homo sapiens
aagaacaaccugaagaaca

SEQ ID NO: 1552644 - RNA, 19 nt, Homo sapiens
ugacccgcuucguggauuu

SEQ ID NO: 1552645 - RNA, 19 nt, Homo sapiens
ggaccauggaugaaagguu

SEQ ID NO: 1552646 - RNA, 19 nt, Homo sapiens
uccuggacaugcagcuuua

SEQ ID NO: 1552647 - RNA, 19 nt, Homo sapiens
gaacaaccugaagaacaug

SEQ ID NO: 1552648 - RNA, 19 nt, Homo sapiens
ggugggcugcuauaacuug

SEQ ID NO: 1552649 - RNA, 19 nt, Homo sapiens
ugcgggaguuuauggauug

SEQ ID NO: 1552650 - RNA, 19 nt, Homo sapiens
ggaaaaccucucuucauau

SEQ ID NO: 1552651 - RNA, 19 nt, Homo sapiens
ucacacaguucaacaucac

SEQ ID NO: 1552652 - RNA, 19 nt, Homo sapiens
gcgggaccauggaugaaag

SEQ ID NO: 1552653 - RNA, 19 nt, Homo sapiens
acagccagguggugagaug

SEQ ID NO: 1552654 - RNA, 19 nt, Homo sapiens
caugaacgagagugaaaga

SEQ ID NO: 1552655 - RNA, 19 nt, Homo sapiens
cauucaaccucaaguucau

SEQ ID NO: 1552656 - RNA, 19 nt, Homo sapiens
ugacgccggugcucacucu

SEQ ID NO: 1552657 - RNA, 19 nt, Homo sapiens
agagaacauucaaccucaa

SEQ ID NO: 1552658 - RNA, 19 nt, Homo sapiens
uugacuuucuguugaggua

SEQ ID NO: 1552659 - RNA, 19 nt, Homo sapiens
caacagccagguggugaga

SEQ ID NO: 1552660 - RNA, 19 nt, Homo sapiens
ccaacgcauugaggaucua

SEQ ID NO: 1552661 - RNA, 19 nt, Homo sapiens
gccaacgcauugaggaucu

SEQ ID NO: 1552662 - RNA, 19 nt, Homo sapiens
caugcagcuuuacgaguau

SEQ ID NO: 1552663 - RNA, 19 nt, Homo sapiens
guugagguaccuuggagaa

SEQ ID NO: 1552664 - RNA, 19 nt, Homo sapiens
gagaacauucaaccucaag

SEQ ID NO: 1552665 - RNA, 19 nt, Homo sapiens
gggcugcuauaacuugacu

SEQ ID NO: 1552666 - RNA, 19 nt, Homo sapiens
ccaguggcccaaagaagau

SEQ ID NO: 1552667 - RNA, 19 nt, Homo sapiens
gagcgggaccauggaugaa

SEQ ID NO: 1552668 - RNA, 19 nt, Homo sapiens
gugggcugcuauaacuuga

SEQ ID NO: 1552669 - RNA, 19 nt, Homo sapiens
cuggugggcugcuauaacu

SEQ ID NO: 1552670 - RNA, 19 nt, Homo sapiens
gaucguguuccuccacauc

SEQ ID NO: 1552671 - RNA, 19 nt, Homo sapiens
uugcgggaguuuauggauu

SEQ ID NO: 1552672 - RNA, 19 nt, Homo sapiens
ccacaccaggaauuucuau

SEQ ID NO: 1552673 - RNA, 19 nt, Homo sapiens
gagguaccuuggagaagcu

SEQ ID NO: 1552674 - RNA, 19 nt, Homo sapiens
cugcaaagcgggucagaag

SEQ ID NO: 1552675 - RNA, 19 nt, Homo sapiens
aggaagaggaggaggaaga

SEQ ID NO: 1552676 - RNA, 19 nt, Homo sapiens
caacgcauugaggaucuaa

SEQ ID NO: 1552677 - RNA, 19 nt, Homo sapiens
cagaggaagacacaguuuc

SEQ ID NO: 1552678 - RNA, 19 nt, Homo sapiens
aaggagacguggcucuucu

SEQ ID NO: 1552679 - RNA, 19 nt, Homo sapiens
agggugagcaggcacauug

SEQ ID NO: 1552680 - RNA, 19 nt, Homo sapiens
ggaaacagcagauugauua

SEQ ID NO: 1552681 - RNA, 19 nt, Homo sapiens
gagaagaucuguggcuaua

SEQ ID NO: 1552682 - RNA, 19 nt, Homo sapiens
caauaaagcugcaguguuc

SEQ ID NO: 1552683 - RNA, 19 nt, Homo sapiens
gagcugaacugcauacaug

SEQ ID NO: 1552684 - RNA, 19 nt, Homo sapiens
ggagacagcuguuccacuu

SEQ ID NO: 1552685 - RNA, 19 nt, Homo sapiens
gcagacggaucccaauaaa

SEQ ID NO: 1552686 - RNA, 19 nt, Homo sapiens
guagggugcuggcugaaua

SEQ ID NO: 1552687 - RNA, 19 nt, Homo sapiens
gaaugagugucuuugugua

SEQ ID NO: 1552688 - RNA, 19 nt, Homo sapiens
gacaacaccugccacuuug

SEQ ID NO: 1552689 - RNA, 19 nt, Homo sapiens
gccacaagcuguccaagaa

SEQ ID NO: 1552690 - RNA, 19 nt, Homo sapiens
caacauaggccuuguccuu

SEQ ID NO: 1552691 - RNA, 19 nt, Homo sapiens
ggacgcgguuguucuauca

SEQ ID NO: 1552692 - RNA, 19 nt, Homo sapiens
ggaugugggugucagugua

SEQ ID NO: 1552693 - RNA, 19 nt, Homo sapiens
ggcgagagcgcgaauauuu

SEQ ID NO: 1552694 - RNA, 19 nt, Homo sapiens
ugacaccucuuucucauuc

SEQ ID NO: 1552695 - RNA, 19 nt, Homo sapiens
ucacacagcuaguuugagu

SEQ ID NO: 1552696 - RNA, 19 nt, Homo sapiens
ggauggaccucaaaaguuu

SEQ ID NO: 1552697 - RNA, 19 nt, Homo sapiens
ggccugaaauuccaccuuu

SEQ ID NO: 1552698 - RNA, 19 nt, Homo sapiens
gcacagccaccaacaaugu

SEQ ID NO: 1552699 - RNA, 19 nt, Homo sapiens
gaagcugucugugaacgaa

SEQ ID NO: 1552700 - RNA, 19 nt, Homo sapiens
ggaccugacagacaacuuu

SEQ ID NO: 1552701 - RNA, 19 nt, Homo sapiens
aaaugugucugcugaaaug

SEQ ID NO: 1552702 - RNA, 19 nt, Homo sapiens
agacaacaccugccacuuu

SEQ ID NO: 1552703 - RNA, 19 nt, Homo sapiens
gagaaugugugugaugugu

SEQ ID NO: 1552704 - RNA, 19 nt, Homo sapiens
uauagcagcuuauggaagu

SEQ ID NO: 1552705 - RNA, 19 nt, Homo sapiens
guggugugcuucugacuuu

SEQ ID NO: 1552706 - RNA, 19 nt, Homo sapiens
gcagggaguuuggcuaaca

SEQ ID NO: 1552707 - RNA, 19 nt, Homo sapiens
gcacagcaaagcccaaguu

SEQ ID NO: 1552708 - RNA, 19 nt, Homo sapiens
ggaaugagugucuuugugu

SEQ ID NO: 1552709 - RNA, 19 nt, Homo sapiens
uaaaggugcucaguacaug

SEQ ID NO: 1552710 - RNA, 19 nt, Homo sapiens
gcuuacagaugacccuauu

SEQ ID NO: 1552711 - RNA, 19 nt, Homo sapiens
agacaucgguguucaacga

SEQ ID NO: 1552712 - RNA, 19 nt, Homo sapiens
gaaacagcagauugauuaa

SEQ ID NO: 1552713 - RNA, 19 nt, Homo sapiens
caaggccucugucugaaau

SEQ ID NO: 1552714 - RNA, 19 nt, Homo sapiens
ggauugagacccauucguu

SEQ ID NO: 1552715 - RNA, 19 nt, Homo sapiens
cuucuagaaugacucuuua

SEQ ID NO: 1552716 - RNA, 19 nt, Homo sapiens
guccuuggguccuggguua

SEQ ID NO: 1552717 - RNA, 19 nt, Homo sapiens
ugucggguauuguuccuua

SEQ ID NO: 1552718 - RNA, 19 nt, Homo sapiens
ccaauaaagugguggugau

SEQ ID NO: 1552719 - RNA, 19 nt, Homo sapiens
agaaugcccucacccagaa

SEQ ID NO: 1552720 - RNA, 19 nt, Homo sapiens
gacauggccucccgcauca

SEQ ID NO: 1552721 - RNA, 19 nt, Homo sapiens
gcagaaggaccacucuuuc

SEQ ID NO: 1552722 - RNA, 19 nt, Homo sapiens
ggaagcacccgccucucua

SEQ ID NO: 1552723 - RNA, 19 nt, Homo sapiens
guaaaugucuaggcaugug

SEQ ID NO: 1552724 - RNA, 19 nt, Homo sapiens
ggccuugccugcagaauag

SEQ ID NO: 1552725 - RNA, 19 nt, Homo sapiens
gcuccagguucucagcaua

SEQ ID NO: 1552726 - RNA, 19 nt, Homo sapiens
cagaugacccuauugaaug

SEQ ID NO: 1552727 - RNA, 19 nt, Homo sapiens
gacaaugaauuuggaagug

SEQ ID NO: 1552728 - RNA, 19 nt, Homo sapiens
ucacacacacagagauaua

SEQ ID NO: 1552729 - RNA, 19 nt, Homo sapiens
gaaccaccagaguccuuua

SEQ ID NO: 1552730 - RNA, 19 nt, Homo sapiens
gcucacacacacagagaua

SEQ ID NO: 1552731 - RNA, 19 nt, Homo sapiens
agugggcccuuccagauua

SEQ ID NO: 1552732 - RNA, 19 nt, Homo sapiens
ccaaauguaaccucuaguu

SEQ ID NO: 1552733 - RNA, 19 nt, Homo sapiens
gugcagaauccuuguguuu

SEQ ID NO: 1552734 - RNA, 19 nt, Homo sapiens
gcagagaagaggccuggaa

SEQ ID NO: 1552735 - RNA, 19 nt, Homo sapiens
gcccgucugugucuaggua

SEQ ID NO: 1552736 - RNA, 19 nt, Homo sapiens
gcagugggacuccugagaa

SEQ ID NO: 1552737 - RNA, 19 nt, Homo sapiens
acucaaacuuuccuccuuu

SEQ ID NO: 1552738 - RNA, 19 nt, Homo sapiens
gagugaaggucagcauguu

SEQ ID NO: 1552739 - RNA, 19 nt, Homo sapiens
caccugagauugacaugau

SEQ ID NO: 1552740 - RNA, 19 nt, Homo sapiens
gcgccaaguucuacugugu

SEQ ID NO: 1552741 - RNA, 19 nt, Homo sapiens
cgagugagccgagacauga

SEQ ID NO: 1552742 - RNA, 19 nt, Homo sapiens
caaauguaaccucuaguug

SEQ ID NO: 1552743 - RNA, 19 nt, Homo sapiens
ggggaucccuugacccuua

SEQ ID NO: 1552744 - RNA, 19 nt, Homo sapiens
gaucuuuccuccuugacau

SEQ ID NO: 1552745 - RNA, 19 nt, Homo sapiens
uagaugacgucacacugaa

SEQ ID NO: 1552746 - RNA, 19 nt, Homo sapiens
gaagaucuguggcuauacc

SEQ ID NO: 1552747 - RNA, 19 nt, Homo sapiens
caaagagagugagaacauc

SEQ ID NO: 1552748 - RNA, 19 nt, Homo sapiens
ccaagguccugaagcugaa

SEQ ID NO: 1552749 - RNA, 19 nt, Homo sapiens
cagggugacugaggcauuu

SEQ ID NO: 1552750 - RNA, 19 nt, Homo sapiens
caguaaaggugcucaguac

SEQ ID NO: 1552751 - RNA, 19 nt, Homo sapiens
ggaggagcgcggaaugaaa

SEQ ID NO: 1552752 - RNA, 19 nt, Homo sapiens
gauugagacccauucguuu

SEQ ID NO: 1552753 - RNA, 19 nt, Homo sapiens
acacagagcccaucaacuc

SEQ ID NO: 1552754 - RNA, 19 nt, Homo sapiens
ggcagaaggaccacucuuu

SEQ ID NO: 1552755 - RNA, 19 nt, Homo sapiens
ccugaggucuccugccaaa

SEQ ID NO: 1552756 - RNA, 19 nt, Homo sapiens
agucggacaucaagaaaug

SEQ ID NO: 1552757 - RNA, 19 nt, Homo sapiens
gcaggagugugugcaaaca

SEQ ID NO: 1552758 - RNA, 19 nt, Homo sapiens
gcaccuucuuuacugcaaa

SEQ ID NO: 1552759 - RNA, 19 nt, Homo sapiens
gccagcaccuucuuuacug

SEQ ID NO: 1552760 - RNA, 19 nt, Homo sapiens
agacggaucccaauaaagu

SEQ ID NO: 1552761 - RNA, 19 nt, Homo sapiens
caucaacucuccgaaccuu

SEQ ID NO: 1552762 - RNA, 19 nt, Homo sapiens
ucaaagagagugagaacau

SEQ ID NO: 1552763 - RNA, 19 nt, Homo sapiens
gcgguuguucuaucaauaa

SEQ ID NO: 1552764 - RNA, 19 nt, Homo sapiens
ggccuucauuucuuaucua

SEQ ID NO: 1552765 - RNA, 19 nt, Homo sapiens
gggugaggcuugacuugga

SEQ ID NO: 1552766 - RNA, 19 nt, Homo sapiens
gcacacacgcacacacuca

SEQ ID NO: 1552767 - RNA, 19 nt, Homo sapiens
gcuacuacauguucaucga

SEQ ID NO: 1552768 - RNA, 19 nt, Homo sapiens
caacucugguggcccucua

SEQ ID NO: 1552769 - RNA, 19 nt, Homo sapiens
gaagcacccgccucucuau

SEQ ID NO: 1552770 - RNA, 19 nt, Homo sapiens
ggcaugugcuggucucugu

SEQ ID NO: 1552771 - RNA, 19 nt, Homo sapiens
cagaggaccuuccaaucca

SEQ ID NO: 1552772 - RNA, 19 nt, Homo sapiens
guccagcccuguucuguag

SEQ ID NO: 1552773 - RNA, 19 nt, Homo sapiens
gggcaggagugugugcaaa

SEQ ID NO: 1552774 - RNA, 19 nt, Homo sapiens
ccugagggcuacuacaugu

SEQ ID NO: 1552775 - RNA, 19 nt, Homo sapiens
gugcucaacuacagacuca

SEQ ID NO: 1552776 - RNA, 19 nt, Homo sapiens
guaccuggaugagccaaug

SEQ ID NO: 1552777 - RNA, 19 nt, Homo sapiens
cagguacgguggaccaaga

SEQ ID NO: 1552778 - RNA, 19 nt, Homo sapiens
gugcucauccucuugguuu

SEQ ID NO: 1552779 - RNA, 19 nt, Homo sapiens
ggucacacagcuaguuuga

SEQ ID NO: 1552780 - RNA, 19 nt, Homo sapiens
gaagagagcagucagcauu

SEQ ID NO: 1552781 - RNA, 19 nt, Homo sapiens
uaacagcaguggaauaugu

SEQ ID NO: 1552782 - RNA, 19 nt, Homo sapiens
guaggaagaugguugaguu

SEQ ID NO: 1552783 - RNA, 19 nt, Homo sapiens
cauccaaguuuaugaauga

SEQ ID NO: 1552784 - RNA, 19 nt, Homo sapiens
gagaguguccucagaaauu

SEQ ID NO: 1552785 - RNA, 19 nt, Homo sapiens
gaagaugguugaguugguu

SEQ ID NO: 1552786 - RNA, 19 nt, Homo sapiens
gggaggagcugaguauguu

SEQ ID NO: 1552787 - RNA, 19 nt, Homo sapiens
uggaugacuuugagauuua

SEQ ID NO: 1552788 - RNA, 19 nt, Homo sapiens
acaaggaacucaaaagaua

SEQ ID NO: 1552789 - RNA, 19 nt, Homo sapiens
guauuugccuauauuguga

SEQ ID NO: 1552790 - RNA, 19 nt, Homo sapiens
gcagugaguuucuguucug

SEQ ID NO: 1552791 - RNA, 19 nt, Homo sapiens
cagaaaugcuggagagugu

SEQ ID NO: 1552792 - RNA, 19 nt, Homo sapiens
gaaaccagcuaugugaaag

SEQ ID NO: 1552793 - RNA, 19 nt, Homo sapiens
gaaauugccaggacuucuu

SEQ ID NO: 1552794 - RNA, 19 nt, Homo sapiens
ccagggagccggucacaaa

SEQ ID NO: 1552795 - RNA, 19 nt, Homo sapiens
cauaauaacagcaguggaa

SEQ ID NO: 1552796 - RNA, 19 nt, Homo sapiens
gggacaggcugacaaguag

SEQ ID NO: 1552797 - RNA, 19 nt, Homo sapiens
ucacacauagugcuguuua

SEQ ID NO: 1552798 - RNA, 19 nt, Homo sapiens
gugaaaguccugcaccaua

SEQ ID NO: 1552799 - RNA, 19 nt, Homo sapiens
gaggagcauugaaggagaa

SEQ ID NO: 1552800 - RNA, 19 nt, Homo sapiens
ccaagggcccucauugaaa

SEQ ID NO: 1552801 - RNA, 19 nt, Homo sapiens
ggacuucuuucccgugauc

SEQ ID NO: 1552802 - RNA, 19 nt, Homo sapiens
gugaguuucuguucuguug

SEQ ID NO: 1552803 - RNA, 19 nt, Homo sapiens
ggaagaugguugaguuggu

SEQ ID NO: 1552804 - RNA, 19 nt, Homo sapiens
gcauccaaguuuaugaaug

SEQ ID NO: 1552805 - RNA, 19 nt, Homo sapiens
gagaaccucacauuuccua

SEQ ID NO: 1552806 - RNA, 19 nt, Homo sapiens
cagcaaagccuccgaguac

SEQ ID NO: 1552807 - RNA, 19 nt, Homo sapiens
gcacugcaagccugaagaa

SEQ ID NO: 1552808 - RNA, 19 nt, Homo sapiens
gcagucagcauucuuagca

SEQ ID NO: 1552809 - RNA, 19 nt, Homo sapiens
gagagagggagaagaguga

SEQ ID NO: 1552810 - RNA, 19 nt, Homo sapiens
caagggcccucauugaaac

SEQ ID NO: 1552811 - RNA, 19 nt, Homo sapiens
gauaaucguccuggccaua

SEQ ID NO: 1552812 - RNA, 19 nt, Homo sapiens
gcaaagccuccgaguacuu

SEQ ID NO: 1552813 - RNA, 19 nt, Homo sapiens
gcagcaaucaguaggaaga

SEQ ID NO: 1552814 - RNA, 19 nt, Homo sapiens
gugaacgaauuagcaguaa

SEQ ID NO: 1552815 - RNA, 19 nt, Homo sapiens
ugaaaguccugcaccauac

SEQ ID NO: 1552816 - RNA, 19 nt, Homo sapiens
acacauagugcuguuuaua

SEQ ID NO: 1552817 - RNA, 19 nt, Homo sapiens
gaacgaauuagcaguaaaa

SEQ ID NO: 1552818 - RNA, 19 nt, Homo sapiens
uaauaacagcaguggaaua

SEQ ID NO: 1552819 - RNA, 19 nt, Homo sapiens
gcccauuccugccucuuug

SEQ ID NO: 1552820 - RNA, 19 nt, Homo sapiens
uaacaaaugguuggaugaa

SEQ ID NO: 1552821 - RNA, 19 nt, Homo sapiens
guggagaaccucacauuuc

SEQ ID NO: 1552822 - RNA, 19 nt, Homo sapiens
ugguugaguugguucauuu

SEQ ID NO: 1552823 - RNA, 19 nt, Homo sapiens
ccuauauugugaacgaauu

SEQ ID NO: 1552824 - RNA, 19 nt, Homo sapiens
ggaugacuuugagauuuau

SEQ ID NO: 1552825 - RNA, 19 nt, Homo sapiens
ugaaaccagcuaugugaaa

SEQ ID NO: 1552826 - RNA, 19 nt, Homo sapiens
ccuuauaccucagucuauu

SEQ ID NO: 1552827 - RNA, 19 nt, Homo sapiens
gaguuucuguucuguugga

SEQ ID NO: 1552828 - RNA, 19 nt, Homo sapiens
gcuggagaguguccucaga

SEQ ID NO: 1552829 - RNA, 19 nt, Homo sapiens
ggucacaaaggcagaaaug

SEQ ID NO: 1552830 - RNA, 19 nt, Homo sapiens
ugaacgaauuagcaguaaa

SEQ ID NO: 1552831 - RNA, 19 nt, Homo sapiens
uuggaugacuuugagauuu

SEQ ID NO: 1552832 - RNA, 19 nt, Homo sapiens
gguggagaaccucacauuu

SEQ ID NO: 1552833 - RNA, 19 nt, Homo sapiens
acaaaugguuggaugaacu

SEQ ID NO: 1552834 - RNA, 19 nt, Homo sapiens
uggagaguguccucagaaa

SEQ ID NO: 1552835 - RNA, 19 nt, Homo sapiens
aauaacagcaguggaauau

SEQ ID NO: 1552836 - RNA, 19 nt, Homo sapiens
gagcauugaaggagaagau

SEQ ID NO: 1552837 - RNA, 19 nt, Homo sapiens
uggaauuguucaaauguuc

SEQ ID NO: 1552838 - RNA, 19 nt, Homo sapiens
uccacugccucgugugaua

SEQ ID NO: 1552839 - RNA, 19 nt, Homo sapiens
caaagccuccgaguacuug

SEQ ID NO: 1552840 - RNA, 19 nt, Homo sapiens
agaguguccucagaaauug

SEQ ID NO: 1552841 - RNA, 19 nt, Homo sapiens
ggagaguguccucagaaau

SEQ ID NO: 1552842 - RNA, 19 nt, Homo sapiens
cacauagugcuguuuauau

SEQ ID NO: 1552843 - RNA, 19 nt, Homo sapiens
agagcagucagcauucuua

SEQ ID NO: 1552844 - RNA, 19 nt, Homo sapiens
accaucaacuacacucuuu

SEQ ID NO: 1552845 - RNA, 19 nt, Homo sapiens
auaccucagucuauuaugu

SEQ ID NO: 1552846 - RNA, 19 nt, Homo sapiens
guuaauucuugccuuauac

SEQ ID NO: 1552847 - RNA, 19 nt, Homo sapiens
gcaugaacgggcuuugaga

SEQ ID NO: 1552848 - RNA, 19 nt, Homo sapiens
aaagaucgguggagaaccu

SEQ ID NO: 1552849 - RNA, 19 nt, Homo sapiens
gaaaguccugcaccauaca

SEQ ID NO: 1552850 - RNA, 19 nt, Homo sapiens
cgaauuagcaguaaaauac

SEQ ID NO: 1552851 - RNA, 19 nt, Homo sapiens
caaaugguuggaugaacuu

SEQ ID NO: 1552852 - RNA, 19 nt, Homo sapiens
uuucuguucuguuggauga

SEQ ID NO: 1552853 - RNA, 19 nt, Homo sapiens
gccuccagcuucucgacua

SEQ ID NO: 1552854 - RNA, 19 nt, Homo sapiens
gguccaagggcccucauug

SEQ ID NO: 1552855 - RNA, 19 nt, Homo sapiens
gggcgacaaucaggucaug

SEQ ID NO: 1552856 - RNA, 19 nt, Homo sapiens
gcaguaaaauacaugauac

SEQ ID NO: 1552857 - RNA, 19 nt, Homo sapiens
cagcauccaaguuuaugaa

SEQ ID NO: 1552858 - RNA, 19 nt, Homo sapiens
cgacuaccaucaacuacac

SEQ ID NO: 1552859 - RNA, 19 nt, Homo sapiens
guacuugcagcuggucuuu

SEQ ID NO: 1552860 - RNA, 19 nt, Homo sapiens
guccaagggcccucauuga

SEQ ID NO: 1552861 - RNA, 19 nt, Homo sapiens
gcacuggaggagcauugaa

SEQ ID NO: 1552862 - RNA, 19 nt, Homo sapiens
aagcagcaaucaguaggaa

SEQ ID NO: 1552863 - RNA, 19 nt, Homo sapiens
ucagcaaagccuccgagua

SEQ ID NO: 1552864 - RNA, 19 nt, Homo sapiens
uaccucagucuauuaugua

SEQ ID NO: 1552865 - RNA, 19 nt, Homo sapiens
ugugaacgaauuagcagua

SEQ ID NO: 1552866 - RNA, 19 nt, Homo sapiens
uguuggaauuguucaaaug

SEQ ID NO: 1552867 - RNA, 19 nt, Homo sapiens
cuuauaccucagucuauua

SEQ ID NO: 1552868 - RNA, 19 nt, Homo sapiens
gcaccauacacuaaagauc

SEQ ID NO: 1552869 - RNA, 19 nt, Homo sapiens
guccugcaccauacacuaa

SEQ ID NO: 1552870 - RNA, 19 nt, Homo sapiens
cccgugaucuucagcaaag

SEQ ID NO: 1552871 - RNA, 19 nt, Homo sapiens
ucagcauucuuagcaguga

SEQ ID NO: 1552872 - RNA, 19 nt, Homo sapiens
uccaagggcccucauugaa

SEQ ID NO: 1552873 - RNA, 19 nt, Homo sapiens
uggagaaccucacauuucc

SEQ ID NO: 1552874 - RNA, 19 nt, Homo sapiens
uaaucguccuggccauaau

SEQ ID NO: 1552875 - RNA, 19 nt, Homo sapiens
ucaguaggaagaugguuga

SEQ ID NO: 1552876 - RNA, 19 nt, Homo sapiens
ucucgacuaccaucaacua

SEQ ID NO: 1552877 - RNA, 19 nt, Homo sapiens
ugaguauguuggagguguu

SEQ ID NO: 1552878 - RNA, 19 nt, Homo sapiens
aaucaggucaugcccaaga

SEQ ID NO: 1552879 - RNA, 19 nt, Homo sapiens
aaauugccaggacuucuuu

SEQ ID NO: 1552880 - RNA, 19 nt, Homo sapiens
ggacagcacugauggcuua

SEQ ID NO: 1552881 - RNA, 19 nt, Homo sapiens
ggucacagcuggccacuga

SEQ ID NO: 1552882 - RNA, 19 nt, Homo sapiens
ugaagcagcucucagcauu

SEQ ID NO: 1552883 - RNA, 19 nt, Homo sapiens
aaacaaagcagaugacaau

SEQ ID NO: 1552884 - RNA, 19 nt, Homo sapiens
gcacauggcacccacaguu

SEQ ID NO: 1552885 - RNA, 19 nt, Homo sapiens
ggauaaagcuggccuucag

SEQ ID NO: 1552886 - RNA, 19 nt, Homo sapiens
ggaagcugcucacaaaucu

SEQ ID NO: 1552887 - RNA, 19 nt, Homo sapiens
gcaaauagugaguucugua

SEQ ID NO: 1552888 - RNA, 19 nt, Homo sapiens
ggaggaccaucaggaaauu

SEQ ID NO: 1552889 - RNA, 19 nt, Homo sapiens
caagucauaucuacagaau

SEQ ID NO: 1552890 - RNA, 19 nt, Homo sapiens
gggcucauacuucuuauaa

SEQ ID NO: 1552891 - RNA, 19 nt, Homo sapiens
gaagagggaccuacugauc

SEQ ID NO: 1552892 - RNA, 19 nt, Homo sapiens
caaauagugaguucuguaa

SEQ ID NO: 1552893 - RNA, 19 nt, Homo sapiens
acacuucaguuuacuauca

SEQ ID NO: 1552894 - RNA, 19 nt, Homo sapiens
ugagaaauuugucaccuau

SEQ ID NO: 1552895 - RNA, 19 nt, Homo sapiens
agucauaucuacagaaugu

SEQ ID NO: 1552896 - RNA, 19 nt, Homo sapiens
gaacagggaguagugagaa

SEQ ID NO: 1552897 - RNA, 19 nt, Homo sapiens
ccaccaggauaucuacauu

SEQ ID NO: 1552898 - RNA, 19 nt, Homo sapiens
gggacucaaugaucuaaga

SEQ ID NO: 1552899 - RNA, 19 nt, Homo sapiens
gcaaggagguccgaguucu

SEQ ID NO: 1552900 - RNA, 19 nt, Homo sapiens
augcggagcuguucaagaa

SEQ ID NO: 1552901 - RNA, 19 nt, Homo sapiens
uaaagaaccaacccaguga

SEQ ID NO: 1552902 - RNA, 19 nt, Homo sapiens
ucaacaggcucaccaacug

SEQ ID NO: 1552903 - RNA, 19 nt, Homo sapiens
gugaggagcugccugacau

SEQ ID NO: 1552904 - RNA, 19 nt, Homo sapiens
aauauaaacuggguggauu

SEQ ID NO: 1552905 - RNA, 19 nt, Homo sapiens
ggagaccauuuuauguuua

SEQ ID NO: 1552906 - RNA, 19 nt, Homo sapiens
gaucaggccaugggacuuu

SEQ ID NO: 1552907 - RNA, 19 nt, Homo sapiens
ggucaucuuuccggauaaa

SEQ ID NO: 1552908 - RNA, 19 nt, Homo sapiens
gggcaggaguguccagcaa

SEQ ID NO: 1552909 - RNA, 19 nt, Homo sapiens
ucaccuauuucacaagaau

SEQ ID NO: 1552910 - RNA, 19 nt, Homo sapiens
gagcaaggagguccgaguu

SEQ ID NO: 1552911 - RNA, 19 nt, Homo sapiens
gggcaacacgcauuaacaa

SEQ ID NO: 1552912 - RNA, 19 nt, Homo sapiens
gaacuacugguuagaaggu

SEQ ID NO: 1552913 - RNA, 19 nt, Homo sapiens
cacaagaggcaaauaguga

SEQ ID NO: 1552914 - RNA, 19 nt, Homo sapiens
aaaugcagcugcuccaagu

SEQ ID NO: 1552915 - RNA, 19 nt, Homo sapiens
gccuaagccucaacaacuu

SEQ ID NO: 1552916 - RNA, 19 nt, Homo sapiens
gggagaccauuuuauguuu

SEQ ID NO: 1552917 - RNA, 19 nt, Homo sapiens
gugcugugauucauguuug

SEQ ID NO: 1552918 - RNA, 19 nt, Homo sapiens
gaaugacgcagcccagcaa

SEQ ID NO: 1552919 - RNA, 19 nt, Homo sapiens
cuaagacacagcaaacaaa

SEQ ID NO: 1552920 - RNA, 19 nt, Homo sapiens
gcagcucagugacaaagag

SEQ ID NO: 1552921 - RNA, 19 nt, Homo sapiens
gcuucggccucuugagaaa

SEQ ID NO: 1552922 - RNA, 19 nt, Homo sapiens
ggaacagggaguagugaga

SEQ ID NO: 1552923 - RNA, 19 nt, Homo sapiens
guagacagaauaaacaagu

SEQ ID NO: 1552924 - RNA, 19 nt, Homo sapiens
agagggaccuacugaucaa

SEQ ID NO: 1552925 - RNA, 19 nt, Homo sapiens
acggucaucuuuccggaua

SEQ ID NO: 1552926 - RNA, 19 nt, Homo sapiens
ucgguuggcuccucuggaa

SEQ ID NO: 1552927 - RNA, 19 nt, Homo sapiens
ggcuuggcauaauuucaua

SEQ ID NO: 1552928 - RNA, 19 nt, Homo sapiens
gauggcaacaccaacaaga

SEQ ID NO: 1552929 - RNA, 19 nt, Homo sapiens
gugaagagggaccuacuga

SEQ ID NO: 1552930 - RNA, 19 nt, Homo sapiens
ugaaagagcuaaaagaacu

SEQ ID NO: 1552931 - RNA, 19 nt, Homo sapiens
gcaggaguguccagcaaaa

SEQ ID NO: 1552932 - RNA, 19 nt, Homo sapiens
ccacaagaggcaaauagug

SEQ ID NO: 1552933 - RNA, 19 nt, Homo sapiens
cagcccagcaacaaauaua

SEQ ID NO: 1552934 - RNA, 19 nt, Homo sapiens
gguggcauccucccagauu

SEQ ID NO: 1552935 - RNA, 19 nt, Homo sapiens
cuaaaacucuggaaaaucu

SEQ ID NO: 1552936 - RNA, 19 nt, Homo sapiens
gaucuaagacacagcaaac

SEQ ID NO: 1552937 - RNA, 19 nt, Homo sapiens
ugucaccuauuucacaaga

SEQ ID NO: 1552938 - RNA, 19 nt, Homo sapiens
cagagcagcugacccucau

SEQ ID NO: 1552939 - RNA, 19 nt, Homo sapiens
ggaguagugagaagacgaa

SEQ ID NO: 1552940 - RNA, 19 nt, Homo sapiens
uucuguaaauggagacuua

SEQ ID NO: 1552941 - RNA, 19 nt, Homo sapiens
auagugaguucuguaaaug

SEQ ID NO: 1552942 - RNA, 19 nt, Homo sapiens
ggccuugauucuacucaga

SEQ ID NO: 1552943 - RNA, 19 nt, Homo sapiens
uugagaaauuugucaccua

SEQ ID NO: 1552944 - RNA, 19 nt, Homo sapiens
gguccgaguucugcaggaa

SEQ ID NO: 1552945 - RNA, 19 nt, Homo sapiens
caauaggucagcuacacaa

SEQ ID NO: 1552946 - RNA, 19 nt, Homo sapiens
gcccagcaacaaauauaaa

SEQ ID NO: 1552947 - RNA, 19 nt, Homo sapiens
aaacaagucauaucuacag

SEQ ID NO: 1552948 - RNA, 19 nt, Homo sapiens
gucaggcacucacaguaga

SEQ ID NO: 1552949 - RNA, 19 nt, Homo sapiens
uguagggacucaaugaucu

SEQ ID NO: 1552950 - RNA, 19 nt, Homo sapiens
ugucgugggucuguaaaga

SEQ ID NO: 1552951 - RNA, 19 nt, Homo sapiens
ugacaaagagagcuacaag

SEQ ID NO: 1552952 - RNA, 19 nt, Homo sapiens
ccuacuggcucugucuuga

SEQ ID NO: 1552953 - RNA, 19 nt, Homo sapiens
gcacucacaguagacagaa

SEQ ID NO: 1552954 - RNA, 19 nt, Homo sapiens
uaaacaaagcagaugacaa

SEQ ID NO: 1552955 - RNA, 19 nt, Homo sapiens
cuguaucacucacuguuug

SEQ ID NO: 1552956 - RNA, 19 nt, Homo sapiens
guagggacucaaugaucua

SEQ ID NO: 1552957 - RNA, 19 nt, Homo sapiens
gaggagcugccugacauga

SEQ ID NO: 1552958 - RNA, 19 nt, Homo sapiens
ugacgcagcccagcaacaa

SEQ ID NO: 1552959 - RNA, 19 nt, Homo sapiens
gggcuuggcauaauuucau

SEQ ID NO: 1552960 - RNA, 19 nt, Homo sapiens
gaagcagcucucagcauuc

SEQ ID NO: 1552961 - RNA, 19 nt, Homo sapiens
cagggaaccacaucuagga

SEQ ID NO: 1552962 - RNA, 19 nt, Homo sapiens
gagaaauuugucaccuauu

SEQ ID NO: 1552963 - RNA, 19 nt, Homo sapiens
ggaaaugcagcugcuccaa

SEQ ID NO: 1552964 - RNA, 19 nt, Homo sapiens
gcuaaaagaacucugcaaa

SEQ ID NO: 1552965 - RNA, 19 nt, Homo sapiens
gcagcugacccucauggau

SEQ ID NO: 1552966 - RNA, 19 nt, Homo sapiens
accaggauaucuacauuca

SEQ ID NO: 1552967 - RNA, 19 nt, Homo sapiens
ccacaggcccacucagaca

SEQ ID NO: 1552968 - RNA, 19 nt, Homo sapiens
ccugggacuuuaucacugu

SEQ ID NO: 1552969 - RNA, 19 nt, Homo sapiens
agaggcaaauagugaguuc

SEQ ID NO: 1552970 - RNA, 19 nt, Homo sapiens
cagcaacaaauauaaacug

SEQ ID NO: 1552971 - RNA, 19 nt, Homo sapiens
acucacaguagacagaaua

SEQ ID NO: 1552972 - RNA, 19 nt, Homo sapiens
uaagacacagcaaacaaag

SEQ ID NO: 1552973 - RNA, 19 nt, Homo sapiens
uaaagcuggccuucaggaa

SEQ ID NO: 1552974 - RNA, 19 nt, Homo sapiens
ucuaagacacagcaaacaa

SEQ ID NO: 1552975 - RNA, 19 nt, Homo sapiens
acacauagaaaccaagucu

SEQ ID NO: 1552976 - RNA, 19 nt, Homo sapiens
caccagggaaccacaucua

SEQ ID NO: 1552977 - RNA, 19 nt, Homo sapiens
gggauuuucugacugaguu

SEQ ID NO: 1552978 - RNA, 19 nt, Homo sapiens
caacgaggccaagccagau

SEQ ID NO: 1552979 - RNA, 19 nt, Homo sapiens
gaucuggagcuuugaugag

SEQ ID NO: 1552980 - RNA, 19 nt, Homo sapiens
ggucagaauuccuccuuua

SEQ ID NO: 1552981 - RNA, 19 nt, Homo sapiens
gaggagaauugguuaggua

SEQ ID NO: 1552982 - RNA, 19 nt, Homo sapiens
gaggaucgguaaccaacua

SEQ ID NO: 1552983 - RNA, 19 nt, Homo sapiens
ugacauaaguauagaccua

SEQ ID NO: 1552984 - RNA, 19 nt, Homo sapiens
aaauacaggugucucuuaa

SEQ ID NO: 1552985 - RNA, 19 nt, Homo sapiens
gugaauguuuguaccguua

SEQ ID NO: 1552986 - RNA, 19 nt, Homo sapiens
gaaacucuauacccaugaa

SEQ ID NO: 1552987 - RNA, 19 nt, Homo sapiens
gaauguuuguaccguuaua

SEQ ID NO: 1552988 - RNA, 19 nt, Homo sapiens
acaggugucucuuaaauau

SEQ ID NO: 1552989 - RNA, 19 nt, Homo sapiens
guagagaguggaaccaaua

SEQ ID NO: 1552990 - RNA, 19 nt, Homo sapiens
gaaaaccacuguucuacuu

SEQ ID NO: 1552991 - RNA, 19 nt, Homo sapiens
gagccuagaugaguuauag

SEQ ID NO: 1552992 - RNA, 19 nt, Homo sapiens
acacuuggguuacuucuau

SEQ ID NO: 1552993 - RNA, 19 nt, Homo sapiens
ggucuagagccaugaaaua

SEQ ID NO: 1552994 - RNA, 19 nt, Homo sapiens
gaagugaaauguuuuguuc

SEQ ID NO: 1552995 - RNA, 19 nt, Homo sapiens
gauuccagcuuuguaguaa

SEQ ID NO: 1552996 - RNA, 19 nt, Homo sapiens
gguuagguaucgauguaua

SEQ ID NO: 1552997 - RNA, 19 nt, Homo sapiens
gguaugggguguacaaaua

SEQ ID NO: 1552998 - RNA, 19 nt, Homo sapiens
gagaguaugcucccacuga

SEQ ID NO: 1552999 - RNA, 19 nt, Homo sapiens
ggcauuaaguaccuucaaa

SEQ ID NO: 1553000 - RNA, 19 nt, Homo sapiens
guagagagugacauaagua

SEQ ID NO: 1553001 - RNA, 19 nt, Homo sapiens
cagauucacgcauauuaua

SEQ ID NO: 1553002 - RNA, 19 nt, Homo sapiens
cacaugaucuaucugaaga

SEQ ID NO: 1553003 - RNA, 19 nt, Homo sapiens
uuugugagauguagaauga

SEQ ID NO: 1553004 - RNA, 19 nt, Homo sapiens
uauacgaugugucagaauu

SEQ ID NO: 1553005 - RNA, 19 nt, Homo sapiens
ucauucccauuguuucuua

SEQ ID NO: 1553006 - RNA, 19 nt, Homo sapiens
gagagugacauaaguauag

SEQ ID NO: 1553007 - RNA, 19 nt, Homo sapiens
aggcauaguuucagaguug

SEQ ID NO: 1553008 - RNA, 19 nt, Homo sapiens
ccauccaucuccagaauga

SEQ ID NO: 1553009 - RNA, 19 nt, Homo sapiens
ccacuguucuacuucugua

SEQ ID NO: 1553010 - RNA, 19 nt, Homo sapiens
ggguuucgauuccagcuuu

SEQ ID NO: 1553011 - RNA, 19 nt, Homo sapiens
gaugaguuauagagaguau

SEQ ID NO: 1553012 - RNA, 19 nt, Homo sapiens
auacaggugucucuuaaau

SEQ ID NO: 1553013 - RNA, 19 nt, Homo sapiens
gauggaaccugggcaaugg

SEQ ID NO: 1553014 - RNA, 19 nt, Homo sapiens
gucccaagcugaaacucua

SEQ ID NO: 1553015 - RNA, 19 nt, Homo sapiens
ugaguuuacugacagcauu

SEQ ID NO: 1553016 - RNA, 19 nt, Homo sapiens
gaucgguaaccaacuauug

SEQ ID NO: 1553017 - RNA, 19 nt, Homo sapiens
ggaugaggagaauugguua

SEQ ID NO: 1553018 - RNA, 19 nt, Homo sapiens
gucagaauuuccuuccuuu

SEQ ID NO: 1553019 - RNA, 19 nt, Homo sapiens
uuacauugcucacgauuuu

SEQ ID NO: 1553020 - RNA, 19 nt, Homo sapiens
gugauuaacuggugguuuu

SEQ ID NO: 1553021 - RNA, 19 nt, Homo sapiens
gggaggaugaggagaauug

SEQ ID NO: 1553022 - RNA, 19 nt, Homo sapiens
cauauuauacgauguguca

SEQ ID NO: 1553023 - RNA, 19 nt, Homo sapiens
gcacaugaucuaucugaag

SEQ ID NO: 1553024 - RNA, 19 nt, Homo sapiens
cgauguauauuucgaggau

SEQ ID NO: 1553025 - RNA, 19 nt, Homo sapiens
uuucagaguugccgcauau

SEQ ID NO: 1553026 - RNA, 19 nt, Homo sapiens
cauauaaguggaacuauuc

SEQ ID NO: 1553027 - RNA, 19 nt, Homo sapiens
aaaggcacaugaucuaucu

SEQ ID NO: 1553028 - RNA, 19 nt, Homo sapiens
aaacaaugccagucaaauc

SEQ ID NO: 1553029 - RNA, 19 nt, Homo sapiens
gauguagaaugaauuagcu

SEQ ID NO: 1553030 - RNA, 19 nt, Homo sapiens
gagaauugguuagguaucg

SEQ ID NO: 1553031 - RNA, 19 nt, Homo sapiens
uaucuuccuucuaugugua

SEQ ID NO: 1553032 - RNA, 19 nt, Homo sapiens
gaaccaauagauacaugga

SEQ ID NO: 1553033 - RNA, 19 nt, Homo sapiens
gagaguggaaccaauagau

SEQ ID NO: 1553034 - RNA, 19 nt, Homo sapiens
uaugcgaauuugcuaugua

SEQ ID NO: 1553035 - RNA, 19 nt, Homo sapiens
ucuaaaggcacaugaucua

SEQ ID NO: 1553036 - RNA, 19 nt, Homo sapiens
caccauccaucuccagaau

SEQ ID NO: 1553037 - RNA, 19 nt, Homo sapiens
uguaguaacagaagugaaa

SEQ ID NO: 1553038 - RNA, 19 nt, Homo sapiens
guaaccaacuauugcaaac

SEQ ID NO: 1553039 - RNA, 19 nt, Homo sapiens
gcauuaaguaccuucaaau

SEQ ID NO: 1553040 - RNA, 19 nt, Homo sapiens
gguaggcauuggucagaau

SEQ ID NO: 1553041 - RNA, 19 nt, Homo sapiens
guagugagccuagaugagu

SEQ ID NO: 1553042 - RNA, 19 nt, Homo sapiens
gguaaccaacuauugcaaa

SEQ ID NO: 1553043 - RNA, 19 nt, Homo sapiens
agaguggaaccaauagaua

SEQ ID NO: 1553044 - RNA, 19 nt, Homo sapiens
ugucagaauuuccuuccuu

SEQ ID NO: 1553045 - RNA, 19 nt, Homo sapiens
aaguggaacuauucgauug

SEQ ID NO: 1553046 - RNA, 19 nt, Homo sapiens
uaaguggaacuauucgauu

SEQ ID NO: 1553047 - RNA, 19 nt, Homo sapiens
cgaauuugcuauguaccuu

SEQ ID NO: 1553048 - RNA, 19 nt, Homo sapiens
agcauuguguauuguguua

SEQ ID NO: 1553049 - RNA, 19 nt, Homo sapiens
uagaugaguuauagagagu

SEQ ID NO: 1553050 - RNA, 19 nt, Homo sapiens
caauaucuuccuucuaugu

SEQ ID NO: 1553051 - RNA, 19 nt, Homo sapiens
uugguuagguaucgaugua

SEQ ID NO: 1553052 - RNA, 19 nt, Homo sapiens
ucgauuggcuugauuuacu

SEQ ID NO: 1553053 - RNA, 19 nt, Homo sapiens
ugacagcauuguguauugu

SEQ ID NO: 1553054 - RNA, 19 nt, Homo sapiens
caaugccagucaaaucugu

SEQ ID NO: 1553055 - RNA, 19 nt, Homo sapiens
ugugagauguagaaugaau

SEQ ID NO: 1553056 - RNA, 19 nt, Homo sapiens
ugucaugaauguagagagu

SEQ ID NO: 1553057 - RNA, 19 nt, Homo sapiens
uuacuuaggcauaguuuca

SEQ ID NO: 1553058 - RNA, 19 nt, Homo sapiens
uugcaaacccggcugcuuu

SEQ ID NO: 1553059 - RNA, 19 nt, Homo sapiens
cgauuggcuugauuuacuu

SEQ ID NO: 1553060 - RNA, 19 nt, Homo sapiens
cugacagcauuguguauug

SEQ ID NO: 1553061 - RNA, 19 nt, Homo sapiens
gguccuggcaucugcugua

SEQ ID NO: 1553062 - RNA, 19 nt, Homo sapiens
uguagagagugacauaagu

SEQ ID NO: 1553063 - RNA, 19 nt, Homo sapiens
uuggguuacuucuaucuuu

SEQ ID NO: 1553064 - RNA, 19 nt, Homo sapiens
ucagaauuccuccuuuaau

SEQ ID NO: 1553065 - RNA, 19 nt, Homo sapiens
gucagaauuccuccuuuaa

SEQ ID NO: 1553066 - RNA, 19 nt, Homo sapiens
uaaaggcacaugaucuauc

SEQ ID NO: 1553067 - RNA, 19 nt, Homo sapiens
gcuccagcuuguaguaaca

SEQ ID NO: 1553068 - RNA, 19 nt, Homo sapiens
agguaucgauguauauuuc

SEQ ID NO: 1553069 - RNA, 19 nt, Homo sapiens
uuacugacagcauugugua

SEQ ID NO: 1553070 - RNA, 19 nt, Homo sapiens
guucgaagugggaggauga

SEQ ID NO: 1553071 - RNA, 19 nt, Homo sapiens
aggugucucuuaaauaugu

SEQ ID NO: 1553072 - RNA, 19 nt, Homo sapiens
uacaggugucucuuaaaua

SEQ ID NO: 1553073 - RNA, 19 nt, Homo sapiens
gugcaaccaucuccaccau

SEQ ID NO: 1553074 - RNA, 19 nt, Homo sapiens
agagugacauaaguauaga

SEQ ID NO: 1553075 - RNA, 19 nt, Homo sapiens
agagagugacauaaguaua

SEQ ID NO: 1553076 - RNA, 19 nt, Homo sapiens
agaguugccgcauauggua

SEQ ID NO: 1553077 - RNA, 19 nt, Homo sapiens
gauuggcuugauuuacuua

SEQ ID NO: 1553078 - RNA, 19 nt, Homo sapiens
uaaacaaugccagucaaau

SEQ ID NO: 1553079 - RNA, 19 nt, Homo sapiens
uguaguaacagaagugaau

SEQ ID NO: 1553080 - RNA, 19 nt, Homo sapiens
gaauaucgauggacuuaaa

SEQ ID NO: 1553081 - RNA, 19 nt, Homo sapiens
gaagagauguagaauguag

SEQ ID NO: 1553082 - RNA, 19 nt, Homo sapiens
gaucaugacacuacuguua

SEQ ID NO: 1553083 - RNA, 19 nt, Homo sapiens
ucucagugcuuaauucuua

SEQ ID NO: 1553084 - RNA, 19 nt, Homo sapiens
gggcagagauggaugaaga

SEQ ID NO: 1553085 - RNA, 19 nt, Homo sapiens
ggacagaugcauacaguaa

SEQ ID NO: 1553086 - RNA, 19 nt, Homo sapiens
ccagugaucuauaaagaaa

SEQ ID NO: 1553087 - RNA, 19 nt, Homo sapiens
guagaaaggguuuaaguuu

SEQ ID NO: 1553088 - RNA, 19 nt, Homo sapiens
gacaucagcuuuacacuuc

SEQ ID NO: 1553089 - RNA, 19 nt, Homo sapiens
gaagcgaugcgauaagaua

SEQ ID NO: 1553090 - RNA, 19 nt, Homo sapiens
gcauguguauccagcguua

SEQ ID NO: 1553091 - RNA, 19 nt, Homo sapiens
uagaaaggguuuaaguuug

SEQ ID NO: 1553092 - RNA, 19 nt, Homo sapiens
ggauugagguuuacaaagg

SEQ ID NO: 1553093 - RNA, 19 nt, Homo sapiens
agagauggaugaagagaaa

SEQ ID NO: 1553094 - RNA, 19 nt, Homo sapiens
agagaaagcccacgaagaa

SEQ ID NO: 1553095 - RNA, 19 nt, Homo sapiens
gaggacagaugcauacagu

SEQ ID NO: 1553096 - RNA, 19 nt, Homo sapiens
gauagaagccaaauuugau

SEQ ID NO: 1553097 - RNA, 19 nt, Homo sapiens
uugaagagauguagaaugu

SEQ ID NO: 1553098 - RNA, 19 nt, Homo sapiens
gaaggcagaacccaagaaa

SEQ ID NO: 1553099 - RNA, 19 nt, Homo sapiens
gauguagaauguagcaaau

SEQ ID NO: 1553100 - RNA, 19 nt, Homo sapiens
gguuuaaguuugcuuguau

SEQ ID NO: 1553101 - RNA, 19 nt, Homo sapiens
ugaggaagauugcaaugga

SEQ ID NO: 1553102 - RNA, 19 nt, Homo sapiens
ccagcucgauucaaauuug

SEQ ID NO: 1553103 - RNA, 19 nt, Homo sapiens
cagaagcgaugcgauaaga

SEQ ID NO: 1553104 - RNA, 19 nt, Homo sapiens
gugagccagugaucuauaa

SEQ ID NO: 1553105 - RNA, 19 nt, Homo sapiens
guuagcagaugcgaaguaa

SEQ ID NO: 1553106 - RNA, 19 nt, Homo sapiens
cagaauaucgauggacuua

SEQ ID NO: 1553107 - RNA, 19 nt, Homo sapiens
gaagaaccaauccaagugu

SEQ ID NO: 1553108 - RNA, 19 nt, Homo sapiens
ggagauugauggcauugag

SEQ ID NO: 1553109 - RNA, 19 nt, Homo sapiens
caaaggguguuagcagaug

SEQ ID NO: 1553110 - RNA, 19 nt, Homo sapiens
caauggagaucaugacacu

SEQ ID NO: 1553111 - RNA, 19 nt, Homo sapiens
gcgaugcgauaagauagaa

SEQ ID NO: 1553112 - RNA, 19 nt, Homo sapiens
ggguuuaaguuugcuugua

SEQ ID NO: 1553113 - RNA, 19 nt, Homo sapiens
uaacgcagacaucagcuuu

SEQ ID NO: 1553114 - RNA, 19 nt, Homo sapiens
ucacugaagcuaauguuug

SEQ ID NO: 1553115 - RNA, 19 nt, Homo sapiens
gaaacccauucaucacaca

SEQ ID NO: 1553116 - RNA, 19 nt, Homo sapiens
ucgagagccugccuaauuc

SEQ ID NO: 1553117 - RNA, 19 nt, Homo sapiens
ugacacuacuguuaauaag

SEQ ID NO: 1553118 - RNA, 19 nt, Homo sapiens
gaggauugagguuuacaaa

SEQ ID NO: 1553119 - RNA, 19 nt, Homo sapiens
gagaaagcccacgaagaaa

SEQ ID NO: 1553120 - RNA, 19 nt, Homo sapiens
gcagaugcgaaguaaagaa

SEQ ID NO: 1553121 - RNA, 19 nt, Homo sapiens
gaagccaaauuugauaagg

SEQ ID NO: 1553122 - RNA, 19 nt, Homo sapiens
uguauuagcugugccuuca

SEQ ID NO: 1553123 - RNA, 19 nt, Homo sapiens
uaaguuugcuuguauuagc

SEQ ID NO: 1553124 - RNA, 19 nt, Homo sapiens
ccccaaauauguuuaagua

SEQ ID NO: 1553125 - RNA, 19 nt, Homo sapiens
uauuagcugugccuucauu

SEQ ID NO: 1553126 - RNA, 19 nt, Homo sapiens
agauagaagccaaauuuga

SEQ ID NO: 1553127 - RNA, 19 nt, Homo sapiens
agaaaggguuuaaguuugc

SEQ ID NO: 1553128 - RNA, 19 nt, Homo sapiens
ggaagaggaguacgaggau

SEQ ID NO: 1553129 - RNA, 19 nt, Homo sapiens
uagcugugccuucauuauu

SEQ ID NO: 1553130 - RNA, 19 nt, Homo sapiens
ucucuucucugaggauuga

SEQ ID NO: 1553131 - RNA, 19 nt, Homo sapiens
ugaagcuaauguuuggaaa

SEQ ID NO: 1553132 - RNA, 19 nt, Homo sapiens
uagcagaugcgaaguaaag

SEQ ID NO: 1553133 - RNA, 19 nt, Homo sapiens
ggccagcucgauucaaauu

SEQ ID NO: 1553134 - RNA, 19 nt, Homo sapiens
ucaugacacuacuguuaau

SEQ ID NO: 1553135 - RNA, 19 nt, Homo sapiens
acacuucacaggagauuga

SEQ ID NO: 1553136 - RNA, 19 nt, Homo sapiens
gauccuggccagcucgauu

SEQ ID NO: 1553137 - RNA, 19 nt, Homo sapiens
acgccgagaugccugauga

SEQ ID NO: 1553138 - RNA, 19 nt, Homo sapiens
gggaggaggaggaggaaga

SEQ ID NO: 1553139 - RNA, 19 nt, Homo sapiens
ugaagaaccaauccaagug

SEQ ID NO: 1553140 - RNA, 19 nt, Homo sapiens
ccauucaucacacagcaua

SEQ ID NO: 1553141 - RNA, 19 nt, Homo sapiens
cugaugacgccaagaagua

SEQ ID NO: 1553142 - RNA, 19 nt, Homo sapiens
aagccaaauuugauaagga

SEQ ID NO: 1553143 - RNA, 19 nt, Homo sapiens
cugcagaagcgaugcgaua

SEQ ID NO: 1553144 - RNA, 19 nt, Homo sapiens
uauccagcguuauguacuu

SEQ ID NO: 1553145 - RNA, 19 nt, Homo sapiens
agccaugacugaacacguu

SEQ ID NO: 1553146 - RNA, 19 nt, Homo sapiens
ucacacagcauacgcuaca

SEQ ID NO: 1553147 - RNA, 19 nt, Homo sapiens
agccaaauuugauaaggaa

SEQ ID NO: 1553148 - RNA, 19 nt, Homo sapiens
agccagugaucuauaaaga

SEQ ID NO: 1553149 - RNA, 19 nt, Homo sapiens
agcugugccuucauuauuu

SEQ ID NO: 1553150 - RNA, 19 nt, Homo sapiens
gauaagauagaagccaaau

SEQ ID NO: 1553151 - RNA, 19 nt, Homo sapiens
ccaagaaggaggguguaaa

SEQ ID NO: 1553152 - RNA, 19 nt, Homo sapiens
gagaucaugacacuacugu

SEQ ID NO: 1553153 - RNA, 19 nt, Homo sapiens
ggaauuucaggcucuggaa

SEQ ID NO: 1553154 - RNA, 19 nt, Homo sapiens
cuggccagcucgauucaaa

SEQ ID NO: 1553155 - RNA, 19 nt, Homo sapiens
agaaguagaaaggguuuaa

SEQ ID NO: 1553156 - RNA, 19 nt, Homo sapiens
caagaaggaggguguaaaa

SEQ ID NO: 1553157 - RNA, 19 nt, Homo sapiens
uucauggucucuucucuga

SEQ ID NO: 1553158 - RNA, 19 nt, Homo sapiens
cacugaagcuaauguuugg

SEQ ID NO: 1553159 - RNA, 19 nt, Homo sapiens
gaagauugcaauggagauc

SEQ ID NO: 1553160 - RNA, 19 nt, Homo sapiens
gcauugaggaagauugcaa

SEQ ID NO: 1553161 - RNA, 19 nt, Homo sapiens
agacaucagcuuuacacuu

SEQ ID NO: 1553162 - RNA, 19 nt, Homo sapiens
gcagagauggaugaagaga

SEQ ID NO: 1553163 - RNA, 19 nt, Homo sapiens
aaacaacaugguuccaaga

SEQ ID NO: 1553164 - RNA, 19 nt, Homo sapiens
gcagacaucagcuuuacac

SEQ ID NO: 1553165 - RNA, 19 nt, Homo sapiens
gagaaggcagaacccaaga

SEQ ID NO: 1553166 - RNA, 19 nt, Homo sapiens
gcagaagcgaugcgauaag

SEQ ID NO: 1553167 - RNA, 19 nt, Homo sapiens
acaggagauugauggcauu

SEQ ID NO: 1553168 - RNA, 19 nt, Homo sapiens
gaugcgaaguaaagaacgu

SEQ ID NO: 1553169 - RNA, 19 nt, Homo sapiens
gccagugaucuauaaagaa

SEQ ID NO: 1553170 - RNA, 19 nt, Homo sapiens
cacuuuaccuagcguuuua

SEQ ID NO: 1553171 - RNA, 19 nt, Homo sapiens
uuagagaaacaacaugguu

SEQ ID NO: 1553172 - RNA, 19 nt, Homo sapiens
cucugaggauugagguuua

SEQ ID NO: 1553173 - RNA, 19 nt, Homo sapiens
ggucucuucucugaggauu

SEQ ID NO: 1553174 - RNA, 19 nt, Homo sapiens
ugugugagccagugaucua

SEQ ID NO: 1553175 - RNA, 19 nt, Homo sapiens
augcauacaguaaggauuu

SEQ ID NO: 1553176 - RNA, 19 nt, Homo sapiens
cggcuucuccucuaacaug

SEQ ID NO: 1553177 - RNA, 19 nt, Homo sapiens
caugacacuacuguuaaua

SEQ ID NO: 1553178 - RNA, 19 nt, Homo sapiens
gaacacccaagccaugacu

SEQ ID NO: 1553179 - RNA, 19 nt, Homo sapiens
aucgagagccugccuaauu

SEQ ID NO: 1553180 - RNA, 19 nt, Homo sapiens
gaugauggcuguuggauuu

SEQ ID NO: 1553181 - RNA, 19 nt, Homo sapiens
gaacaagaauuucaguaug

SEQ ID NO: 1553182 - RNA, 19 nt, Homo sapiens
gcaaaccacuccuggcuuu

SEQ ID NO: 1553183 - RNA, 19 nt, Homo sapiens
caaaggccauuaugcauuu

SEQ ID NO: 1553184 - RNA, 19 nt, Homo sapiens
gguuacagcuaucagauua

SEQ ID NO: 1553185 - RNA, 19 nt, Homo sapiens
gaaugaaacucaagacauc

SEQ ID NO: 1553186 - RNA, 19 nt, Homo sapiens
gcugaugucugguuuauug

SEQ ID NO: 1553187 - RNA, 19 nt, Homo sapiens
gaaauucauugacuggaaa

SEQ ID NO: 1553188 - RNA, 19 nt, Homo sapiens
ggacauaucaauacaaaga

SEQ ID NO: 1553189 - RNA, 19 nt, Homo sapiens
aaagauguguguuggcuua

SEQ ID NO: 1553190 - RNA, 19 nt, Homo sapiens
caucagaggccguguguua

SEQ ID NO: 1553191 - RNA, 19 nt, Homo sapiens
ggaaauucauugacuggaa

SEQ ID NO: 1553192 - RNA, 19 nt, Homo sapiens
gaucaucgaggcuuuguuu

SEQ ID NO: 1553193 - RNA, 19 nt, Homo sapiens
caaguugucugccuuaagu

SEQ ID NO: 1553194 - RNA, 19 nt, Homo sapiens
ggaagagccuccucauucu

SEQ ID NO: 1553195 - RNA, 19 nt, Homo sapiens
gggaagagccuccucauuc

SEQ ID NO: 1553196 - RNA, 19 nt, Homo sapiens
cgacagcucuuccucugaa

SEQ ID NO: 1553197 - RNA, 19 nt, Homo sapiens
uugaagaacugaacaagaa

SEQ ID NO: 1553198 - RNA, 19 nt, Homo sapiens
gcaaaacucaucagauuua

SEQ ID NO: 1553199 - RNA, 19 nt, Homo sapiens
caguauagcugacaauauc

SEQ ID NO: 1553200 - RNA, 19 nt, Homo sapiens
guccaaggaugaugaauau

SEQ ID NO: 1553201 - RNA, 19 nt, Homo sapiens
gaacaaaagccaacucaaa

SEQ ID NO: 1553202 - RNA, 19 nt, Homo sapiens
gaaaugcucaggucaaugg

SEQ ID NO: 1553203 - RNA, 19 nt, Homo sapiens
ccugugauauccacgguua

SEQ ID NO: 1553204 - RNA, 19 nt, Homo sapiens
gaaucuggcuuggcauguu

SEQ ID NO: 1553205 - RNA, 19 nt, Homo sapiens
uaaaauggaucaccuaugu

SEQ ID NO: 1553206 - RNA, 19 nt, Homo sapiens
ccauauugaugucaccuuu

SEQ ID NO: 1553207 - RNA, 19 nt, Homo sapiens
ccagagaucccuuccagaa

SEQ ID NO: 1553208 - RNA, 19 nt, Homo sapiens
gaagaacugaacaagaauu

SEQ ID NO: 1553209 - RNA, 19 nt, Homo sapiens
gguccaaggaugaugaaua

SEQ ID NO: 1553210 - RNA, 19 nt, Homo sapiens
gaugucugguuuauuguug

SEQ ID NO: 1553211 - RNA, 19 nt, Homo sapiens
gaaagggauuccagugaac

SEQ ID NO: 1553212 - RNA, 19 nt, Homo sapiens
uggcuuaacugguccaaug

SEQ ID NO: 1553213 - RNA, 19 nt, Homo sapiens
aaucuggcuuggcauguua

SEQ ID NO: 1553214 - RNA, 19 nt, Homo sapiens
caaaagggguuacagcuau

SEQ ID NO: 1553215 - RNA, 19 nt, Homo sapiens
ucacaagcuguuuccauua

SEQ ID NO: 1553216 - RNA, 19 nt, Homo sapiens
aaacaaaggccauuaugca

SEQ ID NO: 1553217 - RNA, 19 nt, Homo sapiens
ugggugcccucucauuaua

SEQ ID NO: 1553218 - RNA, 19 nt, Homo sapiens
caagcuguuuccauuagaa

SEQ ID NO: 1553219 - RNA, 19 nt, Homo sapiens
uaagacagcccuucacaag

SEQ ID NO: 1553220 - RNA, 19 nt, Homo sapiens
aagcaaaacucaucagauu

SEQ ID NO: 1553221 - RNA, 19 nt, Homo sapiens
ucacauggcccagcauuug

SEQ ID NO: 1553222 - RNA, 19 nt, Homo sapiens
ggacuggguaucuccauug

SEQ ID NO: 1553223 - RNA, 19 nt, Homo sapiens
gcugccaccuagugaauga

SEQ ID NO: 1553224 - RNA, 19 nt, Homo sapiens
cagaaacuauuaucagcau

SEQ ID NO: 1553225 - RNA, 19 nt, Homo sapiens
uaaaauguguccccaaaau

SEQ ID NO: 1553226 - RNA, 19 nt, Homo sapiens
gacaauauccuuaauucag

SEQ ID NO: 1553227 - RNA, 19 nt, Homo sapiens
gguuaugggugcccucuca

SEQ ID NO: 1553228 - RNA, 19 nt, Homo sapiens
uaugggugcccucucauua

SEQ ID NO: 1553229 - RNA, 19 nt, Homo sapiens
guacucacuugaccuccuu

SEQ ID NO: 1553230 - RNA, 19 nt, Homo sapiens
cagaggccguguguuaauu

SEQ ID NO: 1553231 - RNA, 19 nt, Homo sapiens
ucaaugcauuccagggauu

SEQ ID NO: 1553232 - RNA, 19 nt, Homo sapiens
ggaacauucuacccguuuc

SEQ ID NO: 1553233 - RNA, 19 nt, Homo sapiens
cacaagcuguuuccauuag

SEQ ID NO: 1553234 - RNA, 19 nt, Homo sapiens
gaaaagcccaguguaauga

SEQ ID NO: 1553235 - RNA, 19 nt, Homo sapiens
ucucacacacgucguauuu

SEQ ID NO: 1553236 - RNA, 19 nt, Homo sapiens
cugacaauauccuuaauuc

SEQ ID NO: 1553237 - RNA, 19 nt, Homo sapiens
aaacaucacagccaagugu

SEQ ID NO: 1553238 - RNA, 19 nt, Homo sapiens
acaaaggccauuaugcauu

SEQ ID NO: 1553239 - RNA, 19 nt, Homo sapiens
agacagcccuucacaagcu

SEQ ID NO: 1553240 - RNA, 19 nt, Homo sapiens
caucguugcuggguaugaa

SEQ ID NO: 1553241 - RNA, 19 nt, Homo sapiens
gauugcugaugucugguuu

SEQ ID NO: 1553242 - RNA, 19 nt, Homo sapiens
ucacacacgucguauuugc

SEQ ID NO: 1553243 - RNA, 19 nt, Homo sapiens
cauuggaagucucauuuua

SEQ ID NO: 1553244 - RNA, 19 nt, Homo sapiens
gggaacauucuacccguuu

SEQ ID NO: 1553245 - RNA, 19 nt, Homo sapiens
ccaaggaugaugaauauac

SEQ ID NO: 1553246 - RNA, 19 nt, Homo sapiens
gggacuggguaucuccauu

SEQ ID NO: 1553247 - RNA, 19 nt, Homo sapiens
gugccaauguacucacuug

SEQ ID NO: 1553248 - RNA, 19 nt, Homo sapiens
ugucagccauugaacaugu

SEQ ID NO: 1553249 - RNA, 19 nt, Homo sapiens
ugacaaggccaccaucauc

SEQ ID NO: 1553250 - RNA, 19 nt, Homo sapiens
aaaggaaagauguguguug

SEQ ID NO: 1553251 - RNA, 19 nt, Homo sapiens
ugaccuccuucuccauauu

SEQ ID NO: 1553252 - RNA, 19 nt, Homo sapiens
cagcucuuccucugaauuu

SEQ ID NO: 1553253 - RNA, 19 nt, Homo sapiens
gguguccaauucaacaaug

SEQ ID NO: 1553254 - RNA, 19 nt, Homo sapiens
ugagcaauauuucaucucu

SEQ ID NO: 1553255 - RNA, 19 nt, Homo sapiens
ggaaacaucacagccaagu

SEQ ID NO: 1553256 - RNA, 19 nt, Homo sapiens
guauuugcauggugaacau

SEQ ID NO: 1553257 - RNA, 19 nt, Homo sapiens
agagaucccuuccagaaac

SEQ ID NO: 1553258 - RNA, 19 nt, Homo sapiens
ggaaaagcccaguguaaug

SEQ ID NO: 1553259 - RNA, 19 nt, Homo sapiens
gcugacaauauccuuaauu

SEQ ID NO: 1553260 - RNA, 19 nt, Homo sapiens
uagcugacaauauccuuaa

SEQ ID NO: 1553261 - RNA, 19 nt, Homo sapiens
uucacaagcuguuuccauu

SEQ ID NO: 1553262 - RNA, 19 nt, Homo sapiens
ucagucauuugcaguggaa

SEQ ID NO: 1553263 - RNA, 19 nt, Homo sapiens
ucaauggaccugugauauc

SEQ ID NO: 1553264 - RNA, 19 nt, Homo sapiens
gcugcuaguucucacaaag

SEQ ID NO: 1553265 - RNA, 19 nt, Homo sapiens
cuaccucucuuuguucuuc

SEQ ID NO: 1553266 - RNA, 19 nt, Homo sapiens
uuuccaagauagagucaaa

SEQ ID NO: 1553267 - RNA, 19 nt, Homo sapiens
gaagagccuccucauucug

SEQ ID NO: 1553268 - RNA, 19 nt, Homo sapiens
caaccuagcaauaccuaca

SEQ ID NO: 1553269 - RNA, 19 nt, Homo sapiens
gauauccacgguuauucaa

SEQ ID NO: 1553270 - RNA, 19 nt, Homo sapiens
caauggaccugugauaucc

SEQ ID NO: 1553271 - RNA, 19 nt, Homo sapiens
gcuaucagauuaaaaugug

SEQ ID NO: 1553272 - RNA, 19 nt, Homo sapiens
gcuaagacagcccuucaca

SEQ ID NO: 1553273 - RNA, 19 nt, Homo sapiens
cauuauaucugucauuacc

SEQ ID NO: 1553274 - RNA, 19 nt, Homo sapiens
cagagaucccuuccagaaa

SEQ ID NO: 1553275 - RNA, 19 nt, Homo sapiens
caauauuucaucucuguca

SEQ ID NO: 1553276 - RNA, 19 nt, Homo sapiens
acaguaagcugcgacaacu

SEQ ID NO: 1553277 - RNA, 19 nt, Homo sapiens
uugaacauguugccgagaa

SEQ ID NO: 1553278 - RNA, 19 nt, Homo sapiens
ugaaugaaacucaagacau

SEQ ID NO: 1553279 - RNA, 19 nt, Homo sapiens
uggaaaugcucaggucaau

SEQ ID NO: 1553280 - RNA, 19 nt, Homo sapiens
gaacuaaucuucucauacu

SEQ ID NO: 1553281 - RNA, 19 nt, Homo sapiens
uaagaagacuuuaccauug

SEQ ID NO: 1553282 - RNA, 19 nt, Homo sapiens
gcagaaagcaguugugaaa

SEQ ID NO: 1553283 - RNA, 19 nt, Homo sapiens
gggauaaucugccuuguau

SEQ ID NO: 1553284 - RNA, 19 nt, Homo sapiens
gauaggcaauaguguauaa

SEQ ID NO: 1553285 - RNA, 19 nt, Homo sapiens
gauaaucugccuuguauuu

SEQ ID NO: 1553286 - RNA, 19 nt, Homo sapiens
ggagauacauugccugugu

SEQ ID NO: 1553287 - RNA, 19 nt, Homo sapiens
ggagagguauccacucaaa

SEQ ID NO: 1553288 - RNA, 19 nt, Homo sapiens
ggaaaccucucccgauuca

SEQ ID NO: 1553289 - RNA, 19 nt, Homo sapiens
gaacugcaauuuccagaag

SEQ ID NO: 1553290 - RNA, 19 nt, Homo sapiens
gaagaguucuacagcuuug

SEQ ID NO: 1553291 - RNA, 19 nt, Homo sapiens
caucagauccucauauuga

SEQ ID NO: 1553292 - RNA, 19 nt, Homo sapiens
gagagccgcuucgauauga

SEQ ID NO: 1553293 - RNA, 19 nt, Homo sapiens
gcaagaauaaucaaaggaa

SEQ ID NO: 1553294 - RNA, 19 nt, Homo sapiens
gagacaugcuucuuugguu

SEQ ID NO: 1553295 - RNA, 19 nt, Homo sapiens
gaagugguacucaagcuuu

SEQ ID NO: 1553296 - RNA, 19 nt, Homo sapiens
gacaggagcuuggaucuag

SEQ ID NO: 1553297 - RNA, 19 nt, Homo sapiens
uaagauaggcaauagugua

SEQ ID NO: 1553298 - RNA, 19 nt, Homo sapiens
guacaggacugagcgaugu

SEQ ID NO: 1553299 - RNA, 19 nt, Homo sapiens
ccacaauacaguuaucuuu

SEQ ID NO: 1553300 - RNA, 19 nt, Homo sapiens
aaauacagauggcaguuga

SEQ ID NO: 1553301 - RNA, 19 nt, Homo sapiens
caugagauauucugauaca

SEQ ID NO: 1553302 - RNA, 19 nt, Homo sapiens
agaccugaauuucuaauga

SEQ ID NO: 1553303 - RNA, 19 nt, Homo sapiens
agacaugcuucuuugguuu

SEQ ID NO: 1553304 - RNA, 19 nt, Homo sapiens
gaggcaguaugguaauaaa

SEQ ID NO: 1553305 - RNA, 19 nt, Homo sapiens
cauggcagcugcauagaau

SEQ ID NO: 1553306 - RNA, 19 nt, Homo sapiens
gaagguggguggcguuggu

SEQ ID NO: 1553307 - RNA, 19 nt, Homo sapiens
caacaacagggaagagauu

SEQ ID NO: 1553308 - RNA, 19 nt, Homo sapiens
ggguauccaucuugucaaa

SEQ ID NO: 1553309 - RNA, 19 nt, Homo sapiens
gcagcguggucaacauuug

SEQ ID NO: 1553310 - RNA, 19 nt, Homo sapiens
ggaagaguucuacagcuuu

SEQ ID NO: 1553311 - RNA, 19 nt, Homo sapiens
gaggaagaguccaacaaca

SEQ ID NO: 1553312 - RNA, 19 nt, Homo sapiens
gagauauucugauacaaac

SEQ ID NO: 1553313 - RNA, 19 nt, Homo sapiens
ccaaaugcuucagggagua

SEQ ID NO: 1553314 - RNA, 19 nt, Homo sapiens
gcaggcgguuggagacuga

SEQ ID NO: 1553315 - RNA, 19 nt, Homo sapiens
gcacuucuguuuuguguug

SEQ ID NO: 1553316 - RNA, 19 nt, Homo sapiens
ggguacaucucuuauccaa

SEQ ID NO: 1553317 - RNA, 19 nt, Homo sapiens
gaacaguaagaagacuuua

SEQ ID NO: 1553318 - RNA, 19 nt, Homo sapiens
gaagagggguucauuugau

SEQ ID NO: 1553319 - RNA, 19 nt, Homo sapiens
gcgagucuaugugugagua

SEQ ID NO: 1553320 - RNA, 19 nt, Homo sapiens
gcagauaacaacgaacuug

SEQ ID NO: 1553321 - RNA, 19 nt, Homo sapiens
ucacaaguguuaaacugau

SEQ ID NO: 1553322 - RNA, 19 nt, Homo sapiens
gauaacaacgaacuugaug

SEQ ID NO: 1553323 - RNA, 19 nt, Homo sapiens
ggcuagaggugcagauuuc

SEQ ID NO: 1553324 - RNA, 19 nt, Homo sapiens
uaggauggaucagaauauu

SEQ ID NO: 1553325 - RNA, 19 nt, Homo sapiens
guauccaucuugucaaaca

SEQ ID NO: 1553326 - RNA, 19 nt, Homo sapiens
gccaugguuuauaaucuaa

SEQ ID NO: 1553327 - RNA, 19 nt, Homo sapiens
aaacugauguccauuuuga

SEQ ID NO: 1553328 - RNA, 19 nt, Homo sapiens
aaacuugcaagaacaguaa

SEQ ID NO: 1553329 - RNA, 19 nt, Homo sapiens
caguugagcacuucuguuu

SEQ ID NO: 1553330 - RNA, 19 nt, Homo sapiens
gacaugcuucuuugguuua

SEQ ID NO: 1553331 - RNA, 19 nt, Homo sapiens
gguaggauggaucagaaua

SEQ ID NO: 1553332 - RNA, 19 nt, Homo sapiens
uaaucugccuuguauuuag

SEQ ID NO: 1553333 - RNA, 19 nt, Homo sapiens
ggucaacauuugcuccaau

SEQ ID NO: 1553334 - RNA, 19 nt, Homo sapiens
uggaagaguucuacagcuu

SEQ ID NO: 1553335 - RNA, 19 nt, Homo sapiens
aggugcagauuucauauuu

SEQ ID NO: 1553336 - RNA, 19 nt, Homo sapiens
gccuacaugugauauaaau

SEQ ID NO: 1553337 - RNA, 19 nt, Homo sapiens
acugagagccgcuucgaua

SEQ ID NO: 1553338 - RNA, 19 nt, Homo sapiens
guuaaacugauguccauuu

SEQ ID NO: 1553339 - RNA, 19 nt, Homo sapiens
ggaggcaguaugguaauaa

SEQ ID NO: 1553340 - RNA, 19 nt, Homo sapiens
ugaugcaagugauagguuu

SEQ ID NO: 1553341 - RNA, 19 nt, Homo sapiens
gugaagauccgaggcauga

SEQ ID NO: 1553342 - RNA, 19 nt, Homo sapiens
uagaggugcagauuucaua

SEQ ID NO: 1553343 - RNA, 19 nt, Homo sapiens
ucuuguggcugaugcaauu

SEQ ID NO: 1553344 - RNA, 19 nt, Homo sapiens
gaaagcaguugugaaaccu

SEQ ID NO: 1553345 - RNA, 19 nt, Homo sapiens
gaagaggcagaaagcaguu

SEQ ID NO: 1553346 - RNA, 19 nt, Homo sapiens
ugccaugguuuauaaucua

SEQ ID NO: 1553347 - RNA, 19 nt, Homo sapiens
ugaauccuagcaagaauaa

SEQ ID NO: 1553348 - RNA, 19 nt, Homo sapiens
gaggcuacuuggugugguu

SEQ ID NO: 1553349 - RNA, 19 nt, Homo sapiens
gcaauuagaagggacagau

SEQ ID NO: 1553350 - RNA, 19 nt, Homo sapiens
ugcaucagauccucauauu

SEQ ID NO: 1553351 - RNA, 19 nt, Homo sapiens
gcaagaacaguaagaagac

SEQ ID NO: 1553352 - RNA, 19 nt, Homo sapiens
cugaauuucuaaugacuug

SEQ ID NO: 1553353 - RNA, 19 nt, Homo sapiens
ggcaugaagugguacucaa

SEQ ID NO: 1553354 - RNA, 19 nt, Homo sapiens
aucagaauauugccaagua

SEQ ID NO: 1553355 - RNA, 19 nt, Homo sapiens
agggacagauuugaacuaa

SEQ ID NO: 1553356 - RNA, 19 nt, Homo sapiens
gaaaccaaucguuaugcuu

SEQ ID NO: 1553357 - RNA, 19 nt, Homo sapiens
agauauucguccagacuuu

SEQ ID NO: 1553358 - RNA, 19 nt, Homo sapiens
guguguaucuggagagcaa

SEQ ID NO: 1553359 - RNA, 19 nt, Homo sapiens
gaagcaugcacccuuggaa

SEQ ID NO: 1553360 - RNA, 19 nt, Homo sapiens
gaaggguguccaugccaaa

SEQ ID NO: 1553361 - RNA, 19 nt, Homo sapiens
gcauggcagcugcauagaa

SEQ ID NO: 1553362 - RNA, 19 nt, Homo sapiens
gaagauccgaggcaugaag

SEQ ID NO: 1553363 - RNA, 19 nt, Homo sapiens
ugugaaaccucagcgcauu

SEQ ID NO: 1553364 - RNA, 19 nt, Homo sapiens
gaguaaagacagcuucauc

SEQ ID NO: 1553365 - RNA, 19 nt, Homo sapiens
caaaggugaagucugcaaa

SEQ ID NO: 1553366 - RNA, 19 nt, Homo sapiens
aagugguacucaagcuuua

SEQ ID NO: 1553367 - RNA, 19 nt, Homo sapiens
ccaaguacaaggugaagau

SEQ ID NO: 1553368 - RNA, 19 nt, Homo sapiens
gaagcuguaucaggagaag

SEQ ID NO: 1553369 - RNA, 19 nt, Homo sapiens
cuaggaggcaguaugguaa

SEQ ID NO: 1553370 - RNA, 19 nt, Homo sapiens
gaucuaggaggcaguaugg

SEQ ID NO: 1553371 - RNA, 19 nt, Homo sapiens
uaacaacgaacuugaugca

SEQ ID NO: 1553372 - RNA, 19 nt, Homo sapiens
gaggugcagauuucauauu

SEQ ID NO: 1553373 - RNA, 19 nt, Homo sapiens
gggcuagaggugcagauuu

SEQ ID NO: 1553374 - RNA, 19 nt, Homo sapiens
uagcaagaauaaucaaagg

SEQ ID NO: 1553375 - RNA, 19 nt, Homo sapiens
gauggcaguugagcacuuc

SEQ ID NO: 1553376 - RNA, 19 nt, Homo sapiens
gcaaugcugacacaacauc

SEQ ID NO: 1553377 - RNA, 19 nt, Homo sapiens
ggaagaguccaacaacaac

SEQ ID NO: 1553378 - RNA, 19 nt, Homo sapiens
guaggauggaucagaauau

SEQ ID NO: 1553379 - RNA, 19 nt, Homo sapiens
gggaagagauuuucauugc

SEQ ID NO: 1553380 - RNA, 19 nt, Homo sapiens
gaacagaugugcauaaugu

SEQ ID NO: 1553381 - RNA, 19 nt, Homo sapiens
ggaaucagauguagcuuua

SEQ ID NO: 1553382 - RNA, 19 nt, Homo sapiens
gaaguuccaucuacguuua

SEQ ID NO: 1553383 - RNA, 19 nt, Homo sapiens
ggaaagaaaugguauucaa

SEQ ID NO: 1553384 - RNA, 19 nt, Homo sapiens
ugaagaagguggaacaaua

SEQ ID NO: 1553385 - RNA, 19 nt, Homo sapiens
ggagauugaugaugacuuu

SEQ ID NO: 1553386 - RNA, 19 nt, Homo sapiens
gaagguggaacaauaaaua

SEQ ID NO: 1553387 - RNA, 19 nt, Homo sapiens
gaaagaggcacauuugauu

SEQ ID NO: 1553388 - RNA, 19 nt, Homo sapiens
caagaugccucgaacacua

SEQ ID NO: 1553389 - RNA, 19 nt, Homo sapiens
gaagaagguggaacaauaa

SEQ ID NO: 1553390 - RNA, 19 nt, Homo sapiens
guauugcacuucuugauaa

SEQ ID NO: 1553391 - RNA, 19 nt, Homo sapiens
gcucugaauucaaauguuu

SEQ ID NO: 1553392 - RNA, 19 nt, Homo sapiens
gcacacagcugcguaucuu

SEQ ID NO: 1553393 - RNA, 19 nt, Homo sapiens
gaacacaacuuuucgaugu

SEQ ID NO: 1553394 - RNA, 19 nt, Homo sapiens
gcagcaaccuccaccauca

SEQ ID NO: 1553395 - RNA, 19 nt, Homo sapiens
gaaguguuccguugaauau

SEQ ID NO: 1553396 - RNA, 19 nt, Homo sapiens
agagacagaugacagcaua

SEQ ID NO: 1553397 - RNA, 19 nt, Homo sapiens
gacuagcucugaauucaaa

SEQ ID NO: 1553398 - RNA, 19 nt, Homo sapiens
aaagaugacucuccugaug

SEQ ID NO: 1553399 - RNA, 19 nt, Homo sapiens
caaacaugaucaaagugua

SEQ ID NO: 1553400 - RNA, 19 nt, Homo sapiens
ucacuuguccuucaguuua

SEQ ID NO: 1553401 - RNA, 19 nt, Homo sapiens
gaacgucacauaacaaugg

SEQ ID NO: 1553402 - RNA, 19 nt, Homo sapiens
ggaaucaggagaugaagaa

SEQ ID NO: 1553403 - RNA, 19 nt, Homo sapiens
ugauggagaugaagauuau

SEQ ID NO: 1553404 - RNA, 19 nt, Homo sapiens
gaagaccucagaagcguaa

SEQ ID NO: 1553405 - RNA, 19 nt, Homo sapiens
caaaguguauaaccaguuc

SEQ ID NO: 1553406 - RNA, 19 nt, Homo sapiens
ggacaucaggcaacaggua

SEQ ID NO: 1553407 - RNA, 19 nt, Homo sapiens
caugagacgugaccgguuu

SEQ ID NO: 1553408 - RNA, 19 nt, Homo sapiens
ggaaagcccauucgguuug

SEQ ID NO: 1553409 - RNA, 19 nt, Homo sapiens
gagaugguacugacuauga

SEQ ID NO: 1553410 - RNA, 19 nt, Homo sapiens
aaugagaacucccacagaa

SEQ ID NO: 1553411 - RNA, 19 nt, Homo sapiens
ggaaacggcagaagaaagu

SEQ ID NO: 1553412 - RNA, 19 nt, Homo sapiens
gagaaaggaucacauugac

SEQ ID NO: 1553413 - RNA, 19 nt, Homo sapiens
aaugagagaugcaugaaau

SEQ ID NO: 1553414 - RNA, 19 nt, Homo sapiens
caaauugcgaccucucaua

SEQ ID NO: 1553415 - RNA, 19 nt, Homo sapiens
aaagaggcacauuugauua

SEQ ID NO: 1553416 - RNA, 19 nt, Homo sapiens
aaagaaagaggcacauuug

SEQ ID NO: 1553417 - RNA, 19 nt, Homo sapiens
gaacacuaaguuuacauga

SEQ ID NO: 1553418 - RNA, 19 nt, Homo sapiens
ugagaaaggaucacauuga

SEQ ID NO: 1553419 - RNA, 19 nt, Homo sapiens
caacagguacagugagaaa

SEQ ID NO: 1553420 - RNA, 19 nt, Homo sapiens
gagagaugcaugaaauuug

SEQ ID NO: 1553421 - RNA, 19 nt, Homo sapiens
caguaaagguguacaucuu

SEQ ID NO: 1553422 - RNA, 19 nt, Homo sapiens
gaaagaaaugguauucaag

SEQ ID NO: 1553423 - RNA, 19 nt, Homo sapiens
gauaagcucaguucaaugg

SEQ ID NO: 1553424 - RNA, 19 nt, Homo sapiens
cagcaccuguuucugauga

SEQ ID NO: 1553425 - RNA, 19 nt, Homo sapiens
gcgguuaagucccaagaug

SEQ ID NO: 1553426 - RNA, 19 nt, Homo sapiens
gggcuacauuugcugguuu

SEQ ID NO: 1553427 - RNA, 19 nt, Homo sapiens
ugcaggagauugaugauga

SEQ ID NO: 1553428 - RNA, 19 nt, Homo sapiens
gguuagugcugccaugaga

SEQ ID NO: 1553429 - RNA, 19 nt, Homo sapiens
ggaccugucuggagauggu

SEQ ID NO: 1553430 - RNA, 19 nt, Homo sapiens
gcucugaugcugagucuga

SEQ ID NO: 1553431 - RNA, 19 nt, Homo sapiens
gcaauauugucugcagaug

SEQ ID NO: 1553432 - RNA, 19 nt, Homo sapiens
ggcaacagguacagugaga

SEQ ID NO: 1553433 - RNA, 19 nt, Homo sapiens
gaauucaugguuccuuauu

SEQ ID NO: 1553434 - RNA, 19 nt, Homo sapiens
agagaugcaugaaauuugu

SEQ ID NO: 1553435 - RNA, 19 nt, Homo sapiens
gugcauaauguacugguua

SEQ ID NO: 1553436 - RNA, 19 nt, Homo sapiens
cgaggucauugaacucauu

SEQ ID NO: 1553437 - RNA, 19 nt, Homo sapiens
gucaccaccuccugagaua

SEQ ID NO: 1553438 - RNA, 19 nt, Homo sapiens
gggaaagcccauucgguuu

SEQ ID NO: 1553439 - RNA, 19 nt, Homo sapiens
gguuaugucucaguuccua

SEQ ID NO: 1553440 - RNA, 19 nt, Homo sapiens
caucuuggcuugacuagcu

SEQ ID NO: 1553441 - RNA, 19 nt, Homo sapiens
ugacucuccugaugaaguu

SEQ ID NO: 1553442 - RNA, 19 nt, Homo sapiens
gaugaggaaucaggagaug

SEQ ID NO: 1553443 - RNA, 19 nt, Homo sapiens
gcgaugcgcugaaugucau

SEQ ID NO: 1553444 - RNA, 19 nt, Homo sapiens
aaagaacagaugugcauaa

SEQ ID NO: 1553445 - RNA, 19 nt, Homo sapiens
guacaacccguagcaggua

SEQ ID NO: 1553446 - RNA, 19 nt, Homo sapiens
aaaaugugauguugccuua

SEQ ID NO: 1553447 - RNA, 19 nt, Homo sapiens
gucauaagaacacaacuuu

SEQ ID NO: 1553448 - RNA, 19 nt, Homo sapiens
gggcaucaauccguggaaa

SEQ ID NO: 1553449 - RNA, 19 nt, Homo sapiens
ugaaguguuccguugaaua

SEQ ID NO: 1553450 - RNA, 19 nt, Homo sapiens
ccucagaagcguaacauug

SEQ ID NO: 1553451 - RNA, 19 nt, Homo sapiens
aauauugucugcagaugga

SEQ ID NO: 1553452 - RNA, 19 nt, Homo sapiens
ugagagaugcaugaaauuu

SEQ ID NO: 1553453 - RNA, 19 nt, Homo sapiens
cuuauaugcuugcaguaaa

SEQ ID NO: 1553454 - RNA, 19 nt, Homo sapiens
gagaacucccacagaaauu

SEQ ID NO: 1553455 - RNA, 19 nt, Homo sapiens
agacagagcugaugaaaac

SEQ ID NO: 1553456 - RNA, 19 nt, Homo sapiens
gucugcagauggaaugaua

SEQ ID NO: 1553457 - RNA, 19 nt, Homo sapiens
aaauugcgaccucucauaa

SEQ ID NO: 1553458 - RNA, 19 nt, Homo sapiens
caagugcuauagugauaca

SEQ ID NO: 1553459 - RNA, 19 nt, Homo sapiens
caaacgcgaugcgcugaau

SEQ ID NO: 1553460 - RNA, 19 nt, Homo sapiens
cagauggaaugauaacagu

SEQ ID NO: 1553461 - RNA, 19 nt, Homo sapiens
gauggcaaaggcaauauug

SEQ ID NO: 1553462 - RNA, 19 nt, Homo sapiens
gugcgucacuuguccuuca

SEQ ID NO: 1553463 - RNA, 19 nt, Homo sapiens
gaaagcccauucgguuugg

SEQ ID NO: 1553464 - RNA, 19 nt, Homo sapiens
ucacgggugcaaacaauuu

SEQ ID NO: 1553465 - RNA, 19 nt, Homo sapiens
aagcaaacuuaaugagaga

SEQ ID NO: 1553466 - RNA, 19 nt, Homo sapiens
agacgugaccgguuugaaa

SEQ ID NO: 1553467 - RNA, 19 nt, Homo sapiens
gaugagaaaccaguggauu

SEQ ID NO: 1553468 - RNA, 19 nt, Homo sapiens
gggaagauaccgagaugau

SEQ ID NO: 1553469 - RNA, 19 nt, Homo sapiens
gacgugugguaugccauua

SEQ ID NO: 1553470 - RNA, 19 nt, Homo sapiens
aagaacagaugugcauaau

SEQ ID NO: 1553471 - RNA, 19 nt, Homo sapiens
caaagaacagaugugcaua

SEQ ID NO: 1553472 - RNA, 19 nt, Homo sapiens
ugagaacucccacagaaau

SEQ ID NO: 1553473 - RNA, 19 nt, Homo sapiens
gugggaagauaccgagaug

SEQ ID NO: 1553474 - RNA, 19 nt, Homo sapiens
gcgggaaacggcagaagaa

SEQ ID NO: 1553475 - RNA, 19 nt, Homo sapiens
aacauugacucacguuaug

SEQ ID NO: 1553476 - RNA, 19 nt, Homo sapiens
ccaaacaugaucaaagugu

SEQ ID NO: 1553477 - RNA, 19 nt, Homo sapiens
guucagcagccaaacauga

SEQ ID NO: 1553478 - RNA, 19 nt, Homo sapiens
ccacuggaaucagauguag

SEQ ID NO: 1553479 - RNA, 19 nt, Homo sapiens
guacaucuuggcuugacua

SEQ ID NO: 1553480 - RNA, 19 nt, Homo sapiens
ggaaauaacuucuaccaaa

SEQ ID NO: 1553481 - RNA, 19 nt, Homo sapiens
gcaacucucuggucaguaa

SEQ ID NO: 1553482 - RNA, 19 nt, Homo sapiens
gaaguaagcagccauguug

SEQ ID NO: 1553483 - RNA, 19 nt, Homo sapiens
gaaauaacuucuaccaaag

SEQ ID NO: 1553484 - RNA, 19 nt, Homo sapiens
ucacaaugccgaugauuua

SEQ ID NO: 1553485 - RNA, 19 nt, Homo sapiens
caaguaaugugugugauuu

SEQ ID NO: 1553486 - RNA, 19 nt, Homo sapiens
uaccaaagcugaaugaguu

SEQ ID NO: 1553487 - RNA, 19 nt, Homo sapiens
gcacagaggcauuuacaga

SEQ ID NO: 1553488 - RNA, 19 nt, Homo sapiens
gaagagagacgguaacaag

SEQ ID NO: 1553489 - RNA, 19 nt, Homo sapiens
aaagaaggauggaagagaa

SEQ ID NO: 1553490 - RNA, 19 nt, Homo sapiens
caucuucacuggacucuga

SEQ ID NO: 1553491 - RNA, 19 nt, Homo sapiens
gaacacgacugauauuuuc

SEQ ID NO: 1553492 - RNA, 19 nt, Homo sapiens
gaggacggcuauuuggaaa

SEQ ID NO: 1553493 - RNA, 19 nt, Homo sapiens
gagagacgguaacaaggaa

SEQ ID NO: 1553494 - RNA, 19 nt, Homo sapiens
gaaggaagagagacgguaa

SEQ ID NO: 1553495 - RNA, 19 nt, Homo sapiens
uuacagagaucauuauguc

SEQ ID NO: 1553496 - RNA, 19 nt, Homo sapiens
gaaagaaggauggaagaga

SEQ ID NO: 1553497 - RNA, 19 nt, Homo sapiens
guuaauuucccacgaauaa

SEQ ID NO: 1553498 - RNA, 19 nt, Homo sapiens
gcauuuacagagaucauua

SEQ ID NO: 1553499 - RNA, 19 nt, Homo sapiens
uaaacucuauugcaaagga

SEQ ID NO: 1553500 - RNA, 19 nt, Homo sapiens
gcaaguaaugugugugauu

SEQ ID NO: 1553501 - RNA, 19 nt, Homo sapiens
ucucuaaacucuauugcaa

SEQ ID NO: 1553502 - RNA, 19 nt, Homo sapiens
gagcaaaucugaaaacucu

SEQ ID NO: 1553503 - RNA, 19 nt, Homo sapiens
ggagacagaagaaggaaga

SEQ ID NO: 1553504 - RNA, 19 nt, Homo sapiens
ccagauauacauuggguaa

SEQ ID NO: 1553505 - RNA, 19 nt, Homo sapiens
ugaguuaauuucccacgaa

SEQ ID NO: 1553506 - RNA, 19 nt, Homo sapiens
aaucugaacacgacugaua

SEQ ID NO: 1553507 - RNA, 19 nt, Homo sapiens
uaaugugugugauuuggaa

SEQ ID NO: 1553508 - RNA, 19 nt, Homo sapiens
gguaaaaucuacuucauag

SEQ ID NO: 1553509 - RNA, 19 nt, Homo sapiens
gaauguggaccugcaacua

SEQ ID NO: 1553510 - RNA, 19 nt, Homo sapiens
acagaggcauuuacagaga

SEQ ID NO: 1553511 - RNA, 19 nt, Homo sapiens
ucucaucucugcuucacaa

SEQ ID NO: 1553512 - RNA, 19 nt, Homo sapiens
cagccaauccuucugauga

SEQ ID NO: 1553513 - RNA, 19 nt, Homo sapiens
gcaugaggacggcuauuug

SEQ ID NO: 1553514 - RNA, 19 nt, Homo sapiens
gcugaugggugcugauucu

SEQ ID NO: 1553515 - RNA, 19 nt, Homo sapiens
augcagagcuugaagaagu

SEQ ID NO: 1553516 - RNA, 19 nt, Homo sapiens
ggcaggaggucucaucucu

SEQ ID NO: 1553517 - RNA, 19 nt, Homo sapiens
caacaauauugaucuugag

SEQ ID NO: 1553518 - RNA, 19 nt, Homo sapiens
gaauggaaagccagaaagu

SEQ ID NO: 1553519 - RNA, 19 nt, Homo sapiens
acaaggaaauaacuucuac

SEQ ID NO: 1553520 - RNA, 19 nt, Homo sapiens
ugaagcaaguaaugugugu

SEQ ID NO: 1553521 - RNA, 19 nt, Homo sapiens
gaguuaauuucccacgaau

SEQ ID NO: 1553522 - RNA, 19 nt, Homo sapiens
aaaguagagugaagcaagu

SEQ ID NO: 1553523 - RNA, 19 nt, Homo sapiens
ucuaaacucuauugcaaag

SEQ ID NO: 1553524 - RNA, 19 nt, Homo sapiens
guaagcagccauguuggaa

SEQ ID NO: 1553525 - RNA, 19 nt, Homo sapiens
gagcauucuucugagcaaa

SEQ ID NO: 1553526 - RNA, 19 nt, Homo sapiens
ggaaucugaacacgacuga

SEQ ID NO: 1553527 - RNA, 19 nt, Homo sapiens
gugaugggauuguauuugc

SEQ ID NO: 1553528 - RNA, 19 nt, Homo sapiens
caaagagauuaacuacaac

SEQ ID NO: 1553529 - RNA, 19 nt, Homo sapiens
ccuaugaggccucuaagga

SEQ ID NO: 1553530 - RNA, 19 nt, Homo sapiens
ggcaugaggacggcuauuu

SEQ ID NO: 1553531 - RNA, 19 nt, Homo sapiens
ggaggucucaucucugcuu

SEQ ID NO: 1553532 - RNA, 19 nt, Homo sapiens
ugaaaacucucuaaacucu

SEQ ID NO: 1553533 - RNA, 19 nt, Homo sapiens
caucucugcuucacaaugc

SEQ ID NO: 1553534 - RNA, 19 nt, Homo sapiens
cagagaucauuauguccuu

SEQ ID NO: 1553535 - RNA, 19 nt, Homo sapiens
gccagaaaguagagugaag

SEQ ID NO: 1553536 - RNA, 19 nt, Homo sapiens
ugcagagcuugaagaagua

SEQ ID NO: 1553537 - RNA, 19 nt, Homo sapiens
ugaggacggcuauuuggaa

SEQ ID NO: 1553538 - RNA, 19 nt, Homo sapiens
cuucugagcaaaucugaaa

SEQ ID NO: 1553539 - RNA, 19 nt, Homo sapiens
ggaaagccagaaaguagag

SEQ ID NO: 1553540 - RNA, 19 nt, Homo sapiens
guauaaaggaaucugaaca

SEQ ID NO: 1553541 - RNA, 19 nt, Homo sapiens
gagugaagcaaguaaugug

SEQ ID NO: 1553542 - RNA, 19 nt, Homo sapiens
gacccaaaaugcuggaaaa

SEQ ID NO: 1553543 - RNA, 19 nt, Homo sapiens
ggacucugacggacucugu

SEQ ID NO: 1553544 - RNA, 19 nt, Homo sapiens
augaguuccuugccuauga

SEQ ID NO: 1553545 - RNA, 19 nt, Homo sapiens
cagaggcauuuacagagau

SEQ ID NO: 1553546 - RNA, 19 nt, Homo sapiens
aaaggagacagaagaagga

SEQ ID NO: 1553547 - RNA, 19 nt, Homo sapiens
gcauucuucugagcaaauc

SEQ ID NO: 1553548 - RNA, 19 nt, Homo sapiens
ggugaugggauuguauuug

SEQ ID NO: 1553549 - RNA, 19 nt, Homo sapiens
gcugauaacacguggugau

SEQ ID NO: 1553550 - RNA, 19 nt, Homo sapiens
gauggaagagaaggcauga

SEQ ID NO: 1553551 - RNA, 19 nt, Homo sapiens
uaauuucccacgaauaaca

SEQ ID NO: 1553552 - RNA, 19 nt, Homo sapiens
ggaagagagacgguaacaa

SEQ ID NO: 1553553 - RNA, 19 nt, Homo sapiens
caaugccgaugauuuagcu

SEQ ID NO: 1553554 - RNA, 19 nt, Homo sapiens
gggauuguauuugcaacuc

SEQ ID NO: 1553555 - RNA, 19 nt, Homo sapiens
cacaaggaaauaacuucua

SEQ ID NO: 1553556 - RNA, 19 nt, Homo sapiens
gcagagcuugaagaaguaa

SEQ ID NO: 1553557 - RNA, 19 nt, Homo sapiens
ggaaagaaggauggaagag

SEQ ID NO: 1553558 - RNA, 19 nt, Homo sapiens
gguaacaaggaaagaagga

SEQ ID NO: 1553559 - RNA, 19 nt, Homo sapiens
gucaguaagugauaaaaug

SEQ ID NO: 1553560 - RNA, 19 nt, Homo sapiens
gaugggauuguauuugcaa

SEQ ID NO: 1553561 - RNA, 19 nt, Homo sapiens
caauccuucugaugacaau

SEQ ID NO: 1553562 - RNA, 19 nt, Homo sapiens
aagcaaguaauguguguga

SEQ ID NO: 1553563 - RNA, 19 nt, Homo sapiens
agagagacgguaacaagga

SEQ ID NO: 1553564 - RNA, 19 nt, Homo sapiens
gcaaaggagacagaagaag

SEQ ID NO: 1553565 - RNA, 19 nt, Homo sapiens
ggauuguauuugcaacucu

SEQ ID NO: 1553566 - RNA, 19 nt, Homo sapiens
ccaaaaugcuggaaaagcu

SEQ ID NO: 1553567 - RNA, 19 nt, Homo sapiens
cuucauggcaagaaacuau

SEQ ID NO: 1553568 - RNA, 19 nt, Homo sapiens
uaagcagccauguuggaaa

SEQ ID NO: 1553569 - RNA, 19 nt, Homo sapiens
agaaguaagcagccauguu

SEQ ID NO: 1553570 - RNA, 19 nt, Homo sapiens
ggguauaaaggaaucugaa

SEQ ID NO: 1553571 - RNA, 19 nt, Homo sapiens
aauggaaagccagaaagua

SEQ ID NO: 1553572 - RNA, 19 nt, Homo sapiens
uagagugaagcaaguaaug

SEQ ID NO: 1553573 - RNA, 19 nt, Homo sapiens
guagagugaagcaaguaau

SEQ ID NO: 1553574 - RNA, 19 nt, Homo sapiens
gcaacuacaaccagcaaaa

SEQ ID NO: 1553575 - RNA, 19 nt, Homo sapiens
uugcaaaggagacagaaga

SEQ ID NO: 1553576 - RNA, 19 nt, Homo sapiens
ccacaaggaaauaacuucu

SEQ ID NO: 1553577 - RNA, 19 nt, Homo sapiens
gacgguaacaaggaaagaa

SEQ ID NO: 1553578 - RNA, 19 nt, Homo sapiens
guaaugugugugauuugga

SEQ ID NO: 1553579 - RNA, 19 nt, Homo sapiens
ggcagccucuagaacgaau

SEQ ID NO: 1553580 - RNA, 19 nt, Homo sapiens
gaacauuaaugauggaaca

SEQ ID NO: 1553581 - RNA, 19 nt, Homo sapiens
uggaagaguugaagaagua

SEQ ID NO: 1553582 - RNA, 19 nt, Homo sapiens
gcucuucguugcccaguuu

SEQ ID NO: 1553583 - RNA, 19 nt, Homo sapiens
gagagagguuuccgcugua

SEQ ID NO: 1553584 - RNA, 19 nt, Homo sapiens
gaacauggccaaacuucag

SEQ ID NO: 1553585 - RNA, 19 nt, Homo sapiens
guagggagauuuggguaga

SEQ ID NO: 1553586 - RNA, 19 nt, Homo sapiens
gauggaacauggccaaacu

SEQ ID NO: 1553587 - RNA, 19 nt, Homo sapiens
guuacuggauuugguuuaa

SEQ ID NO: 1553588 - RNA, 19 nt, Homo sapiens
ggccaaacuucagucauga

SEQ ID NO: 1553589 - RNA, 19 nt, Homo sapiens
ugaagaaguaccugucgua

SEQ ID NO: 1553590 - RNA, 19 nt, Homo sapiens
uggccaaacuucagucaug

SEQ ID NO: 1553591 - RNA, 19 nt, Homo sapiens
cucaagaggugguggaaga

SEQ ID NO: 1553592 - RNA, 19 nt, Homo sapiens
gaggaggcgaccguuguua

SEQ ID NO: 1553593 - RNA, 19 nt, Homo sapiens
guaaggcauuguaaaaguu

SEQ ID NO: 1553594 - RNA, 19 nt, Homo sapiens
gcucuggacugggauuaag

SEQ ID NO: 1553595 - RNA, 19 nt, Homo sapiens
ggaggaggcgaccguuguu

SEQ ID NO: 1553596 - RNA, 19 nt, Homo sapiens
gcucccugcuugcaaagug

SEQ ID NO: 1553597 - RNA, 19 nt, Homo sapiens
guggaagaguugaagaagu

SEQ ID NO: 1553598 - RNA, 19 nt, Homo sapiens
ccccagagcuuccaguaaa

SEQ ID NO: 1553599 - RNA, 19 nt, Homo sapiens
gccaagcuuucccuuccuu

SEQ ID NO: 1553600 - RNA, 19 nt, Homo sapiens
aggcaacccucuaguaagg

SEQ ID NO: 1553601 - RNA, 19 nt, Homo sapiens
gauccugaagccaugguuu

SEQ ID NO: 1553602 - RNA, 19 nt, Homo sapiens
ggaacauggccaaacuuca

SEQ ID NO: 1553603 - RNA, 19 nt, Homo sapiens
ggaggcgaccguuguuauc

SEQ ID NO: 1553604 - RNA, 19 nt, Homo sapiens
aagaggugguggaagaguu

SEQ ID NO: 1553605 - RNA, 19 nt, Homo sapiens
ccaccagucccgcugcauu

SEQ ID NO: 1553606 - RNA, 19 nt, Homo sapiens
gagcucuggacugggauua

SEQ ID NO: 1553607 - RNA, 19 nt, Homo sapiens
uaaaggugaacccgacgaa

SEQ ID NO: 1553608 - RNA, 19 nt, Homo sapiens
aaaguuacuggauuugguu

SEQ ID NO: 1553609 - RNA, 19 nt, Homo sapiens
caagcuuucccuuccuuug

SEQ ID NO: 1553610 - RNA, 19 nt, Homo sapiens
aaacuucagucaugauccu

SEQ ID NO: 1553611 - RNA, 19 nt, Homo sapiens
aagcuuucccuuccuuuga

SEQ ID NO: 1553612 - RNA, 19 nt, Homo sapiens
ucuaguaaggcauuguaaa

SEQ ID NO: 1553613 - RNA, 19 nt, Homo sapiens
ccucuaguaaggcauugua

SEQ ID NO: 1553614 - RNA, 19 nt, Homo sapiens
ccaaacuucagucaugauc

SEQ ID NO: 1553615 - RNA, 19 nt, Homo sapiens
gaaagcagcuggugauuua

SEQ ID NO: 1553616 - RNA, 19 nt, Homo sapiens
gcaaguagcucugagaaga

SEQ ID NO: 1553617 - RNA, 19 nt, Homo sapiens
ggaagaaucuaaagagaau

SEQ ID NO: 1553618 - RNA, 19 nt, Homo sapiens
ugaggaagaugacaaguaa

SEQ ID NO: 1553619 - RNA, 19 nt, Homo sapiens
gaacggagacgacgccuuu

SEQ ID NO: 1553620 - RNA, 19 nt, Homo sapiens
cgagagaucuggacccaaa

SEQ ID NO: 1553621 - RNA, 19 nt, Homo sapiens
ccaaauacuucucuaagga

SEQ ID NO: 1553622 - RNA, 19 nt, Homo sapiens
gcagugugccauucuguua

SEQ ID NO: 1553623 - RNA, 19 nt, Homo sapiens
gaaagcaaguguucacaac

SEQ ID NO: 1553624 - RNA, 19 nt, Homo sapiens
gcaaggccuucgaugauau

SEQ ID NO: 1553625 - RNA, 19 nt, Homo sapiens
gccauucuguuagacauua

SEQ ID NO: 1553626 - RNA, 19 nt, Homo sapiens
gaauaucagagcaugcaua

SEQ ID NO: 1553627 - RNA, 19 nt, Homo sapiens
guaauaaacgggccacaga

SEQ ID NO: 1553628 - RNA, 19 nt, Homo sapiens
gcuaaagcaucagagaaga

SEQ ID NO: 1553629 - RNA, 19 nt, Homo sapiens
gcagaggaaggaagugauu

SEQ ID NO: 1553630 - RNA, 19 nt, Homo sapiens
caaagagacccagggauga

SEQ ID NO: 1553631 - RNA, 19 nt, Homo sapiens
caacgucacccucucacuu

SEQ ID NO: 1553632 - RNA, 19 nt, Homo sapiens
caaauacuucucuaaggaa

SEQ ID NO: 1553633 - RNA, 19 nt, Homo sapiens
uaauaaaccuuugcaaacg

SEQ ID NO: 1553634 - RNA, 19 nt, Homo sapiens
ccaaguaccaguauaagca

SEQ ID NO: 1553635 - RNA, 19 nt, Homo sapiens
ugagaagauucacgagaga

SEQ ID NO: 1553636 - RNA, 19 nt, Homo sapiens
aaaaucagcugugugcaua

SEQ ID NO: 1553637 - RNA, 19 nt, Homo sapiens
gccaaauacuucucuaagg

SEQ ID NO: 1553638 - RNA, 19 nt, Homo sapiens
caaguauugucagguauuc

SEQ ID NO: 1553639 - RNA, 19 nt, Homo sapiens
gagcaugcauacucugaac

SEQ ID NO: 1553640 - RNA, 19 nt, Homo sapiens
caagugaaagcaaguguuc

SEQ ID NO: 1553641 - RNA, 19 nt, Homo sapiens
ucagguguauagcaaguga

SEQ ID NO: 1553642 - RNA, 19 nt, Homo sapiens
cgaagaucaugcccgagaa

SEQ ID NO: 1553643 - RNA, 19 nt, Homo sapiens
gguugaacguccucagaug

SEQ ID NO: 1553644 - RNA, 19 nt, Homo sapiens
ggccaugacuaaacuaggu

SEQ ID NO: 1553645 - RNA, 19 nt, Homo sapiens
aguaugaggccaugacuaa

SEQ ID NO: 1553646 - RNA, 19 nt, Homo sapiens
guauaagcaucucccaucu

SEQ ID NO: 1553647 - RNA, 19 nt, Homo sapiens
acaccaaguaccaguauaa

SEQ ID NO: 1553648 - RNA, 19 nt, Homo sapiens
ggugauuuaugaagagauc

SEQ ID NO: 1553649 - RNA, 19 nt, Homo sapiens
gaagggagugccagaagca

SEQ ID NO: 1553650 - RNA, 19 nt, Homo sapiens
cagagaaucaucccgaaga

SEQ ID NO: 1553651 - RNA, 19 nt, Homo sapiens
gagacgacgccuuugcaaa

SEQ ID NO: 1553652 - RNA, 19 nt, Homo sapiens
gcaagugaaagcaaguguu

SEQ ID NO: 1553653 - RNA, 19 nt, Homo sapiens
gacaguuaauaaaccuuug

SEQ ID NO: 1553654 - RNA, 19 nt, Homo sapiens
uaucagagcaugcauacuc

SEQ ID NO: 1553655 - RNA, 19 nt, Homo sapiens
gucaucagguguauagcaa

SEQ ID NO: 1553656 - RNA, 19 nt, Homo sapiens
gcacacacacacaccaagu

SEQ ID NO: 1553657 - RNA, 19 nt, Homo sapiens
caucagguguauagcaagu

SEQ ID NO: 1553658 - RNA, 19 nt, Homo sapiens
agaaucaucccgaagauca

SEQ ID NO: 1553659 - RNA, 19 nt, Homo sapiens
gaaaguaugaggccaugac

SEQ ID NO: 1553660 - RNA, 19 nt, Homo sapiens
gugugcauaugaagagaaa

SEQ ID NO: 1553661 - RNA, 19 nt, Homo sapiens
agcaaggccuucgaugaua

SEQ ID NO: 1553662 - RNA, 19 nt, Homo sapiens
gagaauaucagagcaugca

SEQ ID NO: 1553663 - RNA, 19 nt, Homo sapiens
gcauaugaagagaaaguau

SEQ ID NO: 1553664 - RNA, 19 nt, Homo sapiens
gcaugcauacucugaacuu

SEQ ID NO: 1553665 - RNA, 19 nt, Homo sapiens
gggaaaagaugaaauucuc

SEQ ID NO: 1553666 - RNA, 19 nt, Homo sapiens
gcagaacguggugaccuuu

SEQ ID NO: 1553667 - RNA, 19 nt, Homo sapiens
agaaagcagcuggugauuu

SEQ ID NO: 1553668 - RNA, 19 nt, Homo sapiens
gagaaagcagcuggugauu

SEQ ID NO: 1553669 - RNA, 19 nt, Homo sapiens
gaagccagcagaggaagga

SEQ ID NO: 1553670 - RNA, 19 nt, Homo sapiens
cgagaagccagcagaggaa

SEQ ID NO: 1553671 - RNA, 19 nt, Homo sapiens
gaacguccucagaugacuu

SEQ ID NO: 1553672 - RNA, 19 nt, Homo sapiens
ucagcugugugcauaugaa

SEQ ID NO: 1553673 - RNA, 19 nt, Homo sapiens
uggcguuuccguuguauuu

SEQ ID NO: 1553674 - RNA, 19 nt, Homo sapiens
aaucagagucuccgucaga

SEQ ID NO: 1553675 - RNA, 19 nt, Homo sapiens
cagcgacccugaggaagau

SEQ ID NO: 1553676 - RNA, 19 nt, Homo sapiens
ccacagacugcgugagaga

SEQ ID NO: 1553677 - RNA, 19 nt, Homo sapiens
uaaagcaucagagaagaga

SEQ ID NO: 1553678 - RNA, 19 nt, Homo sapiens
ggagacgacgccuuugcaa

SEQ ID NO: 1553679 - RNA, 19 nt, Homo sapiens
gaccguaaccgugggaaug

SEQ ID NO: 1553680 - RNA, 19 nt, Homo sapiens
acccagggaugaugcuaaa

SEQ ID NO: 1553681 - RNA, 19 nt, Homo sapiens
aaguagcucugagaagauu

SEQ ID NO: 1553682 - RNA, 19 nt, Homo sapiens
uggaagaaucuaaagagaa

SEQ ID NO: 1553683 - RNA, 19 nt, Homo sapiens
aagcaaggccuucgaugau

SEQ ID NO: 1553684 - RNA, 19 nt, Homo sapiens
guugaacguccucagauga

SEQ ID NO: 1553685 - RNA, 19 nt, Homo sapiens
auaaaccuuugcaaacguu

SEQ ID NO: 1553686 - RNA, 19 nt, Homo sapiens
uuggaagaaucuaaagaga

SEQ ID NO: 1553687 - RNA, 19 nt, Homo sapiens
gaagaucaugcccgagaag

SEQ ID NO: 1553688 - RNA, 19 nt, Homo sapiens
agagaaucaucccgaagau

SEQ ID NO: 1553689 - RNA, 19 nt, Homo sapiens
cacaccaaguaccaguaua

SEQ ID NO: 1553690 - RNA, 19 nt, Homo sapiens
cugaggaagaugacaagua

SEQ ID NO: 1553691 - RNA, 19 nt, Homo sapiens
gcuggugauuuaugaagag

SEQ ID NO: 1553692 - RNA, 19 nt, Homo sapiens
ugcauacucugaacuugga

SEQ ID NO: 1553693 - RNA, 19 nt, Homo sapiens
aaucagcugugugcauaug

SEQ ID NO: 1553694 - RNA, 19 nt, Homo sapiens
guacuccccucauccgauu

SEQ ID NO: 1553695 - RNA, 19 nt, Homo sapiens
agaacguggugaccuuuca

SEQ ID NO: 1553696 - RNA, 19 nt, Homo sapiens
caucagagaagagaagcaa

SEQ ID NO: 1553697 - RNA, 19 nt, Homo sapiens
agagaaagcagcuggugau

SEQ ID NO: 1553698 - RNA, 19 nt, Homo sapiens
gacccagggaugaugcuaa

SEQ ID NO: 1553699 - RNA, 19 nt, Homo sapiens
caaguagcucugagaagau

SEQ ID NO: 1553700 - RNA, 19 nt, Homo sapiens
gaaaagcaaguagcucuga

SEQ ID NO: 1553701 - RNA, 19 nt, Homo sapiens
cacacacacacaccaagua

SEQ ID NO: 1553702 - RNA, 19 nt, Homo sapiens
cagcagaggaaggaaguga

SEQ ID NO: 1553703 - RNA, 19 nt, Homo sapiens
caaggccuucgaugauauu

SEQ ID NO: 1553704 - RNA, 19 nt, Homo sapiens
aauaaaccuuugcaaacgu

SEQ ID NO: 1553705 - RNA, 19 nt, Homo sapiens
gaaaaucagcugugugcau

SEQ ID NO: 1553706 - RNA, 19 nt, Homo sapiens
ggcaggcuccagagaauca

SEQ ID NO: 1553707 - RNA, 19 nt, Homo sapiens
gugcauaugaagagaaagu

SEQ ID NO: 1553708 - RNA, 19 nt, Homo sapiens
gcaagacaugcuuaaugca

SEQ ID NO: 1553709 - RNA, 19 nt, Homo sapiens
uguuggcguuuccguugua

SEQ ID NO: 1553710 - RNA, 19 nt, Homo sapiens
gugccaagaguucgauguu

SEQ ID NO: 1553711 - RNA, 19 nt, Homo sapiens
guauagcaagugaaagcaa

SEQ ID NO: 1553712 - RNA, 19 nt, Homo sapiens
caugcauacucugaacuug

SEQ ID NO: 1553713 - RNA, 19 nt, Homo sapiens
uaaacgggccacagacucu

SEQ ID NO: 1553714 - RNA, 19 nt, Homo sapiens
ucacucuguuuccuguuca

SEQ ID NO: 1553715 - RNA, 19 nt, Homo sapiens
gaaagcagcuggugauuua

SEQ ID NO: 1553716 - RNA, 19 nt, Homo sapiens
gggcagaucugaguguuua

SEQ ID NO: 1553717 - RNA, 19 nt, Homo sapiens
gaacggagacgacgccuuu

SEQ ID NO: 1553718 - RNA, 19 nt, Homo sapiens
ugacaagaguucgauguua

SEQ ID NO: 1553719 - RNA, 19 nt, Homo sapiens
gccauucuguuagauauua

SEQ ID NO: 1553720 - RNA, 19 nt, Homo sapiens
ugaagaagacgacgaguaa

SEQ ID NO: 1553721 - RNA, 19 nt, Homo sapiens
gaaagcaaguguucacaac

SEQ ID NO: 1553722 - RNA, 19 nt, Homo sapiens
ccaaguaccucugagaaga

SEQ ID NO: 1553723 - RNA, 19 nt, Homo sapiens
cgacauaugcccaugauga

SEQ ID NO: 1553724 - RNA, 19 nt, Homo sapiens
gccaaauacuucucuaaga

SEQ ID NO: 1553725 - RNA, 19 nt, Homo sapiens
gacaagaguucgauguuag

SEQ ID NO: 1553726 - RNA, 19 nt, Homo sapiens
gaugaaauccuuggagaaa

SEQ ID NO: 1553727 - RNA, 19 nt, Homo sapiens
guauaagcaucucccauau

SEQ ID NO: 1553728 - RNA, 19 nt, Homo sapiens
gcaaguauagucagguauu

SEQ ID NO: 1553729 - RNA, 19 nt, Homo sapiens
caagacauccggacccaaa

SEQ ID NO: 1553730 - RNA, 19 nt, Homo sapiens
gcagaggaaggaaaugauu

SEQ ID NO: 1553731 - RNA, 19 nt, Homo sapiens
gaucugaguguuuaauuuc

SEQ ID NO: 1553732 - RNA, 19 nt, Homo sapiens
guuaauacaccuuugcaaa

SEQ ID NO: 1553733 - RNA, 19 nt, Homo sapiens
cgaagaucaugcccaagaa

SEQ ID NO: 1553734 - RNA, 19 nt, Homo sapiens
gauauuagcguuuucauug

SEQ ID NO: 1553735 - RNA, 19 nt, Homo sapiens
ucagcuauguguauaugaa

SEQ ID NO: 1553736 - RNA, 19 nt, Homo sapiens
gaaaaucagcuauguguau

SEQ ID NO: 1553737 - RNA, 19 nt, Homo sapiens
caaaaguccuucgaugaua

SEQ ID NO: 1553738 - RNA, 19 nt, Homo sapiens
gauguuaguguuuccauug

SEQ ID NO: 1553739 - RNA, 19 nt, Homo sapiens
gggaaaagaugaaauccuu

SEQ ID NO: 1553740 - RNA, 19 nt, Homo sapiens
aagcaaguauagucaggua

SEQ ID NO: 1553741 - RNA, 19 nt, Homo sapiens
uaauguguauuucgguuug

SEQ ID NO: 1553742 - RNA, 19 nt, Homo sapiens
ccaccuuucaugcauaaua

SEQ ID NO: 1553743 - RNA, 19 nt, Homo sapiens
guuaguguuuccauuguau

SEQ ID NO: 1553744 - RNA, 19 nt, Homo sapiens
caagaagccagcagaggaa

SEQ ID NO: 1553745 - RNA, 19 nt, Homo sapiens
ugacuaaacuaggcuucaa

SEQ ID NO: 1553746 - RNA, 19 nt, Homo sapiens
aguauaagcaucucccaua

SEQ ID NO: 1553747 - RNA, 19 nt, Homo sapiens
ccaaguaccaguauaagca

SEQ ID NO: 1553748 - RNA, 19 nt, Homo sapiens
agaguucgauguuaguguu

SEQ ID NO: 1553749 - RNA, 19 nt, Homo sapiens
caaguauagucagguauuc

SEQ ID NO: 1553750 - RNA, 19 nt, Homo sapiens
caagugaaagcaaguguuc

SEQ ID NO: 1553751 - RNA, 19 nt, Homo sapiens
gguugaacguccucagaug

SEQ ID NO: 1553752 - RNA, 19 nt, Homo sapiens
ccaagggaaucagguugaa

SEQ ID NO: 1553753 - RNA, 19 nt, Homo sapiens
aguaugaggccaugacuaa

SEQ ID NO: 1553754 - RNA, 19 nt, Homo sapiens
gcucaaauaccagagaaga

SEQ ID NO: 1553755 - RNA, 19 nt, Homo sapiens
acaccaaguaccaguauaa

SEQ ID NO: 1553756 - RNA, 19 nt, Homo sapiens
guaccucugagaagauuaa

SEQ ID NO: 1553757 - RNA, 19 nt, Homo sapiens
uagggcuggugcucaaaua

SEQ ID NO: 1553758 - RNA, 19 nt, Homo sapiens
ucagaaagcaaguauaguc

SEQ ID NO: 1553759 - RNA, 19 nt, Homo sapiens
gugccauucuguuagauau

SEQ ID NO: 1553760 - RNA, 19 nt, Homo sapiens
ggugauuuaugaagagauc

SEQ ID NO: 1553761 - RNA, 19 nt, Homo sapiens
gaagggagugccagaagca

SEQ ID NO: 1553762 - RNA, 19 nt, Homo sapiens
guaugcaugcucugacuuu

SEQ ID NO: 1553763 - RNA, 19 nt, Homo sapiens
gcaagugaaagcaaguguu

SEQ ID NO: 1553764 - RNA, 19 nt, Homo sapiens
ucaggugcauagcaaguga

SEQ ID NO: 1553765 - RNA, 19 nt, Homo sapiens
ucaauuuguuuccuguuca

SEQ ID NO: 1553766 - RNA, 19 nt, Homo sapiens
gagggcagaucugaguguu

SEQ ID NO: 1553767 - RNA, 19 nt, Homo sapiens
ccgaagaucaugcccaaga

SEQ ID NO: 1553768 - RNA, 19 nt, Homo sapiens
gaaaguaugaggccaugac

SEQ ID NO: 1553769 - RNA, 19 nt, Homo sapiens
gugcucaaauaccagagaa

SEQ ID NO: 1553770 - RNA, 19 nt, Homo sapiens
gacaguuaauacaccuuug

SEQ ID NO: 1553771 - RNA, 19 nt, Homo sapiens
gucaucaggugcauagcaa

SEQ ID NO: 1553772 - RNA, 19 nt, Homo sapiens
cugagaagauuaacaagac

SEQ ID NO: 1553773 - RNA, 19 nt, Homo sapiens
ccucugagaagauuaacaa

SEQ ID NO: 1553774 - RNA, 19 nt, Homo sapiens
cagcagaggaaggaaauga

SEQ ID NO: 1553775 - RNA, 19 nt, Homo sapiens
aaucagcuauguguauaug

SEQ ID NO: 1553776 - RNA, 19 nt, Homo sapiens
gagaaaaucagcuaugugu

SEQ ID NO: 1553777 - RNA, 19 nt, Homo sapiens
ucaaauaccagagaagauc

SEQ ID NO: 1553778 - RNA, 19 nt, Homo sapiens
guacuccccuccucugauu

SEQ ID NO: 1553779 - RNA, 19 nt, Homo sapiens
gacuuucucucucgauucu

SEQ ID NO: 1553780 - RNA, 19 nt, Homo sapiens
gcagaacguggugaccuuu

SEQ ID NO: 1553781 - RNA, 19 nt, Homo sapiens
cagcgacccugaagaagac

SEQ ID NO: 1553782 - RNA, 19 nt, Homo sapiens
agaaagcagcuggugauuu

SEQ ID NO: 1553783 - RNA, 19 nt, Homo sapiens
gagaaagcagcuggugauu

SEQ ID NO: 1553784 - RNA, 19 nt, Homo sapiens
gaagccagcagaggaagga

SEQ ID NO: 1553785 - RNA, 19 nt, Homo sapiens
gaacguccucagaugacuu

SEQ ID NO: 1553786 - RNA, 19 nt, Homo sapiens
ugacaguuaauacaccuuu

SEQ ID NO: 1553787 - RNA, 19 nt, Homo sapiens
ggagacgacgccuuugcaa

SEQ ID NO: 1553788 - RNA, 19 nt, Homo sapiens
cauaugcccaugaugagaa

SEQ ID NO: 1553789 - RNA, 19 nt, Homo sapiens
ccacagacugcgugagaga

SEQ ID NO: 1553790 - RNA, 19 nt, Homo sapiens
gaagaucaugcccaagaag

SEQ ID NO: 1553791 - RNA, 19 nt, Homo sapiens
cgauguuaguguuuccauu

SEQ ID NO: 1553792 - RNA, 19 nt, Homo sapiens
gaguaugcaugcucugacu

SEQ ID NO: 1553793 - RNA, 19 nt, Homo sapiens
uaauacaccuuugcaaacg

SEQ ID NO: 1553794 - RNA, 19 nt, Homo sapiens
cagaaagcaaguauaguca

SEQ ID NO: 1553795 - RNA, 19 nt, Homo sapiens
gcauagcaagugaaagcaa

SEQ ID NO: 1553796 - RNA, 19 nt, Homo sapiens
ugagaagauuaacaagaca

SEQ ID NO: 1553797 - RNA, 19 nt, Homo sapiens
gaaaaccaaguaccucuga

SEQ ID NO: 1553798 - RNA, 19 nt, Homo sapiens
cagagaagauccaaaaguc

SEQ ID NO: 1553799 - RNA, 19 nt, Homo sapiens
guugaacguccucagauga

SEQ ID NO: 1553800 - RNA, 19 nt, Homo sapiens
gcagaucugaguguuuaau

SEQ ID NO: 1553801 - RNA, 19 nt, Homo sapiens
cacaccaaguaccaguaua

SEQ ID NO: 1553802 - RNA, 19 nt, Homo sapiens
guauuucgguuuguguauc

SEQ ID NO: 1553803 - RNA, 19 nt, Homo sapiens
gcuggugauuuaugaagag

SEQ ID NO: 1553804 - RNA, 19 nt, Homo sapiens
ugaaauccuuggagaaaau

SEQ ID NO: 1553805 - RNA, 19 nt, Homo sapiens
cuacugagggcagaucuga

SEQ ID NO: 1553806 - RNA, 19 nt, Homo sapiens
uguuaguguuuccauugua

SEQ ID NO: 1553807 - RNA, 19 nt, Homo sapiens
agaacguggugaccuuuca

SEQ ID NO: 1553808 - RNA, 19 nt, Homo sapiens
cugaagaagacgacgagua

SEQ ID NO: 1553809 - RNA, 19 nt, Homo sapiens
agagaaagcagcuggugau

SEQ ID NO: 1553810 - RNA, 19 nt, Homo sapiens
auacaccuuugcaaacguu

SEQ ID NO: 1553811 - RNA, 19 nt, Homo sapiens
acacaaacacacacacaca

SEQ ID NO: 1553812 - RNA, 19 nt, Homo sapiens
cagaucugaguguuuaauu

SEQ ID NO: 1553813 - RNA, 19 nt, Homo sapiens
caaguaccucugagaagau

SEQ ID NO: 1553814 - RNA, 19 nt, Homo sapiens
aaaccaaguaccucugaga

SEQ ID NO: 1553815 - RNA, 19 nt, Homo sapiens
uaagagaucuggacccaaa

SEQ ID NO: 1553816 - RNA, 19 nt, Homo sapiens
gaacagcacuauccucauc

SEQ ID NO: 1553817 - RNA, 19 nt, Homo sapiens
ugaggaagaugaugaguaa

SEQ ID NO: 1553818 - RNA, 19 nt, Homo sapiens
gaacggagacgacgccuuu

SEQ ID NO: 1553819 - RNA, 19 nt, Homo sapiens
gcaaggccuucaaugauau

SEQ ID NO: 1553820 - RNA, 19 nt, Homo sapiens
gaaagcaaguguucacaac

SEQ ID NO: 1553821 - RNA, 19 nt, Homo sapiens
gagcaagacauacuuaaug

SEQ ID NO: 1553822 - RNA, 19 nt, Homo sapiens
gauaaagcaucagagaaga

SEQ ID NO: 1553823 - RNA, 19 nt, Homo sapiens
gggcaguccugaguguuua

SEQ ID NO: 1553824 - RNA, 19 nt, Homo sapiens
caaguauugucauguauuc

SEQ ID NO: 1553825 - RNA, 19 nt, Homo sapiens
guaauaaacaggccacaga

SEQ ID NO: 1553826 - RNA, 19 nt, Homo sapiens
gaugagcaagacauacuua

SEQ ID NO: 1553827 - RNA, 19 nt, Homo sapiens
agcaaggccuucaaugaua

SEQ ID NO: 1553828 - RNA, 19 nt, Homo sapiens
gcagaggaaggaaaugauu

SEQ ID NO: 1553829 - RNA, 19 nt, Homo sapiens
gccaagaguucgauguuag

SEQ ID NO: 1553830 - RNA, 19 nt, Homo sapiens
cgaagaucaugcccaagaa

SEQ ID NO: 1553831 - RNA, 19 nt, Homo sapiens
gaugaaauacucggagaaa

SEQ ID NO: 1553832 - RNA, 19 nt, Homo sapiens
ucagcuauguguauaugaa

SEQ ID NO: 1553833 - RNA, 19 nt, Homo sapiens
gaaaaucagcuauguguau

SEQ ID NO: 1553834 - RNA, 19 nt, Homo sapiens
acacugugccauucuguua

SEQ ID NO: 1553835 - RNA, 19 nt, Homo sapiens
gauguuaguguuuccauug

SEQ ID NO: 1553836 - RNA, 19 nt, Homo sapiens
caaguaccauuauaagcau

SEQ ID NO: 1553837 - RNA, 19 nt, Homo sapiens
uaaugcauauuucgguuug

SEQ ID NO: 1553838 - RNA, 19 nt, Homo sapiens
caaagagacccagggauga

SEQ ID NO: 1553839 - RNA, 19 nt, Homo sapiens
ccaaguaccauuauaagca

SEQ ID NO: 1553840 - RNA, 19 nt, Homo sapiens
gaccguaaccgcaggauuc

SEQ ID NO: 1553841 - RNA, 19 nt, Homo sapiens
gaaaagcaaauacuucuga

SEQ ID NO: 1553842 - RNA, 19 nt, Homo sapiens
ccaccuuucauguguaaua

SEQ ID NO: 1553843 - RNA, 19 nt, Homo sapiens
gccauucuguuagauacua

SEQ ID NO: 1553844 - RNA, 19 nt, Homo sapiens
guuaguguuuccauuguau

SEQ ID NO: 1553845 - RNA, 19 nt, Homo sapiens
cugagaagauuaauaagag

SEQ ID NO: 1553846 - RNA, 19 nt, Homo sapiens
caagaagccagcagaggaa

SEQ ID NO: 1553847 - RNA, 19 nt, Homo sapiens
acaccaaguaccauuauaa

SEQ ID NO: 1553848 - RNA, 19 nt, Homo sapiens
aguccugaguguuuaauuu

SEQ ID NO: 1553849 - RNA, 19 nt, Homo sapiens
gcauauuucgguuugugua

SEQ ID NO: 1553850 - RNA, 19 nt, Homo sapiens
agaguucgauguuaguguu

SEQ ID NO: 1553851 - RNA, 19 nt, Homo sapiens
gaagggagugucagaagca

SEQ ID NO: 1553852 - RNA, 19 nt, Homo sapiens
ugccaagaguucgauguua

SEQ ID NO: 1553853 - RNA, 19 nt, Homo sapiens
caagugaaagcaaguguuc

SEQ ID NO: 1553854 - RNA, 19 nt, Homo sapiens
gguugaacguccucagaug

SEQ ID NO: 1553855 - RNA, 19 nt, Homo sapiens
ggccaugacuaaacuaggu

SEQ ID NO: 1553856 - RNA, 19 nt, Homo sapiens
acuaugaggccaugacuaa

SEQ ID NO: 1553857 - RNA, 19 nt, Homo sapiens
gggaaaagaugaaauacuc

SEQ ID NO: 1553858 - RNA, 19 nt, Homo sapiens
gccacauacuucucuaaga

SEQ ID NO: 1553859 - RNA, 19 nt, Homo sapiens
acccagggaugaugauaaa

SEQ ID NO: 1553860 - RNA, 19 nt, Homo sapiens
gagacgacgccuuugcaaa

SEQ ID NO: 1553861 - RNA, 19 nt, Homo sapiens
ggugauuuaugaagagauc

SEQ ID NO: 1553862 - RNA, 19 nt, Homo sapiens
cagagaaucaucccgaaga

SEQ ID NO: 1553863 - RNA, 19 nt, Homo sapiens
caaugaugagcaagacaua

SEQ ID NO: 1553864 - RNA, 19 nt, Homo sapiens
gcaagugaaagcaaguguu

SEQ ID NO: 1553865 - RNA, 19 nt, Homo sapiens
ucaggugcauagcaaguga

SEQ ID NO: 1553866 - RNA, 19 nt, Homo sapiens
caccuuucauguguaauaa

SEQ ID NO: 1553867 - RNA, 19 nt, Homo sapiens
cacaccaaguaccauuaua

SEQ ID NO: 1553868 - RNA, 19 nt, Homo sapiens
uaaacaggccacagacuuc

SEQ ID NO: 1553869 - RNA, 19 nt, Homo sapiens
caagacauacuuaaugcau

SEQ ID NO: 1553870 - RNA, 19 nt, Homo sapiens
ccgaagaucaugcccaaga

SEQ ID NO: 1553871 - RNA, 19 nt, Homo sapiens
agaaucaucccgaagauca

SEQ ID NO: 1553872 - RNA, 19 nt, Homo sapiens
cagagacccugaggaagau

SEQ ID NO: 1553873 - RNA, 19 nt, Homo sapiens
gacccagggaugaugauaa

SEQ ID NO: 1553874 - RNA, 19 nt, Homo sapiens
caacacacacacacacaca

SEQ ID NO: 1553875 - RNA, 19 nt, Homo sapiens
gucaucaggugcauagcaa

SEQ ID NO: 1553876 - RNA, 19 nt, Homo sapiens
cagcagaggaaggaaauga

SEQ ID NO: 1553877 - RNA, 19 nt, Homo sapiens
aaucagcuauguguauaug

SEQ ID NO: 1553878 - RNA, 19 nt, Homo sapiens
gagaaaaucagcuaugugu

SEQ ID NO: 1553879 - RNA, 19 nt, Homo sapiens
guguuuaauuucagacuuc

SEQ ID NO: 1553880 - RNA, 19 nt, Homo sapiens
gaagccagcagaggaagga

SEQ ID NO: 1553881 - RNA, 19 nt, Homo sapiens
gaacguccucagaugacuu

SEQ ID NO: 1553882 - RNA, 19 nt, Homo sapiens
aagcaaggccuucaaugau

SEQ ID NO: 1553883 - RNA, 19 nt, Homo sapiens
ugacaguuaacaaaccuuu

SEQ ID NO: 1553884 - RNA, 19 nt, Homo sapiens
ggagacgacgccuuugcaa

SEQ ID NO: 1553885 - RNA, 19 nt, Homo sapiens
uaaagcaucagagaagaga

SEQ ID NO: 1553886 - RNA, 19 nt, Homo sapiens
ccacagacugcgugagaga

SEQ ID NO: 1553887 - RNA, 19 nt, Homo sapiens
gaagaucaugcccaagaag

SEQ ID NO: 1553888 - RNA, 19 nt, Homo sapiens
ccucccaccuuucaugugu

SEQ ID NO: 1553889 - RNA, 19 nt, Homo sapiens
ugagggcaguccugagugu

SEQ ID NO: 1553890 - RNA, 19 nt, Homo sapiens
cgauguuaguguuuccauu

SEQ ID NO: 1553891 - RNA, 19 nt, Homo sapiens
gcauuuacacaccacacaa

SEQ ID NO: 1553892 - RNA, 19 nt, Homo sapiens
gcauagcaagugaaagcaa

SEQ ID NO: 1553893 - RNA, 19 nt, Homo sapiens
agaacauggugaccuuuca

SEQ ID NO: 1553894 - RNA, 19 nt, Homo sapiens
gauauugccacauacuucu

SEQ ID NO: 1553895 - RNA, 19 nt, Homo sapiens
guugaacguccucagauga

SEQ ID NO: 1553896 - RNA, 19 nt, Homo sapiens
cagggaugaugauaaagca

SEQ ID NO: 1553897 - RNA, 19 nt, Homo sapiens
agagaaucaucccgaagau

SEQ ID NO: 1553898 - RNA, 19 nt, Homo sapiens
cauguauucucugcauaga

SEQ ID NO: 1553899 - RNA, 19 nt, Homo sapiens
gcuggugauuuaugaagag

SEQ ID NO: 1553900 - RNA, 19 nt, Homo sapiens
guacuccccucauccgauu

SEQ ID NO: 1553901 - RNA, 19 nt, Homo sapiens
gucauguauucucugcaua

SEQ ID NO: 1553902 - RNA, 19 nt, Homo sapiens
ugucauguauucucugcau

SEQ ID NO: 1553903 - RNA, 19 nt, Homo sapiens
uguuaguguuuccauugua

SEQ ID NO: 1553904 - RNA, 19 nt, Homo sapiens
gcagaacauggugaccuuu

SEQ ID NO: 1553905 - RNA, 19 nt, Homo sapiens
caucagagaagagaagcaa

SEQ ID NO: 1553906 - RNA, 19 nt, Homo sapiens
acacacaccaaguaccauu

SEQ ID NO: 1553907 - RNA, 19 nt, Homo sapiens
guauugucauguauucucu

SEQ ID NO: 1553908 - RNA, 19 nt, Homo sapiens
ucccaccuuucauguguaa

SEQ ID NO: 1553909 - RNA, 19 nt, Homo sapiens
gaaacuaugaggccaugac

SEQ ID NO: 1553910 - RNA, 19 nt, Homo sapiens
cacacacacacaccaagua

SEQ ID NO: 1553911 - RNA, 19 nt, Homo sapiens
auaaacaggccacagacuu

SEQ ID NO: 1553912 - RNA, 19 nt, Homo sapiens
cacacaccaaguaccauua

SEQ ID NO: 1553913 - RNA, 19 nt, Homo sapiens
gaaagagugggaaaagaug

SEQ ID NO: 1553914 - RNA, 19 nt, Homo sapiens
gcaccuacgucagaaaaca

SEQ ID NO: 1553915 - RNA, 19 nt, Homo sapiens
gaaagcagcuggugauuua

SEQ ID NO: 1553916 - RNA, 19 nt, Homo sapiens
gaacggagacgaugccuuu

SEQ ID NO: 1553917 - RNA, 19 nt, Homo sapiens
aaacaaguauagucaggua

SEQ ID NO: 1553918 - RNA, 19 nt, Homo sapiens
ugaagaagacgacgaguaa

SEQ ID NO: 1553919 - RNA, 19 nt, Homo sapiens
gaaagcaaguguucacaac

SEQ ID NO: 1553920 - RNA, 19 nt, Homo sapiens
caaggcaucuggacccaaa

SEQ ID NO: 1553921 - RNA, 19 nt, Homo sapiens
gggcaguucugaguguuua

SEQ ID NO: 1553922 - RNA, 19 nt, Homo sapiens
cagcagagguaggaaauga

SEQ ID NO: 1553923 - RNA, 19 nt, Homo sapiens
gccaaauacuucucuaaga

SEQ ID NO: 1553924 - RNA, 19 nt, Homo sapiens
gugcaauucuguuagauau

SEQ ID NO: 1553925 - RNA, 19 nt, Homo sapiens
gaugaaauccucggagaaa

SEQ ID NO: 1553926 - RNA, 19 nt, Homo sapiens
caaaaggccuucgaugaua

SEQ ID NO: 1553927 - RNA, 19 nt, Homo sapiens
gaaaugauucgaaggaagu

SEQ ID NO: 1553928 - RNA, 19 nt, Homo sapiens
caagaagccagcagaggua

SEQ ID NO: 1553929 - RNA, 19 nt, Homo sapiens
ccaacuaccucugagaaga

SEQ ID NO: 1553930 - RNA, 19 nt, Homo sapiens
gcagagguaggaaaugauu

SEQ ID NO: 1553931 - RNA, 19 nt, Homo sapiens
guugaacguucucagauga

SEQ ID NO: 1553932 - RNA, 19 nt, Homo sapiens
guuaauacaccuuugcaaa

SEQ ID NO: 1553933 - RNA, 19 nt, Homo sapiens
gccaagaguucgauguuag

SEQ ID NO: 1553934 - RNA, 19 nt, Homo sapiens
cgaagaucaugcccaagaa

SEQ ID NO: 1553935 - RNA, 19 nt, Homo sapiens
ccacaggaaucagguugaa

SEQ ID NO: 1553936 - RNA, 19 nt, Homo sapiens
uaauguguauuucgguuug

SEQ ID NO: 1553937 - RNA, 19 nt, Homo sapiens
ccaccuuucauguguaaua

SEQ ID NO: 1553938 - RNA, 19 nt, Homo sapiens
gguugaacguucucagaug

SEQ ID NO: 1553939 - RNA, 19 nt, Homo sapiens
ccaaguaccaguauaagca

SEQ ID NO: 1553940 - RNA, 19 nt, Homo sapiens
uagggcugguucucaaaua

SEQ ID NO: 1553941 - RNA, 19 nt, Homo sapiens
agaguucgauguuaguguu

SEQ ID NO: 1553942 - RNA, 19 nt, Homo sapiens
gaaggaagugccagaagca

SEQ ID NO: 1553943 - RNA, 19 nt, Homo sapiens
caaguauagucagguauuc

SEQ ID NO: 1553944 - RNA, 19 nt, Homo sapiens
ugccaagaguucgauguua

SEQ ID NO: 1553945 - RNA, 19 nt, Homo sapiens
caagugaaagcaaguguuc

SEQ ID NO: 1553946 - RNA, 19 nt, Homo sapiens
ggccaugacuaaacuaggu

SEQ ID NO: 1553947 - RNA, 19 nt, Homo sapiens
aguaugaggccaugacuaa

SEQ ID NO: 1553948 - RNA, 19 nt, Homo sapiens
guauaagcaucucccaucu

SEQ ID NO: 1553949 - RNA, 19 nt, Homo sapiens
acaccaaguaccaguauaa

SEQ ID NO: 1553950 - RNA, 19 nt, Homo sapiens
agaauguggugaccuuuca

SEQ ID NO: 1553951 - RNA, 19 nt, Homo sapiens
cagguauucucuccauaga

SEQ ID NO: 1553952 - RNA, 19 nt, Homo sapiens
ggugauuuaugaagagauc

SEQ ID NO: 1553953 - RNA, 19 nt, Homo sapiens
gaaaaguugagcuucauuu

SEQ ID NO: 1553954 - RNA, 19 nt, Homo sapiens
gcaagugaaagcaaguguu

SEQ ID NO: 1553955 - RNA, 19 nt, Homo sapiens
ucaggugcauagcaaguga

SEQ ID NO: 1553956 - RNA, 19 nt, Homo sapiens
gaaaaccaacuaccucuga

SEQ ID NO: 1553957 - RNA, 19 nt, Homo sapiens
ggaagugccagaagcaucu

SEQ ID NO: 1553958 - RNA, 19 nt, Homo sapiens
gagaaaaucaucuaugugu

SEQ ID NO: 1553959 - RNA, 19 nt, Homo sapiens
ccaugcaccuaccucagaa

SEQ ID NO: 1553960 - RNA, 19 nt, Homo sapiens
ccgaagaucaugcccaaga

SEQ ID NO: 1553961 - RNA, 19 nt, Homo sapiens
aggcuacccucccaccuuu

SEQ ID NO: 1553962 - RNA, 19 nt, Homo sapiens
gaaaguaugaggccaugac

SEQ ID NO: 1553963 - RNA, 19 nt, Homo sapiens
gcaccuaccucagaaaaca

SEQ ID NO: 1553964 - RNA, 19 nt, Homo sapiens
gacaguuaauacaccuuug

SEQ ID NO: 1553965 - RNA, 19 nt, Homo sapiens
ugagggcaguucugagugu

SEQ ID NO: 1553966 - RNA, 19 nt, Homo sapiens
ucaaauaccagagaagauc

SEQ ID NO: 1553967 - RNA, 19 nt, Homo sapiens
gucaucaggugcauagcaa

SEQ ID NO: 1553968 - RNA, 19 nt, Homo sapiens
ccucugagaagauuaacaa

SEQ ID NO: 1553969 - RNA, 19 nt, Homo sapiens
caacuaccucugagaagau

SEQ ID NO: 1553970 - RNA, 19 nt, Homo sapiens
gaaucagguugaacguucu

SEQ ID NO: 1553971 - RNA, 19 nt, Homo sapiens
guacuccccuccucugauu

SEQ ID NO: 1553972 - RNA, 19 nt, Homo sapiens
acaaguauagucagguauu

SEQ ID NO: 1553973 - RNA, 19 nt, Homo sapiens
cagcgacccugaagaagac

SEQ ID NO: 1553974 - RNA, 19 nt, Homo sapiens
agaaagcagcuggugauuu

SEQ ID NO: 1553975 - RNA, 19 nt, Homo sapiens
gagaaagcagcuggugauu

SEQ ID NO: 1553976 - RNA, 19 nt, Homo sapiens
gaagccagcagagguagga

SEQ ID NO: 1553977 - RNA, 19 nt, Homo sapiens
ugacaguuaauacaccuuu

SEQ ID NO: 1553978 - RNA, 19 nt, Homo sapiens
acacagagacacacacaca

SEQ ID NO: 1553979 - RNA, 19 nt, Homo sapiens
guucugaguguuuaauuuc

SEQ ID NO: 1553980 - RNA, 19 nt, Homo sapiens
ccacagacugcgugagaga

SEQ ID NO: 1553981 - RNA, 19 nt, Homo sapiens
gaagaucaugcccaagaag

SEQ ID NO: 1553982 - RNA, 19 nt, Homo sapiens
gaccguaaccacaggaauc

SEQ ID NO: 1553983 - RNA, 19 nt, Homo sapiens
ccucccaccuuucaugugu

SEQ ID NO: 1553984 - RNA, 19 nt, Homo sapiens
uaauacaccuuugcaaacg

SEQ ID NO: 1553985 - RNA, 19 nt, Homo sapiens
gcauagcaagugaaagcaa

SEQ ID NO: 1553986 - RNA, 19 nt, Homo sapiens
cacaccaaguaccaguaua

SEQ ID NO: 1553987 - RNA, 19 nt, Homo sapiens
gcauuuacacacacacaca

SEQ ID NO: 1553988 - RNA, 19 nt, Homo sapiens
gagggcaguucugaguguu

SEQ ID NO: 1553989 - RNA, 19 nt, Homo sapiens
guauuucgguuuguguauc

SEQ ID NO: 1553990 - RNA, 19 nt, Homo sapiens
uaguguuuccguuguauuu

SEQ ID NO: 1553991 - RNA, 19 nt, Homo sapiens
gcuggugauuuaugaagag

SEQ ID NO: 1553992 - RNA, 19 nt, Homo sapiens
guuaguguuuccguuguau

SEQ ID NO: 1553993 - RNA, 19 nt, Homo sapiens
cugaagaagacgacgagua

SEQ ID NO: 1553994 - RNA, 19 nt, Homo sapiens
agagaaagcagcuggugau

SEQ ID NO: 1553995 - RNA, 19 nt, Homo sapiens
uaggaaaugauucgaagga

SEQ ID NO: 1553996 - RNA, 19 nt, Homo sapiens
auacaccuuugcaaacguu

SEQ ID NO: 1553997 - RNA, 19 nt, Homo sapiens
auagugugcaauucuguua

SEQ ID NO: 1553998 - RNA, 19 nt, Homo sapiens
cggagaaaaucaucuaugu

SEQ ID NO: 1553999 - RNA, 19 nt, Homo sapiens
ucccaccuuucauguguaa

SEQ ID NO: 1554000 - RNA, 19 nt, Homo sapiens
cacacacacacaccaagua

SEQ ID NO: 1554001 - RNA, 19 nt, Homo sapiens
cuaccucugagaagauuaa

SEQ ID NO: 1554002 - RNA, 19 nt, Homo sapiens
cggagacgaugccuuugca

SEQ ID NO: 1554003 - RNA, 19 nt, Homo sapiens
cauagaacagcacuaccuu

SEQ ID NO: 1554004 - RNA, 19 nt, Homo sapiens
gucagguauucucuccaua

SEQ ID NO: 1554005 - RNA, 19 nt, Homo sapiens
uguuaguguuuccguugua

SEQ ID NO: 1554006 - RNA, 19 nt, Homo sapiens
gugcauagcaagugaaagc

SEQ ID NO: 1554007 - RNA, 19 nt, Homo sapiens
gcagaauguggugaccuuu

SEQ ID NO: 1554008 - RNA, 19 nt, Homo sapiens
gaacguucucagaugacuu

SEQ ID NO: 1554009 - RNA, 19 nt, Homo sapiens
gaaagagugggaaaagaug

SEQ ID NO: 1554010 - RNA, 19 nt, Homo sapiens
gauuuucuccucugcauuu

SEQ ID NO: 1554011 - RNA, 19 nt, Homo sapiens
ccaaaaggccuucgaugau

SEQ ID NO: 1554012 - RNA, 19 nt, Homo sapiens
ggggaaugauuuugauaau

SEQ ID NO: 1554013 - RNA, 19 nt, Homo sapiens
acacacacacacacagaga

SEQ ID NO: 1554014 - RNA, 19 nt, Homo sapiens
acacacacacacacacaga

SEQ ID NO: 1554015 - RNA, 19 nt, Homo sapiens
gaacagcacugaaauccuu

SEQ ID NO: 1554016 - RNA, 19 nt, Homo sapiens
caaauaagauaugcuguuc

SEQ ID NO: 1554017 - RNA, 19 nt, Homo sapiens
gcacaaggacaucaaauca

SEQ ID NO: 1554018 - RNA, 19 nt, Homo sapiens
gccaaaggauggugucuug

SEQ ID NO: 1554019 - RNA, 19 nt, Homo sapiens
acaagaacaucaacaggaa

SEQ ID NO: 1554020 - RNA, 19 nt, Homo sapiens
caaaucaucagcacaagaa

SEQ ID NO: 1554021 - RNA, 19 nt, Homo sapiens
gaaucaaggucugugagaa

SEQ ID NO: 1554022 - RNA, 19 nt, Homo sapiens
gaacacugguggccaaagg

SEQ ID NO: 1554023 - RNA, 19 nt, Homo sapiens
gguuacaccugcagacuau

SEQ ID NO: 1554024 - RNA, 19 nt, Homo sapiens
gauggugucuugugaaagg

SEQ ID NO: 1554025 - RNA, 19 nt, Homo sapiens
acaaggacaucaaaucauc

SEQ ID NO: 1554026 - RNA, 19 nt, Homo sapiens
gaggauaccgugacaagau

SEQ ID NO: 1554027 - RNA, 19 nt, Homo sapiens
aaaggauggugucuuguga

SEQ ID NO: 1554028 - RNA, 19 nt, Homo sapiens
gagaagcgacccagcauag

SEQ ID NO: 1554029 - RNA, 19 nt, Homo sapiens
cagaacaaaugcccaugga

SEQ ID NO: 1554030 - RNA, 19 nt, Homo sapiens
ccaccacuguucauauuuc

SEQ ID NO: 1554031 - RNA, 19 nt, Homo sapiens
gaaaggagggcaagcaaaa

SEQ ID NO: 1554032 - RNA, 19 nt, Homo sapiens
caucaaaucaucagcacaa

SEQ ID NO: 1554033 - RNA, 19 nt, Homo sapiens
gaagcgacccagcauagau

SEQ ID NO: 1554034 - RNA, 19 nt, Homo sapiens
gaagcacaaggacaucaaa

SEQ ID NO: 1554035 - RNA, 19 nt, Homo sapiens
gaaggaggaacagcacuga

SEQ ID NO: 1554036 - RNA, 19 nt, Homo sapiens
ggaggaacagcacugaaau

SEQ ID NO: 1554037 - RNA, 19 nt, Homo sapiens
cccugucccugucaaauaa

SEQ ID NO: 1554038 - RNA, 19 nt, Homo sapiens
caaaggauggugucuugug

SEQ ID NO: 1554039 - RNA, 19 nt, Homo sapiens
ccaaaagugugaaacaaau

SEQ ID NO: 1554040 - RNA, 19 nt, Homo sapiens
ugugggaacauuuguauga

SEQ ID NO: 1554041 - RNA, 19 nt, Homo sapiens
aauaagauaugcuguucag

SEQ ID NO: 1554042 - RNA, 19 nt, Homo sapiens
guaugagcauccuaugagu

SEQ ID NO: 1554043 - RNA, 19 nt, Homo sapiens
aggauggugucuugugaaa

SEQ ID NO: 1554044 - RNA, 19 nt, Homo sapiens
agaugaggaugcagagaau

SEQ ID NO: 1554045 - RNA, 19 nt, Homo sapiens
ugaaaggagggcaagcaaa

SEQ ID NO: 1554046 - RNA, 19 nt, Homo sapiens
gcccacauccgaagcacaa

SEQ ID NO: 1554047 - RNA, 19 nt, Homo sapiens
gaggaacagcacugaaauc

SEQ ID NO: 1554048 - RNA, 19 nt, Homo sapiens
guucauauuuccaaaagug

SEQ ID NO: 1554049 - RNA, 19 nt, Homo sapiens
caucagcacaagaacauca

SEQ ID NO: 1554050 - RNA, 19 nt, Homo sapiens
gcauccaccacuguucaua

SEQ ID NO: 1554051 - RNA, 19 nt, Homo sapiens
ugagaagcgacccagcaua

SEQ ID NO: 1554052 - RNA, 19 nt, Homo sapiens
aagaugaggaugcagagaa

SEQ ID NO: 1554053 - RNA, 19 nt, Homo sapiens
gggaggauaccgugacaag

SEQ ID NO: 1554054 - RNA, 19 nt, Homo sapiens
ccugucaaauaaaccagaa

SEQ ID NO: 1554055 - RNA, 19 nt, Homo sapiens
gcaaaaguguaggacaaau

SEQ ID NO: 1554056 - RNA, 19 nt, Homo sapiens
ccacuguucauauuuccaa

SEQ ID NO: 1554057 - RNA, 19 nt, Homo sapiens
ggaggauaccgugacaaga

SEQ ID NO: 1554058 - RNA, 19 nt, Homo sapiens
gaacucccugucccuguca

SEQ ID NO: 1554059 - RNA, 19 nt, Homo sapiens
ucaaaucaucagcacaaga

SEQ ID NO: 1554060 - RNA, 19 nt, Homo sapiens
aggauaccgugacaagaug

SEQ ID NO: 1554061 - RNA, 19 nt, Homo sapiens
aggaggaacagcacugaaa

SEQ ID NO: 1554062 - RNA, 19 nt, Homo sapiens
ucccugucccugucaaaua

SEQ ID NO: 1554063 - RNA, 19 nt, Homo sapiens
auccaccacuguucauauu

SEQ ID NO: 1554064 - RNA, 19 nt, Homo sapiens
caaggacaucaaaucauca

SEQ ID NO: 1554065 - RNA, 19 nt, Homo sapiens
caaaaguguaggacaaauu

SEQ ID NO: 1554066 - RNA, 19 nt, Homo sapiens
cauccaccacuguucauau

SEQ ID NO: 1554067 - RNA, 19 nt, Homo sapiens
gugaaaggagggcaagcaa

SEQ ID NO: 1554068 - RNA, 19 nt, Homo sapiens
cagggaggauaccgugaca

SEQ ID NO: 1554069 - RNA, 19 nt, Homo sapiens
caagaacaucaacaggaau

SEQ ID NO: 1554070 - RNA, 19 nt, Homo sapiens
ugcagacuaucccacagaa

SEQ ID NO: 1554071 - RNA, 19 nt, Homo sapiens
gugacaagaugaggaugca

SEQ ID NO: 1554072 - RNA, 19 nt, Homo sapiens
ggauaccgugacaagauga

SEQ ID NO: 1554073 - RNA, 19 nt, Homo sapiens
cgaagcacaaggacaucaa

SEQ ID NO: 1554074 - RNA, 19 nt, Homo sapiens
gagagugggcugggaugug

SEQ ID NO: 1554075 - RNA, 19 nt, Homo sapiens
aagcaaaaguguaggacaa

SEQ ID NO: 1554076 - RNA, 19 nt, Homo sapiens
aagaacaucaacaggaaug

SEQ ID NO: 1554077 - RNA, 19 nt, Homo sapiens
agaaucaaggucugugaga

SEQ ID NO: 1554078 - RNA, 19 nt, Homo sapiens
aauccuuucucgcaaucuu

SEQ ID NO: 1554079 - RNA, 19 nt, Homo sapiens
cucgcaaucuuccugcauu

SEQ ID NO: 1554080 - RNA, 19 nt, Homo sapiens
gaacagcacugaaauccuu

SEQ ID NO: 1554081 - RNA, 19 nt, Homo sapiens
caaauaagauaugcuguuc

SEQ ID NO: 1554082 - RNA, 19 nt, Homo sapiens
gcacaaggacaucaaauca

SEQ ID NO: 1554083 - RNA, 19 nt, Homo sapiens
gccaaaggauggugucuug

SEQ ID NO: 1554084 - RNA, 19 nt, Homo sapiens
acaagaacaucaacaggaa

SEQ ID NO: 1554085 - RNA, 19 nt, Homo sapiens
caaaucaucagcacaagaa

SEQ ID NO: 1554086 - RNA, 19 nt, Homo sapiens
gaaucaaggucugugagaa

SEQ ID NO: 1554087 - RNA, 19 nt, Homo sapiens
gaacacugguggccaaagg

SEQ ID NO: 1554088 - RNA, 19 nt, Homo sapiens
gguuacaccugcagacuau

SEQ ID NO: 1554089 - RNA, 19 nt, Homo sapiens
gauggugucuugugaaagg

SEQ ID NO: 1554090 - RNA, 19 nt, Homo sapiens
acaaggacaucaaaucauc

SEQ ID NO: 1554091 - RNA, 19 nt, Homo sapiens
aaaggauggugucuuguga

SEQ ID NO: 1554092 - RNA, 19 nt, Homo sapiens
gagaagcgacccagcauag

SEQ ID NO: 1554093 - RNA, 19 nt, Homo sapiens
cagaacaaaugcccaugga

SEQ ID NO: 1554094 - RNA, 19 nt, Homo sapiens
ccaccacuguucauauuuc

SEQ ID NO: 1554095 - RNA, 19 nt, Homo sapiens
gaaaggagggcaagcaaaa

SEQ ID NO: 1554096 - RNA, 19 nt, Homo sapiens
caucaaaucaucagcacaa

SEQ ID NO: 1554097 - RNA, 19 nt, Homo sapiens
gaagcgacccagcauagau

SEQ ID NO: 1554098 - RNA, 19 nt, Homo sapiens
ggaaucaaggucugugaga

SEQ ID NO: 1554099 - RNA, 19 nt, Homo sapiens
gaagcacaaggacaucaaa

SEQ ID NO: 1554100 - RNA, 19 nt, Homo sapiens
gaaggaggaacagcacuga

SEQ ID NO: 1554101 - RNA, 19 nt, Homo sapiens
ggaggaacagcacugaaau

SEQ ID NO: 1554102 - RNA, 19 nt, Homo sapiens
cccugucccugucaaauaa

SEQ ID NO: 1554103 - RNA, 19 nt, Homo sapiens
caaaggauggugucuugug

SEQ ID NO: 1554104 - RNA, 19 nt, Homo sapiens
ccaaaagugugaaacaaau

SEQ ID NO: 1554105 - RNA, 19 nt, Homo sapiens
ugugggaacauuuguauga

SEQ ID NO: 1554106 - RNA, 19 nt, Homo sapiens
aauaagauaugcuguucag

SEQ ID NO: 1554107 - RNA, 19 nt, Homo sapiens
aggauggugucuugugaaa

SEQ ID NO: 1554108 - RNA, 19 nt, Homo sapiens
guaugagcauccuaugagu

SEQ ID NO: 1554109 - RNA, 19 nt, Homo sapiens
ugaaaggagggcaagcaaa

SEQ ID NO: 1554110 - RNA, 19 nt, Homo sapiens
gcccacauccgaagcacaa

SEQ ID NO: 1554111 - RNA, 19 nt, Homo sapiens
gaggaacagcacugaaauc

SEQ ID NO: 1554112 - RNA, 19 nt, Homo sapiens
guucauauuuccaaaagug

SEQ ID NO: 1554113 - RNA, 19 nt, Homo sapiens
caucagcacaagaacauca

SEQ ID NO: 1554114 - RNA, 19 nt, Homo sapiens
gcauccaccacuguucaua

SEQ ID NO: 1554115 - RNA, 19 nt, Homo sapiens
ugagaagcgacccagcaua

SEQ ID NO: 1554116 - RNA, 19 nt, Homo sapiens
ccugucaaauaaaccagaa

SEQ ID NO: 1554117 - RNA, 19 nt, Homo sapiens
gcaaaaguguaggacaaau

SEQ ID NO: 1554118 - RNA, 19 nt, Homo sapiens
ccacuguucauauuuccaa

SEQ ID NO: 1554119 - RNA, 19 nt, Homo sapiens
gaacucccugucccuguca

SEQ ID NO: 1554120 - RNA, 19 nt, Homo sapiens
ucaaaucaucagcacaaga

SEQ ID NO: 1554121 - RNA, 19 nt, Homo sapiens
aggaggaacagcacugaaa

SEQ ID NO: 1554122 - RNA, 19 nt, Homo sapiens
ucccugucccugucaaaua

SEQ ID NO: 1554123 - RNA, 19 nt, Homo sapiens
auccaccacuguucauauu

SEQ ID NO: 1554124 - RNA, 19 nt, Homo sapiens
caaggacaucaaaucauca

SEQ ID NO: 1554125 - RNA, 19 nt, Homo sapiens
cauccaccacuguucauau

SEQ ID NO: 1554126 - RNA, 19 nt, Homo sapiens
gugaaaggagggcaagcaa

SEQ ID NO: 1554127 - RNA, 19 nt, Homo sapiens
caaaaguguaggacaaauu

SEQ ID NO: 1554128 - RNA, 19 nt, Homo sapiens
caagaacaucaacaggaau

SEQ ID NO: 1554129 - RNA, 19 nt, Homo sapiens
ugcagacuaucccacagaa

SEQ ID NO: 1554130 - RNA, 19 nt, Homo sapiens
cgaagcacaaggacaucaa

SEQ ID NO: 1554131 - RNA, 19 nt, Homo sapiens
gagagugggcugggaugug

SEQ ID NO: 1554132 - RNA, 19 nt, Homo sapiens
aagcaaaaguguaggacaa

SEQ ID NO: 1554133 - RNA, 19 nt, Homo sapiens
aagaacaucaacaggaaug

SEQ ID NO: 1554134 - RNA, 19 nt, Homo sapiens
cucgcaaucuuccugcauu

SEQ ID NO: 1554135 - RNA, 19 nt, Homo sapiens
aauccuuucucgcaaucuu

SEQ ID NO: 1554136 - RNA, 19 nt, Homo sapiens
gaccagagaucaggaauga

SEQ ID NO: 1554137 - RNA, 19 nt, Homo sapiens
ggccaaagaugccuuagaa

SEQ ID NO: 1554138 - RNA, 19 nt, Homo sapiens
gaucaggaaugaaacuaga

SEQ ID NO: 1554139 - RNA, 19 nt, Homo sapiens
ggaaugaaacuagacauga

SEQ ID NO: 1554140 - RNA, 19 nt, Homo sapiens
ccaaagaugccuuagaaga

SEQ ID NO: 1554141 - RNA, 19 nt, Homo sapiens
ccagagaucaggaaugaaa

SEQ ID NO: 1554142 - RNA, 19 nt, Homo sapiens
gaaugaaacuagacaugac

SEQ ID NO: 1554143 - RNA, 19 nt, Homo sapiens
uaaauuagccacuugucuu

SEQ ID NO: 1554144 - RNA, 19 nt, Homo sapiens
aaauuagccacuugucuua

SEQ ID NO: 1554145 - RNA, 19 nt, Homo sapiens
gcaaggggcugccacauag

SEQ ID NO: 1554146 - RNA, 19 nt, Homo sapiens
ccacauagcccaguucaag

SEQ ID NO: 1554147 - RNA, 19 nt, Homo sapiens
aagagucgcuucugcugaa

SEQ ID NO: 1554148 - RNA, 19 nt, Homo sapiens
caaagaugccuuagaagag

SEQ ID NO: 1554149 - RNA, 19 nt, Homo sapiens
ggugacagccucagagugu

SEQ ID NO: 1554150 - RNA, 19 nt, Homo sapiens
ugacaaagaccagagauca

SEQ ID NO: 1554151 - RNA, 19 nt, Homo sapiens
aaagaugccuuagaagagu

SEQ ID NO: 1554152 - RNA, 19 nt, Homo sapiens
cgcgagaccugaauugugu

SEQ ID NO: 1554153 - RNA, 19 nt, Homo sapiens
gagcugcaggccuuuaaga

SEQ ID NO: 1554154 - RNA, 19 nt, Homo sapiens
cuucacacccugcaccaua

SEQ ID NO: 1554155 - RNA, 19 nt, Homo sapiens
caugcaaccugagauuuua

SEQ ID NO: 1554156 - RNA, 19 nt, Homo sapiens
gagaucaggaaugaaacua

SEQ ID NO: 1554157 - RNA, 19 nt, Homo sapiens
agccacuugucuuaauuua

SEQ ID NO: 1554158 - RNA, 19 nt, Homo sapiens
uuagccacuugucuuaauu

SEQ ID NO: 1554159 - RNA, 19 nt, Homo sapiens
ugacagccucagaguguuu

SEQ ID NO: 1554160 - RNA, 19 nt, Homo sapiens
gagggccaaagaugccuua

SEQ ID NO: 1554161 - RNA, 19 nt, Homo sapiens
uuuaagagggccaaagaug

SEQ ID NO: 1554162 - RNA, 19 nt, Homo sapiens
gggccaaagaugccuuaga

SEQ ID NO: 1554163 - RNA, 19 nt, Homo sapiens
uagccacuugucuuaauuu

SEQ ID NO: 1554164 - RNA, 19 nt, Homo sapiens
ucacgcgagaccugaauug

SEQ ID NO: 1554165 - RNA, 19 nt, Homo sapiens
ggccaaagaugccuuagaa

SEQ ID NO: 1554166 - RNA, 19 nt, Homo sapiens
ccaaagaugccuuagaaga

SEQ ID NO: 1554167 - RNA, 19 nt, Homo sapiens
gcaaggggcugccacauag

SEQ ID NO: 1554168 - RNA, 19 nt, Homo sapiens
ccacauagcccaguucaag

SEQ ID NO: 1554169 - RNA, 19 nt, Homo sapiens
aagagucgcuucugcugaa

SEQ ID NO: 1554170 - RNA, 19 nt, Homo sapiens
caaagaugccuuagaagag

SEQ ID NO: 1554171 - RNA, 19 nt, Homo sapiens
aaagaugccuuagaagagu

SEQ ID NO: 1554172 - RNA, 19 nt, Homo sapiens
cgcgagaccugaauugugu

SEQ ID NO: 1554173 - RNA, 19 nt, Homo sapiens
gagcugcaggccuuuaaga

SEQ ID NO: 1554174 - RNA, 19 nt, Homo sapiens
cuucacacccugcaccaua

SEQ ID NO: 1554175 - RNA, 19 nt, Homo sapiens
gagggccaaagaugccuua

SEQ ID NO: 1554176 - RNA, 19 nt, Homo sapiens
uuuaagagggccaaagaug

SEQ ID NO: 1554177 - RNA, 19 nt, Homo sapiens
gggccaaagaugccuuaga

SEQ ID NO: 1554178 - RNA, 19 nt, Homo sapiens
ucacgcgagaccugaauug

SEQ ID NO: 1554179 - RNA, 19 nt, Homo sapiens
gggaagcaguugcgauuua

SEQ ID NO: 1554180 - RNA, 19 nt, Homo sapiens
gggaagggcugccacauug

SEQ ID NO: 1554181 - RNA, 19 nt, Homo sapiens
caucuuggauugcccauuu

SEQ ID NO: 1554182 - RNA, 19 nt, Homo sapiens
gaugggaaccugugucuga

SEQ ID NO: 1554183 - RNA, 19 nt, Homo sapiens
gagcccuacuccuuccuua

SEQ ID NO: 1554184 - RNA, 19 nt, Homo sapiens
ggaagcaguugcgauuuag

SEQ ID NO: 1554185 - RNA, 19 nt, Homo sapiens
cgcgagaccucaaauaugu

SEQ ID NO: 1554186 - RNA, 19 nt, Homo sapiens
acauagggcugaguuuauu

SEQ ID NO: 1554187 - RNA, 19 nt, Homo sapiens
agacauagggcugaguuua

SEQ ID NO: 1554188 - RNA, 19 nt, Homo sapiens
gggaaccugugucugagaa

SEQ ID NO: 1554189 - RNA, 19 nt, Homo sapiens
gcgcugagcccuacuccuu

SEQ ID NO: 1554190 - RNA, 19 nt, Homo sapiens
gacauagggcugaguuuau

SEQ ID NO: 1554191 - RNA, 19 nt, Homo sapiens
uuacacacaucaucuugga

SEQ ID NO: 1554192 - RNA, 19 nt, Homo sapiens
gggcugaguuuauuguuuu

SEQ ID NO: 1554193 - RNA, 19 nt, Homo sapiens
uauuuccucucacccuuua

SEQ ID NO: 1554194 - RNA, 19 nt, Homo sapiens
ccuacuccuuccuuaauuu

SEQ ID NO: 1554195 - RNA, 19 nt, Homo sapiens
ucucacccuuuauuuauga

SEQ ID NO: 1554196 - RNA, 19 nt, Homo sapiens
gcuggugacuuuggugcua

SEQ ID NO: 1554197 - RNA, 19 nt, Homo sapiens
acacacaucaucuuggauu

SEQ ID NO: 1554198 - RNA, 19 nt, Homo sapiens
cuacuccuuccuuaauuua

SEQ ID NO: 1554199 - RNA, 19 nt, Homo sapiens
ccucucacccuuuauuuau

SEQ ID NO: 1554200 - RNA, 19 nt, Homo sapiens
uugcagcucuccugucuuc

SEQ ID NO: 1554201 - RNA, 19 nt, Homo sapiens
ccguggugcuggugacuuu

SEQ ID NO: 1554202 - RNA, 19 nt, Homo sapiens
ucacgcgagaccucaaaua

SEQ ID NO: 1554203 - RNA, 19 nt, Homo sapiens
uaaacaacaaggaauugga

SEQ ID NO: 1554204 - RNA, 19 nt, Homo sapiens
ccagggacgccuuggaaga

SEQ ID NO: 1554205 - RNA, 19 nt, Homo sapiens
gcccuacuccuuccuuaau

SEQ ID NO: 1554206 - RNA, 19 nt, Homo sapiens
cacgcgagaccucaaauau

SEQ ID NO: 1554207 - RNA, 19 nt, Homo sapiens
cacauuggcagguucaaau

SEQ ID NO: 1554208 - RNA, 19 nt, Homo sapiens
agggcugaguuuauuguuu

SEQ ID NO: 1554209 - RNA, 19 nt, Homo sapiens
aggcaucugucaccuucaa

SEQ ID NO: 1554210 - RNA, 19 nt, Homo sapiens
gagacauagggcugaguuu

SEQ ID NO: 1554211 - RNA, 19 nt, Homo sapiens
ccacauuggcagguucaaa

SEQ ID NO: 1554212 - RNA, 19 nt, Homo sapiens
cacacaucaucuuggauug

SEQ ID NO: 1554213 - RNA, 19 nt, Homo sapiens
ugagacauagggcugaguu

SEQ ID NO: 1554214 - RNA, 19 nt, Homo sapiens
cccuacuccuuccuuaauu

SEQ ID NO: 1554215 - RNA, 19 nt, Homo sapiens
ugggaagggcugccacauu

SEQ ID NO: 1554216 - RNA, 19 nt, Homo sapiens
gagcuucgcuugcaagaau

SEQ ID NO: 1554217 - RNA, 19 nt, Homo sapiens
ugaggaagcugccuuauag

SEQ ID NO: 1554218 - RNA, 19 nt, Homo sapiens
ucaaagcggucaucacaga

SEQ ID NO: 1554219 - RNA, 19 nt, Homo sapiens
ggaagcugccuuauaguuu

SEQ ID NO: 1554220 - RNA, 19 nt, Homo sapiens
gaaccaagcuucguaucca

SEQ ID NO: 1554221 - RNA, 19 nt, Homo sapiens
gaauaacuguuccaaagac

SEQ ID NO: 1554222 - RNA, 19 nt, Homo sapiens
gcauaacaaccauacaauu

SEQ ID NO: 1554223 - RNA, 19 nt, Homo sapiens
gagaggagcuucgcuugca

SEQ ID NO: 1554224 - RNA, 19 nt, Homo sapiens
gcuauuggcucagcugguu

SEQ ID NO: 1554225 - RNA, 19 nt, Homo sapiens
gaagcugccuuauaguuuu

SEQ ID NO: 1554226 - RNA, 19 nt, Homo sapiens
gcucaaagcggucaucaca

SEQ ID NO: 1554227 - RNA, 19 nt, Homo sapiens
gaaaagccucauuacauua

SEQ ID NO: 1554228 - RNA, 19 nt, Homo sapiens
gaugaagcauucccucagu

SEQ ID NO: 1554229 - RNA, 19 nt, Homo sapiens
uuucaucacugggacuuua

SEQ ID NO: 1554230 - RNA, 19 nt, Homo sapiens
agaaaagccucauuacauu

SEQ ID NO: 1554231 - RNA, 19 nt, Homo sapiens
auucuguacuucucaguua

SEQ ID NO: 1554232 - RNA, 19 nt, Homo sapiens
uguauuaaaugcugcuaga

SEQ ID NO: 1554233 - RNA, 19 nt, Homo sapiens
gaaaaugagguauucugua

SEQ ID NO: 1554234 - RNA, 19 nt, Homo sapiens
cuggcuggcuccuucuuua

SEQ ID NO: 1554235 - RNA, 19 nt, Homo sapiens
caaagacucagacuaacau

SEQ ID NO: 1554236 - RNA, 19 nt, Homo sapiens
aaugagguauucuguacuu

SEQ ID NO: 1554237 - RNA, 19 nt, Homo sapiens
uuuaucaccucauauggaa

SEQ ID NO: 1554238 - RNA, 19 nt, Homo sapiens
uuccauggcugcauaacaa

SEQ ID NO: 1554239 - RNA, 19 nt, Homo sapiens
gcacuuucgcuacauuuca

SEQ ID NO: 1554240 - RNA, 19 nt, Homo sapiens
gcaccucgcugggacugau

SEQ ID NO: 1554241 - RNA, 19 nt, Homo sapiens
ugagugauguauuaaaugc

SEQ ID NO: 1554242 - RNA, 19 nt, Homo sapiens
uuccaaagacucagacuaa

SEQ ID NO: 1554243 - RNA, 19 nt, Homo sapiens
ccaaagacucagacuaaca

SEQ ID NO: 1554244 - RNA, 19 nt, Homo sapiens
ugaagcauucccucaguuu

SEQ ID NO: 1554245 - RNA, 19 nt, Homo sapiens
cggcugcacuggauucauc

SEQ ID NO: 1554246 - RNA, 19 nt, Homo sapiens
cgagucgacuugcucaaag

SEQ ID NO: 1554247 - RNA, 19 nt, Homo sapiens
gagguauucuguacuucuc

SEQ ID NO: 1554248 - RNA, 19 nt, Homo sapiens
uaacuguuccaaagacuca

SEQ ID NO: 1554249 - RNA, 19 nt, Homo sapiens
uggcugcacucaucaccuu

SEQ ID NO: 1554250 - RNA, 19 nt, Homo sapiens
caucaguguuaacuuccuu

SEQ ID NO: 1554251 - RNA, 19 nt, Homo sapiens
auucaucaguguuaacuuc

SEQ ID NO: 1554252 - RNA, 19 nt, Homo sapiens
uaauccagcuuuggcacuu

SEQ ID NO: 1554253 - RNA, 19 nt, Homo sapiens
guacuucucaguuaagacu

SEQ ID NO: 1554254 - RNA, 19 nt, Homo sapiens
uugaggaagcugccuuaua

SEQ ID NO: 1554255 - RNA, 19 nt, Homo sapiens
agacucagacuaacauaca

SEQ ID NO: 1554256 - RNA, 19 nt, Homo sapiens
agacuuguucuuugaguga

SEQ ID NO: 1554257 - RNA, 19 nt, Homo sapiens
aaaaugagguauucuguac

SEQ ID NO: 1554258 - RNA, 19 nt, Homo sapiens
ccagcuggaugugauaaag

SEQ ID NO: 1554259 - RNA, 19 nt, Homo sapiens
uguauuuaauccagcuuug

SEQ ID NO: 1554260 - RNA, 19 nt, Homo sapiens
gaggccgucugcuccuuuc

SEQ ID NO: 1554261 - RNA, 19 nt, Homo sapiens
aguguuaacuuccuuugag

SEQ ID NO: 1554262 - RNA, 19 nt, Homo sapiens
cgucugcuccuuucucuuc

SEQ ID NO: 1554263 - RNA, 19 nt, Homo sapiens
uagaaaagccucauuacau

SEQ ID NO: 1554264 - RNA, 19 nt, Homo sapiens
cugcauaacaaccauacaa

SEQ ID NO: 1554265 - RNA, 19 nt, Homo sapiens
gcaggaggaagucuaacag

SEQ ID NO: 1554266 - RNA, 19 nt, Homo sapiens
ccugcuggcugcacucauc

SEQ ID NO: 1554267 - RNA, 19 nt, Homo sapiens
aggaagcugccuuauaguu

SEQ ID NO: 1554268 - RNA, 19 nt, Homo sapiens
gcuccuucuuuagguauau

SEQ ID NO: 1554269 - RNA, 19 nt, Homo sapiens
ggaaguccgaaccaagcuu

SEQ ID NO: 1554270 - RNA, 19 nt, Homo sapiens
uuguggagcuugggucuga

SEQ ID NO: 1554271 - RNA, 19 nt, Homo sapiens
cuggaugugauaaagauuu

SEQ ID NO: 1554272 - RNA, 19 nt, Homo sapiens
guuccaaagacucagacua

SEQ ID NO: 1554273 - RNA, 19 nt, Homo sapiens
gcgugaugaugcagaugau

SEQ ID NO: 1554274 - RNA, 19 nt, Homo sapiens
uuccuuccauggcugcaua

SEQ ID NO: 1554275 - RNA, 19 nt, Homo sapiens
gcuggcuccuucuuuaggu

SEQ ID NO: 1554276 - RNA, 19 nt, Homo sapiens
guucuuugagugauguauu

SEQ ID NO: 1554277 - RNA, 19 nt, Homo sapiens
cagcuggaugugauaaaga

SEQ ID NO: 1554278 - RNA, 19 nt, Homo sapiens
gaagcauucccucaguuuu

SEQ ID NO: 1554279 - RNA, 19 nt, Homo sapiens
caggagcuguauuuaaucc

SEQ ID NO: 1554280 - RNA, 19 nt, Homo sapiens
uaugcaggaggaagucuaa

SEQ ID NO: 1554281 - RNA, 19 nt, Homo sapiens
ggucuaugcaggaggaagu

SEQ ID NO: 1554282 - RNA, 19 nt, Homo sapiens
gcgcucugcugcacuucca

SEQ ID NO: 1554283 - RNA, 19 nt, Homo sapiens
caacauggcugcuuacuuc

SEQ ID NO: 1554284 - RNA, 19 nt, Homo sapiens
caaaggacauuucaaaguu

SEQ ID NO: 1554285 - RNA, 19 nt, Homo sapiens
gaaccaaucucacuguuuc

SEQ ID NO: 1554286 - RNA, 19 nt, Homo sapiens
gaaaucuccugcugacuuu

SEQ ID NO: 1554287 - RNA, 19 nt, Homo sapiens
caauaacacuucauagaug

SEQ ID NO: 1554288 - RNA, 19 nt, Homo sapiens
gguuggaagugaauaauuu

SEQ ID NO: 1554289 - RNA, 19 nt, Homo sapiens
gcaagggauuguagccaua

SEQ ID NO: 1554290 - RNA, 19 nt, Homo sapiens
gaaacuuagugaagaaaug

SEQ ID NO: 1554291 - RNA, 19 nt, Homo sapiens
gaugggagagugaaacuua

SEQ ID NO: 1554292 - RNA, 19 nt, Homo sapiens
ccaacagaaucaucauaua

SEQ ID NO: 1554293 - RNA, 19 nt, Homo sapiens
gcugaaauguugaugaguu

SEQ ID NO: 1554294 - RNA, 19 nt, Homo sapiens
ugacuuagcagcacaguaa

SEQ ID NO: 1554295 - RNA, 19 nt, Homo sapiens
aaucauaugucacgucaaa

SEQ ID NO: 1554296 - RNA, 19 nt, Homo sapiens
gaaaucauugcucugcuua

SEQ ID NO: 1554297 - RNA, 19 nt, Homo sapiens
aaagaaccaucucagaauu

SEQ ID NO: 1554298 - RNA, 19 nt, Homo sapiens
ggaagagguuggaagugaa

SEQ ID NO: 1554299 - RNA, 19 nt, Homo sapiens
gagaaucuauugagguugu

SEQ ID NO: 1554300 - RNA, 19 nt, Homo sapiens
gcaaaggacauuucaaagu

SEQ ID NO: 1554301 - RNA, 19 nt, Homo sapiens
gggcaaaggacauuucaaa

SEQ ID NO: 1554302 - RNA, 19 nt, Homo sapiens
ggaaacuacagaugaaauu

SEQ ID NO: 1554303 - RNA, 19 nt, Homo sapiens
gaaauucugcccugaggaa

SEQ ID NO: 1554304 - RNA, 19 nt, Homo sapiens
gagcauugaucauuucucu

SEQ ID NO: 1554305 - RNA, 19 nt, Homo sapiens
uuaccaugcucauccaaua

SEQ ID NO: 1554306 - RNA, 19 nt, Homo sapiens
cagaaugagucuaaaguca

SEQ ID NO: 1554307 - RNA, 19 nt, Homo sapiens
gaaugagucuaaagucagu

SEQ ID NO: 1554308 - RNA, 19 nt, Homo sapiens
guccugaucuucccaguga

SEQ ID NO: 1554309 - RNA, 19 nt, Homo sapiens
gaacagcaagggauuguag

SEQ ID NO: 1554310 - RNA, 19 nt, Homo sapiens
cuaaacagaaugagucuaa

SEQ ID NO: 1554311 - RNA, 19 nt, Homo sapiens
gagugaaacuuagugaaga

SEQ ID NO: 1554312 - RNA, 19 nt, Homo sapiens
ucaaacugcguucaaauaa

SEQ ID NO: 1554313 - RNA, 19 nt, Homo sapiens
augcaaagauaaccaagua

SEQ ID NO: 1554314 - RNA, 19 nt, Homo sapiens
caaucucacuguuucugua

SEQ ID NO: 1554315 - RNA, 19 nt, Homo sapiens
cauggaaacuacagaugaa

SEQ ID NO: 1554316 - RNA, 19 nt, Homo sapiens
gaaccuuuguugaucuaau

SEQ ID NO: 1554317 - RNA, 19 nt, Homo sapiens
uaaaucaucggcauuguga

SEQ ID NO: 1554318 - RNA, 19 nt, Homo sapiens
uaaagaaccaucucagaau

SEQ ID NO: 1554319 - RNA, 19 nt, Homo sapiens
uaaggucuguuggaucuuu

SEQ ID NO: 1554320 - RNA, 19 nt, Homo sapiens
guaaccaagugauggaaga

SEQ ID NO: 1554321 - RNA, 19 nt, Homo sapiens
guacgaagaauuaacugaa

SEQ ID NO: 1554322 - RNA, 19 nt, Homo sapiens
ccuaagagaaugaauagaa

SEQ ID NO: 1554323 - RNA, 19 nt, Homo sapiens
ccaauaacacuucauagau

SEQ ID NO: 1554324 - RNA, 19 nt, Homo sapiens
uggaagagguuggaaguga

SEQ ID NO: 1554325 - RNA, 19 nt, Homo sapiens
gcuuauaauugcagaggaa

SEQ ID NO: 1554326 - RNA, 19 nt, Homo sapiens
caucauauacacuagguuu

SEQ ID NO: 1554327 - RNA, 19 nt, Homo sapiens
cauaguuucuugccaugaa

SEQ ID NO: 1554328 - RNA, 19 nt, Homo sapiens
aaccaaguacgaagaauua

SEQ ID NO: 1554329 - RNA, 19 nt, Homo sapiens
gcugaucucuuuuacuuaa

SEQ ID NO: 1554330 - RNA, 19 nt, Homo sapiens
gauuguagccauaauguuc

SEQ ID NO: 1554331 - RNA, 19 nt, Homo sapiens
gcacaguaauuuggcugaa

SEQ ID NO: 1554332 - RNA, 19 nt, Homo sapiens
gccaugcccuuuccaaauc

SEQ ID NO: 1554333 - RNA, 19 nt, Homo sapiens
ugauaccacucugucuuua

SEQ ID NO: 1554334 - RNA, 19 nt, Homo sapiens
ggaaccaaucucacuguuu

SEQ ID NO: 1554335 - RNA, 19 nt, Homo sapiens
caacagaaucaucauauac

SEQ ID NO: 1554336 - RNA, 19 nt, Homo sapiens
gcucugugcugccaugcaa

SEQ ID NO: 1554337 - RNA, 19 nt, Homo sapiens
caaacugcguucaaauaag

SEQ ID NO: 1554338 - RNA, 19 nt, Homo sapiens
acuccuggcugaucucuuu

SEQ ID NO: 1554339 - RNA, 19 nt, Homo sapiens
uggagaaucuauugagguu

SEQ ID NO: 1554340 - RNA, 19 nt, Homo sapiens
gaaucuuuccuacuuagaa

SEQ ID NO: 1554341 - RNA, 19 nt, Homo sapiens
aaacugcguucaaauaagg

SEQ ID NO: 1554342 - RNA, 19 nt, Homo sapiens
aaguuuggauggaaucuuu

SEQ ID NO: 1554343 - RNA, 19 nt, Homo sapiens
ggccaggucuugugaaagg

SEQ ID NO: 1554344 - RNA, 19 nt, Homo sapiens
cuaauuagagcauugauca

SEQ ID NO: 1554345 - RNA, 19 nt, Homo sapiens
aaaaguaacugaacagcaa

SEQ ID NO: 1554346 - RNA, 19 nt, Homo sapiens
gagucuaaagucaguauaa

SEQ ID NO: 1554347 - RNA, 19 nt, Homo sapiens
ugaaaucuccugcugacuu

SEQ ID NO: 1554348 - RNA, 19 nt, Homo sapiens
gauaaccaaguacgaagaa

SEQ ID NO: 1554349 - RNA, 19 nt, Homo sapiens
ugacucaucgguuauuuau

SEQ ID NO: 1554350 - RNA, 19 nt, Homo sapiens
cauccaauaacacuucaua

SEQ ID NO: 1554351 - RNA, 19 nt, Homo sapiens
gaucuaauacuucugugau

SEQ ID NO: 1554352 - RNA, 19 nt, Homo sapiens
guaccucgcuucuaauucc

SEQ ID NO: 1554353 - RNA, 19 nt, Homo sapiens
gaccaacagaaucaucaua

SEQ ID NO: 1554354 - RNA, 19 nt, Homo sapiens
uaaccaaguacgaagaauu

SEQ ID NO: 1554355 - RNA, 19 nt, Homo sapiens
ucaccuauauuuggauuuc

SEQ ID NO: 1554356 - RNA, 19 nt, Homo sapiens
ggacauggaaacuacagau

SEQ ID NO: 1554357 - RNA, 19 nt, Homo sapiens
gauuugaaccuuuguugau

SEQ ID NO: 1554358 - RNA, 19 nt, Homo sapiens
gaagagguuggaagugaau

SEQ ID NO: 1554359 - RNA, 19 nt, Homo sapiens
auaaagaaccaucucagaa

SEQ ID NO: 1554360 - RNA, 19 nt, Homo sapiens
cuugaccacuuuagauuga

SEQ ID NO: 1554361 - RNA, 19 nt, Homo sapiens
agaggaacauuuugagaua

SEQ ID NO: 1554362 - RNA, 19 nt, Homo sapiens
ggagagugaaacuuaguga

SEQ ID NO: 1554363 - RNA, 19 nt, Homo sapiens
agaaaucauugcucugcuu

SEQ ID NO: 1554364 - RNA, 19 nt, Homo sapiens
guuugaggcuggagagaug

SEQ ID NO: 1554365 - RNA, 19 nt, Homo sapiens
agaagaaggugaugaugac

SEQ ID NO: 1554366 - RNA, 19 nt, Homo sapiens
uuuccaacauggcugcuua

SEQ ID NO: 1554367 - RNA, 19 nt, Homo sapiens
ggaguaaccaagugaugga

SEQ ID NO: 1554368 - RNA, 19 nt, Homo sapiens
uaauguucuugaccacuuu

SEQ ID NO: 1554369 - RNA, 19 nt, Homo sapiens
gucaucaccuuucccaugu

SEQ ID NO: 1554370 - RNA, 19 nt, Homo sapiens
cauaggcaaggaacucaua

SEQ ID NO: 1554371 - RNA, 19 nt, Homo sapiens
aaagauaaccaaguacgaa

SEQ ID NO: 1554372 - RNA, 19 nt, Homo sapiens
auaccacucugucuuuaug

SEQ ID NO: 1554373 - RNA, 19 nt, Homo sapiens
uauaaagaaccaucucaga

SEQ ID NO: 1554374 - RNA, 19 nt, Homo sapiens
gagugcacauuuucauaua

SEQ ID NO: 1554375 - RNA, 19 nt, Homo sapiens
aagaagaaggugaugauga

SEQ ID NO: 1554376 - RNA, 19 nt, Homo sapiens
ucuguuggaucuuucaaau

SEQ ID NO: 1554377 - RNA, 19 nt, Homo sapiens
cuuaaggucuguuggaucu

SEQ ID NO: 1554378 - RNA, 19 nt, Homo sapiens
uuagagcauugaucauuuc

SEQ ID NO: 1554379 - RNA, 19 nt, Homo sapiens
caagcuaccuaccugaaaa

SEQ ID NO: 1554380 - RNA, 19 nt, Homo sapiens
cauguuccauugguuagaa

SEQ ID NO: 1554381 - RNA, 19 nt, Homo sapiens
gcucauccaauaacacuuc

SEQ ID NO: 1554382 - RNA, 19 nt, Homo sapiens
ucuaaugcucccaguauuu

SEQ ID NO: 1554383 - RNA, 19 nt, Homo sapiens
gaaaugaaauguccuauca

SEQ ID NO: 1554384 - RNA, 19 nt, Homo sapiens
ggaccugucuuuacuguuu

SEQ ID NO: 1554385 - RNA, 19 nt, Homo sapiens
ggacuaacuuugaugaauu

SEQ ID NO: 1554386 - RNA, 19 nt, Homo sapiens
gaggagguguccacauuua

SEQ ID NO: 1554387 - RNA, 19 nt, Homo sapiens
gaaggaaggcucaucuaua

SEQ ID NO: 1554388 - RNA, 19 nt, Homo sapiens
ugagauggguuucuaagua

SEQ ID NO: 1554389 - RNA, 19 nt, Homo sapiens
gaagaggccuguggauauu

SEQ ID NO: 1554390 - RNA, 19 nt, Homo sapiens
uaagugcccuuuaauauca

SEQ ID NO: 1554391 - RNA, 19 nt, Homo sapiens
gggaggagguguccacauu

SEQ ID NO: 1554392 - RNA, 19 nt, Homo sapiens
gagauggguuucuaaguau

SEQ ID NO: 1554393 - RNA, 19 nt, Homo sapiens
ggauuucacuguuaaguca

SEQ ID NO: 1554394 - RNA, 19 nt, Homo sapiens
gcagaggcccaauaaauga

SEQ ID NO: 1554395 - RNA, 19 nt, Homo sapiens
caucacagcuucuucagau

SEQ ID NO: 1554396 - RNA, 19 nt, Homo sapiens
acacacaggucuuauuaug

SEQ ID NO: 1554397 - RNA, 19 nt, Homo sapiens
aaacucaccuaucuuucua

SEQ ID NO: 1554398 - RNA, 19 nt, Homo sapiens
guacuuuguuuauccauug

SEQ ID NO: 1554399 - RNA, 19 nt, Homo sapiens
caccacaucuucuugauau

SEQ ID NO: 1554400 - RNA, 19 nt, Homo sapiens
gugaaagucugggauguaa

SEQ ID NO: 1554401 - RNA, 19 nt, Homo sapiens
gagcagcgacugacuuuga

SEQ ID NO: 1554402 - RNA, 19 nt, Homo sapiens
gaagacuaauugugucaug

SEQ ID NO: 1554403 - RNA, 19 nt, Homo sapiens
gaaaugaaacucaccuauc

SEQ ID NO: 1554404 - RNA, 19 nt, Homo sapiens
acacaggucuuauuaugga

SEQ ID NO: 1554405 - RNA, 19 nt, Homo sapiens
gaaagucugggauguaaga

SEQ ID NO: 1554406 - RNA, 19 nt, Homo sapiens
gguacgcugugccaaauuu

SEQ ID NO: 1554407 - RNA, 19 nt, Homo sapiens
cccaauaaaugaacaaaug

SEQ ID NO: 1554408 - RNA, 19 nt, Homo sapiens
ucacagcgguggaguuaau

SEQ ID NO: 1554409 - RNA, 19 nt, Homo sapiens
caaccuguaucaagaacaa

SEQ ID NO: 1554410 - RNA, 19 nt, Homo sapiens
uacacaugcuucagaaaua

SEQ ID NO: 1554411 - RNA, 19 nt, Homo sapiens
gaugguacccuuaagauuc

SEQ ID NO: 1554412 - RNA, 19 nt, Homo sapiens
aaaugaaacucaccuaucu

SEQ ID NO: 1554413 - RNA, 19 nt, Homo sapiens
uuauugaucugacuaguug

SEQ ID NO: 1554414 - RNA, 19 nt, Homo sapiens
ugucaugcuucaaacaaua

SEQ ID NO: 1554415 - RNA, 19 nt, Homo sapiens
cugaaagacugccuugaaa

SEQ ID NO: 1554416 - RNA, 19 nt, Homo sapiens
gauggaagacuaauugugu

SEQ ID NO: 1554417 - RNA, 19 nt, Homo sapiens
aaacagaagacaugaguga

SEQ ID NO: 1554418 - RNA, 19 nt, Homo sapiens
ggaguuaauugcauaucau

SEQ ID NO: 1554419 - RNA, 19 nt, Homo sapiens
caucaucaucuuccuauuu

SEQ ID NO: 1554420 - RNA, 19 nt, Homo sapiens
ugauuuggguuguaucuga

SEQ ID NO: 1554421 - RNA, 19 nt, Homo sapiens
ugugcuagaugaaugauuu

SEQ ID NO: 1554422 - RNA, 19 nt, Homo sapiens
ggaaaugaaacucaccuau

SEQ ID NO: 1554423 - RNA, 19 nt, Homo sapiens
guuaagucauuucagauug

SEQ ID NO: 1554424 - RNA, 19 nt, Homo sapiens
ucaggaagguaguacaaga

SEQ ID NO: 1554425 - RNA, 19 nt, Homo sapiens
gacuaacuuugaugaauug

SEQ ID NO: 1554426 - RNA, 19 nt, Homo sapiens
gaagacaaauccauaaaag

SEQ ID NO: 1554427 - RNA, 19 nt, Homo sapiens
uguuauaagugcccuuuaa

SEQ ID NO: 1554428 - RNA, 19 nt, Homo sapiens
ugaaugugcuagaugaaug

SEQ ID NO: 1554429 - RNA, 19 nt, Homo sapiens
caacagaaaagcugaauaa

SEQ ID NO: 1554430 - RNA, 19 nt, Homo sapiens
gcugaaagacugccuugaa

SEQ ID NO: 1554431 - RNA, 19 nt, Homo sapiens
ugaagaggccuguggauau

SEQ ID NO: 1554432 - RNA, 19 nt, Homo sapiens
ugagaagacuaaguaagaa

SEQ ID NO: 1554433 - RNA, 19 nt, Homo sapiens
ccauugagaagacuaagua

SEQ ID NO: 1554434 - RNA, 19 nt, Homo sapiens
ucucuggauuucacuguua

SEQ ID NO: 1554435 - RNA, 19 nt, Homo sapiens
gguaaucgauuugcagauc

SEQ ID NO: 1554436 - RNA, 19 nt, Homo sapiens
aaggaaggcucaucuauac

SEQ ID NO: 1554437 - RNA, 19 nt, Homo sapiens
gaacaaauuacuacagcau

SEQ ID NO: 1554438 - RNA, 19 nt, Homo sapiens
guacacaugcuucagaaau

SEQ ID NO: 1554439 - RNA, 19 nt, Homo sapiens
gaaaaggcauaccuaagga

SEQ ID NO: 1554440 - RNA, 19 nt, Homo sapiens
cuaauugugucauguagug

SEQ ID NO: 1554441 - RNA, 19 nt, Homo sapiens
ggaaaaugcuauucugugu

SEQ ID NO: 1554442 - RNA, 19 nt, Homo sapiens
gcucaucuauacacuucaa

SEQ ID NO: 1554443 - RNA, 19 nt, Homo sapiens
guucacagcgguggaguua

SEQ ID NO: 1554444 - RNA, 19 nt, Homo sapiens
gauguaagagugaacaaau

SEQ ID NO: 1554445 - RNA, 19 nt, Homo sapiens
ugcuagagcuuacagauau

SEQ ID NO: 1554446 - RNA, 19 nt, Homo sapiens
gcagcuaaauaguaaguac

SEQ ID NO: 1554447 - RNA, 19 nt, Homo sapiens
agaugaaugugcuagauga

SEQ ID NO: 1554448 - RNA, 19 nt, Homo sapiens
ggauaccuuucucaugcua

SEQ ID NO: 1554449 - RNA, 19 nt, Homo sapiens
uagcacagauauagcauag

SEQ ID NO: 1554450 - RNA, 19 nt, Homo sapiens
acuaaugccuugaaagaau

SEQ ID NO: 1554451 - RNA, 19 nt, Homo sapiens
ucacuuaccuccaaaauag

SEQ ID NO: 1554452 - RNA, 19 nt, Homo sapiens
cauuucagauugaccauau

SEQ ID NO: 1554453 - RNA, 19 nt, Homo sapiens
gacuuuaacccuaguggua

SEQ ID NO: 1554454 - RNA, 19 nt, Homo sapiens
cgccagcgcuuccuguauu

SEQ ID NO: 1554455 - RNA, 19 nt, Homo sapiens
gacucuggauuccugauaa

SEQ ID NO: 1554456 - RNA, 19 nt, Homo sapiens
gagaagacuaaguaagaaa

SEQ ID NO: 1554457 - RNA, 19 nt, Homo sapiens
ugaaugauuuggguuguau

SEQ ID NO: 1554458 - RNA, 19 nt, Homo sapiens
ugaauugcauuguaaaggu

SEQ ID NO: 1554459 - RNA, 19 nt, Homo sapiens
gauaagcauucaagcaacu

SEQ ID NO: 1554460 - RNA, 19 nt, Homo sapiens
caaugugaaggacuaauuu

SEQ ID NO: 1554461 - RNA, 19 nt, Homo sapiens
aggcauaccuaaggacuaa

SEQ ID NO: 1554462 - RNA, 19 nt, Homo sapiens
ggcagaggcccaauaaaug

SEQ ID NO: 1554463 - RNA, 19 nt, Homo sapiens
cuugaacccuuccuuaaug

SEQ ID NO: 1554464 - RNA, 19 nt, Homo sapiens
gauggccaguuucuagcua

SEQ ID NO: 1554465 - RNA, 19 nt, Homo sapiens
aaacuaaguggcauuguau

SEQ ID NO: 1554466 - RNA, 19 nt, Homo sapiens
ggaggagguguccacauuu

SEQ ID NO: 1554467 - RNA, 19 nt, Homo sapiens
acacaugcuucagaaauau

SEQ ID NO: 1554468 - RNA, 19 nt, Homo sapiens
guuaauuuauggcguacuu

SEQ ID NO: 1554469 - RNA, 19 nt, Homo sapiens
auaauucacuuaccuccaa

SEQ ID NO: 1554470 - RNA, 19 nt, Homo sapiens
gacagaggauaagcugaaa

SEQ ID NO: 1554471 - RNA, 19 nt, Homo sapiens
ggaggacuaacuuugauga

SEQ ID NO: 1554472 - RNA, 19 nt, Homo sapiens
ucauacagcuccaguucga

SEQ ID NO: 1554473 - RNA, 19 nt, Homo sapiens
gaagacuaaguaagaaaug

SEQ ID NO: 1554474 - RNA, 19 nt, Homo sapiens
ucuaugagauggguuucua

SEQ ID NO: 1554475 - RNA, 19 nt, Homo sapiens
gcuacugcuucuugggaua

SEQ ID NO: 1554476 - RNA, 19 nt, Homo sapiens
uuacuaaugccuugaaaga

SEQ ID NO: 1554477 - RNA, 19 nt, Homo sapiens
ccuaaggacuaauuuaaac

SEQ ID NO: 1554478 - RNA, 19 nt, Homo sapiens
ugacagaggauaagcugaa

SEQ ID NO: 1554479 - RNA, 19 nt, Homo sapiens
ggagguguccacauuuaug

SEQ ID NO: 1554480 - RNA, 19 nt, Homo sapiens
gaaugugcuagaugaauga

SEQ ID NO: 1554481 - RNA, 19 nt, Homo sapiens
gugauaagcauucaagcaa

SEQ ID NO: 1554482 - RNA, 19 nt, Homo sapiens
acaaccaugugcuauuuau

SEQ ID NO: 1554483 - RNA, 19 nt, Homo sapiens
gaaauacucugucuagaaa

SEQ ID NO: 1554484 - RNA, 19 nt, Homo sapiens
gaacaggacuauaggauga

SEQ ID NO: 1554485 - RNA, 19 nt, Homo sapiens
gcaagaagcugaaguaugg

SEQ ID NO: 1554486 - RNA, 19 nt, Homo sapiens
gaaagaaaccucaaugauu

SEQ ID NO: 1554487 - RNA, 19 nt, Homo sapiens
ggaagauggugcuuacuua

SEQ ID NO: 1554488 - RNA, 19 nt, Homo sapiens
gaaaugaugccaaagauaa

SEQ ID NO: 1554489 - RNA, 19 nt, Homo sapiens
gaaguagagucaucuuuaa

SEQ ID NO: 1554490 - RNA, 19 nt, Homo sapiens
ugacauugcuuguuuguaa

SEQ ID NO: 1554491 - RNA, 19 nt, Homo sapiens
gagagacgcccucaaauuu

SEQ ID NO: 1554492 - RNA, 19 nt, Homo sapiens
gaagguagaauacuaugua

SEQ ID NO: 1554493 - RNA, 19 nt, Homo sapiens
caagaaaccuaacaacaug

SEQ ID NO: 1554494 - RNA, 19 nt, Homo sapiens
ggagaaagaaaccaaauuu

SEQ ID NO: 1554495 - RNA, 19 nt, Homo sapiens
caaaguacaugcagaacaa

SEQ ID NO: 1554496 - RNA, 19 nt, Homo sapiens
ggugggagcuuuauauaug

SEQ ID NO: 1554497 - RNA, 19 nt, Homo sapiens
acaaguagcugaagccaaa

SEQ ID NO: 1554498 - RNA, 19 nt, Homo sapiens
gacaugaggugcccuuauu

SEQ ID NO: 1554499 - RNA, 19 nt, Homo sapiens
gaauaggccugaaugagau

SEQ ID NO: 1554500 - RNA, 19 nt, Homo sapiens
ggugggaauugcaagauua

SEQ ID NO: 1554501 - RNA, 19 nt, Homo sapiens
gaugauaacuuggaauuag

SEQ ID NO: 1554502 - RNA, 19 nt, Homo sapiens
ggaaagaacaagugaguga

SEQ ID NO: 1554503 - RNA, 19 nt, Homo sapiens
gcagaaaguauucguguuu

SEQ ID NO: 1554504 - RNA, 19 nt, Homo sapiens
guagacaaaugugaaagua

SEQ ID NO: 1554505 - RNA, 19 nt, Homo sapiens
caacagaagcacaaaguuu

SEQ ID NO: 1554506 - RNA, 19 nt, Homo sapiens
gauucaugcugcuaaguua

SEQ ID NO: 1554507 - RNA, 19 nt, Homo sapiens
gaagaacgguuggagauag

SEQ ID NO: 1554508 - RNA, 19 nt, Homo sapiens
gagcuuacagagcauauua

SEQ ID NO: 1554509 - RNA, 19 nt, Homo sapiens
ggaacaacuuuauccagaa

SEQ ID NO: 1554510 - RNA, 19 nt, Homo sapiens
ccaugaaccuaauaaacua

SEQ ID NO: 1554511 - RNA, 19 nt, Homo sapiens
gcuaauuucuuccuauguu

SEQ ID NO: 1554512 - RNA, 19 nt, Homo sapiens
gcaagaaaccuaacaacau

SEQ ID NO: 1554513 - RNA, 19 nt, Homo sapiens
gagcuucuccagauuauuu

SEQ ID NO: 1554514 - RNA, 19 nt, Homo sapiens
gaugaaauguaucguguuc

SEQ ID NO: 1554515 - RNA, 19 nt, Homo sapiens
ugaaguagagucaucuuua

SEQ ID NO: 1554516 - RNA, 19 nt, Homo sapiens
cugaagagcuggagaccua

SEQ ID NO: 1554517 - RNA, 19 nt, Homo sapiens
gaaacucuacaggaaauua

SEQ ID NO: 1554518 - RNA, 19 nt, Homo sapiens
guaugaaggcuaugaagua

SEQ ID NO: 1554519 - RNA, 19 nt, Homo sapiens
ggacuugauguuccaaaua

SEQ ID NO: 1554520 - RNA, 19 nt, Homo sapiens
aaaugaaacucuacaggaa

SEQ ID NO: 1554521 - RNA, 19 nt, Homo sapiens
gcacuguuccuaaaucauu

SEQ ID NO: 1554522 - RNA, 19 nt, Homo sapiens
gaacuauaauucccaggau

SEQ ID NO: 1554523 - RNA, 19 nt, Homo sapiens
caacauguuugcccucuuc

SEQ ID NO: 1554524 - RNA, 19 nt, Homo sapiens
ugaauuugaucucugauug

SEQ ID NO: 1554525 - RNA, 19 nt, Homo sapiens
ucuuggaucuccugucuua

SEQ ID NO: 1554526 - RNA, 19 nt, Homo sapiens
caagagauuucaagcgaau

SEQ ID NO: 1554527 - RNA, 19 nt, Homo sapiens
gcgaaaagcugaacagguu

SEQ ID NO: 1554528 - RNA, 19 nt, Homo sapiens
caagaacuguauuuacugu

SEQ ID NO: 1554529 - RNA, 19 nt, Homo sapiens
gucaaugccuucagaaaug

SEQ ID NO: 1554530 - RNA, 19 nt, Homo sapiens
gaaguuaggugggaauugc

SEQ ID NO: 1554531 - RNA, 19 nt, Homo sapiens
uaaaguagacgaaaugauc

SEQ ID NO: 1554532 - RNA, 19 nt, Homo sapiens
gaacaacuuuauccagaac

SEQ ID NO: 1554533 - RNA, 19 nt, Homo sapiens
uaauaugccuucuuuggau

SEQ ID NO: 1554534 - RNA, 19 nt, Homo sapiens
caaagaaagaggagaauca

SEQ ID NO: 1554535 - RNA, 19 nt, Homo sapiens
gauggugcuuacuuagaua

SEQ ID NO: 1554536 - RNA, 19 nt, Homo sapiens
cgagaugcuuggaaagaaa

SEQ ID NO: 1554537 - RNA, 19 nt, Homo sapiens
ggaaggaguaaaucuaaga

SEQ ID NO: 1554538 - RNA, 19 nt, Homo sapiens
gugggaagguagaauacua

SEQ ID NO: 1554539 - RNA, 19 nt, Homo sapiens
ugaaacagguauugucauc

SEQ ID NO: 1554540 - RNA, 19 nt, Homo sapiens
gcuguuacuuaagugauua

SEQ ID NO: 1554541 - RNA, 19 nt, Homo sapiens
guagaaaugaugccaaaga

SEQ ID NO: 1554542 - RNA, 19 nt, Homo sapiens
aagaagauguaacggauga

SEQ ID NO: 1554543 - RNA, 19 nt, Homo sapiens
acugaacgcuugcuaaaga

SEQ ID NO: 1554544 - RNA, 19 nt, Homo sapiens
gaauugauggcggauauuu

SEQ ID NO: 1554545 - RNA, 19 nt, Homo sapiens
ugaaauacucugucuagaa

SEQ ID NO: 1554546 - RNA, 19 nt, Homo sapiens
guaacuauuugagacauga

SEQ ID NO: 1554547 - RNA, 19 nt, Homo sapiens
ucuccugucuuauagauuu

SEQ ID NO: 1554548 - RNA, 19 nt, Homo sapiens
ggugauacgugcagcuguu

SEQ ID NO: 1554549 - RNA, 19 nt, Homo sapiens
caguagaaaugaugccaaa

SEQ ID NO: 1554550 - RNA, 19 nt, Homo sapiens
ccucaaugauuuaaggaaa

SEQ ID NO: 1554551 - RNA, 19 nt, Homo sapiens
gaagguaugagacccgauu

SEQ ID NO: 1554552 - RNA, 19 nt, Homo sapiens
guuaaagcccuauuugcua

SEQ ID NO: 1554553 - RNA, 19 nt, Homo sapiens
ugauugagcucucuucucu

SEQ ID NO: 1554554 - RNA, 19 nt, Homo sapiens
agucuugcauuucuagaua

SEQ ID NO: 1554555 - RNA, 19 nt, Homo sapiens
guuggaagguccucucaga

SEQ ID NO: 1554556 - RNA, 19 nt, Homo sapiens
caaaaucccucaaaucaca

SEQ ID NO: 1554557 - RNA, 19 nt, Homo sapiens
ggaauugcaagauuaagga

SEQ ID NO: 1554558 - RNA, 19 nt, Homo sapiens
ggaauucuguuaaaagaug

SEQ ID NO: 1554559 - RNA, 19 nt, Homo sapiens
gucaagaacuguauuuacu

SEQ ID NO: 1554560 - RNA, 19 nt, Homo sapiens
caaaggaagagcuuacaga

SEQ ID NO: 1554561 - RNA, 19 nt, Homo sapiens
gaaggagaaagaaaccaaa

SEQ ID NO: 1554562 - RNA, 19 nt, Homo sapiens
uacagucgcuagaagauga

SEQ ID NO: 1554563 - RNA, 19 nt, Homo sapiens
ccacagucuugcauuucua

SEQ ID NO: 1554564 - RNA, 19 nt, Homo sapiens
gaggugcccuuauuguaca

SEQ ID NO: 1554565 - RNA, 19 nt, Homo sapiens
gaauuugaucucugauuga

SEQ ID NO: 1554566 - RNA, 19 nt, Homo sapiens
uagaaaugaugccaaagau

SEQ ID NO: 1554567 - RNA, 19 nt, Homo sapiens
ggucaaugccuucagaaau

SEQ ID NO: 1554568 - RNA, 19 nt, Homo sapiens
ugugauagguuaacugauc

SEQ ID NO: 1554569 - RNA, 19 nt, Homo sapiens
gaacgcuugcuaaagauga

SEQ ID NO: 1554570 - RNA, 19 nt, Homo sapiens
aauacgagaugcuuggaaa

SEQ ID NO: 1554571 - RNA, 19 nt, Homo sapiens
auucugaacuugugcauga

SEQ ID NO: 1554572 - RNA, 19 nt, Homo sapiens
agaauaggccugaaugaga

SEQ ID NO: 1554573 - RNA, 19 nt, Homo sapiens
uuauagcacuguuccuaaa

SEQ ID NO: 1554574 - RNA, 19 nt, Homo sapiens
gaaagaaaaugcucacaac

SEQ ID NO: 1554575 - RNA, 19 nt, Homo sapiens
caucaagacucugacugaa

SEQ ID NO: 1554576 - RNA, 19 nt, Homo sapiens
agaaacagcuuuugcaaga

SEQ ID NO: 1554577 - RNA, 19 nt, Homo sapiens
ggagauagaaauacgagau

SEQ ID NO: 1554578 - RNA, 19 nt, Homo sapiens
ccaccacuauccucagcua

SEQ ID NO: 1554579 - RNA, 19 nt, Homo sapiens
ucccuaagcuaauuucuuc

SEQ ID NO: 1554580 - RNA, 19 nt, Homo sapiens
gaagauuauucuccaugag

SEQ ID NO: 1554581 - RNA, 19 nt, Homo sapiens
ggcacuuucuggacuaauu

SEQ ID NO: 1554582 - RNA, 19 nt, Homo sapiens
ggaugaugauaacuuggaa

SEQ ID NO: 1554583 - RNA, 19 nt, Homo sapiens
cagcaagacuucgugauuu

SEQ ID NO: 1554584 - RNA, 19 nt, Homo sapiens
gagaaugacuaucuucaag

SEQ ID NO: 1554585 - RNA, 19 nt, Homo sapiens
gagaagauguacgccauga

SEQ ID NO: 1554586 - RNA, 19 nt, Homo sapiens
guacauggcuccggagauc

SEQ ID NO: 1554587 - RNA, 19 nt, Homo sapiens
ugaaguacaugaacaagca

SEQ ID NO: 1554588 - RNA, 19 nt, Homo sapiens
gaggauggaggcccuauga

SEQ ID NO: 1554589 - RNA, 19 nt, Homo sapiens
gaagauguacgccaugaag

SEQ ID NO: 1554590 - RNA, 19 nt, Homo sapiens
ggacgaggaggacauguuc

SEQ ID NO: 1554591 - RNA, 19 nt, Homo sapiens
ggagaucgagcacgucuuc

SEQ ID NO: 1554592 - RNA, 19 nt, Homo sapiens
ggaugggacaggagucuuu

SEQ ID NO: 1554593 - RNA, 19 nt, Homo sapiens
agaagcgccuggccaagaa

SEQ ID NO: 1554594 - RNA, 19 nt, Homo sapiens
ccagcaagacuucgugauu

SEQ ID NO: 1554595 - RNA, 19 nt, Homo sapiens
caacauugccaccaucauc

SEQ ID NO: 1554596 - RNA, 19 nt, Homo sapiens
acaacauucuccuggauga

SEQ ID NO: 1554597 - RNA, 19 nt, Homo sapiens
ccggagaucuuccacucuu

SEQ ID NO: 1554598 - RNA, 19 nt, Homo sapiens
cuccagcaauuucuguaua

SEQ ID NO: 1554599 - RNA, 19 nt, Homo sapiens
ugacaacauucuccuggau

SEQ ID NO: 1554600 - RNA, 19 nt, Homo sapiens
gcacaucauccacagagau

SEQ ID NO: 1554601 - RNA, 19 nt, Homo sapiens
ucugagaauuacaauguga

SEQ ID NO: 1554602 - RNA, 19 nt, Homo sapiens
ggauggaggcccuaugaca

SEQ ID NO: 1554603 - RNA, 19 nt, Homo sapiens
ccucugagaauuacaaugu

SEQ ID NO: 1554604 - RNA, 19 nt, Homo sapiens
ccuuugagcuggaggagau

SEQ ID NO: 1554605 - RNA, 19 nt, Homo sapiens
agauguacgccaugaagua

SEQ ID NO: 1554606 - RNA, 19 nt, Homo sapiens
ugcggaagcuccucacugu

SEQ ID NO: 1554607 - RNA, 19 nt, Homo sapiens
gauggaggcccuaugacau

SEQ ID NO: 1554608 - RNA, 19 nt, Homo sapiens
ggaggugaauguuuucuag

SEQ ID NO: 1554609 - RNA, 19 nt, Homo sapiens
cgagaaugacuaucuucaa

SEQ ID NO: 1554610 - RNA, 19 nt, Homo sapiens
gcaccgugagcguccagua

SEQ ID NO: 1554611 - RNA, 19 nt, Homo sapiens
acaaggaggacgugaacuu

SEQ ID NO: 1554612 - RNA, 19 nt, Homo sapiens
gcucccaguccgagaauga

SEQ ID NO: 1554613 - RNA, 19 nt, Homo sapiens
gggaccaccugagcgagaa

SEQ ID NO: 1554614 - RNA, 19 nt, Homo sapiens
gggacacggagaagaugua

SEQ ID NO: 1554615 - RNA, 19 nt, Homo sapiens
cggagaucuuccacucuuu

SEQ ID NO: 1554616 - RNA, 19 nt, Homo sapiens
cagcaauuucuguauaguu

SEQ ID NO: 1554617 - RNA, 19 nt, Homo sapiens
guggggaggugaauguuuu

SEQ ID NO: 1554618 - RNA, 19 nt, Homo sapiens
gcacugcgaccccaccuuu

SEQ ID NO: 1554619 - RNA, 19 nt, Homo sapiens
caaggaggacgugaacuuc

SEQ ID NO: 1554620 - RNA, 19 nt, Homo sapiens
guccgagaaugacuaucuu

SEQ ID NO: 1554621 - RNA, 19 nt, Homo sapiens
ccagauccuucgggccauu

SEQ ID NO: 1554622 - RNA, 19 nt, Homo sapiens
gagaauuacaaugugagaa

SEQ ID NO: 1554623 - RNA, 19 nt, Homo sapiens
cugaccgacuucaacauug

SEQ ID NO: 1554624 - RNA, 19 nt, Homo sapiens
ccugaccgacuucaacauu

SEQ ID NO: 1554625 - RNA, 19 nt, Homo sapiens
ugaacaagcagcagugcau

SEQ ID NO: 1554626 - RNA, 19 nt, Homo sapiens
aagaagcgccuggccaaga

SEQ ID NO: 1554627 - RNA, 19 nt, Homo sapiens
cgacaaggaggacgugaac

SEQ ID NO: 1554628 - RNA, 19 nt, Homo sapiens
ugaccgacuucaacauugc

SEQ ID NO: 1554629 - RNA, 19 nt, Homo sapiens
augcacaccugaccgacuu

SEQ ID NO: 1554630 - RNA, 19 nt, Homo sapiens
ggagaucuuccacucuuuu

SEQ ID NO: 1554631 - RNA, 19 nt, Homo sapiens
uccagcaauuucuguauag

SEQ ID NO: 1554632 - RNA, 19 nt, Homo sapiens
gcuccagcaauuucuguau

SEQ ID NO: 1554633 - RNA, 19 nt, Homo sapiens
ccacgugguccaaggagau

SEQ ID NO: 1554634 - RNA, 19 nt, Homo sapiens
ccagcaauuucuguauagu

SEQ ID NO: 1554635 - RNA, 19 nt, Homo sapiens
ggcacuggcucuggacuac

SEQ ID NO: 1554636 - RNA, 19 nt, Homo sapiens
cggugaggcuguacaucug

SEQ ID NO: 1554637 - RNA, 19 nt, Homo sapiens
gcaggcagcuuacaaguug

SEQ ID NO: 1554638 - RNA, 19 nt, Homo sapiens
gagcagaaauggugaaagg

SEQ ID NO: 1554639 - RNA, 19 nt, Homo sapiens
caaguuggaugcauauuca

SEQ ID NO: 1554640 - RNA, 19 nt, Homo sapiens
ugaauaaacucaccagcuu

SEQ ID NO: 1554641 - RNA, 19 nt, Homo sapiens
ggugaaaggaguauugaua

SEQ ID NO: 1554642 - RNA, 19 nt, Homo sapiens
cagaaucucacacuuauaa

SEQ ID NO: 1554643 - RNA, 19 nt, Homo sapiens
gagaagcgaugagaaacuu

SEQ ID NO: 1554644 - RNA, 19 nt, Homo sapiens
ggacuuaaaccagaaauau

SEQ ID NO: 1554645 - RNA, 19 nt, Homo sapiens
gaaauuaugcuggucauca

SEQ ID NO: 1554646 - RNA, 19 nt, Homo sapiens
uaaaggacuuaaaccagaa

SEQ ID NO: 1554647 - RNA, 19 nt, Homo sapiens
gcuauaaacauuaguagga

SEQ ID NO: 1554648 - RNA, 19 nt, Homo sapiens
gugaaaggaguauugauaa

SEQ ID NO: 1554649 - RNA, 19 nt, Homo sapiens
ccucagaaucucacacuua

SEQ ID NO: 1554650 - RNA, 19 nt, Homo sapiens
uaacuuggcguaugugaug

SEQ ID NO: 1554651 - RNA, 19 nt, Homo sapiens
uaaugaugcuaauguguug

SEQ ID NO: 1554652 - RNA, 19 nt, Homo sapiens
gagacagaaucccucagaa

SEQ ID NO: 1554653 - RNA, 19 nt, Homo sapiens
gaaccuucuuugagacaga

SEQ ID NO: 1554654 - RNA, 19 nt, Homo sapiens
guagggaggugacgauugc

SEQ ID NO: 1554655 - RNA, 19 nt, Homo sapiens
gugguugauuacuacauua

SEQ ID NO: 1554656 - RNA, 19 nt, Homo sapiens
acaggaacaucucaacguu

SEQ ID NO: 1554657 - RNA, 19 nt, Homo sapiens
caucucaacguucgaguaa

SEQ ID NO: 1554658 - RNA, 19 nt, Homo sapiens
gauugccacucauaaaaua

SEQ ID NO: 1554659 - RNA, 19 nt, Homo sapiens
ggaccuauuuucucuggua

SEQ ID NO: 1554660 - RNA, 19 nt, Homo sapiens
gacagaaucccucagaauc

SEQ ID NO: 1554661 - RNA, 19 nt, Homo sapiens
gcgaucaguuugggaaaug

SEQ ID NO: 1554662 - RNA, 19 nt, Homo sapiens
caagcugagucuucuagau

SEQ ID NO: 1554663 - RNA, 19 nt, Homo sapiens
gaagcgaugagaaacuuau

SEQ ID NO: 1554664 - RNA, 19 nt, Homo sapiens
guauguguguuuauguguu

SEQ ID NO: 1554665 - RNA, 19 nt, Homo sapiens
gaaaacagcuggacuuacc

SEQ ID NO: 1554666 - RNA, 19 nt, Homo sapiens
cuuauaacuuccuaccuuu

SEQ ID NO: 1554667 - RNA, 19 nt, Homo sapiens
cuuacaaguuggaugcaua

SEQ ID NO: 1554668 - RNA, 19 nt, Homo sapiens
gaaaggaguauugauaacu

SEQ ID NO: 1554669 - RNA, 19 nt, Homo sapiens
uuucuuaaguggcugguuu

SEQ ID NO: 1554670 - RNA, 19 nt, Homo sapiens
gcugagucuucuagauuga

SEQ ID NO: 1554671 - RNA, 19 nt, Homo sapiens
gcagguagcagcucuugag

SEQ ID NO: 1554672 - RNA, 19 nt, Homo sapiens
guaggaacuuaaaggacuu

SEQ ID NO: 1554673 - RNA, 19 nt, Homo sapiens
cuugaaguaucuugaaaug

SEQ ID NO: 1554674 - RNA, 19 nt, Homo sapiens
ggccaccagugaagacuau

SEQ ID NO: 1554675 - RNA, 19 nt, Homo sapiens
cucagaaucucacacuuau

SEQ ID NO: 1554676 - RNA, 19 nt, Homo sapiens
gacgauugccacucauaaa

SEQ ID NO: 1554677 - RNA, 19 nt, Homo sapiens
ggguauguguguuuaugug

SEQ ID NO: 1554678 - RNA, 19 nt, Homo sapiens
ugaggcugaugaauuguga

SEQ ID NO: 1554679 - RNA, 19 nt, Homo sapiens
ugaaaggaguauugauaac

SEQ ID NO: 1554680 - RNA, 19 nt, Homo sapiens
ccaguaaaaucaaaugaga

SEQ ID NO: 1554681 - RNA, 19 nt, Homo sapiens
acuuauaacuuccuaccuu

SEQ ID NO: 1554682 - RNA, 19 nt, Homo sapiens
acuauaagcuccuggaaaa

SEQ ID NO: 1554683 - RNA, 19 nt, Homo sapiens
ucacacuuauaacuuccua

SEQ ID NO: 1554684 - RNA, 19 nt, Homo sapiens
gacuguggcuauuccugaa

SEQ ID NO: 1554685 - RNA, 19 nt, Homo sapiens
gaaauggugaaaggaguau

SEQ ID NO: 1554686 - RNA, 19 nt, Homo sapiens
aagcugagucuucuagauu

SEQ ID NO: 1554687 - RNA, 19 nt, Homo sapiens
gacuauaagcuccuggaaa

SEQ ID NO: 1554688 - RNA, 19 nt, Homo sapiens
uccugaggcugaugaauug

SEQ ID NO: 1554689 - RNA, 19 nt, Homo sapiens
ugacgauugccacucauaa

SEQ ID NO: 1554690 - RNA, 19 nt, Homo sapiens
uauguguguuuauguguug

SEQ ID NO: 1554691 - RNA, 19 nt, Homo sapiens
agauggguauguguguuua

SEQ ID NO: 1554692 - RNA, 19 nt, Homo sapiens
ucaaaugagaggaccuauu

SEQ ID NO: 1554693 - RNA, 19 nt, Homo sapiens
gcugaugaauugugaaaau

SEQ ID NO: 1554694 - RNA, 19 nt, Homo sapiens
uugaaugcuuugccauauu

SEQ ID NO: 1554695 - RNA, 19 nt, Homo sapiens
gccgggacauguucuccaa

SEQ ID NO: 1554696 - RNA, 19 nt, Homo sapiens
gacuuaaaccagaaauaug

SEQ ID NO: 1554697 - RNA, 19 nt, Homo sapiens
aaaggagccugcugaagcu

SEQ ID NO: 1554698 - RNA, 19 nt, Homo sapiens
agacagaaucccucagaau

SEQ ID NO: 1554699 - RNA, 19 nt, Homo sapiens
ggucaucacaggaacaucu

SEQ ID NO: 1554700 - RNA, 19 nt, Homo sapiens
aauaaacucaccagcuuga

SEQ ID NO: 1554701 - RNA, 19 nt, Homo sapiens
gauaacuuggcguauguga

SEQ ID NO: 1554702 - RNA, 19 nt, Homo sapiens
agaaauggugaaaggagua

SEQ ID NO: 1554703 - RNA, 19 nt, Homo sapiens
ccaccagugaagacuauaa

SEQ ID NO: 1554704 - RNA, 19 nt, Homo sapiens
ggaggacuguggcuauucc

SEQ ID NO: 1554705 - RNA, 19 nt, Homo sapiens
ucucaacguucgaguaaac

SEQ ID NO: 1554706 - RNA, 19 nt, Homo sapiens
uagauggguauguguguuu

SEQ ID NO: 1554707 - RNA, 19 nt, Homo sapiens
ggaaaugugaugaaaacaa

SEQ ID NO: 1554708 - RNA, 19 nt, Homo sapiens
uugauaacuuggcguaugu

SEQ ID NO: 1554709 - RNA, 19 nt, Homo sapiens
ugugaaugucgguaacuua

SEQ ID NO: 1554710 - RNA, 19 nt, Homo sapiens
ucacaaaguucagaaaaca

SEQ ID NO: 1554711 - RNA, 19 nt, Homo sapiens
cuugaaugcuuugccauau

SEQ ID NO: 1554712 - RNA, 19 nt, Homo sapiens
gaaucucacacuuauaacu

SEQ ID NO: 1554713 - RNA, 19 nt, Homo sapiens
cagaaucccucagaaucuc

SEQ ID NO: 1554714 - RNA, 19 nt, Homo sapiens
ggacauguucuccaaaaug

SEQ ID NO: 1554715 - RNA, 19 nt, Homo sapiens
ggagaagcgaugagaaacu

SEQ ID NO: 1554716 - RNA, 19 nt, Homo sapiens
gcaaaggagccugcugaag

SEQ ID NO: 1554717 - RNA, 19 nt, Homo sapiens
agugguugauuacuacauu

SEQ ID NO: 1554718 - RNA, 19 nt, Homo sapiens
gagcaggcagcuuacaagu

SEQ ID NO: 1554719 - RNA, 19 nt, Homo sapiens
aaggaguauugauaacuug

SEQ ID NO: 1554720 - RNA, 19 nt, Homo sapiens
ucuccaaaauggccacuua

SEQ ID NO: 1554721 - RNA, 19 nt, Homo sapiens
uccugaaccuucuuugaga

SEQ ID NO: 1554722 - RNA, 19 nt, Homo sapiens
gguagggaggugacgauug

SEQ ID NO: 1554723 - RNA, 19 nt, Homo sapiens
acaaagacuagauggguau

SEQ ID NO: 1554724 - RNA, 19 nt, Homo sapiens
ggaaaacaaaacaaacuug

SEQ ID NO: 1554725 - RNA, 19 nt, Homo sapiens
aaacucaccagcuugaagu

SEQ ID NO: 1554726 - RNA, 19 nt, Homo sapiens
uauaagcuccuggaaaaua

SEQ ID NO: 1554727 - RNA, 19 nt, Homo sapiens
ucaccagcuugaaguaucu

SEQ ID NO: 1554728 - RNA, 19 nt, Homo sapiens
ucuaugggacagagucuuu

SEQ ID NO: 1554729 - RNA, 19 nt, Homo sapiens
cuagauggguauguguguu

SEQ ID NO: 1554730 - RNA, 19 nt, Homo sapiens
gaugcuaauguguuguaaa

SEQ ID NO: 1554731 - RNA, 19 nt, Homo sapiens
cagcuugaaguaucuugaa

SEQ ID NO: 1554732 - RNA, 19 nt, Homo sapiens
cuuugcagcuuaucaccuu

SEQ ID NO: 1554733 - RNA, 19 nt, Homo sapiens
cuggagaagcgaugagaaa

SEQ ID NO: 1554734 - RNA, 19 nt, Homo sapiens
aagacuagauggguaugug

SEQ ID NO: 1554735 - RNA, 19 nt, Homo sapiens
uuugggaaaugugaugaaa

SEQ ID NO: 1554736 - RNA, 19 nt, Homo sapiens
ucagaaucucacacuuaua

SEQ ID NO: 1554737 - RNA, 19 nt, Homo sapiens
gaagugaaaucaugcauug

SEQ ID NO: 1554738 - RNA, 19 nt, Homo sapiens
gcugaaagcccuugaaaua

SEQ ID NO: 1554739 - RNA, 19 nt, Homo sapiens
gggaagaccugaaacuuga

SEQ ID NO: 1554740 - RNA, 19 nt, Homo sapiens
gacaaauacuucacucuuu

SEQ ID NO: 1554741 - RNA, 19 nt, Homo sapiens
acagaacguuguacauuua

SEQ ID NO: 1554742 - RNA, 19 nt, Homo sapiens
caacgcagcuauggccuua

SEQ ID NO: 1554743 - RNA, 19 nt, Homo sapiens
ggacaacuauucacaugau

SEQ ID NO: 1554744 - RNA, 19 nt, Homo sapiens
gauggaaacuguguucgua

SEQ ID NO: 1554745 - RNA, 19 nt, Homo sapiens
uuuaagagcuuguugcuuu

SEQ ID NO: 1554746 - RNA, 19 nt, Homo sapiens
gguaauaucuccaauugca

SEQ ID NO: 1554747 - RNA, 19 nt, Homo sapiens
guaagcacauccuugguaa

SEQ ID NO: 1554748 - RNA, 19 nt, Homo sapiens
gaugaaguaugaguucuuu

SEQ ID NO: 1554749 - RNA, 19 nt, Homo sapiens
cagcaaauuucuucuaugu

SEQ ID NO: 1554750 - RNA, 19 nt, Homo sapiens
gaaaucaugcauugaaaga

SEQ ID NO: 1554751 - RNA, 19 nt, Homo sapiens
gcuauggccuuaacaaauc

SEQ ID NO: 1554752 - RNA, 19 nt, Homo sapiens
gcaaggaugacacguauug

SEQ ID NO: 1554753 - RNA, 19 nt, Homo sapiens
gcacauccuugguaauauc

SEQ ID NO: 1554754 - RNA, 19 nt, Homo sapiens
cacagaacguuguacauuu

SEQ ID NO: 1554755 - RNA, 19 nt, Homo sapiens
ugaaagcccuugaaauaca

SEQ ID NO: 1554756 - RNA, 19 nt, Homo sapiens
uaacagaggguaugugcua

SEQ ID NO: 1554757 - RNA, 19 nt, Homo sapiens
ccaaugaauuugaggaaga

SEQ ID NO: 1554758 - RNA, 19 nt, Homo sapiens
gcucugcggugcuguuuga

SEQ ID NO: 1554759 - RNA, 19 nt, Homo sapiens
guggaaaugccaaauauaa

SEQ ID NO: 1554760 - RNA, 19 nt, Homo sapiens
caaguuggacauuaaagua

SEQ ID NO: 1554761 - RNA, 19 nt, Homo sapiens
uaucuugccugcauauuug

SEQ ID NO: 1554762 - RNA, 19 nt, Homo sapiens
gaaaauggauccaauaagg

SEQ ID NO: 1554763 - RNA, 19 nt, Homo sapiens
gcaguggaaaugccaaaua

SEQ ID NO: 1554764 - RNA, 19 nt, Homo sapiens
ucccaaaccucuucuuauu

SEQ ID NO: 1554765 - RNA, 19 nt, Homo sapiens
caaguucugcugaaguuua

SEQ ID NO: 1554766 - RNA, 19 nt, Homo sapiens
gaacaagcuaugccucaaa

SEQ ID NO: 1554767 - RNA, 19 nt, Homo sapiens
ggauuggguuuauuuagug

SEQ ID NO: 1554768 - RNA, 19 nt, Homo sapiens
ggaaaugccaaauauaaca

SEQ ID NO: 1554769 - RNA, 19 nt, Homo sapiens
gaaagaaauguaucucugu

SEQ ID NO: 1554770 - RNA, 19 nt, Homo sapiens
gcagcuuguugaaccguua

SEQ ID NO: 1554771 - RNA, 19 nt, Homo sapiens
gggauuggguuuauuuagu

SEQ ID NO: 1554772 - RNA, 19 nt, Homo sapiens
gcauguaucuugccugcau

SEQ ID NO: 1554773 - RNA, 19 nt, Homo sapiens
gcauaaaacaucugcauua

SEQ ID NO: 1554774 - RNA, 19 nt, Homo sapiens
gaaggcaacuuugucuauc

SEQ ID NO: 1554775 - RNA, 19 nt, Homo sapiens
ccaaaccucuucuuauuuu

SEQ ID NO: 1554776 - RNA, 19 nt, Homo sapiens
ccagaagucgucccauaua

SEQ ID NO: 1554777 - RNA, 19 nt, Homo sapiens
gcaagacgucggcuuaaga

SEQ ID NO: 1554778 - RNA, 19 nt, Homo sapiens
gacuaucuuucucaacuaa

SEQ ID NO: 1554779 - RNA, 19 nt, Homo sapiens
cauuagagcucacugucuu

SEQ ID NO: 1554780 - RNA, 19 nt, Homo sapiens
gaacguuguacauuuaaga

SEQ ID NO: 1554781 - RNA, 19 nt, Homo sapiens
gaaagcccuugaaauacau

SEQ ID NO: 1554782 - RNA, 19 nt, Homo sapiens
caggaguucuugacagauu

SEQ ID NO: 1554783 - RNA, 19 nt, Homo sapiens
gugaaaucaugcauugaaa

SEQ ID NO: 1554784 - RNA, 19 nt, Homo sapiens
caguggaaaugccaaauau

SEQ ID NO: 1554785 - RNA, 19 nt, Homo sapiens
ccacagaacguuguacauu

SEQ ID NO: 1554786 - RNA, 19 nt, Homo sapiens
caacgccauaugcuuauua

SEQ ID NO: 1554787 - RNA, 19 nt, Homo sapiens
agacgucggcuuaagaaua

SEQ ID NO: 1554788 - RNA, 19 nt, Homo sapiens
gaaacuguguucguaugga

SEQ ID NO: 1554789 - RNA, 19 nt, Homo sapiens
ccaaaugaaaucuuccuuu

SEQ ID NO: 1554790 - RNA, 19 nt, Homo sapiens
gggcauaguugaacaagcu

SEQ ID NO: 1554791 - RNA, 19 nt, Homo sapiens
gccaggaguucuugacaga

SEQ ID NO: 1554792 - RNA, 19 nt, Homo sapiens
caacagaaugaaagaaaug

SEQ ID NO: 1554793 - RNA, 19 nt, Homo sapiens
gaacaacagaaugaaagaa

SEQ ID NO: 1554794 - RNA, 19 nt, Homo sapiens
aaacuuggauaucuguuca

SEQ ID NO: 1554795 - RNA, 19 nt, Homo sapiens
ugacucauguucugaagau

SEQ ID NO: 1554796 - RNA, 19 nt, Homo sapiens
gaaugcugguuguauuuua

SEQ ID NO: 1554797 - RNA, 19 nt, Homo sapiens
uguaugaucagaugaagua

SEQ ID NO: 1554798 - RNA, 19 nt, Homo sapiens
ggauuuguuucucaaguuc

SEQ ID NO: 1554799 - RNA, 19 nt, Homo sapiens
aguaaagacugucaaagug

SEQ ID NO: 1554800 - RNA, 19 nt, Homo sapiens
uagcagaaguaaagacugu

SEQ ID NO: 1554801 - RNA, 19 nt, Homo sapiens
ccauauagcagaaguaaag

SEQ ID NO: 1554802 - RNA, 19 nt, Homo sapiens
ggaacuaccagcugcauca

SEQ ID NO: 1554803 - RNA, 19 nt, Homo sapiens
aagcaaggaugacacguau

SEQ ID NO: 1554804 - RNA, 19 nt, Homo sapiens
ugaaagcgcagcuaacaga

SEQ ID NO: 1554805 - RNA, 19 nt, Homo sapiens
aaugaaugcugguuguauu

SEQ ID NO: 1554806 - RNA, 19 nt, Homo sapiens
ugaauaagcaguggaaaug

SEQ ID NO: 1554807 - RNA, 19 nt, Homo sapiens
gacgucggcuuaagaauac

SEQ ID NO: 1554808 - RNA, 19 nt, Homo sapiens
caaugaauuugaggaagaa

SEQ ID NO: 1554809 - RNA, 19 nt, Homo sapiens
aagcacauccuugguaaua

SEQ ID NO: 1554810 - RNA, 19 nt, Homo sapiens
gcgcaaagcaaaauauaua

SEQ ID NO: 1554811 - RNA, 19 nt, Homo sapiens
gagaacaacagaaugaaag

SEQ ID NO: 1554812 - RNA, 19 nt, Homo sapiens
caucaacccucauccuaag

SEQ ID NO: 1554813 - RNA, 19 nt, Homo sapiens
caagcaaggaugacacgua

SEQ ID NO: 1554814 - RNA, 19 nt, Homo sapiens
gcugaacggcuuagcguaa

SEQ ID NO: 1554815 - RNA, 19 nt, Homo sapiens
gaaugaaugcugguuguau

SEQ ID NO: 1554816 - RNA, 19 nt, Homo sapiens
aaugugagcaugucaauga

SEQ ID NO: 1554817 - RNA, 19 nt, Homo sapiens
cuggguauguaaucuauuu

SEQ ID NO: 1554818 - RNA, 19 nt, Homo sapiens
ggaguucuugacagauuua

SEQ ID NO: 1554819 - RNA, 19 nt, Homo sapiens
gcaggugucaaauugguuu

SEQ ID NO: 1554820 - RNA, 19 nt, Homo sapiens
uaggacaacuauucacaug

SEQ ID NO: 1554821 - RNA, 19 nt, Homo sapiens
uagaugacaaggcaauaua

SEQ ID NO: 1554822 - RNA, 19 nt, Homo sapiens
gcaugucaaugaaaacuaa

SEQ ID NO: 1554823 - RNA, 19 nt, Homo sapiens
augaucagaugaaguauga

SEQ ID NO: 1554824 - RNA, 19 nt, Homo sapiens
aaacuguguucguauggaa

SEQ ID NO: 1554825 - RNA, 19 nt, Homo sapiens
guaucuugccugcauauuu

SEQ ID NO: 1554826 - RNA, 19 nt, Homo sapiens
gaaaccagaaucgcugaaa

SEQ ID NO: 1554827 - RNA, 19 nt, Homo sapiens
gauguucuuuccgguguuu

SEQ ID NO: 1554828 - RNA, 19 nt, Homo sapiens
uagugcaggugucaaauug

SEQ ID NO: 1554829 - RNA, 19 nt, Homo sapiens
ugguuugcauccuuaaaua

SEQ ID NO: 1554830 - RNA, 19 nt, Homo sapiens
caagacgucggcuuaagaa

SEQ ID NO: 1554831 - RNA, 19 nt, Homo sapiens
uacaauugcugauggacaa

SEQ ID NO: 1554832 - RNA, 19 nt, Homo sapiens
cguaagcagugaugacuca

SEQ ID NO: 1554833 - RNA, 19 nt, Homo sapiens
gaagucgucccauauagca

SEQ ID NO: 1554834 - RNA, 19 nt, Homo sapiens
cagaagucgucccauauag

SEQ ID NO: 1554835 - RNA, 19 nt, Homo sapiens
gaaacugaaggcaacuuug

SEQ ID NO: 1554836 - RNA, 19 nt, Homo sapiens
ugaaugagggucaauagug

SEQ ID NO: 1554837 - RNA, 19 nt, Homo sapiens
gaaggaaaccauaaagaua

SEQ ID NO: 1554838 - RNA, 19 nt, Homo sapiens
gauaagcacuacuuuguau

SEQ ID NO: 1554839 - RNA, 19 nt, Homo sapiens
gagcauaacuacugaugga

SEQ ID NO: 1554840 - RNA, 19 nt, Homo sapiens
ugaaggcucuggaaucuuu

SEQ ID NO: 1554841 - RNA, 19 nt, Homo sapiens
gaacagauaagcacuacuu

SEQ ID NO: 1554842 - RNA, 19 nt, Homo sapiens
gaaaucagacaaucuccua

SEQ ID NO: 1554843 - RNA, 19 nt, Homo sapiens
gcagaaaucaacccaacua

SEQ ID NO: 1554844 - RNA, 19 nt, Homo sapiens
gacaugagguuauuuaagg

SEQ ID NO: 1554845 - RNA, 19 nt, Homo sapiens
ggaaggaaaccauaaagau

SEQ ID NO: 1554846 - RNA, 19 nt, Homo sapiens
gaaggaaggaaaccauaaa

SEQ ID NO: 1554847 - RNA, 19 nt, Homo sapiens
gaaaucaacccaacuaaaa

SEQ ID NO: 1554848 - RNA, 19 nt, Homo sapiens
gcagaaagaaggcagaaga

SEQ ID NO: 1554849 - RNA, 19 nt, Homo sapiens
auaggcaacugcuuuauuu

SEQ ID NO: 1554850 - RNA, 19 nt, Homo sapiens
gacaauacauuuggaaaca

SEQ ID NO: 1554851 - RNA, 19 nt, Homo sapiens
ggaugcagccuaaauaaau

SEQ ID NO: 1554852 - RNA, 19 nt, Homo sapiens
gaacauuccagaaggauuc

SEQ ID NO: 1554853 - RNA, 19 nt, Homo sapiens
gaucugaaacuacccauau

SEQ ID NO: 1554854 - RNA, 19 nt, Homo sapiens
aaacagagcauaacuacug

SEQ ID NO: 1554855 - RNA, 19 nt, Homo sapiens
gaaaugaguguaaugaucu

SEQ ID NO: 1554856 - RNA, 19 nt, Homo sapiens
ugaaaugaguguaaugauc

SEQ ID NO: 1554857 - RNA, 19 nt, Homo sapiens
ucaaugacguucacgcuau

SEQ ID NO: 1554858 - RNA, 19 nt, Homo sapiens
gcacuacuuuguauaaacu

SEQ ID NO: 1554859 - RNA, 19 nt, Homo sapiens
agaauacuauggacaaguu

SEQ ID NO: 1554860 - RNA, 19 nt, Homo sapiens
ggacaaguuccugacaaua

SEQ ID NO: 1554861 - RNA, 19 nt, Homo sapiens
ucagcuaucauuaguguua

SEQ ID NO: 1554862 - RNA, 19 nt, Homo sapiens
caucagcuaucauuagugu

SEQ ID NO: 1554863 - RNA, 19 nt, Homo sapiens
gagaugggccucuuucugu

SEQ ID NO: 1554864 - RNA, 19 nt, Homo sapiens
gaugcagccuaaauaaaug

SEQ ID NO: 1554865 - RNA, 19 nt, Homo sapiens
gaagcaguguuugcauuug

SEQ ID NO: 1554866 - RNA, 19 nt, Homo sapiens
guucaaacuuggaaauugu

SEQ ID NO: 1554867 - RNA, 19 nt, Homo sapiens
caauacauuuggaaacaga

SEQ ID NO: 1554868 - RNA, 19 nt, Homo sapiens
acacugagcccuuuggaaa

SEQ ID NO: 1554869 - RNA, 19 nt, Homo sapiens
caacacaaauucguaaacu

SEQ ID NO: 1554870 - RNA, 19 nt, Homo sapiens
gacguucacgcuauucuua

SEQ ID NO: 1554871 - RNA, 19 nt, Homo sapiens
gcucgcgucugccacauga

SEQ ID NO: 1554872 - RNA, 19 nt, Homo sapiens
ggagugcaauggugugauc

SEQ ID NO: 1554873 - RNA, 19 nt, Homo sapiens
gugcaauggugugaucaua

SEQ ID NO: 1554874 - RNA, 19 nt, Homo sapiens
gugaagcaguguuugcauu

SEQ ID NO: 1554875 - RNA, 19 nt, Homo sapiens
gagagcaauuaaugagcua

SEQ ID NO: 1554876 - RNA, 19 nt, Homo sapiens
caaaagaagugaaucaagu

SEQ ID NO: 1554877 - RNA, 19 nt, Homo sapiens
gcaauuaaugagcuagaaa

SEQ ID NO: 1554878 - RNA, 19 nt, Homo sapiens
caaagcccuugcauuguau

SEQ ID NO: 1554879 - RNA, 19 nt, Homo sapiens
cagauaagcacuacuuugu

SEQ ID NO: 1554880 - RNA, 19 nt, Homo sapiens
uacccaagagcauauauua

SEQ ID NO: 1554881 - RNA, 19 nt, Homo sapiens
uaaagccuguaagagaaua

SEQ ID NO: 1554882 - RNA, 19 nt, Homo sapiens
uuuaaagccuguaagagaa

SEQ ID NO: 1554883 - RNA, 19 nt, Homo sapiens
aagauaaggagagcaauua

SEQ ID NO: 1554884 - RNA, 19 nt, Homo sapiens
gcaggacccggguuccaua

SEQ ID NO: 1554885 - RNA, 19 nt, Homo sapiens
gagguaagccuagaauugu

SEQ ID NO: 1554886 - RNA, 19 nt, Homo sapiens
gcaaagcaagcagaaagaa

SEQ ID NO: 1554887 - RNA, 19 nt, Homo sapiens
cagccucagucacauauau

SEQ ID NO: 1554888 - RNA, 19 nt, Homo sapiens
ugaaaugagagcuguguuu

SEQ ID NO: 1554889 - RNA, 19 nt, Homo sapiens
caaugacguucacgcuauu

SEQ ID NO: 1554890 - RNA, 19 nt, Homo sapiens
gcucauccuucccuguuau

SEQ ID NO: 1554891 - RNA, 19 nt, Homo sapiens
gcaauggugugaucauagc

SEQ ID NO: 1554892 - RNA, 19 nt, Homo sapiens
aaagaaggcagaagaagga

SEQ ID NO: 1554893 - RNA, 19 nt, Homo sapiens
gaaaugcuccauaacaaaa

SEQ ID NO: 1554894 - RNA, 19 nt, Homo sapiens
gcauauauuagcucacuug

SEQ ID NO: 1554895 - RNA, 19 nt, Homo sapiens
ccagacacagccaaguuua

SEQ ID NO: 1554896 - RNA, 19 nt, Homo sapiens
gaagaaggaaggaaaccau

SEQ ID NO: 1554897 - RNA, 19 nt, Homo sapiens
uguuugaaaugcuccauaa

SEQ ID NO: 1554898 - RNA, 19 nt, Homo sapiens
ggcaacugcuuuauuuaca

SEQ ID NO: 1554899 - RNA, 19 nt, Homo sapiens
gauaaggagagcaauuaau

SEQ ID NO: 1554900 - RNA, 19 nt, Homo sapiens
ggccaccucugguucaaau

SEQ ID NO: 1554901 - RNA, 19 nt, Homo sapiens
ugaaaugcuccauaacaaa

SEQ ID NO: 1554902 - RNA, 19 nt, Homo sapiens
uugaaaugcuccauaacaa

SEQ ID NO: 1554903 - RNA, 19 nt, Homo sapiens
caacuauccugaacuuuug

SEQ ID NO: 1554904 - RNA, 19 nt, Homo sapiens
ccuaggacauauuugaaug

SEQ ID NO: 1554905 - RNA, 19 nt, Homo sapiens
gccuagaauuguacgauug

SEQ ID NO: 1554906 - RNA, 19 nt, Homo sapiens
aaacagagaaaucagacaa

SEQ ID NO: 1554907 - RNA, 19 nt, Homo sapiens
uaaggagagcaauuaauga

SEQ ID NO: 1554908 - RNA, 19 nt, Homo sapiens
aaacggugcuuguucaacu

SEQ ID NO: 1554909 - RNA, 19 nt, Homo sapiens
ugacacaguacaacagaaa

SEQ ID NO: 1554910 - RNA, 19 nt, Homo sapiens
ccaccucugguucaaauaa

SEQ ID NO: 1554911 - RNA, 19 nt, Homo sapiens
gagguuauuuaagguauag

SEQ ID NO: 1554912 - RNA, 19 nt, Homo sapiens
agagguaagccuagaauug

SEQ ID NO: 1554913 - RNA, 19 nt, Homo sapiens
agaaaucaacccaacuaaa

SEQ ID NO: 1554914 - RNA, 19 nt, Homo sapiens
gaaaccauaaagauaagga

SEQ ID NO: 1554915 - RNA, 19 nt, Homo sapiens
gcuacuugcuugacacagu

SEQ ID NO: 1554916 - RNA, 19 nt, Homo sapiens
ugaagcaguguuugcauuu

SEQ ID NO: 1554917 - RNA, 19 nt, Homo sapiens
agaauguuauuacccaaga

SEQ ID NO: 1554918 - RNA, 19 nt, Homo sapiens
uaagacacacgcauggauu

SEQ ID NO: 1554919 - RNA, 19 nt, Homo sapiens
uguaugacaugagguuauu

SEQ ID NO: 1554920 - RNA, 19 nt, Homo sapiens
ugagagcuguguuuuaaaa

SEQ ID NO: 1554921 - RNA, 19 nt, Homo sapiens
aaugagagcuguguuuuaa

SEQ ID NO: 1554922 - RNA, 19 nt, Homo sapiens
ggaaauuguagugaugaaa

SEQ ID NO: 1554923 - RNA, 19 nt, Homo sapiens
gcaacugcuuuauuuacag

SEQ ID NO: 1554924 - RNA, 19 nt, Homo sapiens
cggcuuggauggcucauuc

SEQ ID NO: 1554925 - RNA, 19 nt, Homo sapiens
gcagggaugaagagcauga

SEQ ID NO: 1554926 - RNA, 19 nt, Homo sapiens
cagacaaucuccuagaaaa

SEQ ID NO: 1554927 - RNA, 19 nt, Homo sapiens
uggcaagaaugaccaagga

SEQ ID NO: 1554928 - RNA, 19 nt, Homo sapiens
agacaauucuucuucuucu

SEQ ID NO: 1554929 - RNA, 19 nt, Homo sapiens
ugaagcaagucuacauuuu

SEQ ID NO: 1554930 - RNA, 19 nt, Homo sapiens
aaggagggcuucucaggau

SEQ ID NO: 1554931 - RNA, 19 nt, Homo sapiens
agaccaaucacuagaggua

SEQ ID NO: 1554932 - RNA, 19 nt, Homo sapiens
acaaguuccugacaauaca

SEQ ID NO: 1554933 - RNA, 19 nt, Homo sapiens
cauaacuacugauggagau

SEQ ID NO: 1554934 - RNA, 19 nt, Homo sapiens
auaaggagagcaauuaaug

SEQ ID NO: 1554935 - RNA, 19 nt, Homo sapiens
aaagauaaggagagcaauu

SEQ ID NO: 1554936 - RNA, 19 nt, Homo sapiens
cagaaggauuccacgugaa

SEQ ID NO: 1554937 - RNA, 19 nt, Homo sapiens
gcaguaagcucuuuaaaca

SEQ ID NO: 1554938 - RNA, 19 nt, Homo sapiens
gcucaaagcuggaucauau

SEQ ID NO: 1554939 - RNA, 19 nt, Homo sapiens
gaauggcucuucuauugua

SEQ ID NO: 1554940 - RNA, 19 nt, Homo sapiens
gcuggagacuggagaguua

SEQ ID NO: 1554941 - RNA, 19 nt, Homo sapiens
gauagugacaugaugauua

SEQ ID NO: 1554942 - RNA, 19 nt, Homo sapiens
ggaagauucuaauauguug

SEQ ID NO: 1554943 - RNA, 19 nt, Homo sapiens
gcaccaccaugcccagaua

SEQ ID NO: 1554944 - RNA, 19 nt, Homo sapiens
gagacacucuugagacauu

SEQ ID NO: 1554945 - RNA, 19 nt, Homo sapiens
caagugaucuguccaccuu

SEQ ID NO: 1554946 - RNA, 19 nt, Homo sapiens
caagggaggcugcauagua

SEQ ID NO: 1554947 - RNA, 19 nt, Homo sapiens
gaaaugcuucucuucuaua

SEQ ID NO: 1554948 - RNA, 19 nt, Homo sapiens
gcuccuaagucccuauuaa

SEQ ID NO: 1554949 - RNA, 19 nt, Homo sapiens
ccuaaaagcuugcuacaua

SEQ ID NO: 1554950 - RNA, 19 nt, Homo sapiens
caagagggauuaacaagca

SEQ ID NO: 1554951 - RNA, 19 nt, Homo sapiens
gggaggcugucacugaaua

SEQ ID NO: 1554952 - RNA, 19 nt, Homo sapiens
aaacaaugccuguaccaua

SEQ ID NO: 1554953 - RNA, 19 nt, Homo sapiens
cgaaaugcuucucuucuau

SEQ ID NO: 1554954 - RNA, 19 nt, Homo sapiens
ugaauacuacugacacuua

SEQ ID NO: 1554955 - RNA, 19 nt, Homo sapiens
gagacuggagaguuaauua

SEQ ID NO: 1554956 - RNA, 19 nt, Homo sapiens
gaucaagggaggcugcaua

SEQ ID NO: 1554957 - RNA, 19 nt, Homo sapiens
ggccacgcaucaccaauuu

SEQ ID NO: 1554958 - RNA, 19 nt, Homo sapiens
guacaguggugcgaucuug

SEQ ID NO: 1554959 - RNA, 19 nt, Homo sapiens
uagagaauguuccuagaug

SEQ ID NO: 1554960 - RNA, 19 nt, Homo sapiens
ccacgcaucaccaauuuaa

SEQ ID NO: 1554961 - RNA, 19 nt, Homo sapiens
gaagguaugcaaagucuca

SEQ ID NO: 1554962 - RNA, 19 nt, Homo sapiens
ggaggaagguaugcaaagu

SEQ ID NO: 1554963 - RNA, 19 nt, Homo sapiens
gaagaagugauagugcaua

SEQ ID NO: 1554964 - RNA, 19 nt, Homo sapiens
gaauacuacugacacuuag

SEQ ID NO: 1554965 - RNA, 19 nt, Homo sapiens
ucacugauguugagagaca

SEQ ID NO: 1554966 - RNA, 19 nt, Homo sapiens
ggccgaagcuuuaagaaaa

SEQ ID NO: 1554967 - RNA, 19 nt, Homo sapiens
guacagaaagacucccuaa

SEQ ID NO: 1554968 - RNA, 19 nt, Homo sapiens
gggaagauucuaauauguu

SEQ ID NO: 1554969 - RNA, 19 nt, Homo sapiens
ggaccaagagggauuaaca

SEQ ID NO: 1554970 - RNA, 19 nt, Homo sapiens
gauguggacucugaagguu

SEQ ID NO: 1554971 - RNA, 19 nt, Homo sapiens
uaaagaccaugcagaaacu

SEQ ID NO: 1554972 - RNA, 19 nt, Homo sapiens
acgaaaugcuucucuucua

SEQ ID NO: 1554973 - RNA, 19 nt, Homo sapiens
gccauaugaugaugaaugu

SEQ ID NO: 1554974 - RNA, 19 nt, Homo sapiens
ccaaagugcugggauuaca

SEQ ID NO: 1554975 - RNA, 19 nt, Homo sapiens
ccaaggaugugcuuugcau

SEQ ID NO: 1554976 - RNA, 19 nt, Homo sapiens
cugcagaagugacccauug

SEQ ID NO: 1554977 - RNA, 19 nt, Homo sapiens
gaaguggacacgccagaau

SEQ ID NO: 1554978 - RNA, 19 nt, Homo sapiens
gugcauaggcgaugaagug

SEQ ID NO: 1554979 - RNA, 19 nt, Homo sapiens
aaagcuggaucauaucuca

SEQ ID NO: 1554980 - RNA, 19 nt, Homo sapiens
gcuuaaagaccaugcagaa

SEQ ID NO: 1554981 - RNA, 19 nt, Homo sapiens
caucaccaauuuaaagcaa

SEQ ID NO: 1554982 - RNA, 19 nt, Homo sapiens
gcgaugaaguggagauguc

SEQ ID NO: 1554983 - RNA, 19 nt, Homo sapiens
gauagugcauaggcgauga

SEQ ID NO: 1554984 - RNA, 19 nt, Homo sapiens
ggacuuggaggaucuucuu

SEQ ID NO: 1554985 - RNA, 19 nt, Homo sapiens
gagaguuaauuaguacaga

SEQ ID NO: 1554986 - RNA, 19 nt, Homo sapiens
gugcaggacuccagagaag

SEQ ID NO: 1554987 - RNA, 19 nt, Homo sapiens
uaccauacauaacccuuug

SEQ ID NO: 1554988 - RNA, 19 nt, Homo sapiens
cugggaagauucuaauaug

SEQ ID NO: 1554989 - RNA, 19 nt, Homo sapiens
acuggagaguuaauuagua

SEQ ID NO: 1554990 - RNA, 19 nt, Homo sapiens
ggaggaucuucuucagaga

SEQ ID NO: 1554991 - RNA, 19 nt, Homo sapiens
gaagcauccucagccaaug

SEQ ID NO: 1554992 - RNA, 19 nt, Homo sapiens
uuguaaagaugcuuagcua

SEQ ID NO: 1554993 - RNA, 19 nt, Homo sapiens
gcucugcaguaagcucuuu

SEQ ID NO: 1554994 - RNA, 19 nt, Homo sapiens
gcuaugaguuuugcauuaa

SEQ ID NO: 1554995 - RNA, 19 nt, Homo sapiens
guaaagaugcuuagcuaac

SEQ ID NO: 1554996 - RNA, 19 nt, Homo sapiens
gggccgaagcuuuaagaaa

SEQ ID NO: 1554997 - RNA, 19 nt, Homo sapiens
cugggaugauggaguguua

SEQ ID NO: 1554998 - RNA, 19 nt, Homo sapiens
cgucguugauggugacuga

SEQ ID NO: 1554999 - RNA, 19 nt, Homo sapiens
ggaaaacagugugacaaga

SEQ ID NO: 1555000 - RNA, 19 nt, Homo sapiens
aagggaggcugcauaguag

SEQ ID NO: 1555001 - RNA, 19 nt, Homo sapiens
acaugaugauuaagaguga

SEQ ID NO: 1555002 - RNA, 19 nt, Homo sapiens
guaagcucuuuaaacaaug

SEQ ID NO: 1555003 - RNA, 19 nt, Homo sapiens
cccagauaauguauuguuu

SEQ ID NO: 1555004 - RNA, 19 nt, Homo sapiens
gcccagauaauguauuguu

SEQ ID NO: 1555005 - RNA, 19 nt, Homo sapiens
gaucuuggcucugcaaccu

SEQ ID NO: 1555006 - RNA, 19 nt, Homo sapiens
ccagagaaggccaaauuuc

SEQ ID NO: 1555007 - RNA, 19 nt, Homo sapiens
cuaaaagcuugcuacauaa

SEQ ID NO: 1555008 - RNA, 19 nt, Homo sapiens
aagcuuggaagaagugaua

SEQ ID NO: 1555009 - RNA, 19 nt, Homo sapiens
cagagauagugacaugaug

SEQ ID NO: 1555010 - RNA, 19 nt, Homo sapiens
ugucucagccucccgagua

SEQ ID NO: 1555011 - RNA, 19 nt, Homo sapiens
gagaauguuccuagaugug

SEQ ID NO: 1555012 - RNA, 19 nt, Homo sapiens
uaacgaaaugcuucucuuc

SEQ ID NO: 1555013 - RNA, 19 nt, Homo sapiens
agagacagaugggaaaaua

SEQ ID NO: 1555014 - RNA, 19 nt, Homo sapiens
cagaacagcccuggaggaa

SEQ ID NO: 1555015 - RNA, 19 nt, Homo sapiens
cuugaaagcuuggaagaag

SEQ ID NO: 1555016 - RNA, 19 nt, Homo sapiens
uaaagcaaagucaggauuc

SEQ ID NO: 1555017 - RNA, 19 nt, Homo sapiens
gagggaaaaugacaaguuc

SEQ ID NO: 1555018 - RNA, 19 nt, Homo sapiens
aacaaugccuguaccauac

SEQ ID NO: 1555019 - RNA, 19 nt, Homo sapiens
ccuuugggccgaagcuuua

SEQ ID NO: 1555020 - RNA, 19 nt, Homo sapiens
gaccaagagggauuaacaa

SEQ ID NO: 1555021 - RNA, 19 nt, Homo sapiens
gggccacgcaucaccaauu

SEQ ID NO: 1555022 - RNA, 19 nt, Homo sapiens
guaccauacauaacccuuu

SEQ ID NO: 1555023 - RNA, 19 nt, Homo sapiens
gcacuugaggcaguucuug

SEQ ID NO: 1555024 - RNA, 19 nt, Homo sapiens
ugggaagauucuaauaugu

SEQ ID NO: 1555025 - RNA, 19 nt, Homo sapiens
agagaauguuccuagaugu

SEQ ID NO: 1555026 - RNA, 19 nt, Homo sapiens
gaccaaggaugugcuuugc

SEQ ID NO: 1555027 - RNA, 19 nt, Homo sapiens
agcaugaccugaccaagga

SEQ ID NO: 1555028 - RNA, 19 nt, Homo sapiens
aaaugcuucucuucuauag

SEQ ID NO: 1555029 - RNA, 19 nt, Homo sapiens
ggcuaugaguuuugcauua

SEQ ID NO: 1555030 - RNA, 19 nt, Homo sapiens
ccgaguaccugggauuaca

SEQ ID NO: 1555031 - RNA, 19 nt, Homo sapiens
uuaacgaaaugcuucucuu

SEQ ID NO: 1555032 - RNA, 19 nt, Homo sapiens
gcauuaaaaucggagauau

SEQ ID NO: 1555033 - RNA, 19 nt, Homo sapiens
ccaaguggcuaugaguuuu

SEQ ID NO: 1555034 - RNA, 19 nt, Homo sapiens
uaaagaugcuuagcuaacc

SEQ ID NO: 1555035 - RNA, 19 nt, Homo sapiens
aagaagugauagugcauag

SEQ ID NO: 1555036 - RNA, 19 nt, Homo sapiens
ccagagauagugacaugau

SEQ ID NO: 1555037 - RNA, 19 nt, Homo sapiens
gcacagcacuuaauccuuu

SEQ ID NO: 1555038 - RNA, 19 nt, Homo sapiens
gcccuuaacugcuguauaa

SEQ ID NO: 1555039 - RNA, 19 nt, Homo sapiens
ugacaaagacccuagauua

SEQ ID NO: 1555040 - RNA, 19 nt, Homo sapiens
gaaggcagcaugcucguua

SEQ ID NO: 1555041 - RNA, 19 nt, Homo sapiens
guagaaagaaguagacaua

SEQ ID NO: 1555042 - RNA, 19 nt, Homo sapiens
caaagacccuagauuauag

SEQ ID NO: 1555043 - RNA, 19 nt, Homo sapiens
caagagagaucagauuguu

SEQ ID NO: 1555044 - RNA, 19 nt, Homo sapiens
gagaucagauuguuacugu

SEQ ID NO: 1555045 - RNA, 19 nt, Homo sapiens
gaacagugggauuauuaua

SEQ ID NO: 1555046 - RNA, 19 nt, Homo sapiens
gcauugagauguuuaugug

SEQ ID NO: 1555047 - RNA, 19 nt, Homo sapiens
agaaggagauccacucuga

SEQ ID NO: 1555048 - RNA, 19 nt, Homo sapiens
gagaaacacccacagauga

SEQ ID NO: 1555049 - RNA, 19 nt, Homo sapiens
ugcaagaugugcuuuguua

SEQ ID NO: 1555050 - RNA, 19 nt, Homo sapiens
gcacuuaauccuuuacauu

SEQ ID NO: 1555051 - RNA, 19 nt, Homo sapiens
gaaagaaguagacauagga

SEQ ID NO: 1555052 - RNA, 19 nt, Homo sapiens
guaaagcauugagauguuu

SEQ ID NO: 1555053 - RNA, 19 nt, Homo sapiens
gauuauagcugcccuuaac

SEQ ID NO: 1555054 - RNA, 19 nt, Homo sapiens
acaaagacccuagauuaua

SEQ ID NO: 1555055 - RNA, 19 nt, Homo sapiens
aaaccaagccugcagcaua

SEQ ID NO: 1555056 - RNA, 19 nt, Homo sapiens
gaaugccucuugcaguuga

SEQ ID NO: 1555057 - RNA, 19 nt, Homo sapiens
cuacaaccgucccuauaaa

SEQ ID NO: 1555058 - RNA, 19 nt, Homo sapiens
gauccugcaugcugauaaa

SEQ ID NO: 1555059 - RNA, 19 nt, Homo sapiens
caagaugugcuuuguuaaa

SEQ ID NO: 1555060 - RNA, 19 nt, Homo sapiens
ugucaucucucaccugaaa

SEQ ID NO: 1555061 - RNA, 19 nt, Homo sapiens
gacaaagacccuagauuau

SEQ ID NO: 1555062 - RNA, 19 nt, Homo sapiens
ugaaacaugugcuguguca

SEQ ID NO: 1555063 - RNA, 19 nt, Homo sapiens
acccacagaugaucaauaa

SEQ ID NO: 1555064 - RNA, 19 nt, Homo sapiens
caccugaaauuaacaaugu

SEQ ID NO: 1555065 - RNA, 19 nt, Homo sapiens
ccacagaugaucaauaaau

SEQ ID NO: 1555066 - RNA, 19 nt, Homo sapiens
ccacugcccucagaacaaa

SEQ ID NO: 1555067 - RNA, 19 nt, Homo sapiens
gugauagucugaaauaugg

SEQ ID NO: 1555068 - RNA, 19 nt, Homo sapiens
gaccuuuguucacguguuu

SEQ ID NO: 1555069 - RNA, 19 nt, Homo sapiens
ggccugaggucuccuaaca

SEQ ID NO: 1555070 - RNA, 19 nt, Homo sapiens
caugugauagucugaaaua

SEQ ID NO: 1555071 - RNA, 19 nt, Homo sapiens
caaagaaugcgguuuccaa

SEQ ID NO: 1555072 - RNA, 19 nt, Homo sapiens
uaagggcggugcaagaugu

SEQ ID NO: 1555073 - RNA, 19 nt, Homo sapiens
aauggaaugucucgguaua

SEQ ID NO: 1555074 - RNA, 19 nt, Homo sapiens
gugcugaggaggauuagua

SEQ ID NO: 1555075 - RNA, 19 nt, Homo sapiens
caucaccacucccuaaucu

SEQ ID NO: 1555076 - RNA, 19 nt, Homo sapiens
guaaacaaaccucgcaugu

SEQ ID NO: 1555077 - RNA, 19 nt, Homo sapiens
ugacacaacugccagaacu

SEQ ID NO: 1555078 - RNA, 19 nt, Homo sapiens
uggaaugucucgguauaaa

SEQ ID NO: 1555079 - RNA, 19 nt, Homo sapiens
uggaacagugggauuauua

SEQ ID NO: 1555080 - RNA, 19 nt, Homo sapiens
caacuuuaccuuccaaaca

SEQ ID NO: 1555081 - RNA, 19 nt, Homo sapiens
uguaaagcauugagauguu

SEQ ID NO: 1555082 - RNA, 19 nt, Homo sapiens
gcaaucaacaaucccaaau

SEQ ID NO: 1555083 - RNA, 19 nt, Homo sapiens
gaucagauuguuacugugu

SEQ ID NO: 1555084 - RNA, 19 nt, Homo sapiens
gcaagaugugcuuuguuaa

SEQ ID NO: 1555085 - RNA, 19 nt, Homo sapiens
cgagaaacacccacagaug

SEQ ID NO: 1555086 - RNA, 19 nt, Homo sapiens
aggaaugccucuugcaguu

SEQ ID NO: 1555087 - RNA, 19 nt, Homo sapiens
ccucccaucuccaaacuug

SEQ ID NO: 1555088 - RNA, 19 nt, Homo sapiens
cgucccaccuuacgagaaa

SEQ ID NO: 1555089 - RNA, 19 nt, Homo sapiens
aaccgucccuauaaacuuu

SEQ ID NO: 1555090 - RNA, 19 nt, Homo sapiens
caaacuuggugcccugcaa

SEQ ID NO: 1555091 - RNA, 19 nt, Homo sapiens
gcaagagagaucagauugu

SEQ ID NO: 1555092 - RNA, 19 nt, Homo sapiens
ccuacaaccgucccuauaa

SEQ ID NO: 1555093 - RNA, 19 nt, Homo sapiens
ggaacagugggauuauuau

SEQ ID NO: 1555094 - RNA, 19 nt, Homo sapiens
aacauucccugcacaguga

SEQ ID NO: 1555095 - RNA, 19 nt, Homo sapiens
gaggucuccuaacaacaaa

SEQ ID NO: 1555096 - RNA, 19 nt, Homo sapiens
gcagcaugcucguuaagac

SEQ ID NO: 1555097 - RNA, 19 nt, Homo sapiens
cacagcacuuaauccuuua

SEQ ID NO: 1555098 - RNA, 19 nt, Homo sapiens
agaaagaaguagacauagg

SEQ ID NO: 1555099 - RNA, 19 nt, Homo sapiens
cauccugugucacucugua

SEQ ID NO: 1555100 - RNA, 19 nt, Homo sapiens
caaucaacaaucccaaauu

SEQ ID NO: 1555101 - RNA, 19 nt, Homo sapiens
ggucuuggaagccugauga

SEQ ID NO: 1555102 - RNA, 19 nt, Homo sapiens
gauuaagggcggugcaaga

SEQ ID NO: 1555103 - RNA, 19 nt, Homo sapiens
ggucaacuuuaccuuccaa

SEQ ID NO: 1555104 - RNA, 19 nt, Homo sapiens
gaagaaggagauccacucu

SEQ ID NO: 1555105 - RNA, 19 nt, Homo sapiens
acaaauuagggaagaagua

SEQ ID NO: 1555106 - RNA, 19 nt, Homo sapiens
ccuccacaaucuccuuaaa

SEQ ID NO: 1555107 - RNA, 19 nt, Homo sapiens
caugugcugugucaacuca

SEQ ID NO: 1555108 - RNA, 19 nt, Homo sapiens
gugucuaucuggucaacuu

SEQ ID NO: 1555109 - RNA, 19 nt, Homo sapiens
ggccacaagccaagaggua

SEQ ID NO: 1555110 - RNA, 19 nt, Homo sapiens
gaaggucuccucccaucuc

SEQ ID NO: 1555111 - RNA, 19 nt, Homo sapiens
uccuuuacauugucuauga

SEQ ID NO: 1555112 - RNA, 19 nt, Homo sapiens
cacuuaauccuuuacauug

SEQ ID NO: 1555113 - RNA, 19 nt, Homo sapiens
gcaguugagacaagaggaa

SEQ ID NO: 1555114 - RNA, 19 nt, Homo sapiens
cagguauuguccaagguuu

SEQ ID NO: 1555115 - RNA, 19 nt, Homo sapiens
ggugcaagaugugcuuugu

SEQ ID NO: 1555116 - RNA, 19 nt, Homo sapiens
caaccgucccuauaaacuu

SEQ ID NO: 1555117 - RNA, 19 nt, Homo sapiens
auaaaucucagacccguuu

SEQ ID NO: 1555118 - RNA, 19 nt, Homo sapiens
ugaggucuccuaacaacaa

SEQ ID NO: 1555119 - RNA, 19 nt, Homo sapiens
caaucccaauuauuucaug

SEQ ID NO: 1555120 - RNA, 19 nt, Homo sapiens
caaauuagggaagaaguag

SEQ ID NO: 1555121 - RNA, 19 nt, Homo sapiens
ggagauccacucugauguc

SEQ ID NO: 1555122 - RNA, 19 nt, Homo sapiens
gcugugguccucgugauaa

SEQ ID NO: 1555123 - RNA, 19 nt, Homo sapiens
ggggaaaagaugaaaauaa

SEQ ID NO: 1555124 - RNA, 19 nt, Homo sapiens
guauaaaacccgauuguau

SEQ ID NO: 1555125 - RNA, 19 nt, Homo sapiens
gcccugcaaucauuaaacu

SEQ ID NO: 1555126 - RNA, 19 nt, Homo sapiens
gguuuccaaucccaauuau

SEQ ID NO: 1555127 - RNA, 19 nt, Homo sapiens
agaaugcgguuuccaaucc

SEQ ID NO: 1555128 - RNA, 19 nt, Homo sapiens
gcugcucucugaccugcuu

SEQ ID NO: 1555129 - RNA, 19 nt, Homo sapiens
ggaaugccucuugcaguug

SEQ ID NO: 1555130 - RNA, 19 nt, Homo sapiens
uagauuauagcugcccuua

SEQ ID NO: 1555131 - RNA, 19 nt, Homo sapiens
gaaacacccacagaugauc

SEQ ID NO: 1555132 - RNA, 19 nt, Homo sapiens
ggucugugcugaggaggau

SEQ ID NO: 1555133 - RNA, 19 nt, Homo sapiens
agaguugaauggauuaagg

SEQ ID NO: 1555134 - RNA, 19 nt, Homo sapiens
acauggaacagugggauua

SEQ ID NO: 1555135 - RNA, 19 nt, Homo sapiens
acuugaacaugaaaugcua

SEQ ID NO: 1555136 - RNA, 19 nt, Homo sapiens
ugugauagucugaaauaug

SEQ ID NO: 1555137 - RNA, 19 nt, Homo sapiens
gaaaguuuguccucuaguu

SEQ ID NO: 1555138 - RNA, 19 nt, Homo sapiens
caaugucuaucauguguua

SEQ ID NO: 1555139 - RNA, 19 nt, Homo sapiens
gagaauuccuguuccuuga

SEQ ID NO: 1555140 - RNA, 19 nt, Homo sapiens
gcagagaacgcgagcagua

SEQ ID NO: 1555141 - RNA, 19 nt, Homo sapiens
gaauuccuguuccuugaaa

SEQ ID NO: 1555142 - RNA, 19 nt, Homo sapiens
gcucagagaaccagauauu

SEQ ID NO: 1555143 - RNA, 19 nt, Homo sapiens
cacauucuauuuccuguuu

SEQ ID NO: 1555144 - RNA, 19 nt, Homo sapiens
gaaccagauauucaacuuu

SEQ ID NO: 1555145 - RNA, 19 nt, Homo sapiens
gguauauacagguggauua

SEQ ID NO: 1555146 - RNA, 19 nt, Homo sapiens
gcaguuggucuuuccauug

SEQ ID NO: 1555147 - RNA, 19 nt, Homo sapiens
auucuucccucuguuauua

SEQ ID NO: 1555148 - RNA, 19 nt, Homo sapiens
cugaaugaaugguaaaguu

SEQ ID NO: 1555149 - RNA, 19 nt, Homo sapiens
cgaagagagugaugugcaa

SEQ ID NO: 1555150 - RNA, 19 nt, Homo sapiens
aagcuuggauuaagugaug

SEQ ID NO: 1555151 - RNA, 19 nt, Homo sapiens
aaagacauguggaauaacu

SEQ ID NO: 1555152 - RNA, 19 nt, Homo sapiens
ucagagaaccagauauuca

SEQ ID NO: 1555153 - RNA, 19 nt, Homo sapiens
ggcauccucuccagcguuu

SEQ ID NO: 1555154 - RNA, 19 nt, Homo sapiens
gccgaaagccagcaacuug

SEQ ID NO: 1555155 - RNA, 19 nt, Homo sapiens
cuuaaagacauguggaaua

SEQ ID NO: 1555156 - RNA, 19 nt, Homo sapiens
aaccagauauucaacuuuc

SEQ ID NO: 1555157 - RNA, 19 nt, Homo sapiens
ggacgaagagagugaugug

SEQ ID NO: 1555158 - RNA, 19 nt, Homo sapiens
gauauucaacuuucagaag

SEQ ID NO: 1555159 - RNA, 19 nt, Homo sapiens
guuauucccucgguuuguu

SEQ ID NO: 1555160 - RNA, 19 nt, Homo sapiens
gaaagccagcaacuuggaa

SEQ ID NO: 1555161 - RNA, 19 nt, Homo sapiens
agaaccagauauucaacuu

SEQ ID NO: 1555162 - RNA, 19 nt, Homo sapiens
cuugaaaguuuguccucua

SEQ ID NO: 1555163 - RNA, 19 nt, Homo sapiens
gggcucagagaaccagaua

SEQ ID NO: 1555164 - RNA, 19 nt, Homo sapiens
cagagaaccagauauucaa

SEQ ID NO: 1555165 - RNA, 19 nt, Homo sapiens
gaucugggacgaagagagu

SEQ ID NO: 1555166 - RNA, 19 nt, Homo sapiens
cccaaugucuaucaugugu

SEQ ID NO: 1555167 - RNA, 19 nt, Homo sapiens
ccucuguuauuaaaccauu

SEQ ID NO: 1555168 - RNA, 19 nt, Homo sapiens
acuacguacugcugaauga

SEQ ID NO: 1555169 - RNA, 19 nt, Homo sapiens
gagggaaagggcucagaga

SEQ ID NO: 1555170 - RNA, 19 nt, Homo sapiens
auauacagguggauuacga

SEQ ID NO: 1555171 - RNA, 19 nt, Homo sapiens
gcccugcucuccugcucuu

SEQ ID NO: 1555172 - RNA, 19 nt, Homo sapiens
caagugcuggguccuguga

SEQ ID NO: 1555173 - RNA, 19 nt, Homo sapiens
cuacagagacagccgaaag

SEQ ID NO: 1555174 - RNA, 19 nt, Homo sapiens
cggcagcccuacagagaca

SEQ ID NO: 1555175 - RNA, 19 nt, Homo sapiens
cuuauucuucccucuguua

SEQ ID NO: 1555176 - RNA, 19 nt, Homo sapiens
uuguuucgcucucccauug

SEQ ID NO: 1555177 - RNA, 19 nt, Homo sapiens
acauguggaauaacuauga

SEQ ID NO: 1555178 - RNA, 19 nt, Homo sapiens
gggaaagggcucagagaac

SEQ ID NO: 1555179 - RNA, 19 nt, Homo sapiens
ccucuacucccucccugua

SEQ ID NO: 1555180 - RNA, 19 nt, Homo sapiens
cgaaagccagcaacuugga

SEQ ID NO: 1555181 - RNA, 19 nt, Homo sapiens
gcgggagccuacagaggau

SEQ ID NO: 1555182 - RNA, 19 nt, Homo sapiens
agacauguggaauaacuau

SEQ ID NO: 1555183 - RNA, 19 nt, Homo sapiens
aaaguuuguccucuaguug

SEQ ID NO: 1555184 - RNA, 19 nt, Homo sapiens
gagagugaugugcaagguu

SEQ ID NO: 1555185 - RNA, 19 nt, Homo sapiens
cuaguuggaaagagguaua

SEQ ID NO: 1555186 - RNA, 19 nt, Homo sapiens
ccuguuccuugaaaguuug

SEQ ID NO: 1555187 - RNA, 19 nt, Homo sapiens
gguuggaaggaucuuguuu

SEQ ID NO: 1555188 - RNA, 19 nt, Homo sapiens
gaaagggcucagagaacca

SEQ ID NO: 1555189 - RNA, 19 nt, Homo sapiens
gguaggcaguaggcucuca

SEQ ID NO: 1555190 - RNA, 19 nt, Homo sapiens
caguuggucuuuccauugc

SEQ ID NO: 1555191 - RNA, 19 nt, Homo sapiens
uugaaaguuuguccucuag

SEQ ID NO: 1555192 - RNA, 19 nt, Homo sapiens
acuaugagaauuccuguuc

SEQ ID NO: 1555193 - RNA, 19 nt, Homo sapiens
gccacuuucuccugaccuu

SEQ ID NO: 1555194 - RNA, 19 nt, Homo sapiens
gaaggggucucuggacagu

SEQ ID NO: 1555195 - RNA, 19 nt, Homo sapiens
acugcugaaugaaugguaa

SEQ ID NO: 1555196 - RNA, 19 nt, Homo sapiens
ugcaguuggucuuuccauu

SEQ ID NO: 1555197 - RNA, 19 nt, Homo sapiens
uccuguuccuugaaaguuu

SEQ ID NO: 1555198 - RNA, 19 nt, Homo sapiens
guuggaaggaucuuguuuc

SEQ ID NO: 1555199 - RNA, 19 nt, Homo sapiens
gaaaacccacggcaaucuu

SEQ ID NO: 1555200 - RNA, 19 nt, Homo sapiens
uuggauacuuaaagacaug

SEQ ID NO: 1555201 - RNA, 19 nt, Homo sapiens
ugucuaucauguguuauuc

SEQ ID NO: 1555202 - RNA, 19 nt, Homo sapiens
guaaugaacuugacccuaa

SEQ ID NO: 1555203 - RNA, 19 nt, Homo sapiens
agaaagaacugccuaauug

SEQ ID NO: 1555204 - RNA, 19 nt, Homo sapiens
ggagacagauguuccauga

SEQ ID NO: 1555205 - RNA, 19 nt, Homo sapiens
ugacagaaacccuaaauua

SEQ ID NO: 1555206 - RNA, 19 nt, Homo sapiens
gaacaaugaugcuaaguag

SEQ ID NO: 1555207 - RNA, 19 nt, Homo sapiens
gaaacaagaguggauauua

SEQ ID NO: 1555208 - RNA, 19 nt, Homo sapiens
ggauuaaucucuuucuuga

SEQ ID NO: 1555209 - RNA, 19 nt, Homo sapiens
uaacaaagacuuccaagaa

SEQ ID NO: 1555210 - RNA, 19 nt, Homo sapiens
gcaugugccuucucuuuaa

SEQ ID NO: 1555211 - RNA, 19 nt, Homo sapiens
gaaaugguccugaaaauua

SEQ ID NO: 1555212 - RNA, 19 nt, Homo sapiens
gaggaucacucuauuuguu

SEQ ID NO: 1555213 - RNA, 19 nt, Homo sapiens
gaagguguuuguucagauu

SEQ ID NO: 1555214 - RNA, 19 nt, Homo sapiens
ugacugcccuuguucuaua

SEQ ID NO: 1555215 - RNA, 19 nt, Homo sapiens
ggaacucuuugaagcauuu

SEQ ID NO: 1555216 - RNA, 19 nt, Homo sapiens
uaaggacacuucccagaaa

SEQ ID NO: 1555217 - RNA, 19 nt, Homo sapiens
ggauuguccuggaagauaa

SEQ ID NO: 1555218 - RNA, 19 nt, Homo sapiens
gaacagguaucagaagaca

SEQ ID NO: 1555219 - RNA, 19 nt, Homo sapiens
caggaugacuugaauuuau

SEQ ID NO: 1555220 - RNA, 19 nt, Homo sapiens
ugaguaggcugcuuccuuu

SEQ ID NO: 1555221 - RNA, 19 nt, Homo sapiens
uaaaugcucugcucagugu

SEQ ID NO: 1555222 - RNA, 19 nt, Homo sapiens
ugacauuuguucagaguuu

SEQ ID NO: 1555223 - RNA, 19 nt, Homo sapiens
acaaagacuuccaagaauu

SEQ ID NO: 1555224 - RNA, 19 nt, Homo sapiens
gaugagaguugcaauugug

SEQ ID NO: 1555225 - RNA, 19 nt, Homo sapiens
gaguggauauuacagauug

SEQ ID NO: 1555226 - RNA, 19 nt, Homo sapiens
agaggcaucuugugcaaua

SEQ ID NO: 1555227 - RNA, 19 nt, Homo sapiens
ggaacaaugaugcuaagua

SEQ ID NO: 1555228 - RNA, 19 nt, Homo sapiens
uccuuuagcuguaagauua

SEQ ID NO: 1555229 - RNA, 19 nt, Homo sapiens
ccauuaaucugauacaugu

SEQ ID NO: 1555230 - RNA, 19 nt, Homo sapiens
acacauugcuucaacuuau

SEQ ID NO: 1555231 - RNA, 19 nt, Homo sapiens
ugucccagcucucuaauaa

SEQ ID NO: 1555232 - RNA, 19 nt, Homo sapiens
gaacuucagcuuucucuuc

SEQ ID NO: 1555233 - RNA, 19 nt, Homo sapiens
aagcaaagaugacacaugu

SEQ ID NO: 1555234 - RNA, 19 nt, Homo sapiens
uaaguagcauggacaaaga

SEQ ID NO: 1555235 - RNA, 19 nt, Homo sapiens
gaggauagcauugcguaua

SEQ ID NO: 1555236 - RNA, 19 nt, Homo sapiens
gaucuuagacucccacaga

SEQ ID NO: 1555237 - RNA, 19 nt, Homo sapiens
gcaaagaugacacauguag

SEQ ID NO: 1555238 - RNA, 19 nt, Homo sapiens
ccaagaacauugccuccaa

SEQ ID NO: 1555239 - RNA, 19 nt, Homo sapiens
caacaaauaaaccuccuuu

SEQ ID NO: 1555240 - RNA, 19 nt, Homo sapiens
ccucugggcuuuccuguug

SEQ ID NO: 1555241 - RNA, 19 nt, Homo sapiens
ugcaugaaauuuagccuua

SEQ ID NO: 1555242 - RNA, 19 nt, Homo sapiens
caagcaugcaugaaauuua

SEQ ID NO: 1555243 - RNA, 19 nt, Homo sapiens
gcaagaacagguaucagaa

SEQ ID NO: 1555244 - RNA, 19 nt, Homo sapiens
ccucugcccucuucaauau

SEQ ID NO: 1555245 - RNA, 19 nt, Homo sapiens
gaaaggaacaaugaugcua

SEQ ID NO: 1555246 - RNA, 19 nt, Homo sapiens
gaaaggaaagaaucacuuc

SEQ ID NO: 1555247 - RNA, 19 nt, Homo sapiens
gcucuaggauucaaugauc

SEQ ID NO: 1555248 - RNA, 19 nt, Homo sapiens
ggucugcgguacaggcaua

SEQ ID NO: 1555249 - RNA, 19 nt, Homo sapiens
aaacaagaguggauauuac

SEQ ID NO: 1555250 - RNA, 19 nt, Homo sapiens
guaggaaccguuaucauug

SEQ ID NO: 1555251 - RNA, 19 nt, Homo sapiens
gcaugaaauuuagccuuaa

SEQ ID NO: 1555252 - RNA, 19 nt, Homo sapiens
gaacacauugcuucaacuu

SEQ ID NO: 1555253 - RNA, 19 nt, Homo sapiens
gcaggaugacuugaauuua

SEQ ID NO: 1555254 - RNA, 19 nt, Homo sapiens
agacagauguuccaugaca

SEQ ID NO: 1555255 - RNA, 19 nt, Homo sapiens
ucuggagucuggcuuauuu

SEQ ID NO: 1555256 - RNA, 19 nt, Homo sapiens
ugaacccgcuugaacauau

SEQ ID NO: 1555257 - RNA, 19 nt, Homo sapiens
gaaaguaucaguaaauucc

SEQ ID NO: 1555258 - RNA, 19 nt, Homo sapiens
caaagacuuccaagaauug

SEQ ID NO: 1555259 - RNA, 19 nt, Homo sapiens
gcagaaaggaacaaugaug

SEQ ID NO: 1555260 - RNA, 19 nt, Homo sapiens
gaaagaacugccuaauugu

SEQ ID NO: 1555261 - RNA, 19 nt, Homo sapiens
ggagggaucuggucaugac

SEQ ID NO: 1555262 - RNA, 19 nt, Homo sapiens
caaccacacucggccaauu

SEQ ID NO: 1555263 - RNA, 19 nt, Homo sapiens
ccaguagcguuguguguga

SEQ ID NO: 1555264 - RNA, 19 nt, Homo sapiens
cuucuugaaugacugaaua

SEQ ID NO: 1555265 - RNA, 19 nt, Homo sapiens
acacucggccaauuauuua

SEQ ID NO: 1555266 - RNA, 19 nt, Homo sapiens
cacauugcuucaacuuaua

SEQ ID NO: 1555267 - RNA, 19 nt, Homo sapiens
gaaauugaacacauugcuu

SEQ ID NO: 1555268 - RNA, 19 nt, Homo sapiens
gcagaugagaguugcaauu

SEQ ID NO: 1555269 - RNA, 19 nt, Homo sapiens
ccagcucucuaauaacaaa

SEQ ID NO: 1555270 - RNA, 19 nt, Homo sapiens
ccagugaaaugguccugaa

SEQ ID NO: 1555271 - RNA, 19 nt, Homo sapiens
uggcuuauuuccagcauuu

SEQ ID NO: 1555272 - RNA, 19 nt, Homo sapiens
caguagauauugaggauca

SEQ ID NO: 1555273 - RNA, 19 nt, Homo sapiens
gaaaagagaugaguuuagg

SEQ ID NO: 1555274 - RNA, 19 nt, Homo sapiens
gacauguuauuaggucaua

SEQ ID NO: 1555275 - RNA, 19 nt, Homo sapiens
aggauagcauugcguauaa

SEQ ID NO: 1555276 - RNA, 19 nt, Homo sapiens
ggccaugcccugaguguuu

SEQ ID NO: 1555277 - RNA, 19 nt, Homo sapiens
ucagcuuucucuucuguaa

SEQ ID NO: 1555278 - RNA, 19 nt, Homo sapiens
cauuacaucugcauucuag

SEQ ID NO: 1555279 - RNA, 19 nt, Homo sapiens
gaucugccauuaaucugau

SEQ ID NO: 1555280 - RNA, 19 nt, Homo sapiens
uaaauggaccagaggcuaa

SEQ ID NO: 1555281 - RNA, 19 nt, Homo sapiens
ggaaaggaaagaaucacuu

SEQ ID NO: 1555282 - RNA, 19 nt, Homo sapiens
ggauagcauugcguauaaa

SEQ ID NO: 1555283 - RNA, 19 nt, Homo sapiens
ccagaaaguaucaguaaau

SEQ ID NO: 1555284 - RNA, 19 nt, Homo sapiens
cagaagagcaggaugacuu

SEQ ID NO: 1555285 - RNA, 19 nt, Homo sapiens
caacaucguguacuucaga

SEQ ID NO: 1555286 - RNA, 19 nt, Homo sapiens
gaagagauccccagagaga

SEQ ID NO: 1555287 - RNA, 19 nt, Homo sapiens
uagaaagaacugccuaauu

SEQ ID NO: 1555288 - RNA, 19 nt, Homo sapiens
gcaagggccgauuggaauu

SEQ ID NO: 1555289 - RNA, 19 nt, Homo sapiens
ggaaacaagaguggauauu

SEQ ID NO: 1555290 - RNA, 19 nt, Homo sapiens
ggacacuucccagaaauug

SEQ ID NO: 1555291 - RNA, 19 nt, Homo sapiens
ccacuccucugcccucuuc

SEQ ID NO: 1555292 - RNA, 19 nt, Homo sapiens
gacagaaacccuaaauuac

SEQ ID NO: 1555293 - RNA, 19 nt, Homo sapiens
guuauuguccacuuacuaa

SEQ ID NO: 1555294 - RNA, 19 nt, Homo sapiens
guccgucucuccagugaaa

SEQ ID NO: 1555295 - RNA, 19 nt, Homo sapiens
aacaaagacuuccaagaau

SEQ ID NO: 1555296 - RNA, 19 nt, Homo sapiens
aagaacagguaucagaaga

SEQ ID NO: 1555297 - RNA, 19 nt, Homo sapiens
gcuaauggacuaggaagaa

SEQ ID NO: 1555298 - RNA, 19 nt, Homo sapiens
gcucagacccuccuggaau

SEQ ID NO: 1555299 - RNA, 19 nt, Homo sapiens
gaugaccucugcagucucu

SEQ ID NO: 1555300 - RNA, 19 nt, Homo sapiens
gcuuuagccugaaccuuga

SEQ ID NO: 1555301 - RNA, 19 nt, Homo sapiens
uaagaugcaaggcgucuaa

SEQ ID NO: 1555302 - RNA, 19 nt, Homo sapiens
gcagaggaauuguuaugua

SEQ ID NO: 1555303 - RNA, 19 nt, Homo sapiens
gaggucaucuuguuugaga

SEQ ID NO: 1555304 - RNA, 19 nt, Homo sapiens
uaugagaucuccuucaaug

SEQ ID NO: 1555305 - RNA, 19 nt, Homo sapiens
gauaucaaaucuacagaca

SEQ ID NO: 1555306 - RNA, 19 nt, Homo sapiens
caccacgccuggcuaauuu

SEQ ID NO: 1555307 - RNA, 19 nt, Homo sapiens
aaaaugagcuucuuugaga

SEQ ID NO: 1555308 - RNA, 19 nt, Homo sapiens
uggagaaccuucccauaaa

SEQ ID NO: 1555309 - RNA, 19 nt, Homo sapiens
cagaggaauuguuauguau

SEQ ID NO: 1555310 - RNA, 19 nt, Homo sapiens
gagaucuccuucaauguau

SEQ ID NO: 1555311 - RNA, 19 nt, Homo sapiens
gacguaaccuugggcgaua

SEQ ID NO: 1555312 - RNA, 19 nt, Homo sapiens
uaucaaaucuacagacaag

SEQ ID NO: 1555313 - RNA, 19 nt, Homo sapiens
ugagaucuccuucaaugua

SEQ ID NO: 1555314 - RNA, 19 nt, Homo sapiens
ucacggaggcuggagauua

SEQ ID NO: 1555315 - RNA, 19 nt, Homo sapiens
gggaagcacucgggcauug

SEQ ID NO: 1555316 - RNA, 19 nt, Homo sapiens
aauaugagaucuccuucaa

SEQ ID NO: 1555317 - RNA, 19 nt, Homo sapiens
ggagaaccuucccauaaac

SEQ ID NO: 1555318 - RNA, 19 nt, Homo sapiens
gauggagucucacuuuguc

SEQ ID NO: 1555319 - RNA, 19 nt, Homo sapiens
cugcugaacuggaauuaug

SEQ ID NO: 1555320 - RNA, 19 nt, Homo sapiens
caacuuugguuucaugaac

SEQ ID NO: 1555321 - RNA, 19 nt, Homo sapiens
gaacaugcugugucugaau

SEQ ID NO: 1555322 - RNA, 19 nt, Homo sapiens
uaauuaaacgugccuuuga

SEQ ID NO: 1555323 - RNA, 19 nt, Homo sapiens
agcaggcucuuauucuuua

SEQ ID NO: 1555324 - RNA, 19 nt, Homo sapiens
gaauauugggccucagaaa

SEQ ID NO: 1555325 - RNA, 19 nt, Homo sapiens
gaucugucagcaucaauaa

SEQ ID NO: 1555326 - RNA, 19 nt, Homo sapiens
gagcagaaaggaauaacug

SEQ ID NO: 1555327 - RNA, 19 nt, Homo sapiens
cauggcaaauacagaauga

SEQ ID NO: 1555328 - RNA, 19 nt, Homo sapiens
ugacauggcacagguguuu

SEQ ID NO: 1555329 - RNA, 19 nt, Homo sapiens
ggagggcuuuaccaucuau

SEQ ID NO: 1555330 - RNA, 19 nt, Homo sapiens
ggaauaacuggaucuguca

SEQ ID NO: 1555331 - RNA, 19 nt, Homo sapiens
gaaugagcagaaaggaaua

SEQ ID NO: 1555332 - RNA, 19 nt, Homo sapiens
ggauucguguucaucaaug

SEQ ID NO: 1555333 - RNA, 19 nt, Homo sapiens
ggaucugucagcaucaaua

SEQ ID NO: 1555334 - RNA, 19 nt, Homo sapiens
ccuacgggcuuguccugua

SEQ ID NO: 1555335 - RNA, 19 nt, Homo sapiens
aaacgugccuuugaguaga

SEQ ID NO: 1555336 - RNA, 19 nt, Homo sapiens
cagacaagcccacgcugua

SEQ ID NO: 1555337 - RNA, 19 nt, Homo sapiens
ucuauucccuggagaugaa

SEQ ID NO: 1555338 - RNA, 19 nt, Homo sapiens
ggacgcccuauccuacuua

SEQ ID NO: 1555339 - RNA, 19 nt, Homo sapiens
ggcuggagauuacacagaa

SEQ ID NO: 1555340 - RNA, 19 nt, Homo sapiens
ccaaaguacugggauuaca

SEQ ID NO: 1555341 - RNA, 19 nt, Homo sapiens
gggcuuguccuguaugaga

SEQ ID NO: 1555342 - RNA, 19 nt, Homo sapiens
ccacauauuucgggaagca

SEQ ID NO: 1555343 - RNA, 19 nt, Homo sapiens
aaacugugucugaacauuu

SEQ ID NO: 1555344 - RNA, 19 nt, Homo sapiens
gcaggcucuuauucuuuaa

SEQ ID NO: 1555345 - RNA, 19 nt, Homo sapiens
ucaaauaugagaucuccuu

SEQ ID NO: 1555346 - RNA, 19 nt, Homo sapiens
agaaugagcagaaaggaau

SEQ ID NO: 1555347 - RNA, 19 nt, Homo sapiens
gaaucaaggacgagucaau

SEQ ID NO: 1555348 - RNA, 19 nt, Homo sapiens
gagaaucaaggacgaguca

SEQ ID NO: 1555349 - RNA, 19 nt, Homo sapiens
gaaccuucccauaaacaau

SEQ ID NO: 1555350 - RNA, 19 nt, Homo sapiens
gcccuauccuacuuaaaug

SEQ ID NO: 1555351 - RNA, 19 nt, Homo sapiens
ggaguucaucuauaaguca

SEQ ID NO: 1555352 - RNA, 19 nt, Homo sapiens
acaaugauagggauucuga

SEQ ID NO: 1555353 - RNA, 19 nt, Homo sapiens
caacaaaacagcagaggaa

SEQ ID NO: 1555354 - RNA, 19 nt, Homo sapiens
ugcuggaguucaucuauaa

SEQ ID NO: 1555355 - RNA, 19 nt, Homo sapiens
ccaccacgccuggcuaauu

SEQ ID NO: 1555356 - RNA, 19 nt, Homo sapiens
gacaagcccacgcuguaaa

SEQ ID NO: 1555357 - RNA, 19 nt, Homo sapiens
uagcaggcucuuauucuuu

SEQ ID NO: 1555358 - RNA, 19 nt, Homo sapiens
uuagcaggcucuuauucuu

SEQ ID NO: 1555359 - RNA, 19 nt, Homo sapiens
gcaaaggagguugaacaug

SEQ ID NO: 1555360 - RNA, 19 nt, Homo sapiens
ugaggauccugguggagaa

SEQ ID NO: 1555361 - RNA, 19 nt, Homo sapiens
cagcagaggaauuguuaug

SEQ ID NO: 1555362 - RNA, 19 nt, Homo sapiens
gggacgcccuauccuacuu

SEQ ID NO: 1555363 - RNA, 19 nt, Homo sapiens
uaaacgugccuuugaguag

SEQ ID NO: 1555364 - RNA, 19 nt, Homo sapiens
caaaacagcagaggaauug

SEQ ID NO: 1555365 - RNA, 19 nt, Homo sapiens
uugcuggaguucaucuaua

SEQ ID NO: 1555366 - RNA, 19 nt, Homo sapiens
caccagcuaugacuaugau

SEQ ID NO: 1555367 - RNA, 19 nt, Homo sapiens
guaaaacugugucugaaca

SEQ ID NO: 1555368 - RNA, 19 nt, Homo sapiens
gcuggagauuacacagaaa

SEQ ID NO: 1555369 - RNA, 19 nt, Homo sapiens
gaguggcucagauaucaaa

SEQ ID NO: 1555370 - RNA, 19 nt, Homo sapiens
guaccuuccuggaguuugg

SEQ ID NO: 1555371 - RNA, 19 nt, Homo sapiens
gaaaggaauaacuggaucu

SEQ ID NO: 1555372 - RNA, 19 nt, Homo sapiens
aauaaggaccugcacauuc

SEQ ID NO: 1555373 - RNA, 19 nt, Homo sapiens
cuacgggcuuguccuguau

SEQ ID NO: 1555374 - RNA, 19 nt, Homo sapiens
aacaugcugugucugaauu

SEQ ID NO: 1555375 - RNA, 19 nt, Homo sapiens
ccaaucuccugaccuugug

SEQ ID NO: 1555376 - RNA, 19 nt, Homo sapiens
uaauaaggaccugcacauu

SEQ ID NO: 1555377 - RNA, 19 nt, Homo sapiens
uuaaacgugccuuugagua

SEQ ID NO: 1555378 - RNA, 19 nt, Homo sapiens
cuaucuauaugaugccuau

SEQ ID NO: 1555379 - RNA, 19 nt, Homo sapiens
gucccaaucuccugaccuu

SEQ ID NO: 1555380 - RNA, 19 nt, Homo sapiens
gguugaacaugcugugucu

SEQ ID NO: 1555381 - RNA, 19 nt, Homo sapiens
ggaauauugggccucagaa

SEQ ID NO: 1555382 - RNA, 19 nt, Homo sapiens
cuggagggcuuuaccaucu

SEQ ID NO: 1555383 - RNA, 19 nt, Homo sapiens
aaauacagaaugagcagaa

SEQ ID NO: 1555384 - RNA, 19 nt, Homo sapiens
ggauccugguggagaauca

SEQ ID NO: 1555385 - RNA, 19 nt, Homo sapiens
gagaaccuucccauaaaca

SEQ ID NO: 1555386 - RNA, 19 nt, Homo sapiens
cacggaggcuggagauuac

SEQ ID NO: 1555387 - RNA, 19 nt, Homo sapiens
gaucuccuucaauguauau

SEQ ID NO: 1555388 - RNA, 19 nt, Homo sapiens
cagaaaggaauaacuggau

SEQ ID NO: 1555389 - RNA, 19 nt, Homo sapiens
ugaacaugcugugucugaa

SEQ ID NO: 1555390 - RNA, 19 nt, Homo sapiens
agacaagcccacgcuguaa

SEQ ID NO: 1555391 - RNA, 19 nt, Homo sapiens
gacgcccuauccuacuuaa

SEQ ID NO: 1555392 - RNA, 19 nt, Homo sapiens
gaguucaucuauaagucau

SEQ ID NO: 1555393 - RNA, 19 nt, Homo sapiens
ucaccaaguuagccaggau

SEQ ID NO: 1555394 - RNA, 19 nt, Homo sapiens
guucaucaauggacguaac

SEQ ID NO: 1555395 - RNA, 19 nt, Homo sapiens
ugaacuggaauuauggauu

SEQ ID NO: 1555396 - RNA, 19 nt, Homo sapiens
cagaaugagcagaaaggaa

SEQ ID NO: 1555397 - RNA, 19 nt, Homo sapiens
aaucaaggacgagucaauu

SEQ ID NO: 1555398 - RNA, 19 nt, Homo sapiens
gcaccauguuaaagaugca

SEQ ID NO: 1555399 - RNA, 19 nt, Homo sapiens
ugagccugcugaacuggaa

SEQ ID NO: 1555400 - RNA, 19 nt, Homo sapiens
gaaaaugagcuucuuugag

SEQ ID NO: 1555401 - RNA, 19 nt, Homo sapiens
auaaggaccugcacauucc

SEQ ID NO: 1555402 - RNA, 19 nt, Homo sapiens
gaacugcagcugcuuguua

SEQ ID NO: 1555403 - RNA, 19 nt, Homo sapiens
gaaguugacugccagauca

SEQ ID NO: 1555404 - RNA, 19 nt, Homo sapiens
gcagauagauuccauucau

SEQ ID NO: 1555405 - RNA, 19 nt, Homo sapiens
caauaaagcaugcgauuug

SEQ ID NO: 1555406 - RNA, 19 nt, Homo sapiens
gaaagaagaaaccagaaug

SEQ ID NO: 1555407 - RNA, 19 nt, Homo sapiens
uagagaaacugcucagaga

SEQ ID NO: 1555408 - RNA, 19 nt, Homo sapiens
gcacuucgcccucggaaau

SEQ ID NO: 1555409 - RNA, 19 nt, Homo sapiens
gagcaaagcaaaucuuauc

SEQ ID NO: 1555410 - RNA, 19 nt, Homo sapiens
uagcgaagaacucuaauuu

SEQ ID NO: 1555411 - RNA, 19 nt, Homo sapiens
aagcaaaucuuauccucaa

SEQ ID NO: 1555412 - RNA, 19 nt, Homo sapiens
gcacaacuucuauuucuuc

SEQ ID NO: 1555413 - RNA, 19 nt, Homo sapiens
gcucagagaaccugccuuu

SEQ ID NO: 1555414 - RNA, 19 nt, Homo sapiens
uagauuccauucauccuuu

SEQ ID NO: 1555415 - RNA, 19 nt, Homo sapiens
gaaaucacaccacgcacaa

SEQ ID NO: 1555416 - RNA, 19 nt, Homo sapiens
agaagccuguuacgagaua

SEQ ID NO: 1555417 - RNA, 19 nt, Homo sapiens
gggagcaaagcaaaucuua

SEQ ID NO: 1555418 - RNA, 19 nt, Homo sapiens
gcaaagaaccagugugacu

SEQ ID NO: 1555419 - RNA, 19 nt, Homo sapiens
ggccacauguacccaguaa

SEQ ID NO: 1555420 - RNA, 19 nt, Homo sapiens
ucuaaugucuacaccauau

SEQ ID NO: 1555421 - RNA, 19 nt, Homo sapiens
ccacgcacaacuucuauuu

SEQ ID NO: 1555422 - RNA, 19 nt, Homo sapiens
agaagaaaccagaauguug

SEQ ID NO: 1555423 - RNA, 19 nt, Homo sapiens
aauaaagcaugcgauuuga

SEQ ID NO: 1555424 - RNA, 19 nt, Homo sapiens
ccacauguacccaguaaca

SEQ ID NO: 1555425 - RNA, 19 nt, Homo sapiens
ucaagcagccacauggaaa

SEQ ID NO: 1555426 - RNA, 19 nt, Homo sapiens
ucagagaaccugccuuuac

SEQ ID NO: 1555427 - RNA, 19 nt, Homo sapiens
uaacagagggagcaaagca

SEQ ID NO: 1555428 - RNA, 19 nt, Homo sapiens
ggaaguugacugccagauc

SEQ ID NO: 1555429 - RNA, 19 nt, Homo sapiens
ucaauaaagcaugcgauuu

SEQ ID NO: 1555430 - RNA, 19 nt, Homo sapiens
gcaaaucuuauccucaaag

SEQ ID NO: 1555431 - RNA, 19 nt, Homo sapiens
ccacgcagauagauuccau

SEQ ID NO: 1555432 - RNA, 19 nt, Homo sapiens
uaaagcaugcgauuugauc

SEQ ID NO: 1555433 - RNA, 19 nt, Homo sapiens
acgcacaacuucuauuucu

SEQ ID NO: 1555434 - RNA, 19 nt, Homo sapiens
uggauaacaugccaucauc

SEQ ID NO: 1555435 - RNA, 19 nt, Homo sapiens
cagauagauuccauucauc

SEQ ID NO: 1555436 - RNA, 19 nt, Homo sapiens
ggagcaaagcaaaucuuau

SEQ ID NO: 1555437 - RNA, 19 nt, Homo sapiens
caguuucggccuugcaaua

SEQ ID NO: 1555438 - RNA, 19 nt, Homo sapiens
aaagaagaaaccagaaugu

SEQ ID NO: 1555439 - RNA, 19 nt, Homo sapiens
aggauccaguaguguaaua

SEQ ID NO: 1555440 - RNA, 19 nt, Homo sapiens
gccauauggaugaauuuaa

SEQ ID NO: 1555441 - RNA, 19 nt, Homo sapiens
ugaaagaagaaaccagaau

SEQ ID NO: 1555442 - RNA, 19 nt, Homo sapiens
gagaaacugcucagagaac

SEQ ID NO: 1555443 - RNA, 19 nt, Homo sapiens
gcagcugcuuguuagaucu

SEQ ID NO: 1555444 - RNA, 19 nt, Homo sapiens
gauaacaugccaucaucuc

SEQ ID NO: 1555445 - RNA, 19 nt, Homo sapiens
gcaugcgauuugaucacaa

SEQ ID NO: 1555446 - RNA, 19 nt, Homo sapiens
gaaaucucacugucggaau

SEQ ID NO: 1555447 - RNA, 19 nt, Homo sapiens
cagagaaccugccuuuacc

SEQ ID NO: 1555448 - RNA, 19 nt, Homo sapiens
uugcaaagaaccaguguga

SEQ ID NO: 1555449 - RNA, 19 nt, Homo sapiens
aaaucucacugucggaauc

SEQ ID NO: 1555450 - RNA, 19 nt, Homo sapiens
ucaggauccaguaguguaa

SEQ ID NO: 1555451 - RNA, 19 nt, Homo sapiens
uuucggccuugcaauaauu

SEQ ID NO: 1555452 - RNA, 19 nt, Homo sapiens
uuccauucauccuuucuaa

SEQ ID NO: 1555453 - RNA, 19 nt, Homo sapiens
acaccacgcacaacuucua

SEQ ID NO: 1555454 - RNA, 19 nt, Homo sapiens
ucacaccacgcacaacuuc

SEQ ID NO: 1555455 - RNA, 19 nt, Homo sapiens
caacucaggauccaguagu

SEQ ID NO: 1555456 - RNA, 19 nt, Homo sapiens
ccuggugguuccauagaga

SEQ ID NO: 1555457 - RNA, 19 nt, Homo sapiens
gaauuagcgaagaacucua

SEQ ID NO: 1555458 - RNA, 19 nt, Homo sapiens
acagagggagcaaagcaaa

SEQ ID NO: 1555459 - RNA, 19 nt, Homo sapiens
aagaagaaaccagaauguu

SEQ ID NO: 1555460 - RNA, 19 nt, Homo sapiens
acuauucaguggccacaug

SEQ ID NO: 1555461 - RNA, 19 nt, Homo sapiens
cacaacuucuauuucuuca

SEQ ID NO: 1555462 - RNA, 19 nt, Homo sapiens
ucggaauccuuggaaauca

SEQ ID NO: 1555463 - RNA, 19 nt, Homo sapiens
ucccggagcucaguucauc

SEQ ID NO: 1555464 - RNA, 19 nt, Homo sapiens
gcaaagcaaaucuuauccu

SEQ ID NO: 1555465 - RNA, 19 nt, Homo sapiens
guuucggccuugcaauaau

SEQ ID NO: 1555466 - RNA, 19 nt, Homo sapiens
acauuguguugaaagaaga

SEQ ID NO: 1555467 - RNA, 19 nt, Homo sapiens
ugaauuagcgaagaacucu

SEQ ID NO: 1555468 - RNA, 19 nt, Homo sapiens
uuucuaaugucuacaccau

SEQ ID NO: 1555469 - RNA, 19 nt, Homo sapiens
gcaugugaaauuauacucu

SEQ ID NO: 1555470 - RNA, 19 nt, Homo sapiens
cauccuuucuaaugucuac

SEQ ID NO: 1555471 - RNA, 19 nt, Homo sapiens
gaagccuguuacgagauau

SEQ ID NO: 1555472 - RNA, 19 nt, Homo sapiens
agagaaacugcucagagaa

SEQ ID NO: 1555473 - RNA, 19 nt, Homo sapiens
acauguacccaguaacaga

SEQ ID NO: 1555474 - RNA, 19 nt, Homo sapiens
caugccaucaucucacauu

SEQ ID NO: 1555475 - RNA, 19 nt, Homo sapiens
ggaauccuuggaaaucaca

SEQ ID NO: 1555476 - RNA, 19 nt, Homo sapiens
ugccauauggaugaauuua

SEQ ID NO: 1555477 - RNA, 19 nt, Homo sapiens
gaaaggagcucugaauuua

SEQ ID NO: 1555478 - RNA, 19 nt, Homo sapiens
ggagaaagcuguugagaua

SEQ ID NO: 1555479 - RNA, 19 nt, Homo sapiens
gaacauauccagacuauuu

SEQ ID NO: 1555480 - RNA, 19 nt, Homo sapiens
ggagauagcacuguaauua

SEQ ID NO: 1555481 - RNA, 19 nt, Homo sapiens
gaagaaacauuaccagguu

SEQ ID NO: 1555482 - RNA, 19 nt, Homo sapiens
gaacagaaccaaagauaaa

SEQ ID NO: 1555483 - RNA, 19 nt, Homo sapiens
guacuuuccuugauuguua

SEQ ID NO: 1555484 - RNA, 19 nt, Homo sapiens
guaaagaaauggugucuau

SEQ ID NO: 1555485 - RNA, 19 nt, Homo sapiens
gcaaauaguuuaaggaaca

SEQ ID NO: 1555486 - RNA, 19 nt, Homo sapiens
aaacuaaacugaccugaaa

SEQ ID NO: 1555487 - RNA, 19 nt, Homo sapiens
caagugaguuuacugauuu

SEQ ID NO: 1555488 - RNA, 19 nt, Homo sapiens
ggaaugaguuggcagcuuu

SEQ ID NO: 1555489 - RNA, 19 nt, Homo sapiens
gauaagaaaucucaacugu

SEQ ID NO: 1555490 - RNA, 19 nt, Homo sapiens
gaaaugaaauggucuagag

SEQ ID NO: 1555491 - RNA, 19 nt, Homo sapiens
gaaauggucuagagggaaa

SEQ ID NO: 1555492 - RNA, 19 nt, Homo sapiens
caggauaaauucagugaua

SEQ ID NO: 1555493 - RNA, 19 nt, Homo sapiens
gaaaugcuguguuuaaucu

SEQ ID NO: 1555494 - RNA, 19 nt, Homo sapiens
ccaaagauguuccugugua

SEQ ID NO: 1555495 - RNA, 19 nt, Homo sapiens
ggaaugggaugaacaagga

SEQ ID NO: 1555496 - RNA, 19 nt, Homo sapiens
ucacguggcugcucaguuu

SEQ ID NO: 1555497 - RNA, 19 nt, Homo sapiens
gcaaagugguauaauguug

SEQ ID NO: 1555498 - RNA, 19 nt, Homo sapiens
acaaauaccuugagagaug

SEQ ID NO: 1555499 - RNA, 19 nt, Homo sapiens
gcucaugccuguaauccua

SEQ ID NO: 1555500 - RNA, 19 nt, Homo sapiens
gaaacccugucucuacuaa

SEQ ID NO: 1555501 - RNA, 19 nt, Homo sapiens
cagcagaacuucaggagaa

SEQ ID NO: 1555502 - RNA, 19 nt, Homo sapiens
gcaagacucugcuucuaug

SEQ ID NO: 1555503 - RNA, 19 nt, Homo sapiens
ggguuucacuccauauuua

SEQ ID NO: 1555504 - RNA, 19 nt, Homo sapiens
gggcaaauguaacaccaua

SEQ ID NO: 1555505 - RNA, 19 nt, Homo sapiens
gacaguagccagccuaaua

SEQ ID NO: 1555506 - RNA, 19 nt, Homo sapiens
gagauaguuugcuaaguuu

SEQ ID NO: 1555507 - RNA, 19 nt, Homo sapiens
ugagauaguuugcuaaguu

SEQ ID NO: 1555508 - RNA, 19 nt, Homo sapiens
ccuauuggcuuuguucuua

SEQ ID NO: 1555509 - RNA, 19 nt, Homo sapiens
gaaggcaauugcacuuaaa

SEQ ID NO: 1555510 - RNA, 19 nt, Homo sapiens
caaaugaaguguuaucagu

SEQ ID NO: 1555511 - RNA, 19 nt, Homo sapiens
gaaacccuguguccacuaa

SEQ ID NO: 1555512 - RNA, 19 nt, Homo sapiens
gaucuuauaugacuguaug

SEQ ID NO: 1555513 - RNA, 19 nt, Homo sapiens
gauaauagaccuccuggaa

SEQ ID NO: 1555514 - RNA, 19 nt, Homo sapiens
gcacuacaauguuuaucuu

SEQ ID NO: 1555515 - RNA, 19 nt, Homo sapiens
ggacugaucuggcguucug

SEQ ID NO: 1555516 - RNA, 19 nt, Homo sapiens
gaugguggauguuugauug

SEQ ID NO: 1555517 - RNA, 19 nt, Homo sapiens
ggagaaugguuguuggaaa

SEQ ID NO: 1555518 - RNA, 19 nt, Homo sapiens
gaagaccaccuugaaauuu

SEQ ID NO: 1555519 - RNA, 19 nt, Homo sapiens
gaguaggaaucgugguuua

SEQ ID NO: 1555520 - RNA, 19 nt, Homo sapiens
caucuuuccucuuuguuua

SEQ ID NO: 1555521 - RNA, 19 nt, Homo sapiens
gaucaaagcauacauugga

SEQ ID NO: 1555522 - RNA, 19 nt, Homo sapiens
gacaauggauacaagguuu

SEQ ID NO: 1555523 - RNA, 19 nt, Homo sapiens
gagaagauauguguagaau

SEQ ID NO: 1555524 - RNA, 19 nt, Homo sapiens
gauaauagacagcuagcua

SEQ ID NO: 1555525 - RNA, 19 nt, Homo sapiens
gaauguuccuuaaaucaug

SEQ ID NO: 1555526 - RNA, 19 nt, Homo sapiens
ucacaucuccucaugauaa

SEQ ID NO: 1555527 - RNA, 19 nt, Homo sapiens
gaaguguguucugucuuua

SEQ ID NO: 1555528 - RNA, 19 nt, Homo sapiens
ugaaguguguucugucuuu

SEQ ID NO: 1555529 - RNA, 19 nt, Homo sapiens
ccacagagguauaaauagu

SEQ ID NO: 1555530 - RNA, 19 nt, Homo sapiens
ccuguuaccucacugauaa

SEQ ID NO: 1555531 - RNA, 19 nt, Homo sapiens
gcagagaggcuuugugguu

SEQ ID NO: 1555532 - RNA, 19 nt, Homo sapiens
gagauuggauacuuuggaa

SEQ ID NO: 1555533 - RNA, 19 nt, Homo sapiens
gcuaggauguuguaucaga

SEQ ID NO: 1555534 - RNA, 19 nt, Homo sapiens
gcaaggaagacaauggaua

SEQ ID NO: 1555535 - RNA, 19 nt, Homo sapiens
ccaggaagguaaagaaaug

SEQ ID NO: 1555536 - RNA, 19 nt, Homo sapiens
uaggaaucgugguuuauua

SEQ ID NO: 1555537 - RNA, 19 nt, Homo sapiens
guacaaauaccuugagaga

SEQ ID NO: 1555538 - RNA, 19 nt, Homo sapiens
gaaccuauaagaaugugua

SEQ ID NO: 1555539 - RNA, 19 nt, Homo sapiens
gaaggacuauugcccuguu

SEQ ID NO: 1555540 - RNA, 19 nt, Homo sapiens
uggauaaguuguucuauga

SEQ ID NO: 1555541 - RNA, 19 nt, Homo sapiens
uugaguaacugaugcauaa

SEQ ID NO: 1555542 - RNA, 19 nt, Homo sapiens
ggagauaacaauaacaaga

SEQ ID NO: 1555543 - RNA, 19 nt, Homo sapiens
ucaagugaguuuacugauu

SEQ ID NO: 1555544 - RNA, 19 nt, Homo sapiens
gaacugaagaaacucauug

SEQ ID NO: 1555545 - RNA, 19 nt, Homo sapiens
gaaaugcugaugugaagaa

SEQ ID NO: 1555546 - RNA, 19 nt, Homo sapiens
ggaagacaauggauacaag

SEQ ID NO: 1555547 - RNA, 19 nt, Homo sapiens
gggaaaugcuucucgugaa

SEQ ID NO: 1555548 - RNA, 19 nt, Homo sapiens
ugucugagcaugauacuua

SEQ ID NO: 1555549 - RNA, 19 nt, Homo sapiens
ggaaauggcauauauucug

SEQ ID NO: 1555550 - RNA, 19 nt, Homo sapiens
agacuagccuggccaauau

SEQ ID NO: 1555551 - RNA, 19 nt, Homo sapiens
gagguccaguuuauucuaa

SEQ ID NO: 1555552 - RNA, 19 nt, Homo sapiens
uauaugcagucaagaauga

SEQ ID NO: 1555553 - RNA, 19 nt, Homo sapiens
gagacuagccuggccaaua

SEQ ID NO: 1555554 - RNA, 19 nt, Homo sapiens
gauuaagccuaguucugua

SEQ ID NO: 1555555 - RNA, 19 nt, Homo sapiens
ggaacagaaccaaagauaa

SEQ ID NO: 1555556 - RNA, 19 nt, Homo sapiens
uugaaaggcuucguaauuu

SEQ ID NO: 1555557 - RNA, 19 nt, Homo sapiens
ugaaggcaauugcacuuaa

SEQ ID NO: 1555558 - RNA, 19 nt, Homo sapiens
gagaaugguuguuggaaag

SEQ ID NO: 1555559 - RNA, 19 nt, Homo sapiens
gcauaagugcaaugaauaa

SEQ ID NO: 1555560 - RNA, 19 nt, Homo sapiens
aaaccuaauuguccaacua

SEQ ID NO: 1555561 - RNA, 19 nt, Homo sapiens
gaccuaaacaaauugcuua

SEQ ID NO: 1555562 - RNA, 19 nt, Homo sapiens
caacacuccuauuggcuuu

SEQ ID NO: 1555563 - RNA, 19 nt, Homo sapiens
uaucucaucuggccgagua

SEQ ID NO: 1555564 - RNA, 19 nt, Homo sapiens
gauuggaaguaggauaaua

SEQ ID NO: 1555565 - RNA, 19 nt, Homo sapiens
caaaagagcagauugaaaa

SEQ ID NO: 1555566 - RNA, 19 nt, Homo sapiens
ggaaugucuuuauauagga

SEQ ID NO: 1555567 - RNA, 19 nt, Homo sapiens
gcucacaucuguaauacca

SEQ ID NO: 1555568 - RNA, 19 nt, Homo sapiens
gagaaaggagcucugaauu

SEQ ID NO: 1555569 - RNA, 19 nt, Homo sapiens
acagaaacaucacaauuca

SEQ ID NO: 1555570 - RNA, 19 nt, Homo sapiens
gagugcagcuguugugguu

SEQ ID NO: 1555571 - RNA, 19 nt, Homo sapiens
ccaccacagucucuucuaa

SEQ ID NO: 1555572 - RNA, 19 nt, Homo sapiens
gcagacauccccuuaaaua

SEQ ID NO: 1555573 - RNA, 19 nt, Homo sapiens
uagaacauauccagacuau

SEQ ID NO: 1555574 - RNA, 19 nt, Homo sapiens
ggacaaagugacauaccua

SEQ ID NO: 1555575 - RNA, 19 nt, Homo sapiens
auaagaauguguagaguga

SEQ ID NO: 1555576 - RNA, 19 nt, Homo sapiens
uagaccaucuuuccucuuu

SEQ ID NO: 1555577 - RNA, 19 nt, Homo sapiens
gcaaacagcccuuaacuua

SEQ ID NO: 1555578 - RNA, 19 nt, Homo sapiens
ggaccuagcugaagugauc

SEQ ID NO: 1555579 - RNA, 19 nt, Homo sapiens
gguaaagucucaauacuag

SEQ ID NO: 1555580 - RNA, 19 nt, Homo sapiens
uguccaaggucacauaaua

SEQ ID NO: 1555581 - RNA, 19 nt, Homo sapiens
caugauguguggauguuua

SEQ ID NO: 1555582 - RNA, 19 nt, Homo sapiens
gcaaaggucuccugaagcu

SEQ ID NO: 1555583 - RNA, 19 nt, Homo sapiens
ggagggagguucucuaaaa

SEQ ID NO: 1555584 - RNA, 19 nt, Homo sapiens
caacagagcgagacuuugu

SEQ ID NO: 1555585 - RNA, 19 nt, Homo sapiens
aauaauggcugaugcuaau

SEQ ID NO: 1555586 - RNA, 19 nt, Homo sapiens
uaagcuacaucccgaauuc

SEQ ID NO: 1555587 - RNA, 19 nt, Homo sapiens
ggaaagcuguggagucacu

SEQ ID NO: 1555588 - RNA, 19 nt, Homo sapiens
gagcucagaugcacacucu

SEQ ID NO: 1555589 - RNA, 19 nt, Homo sapiens
guggaaagcuguggaguca

SEQ ID NO: 1555590 - RNA, 19 nt, Homo sapiens
ggcaagcucuucgugauug

SEQ ID NO: 1555591 - RNA, 19 nt, Homo sapiens
gcgaggaggccguguuuga

SEQ ID NO: 1555592 - RNA, 19 nt, Homo sapiens
caaagacuguaaggacuga

SEQ ID NO: 1555593 - RNA, 19 nt, Homo sapiens
uggcugaugcuaauaauaa

SEQ ID NO: 1555594 - RNA, 19 nt, Homo sapiens
cuaaaacccucucuuugua

SEQ ID NO: 1555595 - RNA, 19 nt, Homo sapiens
ccgcaaaggucuccugaag

SEQ ID NO: 1555596 - RNA, 19 nt, Homo sapiens
gcaaaaucuucaccuauga

SEQ ID NO: 1555597 - RNA, 19 nt, Homo sapiens
guaacagccugauggucaa

SEQ ID NO: 1555598 - RNA, 19 nt, Homo sapiens
gcggagaaagcaccgauaa

SEQ ID NO: 1555599 - RNA, 19 nt, Homo sapiens
ggcaggugauucagauuug

SEQ ID NO: 1555600 - RNA, 19 nt, Homo sapiens
gggcaggugauucagauuu

SEQ ID NO: 1555601 - RNA, 19 nt, Homo sapiens
ggagaaagcaccgauaagg

SEQ ID NO: 1555602 - RNA, 19 nt, Homo sapiens
cauggcaccuccacgcaaa

SEQ ID NO: 1555603 - RNA, 19 nt, Homo sapiens
cggcuacacucgcucagaa

SEQ ID NO: 1555604 - RNA, 19 nt, Homo sapiens
ggcaacagagcgagacuuu

SEQ ID NO: 1555605 - RNA, 19 nt, Homo sapiens
gcaggagaauggcaugaac

SEQ ID NO: 1555606 - RNA, 19 nt, Homo sapiens
gaaaccccgucucuacuaa

SEQ ID NO: 1555607 - RNA, 19 nt, Homo sapiens
ggacaaggugcagugcuuu

SEQ ID NO: 1555608 - RNA, 19 nt, Homo sapiens
uaauaauggcugaugcuaa

SEQ ID NO: 1555609 - RNA, 19 nt, Homo sapiens
caaggucacauaauaaugg

SEQ ID NO: 1555610 - RNA, 19 nt, Homo sapiens
gaauucagaaacaaagaug

SEQ ID NO: 1555611 - RNA, 19 nt, Homo sapiens
gagaaagcaccgauaaggu

SEQ ID NO: 1555612 - RNA, 19 nt, Homo sapiens
uaauggcugaugcuaauaa

SEQ ID NO: 1555613 - RNA, 19 nt, Homo sapiens
ggacacaagguacagaucu

SEQ ID NO: 1555614 - RNA, 19 nt, Homo sapiens
gcagugagcccagauugca

SEQ ID NO: 1555615 - RNA, 19 nt, Homo sapiens
gaggccacaucaacaguca

SEQ ID NO: 1555616 - RNA, 19 nt, Homo sapiens
agucuagguuugaaucuug

SEQ ID NO: 1555617 - RNA, 19 nt, Homo sapiens
guccaaggucacauaauaa

SEQ ID NO: 1555618 - RNA, 19 nt, Homo sapiens
ccgcuuacuuccuggagaa

SEQ ID NO: 1555619 - RNA, 19 nt, Homo sapiens
ggaucaagguagccucucu

SEQ ID NO: 1555620 - RNA, 19 nt, Homo sapiens
gggcaagcucuucgugauu

SEQ ID NO: 1555621 - RNA, 19 nt, Homo sapiens
gagucuagguuugaaucuu

SEQ ID NO: 1555622 - RNA, 19 nt, Homo sapiens
gacacaagguacagaucug

SEQ ID NO: 1555623 - RNA, 19 nt, Homo sapiens
ugacugugccacucaagaa

SEQ ID NO: 1555624 - RNA, 19 nt, Homo sapiens
gcagguggaggcacaagau

SEQ ID NO: 1555625 - RNA, 19 nt, Homo sapiens
ccugugcucuccgcaauga

SEQ ID NO: 1555626 - RNA, 19 nt, Homo sapiens
gcgggaugaucgcggagaa

SEQ ID NO: 1555627 - RNA, 19 nt, Homo sapiens
cggacaaggugcagugcuu

SEQ ID NO: 1555628 - RNA, 19 nt, Homo sapiens
gcuacacucgcucagaauu

SEQ ID NO: 1555629 - RNA, 19 nt, Homo sapiens
cugugccacucaagaauaa

SEQ ID NO: 1555630 - RNA, 19 nt, Homo sapiens
ucauggaccuagcugaagu

SEQ ID NO: 1555631 - RNA, 19 nt, Homo sapiens
ccacgcaaacagcccuuaa

SEQ ID NO: 1555632 - RNA, 19 nt, Homo sapiens
gggauaguuuccagcucaa

SEQ ID NO: 1555633 - RNA, 19 nt, Homo sapiens
gcucagggagguacagcaa

SEQ ID NO: 1555634 - RNA, 19 nt, Homo sapiens
ugguaaagucucaauacua

SEQ ID NO: 1555635 - RNA, 19 nt, Homo sapiens
cuacaucccgaauucagaa

SEQ ID NO: 1555636 - RNA, 19 nt, Homo sapiens
gcaggugauucagauuugg

SEQ ID NO: 1555637 - RNA, 19 nt, Homo sapiens
gucaugauguguggauguu

SEQ ID NO: 1555638 - RNA, 19 nt, Homo sapiens
gugguaaagucucaauacu

SEQ ID NO: 1555639 - RNA, 19 nt, Homo sapiens
guaagcuacaucccgaauu

SEQ ID NO: 1555640 - RNA, 19 nt, Homo sapiens
cgaggaggccguguuugaa

SEQ ID NO: 1555641 - RNA, 19 nt, Homo sapiens
gaugaucgcggagaaagca

SEQ ID NO: 1555642 - RNA, 19 nt, Homo sapiens
gaggaggccguguuugaag

SEQ ID NO: 1555643 - RNA, 19 nt, Homo sapiens
ucaauuaagugggguggua

SEQ ID NO: 1555644 - RNA, 19 nt, Homo sapiens
ucagggagguacagcaacu

SEQ ID NO: 1555645 - RNA, 19 nt, Homo sapiens
gacaaggugcagugcuuug

SEQ ID NO: 1555646 - RNA, 19 nt, Homo sapiens
gcaagcucuucgugauugg

SEQ ID NO: 1555647 - RNA, 19 nt, Homo sapiens
cgggcaagcucuucgugau

SEQ ID NO: 1555648 - RNA, 19 nt, Homo sapiens
ggugguaaagucucaauac

SEQ ID NO: 1555649 - RNA, 19 nt, Homo sapiens
caucccgaauucagaaaca

SEQ ID NO: 1555650 - RNA, 19 nt, Homo sapiens
ggcugaugcuaauaauaau

SEQ ID NO: 1555651 - RNA, 19 nt, Homo sapiens
ccaaggucacauaauaaug

SEQ ID NO: 1555652 - RNA, 19 nt, Homo sapiens
ucgaggcugucucccuuga

SEQ ID NO: 1555653 - RNA, 19 nt, Homo sapiens
cggcccauguccucacuug

SEQ ID NO: 1555654 - RNA, 19 nt, Homo sapiens
caucugcacaccuggauca

SEQ ID NO: 1555655 - RNA, 19 nt, Homo sapiens
gcaacagagcgagacuuug

SEQ ID NO: 1555656 - RNA, 19 nt, Homo sapiens
gagcaaaaucuucaccuau

SEQ ID NO: 1555657 - RNA, 19 nt, Homo sapiens
gauaguuuccagcucaaag

SEQ ID NO: 1555658 - RNA, 19 nt, Homo sapiens
gguagccucucugcacaag

SEQ ID NO: 1555659 - RNA, 19 nt, Homo sapiens
gcuacaucccgaauucaga

SEQ ID NO: 1555660 - RNA, 19 nt, Homo sapiens
cgaauucagaaacaaagau

SEQ ID NO: 1555661 - RNA, 19 nt, Homo sapiens
aauggucccuuuucuugua

SEQ ID NO: 1555662 - RNA, 19 nt, Homo sapiens
caccagcacccuucucaca

SEQ ID NO: 1555663 - RNA, 19 nt, Homo sapiens
gcccauguccucacuugca

SEQ ID NO: 1555664 - RNA, 19 nt, Homo sapiens
ucagcuuggugccagguau

SEQ ID NO: 1555665 - RNA, 19 nt, Homo sapiens
gagcuugggcaggugauuc

SEQ ID NO: 1555666 - RNA, 19 nt, Homo sapiens
ugagcaaaaucuucaccua

SEQ ID NO: 1555667 - RNA, 19 nt, Homo sapiens
uaaguggggugguaaaguc

SEQ ID NO: 1555668 - RNA, 19 nt, Homo sapiens
ggccacaucaacagucaug

SEQ ID NO: 1555669 - RNA, 19 nt, Homo sapiens
ucaccaucauccagagcuu

SEQ ID NO: 1555670 - RNA, 19 nt, Homo sapiens
cuggagggagguucucuaa

SEQ ID NO: 1555671 - RNA, 19 nt, Homo sapiens
uaaagucucaauacuagcu

SEQ ID NO: 1555672 - RNA, 19 nt, Homo sapiens
gucuagguuugaaucuuga

SEQ ID NO: 1555673 - RNA, 19 nt, Homo sapiens
uaaaacccucucuuuguaa

SEQ ID NO: 1555674 - RNA, 19 nt, Homo sapiens
ccagaaagcuaaugucuau

SEQ ID NO: 1555675 - RNA, 19 nt, Homo sapiens
gguaagagcuggcuucugu

SEQ ID NO: 1555676 - RNA, 19 nt, Homo sapiens
gcuaaugucuauuggauuu

SEQ ID NO: 1555677 - RNA, 19 nt, Homo sapiens
gaacgaguacuguuaauga

SEQ ID NO: 1555678 - RNA, 19 nt, Homo sapiens
aaagaaaggugugaaguuu

SEQ ID NO: 1555679 - RNA, 19 nt, Homo sapiens
ucacugagccucuuaauau

SEQ ID NO: 1555680 - RNA, 19 nt, Homo sapiens
caaaugucaucucuaauug

SEQ ID NO: 1555681 - RNA, 19 nt, Homo sapiens
gaaagcaccacaggaaaua

SEQ ID NO: 1555682 - RNA, 19 nt, Homo sapiens
aaugguagaugcaacuuua

SEQ ID NO: 1555683 - RNA, 19 nt, Homo sapiens
ggaggaguaugaucuguug

SEQ ID NO: 1555684 - RNA, 19 nt, Homo sapiens
caugagaucugaugguuau

SEQ ID NO: 1555685 - RNA, 19 nt, Homo sapiens
ccaaaugucaucucuaauu

SEQ ID NO: 1555686 - RNA, 19 nt, Homo sapiens
guucugcuguguauauaua

SEQ ID NO: 1555687 - RNA, 19 nt, Homo sapiens
ggaaauagaacgaguacug

SEQ ID NO: 1555688 - RNA, 19 nt, Homo sapiens
gaaggucaguguauuuagu

SEQ ID NO: 1555689 - RNA, 19 nt, Homo sapiens
ccauuucucuccugucuuu

SEQ ID NO: 1555690 - RNA, 19 nt, Homo sapiens
gaacugugagucaauuaaa

SEQ ID NO: 1555691 - RNA, 19 nt, Homo sapiens
gcacaucucuuuuguagga

SEQ ID NO: 1555692 - RNA, 19 nt, Homo sapiens
gagaucugaugguuauaaa

SEQ ID NO: 1555693 - RNA, 19 nt, Homo sapiens
uaagaaagcaccacaggaa

SEQ ID NO: 1555694 - RNA, 19 nt, Homo sapiens
gaauuucuguucccugaau

SEQ ID NO: 1555695 - RNA, 19 nt, Homo sapiens
gcucagagggaaauaagua

SEQ ID NO: 1555696 - RNA, 19 nt, Homo sapiens
cgaguacuguuaaugauga

SEQ ID NO: 1555697 - RNA, 19 nt, Homo sapiens
gugcuuacuuuccuucuuu

SEQ ID NO: 1555698 - RNA, 19 nt, Homo sapiens
gaggugagacuuacugauu

SEQ ID NO: 1555699 - RNA, 19 nt, Homo sapiens
gaccagaggaguuaagaaa

SEQ ID NO: 1555700 - RNA, 19 nt, Homo sapiens
ccauugugcuaacagaaua

SEQ ID NO: 1555701 - RNA, 19 nt, Homo sapiens
guaggagacuuaaauuugg

SEQ ID NO: 1555702 - RNA, 19 nt, Homo sapiens
uuucuuaccuaguguagua

SEQ ID NO: 1555703 - RNA, 19 nt, Homo sapiens
ugucuaaacuguugugaau

SEQ ID NO: 1555704 - RNA, 19 nt, Homo sapiens
gaugcaacuuuaaaugcua

SEQ ID NO: 1555705 - RNA, 19 nt, Homo sapiens
gugagcagcuggagggaaa

SEQ ID NO: 1555706 - RNA, 19 nt, Homo sapiens
ggcaaacuguaaccucuuu

SEQ ID NO: 1555707 - RNA, 19 nt, Homo sapiens
ccaccugucccuucuauuu

SEQ ID NO: 1555708 - RNA, 19 nt, Homo sapiens
gcgaaggucaguguauuua

SEQ ID NO: 1555709 - RNA, 19 nt, Homo sapiens
uagcaggucugaugaaugg

SEQ ID NO: 1555710 - RNA, 19 nt, Homo sapiens
uaaagaaaggugugaaguu

SEQ ID NO: 1555711 - RNA, 19 nt, Homo sapiens
gucaguguauuuaguguaa

SEQ ID NO: 1555712 - RNA, 19 nt, Homo sapiens
agccaaaugucaucucuaa

SEQ ID NO: 1555713 - RNA, 19 nt, Homo sapiens
gaaagcuaaugucuauugg

SEQ ID NO: 1555714 - RNA, 19 nt, Homo sapiens
ggugagacuuacugauuug

SEQ ID NO: 1555715 - RNA, 19 nt, Homo sapiens
ggaacugugagucaauuaa

SEQ ID NO: 1555716 - RNA, 19 nt, Homo sapiens
ggaugugaguuaguugaaa

SEQ ID NO: 1555717 - RNA, 19 nt, Homo sapiens
gcaggaauaucuggaugug

SEQ ID NO: 1555718 - RNA, 19 nt, Homo sapiens
ggacacauggcaccaauag

SEQ ID NO: 1555719 - RNA, 19 nt, Homo sapiens
gugauugcccuuucccuua

SEQ ID NO: 1555720 - RNA, 19 nt, Homo sapiens
ggaagggcauaaagaaagg

SEQ ID NO: 1555721 - RNA, 19 nt, Homo sapiens
ccaucucccuccacccuua

SEQ ID NO: 1555722 - RNA, 19 nt, Homo sapiens
ucucuucugucacgguuua

SEQ ID NO: 1555723 - RNA, 19 nt, Homo sapiens
gcacuuccuugcuaucucu

SEQ ID NO: 1555724 - RNA, 19 nt, Homo sapiens
agacuauagugucauugua

SEQ ID NO: 1555725 - RNA, 19 nt, Homo sapiens
cuaagacuauagugucauu

SEQ ID NO: 1555726 - RNA, 19 nt, Homo sapiens
aggauacacuugcacagua

SEQ ID NO: 1555727 - RNA, 19 nt, Homo sapiens
cagcgaaggucaguguauu

SEQ ID NO: 1555728 - RNA, 19 nt, Homo sapiens
guaggguucucuucuguca

SEQ ID NO: 1555729 - RNA, 19 nt, Homo sapiens
gaucugaugguuauaaagu

SEQ ID NO: 1555730 - RNA, 19 nt, Homo sapiens
ggauacacuugcacaguag

SEQ ID NO: 1555731 - RNA, 19 nt, Homo sapiens
gaaauagaacgaguacugu

SEQ ID NO: 1555732 - RNA, 19 nt, Homo sapiens
gaauggaggugagacuuac

SEQ ID NO: 1555733 - RNA, 19 nt, Homo sapiens
aauagaacgaguacuguua

SEQ ID NO: 1555734 - RNA, 19 nt, Homo sapiens
ggagaaaggcaugaagaga

SEQ ID NO: 1555735 - RNA, 19 nt, Homo sapiens
gaggacacauggcaccaau

SEQ ID NO: 1555736 - RNA, 19 nt, Homo sapiens
gauugguucugcuguguau

SEQ ID NO: 1555737 - RNA, 19 nt, Homo sapiens
ugucacgguuuaacucuuu

SEQ ID NO: 1555738 - RNA, 19 nt, Homo sapiens
gguuaucucucuccuacug

SEQ ID NO: 1555739 - RNA, 19 nt, Homo sapiens
gacuauagugucauuguaa

SEQ ID NO: 1555740 - RNA, 19 nt, Homo sapiens
guagaugcaacuuuaaaug

SEQ ID NO: 1555741 - RNA, 19 nt, Homo sapiens
uggcagugcuugauugguu

SEQ ID NO: 1555742 - RNA, 19 nt, Homo sapiens
uguaggagacuuaaauuug

SEQ ID NO: 1555743 - RNA, 19 nt, Homo sapiens
auucuccucuccuuucuua

SEQ ID NO: 1555744 - RNA, 19 nt, Homo sapiens
agaaagcuaaugucuauug

SEQ ID NO: 1555745 - RNA, 19 nt, Homo sapiens
uaaaugcuaucaguaaguc

SEQ ID NO: 1555746 - RNA, 19 nt, Homo sapiens
ucugaugaauggaaucuga

SEQ ID NO: 1555747 - RNA, 19 nt, Homo sapiens
gaauagcaggucugaugaa

SEQ ID NO: 1555748 - RNA, 19 nt, Homo sapiens
ggugugaaguuuccaaagg

SEQ ID NO: 1555749 - RNA, 19 nt, Homo sapiens
ucuaaacuguugugaauac

SEQ ID NO: 1555750 - RNA, 19 nt, Homo sapiens
gagggugggcaaacuguaa

SEQ ID NO: 1555751 - RNA, 19 nt, Homo sapiens
ugauguaggugcuugauac

SEQ ID NO: 1555752 - RNA, 19 nt, Homo sapiens
uaauaacccugugacuguu

SEQ ID NO: 1555753 - RNA, 19 nt, Homo sapiens
uuaauaacccugugacugu

SEQ ID NO: 1555754 - RNA, 19 nt, Homo sapiens
caaagugguuaaaggugau

SEQ ID NO: 1555755 - RNA, 19 nt, Homo sapiens
gagcaacgcccagaacauc

SEQ ID NO: 1555756 - RNA, 19 nt, Homo sapiens
agaauggaggugagacuua

SEQ ID NO: 1555757 - RNA, 19 nt, Homo sapiens
ccacggaagggcauaaaga

SEQ ID NO: 1555758 - RNA, 19 nt, Homo sapiens
ugauuuggguguuuucuua

SEQ ID NO: 1555759 - RNA, 19 nt, Homo sapiens
aagcuaaugucuauuggau

SEQ ID NO: 1555760 - RNA, 19 nt, Homo sapiens
uaaaacagguuaucucucu

SEQ ID NO: 1555761 - RNA, 19 nt, Homo sapiens
gcacacaucaaaaguauug

SEQ ID NO: 1555762 - RNA, 19 nt, Homo sapiens
cacugagccucuuaauauu

SEQ ID NO: 1555763 - RNA, 19 nt, Homo sapiens
ucccaggcauuuaagcuaa

SEQ ID NO: 1555764 - RNA, 19 nt, Homo sapiens
ggugauuaauuccauugug

SEQ ID NO: 1555765 - RNA, 19 nt, Homo sapiens
agacgguaauguucuucua

SEQ ID NO: 1555766 - RNA, 19 nt, Homo sapiens
ucgcuuagcuuuguuaggu

SEQ ID NO: 1555767 - RNA, 19 nt, Homo sapiens
guaggugcuugauacuguu

SEQ ID NO: 1555768 - RNA, 19 nt, Homo sapiens
uguaggugcuugauacugu

SEQ ID NO: 1555769 - RNA, 19 nt, Homo sapiens
ccgcaucccaggcauuuaa

SEQ ID NO: 1555770 - RNA, 19 nt, Homo sapiens
gaugugaguuaguugaaaa

SEQ ID NO: 1555771 - RNA, 19 nt, Homo sapiens
aggauugauugcaggaaua

SEQ ID NO: 1555772 - RNA, 19 nt, Homo sapiens
gcagggaggaguaugaucu

SEQ ID NO: 1555773 - RNA, 19 nt, Homo sapiens
aaacuguaaccucuuugua

SEQ ID NO: 1555774 - RNA, 19 nt, Homo sapiens
ggaaagaacucuccaaccu

SEQ ID NO: 1555775 - RNA, 19 nt, Homo sapiens
uaagacaggcggacaauuu

SEQ ID NO: 1555776 - RNA, 19 nt, Homo sapiens
ucaaaucucugaucaucuu

SEQ ID NO: 1555777 - RNA, 19 nt, Homo sapiens
gaaugacugugguuggaaa

SEQ ID NO: 1555778 - RNA, 19 nt, Homo sapiens
ggacucaggcuaauuccua

SEQ ID NO: 1555779 - RNA, 19 nt, Homo sapiens
gcacuggacuaaugacaca

SEQ ID NO: 1555780 - RNA, 19 nt, Homo sapiens
gcugugcaguuucuuguaa

SEQ ID NO: 1555781 - RNA, 19 nt, Homo sapiens
acacucaagucuguaaaua

SEQ ID NO: 1555782 - RNA, 19 nt, Homo sapiens
gguuggcucugucugcuua

SEQ ID NO: 1555783 - RNA, 19 nt, Homo sapiens
gggauuucuuggcuauuua

SEQ ID NO: 1555784 - RNA, 19 nt, Homo sapiens
uauaguaucucccuagcaa

SEQ ID NO: 1555785 - RNA, 19 nt, Homo sapiens
ucucugaguuguugacuuu

SEQ ID NO: 1555786 - RNA, 19 nt, Homo sapiens
ccugauagaguguuuauaa

SEQ ID NO: 1555787 - RNA, 19 nt, Homo sapiens
cacguuacauugaguauga

SEQ ID NO: 1555788 - RNA, 19 nt, Homo sapiens
gugcauauuuauugcguuu

SEQ ID NO: 1555789 - RNA, 19 nt, Homo sapiens
guaaauauccuuccucacu

SEQ ID NO: 1555790 - RNA, 19 nt, Homo sapiens
cgacuaauuccaucucuuu

SEQ ID NO: 1555791 - RNA, 19 nt, Homo sapiens
gaauggacuugcuggugaa

SEQ ID NO: 1555792 - RNA, 19 nt, Homo sapiens
ccaaugggauggcagacuu

SEQ ID NO: 1555793 - RNA, 19 nt, Homo sapiens
uguaacagcugaggacaaa

SEQ ID NO: 1555794 - RNA, 19 nt, Homo sapiens
guacagcugugcaguuucu

SEQ ID NO: 1555795 - RNA, 19 nt, Homo sapiens
ggacuaaugacacaaauac

SEQ ID NO: 1555796 - RNA, 19 nt, Homo sapiens
guacacacguuacauugag

SEQ ID NO: 1555797 - RNA, 19 nt, Homo sapiens
gugugucugugcauauuua

SEQ ID NO: 1555798 - RNA, 19 nt, Homo sapiens
gcauggcucugaggacauu

SEQ ID NO: 1555799 - RNA, 19 nt, Homo sapiens
ggucucagcuuuaccaaaa

SEQ ID NO: 1555800 - RNA, 19 nt, Homo sapiens
aaauaaagcacacacgauu

SEQ ID NO: 1555801 - RNA, 19 nt, Homo sapiens
caacacuuccauuccauuu

SEQ ID NO: 1555802 - RNA, 19 nt, Homo sapiens
ugaaaccugugcuuuggaa

SEQ ID NO: 1555803 - RNA, 19 nt, Homo sapiens
guuagauccuuucaauaug

SEQ ID NO: 1555804 - RNA, 19 nt, Homo sapiens
ccucaaaucucugaucauc

SEQ ID NO: 1555805 - RNA, 19 nt, Homo sapiens
cuauaauccuucucuauuc

SEQ ID NO: 1555806 - RNA, 19 nt, Homo sapiens
cagaauugucggccauuua

SEQ ID NO: 1555807 - RNA, 19 nt, Homo sapiens
cguuagauccuuucaauau

SEQ ID NO: 1555808 - RNA, 19 nt, Homo sapiens
gguccugccuaaauuccua

SEQ ID NO: 1555809 - RNA, 19 nt, Homo sapiens
ccuauaauccuucucuauu

SEQ ID NO: 1555810 - RNA, 19 nt, Homo sapiens
guuguugacuuucuccuau

SEQ ID NO: 1555811 - RNA, 19 nt, Homo sapiens
caccaucucugaguuguug

SEQ ID NO: 1555812 - RNA, 19 nt, Homo sapiens
cagcuuacacuccuguuaa

SEQ ID NO: 1555813 - RNA, 19 nt, Homo sapiens
cagagacacugcacagcuu

SEQ ID NO: 1555814 - RNA, 19 nt, Homo sapiens
gccuaaauuccuacaaaua

SEQ ID NO: 1555815 - RNA, 19 nt, Homo sapiens
aaauauccuuccucacuga

SEQ ID NO: 1555816 - RNA, 19 nt, Homo sapiens
ugacacaaauacuuuaggu

SEQ ID NO: 1555817 - RNA, 19 nt, Homo sapiens
gcauauuuauugcguuucu

SEQ ID NO: 1555818 - RNA, 19 nt, Homo sapiens
aaagcacacacgauuauaa

SEQ ID NO: 1555819 - RNA, 19 nt, Homo sapiens
aauaaagcacacacgauua

SEQ ID NO: 1555820 - RNA, 19 nt, Homo sapiens
acacuuccauuccauuugu

SEQ ID NO: 1555821 - RNA, 19 nt, Homo sapiens
gaguuuguguuuccuaagu

SEQ ID NO: 1555822 - RNA, 19 nt, Homo sapiens
ggcggacaauuuagacaaa

SEQ ID NO: 1555823 - RNA, 19 nt, Homo sapiens
acucaagucuguaaauauc

SEQ ID NO: 1555824 - RNA, 19 nt, Homo sapiens
caaggacucaggcuaauuc

SEQ ID NO: 1555825 - RNA, 19 nt, Homo sapiens
ggugauugcucuggugaga

SEQ ID NO: 1555826 - RNA, 19 nt, Homo sapiens
cgggauuucuuggcuauuu

SEQ ID NO: 1555827 - RNA, 19 nt, Homo sapiens
gacucaggcuaauuccuaa

SEQ ID NO: 1555828 - RNA, 19 nt, Homo sapiens
gaucaucuaaagaguauag

SEQ ID NO: 1555829 - RNA, 19 nt, Homo sapiens
ggagggaggugggaauacu

SEQ ID NO: 1555830 - RNA, 19 nt, Homo sapiens
aagacaggcggacaauuua

SEQ ID NO: 1555831 - RNA, 19 nt, Homo sapiens
uggcagcgaugaugcaugu

SEQ ID NO: 1555832 - RNA, 19 nt, Homo sapiens
gagccugucuucacaaagc

SEQ ID NO: 1555833 - RNA, 19 nt, Homo sapiens
ccaauuauucugauagcaa

SEQ ID NO: 1555834 - RNA, 19 nt, Homo sapiens
gcuaagugcagaggcauuu

SEQ ID NO: 1555835 - RNA, 19 nt, Homo sapiens
uuacuucuguguauguaug

SEQ ID NO: 1555836 - RNA, 19 nt, Homo sapiens
cugccuaaauuccuacaaa

SEQ ID NO: 1555837 - RNA, 19 nt, Homo sapiens
uaaagcacacacgauuaua

SEQ ID NO: 1555838 - RNA, 19 nt, Homo sapiens
caggcuaauuccuaaguug

SEQ ID NO: 1555839 - RNA, 19 nt, Homo sapiens
ucugugcgcugucuuagau

SEQ ID NO: 1555840 - RNA, 19 nt, Homo sapiens
cccguuagauccuuucaau

SEQ ID NO: 1555841 - RNA, 19 nt, Homo sapiens
gaggacagacaaccaagug

SEQ ID NO: 1555842 - RNA, 19 nt, Homo sapiens
gcucuccucccacagaauu

SEQ ID NO: 1555843 - RNA, 19 nt, Homo sapiens
aagcacacacgauuauaaa

SEQ ID NO: 1555844 - RNA, 19 nt, Homo sapiens
uuuauugcguuucuaguug

SEQ ID NO: 1555845 - RNA, 19 nt, Homo sapiens
ucguguaacuggugcuauu

SEQ ID NO: 1555846 - RNA, 19 nt, Homo sapiens
ucacugaaaccugugcuuu

SEQ ID NO: 1555847 - RNA, 19 nt, Homo sapiens
ggacaauuuagacaaagau

SEQ ID NO: 1555848 - RNA, 19 nt, Homo sapiens
uuccuaaguugaucacauu

SEQ ID NO: 1555849 - RNA, 19 nt, Homo sapiens
gcuaauuccuaaguugauc

SEQ ID NO: 1555850 - RNA, 19 nt, Homo sapiens
ggacuugcuggugaaauga

SEQ ID NO: 1555851 - RNA, 19 nt, Homo sapiens
uggacuugcuggugaaaug

SEQ ID NO: 1555852 - RNA, 19 nt, Homo sapiens
agaauugucggccauuuau

SEQ ID NO: 1555853 - RNA, 19 nt, Homo sapiens
cacacacacucaagucugu

SEQ ID NO: 1555854 - RNA, 19 nt, Homo sapiens
gccaaggacucaggcuaau

SEQ ID NO: 1555855 - RNA, 19 nt, Homo sapiens
ugucugugcauauuuauug

SEQ ID NO: 1555856 - RNA, 19 nt, Homo sapiens
cagugugucugugcauauu

SEQ ID NO: 1555857 - RNA, 19 nt, Homo sapiens
acagaauugucggccauuu

SEQ ID NO: 1555858 - RNA, 19 nt, Homo sapiens
ccuugaagcauguggagua

SEQ ID NO: 1555859 - RNA, 19 nt, Homo sapiens
aauugucggccauuuauuu

SEQ ID NO: 1555860 - RNA, 19 nt, Homo sapiens
uguugacuuucuccuauaa

SEQ ID NO: 1555861 - RNA, 19 nt, Homo sapiens
gaauugucggccauuuauu

SEQ ID NO: 1555862 - RNA, 19 nt, Homo sapiens
ggcucugucugcuuaaaga

SEQ ID NO: 1555863 - RNA, 19 nt, Homo sapiens
gcacacacgauuauaaaau

SEQ ID NO: 1555864 - RNA, 19 nt, Homo sapiens
guaucucccuagcaacuca

SEQ ID NO: 1555865 - RNA, 19 nt, Homo sapiens
cggacaauuuagacaaaga

SEQ ID NO: 1555866 - RNA, 19 nt, Homo sapiens
gacaggcggacaauuuaga

SEQ ID NO: 1555867 - RNA, 19 nt, Homo sapiens
uuguacagcugugcaguuu

SEQ ID NO: 1555868 - RNA, 19 nt, Homo sapiens
aaacacacacacacacuca

SEQ ID NO: 1555869 - RNA, 19 nt, Homo sapiens
ucucuucuuuccugucuug

SEQ ID NO: 1555870 - RNA, 19 nt, Homo sapiens
ccauucauaagcuuucuuu

SEQ ID NO: 1555871 - RNA, 19 nt, Homo sapiens
gaagccaugccaucaccuu

SEQ ID NO: 1555872 - RNA, 19 nt, Homo sapiens
gcaaugucaccuucacaca

SEQ ID NO: 1555873 - RNA, 19 nt, Homo sapiens
ggaaacacacacacacacu

SEQ ID NO: 1555874 - RNA, 19 nt, Homo sapiens
ccaggaacaugcagaaaga

SEQ ID NO: 1555875 - RNA, 19 nt, Homo sapiens
gaacaugcagaaagagaaa

SEQ ID NO: 1555876 - RNA, 19 nt, Homo sapiens
gcuagaagcugcccuugca

SEQ ID NO: 1555877 - RNA, 19 nt, Homo sapiens
uuucgaggauguucugaua

SEQ ID NO: 1555878 - RNA, 19 nt, Homo sapiens
ggaacaugcagaaagagaa

SEQ ID NO: 1555879 - RNA, 19 nt, Homo sapiens
caucucaguucagcagaaa

SEQ ID NO: 1555880 - RNA, 19 nt, Homo sapiens
gcucaggucugggccacuu

SEQ ID NO: 1555881 - RNA, 19 nt, Homo sapiens
caggaaggcucugacaaca

SEQ ID NO: 1555882 - RNA, 19 nt, Homo sapiens
gcaggaaggcucugacaac

SEQ ID NO: 1555883 - RNA, 19 nt, Homo sapiens
gcugggcucuuucgaggau

SEQ ID NO: 1555884 - RNA, 19 nt, Homo sapiens
gcagaaagagaaagucaac

SEQ ID NO: 1555885 - RNA, 19 nt, Homo sapiens
auacacggcugcgggauga

SEQ ID NO: 1555886 - RNA, 19 nt, Homo sapiens
ugacugaagacaugaagga

SEQ ID NO: 1555887 - RNA, 19 nt, Homo sapiens
ucacggaccaugagcuaga

SEQ ID NO: 1555888 - RNA, 19 nt, Homo sapiens
ggaagaggaggagcgauuc

SEQ ID NO: 1555889 - RNA, 19 nt, Homo sapiens
agagaaagucaaccugcua

SEQ ID NO: 1555890 - RNA, 19 nt, Homo sapiens
ggucugggccacuuucauc

SEQ ID NO: 1555891 - RNA, 19 nt, Homo sapiens
ccaucucaguucagcagaa

SEQ ID NO: 1555892 - RNA, 19 nt, Homo sapiens
ucgccugacugaagacaug

SEQ ID NO: 1555893 - RNA, 19 nt, Homo sapiens
cuuccacccuccaguuaga

SEQ ID NO: 1555894 - RNA, 19 nt, Homo sapiens
caccucccauccacagaga

SEQ ID NO: 1555895 - RNA, 19 nt, Homo sapiens
aggaagaggaggagcgauu

SEQ ID NO: 1555896 - RNA, 19 nt, Homo sapiens
uggaugaggaggaggaaga

SEQ ID NO: 1555897 - RNA, 19 nt, Homo sapiens
gaacagaggccucaucuca

SEQ ID NO: 1555898 - RNA, 19 nt, Homo sapiens
guucugagaucccaguuua

SEQ ID NO: 1555899 - RNA, 19 nt, Homo sapiens
gaggagaggucagggcuaa

SEQ ID NO: 1555900 - RNA, 19 nt, Homo sapiens
ggacagagcccuucagaac

SEQ ID NO: 1555901 - RNA, 19 nt, Homo sapiens
agacagaacugccuucaag

SEQ ID NO: 1555902 - RNA, 19 nt, Homo sapiens
ccuagcaauuuccaucuua

SEQ ID NO: 1555903 - RNA, 19 nt, Homo sapiens
aaagucagguguucagcua

SEQ ID NO: 1555904 - RNA, 19 nt, Homo sapiens
ccacagugcucucuucagu

SEQ ID NO: 1555905 - RNA, 19 nt, Homo sapiens
agaacugccuucaagauga

SEQ ID NO: 1555906 - RNA, 19 nt, Homo sapiens
uagaagcaguucgguuaua

SEQ ID NO: 1555907 - RNA, 19 nt, Homo sapiens
uacaguagcuuucccuuca

SEQ ID NO: 1555908 - RNA, 19 nt, Homo sapiens
ucuagaagcaguucgguua

SEQ ID NO: 1555909 - RNA, 19 nt, Homo sapiens
gaacugccuucaagaugag

SEQ ID NO: 1555910 - RNA, 19 nt, Homo sapiens
ggaauaauuacacccaaau

SEQ ID NO: 1555911 - RNA, 19 nt, Homo sapiens
acagugcucucuucaguuc

SEQ ID NO: 1555912 - RNA, 19 nt, Homo sapiens
ucacuugauucuauugugu

SEQ ID NO: 1555913 - RNA, 19 nt, Homo sapiens
ccuagugacuggccauaga

SEQ ID NO: 1555914 - RNA, 19 nt, Homo sapiens
guacuacgcccuguauuuc

SEQ ID NO: 1555915 - RNA, 19 nt, Homo sapiens
ccaaugguccuaauuugug

SEQ ID NO: 1555916 - RNA, 19 nt, Homo sapiens
caaaugcuguuuuaucuca

SEQ ID NO: 1555917 - RNA, 19 nt, Homo sapiens
ucccuucacuugauucuau

SEQ ID NO: 1555918 - RNA, 19 nt, Homo sapiens
acggagugcuaaacaaauu

SEQ ID NO: 1555919 - RNA, 19 nt, Homo sapiens
uaauuuguguucugagauc

SEQ ID NO: 1555920 - RNA, 19 nt, Homo sapiens
ccuaauuuguguucugaga

SEQ ID NO: 1555921 - RNA, 19 nt, Homo sapiens
uggaauaauuacacccaaa

SEQ ID NO: 1555922 - RNA, 19 nt, Homo sapiens
acuaucaguucuccuuaaa

SEQ ID NO: 1555923 - RNA, 19 nt, Homo sapiens
caaugguccuaauuugugu

SEQ ID NO: 1555924 - RNA, 19 nt, Homo sapiens
gaggacagagcccuucaga

SEQ ID NO: 1555925 - RNA, 19 nt, Homo sapiens
caaauucuagcucuguguu

SEQ ID NO: 1555926 - RNA, 19 nt, Homo sapiens
ccaccuguguuuccaaguc

SEQ ID NO: 1555927 - RNA, 19 nt, Homo sapiens
uacuaucaguucuccuuaa

SEQ ID NO: 1555928 - RNA, 19 nt, Homo sapiens
gaagggcacuuuuccuagu

SEQ ID NO: 1555929 - RNA, 19 nt, Homo sapiens
cgaucuugcucugcuguuu

SEQ ID NO: 1555930 - RNA, 19 nt, Homo sapiens
acagagcccuucagaacag

SEQ ID NO: 1555931 - RNA, 19 nt, Homo sapiens
aaacaaauucuagcucugu

SEQ ID NO: 1555932 - RNA, 19 nt, Homo sapiens
guccuaauuuguguucuga

SEQ ID NO: 1555933 - RNA, 19 nt, Homo sapiens
gguccuaauuuguguucug

SEQ ID NO: 1555934 - RNA, 19 nt, Homo sapiens
cagaacugccuucaagaug

SEQ ID NO: 1555935 - RNA, 19 nt, Homo sapiens
agcaauaaaugcaaacaag

SEQ ID NO: 1555936 - RNA, 19 nt, Homo sapiens
gguaggccuugugcucuga

SEQ ID NO: 1555937 - RNA, 19 nt, Homo sapiens
acagaggccucaucucacu

SEQ ID NO: 1555938 - RNA, 19 nt, Homo sapiens
gacagagcccuucagaaca

SEQ ID NO: 1555939 - RNA, 19 nt, Homo sapiens
ccagauuuacuaucaguuc

SEQ ID NO: 1555940 - RNA, 19 nt, Homo sapiens
guuccuaaagcaauaaaug

SEQ ID NO: 1555941 - RNA, 19 nt, Homo sapiens
ccuccucucugcccacuuc

SEQ ID NO: 1555942 - RNA, 19 nt, Homo sapiens
guagcuuucccuucacuug

SEQ ID NO: 1555943 - RNA, 19 nt, Homo sapiens
gccuagcaauuuccaucuu

SEQ ID NO: 1555944 - RNA, 19 nt, Homo sapiens
cuggguuccuaaagcaaua

SEQ ID NO: 1555945 - RNA, 19 nt, Homo sapiens
gcuacggacacccgggaua

SEQ ID NO: 1555946 - RNA, 19 nt, Homo sapiens
ggcaggcccuaguguugug

SEQ ID NO: 1555947 - RNA, 19 nt, Homo sapiens
agaagcaguucgguuauac

SEQ ID NO: 1555948 - RNA, 19 nt, Homo sapiens
auucccagauuuacuauca

SEQ ID NO: 1555949 - RNA, 19 nt, Homo sapiens
uuacuaucaguucuccuua

SEQ ID NO: 1555950 - RNA, 19 nt, Homo sapiens
uuuaucagcuuuugccuuu

SEQ ID NO: 1555951 - RNA, 19 nt, Homo sapiens
caucuuagccacacuucuc

SEQ ID NO: 1555952 - RNA, 19 nt, Homo sapiens
gacagaacugccuucaaga

SEQ ID NO: 1555953 - RNA, 19 nt, Homo sapiens
gaucuugcucugcuguuuc

SEQ ID NO: 1555954 - RNA, 19 nt, Homo sapiens
gcuuucccuucacuugauu

SEQ ID NO: 1555955 - RNA, 19 nt, Homo sapiens
cagauuuacuaucaguucu

SEQ ID NO: 1555956 - RNA, 19 nt, Homo sapiens
ggacaggaagggcacuuuu

SEQ ID NO: 1555957 - RNA, 19 nt, Homo sapiens
cccauucccagauuuacua

SEQ ID NO: 1555958 - RNA, 19 nt, Homo sapiens
cuagcaauuuccaucuuag

SEQ ID NO: 1555959 - RNA, 19 nt, Homo sapiens
ggacucuggguuccuaaag

SEQ ID NO: 1555960 - RNA, 19 nt, Homo sapiens
ucgccacgcuccugaugau

SEQ ID NO: 1555961 - RNA, 19 nt, Homo sapiens
uagcuuucccuucacuuga

SEQ ID NO: 1555962 - RNA, 19 nt, Homo sapiens
ugagaucccaguuuacucu

SEQ ID NO: 1555963 - RNA, 19 nt, Homo sapiens
acagaacugccuucaagau

SEQ ID NO: 1555964 - RNA, 19 nt, Homo sapiens
guagggaccagacagaacu

SEQ ID NO: 1555965 - RNA, 19 nt, Homo sapiens
guauaaaagucagguguuc

SEQ ID NO: 1555966 - RNA, 19 nt, Homo sapiens
ccuccacagugcucucuuc

SEQ ID NO: 1555967 - RNA, 19 nt, Homo sapiens
ggagccagggcagaacaaa

SEQ ID NO: 1555968 - RNA, 19 nt, Homo sapiens
ggagaggucagggcuaagg

SEQ ID NO: 1555969 - RNA, 19 nt, Homo sapiens
ccuaaagcaauaaaugcaa

SEQ ID NO: 1555970 - RNA, 19 nt, Homo sapiens
cagaacagaggccucaucu

SEQ ID NO: 1555971 - RNA, 19 nt, Homo sapiens
guguaugccucccugaaaa

SEQ ID NO: 1555972 - RNA, 19 nt, Homo sapiens
uaucagcuuuugccuuuug

SEQ ID NO: 1555973 - RNA, 19 nt, Homo sapiens
gaugaucacguauaaaagu

SEQ ID NO: 1555974 - RNA, 19 nt, Homo sapiens
ucaguggggucuggcuuua

SEQ ID NO: 1555975 - RNA, 19 nt, Homo sapiens
gaacuuagguggaccauua

SEQ ID NO: 1555976 - RNA, 19 nt, Homo sapiens
gcacaaacuucacuacuua

SEQ ID NO: 1555977 - RNA, 19 nt, Homo sapiens
gaaagaugcuccuccaguu

SEQ ID NO: 1555978 - RNA, 19 nt, Homo sapiens
gaacucagcagcuaccaua

SEQ ID NO: 1555979 - RNA, 19 nt, Homo sapiens
caagagaaauuaacccuau

SEQ ID NO: 1555980 - RNA, 19 nt, Homo sapiens
guaauuuccugccuccuua

SEQ ID NO: 1555981 - RNA, 19 nt, Homo sapiens
gagagaauauagucagaaa

SEQ ID NO: 1555982 - RNA, 19 nt, Homo sapiens
gcagauauuuggcuugaga

SEQ ID NO: 1555983 - RNA, 19 nt, Homo sapiens
gaagggaaguaccgagaug

SEQ ID NO: 1555984 - RNA, 19 nt, Homo sapiens
aaacaugcaugaaggagaa

SEQ ID NO: 1555985 - RNA, 19 nt, Homo sapiens
ccacaucgccucuuuagga

SEQ ID NO: 1555986 - RNA, 19 nt, Homo sapiens
gaacuacgaacgagugaga

SEQ ID NO: 1555987 - RNA, 19 nt, Homo sapiens
gaacgagugagagaauaua

SEQ ID NO: 1555988 - RNA, 19 nt, Homo sapiens
gagaugcugugaguaggua

SEQ ID NO: 1555989 - RNA, 19 nt, Homo sapiens
ccgcaacaauuccugagua

SEQ ID NO: 1555990 - RNA, 19 nt, Homo sapiens
gagaauauagucagaaagu

SEQ ID NO: 1555991 - RNA, 19 nt, Homo sapiens
gaaccgugggcgacaguua

SEQ ID NO: 1555992 - RNA, 19 nt, Homo sapiens
guaccgagaugcugugagu

SEQ ID NO: 1555993 - RNA, 19 nt, Homo sapiens
gcaugaaggagaaaucuga

SEQ ID NO: 1555994 - RNA, 19 nt, Homo sapiens
ccacaucccuuuccuuacu

SEQ ID NO: 1555995 - RNA, 19 nt, Homo sapiens
aaacuucacuacuuagaca

SEQ ID NO: 1555996 - RNA, 19 nt, Homo sapiens
gaacgacagccugauaaug

SEQ ID NO: 1555997 - RNA, 19 nt, Homo sapiens
gaaaacauauugcauacca

SEQ ID NO: 1555998 - RNA, 19 nt, Homo sapiens
ccucacgccugaacaagaa

SEQ ID NO: 1555999 - RNA, 19 nt, Homo sapiens
gggcgacaguuauggagaa

SEQ ID NO: 1556000 - RNA, 19 nt, Homo sapiens
gcaggaggcucagcuguac

SEQ ID NO: 1556001 - RNA, 19 nt, Homo sapiens
cagacagacugcuauaaca

SEQ ID NO: 1556002 - RNA, 19 nt, Homo sapiens
cuacuugccugcacuucuu

SEQ ID NO: 1556003 - RNA, 19 nt, Homo sapiens
ccaggaagaaggguaauuu

SEQ ID NO: 1556004 - RNA, 19 nt, Homo sapiens
agacugcuauaacaaucua

SEQ ID NO: 1556005 - RNA, 19 nt, Homo sapiens
agucagaacucagcagcua

SEQ ID NO: 1556006 - RNA, 19 nt, Homo sapiens
agauggagcccgugaacua

SEQ ID NO: 1556007 - RNA, 19 nt, Homo sapiens
aggcucagcuguacaagga

SEQ ID NO: 1556008 - RNA, 19 nt, Homo sapiens
gggccuugcuugaguucuu

SEQ ID NO: 1556009 - RNA, 19 nt, Homo sapiens
guagggccuugcuugaguu

SEQ ID NO: 1556010 - RNA, 19 nt, Homo sapiens
ggaacgacagccugauaau

SEQ ID NO: 1556011 - RNA, 19 nt, Homo sapiens
gugagagaauauagucaga

SEQ ID NO: 1556012 - RNA, 19 nt, Homo sapiens
uuuccugccuccuuaaauu

SEQ ID NO: 1556013 - RNA, 19 nt, Homo sapiens
ucccacaucccuuuccuua

SEQ ID NO: 1556014 - RNA, 19 nt, Homo sapiens
cacaucgccucuuuaggaa

SEQ ID NO: 1556015 - RNA, 19 nt, Homo sapiens
ugcacaaacuucacuacuu

SEQ ID NO: 1556016 - RNA, 19 nt, Homo sapiens
caucgccucuuuaggaagu

SEQ ID NO: 1556017 - RNA, 19 nt, Homo sapiens
gagucugcccucuccguua

SEQ ID NO: 1556018 - RNA, 19 nt, Homo sapiens
cuauccaucuguuuauuuc

SEQ ID NO: 1556019 - RNA, 19 nt, Homo sapiens
ccuccuggcugccgugaau

SEQ ID NO: 1556020 - RNA, 19 nt, Homo sapiens
cucagcagcuaccauagaa

SEQ ID NO: 1556021 - RNA, 19 nt, Homo sapiens
gacagacugcuauaacaau

SEQ ID NO: 1556022 - RNA, 19 nt, Homo sapiens
gguaauuuccugccuccuu

SEQ ID NO: 1556023 - RNA, 19 nt, Homo sapiens
gaccauuaaacaugcauga

SEQ ID NO: 1556024 - RNA, 19 nt, Homo sapiens
uugcagauauuuggcuuga

SEQ ID NO: 1556025 - RNA, 19 nt, Homo sapiens
gguuaacaaagaagaaaga

SEQ ID NO: 1556026 - RNA, 19 nt, Homo sapiens
cgaacgagugagagaauau

SEQ ID NO: 1556027 - RNA, 19 nt, Homo sapiens
agacagacugcuauaacaa

SEQ ID NO: 1556028 - RNA, 19 nt, Homo sapiens
ggaagggaaguaccgagau

SEQ ID NO: 1556029 - RNA, 19 nt, Homo sapiens
aaagaugcuccuccaguug

SEQ ID NO: 1556030 - RNA, 19 nt, Homo sapiens
ucccuuuccuuacuacuug

SEQ ID NO: 1556031 - RNA, 19 nt, Homo sapiens
acagacugcuauaacaauc

SEQ ID NO: 1556032 - RNA, 19 nt, Homo sapiens
cacaucccuuuccuuacua

SEQ ID NO: 1556033 - RNA, 19 nt, Homo sapiens
acgaacgagugagagaaua

SEQ ID NO: 1556034 - RNA, 19 nt, Homo sapiens
ugaguagggccuugcuuga

SEQ ID NO: 1556035 - RNA, 19 nt, Homo sapiens
ccucagcaagagaaauuaa

SEQ ID NO: 1556036 - RNA, 19 nt, Homo sapiens
auguugggcuucauuauuc

SEQ ID NO: 1556037 - RNA, 19 nt, Homo sapiens
cugcuugucuccuucagau

SEQ ID NO: 1556038 - RNA, 19 nt, Homo sapiens
ccagacagacugcuauaac

SEQ ID NO: 1556039 - RNA, 19 nt, Homo sapiens
ccauuaaacaugcaugaag

SEQ ID NO: 1556040 - RNA, 19 nt, Homo sapiens
gcucuaccugggcauguuu

SEQ ID NO: 1556041 - RNA, 19 nt, Homo sapiens
uuaaauuggcugcuacugu

SEQ ID NO: 1556042 - RNA, 19 nt, Homo sapiens
aagaugcuccuccaguuga

SEQ ID NO: 1556043 - RNA, 19 nt, Homo sapiens
uggaacgacagccugauaa

SEQ ID NO: 1556044 - RNA, 19 nt, Homo sapiens
cgagugagagaauauaguc

SEQ ID NO: 1556045 - RNA, 19 nt, Homo sapiens
cuauaccuuucaauacaug

SEQ ID NO: 1556046 - RNA, 19 nt, Homo sapiens
cuccuucacuucccaguuc

SEQ ID NO: 1556047 - RNA, 19 nt, Homo sapiens
cauguuauuguugcagaua

SEQ ID NO: 1556048 - RNA, 19 nt, Homo sapiens
uuagguggaccauuaaaca

SEQ ID NO: 1556049 - RNA, 19 nt, Homo sapiens
ccacccagacagacugcua

SEQ ID NO: 1556050 - RNA, 19 nt, Homo sapiens
cgcaacaauuccugaguag

SEQ ID NO: 1556051 - RNA, 19 nt, Homo sapiens
guuucuaguucugcacaaa

SEQ ID NO: 1556052 - RNA, 19 nt, Homo sapiens
aguagggccuugcuugagu

SEQ ID NO: 1556053 - RNA, 19 nt, Homo sapiens
gucuauccaucuguuuauu

SEQ ID NO: 1556054 - RNA, 19 nt, Homo sapiens
ucuagcugcuugucuccuu

SEQ ID NO: 1556055 - RNA, 19 nt, Homo sapiens
acaaacuucacuacuuaga

SEQ ID NO: 1556056 - RNA, 19 nt, Homo sapiens
uaccugggcauguuugguu

SEQ ID NO: 1556057 - RNA, 19 nt, Homo sapiens
cuggaacgacagccugaua

SEQ ID NO: 1556058 - RNA, 19 nt, Homo sapiens
caggaagaaggguaauuuc

SEQ ID NO: 1556059 - RNA, 19 nt, Homo sapiens
ucacuugcuccuucacuuc

SEQ ID NO: 1556060 - RNA, 19 nt, Homo sapiens
ggcuugagaaauauaauca

SEQ ID NO: 1556061 - RNA, 19 nt, Homo sapiens
cuccuuaaauuggcugcua

SEQ ID NO: 1556062 - RNA, 19 nt, Homo sapiens
ucagaaaguccuggaacga

SEQ ID NO: 1556063 - RNA, 19 nt, Homo sapiens
gcugggaggucuaauauau

SEQ ID NO: 1556064 - RNA, 19 nt, Homo sapiens
gcacuuugcauucauuauu

SEQ ID NO: 1556065 - RNA, 19 nt, Homo sapiens
gcaggguucuccaccauga

SEQ ID NO: 1556066 - RNA, 19 nt, Homo sapiens
gcucccaccuuccuuguuu

SEQ ID NO: 1556067 - RNA, 19 nt, Homo sapiens
gaagaucauaugcaaauug

SEQ ID NO: 1556068 - RNA, 19 nt, Homo sapiens
ccacauggcacuaugguaa

SEQ ID NO: 1556069 - RNA, 19 nt, Homo sapiens
gaagaauggcagacuauug

SEQ ID NO: 1556070 - RNA, 19 nt, Homo sapiens
ccacauucuuugccuguaa

SEQ ID NO: 1556071 - RNA, 19 nt, Homo sapiens
gcuauuauguuccuacagu

SEQ ID NO: 1556072 - RNA, 19 nt, Homo sapiens
gacggaagaucauaugcaa

SEQ ID NO: 1556073 - RNA, 19 nt, Homo sapiens
ucuaauaucccauuucuga

SEQ ID NO: 1556074 - RNA, 19 nt, Homo sapiens
gaucaccuguucagucuca

SEQ ID NO: 1556075 - RNA, 19 nt, Homo sapiens
gaucauaugcaaauugugu

SEQ ID NO: 1556076 - RNA, 19 nt, Homo sapiens
ugagaagaauggcagacua

SEQ ID NO: 1556077 - RNA, 19 nt, Homo sapiens
ggaagaucauaugcaaauu

SEQ ID NO: 1556078 - RNA, 19 nt, Homo sapiens
uaugaacaaucuccacauu

SEQ ID NO: 1556079 - RNA, 19 nt, Homo sapiens
gcacuaugguaacuuugug

SEQ ID NO: 1556080 - RNA, 19 nt, Homo sapiens
ugaacaaucuccacauucu

SEQ ID NO: 1556081 - RNA, 19 nt, Homo sapiens
agauuugucugauagcuuu

SEQ ID NO: 1556082 - RNA, 19 nt, Homo sapiens
uuaagaagauucaguuguc

SEQ ID NO: 1556083 - RNA, 19 nt, Homo sapiens
caggaucuuucacagagua

SEQ ID NO: 1556084 - RNA, 19 nt, Homo sapiens
uggcacauauugcaacuga

SEQ ID NO: 1556085 - RNA, 19 nt, Homo sapiens
ucuaauauauggccaucuu

SEQ ID NO: 1556086 - RNA, 19 nt, Homo sapiens
ucaggaaacucagagauca

SEQ ID NO: 1556087 - RNA, 19 nt, Homo sapiens
gggaucaccuguucagucu

SEQ ID NO: 1556088 - RNA, 19 nt, Homo sapiens
gagaagaauggcagacuau

SEQ ID NO: 1556089 - RNA, 19 nt, Homo sapiens
gugcagggcccaccaagaa

SEQ ID NO: 1556090 - RNA, 19 nt, Homo sapiens
ggaaacacuuuuauucuca

SEQ ID NO: 1556091 - RNA, 19 nt, Homo sapiens
cuauugaacagguguauuu

SEQ ID NO: 1556092 - RNA, 19 nt, Homo sapiens
ggacugcauccaccugaaa

SEQ ID NO: 1556093 - RNA, 19 nt, Homo sapiens
ugacuuaucaggaaacuca

SEQ ID NO: 1556094 - RNA, 19 nt, Homo sapiens
aagaauggcagacuauuga

SEQ ID NO: 1556095 - RNA, 19 nt, Homo sapiens
cuauuuggcugccuaaagu

SEQ ID NO: 1556096 - RNA, 19 nt, Homo sapiens
gaacaaucuccacauucuu

SEQ ID NO: 1556097 - RNA, 19 nt, Homo sapiens
uuauaucugugacuucuga

SEQ ID NO: 1556098 - RNA, 19 nt, Homo sapiens
cauuguaacugagauugaa

SEQ ID NO: 1556099 - RNA, 19 nt, Homo sapiens
cuacuguucccuaauauug

SEQ ID NO: 1556100 - RNA, 19 nt, Homo sapiens
gccaugauguccauaguac

SEQ ID NO: 1556101 - RNA, 19 nt, Homo sapiens
gcaacugacugugucuaca

SEQ ID NO: 1556102 - RNA, 19 nt, Homo sapiens
agugggaccugguauguga

SEQ ID NO: 1556103 - RNA, 19 nt, Homo sapiens
cuaauauuguguuggagaa

SEQ ID NO: 1556104 - RNA, 19 nt, Homo sapiens
gaacagguguauuuuaggu

SEQ ID NO: 1556105 - RNA, 19 nt, Homo sapiens
uaagaagauucaguuguca

SEQ ID NO: 1556106 - RNA, 19 nt, Homo sapiens
cggaagaucauaugcaaau

SEQ ID NO: 1556107 - RNA, 19 nt, Homo sapiens
agaagcaaacaauggaaua

SEQ ID NO: 1556108 - RNA, 19 nt, Homo sapiens
cacgaucuaugacaauaau

SEQ ID NO: 1556109 - RNA, 19 nt, Homo sapiens
uaauaucccauuucugaga

SEQ ID NO: 1556110 - RNA, 19 nt, Homo sapiens
gcaaacaauggaauaggau

SEQ ID NO: 1556111 - RNA, 19 nt, Homo sapiens
gaagcaaacaauggaauag

SEQ ID NO: 1556112 - RNA, 19 nt, Homo sapiens
ccuauugugucaccugaga

SEQ ID NO: 1556113 - RNA, 19 nt, Homo sapiens
auucaggacuggcacauau

SEQ ID NO: 1556114 - RNA, 19 nt, Homo sapiens
ccaccuuccuuguuuacug

SEQ ID NO: 1556115 - RNA, 19 nt, Homo sapiens
ggacggaagaucauaugca

SEQ ID NO: 1556116 - RNA, 19 nt, Homo sapiens
augguucaaucccuauuua

SEQ ID NO: 1556117 - RNA, 19 nt, Homo sapiens
caagaagaaagcaguguca

SEQ ID NO: 1556118 - RNA, 19 nt, Homo sapiens
gcagggcccaccaagaaga

SEQ ID NO: 1556119 - RNA, 19 nt, Homo sapiens
gagaagcaaacaauggaau

SEQ ID NO: 1556120 - RNA, 19 nt, Homo sapiens
gagccaugauguccauagu

SEQ ID NO: 1556121 - RNA, 19 nt, Homo sapiens
gcacauauugcaacugacu

SEQ ID NO: 1556122 - RNA, 19 nt, Homo sapiens
gaugaccuccugagaaucu

SEQ ID NO: 1556123 - RNA, 19 nt, Homo sapiens
cauaauuguccucuucuug

SEQ ID NO: 1556124 - RNA, 19 nt, Homo sapiens
ggacuggcacauauugcaa

SEQ ID NO: 1556125 - RNA, 19 nt, Homo sapiens
acagaagugucagcgcuuu

SEQ ID NO: 1556126 - RNA, 19 nt, Homo sapiens
aaacaauggaauaggauga

SEQ ID NO: 1556127 - RNA, 19 nt, Homo sapiens
aacaaucuccacauucuuu

SEQ ID NO: 1556128 - RNA, 19 nt, Homo sapiens
uggagaacuucacugcauu

SEQ ID NO: 1556129 - RNA, 19 nt, Homo sapiens
gaaacucagagaucaggau

SEQ ID NO: 1556130 - RNA, 19 nt, Homo sapiens
gaaaauccaccguugacuu

SEQ ID NO: 1556131 - RNA, 19 nt, Homo sapiens
gcgaggcuaugguagacau

SEQ ID NO: 1556132 - RNA, 19 nt, Homo sapiens
uaagcgaggcuaugguaga

SEQ ID NO: 1556133 - RNA, 19 nt, Homo sapiens
aaaauccaccguugacuua

SEQ ID NO: 1556134 - RNA, 19 nt, Homo sapiens
guucaaucccuauuuaugg

SEQ ID NO: 1556135 - RNA, 19 nt, Homo sapiens
ccaucccacuggacucaaa

SEQ ID NO: 1556136 - RNA, 19 nt, Homo sapiens
ggagaacuucacugcauuc

SEQ ID NO: 1556137 - RNA, 19 nt, Homo sapiens
auccuacuguucccuaaua

SEQ ID NO: 1556138 - RNA, 19 nt, Homo sapiens
ggagauuccagauuugucu

SEQ ID NO: 1556139 - RNA, 19 nt, Homo sapiens
ggauccacauggcacuaug

SEQ ID NO: 1556140 - RNA, 19 nt, Homo sapiens
gaggcuggcacuuugcauu

SEQ ID NO: 1556141 - RNA, 19 nt, Homo sapiens
uguaagcgaggcuauggua

SEQ ID NO: 1556142 - RNA, 19 nt, Homo sapiens
ccauaauuguccucuucuu

SEQ ID NO: 1556143 - RNA, 19 nt, Homo sapiens
uaauauauggccaucuuuc

SEQ ID NO: 1556144 - RNA, 19 nt, Homo sapiens
ugggaggucuaauauaugg

SEQ ID NO: 1556145 - RNA, 19 nt, Homo sapiens
gguucaaucccuauuuaug

SEQ ID NO: 1556146 - RNA, 19 nt, Homo sapiens
gaaucucagucacuaaaau

SEQ ID NO: 1556147 - RNA, 19 nt, Homo sapiens
gcucuuuccucuccaccau

SEQ ID NO: 1556148 - RNA, 19 nt, Homo sapiens
ucacagaguagucuuuuaa

SEQ ID NO: 1556149 - RNA, 19 nt, Homo sapiens
cagcuuagaguggacauug

SEQ ID NO: 1556150 - RNA, 19 nt, Homo sapiens
gggacugcauccaccugaa

SEQ ID NO: 1556151 - RNA, 19 nt, Homo sapiens
ucccuaauauuguguugga

SEQ ID NO: 1556152 - RNA, 19 nt, Homo sapiens
agcaaacaauggaauagga

SEQ ID NO: 1556153 - RNA, 19 nt, Homo sapiens
uaauuguccucuucuuguc

SEQ ID NO: 1556154 - RNA, 19 nt, Homo sapiens
cagaagugucagcgcuuua

SEQ ID NO: 1556155 - RNA, 19 nt, Homo sapiens
ucacgaucuaugacaauaa

SEQ ID NO: 1556156 - RNA, 19 nt, Homo sapiens
uauauggccaucuuucaga

SEQ ID NO: 1556157 - RNA, 19 nt, Homo sapiens
ugguagacauagaaaggaa

SEQ ID NO: 1556158 - RNA, 19 nt, Homo sapiens
ugugacuucugaaacuauu

SEQ ID NO: 1556159 - RNA, 19 nt, Homo sapiens
acagcuagcagucucuuug

SEQ ID NO: 1556160 - RNA, 19 nt, Homo sapiens
acccauaauuguccucuuc

SEQ ID NO: 1556161 - RNA, 19 nt, Homo sapiens
ucaggacuggcacauauug

SEQ ID NO: 1556162 - RNA, 19 nt, Homo sapiens
gggaaacacuuuuauucuc

SEQ ID NO: 1556163 - RNA, 19 nt, Homo sapiens
ucccauagcuuucuaauua

SEQ ID NO: 1556164 - RNA, 19 nt, Homo sapiens
caacauggcugugucauuc

SEQ ID NO: 1556165 - RNA, 19 nt, Homo sapiens
gggaugagauuaugcuauu

SEQ ID NO: 1556166 - RNA, 19 nt, Homo sapiens
uagaauagguggucucuug

SEQ ID NO: 1556167 - RNA, 19 nt, Homo sapiens
acauacaggugaaacauua

SEQ ID NO: 1556168 - RNA, 19 nt, Homo sapiens
gaucuuccaucucaaguug

SEQ ID NO: 1556169 - RNA, 19 nt, Homo sapiens
ggacagaagggcuuugaaa

SEQ ID NO: 1556170 - RNA, 19 nt, Homo sapiens
gauuugaucuuccaucuca

SEQ ID NO: 1556171 - RNA, 19 nt, Homo sapiens
gaaauguucuauggaaguu

SEQ ID NO: 1556172 - RNA, 19 nt, Homo sapiens
gcaaugggaugagauuaug

SEQ ID NO: 1556173 - RNA, 19 nt, Homo sapiens
gcuagacccuugccuuuga

SEQ ID NO: 1556174 - RNA, 19 nt, Homo sapiens
gauaagggcauaaugaaga

SEQ ID NO: 1556175 - RNA, 19 nt, Homo sapiens
cauagugccuucucugaaa

SEQ ID NO: 1556176 - RNA, 19 nt, Homo sapiens
gaaagaagacaagauccua

SEQ ID NO: 1556177 - RNA, 19 nt, Homo sapiens
guaguaagaaugccuuuaa

SEQ ID NO: 1556178 - RNA, 19 nt, Homo sapiens
gauccuaauuccugucauu

SEQ ID NO: 1556179 - RNA, 19 nt, Homo sapiens
gaagacaagauccuaauuc

SEQ ID NO: 1556180 - RNA, 19 nt, Homo sapiens
ggauaaguauguauguaug

SEQ ID NO: 1556181 - RNA, 19 nt, Homo sapiens
gcugagucaugccuuauuu

SEQ ID NO: 1556182 - RNA, 19 nt, Homo sapiens
ugaguggcuuugaaacuua

SEQ ID NO: 1556183 - RNA, 19 nt, Homo sapiens
uaucuaagcucuuuaaagc

SEQ ID NO: 1556184 - RNA, 19 nt, Homo sapiens
caccacgccuggcuaauuu

SEQ ID NO: 1556185 - RNA, 19 nt, Homo sapiens
aaacagaucuagggacaga

SEQ ID NO: 1556186 - RNA, 19 nt, Homo sapiens
gagaaaguacaauucagua

SEQ ID NO: 1556187 - RNA, 19 nt, Homo sapiens
ggaugagauuaugcuauua

SEQ ID NO: 1556188 - RNA, 19 nt, Homo sapiens
uuaagaagcccauuguaaa

SEQ ID NO: 1556189 - RNA, 19 nt, Homo sapiens
aagacaagcuucaguuaug

SEQ ID NO: 1556190 - RNA, 19 nt, Homo sapiens
gaagugcaguggcgcaauc

SEQ ID NO: 1556191 - RNA, 19 nt, Homo sapiens
ugaaucaaguccaugcaaa

SEQ ID NO: 1556192 - RNA, 19 nt, Homo sapiens
gaacaagaaagaagacaag

SEQ ID NO: 1556193 - RNA, 19 nt, Homo sapiens
guucagaaguaguaagaau

SEQ ID NO: 1556194 - RNA, 19 nt, Homo sapiens
gggauugccucagguggua

SEQ ID NO: 1556195 - RNA, 19 nt, Homo sapiens
caagaaagaagacaagauc

SEQ ID NO: 1556196 - RNA, 19 nt, Homo sapiens
ucagauuccuagcuuugua

SEQ ID NO: 1556197 - RNA, 19 nt, Homo sapiens
ucagagucaugccuuguuu

SEQ ID NO: 1556198 - RNA, 19 nt, Homo sapiens
ccagcugagucaugccuua

SEQ ID NO: 1556199 - RNA, 19 nt, Homo sapiens
ggaguuaauacuaaucuug

SEQ ID NO: 1556200 - RNA, 19 nt, Homo sapiens
caccacacccggcuuauuu

SEQ ID NO: 1556201 - RNA, 19 nt, Homo sapiens
gagacggacucuuguacug

SEQ ID NO: 1556202 - RNA, 19 nt, Homo sapiens
gcugugucauucuggcuua

SEQ ID NO: 1556203 - RNA, 19 nt, Homo sapiens
ccaaagugcugggauuaca

SEQ ID NO: 1556204 - RNA, 19 nt, Homo sapiens
ggagaaaguacaauucagu

SEQ ID NO: 1556205 - RNA, 19 nt, Homo sapiens
ccaaggagaaaguacaauu

SEQ ID NO: 1556206 - RNA, 19 nt, Homo sapiens
gcaagggaagguagcauug

SEQ ID NO: 1556207 - RNA, 19 nt, Homo sapiens
agacaagcuucaguuauga

SEQ ID NO: 1556208 - RNA, 19 nt, Homo sapiens
gggauaagggcauaaugaa

SEQ ID NO: 1556209 - RNA, 19 nt, Homo sapiens
agacagggcuucgccaugu

SEQ ID NO: 1556210 - RNA, 19 nt, Homo sapiens
gaguggcuuugaaacuuaa

SEQ ID NO: 1556211 - RNA, 19 nt, Homo sapiens
gaauguacagguauccuau

SEQ ID NO: 1556212 - RNA, 19 nt, Homo sapiens
cauucuggcuuacauaugu

SEQ ID NO: 1556213 - RNA, 19 nt, Homo sapiens
gaguuuggauaaguaugua

SEQ ID NO: 1556214 - RNA, 19 nt, Homo sapiens
gauagggugaguuuggaua

SEQ ID NO: 1556215 - RNA, 19 nt, Homo sapiens
cuacuuggcuuguaaaaug

SEQ ID NO: 1556216 - RNA, 19 nt, Homo sapiens
uuaccuagcaggcuuguuu

SEQ ID NO: 1556217 - RNA, 19 nt, Homo sapiens
cuggaacuauugaaaugua

SEQ ID NO: 1556218 - RNA, 19 nt, Homo sapiens
gggugaguuuggauaagua

SEQ ID NO: 1556219 - RNA, 19 nt, Homo sapiens
ggagucaucacuuuuauaa

SEQ ID NO: 1556220 - RNA, 19 nt, Homo sapiens
guccuggagucaucacuuu

SEQ ID NO: 1556221 - RNA, 19 nt, Homo sapiens
ccaaaucuuucacauacag

SEQ ID NO: 1556222 - RNA, 19 nt, Homo sapiens
aggauuaucuaagcucuuu

SEQ ID NO: 1556223 - RNA, 19 nt, Homo sapiens
guacagguauccuauuuuc

SEQ ID NO: 1556224 - RNA, 19 nt, Homo sapiens
gagagacugcuucaucgaa

SEQ ID NO: 1556225 - RNA, 19 nt, Homo sapiens
ggguagugguucucaucua

SEQ ID NO: 1556226 - RNA, 19 nt, Homo sapiens
guguuucgcuuuauuccuu

SEQ ID NO: 1556227 - RNA, 19 nt, Homo sapiens
caaauuucgugugccagaa

SEQ ID NO: 1556228 - RNA, 19 nt, Homo sapiens
gaaguaccaaggagaaagu

SEQ ID NO: 1556229 - RNA, 19 nt, Homo sapiens
gagacugcuucaucgaaug

SEQ ID NO: 1556230 - RNA, 19 nt, Homo sapiens
uaaguccuguuguagcuau

SEQ ID NO: 1556231 - RNA, 19 nt, Homo sapiens
aaagaagacaagauccuaa

SEQ ID NO: 1556232 - RNA, 19 nt, Homo sapiens
cguaguauaccaagaaaug

SEQ ID NO: 1556233 - RNA, 19 nt, Homo sapiens
gaagcccauuguaaaauaa

SEQ ID NO: 1556234 - RNA, 19 nt, Homo sapiens
gcgcaaucuuggcucacua

SEQ ID NO: 1556235 - RNA, 19 nt, Homo sapiens
gguggucucuugccaguac

SEQ ID NO: 1556236 - RNA, 19 nt, Homo sapiens
caaggagaaaguacaauuc

SEQ ID NO: 1556237 - RNA, 19 nt, Homo sapiens
gaugagauuaugcuauuag

SEQ ID NO: 1556238 - RNA, 19 nt, Homo sapiens
ccaccacgccuggcuaauu

SEQ ID NO: 1556239 - RNA, 19 nt, Homo sapiens
aaucuuggcucacuacaac

SEQ ID NO: 1556240 - RNA, 19 nt, Homo sapiens
gugguugguuucauuagug

SEQ ID NO: 1556241 - RNA, 19 nt, Homo sapiens
agagagagacugcuucauc

SEQ ID NO: 1556242 - RNA, 19 nt, Homo sapiens
ccacagagagagacugcuu

SEQ ID NO: 1556243 - RNA, 19 nt, Homo sapiens
cuagcaggcuuguuuaaaa

SEQ ID NO: 1556244 - RNA, 19 nt, Homo sapiens
auuaagaagcccauuguaa

SEQ ID NO: 1556245 - RNA, 19 nt, Homo sapiens
gucaagggauaagggcaua

SEQ ID NO: 1556246 - RNA, 19 nt, Homo sapiens
ggaauaaagaucacaacac

SEQ ID NO: 1556247 - RNA, 19 nt, Homo sapiens
gaaugggaaguaccaagga

SEQ ID NO: 1556248 - RNA, 19 nt, Homo sapiens
guucagauuccuagcuuug

SEQ ID NO: 1556249 - RNA, 19 nt, Homo sapiens
agaagcccauuguaaaaua

SEQ ID NO: 1556250 - RNA, 19 nt, Homo sapiens
gacagggcuucgccauguu

SEQ ID NO: 1556251 - RNA, 19 nt, Homo sapiens
ccaaguagcagggauuaca

SEQ ID NO: 1556252 - RNA, 19 nt, Homo sapiens
gggaagguagcauugauuc

SEQ ID NO: 1556253 - RNA, 19 nt, Homo sapiens
gaaacauuaagccacaaau

SEQ ID NO: 1556254 - RNA, 19 nt, Homo sapiens
agagacugcuucaucgaau

SEQ ID NO: 1556255 - RNA, 19 nt, Homo sapiens
ggauaagggcauaaugaag

SEQ ID NO: 1556256 - RNA, 19 nt, Homo sapiens
ggugguugguuucauuagu

SEQ ID NO: 1556257 - RNA, 19 nt, Homo sapiens
acuggaaccuggccuuguu

SEQ ID NO: 1556258 - RNA, 19 nt, Homo sapiens
aaagugcaaugggaugaga

SEQ ID NO: 1556259 - RNA, 19 nt, Homo sapiens
auaaauagugguucagaga

SEQ ID NO: 1556260 - RNA, 19 nt, Homo sapiens
gacauuaagaagcccauug

SEQ ID NO: 1556261 - RNA, 19 nt, Homo sapiens
ugccucagccucccaagua

SEQ ID NO: 1556262 - RNA, 19 nt, Homo sapiens
caagggaagguagcauuga

SEQ ID NO: 1556263 - RNA, 19 nt, Homo sapiens
ccagaaacuuggagaaaug

SEQ ID NO: 1556264 - RNA, 19 nt, Homo sapiens
gaugaugagguccagauua

SEQ ID NO: 1556265 - RNA, 19 nt, Homo sapiens
ugacccaggugaagacuuu

SEQ ID NO: 1556266 - RNA, 19 nt, Homo sapiens
aagcauggcuacaacauug

SEQ ID NO: 1556267 - RNA, 19 nt, Homo sapiens
gaugcugccugacaaguug

SEQ ID NO: 1556268 - RNA, 19 nt, Homo sapiens
gaacuuaugcagacaugga

SEQ ID NO: 1556269 - RNA, 19 nt, Homo sapiens
ggacaaagaagacagugau

SEQ ID NO: 1556270 - RNA, 19 nt, Homo sapiens
gaauggcuguguccuaguc

SEQ ID NO: 1556271 - RNA, 19 nt, Homo sapiens
ggagaagcauggcuacaac

SEQ ID NO: 1556272 - RNA, 19 nt, Homo sapiens
gguaaugcccucagugaug

SEQ ID NO: 1556273 - RNA, 19 nt, Homo sapiens
gaagcauggcuacaacauu

SEQ ID NO: 1556274 - RNA, 19 nt, Homo sapiens
augcagacauggauuuauu

SEQ ID NO: 1556275 - RNA, 19 nt, Homo sapiens
ugaaauacuacuacucuug

SEQ ID NO: 1556276 - RNA, 19 nt, Homo sapiens
gcuguucucauuccucuuu

SEQ ID NO: 1556277 - RNA, 19 nt, Homo sapiens
gaccacagaugagcagcuu

SEQ ID NO: 1556278 - RNA, 19 nt, Homo sapiens
gcuccgaggucuugacucu

SEQ ID NO: 1556279 - RNA, 19 nt, Homo sapiens
cagccgaacuagugugaug

SEQ ID NO: 1556280 - RNA, 19 nt, Homo sapiens
ccacuucugcacaaacuuu

SEQ ID NO: 1556281 - RNA, 19 nt, Homo sapiens
aggacaaggugcuguuuga

SEQ ID NO: 1556282 - RNA, 19 nt, Homo sapiens
caaagaagacagugaugag

SEQ ID NO: 1556283 - RNA, 19 nt, Homo sapiens
gggaacuuaugcagacaug

SEQ ID NO: 1556284 - RNA, 19 nt, Homo sapiens
ugugcuggcuguucucauu

SEQ ID NO: 1556285 - RNA, 19 nt, Homo sapiens
ggugaaauacuacuacucu

SEQ ID NO: 1556286 - RNA, 19 nt, Homo sapiens
ggacaaggugcuguuugaa

SEQ ID NO: 1556287 - RNA, 19 nt, Homo sapiens
gaugagguccagauuacau

SEQ ID NO: 1556288 - RNA, 19 nt, Homo sapiens
gcaugaagcagacgaacag

SEQ ID NO: 1556289 - RNA, 19 nt, Homo sapiens
cugcagaucccaagagaga

SEQ ID NO: 1556290 - RNA, 19 nt, Homo sapiens
agacagugaugagcucgaa

SEQ ID NO: 1556291 - RNA, 19 nt, Homo sapiens
ggagggcgguauugaucca

SEQ ID NO: 1556292 - RNA, 19 nt, Homo sapiens
gugaaauacuacuacucuu

SEQ ID NO: 1556293 - RNA, 19 nt, Homo sapiens
agcagaggcuggaagagaa

SEQ ID NO: 1556294 - RNA, 19 nt, Homo sapiens
gggcgguauugauccacua

SEQ ID NO: 1556295 - RNA, 19 nt, Homo sapiens
acaaagaagacagugauga

SEQ ID NO: 1556296 - RNA, 19 nt, Homo sapiens
gcgcugggcaugcuucugu

SEQ ID NO: 1556297 - RNA, 19 nt, Homo sapiens
caagcccaccuuccagaaa

SEQ ID NO: 1556298 - RNA, 19 nt, Homo sapiens
agacuuucuuugugagcua

SEQ ID NO: 1556299 - RNA, 19 nt, Homo sapiens
acauugcgauggccaagga

SEQ ID NO: 1556300 - RNA, 19 nt, Homo sapiens
guagguauggcaaagacuu

SEQ ID NO: 1556301 - RNA, 19 nt, Homo sapiens
gaggacaaggugcuguuug

SEQ ID NO: 1556302 - RNA, 19 nt, Homo sapiens
ugucagaugccaagcuuga

SEQ ID NO: 1556303 - RNA, 19 nt, Homo sapiens
caaccacugugugucagau

SEQ ID NO: 1556304 - RNA, 19 nt, Homo sapiens
cagaggugauugggaacaa

SEQ ID NO: 1556305 - RNA, 19 nt, Homo sapiens
gaggugauugggaacaaga

SEQ ID NO: 1556306 - RNA, 19 nt, Homo sapiens
caagccauccguagguaug

SEQ ID NO: 1556307 - RNA, 19 nt, Homo sapiens
uccgaggucuugacucuca

SEQ ID NO: 1556308 - RNA, 19 nt, Homo sapiens
aggaggugcugcaggaaug

SEQ ID NO: 1556309 - RNA, 19 nt, Homo sapiens
ccaccaagcccaccuucca

SEQ ID NO: 1556310 - RNA, 19 nt, Homo sapiens
gguccugcccuuugugugu

SEQ ID NO: 1556311 - RNA, 19 nt, Homo sapiens
gaggaggugcugcaggaau

SEQ ID NO: 1556312 - RNA, 19 nt, Homo sapiens
cuagugugauggacagaca

SEQ ID NO: 1556313 - RNA, 19 nt, Homo sapiens
ggacaguagaggacaaggu

SEQ ID NO: 1556314 - RNA, 19 nt, Homo sapiens
gcagacauggauuuauuuu

SEQ ID NO: 1556315 - RNA, 19 nt, Homo sapiens
augaugagguccagauuac

SEQ ID NO: 1556316 - RNA, 19 nt, Homo sapiens
gacaaagaagacagugaug

SEQ ID NO: 1556317 - RNA, 19 nt, Homo sapiens
gagaagcauggcuacaaca

SEQ ID NO: 1556318 - RNA, 19 nt, Homo sapiens
ugugucagaugccaagcuu

SEQ ID NO: 1556319 - RNA, 19 nt, Homo sapiens
caccggaccuugcgcucau

SEQ ID NO: 1556320 - RNA, 19 nt, Homo sapiens
gaccuccugccucuccuaa

SEQ ID NO: 1556321 - RNA, 19 nt, Homo sapiens
uaagcacgauguggagaag

SEQ ID NO: 1556322 - RNA, 19 nt, Homo sapiens
aaauacuacuacucuugga

SEQ ID NO: 1556323 - RNA, 19 nt, Homo sapiens
gacaaggugcuguuugaac

SEQ ID NO: 1556324 - RNA, 19 nt, Homo sapiens
ccaagcccaccuuccagaa

SEQ ID NO: 1556325 - RNA, 19 nt, Homo sapiens
ggccagcugggaaaugcua

SEQ ID NO: 1556326 - RNA, 19 nt, Homo sapiens
aggcaucucuggugucacu

SEQ ID NO: 1556327 - RNA, 19 nt, Homo sapiens
ccacagaugagcagcuuuu

SEQ ID NO: 1556328 - RNA, 19 nt, Homo sapiens
gggcguacauaguaaucac

SEQ ID NO: 1556329 - RNA, 19 nt, Homo sapiens
gcaucucuggugucacuga

SEQ ID NO: 1556330 - RNA, 19 nt, Homo sapiens
caaggacaaagaagacagu

SEQ ID NO: 1556331 - RNA, 19 nt, Homo sapiens
guucaagccauccguaggu

SEQ ID NO: 1556332 - RNA, 19 nt, Homo sapiens
gagccaacauucacauuua

SEQ ID NO: 1556333 - RNA, 19 nt, Homo sapiens
gaagaccucuccuauguga

SEQ ID NO: 1556334 - RNA, 19 nt, Homo sapiens
gagagaagauuauaaaugg

SEQ ID NO: 1556335 - RNA, 19 nt, Homo sapiens
gaaagggccucacaguuca

SEQ ID NO: 1556336 - RNA, 19 nt, Homo sapiens
ccagagaaauccagccaua

SEQ ID NO: 1556337 - RNA, 19 nt, Homo sapiens
ggaaagggccucacaguuc

SEQ ID NO: 1556338 - RNA, 19 nt, Homo sapiens
ccagugaacucuagguuga

SEQ ID NO: 1556339 - RNA, 19 nt, Homo sapiens
gcaguucauuuauuacuug

SEQ ID NO: 1556340 - RNA, 19 nt, Homo sapiens
uaccauggcuauaccaaua

SEQ ID NO: 1556341 - RNA, 19 nt, Homo sapiens
gagccgagaucgugccauu

SEQ ID NO: 1556342 - RNA, 19 nt, Homo sapiens
cacggcaguucauuuauua

SEQ ID NO: 1556343 - RNA, 19 nt, Homo sapiens
ccacggcaguucauuuauu

SEQ ID NO: 1556344 - RNA, 19 nt, Homo sapiens
gugguuagcuguuggauuc

SEQ ID NO: 1556345 - RNA, 19 nt, Homo sapiens
ggauucugauacuuucuua

SEQ ID NO: 1556346 - RNA, 19 nt, Homo sapiens
gcaggagaaucacuugaau

SEQ ID NO: 1556347 - RNA, 19 nt, Homo sapiens
ggagagagagaagauuaua

SEQ ID NO: 1556348 - RNA, 19 nt, Homo sapiens
caucuagcaugacugagua

SEQ ID NO: 1556349 - RNA, 19 nt, Homo sapiens
cugaagaccucuccuaugu

SEQ ID NO: 1556350 - RNA, 19 nt, Homo sapiens
gcggagagagagaagauua

SEQ ID NO: 1556351 - RNA, 19 nt, Homo sapiens
gaguaccacuaauuugaaa

SEQ ID NO: 1556352 - RNA, 19 nt, Homo sapiens
gacagcggcucccuacuau

SEQ ID NO: 1556353 - RNA, 19 nt, Homo sapiens
gauggugugugacauuaga

SEQ ID NO: 1556354 - RNA, 19 nt, Homo sapiens
ggucaggaguucaagacaa

SEQ ID NO: 1556355 - RNA, 19 nt, Homo sapiens
gcaguacucaccagagaaa

SEQ ID NO: 1556356 - RNA, 19 nt, Homo sapiens
cuucgaaccuggcucauga

SEQ ID NO: 1556357 - RNA, 19 nt, Homo sapiens
gacaguuccuucuuucuuc

SEQ ID NO: 1556358 - RNA, 19 nt, Homo sapiens
caaugucacugaagcacuu

SEQ ID NO: 1556359 - RNA, 19 nt, Homo sapiens
ucugaaggaugaauucuau

SEQ ID NO: 1556360 - RNA, 19 nt, Homo sapiens
gagagagagaagauuauaa

SEQ ID NO: 1556361 - RNA, 19 nt, Homo sapiens
uggaugaugugacugauga

SEQ ID NO: 1556362 - RNA, 19 nt, Homo sapiens
acugugaccucuugcuaua

SEQ ID NO: 1556363 - RNA, 19 nt, Homo sapiens
gagcaugggauggauguuu

SEQ ID NO: 1556364 - RNA, 19 nt, Homo sapiens
uaaugaccguggagacaaa

SEQ ID NO: 1556365 - RNA, 19 nt, Homo sapiens
gagaaauccagccauauca

SEQ ID NO: 1556366 - RNA, 19 nt, Homo sapiens
gggugacaguuccuucuuu

SEQ ID NO: 1556367 - RNA, 19 nt, Homo sapiens
gcagcagucuucccucagu

SEQ ID NO: 1556368 - RNA, 19 nt, Homo sapiens
guaaaggucaggaguucaa

SEQ ID NO: 1556369 - RNA, 19 nt, Homo sapiens
ccuacaaagucauaguaaa

SEQ ID NO: 1556370 - RNA, 19 nt, Homo sapiens
gcucagugguugcaaacau

SEQ ID NO: 1556371 - RNA, 19 nt, Homo sapiens
cuuagaggcugaccguauu

SEQ ID NO: 1556372 - RNA, 19 nt, Homo sapiens
gaaauccagccauaucauc

SEQ ID NO: 1556373 - RNA, 19 nt, Homo sapiens
cagaauaucgcuauaacau

SEQ ID NO: 1556374 - RNA, 19 nt, Homo sapiens
ggugacaguuccuucuuuc

SEQ ID NO: 1556375 - RNA, 19 nt, Homo sapiens
agacagcggcucccuacua

SEQ ID NO: 1556376 - RNA, 19 nt, Homo sapiens
ggagaugccauuggaauca

SEQ ID NO: 1556377 - RNA, 19 nt, Homo sapiens
gcaaagaggagagccaaca

SEQ ID NO: 1556378 - RNA, 19 nt, Homo sapiens
ugaugugacugaugaauac

SEQ ID NO: 1556379 - RNA, 19 nt, Homo sapiens
gaaaccccgucucuacuaa

SEQ ID NO: 1556380 - RNA, 19 nt, Homo sapiens
gcggguaugcacaaagaua

SEQ ID NO: 1556381 - RNA, 19 nt, Homo sapiens
acagauacuugucauaaac

SEQ ID NO: 1556382 - RNA, 19 nt, Homo sapiens
gguugaguaccacuaauuu

SEQ ID NO: 1556383 - RNA, 19 nt, Homo sapiens
uagcaugacugaguauaca

SEQ ID NO: 1556384 - RNA, 19 nt, Homo sapiens
ccagcagaauaucgcuaua

SEQ ID NO: 1556385 - RNA, 19 nt, Homo sapiens
cagcagucuucccucagua

SEQ ID NO: 1556386 - RNA, 19 nt, Homo sapiens
uuacacaguuccaucaucu

SEQ ID NO: 1556387 - RNA, 19 nt, Homo sapiens
aagcggguaugcacaaaga

SEQ ID NO: 1556388 - RNA, 19 nt, Homo sapiens
cugauggugugugacauua

SEQ ID NO: 1556389 - RNA, 19 nt, Homo sapiens
cuacaaagucauaguaaag

SEQ ID NO: 1556390 - RNA, 19 nt, Homo sapiens
cauaucaucuuggccuguu

SEQ ID NO: 1556391 - RNA, 19 nt, Homo sapiens
cagcagaauaucgcuauaa

SEQ ID NO: 1556392 - RNA, 19 nt, Homo sapiens
ggcaguucauuuauuacuu

SEQ ID NO: 1556393 - RNA, 19 nt, Homo sapiens
aauacuugauguccaugua

SEQ ID NO: 1556394 - RNA, 19 nt, Homo sapiens
gcuugacugugaccucuug

SEQ ID NO: 1556395 - RNA, 19 nt, Homo sapiens
gacccugucucuacuaaaa

SEQ ID NO: 1556396 - RNA, 19 nt, Homo sapiens
ugacaggacccauggaaca

SEQ ID NO: 1556397 - RNA, 19 nt, Homo sapiens
gggcggaucaccugaguuc

SEQ ID NO: 1556398 - RNA, 19 nt, Homo sapiens
uaguaaaggucaggaguuc

SEQ ID NO: 1556399 - RNA, 19 nt, Homo sapiens
aaagcucagugguugcaaa

SEQ ID NO: 1556400 - RNA, 19 nt, Homo sapiens
cugaaacuccagcagaaua

SEQ ID NO: 1556401 - RNA, 19 nt, Homo sapiens
gcuguuggauucugauacu

SEQ ID NO: 1556402 - RNA, 19 nt, Homo sapiens
gaaucagucaggcgucuau

SEQ ID NO: 1556403 - RNA, 19 nt, Homo sapiens
ugggaaguguggcugguaa

SEQ ID NO: 1556404 - RNA, 19 nt, Homo sapiens
cugaagcacuuguggaaag

SEQ ID NO: 1556405 - RNA, 19 nt, Homo sapiens
gcagaauaucgcuauaaca

SEQ ID NO: 1556406 - RNA, 19 nt, Homo sapiens
ugacaguuccuucuuucuu

SEQ ID NO: 1556407 - RNA, 19 nt, Homo sapiens
ucuccuaugugaaccgaaa

SEQ ID NO: 1556408 - RNA, 19 nt, Homo sapiens
gcugaagaccucuccuaug

SEQ ID NO: 1556409 - RNA, 19 nt, Homo sapiens
ggcaggagaaucacuugaa

SEQ ID NO: 1556410 - RNA, 19 nt, Homo sapiens
ugugaccucuugcuauaug

SEQ ID NO: 1556411 - RNA, 19 nt, Homo sapiens
uuaugacugugccuacaaa

SEQ ID NO: 1556412 - RNA, 19 nt, Homo sapiens
ugaaacuccagcagaauau

SEQ ID NO: 1556413 - RNA, 19 nt, Homo sapiens
gucaggaguucaagacaag

SEQ ID NO: 1556414 - RNA, 19 nt, Homo sapiens
aaagaggagagccaacauu

SEQ ID NO: 1556415 - RNA, 19 nt, Homo sapiens
cugcaguacucaccagaga

SEQ ID NO: 1556416 - RNA, 19 nt, Homo sapiens
ucuaugagucguuguguug

SEQ ID NO: 1556417 - RNA, 19 nt, Homo sapiens
cacagguccuugcagcauu

SEQ ID NO: 1556418 - RNA, 19 nt, Homo sapiens
guuggauucugauacuuuc

SEQ ID NO: 1556419 - RNA, 19 nt, Homo sapiens
uaagcuggaugaugugacu

SEQ ID NO: 1556420 - RNA, 19 nt, Homo sapiens
ccuguaaucccagcacuuu

SEQ ID NO: 1556421 - RNA, 19 nt, Homo sapiens
ugaguaccacuaauuugaa

SEQ ID NO: 1556422 - RNA, 19 nt, Homo sapiens
ugacugugaccucuugcua

SEQ ID NO: 1556423 - RNA, 19 nt, Homo sapiens
gagagccaacauucacauu

SEQ ID NO: 1556424 - RNA, 19 nt, Homo sapiens
ugaagcggguaugcacaaa

SEQ ID NO: 1556425 - RNA, 19 nt, Homo sapiens
guuagcuguuggauucuga

SEQ ID NO: 1556426 - RNA, 19 nt, Homo sapiens
ugugacugaugaauacuug

SEQ ID NO: 1556427 - RNA, 19 nt, Homo sapiens
acaguuccaucaucuagca

SEQ ID NO: 1556428 - RNA, 19 nt, Homo sapiens
agagaaauccagccauauc

SEQ ID NO: 1556429 - RNA, 19 nt, Homo sapiens
acagguccuugcagcauug

SEQ ID NO: 1556430 - RNA, 19 nt, Homo sapiens
cagcgauccagggcuauua

SEQ ID NO: 1556431 - RNA, 19 nt, Homo sapiens
aggagaaucacuugaauca

SEQ ID NO: 1556432 - RNA, 19 nt, Homo sapiens
gaaccuugcuucagaauga

SEQ ID NO: 1556433 - RNA, 19 nt, Homo sapiens
gaagagggaugacaaguau

SEQ ID NO: 1556434 - RNA, 19 nt, Homo sapiens
ucaaagagaugaagaagaa

SEQ ID NO: 1556435 - RNA, 19 nt, Homo sapiens
gcaaggagaucacggacuu

SEQ ID NO: 1556436 - RNA, 19 nt, Homo sapiens
agaagaagguggcaaauga

SEQ ID NO: 1556437 - RNA, 19 nt, Homo sapiens
guacaaggauggcauggaa

SEQ ID NO: 1556438 - RNA, 19 nt, Homo sapiens
acaccuggcucaucaauaa

SEQ ID NO: 1556439 - RNA, 19 nt, Homo sapiens
ugacugaugugacuaaaga

SEQ ID NO: 1556440 - RNA, 19 nt, Homo sapiens
gcgcaugccuggaguguga

SEQ ID NO: 1556441 - RNA, 19 nt, Homo sapiens
ggaugacucugacaacuau

SEQ ID NO: 1556442 - RNA, 19 nt, Homo sapiens
ggccaaggauccuguuaaa

SEQ ID NO: 1556443 - RNA, 19 nt, Homo sapiens
ccaaguacaugcugguuau

SEQ ID NO: 1556444 - RNA, 19 nt, Homo sapiens
gcaauaaacguaacucauc

SEQ ID NO: 1556445 - RNA, 19 nt, Homo sapiens
ucaggaagcucaaagagau

SEQ ID NO: 1556446 - RNA, 19 nt, Homo sapiens
agaaagagaugcuggagau

SEQ ID NO: 1556447 - RNA, 19 nt, Homo sapiens
gaagguggcaaaugagaaa

SEQ ID NO: 1556448 - RNA, 19 nt, Homo sapiens
caaggaguccgccaagaua

SEQ ID NO: 1556449 - RNA, 19 nt, Homo sapiens
ucaggaggcuguuaugaug

SEQ ID NO: 1556450 - RNA, 19 nt, Homo sapiens
ggccaggacugcaccauga

SEQ ID NO: 1556451 - RNA, 19 nt, Homo sapiens
gagcgugucuucagcaaca

SEQ ID NO: 1556452 - RNA, 19 nt, Homo sapiens
gaugauaagucaguuguag

SEQ ID NO: 1556453 - RNA, 19 nt, Homo sapiens
ccaaagugcccaagaaaga

SEQ ID NO: 1556454 - RNA, 19 nt, Homo sapiens
gaaagugaagccucuguau

SEQ ID NO: 1556455 - RNA, 19 nt, Homo sapiens
aagcucaucuuucccagua

SEQ ID NO: 1556456 - RNA, 19 nt, Homo sapiens
aagcagagcugaucaucga

SEQ ID NO: 1556457 - RNA, 19 nt, Homo sapiens
ccaagaagaagcagaagaa

SEQ ID NO: 1556458 - RNA, 19 nt, Homo sapiens
gaaaucaaagcaccucaug

SEQ ID NO: 1556459 - RNA, 19 nt, Homo sapiens
acaaagagaccaagguuga

SEQ ID NO: 1556460 - RNA, 19 nt, Homo sapiens
aacagaaggucaagagaaa

SEQ ID NO: 1556461 - RNA, 19 nt, Homo sapiens
uaacagaaggucaagagaa

SEQ ID NO: 1556462 - RNA, 19 nt, Homo sapiens
gagagacaauuaccaagag

SEQ ID NO: 1556463 - RNA, 19 nt, Homo sapiens
gaaaaccacugcccaaagu

SEQ ID NO: 1556464 - RNA, 19 nt, Homo sapiens
guacugccaucgucacugu

SEQ ID NO: 1556465 - RNA, 19 nt, Homo sapiens
ccgagagucugcagaagaa

SEQ ID NO: 1556466 - RNA, 19 nt, Homo sapiens
ggaaagugaagccucugua

SEQ ID NO: 1556467 - RNA, 19 nt, Homo sapiens
uaccgaaccuugcuucaga

SEQ ID NO: 1556468 - RNA, 19 nt, Homo sapiens
gaugacaaguaugaaauca

SEQ ID NO: 1556469 - RNA, 19 nt, Homo sapiens
gcucucugguguuuguuaa

SEQ ID NO: 1556470 - RNA, 19 nt, Homo sapiens
gaaauacuucuuccgaauc

SEQ ID NO: 1556471 - RNA, 19 nt, Homo sapiens
ugaagagggaugacaagua

SEQ ID NO: 1556472 - RNA, 19 nt, Homo sapiens
cgaguuauagcuguaaaua

SEQ ID NO: 1556473 - RNA, 19 nt, Homo sapiens
ggaggacacagaauaugaa

SEQ ID NO: 1556474 - RNA, 19 nt, Homo sapiens
cgacagcauuaacaaggaa

SEQ ID NO: 1556475 - RNA, 19 nt, Homo sapiens
gagcccagcugaguugugu

SEQ ID NO: 1556476 - RNA, 19 nt, Homo sapiens
ggagagaugaagccuguga

SEQ ID NO: 1556477 - RNA, 19 nt, Homo sapiens
guacugagccacugaggau

SEQ ID NO: 1556478 - RNA, 19 nt, Homo sapiens
gauauucuacgacagcauu

SEQ ID NO: 1556479 - RNA, 19 nt, Homo sapiens
gaaugaguuuggagaagca

SEQ ID NO: 1556480 - RNA, 19 nt, Homo sapiens
aaagagaugcuggagauuu

SEQ ID NO: 1556481 - RNA, 19 nt, Homo sapiens
caaagaugauaagucaguu

SEQ ID NO: 1556482 - RNA, 19 nt, Homo sapiens
ggucugacgcacacgcuua

SEQ ID NO: 1556483 - RNA, 19 nt, Homo sapiens
ucccugagcucguggagaa

SEQ ID NO: 1556484 - RNA, 19 nt, Homo sapiens
guuaugauguggaguuucu

SEQ ID NO: 1556485 - RNA, 19 nt, Homo sapiens
gcucaucuuucccaguaug

SEQ ID NO: 1556486 - RNA, 19 nt, Homo sapiens
gcaaguacgaugugaagca

SEQ ID NO: 1556487 - RNA, 19 nt, Homo sapiens
agaacgagcugggcaagga

SEQ ID NO: 1556488 - RNA, 19 nt, Homo sapiens
caaaggagugguccaagug

SEQ ID NO: 1556489 - RNA, 19 nt, Homo sapiens
ggaccugcauguaucugau

SEQ ID NO: 1556490 - RNA, 19 nt, Homo sapiens
gcucaguaguggccaagga

SEQ ID NO: 1556491 - RNA, 19 nt, Homo sapiens
ucaagugacugaugugacu

SEQ ID NO: 1556492 - RNA, 19 nt, Homo sapiens
ggauggagacccuacugaa

SEQ ID NO: 1556493 - RNA, 19 nt, Homo sapiens
agacagcuguguuugagau

SEQ ID NO: 1556494 - RNA, 19 nt, Homo sapiens
gcugcacgcucaccgucua

SEQ ID NO: 1556495 - RNA, 19 nt, Homo sapiens
gaggcucacuacaucauca

SEQ ID NO: 1556496 - RNA, 19 nt, Homo sapiens
cgagagacaauuaccaaga

SEQ ID NO: 1556497 - RNA, 19 nt, Homo sapiens
gaauccgggcugugaauga

SEQ ID NO: 1556498 - RNA, 19 nt, Homo sapiens
gcacuaaguacagcaugaa

SEQ ID NO: 1556499 - RNA, 19 nt, Homo sapiens
ccagacagcuguguuugag

SEQ ID NO: 1556500 - RNA, 19 nt, Homo sapiens
ugacaacuauaagugcauu

SEQ ID NO: 1556501 - RNA, 19 nt, Homo sapiens
ggagaagcacgcuaugaca

SEQ ID NO: 1556502 - RNA, 19 nt, Homo sapiens
acaaaggagugguccaagu

SEQ ID NO: 1556503 - RNA, 19 nt, Homo sapiens
gauggagacccuacugaau

SEQ ID NO: 1556504 - RNA, 19 nt, Homo sapiens
ggcacuaaguacagcauga

SEQ ID NO: 1556505 - RNA, 19 nt, Homo sapiens
agugugagcugacauccaa

SEQ ID NO: 1556506 - RNA, 19 nt, Homo sapiens
acgcacacgcuuaagauua

SEQ ID NO: 1556507 - RNA, 19 nt, Homo sapiens
ugcucaagcucaagaauga

SEQ ID NO: 1556508 - RNA, 19 nt, Homo sapiens
ggucuuugacugcauaaug

SEQ ID NO: 1556509 - RNA, 19 nt, Homo sapiens
aaucaaagcaccucaugug

SEQ ID NO: 1556510 - RNA, 19 nt, Homo sapiens
gcucaccgucuaugacaaa

SEQ ID NO: 1556511 - RNA, 19 nt, Homo sapiens
ucaaggacagcggcgauua

SEQ ID NO: 1556512 - RNA, 19 nt, Homo sapiens
ccacagugacccucuacaa

SEQ ID NO: 1556513 - RNA, 19 nt, Homo sapiens
ucaucgagaggcagaaaua

SEQ ID NO: 1556514 - RNA, 19 nt, Homo sapiens
aaagugaagccucuguauu

SEQ ID NO: 1556515 - RNA, 19 nt, Homo sapiens
ccaagggcacggaaaguga

SEQ ID NO: 1556516 - RNA, 19 nt, Homo sapiens
aggcccagcucacuauuga

SEQ ID NO: 1556517 - RNA, 19 nt, Homo sapiens
gcacgcucaccgucuauga

SEQ ID NO: 1556518 - RNA, 19 nt, Homo sapiens
ucccaguuccucauuaaua

SEQ ID NO: 1556519 - RNA, 19 nt, Homo sapiens
gagcauaguggaguucuuc

SEQ ID NO: 1556520 - RNA, 19 nt, Homo sapiens
uggaugagccacugaaguu

SEQ ID NO: 1556521 - RNA, 19 nt, Homo sapiens
uguccaaagugcccaagaa

SEQ ID NO: 1556522 - RNA, 19 nt, Homo sapiens
gaaagagaugcuggagauu

SEQ ID NO: 1556523 - RNA, 19 nt, Homo sapiens
agaagaagcagaagaaggu

SEQ ID NO: 1556524 - RNA, 19 nt, Homo sapiens
ugacuucggaugacucuga

SEQ ID NO: 1556525 - RNA, 19 nt, Homo sapiens
gcucaagcccuacgagaag

SEQ ID NO: 1556526 - RNA, 19 nt, Homo sapiens
cagugacucugaccuggaa

SEQ ID NO: 1556527 - RNA, 19 nt, Homo sapiens
gggaugacaaguaugaaau

SEQ ID NO: 1556528 - RNA, 19 nt, Homo sapiens
ccaagaaagagcccaacuu

SEQ ID NO: 1556529 - RNA, 19 nt, Homo sapiens
gaggccauccggauucuga

SEQ ID NO: 1556530 - RNA, 19 nt, Homo sapiens
gaaugaaaucggugacagu

SEQ ID NO: 1556531 - RNA, 19 nt, Homo sapiens
gagaagcacgcuaugacau

SEQ ID NO: 1556532 - RNA, 19 nt, Homo sapiens
gaagaagaaugugagauua

SEQ ID NO: 1556533 - RNA, 19 nt, Homo sapiens
ggaaacacaucuucacauu

SEQ ID NO: 1556534 - RNA, 19 nt, Homo sapiens
ggaaagggcacaaguacua

SEQ ID NO: 1556535 - RNA, 19 nt, Homo sapiens
caucacagcuggucuuuga

SEQ ID NO: 1556536 - RNA, 19 nt, Homo sapiens
gcacguacauccuguggaa

SEQ ID NO: 1556537 - RNA, 19 nt, Homo sapiens
aaacacaucuucacauuuc

SEQ ID NO: 1556538 - RNA, 19 nt, Homo sapiens
gaaagagugugaguacauu

SEQ ID NO: 1556539 - RNA, 19 nt, Homo sapiens
gcaaugagaggguguauga

SEQ ID NO: 1556540 - RNA, 19 nt, Homo sapiens
uaagauggcucugaaggua

SEQ ID NO: 1556541 - RNA, 19 nt, Homo sapiens
cuaaugcugucacaaauaa

SEQ ID NO: 1556542 - RNA, 19 nt, Homo sapiens
gcucaacacuugcuuuaug

SEQ ID NO: 1556543 - RNA, 19 nt, Homo sapiens
ggaagaagaaugugagauu

SEQ ID NO: 1556544 - RNA, 19 nt, Homo sapiens
gagcugggcuacuccauau

SEQ ID NO: 1556545 - RNA, 19 nt, Homo sapiens
gauguaagauaucugcauu

SEQ ID NO: 1556546 - RNA, 19 nt, Homo sapiens
ccucauugcuuucccauuu

SEQ ID NO: 1556547 - RNA, 19 nt, Homo sapiens
gcaaguccuuuaccuguug

SEQ ID NO: 1556548 - RNA, 19 nt, Homo sapiens
gaagguagcgagacgauga

SEQ ID NO: 1556549 - RNA, 19 nt, Homo sapiens
uggcuucgguuucuucuua

SEQ ID NO: 1556550 - RNA, 19 nt, Homo sapiens
guagaaaggucagggaaug

SEQ ID NO: 1556551 - RNA, 19 nt, Homo sapiens
ugaugcaucuuacaaauug

SEQ ID NO: 1556552 - RNA, 19 nt, Homo sapiens
gaaacacaucuucacauuu

SEQ ID NO: 1556553 - RNA, 19 nt, Homo sapiens
gcauuucauuuacuacuga

SEQ ID NO: 1556554 - RNA, 19 nt, Homo sapiens
ccaguucauuccauucuuu

SEQ ID NO: 1556555 - RNA, 19 nt, Homo sapiens
gaaguaagagaacccaaga

SEQ ID NO: 1556556 - RNA, 19 nt, Homo sapiens
cggauucccuguauucuga

SEQ ID NO: 1556557 - RNA, 19 nt, Homo sapiens
uaagagaacccaagaccaa

SEQ ID NO: 1556558 - RNA, 19 nt, Homo sapiens
gaaaggucagggaauguuu

SEQ ID NO: 1556559 - RNA, 19 nt, Homo sapiens
gcugggcuacuccauauua

SEQ ID NO: 1556560 - RNA, 19 nt, Homo sapiens
acaagcaacuggagcagaa

SEQ ID NO: 1556561 - RNA, 19 nt, Homo sapiens
cuucacauuucccuuauuu

SEQ ID NO: 1556562 - RNA, 19 nt, Homo sapiens
uuaucagucuucacacuua

SEQ ID NO: 1556563 - RNA, 19 nt, Homo sapiens
ggacacauaccacaugcaa

SEQ ID NO: 1556564 - RNA, 19 nt, Homo sapiens
gaucugaugggauguaaga

SEQ ID NO: 1556565 - RNA, 19 nt, Homo sapiens
caucuucacauuucccuua

SEQ ID NO: 1556566 - RNA, 19 nt, Homo sapiens
gaaagggcacaaguacuaa

SEQ ID NO: 1556567 - RNA, 19 nt, Homo sapiens
cugaagaccuccucggauu

SEQ ID NO: 1556568 - RNA, 19 nt, Homo sapiens
uugaaucccucauugcuuu

SEQ ID NO: 1556569 - RNA, 19 nt, Homo sapiens
guuccuauccucugaguaa

SEQ ID NO: 1556570 - RNA, 19 nt, Homo sapiens
ggcaggagguccaggcuau

SEQ ID NO: 1556571 - RNA, 19 nt, Homo sapiens
gagggaaagggcacaagua

SEQ ID NO: 1556572 - RNA, 19 nt, Homo sapiens
ggaacuggaucggugcuau

SEQ ID NO: 1556573 - RNA, 19 nt, Homo sapiens
uguaagauaucugcauuug

SEQ ID NO: 1556574 - RNA, 19 nt, Homo sapiens
guacccaaguauaugugua

SEQ ID NO: 1556575 - RNA, 19 nt, Homo sapiens
gguccaggcuauagaguca

SEQ ID NO: 1556576 - RNA, 19 nt, Homo sapiens
ccucauuucugucuuggaa

SEQ ID NO: 1556577 - RNA, 19 nt, Homo sapiens
gagccucauuucugucuug

SEQ ID NO: 1556578 - RNA, 19 nt, Homo sapiens
cuuaaagucugaccacguu

SEQ ID NO: 1556579 - RNA, 19 nt, Homo sapiens
aauaugauccagacucuaa

SEQ ID NO: 1556580 - RNA, 19 nt, Homo sapiens
aagauaaugcugcagcuua

SEQ ID NO: 1556581 - RNA, 19 nt, Homo sapiens
ccaagaccaacuaagauuu

SEQ ID NO: 1556582 - RNA, 19 nt, Homo sapiens
cacauuucaucaucucuaa

SEQ ID NO: 1556583 - RNA, 19 nt, Homo sapiens
acauuucccuuauuuagga

SEQ ID NO: 1556584 - RNA, 19 nt, Homo sapiens
cugaugggauguaagauau

SEQ ID NO: 1556585 - RNA, 19 nt, Homo sapiens
ggagaagcauaaggcucua

SEQ ID NO: 1556586 - RNA, 19 nt, Homo sapiens
ucacugaucagagcucuuu

SEQ ID NO: 1556587 - RNA, 19 nt, Homo sapiens
aaaucauucugcucucuuu

SEQ ID NO: 1556588 - RNA, 19 nt, Homo sapiens
ucacacuuauuaaccauca

SEQ ID NO: 1556589 - RNA, 19 nt, Homo sapiens
guaugugcgugcaaugaga

SEQ ID NO: 1556590 - RNA, 19 nt, Homo sapiens
caaauucacgugguuaugu

SEQ ID NO: 1556591 - RNA, 19 nt, Homo sapiens
guacauuagguugcaauuu

SEQ ID NO: 1556592 - RNA, 19 nt, Homo sapiens
gauugucucugcaugucuu

SEQ ID NO: 1556593 - RNA, 19 nt, Homo sapiens
ucacauuucccuuauuuag

SEQ ID NO: 1556594 - RNA, 19 nt, Homo sapiens
caugugcccuguguugaaa

SEQ ID NO: 1556595 - RNA, 19 nt, Homo sapiens
ucagucuucacacuuauua

SEQ ID NO: 1556596 - RNA, 19 nt, Homo sapiens
ccagugccauaauugcauu

SEQ ID NO: 1556597 - RNA, 19 nt, Homo sapiens
gaacuggaucggugcuaug

SEQ ID NO: 1556598 - RNA, 19 nt, Homo sapiens
gagaacccaagaccaacua

SEQ ID NO: 1556599 - RNA, 19 nt, Homo sapiens
auacuaaugcugucacaaa

SEQ ID NO: 1556600 - RNA, 19 nt, Homo sapiens
aaaccugauucaucccaaa

SEQ ID NO: 1556601 - RNA, 19 nt, Homo sapiens
ucacaaauucacgugguua

SEQ ID NO: 1556602 - RNA, 19 nt, Homo sapiens
gcagauaaccucuuuugug

SEQ ID NO: 1556603 - RNA, 19 nt, Homo sapiens
cugguugacuacaugauuu

SEQ ID NO: 1556604 - RNA, 19 nt, Homo sapiens
acacauaccacaugcaaca

SEQ ID NO: 1556605 - RNA, 19 nt, Homo sapiens
cuccagaaauuccuagaga

SEQ ID NO: 1556606 - RNA, 19 nt, Homo sapiens
agaagaaugugagauuaca

SEQ ID NO: 1556607 - RNA, 19 nt, Homo sapiens
ggcagcagcuccaguucau

SEQ ID NO: 1556608 - RNA, 19 nt, Homo sapiens
gaugggauguaagauaucu

SEQ ID NO: 1556609 - RNA, 19 nt, Homo sapiens
aaugagaggguguaugaaa

SEQ ID NO: 1556610 - RNA, 19 nt, Homo sapiens
ugcaucgacuccagaaauu

SEQ ID NO: 1556611 - RNA, 19 nt, Homo sapiens
caacacuugcuuuauguca

SEQ ID NO: 1556612 - RNA, 19 nt, Homo sapiens
cagcuggucuuugaugauc

SEQ ID NO: 1556613 - RNA, 19 nt, Homo sapiens
guaagauaucugcauuuga

SEQ ID NO: 1556614 - RNA, 19 nt, Homo sapiens
ugugaugcaucuuacaaau

SEQ ID NO: 1556615 - RNA, 19 nt, Homo sapiens
ccucuuuauuugccuguuu

SEQ ID NO: 1556616 - RNA, 19 nt, Homo sapiens
ugaaagagugugaguacau

SEQ ID NO: 1556617 - RNA, 19 nt, Homo sapiens
ugcaggagcuacacucugu

SEQ ID NO: 1556618 - RNA, 19 nt, Homo sapiens
cuacaucuucucucccuuu

SEQ ID NO: 1556619 - RNA, 19 nt, Homo sapiens
ucugaugggauguaagaua

SEQ ID NO: 1556620 - RNA, 19 nt, Homo sapiens
gugaugcaucuuacaaauu

SEQ ID NO: 1556621 - RNA, 19 nt, Homo sapiens
ggauacuaaugcugucaca

SEQ ID NO: 1556622 - RNA, 19 nt, Homo sapiens
gcaggagguccaggcuaua

SEQ ID NO: 1556623 - RNA, 19 nt, Homo sapiens
ccuguauucugaagguauu

SEQ ID NO: 1556624 - RNA, 19 nt, Homo sapiens
agagcuggcugugggaauu

SEQ ID NO: 1556625 - RNA, 19 nt, Homo sapiens
uagccgaggagaagcauaa

SEQ ID NO: 1556626 - RNA, 19 nt, Homo sapiens
ucacauuucaucaucucua

SEQ ID NO: 1556627 - RNA, 19 nt, Homo sapiens
ccuauccucugaguaauca

SEQ ID NO: 1556628 - RNA, 19 nt, Homo sapiens
cagcagcuccaguucauuc

SEQ ID NO: 1556629 - RNA, 19 nt, Homo sapiens
uacuaaugcugucacaaau

SEQ ID NO: 1556630 - RNA, 19 nt, Homo sapiens
gccauaauugcauuucauu

SEQ ID NO: 1556631 - RNA, 19 nt, Homo sapiens
ugagaggguguaugaaaga

SEQ ID NO: 1556632 - RNA, 19 nt, Homo sapiens
gagcaucucuauuaacuua

SEQ ID NO: 1556633 - RNA, 19 nt, Homo sapiens
gaaauucggucguaaagau

SEQ ID NO: 1556634 - RNA, 19 nt, Homo sapiens
ggaaaucacuucugcaaca

SEQ ID NO: 1556635 - RNA, 19 nt, Homo sapiens
ggagugggauggccuaauu

SEQ ID NO: 1556636 - RNA, 19 nt, Homo sapiens
ggacuuggcuucggaaauc

SEQ ID NO: 1556637 - RNA, 19 nt, Homo sapiens
uaaaugcaaugacaagugu

SEQ ID NO: 1556638 - RNA, 19 nt, Homo sapiens
ccacaugggucguguucuu

SEQ ID NO: 1556639 - RNA, 19 nt, Homo sapiens
agacuucuguccucuguaa

SEQ ID NO: 1556640 - RNA, 19 nt, Homo sapiens
ugaaagagaugaggaagca

SEQ ID NO: 1556641 - RNA, 19 nt, Homo sapiens
guaaagaugcuguuucucu

SEQ ID NO: 1556642 - RNA, 19 nt, Homo sapiens
gaauaaaguccugcugugu

SEQ ID NO: 1556643 - RNA, 19 nt, Homo sapiens
gcuuuggucugucuuguuc

SEQ ID NO: 1556644 - RNA, 19 nt, Homo sapiens
cuacccagcucccggcauu

SEQ ID NO: 1556645 - RNA, 19 nt, Homo sapiens
acuuggagcaucucuauua

SEQ ID NO: 1556646 - RNA, 19 nt, Homo sapiens
ggcaagggcagucguuuga

SEQ ID NO: 1556647 - RNA, 19 nt, Homo sapiens
aaacuuggagcaucucuau

SEQ ID NO: 1556648 - RNA, 19 nt, Homo sapiens
ggugaaacuuggagcaucu

SEQ ID NO: 1556649 - RNA, 19 nt, Homo sapiens
gcaucucuauuaacuuagu

SEQ ID NO: 1556650 - RNA, 19 nt, Homo sapiens
ccagaaauucggucguaaa

SEQ ID NO: 1556651 - RNA, 19 nt, Homo sapiens
accagaagcugaaagagau

SEQ ID NO: 1556652 - RNA, 19 nt, Homo sapiens
cuuggagcaucucuauuaa

SEQ ID NO: 1556653 - RNA, 19 nt, Homo sapiens
gaaacuuggagcaucucua

SEQ ID NO: 1556654 - RNA, 19 nt, Homo sapiens
gccagaaauucggucguaa

SEQ ID NO: 1556655 - RNA, 19 nt, Homo sapiens
gaugcuguuucucuucaug

SEQ ID NO: 1556656 - RNA, 19 nt, Homo sapiens
ccaccuugaucucagacuu

SEQ ID NO: 1556657 - RNA, 19 nt, Homo sapiens
caccagaagcugaaagaga

SEQ ID NO: 1556658 - RNA, 19 nt, Homo sapiens
gcagauacaaggauuuuga

SEQ ID NO: 1556659 - RNA, 19 nt, Homo sapiens
ggcccuaaaugcaaugaca

SEQ ID NO: 1556660 - RNA, 19 nt, Homo sapiens
ugcgcaaggugaagaguuu

SEQ ID NO: 1556661 - RNA, 19 nt, Homo sapiens
uggagcaucucuauuaacu

SEQ ID NO: 1556662 - RNA, 19 nt, Homo sapiens
gaaaucacuucugcaacac

SEQ ID NO: 1556663 - RNA, 19 nt, Homo sapiens
gacgguggccucagaagau

SEQ ID NO: 1556664 - RNA, 19 nt, Homo sapiens
ccacagugcgcaaggugaa

SEQ ID NO: 1556665 - RNA, 19 nt, Homo sapiens
ucguaaagaugcuguuucu

SEQ ID NO: 1556666 - RNA, 19 nt, Homo sapiens
gggcaagggcagucguuug

SEQ ID NO: 1556667 - RNA, 19 nt, Homo sapiens
ccaggccuguuucaacuag

SEQ ID NO: 1556668 - RNA, 19 nt, Homo sapiens
cuaaaugcaaugacaagug

SEQ ID NO: 1556669 - RNA, 19 nt, Homo sapiens
agccagaaauucggucgua

SEQ ID NO: 1556670 - RNA, 19 nt, Homo sapiens
aaucacuucugcaacacaa

SEQ ID NO: 1556671 - RNA, 19 nt, Homo sapiens
guccaggccuguuucaacu

SEQ ID NO: 1556672 - RNA, 19 nt, Homo sapiens
cuucauguuucucaaaugg

SEQ ID NO: 1556673 - RNA, 19 nt, Homo sapiens
uaaccaagggaauaaaguc

SEQ ID NO: 1556674 - RNA, 19 nt, Homo sapiens
ggucguaaagaugcuguuu

SEQ ID NO: 1556675 - RNA, 19 nt, Homo sapiens
auacaaggauuuugagaug

SEQ ID NO: 1556676 - RNA, 19 nt, Homo sapiens
cacaugggucguguucuua

SEQ ID NO: 1556677 - RNA, 19 nt, Homo sapiens
cgacgguggccucagaaga

SEQ ID NO: 1556678 - RNA, 19 nt, Homo sapiens
ggccaugcuuccacuuucu

SEQ ID NO: 1556679 - RNA, 19 nt, Homo sapiens
gagugggauggccuaauuu

SEQ ID NO: 1556680 - RNA, 19 nt, Homo sapiens
uuaccugccuccuguuugg

SEQ ID NO: 1556681 - RNA, 19 nt, Homo sapiens
guaaccaagggaauaaagu

SEQ ID NO: 1556682 - RNA, 19 nt, Homo sapiens
cagaaauucggucguaaag

SEQ ID NO: 1556683 - RNA, 19 nt, Homo sapiens
gcuguuucucuucauguuu

SEQ ID NO: 1556684 - RNA, 19 nt, Homo sapiens
gcuuaccugccuccuguuu

SEQ ID NO: 1556685 - RNA, 19 nt, Homo sapiens
aagugucucuauacaggaa

SEQ ID NO: 1556686 - RNA, 19 nt, Homo sapiens
guaucugugugggcccuaa

SEQ ID NO: 1556687 - RNA, 19 nt, Homo sapiens
caaggaggacagagccaau

SEQ ID NO: 1556688 - RNA, 19 nt, Homo sapiens
gggcuuuggucugucuugu

SEQ ID NO: 1556689 - RNA, 19 nt, Homo sapiens
aggcugggcuuuggucugu

SEQ ID NO: 1556690 - RNA, 19 nt, Homo sapiens
ucggaaaucacuucugcaa

SEQ ID NO: 1556691 - RNA, 19 nt, Homo sapiens
ggucugucuuguucucucu

SEQ ID NO: 1556692 - RNA, 19 nt, Homo sapiens
cuauugggcacuucaaaca

SEQ ID NO: 1556693 - RNA, 19 nt, Homo sapiens
guagcagagucuccuaucc

SEQ ID NO: 1556694 - RNA, 19 nt, Homo sapiens
ccagcucccggcauuguug

SEQ ID NO: 1556695 - RNA, 19 nt, Homo sapiens
ggaaugcuguuauguauuu

SEQ ID NO: 1556696 - RNA, 19 nt, Homo sapiens
ggaaauggcacugaaauua

SEQ ID NO: 1556697 - RNA, 19 nt, Homo sapiens
gaaagaauaugccagaaag

SEQ ID NO: 1556698 - RNA, 19 nt, Homo sapiens
gacaauccaugauaaagua

SEQ ID NO: 1556699 - RNA, 19 nt, Homo sapiens
gcagauuuaugcuguuuaa

SEQ ID NO: 1556700 - RNA, 19 nt, Homo sapiens
gagcaauaauucugaacua

SEQ ID NO: 1556701 - RNA, 19 nt, Homo sapiens
ggaagaaccuuguuguuuu

SEQ ID NO: 1556702 - RNA, 19 nt, Homo sapiens
gauagaucuugaacuguua

SEQ ID NO: 1556703 - RNA, 19 nt, Homo sapiens
gaaauggcacugaaauuau

SEQ ID NO: 1556704 - RNA, 19 nt, Homo sapiens
caaacgagaagaaagaaua

SEQ ID NO: 1556705 - RNA, 19 nt, Homo sapiens
cagagaagaucaauucaug

SEQ ID NO: 1556706 - RNA, 19 nt, Homo sapiens
ccaaagcccuauaaauguu

SEQ ID NO: 1556707 - RNA, 19 nt, Homo sapiens
caccaaaccuguuccacua

SEQ ID NO: 1556708 - RNA, 19 nt, Homo sapiens
gauuaugguuguuguggua

SEQ ID NO: 1556709 - RNA, 19 nt, Homo sapiens
ucaaaugacuguaaguugu

SEQ ID NO: 1556710 - RNA, 19 nt, Homo sapiens
gggagaauuuacugcaaua

SEQ ID NO: 1556711 - RNA, 19 nt, Homo sapiens
caagaaguaucaguauuga

SEQ ID NO: 1556712 - RNA, 19 nt, Homo sapiens
aaauguaucuggucaaugu

SEQ ID NO: 1556713 - RNA, 19 nt, Homo sapiens
gaaacuagcauuccaacau

SEQ ID NO: 1556714 - RNA, 19 nt, Homo sapiens
gcagggaaauauagcauca

SEQ ID NO: 1556715 - RNA, 19 nt, Homo sapiens
cauguuaacaguuggauua

SEQ ID NO: 1556716 - RNA, 19 nt, Homo sapiens
ugguaaaugugaucaguua

SEQ ID NO: 1556717 - RNA, 19 nt, Homo sapiens
gaaagucaccuaagauucu

SEQ ID NO: 1556718 - RNA, 19 nt, Homo sapiens
caucagcuaccauauauaa

SEQ ID NO: 1556719 - RNA, 19 nt, Homo sapiens
gcacugaaauuauguacac

SEQ ID NO: 1556720 - RNA, 19 nt, Homo sapiens
gccagaaagugaucauuga

SEQ ID NO: 1556721 - RNA, 19 nt, Homo sapiens
cuuggaauguggaaauuua

SEQ ID NO: 1556722 - RNA, 19 nt, Homo sapiens
cuauaaauguugcaucuug

SEQ ID NO: 1556723 - RNA, 19 nt, Homo sapiens
guaaggagcagggaaauau

SEQ ID NO: 1556724 - RNA, 19 nt, Homo sapiens
guaagaguauaucacagaa

SEQ ID NO: 1556725 - RNA, 19 nt, Homo sapiens
caagagcucuauacaacau

SEQ ID NO: 1556726 - RNA, 19 nt, Homo sapiens
uaaugagacugaaugcaaa

SEQ ID NO: 1556727 - RNA, 19 nt, Homo sapiens
uuaaagaguuugcauugga

SEQ ID NO: 1556728 - RNA, 19 nt, Homo sapiens
gcuauuaaauguguuguca

SEQ ID NO: 1556729 - RNA, 19 nt, Homo sapiens
aaugaaggcuguugcaaga

SEQ ID NO: 1556730 - RNA, 19 nt, Homo sapiens
aaacuagcauuccaacaug

SEQ ID NO: 1556731 - RNA, 19 nt, Homo sapiens
gaaggagcaauaauucuga

SEQ ID NO: 1556732 - RNA, 19 nt, Homo sapiens
gggaauuucucacaguaga

SEQ ID NO: 1556733 - RNA, 19 nt, Homo sapiens
guacuugcauacuguugaa

SEQ ID NO: 1556734 - RNA, 19 nt, Homo sapiens
aauccuagcucucucuuau

SEQ ID NO: 1556735 - RNA, 19 nt, Homo sapiens
gcuuagagauagauaaugg

SEQ ID NO: 1556736 - RNA, 19 nt, Homo sapiens
gcuauagcuauccaaauua

SEQ ID NO: 1556737 - RNA, 19 nt, Homo sapiens
gaagggauugugaagcuuu

SEQ ID NO: 1556738 - RNA, 19 nt, Homo sapiens
gaugaaggagcaauaauuc

SEQ ID NO: 1556739 - RNA, 19 nt, Homo sapiens
guaccuggcacuacaauug

SEQ ID NO: 1556740 - RNA, 19 nt, Homo sapiens
ggauguacuugcauacugu

SEQ ID NO: 1556741 - RNA, 19 nt, Homo sapiens
caucauaacgucagauaga

SEQ ID NO: 1556742 - RNA, 19 nt, Homo sapiens
gggaguaccuggcacuaca

SEQ ID NO: 1556743 - RNA, 19 nt, Homo sapiens
ucaagaaguaucaguauug

SEQ ID NO: 1556744 - RNA, 19 nt, Homo sapiens
agagugauaugcuuagaga

SEQ ID NO: 1556745 - RNA, 19 nt, Homo sapiens
ugcuauagcuauccaaauu

SEQ ID NO: 1556746 - RNA, 19 nt, Homo sapiens
aaauggcacugaaauuaug

SEQ ID NO: 1556747 - RNA, 19 nt, Homo sapiens
ggacaauccaugauaaagu

SEQ ID NO: 1556748 - RNA, 19 nt, Homo sapiens
gaugauguguguguauuuc

SEQ ID NO: 1556749 - RNA, 19 nt, Homo sapiens
ggauugugaagcuuuauaa

SEQ ID NO: 1556750 - RNA, 19 nt, Homo sapiens
caacauguacaaauaguca

SEQ ID NO: 1556751 - RNA, 19 nt, Homo sapiens
caaaaugaaugaagggauu

SEQ ID NO: 1556752 - RNA, 19 nt, Homo sapiens
gaaaauggaacaucaguug

SEQ ID NO: 1556753 - RNA, 19 nt, Homo sapiens
guguguauuucaagaagua

SEQ ID NO: 1556754 - RNA, 19 nt, Homo sapiens
uuacugcaauagaccauaa

SEQ ID NO: 1556755 - RNA, 19 nt, Homo sapiens
ucuguuguccucaguauua

SEQ ID NO: 1556756 - RNA, 19 nt, Homo sapiens
gaaguugagugcuguuuug

SEQ ID NO: 1556757 - RNA, 19 nt, Homo sapiens
cccaucagcuaccauauau

SEQ ID NO: 1556758 - RNA, 19 nt, Homo sapiens
agaaagugaucauugaauc

SEQ ID NO: 1556759 - RNA, 19 nt, Homo sapiens
caacauggcacugugaaug

SEQ ID NO: 1556760 - RNA, 19 nt, Homo sapiens
cucaucaacuggaagguua

SEQ ID NO: 1556761 - RNA, 19 nt, Homo sapiens
gcuggaaugcuguuaugua

SEQ ID NO: 1556762 - RNA, 19 nt, Homo sapiens
gccaaagcccuauaaaugu

SEQ ID NO: 1556763 - RNA, 19 nt, Homo sapiens
caaagucugcuauagcuau

SEQ ID NO: 1556764 - RNA, 19 nt, Homo sapiens
caccuaagauucugcaagu

SEQ ID NO: 1556765 - RNA, 19 nt, Homo sapiens
gcccaucagcuaccauaua

SEQ ID NO: 1556766 - RNA, 19 nt, Homo sapiens
gaaaauguaucuggucaau

SEQ ID NO: 1556767 - RNA, 19 nt, Homo sapiens
uaaagaguuugcauuggau

SEQ ID NO: 1556768 - RNA, 19 nt, Homo sapiens
uauugaaagucaccuaaga

SEQ ID NO: 1556769 - RNA, 19 nt, Homo sapiens
gagccaaagcccuauaaau

SEQ ID NO: 1556770 - RNA, 19 nt, Homo sapiens
gaucauugaaucggucaua

SEQ ID NO: 1556771 - RNA, 19 nt, Homo sapiens
gcaauaauucugaacuaca

SEQ ID NO: 1556772 - RNA, 19 nt, Homo sapiens
gagaauuuacugcaauaga

SEQ ID NO: 1556773 - RNA, 19 nt, Homo sapiens
ccaaaccuguuccacuaug

SEQ ID NO: 1556774 - RNA, 19 nt, Homo sapiens
gauucaaguucgacaggaa

SEQ ID NO: 1556775 - RNA, 19 nt, Homo sapiens
gccaaugaagaaugaaaua

SEQ ID NO: 1556776 - RNA, 19 nt, Homo sapiens
caaaugacuguaaguuguu

SEQ ID NO: 1556777 - RNA, 19 nt, Homo sapiens
uuaggcauguggcagauuu

SEQ ID NO: 1556778 - RNA, 19 nt, Homo sapiens
uauguacacucuccaggaa

SEQ ID NO: 1556779 - RNA, 19 nt, Homo sapiens
ggaagaagacuuuuguuau

SEQ ID NO: 1556780 - RNA, 19 nt, Homo sapiens
caacugugcagaagauaug

SEQ ID NO: 1556781 - RNA, 19 nt, Homo sapiens
aagaguauaucacagaauc

SEQ ID NO: 1556782 - RNA, 19 nt, Homo sapiens
guaguaagaguauaucaca

SEQ ID NO: 1556783 - RNA, 19 nt, Homo sapiens
uguaacagauaaccagaga

SEQ ID NO: 1556784 - RNA, 19 nt, Homo sapiens
cugaaugguuuauagagaa

SEQ ID NO: 1556785 - RNA, 19 nt, Homo sapiens
uccaagagcucuauacaac

SEQ ID NO: 1556786 - RNA, 19 nt, Homo sapiens
aaauggaacaucaguugua

SEQ ID NO: 1556787 - RNA, 19 nt, Homo sapiens
guauuuggaagaagacuuu

SEQ ID NO: 1556788 - RNA, 19 nt, Homo sapiens
gauuguggaugcauacagu

SEQ ID NO: 1556789 - RNA, 19 nt, Homo sapiens
gagugauuguggaugcaua

SEQ ID NO: 1556790 - RNA, 19 nt, Homo sapiens
guauuacuguguaugugaa

SEQ ID NO: 1556791 - RNA, 19 nt, Homo sapiens
uaaggagcagggaaauaua

SEQ ID NO: 1556792 - RNA, 19 nt, Homo sapiens
ugagcaguauguaguaaga

SEQ ID NO: 1556793 - RNA, 19 nt, Homo sapiens
cuggaaugcuguuauguau

SEQ ID NO: 1556794 - RNA, 19 nt, Homo sapiens
uugaaucggucauaaggaa

SEQ ID NO: 1556795 - RNA, 19 nt, Homo sapiens
gagaacagcuaaauugaua

SEQ ID NO: 1556796 - RNA, 19 nt, Homo sapiens
gaacagugguggacaauau

SEQ ID NO: 1556797 - RNA, 19 nt, Homo sapiens
ggaguaauuuguucugaua

SEQ ID NO: 1556798 - RNA, 19 nt, Homo sapiens
gaaagaacauuacacaucu

SEQ ID NO: 1556799 - RNA, 19 nt, Homo sapiens
gauaaagacuggugauaau

SEQ ID NO: 1556800 - RNA, 19 nt, Homo sapiens
ggagugaucuguucugaug

SEQ ID NO: 1556801 - RNA, 19 nt, Homo sapiens
gaagagaccuggaucacau

SEQ ID NO: 1556802 - RNA, 19 nt, Homo sapiens
ggaaaugagucaaauaucu

SEQ ID NO: 1556803 - RNA, 19 nt, Homo sapiens
gaacaucaccacagccaua

SEQ ID NO: 1556804 - RNA, 19 nt, Homo sapiens
gaugacggcuggaacagua

SEQ ID NO: 1556805 - RNA, 19 nt, Homo sapiens
gaaugcagcuguugugugu

SEQ ID NO: 1556806 - RNA, 19 nt, Homo sapiens
gaacaaugcugcagcugau

SEQ ID NO: 1556807 - RNA, 19 nt, Homo sapiens
gaggugaaauuccaagaaa

SEQ ID NO: 1556808 - RNA, 19 nt, Homo sapiens
gaauuaaacuguggagaug

SEQ ID NO: 1556809 - RNA, 19 nt, Homo sapiens
gaugauggguggaacacua

SEQ ID NO: 1556810 - RNA, 19 nt, Homo sapiens
gaacagauuuggaguugag

SEQ ID NO: 1556811 - RNA, 19 nt, Homo sapiens
gaugauggguggaacuuga

SEQ ID NO: 1556812 - RNA, 19 nt, Homo sapiens
ggacaagaaccucagauga

SEQ ID NO: 1556813 - RNA, 19 nt, Homo sapiens
gaaauacugucucugugau

SEQ ID NO: 1556814 - RNA, 19 nt, Homo sapiens
cuggauaacugucaaauga

SEQ ID NO: 1556815 - RNA, 19 nt, Homo sapiens
aaacucaccuugcauuaug

SEQ ID NO: 1556816 - RNA, 19 nt, Homo sapiens
ccagaucaaccucuaaaua

SEQ ID NO: 1556817 - RNA, 19 nt, Homo sapiens
aaauguaucugacccauau

SEQ ID NO: 1556818 - RNA, 19 nt, Homo sapiens
acacagguuucauugcuua

SEQ ID NO: 1556819 - RNA, 19 nt, Homo sapiens
ggaauucugugugcuaaug

SEQ ID NO: 1556820 - RNA, 19 nt, Homo sapiens
ggagauuggaggugaaaua

SEQ ID NO: 1556821 - RNA, 19 nt, Homo sapiens
ggaaacagacugcguguca

SEQ ID NO: 1556822 - RNA, 19 nt, Homo sapiens
gaaagccuaugcauguguu

SEQ ID NO: 1556823 - RNA, 19 nt, Homo sapiens
gaagucaaguugcccuaug

SEQ ID NO: 1556824 - RNA, 19 nt, Homo sapiens
ggaaauacugucucuguga

SEQ ID NO: 1556825 - RNA, 19 nt, Homo sapiens
gcagauggaaguaacaauu

SEQ ID NO: 1556826 - RNA, 19 nt, Homo sapiens
agagauagacccauaauga

SEQ ID NO: 1556827 - RNA, 19 nt, Homo sapiens
ggaacuauaugugaugaug

SEQ ID NO: 1556828 - RNA, 19 nt, Homo sapiens
uugaugauguuuccuguua

SEQ ID NO: 1556829 - RNA, 19 nt, Homo sapiens
caaaaugacuuuagacuuc

SEQ ID NO: 1556830 - RNA, 19 nt, Homo sapiens
gcacuuauuuuauccagua

SEQ ID NO: 1556831 - RNA, 19 nt, Homo sapiens
ggacacagguuucauugcu

SEQ ID NO: 1556832 - RNA, 19 nt, Homo sapiens
gaaagaaguguucgugugu

SEQ ID NO: 1556833 - RNA, 19 nt, Homo sapiens
gagaagauguuggugugaa

SEQ ID NO: 1556834 - RNA, 19 nt, Homo sapiens
gaaugugggucugcaauca

SEQ ID NO: 1556835 - RNA, 19 nt, Homo sapiens
gggaaagcauaauugugua

SEQ ID NO: 1556836 - RNA, 19 nt, Homo sapiens
gaagaugcccguguucuau

SEQ ID NO: 1556837 - RNA, 19 nt, Homo sapiens
ggacaguggaggugaaauu

SEQ ID NO: 1556838 - RNA, 19 nt, Homo sapiens
gacaggcucugguuucaug

SEQ ID NO: 1556839 - RNA, 19 nt, Homo sapiens
aaauuuggcuugaugaugu

SEQ ID NO: 1556840 - RNA, 19 nt, Homo sapiens
ugaaggagacaacaacuuu

SEQ ID NO: 1556841 - RNA, 19 nt, Homo sapiens
gacaugcggugcaaaggaa

SEQ ID NO: 1556842 - RNA, 19 nt, Homo sapiens
ggaauggagucccacuugu

SEQ ID NO: 1556843 - RNA, 19 nt, Homo sapiens
gaauaaagaggaagucaag

SEQ ID NO: 1556844 - RNA, 19 nt, Homo sapiens
gcagagaaguuggaguugu

SEQ ID NO: 1556845 - RNA, 19 nt, Homo sapiens
gaguagaggugagaauuca

SEQ ID NO: 1556846 - RNA, 19 nt, Homo sapiens
caccauaaguggaacaaug

SEQ ID NO: 1556847 - RNA, 19 nt, Homo sapiens
ggaacuaaccgcuguaugg

SEQ ID NO: 1556848 - RNA, 19 nt, Homo sapiens
gaugauguuuccuguuaug

SEQ ID NO: 1556849 - RNA, 19 nt, Homo sapiens
gaacacuacugccucaacu

SEQ ID NO: 1556850 - RNA, 19 nt, Homo sapiens
aggaagagauagacccaua

SEQ ID NO: 1556851 - RNA, 19 nt, Homo sapiens
cagaucaaccucuaaauau

SEQ ID NO: 1556852 - RNA, 19 nt, Homo sapiens
gagcugugcugggagauug

SEQ ID NO: 1556853 - RNA, 19 nt, Homo sapiens
aaauuuggcucgaugaugu

SEQ ID NO: 1556854 - RNA, 19 nt, Homo sapiens
ggaugacguuucuugcauu

SEQ ID NO: 1556855 - RNA, 19 nt, Homo sapiens
aagaucagaugcuggagua

SEQ ID NO: 1556856 - RNA, 19 nt, Homo sapiens
cuagagacauuuggauaaa

SEQ ID NO: 1556857 - RNA, 19 nt, Homo sapiens
gcuagagacauuuggauaa

SEQ ID NO: 1556858 - RNA, 19 nt, Homo sapiens
gauguuguauggcuugaug

SEQ ID NO: 1556859 - RNA, 19 nt, Homo sapiens
gaaacucaccuugcauuau

SEQ ID NO: 1556860 - RNA, 19 nt, Homo sapiens
gaugauguuuccugugaug

SEQ ID NO: 1556861 - RNA, 19 nt, Homo sapiens
gaaacgcuucuacaggaua

SEQ ID NO: 1556862 - RNA, 19 nt, Homo sapiens
gaaaugagucaaauaucug

SEQ ID NO: 1556863 - RNA, 19 nt, Homo sapiens
gacaauaugugaccagaac

SEQ ID NO: 1556864 - RNA, 19 nt, Homo sapiens
ucaggucguuuagcacuua

SEQ ID NO: 1556865 - RNA, 19 nt, Homo sapiens
cagagaggaugugauugua

SEQ ID NO: 1556866 - RNA, 19 nt, Homo sapiens
gaagagauagacccauaau

SEQ ID NO: 1556867 - RNA, 19 nt, Homo sapiens
guuaauagcccugcuguau

SEQ ID NO: 1556868 - RNA, 19 nt, Homo sapiens
ggaaaugagucagcucucu

SEQ ID NO: 1556869 - RNA, 19 nt, Homo sapiens
gacagucgcugaaaucacu

SEQ ID NO: 1556870 - RNA, 19 nt, Homo sapiens
cagacugcgugucauuuaa

SEQ ID NO: 1556871 - RNA, 19 nt, Homo sapiens
ucgaugauguuuccuguga

SEQ ID NO: 1556872 - RNA, 19 nt, Homo sapiens
gaugacguuucuugcauug

SEQ ID NO: 1556873 - RNA, 19 nt, Homo sapiens
ggagaguggaggugaaauu

SEQ ID NO: 1556874 - RNA, 19 nt, Homo sapiens
uaggagaacagcuaaauug

SEQ ID NO: 1556875 - RNA, 19 nt, Homo sapiens
uaaagaggaagucaaguug

SEQ ID NO: 1556876 - RNA, 19 nt, Homo sapiens
ggaagagauagacccauaa

SEQ ID NO: 1556877 - RNA, 19 nt, Homo sapiens
ggaaacgcuucuacaggau

SEQ ID NO: 1556878 - RNA, 19 nt, Homo sapiens
gacuggagguguacuuuca

SEQ ID NO: 1556879 - RNA, 19 nt, Homo sapiens
gagaggaugugauuguaac

SEQ ID NO: 1556880 - RNA, 19 nt, Homo sapiens
guggaaagccuaugcaugu

SEQ ID NO: 1556881 - RNA, 19 nt, Homo sapiens
gauuggaggugaaauacca

SEQ ID NO: 1556882 - RNA, 19 nt, Homo sapiens
gugcuaaaccuaguaauga

SEQ ID NO: 1556883 - RNA, 19 nt, Homo sapiens
cagcugaugucguaugcaa

SEQ ID NO: 1556884 - RNA, 19 nt, Homo sapiens
gcuccugaauuccugcuuu

SEQ ID NO: 1556885 - RNA, 19 nt, Homo sapiens
cacggucucugcucacuuu

SEQ ID NO: 1556886 - RNA, 19 nt, Homo sapiens
cagagagccucauuucaca

SEQ ID NO: 1556887 - RNA, 19 nt, Homo sapiens
caugacagauggagcacaa

SEQ ID NO: 1556888 - RNA, 19 nt, Homo sapiens
ggguggaacuugaauacug

SEQ ID NO: 1556889 - RNA, 19 nt, Homo sapiens
caagaaagguggggaacua

SEQ ID NO: 1556890 - RNA, 19 nt, Homo sapiens
ugauaaagacuggugauaa

SEQ ID NO: 1556891 - RNA, 19 nt, Homo sapiens
ccaaugugcugugcagaga

SEQ ID NO: 1556892 - RNA, 19 nt, Homo sapiens
gcuaauggcuggggaauga

SEQ ID NO: 1556893 - RNA, 19 nt, Homo sapiens
gagauagacccauaaugau

SEQ ID NO: 1556894 - RNA, 19 nt, Homo sapiens
uaaggcagaucuggaccua

SEQ ID NO: 1556895 - RNA, 19 nt, Homo sapiens
gcauagaccucgugaagga

SEQ ID NO: 1556896 - RNA, 19 nt, Homo sapiens
gaucugagcuguaacacau

SEQ ID NO: 1556897 - RNA, 19 nt, Homo sapiens
gggaagagcuccugagaag

SEQ ID NO: 1556898 - RNA, 19 nt, Homo sapiens
ugagugagguguucgagua

SEQ ID NO: 1556899 - RNA, 19 nt, Homo sapiens
guacagcaauucaucaaag

SEQ ID NO: 1556900 - RNA, 19 nt, Homo sapiens
ggaucgaucugagcuguaa

SEQ ID NO: 1556901 - RNA, 19 nt, Homo sapiens
ugaaccagguggagucgua

SEQ ID NO: 1556902 - RNA, 19 nt, Homo sapiens
gggaggacuuugagagaga

SEQ ID NO: 1556903 - RNA, 19 nt, Homo sapiens
gaaggagagaucugacuga

SEQ ID NO: 1556904 - RNA, 19 nt, Homo sapiens
gagaaggacaggucaggaa

SEQ ID NO: 1556905 - RNA, 19 nt, Homo sapiens
ggauaugagugagguguuc

SEQ ID NO: 1556906 - RNA, 19 nt, Homo sapiens
ggaagaagaggaggaggaa

SEQ ID NO: 1556907 - RNA, 19 nt, Homo sapiens
ggaggaagaggauaugagu

SEQ ID NO: 1556908 - RNA, 19 nt, Homo sapiens
guacaucgcagagcagaga

SEQ ID NO: 1556909 - RNA, 19 nt, Homo sapiens
gcaugaacaccaaggaguu

SEQ ID NO: 1556910 - RNA, 19 nt, Homo sapiens
guacguaccuguguuugac

SEQ ID NO: 1556911 - RNA, 19 nt, Homo sapiens
gaauuucuuccaucauuuc

SEQ ID NO: 1556912 - RNA, 19 nt, Homo sapiens
gcaauucaucaaagacaug

SEQ ID NO: 1556913 - RNA, 19 nt, Homo sapiens
ucacgcgagucuucuugaa

SEQ ID NO: 1556914 - RNA, 19 nt, Homo sapiens
ucaacaucgucaucacuga

SEQ ID NO: 1556915 - RNA, 19 nt, Homo sapiens
ggaggucacgcgagucuuc

SEQ ID NO: 1556916 - RNA, 19 nt, Homo sapiens
ucagaagggaggacuuuga

SEQ ID NO: 1556917 - RNA, 19 nt, Homo sapiens
ggagcuaccaguacgugaa

SEQ ID NO: 1556918 - RNA, 19 nt, Homo sapiens
gaaggugcacgcccacauc

SEQ ID NO: 1556919 - RNA, 19 nt, Homo sapiens
uacagcaauucaucaaaga

SEQ ID NO: 1556920 - RNA, 19 nt, Homo sapiens
gaccuucagugcccggaau

SEQ ID NO: 1556921 - RNA, 19 nt, Homo sapiens
aggaagaggauaugaguga

SEQ ID NO: 1556922 - RNA, 19 nt, Homo sapiens
aagaagaggaggaggaaga

SEQ ID NO: 1556923 - RNA, 19 nt, Homo sapiens
cgaguacguaccuguguuu

SEQ ID NO: 1556924 - RNA, 19 nt, Homo sapiens
gggagcugcuggacaggau

SEQ ID NO: 1556925 - RNA, 19 nt, Homo sapiens
gugaugaggcugcauugug

SEQ ID NO: 1556926 - RNA, 19 nt, Homo sapiens
cagcuacagcgcauuguga

SEQ ID NO: 1556927 - RNA, 19 nt, Homo sapiens
gagcgacaccauccucauc

SEQ ID NO: 1556928 - RNA, 19 nt, Homo sapiens
gcaucaucuuccucuguga

SEQ ID NO: 1556929 - RNA, 19 nt, Homo sapiens
ggacugacuggaucgaucu

SEQ ID NO: 1556930 - RNA, 19 nt, Homo sapiens
ccaccagacccucuucuag

SEQ ID NO: 1556931 - RNA, 19 nt, Homo sapiens
ugaaggacccgcacagcau

SEQ ID NO: 1556932 - RNA, 19 nt, Homo sapiens
gguacagcaauucaucaaa

SEQ ID NO: 1556933 - RNA, 19 nt, Homo sapiens
uccaagcccugaggacuga

SEQ ID NO: 1556934 - RNA, 19 nt, Homo sapiens
caccagacccucuucuagu

SEQ ID NO: 1556935 - RNA, 19 nt, Homo sapiens
aaggacaggucaggaagga

SEQ ID NO: 1556936 - RNA, 19 nt, Homo sapiens
uggcauagaccucgugaag

SEQ ID NO: 1556937 - RNA, 19 nt, Homo sapiens
guugagauggcacugaaga

SEQ ID NO: 1556938 - RNA, 19 nt, Homo sapiens
uccuggagcuugaacuguu

SEQ ID NO: 1556939 - RNA, 19 nt, Homo sapiens
ggaggaggaagaggauaug

SEQ ID NO: 1556940 - RNA, 19 nt, Homo sapiens
uggugcggcucucggagua

SEQ ID NO: 1556941 - RNA, 19 nt, Homo sapiens
ccuggagcuugaacuguug

SEQ ID NO: 1556942 - RNA, 19 nt, Homo sapiens
gaggaggaagaggauauga

SEQ ID NO: 1556943 - RNA, 19 nt, Homo sapiens
cuucccagcuggagucauc

SEQ ID NO: 1556944 - RNA, 19 nt, Homo sapiens
ucgaguacguaccuguguu

SEQ ID NO: 1556945 - RNA, 19 nt, Homo sapiens
ggucacgcgagucuucuug

SEQ ID NO: 1556946 - RNA, 19 nt, Homo sapiens
accagacccucuucuagug

SEQ ID NO: 1556947 - RNA, 19 nt, Homo sapiens
cagcaucaucuuccucugu

SEQ ID NO: 1556948 - RNA, 19 nt, Homo sapiens
acaaguggagggagaggaa

SEQ ID NO: 1556949 - RNA, 19 nt, Homo sapiens
cagcaauucaucaaagaca

SEQ ID NO: 1556950 - RNA, 19 nt, Homo sapiens
gugcuggccucaggguuuc

SEQ ID NO: 1556951 - RNA, 19 nt, Homo sapiens
gugcggcucucggaguaug

SEQ ID NO: 1556952 - RNA, 19 nt, Homo sapiens
ggagcugcuggacaggaua

SEQ ID NO: 1556953 - RNA, 19 nt, Homo sapiens
ggacuucaggcuggcauag

SEQ ID NO: 1556954 - RNA, 19 nt, Homo sapiens
gagcuaccaguacgugaag

SEQ ID NO: 1556955 - RNA, 19 nt, Homo sapiens
cuauagcagugaggacaug

SEQ ID NO: 1556956 - RNA, 19 nt, Homo sapiens
ggguacagcaauucaucaa

SEQ ID NO: 1556957 - RNA, 19 nt, Homo sapiens
gucucucccucaggaauuu

SEQ ID NO: 1556958 - RNA, 19 nt, Homo sapiens
ggagucaucgaugccauuc

SEQ ID NO: 1556959 - RNA, 19 nt, Homo sapiens
uaccaguacgugaagcuaa

SEQ ID NO: 1556960 - RNA, 19 nt, Homo sapiens
gaaguaccaugcaacauug

SEQ ID NO: 1556961 - RNA, 19 nt, Homo sapiens
gaaauaaaguacugacucu

SEQ ID NO: 1556962 - RNA, 19 nt, Homo sapiens
ucaaagggcugcaaauuag

SEQ ID NO: 1556963 - RNA, 19 nt, Homo sapiens
caggguggauuucauguua

SEQ ID NO: 1556964 - RNA, 19 nt, Homo sapiens
gcuauuuccucuugaguuu

SEQ ID NO: 1556965 - RNA, 19 nt, Homo sapiens
ugacacagaugaaauaaag

SEQ ID NO: 1556966 - RNA, 19 nt, Homo sapiens
ggagaucgaugaacccaau

SEQ ID NO: 1556967 - RNA, 19 nt, Homo sapiens
caaccaaccuucggaauca

SEQ ID NO: 1556968 - RNA, 19 nt, Homo sapiens
gugcuaaugucaaugcuaa

SEQ ID NO: 1556969 - RNA, 19 nt, Homo sapiens
gaaagccuacucugcauuu

SEQ ID NO: 1556970 - RNA, 19 nt, Homo sapiens
uuacauaucuggguuucua

SEQ ID NO: 1556971 - RNA, 19 nt, Homo sapiens
gagcaaaccaucaucaguu

SEQ ID NO: 1556972 - RNA, 19 nt, Homo sapiens
ucaaugugcuggugaguug

SEQ ID NO: 1556973 - RNA, 19 nt, Homo sapiens
caaaccaucaucaguuaua

SEQ ID NO: 1556974 - RNA, 19 nt, Homo sapiens
gcuuggagcuacugguuaa

SEQ ID NO: 1556975 - RNA, 19 nt, Homo sapiens
gaaacaccaucucuuaaaa

SEQ ID NO: 1556976 - RNA, 19 nt, Homo sapiens
aaacacagcuuugcacauc

SEQ ID NO: 1556977 - RNA, 19 nt, Homo sapiens
gaagaaaccaaccaaccuu

SEQ ID NO: 1556978 - RNA, 19 nt, Homo sapiens
agauugaaguggugaagua

SEQ ID NO: 1556979 - RNA, 19 nt, Homo sapiens
aaugaaacaccaucucuua

SEQ ID NO: 1556980 - RNA, 19 nt, Homo sapiens
aguaagagaccaauucuaa

SEQ ID NO: 1556981 - RNA, 19 nt, Homo sapiens
ucacgaagcggcuccuuaa

SEQ ID NO: 1556982 - RNA, 19 nt, Homo sapiens
gaaaggaacauucgaaucc

SEQ ID NO: 1556983 - RNA, 19 nt, Homo sapiens
gaagugcguucccuacucu

SEQ ID NO: 1556984 - RNA, 19 nt, Homo sapiens
gcaugcugcugccuacgua

SEQ ID NO: 1556985 - RNA, 19 nt, Homo sapiens
ugaaacaccaucucuuaaa

SEQ ID NO: 1556986 - RNA, 19 nt, Homo sapiens
gaaacuaugggaagagguu

SEQ ID NO: 1556987 - RNA, 19 nt, Homo sapiens
cacuuuagaugacuacaaa

SEQ ID NO: 1556988 - RNA, 19 nt, Homo sapiens
agcaaaccaucaucaguua

SEQ ID NO: 1556989 - RNA, 19 nt, Homo sapiens
guacugacucuaagccuaa

SEQ ID NO: 1556990 - RNA, 19 nt, Homo sapiens
cgaagcggcuccuuaacug

SEQ ID NO: 1556991 - RNA, 19 nt, Homo sapiens
gauuucauguuaaguguuc

SEQ ID NO: 1556992 - RNA, 19 nt, Homo sapiens
agucauccauuaucaacua

SEQ ID NO: 1556993 - RNA, 19 nt, Homo sapiens
gcuuugcaaugauauaaga

SEQ ID NO: 1556994 - RNA, 19 nt, Homo sapiens
guaagagaccaauucuaaa

SEQ ID NO: 1556995 - RNA, 19 nt, Homo sapiens
guagaaugcuuugccacaa

SEQ ID NO: 1556996 - RNA, 19 nt, Homo sapiens
gagagcaggucaggcuuga

SEQ ID NO: 1556997 - RNA, 19 nt, Homo sapiens
ccuaggugcuugccuuuga

SEQ ID NO: 1556998 - RNA, 19 nt, Homo sapiens
cagcacccauccuuucuug

SEQ ID NO: 1556999 - RNA, 19 nt, Homo sapiens
agaaguaccaugcaacauu

SEQ ID NO: 1557000 - RNA, 19 nt, Homo sapiens
cagaugaaauaaaguacug

SEQ ID NO: 1557001 - RNA, 19 nt, Homo sapiens
caugucaccucaaauucaa

SEQ ID NO: 1557002 - RNA, 19 nt, Homo sapiens
caacauuguaccuauaguu

SEQ ID NO: 1557003 - RNA, 19 nt, Homo sapiens
cuauugagcuggugaaugc

SEQ ID NO: 1557004 - RNA, 19 nt, Homo sapiens
caagggagccagccugaau

SEQ ID NO: 1557005 - RNA, 19 nt, Homo sapiens
auuacuggcuuccuucaua

SEQ ID NO: 1557006 - RNA, 19 nt, Homo sapiens
caucaucaguuauauuagg

SEQ ID NO: 1557007 - RNA, 19 nt, Homo sapiens
ggaaucauuaauccuguuu

SEQ ID NO: 1557008 - RNA, 19 nt, Homo sapiens
gaagucagauuuucucaag

SEQ ID NO: 1557009 - RNA, 19 nt, Homo sapiens
gagcuacugguuaauaaug

SEQ ID NO: 1557010 - RNA, 19 nt, Homo sapiens
uggagcuacugguuaauaa

SEQ ID NO: 1557011 - RNA, 19 nt, Homo sapiens
agucaaacgugucaaaaua

SEQ ID NO: 1557012 - RNA, 19 nt, Homo sapiens
caacaggguggauuucaug

SEQ ID NO: 1557013 - RNA, 19 nt, Homo sapiens
caaagaagaaaccaaccaa

SEQ ID NO: 1557014 - RNA, 19 nt, Homo sapiens
gacauucacuuuagaugac

SEQ ID NO: 1557015 - RNA, 19 nt, Homo sapiens
gaggcgaacuccauugcau

SEQ ID NO: 1557016 - RNA, 19 nt, Homo sapiens
caagagaggcgaacuccau

SEQ ID NO: 1557017 - RNA, 19 nt, Homo sapiens
acuuacaacucuaacauga

SEQ ID NO: 1557018 - RNA, 19 nt, Homo sapiens
ucaaguagcaaagaagaaa

SEQ ID NO: 1557019 - RNA, 19 nt, Homo sapiens
ucgaugaacccaaugcuuu

SEQ ID NO: 1557020 - RNA, 19 nt, Homo sapiens
gcagaaggagaacaucaau

SEQ ID NO: 1557021 - RNA, 19 nt, Homo sapiens
cuagagaaguaccaugcaa

SEQ ID NO: 1557022 - RNA, 19 nt, Homo sapiens
caaguuuucugaauccuaa

SEQ ID NO: 1557023 - RNA, 19 nt, Homo sapiens
gccacaacauaucuaucua

SEQ ID NO: 1557024 - RNA, 19 nt, Homo sapiens
caugcaacauuguaccuau

SEQ ID NO: 1557025 - RNA, 19 nt, Homo sapiens
uaacaugagcaaaccauca

SEQ ID NO: 1557026 - RNA, 19 nt, Homo sapiens
gaugaggccgcaguucuuu

SEQ ID NO: 1557027 - RNA, 19 nt, Homo sapiens
agaugacacagaugaaaua

SEQ ID NO: 1557028 - RNA, 19 nt, Homo sapiens
ugaaauaaaccagcccauu

SEQ ID NO: 1557029 - RNA, 19 nt, Homo sapiens
ugucaugucaccucaaauu

SEQ ID NO: 1557030 - RNA, 19 nt, Homo sapiens
gcugcagucucgaccaaug

SEQ ID NO: 1557031 - RNA, 19 nt, Homo sapiens
guacacauucuaccuucaa

SEQ ID NO: 1557032 - RNA, 19 nt, Homo sapiens
gaugacacagaugaaauaa

SEQ ID NO: 1557033 - RNA, 19 nt, Homo sapiens
gcaaagaagaaaccaacca

SEQ ID NO: 1557034 - RNA, 19 nt, Homo sapiens
caaauuaguaagagaccaa

SEQ ID NO: 1557035 - RNA, 19 nt, Homo sapiens
ccacaacauaucuaucuau

SEQ ID NO: 1557036 - RNA, 19 nt, Homo sapiens
gaacauucgaauccuguca

SEQ ID NO: 1557037 - RNA, 19 nt, Homo sapiens
uauuuccucuugaguuuga

SEQ ID NO: 1557038 - RNA, 19 nt, Homo sapiens
cacuguaacucuccaauac

SEQ ID NO: 1557039 - RNA, 19 nt, Homo sapiens
caaaagaugacacagauga

SEQ ID NO: 1557040 - RNA, 19 nt, Homo sapiens
gauugcacaugagcagauu

SEQ ID NO: 1557041 - RNA, 19 nt, Homo sapiens
aucaaagggcugcaaauua

SEQ ID NO: 1557042 - RNA, 19 nt, Homo sapiens
gaagcggcuccuuaacuga

SEQ ID NO: 1557043 - RNA, 19 nt, Homo sapiens
gugauugaauuagaaagga

SEQ ID NO: 1557044 - RNA, 19 nt, Homo sapiens
ccaggaugcuguggcuauu

SEQ ID NO: 1557045 - RNA, 19 nt, Homo sapiens
gaccauccugggcaacaua

SEQ ID NO: 1557046 - RNA, 19 nt, Homo sapiens
agacauucacuuuagauga

SEQ ID NO: 1557047 - RNA, 19 nt, Homo sapiens
ccaacaggguggauuucau

SEQ ID NO: 1557048 - RNA, 19 nt, Homo sapiens
aaagggcugcaaauuagua

SEQ ID NO: 1557049 - RNA, 19 nt, Homo sapiens
aaucaaagggcugcaaauu

SEQ ID NO: 1557050 - RNA, 19 nt, Homo sapiens
ccugucaugucaccucaaa

SEQ ID NO: 1557051 - RNA, 19 nt, Homo sapiens
uuaggacgcugcagaaacu

SEQ ID NO: 1557052 - RNA, 19 nt, Homo sapiens
aauccuggcucccguguuc

SEQ ID NO: 1557053 - RNA, 19 nt, Homo sapiens
gccgagauguggaggaagu

SEQ ID NO: 1557054 - RNA, 19 nt, Homo sapiens
ugaaccugcuccucaacaa

SEQ ID NO: 1557055 - RNA, 19 nt, Homo sapiens
gugcauagugggcaucuug

SEQ ID NO: 1557056 - RNA, 19 nt, Homo sapiens
aaagaugacacagaugaaa

SEQ ID NO: 1557057 - RNA, 19 nt, Homo sapiens
gagcaggucaggcuugaag

SEQ ID NO: 1557058 - RNA, 19 nt, Homo sapiens
gaaacacagcuuugcacau

SEQ ID NO: 1557059 - RNA, 19 nt, Homo sapiens
gcacuuggagguccuaaaa

SEQ ID NO: 1557060 - RNA, 19 nt, Homo sapiens
gaacugcucuuagaaaugu

SEQ ID NO: 1557061 - RNA, 19 nt, Homo sapiens
gcacuuagcugccuacaac

SEQ ID NO: 1557062 - RNA, 19 nt, Homo sapiens
ggaacgagcugacaucaca

SEQ ID NO: 1557063 - RNA, 19 nt, Homo sapiens
gaacacggcccuccacuug

SEQ ID NO: 1557064 - RNA, 19 nt, Homo sapiens
gcagugagaagccuuaauu

SEQ ID NO: 1557065 - RNA, 19 nt, Homo sapiens
ggaauggucuagcuucugu

SEQ ID NO: 1557066 - RNA, 19 nt, Homo sapiens
ucacagaugucauggaugu

SEQ ID NO: 1557067 - RNA, 19 nt, Homo sapiens
gaaaugugcccucaugauc

SEQ ID NO: 1557068 - RNA, 19 nt, Homo sapiens
gaacagccgagauaccaaa

SEQ ID NO: 1557069 - RNA, 19 nt, Homo sapiens
gaaccucgaacugcucuua

SEQ ID NO: 1557070 - RNA, 19 nt, Homo sapiens
gcagaugccacuccacauu

SEQ ID NO: 1557071 - RNA, 19 nt, Homo sapiens
gcaagggccaugagaaaug

SEQ ID NO: 1557072 - RNA, 19 nt, Homo sapiens
ccacauugcugcccggaau

SEQ ID NO: 1557073 - RNA, 19 nt, Homo sapiens
gccgguggcuugauaucua

SEQ ID NO: 1557074 - RNA, 19 nt, Homo sapiens
gaacgccacugaccacacu

SEQ ID NO: 1557075 - RNA, 19 nt, Homo sapiens
gaagaggacgagccacuga

SEQ ID NO: 1557076 - RNA, 19 nt, Homo sapiens
caagacagcaccacagaga

SEQ ID NO: 1557077 - RNA, 19 nt, Homo sapiens
gaaaggauccacagcugau

SEQ ID NO: 1557078 - RNA, 19 nt, Homo sapiens
agucagcccuuugcacuua

SEQ ID NO: 1557079 - RNA, 19 nt, Homo sapiens
cucaagaacugcagcauug

SEQ ID NO: 1557080 - RNA, 19 nt, Homo sapiens
gaccuuggccuuaucaaug

SEQ ID NO: 1557081 - RNA, 19 nt, Homo sapiens
ccacuucuguacccuauca

SEQ ID NO: 1557082 - RNA, 19 nt, Homo sapiens
gaccgcugcuguggaauuu

SEQ ID NO: 1557083 - RNA, 19 nt, Homo sapiens
guacaucugcugcuagaga

SEQ ID NO: 1557084 - RNA, 19 nt, Homo sapiens
aagauugucuggaguuguu

SEQ ID NO: 1557085 - RNA, 19 nt, Homo sapiens
ggcuugauaucuaauucua

SEQ ID NO: 1557086 - RNA, 19 nt, Homo sapiens
aggcagaccuuacuguguu

SEQ ID NO: 1557087 - RNA, 19 nt, Homo sapiens
ccaaaaugauugcuaaaug

SEQ ID NO: 1557088 - RNA, 19 nt, Homo sapiens
aaacauuuagggcacuuua

SEQ ID NO: 1557089 - RNA, 19 nt, Homo sapiens
cggagacgcuggugaaucu

SEQ ID NO: 1557090 - RNA, 19 nt, Homo sapiens
caacagacagaaccucgaa

SEQ ID NO: 1557091 - RNA, 19 nt, Homo sapiens
caagggccaugagaaaugu

SEQ ID NO: 1557092 - RNA, 19 nt, Homo sapiens
ugucauggaugucuaugga

SEQ ID NO: 1557093 - RNA, 19 nt, Homo sapiens
uggucuagcuucuguggua

SEQ ID NO: 1557094 - RNA, 19 nt, Homo sapiens
uagcaagggccaugagaaa

SEQ ID NO: 1557095 - RNA, 19 nt, Homo sapiens
gcacugggccuccuacacu

SEQ ID NO: 1557096 - RNA, 19 nt, Homo sapiens
ccucugcccucaucaagga

SEQ ID NO: 1557097 - RNA, 19 nt, Homo sapiens
cagccgagauaccaaagga

SEQ ID NO: 1557098 - RNA, 19 nt, Homo sapiens
gcucaagaacugcagcauu

SEQ ID NO: 1557099 - RNA, 19 nt, Homo sapiens
gcacuaugcagccgccuau

SEQ ID NO: 1557100 - RNA, 19 nt, Homo sapiens
uaucaaugcuaccaacagu

SEQ ID NO: 1557101 - RNA, 19 nt, Homo sapiens
ugucuggaguuguuacuug

SEQ ID NO: 1557102 - RNA, 19 nt, Homo sapiens
gaauggccauguggacugu

SEQ ID NO: 1557103 - RNA, 19 nt, Homo sapiens
gcagcagugagaagccuua

SEQ ID NO: 1557104 - RNA, 19 nt, Homo sapiens
gcuucagccugcucaagaa

SEQ ID NO: 1557105 - RNA, 19 nt, Homo sapiens
ggaaaccccuucacuccuu

SEQ ID NO: 1557106 - RNA, 19 nt, Homo sapiens
cuggaguucuuacuggaua

SEQ ID NO: 1557107 - RNA, 19 nt, Homo sapiens
gagagcaccauuccaguca

SEQ ID NO: 1557108 - RNA, 19 nt, Homo sapiens
ucgaacugcucuuagaaau

SEQ ID NO: 1557109 - RNA, 19 nt, Homo sapiens
gcaucaagcugaggugaac

SEQ ID NO: 1557110 - RNA, 19 nt, Homo sapiens
gcuggugaaucuggacgua

SEQ ID NO: 1557111 - RNA, 19 nt, Homo sapiens
gagaaaugugcccucauga

SEQ ID NO: 1557112 - RNA, 19 nt, Homo sapiens
gugcagugauuaauaacca

SEQ ID NO: 1557113 - RNA, 19 nt, Homo sapiens
ggaccacgacgcauuugug

SEQ ID NO: 1557114 - RNA, 19 nt, Homo sapiens
ggacguaagggaccacaag

SEQ ID NO: 1557115 - RNA, 19 nt, Homo sapiens
guguacaucugcugcuaga

SEQ ID NO: 1557116 - RNA, 19 nt, Homo sapiens
ugccuggccuugauccuuu

SEQ ID NO: 1557117 - RNA, 19 nt, Homo sapiens
acacuggacaugaagauug

SEQ ID NO: 1557118 - RNA, 19 nt, Homo sapiens
uuaacugccuggaggaugu

SEQ ID NO: 1557119 - RNA, 19 nt, Homo sapiens
ccgguggcuugauaucuaa

SEQ ID NO: 1557120 - RNA, 19 nt, Homo sapiens
ggcagaaacccaagaccuu

SEQ ID NO: 1557121 - RNA, 19 nt, Homo sapiens
ggacaggcagggcuacaca

SEQ ID NO: 1557122 - RNA, 19 nt, Homo sapiens
gcccuccacuuggcuugua

SEQ ID NO: 1557123 - RNA, 19 nt, Homo sapiens
gugccaagauugugaacag

SEQ ID NO: 1557124 - RNA, 19 nt, Homo sapiens
cagaugucauggaugucua

SEQ ID NO: 1557125 - RNA, 19 nt, Homo sapiens
gcucuuagaaauguccuuu

SEQ ID NO: 1557126 - RNA, 19 nt, Homo sapiens
gauccccucuucuuccaua

SEQ ID NO: 1557127 - RNA, 19 nt, Homo sapiens
caacagugcgcugcagaug

SEQ ID NO: 1557128 - RNA, 19 nt, Homo sapiens
uuacuguguuggaugagaa

SEQ ID NO: 1557129 - RNA, 19 nt, Homo sapiens
ugaagauugucuggaguug

SEQ ID NO: 1557130 - RNA, 19 nt, Homo sapiens
gcuggaccacgacgcauuu

SEQ ID NO: 1557131 - RNA, 19 nt, Homo sapiens
caaaaugauugcuaaaugc

SEQ ID NO: 1557132 - RNA, 19 nt, Homo sapiens
guagcaagggccaugagaa

SEQ ID NO: 1557133 - RNA, 19 nt, Homo sapiens
cagaugccacuccacauug

SEQ ID NO: 1557134 - RNA, 19 nt, Homo sapiens
gaacacagcccguuuucgu

SEQ ID NO: 1557135 - RNA, 19 nt, Homo sapiens
aggcugcccuuuccacaga

SEQ ID NO: 1557136 - RNA, 19 nt, Homo sapiens
gugcugugccgagacuuua

SEQ ID NO: 1557137 - RNA, 19 nt, Homo sapiens
uacaucugcugcuagagaa

SEQ ID NO: 1557138 - RNA, 19 nt, Homo sapiens
cagacugccuggccuugau

SEQ ID NO: 1557139 - RNA, 19 nt, Homo sapiens
agacagcaccacagagaug

SEQ ID NO: 1557140 - RNA, 19 nt, Homo sapiens
uggaauuucugcuguaucg

SEQ ID NO: 1557141 - RNA, 19 nt, Homo sapiens
gaagccuuaauuucuggua

SEQ ID NO: 1557142 - RNA, 19 nt, Homo sapiens
ggcagaccuuacuguguug

SEQ ID NO: 1557143 - RNA, 19 nt, Homo sapiens
gucuggaguuguuacuuga

SEQ ID NO: 1557144 - RNA, 19 nt, Homo sapiens
cuccuacacuggacaugaa

SEQ ID NO: 1557145 - RNA, 19 nt, Homo sapiens
cgaacugcucuuagaaaug

SEQ ID NO: 1557146 - RNA, 19 nt, Homo sapiens
gcucugggugccaagauug

SEQ ID NO: 1557147 - RNA, 19 nt, Homo sapiens
gaaaccccuucacuccuuu

SEQ ID NO: 1557148 - RNA, 19 nt, Homo sapiens
gaagauugucuggaguugu

SEQ ID NO: 1557149 - RNA, 19 nt, Homo sapiens
cacuggacaugaagauugu

SEQ ID NO: 1557150 - RNA, 19 nt, Homo sapiens
cagugagaagccuuaauuu

SEQ ID NO: 1557151 - RNA, 19 nt, Homo sapiens
ucucuugguucccucuuuc

SEQ ID NO: 1557152 - RNA, 19 nt, Homo sapiens
agaaaugugcccucaugau

SEQ ID NO: 1557153 - RNA, 19 nt, Homo sapiens
guggcuugauaucuaauuc

SEQ ID NO: 1557154 - RNA, 19 nt, Homo sapiens
ggauguggagagcaccauu

SEQ ID NO: 1557155 - RNA, 19 nt, Homo sapiens
ccgcugcuguggaauuucu

SEQ ID NO: 1557156 - RNA, 19 nt, Homo sapiens
gauguggagagcaccauuc

SEQ ID NO: 1557157 - RNA, 19 nt, Homo sapiens
agugagaagccuuaauuuc

SEQ ID NO: 1557158 - RNA, 19 nt, Homo sapiens
ggcuguggaugaagaaggu

SEQ ID NO: 1557159 - RNA, 19 nt, Homo sapiens
ugaaggagucccgcaggaa

SEQ ID NO: 1557160 - RNA, 19 nt, Homo sapiens
gcacugauaucacguggau

SEQ ID NO: 1557161 - RNA, 19 nt, Homo sapiens
aaacagaacccaucccaaa

SEQ ID NO: 1557162 - RNA, 19 nt, Homo sapiens
gcccagcccugcuuuauca

SEQ ID NO: 1557163 - RNA, 19 nt, Homo sapiens
gaaugaggauugucugaac

SEQ ID NO: 1557164 - RNA, 19 nt, Homo sapiens
gcagugggauggcccuuca

SEQ ID NO: 1557165 - RNA, 19 nt, Homo sapiens
caacuuggauccggagaau

SEQ ID NO: 1557166 - RNA, 19 nt, Homo sapiens
ccugggaccucgucuacua

SEQ ID NO: 1557167 - RNA, 19 nt, Homo sapiens
gcagacaauuccacacaca

SEQ ID NO: 1557168 - RNA, 19 nt, Homo sapiens
ggacacagggccaguagga

SEQ ID NO: 1557169 - RNA, 19 nt, Homo sapiens
cuacacaaccucacugaug

SEQ ID NO: 1557170 - RNA, 19 nt, Homo sapiens
ggacagcaugggccucuga

SEQ ID NO: 1557171 - RNA, 19 nt, Homo sapiens
agcaggagcagaaccauua

SEQ ID NO: 1557172 - RNA, 19 nt, Homo sapiens
ccacgaacugggugacuuu

SEQ ID NO: 1557173 - RNA, 19 nt, Homo sapiens
ggugcugccuucucugaug

SEQ ID NO: 1557174 - RNA, 19 nt, Homo sapiens
cauaggugcugccuucucu

SEQ ID NO: 1557175 - RNA, 19 nt, Homo sapiens
aaacgaaggaaucucgaaa

SEQ ID NO: 1557176 - RNA, 19 nt, Homo sapiens
gcuaccgcaugcacaagaa

SEQ ID NO: 1557177 - RNA, 19 nt, Homo sapiens
gagcaggagcagaaccauu

SEQ ID NO: 1557178 - RNA, 19 nt, Homo sapiens
aguaggagcaauaggauuu

SEQ ID NO: 1557179 - RNA, 19 nt, Homo sapiens
gagauggucuacacaaccu

SEQ ID NO: 1557180 - RNA, 19 nt, Homo sapiens
ucuacuaucugcccugcuu

SEQ ID NO: 1557181 - RNA, 19 nt, Homo sapiens
uggcugaccaccugaauga

SEQ ID NO: 1557182 - RNA, 19 nt, Homo sapiens
acgaaggaaucucgaaaca

SEQ ID NO: 1557183 - RNA, 19 nt, Homo sapiens
gccaguaggagcaauagga

SEQ ID NO: 1557184 - RNA, 19 nt, Homo sapiens
ccacacacaggccacagaa

SEQ ID NO: 1557185 - RNA, 19 nt, Homo sapiens
gcaccaaggccacagucau

SEQ ID NO: 1557186 - RNA, 19 nt, Homo sapiens
ucucgaaacacgcaacuug

SEQ ID NO: 1557187 - RNA, 19 nt, Homo sapiens
cggccucaguaccaccuua

SEQ ID NO: 1557188 - RNA, 19 nt, Homo sapiens
gggagauggucuacacaac

SEQ ID NO: 1557189 - RNA, 19 nt, Homo sapiens
cuacagcaaggccuaauag

SEQ ID NO: 1557190 - RNA, 19 nt, Homo sapiens
caccaaggccacagucaug

SEQ ID NO: 1557191 - RNA, 19 nt, Homo sapiens
agucagggcuguccuuucg

SEQ ID NO: 1557192 - RNA, 19 nt, Homo sapiens
gcaacuuggauccggagaa

SEQ ID NO: 1557193 - RNA, 19 nt, Homo sapiens
ccaccugaaugaggauugu

SEQ ID NO: 1557194 - RNA, 19 nt, Homo sapiens
acagaacccugagcugagu

SEQ ID NO: 1557195 - RNA, 19 nt, Homo sapiens
ugaaugaggauugucugaa

SEQ ID NO: 1557196 - RNA, 19 nt, Homo sapiens
cgaaacacgcaacuuggau

SEQ ID NO: 1557197 - RNA, 19 nt, Homo sapiens
cagcccugcuuuaucagau

SEQ ID NO: 1557198 - RNA, 19 nt, Homo sapiens
ggccucaugcuugccauaa

SEQ ID NO: 1557199 - RNA, 19 nt, Homo sapiens
gcggugggcacucuuugug

SEQ ID NO: 1557200 - RNA, 19 nt, Homo sapiens
ccaguaggagcaauaggau

SEQ ID NO: 1557201 - RNA, 19 nt, Homo sapiens
gggagaauaggagccagaa

SEQ ID NO: 1557202 - RNA, 19 nt, Homo sapiens
gaacacaggucuggaagaa

SEQ ID NO: 1557203 - RNA, 19 nt, Homo sapiens
gaagaaaggagccaucuau

SEQ ID NO: 1557204 - RNA, 19 nt, Homo sapiens
guggaaaggugauaagaaa

SEQ ID NO: 1557205 - RNA, 19 nt, Homo sapiens
ggagauugaugccagagaa

SEQ ID NO: 1557206 - RNA, 19 nt, Homo sapiens
ggucauuucuugccaauag

SEQ ID NO: 1557207 - RNA, 19 nt, Homo sapiens
cacaaacgcuucaggagaa

SEQ ID NO: 1557208 - RNA, 19 nt, Homo sapiens
gaaaggagccaucuaugag

SEQ ID NO: 1557209 - RNA, 19 nt, Homo sapiens
acacaggucuggaagaaga

SEQ ID NO: 1557210 - RNA, 19 nt, Homo sapiens
ggaaaggugauaagaaauc

SEQ ID NO: 1557211 - RNA, 19 nt, Homo sapiens
gaaauucaagccuguguca

SEQ ID NO: 1557212 - RNA, 19 nt, Homo sapiens
gaagacagaggaaggagau

SEQ ID NO: 1557213 - RNA, 19 nt, Homo sapiens
ggaaggacaacgugaaaca

SEQ ID NO: 1557214 - RNA, 19 nt, Homo sapiens
gaaugcaugagaauaaaga

SEQ ID NO: 1557215 - RNA, 19 nt, Homo sapiens
gacccaaggaguauuauga

SEQ ID NO: 1557216 - RNA, 19 nt, Homo sapiens
agaaaggagccaucuauga

SEQ ID NO: 1557217 - RNA, 19 nt, Homo sapiens
gugauaagaaaucggguua

SEQ ID NO: 1557218 - RNA, 19 nt, Homo sapiens
gaaaggugauaagaaaucg

SEQ ID NO: 1557219 - RNA, 19 nt, Homo sapiens
ggaaagugcaggagagucu

SEQ ID NO: 1557220 - RNA, 19 nt, Homo sapiens
gaauggcgacuacuaugug

SEQ ID NO: 1557221 - RNA, 19 nt, Homo sapiens
uggaaugcaugagaauaaa

SEQ ID NO: 1557222 - RNA, 19 nt, Homo sapiens
gacagaggaaggagauuga

SEQ ID NO: 1557223 - RNA, 19 nt, Homo sapiens
gguggaaaggugauaagaa

SEQ ID NO: 1557224 - RNA, 19 nt, Homo sapiens
ccaccaugccagucucuaa

SEQ ID NO: 1557225 - RNA, 19 nt, Homo sapiens
gaaagugcaggagagucua

SEQ ID NO: 1557226 - RNA, 19 nt, Homo sapiens
gugaaacacgggaaaggaa

SEQ ID NO: 1557227 - RNA, 19 nt, Homo sapiens
ccagguauacgcugugaau

SEQ ID NO: 1557228 - RNA, 19 nt, Homo sapiens
cuggaaugcaugagaauaa

SEQ ID NO: 1557229 - RNA, 19 nt, Homo sapiens
gaaacacgggaaaggaaca

SEQ ID NO: 1557230 - RNA, 19 nt, Homo sapiens
ggaacacaggucuggaaga

SEQ ID NO: 1557231 - RNA, 19 nt, Homo sapiens
ccucgggacccucuucauu

SEQ ID NO: 1557232 - RNA, 19 nt, Homo sapiens
gagaaauucaagccugugu

SEQ ID NO: 1557233 - RNA, 19 nt, Homo sapiens
aaacgcuucaggagaaauu

SEQ ID NO: 1557234 - RNA, 19 nt, Homo sapiens
gggacccucuucauucucu

SEQ ID NO: 1557235 - RNA, 19 nt, Homo sapiens
guggaaggacaacgugaaa

SEQ ID NO: 1557236 - RNA, 19 nt, Homo sapiens
acaaacgcuucaggagaaa

SEQ ID NO: 1557237 - RNA, 19 nt, Homo sapiens
cagcaacggcgacaucuac

SEQ ID NO: 1557238 - RNA, 19 nt, Homo sapiens
ggaaugcaugagaauaaag

SEQ ID NO: 1557239 - RNA, 19 nt, Homo sapiens
ugaauggcgacuacuaugu

SEQ ID NO: 1557240 - RNA, 19 nt, Homo sapiens
gugaauggcgacuacuaug

SEQ ID NO: 1557241 - RNA, 19 nt, Homo sapiens
agacagaggaaggagauug

SEQ ID NO: 1557242 - RNA, 19 nt, Homo sapiens
ccaugccagucucuaagug

SEQ ID NO: 1557243 - RNA, 19 nt, Homo sapiens
gaucucauccuggaaugca

SEQ ID NO: 1557244 - RNA, 19 nt, Homo sapiens
gacagugggagaacgacaa

SEQ ID NO: 1557245 - RNA, 19 nt, Homo sapiens
ggacccaaggaguauuaug

SEQ ID NO: 1557246 - RNA, 19 nt, Homo sapiens
ucggacccaaggaguauua

SEQ ID NO: 1557247 - RNA, 19 nt, Homo sapiens
agaagaaaggagccaucua

SEQ ID NO: 1557248 - RNA, 19 nt, Homo sapiens
agcacugggucauuucuug

SEQ ID NO: 1557249 - RNA, 19 nt, Homo sapiens
gcaacggcgacaucuacga

SEQ ID NO: 1557250 - RNA, 19 nt, Homo sapiens
uucauucucugaucucauc

SEQ ID NO: 1557251 - RNA, 19 nt, Homo sapiens
ccucuucauucucugaucu

SEQ ID NO: 1557252 - RNA, 19 nt, Homo sapiens
uaaggaagcugaaauggua

SEQ ID NO: 1557253 - RNA, 19 nt, Homo sapiens
gaaguugacuggagagaga

SEQ ID NO: 1557254 - RNA, 19 nt, Homo sapiens
gaagauuaguguauuagug

SEQ ID NO: 1557255 - RNA, 19 nt, Homo sapiens
gaaaugagaauguguaagu

SEQ ID NO: 1557256 - RNA, 19 nt, Homo sapiens
guaaguggauuggaaguuu

SEQ ID NO: 1557257 - RNA, 19 nt, Homo sapiens
cagaaaugcuugagaaaug

SEQ ID NO: 1557258 - RNA, 19 nt, Homo sapiens
ggagagagauaaacaaacu

SEQ ID NO: 1557259 - RNA, 19 nt, Homo sapiens
gaggagacucuguaauuua

SEQ ID NO: 1557260 - RNA, 19 nt, Homo sapiens
uaacgaagccaaucaaaga

SEQ ID NO: 1557261 - RNA, 19 nt, Homo sapiens
gcagagcccucagagauga

SEQ ID NO: 1557262 - RNA, 19 nt, Homo sapiens
ggaaauggcagaaaugcuu

SEQ ID NO: 1557263 - RNA, 19 nt, Homo sapiens
uaaguggauuggaaguuua

SEQ ID NO: 1557264 - RNA, 19 nt, Homo sapiens
gcuccacacuucuuuggua

SEQ ID NO: 1557265 - RNA, 19 nt, Homo sapiens
ugaggagacucuguaauuu

SEQ ID NO: 1557266 - RNA, 19 nt, Homo sapiens
gagcagcgcagccacagua

SEQ ID NO: 1557267 - RNA, 19 nt, Homo sapiens
gaagggcaaaguauuauug

SEQ ID NO: 1557268 - RNA, 19 nt, Homo sapiens
uaacaggcaucgaacugaa

SEQ ID NO: 1557269 - RNA, 19 nt, Homo sapiens
caaccaacguaaaccugua

SEQ ID NO: 1557270 - RNA, 19 nt, Homo sapiens
uaaacaaacucccagucaa

SEQ ID NO: 1557271 - RNA, 19 nt, Homo sapiens
gcaacagaguuuccauugu

SEQ ID NO: 1557272 - RNA, 19 nt, Homo sapiens
gcaucgaacugaaagaauc

SEQ ID NO: 1557273 - RNA, 19 nt, Homo sapiens
caagauuuccuccauuaaa

SEQ ID NO: 1557274 - RNA, 19 nt, Homo sapiens
ggccaaugcugcccuaaug

SEQ ID NO: 1557275 - RNA, 19 nt, Homo sapiens
gguccuuggugcaguauuu

SEQ ID NO: 1557276 - RNA, 19 nt, Homo sapiens
ccacacuucuuugguagua

SEQ ID NO: 1557277 - RNA, 19 nt, Homo sapiens
uguaagaucccgccaagua

SEQ ID NO: 1557278 - RNA, 19 nt, Homo sapiens
gaccaacagugaagauuag

SEQ ID NO: 1557279 - RNA, 19 nt, Homo sapiens
ggccuacucucacuccuuu

SEQ ID NO: 1557280 - RNA, 19 nt, Homo sapiens
aggagacucuguaauuuaa

SEQ ID NO: 1557281 - RNA, 19 nt, Homo sapiens
ugacaugguugcugguuug

SEQ ID NO: 1557282 - RNA, 19 nt, Homo sapiens
gcaguuaacaggcaucgaa

SEQ ID NO: 1557283 - RNA, 19 nt, Homo sapiens
gcuguuugcuguacauaga

SEQ ID NO: 1557284 - RNA, 19 nt, Homo sapiens
gcccagaguucuuuuauuu

SEQ ID NO: 1557285 - RNA, 19 nt, Homo sapiens
aauaaaggguuacgucaau

SEQ ID NO: 1557286 - RNA, 19 nt, Homo sapiens
uaccauaaaugcugcuauu

SEQ ID NO: 1557287 - RNA, 19 nt, Homo sapiens
gacgagggcuggucuccuu

SEQ ID NO: 1557288 - RNA, 19 nt, Homo sapiens
gaagccaccuccgcuguau

SEQ ID NO: 1557289 - RNA, 19 nt, Homo sapiens
cauaaaugcugcuauucug

SEQ ID NO: 1557290 - RNA, 19 nt, Homo sapiens
guugugaggcuuuaacuaa

SEQ ID NO: 1557291 - RNA, 19 nt, Homo sapiens
ggagugugguccagugguu

SEQ ID NO: 1557292 - RNA, 19 nt, Homo sapiens
accaagauuuccuccauua

SEQ ID NO: 1557293 - RNA, 19 nt, Homo sapiens
ggaauagagggaagagaaa

SEQ ID NO: 1557294 - RNA, 19 nt, Homo sapiens
gggaauagagggaagagaa

SEQ ID NO: 1557295 - RNA, 19 nt, Homo sapiens
aaacaaacucccagucaaa

SEQ ID NO: 1557296 - RNA, 19 nt, Homo sapiens
uggcagaaaugcuugagaa

SEQ ID NO: 1557297 - RNA, 19 nt, Homo sapiens
ggauuggaaguuuauagua

SEQ ID NO: 1557298 - RNA, 19 nt, Homo sapiens
gagaaaugagaauguguaa

SEQ ID NO: 1557299 - RNA, 19 nt, Homo sapiens
ggauaauaauacugaccua

SEQ ID NO: 1557300 - RNA, 19 nt, Homo sapiens
gagaauguguaaguggauu

SEQ ID NO: 1557301 - RNA, 19 nt, Homo sapiens
agaaaugcuugagaaauga

SEQ ID NO: 1557302 - RNA, 19 nt, Homo sapiens
gcucugugcuuucuuggau

SEQ ID NO: 1557303 - RNA, 19 nt, Homo sapiens
gaugugugaugcuguuaau

SEQ ID NO: 1557304 - RNA, 19 nt, Homo sapiens
gcagaaaugcuugagaaau

SEQ ID NO: 1557305 - RNA, 19 nt, Homo sapiens
caggcugucuccucaguaa

SEQ ID NO: 1557306 - RNA, 19 nt, Homo sapiens
uaaugaugccucuuucuuu

SEQ ID NO: 1557307 - RNA, 19 nt, Homo sapiens
gcuggucuccuucacauuu

SEQ ID NO: 1557308 - RNA, 19 nt, Homo sapiens
aaagaugugugaugcuguu

SEQ ID NO: 1557309 - RNA, 19 nt, Homo sapiens
uaacacaugggccuuggua

SEQ ID NO: 1557310 - RNA, 19 nt, Homo sapiens
guaaugaugccucuuucuu

SEQ ID NO: 1557311 - RNA, 19 nt, Homo sapiens
ggccaugucuccugguuca

SEQ ID NO: 1557312 - RNA, 19 nt, Homo sapiens
ucaggaggaucucgaagug

SEQ ID NO: 1557313 - RNA, 19 nt, Homo sapiens
aaaccucucuucaccuaau

SEQ ID NO: 1557314 - RNA, 19 nt, Homo sapiens
cuuguucccuguucuguuu

SEQ ID NO: 1557315 - RNA, 19 nt, Homo sapiens
gaauguauauagguaaagg

SEQ ID NO: 1557316 - RNA, 19 nt, Homo sapiens
uaaaaccucucuucaccua

SEQ ID NO: 1557317 - RNA, 19 nt, Homo sapiens
agaccaacagugaagauua

SEQ ID NO: 1557318 - RNA, 19 nt, Homo sapiens
gagacucuguaauuuaaag

SEQ ID NO: 1557319 - RNA, 19 nt, Homo sapiens
caccuccgcuguauuugaa

SEQ ID NO: 1557320 - RNA, 19 nt, Homo sapiens
cagccagccucauaggaaa

SEQ ID NO: 1557321 - RNA, 19 nt, Homo sapiens
ugagaaaugagaaugugua

SEQ ID NO: 1557322 - RNA, 19 nt, Homo sapiens
ggaagggcaaaguauuauu

SEQ ID NO: 1557323 - RNA, 19 nt, Homo sapiens
gauucccuuuccaagauua

SEQ ID NO: 1557324 - RNA, 19 nt, Homo sapiens
caacagugaagauuagugu

SEQ ID NO: 1557325 - RNA, 19 nt, Homo sapiens
ccagguccuuggugcagua

SEQ ID NO: 1557326 - RNA, 19 nt, Homo sapiens
ggauucccuuuccaagauu

SEQ ID NO: 1557327 - RNA, 19 nt, Homo sapiens
caugguugcugguuugugu

SEQ ID NO: 1557328 - RNA, 19 nt, Homo sapiens
ugugugaugcuguuaauaa

SEQ ID NO: 1557329 - RNA, 19 nt, Homo sapiens
caccaucaccagcaguuua

SEQ ID NO: 1557330 - RNA, 19 nt, Homo sapiens
acacuucuuugguaguaaa

SEQ ID NO: 1557331 - RNA, 19 nt, Homo sapiens
gguuugugauuauucaaga

SEQ ID NO: 1557332 - RNA, 19 nt, Homo sapiens
aaggagagauuggaagaga

SEQ ID NO: 1557333 - RNA, 19 nt, Homo sapiens
gcccuaaugagacgugaua

SEQ ID NO: 1557334 - RNA, 19 nt, Homo sapiens
gggcuggucuccuucacau

SEQ ID NO: 1557335 - RNA, 19 nt, Homo sapiens
cagugaagauuaguguauu

SEQ ID NO: 1557336 - RNA, 19 nt, Homo sapiens
uuaaccuccuuguugcuua

SEQ ID NO: 1557337 - RNA, 19 nt, Homo sapiens
ggacuuaaggaagcugaaa

SEQ ID NO: 1557338 - RNA, 19 nt, Homo sapiens
gcuagggaagggcaaagua

SEQ ID NO: 1557339 - RNA, 19 nt, Homo sapiens
gugcuuagaggcccauaaa

SEQ ID NO: 1557340 - RNA, 19 nt, Homo sapiens
caauaaaggguuacgucaa

SEQ ID NO: 1557341 - RNA, 19 nt, Homo sapiens
gaauagagggaagagaaau

SEQ ID NO: 1557342 - RNA, 19 nt, Homo sapiens
ggaugaggagacucuguaa

SEQ ID NO: 1557343 - RNA, 19 nt, Homo sapiens
agggaagggcaaaguauua

SEQ ID NO: 1557344 - RNA, 19 nt, Homo sapiens
ucagcucugugcuuucuug

SEQ ID NO: 1557345 - RNA, 19 nt, Homo sapiens
ucugagaucuaaccguuuc

SEQ ID NO: 1557346 - RNA, 19 nt, Homo sapiens
caaaggggcucucgcaaag

SEQ ID NO: 1557347 - RNA, 19 nt, Homo sapiens
cuucuuugguaguaaauga

SEQ ID NO: 1557348 - RNA, 19 nt, Homo sapiens
uuaccaagauuuccuccau

SEQ ID NO: 1557349 - RNA, 19 nt, Homo sapiens
cugggcaucuucuguaaug

SEQ ID NO: 1557350 - RNA, 19 nt, Homo sapiens
uaagaaggagagauuggaa

SEQ ID NO: 1557351 - RNA, 19 nt, Homo sapiens
gggcauagugaugagauuu

SEQ ID NO: 1557352 - RNA, 19 nt, Homo sapiens
ggacgaaccuuagagauca

SEQ ID NO: 1557353 - RNA, 19 nt, Homo sapiens
gaaaaccccuuaacaguga

SEQ ID NO: 1557354 - RNA, 19 nt, Homo sapiens
ccagacaacuuacgggauu

SEQ ID NO: 1557355 - RNA, 19 nt, Homo sapiens
ccagacugcuuaugacaaa

SEQ ID NO: 1557356 - RNA, 19 nt, Homo sapiens
caauuuaacugcacauucu

SEQ ID NO: 1557357 - RNA, 19 nt, Homo sapiens
gccaagaguuuaauugcaa

SEQ ID NO: 1557358 - RNA, 19 nt, Homo sapiens
ggaguggagucccaaacuu

SEQ ID NO: 1557359 - RNA, 19 nt, Homo sapiens
gaaccuuagagaucacuua

SEQ ID NO: 1557360 - RNA, 19 nt, Homo sapiens
uaacugcacauucucaauu

SEQ ID NO: 1557361 - RNA, 19 nt, Homo sapiens
aguuagggcuugucagaua

SEQ ID NO: 1557362 - RNA, 19 nt, Homo sapiens
ggaauggagggaaaugaaa

SEQ ID NO: 1557363 - RNA, 19 nt, Homo sapiens
gcaacccuaucagccuuua

SEQ ID NO: 1557364 - RNA, 19 nt, Homo sapiens
ggcagcaacucauaaagau

SEQ ID NO: 1557365 - RNA, 19 nt, Homo sapiens
cuuaagcuaucacgaugua

SEQ ID NO: 1557366 - RNA, 19 nt, Homo sapiens
aaacagcagccaaggcaua

SEQ ID NO: 1557367 - RNA, 19 nt, Homo sapiens
cauguuuaccuacaacuua

SEQ ID NO: 1557368 - RNA, 19 nt, Homo sapiens
caacuuagaauugucuuug

SEQ ID NO: 1557369 - RNA, 19 nt, Homo sapiens
guuagggcuugucagauaa

SEQ ID NO: 1557370 - RNA, 19 nt, Homo sapiens
cagcaacucauaaagauau

SEQ ID NO: 1557371 - RNA, 19 nt, Homo sapiens
gcagcaacucauaaagaua

SEQ ID NO: 1557372 - RNA, 19 nt, Homo sapiens
gaauucccguucagcucua

SEQ ID NO: 1557373 - RNA, 19 nt, Homo sapiens
ccaagaguuuaauugcaaa

SEQ ID NO: 1557374 - RNA, 19 nt, Homo sapiens
cggcacagcccgcuuuaaa

SEQ ID NO: 1557375 - RNA, 19 nt, Homo sapiens
gaguggagucccaaacuuu

SEQ ID NO: 1557376 - RNA, 19 nt, Homo sapiens
guaguuagggcuugucaga

SEQ ID NO: 1557377 - RNA, 19 nt, Homo sapiens
cagcaaggacacaaccaua

SEQ ID NO: 1557378 - RNA, 19 nt, Homo sapiens
ugaaaagcauguuuaccua

SEQ ID NO: 1557379 - RNA, 19 nt, Homo sapiens
ggccaagaguuuaauugca

SEQ ID NO: 1557380 - RNA, 19 nt, Homo sapiens
gcacagcccgcuuuaaacg

SEQ ID NO: 1557381 - RNA, 19 nt, Homo sapiens
aguaaggaauggagggaaa

SEQ ID NO: 1557382 - RNA, 19 nt, Homo sapiens
aauacaggacgcccaguua

SEQ ID NO: 1557383 - RNA, 19 nt, Homo sapiens
agagggccguggucuagaa

SEQ ID NO: 1557384 - RNA, 19 nt, Homo sapiens
gggcuugucagauaaaaua

SEQ ID NO: 1557385 - RNA, 19 nt, Homo sapiens
gaaaacggaacaaacgaaa

SEQ ID NO: 1557386 - RNA, 19 nt, Homo sapiens
gggccguggucuagaacaa

SEQ ID NO: 1557387 - RNA, 19 nt, Homo sapiens
uaaccaguguuuuggcaua

SEQ ID NO: 1557388 - RNA, 19 nt, Homo sapiens
ccuaagcggacacguugua

SEQ ID NO: 1557389 - RNA, 19 nt, Homo sapiens
ggaaaugaaaagcauguuu

SEQ ID NO: 1557390 - RNA, 19 nt, Homo sapiens
aaauccagacugcuuauga

SEQ ID NO: 1557391 - RNA, 19 nt, Homo sapiens
aacugcacauucucaauuu

SEQ ID NO: 1557392 - RNA, 19 nt, Homo sapiens
ggccgugguuugaaguuuc

SEQ ID NO: 1557393 - RNA, 19 nt, Homo sapiens
uaccuacaacuuagaauug

SEQ ID NO: 1557394 - RNA, 19 nt, Homo sapiens
uuucagauaaccaguguuu

SEQ ID NO: 1557395 - RNA, 19 nt, Homo sapiens
gcagaaaacaggcgggaaa

SEQ ID NO: 1557396 - RNA, 19 nt, Homo sapiens
ccaauuuaacugcacauuc

SEQ ID NO: 1557397 - RNA, 19 nt, Homo sapiens
auacaggacgcccaguuaa

SEQ ID NO: 1557398 - RNA, 19 nt, Homo sapiens
gcaccuccuuucccaacca

SEQ ID NO: 1557399 - RNA, 19 nt, Homo sapiens
uaagcuaucacgauguaau

SEQ ID NO: 1557400 - RNA, 19 nt, Homo sapiens
uggcagcaacucauaaaga

SEQ ID NO: 1557401 - RNA, 19 nt, Homo sapiens
aaagcauguuuaccuacaa

SEQ ID NO: 1557402 - RNA, 19 nt, Homo sapiens
caggacgcccaguuaaauu

SEQ ID NO: 1557403 - RNA, 19 nt, Homo sapiens
ggagggaaaugaaaagcau

SEQ ID NO: 1557404 - RNA, 19 nt, Homo sapiens
cagacaacuuacgggauuu

SEQ ID NO: 1557405 - RNA, 19 nt, Homo sapiens
uaagccaaguuagggagaa

SEQ ID NO: 1557406 - RNA, 19 nt, Homo sapiens
cgugcuacauuccgcagaa

SEQ ID NO: 1557407 - RNA, 19 nt, Homo sapiens
uaauucccuuucuggcaaa

SEQ ID NO: 1557408 - RNA, 19 nt, Homo sapiens
gcauguuuaccuacaacuu

SEQ ID NO: 1557409 - RNA, 19 nt, Homo sapiens
gaaggcugacugccaugga

SEQ ID NO: 1557410 - RNA, 19 nt, Homo sapiens
gaauggagggaaaugaaaa

SEQ ID NO: 1557411 - RNA, 19 nt, Homo sapiens
uacaggacgcccaguuaaa

SEQ ID NO: 1557412 - RNA, 19 nt, Homo sapiens
gugcuacauuccgcagaaa

SEQ ID NO: 1557413 - RNA, 19 nt, Homo sapiens
uggcugccgugcuacauuc

SEQ ID NO: 1557414 - RNA, 19 nt, Homo sapiens
ucagcgugcuaccagaaau

SEQ ID NO: 1557415 - RNA, 19 nt, Homo sapiens
acaggacgcccaguuaaau

SEQ ID NO: 1557416 - RNA, 19 nt, Homo sapiens
aagcuaucacgauguaauu

SEQ ID NO: 1557417 - RNA, 19 nt, Homo sapiens
ucagauaaccaguguuuug

SEQ ID NO: 1557418 - RNA, 19 nt, Homo sapiens
caaggacacaaccauacga

SEQ ID NO: 1557419 - RNA, 19 nt, Homo sapiens
gcaaggacacaaccauacg

SEQ ID NO: 1557420 - RNA, 19 nt, Homo sapiens
gaaaauccagacugcuuau

SEQ ID NO: 1557421 - RNA, 19 nt, Homo sapiens
ugaaaauccagacugcuua

SEQ ID NO: 1557422 - RNA, 19 nt, Homo sapiens
aaauacaggacgcccaguu

SEQ ID NO: 1557423 - RNA, 19 nt, Homo sapiens
agaaguaguuagggcuugu

SEQ ID NO: 1557424 - RNA, 19 nt, Homo sapiens
ggacgcccaguuaaauugg

SEQ ID NO: 1557425 - RNA, 19 nt, Homo sapiens
aaccuuagagaucacuuaa

SEQ ID NO: 1557426 - RNA, 19 nt, Homo sapiens
aauuucagauaaccagugu

SEQ ID NO: 1557427 - RNA, 19 nt, Homo sapiens
gauuccacgucaccagagu

SEQ ID NO: 1557428 - RNA, 19 nt, Homo sapiens
cggacgaaccuuagagauc

SEQ ID NO: 1557429 - RNA, 19 nt, Homo sapiens
gaaggacuguggaugauua

SEQ ID NO: 1557430 - RNA, 19 nt, Homo sapiens
gaauagaaccucuuaauga

SEQ ID NO: 1557431 - RNA, 19 nt, Homo sapiens
gcacugaaaugggacuuua

SEQ ID NO: 1557432 - RNA, 19 nt, Homo sapiens
gaagaggcaugguguguug

SEQ ID NO: 1557433 - RNA, 19 nt, Homo sapiens
gaauuugacuucauggaaa

SEQ ID NO: 1557434 - RNA, 19 nt, Homo sapiens
gccagaaucuuaagguaua

SEQ ID NO: 1557435 - RNA, 19 nt, Homo sapiens
caacugggaggucuuauua

SEQ ID NO: 1557436 - RNA, 19 nt, Homo sapiens
ccaaagaaguaagagauaa

SEQ ID NO: 1557437 - RNA, 19 nt, Homo sapiens
gaaaacagcuccuugaaca

SEQ ID NO: 1557438 - RNA, 19 nt, Homo sapiens
ccaccauacuccuugauua

SEQ ID NO: 1557439 - RNA, 19 nt, Homo sapiens
gagauaaauuguuggaguu

SEQ ID NO: 1557440 - RNA, 19 nt, Homo sapiens
caaagcggcugcaaucuuc

SEQ ID NO: 1557441 - RNA, 19 nt, Homo sapiens
ggaguuacaugugaauuau

SEQ ID NO: 1557442 - RNA, 19 nt, Homo sapiens
gagcauaauaggagaauuu

SEQ ID NO: 1557443 - RNA, 19 nt, Homo sapiens
gaaccaagcaaauuucaga

SEQ ID NO: 1557444 - RNA, 19 nt, Homo sapiens
uuacgaagaugcagacuug

SEQ ID NO: 1557445 - RNA, 19 nt, Homo sapiens
ucaaagcugugaaggauug

SEQ ID NO: 1557446 - RNA, 19 nt, Homo sapiens
cguaaucaauggagcauaa

SEQ ID NO: 1557447 - RNA, 19 nt, Homo sapiens
uguuauggcuuccuugaua

SEQ ID NO: 1557448 - RNA, 19 nt, Homo sapiens
ccaagcaaauuucagaaga

SEQ ID NO: 1557449 - RNA, 19 nt, Homo sapiens
uaacagugaugucaauaca

SEQ ID NO: 1557450 - RNA, 19 nt, Homo sapiens
ggcaauaauucuaaagaga

SEQ ID NO: 1557451 - RNA, 19 nt, Homo sapiens
ccauguauguugugggaua

SEQ ID NO: 1557452 - RNA, 19 nt, Homo sapiens
gcaguaugcuugaaaucug

SEQ ID NO: 1557453 - RNA, 19 nt, Homo sapiens
gcaaaccuccguaaucaau

SEQ ID NO: 1557454 - RNA, 19 nt, Homo sapiens
uauagcagccagaaucuua

SEQ ID NO: 1557455 - RNA, 19 nt, Homo sapiens
uuaaugacgugggcaauaa

SEQ ID NO: 1557456 - RNA, 19 nt, Homo sapiens
uuacacagauagcaucauu

SEQ ID NO: 1557457 - RNA, 19 nt, Homo sapiens
guacuucagauguguauuu

SEQ ID NO: 1557458 - RNA, 19 nt, Homo sapiens
guacagaguauuaaagguu

SEQ ID NO: 1557459 - RNA, 19 nt, Homo sapiens
caaauacaguaccacauca

SEQ ID NO: 1557460 - RNA, 19 nt, Homo sapiens
ucucucaccucucaucuuu

SEQ ID NO: 1557461 - RNA, 19 nt, Homo sapiens
ggacuguggaugauuauga

SEQ ID NO: 1557462 - RNA, 19 nt, Homo sapiens
acaaucacccuuuggcuua

SEQ ID NO: 1557463 - RNA, 19 nt, Homo sapiens
uaccugugcucccgaauuu

SEQ ID NO: 1557464 - RNA, 19 nt, Homo sapiens
gggagauccugcuugcuuu

SEQ ID NO: 1557465 - RNA, 19 nt, Homo sapiens
gaaugucaccagaauagaa

SEQ ID NO: 1557466 - RNA, 19 nt, Homo sapiens
gcaucaagcugucuacacu

SEQ ID NO: 1557467 - RNA, 19 nt, Homo sapiens
aagguuaucuuuggcauuu

SEQ ID NO: 1557468 - RNA, 19 nt, Homo sapiens
ccgcugagauacacaaaga

SEQ ID NO: 1557469 - RNA, 19 nt, Homo sapiens
cagauagcaucauuauuuc

SEQ ID NO: 1557470 - RNA, 19 nt, Homo sapiens
acuaagaccugcuggaaug

SEQ ID NO: 1557471 - RNA, 19 nt, Homo sapiens
agaaggauacuacccauuu

SEQ ID NO: 1557472 - RNA, 19 nt, Homo sapiens
gagauacacaaagacauua

SEQ ID NO: 1557473 - RNA, 19 nt, Homo sapiens
ugacaggcuuacugaauau

SEQ ID NO: 1557474 - RNA, 19 nt, Homo sapiens
cggcaucgcugucuuugug

SEQ ID NO: 1557475 - RNA, 19 nt, Homo sapiens
caagcaaauuucagaagau

SEQ ID NO: 1557476 - RNA, 19 nt, Homo sapiens
caucauuauuucccaugua

SEQ ID NO: 1557477 - RNA, 19 nt, Homo sapiens
aaucauagccuccugguau

SEQ ID NO: 1557478 - RNA, 19 nt, Homo sapiens
auaaaacgcuuccaucuuu

SEQ ID NO: 1557479 - RNA, 19 nt, Homo sapiens
gaacaugauuucaguuacc

SEQ ID NO: 1557480 - RNA, 19 nt, Homo sapiens
gcucaaagcggcugcaauc

SEQ ID NO: 1557481 - RNA, 19 nt, Homo sapiens
ggauuguucuucauguaug

SEQ ID NO: 1557482 - RNA, 19 nt, Homo sapiens
uugaaugucagccuuauua

SEQ ID NO: 1557483 - RNA, 19 nt, Homo sapiens
cagccagaaucuuaaggua

SEQ ID NO: 1557484 - RNA, 19 nt, Homo sapiens
gggaggauccaaagucuga

SEQ ID NO: 1557485 - RNA, 19 nt, Homo sapiens
uaauuugccucaggaagaa

SEQ ID NO: 1557486 - RNA, 19 nt, Homo sapiens
aaacucaacuuuuggcuaa

SEQ ID NO: 1557487 - RNA, 19 nt, Homo sapiens
cagaauagaaccucuuaau

SEQ ID NO: 1557488 - RNA, 19 nt, Homo sapiens
gaaggauacuacccauuuu

SEQ ID NO: 1557489 - RNA, 19 nt, Homo sapiens
gcagcuaacccucccuuau

SEQ ID NO: 1557490 - RNA, 19 nt, Homo sapiens
ugaugucaauacaagguua

SEQ ID NO: 1557491 - RNA, 19 nt, Homo sapiens
gacuguggaugauuaugaa

SEQ ID NO: 1557492 - RNA, 19 nt, Homo sapiens
gaauaguguguacagagua

SEQ ID NO: 1557493 - RNA, 19 nt, Homo sapiens
gccaaagaaguaagagaua

SEQ ID NO: 1557494 - RNA, 19 nt, Homo sapiens
ucaguuacccuuaguuuca

SEQ ID NO: 1557495 - RNA, 19 nt, Homo sapiens
uagaaccucuuaaugaagu

SEQ ID NO: 1557496 - RNA, 19 nt, Homo sapiens
augacaggcuuacugaaua

SEQ ID NO: 1557497 - RNA, 19 nt, Homo sapiens
gggcugugccugaaauuga

SEQ ID NO: 1557498 - RNA, 19 nt, Homo sapiens
ugagauacacaaagacauu

SEQ ID NO: 1557499 - RNA, 19 nt, Homo sapiens
gggcaauaauucuaaagag

SEQ ID NO: 1557500 - RNA, 19 nt, Homo sapiens
acacagauagcaucauuau

SEQ ID NO: 1557501 - RNA, 19 nt, Homo sapiens
uaacugagaaggauacuac

SEQ ID NO: 1557502 - RNA, 19 nt, Homo sapiens
cagcuaacccucccuuaug

SEQ ID NO: 1557503 - RNA, 19 nt, Homo sapiens
ucauuucucucaccucuca

SEQ ID NO: 1557504 - RNA, 19 nt, Homo sapiens
ucgaaaaucugccaaagaa

SEQ ID NO: 1557505 - RNA, 19 nt, Homo sapiens
ugacccagcuccaccauac

SEQ ID NO: 1557506 - RNA, 19 nt, Homo sapiens
aaagacuguucgugauauu

SEQ ID NO: 1557507 - RNA, 19 nt, Homo sapiens
ugaaugacaggcuuacuga

SEQ ID NO: 1557508 - RNA, 19 nt, Homo sapiens
uguggaugauuaugaauga

SEQ ID NO: 1557509 - RNA, 19 nt, Homo sapiens
guuauggcuuccuugauau

SEQ ID NO: 1557510 - RNA, 19 nt, Homo sapiens
gaaaaggcuuggagcuaga

SEQ ID NO: 1557511 - RNA, 19 nt, Homo sapiens
ggcaugguguguugugaga

SEQ ID NO: 1557512 - RNA, 19 nt, Homo sapiens
uggaguuacaugugaauua

SEQ ID NO: 1557513 - RNA, 19 nt, Homo sapiens
gcaagcaucaagcugucua

SEQ ID NO: 1557514 - RNA, 19 nt, Homo sapiens
acagugaugucaauacaag

SEQ ID NO: 1557515 - RNA, 19 nt, Homo sapiens
cgaauuugacuucauggaa

SEQ ID NO: 1557516 - RNA, 19 nt, Homo sapiens
gcaaauuucagaagaucau

SEQ ID NO: 1557517 - RNA, 19 nt, Homo sapiens
aaacuaagaccugcuggaa

SEQ ID NO: 1557518 - RNA, 19 nt, Homo sapiens
ucacaagcuuuaauaacag

SEQ ID NO: 1557519 - RNA, 19 nt, Homo sapiens
gauccaaagucugaaagag

SEQ ID NO: 1557520 - RNA, 19 nt, Homo sapiens
gcaggugccaugccuacaa

SEQ ID NO: 1557521 - RNA, 19 nt, Homo sapiens
cauuauugcuuccaguugu

SEQ ID NO: 1557522 - RNA, 19 nt, Homo sapiens
ucgccugagugaucuuaua

SEQ ID NO: 1557523 - RNA, 19 nt, Homo sapiens
guuaaugacgugggcaaua

SEQ ID NO: 1557524 - RNA, 19 nt, Homo sapiens
gacaccaccucuccgugaa

SEQ ID NO: 1557525 - RNA, 19 nt, Homo sapiens
cuuacugaauauccucuua

SEQ ID NO: 1557526 - RNA, 19 nt, Homo sapiens
ucaaagcggcugcaaucuu

SEQ ID NO: 1557527 - RNA, 19 nt, Homo sapiens
agaauaguguguacagagu

SEQ ID NO: 1557528 - RNA, 19 nt, Homo sapiens
ucaaauacaguaccacauc

SEQ ID NO: 1557529 - RNA, 19 nt, Homo sapiens
gaagagacuuugcuuaaua

SEQ ID NO: 1557530 - RNA, 19 nt, Homo sapiens
ccaaauaaguguucaggaa

SEQ ID NO: 1557531 - RNA, 19 nt, Homo sapiens
ucacuuagcugcacauuca

SEQ ID NO: 1557532 - RNA, 19 nt, Homo sapiens
aaaccacccucaucuguua

SEQ ID NO: 1557533 - RNA, 19 nt, Homo sapiens
cugguuaucugguuuauua

SEQ ID NO: 1557534 - RNA, 19 nt, Homo sapiens
gaaguuaacuacuccaaag

SEQ ID NO: 1557535 - RNA, 19 nt, Homo sapiens
ggaagaugaugaccauuau

SEQ ID NO: 1557536 - RNA, 19 nt, Homo sapiens
uaagaaugcuucauggaaa

SEQ ID NO: 1557537 - RNA, 19 nt, Homo sapiens
gaaauugaguuagaagaga

SEQ ID NO: 1557538 - RNA, 19 nt, Homo sapiens
aaacuuaccucuuugaauc

SEQ ID NO: 1557539 - RNA, 19 nt, Homo sapiens
ugaugaaacuuaccucuuu

SEQ ID NO: 1557540 - RNA, 19 nt, Homo sapiens
gagaagaucugccucuaag

SEQ ID NO: 1557541 - RNA, 19 nt, Homo sapiens
ggaagaacuugauaaugga

SEQ ID NO: 1557542 - RNA, 19 nt, Homo sapiens
gcaagaagaucugucaauc

SEQ ID NO: 1557543 - RNA, 19 nt, Homo sapiens
caucuucacuugcuucauu

SEQ ID NO: 1557544 - RNA, 19 nt, Homo sapiens
gaaguaagaaaccuagaaa

SEQ ID NO: 1557545 - RNA, 19 nt, Homo sapiens
gggauacucuucaaggauu

SEQ ID NO: 1557546 - RNA, 19 nt, Homo sapiens
gaauuuaaaucagccaguu

SEQ ID NO: 1557547 - RNA, 19 nt, Homo sapiens
ggacccagcuccuugaagu

SEQ ID NO: 1557548 - RNA, 19 nt, Homo sapiens
ugaaaugaauccuuuguca

SEQ ID NO: 1557549 - RNA, 19 nt, Homo sapiens
guacuauuaugucaacuga

SEQ ID NO: 1557550 - RNA, 19 nt, Homo sapiens
uaacuacuccaaagucaua

SEQ ID NO: 1557551 - RNA, 19 nt, Homo sapiens
caaaucagauguguucaau

SEQ ID NO: 1557552 - RNA, 19 nt, Homo sapiens
gagguaaucugggcucuau

SEQ ID NO: 1557553 - RNA, 19 nt, Homo sapiens
gcaguuaacauguuucaga

SEQ ID NO: 1557554 - RNA, 19 nt, Homo sapiens
uagaagagacuuugcuuaa

SEQ ID NO: 1557555 - RNA, 19 nt, Homo sapiens
uggaagaacuugauaaugg

SEQ ID NO: 1557556 - RNA, 19 nt, Homo sapiens
gaaggacgguaccgacuag

SEQ ID NO: 1557557 - RNA, 19 nt, Homo sapiens
gcaugaagccacuuuguug

SEQ ID NO: 1557558 - RNA, 19 nt, Homo sapiens
agacuuugcuuaauacuuc

SEQ ID NO: 1557559 - RNA, 19 nt, Homo sapiens
ggacaauaccgcaaacuuc

SEQ ID NO: 1557560 - RNA, 19 nt, Homo sapiens
ggaccaggauuggcuaaug

SEQ ID NO: 1557561 - RNA, 19 nt, Homo sapiens
gaugaaacuuaccucuuug

SEQ ID NO: 1557562 - RNA, 19 nt, Homo sapiens
caaauaaguguucaggaaa

SEQ ID NO: 1557563 - RNA, 19 nt, Homo sapiens
ggagaagaucugccucuaa

SEQ ID NO: 1557564 - RNA, 19 nt, Homo sapiens
ggaaguaagaaaccuagaa

SEQ ID NO: 1557565 - RNA, 19 nt, Homo sapiens
cuuugaaucugaagguuua

SEQ ID NO: 1557566 - RNA, 19 nt, Homo sapiens
aaucagauguguucaauac

SEQ ID NO: 1557567 - RNA, 19 nt, Homo sapiens
ggaaaccacccucaucugu

SEQ ID NO: 1557568 - RNA, 19 nt, Homo sapiens
uaaagggccucccagaagu

SEQ ID NO: 1557569 - RNA, 19 nt, Homo sapiens
gcuaagagccagcauucaa

SEQ ID NO: 1557570 - RNA, 19 nt, Homo sapiens
aaacccagcgugccaguua

SEQ ID NO: 1557571 - RNA, 19 nt, Homo sapiens
gaaaccacccucaucuguu

SEQ ID NO: 1557572 - RNA, 19 nt, Homo sapiens
gagccagcauucaacuaaa

SEQ ID NO: 1557573 - RNA, 19 nt, Homo sapiens
aaacuuaaaucggccuuga

SEQ ID NO: 1557574 - RNA, 19 nt, Homo sapiens
gaaacuuaccucuuugaau

SEQ ID NO: 1557575 - RNA, 19 nt, Homo sapiens
gaagauuccaucagcauuc

SEQ ID NO: 1557576 - RNA, 19 nt, Homo sapiens
gaccaggauuggcuaaugu

SEQ ID NO: 1557577 - RNA, 19 nt, Homo sapiens
gaagaucugccucuaaguc

SEQ ID NO: 1557578 - RNA, 19 nt, Homo sapiens
gcaccgaagucagcacaga

SEQ ID NO: 1557579 - RNA, 19 nt, Homo sapiens
gaacugcaccuuguauauc

SEQ ID NO: 1557580 - RNA, 19 nt, Homo sapiens
ggaguacuauuaugucaac

SEQ ID NO: 1557581 - RNA, 19 nt, Homo sapiens
ggauagcugugaggcauga

SEQ ID NO: 1557582 - RNA, 19 nt, Homo sapiens
aaaggaagaugaugaccau

SEQ ID NO: 1557583 - RNA, 19 nt, Homo sapiens
uaaaucagccaguuucugu

SEQ ID NO: 1557584 - RNA, 19 nt, Homo sapiens
ucagagaaguuaacuacuc

SEQ ID NO: 1557585 - RNA, 19 nt, Homo sapiens
cauauuucuuccagagaua

SEQ ID NO: 1557586 - RNA, 19 nt, Homo sapiens
ugucgaauauuacaguuug

SEQ ID NO: 1557587 - RNA, 19 nt, Homo sapiens
ucaguacgaugaguggaua

SEQ ID NO: 1557588 - RNA, 19 nt, Homo sapiens
gcaauucaaguaugguuug

SEQ ID NO: 1557589 - RNA, 19 nt, Homo sapiens
ggauacucuucaaggauuu

SEQ ID NO: 1557590 - RNA, 19 nt, Homo sapiens
ugcaucagguucauucuuu

SEQ ID NO: 1557591 - RNA, 19 nt, Homo sapiens
aaaagcagccucagaauaa

SEQ ID NO: 1557592 - RNA, 19 nt, Homo sapiens
ucacuugcuucauuaaauc

SEQ ID NO: 1557593 - RNA, 19 nt, Homo sapiens
gcaggcuccuucaaacaau

SEQ ID NO: 1557594 - RNA, 19 nt, Homo sapiens
gucaguccguucuaaauug

SEQ ID NO: 1557595 - RNA, 19 nt, Homo sapiens
caguuaacauguuucagaa

SEQ ID NO: 1557596 - RNA, 19 nt, Homo sapiens
gaagaugaugaccauuauu

SEQ ID NO: 1557597 - RNA, 19 nt, Homo sapiens
aaagugcccuguaagaaag

SEQ ID NO: 1557598 - RNA, 19 nt, Homo sapiens
caagcugccuaaagcaaau

SEQ ID NO: 1557599 - RNA, 19 nt, Homo sapiens
caaccuaaguauuugaaac

SEQ ID NO: 1557600 - RNA, 19 nt, Homo sapiens
gaaucugaagguuuaguuu

SEQ ID NO: 1557601 - RNA, 19 nt, Homo sapiens
gcaucagguucauucuuug

SEQ ID NO: 1557602 - RNA, 19 nt, Homo sapiens
ugagaaaagugcccuguaa

SEQ ID NO: 1557603 - RNA, 19 nt, Homo sapiens
gcucagagaaguuaacuac

SEQ ID NO: 1557604 - RNA, 19 nt, Homo sapiens
aggaagaugaugaccauua

SEQ ID NO: 1557605 - RNA, 19 nt, Homo sapiens
gcaaauauaccuguaagac

SEQ ID NO: 1557606 - RNA, 19 nt, Homo sapiens
cauuaaauccaguagguaa

SEQ ID NO: 1557607 - RNA, 19 nt, Homo sapiens
caaaaggcauaacgaagaa

SEQ ID NO: 1557608 - RNA, 19 nt, Homo sapiens
aaagucauauagccaguau

SEQ ID NO: 1557609 - RNA, 19 nt, Homo sapiens
ggaacacagucucaaccau

SEQ ID NO: 1557610 - RNA, 19 nt, Homo sapiens
uaaugcaguaucucacuua

SEQ ID NO: 1557611 - RNA, 19 nt, Homo sapiens
uuccagagauaaugcagua

SEQ ID NO: 1557612 - RNA, 19 nt, Homo sapiens
agucauauagccaguauuu

SEQ ID NO: 1557613 - RNA, 19 nt, Homo sapiens
guuaacuacuccaaaguca

SEQ ID NO: 1557614 - RNA, 19 nt, Homo sapiens
ugucagcaguuaacauguu

SEQ ID NO: 1557615 - RNA, 19 nt, Homo sapiens
agaagagacuuugcuuaau

SEQ ID NO: 1557616 - RNA, 19 nt, Homo sapiens
augcaacucugaagaauca

SEQ ID NO: 1557617 - RNA, 19 nt, Homo sapiens
uggcuaauguuugucagua

SEQ ID NO: 1557618 - RNA, 19 nt, Homo sapiens
ccauugcugucuuuaugaa

SEQ ID NO: 1557619 - RNA, 19 nt, Homo sapiens
gucgaauugugucaagaua

SEQ ID NO: 1557620 - RNA, 19 nt, Homo sapiens
ggaugcagauaguggagau

SEQ ID NO: 1557621 - RNA, 19 nt, Homo sapiens
aaagcagccucagaauaaa

SEQ ID NO: 1557622 - RNA, 19 nt, Homo sapiens
uaguuguucucaucgauuu

SEQ ID NO: 1557623 - RNA, 19 nt, Homo sapiens
gaaaagugcccuguaagaa

SEQ ID NO: 1557624 - RNA, 19 nt, Homo sapiens
ucaaucugguuaucugguu

SEQ ID NO: 1557625 - RNA, 19 nt, Homo sapiens
caaacaaugcaucaucuuc

SEQ ID NO: 1557626 - RNA, 19 nt, Homo sapiens
gucagcaguuaacauguuu

SEQ ID NO: 1557627 - RNA, 19 nt, Homo sapiens
uaaugaaaguguaccugau

SEQ ID NO: 1557628 - RNA, 19 nt, Homo sapiens
ucaccagcuuuaccaagaa

SEQ ID NO: 1557629 - RNA, 19 nt, Homo sapiens
gcacacaaauggacaauaa

SEQ ID NO: 1557630 - RNA, 19 nt, Homo sapiens
ucaaggaaguuuacaguuu

SEQ ID NO: 1557631 - RNA, 19 nt, Homo sapiens
gagaagugcuuuggucuuu

SEQ ID NO: 1557632 - RNA, 19 nt, Homo sapiens
gcaacaugcuguaggaauu

SEQ ID NO: 1557633 - RNA, 19 nt, Homo sapiens
gauagaggaugacgucuga

SEQ ID NO: 1557634 - RNA, 19 nt, Homo sapiens
caucagaucugcucaggaa

SEQ ID NO: 1557635 - RNA, 19 nt, Homo sapiens
gagaacgaaugaauacaaa

SEQ ID NO: 1557636 - RNA, 19 nt, Homo sapiens
gaaagugcuucagcuaauu

SEQ ID NO: 1557637 - RNA, 19 nt, Homo sapiens
gaucacagcugagcggaaa

SEQ ID NO: 1557638 - RNA, 19 nt, Homo sapiens
gugcuuuggucuuuauuua

SEQ ID NO: 1557639 - RNA, 19 nt, Homo sapiens
gaagugcuuuggucuuuau

SEQ ID NO: 1557640 - RNA, 19 nt, Homo sapiens
guacucagcucucaaaggu

SEQ ID NO: 1557641 - RNA, 19 nt, Homo sapiens
gaaagacggcuacacagaa

SEQ ID NO: 1557642 - RNA, 19 nt, Homo sapiens
cuaaagcugugaaauuuga

SEQ ID NO: 1557643 - RNA, 19 nt, Homo sapiens
uaaugaagcucccaaaugg

SEQ ID NO: 1557644 - RNA, 19 nt, Homo sapiens
ggaagaacaagucuauaaa

SEQ ID NO: 1557645 - RNA, 19 nt, Homo sapiens
gcucauguauuucacaguu

SEQ ID NO: 1557646 - RNA, 19 nt, Homo sapiens
aaagaaggcacaauaguuu

SEQ ID NO: 1557647 - RNA, 19 nt, Homo sapiens
uggagugucuguuucuuua

SEQ ID NO: 1557648 - RNA, 19 nt, Homo sapiens
gaagugggcaaucuuuaaa

SEQ ID NO: 1557649 - RNA, 19 nt, Homo sapiens
cgaaagugcuucagcuaau

SEQ ID NO: 1557650 - RNA, 19 nt, Homo sapiens
acguguagcucauguauuu

SEQ ID NO: 1557651 - RNA, 19 nt, Homo sapiens
gcagugagcuaugauugug

SEQ ID NO: 1557652 - RNA, 19 nt, Homo sapiens
ggaaccuggugcagaagua

SEQ ID NO: 1557653 - RNA, 19 nt, Homo sapiens
aaagacggcuacacagaaa

SEQ ID NO: 1557654 - RNA, 19 nt, Homo sapiens
ccaguuagcuaccucuuca

SEQ ID NO: 1557655 - RNA, 19 nt, Homo sapiens
guaaugaagcucccaaaug

SEQ ID NO: 1557656 - RNA, 19 nt, Homo sapiens
ggaaagacggcuacacaga

SEQ ID NO: 1557657 - RNA, 19 nt, Homo sapiens
ugaggaaccuggugcagaa

SEQ ID NO: 1557658 - RNA, 19 nt, Homo sapiens
ggagaacgaaugaauacaa

SEQ ID NO: 1557659 - RNA, 19 nt, Homo sapiens
ucugagugauggaaucuua

SEQ ID NO: 1557660 - RNA, 19 nt, Homo sapiens
aaauggaacucacaugugu

SEQ ID NO: 1557661 - RNA, 19 nt, Homo sapiens
ccgugaaacuucucuauug

SEQ ID NO: 1557662 - RNA, 19 nt, Homo sapiens
gaaacaauacacugccaaa

SEQ ID NO: 1557663 - RNA, 19 nt, Homo sapiens
gagacuaaguaaaggaaau

SEQ ID NO: 1557664 - RNA, 19 nt, Homo sapiens
gcaagcguuuauuuacuga

SEQ ID NO: 1557665 - RNA, 19 nt, Homo sapiens
uccuaaagcugugaaauuu

SEQ ID NO: 1557666 - RNA, 19 nt, Homo sapiens
gcuuuggucuuuauuuaga

SEQ ID NO: 1557667 - RNA, 19 nt, Homo sapiens
caccaucacuuaccgauuc

SEQ ID NO: 1557668 - RNA, 19 nt, Homo sapiens
cggaagaacaagucuauaa

SEQ ID NO: 1557669 - RNA, 19 nt, Homo sapiens
acucagcucucaaagguaa

SEQ ID NO: 1557670 - RNA, 19 nt, Homo sapiens
caccaaaacuuagguaaua

SEQ ID NO: 1557671 - RNA, 19 nt, Homo sapiens
uaaggugucuccacuagca

SEQ ID NO: 1557672 - RNA, 19 nt, Homo sapiens
ggaaagcccaguaaugaag

SEQ ID NO: 1557673 - RNA, 19 nt, Homo sapiens
uagcugcugugacuauaaa

SEQ ID NO: 1557674 - RNA, 19 nt, Homo sapiens
caaggaaguuuacaguuuu

SEQ ID NO: 1557675 - RNA, 19 nt, Homo sapiens
gguaagaagugggcaaucu

SEQ ID NO: 1557676 - RNA, 19 nt, Homo sapiens
cagcggcaacucauucuua

SEQ ID NO: 1557677 - RNA, 19 nt, Homo sapiens
gaacgugcagguuggagaa

SEQ ID NO: 1557678 - RNA, 19 nt, Homo sapiens
guucuuggcuccuaacucu

SEQ ID NO: 1557679 - RNA, 19 nt, Homo sapiens
ggcuaagauuucuaaagua

SEQ ID NO: 1557680 - RNA, 19 nt, Homo sapiens
gcacccuuauucuggcaua

SEQ ID NO: 1557681 - RNA, 19 nt, Homo sapiens
gaugacgucugaccucuac

SEQ ID NO: 1557682 - RNA, 19 nt, Homo sapiens
agaaugaagugugguguug

SEQ ID NO: 1557683 - RNA, 19 nt, Homo sapiens
aggcuaagauuucuaaagu

SEQ ID NO: 1557684 - RNA, 19 nt, Homo sapiens
uguaggaauuuaacucuug

SEQ ID NO: 1557685 - RNA, 19 nt, Homo sapiens
cauaugagcacacaaaugg

SEQ ID NO: 1557686 - RNA, 19 nt, Homo sapiens
caacaugcuguaggaauuu

SEQ ID NO: 1557687 - RNA, 19 nt, Homo sapiens
uaacucuggaucugucuua

SEQ ID NO: 1557688 - RNA, 19 nt, Homo sapiens
gucaagcucucuaguucuu

SEQ ID NO: 1557689 - RNA, 19 nt, Homo sapiens
ggacugcacccuuauucug

SEQ ID NO: 1557690 - RNA, 19 nt, Homo sapiens
aaagguaguuacaagugaa

SEQ ID NO: 1557691 - RNA, 19 nt, Homo sapiens
cagguuagcugcugugacu

SEQ ID NO: 1557692 - RNA, 19 nt, Homo sapiens
gcguuuauuuacugaugua

SEQ ID NO: 1557693 - RNA, 19 nt, Homo sapiens
cguauaaucucaccuuugc

SEQ ID NO: 1557694 - RNA, 19 nt, Homo sapiens
aaacucgucaugcugguua

SEQ ID NO: 1557695 - RNA, 19 nt, Homo sapiens
uuuaagcugugaauacuga

SEQ ID NO: 1557696 - RNA, 19 nt, Homo sapiens
uaaaucaacccuuugucaa

SEQ ID NO: 1557697 - RNA, 19 nt, Homo sapiens
aaagugcuucagcuaauua

SEQ ID NO: 1557698 - RNA, 19 nt, Homo sapiens
ccaagaaccuaucgaugac

SEQ ID NO: 1557699 - RNA, 19 nt, Homo sapiens
agaagugcuuuggucuuua

SEQ ID NO: 1557700 - RNA, 19 nt, Homo sapiens
ccgcagcacuaacagauca

SEQ ID NO: 1557701 - RNA, 19 nt, Homo sapiens
gcugugaauacugaaauua

SEQ ID NO: 1557702 - RNA, 19 nt, Homo sapiens
ccaccagucucuacuaaaa

SEQ ID NO: 1557703 - RNA, 19 nt, Homo sapiens
ugacucaacuacuggaaag

SEQ ID NO: 1557704 - RNA, 19 nt, Homo sapiens
caacucauucuuacucaga

SEQ ID NO: 1557705 - RNA, 19 nt, Homo sapiens
uccaagaaccuaucgauga

SEQ ID NO: 1557706 - RNA, 19 nt, Homo sapiens
guaggaauuuaacucuugu

SEQ ID NO: 1557707 - RNA, 19 nt, Homo sapiens
gauuggauccaguuagcua

SEQ ID NO: 1557708 - RNA, 19 nt, Homo sapiens
gggaaaagaaggcacaaua

SEQ ID NO: 1557709 - RNA, 19 nt, Homo sapiens
agaagugggcaaucuuuaa

SEQ ID NO: 1557710 - RNA, 19 nt, Homo sapiens
gauagaugaaggagacauu

SEQ ID NO: 1557711 - RNA, 19 nt, Homo sapiens
gcauaugagcacacaaaug

SEQ ID NO: 1557712 - RNA, 19 nt, Homo sapiens
uaaagcauaugagcacaca

SEQ ID NO: 1557713 - RNA, 19 nt, Homo sapiens
uaaguugaccaccgugaaa

SEQ ID NO: 1557714 - RNA, 19 nt, Homo sapiens
uagcaccacuuuacucaag

SEQ ID NO: 1557715 - RNA, 19 nt, Homo sapiens
cggcuacacagaaaguuua

SEQ ID NO: 1557716 - RNA, 19 nt, Homo sapiens
uuacuaaacucgucaugcu

SEQ ID NO: 1557717 - RNA, 19 nt, Homo sapiens
guuagcugcugugacuaua

SEQ ID NO: 1557718 - RNA, 19 nt, Homo sapiens
gugucccggucauuaaaua

SEQ ID NO: 1557719 - RNA, 19 nt, Homo sapiens
guuggagaacgaaugaaua

SEQ ID NO: 1557720 - RNA, 19 nt, Homo sapiens
gagugucuguuucuuuaag

SEQ ID NO: 1557721 - RNA, 19 nt, Homo sapiens
uaucucuucuuccucugua

SEQ ID NO: 1557722 - RNA, 19 nt, Homo sapiens
gggcguaucucuucuuccu

SEQ ID NO: 1557723 - RNA, 19 nt, Homo sapiens
gagaaugaagugugguguu

SEQ ID NO: 1557724 - RNA, 19 nt, Homo sapiens
agccuggacugcacccuua

SEQ ID NO: 1557725 - RNA, 19 nt, Homo sapiens
caaaugggaaacacaagug

SEQ ID NO: 1557726 - RNA, 19 nt, Homo sapiens
gaugaaggagacauuaauc

SEQ ID NO: 1557727 - RNA, 19 nt, Homo sapiens
uaaauggaacucacaugug

SEQ ID NO: 1557728 - RNA, 19 nt, Homo sapiens
acacguguuugaagcaguu

SEQ ID NO: 1557729 - RNA, 19 nt, Homo sapiens
guaggaagguugcugaaua

SEQ ID NO: 1557730 - RNA, 19 nt, Homo sapiens
gaacacaacacuccugaua

SEQ ID NO: 1557731 - RNA, 19 nt, Homo sapiens
ggucacaacugcccucaua

SEQ ID NO: 1557732 - RNA, 19 nt, Homo sapiens
gaucaaauuugcccugaaa

SEQ ID NO: 1557733 - RNA, 19 nt, Homo sapiens
gaccagaaauuaccaaaga

SEQ ID NO: 1557734 - RNA, 19 nt, Homo sapiens
gcagucagccucuacuuua

SEQ ID NO: 1557735 - RNA, 19 nt, Homo sapiens
caacugcccucauaaauag

SEQ ID NO: 1557736 - RNA, 19 nt, Homo sapiens
uaaaguauguugcugugua

SEQ ID NO: 1557737 - RNA, 19 nt, Homo sapiens
gauuaaaccugaugagaau

SEQ ID NO: 1557738 - RNA, 19 nt, Homo sapiens
gggcgcagcuuaacaaguu

SEQ ID NO: 1557739 - RNA, 19 nt, Homo sapiens
gaagguugcugaauaugga

SEQ ID NO: 1557740 - RNA, 19 nt, Homo sapiens
gaaggaagagccaggauuu

SEQ ID NO: 1557741 - RNA, 19 nt, Homo sapiens
acacaacacuccugauaaa

SEQ ID NO: 1557742 - RNA, 19 nt, Homo sapiens
gaagauuguuguacgagaa

SEQ ID NO: 1557743 - RNA, 19 nt, Homo sapiens
caucagcucugguuuaaau

SEQ ID NO: 1557744 - RNA, 19 nt, Homo sapiens
uaacaaguuucccauuuga

SEQ ID NO: 1557745 - RNA, 19 nt, Homo sapiens
ccucauaaauagugacaua

SEQ ID NO: 1557746 - RNA, 19 nt, Homo sapiens
caaacugucucuaaagaug

SEQ ID NO: 1557747 - RNA, 19 nt, Homo sapiens
gaaucaagccuuccauuau

SEQ ID NO: 1557748 - RNA, 19 nt, Homo sapiens
gcaagcagcauccaauuga

SEQ ID NO: 1557749 - RNA, 19 nt, Homo sapiens
cgagaauccuguaucuuaa

SEQ ID NO: 1557750 - RNA, 19 nt, Homo sapiens
guacauacaguuacaaaug

SEQ ID NO: 1557751 - RNA, 19 nt, Homo sapiens
gcaauaugacuaugacaaa

SEQ ID NO: 1557752 - RNA, 19 nt, Homo sapiens
gaugaucauuacagacuaa

SEQ ID NO: 1557753 - RNA, 19 nt, Homo sapiens
gcacaucaucuuagcagua

SEQ ID NO: 1557754 - RNA, 19 nt, Homo sapiens
gagagaauguuagaagaga

SEQ ID NO: 1557755 - RNA, 19 nt, Homo sapiens
gccaucagcucugguuuaa

SEQ ID NO: 1557756 - RNA, 19 nt, Homo sapiens
gaccaaguauaaaguaugu

SEQ ID NO: 1557757 - RNA, 19 nt, Homo sapiens
ucacugagcccaaagaaga

SEQ ID NO: 1557758 - RNA, 19 nt, Homo sapiens
gccaaacugucucuaaaga

SEQ ID NO: 1557759 - RNA, 19 nt, Homo sapiens
acaaaugucugugguauuc

SEQ ID NO: 1557760 - RNA, 19 nt, Homo sapiens
gaggaguucucuaauguag

SEQ ID NO: 1557761 - RNA, 19 nt, Homo sapiens
gcagaugcucuucgcaaua

SEQ ID NO: 1557762 - RNA, 19 nt, Homo sapiens
ggugaggaguucucuaaug

SEQ ID NO: 1557763 - RNA, 19 nt, Homo sapiens
uaagaauccuguacaaugg

SEQ ID NO: 1557764 - RNA, 19 nt, Homo sapiens
cuugaugcauccaaauuua

SEQ ID NO: 1557765 - RNA, 19 nt, Homo sapiens
gugaggaguucucuaaugu

SEQ ID NO: 1557766 - RNA, 19 nt, Homo sapiens
gggcuuugcuugcacaguu

SEQ ID NO: 1557767 - RNA, 19 nt, Homo sapiens
aaacuggucuuaacagaag

SEQ ID NO: 1557768 - RNA, 19 nt, Homo sapiens
cuuaacaaguuucccauuu

SEQ ID NO: 1557769 - RNA, 19 nt, Homo sapiens
ugauaaagcucagggaaau

SEQ ID NO: 1557770 - RNA, 19 nt, Homo sapiens
aaucaagccuuccauuaug

SEQ ID NO: 1557771 - RNA, 19 nt, Homo sapiens
acgagaauccuguaucuua

SEQ ID NO: 1557772 - RNA, 19 nt, Homo sapiens
guacgagaauccuguaucu

SEQ ID NO: 1557773 - RNA, 19 nt, Homo sapiens
uaaccaaccuggcggaaca

SEQ ID NO: 1557774 - RNA, 19 nt, Homo sapiens
gugccaaacugucucuaaa

SEQ ID NO: 1557775 - RNA, 19 nt, Homo sapiens
cuagagacauguguuuauu

SEQ ID NO: 1557776 - RNA, 19 nt, Homo sapiens
guacaauggaccagaaauu

SEQ ID NO: 1557777 - RNA, 19 nt, Homo sapiens
cgaaagacuuggugaaggu

SEQ ID NO: 1557778 - RNA, 19 nt, Homo sapiens
cagaugcucuucgcaauau

SEQ ID NO: 1557779 - RNA, 19 nt, Homo sapiens
caggauuucucacugguuu

SEQ ID NO: 1557780 - RNA, 19 nt, Homo sapiens
uaggaagguugcugaauau

SEQ ID NO: 1557781 - RNA, 19 nt, Homo sapiens
gcuguucccugaugagaga

SEQ ID NO: 1557782 - RNA, 19 nt, Homo sapiens
acaacugcccucauaaaua

SEQ ID NO: 1557783 - RNA, 19 nt, Homo sapiens
gugaugaaguguuggaaau

SEQ ID NO: 1557784 - RNA, 19 nt, Homo sapiens
cagacuaaaugaugaacuu

SEQ ID NO: 1557785 - RNA, 19 nt, Homo sapiens
uuaacaaguuucccauuug

SEQ ID NO: 1557786 - RNA, 19 nt, Homo sapiens
guacccaggugaaacugaa

SEQ ID NO: 1557787 - RNA, 19 nt, Homo sapiens
ugaaaggaaucgagacauc

SEQ ID NO: 1557788 - RNA, 19 nt, Homo sapiens
gagaaauggugaggaguuc

SEQ ID NO: 1557789 - RNA, 19 nt, Homo sapiens
gaugcaugcuaaaguguga

SEQ ID NO: 1557790 - RNA, 19 nt, Homo sapiens
gaccauagaggaagacaga

SEQ ID NO: 1557791 - RNA, 19 nt, Homo sapiens
cuauugcgguccaaacuuu

SEQ ID NO: 1557792 - RNA, 19 nt, Homo sapiens
uacaauggaccagaaauua

SEQ ID NO: 1557793 - RNA, 19 nt, Homo sapiens
gcaacacacugggauaugg

SEQ ID NO: 1557794 - RNA, 19 nt, Homo sapiens
gaagagccaggauuucuca

SEQ ID NO: 1557795 - RNA, 19 nt, Homo sapiens
ggaugaucauuacagacua

SEQ ID NO: 1557796 - RNA, 19 nt, Homo sapiens
uaacagaaggagagagaaa

SEQ ID NO: 1557797 - RNA, 19 nt, Homo sapiens
ccacgaaugagguuauaaa

SEQ ID NO: 1557798 - RNA, 19 nt, Homo sapiens
guuagcuuguuccauguua

SEQ ID NO: 1557799 - RNA, 19 nt, Homo sapiens
uggcagccguagugucuua

SEQ ID NO: 1557800 - RNA, 19 nt, Homo sapiens
uuaagaauccuguacaaug

SEQ ID NO: 1557801 - RNA, 19 nt, Homo sapiens
uaaagaaacgguccauauc

SEQ ID NO: 1557802 - RNA, 19 nt, Homo sapiens
uuaaagaaacgguccauau

SEQ ID NO: 1557803 - RNA, 19 nt, Homo sapiens
gaaaggaaucgagacauca

SEQ ID NO: 1557804 - RNA, 19 nt, Homo sapiens
caagcagcauccaauugaa

SEQ ID NO: 1557805 - RNA, 19 nt, Homo sapiens
uuacaaaugucugugguau

SEQ ID NO: 1557806 - RNA, 19 nt, Homo sapiens
ucaggaggcuugcccuuuc

SEQ ID NO: 1557807 - RNA, 19 nt, Homo sapiens
cgucagagacaacuauaaa

SEQ ID NO: 1557808 - RNA, 19 nt, Homo sapiens
gaugagagaauguuagaag

SEQ ID NO: 1557809 - RNA, 19 nt, Homo sapiens
cagacggcguugcugcuua

SEQ ID NO: 1557810 - RNA, 19 nt, Homo sapiens
ucugugguauucuugcuua

SEQ ID NO: 1557811 - RNA, 19 nt, Homo sapiens
gaaauuaccaaagaagaag

SEQ ID NO: 1557812 - RNA, 19 nt, Homo sapiens
gaacugguuggccgaaaga

SEQ ID NO: 1557813 - RNA, 19 nt, Homo sapiens
ggauauggcagccguagug

SEQ ID NO: 1557814 - RNA, 19 nt, Homo sapiens
gggccuaacacaaacagua

SEQ ID NO: 1557815 - RNA, 19 nt, Homo sapiens
agacggcguugcugcuuaa

SEQ ID NO: 1557816 - RNA, 19 nt, Homo sapiens
ucacaacugcccucauaaa

SEQ ID NO: 1557817 - RNA, 19 nt, Homo sapiens
caucuuagcaguauuugug

SEQ ID NO: 1557818 - RNA, 19 nt, Homo sapiens
cgugcuagaccucaauuua

SEQ ID NO: 1557819 - RNA, 19 nt, Homo sapiens
gaaguggccgugaacacaa

SEQ ID NO: 1557820 - RNA, 19 nt, Homo sapiens
acagucaccuucuccuuug

SEQ ID NO: 1557821 - RNA, 19 nt, Homo sapiens
ggaacugguuggccgaaag

SEQ ID NO: 1557822 - RNA, 19 nt, Homo sapiens
ucaccuucuuccaguguua

SEQ ID NO: 1557823 - RNA, 19 nt, Homo sapiens
ugaggaugaucauuacaga

SEQ ID NO: 1557824 - RNA, 19 nt, Homo sapiens
caucaucuuagcaguauuu

SEQ ID NO: 1557825 - RNA, 19 nt, Homo sapiens
ucuguggucuaguaaauga

SEQ ID NO: 1557826 - RNA, 19 nt, Homo sapiens
ccaaguauaaaguauguug

SEQ ID NO: 1557827 - RNA, 19 nt, Homo sapiens
guuggaaacuacuuugauc

SEQ ID NO: 1557828 - RNA, 19 nt, Homo sapiens
gcucgcugccuguaccuua

SEQ ID NO: 1557829 - RNA, 19 nt, Homo sapiens
ggaaauccauuacuucaaa

SEQ ID NO: 1557830 - RNA, 19 nt, Homo sapiens
ggaaggaaauccauuacuu

SEQ ID NO: 1557831 - RNA, 19 nt, Homo sapiens
cugaaucgcuuucccuuua

SEQ ID NO: 1557832 - RNA, 19 nt, Homo sapiens
caacuucucugcaaacaca

SEQ ID NO: 1557833 - RNA, 19 nt, Homo sapiens
gaagccaccucgcuauuca

SEQ ID NO: 1557834 - RNA, 19 nt, Homo sapiens
caacaaaugcaccaaagaa

SEQ ID NO: 1557835 - RNA, 19 nt, Homo sapiens
gcagaucccucgcagagau

SEQ ID NO: 1557836 - RNA, 19 nt, Homo sapiens
gaaucgcuuucccuuuaua

SEQ ID NO: 1557837 - RNA, 19 nt, Homo sapiens
gcacacggcagcagaagaa

SEQ ID NO: 1557838 - RNA, 19 nt, Homo sapiens
gcagagaucuuggcaacuc

SEQ ID NO: 1557839 - RNA, 19 nt, Homo sapiens
gcaagugagucugcgauuc

SEQ ID NO: 1557840 - RNA, 19 nt, Homo sapiens
augaagagguccaugauga

SEQ ID NO: 1557841 - RNA, 19 nt, Homo sapiens
ccacaucccugucccuuac

SEQ ID NO: 1557842 - RNA, 19 nt, Homo sapiens
uaaagugccacaacaaaug

SEQ ID NO: 1557843 - RNA, 19 nt, Homo sapiens
ccaguuugauuguccuaaa

SEQ ID NO: 1557844 - RNA, 19 nt, Homo sapiens
ggacaaaauucagcccaua

SEQ ID NO: 1557845 - RNA, 19 nt, Homo sapiens
gaggagauccagcaagguu

SEQ ID NO: 1557846 - RNA, 19 nt, Homo sapiens
gagauuggcgagcucauug

SEQ ID NO: 1557847 - RNA, 19 nt, Homo sapiens
gaccucgaauccaaucuug

SEQ ID NO: 1557848 - RNA, 19 nt, Homo sapiens
cagaguccguuccguguga

SEQ ID NO: 1557849 - RNA, 19 nt, Homo sapiens
caacgucggagaaugaaga

SEQ ID NO: 1557850 - RNA, 19 nt, Homo sapiens
gaaugaagagguccaugau

SEQ ID NO: 1557851 - RNA, 19 nt, Homo sapiens
gaggccaacuucucugcaa

SEQ ID NO: 1557852 - RNA, 19 nt, Homo sapiens
guuaaagugccacaacaaa

SEQ ID NO: 1557853 - RNA, 19 nt, Homo sapiens
guaggcagcugcgagaaca

SEQ ID NO: 1557854 - RNA, 19 nt, Homo sapiens
aauauaacguacaggaguu

SEQ ID NO: 1557855 - RNA, 19 nt, Homo sapiens
gaucuuggcaacuccauca

SEQ ID NO: 1557856 - RNA, 19 nt, Homo sapiens
cccauaacaugcauugaug

SEQ ID NO: 1557857 - RNA, 19 nt, Homo sapiens
gagccaacgucggagaaug

SEQ ID NO: 1557858 - RNA, 19 nt, Homo sapiens
aaauucagcccauaacaug

SEQ ID NO: 1557859 - RNA, 19 nt, Homo sapiens
ccacaacaaaugcaccaaa

SEQ ID NO: 1557860 - RNA, 19 nt, Homo sapiens
ccggugaccucgaauccaa

SEQ ID NO: 1557861 - RNA, 19 nt, Homo sapiens
acaaauacaagcagcaguu

SEQ ID NO: 1557862 - RNA, 19 nt, Homo sapiens
ggaagccaccucgcuauuc

SEQ ID NO: 1557863 - RNA, 19 nt, Homo sapiens
ugaaucgcuuucccuuuau

SEQ ID NO: 1557864 - RNA, 19 nt, Homo sapiens
ggccugagcacaugaagau

SEQ ID NO: 1557865 - RNA, 19 nt, Homo sapiens
ggagauuggcgagcucauu

SEQ ID NO: 1557866 - RNA, 19 nt, Homo sapiens
cagcaucccacuacuacaa

SEQ ID NO: 1557867 - RNA, 19 nt, Homo sapiens
aagaagagcaaacccuuga

SEQ ID NO: 1557868 - RNA, 19 nt, Homo sapiens
gaucauccaccgaggagau

SEQ ID NO: 1557869 - RNA, 19 nt, Homo sapiens
cacaacaaaugcaccaaag

SEQ ID NO: 1557870 - RNA, 19 nt, Homo sapiens
ucaccaggccaguuugauu

SEQ ID NO: 1557871 - RNA, 19 nt, Homo sapiens
agaaugaagagguccauga

SEQ ID NO: 1557872 - RNA, 19 nt, Homo sapiens
gaaccaaaugcaagugagu

SEQ ID NO: 1557873 - RNA, 19 nt, Homo sapiens
gagccaagaagaagagcaa

SEQ ID NO: 1557874 - RNA, 19 nt, Homo sapiens
gcccauaacaugcauugau

SEQ ID NO: 1557875 - RNA, 19 nt, Homo sapiens
gaagagcaaacccuugaac

SEQ ID NO: 1557876 - RNA, 19 nt, Homo sapiens
caugagaacguggugcuuu

SEQ ID NO: 1557877 - RNA, 19 nt, Homo sapiens
uuggcgagcucauuggaaa

SEQ ID NO: 1557878 - RNA, 19 nt, Homo sapiens
gcaucccacuacuacaaau

SEQ ID NO: 1557879 - RNA, 19 nt, Homo sapiens
ccaacaaaaucaacaagga

SEQ ID NO: 1557880 - RNA, 19 nt, Homo sapiens
uuauaaagcacagcugaaa

SEQ ID NO: 1557881 - RNA, 19 nt, Homo sapiens
ccgaagagucagaggauga

SEQ ID NO: 1557882 - RNA, 19 nt, Homo sapiens
gaccugcacaucagucaga

SEQ ID NO: 1557883 - RNA, 19 nt, Homo sapiens
caccaggccaguuugauug

SEQ ID NO: 1557884 - RNA, 19 nt, Homo sapiens
ggagauccagcaagguuag

SEQ ID NO: 1557885 - RNA, 19 nt, Homo sapiens
caguuugauuguccuaaau

SEQ ID NO: 1557886 - RNA, 19 nt, Homo sapiens
acaagcagcaguucaucuu

SEQ ID NO: 1557887 - RNA, 19 nt, Homo sapiens
uuaaagugccacaacaaau

SEQ ID NO: 1557888 - RNA, 19 nt, Homo sapiens
gcugaaucgcuuucccuuu

SEQ ID NO: 1557889 - RNA, 19 nt, Homo sapiens
ccaaguacuggaugucuca

SEQ ID NO: 1557890 - RNA, 19 nt, Homo sapiens
ugaugaggccgaagaguca

SEQ ID NO: 1557891 - RNA, 19 nt, Homo sapiens
caucccacuacuacaaaua

SEQ ID NO: 1557892 - RNA, 19 nt, Homo sapiens
ugacaucaacaacccucua

SEQ ID NO: 1557893 - RNA, 19 nt, Homo sapiens
caagguuaguccggacaga

SEQ ID NO: 1557894 - RNA, 19 nt, Homo sapiens
uugagcagcuggagauugg

SEQ ID NO: 1557895 - RNA, 19 nt, Homo sapiens
aaggaaauccauuacuuca

SEQ ID NO: 1557896 - RNA, 19 nt, Homo sapiens
caaauacaagcagcaguuc

SEQ ID NO: 1557897 - RNA, 19 nt, Homo sapiens
ccugucaucuucugaucau

SEQ ID NO: 1557898 - RNA, 19 nt, Homo sapiens
ucccuccgcuccuucuuug

SEQ ID NO: 1557899 - RNA, 19 nt, Homo sapiens
agaccagcaucuuccuuca

SEQ ID NO: 1557900 - RNA, 19 nt, Homo sapiens
caaguuaaagugccacaac

SEQ ID NO: 1557901 - RNA, 19 nt, Homo sapiens
gggaggugauggccuacag

SEQ ID NO: 1557902 - RNA, 19 nt, Homo sapiens
caacgaggaccagcucaag

SEQ ID NO: 1557903 - RNA, 19 nt, Homo sapiens
gccaacuucucugcaaaca

SEQ ID NO: 1557904 - RNA, 19 nt, Homo sapiens
ccacuacuacaaauacaag

SEQ ID NO: 1557905 - RNA, 19 nt, Homo sapiens
aaguuaaagugccacaaca

SEQ ID NO: 1557906 - RNA, 19 nt, Homo sapiens
gaacguggugcuuuucaug

SEQ ID NO: 1557907 - RNA, 19 nt, Homo sapiens
ggcagacacggcaugagaa

SEQ ID NO: 1557908 - RNA, 19 nt, Homo sapiens
gcccagagccaagaagaag

SEQ ID NO: 1557909 - RNA, 19 nt, Homo sapiens
ccugagcacaugaagauuc

SEQ ID NO: 1557910 - RNA, 19 nt, Homo sapiens
caucaccaggccaguuuga

SEQ ID NO: 1557911 - RNA, 19 nt, Homo sapiens
gcagacacggcaugagaac

SEQ ID NO: 1557912 - RNA, 19 nt, Homo sapiens
gacaaaauucagcccauaa

SEQ ID NO: 1557913 - RNA, 19 nt, Homo sapiens
cggaagccaccucgcuauu

SEQ ID NO: 1557914 - RNA, 19 nt, Homo sapiens
acaacaaaugcaccaaaga

SEQ ID NO: 1557915 - RNA, 19 nt, Homo sapiens
cugaagaacugguugacua

SEQ ID NO: 1557916 - RNA, 19 nt, Homo sapiens
gaagacaggccgagugaug

SEQ ID NO: 1557917 - RNA, 19 nt, Homo sapiens
ugacugggucuaugaauaa

SEQ ID NO: 1557918 - RNA, 19 nt, Homo sapiens
ucccugggcuggugaagua

SEQ ID NO: 1557919 - RNA, 19 nt, Homo sapiens
gcacuacauugaccugaag

SEQ ID NO: 1557920 - RNA, 19 nt, Homo sapiens
ugaagcagcacuacauuga

SEQ ID NO: 1557921 - RNA, 19 nt, Homo sapiens
gcucaugacugggucuaug

SEQ ID NO: 1557922 - RNA, 19 nt, Homo sapiens
gcauucagguuggcaggaa

SEQ ID NO: 1557923 - RNA, 19 nt, Homo sapiens
ucauggcagugauucagua

SEQ ID NO: 1557924 - RNA, 19 nt, Homo sapiens
guuuaagccugaagaacug

SEQ ID NO: 1557925 - RNA, 19 nt, Homo sapiens
augacugggucuaugaaua

SEQ ID NO: 1557926 - RNA, 19 nt, Homo sapiens
ggcaggaacaucauucaug

SEQ ID NO: 1557927 - RNA, 19 nt, Homo sapiens
gugaagacaggccgaguga

SEQ ID NO: 1557928 - RNA, 19 nt, Homo sapiens
aagaacugguugacuacaa

SEQ ID NO: 1557929 - RNA, 19 nt, Homo sapiens
gguuuaagccugaagaacu

SEQ ID NO: 1557930 - RNA, 19 nt, Homo sapiens
ucaagcgcuucgagcagaa

SEQ ID NO: 1557931 - RNA, 19 nt, Homo sapiens
gggcugaacgucgugaaga

SEQ ID NO: 1557932 - RNA, 19 nt, Homo sapiens
gaacugguugacuacaagu

SEQ ID NO: 1557933 - RNA, 19 nt, Homo sapiens
agaacugguugacuacaag

SEQ ID NO: 1557934 - RNA, 19 nt, Homo sapiens
gaagaacugguugacuaca

SEQ ID NO: 1557935 - RNA, 19 nt, Homo sapiens
cagguuggcaggaacauca

SEQ ID NO: 1557936 - RNA, 19 nt, Homo sapiens
uggcagugauucaguaaaa

SEQ ID NO: 1557937 - RNA, 19 nt, Homo sapiens
cugaagaacaccugaagca

SEQ ID NO: 1557938 - RNA, 19 nt, Homo sapiens
gggcuggugaaguacauga

SEQ ID NO: 1557939 - RNA, 19 nt, Homo sapiens
gaacaugaauagagacaua

SEQ ID NO: 1557940 - RNA, 19 nt, Homo sapiens
gaaagagaauggagccuua

SEQ ID NO: 1557941 - RNA, 19 nt, Homo sapiens
acacaaagauugacaguaa

SEQ ID NO: 1557942 - RNA, 19 nt, Homo sapiens
gcgaauaucuacuaagaaa

SEQ ID NO: 1557943 - RNA, 19 nt, Homo sapiens
gaaaugaucuuaguacauc

SEQ ID NO: 1557944 - RNA, 19 nt, Homo sapiens
gcaaagaagacaagauaua

SEQ ID NO: 1557945 - RNA, 19 nt, Homo sapiens
gggcagaaauugaaacuga

SEQ ID NO: 1557946 - RNA, 19 nt, Homo sapiens
gaagaaccacauagacuua

SEQ ID NO: 1557947 - RNA, 19 nt, Homo sapiens
gaauggagccuuagaauca

SEQ ID NO: 1557948 - RNA, 19 nt, Homo sapiens
ggaaugaaccugccugauu

SEQ ID NO: 1557949 - RNA, 19 nt, Homo sapiens
gaaggacauucuaugagua

SEQ ID NO: 1557950 - RNA, 19 nt, Homo sapiens
gaagcuaaaugucuggaaa

SEQ ID NO: 1557951 - RNA, 19 nt, Homo sapiens
ggaagaaggaggaauauau

SEQ ID NO: 1557952 - RNA, 19 nt, Homo sapiens
cuaaaugucuggaaaguau

SEQ ID NO: 1557953 - RNA, 19 nt, Homo sapiens
gaagaaggaggaauauauu

SEQ ID NO: 1557954 - RNA, 19 nt, Homo sapiens
gguaacaacuuuaauccuu

SEQ ID NO: 1557955 - RNA, 19 nt, Homo sapiens
ggaaggacauucuaugagu

SEQ ID NO: 1557956 - RNA, 19 nt, Homo sapiens
guuccaagaugguugaaua

SEQ ID NO: 1557957 - RNA, 19 nt, Homo sapiens
gaccugcaauuauaaguaa

SEQ ID NO: 1557958 - RNA, 19 nt, Homo sapiens
ggcauggacucauauagua

SEQ ID NO: 1557959 - RNA, 19 nt, Homo sapiens
gaccagcgcaguacuguua

SEQ ID NO: 1557960 - RNA, 19 nt, Homo sapiens
caagaugguugaauaggaa

SEQ ID NO: 1557961 - RNA, 19 nt, Homo sapiens
gcaagcgaauaucuacuaa

SEQ ID NO: 1557962 - RNA, 19 nt, Homo sapiens
ccaagcagcucugaaagaa

SEQ ID NO: 1557963 - RNA, 19 nt, Homo sapiens
acaauucaccuacccauua

SEQ ID NO: 1557964 - RNA, 19 nt, Homo sapiens
gaacgagaaaccauggaua

SEQ ID NO: 1557965 - RNA, 19 nt, Homo sapiens
caucucagguaacaacuuu

SEQ ID NO: 1557966 - RNA, 19 nt, Homo sapiens
gugcaaagaagacaagaua

SEQ ID NO: 1557967 - RNA, 19 nt, Homo sapiens
guaagaugcuugagaaguc

SEQ ID NO: 1557968 - RNA, 19 nt, Homo sapiens
gauggaagaaggaggaaua

SEQ ID NO: 1557969 - RNA, 19 nt, Homo sapiens
cggaagaauugcacucuaa

SEQ ID NO: 1557970 - RNA, 19 nt, Homo sapiens
uaaaagcccugcuguaauu

SEQ ID NO: 1557971 - RNA, 19 nt, Homo sapiens
acacaugucuuggauuaaa

SEQ ID NO: 1557972 - RNA, 19 nt, Homo sapiens
ggacuacaguacaucaaau

SEQ ID NO: 1557973 - RNA, 19 nt, Homo sapiens
aaagagccaucucagguaa

SEQ ID NO: 1557974 - RNA, 19 nt, Homo sapiens
acaguaagaugcuugagaa

SEQ ID NO: 1557975 - RNA, 19 nt, Homo sapiens
cacaaggcauggacucaua

SEQ ID NO: 1557976 - RNA, 19 nt, Homo sapiens
ggagauacuuguguaguca

SEQ ID NO: 1557977 - RNA, 19 nt, Homo sapiens
aaacauagaugagcaaagg

SEQ ID NO: 1557978 - RNA, 19 nt, Homo sapiens
uagaagcacggaugaaaua

SEQ ID NO: 1557979 - RNA, 19 nt, Homo sapiens
gcgcagagcugagaugucu

SEQ ID NO: 1557980 - RNA, 19 nt, Homo sapiens
gaaacaggaagcuaaaugu

SEQ ID NO: 1557981 - RNA, 19 nt, Homo sapiens
gacauguucugcacuauuc

SEQ ID NO: 1557982 - RNA, 19 nt, Homo sapiens
aagcgaauaucuacuaaga

SEQ ID NO: 1557983 - RNA, 19 nt, Homo sapiens
ucagaaacuugcauaugaa

SEQ ID NO: 1557984 - RNA, 19 nt, Homo sapiens
caaagagccaucucaggua

SEQ ID NO: 1557985 - RNA, 19 nt, Homo sapiens
gaggugcaguccaggagua

SEQ ID NO: 1557986 - RNA, 19 nt, Homo sapiens
cucagaaacuugcauauga

SEQ ID NO: 1557987 - RNA, 19 nt, Homo sapiens
ccaagaugguugaauagga

SEQ ID NO: 1557988 - RNA, 19 nt, Homo sapiens
ucagagagaguauaacaaa

SEQ ID NO: 1557989 - RNA, 19 nt, Homo sapiens
uaugugaucugaaugacaa

SEQ ID NO: 1557990 - RNA, 19 nt, Homo sapiens
gcacagaguagucggucua

SEQ ID NO: 1557991 - RNA, 19 nt, Homo sapiens
gaaauagaaugaggugcau

SEQ ID NO: 1557992 - RNA, 19 nt, Homo sapiens
gagcugccauuuaagaagu

SEQ ID NO: 1557993 - RNA, 19 nt, Homo sapiens
guucagauuuggacacaug

SEQ ID NO: 1557994 - RNA, 19 nt, Homo sapiens
ggauaugugaucugaauga

SEQ ID NO: 1557995 - RNA, 19 nt, Homo sapiens
gaugggugauuucugcauu

SEQ ID NO: 1557996 - RNA, 19 nt, Homo sapiens
aagcacggaugaaauaaga

SEQ ID NO: 1557997 - RNA, 19 nt, Homo sapiens
acuguuaacuguucugauu

SEQ ID NO: 1557998 - RNA, 19 nt, Homo sapiens
caauguaaacugucaaaga

SEQ ID NO: 1557999 - RNA, 19 nt, Homo sapiens
ucuaaacucugccuugaug

SEQ ID NO: 1558000 - RNA, 19 nt, Homo sapiens
gcauggaccuauucauuuu

SEQ ID NO: 1558001 - RNA, 19 nt, Homo sapiens
uguaaacugucaaagacua

SEQ ID NO: 1558002 - RNA, 19 nt, Homo sapiens
caaccauccuccugcagaa

SEQ ID NO: 1558003 - RNA, 19 nt, Homo sapiens
gcagaaauugaaacugaaa

SEQ ID NO: 1558004 - RNA, 19 nt, Homo sapiens
ugagaugcauggaccuauu

SEQ ID NO: 1558005 - RNA, 19 nt, Homo sapiens
ggacacaugccguggguau

SEQ ID NO: 1558006 - RNA, 19 nt, Homo sapiens
caagugugauuaugauagu

SEQ ID NO: 1558007 - RNA, 19 nt, Homo sapiens
gagaauggagccuuagaau

SEQ ID NO: 1558008 - RNA, 19 nt, Homo sapiens
ggaguagggcagaaauuga

SEQ ID NO: 1558009 - RNA, 19 nt, Homo sapiens
auccugagcugccauuuaa

SEQ ID NO: 1558010 - RNA, 19 nt, Homo sapiens
uaugggagauacuugugua

SEQ ID NO: 1558011 - RNA, 19 nt, Homo sapiens
gaugaagauuguagaagca

SEQ ID NO: 1558012 - RNA, 19 nt, Homo sapiens
ccacugauacugacauguu

SEQ ID NO: 1558013 - RNA, 19 nt, Homo sapiens
gaacagcuccagucuacag

SEQ ID NO: 1558014 - RNA, 19 nt, Homo sapiens
ggagggaccacacaaagau

SEQ ID NO: 1558015 - RNA, 19 nt, Homo sapiens
aaaccaauguaaacuguca

SEQ ID NO: 1558016 - RNA, 19 nt, Homo sapiens
caaaagaaacugugagaaa

SEQ ID NO: 1558017 - RNA, 19 nt, Homo sapiens
ucagaaauauccagcaaac

SEQ ID NO: 1558018 - RNA, 19 nt, Homo sapiens
gaaaaugauuaccaagaga

SEQ ID NO: 1558019 - RNA, 19 nt, Homo sapiens
caagagaagacaccacaga

SEQ ID NO: 1558020 - RNA, 19 nt, Homo sapiens
acugacagaugcauuagaa

SEQ ID NO: 1558021 - RNA, 19 nt, Homo sapiens
ucaguggaguuaccuucua

SEQ ID NO: 1558022 - RNA, 19 nt, Homo sapiens
agaaaccaauguaaacugu

SEQ ID NO: 1558023 - RNA, 19 nt, Homo sapiens
gaaagaagaaagcaaaaga

SEQ ID NO: 1558024 - RNA, 19 nt, Homo sapiens
aaacagcaagugcaacgua

SEQ ID NO: 1558025 - RNA, 19 nt, Homo sapiens
uaagaagccagacguaugu

SEQ ID NO: 1558026 - RNA, 19 nt, Homo sapiens
gaguagggcagaaauugaa

SEQ ID NO: 1558027 - RNA, 19 nt, Homo sapiens
gaucaagcaggaaagaaga

SEQ ID NO: 1558028 - RNA, 19 nt, Homo sapiens
cgcagaagaugggugauuu

SEQ ID NO: 1558029 - RNA, 19 nt, Homo sapiens
ugaauaaugaccugcaauu

SEQ ID NO: 1558030 - RNA, 19 nt, Homo sapiens
acucauccauuauguguug

SEQ ID NO: 1558031 - RNA, 19 nt, Homo sapiens
gagcaaaggauaaagaaaa

SEQ ID NO: 1558032 - RNA, 19 nt, Homo sapiens
gaugagcaaaggauaaaga

SEQ ID NO: 1558033 - RNA, 19 nt, Homo sapiens
gaaccagucuacuccuaac

SEQ ID NO: 1558034 - RNA, 19 nt, Homo sapiens
uaaacagucuaggaaauag

SEQ ID NO: 1558035 - RNA, 19 nt, Homo sapiens
gcacuuuccaccuuuacaa

SEQ ID NO: 1558036 - RNA, 19 nt, Homo sapiens
gaagccagacguaugugaa

SEQ ID NO: 1558037 - RNA, 19 nt, Homo sapiens
aaacuuccgcuauuccuuu

SEQ ID NO: 1558038 - RNA, 19 nt, Homo sapiens
gggagauacuuguguaguc

SEQ ID NO: 1558039 - RNA, 19 nt, Homo sapiens
gcgagaagcuugugaaguu

SEQ ID NO: 1558040 - RNA, 19 nt, Homo sapiens
uaacaggccugguauuuau

SEQ ID NO: 1558041 - RNA, 19 nt, Homo sapiens
caagucaucuuaacuaaug

SEQ ID NO: 1558042 - RNA, 19 nt, Homo sapiens
gaucuucccuuguaaaugu

SEQ ID NO: 1558043 - RNA, 19 nt, Homo sapiens
gaaauuucaucaggcaaua

SEQ ID NO: 1558044 - RNA, 19 nt, Homo sapiens
caaagacuauagacuguaa

SEQ ID NO: 1558045 - RNA, 19 nt, Homo sapiens
gacaucaccuucccaguuu

SEQ ID NO: 1558046 - RNA, 19 nt, Homo sapiens
guacaaucccuuaccaaua

SEQ ID NO: 1558047 - RNA, 19 nt, Homo sapiens
guacuugacuguccugaug

SEQ ID NO: 1558048 - RNA, 19 nt, Homo sapiens
gaaccaagaacauguuuau

SEQ ID NO: 1558049 - RNA, 19 nt, Homo sapiens
gaccacaacuuuccuagga

SEQ ID NO: 1558050 - RNA, 19 nt, Homo sapiens
gcagaagcaagucaucuua

SEQ ID NO: 1558051 - RNA, 19 nt, Homo sapiens
caaggaagcaucugacaaa

SEQ ID NO: 1558052 - RNA, 19 nt, Homo sapiens
ucagagacauuguacuuga

SEQ ID NO: 1558053 - RNA, 19 nt, Homo sapiens
ucaagucacuggaaguaaa

SEQ ID NO: 1558054 - RNA, 19 nt, Homo sapiens
gcaccuggaaguucuguua

SEQ ID NO: 1558055 - RNA, 19 nt, Homo sapiens
gcaguaacagucccaagua

SEQ ID NO: 1558056 - RNA, 19 nt, Homo sapiens
uugcagaucuucccuugua

SEQ ID NO: 1558057 - RNA, 19 nt, Homo sapiens
uuacagaggccacaacuuu

SEQ ID NO: 1558058 - RNA, 19 nt, Homo sapiens
caacugggaucaccaacau

SEQ ID NO: 1558059 - RNA, 19 nt, Homo sapiens
gcaaagcaaggaacuagaa

SEQ ID NO: 1558060 - RNA, 19 nt, Homo sapiens
gacaggagcuaccacuaga

SEQ ID NO: 1558061 - RNA, 19 nt, Homo sapiens
cgaccuucauguacaguua

SEQ ID NO: 1558062 - RNA, 19 nt, Homo sapiens
cuacagugguugcaagaaa

SEQ ID NO: 1558063 - RNA, 19 nt, Homo sapiens
gaagcuacgacguccuuua

SEQ ID NO: 1558064 - RNA, 19 nt, Homo sapiens
gaacuagaagcacaauaga

SEQ ID NO: 1558065 - RNA, 19 nt, Homo sapiens
ggaacuagaagcacaauag

SEQ ID NO: 1558066 - RNA, 19 nt, Homo sapiens
gaucaagucacuggaagua

SEQ ID NO: 1558067 - RNA, 19 nt, Homo sapiens
gcacagcagcuacaacuuc

SEQ ID NO: 1558068 - RNA, 19 nt, Homo sapiens
uaacaauacugacuaugag

SEQ ID NO: 1558069 - RNA, 19 nt, Homo sapiens
guaacaggcucuggaacaa

SEQ ID NO: 1558070 - RNA, 19 nt, Homo sapiens
gaagaaaacuaugaacuca

SEQ ID NO: 1558071 - RNA, 19 nt, Homo sapiens
gaaaucggauacugugaac

SEQ ID NO: 1558072 - RNA, 19 nt, Homo sapiens
aaugacaccugcugugaaa

SEQ ID NO: 1558073 - RNA, 19 nt, Homo sapiens
ccacugaggcuggaaguaa

SEQ ID NO: 1558074 - RNA, 19 nt, Homo sapiens
gccaaacccuggaagugaa

SEQ ID NO: 1558075 - RNA, 19 nt, Homo sapiens
caguaacagucccaaguaa

SEQ ID NO: 1558076 - RNA, 19 nt, Homo sapiens
gcuaaagugcucucuggua

SEQ ID NO: 1558077 - RNA, 19 nt, Homo sapiens
gaacauucaugccuuugcu

SEQ ID NO: 1558078 - RNA, 19 nt, Homo sapiens
ccaacaagaccacaaguau

SEQ ID NO: 1558079 - RNA, 19 nt, Homo sapiens
agacugccaaguacaauua

SEQ ID NO: 1558080 - RNA, 19 nt, Homo sapiens
gggaucaccaacauaauuu

SEQ ID NO: 1558081 - RNA, 19 nt, Homo sapiens
acacaaaggcuaccacuuc

SEQ ID NO: 1558082 - RNA, 19 nt, Homo sapiens
uuagacauaugccaacuau

SEQ ID NO: 1558083 - RNA, 19 nt, Homo sapiens
uacaaucccuuaccaauac

SEQ ID NO: 1558084 - RNA, 19 nt, Homo sapiens
guacugaugcaaagacuau

SEQ ID NO: 1558085 - RNA, 19 nt, Homo sapiens
ugacaucaccuucccaguu

SEQ ID NO: 1558086 - RNA, 19 nt, Homo sapiens
ugagauuggugcuucauuc

SEQ ID NO: 1558087 - RNA, 19 nt, Homo sapiens
cauagucucuggcacaaca

SEQ ID NO: 1558088 - RNA, 19 nt, Homo sapiens
acucagaggcuacaacuuu

SEQ ID NO: 1558089 - RNA, 19 nt, Homo sapiens
uauauacgaccuucaugua

SEQ ID NO: 1558090 - RNA, 19 nt, Homo sapiens
gcaguacaaucccuuacca

SEQ ID NO: 1558091 - RNA, 19 nt, Homo sapiens
gggcuuugcugcaguaguc

SEQ ID NO: 1558092 - RNA, 19 nt, Homo sapiens
gcaaagacuauagacugua

SEQ ID NO: 1558093 - RNA, 19 nt, Homo sapiens
cccagaaacuuccaucuca

SEQ ID NO: 1558094 - RNA, 19 nt, Homo sapiens
cugcagagaccacaacuuu

SEQ ID NO: 1558095 - RNA, 19 nt, Homo sapiens
ggacagaagacaggagcua

SEQ ID NO: 1558096 - RNA, 19 nt, Homo sapiens
gcuacaacuuucucuggaa

SEQ ID NO: 1558097 - RNA, 19 nt, Homo sapiens
ccacaggagucaaagaaac

SEQ ID NO: 1558098 - RNA, 19 nt, Homo sapiens
uagcaccacuggagcagaa

SEQ ID NO: 1558099 - RNA, 19 nt, Homo sapiens
gcagaucuucccuuguaaa

SEQ ID NO: 1558100 - RNA, 19 nt, Homo sapiens
ggaguggucucuggcaaca

SEQ ID NO: 1558101 - RNA, 19 nt, Homo sapiens
ggaaugaauacagguacua

SEQ ID NO: 1558102 - RNA, 19 nt, Homo sapiens
gaccugcucuuguuuagac

SEQ ID NO: 1558103 - RNA, 19 nt, Homo sapiens
cacaggaaguggaaugaau

SEQ ID NO: 1558104 - RNA, 19 nt, Homo sapiens
uuaacaggccugguauuua

SEQ ID NO: 1558105 - RNA, 19 nt, Homo sapiens
gaacucagagacauuguac

SEQ ID NO: 1558106 - RNA, 19 nt, Homo sapiens
gauuggugcuucauucgau

SEQ ID NO: 1558107 - RNA, 19 nt, Homo sapiens
ccacaggaguccauagaac

SEQ ID NO: 1558108 - RNA, 19 nt, Homo sapiens
aaaugugacuguuaucuac

SEQ ID NO: 1558109 - RNA, 19 nt, Homo sapiens
aagcaagucaucuuaacua

SEQ ID NO: 1558110 - RNA, 19 nt, Homo sapiens
caacaagaccacaaguauc

SEQ ID NO: 1558111 - RNA, 19 nt, Homo sapiens
ggagguuucagaacagauu

SEQ ID NO: 1558112 - RNA, 19 nt, Homo sapiens
uauacgaccuucauguaca

SEQ ID NO: 1558113 - RNA, 19 nt, Homo sapiens
gcaagucaucuuaacuaau

SEQ ID NO: 1558114 - RNA, 19 nt, Homo sapiens
guaagacaggcacagcuaa

SEQ ID NO: 1558115 - RNA, 19 nt, Homo sapiens
uggaaccacugaagcagaa

SEQ ID NO: 1558116 - RNA, 19 nt, Homo sapiens
gggagaagccaaccuacug

SEQ ID NO: 1558117 - RNA, 19 nt, Homo sapiens
ggccaaacccuggaaguga

SEQ ID NO: 1558118 - RNA, 19 nt, Homo sapiens
acaggaaguggaaugaaua

SEQ ID NO: 1558119 - RNA, 19 nt, Homo sapiens
cuacaacuuucucuggaau

SEQ ID NO: 1558120 - RNA, 19 nt, Homo sapiens
gugaaaagacugccaagua

SEQ ID NO: 1558121 - RNA, 19 nt, Homo sapiens
gaggaagacagaaucuaug

SEQ ID NO: 1558122 - RNA, 19 nt, Homo sapiens
ugaggaagacagaaucuau

SEQ ID NO: 1558123 - RNA, 19 nt, Homo sapiens
cagaagcaagucaucuuaa

SEQ ID NO: 1558124 - RNA, 19 nt, Homo sapiens
gcaaaccuggugugcagaa

SEQ ID NO: 1558125 - RNA, 19 nt, Homo sapiens
cauauggacugccaauugc

SEQ ID NO: 1558126 - RNA, 19 nt, Homo sapiens
gccaacaagaccacaagua

SEQ ID NO: 1558127 - RNA, 19 nt, Homo sapiens
uaagacaggcacagcuaaa

SEQ ID NO: 1558128 - RNA, 19 nt, Homo sapiens
caucucaccuagcaguuuc

SEQ ID NO: 1558129 - RNA, 19 nt, Homo sapiens
gcuacgacguccuuuagag

SEQ ID NO: 1558130 - RNA, 19 nt, Homo sapiens
gcucuuguuuagacauaug

SEQ ID NO: 1558131 - RNA, 19 nt, Homo sapiens
cggauacugugaaccaaga

SEQ ID NO: 1558132 - RNA, 19 nt, Homo sapiens
acauauggacugccaauug

SEQ ID NO: 1558133 - RNA, 19 nt, Homo sapiens
ccacugaagcagaaauuuc

SEQ ID NO: 1558134 - RNA, 19 nt, Homo sapiens
gccaaguacaauuaugaua

SEQ ID NO: 1558135 - RNA, 19 nt, Homo sapiens
ugaaaucggauacugugaa

SEQ ID NO: 1558136 - RNA, 19 nt, Homo sapiens
cuugugaaguuccaaucua

SEQ ID NO: 1558137 - RNA, 19 nt, Homo sapiens
gccaauugccacagaggua

SEQ ID NO: 1558138 - RNA, 19 nt, Homo sapiens
cacugaggcuggaaguaaa

SEQ ID NO: 1558139 - RNA, 19 nt, Homo sapiens
caacagagcuuacagaaug

SEQ ID NO: 1558140 - RNA, 19 nt, Homo sapiens
gaacaaagaaugaguacuu

SEQ ID NO: 1558141 - RNA, 19 nt, Homo sapiens
gaucagauauccacacaga

SEQ ID NO: 1558142 - RNA, 19 nt, Homo sapiens
caagccagcuaauauuuaa

SEQ ID NO: 1558143 - RNA, 19 nt, Homo sapiens
gaagagagacuuuguacau

SEQ ID NO: 1558144 - RNA, 19 nt, Homo sapiens
ggauacagcugaugguguu

SEQ ID NO: 1558145 - RNA, 19 nt, Homo sapiens
cgaaaccucaucucuauua

SEQ ID NO: 1558146 - RNA, 19 nt, Homo sapiens
gcaagccagcuaauauuua

SEQ ID NO: 1558147 - RNA, 19 nt, Homo sapiens
gaaaccucaucucuauuaa

SEQ ID NO: 1558148 - RNA, 19 nt, Homo sapiens
ugauuucccuuaucucaua

SEQ ID NO: 1558149 - RNA, 19 nt, Homo sapiens
ggcgaaaccucaucucuau

SEQ ID NO: 1558150 - RNA, 19 nt, Homo sapiens
ggucaacccugggcuauga

SEQ ID NO: 1558151 - RNA, 19 nt, Homo sapiens
cgaagaaauuguggaagua

SEQ ID NO: 1558152 - RNA, 19 nt, Homo sapiens
gcaaaaugcuccugucuga

SEQ ID NO: 1558153 - RNA, 19 nt, Homo sapiens
ccaaacuccuaucuccuua

SEQ ID NO: 1558154 - RNA, 19 nt, Homo sapiens
gauccuaagcucuaaguaa

SEQ ID NO: 1558155 - RNA, 19 nt, Homo sapiens
gcuaugagauuuuguacua

SEQ ID NO: 1558156 - RNA, 19 nt, Homo sapiens
ggaugacuccgaagaaauu

SEQ ID NO: 1558157 - RNA, 19 nt, Homo sapiens
gcacaaaauucuguaauga

SEQ ID NO: 1558158 - RNA, 19 nt, Homo sapiens
gucucuagcugauguauuu

SEQ ID NO: 1558159 - RNA, 19 nt, Homo sapiens
uaacaugauuucccuuauc

SEQ ID NO: 1558160 - RNA, 19 nt, Homo sapiens
guacagaaagaacuuagaa

SEQ ID NO: 1558161 - RNA, 19 nt, Homo sapiens
gaagggcuaugaaaagaaa

SEQ ID NO: 1558162 - RNA, 19 nt, Homo sapiens
ccauccugcuucuugauua

SEQ ID NO: 1558163 - RNA, 19 nt, Homo sapiens
aaguaaagcuauugccaaa

SEQ ID NO: 1558164 - RNA, 19 nt, Homo sapiens
gccauuauguuucaguaga

SEQ ID NO: 1558165 - RNA, 19 nt, Homo sapiens
uccaacagguccagccuua

SEQ ID NO: 1558166 - RNA, 19 nt, Homo sapiens
agaaagaacuuagaaacca

SEQ ID NO: 1558167 - RNA, 19 nt, Homo sapiens
agaccuagauggaaaauaa

SEQ ID NO: 1558168 - RNA, 19 nt, Homo sapiens
uaacuggccuccugcucuu

SEQ ID NO: 1558169 - RNA, 19 nt, Homo sapiens
gcaguuuccucaagugucu

SEQ ID NO: 1558170 - RNA, 19 nt, Homo sapiens
gcagguugacauaguuuaa

SEQ ID NO: 1558171 - RNA, 19 nt, Homo sapiens
ggagcacaguguccauaga

SEQ ID NO: 1558172 - RNA, 19 nt, Homo sapiens
caacagguccagccuuaug

SEQ ID NO: 1558173 - RNA, 19 nt, Homo sapiens
ccgaagaaauuguggaagu

SEQ ID NO: 1558174 - RNA, 19 nt, Homo sapiens
aaacuucugcucccucuaa

SEQ ID NO: 1558175 - RNA, 19 nt, Homo sapiens
ccagacaccugcuccaucu

SEQ ID NO: 1558176 - RNA, 19 nt, Homo sapiens
gaucaaccguucaauucag

SEQ ID NO: 1558177 - RNA, 19 nt, Homo sapiens
gcacaccuccugacacauc

SEQ ID NO: 1558178 - RNA, 19 nt, Homo sapiens
gaggcaagaauuacucaaa

SEQ ID NO: 1558179 - RNA, 19 nt, Homo sapiens
ggcaagaauuacucaaaca

SEQ ID NO: 1558180 - RNA, 19 nt, Homo sapiens
gaggcugaggcaagaauua

SEQ ID NO: 1558181 - RNA, 19 nt, Homo sapiens
gagacuuuguacauccaua

SEQ ID NO: 1558182 - RNA, 19 nt, Homo sapiens
gaaaagguccaaacuccua

SEQ ID NO: 1558183 - RNA, 19 nt, Homo sapiens
guggaugacuccgaagaaa

SEQ ID NO: 1558184 - RNA, 19 nt, Homo sapiens
ccugugaucccaacacuuu

SEQ ID NO: 1558185 - RNA, 19 nt, Homo sapiens
caguuuacacucuuacaua

SEQ ID NO: 1558186 - RNA, 19 nt, Homo sapiens
ugaacgauaucgaucagau

SEQ ID NO: 1558187 - RNA, 19 nt, Homo sapiens
ucugauaccaccuauguaa

SEQ ID NO: 1558188 - RNA, 19 nt, Homo sapiens
acagcaguauggaauguuu

SEQ ID NO: 1558189 - RNA, 19 nt, Homo sapiens
guauugauguauggugaaa

SEQ ID NO: 1558190 - RNA, 19 nt, Homo sapiens
ggagagccuuuaggaguca

SEQ ID NO: 1558191 - RNA, 19 nt, Homo sapiens
gcauaaagaacagaagaug

SEQ ID NO: 1558192 - RNA, 19 nt, Homo sapiens
auccuaagcucuaaguaaa

SEQ ID NO: 1558193 - RNA, 19 nt, Homo sapiens
ccacggagaggucaaagga

SEQ ID NO: 1558194 - RNA, 19 nt, Homo sapiens
gauaccaccuauguaagug

SEQ ID NO: 1558195 - RNA, 19 nt, Homo sapiens
gcaguacagaaagaacuua

SEQ ID NO: 1558196 - RNA, 19 nt, Homo sapiens
gcaacagagcuuacagaau

SEQ ID NO: 1558197 - RNA, 19 nt, Homo sapiens
cucaucaucuuccucaauu

SEQ ID NO: 1558198 - RNA, 19 nt, Homo sapiens
gagccagggaugaacgaua

SEQ ID NO: 1558199 - RNA, 19 nt, Homo sapiens
gcagugagccgagauugca

SEQ ID NO: 1558200 - RNA, 19 nt, Homo sapiens
uuacgcagguugacauagu

SEQ ID NO: 1558201 - RNA, 19 nt, Homo sapiens
gaauuacgcagguugacau

SEQ ID NO: 1558202 - RNA, 19 nt, Homo sapiens
uuaaaggcaugcacaaagg

SEQ ID NO: 1558203 - RNA, 19 nt, Homo sapiens
gcucucugcugccuugcaa

SEQ ID NO: 1558204 - RNA, 19 nt, Homo sapiens
aaaaggcgauccacauuug

SEQ ID NO: 1558205 - RNA, 19 nt, Homo sapiens
uggcaaagcauaaagaaca

SEQ ID NO: 1558206 - RNA, 19 nt, Homo sapiens
gaugaacgauaucgaucag

SEQ ID NO: 1558207 - RNA, 19 nt, Homo sapiens
aaacuccuaucuccuuaca

SEQ ID NO: 1558208 - RNA, 19 nt, Homo sapiens
aaaggauccuaagcucuaa

SEQ ID NO: 1558209 - RNA, 19 nt, Homo sapiens
ggaucaaccguucaauuca

SEQ ID NO: 1558210 - RNA, 19 nt, Homo sapiens
gaacagaagauggcuuugc

SEQ ID NO: 1558211 - RNA, 19 nt, Homo sapiens
cuuacaacauuucugaaga

SEQ ID NO: 1558212 - RNA, 19 nt, Homo sapiens
cuuuaggagucaucuguaa

SEQ ID NO: 1558213 - RNA, 19 nt, Homo sapiens
gcagaugaccccugugaaa

SEQ ID NO: 1558214 - RNA, 19 nt, Homo sapiens
ccaauacucgaauagagaa

SEQ ID NO: 1558215 - RNA, 19 nt, Homo sapiens
gccaauacucgaauagaga

SEQ ID NO: 1558216 - RNA, 19 nt, Homo sapiens
ggaugaacgauaucgauca

SEQ ID NO: 1558217 - RNA, 19 nt, Homo sapiens
ccucagaagcuguauauac

SEQ ID NO: 1558218 - RNA, 19 nt, Homo sapiens
cagaauaucauggguagug

SEQ ID NO: 1558219 - RNA, 19 nt, Homo sapiens
cuucugcucccucuaagua

SEQ ID NO: 1558220 - RNA, 19 nt, Homo sapiens
gaggaugagggcucucuga

SEQ ID NO: 1558221 - RNA, 19 nt, Homo sapiens
caaagcauaaagaacagaa

SEQ ID NO: 1558222 - RNA, 19 nt, Homo sapiens
ugauucagcaguacagaaa

SEQ ID NO: 1558223 - RNA, 19 nt, Homo sapiens
cauccugcuucuugauuau

SEQ ID NO: 1558224 - RNA, 19 nt, Homo sapiens
gaagaaauuguggaaguac

SEQ ID NO: 1558225 - RNA, 19 nt, Homo sapiens
guuaaaggcaugcacaaag

SEQ ID NO: 1558226 - RNA, 19 nt, Homo sapiens
agccagggaugaacgauau

SEQ ID NO: 1558227 - RNA, 19 nt, Homo sapiens
gaucguccacuucuucauc

SEQ ID NO: 1558228 - RNA, 19 nt, Homo sapiens
aagaacagaagauggcuuu

SEQ ID NO: 1558229 - RNA, 19 nt, Homo sapiens
gaccagcccggacaacaug

SEQ ID NO: 1558230 - RNA, 19 nt, Homo sapiens
ucaauucgcccagcaaaca

SEQ ID NO: 1558231 - RNA, 19 nt, Homo sapiens
ccugaugucacuacaacua

SEQ ID NO: 1558232 - RNA, 19 nt, Homo sapiens
ucagauauccacacagaag

SEQ ID NO: 1558233 - RNA, 19 nt, Homo sapiens
gcaagaauuacucaaacag

SEQ ID NO: 1558234 - RNA, 19 nt, Homo sapiens
gaagggaguaggaaaagaa

SEQ ID NO: 1558235 - RNA, 19 nt, Homo sapiens
gagggaagggaguaggaaa

SEQ ID NO: 1558236 - RNA, 19 nt, Homo sapiens
gagagacuuuguacaucca

SEQ ID NO: 1558237 - RNA, 19 nt, Homo sapiens
ugacugcacuggacaugac

SEQ ID NO: 1558238 - RNA, 19 nt, Homo sapiens
ucacuacaacuaccucuuc

SEQ ID NO: 1558239 - RNA, 19 nt, Homo sapiens
ggacaaaucugaacuaauu

SEQ ID NO: 1558240 - RNA, 19 nt, Homo sapiens
ggaaacauauggacuauaa

SEQ ID NO: 1558241 - RNA, 19 nt, Homo sapiens
gaguuuaucugauuccuua

SEQ ID NO: 1558242 - RNA, 19 nt, Homo sapiens
gcucacaacucccuauuaa

SEQ ID NO: 1558243 - RNA, 19 nt, Homo sapiens
caaagacacuggucaaguu

SEQ ID NO: 1558244 - RNA, 19 nt, Homo sapiens
ggacuggccuagcuauaaa

SEQ ID NO: 1558245 - RNA, 19 nt, Homo sapiens
gaacugaagauuuccauug

SEQ ID NO: 1558246 - RNA, 19 nt, Homo sapiens
gagaggaaaugcuuuaagu

SEQ ID NO: 1558247 - RNA, 19 nt, Homo sapiens
ggagagaggaaaugcuuua

SEQ ID NO: 1558248 - RNA, 19 nt, Homo sapiens
gcaacauacugcuuucauu

SEQ ID NO: 1558249 - RNA, 19 nt, Homo sapiens
uggcagaggugcagaaauu

SEQ ID NO: 1558250 - RNA, 19 nt, Homo sapiens
ggaaugaaauauccaagag

SEQ ID NO: 1558251 - RNA, 19 nt, Homo sapiens
ggacuguauugugacauua

SEQ ID NO: 1558252 - RNA, 19 nt, Homo sapiens
guagauaguuauucaguag

SEQ ID NO: 1558253 - RNA, 19 nt, Homo sapiens
gaggaaaugcuuuaaguug

SEQ ID NO: 1558254 - RNA, 19 nt, Homo sapiens
uaucugagguccuguauag

SEQ ID NO: 1558255 - RNA, 19 nt, Homo sapiens
gaacccaucuucacagcau

SEQ ID NO: 1558256 - RNA, 19 nt, Homo sapiens
ggaaaugcuuuaaguuguc

SEQ ID NO: 1558257 - RNA, 19 nt, Homo sapiens
gggcuuugauugcauuauu

SEQ ID NO: 1558258 - RNA, 19 nt, Homo sapiens
cauacugcuuucauucuua

SEQ ID NO: 1558259 - RNA, 19 nt, Homo sapiens
uacauguucugcugcauua

SEQ ID NO: 1558260 - RNA, 19 nt, Homo sapiens
gcuuuaaguuguccuaaga

SEQ ID NO: 1558261 - RNA, 19 nt, Homo sapiens
gaacugcaagaauaugaaa

SEQ ID NO: 1558262 - RNA, 19 nt, Homo sapiens
uagcaguacuccagauuga

SEQ ID NO: 1558263 - RNA, 19 nt, Homo sapiens
gccaaugccugcucucuuc

SEQ ID NO: 1558264 - RNA, 19 nt, Homo sapiens
gaaaggauugcaacuguca

SEQ ID NO: 1558265 - RNA, 19 nt, Homo sapiens
cuaaugaauugauggaaug

SEQ ID NO: 1558266 - RNA, 19 nt, Homo sapiens
gaacuagggcagccuggaa

SEQ ID NO: 1558267 - RNA, 19 nt, Homo sapiens
gggacuguauugugacauu

SEQ ID NO: 1558268 - RNA, 19 nt, Homo sapiens
caacauacugcuuucauuc

SEQ ID NO: 1558269 - RNA, 19 nt, Homo sapiens
caagaugucuguggaaagg

SEQ ID NO: 1558270 - RNA, 19 nt, Homo sapiens
auugggaacugcaagaaua

SEQ ID NO: 1558271 - RNA, 19 nt, Homo sapiens
gauugcaacugucauccuu

SEQ ID NO: 1558272 - RNA, 19 nt, Homo sapiens
agaaaugaaugaagaggau

SEQ ID NO: 1558273 - RNA, 19 nt, Homo sapiens
gaaagcuggguuggacuua

SEQ ID NO: 1558274 - RNA, 19 nt, Homo sapiens
gaagauuuccauugaugug

SEQ ID NO: 1558275 - RNA, 19 nt, Homo sapiens
uggaaaggauugcaacugu

SEQ ID NO: 1558276 - RNA, 19 nt, Homo sapiens
gagccuguguuccaagaug

SEQ ID NO: 1558277 - RNA, 19 nt, Homo sapiens
gaacuaauuccuugagacu

SEQ ID NO: 1558278 - RNA, 19 nt, Homo sapiens
gcucucuucucaccacauu

SEQ ID NO: 1558279 - RNA, 19 nt, Homo sapiens
gcacacagagaguuuaucu

SEQ ID NO: 1558280 - RNA, 19 nt, Homo sapiens
ggguuggacuuacacaaga

SEQ ID NO: 1558281 - RNA, 19 nt, Homo sapiens
gugaagcacaauuuaauga

SEQ ID NO: 1558282 - RNA, 19 nt, Homo sapiens
gugacauuaucaaccuuua

SEQ ID NO: 1558283 - RNA, 19 nt, Homo sapiens
gcaguacuccagauugaga

SEQ ID NO: 1558284 - RNA, 19 nt, Homo sapiens
uaugggaacucaucaaagg

SEQ ID NO: 1558285 - RNA, 19 nt, Homo sapiens
ccuaaugaauugauggaau

SEQ ID NO: 1558286 - RNA, 19 nt, Homo sapiens
acugaaagcugaguuggaa

SEQ ID NO: 1558287 - RNA, 19 nt, Homo sapiens
guacugggauugggaacug

SEQ ID NO: 1558288 - RNA, 19 nt, Homo sapiens
ggcuuugauugcauuauuu

SEQ ID NO: 1558289 - RNA, 19 nt, Homo sapiens
gaaccugugugagcuacau

SEQ ID NO: 1558290 - RNA, 19 nt, Homo sapiens
gaaugaaauauccaagaga

SEQ ID NO: 1558291 - RNA, 19 nt, Homo sapiens
aggcagaucuuuccaaggu

SEQ ID NO: 1558292 - RNA, 19 nt, Homo sapiens
cagagcaacugcaugucuu

SEQ ID NO: 1558293 - RNA, 19 nt, Homo sapiens
ucucuguccucuagaacua

SEQ ID NO: 1558294 - RNA, 19 nt, Homo sapiens
cugaagauuuccauugaug

SEQ ID NO: 1558295 - RNA, 19 nt, Homo sapiens
ccaccuccuugacauuuau

SEQ ID NO: 1558296 - RNA, 19 nt, Homo sapiens
aaaugagucccuuugcaua

SEQ ID NO: 1558297 - RNA, 19 nt, Homo sapiens
guacuuugucagcaacaua

SEQ ID NO: 1558298 - RNA, 19 nt, Homo sapiens
ucacaacucccuauuaagg

SEQ ID NO: 1558299 - RNA, 19 nt, Homo sapiens
gaggaggcauucaaacacu

SEQ ID NO: 1558300 - RNA, 19 nt, Homo sapiens
gcuauaaacaccagcaaca

SEQ ID NO: 1558301 - RNA, 19 nt, Homo sapiens
gcagaggugcagaaauuuc

SEQ ID NO: 1558302 - RNA, 19 nt, Homo sapiens
caagaauacccugaucuga

SEQ ID NO: 1558303 - RNA, 19 nt, Homo sapiens
aacugaagauuuccauuga

SEQ ID NO: 1558304 - RNA, 19 nt, Homo sapiens
gguggaaagguaaugaauu

SEQ ID NO: 1558305 - RNA, 19 nt, Homo sapiens
caaccaugaucucuaucug

SEQ ID NO: 1558306 - RNA, 19 nt, Homo sapiens
aggaaaugcuuuaaguugu

SEQ ID NO: 1558307 - RNA, 19 nt, Homo sapiens
uuguagaacugaagauuuc

SEQ ID NO: 1558308 - RNA, 19 nt, Homo sapiens
ggaacugcaagaauaugaa

SEQ ID NO: 1558309 - RNA, 19 nt, Homo sapiens
caagugggcagguucugaa

SEQ ID NO: 1558310 - RNA, 19 nt, Homo sapiens
gcaagugggcagguucuga

SEQ ID NO: 1558311 - RNA, 19 nt, Homo sapiens
auugacaucuugccagaaa

SEQ ID NO: 1558312 - RNA, 19 nt, Homo sapiens
acuaauuccuugagacuuc

SEQ ID NO: 1558313 - RNA, 19 nt, Homo sapiens
acauucaccuggacaaauc

SEQ ID NO: 1558314 - RNA, 19 nt, Homo sapiens
gggaacugcaagaauauga

SEQ ID NO: 1558315 - RNA, 19 nt, Homo sapiens
guaauugucacaugugucu

SEQ ID NO: 1558316 - RNA, 19 nt, Homo sapiens
caaaagcccuugaacuucu

SEQ ID NO: 1558317 - RNA, 19 nt, Homo sapiens
gagcaugcgaggguucuuu

SEQ ID NO: 1558318 - RNA, 19 nt, Homo sapiens
acacaagaauacccugauc

SEQ ID NO: 1558319 - RNA, 19 nt, Homo sapiens
agacaggaccagagcauug

SEQ ID NO: 1558320 - RNA, 19 nt, Homo sapiens
gagagaggaaaugcuuuaa

SEQ ID NO: 1558321 - RNA, 19 nt, Homo sapiens
uaaaugagucccuuugcau

SEQ ID NO: 1558322 - RNA, 19 nt, Homo sapiens
uuaaaugagucccuuugca

SEQ ID NO: 1558323 - RNA, 19 nt, Homo sapiens
gaggacuggccuagcuaua

SEQ ID NO: 1558324 - RNA, 19 nt, Homo sapiens
gguuggacuuacacaagaa

SEQ ID NO: 1558325 - RNA, 19 nt, Homo sapiens
uguauagugggaucauuua

SEQ ID NO: 1558326 - RNA, 19 nt, Homo sapiens
aaacuguugugaugucaag

SEQ ID NO: 1558327 - RNA, 19 nt, Homo sapiens
ggaccuauuuuacauguag

SEQ ID NO: 1558328 - RNA, 19 nt, Homo sapiens
ggcaaggacucaugcuaac

SEQ ID NO: 1558329 - RNA, 19 nt, Homo sapiens
uuuguagccuaaugaauug

SEQ ID NO: 1558330 - RNA, 19 nt, Homo sapiens
aaaucuggaucuuuaugug

SEQ ID NO: 1558331 - RNA, 19 nt, Homo sapiens
aaagacacuggucaaguuu

SEQ ID NO: 1558332 - RNA, 19 nt, Homo sapiens
cagaggaggcauucaaaca

SEQ ID NO: 1558333 - RNA, 19 nt, Homo sapiens
cuggacaaaucugaacuaa

SEQ ID NO: 1558334 - RNA, 19 nt, Homo sapiens
gaaugguuguagggacuga

SEQ ID NO: 1558335 - RNA, 19 nt, Homo sapiens
aagaauacccugaucugau

SEQ ID NO: 1558336 - RNA, 19 nt, Homo sapiens
agggcagccuggaaacaua

SEQ ID NO: 1558337 - RNA, 19 nt, Homo sapiens
uaaguuguccuaagauaac

SEQ ID NO: 1558338 - RNA, 19 nt, Homo sapiens
acauacugcuuucauucuu

SEQ ID NO: 1558339 - RNA, 19 nt, Homo sapiens
caaaugaccugcuuacuuu

SEQ ID NO: 1558340 - RNA, 19 nt, Homo sapiens
gauaguaaaucccaaguaa

SEQ ID NO: 1558341 - RNA, 19 nt, Homo sapiens
gauuugagcuuucuucuug

SEQ ID NO: 1558342 - RNA, 19 nt, Homo sapiens
gauuugagcuuucuucuug

SEQ ID NO: 1558343 - RNA, 19 nt, Homo sapiens
gacaguaaaucccaaguaa

SEQ ID NO: 1558344 - RNA, 19 nt, Homo sapiens
gaaagagauucaacugugu

SEQ ID NO: 1558345 - RNA, 19 nt, Homo sapiens
gcaaaugaccugcuuacuu

SEQ ID NO: 1558346 - RNA, 19 nt, Homo sapiens
ucugguagauugcaaauaa

SEQ ID NO: 1558347 - RNA, 19 nt, Homo sapiens
guaccagucuuuuguauua

SEQ ID NO: 1558348 - RNA, 19 nt, Homo sapiens
gguauuaauucucacugua

SEQ ID NO: 1558349 - RNA, 19 nt, Homo sapiens
uacaaaggcuuggcuuaua

SEQ ID NO: 1558350 - RNA, 19 nt, Homo sapiens
ggaaguggguauuaauucu

SEQ ID NO: 1558351 - RNA, 19 nt, Homo sapiens
gcaaauaacaagcuuucuu

SEQ ID NO: 1558352 - RNA, 19 nt, Homo sapiens
ugaaagacuugcuguuguu

SEQ ID NO: 1558353 - RNA, 19 nt, Homo sapiens
ucugguagauugcaaauga

SEQ ID NO: 1558354 - RNA, 19 nt, Homo sapiens
uaacaagcuuucuuucugu

SEQ ID NO: 1558355 - RNA, 19 nt, Homo sapiens
gaaacccugucuaguuguu

SEQ ID NO: 1558356 - RNA, 19 nt, Homo sapiens
ggacaguaaaucccaagua

SEQ ID NO: 1558357 - RNA, 19 nt, Homo sapiens
ccacagcuccugagaauuc

SEQ ID NO: 1558358 - RNA, 19 nt, Homo sapiens
gaaagacuugcuguuguua

SEQ ID NO: 1558359 - RNA, 19 nt, Homo sapiens
aaacaccccuucuaaauuu

SEQ ID NO: 1558360 - RNA, 19 nt, Homo sapiens
guaaaucccaaguaaggua

SEQ ID NO: 1558361 - RNA, 19 nt, Homo sapiens
guaaaucccaaguaaggua

SEQ ID NO: 1558362 - RNA, 19 nt, Homo sapiens
gaaaacaccccuucuaaau

SEQ ID NO: 1558363 - RNA, 19 nt, Homo sapiens
acaaaggcuuggcuuauau

SEQ ID NO: 1558364 - RNA, 19 nt, Homo sapiens
ccacaguccuccagucaau

SEQ ID NO: 1558365 - RNA, 19 nt, Homo sapiens
uggcuuauauugcaaaguu

SEQ ID NO: 1558366 - RNA, 19 nt, Homo sapiens
gaaacgcggugcuguugag

SEQ ID NO: 1558367 - RNA, 19 nt, Homo sapiens
guccagcaguugccgaaua

SEQ ID NO: 1558368 - RNA, 19 nt, Homo sapiens
agagucagcucauuugcuu

SEQ ID NO: 1558369 - RNA, 19 nt, Homo sapiens
guagcuugauccacugaaa

SEQ ID NO: 1558370 - RNA, 19 nt, Homo sapiens
gaauugcuuucugccauug

SEQ ID NO: 1558371 - RNA, 19 nt, Homo sapiens
auaacaagcuuucuuucug

SEQ ID NO: 1558372 - RNA, 19 nt, Homo sapiens
gagauucaacuguguggaa

SEQ ID NO: 1558373 - RNA, 19 nt, Homo sapiens
acauuaagcaccagaguuu

SEQ ID NO: 1558374 - RNA, 19 nt, Homo sapiens
ggacaccuauacccacagu

SEQ ID NO: 1558375 - RNA, 19 nt, Homo sapiens
ccaagagucagcucauuug

SEQ ID NO: 1558376 - RNA, 19 nt, Homo sapiens
cuuaggcucugguagauug

SEQ ID NO: 1558377 - RNA, 19 nt, Homo sapiens
gcuccaggguaccauauag

SEQ ID NO: 1558378 - RNA, 19 nt, Homo sapiens
gaguuuaaguagcuugauc

SEQ ID NO: 1558379 - RNA, 19 nt, Homo sapiens
cuguauaagugaagacauu

SEQ ID NO: 1558380 - RNA, 19 nt, Homo sapiens
caugaaagacuugcuguug

SEQ ID NO: 1558381 - RNA, 19 nt, Homo sapiens
ucauuugcuucuuguacua

SEQ ID NO: 1558382 - RNA, 19 nt, Homo sapiens
acucuagucuuguggagaa

SEQ ID NO: 1558383 - RNA, 19 nt, Homo sapiens
gcccaagagucagcucauu

SEQ ID NO: 1558384 - RNA, 19 nt, Homo sapiens
uccagucaaucccaauuaa

SEQ ID NO: 1558385 - RNA, 19 nt, Homo sapiens
cauacaaaggcuuggcuua

SEQ ID NO: 1558386 - RNA, 19 nt, Homo sapiens
ucaacuguguggaaccuau

SEQ ID NO: 1558387 - RNA, 19 nt, Homo sapiens
gauugcaaaugaccugcuu

SEQ ID NO: 1558388 - RNA, 19 nt, Homo sapiens
caaaggcuuggcuuauauu

SEQ ID NO: 1558389 - RNA, 19 nt, Homo sapiens
ggcugaagcugccagaagu

SEQ ID NO: 1558390 - RNA, 19 nt, Homo sapiens
caccagaguuuaaguagcu

SEQ ID NO: 1558391 - RNA, 19 nt, Homo sapiens
caggaaguggguauuaauu

SEQ ID NO: 1558392 - RNA, 19 nt, Homo sapiens
gacauuaagcaccagaguu

SEQ ID NO: 1558393 - RNA, 19 nt, Homo sapiens
gauugcaaauaacaagcuu

SEQ ID NO: 1558394 - RNA, 19 nt, Homo sapiens
caggguaccauauagaguu

SEQ ID NO: 1558395 - RNA, 19 nt, Homo sapiens
gaccugagcaaagcaguga

SEQ ID NO: 1558396 - RNA, 19 nt, Homo sapiens
ggguauuaauucucacugu

SEQ ID NO: 1558397 - RNA, 19 nt, Homo sapiens
cuaaggauaacuucaggaa

SEQ ID NO: 1558398 - RNA, 19 nt, Homo sapiens
gcagauuugagcuuucuuc

SEQ ID NO: 1558399 - RNA, 19 nt, Homo sapiens
gcagauuugagcuuucuuc

SEQ ID NO: 1558400 - RNA, 19 nt, Homo sapiens
gggauccacagucuacaaa

SEQ ID NO: 1558401 - RNA, 19 nt, Homo sapiens
aggcuuggcuuauauugca

SEQ ID NO: 1558402 - RNA, 19 nt, Homo sapiens
uaagugaagacauuaagca

SEQ ID NO: 1558403 - RNA, 19 nt, Homo sapiens
ucagcucauuugcuucuug

SEQ ID NO: 1558404 - RNA, 19 nt, Homo sapiens
gggccuuuauguucagguu

SEQ ID NO: 1558405 - RNA, 19 nt, Homo sapiens
caguaaaucccaaguaagg

SEQ ID NO: 1558406 - RNA, 19 nt, Homo sapiens
gcccuuaggcucugguaga

SEQ ID NO: 1558407 - RNA, 19 nt, Homo sapiens
gugaaacgcggugcuguug

SEQ ID NO: 1558408 - RNA, 19 nt, Homo sapiens
cagcucauuugcuucuugu

SEQ ID NO: 1558409 - RNA, 19 nt, Homo sapiens
gucaaucccaauuaaggua

SEQ ID NO: 1558410 - RNA, 19 nt, Homo sapiens
cccaagagucagcucauuu

SEQ ID NO: 1558411 - RNA, 19 nt, Homo sapiens
aaguccaccugccaucuuu

SEQ ID NO: 1558412 - RNA, 19 nt, Homo sapiens
cgauaguaaaucccaagua

SEQ ID NO: 1558413 - RNA, 19 nt, Homo sapiens
guagauugcaaauaacaag

SEQ ID NO: 1558414 - RNA, 19 nt, Homo sapiens
augaaagacuugcuguugu

SEQ ID NO: 1558415 - RNA, 19 nt, Homo sapiens
gaaguggguauuaauucuc

SEQ ID NO: 1558416 - RNA, 19 nt, Homo sapiens
auacaaaggcuuggcuuau

SEQ ID NO: 1558417 - RNA, 19 nt, Homo sapiens
uaguaaaucccaaguaagg

SEQ ID NO: 1558418 - RNA, 19 nt, Homo sapiens
aggguaccauauagaguuu

SEQ ID NO: 1558419 - RNA, 19 nt, Homo sapiens
aagcaccagaguuuaagua

SEQ ID NO: 1558420 - RNA, 19 nt, Homo sapiens
cauuaagcaccagaguuua

SEQ ID NO: 1558421 - RNA, 19 nt, Homo sapiens
gucggcagauuugagcuuu

SEQ ID NO: 1558422 - RNA, 19 nt, Homo sapiens
gucggcagauuugagcuuu

SEQ ID NO: 1558423 - RNA, 19 nt, Homo sapiens
ggcuuauauugcaaaguuu

SEQ ID NO: 1558424 - RNA, 19 nt, Homo sapiens
gacuugcuguuguuaggau

SEQ ID NO: 1558425 - RNA, 19 nt, Homo sapiens
uuucugccauuguuauugu

SEQ ID NO: 1558426 - RNA, 19 nt, Homo sapiens
ucaggaaguggguauuaau

SEQ ID NO: 1558427 - RNA, 19 nt, Homo sapiens
uucaggaaguggguauuaa

SEQ ID NO: 1558428 - RNA, 19 nt, Homo sapiens
gggcugaagcugccagaag

SEQ ID NO: 1558429 - RNA, 19 nt, Homo sapiens
uaucaaaguguaccagucu

SEQ ID NO: 1558430 - RNA, 19 nt, Homo sapiens
aaaacaccccuucuaaauu

SEQ ID NO: 1558431 - RNA, 19 nt, Homo sapiens
aaguggguauuaauucuca

SEQ ID NO: 1558432 - RNA, 19 nt, Homo sapiens
gcucauuugcuucuuguac

SEQ ID NO: 1558433 - RNA, 19 nt, Homo sapiens
cuaguuguucagagacaua

SEQ ID NO: 1558434 - RNA, 19 nt, Homo sapiens
uccagcaguugccgaauag

SEQ ID NO: 1558435 - RNA, 19 nt, Homo sapiens
gguagauugcaaauaacaa

SEQ ID NO: 1558436 - RNA, 19 nt, Homo sapiens
cggcagauuugagcuuucu

SEQ ID NO: 1558437 - RNA, 19 nt, Homo sapiens
ugaccugcuuacuuucugu

SEQ ID NO: 1558438 - RNA, 19 nt, Homo sapiens
cggcagauuugagcuuucu

SEQ ID NO: 1558439 - RNA, 19 nt, Homo sapiens
gaaguugucuauccucuuu

SEQ ID NO: 1558440 - RNA, 19 nt, Homo sapiens
caacugugcuuaagccaua

SEQ ID NO: 1558441 - RNA, 19 nt, Homo sapiens
agacagagauggugauuug

SEQ ID NO: 1558442 - RNA, 19 nt, Homo sapiens
gaaaugaaguugucuaucc

SEQ ID NO: 1558443 - RNA, 19 nt, Homo sapiens
ggucagcacuagaacagua

SEQ ID NO: 1558444 - RNA, 19 nt, Homo sapiens
gggaagauauucacgacaa

SEQ ID NO: 1558445 - RNA, 19 nt, Homo sapiens
gaccuggaaugguaacuuu

SEQ ID NO: 1558446 - RNA, 19 nt, Homo sapiens
gcgccgaccuggaauggua

SEQ ID NO: 1558447 - RNA, 19 nt, Homo sapiens
gucaggaacuggucacuuu

SEQ ID NO: 1558448 - RNA, 19 nt, Homo sapiens
gaacuggucacuuugaaug

SEQ ID NO: 1558449 - RNA, 19 nt, Homo sapiens
caauacaucuuucccuuuc

SEQ ID NO: 1558450 - RNA, 19 nt, Homo sapiens
gaugguagccucuaguuug

SEQ ID NO: 1558451 - RNA, 19 nt, Homo sapiens
cuagcaacauuuaugguua

SEQ ID NO: 1558452 - RNA, 19 nt, Homo sapiens
gcaaacacagccauggaua

SEQ ID NO: 1558453 - RNA, 19 nt, Homo sapiens
cagagauggugauuuguuu

SEQ ID NO: 1558454 - RNA, 19 nt, Homo sapiens
uacccugacuugaucauua

SEQ ID NO: 1558455 - RNA, 19 nt, Homo sapiens
ggauuacaguguuuacaga

SEQ ID NO: 1558456 - RNA, 19 nt, Homo sapiens
gauggugauuuguuuaguu

SEQ ID NO: 1558457 - RNA, 19 nt, Homo sapiens
ggagguacauuuccuaagc

SEQ ID NO: 1558458 - RNA, 19 nt, Homo sapiens
gaagugcucaucacgaaug

SEQ ID NO: 1558459 - RNA, 19 nt, Homo sapiens
ggagucagguauguuucua

SEQ ID NO: 1558460 - RNA, 19 nt, Homo sapiens
gaugguugguggccagauu

SEQ ID NO: 1558461 - RNA, 19 nt, Homo sapiens
agucagguauguuucuaua

SEQ ID NO: 1558462 - RNA, 19 nt, Homo sapiens
caacauuuaugguuauagg

SEQ ID NO: 1558463 - RNA, 19 nt, Homo sapiens
acacucagccuaacucuug

SEQ ID NO: 1558464 - RNA, 19 nt, Homo sapiens
ggauacacuauuuaccuua

SEQ ID NO: 1558465 - RNA, 19 nt, Homo sapiens
gcagagaccaagaauucaa

SEQ ID NO: 1558466 - RNA, 19 nt, Homo sapiens
gcauacauguuagccaaau

SEQ ID NO: 1558467 - RNA, 19 nt, Homo sapiens
gcuuacugauugacacuuu

SEQ ID NO: 1558468 - RNA, 19 nt, Homo sapiens
ugaaugcuauagcuuugaa

SEQ ID NO: 1558469 - RNA, 19 nt, Homo sapiens
agacaaaacugaaugcuau

SEQ ID NO: 1558470 - RNA, 19 nt, Homo sapiens
ggugauuuguuuaguuuca

SEQ ID NO: 1558471 - RNA, 19 nt, Homo sapiens
gauauucacgacaagguuu

SEQ ID NO: 1558472 - RNA, 19 nt, Homo sapiens
agccauggauacacuauuu

SEQ ID NO: 1558473 - RNA, 19 nt, Homo sapiens
aaggaaggcuuucauuugg

SEQ ID NO: 1558474 - RNA, 19 nt, Homo sapiens
guccucggcuuacugauug

SEQ ID NO: 1558475 - RNA, 19 nt, Homo sapiens
gcacuagaacaguaucuuc

SEQ ID NO: 1558476 - RNA, 19 nt, Homo sapiens
uggcagagaccaagaauuc

SEQ ID NO: 1558477 - RNA, 19 nt, Homo sapiens
gaaugugggagggaagaua

SEQ ID NO: 1558478 - RNA, 19 nt, Homo sapiens
cugaagugcucaucacgaa

SEQ ID NO: 1558479 - RNA, 19 nt, Homo sapiens
caacucgaauuugcaaaca

SEQ ID NO: 1558480 - RNA, 19 nt, Homo sapiens
gauacacuauuuaccuuac

SEQ ID NO: 1558481 - RNA, 19 nt, Homo sapiens
aaacuggagucagguaugu

SEQ ID NO: 1558482 - RNA, 19 nt, Homo sapiens
ugacagcacuacugauaac

SEQ ID NO: 1558483 - RNA, 19 nt, Homo sapiens
ucugacagcacuacugaua

SEQ ID NO: 1558484 - RNA, 19 nt, Homo sapiens
gaacucaccagcuuuuauu

SEQ ID NO: 1558485 - RNA, 19 nt, Homo sapiens
gggaaucuaagucugguuu

SEQ ID NO: 1558486 - RNA, 19 nt, Homo sapiens
ggaagauauucacgacaag

SEQ ID NO: 1558487 - RNA, 19 nt, Homo sapiens
cagcacuacugauaaccaa

SEQ ID NO: 1558488 - RNA, 19 nt, Homo sapiens
cagggaggauuacaguguu

SEQ ID NO: 1558489 - RNA, 19 nt, Homo sapiens
uaacagggaggauuacagu

SEQ ID NO: 1558490 - RNA, 19 nt, Homo sapiens
cuauuuaccuuacaguagu

SEQ ID NO: 1558491 - RNA, 19 nt, Homo sapiens
gaucauuacaccuucuaug

SEQ ID NO: 1558492 - RNA, 19 nt, Homo sapiens
ccauguacuuggugcuuug

SEQ ID NO: 1558493 - RNA, 19 nt, Homo sapiens
accagagacuaucaucaua

SEQ ID NO: 1558494 - RNA, 19 nt, Homo sapiens
ugaagugagggaagaauga

SEQ ID NO: 1558495 - RNA, 19 nt, Homo sapiens
aaacugauggauacccuaa

SEQ ID NO: 1558496 - RNA, 19 nt, Homo sapiens
cagacuaucuuaggcuuca

SEQ ID NO: 1558497 - RNA, 19 nt, Homo sapiens
aagaaugaguagucaggaa

SEQ ID NO: 1558498 - RNA, 19 nt, Homo sapiens
aguugggccuuccguauuu

SEQ ID NO: 1558499 - RNA, 19 nt, Homo sapiens
ucaauacaucuuucccuuu

SEQ ID NO: 1558500 - RNA, 19 nt, Homo sapiens
gacaagguuuucuacgaua

SEQ ID NO: 1558501 - RNA, 19 nt, Homo sapiens
gagggaagaaugaguaguc

SEQ ID NO: 1558502 - RNA, 19 nt, Homo sapiens
cauuacaccuucuaugcau

SEQ ID NO: 1558503 - RNA, 19 nt, Homo sapiens
uaacuagcaacauuuaugg

SEQ ID NO: 1558504 - RNA, 19 nt, Homo sapiens
gagauggugauuuguuuag

SEQ ID NO: 1558505 - RNA, 19 nt, Homo sapiens
gccauggauacacuauuua

SEQ ID NO: 1558506 - RNA, 19 nt, Homo sapiens
gguuauagguugauuuccu

SEQ ID NO: 1558507 - RNA, 19 nt, Homo sapiens
cuuacugauugacacuuua

SEQ ID NO: 1558508 - RNA, 19 nt, Homo sapiens
gauuacaguguuuacagaa

SEQ ID NO: 1558509 - RNA, 19 nt, Homo sapiens
uggauacacuauuuaccuu

SEQ ID NO: 1558510 - RNA, 19 nt, Homo sapiens
gguagccucuaguuugaag

SEQ ID NO: 1558511 - RNA, 19 nt, Homo sapiens
guacuuggugcuuugguau

SEQ ID NO: 1558512 - RNA, 19 nt, Homo sapiens
cuagacaacuccauguacu

SEQ ID NO: 1558513 - RNA, 19 nt, Homo sapiens
guucugacagcacuacuga

SEQ ID NO: 1558514 - RNA, 19 nt, Homo sapiens
cccuuucucuucuucauga

SEQ ID NO: 1558515 - RNA, 19 nt, Homo sapiens
guucuaccuucaauacauc

SEQ ID NO: 1558516 - RNA, 19 nt, Homo sapiens
uguacuuggugcuuuggua

SEQ ID NO: 1558517 - RNA, 19 nt, Homo sapiens
acacagccauggauacacu

SEQ ID NO: 1558518 - RNA, 19 nt, Homo sapiens
gggaggauuacaguguuua

SEQ ID NO: 1558519 - RNA, 19 nt, Homo sapiens
caaaacaauugagaugcua

SEQ ID NO: 1558520 - RNA, 19 nt, Homo sapiens
agagauggugauuuguuua

SEQ ID NO: 1558521 - RNA, 19 nt, Homo sapiens
cacacuagcuugggugaca

SEQ ID NO: 1558522 - RNA, 19 nt, Homo sapiens
acagagauggugauuuguu

SEQ ID NO: 1558523 - RNA, 19 nt, Homo sapiens
ggaacuggucacuuugaau

SEQ ID NO: 1558524 - RNA, 19 nt, Homo sapiens
cauguuagccaaaucuaca

SEQ ID NO: 1558525 - RNA, 19 nt, Homo sapiens
caucauaccagagcaaucu

SEQ ID NO: 1558526 - RNA, 19 nt, Homo sapiens
gccggaacacucaagcuuu

SEQ ID NO: 1558527 - RNA, 19 nt, Homo sapiens
aaacacagccauggauaca

SEQ ID NO: 1558528 - RNA, 19 nt, Homo sapiens
agaccaagaauucaagaug

SEQ ID NO: 1558529 - RNA, 19 nt, Homo sapiens
caucuuucccuuucucuuc

SEQ ID NO: 1558530 - RNA, 19 nt, Homo sapiens
agacaacuccauguacuug

SEQ ID NO: 1558531 - RNA, 19 nt, Homo sapiens
auuuagggcauacauguua

SEQ ID NO: 1558532 - RNA, 19 nt, Homo sapiens
acugaaugcuauagcuuug

SEQ ID NO: 1558533 - RNA, 19 nt, Homo sapiens
caaauguccucggcuuacu

SEQ ID NO: 1558534 - RNA, 19 nt, Homo sapiens
caaacuggagucagguaug

SEQ ID NO: 1558535 - RNA, 19 nt, Homo sapiens
gcacuacugauaaccaaac

SEQ ID NO: 1558536 - RNA, 19 nt, Homo sapiens
gcaaaacaauugagaugcu

SEQ ID NO: 1558537 - RNA, 19 nt, Homo sapiens
ucguuuggcacgcauguua

SEQ ID NO: 1558538 - RNA, 19 nt, Homo sapiens
aaaucuacacucagccuaa

SEQ ID NO: 1558539 - RNA, 19 nt, Homo sapiens
caauuuagcuguagucaua

SEQ ID NO: 1558540 - RNA, 19 nt, Homo sapiens
ggaagaaacccauuuauaa

SEQ ID NO: 1558541 - RNA, 19 nt, Homo sapiens
gaacacaaguuuccaauca

SEQ ID NO: 1558542 - RNA, 19 nt, Homo sapiens
gaagaucuuugcccuauuu

SEQ ID NO: 1558543 - RNA, 19 nt, Homo sapiens
gaaauucucccacuccaua

SEQ ID NO: 1558544 - RNA, 19 nt, Homo sapiens
ucaaacagcugaaaggaaa

SEQ ID NO: 1558545 - RNA, 19 nt, Homo sapiens
ggaaaucuccucuaucaaa

SEQ ID NO: 1558546 - RNA, 19 nt, Homo sapiens
guacaaagcugaguaacug

SEQ ID NO: 1558547 - RNA, 19 nt, Homo sapiens
ccacugagcuaaacacaga

SEQ ID NO: 1558548 - RNA, 19 nt, Homo sapiens
cuacucaacuuccauaauu

SEQ ID NO: 1558549 - RNA, 19 nt, Homo sapiens
ucacaugacuguccaauag

SEQ ID NO: 1558550 - RNA, 19 nt, Homo sapiens
ccaaugagaugaaauguac

SEQ ID NO: 1558551 - RNA, 19 nt, Homo sapiens
ccucauauaugcagaagaa

SEQ ID NO: 1558552 - RNA, 19 nt, Homo sapiens
gaaccaagacucucugaug

SEQ ID NO: 1558553 - RNA, 19 nt, Homo sapiens
ccagauugcuucuuggaaa

SEQ ID NO: 1558554 - RNA, 19 nt, Homo sapiens
gaugauaaauggcauaacu

SEQ ID NO: 1558555 - RNA, 19 nt, Homo sapiens
gaaauucauuagugugugu

SEQ ID NO: 1558556 - RNA, 19 nt, Homo sapiens
gaaacaaguucacaugacu

SEQ ID NO: 1558557 - RNA, 19 nt, Homo sapiens
gacauuacauaccuaaguu

SEQ ID NO: 1558558 - RNA, 19 nt, Homo sapiens
gaaggaaucugccaaaccu

SEQ ID NO: 1558559 - RNA, 19 nt, Homo sapiens
ucagcaaacucaagacaaa

SEQ ID NO: 1558560 - RNA, 19 nt, Homo sapiens
gaucaagucuuuguaagca

SEQ ID NO: 1558561 - RNA, 19 nt, Homo sapiens
ggacuugaguguugcuguu

SEQ ID NO: 1558562 - RNA, 19 nt, Homo sapiens
aagcucaacuccauuguuu

SEQ ID NO: 1558563 - RNA, 19 nt, Homo sapiens
gagcaagggcaaucaguuu

SEQ ID NO: 1558564 - RNA, 19 nt, Homo sapiens
caacaagggaaaugacuuu

SEQ ID NO: 1558565 - RNA, 19 nt, Homo sapiens
cagaagaucuuugcccuau

SEQ ID NO: 1558566 - RNA, 19 nt, Homo sapiens
gcaucugucuucuaagcua

SEQ ID NO: 1558567 - RNA, 19 nt, Homo sapiens
gaucauuuauuucccuuuc

SEQ ID NO: 1558568 - RNA, 19 nt, Homo sapiens
gagaugaaauguacaagcu

SEQ ID NO: 1558569 - RNA, 19 nt, Homo sapiens
ggaaacaaguucacaugac

SEQ ID NO: 1558570 - RNA, 19 nt, Homo sapiens
ccaaacagaagcuuuagaa

SEQ ID NO: 1558571 - RNA, 19 nt, Homo sapiens
ccagaaucaucagaaauuu

SEQ ID NO: 1558572 - RNA, 19 nt, Homo sapiens
caagguaacucgccaaagc

SEQ ID NO: 1558573 - RNA, 19 nt, Homo sapiens
gcacagccuugcagaugau

SEQ ID NO: 1558574 - RNA, 19 nt, Homo sapiens
uaggacaucuggguugaua

SEQ ID NO: 1558575 - RNA, 19 nt, Homo sapiens
uauaaagcgccaucuauuu

SEQ ID NO: 1558576 - RNA, 19 nt, Homo sapiens
gaguguugcuguuuauuca

SEQ ID NO: 1558577 - RNA, 19 nt, Homo sapiens
ugaccaaacagaagcuuua

SEQ ID NO: 1558578 - RNA, 19 nt, Homo sapiens
uggaagaaacccauuuaua

SEQ ID NO: 1558579 - RNA, 19 nt, Homo sapiens
gaaaucuccucuaucaaaa

SEQ ID NO: 1558580 - RNA, 19 nt, Homo sapiens
ugucacagaucccgaaaug

SEQ ID NO: 1558581 - RNA, 19 nt, Homo sapiens
gcuaaacacagaagaaugu

SEQ ID NO: 1558582 - RNA, 19 nt, Homo sapiens
ggcccaugcugcuuaaauu

SEQ ID NO: 1558583 - RNA, 19 nt, Homo sapiens
gcacuucaccgcccaagau

SEQ ID NO: 1558584 - RNA, 19 nt, Homo sapiens
aaagggcaauuuagcugua

SEQ ID NO: 1558585 - RNA, 19 nt, Homo sapiens
ggaccaaugagaugaaaug

SEQ ID NO: 1558586 - RNA, 19 nt, Homo sapiens
cuuuagaacugcaagguaa

SEQ ID NO: 1558587 - RNA, 19 nt, Homo sapiens
aacagaagcuuuagaacug

SEQ ID NO: 1558588 - RNA, 19 nt, Homo sapiens
cuauauugguguauuggua

SEQ ID NO: 1558589 - RNA, 19 nt, Homo sapiens
caagggaaaugacuuugag

SEQ ID NO: 1558590 - RNA, 19 nt, Homo sapiens
cuucuuuccugucuauaua

SEQ ID NO: 1558591 - RNA, 19 nt, Homo sapiens
caagauuucugcugaucau

SEQ ID NO: 1558592 - RNA, 19 nt, Homo sapiens
uacuagaacuaucagcaua

SEQ ID NO: 1558593 - RNA, 19 nt, Homo sapiens
aaaaugagguuguuaagga

SEQ ID NO: 1558594 - RNA, 19 nt, Homo sapiens
ugcauuaccucccagauga

SEQ ID NO: 1558595 - RNA, 19 nt, Homo sapiens
gcaccagcuucacuagaga

SEQ ID NO: 1558596 - RNA, 19 nt, Homo sapiens
uaagugcccuccaguacau

SEQ ID NO: 1558597 - RNA, 19 nt, Homo sapiens
acacaaguuuccaaucaga

SEQ ID NO: 1558598 - RNA, 19 nt, Homo sapiens
auucaaaucuuccagcuau

SEQ ID NO: 1558599 - RNA, 19 nt, Homo sapiens
cacuagagauucugaggaa

SEQ ID NO: 1558600 - RNA, 19 nt, Homo sapiens
uccaggaaguguucucuaa

SEQ ID NO: 1558601 - RNA, 19 nt, Homo sapiens
gcuagauacuuucacauac

SEQ ID NO: 1558602 - RNA, 19 nt, Homo sapiens
gcuaggguuuccuggguuu

SEQ ID NO: 1558603 - RNA, 19 nt, Homo sapiens
gcaagcaauuucagauggu

SEQ ID NO: 1558604 - RNA, 19 nt, Homo sapiens
gcuaagacaucugcaagag

SEQ ID NO: 1558605 - RNA, 19 nt, Homo sapiens
gcuaggacaucuggguuga

SEQ ID NO: 1558606 - RNA, 19 nt, Homo sapiens
cuagaacuaucagcauaaa

SEQ ID NO: 1558607 - RNA, 19 nt, Homo sapiens
gauuucugcugaucauuuc

SEQ ID NO: 1558608 - RNA, 19 nt, Homo sapiens
gaaauguacaagcucaaau

SEQ ID NO: 1558609 - RNA, 19 nt, Homo sapiens
gggaaacaaguucacauga

SEQ ID NO: 1558610 - RNA, 19 nt, Homo sapiens
uggcauaacugggacaaau

SEQ ID NO: 1558611 - RNA, 19 nt, Homo sapiens
gaucauuucagcaaacuca

SEQ ID NO: 1558612 - RNA, 19 nt, Homo sapiens
ugaguucauuagcuucuuu

SEQ ID NO: 1558613 - RNA, 19 nt, Homo sapiens
gaagcucaacuccauuguu

SEQ ID NO: 1558614 - RNA, 19 nt, Homo sapiens
auacacagcucgggcuuug

SEQ ID NO: 1558615 - RNA, 19 nt, Homo sapiens
gaaggaauucaugaaauca

SEQ ID NO: 1558616 - RNA, 19 nt, Homo sapiens
auaaagcgccaucuauuug

SEQ ID NO: 1558617 - RNA, 19 nt, Homo sapiens
ucccagagauauucaaauc

SEQ ID NO: 1558618 - RNA, 19 nt, Homo sapiens
gagcuaaacacagaagaau

SEQ ID NO: 1558619 - RNA, 19 nt, Homo sapiens
gagagcagcccuucuucug

SEQ ID NO: 1558620 - RNA, 19 nt, Homo sapiens
acacagcucgggcuuugua

SEQ ID NO: 1558621 - RNA, 19 nt, Homo sapiens
ucagcuggauaaugcaauu

SEQ ID NO: 1558622 - RNA, 19 nt, Homo sapiens
ugguaucucuguaucugua

SEQ ID NO: 1558623 - RNA, 19 nt, Homo sapiens
gggaaaugacuuugagguu

SEQ ID NO: 1558624 - RNA, 19 nt, Homo sapiens
gcagaugauaaauggcaua

SEQ ID NO: 1558625 - RNA, 19 nt, Homo sapiens
caaacuuuaugcaggacuu

SEQ ID NO: 1558626 - RNA, 19 nt, Homo sapiens
guaaaaggaacacaaguuu

SEQ ID NO: 1558627 - RNA, 19 nt, Homo sapiens
guguauugguaguauauug

SEQ ID NO: 1558628 - RNA, 19 nt, Homo sapiens
gguuccagauugcuucuug

SEQ ID NO: 1558629 - RNA, 19 nt, Homo sapiens
uguaagcacugccaaaggu

SEQ ID NO: 1558630 - RNA, 19 nt, Homo sapiens
cuucuaagcuagucaggau

SEQ ID NO: 1558631 - RNA, 19 nt, Homo sapiens
acauuugucugcuggaaga

SEQ ID NO: 1558632 - RNA, 19 nt, Homo sapiens
augcaggacuugaguguug

SEQ ID NO: 1558633 - RNA, 19 nt, Homo sapiens
aaacagaagcuuuagaacu

SEQ ID NO: 1558634 - RNA, 19 nt, Homo sapiens
gggagagacucagauccuu

SEQ ID NO: 1558635 - RNA, 19 nt, Homo sapiens
caauugcacucagaagauc

SEQ ID NO: 1558636 - RNA, 19 nt, Homo sapiens
uagcuucuuuccugucuau

SEQ ID NO: 1558637 - RNA, 19 nt, Homo sapiens
caggaucaagucuuuguaa

SEQ ID NO: 1558638 - RNA, 19 nt, Homo sapiens
uagucaggaucaagucuuu

SEQ ID NO: 1558639 - RNA, 19 nt, Homo sapiens
cuagagagcuaauguagua

SEQ ID NO: 1558640 - RNA, 19 nt, Homo sapiens
gggaagaucugggcaauuu

SEQ ID NO: 1558641 - RNA, 19 nt, Homo sapiens
ggacagggaaagauaauua

SEQ ID NO: 1558642 - RNA, 19 nt, Homo sapiens
gaccagagcucggaaugua

SEQ ID NO: 1558643 - RNA, 19 nt, Homo sapiens
ggagaugaccagaauauaa

SEQ ID NO: 1558644 - RNA, 19 nt, Homo sapiens
gaagugagagggacaauug

SEQ ID NO: 1558645 - RNA, 19 nt, Homo sapiens
gaagggacagggaaagaua

SEQ ID NO: 1558646 - RNA, 19 nt, Homo sapiens
ggacaauuggguucauuua

SEQ ID NO: 1558647 - RNA, 19 nt, Homo sapiens
ggugagaaguguuguuaga

SEQ ID NO: 1558648 - RNA, 19 nt, Homo sapiens
gauauuugcuuuccuagag

SEQ ID NO: 1558649 - RNA, 19 nt, Homo sapiens
ugagaaguguuguuagaaa

SEQ ID NO: 1558650 - RNA, 19 nt, Homo sapiens
ccaagcagcaggauaagua

SEQ ID NO: 1558651 - RNA, 19 nt, Homo sapiens
gaccaucacuguuucuuca

SEQ ID NO: 1558652 - RNA, 19 nt, Homo sapiens
gaagccagcccugcuauuu

SEQ ID NO: 1558653 - RNA, 19 nt, Homo sapiens
uaggugagcuuacacauuc

SEQ ID NO: 1558654 - RNA, 19 nt, Homo sapiens
ugagauauuugcuuuccua

SEQ ID NO: 1558655 - RNA, 19 nt, Homo sapiens
ugauagagauggcugaaga

SEQ ID NO: 1558656 - RNA, 19 nt, Homo sapiens
gcacgaccaucacuguuuc

SEQ ID NO: 1558657 - RNA, 19 nt, Homo sapiens
ugaacaggaugacaagauu

SEQ ID NO: 1558658 - RNA, 19 nt, Homo sapiens
acaauuggguucauuuaug

SEQ ID NO: 1558659 - RNA, 19 nt, Homo sapiens
gcaauuacguccuugucau

SEQ ID NO: 1558660 - RNA, 19 nt, Homo sapiens
gcaacagccuggguucuug

SEQ ID NO: 1558661 - RNA, 19 nt, Homo sapiens
gagagcuaauguaguauug

SEQ ID NO: 1558662 - RNA, 19 nt, Homo sapiens
gaguggagaugaccagaau

SEQ ID NO: 1558663 - RNA, 19 nt, Homo sapiens
ccuagaggcuggcaaaugu

SEQ ID NO: 1558664 - RNA, 19 nt, Homo sapiens
gcuccaagcagcaggauaa

SEQ ID NO: 1558665 - RNA, 19 nt, Homo sapiens
gcaggaacaugcgcaacuu

SEQ ID NO: 1558666 - RNA, 19 nt, Homo sapiens
gcaaugcagugaugaacag

SEQ ID NO: 1558667 - RNA, 19 nt, Homo sapiens
ccugugagauauuugcuuu

SEQ ID NO: 1558668 - RNA, 19 nt, Homo sapiens
cagagaugccugugagaua

SEQ ID NO: 1558669 - RNA, 19 nt, Homo sapiens
gaagugagagcuccaagca

SEQ ID NO: 1558670 - RNA, 19 nt, Homo sapiens
agggaaagauaauuacuga

SEQ ID NO: 1558671 - RNA, 19 nt, Homo sapiens
ggaagaagggacagggaaa

SEQ ID NO: 1558672 - RNA, 19 nt, Homo sapiens
gagaugaccagaauauaag

SEQ ID NO: 1558673 - RNA, 19 nt, Homo sapiens
guaagguccuagcaucuuc

SEQ ID NO: 1558674 - RNA, 19 nt, Homo sapiens
guaagaggcagccaaguca

SEQ ID NO: 1558675 - RNA, 19 nt, Homo sapiens
ggaccuagaggcuggcaaa

SEQ ID NO: 1558676 - RNA, 19 nt, Homo sapiens
uagacacucccgucauuua

SEQ ID NO: 1558677 - RNA, 19 nt, Homo sapiens
acaauucuggccauacuua

SEQ ID NO: 1558678 - RNA, 19 nt, Homo sapiens
gcugauagcugcgcaacag

SEQ ID NO: 1558679 - RNA, 19 nt, Homo sapiens
agagaugccugugagauau

SEQ ID NO: 1558680 - RNA, 19 nt, Homo sapiens
gaggcaagaucugcagaga

SEQ ID NO: 1558681 - RNA, 19 nt, Homo sapiens
gagaaguguuguuagaaac

SEQ ID NO: 1558682 - RNA, 19 nt, Homo sapiens
caccgugucucauucauca

SEQ ID NO: 1558683 - RNA, 19 nt, Homo sapiens
gauucacacucccugcaaa

SEQ ID NO: 1558684 - RNA, 19 nt, Homo sapiens
ggaagggauuucuguacag

SEQ ID NO: 1558685 - RNA, 19 nt, Homo sapiens
ugacuccuccugagcauaa

SEQ ID NO: 1558686 - RNA, 19 nt, Homo sapiens
gaacaggaugacaagauuc

SEQ ID NO: 1558687 - RNA, 19 nt, Homo sapiens
ggaggacuuuacugugguu

SEQ ID NO: 1558688 - RNA, 19 nt, Homo sapiens
ccaggucuuugccagauga

SEQ ID NO: 1558689 - RNA, 19 nt, Homo sapiens
ccacaauucuggccauacu

SEQ ID NO: 1558690 - RNA, 19 nt, Homo sapiens
gcagugaugaacaggauga

SEQ ID NO: 1558691 - RNA, 19 nt, Homo sapiens
ggacuuuacugugguucug

SEQ ID NO: 1558692 - RNA, 19 nt, Homo sapiens
guucugauguccugguugu

SEQ ID NO: 1558693 - RNA, 19 nt, Homo sapiens
uugaauggcugccugugaa

SEQ ID NO: 1558694 - RNA, 19 nt, Homo sapiens
caauuggguucauuuaugc

SEQ ID NO: 1558695 - RNA, 19 nt, Homo sapiens
gcaaucaauggccugcuuu

SEQ ID NO: 1558696 - RNA, 19 nt, Homo sapiens
aguagacacucccgucauu

SEQ ID NO: 1558697 - RNA, 19 nt, Homo sapiens
gcaucucccuggugaccuu

SEQ ID NO: 1558698 - RNA, 19 nt, Homo sapiens
gggauauucgacuguauaa

SEQ ID NO: 1558699 - RNA, 19 nt, Homo sapiens
gaggcuggcaaauguuuaa

SEQ ID NO: 1558700 - RNA, 19 nt, Homo sapiens
gcugguggaucaugacaag

SEQ ID NO: 1558701 - RNA, 19 nt, Homo sapiens
gcuuacacauuccuuccaa

SEQ ID NO: 1558702 - RNA, 19 nt, Homo sapiens
guucauuuaugcccuauac

SEQ ID NO: 1558703 - RNA, 19 nt, Homo sapiens
gacaauuggguucauuuau

SEQ ID NO: 1558704 - RNA, 19 nt, Homo sapiens
gggaaagggagaagugaga

SEQ ID NO: 1558705 - RNA, 19 nt, Homo sapiens
caagucagcucugccaacu

SEQ ID NO: 1558706 - RNA, 19 nt, Homo sapiens
guauuguccuugaagaaca

SEQ ID NO: 1558707 - RNA, 19 nt, Homo sapiens
gagauggagcagugucauu

SEQ ID NO: 1558708 - RNA, 19 nt, Homo sapiens
guggugagaaguguuguua

SEQ ID NO: 1558709 - RNA, 19 nt, Homo sapiens
guggagaugaccagaauau

SEQ ID NO: 1558710 - RNA, 19 nt, Homo sapiens
uggaagggauuucuguaca

SEQ ID NO: 1558711 - RNA, 19 nt, Homo sapiens
ggcugccucugcuuucuuu

SEQ ID NO: 1558712 - RNA, 19 nt, Homo sapiens
ggcacgaccaucacuguuu

SEQ ID NO: 1558713 - RNA, 19 nt, Homo sapiens
acaccucccuggcgcaaga

SEQ ID NO: 1558714 - RNA, 19 nt, Homo sapiens
agacuugaguagcauuugu

SEQ ID NO: 1558715 - RNA, 19 nt, Homo sapiens
gcagagauugggaggacuu

SEQ ID NO: 1558716 - RNA, 19 nt, Homo sapiens
gcagagaugccugugagau

SEQ ID NO: 1558717 - RNA, 19 nt, Homo sapiens
cuuccagccuuucuacuug

SEQ ID NO: 1558718 - RNA, 19 nt, Homo sapiens
gcagcaggauaaguaguag

SEQ ID NO: 1558719 - RNA, 19 nt, Homo sapiens
acacauggcccuguauugu

SEQ ID NO: 1558720 - RNA, 19 nt, Homo sapiens
gagguugccagaugugaga

SEQ ID NO: 1558721 - RNA, 19 nt, Homo sapiens
caacagccuggguucuuga

SEQ ID NO: 1558722 - RNA, 19 nt, Homo sapiens
gaggcacugcuguguguuu

SEQ ID NO: 1558723 - RNA, 19 nt, Homo sapiens
gaugggugguggugagaag

SEQ ID NO: 1558724 - RNA, 19 nt, Homo sapiens
gaugggaaggcaaggaaga

SEQ ID NO: 1558725 - RNA, 19 nt, Homo sapiens
gauucuugcugcugguaug

SEQ ID NO: 1558726 - RNA, 19 nt, Homo sapiens
cuuccuggcucauccauuc

SEQ ID NO: 1558727 - RNA, 19 nt, Homo sapiens
gugagcugguggaucauga

SEQ ID NO: 1558728 - RNA, 19 nt, Homo sapiens
acucauccauccuacguau

SEQ ID NO: 1558729 - RNA, 19 nt, Homo sapiens
uggaggcacugcugugugu

SEQ ID NO: 1558730 - RNA, 19 nt, Homo sapiens
gaccaucccugcgcaucug

SEQ ID NO: 1558731 - RNA, 19 nt, Homo sapiens
ggaguggagaugaccagaa

SEQ ID NO: 1558732 - RNA, 19 nt, Homo sapiens
gagaugccugugagauauu

SEQ ID NO: 1558733 - RNA, 19 nt, Homo sapiens
cauuuaugcccuauacaaa

SEQ ID NO: 1558734 - RNA, 19 nt, Homo sapiens
gggacaauuggguucauuu

SEQ ID NO: 1558735 - RNA, 19 nt, Homo sapiens
gaagaagggacagggaaag

SEQ ID NO: 1558736 - RNA, 19 nt, Homo sapiens
gugaugaacaggaugacaa

SEQ ID NO: 1558737 - RNA, 19 nt, Homo sapiens
gcagugacccgcugauagc

SEQ ID NO: 1558738 - RNA, 19 nt, Homo sapiens
ccaaagccaauaugacauc

SEQ ID NO: 1558739 - RNA, 19 nt, Homo sapiens
gaacaugaucuuaaccaua

SEQ ID NO: 1558740 - RNA, 19 nt, Homo sapiens
gaagagaaaugaagaagac

SEQ ID NO: 1558741 - RNA, 19 nt, Homo sapiens
gcaagaugcucacgcgaaa

SEQ ID NO: 1558742 - RNA, 19 nt, Homo sapiens
gaaaugaagaagacuggua

SEQ ID NO: 1558743 - RNA, 19 nt, Homo sapiens
gguaaugaauguaaagugu

SEQ ID NO: 1558744 - RNA, 19 nt, Homo sapiens
ucacuacuguggcucauuu

SEQ ID NO: 1558745 - RNA, 19 nt, Homo sapiens
gggcguagccguagucuug

SEQ ID NO: 1558746 - RNA, 19 nt, Homo sapiens
gacacugaguacuaaauaa

SEQ ID NO: 1558747 - RNA, 19 nt, Homo sapiens
cauacugucuuccaaguga

SEQ ID NO: 1558748 - RNA, 19 nt, Homo sapiens
caacccaccuggcaugauc

SEQ ID NO: 1558749 - RNA, 19 nt, Homo sapiens
ggaagagaaaugaagaaga

SEQ ID NO: 1558750 - RNA, 19 nt, Homo sapiens
ugacacugaguacuaaaua

SEQ ID NO: 1558751 - RNA, 19 nt, Homo sapiens
ccaaagugcugggauuaca

SEQ ID NO: 1558752 - RNA, 19 nt, Homo sapiens
agacagaccugaguucaag

SEQ ID NO: 1558753 - RNA, 19 nt, Homo sapiens
gaucuuaaccauacugucu

SEQ ID NO: 1558754 - RNA, 19 nt, Homo sapiens
gcggagcaguggcgcauau

SEQ ID NO: 1558755 - RNA, 19 nt, Homo sapiens
gaaccuucagugagucuuu

SEQ ID NO: 1558756 - RNA, 19 nt, Homo sapiens
uaaccauacugucuuccaa

SEQ ID NO: 1558757 - RNA, 19 nt, Homo sapiens
gauucuaccuuucuaagac

SEQ ID NO: 1558758 - RNA, 19 nt, Homo sapiens
aacaugaucuuaaccauac

SEQ ID NO: 1558759 - RNA, 19 nt, Homo sapiens
agacggcggucacuacugu

SEQ ID NO: 1558760 - RNA, 19 nt, Homo sapiens
gaggguaugggaagagaaa

SEQ ID NO: 1558761 - RNA, 19 nt, Homo sapiens
uacuguggcucauuuaaau

SEQ ID NO: 1558762 - RNA, 19 nt, Homo sapiens
gcgcuucacuccgcccaaa

SEQ ID NO: 1558763 - RNA, 19 nt, Homo sapiens
ccggagaacaugaucuuaa

SEQ ID NO: 1558764 - RNA, 19 nt, Homo sapiens
gaacuaaacccgggaaacc

SEQ ID NO: 1558765 - RNA, 19 nt, Homo sapiens
ucuaagacaucuggaguca

SEQ ID NO: 1558766 - RNA, 19 nt, Homo sapiens
gguaugggaagagaaauga

SEQ ID NO: 1558767 - RNA, 19 nt, Homo sapiens
gcuucacuccgcccaaaua

SEQ ID NO: 1558768 - RNA, 19 nt, Homo sapiens
ggcugacacugaguacuaa

SEQ ID NO: 1558769 - RNA, 19 nt, Homo sapiens
cuacuguggcucauuuaaa

SEQ ID NO: 1558770 - RNA, 19 nt, Homo sapiens
ggacagcgaaaggagagaa

SEQ ID NO: 1558771 - RNA, 19 nt, Homo sapiens
cggagaacaugaucuuaac

SEQ ID NO: 1558772 - RNA, 19 nt, Homo sapiens
ccgggaaaccgcugaaaga

SEQ ID NO: 1558773 - RNA, 19 nt, Homo sapiens
uggcugacacugaguacua

SEQ ID NO: 1558774 - RNA, 19 nt, Homo sapiens
gagaacaugaucuuaacca

SEQ ID NO: 1558775 - RNA, 19 nt, Homo sapiens
ggugagcgggugaacuaaa

SEQ ID NO: 1558776 - RNA, 19 nt, Homo sapiens
ucggugagcgggugaacua

SEQ ID NO: 1558777 - RNA, 19 nt, Homo sapiens
agucuuggcccacgucauu

SEQ ID NO: 1558778 - RNA, 19 nt, Homo sapiens
gugagcgggugaacuaaac

SEQ ID NO: 1558779 - RNA, 19 nt, Homo sapiens
ggagcaguggcgcauauca

SEQ ID NO: 1558780 - RNA, 19 nt, Homo sapiens
agaaaccaccacaggcaaa

SEQ ID NO: 1558781 - RNA, 19 nt, Homo sapiens
gagaccacuccgcagcuuu

SEQ ID NO: 1558782 - RNA, 19 nt, Homo sapiens
gcccggagaacaugaucuu

SEQ ID NO: 1558783 - RNA, 19 nt, Homo sapiens
ugagaccacuccgcagcuu

SEQ ID NO: 1558784 - RNA, 19 nt, Homo sapiens
agaacaugaucuuaaccau

SEQ ID NO: 1558785 - RNA, 19 nt, Homo sapiens
cagacagaccugaguucaa

SEQ ID NO: 1558786 - RNA, 19 nt, Homo sapiens
gggaagagaaaugaagaag

SEQ ID NO: 1558787 - RNA, 19 nt, Homo sapiens
gacagcgaaaggagagaaa

SEQ ID NO: 1558788 - RNA, 19 nt, Homo sapiens
ucacuccgcccaaauaagc

SEQ ID NO: 1558789 - RNA, 19 nt, Homo sapiens
ggguaugggaagagaaaug

SEQ ID NO: 1558790 - RNA, 19 nt, Homo sapiens
gaauaaaccugucaaugua

SEQ ID NO: 1558791 - RNA, 19 nt, Homo sapiens
gaaauuugcuugcaucuuu

SEQ ID NO: 1558792 - RNA, 19 nt, Homo sapiens
caaaguggaucuauucaua

SEQ ID NO: 1558793 - RNA, 19 nt, Homo sapiens
gcuagaaucuuccaaguau

SEQ ID NO: 1558794 - RNA, 19 nt, Homo sapiens
ucacucagcuggcauguaa

SEQ ID NO: 1558795 - RNA, 19 nt, Homo sapiens
gcagauguauuguagaaau

SEQ ID NO: 1558796 - RNA, 19 nt, Homo sapiens
gggaguagaugauuucuuc

SEQ ID NO: 1558797 - RNA, 19 nt, Homo sapiens
gauuaaaggugagcuauau

SEQ ID NO: 1558798 - RNA, 19 nt, Homo sapiens
gaacauaaggacauucuga

SEQ ID NO: 1558799 - RNA, 19 nt, Homo sapiens
uaagaaagcugugagacaa

SEQ ID NO: 1558800 - RNA, 19 nt, Homo sapiens
gauaagcaguagcuaauuc

SEQ ID NO: 1558801 - RNA, 19 nt, Homo sapiens
ggaaagaauugagguuguu

SEQ ID NO: 1558802 - RNA, 19 nt, Homo sapiens
gcugcuaccucacuacuuu

SEQ ID NO: 1558803 - RNA, 19 nt, Homo sapiens
cuaagucucucuagaagaa

SEQ ID NO: 1558804 - RNA, 19 nt, Homo sapiens
caaccaaaguggaucuauu

SEQ ID NO: 1558805 - RNA, 19 nt, Homo sapiens
guuauuaagugacagcuuu

SEQ ID NO: 1558806 - RNA, 19 nt, Homo sapiens
gcaauuagaaugucuuuag

SEQ ID NO: 1558807 - RNA, 19 nt, Homo sapiens
cuacuugucuuuaacaguu

SEQ ID NO: 1558808 - RNA, 19 nt, Homo sapiens
ccggaaagcuuuauguaug

SEQ ID NO: 1558809 - RNA, 19 nt, Homo sapiens
gggcuaauguuccauguuc

SEQ ID NO: 1558810 - RNA, 19 nt, Homo sapiens
gaaguuauuucgauguucu

SEQ ID NO: 1558811 - RNA, 19 nt, Homo sapiens
gcugccaccuguguuauua

SEQ ID NO: 1558812 - RNA, 19 nt, Homo sapiens
uguagcagcuggauuuauu

SEQ ID NO: 1558813 - RNA, 19 nt, Homo sapiens
uaaaaggccugguuaugua

SEQ ID NO: 1558814 - RNA, 19 nt, Homo sapiens
gaaugucuuuagccucuuu

SEQ ID NO: 1558815 - RNA, 19 nt, Homo sapiens
gaaguuaguuuucucuuug

SEQ ID NO: 1558816 - RNA, 19 nt, Homo sapiens
gaagggaaaggaugucuau

SEQ ID NO: 1558817 - RNA, 19 nt, Homo sapiens
aaucauggguuauuucaga

SEQ ID NO: 1558818 - RNA, 19 nt, Homo sapiens
auaaugaacuucccucuuc

SEQ ID NO: 1558819 - RNA, 19 nt, Homo sapiens
gcagaagaauuaccaacca

SEQ ID NO: 1558820 - RNA, 19 nt, Homo sapiens
acacacaccuccaugguau

SEQ ID NO: 1558821 - RNA, 19 nt, Homo sapiens
ucacaucaaggaucaauuu

SEQ ID NO: 1558822 - RNA, 19 nt, Homo sapiens
gggaaaggaugucuauuuu

SEQ ID NO: 1558823 - RNA, 19 nt, Homo sapiens
agaauaaaccugucaaugu

SEQ ID NO: 1558824 - RNA, 19 nt, Homo sapiens
aagcagauguauuguagaa

SEQ ID NO: 1558825 - RNA, 19 nt, Homo sapiens
gcucuuugcuguccacuca

SEQ ID NO: 1558826 - RNA, 19 nt, Homo sapiens
caacuuguguguguguaaa

SEQ ID NO: 1558827 - RNA, 19 nt, Homo sapiens
ggugagcuauauggaguua

SEQ ID NO: 1558828 - RNA, 19 nt, Homo sapiens
gauaacugguacugccuuu

SEQ ID NO: 1558829 - RNA, 19 nt, Homo sapiens
ggugaacgcuucuauuugc

SEQ ID NO: 1558830 - RNA, 19 nt, Homo sapiens
uauaagggauucuaugaag

SEQ ID NO: 1558831 - RNA, 19 nt, Homo sapiens
ggugccagcugccagguaa

SEQ ID NO: 1558832 - RNA, 19 nt, Homo sapiens
cagaguguccugaaacuuu

SEQ ID NO: 1558833 - RNA, 19 nt, Homo sapiens
gucaauggcugguaagcaa

SEQ ID NO: 1558834 - RNA, 19 nt, Homo sapiens
ucuguuaguugccugauaa

SEQ ID NO: 1558835 - RNA, 19 nt, Homo sapiens
ccacagacucuaaacacua

SEQ ID NO: 1558836 - RNA, 19 nt, Homo sapiens
ccauggagauucuaaugug

SEQ ID NO: 1558837 - RNA, 19 nt, Homo sapiens
aaucaugacuguucuucuu

SEQ ID NO: 1558838 - RNA, 19 nt, Homo sapiens
gguacugccuuugauuaaa

SEQ ID NO: 1558839 - RNA, 19 nt, Homo sapiens
cauaucagcuguguaguag

SEQ ID NO: 1558840 - RNA, 19 nt, Homo sapiens
gagacaauguguugauuuu

SEQ ID NO: 1558841 - RNA, 19 nt, Homo sapiens
gcacggccauggagauucu

SEQ ID NO: 1558842 - RNA, 19 nt, Homo sapiens
ugacuacaaucaugacugu

SEQ ID NO: 1558843 - RNA, 19 nt, Homo sapiens
ccacauugauuagguuguu

SEQ ID NO: 1558844 - RNA, 19 nt, Homo sapiens
gagcuaaucauggguuauu

SEQ ID NO: 1558845 - RNA, 19 nt, Homo sapiens
ggaaguuaguuuucucuuu

SEQ ID NO: 1558846 - RNA, 19 nt, Homo sapiens
gaaagaauugagguuguuu

SEQ ID NO: 1558847 - RNA, 19 nt, Homo sapiens
gcagcuggauuuauuacca

SEQ ID NO: 1558848 - RNA, 19 nt, Homo sapiens
gcaagaagggaaaggaugu

SEQ ID NO: 1558849 - RNA, 19 nt, Homo sapiens
gaauuugaccggaaagcuu

SEQ ID NO: 1558850 - RNA, 19 nt, Homo sapiens
agaauucuauagcuacuug

SEQ ID NO: 1558851 - RNA, 19 nt, Homo sapiens
ccaccuguguuauuaagug

SEQ ID NO: 1558852 - RNA, 19 nt, Homo sapiens
ucaggucaauggcugguaa

SEQ ID NO: 1558853 - RNA, 19 nt, Homo sapiens
uaacugguacugccuuuga

SEQ ID NO: 1558854 - RNA, 19 nt, Homo sapiens
gaaggaagcagaaaauguu

SEQ ID NO: 1558855 - RNA, 19 nt, Homo sapiens
gaccggaaagcuuuaugua

SEQ ID NO: 1558856 - RNA, 19 nt, Homo sapiens
cagcuggcauguaaugaga

SEQ ID NO: 1558857 - RNA, 19 nt, Homo sapiens
guaagaaagcugugagaca

SEQ ID NO: 1558858 - RNA, 19 nt, Homo sapiens
gaacaugcaaggaauacag

SEQ ID NO: 1558859 - RNA, 19 nt, Homo sapiens
guguaaacaucaauuugga

SEQ ID NO: 1558860 - RNA, 19 nt, Homo sapiens
cagaagaauuaccaaccaa

SEQ ID NO: 1558861 - RNA, 19 nt, Homo sapiens
agaagaacauaaggacauu

SEQ ID NO: 1558862 - RNA, 19 nt, Homo sapiens
gcuggcauguaaugagauu

SEQ ID NO: 1558863 - RNA, 19 nt, Homo sapiens
caaaguauaagggauucua

SEQ ID NO: 1558864 - RNA, 19 nt, Homo sapiens
guucuuucccugcguauuu

SEQ ID NO: 1558865 - RNA, 19 nt, Homo sapiens
gaagaauuaccaaccaaag

SEQ ID NO: 1558866 - RNA, 19 nt, Homo sapiens
gcaguucauuucaggucaa

SEQ ID NO: 1558867 - RNA, 19 nt, Homo sapiens
gauguucuuugagugcuuu

SEQ ID NO: 1558868 - RNA, 19 nt, Homo sapiens
gggcuagaaucuuccaagu

SEQ ID NO: 1558869 - RNA, 19 nt, Homo sapiens
ucauaucagcuguguagua

SEQ ID NO: 1558870 - RNA, 19 nt, Homo sapiens
gccaccaagugcacuguuu

SEQ ID NO: 1558871 - RNA, 19 nt, Homo sapiens
guuauaagaggcauguauu

SEQ ID NO: 1558872 - RNA, 19 nt, Homo sapiens
ggaaauaauaguaguagcu

SEQ ID NO: 1558873 - RNA, 19 nt, Homo sapiens
gcugugagacaauguguug

SEQ ID NO: 1558874 - RNA, 19 nt, Homo sapiens
gaucccagaggaaagaauu

SEQ ID NO: 1558875 - RNA, 19 nt, Homo sapiens
guagcagcuggauuuauua

SEQ ID NO: 1558876 - RNA, 19 nt, Homo sapiens
gccugguuauguaauauuu

SEQ ID NO: 1558877 - RNA, 19 nt, Homo sapiens
gaugcggccuugcucuguu

SEQ ID NO: 1558878 - RNA, 19 nt, Homo sapiens
ccaaagugaugggauuaca

SEQ ID NO: 1558879 - RNA, 19 nt, Homo sapiens
cuaaggcacauacuucaaa

SEQ ID NO: 1558880 - RNA, 19 nt, Homo sapiens
agggaaaggaugucuauuu

SEQ ID NO: 1558881 - RNA, 19 nt, Homo sapiens
cagauguauuguagaaaug

SEQ ID NO: 1558882 - RNA, 19 nt, Homo sapiens
auaaggacauucugaacau

SEQ ID NO: 1558883 - RNA, 19 nt, Homo sapiens
guauaagggauucuaugaa

SEQ ID NO: 1558884 - RNA, 19 nt, Homo sapiens
gagaugagucagccacaga

SEQ ID NO: 1558885 - RNA, 19 nt, Homo sapiens
gggaagcugugcccgaucu

SEQ ID NO: 1558886 - RNA, 19 nt, Homo sapiens
uccaugguauuccuucuuu

SEQ ID NO: 1558887 - RNA, 19 nt, Homo sapiens
gugagacaauguguugauu

SEQ ID NO: 1558888 - RNA, 19 nt, Homo sapiens
agaaagcugugagacaaug

SEQ ID NO: 1558889 - RNA, 19 nt, Homo sapiens
aaacuuggagcuaaucaug

SEQ ID NO: 1558890 - RNA, 19 nt, Homo sapiens
caccaauccuugcaaauua

SEQ ID NO: 1558891 - RNA, 19 nt, Homo sapiens
gagcacaucucgaguauac

SEQ ID NO: 1558892 - RNA, 19 nt, Homo sapiens
ggucaaggauacugauaaa

SEQ ID NO: 1558893 - RNA, 19 nt, Homo sapiens
gcaugggcgucauccuuua

SEQ ID NO: 1558894 - RNA, 19 nt, Homo sapiens
ccaagauggugccuucuaa

SEQ ID NO: 1558895 - RNA, 19 nt, Homo sapiens
cgaacucccuccucaauau

SEQ ID NO: 1558896 - RNA, 19 nt, Homo sapiens
gcaccaauccuugcaaauu

SEQ ID NO: 1558897 - RNA, 19 nt, Homo sapiens
gauaucagacuuuggcuuu

SEQ ID NO: 1558898 - RNA, 19 nt, Homo sapiens
gauaaaguacucacuguau

SEQ ID NO: 1558899 - RNA, 19 nt, Homo sapiens
uaagagagacucagaagga

SEQ ID NO: 1558900 - RNA, 19 nt, Homo sapiens
gggagaaugugaagauauc

SEQ ID NO: 1558901 - RNA, 19 nt, Homo sapiens
gagcaaagcaggaggucuu

SEQ ID NO: 1558902 - RNA, 19 nt, Homo sapiens
cuacaacccuuuccugucu

SEQ ID NO: 1558903 - RNA, 19 nt, Homo sapiens
gugaagauaucagacuuug

SEQ ID NO: 1558904 - RNA, 19 nt, Homo sapiens
caacuucuaucgggccauu

SEQ ID NO: 1558905 - RNA, 19 nt, Homo sapiens
uuaaucauauggucaagga

SEQ ID NO: 1558906 - RNA, 19 nt, Homo sapiens
gagcaacccacccaugaga

SEQ ID NO: 1558907 - RNA, 19 nt, Homo sapiens
gagcaugggcgucauccuu

SEQ ID NO: 1558908 - RNA, 19 nt, Homo sapiens
cagcaccaauccuugcaaa

SEQ ID NO: 1558909 - RNA, 19 nt, Homo sapiens
gaggucacuuucccagcua

SEQ ID NO: 1558910 - RNA, 19 nt, Homo sapiens
ucaaggauacugauaaagu

SEQ ID NO: 1558911 - RNA, 19 nt, Homo sapiens
gcacaucucgaguauacau

SEQ ID NO: 1558912 - RNA, 19 nt, Homo sapiens
aaucauauggucaaggaua

SEQ ID NO: 1558913 - RNA, 19 nt, Homo sapiens
guggugauguccuugaaug

SEQ ID NO: 1558914 - RNA, 19 nt, Homo sapiens
gcacaaguaccucaucaac

SEQ ID NO: 1558915 - RNA, 19 nt, Homo sapiens
ccacuaaacagcaccaauc

SEQ ID NO: 1558916 - RNA, 19 nt, Homo sapiens
cuaaacagcaccaauccuu

SEQ ID NO: 1558917 - RNA, 19 nt, Homo sapiens
auaaaguacucacuguaug

SEQ ID NO: 1558918 - RNA, 19 nt, Homo sapiens
caggaggucuugggcuaaa

SEQ ID NO: 1558919 - RNA, 19 nt, Homo sapiens
uuacgaggcuugcccuaca

SEQ ID NO: 1558920 - RNA, 19 nt, Homo sapiens
gacuuacuguggcagcuuu

SEQ ID NO: 1558921 - RNA, 19 nt, Homo sapiens
gugggagaaugugaagaua

SEQ ID NO: 1558922 - RNA, 19 nt, Homo sapiens
uuaugcacaucucccauuu

SEQ ID NO: 1558923 - RNA, 19 nt, Homo sapiens
gaaccugauccuccagaug

SEQ ID NO: 1558924 - RNA, 19 nt, Homo sapiens
cgucauccuuuacacucua

SEQ ID NO: 1558925 - RNA, 19 nt, Homo sapiens
ccacuaagcgugccaccau

SEQ ID NO: 1558926 - RNA, 19 nt, Homo sapiens
ccucaucuuuacccucuga

SEQ ID NO: 1558927 - RNA, 19 nt, Homo sapiens
gccaagauggugccuucua

SEQ ID NO: 1558928 - RNA, 19 nt, Homo sapiens
ugauaaaguacucacugua

SEQ ID NO: 1558929 - RNA, 19 nt, Homo sapiens
gugauguccuugaauggau

SEQ ID NO: 1558930 - RNA, 19 nt, Homo sapiens
gcuaagagagacucagaag

SEQ ID NO: 1558931 - RNA, 19 nt, Homo sapiens
ucgcccaucugcccuuuga

SEQ ID NO: 1558932 - RNA, 19 nt, Homo sapiens
aguacucacuguaugcaaa

SEQ ID NO: 1558933 - RNA, 19 nt, Homo sapiens
gaacucccuccucaauauc

SEQ ID NO: 1558934 - RNA, 19 nt, Homo sapiens
gcaggaggucuugggcuaa

SEQ ID NO: 1558935 - RNA, 19 nt, Homo sapiens
cggcacaaguaccucauca

SEQ ID NO: 1558936 - RNA, 19 nt, Homo sapiens
cagcugacccugggcauug

SEQ ID NO: 1558937 - RNA, 19 nt, Homo sapiens
gauaccauccucugucucu

SEQ ID NO: 1558938 - RNA, 19 nt, Homo sapiens
uaucuagccuauucaugca

SEQ ID NO: 1558939 - RNA, 19 nt, Homo sapiens
gcaacccacccaugagauc

SEQ ID NO: 1558940 - RNA, 19 nt, Homo sapiens
gcccuuugaugacaccaau

SEQ ID NO: 1558941 - RNA, 19 nt, Homo sapiens
cugauaaaguacucacugu

SEQ ID NO: 1558942 - RNA, 19 nt, Homo sapiens
ggguggugauguccuugaa

SEQ ID NO: 1558943 - RNA, 19 nt, Homo sapiens
ccacaacaccacuaaacag

SEQ ID NO: 1558944 - RNA, 19 nt, Homo sapiens
ucccggugguccucagaua

SEQ ID NO: 1558945 - RNA, 19 nt, Homo sapiens
ucaggguggugauguccuu

SEQ ID NO: 1558946 - RNA, 19 nt, Homo sapiens
ggacaagugggagaaugug

SEQ ID NO: 1558947 - RNA, 19 nt, Homo sapiens
caaauuacgaccugaaaau

SEQ ID NO: 1558948 - RNA, 19 nt, Homo sapiens
ccaccauucuggacaucau

SEQ ID NO: 1558949 - RNA, 19 nt, Homo sapiens
ggucgcccaucugcccuuu

SEQ ID NO: 1558950 - RNA, 19 nt, Homo sapiens
gacaagugggagaauguga

SEQ ID NO: 1558951 - RNA, 19 nt, Homo sapiens
uggcuuuccuuccucucua

SEQ ID NO: 1558952 - RNA, 19 nt, Homo sapiens
ucucgaguauacaucauuc

SEQ ID NO: 1558953 - RNA, 19 nt, Homo sapiens
gccuauucaugcacucuau

SEQ ID NO: 1558954 - RNA, 19 nt, Homo sapiens
ugaugacaccaaucucaaa

SEQ ID NO: 1558955 - RNA, 19 nt, Homo sapiens
ccucuguccucaucuuuac

SEQ ID NO: 1558956 - RNA, 19 nt, Homo sapiens
cuauucaugcacucuauuu

SEQ ID NO: 1558957 - RNA, 19 nt, Homo sapiens
ucgaacucccuccucaaua

SEQ ID NO: 1558958 - RNA, 19 nt, Homo sapiens
aaaguuggagaaccuguug

SEQ ID NO: 1558959 - RNA, 19 nt, Homo sapiens
uaaaguuggagaaccuguu

SEQ ID NO: 1558960 - RNA, 19 nt, Homo sapiens
ggugauguccuugaaugga

SEQ ID NO: 1558961 - RNA, 19 nt, Homo sapiens
uaaaguacucacuguaugc

SEQ ID NO: 1558962 - RNA, 19 nt, Homo sapiens
gcaaauuacgaccugaaaa

SEQ ID NO: 1558963 - RNA, 19 nt, Homo sapiens
ucagaaggaggucacuuuc

SEQ ID NO: 1558964 - RNA, 19 nt, Homo sapiens
cacuaagcgugccaccauu

SEQ ID NO: 1558965 - RNA, 19 nt, Homo sapiens
cugucucucucccuacuuu

SEQ ID NO: 1558966 - RNA, 19 nt, Homo sapiens
acaacccuuuccugucuga

SEQ ID NO: 1558967 - RNA, 19 nt, Homo sapiens
agaaugugaagauaucaga

SEQ ID NO: 1558968 - RNA, 19 nt, Homo sapiens
cugagcaacccacccauga

SEQ ID NO: 1558969 - RNA, 19 nt, Homo sapiens
cucagaaggaggucacuuu

SEQ ID NO: 1558970 - RNA, 19 nt, Homo sapiens
acaagugggagaaugugaa

SEQ ID NO: 1558971 - RNA, 19 nt, Homo sapiens
cccuucagcucccagucua

SEQ ID NO: 1558972 - RNA, 19 nt, Homo sapiens
guaccucaucaacuucuau

SEQ ID NO: 1558973 - RNA, 19 nt, Homo sapiens
caaguuccagccugagcaa

SEQ ID NO: 1558974 - RNA, 19 nt, Homo sapiens
uggguuguagcccuucuua

SEQ ID NO: 1558975 - RNA, 19 nt, Homo sapiens
uaucagacuuuggcuuugc

SEQ ID NO: 1558976 - RNA, 19 nt, Homo sapiens
gaagauaggugugucuaaa

SEQ ID NO: 1558977 - RNA, 19 nt, Homo sapiens
aaagguaaguugcugauua

SEQ ID NO: 1558978 - RNA, 19 nt, Homo sapiens
ccuagagccuuaauaguua

SEQ ID NO: 1558979 - RNA, 19 nt, Homo sapiens
gaauggugguucauaguaa

SEQ ID NO: 1558980 - RNA, 19 nt, Homo sapiens
gaaauuagugcuuugguuu

SEQ ID NO: 1558981 - RNA, 19 nt, Homo sapiens
ggaaaucugucaaugaaca

SEQ ID NO: 1558982 - RNA, 19 nt, Homo sapiens
uguauaaggugcaaugaua

SEQ ID NO: 1558983 - RNA, 19 nt, Homo sapiens
gugaaacaauggaagaaua

SEQ ID NO: 1558984 - RNA, 19 nt, Homo sapiens
ggaagaagaagaagaagaa

SEQ ID NO: 1558985 - RNA, 19 nt, Homo sapiens
gcaagccacuuacuuaauc

SEQ ID NO: 1558986 - RNA, 19 nt, Homo sapiens
ggacagguauagauuuaau

SEQ ID NO: 1558987 - RNA, 19 nt, Homo sapiens
gaagaaggaggaagaagaa

SEQ ID NO: 1558988 - RNA, 19 nt, Homo sapiens
gcagaugaguaacgaaaga

SEQ ID NO: 1558989 - RNA, 19 nt, Homo sapiens
gguuaucgguucagcguua

SEQ ID NO: 1558990 - RNA, 19 nt, Homo sapiens
gaaauuacccgucauucau

SEQ ID NO: 1558991 - RNA, 19 nt, Homo sapiens
gggagacagugaaguaauu

SEQ ID NO: 1558992 - RNA, 19 nt, Homo sapiens
gauggaagcacuuugaauu

SEQ ID NO: 1558993 - RNA, 19 nt, Homo sapiens
guaaguugcugauuaaguc

SEQ ID NO: 1558994 - RNA, 19 nt, Homo sapiens
ggagggagacagugaagua

SEQ ID NO: 1558995 - RNA, 19 nt, Homo sapiens
ggaagaauauagcacagau

SEQ ID NO: 1558996 - RNA, 19 nt, Homo sapiens
ccacuuacuuaaucuugua

SEQ ID NO: 1558997 - RNA, 19 nt, Homo sapiens
uaaggaugcuucaccauau

SEQ ID NO: 1558998 - RNA, 19 nt, Homo sapiens
ggaauggugguucauagua

SEQ ID NO: 1558999 - RNA, 19 nt, Homo sapiens
ggaagaauguguggagugu

SEQ ID NO: 1559000 - RNA, 19 nt, Homo sapiens
ggaggaagaagaagaagaa

SEQ ID NO: 1559001 - RNA, 19 nt, Homo sapiens
gaaggaggaagaagaagaa

SEQ ID NO: 1559002 - RNA, 19 nt, Homo sapiens
gaacugggagucauaggaa

SEQ ID NO: 1559003 - RNA, 19 nt, Homo sapiens
ucacugugccuuaaguuua

SEQ ID NO: 1559004 - RNA, 19 nt, Homo sapiens
uaucaagccuauuugugua

SEQ ID NO: 1559005 - RNA, 19 nt, Homo sapiens
agaauaaauugcagacuga

SEQ ID NO: 1559006 - RNA, 19 nt, Homo sapiens
aagaauguguggaguguuu

SEQ ID NO: 1559007 - RNA, 19 nt, Homo sapiens
gcaaugauagccuaaugaa

SEQ ID NO: 1559008 - RNA, 19 nt, Homo sapiens
ggacucaaauaacuagcuu

SEQ ID NO: 1559009 - RNA, 19 nt, Homo sapiens
ugaaaugacuaucaagcuu

SEQ ID NO: 1559010 - RNA, 19 nt, Homo sapiens
gcagacugauuccauuguu

SEQ ID NO: 1559011 - RNA, 19 nt, Homo sapiens
uagcacagaugaagacgaa

SEQ ID NO: 1559012 - RNA, 19 nt, Homo sapiens
ugggacagguauagauuua

SEQ ID NO: 1559013 - RNA, 19 nt, Homo sapiens
caauauagugggucuguaa

SEQ ID NO: 1559014 - RNA, 19 nt, Homo sapiens
aagguaaguugcugauuaa

SEQ ID NO: 1559015 - RNA, 19 nt, Homo sapiens
guucagcguuaauccuaua

SEQ ID NO: 1559016 - RNA, 19 nt, Homo sapiens
ggagacagugaaguaauua

SEQ ID NO: 1559017 - RNA, 19 nt, Homo sapiens
aauaguggcuaguuuaugu

SEQ ID NO: 1559018 - RNA, 19 nt, Homo sapiens
caagauggaagcacuuuga

SEQ ID NO: 1559019 - RNA, 19 nt, Homo sapiens
ggagagucauccacuuugu

SEQ ID NO: 1559020 - RNA, 19 nt, Homo sapiens
cauaguaagugaugguaau

SEQ ID NO: 1559021 - RNA, 19 nt, Homo sapiens
gaauauagcacagaugaag

SEQ ID NO: 1559022 - RNA, 19 nt, Homo sapiens
guuauucacugugccuuaa

SEQ ID NO: 1559023 - RNA, 19 nt, Homo sapiens
caaugaacaugaacugagu

SEQ ID NO: 1559024 - RNA, 19 nt, Homo sapiens
aaagugaucuucugaaucc

SEQ ID NO: 1559025 - RNA, 19 nt, Homo sapiens
ccacuccucuaccuacuug

SEQ ID NO: 1559026 - RNA, 19 nt, Homo sapiens
cgucauucaucauuuagaa

SEQ ID NO: 1559027 - RNA, 19 nt, Homo sapiens
cuaaggaugcuucaccaua

SEQ ID NO: 1559028 - RNA, 19 nt, Homo sapiens
agaagaagaagaagaagaa

SEQ ID NO: 1559029 - RNA, 19 nt, Homo sapiens
caggaugucugaagaagca

SEQ ID NO: 1559030 - RNA, 19 nt, Homo sapiens
caaggagagucauccacuu

SEQ ID NO: 1559031 - RNA, 19 nt, Homo sapiens
ccuacuugguuauuuguaa

SEQ ID NO: 1559032 - RNA, 19 nt, Homo sapiens
cuaccuacuugguuauuug

SEQ ID NO: 1559033 - RNA, 19 nt, Homo sapiens
caucaggagcaauuagaua

SEQ ID NO: 1559034 - RNA, 19 nt, Homo sapiens
uaagauaggcuuccauuuu

SEQ ID NO: 1559035 - RNA, 19 nt, Homo sapiens
agaaauuagugcuuugguu

SEQ ID NO: 1559036 - RNA, 19 nt, Homo sapiens
uucagaaacucaaagcuuu

SEQ ID NO: 1559037 - RNA, 19 nt, Homo sapiens
acacacacauauaucucua

SEQ ID NO: 1559038 - RNA, 19 nt, Homo sapiens
cagcguuaauccuauagaa

SEQ ID NO: 1559039 - RNA, 19 nt, Homo sapiens
agagucauccacuuuguua

SEQ ID NO: 1559040 - RNA, 19 nt, Homo sapiens
gaugaauauuaucggauga

SEQ ID NO: 1559041 - RNA, 19 nt, Homo sapiens
uaacuucauucgagauagu

SEQ ID NO: 1559042 - RNA, 19 nt, Homo sapiens
guaagugaugguaaucuuu

SEQ ID NO: 1559043 - RNA, 19 nt, Homo sapiens
gcaggagaaucacuugaac

SEQ ID NO: 1559044 - RNA, 19 nt, Homo sapiens
gugcaaugauagccuaaug

SEQ ID NO: 1559045 - RNA, 19 nt, Homo sapiens
aaugcaagccacuuacuua

SEQ ID NO: 1559046 - RNA, 19 nt, Homo sapiens
aaggaugcuucaccauaua

SEQ ID NO: 1559047 - RNA, 19 nt, Homo sapiens
guggcuaguuuauguuuau

SEQ ID NO: 1559048 - RNA, 19 nt, Homo sapiens
cuaaauguguguauagaac

SEQ ID NO: 1559049 - RNA, 19 nt, Homo sapiens
ccauguggcauccugguua

SEQ ID NO: 1559050 - RNA, 19 nt, Homo sapiens
ggaugaagaaggaggaaga

SEQ ID NO: 1559051 - RNA, 19 nt, Homo sapiens
guccaauaguggcuaguuu

SEQ ID NO: 1559052 - RNA, 19 nt, Homo sapiens
auggaaaucugucaaugaa

SEQ ID NO: 1559053 - RNA, 19 nt, Homo sapiens
uaauggaaaucugucaaug

SEQ ID NO: 1559054 - RNA, 19 nt, Homo sapiens
acacacacacacacauaua

SEQ ID NO: 1559055 - RNA, 19 nt, Homo sapiens
gggcagaugaguaacgaaa

SEQ ID NO: 1559056 - RNA, 19 nt, Homo sapiens
gaugcuucaccauauaaua

SEQ ID NO: 1559057 - RNA, 19 nt, Homo sapiens
gaagaagaagaagaagaaa

SEQ ID NO: 1559058 - RNA, 19 nt, Homo sapiens
ugaagaaggaggaagaaga

SEQ ID NO: 1559059 - RNA, 19 nt, Homo sapiens
cauuaggaguguucagcua

SEQ ID NO: 1559060 - RNA, 19 nt, Homo sapiens
acagguugaaggauaauua

SEQ ID NO: 1559061 - RNA, 19 nt, Homo sapiens
caccagauauuaagauagg

SEQ ID NO: 1559062 - RNA, 19 nt, Homo sapiens
caagccuauuuguguauuu

SEQ ID NO: 1559063 - RNA, 19 nt, Homo sapiens
acacacacacacacacaua

SEQ ID NO: 1559064 - RNA, 19 nt, Homo sapiens
gcaaaagccagaucugaaa

SEQ ID NO: 1559065 - RNA, 19 nt, Homo sapiens
uuaauagccuucuaaacag

SEQ ID NO: 1559066 - RNA, 19 nt, Homo sapiens
aagaauauagcacagauga

SEQ ID NO: 1559067 - RNA, 19 nt, Homo sapiens
gcacagaugaagacgaagu

SEQ ID NO: 1559068 - RNA, 19 nt, Homo sapiens
cagugggacuuaauacaau

SEQ ID NO: 1559069 - RNA, 19 nt, Homo sapiens
cuaucaagcuucaaacucu

SEQ ID NO: 1559070 - RNA, 19 nt, Homo sapiens
gauauuguauaaggugcaa

SEQ ID NO: 1559071 - RNA, 19 nt, Homo sapiens
aaagccagaucugaaauuc

SEQ ID NO: 1559072 - RNA, 19 nt, Homo sapiens
gaucaaccagagacaguga

SEQ ID NO: 1559073 - RNA, 19 nt, Homo sapiens
aacuacagguugaaggaua

SEQ ID NO: 1559074 - RNA, 19 nt, Homo sapiens
gaauauuaucggaugaaga

SEQ ID NO: 1559075 - RNA, 19 nt, Homo sapiens
uugauggccuggagaagaa

SEQ ID NO: 1559076 - RNA, 19 nt, Homo sapiens
ggaggggacucggaaauaa

SEQ ID NO: 1559077 - RNA, 19 nt, Homo sapiens
gcagagcccacgucacaug

SEQ ID NO: 1559078 - RNA, 19 nt, Homo sapiens
ggaaugacuggucccuuga

SEQ ID NO: 1559079 - RNA, 19 nt, Homo sapiens
gcccuggucucaucuggau

SEQ ID NO: 1559080 - RNA, 19 nt, Homo sapiens
ggacucggaaauaaauugu

SEQ ID NO: 1559081 - RNA, 19 nt, Homo sapiens
ccaucugucugucacugaa

SEQ ID NO: 1559082 - RNA, 19 nt, Homo sapiens
acucggaaauaaauuguag

SEQ ID NO: 1559083 - RNA, 19 nt, Homo sapiens
gggacucggaaauaaauug

SEQ ID NO: 1559084 - RNA, 19 nt, Homo sapiens
gggcagcuguggugaucag

SEQ ID NO: 1559085 - RNA, 19 nt, Homo sapiens
ggucuuggaggagcagauu

SEQ ID NO: 1559086 - RNA, 19 nt, Homo sapiens
ugugccagauccaccugua

SEQ ID NO: 1559087 - RNA, 19 nt, Homo sapiens
ggugcuacgucgacuacag

SEQ ID NO: 1559088 - RNA, 19 nt, Homo sapiens
gaccugugcccgagcagau

SEQ ID NO: 1559089 - RNA, 19 nt, Homo sapiens
cacagcgaccagagccuua

SEQ ID NO: 1559090 - RNA, 19 nt, Homo sapiens
gagaaucacuguuauaaug

SEQ ID NO: 1559091 - RNA, 19 nt, Homo sapiens
gaagggaguuugaaaguug

SEQ ID NO: 1559092 - RNA, 19 nt, Homo sapiens
ccagagaacugucauuauu

SEQ ID NO: 1559093 - RNA, 19 nt, Homo sapiens
gaaacagcaugcuaaaugu

SEQ ID NO: 1559094 - RNA, 19 nt, Homo sapiens
gcaaagauaugcauuuacu

SEQ ID NO: 1559095 - RNA, 19 nt, Homo sapiens
uaauaaagcuggauacagu

SEQ ID NO: 1559096 - RNA, 19 nt, Homo sapiens
gaaagccacugagauagaa

SEQ ID NO: 1559097 - RNA, 19 nt, Homo sapiens
gaaaguuguuguauacugu

SEQ ID NO: 1559098 - RNA, 19 nt, Homo sapiens
ggaggaguguuaugaaaga

SEQ ID NO: 1559099 - RNA, 19 nt, Homo sapiens
gaagguaccuacagagaag

SEQ ID NO: 1559100 - RNA, 19 nt, Homo sapiens
gagagaagguaccuacaga

SEQ ID NO: 1559101 - RNA, 19 nt, Homo sapiens
uacaguggcuuucugauuu

SEQ ID NO: 1559102 - RNA, 19 nt, Homo sapiens
gaauagaaaugcacaaagc

SEQ ID NO: 1559103 - RNA, 19 nt, Homo sapiens
ggccauaugucacuaauag

SEQ ID NO: 1559104 - RNA, 19 nt, Homo sapiens
gaagaugagucuggaagug

SEQ ID NO: 1559105 - RNA, 19 nt, Homo sapiens
guacacagaauacuucauu

SEQ ID NO: 1559106 - RNA, 19 nt, Homo sapiens
uuacuucucuggcuacaaa

SEQ ID NO: 1559107 - RNA, 19 nt, Homo sapiens
ugaaacagcaugcuaaaug

SEQ ID NO: 1559108 - RNA, 19 nt, Homo sapiens
gcacaaagcagagcagugu

SEQ ID NO: 1559109 - RNA, 19 nt, Homo sapiens
gaaccacacuucgagaauc

SEQ ID NO: 1559110 - RNA, 19 nt, Homo sapiens
gaugauagccacaaagcaa

SEQ ID NO: 1559111 - RNA, 19 nt, Homo sapiens
acagaauacuucauuguug

SEQ ID NO: 1559112 - RNA, 19 nt, Homo sapiens
gaauaacccugcagaaaau

SEQ ID NO: 1559113 - RNA, 19 nt, Homo sapiens
gaaaggccucugcaaagaa

SEQ ID NO: 1559114 - RNA, 19 nt, Homo sapiens
ggaguguuaugaaagaaga

SEQ ID NO: 1559115 - RNA, 19 nt, Homo sapiens
agagaacugucauuauuug

SEQ ID NO: 1559116 - RNA, 19 nt, Homo sapiens
ggagaagggccauauguca

SEQ ID NO: 1559117 - RNA, 19 nt, Homo sapiens
gagcagugguuccuguuuc

SEQ ID NO: 1559118 - RNA, 19 nt, Homo sapiens
gggaauaacccugcagaaa

SEQ ID NO: 1559119 - RNA, 19 nt, Homo sapiens
caagugaagugugugcauu

SEQ ID NO: 1559120 - RNA, 19 nt, Homo sapiens
agaaaggccucugcaaaga

SEQ ID NO: 1559121 - RNA, 19 nt, Homo sapiens
cagagaagauccacaaggu

SEQ ID NO: 1559122 - RNA, 19 nt, Homo sapiens
cagaauacuucauuguugu

SEQ ID NO: 1559123 - RNA, 19 nt, Homo sapiens
ggagagcaauugcacaaac

SEQ ID NO: 1559124 - RNA, 19 nt, Homo sapiens
gaagaagggaguuugaaag

SEQ ID NO: 1559125 - RNA, 19 nt, Homo sapiens
ggaauaacccugcagaaaa

SEQ ID NO: 1559126 - RNA, 19 nt, Homo sapiens
gaugaaauccaaaggugaa

SEQ ID NO: 1559127 - RNA, 19 nt, Homo sapiens
aguguuaguugcaaagaua

SEQ ID NO: 1559128 - RNA, 19 nt, Homo sapiens
gagagcaauugcacaaaca

SEQ ID NO: 1559129 - RNA, 19 nt, Homo sapiens
gcaauugcacaaacacuug

SEQ ID NO: 1559130 - RNA, 19 nt, Homo sapiens
guuauaauguacagcagaa

SEQ ID NO: 1559131 - RNA, 19 nt, Homo sapiens
uauguccucuucucuguuu

SEQ ID NO: 1559132 - RNA, 19 nt, Homo sapiens
gaagggccauaugucacua

SEQ ID NO: 1559133 - RNA, 19 nt, Homo sapiens
gagaagguaccuacagaga

SEQ ID NO: 1559134 - RNA, 19 nt, Homo sapiens
acacauggccaccuuggua

SEQ ID NO: 1559135 - RNA, 19 nt, Homo sapiens
gauaugcauuuacuucucu

SEQ ID NO: 1559136 - RNA, 19 nt, Homo sapiens
cuacagagaagaagggaaa

SEQ ID NO: 1559137 - RNA, 19 nt, Homo sapiens
gaaggaccagccacuuuga

SEQ ID NO: 1559138 - RNA, 19 nt, Homo sapiens
caagugauccucccaccuu

SEQ ID NO: 1559139 - RNA, 19 nt, Homo sapiens
cagagaacugucauuauuu

SEQ ID NO: 1559140 - RNA, 19 nt, Homo sapiens
guuuggaucuccuucaaug

SEQ ID NO: 1559141 - RNA, 19 nt, Homo sapiens
gaguuuggaucuccuucaa

SEQ ID NO: 1559142 - RNA, 19 nt, Homo sapiens
uguauacuguuaacgauug

SEQ ID NO: 1559143 - RNA, 19 nt, Homo sapiens
ugaaaguuguuguauacug

SEQ ID NO: 1559144 - RNA, 19 nt, Homo sapiens
gaaaugucaacccucacua

SEQ ID NO: 1559145 - RNA, 19 nt, Homo sapiens
ccauaugucacuaauagaa

SEQ ID NO: 1559146 - RNA, 19 nt, Homo sapiens
ugaagaagggaguuugaaa

SEQ ID NO: 1559147 - RNA, 19 nt, Homo sapiens
gcagagcagugugaagaag

SEQ ID NO: 1559148 - RNA, 19 nt, Homo sapiens
uuugaaagccacugagaua

SEQ ID NO: 1559149 - RNA, 19 nt, Homo sapiens
uuauuugacuggacacuug

SEQ ID NO: 1559150 - RNA, 19 nt, Homo sapiens
ggguaaugcugaugcuuca

SEQ ID NO: 1559151 - RNA, 19 nt, Homo sapiens
uagaaggaccagccacuuu

SEQ ID NO: 1559152 - RNA, 19 nt, Homo sapiens
gcugguaguucccuaaagg

SEQ ID NO: 1559153 - RNA, 19 nt, Homo sapiens
gaaauccaaaggugaaucu

SEQ ID NO: 1559154 - RNA, 19 nt, Homo sapiens
agaagggaguuugaaaguu

SEQ ID NO: 1559155 - RNA, 19 nt, Homo sapiens
gcuaugaaacagcaugcua

SEQ ID NO: 1559156 - RNA, 19 nt, Homo sapiens
caugaucagcuguauggua

SEQ ID NO: 1559157 - RNA, 19 nt, Homo sapiens
ggagaugccaagugaagug

SEQ ID NO: 1559158 - RNA, 19 nt, Homo sapiens
ugaaagccacugagauaga

SEQ ID NO: 1559159 - RNA, 19 nt, Homo sapiens
acuugaagcuugcccugua

SEQ ID NO: 1559160 - RNA, 19 nt, Homo sapiens
ugucaacccucacuaaacu

SEQ ID NO: 1559161 - RNA, 19 nt, Homo sapiens
gaugccaagugaagugugu

SEQ ID NO: 1559162 - RNA, 19 nt, Homo sapiens
gaugagucuggaaguguua

SEQ ID NO: 1559163 - RNA, 19 nt, Homo sapiens
ucgagaaucacuguuauaa

SEQ ID NO: 1559164 - RNA, 19 nt, Homo sapiens
caaagaagagagagaaggu

SEQ ID NO: 1559165 - RNA, 19 nt, Homo sapiens
ggaaccacacuucgagaau

SEQ ID NO: 1559166 - RNA, 19 nt, Homo sapiens
gaggaguguuaugaaagaa

SEQ ID NO: 1559167 - RNA, 19 nt, Homo sapiens
uuacaguggcuuucugauu

SEQ ID NO: 1559168 - RNA, 19 nt, Homo sapiens
caugcuaaaugugaaaugu

SEQ ID NO: 1559169 - RNA, 19 nt, Homo sapiens
uaagcuauguuaguacaca

SEQ ID NO: 1559170 - RNA, 19 nt, Homo sapiens
uuugauaacuguguacuuc

SEQ ID NO: 1559171 - RNA, 19 nt, Homo sapiens
aaacagacuaggcacagaa

SEQ ID NO: 1559172 - RNA, 19 nt, Homo sapiens
aguaggaacugcagagaag

SEQ ID NO: 1559173 - RNA, 19 nt, Homo sapiens
gaagaagaagaggcgauga

SEQ ID NO: 1559174 - RNA, 19 nt, Homo sapiens
gaagcuugcccuguaugaa

SEQ ID NO: 1559175 - RNA, 19 nt, Homo sapiens
cacagaauacuucauuguu

SEQ ID NO: 1559176 - RNA, 19 nt, Homo sapiens
uaaaccugcuccuccaaag

SEQ ID NO: 1559177 - RNA, 19 nt, Homo sapiens
agagcagugugaagaagaa

SEQ ID NO: 1559178 - RNA, 19 nt, Homo sapiens
gaguuugaaaguuguugua

SEQ ID NO: 1559179 - RNA, 19 nt, Homo sapiens
aaaugucaacccucacuaa

SEQ ID NO: 1559180 - RNA, 19 nt, Homo sapiens
cuaugaaacagcaugcuaa

SEQ ID NO: 1559181 - RNA, 19 nt, Homo sapiens
cccugaagcuggacugaug

SEQ ID NO: 1559182 - RNA, 19 nt, Homo sapiens
aaaggccucugcaaagaag

SEQ ID NO: 1559183 - RNA, 19 nt, Homo sapiens
gagaacugucauuauuuga

SEQ ID NO: 1559184 - RNA, 19 nt, Homo sapiens
agaaggaccagccacuuug

SEQ ID NO: 1559185 - RNA, 19 nt, Homo sapiens
cuaaagggcgugcaaggau

SEQ ID NO: 1559186 - RNA, 19 nt, Homo sapiens
ucccagagaacugucauua

SEQ ID NO: 1559187 - RNA, 19 nt, Homo sapiens
guuguauacuguuaacgau

SEQ ID NO: 1559188 - RNA, 19 nt, Homo sapiens
ugauacacauggccaccuu

SEQ ID NO: 1559189 - RNA, 19 nt, Homo sapiens
gcuguaugguagccuugaa

SEQ ID NO: 1559190 - RNA, 19 nt, Homo sapiens
gaacugaccugauaauuaa

SEQ ID NO: 1559191 - RNA, 19 nt, Homo sapiens
ggaaggagcuguaggaaau

SEQ ID NO: 1559192 - RNA, 19 nt, Homo sapiens
ggaacugaccugauaauua

SEQ ID NO: 1559193 - RNA, 19 nt, Homo sapiens
gggaggaacugaccugaua

SEQ ID NO: 1559194 - RNA, 19 nt, Homo sapiens
ccaaacagcuucauugaug

SEQ ID NO: 1559195 - RNA, 19 nt, Homo sapiens
gaaaugagguaggaaagaa

SEQ ID NO: 1559196 - RNA, 19 nt, Homo sapiens
ucaaagaaguuacaaguug

SEQ ID NO: 1559197 - RNA, 19 nt, Homo sapiens
ggaaaccucugaaucaaau

SEQ ID NO: 1559198 - RNA, 19 nt, Homo sapiens
caagauaucugcauccaau

SEQ ID NO: 1559199 - RNA, 19 nt, Homo sapiens
caaagaaguuacaaguuga

SEQ ID NO: 1559200 - RNA, 19 nt, Homo sapiens
ggacacagcugcuauucag

SEQ ID NO: 1559201 - RNA, 19 nt, Homo sapiens
auacaucuguccucaguua

SEQ ID NO: 1559202 - RNA, 19 nt, Homo sapiens
gcuaugguccuauaauuaa

SEQ ID NO: 1559203 - RNA, 19 nt, Homo sapiens
gcacaaaucauuaacuaca

SEQ ID NO: 1559204 - RNA, 19 nt, Homo sapiens
gccaugcuaugcuuugaua

SEQ ID NO: 1559205 - RNA, 19 nt, Homo sapiens
ccaaggaccuacucuauac

SEQ ID NO: 1559206 - RNA, 19 nt, Homo sapiens
ugagcagacuuccuccuua

SEQ ID NO: 1559207 - RNA, 19 nt, Homo sapiens
gacccgcuauacuaucuua

SEQ ID NO: 1559208 - RNA, 19 nt, Homo sapiens
acacugcccugguuucuug

SEQ ID NO: 1559209 - RNA, 19 nt, Homo sapiens
ggaugacacugcccugguu

SEQ ID NO: 1559210 - RNA, 19 nt, Homo sapiens
gagcagacuuccuccuuag

SEQ ID NO: 1559211 - RNA, 19 nt, Homo sapiens
caucuguccucaguuauaa

SEQ ID NO: 1559212 - RNA, 19 nt, Homo sapiens
uagcuaugguccuauaauu

SEQ ID NO: 1559213 - RNA, 19 nt, Homo sapiens
ugaagacccugcuguguca

SEQ ID NO: 1559214 - RNA, 19 nt, Homo sapiens
aaaggaaaccucugaauca

SEQ ID NO: 1559215 - RNA, 19 nt, Homo sapiens
gaacauucagcaaauagug

SEQ ID NO: 1559216 - RNA, 19 nt, Homo sapiens
cugcacaaaucauuaacua

SEQ ID NO: 1559217 - RNA, 19 nt, Homo sapiens
gaccuacucuauacucuca

SEQ ID NO: 1559218 - RNA, 19 nt, Homo sapiens
ucaagacccuuugguguug

SEQ ID NO: 1559219 - RNA, 19 nt, Homo sapiens
gaucagcuuuccaguccuu

SEQ ID NO: 1559220 - RNA, 19 nt, Homo sapiens
acagaacauucagcaaaua

SEQ ID NO: 1559221 - RNA, 19 nt, Homo sapiens
gccaggcaccacuguauua

SEQ ID NO: 1559222 - RNA, 19 nt, Homo sapiens
ugacauuaauagaggauga

SEQ ID NO: 1559223 - RNA, 19 nt, Homo sapiens
gaaccuggaaggagcugua

SEQ ID NO: 1559224 - RNA, 19 nt, Homo sapiens
caaaggaaaccucugaauc

SEQ ID NO: 1559225 - RNA, 19 nt, Homo sapiens
ccaaugaucaugccaaaca

SEQ ID NO: 1559226 - RNA, 19 nt, Homo sapiens
gaaguaaagccaggaaauc

SEQ ID NO: 1559227 - RNA, 19 nt, Homo sapiens
caucagaaacucacauguu

SEQ ID NO: 1559228 - RNA, 19 nt, Homo sapiens
gcuaacaccucaucuucca

SEQ ID NO: 1559229 - RNA, 19 nt, Homo sapiens
aaacucacauguugguuca

SEQ ID NO: 1559230 - RNA, 19 nt, Homo sapiens
ggaaaugagguaggaaaga

SEQ ID NO: 1559231 - RNA, 19 nt, Homo sapiens
gcagacuuccuccuuaguu

SEQ ID NO: 1559232 - RNA, 19 nt, Homo sapiens
acucaacaguuaccucgua

SEQ ID NO: 1559233 - RNA, 19 nt, Homo sapiens
aaccauggcuuugcuagaa

SEQ ID NO: 1559234 - RNA, 19 nt, Homo sapiens
caccucaucuuccaucuuc

SEQ ID NO: 1559235 - RNA, 19 nt, Homo sapiens
gccaggaaaucaucugcuu

SEQ ID NO: 1559236 - RNA, 19 nt, Homo sapiens
guugugacccgcuauacua

SEQ ID NO: 1559237 - RNA, 19 nt, Homo sapiens
ccaagacucaaagaaguua

SEQ ID NO: 1559238 - RNA, 19 nt, Homo sapiens
ccugcugugucaucuguua

SEQ ID NO: 1559239 - RNA, 19 nt, Homo sapiens
uacagaacauucagcaaau

SEQ ID NO: 1559240 - RNA, 19 nt, Homo sapiens
uguaggaaaugaagaaucu

SEQ ID NO: 1559241 - RNA, 19 nt, Homo sapiens
caucuguguucucaucuug

SEQ ID NO: 1559242 - RNA, 19 nt, Homo sapiens
auacagaacauucagcaaa

SEQ ID NO: 1559243 - RNA, 19 nt, Homo sapiens
auuaauagcuaugguccua

SEQ ID NO: 1559244 - RNA, 19 nt, Homo sapiens
ggaggaacugaccugauaa

SEQ ID NO: 1559245 - RNA, 19 nt, Homo sapiens
gagaguggcaggucuuaca

SEQ ID NO: 1559246 - RNA, 19 nt, Homo sapiens
uagaaccaaacaccaaaua

SEQ ID NO: 1559247 - RNA, 19 nt, Homo sapiens
uggcauugcuguagguguu

SEQ ID NO: 1559248 - RNA, 19 nt, Homo sapiens
gcguuuagauucugcugau

SEQ ID NO: 1559249 - RNA, 19 nt, Homo sapiens
uguguacauugucaagaua

SEQ ID NO: 1559250 - RNA, 19 nt, Homo sapiens
gaaaauaucaugugagacu

SEQ ID NO: 1559251 - RNA, 19 nt, Homo sapiens
caucugccaugcuaugcuu

SEQ ID NO: 1559252 - RNA, 19 nt, Homo sapiens
ccucaucuguguucucauc

SEQ ID NO: 1559253 - RNA, 19 nt, Homo sapiens
aaggaaaccucugaaucaa

SEQ ID NO: 1559254 - RNA, 19 nt, Homo sapiens
uggcaguacuuccaaagga

SEQ ID NO: 1559255 - RNA, 19 nt, Homo sapiens
gaaccaaacaccaaauacg

SEQ ID NO: 1559256 - RNA, 19 nt, Homo sapiens
gaacuguaccaccauuucu

SEQ ID NO: 1559257 - RNA, 19 nt, Homo sapiens
cauaggacgcccaaagcua

SEQ ID NO: 1559258 - RNA, 19 nt, Homo sapiens
cgaaguaaagccaggaaau

SEQ ID NO: 1559259 - RNA, 19 nt, Homo sapiens
cugcugaugccaaaguuua

SEQ ID NO: 1559260 - RNA, 19 nt, Homo sapiens
gcccaagcguuuagauucu

SEQ ID NO: 1559261 - RNA, 19 nt, Homo sapiens
ggaguaaaagugacauuaa

SEQ ID NO: 1559262 - RNA, 19 nt, Homo sapiens
cauguugguucaaggucua

SEQ ID NO: 1559263 - RNA, 19 nt, Homo sapiens
aucagaaacucacauguug

SEQ ID NO: 1559264 - RNA, 19 nt, Homo sapiens
ugagacuccuggcuuacaa

SEQ ID NO: 1559265 - RNA, 19 nt, Homo sapiens
uguugcagcugauacagaa

SEQ ID NO: 1559266 - RNA, 19 nt, Homo sapiens
cagccucaaagaagauuua

SEQ ID NO: 1559267 - RNA, 19 nt, Homo sapiens
guaaagccaggaaaucauc

SEQ ID NO: 1559268 - RNA, 19 nt, Homo sapiens
gggcaauaaccauggcuuu

SEQ ID NO: 1559269 - RNA, 19 nt, Homo sapiens
gaauuugccguucgauuac

SEQ ID NO: 1559270 - RNA, 19 nt, Homo sapiens
acaaccagcuucucaagac

SEQ ID NO: 1559271 - RNA, 19 nt, Homo sapiens
aggcaccacuguauuaauc

SEQ ID NO: 1559272 - RNA, 19 nt, Homo sapiens
cuccuuagcuaguggaaau

SEQ ID NO: 1559273 - RNA, 19 nt, Homo sapiens
gcacagaauggaacucaac

SEQ ID NO: 1559274 - RNA, 19 nt, Homo sapiens
cagacuuccuccuuaguuc

SEQ ID NO: 1559275 - RNA, 19 nt, Homo sapiens
ucacauaggacgcccaaag

SEQ ID NO: 1559276 - RNA, 19 nt, Homo sapiens
ccaaaguuuauucaggaua

SEQ ID NO: 1559277 - RNA, 19 nt, Homo sapiens
ccaaaggaaaccucugaau

SEQ ID NO: 1559278 - RNA, 19 nt, Homo sapiens
caugcuaugcuuugauaaa

SEQ ID NO: 1559279 - RNA, 19 nt, Homo sapiens
gaaucuuuaaugccaauga

SEQ ID NO: 1559280 - RNA, 19 nt, Homo sapiens
gagguggcagcaagaugua

SEQ ID NO: 1559281 - RNA, 19 nt, Homo sapiens
uaccaaggaccuacucuau

SEQ ID NO: 1559282 - RNA, 19 nt, Homo sapiens
ugcuguagguguuggcaua

SEQ ID NO: 1559283 - RNA, 19 nt, Homo sapiens
ggcccaagcguuuagauuc

SEQ ID NO: 1559284 - RNA, 19 nt, Homo sapiens
cccuaagucuccagaguug

SEQ ID NO: 1559285 - RNA, 19 nt, Homo sapiens
ccaaacaccaaauacgaau

SEQ ID NO: 1559286 - RNA, 19 nt, Homo sapiens
ugaguccaacgaugagaua

SEQ ID NO: 1559287 - RNA, 19 nt, Homo sapiens
gcauagccuugaccugcau

SEQ ID NO: 1559288 - RNA, 19 nt, Homo sapiens
gccgccaucugccaugcua

SEQ ID NO: 1559289 - RNA, 19 nt, Homo sapiens
gacaaccagcuucucaaga

SEQ ID NO: 1559290 - RNA, 19 nt, Homo sapiens
guacauagauggacacaug

SEQ ID NO: 1559291 - RNA, 19 nt, Homo sapiens
gcacuugcauguauaaaga

SEQ ID NO: 1559292 - RNA, 19 nt, Homo sapiens
gcacagacauauaaagaca

SEQ ID NO: 1559293 - RNA, 19 nt, Homo sapiens
gaagaacaguuuagaagca

SEQ ID NO: 1559294 - RNA, 19 nt, Homo sapiens
ucugaaaugucucuacuua

SEQ ID NO: 1559295 - RNA, 19 nt, Homo sapiens
gaagauacccugugcaaag

SEQ ID NO: 1559296 - RNA, 19 nt, Homo sapiens
caaagcacuugcauguaua

SEQ ID NO: 1559297 - RNA, 19 nt, Homo sapiens
acaaagcacuugcauguau

SEQ ID NO: 1559298 - RNA, 19 nt, Homo sapiens
ggaguuaucuggguaucaa

SEQ ID NO: 1559299 - RNA, 19 nt, Homo sapiens
auaaagaacuccuccaaau

SEQ ID NO: 1559300 - RNA, 19 nt, Homo sapiens
ggaaaugcagccucaguaa

SEQ ID NO: 1559301 - RNA, 19 nt, Homo sapiens
gugcaaagacugacaauau

SEQ ID NO: 1559302 - RNA, 19 nt, Homo sapiens
gaagggagaaaguaauuug

SEQ ID NO: 1559303 - RNA, 19 nt, Homo sapiens
caacaucucugcugaagcu

SEQ ID NO: 1559304 - RNA, 19 nt, Homo sapiens
gaauuuccauuuagugcuu

SEQ ID NO: 1559305 - RNA, 19 nt, Homo sapiens
gaaaugucucuacuuauug

SEQ ID NO: 1559306 - RNA, 19 nt, Homo sapiens
gggagaaaguaauuuggaa

SEQ ID NO: 1559307 - RNA, 19 nt, Homo sapiens
acaagaauguucauaguag

SEQ ID NO: 1559308 - RNA, 19 nt, Homo sapiens
ugacaaagcacuugcaugu

SEQ ID NO: 1559309 - RNA, 19 nt, Homo sapiens
gagaagggagaaaguaauu

SEQ ID NO: 1559310 - RNA, 19 nt, Homo sapiens
ccaagcacaucaaauaaag

SEQ ID NO: 1559311 - RNA, 19 nt, Homo sapiens
aagcaaaucugaccacauc

SEQ ID NO: 1559312 - RNA, 19 nt, Homo sapiens
gaagauccaagacgcguuu

SEQ ID NO: 1559313 - RNA, 19 nt, Homo sapiens
gagcacagacucucacaug

SEQ ID NO: 1559314 - RNA, 19 nt, Homo sapiens
gagcccagguauauaucua

SEQ ID NO: 1559315 - RNA, 19 nt, Homo sapiens
gagaaggugugcagcuuag

SEQ ID NO: 1559316 - RNA, 19 nt, Homo sapiens
gagaacaccuugguaaacu

SEQ ID NO: 1559317 - RNA, 19 nt, Homo sapiens
gaaguccaguuaggagauu

SEQ ID NO: 1559318 - RNA, 19 nt, Homo sapiens
agaagugucuggcaaggaa

SEQ ID NO: 1559319 - RNA, 19 nt, Homo sapiens
caagaauguucauaguaga

SEQ ID NO: 1559320 - RNA, 19 nt, Homo sapiens
gcaacucuuccgucuauuu

SEQ ID NO: 1559321 - RNA, 19 nt, Homo sapiens
cacuugacaucccauauaa

SEQ ID NO: 1559322 - RNA, 19 nt, Homo sapiens
ucacuugacaucccauaua

SEQ ID NO: 1559323 - RNA, 19 nt, Homo sapiens
acucucacaugcacaaaua

SEQ ID NO: 1559324 - RNA, 19 nt, Homo sapiens
gcaaagacugacaauauca

SEQ ID NO: 1559325 - RNA, 19 nt, Homo sapiens
aaagaacuccuccaaauca

SEQ ID NO: 1559326 - RNA, 19 nt, Homo sapiens
uaaagacagucaugcagau

SEQ ID NO: 1559327 - RNA, 19 nt, Homo sapiens
uggcaacucuuccgucuau

SEQ ID NO: 1559328 - RNA, 19 nt, Homo sapiens
agauggaacuggauaugaa

SEQ ID NO: 1559329 - RNA, 19 nt, Homo sapiens
caaauggccaagaagcaua

SEQ ID NO: 1559330 - RNA, 19 nt, Homo sapiens
ggaacuggauaugaauuuc

SEQ ID NO: 1559331 - RNA, 19 nt, Homo sapiens
gaaaaugaagggaggguua

SEQ ID NO: 1559332 - RNA, 19 nt, Homo sapiens
ggaugaaguugaaaucacu

SEQ ID NO: 1559333 - RNA, 19 nt, Homo sapiens
cagaagagccacaucacaa

SEQ ID NO: 1559334 - RNA, 19 nt, Homo sapiens
gggaaaugcagccucagua

SEQ ID NO: 1559335 - RNA, 19 nt, Homo sapiens
cuagagaacaccuugguaa

SEQ ID NO: 1559336 - RNA, 19 nt, Homo sapiens
gauacaagaauguucauag

SEQ ID NO: 1559337 - RNA, 19 nt, Homo sapiens
ccugugagcucuggaauca

SEQ ID NO: 1559338 - RNA, 19 nt, Homo sapiens
cacaaacacugcagagaca

SEQ ID NO: 1559339 - RNA, 19 nt, Homo sapiens
caagauacaagaauguuca

SEQ ID NO: 1559340 - RNA, 19 nt, Homo sapiens
ccaagacgcguuucagaga

SEQ ID NO: 1559341 - RNA, 19 nt, Homo sapiens
acuccaagcacaucaaaua

SEQ ID NO: 1559342 - RNA, 19 nt, Homo sapiens
gaacuccuccaaaucaaca

SEQ ID NO: 1559343 - RNA, 19 nt, Homo sapiens
caguguggcucccuuugaa

SEQ ID NO: 1559344 - RNA, 19 nt, Homo sapiens
guagagccguuuguauuag

SEQ ID NO: 1559345 - RNA, 19 nt, Homo sapiens
aguagagccguuuguauua

SEQ ID NO: 1559346 - RNA, 19 nt, Homo sapiens
uaguagagccguuuguauu

SEQ ID NO: 1559347 - RNA, 19 nt, Homo sapiens
cagagaagggagaaaguaa

SEQ ID NO: 1559348 - RNA, 19 nt, Homo sapiens
cuuguuggauuaaauguga

SEQ ID NO: 1559349 - RNA, 19 nt, Homo sapiens
cguaggcacagacauauaa

SEQ ID NO: 1559350 - RNA, 19 nt, Homo sapiens
ggccguaggcacagacaua

SEQ ID NO: 1559351 - RNA, 19 nt, Homo sapiens
cggaagggguaaauuaaua

SEQ ID NO: 1559352 - RNA, 19 nt, Homo sapiens
uaaagaacuccuccaaauc

SEQ ID NO: 1559353 - RNA, 19 nt, Homo sapiens
uaaaugugaugcuacuucu

SEQ ID NO: 1559354 - RNA, 19 nt, Homo sapiens
gauuaaaugugaugcuacu

SEQ ID NO: 1559355 - RNA, 19 nt, Homo sapiens
uuuagugcuuguuggauua

SEQ ID NO: 1559356 - RNA, 19 nt, Homo sapiens
gcacagacucucacaugca

SEQ ID NO: 1559357 - RNA, 19 nt, Homo sapiens
gaacaguuuagaagcauca

SEQ ID NO: 1559358 - RNA, 19 nt, Homo sapiens
gaaaugcagccucaguaag

SEQ ID NO: 1559359 - RNA, 19 nt, Homo sapiens
aagcaucacuaaagcugaa

SEQ ID NO: 1559360 - RNA, 19 nt, Homo sapiens
cauccuugcucuauuucuu

SEQ ID NO: 1559361 - RNA, 19 nt, Homo sapiens
ccagagaagggagaaagua

SEQ ID NO: 1559362 - RNA, 19 nt, Homo sapiens
caucucugcugaagcucua

SEQ ID NO: 1559363 - RNA, 19 nt, Homo sapiens
guauaaagaacuccuccaa

SEQ ID NO: 1559364 - RNA, 19 nt, Homo sapiens
caaaccagaagaucuuaga

SEQ ID NO: 1559365 - RNA, 19 nt, Homo sapiens
ccuacaggaugaaguugaa

SEQ ID NO: 1559366 - RNA, 19 nt, Homo sapiens
gaagagccacaucacaaag

SEQ ID NO: 1559367 - RNA, 19 nt, Homo sapiens
uggauuaaaugugaugcua

SEQ ID NO: 1559368 - RNA, 19 nt, Homo sapiens
ugagaaggugugcagcuua

SEQ ID NO: 1559369 - RNA, 19 nt, Homo sapiens
ccaagaagcauaugaaaau

SEQ ID NO: 1559370 - RNA, 19 nt, Homo sapiens
gacaaagcacuugcaugua

SEQ ID NO: 1559371 - RNA, 19 nt, Homo sapiens
ucucccagccgaaagaaua

SEQ ID NO: 1559372 - RNA, 19 nt, Homo sapiens
acaccuugguaaacucuuu

SEQ ID NO: 1559373 - RNA, 19 nt, Homo sapiens
caaagacugacaauaucaa

SEQ ID NO: 1559374 - RNA, 19 nt, Homo sapiens
ugcaaagacugacaauauc

SEQ ID NO: 1559375 - RNA, 19 nt, Homo sapiens
uauaaagaacuccuccaaa

SEQ ID NO: 1559376 - RNA, 19 nt, Homo sapiens
caacuccaagcacaucaaa

SEQ ID NO: 1559377 - RNA, 19 nt, Homo sapiens
cauaguagagccguuugua

SEQ ID NO: 1559378 - RNA, 19 nt, Homo sapiens
uacacaagauacaagaaug

SEQ ID NO: 1559379 - RNA, 19 nt, Homo sapiens
ccagguauauaucuaacag

SEQ ID NO: 1559380 - RNA, 19 nt, Homo sapiens
gcaaggaacacuauuuugu

SEQ ID NO: 1559381 - RNA, 19 nt, Homo sapiens
gaaagugcaaagacugaca

SEQ ID NO: 1559382 - RNA, 19 nt, Homo sapiens
agaagagccacaucacaaa

SEQ ID NO: 1559383 - RNA, 19 nt, Homo sapiens
uagagaacaccuugguaaa

SEQ ID NO: 1559384 - RNA, 19 nt, Homo sapiens
caaagucugcacaggauuc

SEQ ID NO: 1559385 - RNA, 19 nt, Homo sapiens
cuacugacuccaucucuga

SEQ ID NO: 1559386 - RNA, 19 nt, Homo sapiens
acaugucuaugcccacaaa

SEQ ID NO: 1559387 - RNA, 19 nt, Homo sapiens
ggaugcagaacaacuggaa

SEQ ID NO: 1559388 - RNA, 19 nt, Homo sapiens
cauccuccauggccagcua

SEQ ID NO: 1559389 - RNA, 19 nt, Homo sapiens
guugaaaucacuugacauc

SEQ ID NO: 1559390 - RNA, 19 nt, Homo sapiens
ggcauuaucucaucgguua

SEQ ID NO: 1559391 - RNA, 19 nt, Homo sapiens
caaagugugucuuguguau

SEQ ID NO: 1559392 - RNA, 19 nt, Homo sapiens
cagaaucccugccuacaaa

SEQ ID NO: 1559393 - RNA, 19 nt, Homo sapiens
aagugugucuuguguauua

SEQ ID NO: 1559394 - RNA, 19 nt, Homo sapiens
ggaccuggcuggcuacaca

SEQ ID NO: 1559395 - RNA, 19 nt, Homo sapiens
gaaagcuggucuccuauac

SEQ ID NO: 1559396 - RNA, 19 nt, Homo sapiens
agacguaguuuacuuuguu

SEQ ID NO: 1559397 - RNA, 19 nt, Homo sapiens
gguauucuccacccacuua

SEQ ID NO: 1559398 - RNA, 19 nt, Homo sapiens
ugaaaggcauuaucucauc

SEQ ID NO: 1559399 - RNA, 19 nt, Homo sapiens
gggaagagccggaggaaag

SEQ ID NO: 1559400 - RNA, 19 nt, Homo sapiens
caccacgccucgcugauuu

SEQ ID NO: 1559401 - RNA, 19 nt, Homo sapiens
uccgaaagcuggucuccua

SEQ ID NO: 1559402 - RNA, 19 nt, Homo sapiens
gaccgccuguguccuuuaa

SEQ ID NO: 1559403 - RNA, 19 nt, Homo sapiens
cgaaagcuggucuccuaua

SEQ ID NO: 1559404 - RNA, 19 nt, Homo sapiens
aagcuggucuccuauacaa

SEQ ID NO: 1559405 - RNA, 19 nt, Homo sapiens
ggucuaaggucaaaauaau

SEQ ID NO: 1559406 - RNA, 19 nt, Homo sapiens
gcgaacagcccuucuggau

SEQ ID NO: 1559407 - RNA, 19 nt, Homo sapiens
ucucaucgguuaaaacaua

SEQ ID NO: 1559408 - RNA, 19 nt, Homo sapiens
ucucgcagcuccucguuau

SEQ ID NO: 1559409 - RNA, 19 nt, Homo sapiens
aagcaccgcuggccacaga

SEQ ID NO: 1559410 - RNA, 19 nt, Homo sapiens
ggaagagccggaggaaaga

SEQ ID NO: 1559411 - RNA, 19 nt, Homo sapiens
caccgaggcuggagugcaa

SEQ ID NO: 1559412 - RNA, 19 nt, Homo sapiens
gagacguaguuuacuuugu

SEQ ID NO: 1559413 - RNA, 19 nt, Homo sapiens
gggagacguaguuuacuuu

SEQ ID NO: 1559414 - RNA, 19 nt, Homo sapiens
agagaggucuaaggucaaa

SEQ ID NO: 1559415 - RNA, 19 nt, Homo sapiens
gagaccgccuguguccuuu

SEQ ID NO: 1559416 - RNA, 19 nt, Homo sapiens
ugacucacauucugcucuu

SEQ ID NO: 1559417 - RNA, 19 nt, Homo sapiens
gaucuuggcucugcaaccu

SEQ ID NO: 1559418 - RNA, 19 nt, Homo sapiens
gcacacuggcgcagaagau

SEQ ID NO: 1559419 - RNA, 19 nt, Homo sapiens
ggagacguaguuuacuuug

SEQ ID NO: 1559420 - RNA, 19 nt, Homo sapiens
gguccgcguucacguuaga

SEQ ID NO: 1559421 - RNA, 19 nt, Homo sapiens
guuaagagaggucuaaggu

SEQ ID NO: 1559422 - RNA, 19 nt, Homo sapiens
gaauuucagacaguuaaga

SEQ ID NO: 1559423 - RNA, 19 nt, Homo sapiens
ccucagagaccgccugugu

SEQ ID NO: 1559424 - RNA, 19 nt, Homo sapiens
gcuugccuuucuccguuua

SEQ ID NO: 1559425 - RNA, 19 nt, Homo sapiens
gggcugaguuggugaacac

SEQ ID NO: 1559426 - RNA, 19 nt, Homo sapiens
ccaaagugugucuugugua

SEQ ID NO: 1559427 - RNA, 19 nt, Homo sapiens
ccgccuguguccuuuaaga

SEQ ID NO: 1559428 - RNA, 19 nt, Homo sapiens
acagcacacuggcgcagaa

SEQ ID NO: 1559429 - RNA, 19 nt, Homo sapiens
gccucagccucccgaguaa

SEQ ID NO: 1559430 - RNA, 19 nt, Homo sapiens
ggugaacacgguccucguu

SEQ ID NO: 1559431 - RNA, 19 nt, Homo sapiens
gcguucacguuagaguuaa

SEQ ID NO: 1559432 - RNA, 19 nt, Homo sapiens
ccaccacgccucgcugauu

SEQ ID NO: 1559433 - RNA, 19 nt, Homo sapiens
gguccacaauccagagaag

SEQ ID NO: 1559434 - RNA, 19 nt, Homo sapiens
ccgaauuucagacaguuaa

SEQ ID NO: 1559435 - RNA, 19 nt, Homo sapiens
uaaccgaugccuauuuuaa

SEQ ID NO: 1559436 - RNA, 19 nt, Homo sapiens
gacguaguuuacuuuguuc

SEQ ID NO: 1559437 - RNA, 19 nt, Homo sapiens
gaggcgaacaggaggcauu

SEQ ID NO: 1559438 - RNA, 19 nt, Homo sapiens
uccaaagugugucuugugu

SEQ ID NO: 1559439 - RNA, 19 nt, Homo sapiens
auacuaugcuaagcccuuu

SEQ ID NO: 1559440 - RNA, 19 nt, Homo sapiens
ggaggcagcgccaauaucc

SEQ ID NO: 1559441 - RNA, 19 nt, Homo sapiens
cgcguucacguuagaguua

SEQ ID NO: 1559442 - RNA, 19 nt, Homo sapiens
gcuggucuccuauacaaag

SEQ ID NO: 1559443 - RNA, 19 nt, Homo sapiens
gccuuucuccguuuauuga

SEQ ID NO: 1559444 - RNA, 19 nt, Homo sapiens
gccuguguccuuuaagaaa

SEQ ID NO: 1559445 - RNA, 19 nt, Homo sapiens
cgacggaaagccacugcaa

SEQ ID NO: 1559446 - RNA, 19 nt, Homo sapiens
uuuauugacucacauucug

SEQ ID NO: 1559447 - RNA, 19 nt, Homo sapiens
cagagcaagaccacgagua

SEQ ID NO: 1559448 - RNA, 19 nt, Homo sapiens
ggccagauacuaugcuaag

SEQ ID NO: 1559449 - RNA, 19 nt, Homo sapiens
gauccaaccaacccaccaa

SEQ ID NO: 1559450 - RNA, 19 nt, Homo sapiens
gagacgggguuucgccauu

SEQ ID NO: 1559451 - RNA, 19 nt, Homo sapiens
ugccucagccucccgagua

SEQ ID NO: 1559452 - RNA, 19 nt, Homo sapiens
ucugcucuuuggaucauuu

SEQ ID NO: 1559453 - RNA, 19 nt, Homo sapiens
acaguuaagagaggucuaa

SEQ ID NO: 1559454 - RNA, 19 nt, Homo sapiens
ucuucuuacuggccagaua

SEQ ID NO: 1559455 - RNA, 19 nt, Homo sapiens
auauuuaaccgaugccuau

SEQ ID NO: 1559456 - RNA, 19 nt, Homo sapiens
ggggagacguaguuuacuu

SEQ ID NO: 1559457 - RNA, 19 nt, Homo sapiens
ucgaguaggcgcucaaugg

SEQ ID NO: 1559458 - RNA, 19 nt, Homo sapiens
cggucgugcuaaucacuuu

SEQ ID NO: 1559459 - RNA, 19 nt, Homo sapiens
agagaccgccuguguccuu

SEQ ID NO: 1559460 - RNA, 19 nt, Homo sapiens
gcgccaauauccggucucu

SEQ ID NO: 1559461 - RNA, 19 nt, Homo sapiens
cauuaucucaucgguuaaa

SEQ ID NO: 1559462 - RNA, 19 nt, Homo sapiens
ucgcagcuccucguuauuc

SEQ ID NO: 1559463 - RNA, 19 nt, Homo sapiens
gaaauacucucucagauug

SEQ ID NO: 1559464 - RNA, 19 nt, Homo sapiens
gaaaugugcuuaggaauau

SEQ ID NO: 1559465 - RNA, 19 nt, Homo sapiens
ggacaucauugccaucuuu

SEQ ID NO: 1559466 - RNA, 19 nt, Homo sapiens
ucauuaaggucccauguua

SEQ ID NO: 1559467 - RNA, 19 nt, Homo sapiens
gcagaugacacccuucuua

SEQ ID NO: 1559468 - RNA, 19 nt, Homo sapiens
gaagaagaguuugugcuuu

SEQ ID NO: 1559469 - RNA, 19 nt, Homo sapiens
aagaagaguuugugcuuua

SEQ ID NO: 1559470 - RNA, 19 nt, Homo sapiens
gcagugagcugagaucaug

SEQ ID NO: 1559471 - RNA, 19 nt, Homo sapiens
ugucaaagcuuuagcaaga

SEQ ID NO: 1559472 - RNA, 19 nt, Homo sapiens
ggccaucucuucugaguuu

SEQ ID NO: 1559473 - RNA, 19 nt, Homo sapiens
guacuaguaucaucacuga

SEQ ID NO: 1559474 - RNA, 19 nt, Homo sapiens
guauaaaggaccauuguua

SEQ ID NO: 1559475 - RNA, 19 nt, Homo sapiens
gaaacccugucuccacuaa

SEQ ID NO: 1559476 - RNA, 19 nt, Homo sapiens
gcagugauaccuggaauua

SEQ ID NO: 1559477 - RNA, 19 nt, Homo sapiens
agugauaccuggaauuaua

SEQ ID NO: 1559478 - RNA, 19 nt, Homo sapiens
gaaggaggacuguuugaaa

SEQ ID NO: 1559479 - RNA, 19 nt, Homo sapiens
gagcuucuguuuccugauu

SEQ ID NO: 1559480 - RNA, 19 nt, Homo sapiens
gaugacacccuucuuauug

SEQ ID NO: 1559481 - RNA, 19 nt, Homo sapiens
gaggaucaauggaagugua

SEQ ID NO: 1559482 - RNA, 19 nt, Homo sapiens
ggcauguccucuucauuua

SEQ ID NO: 1559483 - RNA, 19 nt, Homo sapiens
guaaagggaagaagaguuu

SEQ ID NO: 1559484 - RNA, 19 nt, Homo sapiens
ucacagauauuacagaaca

SEQ ID NO: 1559485 - RNA, 19 nt, Homo sapiens
ggugaaagauauucucuca

SEQ ID NO: 1559486 - RNA, 19 nt, Homo sapiens
guccagaguuguuauugua

SEQ ID NO: 1559487 - RNA, 19 nt, Homo sapiens
caagaguucuauuucugua

SEQ ID NO: 1559488 - RNA, 19 nt, Homo sapiens
gaaaaccacugcugaaaau

SEQ ID NO: 1559489 - RNA, 19 nt, Homo sapiens
auagaagguuggauacuua

SEQ ID NO: 1559490 - RNA, 19 nt, Homo sapiens
gaucaagaguucuauuucu

SEQ ID NO: 1559491 - RNA, 19 nt, Homo sapiens
gcucaaggagucugaauuu

SEQ ID NO: 1559492 - RNA, 19 nt, Homo sapiens
uguaagguaugucguuaua

SEQ ID NO: 1559493 - RNA, 19 nt, Homo sapiens
ugaaaugugcuuaggaaua

SEQ ID NO: 1559494 - RNA, 19 nt, Homo sapiens
gaaaugaaaugugcuuagg

SEQ ID NO: 1559495 - RNA, 19 nt, Homo sapiens
caguguaacuugagauaaa

SEQ ID NO: 1559496 - RNA, 19 nt, Homo sapiens
ccagaguuguuauuguaua

SEQ ID NO: 1559497 - RNA, 19 nt, Homo sapiens
ggaaaguccagaguuguua

SEQ ID NO: 1559498 - RNA, 19 nt, Homo sapiens
uaaaccaaguggaaucaaa

SEQ ID NO: 1559499 - RNA, 19 nt, Homo sapiens
ugcauugggugauaauuua

SEQ ID NO: 1559500 - RNA, 19 nt, Homo sapiens
guacuacauuuguuacaga

SEQ ID NO: 1559501 - RNA, 19 nt, Homo sapiens
ccaaaucaauggcaaugga

SEQ ID NO: 1559502 - RNA, 19 nt, Homo sapiens
ggaauuguuucaaguacug

SEQ ID NO: 1559503 - RNA, 19 nt, Homo sapiens
gaacaacuggaaagaauca

SEQ ID NO: 1559504 - RNA, 19 nt, Homo sapiens
gaaucaaaggugaaagaua

SEQ ID NO: 1559505 - RNA, 19 nt, Homo sapiens
ggaagaagaguuugugcuu

SEQ ID NO: 1559506 - RNA, 19 nt, Homo sapiens
ugguuaggcucucaaauaa

SEQ ID NO: 1559507 - RNA, 19 nt, Homo sapiens
gaagaccgcaugugccauu

SEQ ID NO: 1559508 - RNA, 19 nt, Homo sapiens
ucaagaccauccuggcuaa

SEQ ID NO: 1559509 - RNA, 19 nt, Homo sapiens
gaucaauggaaguguauaa

SEQ ID NO: 1559510 - RNA, 19 nt, Homo sapiens
gaauguugcauacuuagaa

SEQ ID NO: 1559511 - RNA, 19 nt, Homo sapiens
gagagaccagugagaauaa

SEQ ID NO: 1559512 - RNA, 19 nt, Homo sapiens
uaacuggcauguccucuuc

SEQ ID NO: 1559513 - RNA, 19 nt, Homo sapiens
guauguuuaugucagcuua

SEQ ID NO: 1559514 - RNA, 19 nt, Homo sapiens
gaaagauauucucucaaag

SEQ ID NO: 1559515 - RNA, 19 nt, Homo sapiens
cggaacaacuggaaagaau

SEQ ID NO: 1559516 - RNA, 19 nt, Homo sapiens
gaacuucaagcuucacaga

SEQ ID NO: 1559517 - RNA, 19 nt, Homo sapiens
ucaauccuauguucugaaa

SEQ ID NO: 1559518 - RNA, 19 nt, Homo sapiens
gcaagcuacugaacuucuu

SEQ ID NO: 1559519 - RNA, 19 nt, Homo sapiens
cauccuggcucugucauuu

SEQ ID NO: 1559520 - RNA, 19 nt, Homo sapiens
cgacgaauguuaaugaaac

SEQ ID NO: 1559521 - RNA, 19 nt, Homo sapiens
ggauuuaaauucagaacag

SEQ ID NO: 1559522 - RNA, 19 nt, Homo sapiens
acucuucccuaguuuauuu

SEQ ID NO: 1559523 - RNA, 19 nt, Homo sapiens
aaugaaaugugcuuaggaa

SEQ ID NO: 1559524 - RNA, 19 nt, Homo sapiens
ugagcaagcuacugaacuu

SEQ ID NO: 1559525 - RNA, 19 nt, Homo sapiens
gaagagcaagcccuuacaa

SEQ ID NO: 1559526 - RNA, 19 nt, Homo sapiens
uauagaagguuggauacuu

SEQ ID NO: 1559527 - RNA, 19 nt, Homo sapiens
uaaaggaccauuguuagaa

SEQ ID NO: 1559528 - RNA, 19 nt, Homo sapiens
caucuugcauugggugaua

SEQ ID NO: 1559529 - RNA, 19 nt, Homo sapiens
uaccuaacaucuugcauug

SEQ ID NO: 1559530 - RNA, 19 nt, Homo sapiens
gauuagaugugacuguaca

SEQ ID NO: 1559531 - RNA, 19 nt, Homo sapiens
gaauuauguuccaucuuuc

SEQ ID NO: 1559532 - RNA, 19 nt, Homo sapiens
cagaugauauagcaagaau

SEQ ID NO: 1559533 - RNA, 19 nt, Homo sapiens
gaauguaagguaugucguu

SEQ ID NO: 1559534 - RNA, 19 nt, Homo sapiens
agaagcaguucauugagaa

SEQ ID NO: 1559535 - RNA, 19 nt, Homo sapiens
uaucaucacugaaaguaag

SEQ ID NO: 1559536 - RNA, 19 nt, Homo sapiens
ccgcaugugccauuaauaa

SEQ ID NO: 1559537 - RNA, 19 nt, Homo sapiens
gaaguucaagcuauguuug

SEQ ID NO: 1559538 - RNA, 19 nt, Homo sapiens
ggaaguucaagcuauguuu

SEQ ID NO: 1559539 - RNA, 19 nt, Homo sapiens
acuucaagcuucacagaua

SEQ ID NO: 1559540 - RNA, 19 nt, Homo sapiens
cagaaauacucucucagau

SEQ ID NO: 1559541 - RNA, 19 nt, Homo sapiens
caagaauuauguuccaucu

SEQ ID NO: 1559542 - RNA, 19 nt, Homo sapiens
uaucacgucugcuggaaga

SEQ ID NO: 1559543 - RNA, 19 nt, Homo sapiens
agaaauacucucucagauu

SEQ ID NO: 1559544 - RNA, 19 nt, Homo sapiens
aagaagcaguucauugaga

SEQ ID NO: 1559545 - RNA, 19 nt, Homo sapiens
gaaccuugucucacuuuga

SEQ ID NO: 1559546 - RNA, 19 nt, Homo sapiens
caucauugccaucuuuaaa

SEQ ID NO: 1559547 - RNA, 19 nt, Homo sapiens
caacagagcaagacuccau

SEQ ID NO: 1559548 - RNA, 19 nt, Homo sapiens
ucagaaauacucucucaga

SEQ ID NO: 1559549 - RNA, 19 nt, Homo sapiens
aauguaagguaugucguua

SEQ ID NO: 1559550 - RNA, 19 nt, Homo sapiens
guagagagaccagugagaa

SEQ ID NO: 1559551 - RNA, 19 nt, Homo sapiens
gcucaauccuauguucuga

SEQ ID NO: 1559552 - RNA, 19 nt, Homo sapiens
uggcauguccucuucauuu

SEQ ID NO: 1559553 - RNA, 19 nt, Homo sapiens
ucaggaaguucaagcuaug

SEQ ID NO: 1559554 - RNA, 19 nt, Homo sapiens
uccauauucuguacucaua

SEQ ID NO: 1559555 - RNA, 19 nt, Homo sapiens
gaggguagucuuaugauca

SEQ ID NO: 1559556 - RNA, 19 nt, Homo sapiens
caucucuucugaguuuaua

SEQ ID NO: 1559557 - RNA, 19 nt, Homo sapiens
uaacauuggccaucucuuc

SEQ ID NO: 1559558 - RNA, 19 nt, Homo sapiens
gaguauacauccauuucuc

SEQ ID NO: 1559559 - RNA, 19 nt, Homo sapiens
gaccgcaugugccauuaau

SEQ ID NO: 1559560 - RNA, 19 nt, Homo sapiens
guuaggcucucaaauaaaa

SEQ ID NO: 1559561 - RNA, 19 nt, Homo sapiens
gaacuucuuugagcuucug

SEQ ID NO: 1559562 - RNA, 19 nt, Homo sapiens
gaaucuuucggaauuguuu

SEQ ID NO: 1559563 - RNA, 19 nt, Homo sapiens
caacugcgcugaagaauug

SEQ ID NO: 1559564 - RNA, 19 nt, Homo sapiens
gaauaucccuugucuaaau

SEQ ID NO: 1559565 - RNA, 19 nt, Homo sapiens
gaagggaccauuccauuua

SEQ ID NO: 1559566 - RNA, 19 nt, Homo sapiens
gaaauaagccagauacaga

SEQ ID NO: 1559567 - RNA, 19 nt, Homo sapiens
gauagcagcuuuguuugua

SEQ ID NO: 1559568 - RNA, 19 nt, Homo sapiens
gaacagugaccaaguguaa

SEQ ID NO: 1559569 - RNA, 19 nt, Homo sapiens
gaagaauugugcuaaguga

SEQ ID NO: 1559570 - RNA, 19 nt, Homo sapiens
gaacauuucuuccaugaac

SEQ ID NO: 1559571 - RNA, 19 nt, Homo sapiens
ugacaucccuggcugcuuu

SEQ ID NO: 1559572 - RNA, 19 nt, Homo sapiens
gaguaaaucuucagaaagg

SEQ ID NO: 1559573 - RNA, 19 nt, Homo sapiens
gcuacuacgugcuguauau

SEQ ID NO: 1559574 - RNA, 19 nt, Homo sapiens
ggaauacucuuugaacaag

SEQ ID NO: 1559575 - RNA, 19 nt, Homo sapiens
ugacacagaucggcuuaaa

SEQ ID NO: 1559576 - RNA, 19 nt, Homo sapiens
gauggucccuuccuggauu

SEQ ID NO: 1559577 - RNA, 19 nt, Homo sapiens
gaacacgggcuuccucaug

SEQ ID NO: 1559578 - RNA, 19 nt, Homo sapiens
aaagacaaauacuguguga

SEQ ID NO: 1559579 - RNA, 19 nt, Homo sapiens
gcacccagccucauguuga

SEQ ID NO: 1559580 - RNA, 19 nt, Homo sapiens
ucacauccaucgccguaaa

SEQ ID NO: 1559581 - RNA, 19 nt, Homo sapiens
uaggacagccugagaguaa

SEQ ID NO: 1559582 - RNA, 19 nt, Homo sapiens
gagcagcugagagaaguua

SEQ ID NO: 1559583 - RNA, 19 nt, Homo sapiens
ggaaggagcgcuacuacgu

SEQ ID NO: 1559584 - RNA, 19 nt, Homo sapiens
uaagccagauacagaaaga

SEQ ID NO: 1559585 - RNA, 19 nt, Homo sapiens
cgaagggaccauuccauuu

SEQ ID NO: 1559586 - RNA, 19 nt, Homo sapiens
gaauugugcuaagugaaau

SEQ ID NO: 1559587 - RNA, 19 nt, Homo sapiens
guagcauuguggaacauuu

SEQ ID NO: 1559588 - RNA, 19 nt, Homo sapiens
ccaaacccaugaccacugu

SEQ ID NO: 1559589 - RNA, 19 nt, Homo sapiens
cuggauagcagcuuuguuu

SEQ ID NO: 1559590 - RNA, 19 nt, Homo sapiens
gagaacugaucgauguauc

SEQ ID NO: 1559591 - RNA, 19 nt, Homo sapiens
ugaacaagcucugcuaaaa

SEQ ID NO: 1559592 - RNA, 19 nt, Homo sapiens
ccauagccaccuuggaaua

SEQ ID NO: 1559593 - RNA, 19 nt, Homo sapiens
gcaggaaggagcgcuacua

SEQ ID NO: 1559594 - RNA, 19 nt, Homo sapiens
ucucguauauggaaccuau

SEQ ID NO: 1559595 - RNA, 19 nt, Homo sapiens
ugugugaucucguauaugg

SEQ ID NO: 1559596 - RNA, 19 nt, Homo sapiens
guucuuuacucccucaaau

SEQ ID NO: 1559597 - RNA, 19 nt, Homo sapiens
ggaauaucccuugucuaaa

SEQ ID NO: 1559598 - RNA, 19 nt, Homo sapiens
agggagaacugaucgaugu

SEQ ID NO: 1559599 - RNA, 19 nt, Homo sapiens
gaaaucgagcccaacuuca

SEQ ID NO: 1559600 - RNA, 19 nt, Homo sapiens
ccagauacagaaagacaaa

SEQ ID NO: 1559601 - RNA, 19 nt, Homo sapiens
uauaaacuccagcuacuug

SEQ ID NO: 1559602 - RNA, 19 nt, Homo sapiens
ggauagcagcuuuguuugu

SEQ ID NO: 1559603 - RNA, 19 nt, Homo sapiens
agacaaauacugugugauc

SEQ ID NO: 1559604 - RNA, 19 nt, Homo sapiens
uagaugccauucccagaga

SEQ ID NO: 1559605 - RNA, 19 nt, Homo sapiens
ucucauuguuuccugcuuu

SEQ ID NO: 1559606 - RNA, 19 nt, Homo sapiens
ugccaagucuuaccugguu

SEQ ID NO: 1559607 - RNA, 19 nt, Homo sapiens
gagaacagucugccaaguc

SEQ ID NO: 1559608 - RNA, 19 nt, Homo sapiens
aauacugugugaucucgua

SEQ ID NO: 1559609 - RNA, 19 nt, Homo sapiens
agaauugugcuaagugaaa

SEQ ID NO: 1559610 - RNA, 19 nt, Homo sapiens
cagagcagcugagagaagu

SEQ ID NO: 1559611 - RNA, 19 nt, Homo sapiens
guaacuggaccugguauug

SEQ ID NO: 1559612 - RNA, 19 nt, Homo sapiens
ugaaaucgagcccaacuuc

SEQ ID NO: 1559613 - RNA, 19 nt, Homo sapiens
gcugaagaauugugcuaag

SEQ ID NO: 1559614 - RNA, 19 nt, Homo sapiens
uagcagcuuuguuuguaga

SEQ ID NO: 1559615 - RNA, 19 nt, Homo sapiens
gacaaauacugugugaucu

SEQ ID NO: 1559616 - RNA, 19 nt, Homo sapiens
gauggaggucucacuaugu

SEQ ID NO: 1559617 - RNA, 19 nt, Homo sapiens
agauggaggucucacuaug

SEQ ID NO: 1559618 - RNA, 19 nt, Homo sapiens
ggaacagugaccaagugua

SEQ ID NO: 1559619 - RNA, 19 nt, Homo sapiens
uuacaacugcgcugaagaa

SEQ ID NO: 1559620 - RNA, 19 nt, Homo sapiens
gcagagcagcugagagaag

SEQ ID NO: 1559621 - RNA, 19 nt, Homo sapiens
ucaaacuccuggacucaag

SEQ ID NO: 1559622 - RNA, 19 nt, Homo sapiens
gugaccaaguguaauuuca

SEQ ID NO: 1559623 - RNA, 19 nt, Homo sapiens
acagugaccaaguguaauu

SEQ ID NO: 1559624 - RNA, 19 nt, Homo sapiens
ugaaggggcuggucaacaa

SEQ ID NO: 1559625 - RNA, 19 nt, Homo sapiens
ugcccaggcugaucucaaa

SEQ ID NO: 1559626 - RNA, 19 nt, Homo sapiens
agucagagauggaggugau

SEQ ID NO: 1559627 - RNA, 19 nt, Homo sapiens
ggagaacugaucgauguau

SEQ ID NO: 1559628 - RNA, 19 nt, Homo sapiens
aaauaagccagauacagaa

SEQ ID NO: 1559629 - RNA, 19 nt, Homo sapiens
uaagugaaauaagccagau

SEQ ID NO: 1559630 - RNA, 19 nt, Homo sapiens
ccuggcugcuuuccuggua

SEQ ID NO: 1559631 - RNA, 19 nt, Homo sapiens
ggcccuggauagcagcuuu

SEQ ID NO: 1559632 - RNA, 19 nt, Homo sapiens
ccuagacauuacaugauga

SEQ ID NO: 1559633 - RNA, 19 nt, Homo sapiens
gcaccagcaccuucuguag

SEQ ID NO: 1559634 - RNA, 19 nt, Homo sapiens
ccgaagggaccauuccauu

SEQ ID NO: 1559635 - RNA, 19 nt, Homo sapiens
agaacagucugccaagucu

SEQ ID NO: 1559636 - RNA, 19 nt, Homo sapiens
uuucuuccaugaacuucua

SEQ ID NO: 1559637 - RNA, 19 nt, Homo sapiens
ccacccgcguaacuauaaa

SEQ ID NO: 1559638 - RNA, 19 nt, Homo sapiens
gaugaguaaaucuucagaa

SEQ ID NO: 1559639 - RNA, 19 nt, Homo sapiens
aacagucugccaagucuua

SEQ ID NO: 1559640 - RNA, 19 nt, Homo sapiens
gaacugaucgauguaucuc

SEQ ID NO: 1559641 - RNA, 19 nt, Homo sapiens
cgaggcggguggaucacuu

SEQ ID NO: 1559642 - RNA, 19 nt, Homo sapiens
ccuguaaucccagcacuuu

SEQ ID NO: 1559643 - RNA, 19 nt, Homo sapiens
ggguuucuguuaucugaca

SEQ ID NO: 1559644 - RNA, 19 nt, Homo sapiens
ccucagcacucuguguugu

SEQ ID NO: 1559645 - RNA, 19 nt, Homo sapiens
uaacuauaaacuccagcua

SEQ ID NO: 1559646 - RNA, 19 nt, Homo sapiens
uggaauacucuuugaacaa

SEQ ID NO: 1559647 - RNA, 19 nt, Homo sapiens
auaaaaccguugaaccaua

SEQ ID NO: 1559648 - RNA, 19 nt, Homo sapiens
ugaagaauugugcuaagug

SEQ ID NO: 1559649 - RNA, 19 nt, Homo sapiens
uaccuugaguugccaguuc

SEQ ID NO: 1559650 - RNA, 19 nt, Homo sapiens
aauaucccuugucuaaaug

SEQ ID NO: 1559651 - RNA, 19 nt, Homo sapiens
gacaacaucauggcccaaa

SEQ ID NO: 1559652 - RNA, 19 nt, Homo sapiens
gcgcugaagaauugugcua

SEQ ID NO: 1559653 - RNA, 19 nt, Homo sapiens
ccauagaaacggcagaaca

SEQ ID NO: 1559654 - RNA, 19 nt, Homo sapiens
acugugugaucucguauau

SEQ ID NO: 1559655 - RNA, 19 nt, Homo sapiens
agaaagacaaauacugugu

SEQ ID NO: 1559656 - RNA, 19 nt, Homo sapiens
gauacagaaagacaaauac

SEQ ID NO: 1559657 - RNA, 19 nt, Homo sapiens
uaaaaccguugaaccauag

SEQ ID NO: 1559658 - RNA, 19 nt, Homo sapiens
uuuacucccucaaauguuc

SEQ ID NO: 1559659 - RNA, 19 nt, Homo sapiens
auggaggucucacuauguu

SEQ ID NO: 1559660 - RNA, 19 nt, Homo sapiens
auuacaugaugacccuuua

SEQ ID NO: 1559661 - RNA, 19 nt, Homo sapiens
uccuagacauuacaugaug

SEQ ID NO: 1559662 - RNA, 19 nt, Homo sapiens
caugacacagaucggcuua

SEQ ID NO: 1559663 - RNA, 19 nt, Homo sapiens
caacaugacugcuggaaga

SEQ ID NO: 1559664 - RNA, 19 nt, Homo sapiens
uaaaggagcuacaggagaa

SEQ ID NO: 1559665 - RNA, 19 nt, Homo sapiens
gcaggagauuugcacauua

SEQ ID NO: 1559666 - RNA, 19 nt, Homo sapiens
ggaaggaacuagagagagu

SEQ ID NO: 1559667 - RNA, 19 nt, Homo sapiens
gagaggagcuuguccaaac

SEQ ID NO: 1559668 - RNA, 19 nt, Homo sapiens
caacaacuccaauuagaaa

SEQ ID NO: 1559669 - RNA, 19 nt, Homo sapiens
ugaauaugcugaacaucua

SEQ ID NO: 1559670 - RNA, 19 nt, Homo sapiens
gaagaaggcaaaccaguug

SEQ ID NO: 1559671 - RNA, 19 nt, Homo sapiens
gaacauacagaaagaggaa

SEQ ID NO: 1559672 - RNA, 19 nt, Homo sapiens
caggagauuugcacauuaa

SEQ ID NO: 1559673 - RNA, 19 nt, Homo sapiens
gaaagcaaacaucaagaaa

SEQ ID NO: 1559674 - RNA, 19 nt, Homo sapiens
gaaacguucucucagauac

SEQ ID NO: 1559675 - RNA, 19 nt, Homo sapiens
gaagaacaccaucaaaucu

SEQ ID NO: 1559676 - RNA, 19 nt, Homo sapiens
gaaggagucauuucaacaa

SEQ ID NO: 1559677 - RNA, 19 nt, Homo sapiens
caugaaacguucucucaga

SEQ ID NO: 1559678 - RNA, 19 nt, Homo sapiens
ggaggaggcacuacugaaa

SEQ ID NO: 1559679 - RNA, 19 nt, Homo sapiens
gcaaacaucaagaaacaga

SEQ ID NO: 1559680 - RNA, 19 nt, Homo sapiens
aagcaaacaucaagaaaca

SEQ ID NO: 1559681 - RNA, 19 nt, Homo sapiens
gagauuugcacauuaaaga

SEQ ID NO: 1559682 - RNA, 19 nt, Homo sapiens
ggaaggcccuacaucaucu

SEQ ID NO: 1559683 - RNA, 19 nt, Homo sapiens
gaagaaguaacgugauuuc

SEQ ID NO: 1559684 - RNA, 19 nt, Homo sapiens
agaaacaaguggaacauca

SEQ ID NO: 1559685 - RNA, 19 nt, Homo sapiens
aaagagaagcagcaagaua

SEQ ID NO: 1559686 - RNA, 19 nt, Homo sapiens
agaacaccaucaaaucuuu

SEQ ID NO: 1559687 - RNA, 19 nt, Homo sapiens
gagcaguaguccuggauuc

SEQ ID NO: 1559688 - RNA, 19 nt, Homo sapiens
gagcuuguccaaacucaaa

SEQ ID NO: 1559689 - RNA, 19 nt, Homo sapiens
ggagagcccgugccaagaa

SEQ ID NO: 1559690 - RNA, 19 nt, Homo sapiens
agaagaaacucaacacaac

SEQ ID NO: 1559691 - RNA, 19 nt, Homo sapiens
gcgcauaagucuccugaac

SEQ ID NO: 1559692 - RNA, 19 nt, Homo sapiens
uggaagaaguaacgugauu

SEQ ID NO: 1559693 - RNA, 19 nt, Homo sapiens
gcacauuaaagaaagagaa

SEQ ID NO: 1559694 - RNA, 19 nt, Homo sapiens
ggaccuguaccacaugaaa

SEQ ID NO: 1559695 - RNA, 19 nt, Homo sapiens
cagaaagaggaacuaaaua

SEQ ID NO: 1559696 - RNA, 19 nt, Homo sapiens
gaagaaacucaacacaaca

SEQ ID NO: 1559697 - RNA, 19 nt, Homo sapiens
gaaaacaaauggcaguauc

SEQ ID NO: 1559698 - RNA, 19 nt, Homo sapiens
gaaaagaaagcaaacauca

SEQ ID NO: 1559699 - RNA, 19 nt, Homo sapiens
ggaagaaguaacgugauuu

SEQ ID NO: 1559700 - RNA, 19 nt, Homo sapiens
gauucaagguccguagaaa

SEQ ID NO: 1559701 - RNA, 19 nt, Homo sapiens
ugaaacaacagaagaaaca

SEQ ID NO: 1559702 - RNA, 19 nt, Homo sapiens
gcaguccuguuucuugcuu

SEQ ID NO: 1559703 - RNA, 19 nt, Homo sapiens
ucgaggagccaaacaauga

SEQ ID NO: 1559704 - RNA, 19 nt, Homo sapiens
agaaagagaagcagcaaga

SEQ ID NO: 1559705 - RNA, 19 nt, Homo sapiens
gaauaugcugaacaucuaa

SEQ ID NO: 1559706 - RNA, 19 nt, Homo sapiens
ccaauuagaaagacaugaa

SEQ ID NO: 1559707 - RNA, 19 nt, Homo sapiens
ucucagauacuuugaagaa

SEQ ID NO: 1559708 - RNA, 19 nt, Homo sapiens
acagaaagaggaacuaaau

SEQ ID NO: 1559709 - RNA, 19 nt, Homo sapiens
gguaaaaccucaucucuac

SEQ ID NO: 1559710 - RNA, 19 nt, Homo sapiens
gcaguuggagcagcaagua

SEQ ID NO: 1559711 - RNA, 19 nt, Homo sapiens
cagaagaaacucaacacaa

SEQ ID NO: 1559712 - RNA, 19 nt, Homo sapiens
gaaacucaacacaacaaau

SEQ ID NO: 1559713 - RNA, 19 nt, Homo sapiens
uaaaggagaguuagagagu

SEQ ID NO: 1559714 - RNA, 19 nt, Homo sapiens
ugaagaacaccaucaaauc

SEQ ID NO: 1559715 - RNA, 19 nt, Homo sapiens
aagagaagcagcaagauau

SEQ ID NO: 1559716 - RNA, 19 nt, Homo sapiens
agaaagacaugaauaugcu

SEQ ID NO: 1559717 - RNA, 19 nt, Homo sapiens
cauugaacauacagaaaga

SEQ ID NO: 1559718 - RNA, 19 nt, Homo sapiens
caagaaacagaaagccaaa

SEQ ID NO: 1559719 - RNA, 19 nt, Homo sapiens
gaacaucagcuggaagaag

SEQ ID NO: 1559720 - RNA, 19 nt, Homo sapiens
ggcccuacaucaucugcua

SEQ ID NO: 1559721 - RNA, 19 nt, Homo sapiens
caagagcgcacugcaguug

SEQ ID NO: 1559722 - RNA, 19 nt, Homo sapiens
gaggaaggaacuagagaga

SEQ ID NO: 1559723 - RNA, 19 nt, Homo sapiens
guacggaguggaaguuaga

SEQ ID NO: 1559724 - RNA, 19 nt, Homo sapiens
gagaucagccuggccaaug

SEQ ID NO: 1559725 - RNA, 19 nt, Homo sapiens
ccuauaaucccagcacuuu

SEQ ID NO: 1559726 - RNA, 19 nt, Homo sapiens
gagcgaacaggaacaggaa

SEQ ID NO: 1559727 - RNA, 19 nt, Homo sapiens
ggacaagaagagaggauuc

SEQ ID NO: 1559728 - RNA, 19 nt, Homo sapiens
ugaaacguucucucagaua

SEQ ID NO: 1559729 - RNA, 19 nt, Homo sapiens
aaagaaagcaaacaucaag

SEQ ID NO: 1559730 - RNA, 19 nt, Homo sapiens
gaagaaacaaguggaacau

SEQ ID NO: 1559731 - RNA, 19 nt, Homo sapiens
gacaucaucauccuagcua

SEQ ID NO: 1559732 - RNA, 19 nt, Homo sapiens
gaaagaggaacuaaauacg

SEQ ID NO: 1559733 - RNA, 19 nt, Homo sapiens
gggaaggcccuacaucauc

SEQ ID NO: 1559734 - RNA, 19 nt, Homo sapiens
cgcaggagauuugcacauu

SEQ ID NO: 1559735 - RNA, 19 nt, Homo sapiens
agaaagcaaacaucaagaa

SEQ ID NO: 1559736 - RNA, 19 nt, Homo sapiens
ccucaucucuacuaaaauu

SEQ ID NO: 1559737 - RNA, 19 nt, Homo sapiens
uucaacaacuccaauuaga

SEQ ID NO: 1559738 - RNA, 19 nt, Homo sapiens
gacauugaacauacagaaa

SEQ ID NO: 1559739 - RNA, 19 nt, Homo sapiens
aaacagcccuagaguucca

SEQ ID NO: 1559740 - RNA, 19 nt, Homo sapiens
gggcauugguggcauucug

SEQ ID NO: 1559741 - RNA, 19 nt, Homo sapiens
caacugaagaacaccauca

SEQ ID NO: 1559742 - RNA, 19 nt, Homo sapiens
gcagaagaaacucaacaca

SEQ ID NO: 1559743 - RNA, 19 nt, Homo sapiens
gaaagagaagcagcaagau

SEQ ID NO: 1559744 - RNA, 19 nt, Homo sapiens
ucaacaacuccaauuagaa

SEQ ID NO: 1559745 - RNA, 19 nt, Homo sapiens
gcagcguaaaggagaguua

SEQ ID NO: 1559746 - RNA, 19 nt, Homo sapiens
agaaagaggaacuaaauac

SEQ ID NO: 1559747 - RNA, 19 nt, Homo sapiens
gaaacaacagaagaaacaa

SEQ ID NO: 1559748 - RNA, 19 nt, Homo sapiens
ggagaggagcuuguccaaa

SEQ ID NO: 1559749 - RNA, 19 nt, Homo sapiens
agaagaaggcaaaccaguu

SEQ ID NO: 1559750 - RNA, 19 nt, Homo sapiens
gcuguccgccugcaacauu

SEQ ID NO: 1559751 - RNA, 19 nt, Homo sapiens
auacggaccuguaccacau

SEQ ID NO: 1559752 - RNA, 19 nt, Homo sapiens
aacaucagcuggaagaagu

SEQ ID NO: 1559753 - RNA, 19 nt, Homo sapiens
ggucgggaguuugagauca

SEQ ID NO: 1559754 - RNA, 19 nt, Homo sapiens
ugcaguggcucaugccuau

SEQ ID NO: 1559755 - RNA, 19 nt, Homo sapiens
aagugcagcugacacaguu

SEQ ID NO: 1559756 - RNA, 19 nt, Homo sapiens
caucugcuacccugaaaga

SEQ ID NO: 1559757 - RNA, 19 nt, Homo sapiens
gcaguaguccuggauucaa

SEQ ID NO: 1559758 - RNA, 19 nt, Homo sapiens
cacuugaggucgggaguuu

SEQ ID NO: 1559759 - RNA, 19 nt, Homo sapiens
acaugaauaugcugaacau

SEQ ID NO: 1559760 - RNA, 19 nt, Homo sapiens
aaggagaguuagagagugu

SEQ ID NO: 1559761 - RNA, 19 nt, Homo sapiens
ggauucaagguccguagaa

SEQ ID NO: 1559762 - RNA, 19 nt, Homo sapiens
aaagggugcuagagguuca

SEQ ID NO: 1559763 - RNA, 19 nt, Homo sapiens
gcacaaggauccuacauug

SEQ ID NO: 1559764 - RNA, 19 nt, Homo sapiens
caaccuguauccacuauua

SEQ ID NO: 1559765 - RNA, 19 nt, Homo sapiens
gagcagggcugacguugaa

SEQ ID NO: 1559766 - RNA, 19 nt, Homo sapiens
gaaaugggcgugagaaugu

SEQ ID NO: 1559767 - RNA, 19 nt, Homo sapiens
ccuaguaucuugacauuga

SEQ ID NO: 1559768 - RNA, 19 nt, Homo sapiens
ggagacagaugcucaugga

SEQ ID NO: 1559769 - RNA, 19 nt, Homo sapiens
ggagaugguagaugaguua

SEQ ID NO: 1559770 - RNA, 19 nt, Homo sapiens
ugaggaaggugaagaaaga

SEQ ID NO: 1559771 - RNA, 19 nt, Homo sapiens
gagcaccucuacuuugaaa

SEQ ID NO: 1559772 - RNA, 19 nt, Homo sapiens
gggagaggauuaccuuuga

SEQ ID NO: 1559773 - RNA, 19 nt, Homo sapiens
cagaacgacugcagcauuu

SEQ ID NO: 1559774 - RNA, 19 nt, Homo sapiens
ggcguaagcuuugagauaa

SEQ ID NO: 1559775 - RNA, 19 nt, Homo sapiens
ggaauaaugacaucgauga

SEQ ID NO: 1559776 - RNA, 19 nt, Homo sapiens
ugacaaaggugccuacagu

SEQ ID NO: 1559777 - RNA, 19 nt, Homo sapiens
ggucggauaucaaucauuc

SEQ ID NO: 1559778 - RNA, 19 nt, Homo sapiens
gaacggacccgaaggagau

SEQ ID NO: 1559779 - RNA, 19 nt, Homo sapiens
cgaggaagcugccugaaca

SEQ ID NO: 1559780 - RNA, 19 nt, Homo sapiens
gaugguagaugaguuacaa

SEQ ID NO: 1559781 - RNA, 19 nt, Homo sapiens
ccaaaggagucaaccgauu

SEQ ID NO: 1559782 - RNA, 19 nt, Homo sapiens
gcaguagucacccugaaua

SEQ ID NO: 1559783 - RNA, 19 nt, Homo sapiens
agauaaagcuguacaccaa

SEQ ID NO: 1559784 - RNA, 19 nt, Homo sapiens
ugauugagguugggaauaa

SEQ ID NO: 1559785 - RNA, 19 nt, Homo sapiens
gggaaagucucuuguuugg

SEQ ID NO: 1559786 - RNA, 19 nt, Homo sapiens
gcagugggcuaccauaaac

SEQ ID NO: 1559787 - RNA, 19 nt, Homo sapiens
gagaagacaccgugacaga

SEQ ID NO: 1559788 - RNA, 19 nt, Homo sapiens
gacagaugcucauggauca

SEQ ID NO: 1559789 - RNA, 19 nt, Homo sapiens
acgagagucugguguauuu

SEQ ID NO: 1559790 - RNA, 19 nt, Homo sapiens
gcacagugucuuccuuaaa

SEQ ID NO: 1559791 - RNA, 19 nt, Homo sapiens
gagauugucaucagugaaa

SEQ ID NO: 1559792 - RNA, 19 nt, Homo sapiens
gcaaagagacaagccaaga

SEQ ID NO: 1559793 - RNA, 19 nt, Homo sapiens
gaggauuggugcuggaaga

SEQ ID NO: 1559794 - RNA, 19 nt, Homo sapiens
guggaaaugugaucacuuc

SEQ ID NO: 1559795 - RNA, 19 nt, Homo sapiens
cagggaagcugaucgagau

SEQ ID NO: 1559796 - RNA, 19 nt, Homo sapiens
gcaacaggguucagugucu

SEQ ID NO: 1559797 - RNA, 19 nt, Homo sapiens
gaaggugaagaaagaauga

SEQ ID NO: 1559798 - RNA, 19 nt, Homo sapiens
cgccaugacuuucaccuuu

SEQ ID NO: 1559799 - RNA, 19 nt, Homo sapiens
ggagagaaaaucacuguua

SEQ ID NO: 1559800 - RNA, 19 nt, Homo sapiens
cauaguugcuggcuacaau

SEQ ID NO: 1559801 - RNA, 19 nt, Homo sapiens
cgagaacuauguugugcuu

SEQ ID NO: 1559802 - RNA, 19 nt, Homo sapiens
ugaaggaguuccgguuuga

SEQ ID NO: 1559803 - RNA, 19 nt, Homo sapiens
ggaaaugggcgugagaaug

SEQ ID NO: 1559804 - RNA, 19 nt, Homo sapiens
cgccaucacucuggaauuu

SEQ ID NO: 1559805 - RNA, 19 nt, Homo sapiens
uggaagugcuggaggauga

SEQ ID NO: 1559806 - RNA, 19 nt, Homo sapiens
gaagagggcaaguucagau

SEQ ID NO: 1559807 - RNA, 19 nt, Homo sapiens
ucaaacccaugaugaagga

SEQ ID NO: 1559808 - RNA, 19 nt, Homo sapiens
aaaggugccuacaguguug

SEQ ID NO: 1559809 - RNA, 19 nt, Homo sapiens
caccauccaugcucagaaa

SEQ ID NO: 1559810 - RNA, 19 nt, Homo sapiens
gaugaaggaguuccgguuu

SEQ ID NO: 1559811 - RNA, 19 nt, Homo sapiens
cgaaggagaugguguucca

SEQ ID NO: 1559812 - RNA, 19 nt, Homo sapiens
aagauccaguccacaguua

SEQ ID NO: 1559813 - RNA, 19 nt, Homo sapiens
gaaggcaacgaccacauug

SEQ ID NO: 1559814 - RNA, 19 nt, Homo sapiens
ggccagaaccugaagauca

SEQ ID NO: 1559815 - RNA, 19 nt, Homo sapiens
gcaugggacuuugaaauac

SEQ ID NO: 1559816 - RNA, 19 nt, Homo sapiens
cccagaagaugcaaagaga

SEQ ID NO: 1559817 - RNA, 19 nt, Homo sapiens
ggacaacggcauucugaca

SEQ ID NO: 1559818 - RNA, 19 nt, Homo sapiens
ugcaggagaugguagauga

SEQ ID NO: 1559819 - RNA, 19 nt, Homo sapiens
caccuaguaucuugacauu

SEQ ID NO: 1559820 - RNA, 19 nt, Homo sapiens
gcugagauguucccugucu

SEQ ID NO: 1559821 - RNA, 19 nt, Homo sapiens
caaagagacaagccaagaa

SEQ ID NO: 1559822 - RNA, 19 nt, Homo sapiens
guucaccgcugaucacagu

SEQ ID NO: 1559823 - RNA, 19 nt, Homo sapiens
ucagugacaucugcacaaa

SEQ ID NO: 1559824 - RNA, 19 nt, Homo sapiens
aaagagacaagccaagaaa

SEQ ID NO: 1559825 - RNA, 19 nt, Homo sapiens
gcguaagcuuugagauaaa

SEQ ID NO: 1559826 - RNA, 19 nt, Homo sapiens
caaaggugccuacaguguu

SEQ ID NO: 1559827 - RNA, 19 nt, Homo sapiens
ucucguaugauuucucuua

SEQ ID NO: 1559828 - RNA, 19 nt, Homo sapiens
uaugacacgucuucaccua

SEQ ID NO: 1559829 - RNA, 19 nt, Homo sapiens
acacugugauuccguucua

SEQ ID NO: 1559830 - RNA, 19 nt, Homo sapiens
gaaauccucgcaacucauc

SEQ ID NO: 1559831 - RNA, 19 nt, Homo sapiens
ccuagggauucaucuguuu

SEQ ID NO: 1559832 - RNA, 19 nt, Homo sapiens
caaaggagucaaccgauuc

SEQ ID NO: 1559833 - RNA, 19 nt, Homo sapiens
cugggaaagucucuuguuu

SEQ ID NO: 1559834 - RNA, 19 nt, Homo sapiens
gcucauggaucauuuuguu

SEQ ID NO: 1559835 - RNA, 19 nt, Homo sapiens
cauaaacacaucaccuuga

SEQ ID NO: 1559836 - RNA, 19 nt, Homo sapiens
gaaggagggcuauguucug

SEQ ID NO: 1559837 - RNA, 19 nt, Homo sapiens
gaaggagucgagauuguca

SEQ ID NO: 1559838 - RNA, 19 nt, Homo sapiens
gccaugacuuucaccuuug

SEQ ID NO: 1559839 - RNA, 19 nt, Homo sapiens
ggagaggauuaccuuugau

SEQ ID NO: 1559840 - RNA, 19 nt, Homo sapiens
ccaugucccuugucacugu

SEQ ID NO: 1559841 - RNA, 19 nt, Homo sapiens
gaacaggacaucgcacaag

SEQ ID NO: 1559842 - RNA, 19 nt, Homo sapiens
ccagaucccaguaugacua

SEQ ID NO: 1559843 - RNA, 19 nt, Homo sapiens
ccagaacgacugcagcauu

SEQ ID NO: 1559844 - RNA, 19 nt, Homo sapiens
ccugagcccuggccaguau

SEQ ID NO: 1559845 - RNA, 19 nt, Homo sapiens
ggaaggugaagaaagaaug

SEQ ID NO: 1559846 - RNA, 19 nt, Homo sapiens
gauuggugcuggaagaaca

SEQ ID NO: 1559847 - RNA, 19 nt, Homo sapiens
gaucuucagccuucguuug

SEQ ID NO: 1559848 - RNA, 19 nt, Homo sapiens
ccaagaaacagaagacaag

SEQ ID NO: 1559849 - RNA, 19 nt, Homo sapiens
gaacuauguugugcuucug

SEQ ID NO: 1559850 - RNA, 19 nt, Homo sapiens
gagggcaaguucagauuac

SEQ ID NO: 1559851 - RNA, 19 nt, Homo sapiens
acaacggcauucugacauu

SEQ ID NO: 1559852 - RNA, 19 nt, Homo sapiens
ccugagugguggccuguuu

SEQ ID NO: 1559853 - RNA, 19 nt, Homo sapiens
gaacuaucaccaccgacaa

SEQ ID NO: 1559854 - RNA, 19 nt, Homo sapiens
caacggcauucugacauuc

SEQ ID NO: 1559855 - RNA, 19 nt, Homo sapiens
ggagggcuauguucugacu

SEQ ID NO: 1559856 - RNA, 19 nt, Homo sapiens
ugacacgucuucaccuagu

SEQ ID NO: 1559857 - RNA, 19 nt, Homo sapiens
gaugacgugucugcaguug

SEQ ID NO: 1559858 - RNA, 19 nt, Homo sapiens
gcugugcuguggugugaga

SEQ ID NO: 1559859 - RNA, 19 nt, Homo sapiens
ucaucgagauaaagcugua

SEQ ID NO: 1559860 - RNA, 19 nt, Homo sapiens
aaacggagagcccgaacaa

SEQ ID NO: 1559861 - RNA, 19 nt, Homo sapiens
ggcacagugucuuccuuaa

SEQ ID NO: 1559862 - RNA, 19 nt, Homo sapiens
agucuuuacugaugacaaa

SEQ ID NO: 1559863 - RNA, 19 nt, Homo sapiens
gaagugagauccaggagaa

SEQ ID NO: 1559864 - RNA, 19 nt, Homo sapiens
gaacuuaagcucuggguaa

SEQ ID NO: 1559865 - RNA, 19 nt, Homo sapiens
gaagagaccucaucaucca

SEQ ID NO: 1559866 - RNA, 19 nt, Homo sapiens
ucccaaagauggagaaaua

SEQ ID NO: 1559867 - RNA, 19 nt, Homo sapiens
gccaagaaauuaagucuau

SEQ ID NO: 1559868 - RNA, 19 nt, Homo sapiens
gcccaaagauggagcacua

SEQ ID NO: 1559869 - RNA, 19 nt, Homo sapiens
gcggaaggcuguggaagua

SEQ ID NO: 1559870 - RNA, 19 nt, Homo sapiens
caccuuggcugaccugaua

SEQ ID NO: 1559871 - RNA, 19 nt, Homo sapiens
gagaaacacuggcagagau

SEQ ID NO: 1559872 - RNA, 19 nt, Homo sapiens
gaacgugugucucuucuac

SEQ ID NO: 1559873 - RNA, 19 nt, Homo sapiens
ggaggaauuuguaccuauu

SEQ ID NO: 1559874 - RNA, 19 nt, Homo sapiens
ccaauuccauguacauuau

SEQ ID NO: 1559875 - RNA, 19 nt, Homo sapiens
ggacaaagacaaacaccaa

SEQ ID NO: 1559876 - RNA, 19 nt, Homo sapiens
ggagaaaccagaagugaga

SEQ ID NO: 1559877 - RNA, 19 nt, Homo sapiens
gcagagcuaugcggaugua

SEQ ID NO: 1559878 - RNA, 19 nt, Homo sapiens
gaagaaccauucaggaaaa

SEQ ID NO: 1559879 - RNA, 19 nt, Homo sapiens
ggaaggcuguggaaguaga

SEQ ID NO: 1559880 - RNA, 19 nt, Homo sapiens
gcuuucggcucacaguuua

SEQ ID NO: 1559881 - RNA, 19 nt, Homo sapiens
ccacuaaagcagaagaaua

SEQ ID NO: 1559882 - RNA, 19 nt, Homo sapiens
caaagaagccacuaaagca

SEQ ID NO: 1559883 - RNA, 19 nt, Homo sapiens
ggaaaaggcucucaacuac

SEQ ID NO: 1559884 - RNA, 19 nt, Homo sapiens
gacccacccuuccucuaua

SEQ ID NO: 1559885 - RNA, 19 nt, Homo sapiens
agaaggcaaugauacaauu

SEQ ID NO: 1559886 - RNA, 19 nt, Homo sapiens
gagcuaugcggauguauga

SEQ ID NO: 1559887 - RNA, 19 nt, Homo sapiens
gcaguggcccucagaaaga

SEQ ID NO: 1559888 - RNA, 19 nt, Homo sapiens
ugaagucuaucaagagaga

SEQ ID NO: 1559889 - RNA, 19 nt, Homo sapiens
gcucucaacuacucccaaa

SEQ ID NO: 1559890 - RNA, 19 nt, Homo sapiens
cagaugcgaugaucagaug

SEQ ID NO: 1559891 - RNA, 19 nt, Homo sapiens
gauuauugguuacacaugu

SEQ ID NO: 1559892 - RNA, 19 nt, Homo sapiens
gaaggcaaugauacaauuu

SEQ ID NO: 1559893 - RNA, 19 nt, Homo sapiens
ccaaagauggagaaauaaa

SEQ ID NO: 1559894 - RNA, 19 nt, Homo sapiens
ggaggagccaagaaauuaa

SEQ ID NO: 1559895 - RNA, 19 nt, Homo sapiens
uggaggagccaagaaauua

SEQ ID NO: 1559896 - RNA, 19 nt, Homo sapiens
gaagaaccuugcagaagcu

SEQ ID NO: 1559897 - RNA, 19 nt, Homo sapiens
gggaagagaccucaucauc

SEQ ID NO: 1559898 - RNA, 19 nt, Homo sapiens
uggcagagauucaaagaag

SEQ ID NO: 1559899 - RNA, 19 nt, Homo sapiens
ucaacuccaucaugucuga

SEQ ID NO: 1559900 - RNA, 19 nt, Homo sapiens
gaggagcaguuacccaaca

SEQ ID NO: 1559901 - RNA, 19 nt, Homo sapiens
ggacccacccuuccucuau

SEQ ID NO: 1559902 - RNA, 19 nt, Homo sapiens
uacaagcucugaagaagau

SEQ ID NO: 1559903 - RNA, 19 nt, Homo sapiens
agaaggcccuggagaaaca

SEQ ID NO: 1559904 - RNA, 19 nt, Homo sapiens
gcuacaagcucugaagaag

SEQ ID NO: 1559905 - RNA, 19 nt, Homo sapiens
aaauaagcauuggguguuu

SEQ ID NO: 1559906 - RNA, 19 nt, Homo sapiens
cuucugaaauccugucuga

SEQ ID NO: 1559907 - RNA, 19 nt, Homo sapiens
cauaaggcuuugcuucuuc

SEQ ID NO: 1559908 - RNA, 19 nt, Homo sapiens
caucgaccauccaugagaa

SEQ ID NO: 1559909 - RNA, 19 nt, Homo sapiens
gcagaagaauaugaaugga

SEQ ID NO: 1559910 - RNA, 19 nt, Homo sapiens
gcaauggcuacacaaacua

SEQ ID NO: 1559911 - RNA, 19 nt, Homo sapiens
cacuaaagcagaagaauau

SEQ ID NO: 1559912 - RNA, 19 nt, Homo sapiens
ggagaaacacuggcagaga

SEQ ID NO: 1559913 - RNA, 19 nt, Homo sapiens
gaaaaguacugggaaguuc

SEQ ID NO: 1559914 - RNA, 19 nt, Homo sapiens
cacccuuccucuauaagua

SEQ ID NO: 1559915 - RNA, 19 nt, Homo sapiens
gaaaaccauugcauuagga

SEQ ID NO: 1559916 - RNA, 19 nt, Homo sapiens
cacaacaauuuacaaagug

SEQ ID NO: 1559917 - RNA, 19 nt, Homo sapiens
ucaaagcuuucugacacua

SEQ ID NO: 1559918 - RNA, 19 nt, Homo sapiens
gaagugcuguaagucugaa

SEQ ID NO: 1559919 - RNA, 19 nt, Homo sapiens
ggagacacaggcauuuaug

SEQ ID NO: 1559920 - RNA, 19 nt, Homo sapiens
gagaaggcaaugauacaau

SEQ ID NO: 1559921 - RNA, 19 nt, Homo sapiens
gaugagcuccuggcagaaa

SEQ ID NO: 1559922 - RNA, 19 nt, Homo sapiens
gaaauccugucugacuaca

SEQ ID NO: 1559923 - RNA, 19 nt, Homo sapiens
gaaagaagaguuccaaaag

SEQ ID NO: 1559924 - RNA, 19 nt, Homo sapiens
ucauaaggcuuugcuucuu

SEQ ID NO: 1559925 - RNA, 19 nt, Homo sapiens
uaaccagacacaggacuua

SEQ ID NO: 1559926 - RNA, 19 nt, Homo sapiens
gcagggaaucuaccucuuc

SEQ ID NO: 1559927 - RNA, 19 nt, Homo sapiens
gaaccuugcagaagcuguu

SEQ ID NO: 1559928 - RNA, 19 nt, Homo sapiens
cuuaagcucuggguaaaga

SEQ ID NO: 1559929 - RNA, 19 nt, Homo sapiens
ugacaucaacuccaucaug

SEQ ID NO: 1559930 - RNA, 19 nt, Homo sapiens
gagacacaggcauuuauga

SEQ ID NO: 1559931 - RNA, 19 nt, Homo sapiens
cagagaaggcccuggagaa

SEQ ID NO: 1559932 - RNA, 19 nt, Homo sapiens
cagggaaucuaccucuuca

SEQ ID NO: 1559933 - RNA, 19 nt, Homo sapiens
cugaaauccugucugacua

SEQ ID NO: 1559934 - RNA, 19 nt, Homo sapiens
aaagcuuucugacacuauu

SEQ ID NO: 1559935 - RNA, 19 nt, Homo sapiens
gauaagccagggcacagaa

SEQ ID NO: 1559936 - RNA, 19 nt, Homo sapiens
gggaggagggcaccaaugu

SEQ ID NO: 1559937 - RNA, 19 nt, Homo sapiens
gacccagucuucagauugg

SEQ ID NO: 1559938 - RNA, 19 nt, Homo sapiens
ugacacuauugaagucuau

SEQ ID NO: 1559939 - RNA, 19 nt, Homo sapiens
cuaaagcagaagaauauga

SEQ ID NO: 1559940 - RNA, 19 nt, Homo sapiens
agaagccacuaaagcagaa

SEQ ID NO: 1559941 - RNA, 19 nt, Homo sapiens
gacacaggcauuuaugaga

SEQ ID NO: 1559942 - RNA, 19 nt, Homo sapiens
ccacugguuuggagacaca

SEQ ID NO: 1559943 - RNA, 19 nt, Homo sapiens
ugagaugguucccgugagu

SEQ ID NO: 1559944 - RNA, 19 nt, Homo sapiens
aggcaaugauacaauuuga

SEQ ID NO: 1559945 - RNA, 19 nt, Homo sapiens
aaauucggacaauggauua

SEQ ID NO: 1559946 - RNA, 19 nt, Homo sapiens
gcuaugcggauguaugaga

SEQ ID NO: 1559947 - RNA, 19 nt, Homo sapiens
uggaggaauuuguaccuau

SEQ ID NO: 1559948 - RNA, 19 nt, Homo sapiens
guggaggaauuuguaccua

SEQ ID NO: 1559949 - RNA, 19 nt, Homo sapiens
acaaacuagucaugucuuc

SEQ ID NO: 1559950 - RNA, 19 nt, Homo sapiens
ggaaaaccauugcauuagg

SEQ ID NO: 1559951 - RNA, 19 nt, Homo sapiens
ccacaaggagaagcuguuu

SEQ ID NO: 1559952 - RNA, 19 nt, Homo sapiens
gaauucaguggcucacaga

SEQ ID NO: 1559953 - RNA, 19 nt, Homo sapiens
agagaaggcccuggagaaa

SEQ ID NO: 1559954 - RNA, 19 nt, Homo sapiens
gagcuuggagaaaccagaa

SEQ ID NO: 1559955 - RNA, 19 nt, Homo sapiens
augagaagcugcccagauc

SEQ ID NO: 1559956 - RNA, 19 nt, Homo sapiens
cagagucagcauccucaua

SEQ ID NO: 1559957 - RNA, 19 nt, Homo sapiens
ucaaagaagccacuaaagc

SEQ ID NO: 1559958 - RNA, 19 nt, Homo sapiens
gaaccauucaggaaaagua

SEQ ID NO: 1559959 - RNA, 19 nt, Homo sapiens
gaaagcuggaggccugaga

SEQ ID NO: 1559960 - RNA, 19 nt, Homo sapiens
cgauaucucugcgaccaau

SEQ ID NO: 1559961 - RNA, 19 nt, Homo sapiens
ccauggaggagccaagaaa

SEQ ID NO: 1559962 - RNA, 19 nt, Homo sapiens
gagcccuucucccaaagau

SEQ ID NO: 1559963 - RNA, 19 nt, Homo sapiens
ggaaaucacuuaucuguaa

SEQ ID NO: 1559964 - RNA, 19 nt, Homo sapiens
ggauugugcugagaaauua

SEQ ID NO: 1559965 - RNA, 19 nt, Homo sapiens
agacuuaacuugguucuua

SEQ ID NO: 1559966 - RNA, 19 nt, Homo sapiens
ggaaauuggugguuugaug

SEQ ID NO: 1559967 - RNA, 19 nt, Homo sapiens
gaagagcacuggaggaaag

SEQ ID NO: 1559968 - RNA, 19 nt, Homo sapiens
agacugaccugaacuuauu

SEQ ID NO: 1559969 - RNA, 19 nt, Homo sapiens
uagaacagcuugaaagaga

SEQ ID NO: 1559970 - RNA, 19 nt, Homo sapiens
ugauaaaccuugccucuga

SEQ ID NO: 1559971 - RNA, 19 nt, Homo sapiens
gaagacaacgacucaguaa

SEQ ID NO: 1559972 - RNA, 19 nt, Homo sapiens
gaaggagaauaaucuugaa

SEQ ID NO: 1559973 - RNA, 19 nt, Homo sapiens
cugaauagccgaaacuuua

SEQ ID NO: 1559974 - RNA, 19 nt, Homo sapiens
ccuauuugcucauuuauug

SEQ ID NO: 1559975 - RNA, 19 nt, Homo sapiens
gagauaauucgcccuauuu

SEQ ID NO: 1559976 - RNA, 19 nt, Homo sapiens
gaccugaacuuauuauugg

SEQ ID NO: 1559977 - RNA, 19 nt, Homo sapiens
cacaagaaaugaagacuga

SEQ ID NO: 1559978 - RNA, 19 nt, Homo sapiens
gaagcagccuuauauacau

SEQ ID NO: 1559979 - RNA, 19 nt, Homo sapiens
ggugagcggugaugaagaa

SEQ ID NO: 1559980 - RNA, 19 nt, Homo sapiens
cuagacaguuacagaguua

SEQ ID NO: 1559981 - RNA, 19 nt, Homo sapiens
agagaaacagguuguauua

SEQ ID NO: 1559982 - RNA, 19 nt, Homo sapiens
gaaagcaaaggaaauucua

SEQ ID NO: 1559983 - RNA, 19 nt, Homo sapiens
gacaacgacucaguaauga

SEQ ID NO: 1559984 - RNA, 19 nt, Homo sapiens
cagaauacauggaaacauc

SEQ ID NO: 1559985 - RNA, 19 nt, Homo sapiens
agacaagcauggaaaguga

SEQ ID NO: 1559986 - RNA, 19 nt, Homo sapiens
gaaaugaggaagaaauaca

SEQ ID NO: 1559987 - RNA, 19 nt, Homo sapiens
gacucacucuugcaaauaa

SEQ ID NO: 1559988 - RNA, 19 nt, Homo sapiens
gaagacugaccugaacuua

SEQ ID NO: 1559989 - RNA, 19 nt, Homo sapiens
caaaugaagacaccguuaa

SEQ ID NO: 1559990 - RNA, 19 nt, Homo sapiens
gcaauuaaaggacauaagu

SEQ ID NO: 1559991 - RNA, 19 nt, Homo sapiens
ucaugcagcuggaaucuga

SEQ ID NO: 1559992 - RNA, 19 nt, Homo sapiens
gagagaaacagguuguauu

SEQ ID NO: 1559993 - RNA, 19 nt, Homo sapiens
agaguuguuugaagacuua

SEQ ID NO: 1559994 - RNA, 19 nt, Homo sapiens
gaauagaacagcuugaaag

SEQ ID NO: 1559995 - RNA, 19 nt, Homo sapiens
gagaauauccuuuugauga

SEQ ID NO: 1559996 - RNA, 19 nt, Homo sapiens
gcacgacaccugagauaau

SEQ ID NO: 1559997 - RNA, 19 nt, Homo sapiens
gaagacagauauaaaagug

SEQ ID NO: 1559998 - RNA, 19 nt, Homo sapiens
gaggaaagcaaaggaaauu

SEQ ID NO: 1559999 - RNA, 19 nt, Homo sapiens
gaguuggauuugucagaua

SEQ ID NO: 1560000 - RNA, 19 nt, Homo sapiens
ucaggacaguuauuucaaa

SEQ ID NO: 1560001 - RNA, 19 nt, Homo sapiens
cagcagacuuuguguacuu

SEQ ID NO: 1560002 - RNA, 19 nt, Homo sapiens
gcacaaggaauucauccaa

SEQ ID NO: 1560003 - RNA, 19 nt, Homo sapiens
guuguucucagucuuauua

SEQ ID NO: 1560004 - RNA, 19 nt, Homo sapiens
ggaggaauaagugaauaua

SEQ ID NO: 1560005 - RNA, 19 nt, Homo sapiens
guuccgaaauguugacgua

SEQ ID NO: 1560006 - RNA, 19 nt, Homo sapiens
caaucaagauccauuuaca

SEQ ID NO: 1560007 - RNA, 19 nt, Homo sapiens
caaaugaugaccaaaugaa

SEQ ID NO: 1560008 - RNA, 19 nt, Homo sapiens
guacaaaugaugaccaaau

SEQ ID NO: 1560009 - RNA, 19 nt, Homo sapiens
ccuaagcucugcacaagga

SEQ ID NO: 1560010 - RNA, 19 nt, Homo sapiens
ggacucacucuugcaaaua

SEQ ID NO: 1560011 - RNA, 19 nt, Homo sapiens
ugagauaauucgcccuauu

SEQ ID NO: 1560012 - RNA, 19 nt, Homo sapiens
gaaauuggugguuugaugu

SEQ ID NO: 1560013 - RNA, 19 nt, Homo sapiens
gaaagugaagacacaaaga

SEQ ID NO: 1560014 - RNA, 19 nt, Homo sapiens
uguggaagcugaagacaga

SEQ ID NO: 1560015 - RNA, 19 nt, Homo sapiens
ucuaaagcauguacaaaug

SEQ ID NO: 1560016 - RNA, 19 nt, Homo sapiens
ggauaacauuucaucuaug

SEQ ID NO: 1560017 - RNA, 19 nt, Homo sapiens
ggaagaaauacaaagagaa

SEQ ID NO: 1560018 - RNA, 19 nt, Homo sapiens
aaaggaaauucuacacaga

SEQ ID NO: 1560019 - RNA, 19 nt, Homo sapiens
gaauucauccaacucugua

SEQ ID NO: 1560020 - RNA, 19 nt, Homo sapiens
agaaggaaaugaggaagaa

SEQ ID NO: 1560021 - RNA, 19 nt, Homo sapiens
caggauaacauuucaucua

SEQ ID NO: 1560022 - RNA, 19 nt, Homo sapiens
aaacacagcaauuaaagga

SEQ ID NO: 1560023 - RNA, 19 nt, Homo sapiens
agacaacgacucaguaaug

SEQ ID NO: 1560024 - RNA, 19 nt, Homo sapiens
ugaaggagaauaaucuuga

SEQ ID NO: 1560025 - RNA, 19 nt, Homo sapiens
uuucuaaacuucuggcauu

SEQ ID NO: 1560026 - RNA, 19 nt, Homo sapiens
guaccacauuguuucuaaa

SEQ ID NO: 1560027 - RNA, 19 nt, Homo sapiens
aaacaugaguuggauuugu

SEQ ID NO: 1560028 - RNA, 19 nt, Homo sapiens
caacgacucaguaaugaau

SEQ ID NO: 1560029 - RNA, 19 nt, Homo sapiens
uacaaaugaugaccaaaug

SEQ ID NO: 1560030 - RNA, 19 nt, Homo sapiens
ggagucaugucuaaagcau

SEQ ID NO: 1560031 - RNA, 19 nt, Homo sapiens
gcaaaggaaauucuacaca

SEQ ID NO: 1560032 - RNA, 19 nt, Homo sapiens
uggcauuacugcuucauga

SEQ ID NO: 1560033 - RNA, 19 nt, Homo sapiens
aaagaagcagccuuauaua

SEQ ID NO: 1560034 - RNA, 19 nt, Homo sapiens
aaagugaacuaaggaaauc

SEQ ID NO: 1560035 - RNA, 19 nt, Homo sapiens
aagucaagcugcaaucaaa

SEQ ID NO: 1560036 - RNA, 19 nt, Homo sapiens
ccaaaugaagacaccguua

SEQ ID NO: 1560037 - RNA, 19 nt, Homo sapiens
cacgacaccugagauaauu

SEQ ID NO: 1560038 - RNA, 19 nt, Homo sapiens
gcaaagucaagugaacaua

SEQ ID NO: 1560039 - RNA, 19 nt, Homo sapiens
uccgaaauguugacguaua

SEQ ID NO: 1560040 - RNA, 19 nt, Homo sapiens
uaagugugaaggagaauaa

SEQ ID NO: 1560041 - RNA, 19 nt, Homo sapiens
gcauuacugcuucaugaaa

SEQ ID NO: 1560042 - RNA, 19 nt, Homo sapiens
gauguauugucucaaguuc

SEQ ID NO: 1560043 - RNA, 19 nt, Homo sapiens
gaacauagcaugguaaaag

SEQ ID NO: 1560044 - RNA, 19 nt, Homo sapiens
gauaaaccuugccucugau

SEQ ID NO: 1560045 - RNA, 19 nt, Homo sapiens
gaagcugaagacagauaua

SEQ ID NO: 1560046 - RNA, 19 nt, Homo sapiens
uaaaggacauaagugugaa

SEQ ID NO: 1560047 - RNA, 19 nt, Homo sapiens
uuaaaggacauaaguguga

SEQ ID NO: 1560048 - RNA, 19 nt, Homo sapiens
gagacucuuuccagugcua

SEQ ID NO: 1560049 - RNA, 19 nt, Homo sapiens
gaaaucacuuaucuguaac

SEQ ID NO: 1560050 - RNA, 19 nt, Homo sapiens
gcaaauccaguccaugcuu

SEQ ID NO: 1560051 - RNA, 19 nt, Homo sapiens
gaauauagacaagcaugga

SEQ ID NO: 1560052 - RNA, 19 nt, Homo sapiens
gagaaggaaaugaggaaga

SEQ ID NO: 1560053 - RNA, 19 nt, Homo sapiens
gagcggugaugaagaaagg

SEQ ID NO: 1560054 - RNA, 19 nt, Homo sapiens
ccaaguaccacauuguuuc

SEQ ID NO: 1560055 - RNA, 19 nt, Homo sapiens
cgcccuauuugcucauuua

SEQ ID NO: 1560056 - RNA, 19 nt, Homo sapiens
guacuucagaguuguuuga

SEQ ID NO: 1560057 - RNA, 19 nt, Homo sapiens
ggucacuauucauucaauu

SEQ ID NO: 1560058 - RNA, 19 nt, Homo sapiens
ggaaagcaaaggaaauucu

SEQ ID NO: 1560059 - RNA, 19 nt, Homo sapiens
ggacaguuauuucaaaaca

SEQ ID NO: 1560060 - RNA, 19 nt, Homo sapiens
gaacuuauuauuggagugu

SEQ ID NO: 1560061 - RNA, 19 nt, Homo sapiens
ggaauucauccaacucugu

SEQ ID NO: 1560062 - RNA, 19 nt, Homo sapiens
aagcagaagaugaggauaa

SEQ ID NO: 1560063 - RNA, 19 nt, Homo sapiens
gaaaggaaaccaucacuaa

SEQ ID NO: 1560064 - RNA, 19 nt, Homo sapiens
ucaauuggcucuugccuua

SEQ ID NO: 1560065 - RNA, 19 nt, Homo sapiens
gcacacagauccugguaaa

SEQ ID NO: 1560066 - RNA, 19 nt, Homo sapiens
gcacccagcuuggcauuua

SEQ ID NO: 1560067 - RNA, 19 nt, Homo sapiens
gcacuuagccuccagauga

SEQ ID NO: 1560068 - RNA, 19 nt, Homo sapiens
gcaugaagcucaaggagaa

SEQ ID NO: 1560069 - RNA, 19 nt, Homo sapiens
gaaauacugggccaacuuu

SEQ ID NO: 1560070 - RNA, 19 nt, Homo sapiens
gcucuugccuuauaucaug

SEQ ID NO: 1560071 - RNA, 19 nt, Homo sapiens
gagauguacuuccucuuug

SEQ ID NO: 1560072 - RNA, 19 nt, Homo sapiens
ucaacaaccuggaauucaa

SEQ ID NO: 1560073 - RNA, 19 nt, Homo sapiens
gaccuuucaucacuaguaa

SEQ ID NO: 1560074 - RNA, 19 nt, Homo sapiens
gauuagaccugaauuucuc

SEQ ID NO: 1560075 - RNA, 19 nt, Homo sapiens
gaucccagaugacccuuug

SEQ ID NO: 1560076 - RNA, 19 nt, Homo sapiens
gaaaguggccaagaagguu

SEQ ID NO: 1560077 - RNA, 19 nt, Homo sapiens
gguggucucuucaauaaag

SEQ ID NO: 1560078 - RNA, 19 nt, Homo sapiens
gagacuagccauggacaua

SEQ ID NO: 1560079 - RNA, 19 nt, Homo sapiens
ucaaugagcaugacuggaa

SEQ ID NO: 1560080 - RNA, 19 nt, Homo sapiens
cuacuucacuguugacauc

SEQ ID NO: 1560081 - RNA, 19 nt, Homo sapiens
gaagcagaggcaauucuaa

SEQ ID NO: 1560082 - RNA, 19 nt, Homo sapiens
gaaaguggugcugguguuu

SEQ ID NO: 1560083 - RNA, 19 nt, Homo sapiens
guacgagggcucugacuug

SEQ ID NO: 1560084 - RNA, 19 nt, Homo sapiens
gccuccagaugaugaaaua

SEQ ID NO: 1560085 - RNA, 19 nt, Homo sapiens
gugccugucuguucacauu

SEQ ID NO: 1560086 - RNA, 19 nt, Homo sapiens
ugagauguacuuccucuuu

SEQ ID NO: 1560087 - RNA, 19 nt, Homo sapiens
aggaguaccuggacaaugu

SEQ ID NO: 1560088 - RNA, 19 nt, Homo sapiens
aauuggcucuugccuuaua

SEQ ID NO: 1560089 - RNA, 19 nt, Homo sapiens
gagagacccggaagagauu

SEQ ID NO: 1560090 - RNA, 19 nt, Homo sapiens
caacaaggaugaaaaguac

SEQ ID NO: 1560091 - RNA, 19 nt, Homo sapiens
gggguggucucuucaauaa

SEQ ID NO: 1560092 - RNA, 19 nt, Homo sapiens
ugccuuauaucaugaaguu

SEQ ID NO: 1560093 - RNA, 19 nt, Homo sapiens
gaaaccguaugauggacau

SEQ ID NO: 1560094 - RNA, 19 nt, Homo sapiens
ugagauuccuccaacugaa

SEQ ID NO: 1560095 - RNA, 19 nt, Homo sapiens
ucaugaaguucccgcuaaa

SEQ ID NO: 1560096 - RNA, 19 nt, Homo sapiens
aaagaaguguugauuagac

SEQ ID NO: 1560097 - RNA, 19 nt, Homo sapiens
gcacaggcucggcaucuuc

SEQ ID NO: 1560098 - RNA, 19 nt, Homo sapiens
agaaaguggugcugguguu

SEQ ID NO: 1560099 - RNA, 19 nt, Homo sapiens
ggacauaccuggggacaag

SEQ ID NO: 1560100 - RNA, 19 nt, Homo sapiens
gacccuggauugaaacgau

SEQ ID NO: 1560101 - RNA, 19 nt, Homo sapiens
acuggaagaugcuacgaaa

SEQ ID NO: 1560102 - RNA, 19 nt, Homo sapiens
gggaugagauguacuuccu

SEQ ID NO: 1560103 - RNA, 19 nt, Homo sapiens
aaggaaaccaucacuaaga

SEQ ID NO: 1560104 - RNA, 19 nt, Homo sapiens
ggagacccaggaaauguga

SEQ ID NO: 1560105 - RNA, 19 nt, Homo sapiens
gucuguaccugaacgugua

SEQ ID NO: 1560106 - RNA, 19 nt, Homo sapiens
gcaggaaggagccaaagag

SEQ ID NO: 1560107 - RNA, 19 nt, Homo sapiens
ugauggacauaguucaaga

SEQ ID NO: 1560108 - RNA, 19 nt, Homo sapiens
acuaagaugcucuggagua

SEQ ID NO: 1560109 - RNA, 19 nt, Homo sapiens
caacaaccuggaauucaau

SEQ ID NO: 1560110 - RNA, 19 nt, Homo sapiens
uagggcagguugugacaug

SEQ ID NO: 1560111 - RNA, 19 nt, Homo sapiens
gaugagauuccuccaacug

SEQ ID NO: 1560112 - RNA, 19 nt, Homo sapiens
caaauccucccacccuuca

SEQ ID NO: 1560113 - RNA, 19 nt, Homo sapiens
aggaaaccaucacuaagau

SEQ ID NO: 1560114 - RNA, 19 nt, Homo sapiens
ugaaauacugggccaacuu

SEQ ID NO: 1560115 - RNA, 19 nt, Homo sapiens
agaaaggaaaccaucacua

SEQ ID NO: 1560116 - RNA, 19 nt, Homo sapiens
ggcaggcgaugagaaagga

SEQ ID NO: 1560117 - RNA, 19 nt, Homo sapiens
caagaugagauuccuccaa

SEQ ID NO: 1560118 - RNA, 19 nt, Homo sapiens
ccagaguggcaccgcguua

SEQ ID NO: 1560119 - RNA, 19 nt, Homo sapiens
gcacaggaaaccccaauga

SEQ ID NO: 1560120 - RNA, 19 nt, Homo sapiens
cugucuaccuguaugaauu

SEQ ID NO: 1560121 - RNA, 19 nt, Homo sapiens
agaugccacuuucguguau

SEQ ID NO: 1560122 - RNA, 19 nt, Homo sapiens
agagagacccggaagagau

SEQ ID NO: 1560123 - RNA, 19 nt, Homo sapiens
ggaguacccgcacccuguu

SEQ ID NO: 1560124 - RNA, 19 nt, Homo sapiens
guugauuagaccugaauuu

SEQ ID NO: 1560125 - RNA, 19 nt, Homo sapiens
ccuugugacuccuucuuau

SEQ ID NO: 1560126 - RNA, 19 nt, Homo sapiens
uguugaauaucaccaagga

SEQ ID NO: 1560127 - RNA, 19 nt, Homo sapiens
ucagaccuuucaucacuag

SEQ ID NO: 1560128 - RNA, 19 nt, Homo sapiens
auucagaccuuucaucacu

SEQ ID NO: 1560129 - RNA, 19 nt, Homo sapiens
cuaagaugcucuggaguac

SEQ ID NO: 1560130 - RNA, 19 nt, Homo sapiens
acacagauccugguaaacu

SEQ ID NO: 1560131 - RNA, 19 nt, Homo sapiens
ugcggacccuggauugaaa

SEQ ID NO: 1560132 - RNA, 19 nt, Homo sapiens
ccaacugaacuuccagaga

SEQ ID NO: 1560133 - RNA, 19 nt, Homo sapiens
cacagauccugguaaacug

SEQ ID NO: 1560134 - RNA, 19 nt, Homo sapiens
cuaguaacccacugaaagu

SEQ ID NO: 1560135 - RNA, 19 nt, Homo sapiens
guugugacauggagcaaac

SEQ ID NO: 1560136 - RNA, 19 nt, Homo sapiens
gaccugcacugcccuuucc

SEQ ID NO: 1560137 - RNA, 19 nt, Homo sapiens
gagugggcaugaagcucaa

SEQ ID NO: 1560138 - RNA, 19 nt, Homo sapiens
cccgcacccuguugaauau

SEQ ID NO: 1560139 - RNA, 19 nt, Homo sapiens
caugagcccugugguggau

SEQ ID NO: 1560140 - RNA, 19 nt, Homo sapiens
agaccuuucaucacuagua

SEQ ID NO: 1560141 - RNA, 19 nt, Homo sapiens
ggaccugcacugcccuuuc

SEQ ID NO: 1560142 - RNA, 19 nt, Homo sapiens
aggagaagaagauggcuuu

SEQ ID NO: 1560143 - RNA, 19 nt, Homo sapiens
guguggugaucccagauga

SEQ ID NO: 1560144 - RNA, 19 nt, Homo sapiens
gggccacuccaaagucuau

SEQ ID NO: 1560145 - RNA, 19 nt, Homo sapiens
aucaugaaguucccgcuaa

SEQ ID NO: 1560146 - RNA, 19 nt, Homo sapiens
cagcacacagauccuggua

SEQ ID NO: 1560147 - RNA, 19 nt, Homo sapiens
ccacaacagcacacagauc

SEQ ID NO: 1560148 - RNA, 19 nt, Homo sapiens
ugaaaguggccaagaaggu

SEQ ID NO: 1560149 - RNA, 19 nt, Homo sapiens
acacagggguggucucuuc

SEQ ID NO: 1560150 - RNA, 19 nt, Homo sapiens
uaccauccauccugcucaa

SEQ ID NO: 1560151 - RNA, 19 nt, Homo sapiens
cuaccuguaugaauuugag

SEQ ID NO: 1560152 - RNA, 19 nt, Homo sapiens
gaggaguaccuggacaaug

SEQ ID NO: 1560153 - RNA, 19 nt, Homo sapiens
aaaggaaaccaucacuaag

SEQ ID NO: 1560154 - RNA, 19 nt, Homo sapiens
gagaaaggaaaccaucacu

SEQ ID NO: 1560155 - RNA, 19 nt, Homo sapiens
ucacugcggacccuggauu

SEQ ID NO: 1560156 - RNA, 19 nt, Homo sapiens
acuccaaagucuauacaca

SEQ ID NO: 1560157 - RNA, 19 nt, Homo sapiens
ucucucccacccacacuua

SEQ ID NO: 1560158 - RNA, 19 nt, Homo sapiens
ugucuaccuguaugaauuu

SEQ ID NO: 1560159 - RNA, 19 nt, Homo sapiens
ggaggaguaccuggacaau

SEQ ID NO: 1560160 - RNA, 19 nt, Homo sapiens
cacuugugguggaggagua

SEQ ID NO: 1560161 - RNA, 19 nt, Homo sapiens
gggagacccaggaaaugug

SEQ ID NO: 1560162 - RNA, 19 nt, Homo sapiens
ccagagagacccggaagag

SEQ ID NO: 1560163 - RNA, 19 nt, Homo sapiens
gaugggagauguugaguuu

SEQ ID NO: 1560164 - RNA, 19 nt, Homo sapiens
cgaggucacuggaggauaa

SEQ ID NO: 1560165 - RNA, 19 nt, Homo sapiens
cgaagcaugugcagaauug

SEQ ID NO: 1560166 - RNA, 19 nt, Homo sapiens
caagucaccuguuccaguu

SEQ ID NO: 1560167 - RNA, 19 nt, Homo sapiens
gguggaacaucucgaauau

SEQ ID NO: 1560168 - RNA, 19 nt, Homo sapiens
gaaggcauguuccggaagu

SEQ ID NO: 1560169 - RNA, 19 nt, Homo sapiens
gcauuucccugauuacaag

SEQ ID NO: 1560170 - RNA, 19 nt, Homo sapiens
gacguggaaucuucuuauu

SEQ ID NO: 1560171 - RNA, 19 nt, Homo sapiens
caagucagguggaacaucu

SEQ ID NO: 1560172 - RNA, 19 nt, Homo sapiens
gcuugcauuucccugauua

SEQ ID NO: 1560173 - RNA, 19 nt, Homo sapiens
gcccagaugucuuccacuu

SEQ ID NO: 1560174 - RNA, 19 nt, Homo sapiens
gcgggaagccuaagaggaa

SEQ ID NO: 1560175 - RNA, 19 nt, Homo sapiens
ucaccacgcugcugagugu

SEQ ID NO: 1560176 - RNA, 19 nt, Homo sapiens
ccagaugucuuccacuuac

SEQ ID NO: 1560177 - RNA, 19 nt, Homo sapiens
gccuuuggcuugccuuuga

SEQ ID NO: 1560178 - RNA, 19 nt, Homo sapiens
gaagccacguuccagaagu

SEQ ID NO: 1560179 - RNA, 19 nt, Homo sapiens
uaucgaagcaugugcagaa

SEQ ID NO: 1560180 - RNA, 19 nt, Homo sapiens
cacaucagcucccucaaca

SEQ ID NO: 1560181 - RNA, 19 nt, Homo sapiens
ccuguuggguuggucaaua

SEQ ID NO: 1560182 - RNA, 19 nt, Homo sapiens
cguggaaucuucuuauuuu

SEQ ID NO: 1560183 - RNA, 19 nt, Homo sapiens
ugacuucguuuguucuauc

SEQ ID NO: 1560184 - RNA, 19 nt, Homo sapiens
gauuacaagucagguggaa

SEQ ID NO: 1560185 - RNA, 19 nt, Homo sapiens
gaucguaggcccagauguc

SEQ ID NO: 1560186 - RNA, 19 nt, Homo sapiens
ggaaaauggugcaguugug

SEQ ID NO: 1560187 - RNA, 19 nt, Homo sapiens
ccaguucuuugcccauuuc

SEQ ID NO: 1560188 - RNA, 19 nt, Homo sapiens
gcacaucagcucccucaac

SEQ ID NO: 1560189 - RNA, 19 nt, Homo sapiens
auacguggcuggccuuugg

SEQ ID NO: 1560190 - RNA, 19 nt, Homo sapiens
gacaagagcacgggaugga

SEQ ID NO: 1560191 - RNA, 19 nt, Homo sapiens
gcccagcucugcccuucau

SEQ ID NO: 1560192 - RNA, 19 nt, Homo sapiens
gcagaucgcacccaaucag

SEQ ID NO: 1560193 - RNA, 19 nt, Homo sapiens
ugacguggaaucuucuuau

SEQ ID NO: 1560194 - RNA, 19 nt, Homo sapiens
gcagguggaaucacuggau

SEQ ID NO: 1560195 - RNA, 19 nt, Homo sapiens
uuucugggccauuugauuu

SEQ ID NO: 1560196 - RNA, 19 nt, Homo sapiens
gcaugugcagaauuguuaa

SEQ ID NO: 1560197 - RNA, 19 nt, Homo sapiens
aagccacguuccagaaguu

SEQ ID NO: 1560198 - RNA, 19 nt, Homo sapiens
agugugacguggaaucuuc

SEQ ID NO: 1560199 - RNA, 19 nt, Homo sapiens
gucuuccacuuacuugauu

SEQ ID NO: 1560200 - RNA, 19 nt, Homo sapiens
gugauuacacguuggauac

SEQ ID NO: 1560201 - RNA, 19 nt, Homo sapiens
uugcacaguggaagaauuu

SEQ ID NO: 1560202 - RNA, 19 nt, Homo sapiens
aagguucugucccauggaa

SEQ ID NO: 1560203 - RNA, 19 nt, Homo sapiens
gguggaaugggaugugaga

SEQ ID NO: 1560204 - RNA, 19 nt, Homo sapiens
agcaugugcagaauuguua

SEQ ID NO: 1560205 - RNA, 19 nt, Homo sapiens
uagcuugcauuucccugau

SEQ ID NO: 1560206 - RNA, 19 nt, Homo sapiens
ggaagaggcggaaaaugga

SEQ ID NO: 1560207 - RNA, 19 nt, Homo sapiens
ccuuugacuucguuuguuc

SEQ ID NO: 1560208 - RNA, 19 nt, Homo sapiens
gccuuugacuucguuuguu

SEQ ID NO: 1560209 - RNA, 19 nt, Homo sapiens
uuacaagucagguggaaca

SEQ ID NO: 1560210 - RNA, 19 nt, Homo sapiens
ucagguggaacaucucgaa

SEQ ID NO: 1560211 - RNA, 19 nt, Homo sapiens
gaugucuuccacuuacuug

SEQ ID NO: 1560212 - RNA, 19 nt, Homo sapiens
gcuccuccaugcaguacuc

SEQ ID NO: 1560213 - RNA, 19 nt, Homo sapiens
ccugggaccugugaguuca

SEQ ID NO: 1560214 - RNA, 19 nt, Homo sapiens
gcucuccagcugccacuga

SEQ ID NO: 1560215 - RNA, 19 nt, Homo sapiens
cuguuggguuggucaauau

SEQ ID NO: 1560216 - RNA, 19 nt, Homo sapiens
cccagaugucuuccacuua

SEQ ID NO: 1560217 - RNA, 19 nt, Homo sapiens
guuggguuggucaauauuu

SEQ ID NO: 1560218 - RNA, 19 nt, Homo sapiens
agguggaacaucucgaaua

SEQ ID NO: 1560219 - RNA, 19 nt, Homo sapiens
ucaccaaccggccaacauc

SEQ ID NO: 1560220 - RNA, 19 nt, Homo sapiens
gucuuaagcuguggcaagu

SEQ ID NO: 1560221 - RNA, 19 nt, Homo sapiens
gcacaagguuccaacuuua

SEQ ID NO: 1560222 - RNA, 19 nt, Homo sapiens
gcagagaacucccagagaa

SEQ ID NO: 1560223 - RNA, 19 nt, Homo sapiens
gaacaaaugucucauaacg

SEQ ID NO: 1560224 - RNA, 19 nt, Homo sapiens
ggauuuaucuuaucuaugg

SEQ ID NO: 1560225 - RNA, 19 nt, Homo sapiens
acaguuaccuccuauuuaa

SEQ ID NO: 1560226 - RNA, 19 nt, Homo sapiens
caaauaugcguuucuguua

SEQ ID NO: 1560227 - RNA, 19 nt, Homo sapiens
gaugguaucuaucucuuga

SEQ ID NO: 1560228 - RNA, 19 nt, Homo sapiens
gcacaagcuuugacagguu

SEQ ID NO: 1560229 - RNA, 19 nt, Homo sapiens
ccaguaacauggaaauuug

SEQ ID NO: 1560230 - RNA, 19 nt, Homo sapiens
gcuaaaugguucaacacua

SEQ ID NO: 1560231 - RNA, 19 nt, Homo sapiens
caacaguuaccuccuauuu

SEQ ID NO: 1560232 - RNA, 19 nt, Homo sapiens
ggaaacaaauggaauaucc

SEQ ID NO: 1560233 - RNA, 19 nt, Homo sapiens
gaacaggaaacaaauggaa

SEQ ID NO: 1560234 - RNA, 19 nt, Homo sapiens
cuaaaugguucaacacuau

SEQ ID NO: 1560235 - RNA, 19 nt, Homo sapiens
gacacaauuucacgaagua

SEQ ID NO: 1560236 - RNA, 19 nt, Homo sapiens
gaucaggagucuaaaugug

SEQ ID NO: 1560237 - RNA, 19 nt, Homo sapiens
gaaaggugcuaagacaaau

SEQ ID NO: 1560238 - RNA, 19 nt, Homo sapiens
ccaaguagcugggauuaca

SEQ ID NO: 1560239 - RNA, 19 nt, Homo sapiens
ggacacaauuucacgaagu

SEQ ID NO: 1560240 - RNA, 19 nt, Homo sapiens
aaacggaucaggagucuaa

SEQ ID NO: 1560241 - RNA, 19 nt, Homo sapiens
gcauauugauccuggaguu

SEQ ID NO: 1560242 - RNA, 19 nt, Homo sapiens
gcaaccacaugcuaaaugg

SEQ ID NO: 1560243 - RNA, 19 nt, Homo sapiens
gugauuucguggcugauua

SEQ ID NO: 1560244 - RNA, 19 nt, Homo sapiens
gugcuaagacaaaugguua

SEQ ID NO: 1560245 - RNA, 19 nt, Homo sapiens
aggaacaaaugucucauaa

SEQ ID NO: 1560246 - RNA, 19 nt, Homo sapiens
gaggaacaaaugucucaua

SEQ ID NO: 1560247 - RNA, 19 nt, Homo sapiens
cagagcugcugcaccauuu

SEQ ID NO: 1560248 - RNA, 19 nt, Homo sapiens
gaaauuaauucuggaucuc

SEQ ID NO: 1560249 - RNA, 19 nt, Homo sapiens
gccaagaccaccuauacua

SEQ ID NO: 1560250 - RNA, 19 nt, Homo sapiens
gcacggauauguuuuaagu

SEQ ID NO: 1560251 - RNA, 19 nt, Homo sapiens
cagaguagcugggauuaca

SEQ ID NO: 1560252 - RNA, 19 nt, Homo sapiens
uuucguggcugauuaagaa

SEQ ID NO: 1560253 - RNA, 19 nt, Homo sapiens
ucacagggauaaacuccaa

SEQ ID NO: 1560254 - RNA, 19 nt, Homo sapiens
ccaccaagcccagcuaauu

SEQ ID NO: 1560255 - RNA, 19 nt, Homo sapiens
ucacaugauuccaguaaca

SEQ ID NO: 1560256 - RNA, 19 nt, Homo sapiens
ugaauaauguugcuuugag

SEQ ID NO: 1560257 - RNA, 19 nt, Homo sapiens
ugaaaggugcuaagacaaa

SEQ ID NO: 1560258 - RNA, 19 nt, Homo sapiens
cauggaaauuugguucaua

SEQ ID NO: 1560259 - RNA, 19 nt, Homo sapiens
ggauauauaugcaaaagug

SEQ ID NO: 1560260 - RNA, 19 nt, Homo sapiens
agacggaguuucaccaugu

SEQ ID NO: 1560261 - RNA, 19 nt, Homo sapiens
gggcugacgugacuagauc

SEQ ID NO: 1560262 - RNA, 19 nt, Homo sapiens
ucaaauaugcguuucuguu

SEQ ID NO: 1560263 - RNA, 19 nt, Homo sapiens
aaugaaaggugcuaagaca

SEQ ID NO: 1560264 - RNA, 19 nt, Homo sapiens
uagcagagauuggacacaa

SEQ ID NO: 1560265 - RNA, 19 nt, Homo sapiens
ucacauggaggaacaaaug

SEQ ID NO: 1560266 - RNA, 19 nt, Homo sapiens
ggccaucuguuaucuucuu

SEQ ID NO: 1560267 - RNA, 19 nt, Homo sapiens
ugcacaagguuccaacuuu

SEQ ID NO: 1560268 - RNA, 19 nt, Homo sapiens
caccaagcccagcuaauuu

SEQ ID NO: 1560269 - RNA, 19 nt, Homo sapiens
ugauaauucugucugaugu

SEQ ID NO: 1560270 - RNA, 19 nt, Homo sapiens
ccagcaggcuauugugaau

SEQ ID NO: 1560271 - RNA, 19 nt, Homo sapiens
uagccaggaugguaucuau

SEQ ID NO: 1560272 - RNA, 19 nt, Homo sapiens
gaaguguucacgugauuuc

SEQ ID NO: 1560273 - RNA, 19 nt, Homo sapiens
gagccaagaccaccuauac

SEQ ID NO: 1560274 - RNA, 19 nt, Homo sapiens
acaggaaacaaauggaaua

SEQ ID NO: 1560275 - RNA, 19 nt, Homo sapiens
gagaaaccacuguccuguu

SEQ ID NO: 1560276 - RNA, 19 nt, Homo sapiens
ccagacaucaacccaguaa

SEQ ID NO: 1560277 - RNA, 19 nt, Homo sapiens
caugauuccaguaacaaua

SEQ ID NO: 1560278 - RNA, 19 nt, Homo sapiens
ucaggagucuaaaugugaa

SEQ ID NO: 1560279 - RNA, 19 nt, Homo sapiens
cacaugaacaggaaacaaa

SEQ ID NO: 1560280 - RNA, 19 nt, Homo sapiens
gcgcaaugcccgacagaug

SEQ ID NO: 1560281 - RNA, 19 nt, Homo sapiens
ccaccgcacggauauguuu

SEQ ID NO: 1560282 - RNA, 19 nt, Homo sapiens
gaauggcugggucacauga

SEQ ID NO: 1560283 - RNA, 19 nt, Homo sapiens
gccaacaguuaccuccuau

SEQ ID NO: 1560284 - RNA, 19 nt, Homo sapiens
ccaaaguggugggauuaca

SEQ ID NO: 1560285 - RNA, 19 nt, Homo sapiens
ucucaaacuucucacuuca

SEQ ID NO: 1560286 - RNA, 19 nt, Homo sapiens
ucagagcgguggaacaaac

SEQ ID NO: 1560287 - RNA, 19 nt, Homo sapiens
ggaaauuugguucauaaac

SEQ ID NO: 1560288 - RNA, 19 nt, Homo sapiens
ggucacaugauaauucugu

SEQ ID NO: 1560289 - RNA, 19 nt, Homo sapiens
cauguuagccaggauggua

SEQ ID NO: 1560290 - RNA, 19 nt, Homo sapiens
caugcuaaaugguucaaca

SEQ ID NO: 1560291 - RNA, 19 nt, Homo sapiens
gacuagaucacguuucuca

SEQ ID NO: 1560292 - RNA, 19 nt, Homo sapiens
gagaacucccagagaagaa

SEQ ID NO: 1560293 - RNA, 19 nt, Homo sapiens
aacaguuaccuccuauuua

SEQ ID NO: 1560294 - RNA, 19 nt, Homo sapiens
caaaugguuagccgucuga

SEQ ID NO: 1560295 - RNA, 19 nt, Homo sapiens
ccacauccagccaacaguu

SEQ ID NO: 1560296 - RNA, 19 nt, Homo sapiens
cacaauuucacgaaguaua

SEQ ID NO: 1560297 - RNA, 19 nt, Homo sapiens
aaccacaugugaaguguuc

SEQ ID NO: 1560298 - RNA, 19 nt, Homo sapiens
ccaaacggaucaggagucu

SEQ ID NO: 1560299 - RNA, 19 nt, Homo sapiens
ggaaccaggcauauugauc

SEQ ID NO: 1560300 - RNA, 19 nt, Homo sapiens
ccuccuauuuaauggcuaa

SEQ ID NO: 1560301 - RNA, 19 nt, Homo sapiens
aaauaugcguuucuguuac

SEQ ID NO: 1560302 - RNA, 19 nt, Homo sapiens
gacggaguuucaccauguu

SEQ ID NO: 1560303 - RNA, 19 nt, Homo sapiens
ugccucagccucccaagua

SEQ ID NO: 1560304 - RNA, 19 nt, Homo sapiens
ucccaagguucauucagaa

SEQ ID NO: 1560305 - RNA, 19 nt, Homo sapiens
agacaucaacccaguaaca

SEQ ID NO: 1560306 - RNA, 19 nt, Homo sapiens
agacgacgcggacaaacaa

SEQ ID NO: 1560307 - RNA, 19 nt, Homo sapiens
ggagccaagaccaccuaua

SEQ ID NO: 1560308 - RNA, 19 nt, Homo sapiens
cccaguaacauggaaauuu

SEQ ID NO: 1560309 - RNA, 19 nt, Homo sapiens
cacauccagccaacaguua

SEQ ID NO: 1560310 - RNA, 19 nt, Homo sapiens
ccagagcugcugcaccauu

SEQ ID NO: 1560311 - RNA, 19 nt, Homo sapiens
ccagacugcugagauuaca

SEQ ID NO: 1560312 - RNA, 19 nt, Homo sapiens
caacggcuugcagucuuua

SEQ ID NO: 1560313 - RNA, 19 nt, Homo sapiens
ggaucaggagucuaaaugu

SEQ ID NO: 1560314 - RNA, 19 nt, Homo sapiens
ugucacaugauuccaguaa

SEQ ID NO: 1560315 - RNA, 19 nt, Homo sapiens
gccaucuguuaucuucuuu

SEQ ID NO: 1560316 - RNA, 19 nt, Homo sapiens
acaugauaauucugucuga

SEQ ID NO: 1560317 - RNA, 19 nt, Homo sapiens
ggucucaaacuucucacuu

SEQ ID NO: 1560318 - RNA, 19 nt, Homo sapiens
uaguagagacggaguuuca

SEQ ID NO: 1560319 - RNA, 19 nt, Homo sapiens
ucuuauuggccaucuguua

SEQ ID NO: 1560320 - RNA, 19 nt, Homo sapiens
ggagugcucggucuucucu

SEQ ID NO: 1560321 - RNA, 19 nt, Homo sapiens
ccucuaaacucaacuauga

SEQ ID NO: 1560322 - RNA, 19 nt, Homo sapiens
caacugaucauaguacaua

SEQ ID NO: 1560323 - RNA, 19 nt, Homo sapiens
gaacuuaauauccaacuga

SEQ ID NO: 1560324 - RNA, 19 nt, Homo sapiens
gauaauauguggcaucacu

SEQ ID NO: 1560325 - RNA, 19 nt, Homo sapiens
gaugacagcucaguugaau

SEQ ID NO: 1560326 - RNA, 19 nt, Homo sapiens
auaaugcucugauuccuaa

SEQ ID NO: 1560327 - RNA, 19 nt, Homo sapiens
ggcaucacuugcacacuua

SEQ ID NO: 1560328 - RNA, 19 nt, Homo sapiens
ugacagcucaguugaauau

SEQ ID NO: 1560329 - RNA, 19 nt, Homo sapiens
guuagaagaauuccuauug

SEQ ID NO: 1560330 - RNA, 19 nt, Homo sapiens
aaacacaaucucacacuuu

SEQ ID NO: 1560331 - RNA, 19 nt, Homo sapiens
gguguuaaaucuacaagca

SEQ ID NO: 1560332 - RNA, 19 nt, Homo sapiens
cgaaagaagaauauacuga

SEQ ID NO: 1560333 - RNA, 19 nt, Homo sapiens
ccaaugcgcagacgaaaga

SEQ ID NO: 1560334 - RNA, 19 nt, Homo sapiens
uagaagaauuccuauugga

SEQ ID NO: 1560335 - RNA, 19 nt, Homo sapiens
gauaaugcucugauuccua

SEQ ID NO: 1560336 - RNA, 19 nt, Homo sapiens
uaauguagcagugaaguaa

SEQ ID NO: 1560337 - RNA, 19 nt, Homo sapiens
acaagcaagacauauguua

SEQ ID NO: 1560338 - RNA, 19 nt, Homo sapiens
gcagacgaaagaagaauau

SEQ ID NO: 1560339 - RNA, 19 nt, Homo sapiens
auacguauauugagagugu

SEQ ID NO: 1560340 - RNA, 19 nt, Homo sapiens
uguccugugugcauuauaa

SEQ ID NO: 1560341 - RNA, 19 nt, Homo sapiens
cuacauuugucugucuaua

SEQ ID NO: 1560342 - RNA, 19 nt, Homo sapiens
acacauugcuuuuaccuuu

SEQ ID NO: 1560343 - RNA, 19 nt, Homo sapiens
gcacacuuauuuuguagaa

SEQ ID NO: 1560344 - RNA, 19 nt, Homo sapiens
uggcaucacuugcacacuu

SEQ ID NO: 1560345 - RNA, 19 nt, Homo sapiens
cagcucaguugaauaugga

SEQ ID NO: 1560346 - RNA, 19 nt, Homo sapiens
uauuggagguguuaaaucu

SEQ ID NO: 1560347 - RNA, 19 nt, Homo sapiens
ggagagagaagcugaaagc

SEQ ID NO: 1560348 - RNA, 19 nt, Homo sapiens
caagcaagacauauguuau

SEQ ID NO: 1560349 - RNA, 19 nt, Homo sapiens
gaugauaaugcucugauuc

SEQ ID NO: 1560350 - RNA, 19 nt, Homo sapiens
acacuaaggaacaugauga

SEQ ID NO: 1560351 - RNA, 19 nt, Homo sapiens
gacuuaaagaagcagauua

SEQ ID NO: 1560352 - RNA, 19 nt, Homo sapiens
uuagaagaauuccuauugg

SEQ ID NO: 1560353 - RNA, 19 nt, Homo sapiens
uaugauaccgucaccuuug

SEQ ID NO: 1560354 - RNA, 19 nt, Homo sapiens
cuuaauauccaacugauca

SEQ ID NO: 1560355 - RNA, 19 nt, Homo sapiens
acauuugucugucuauagu

SEQ ID NO: 1560356 - RNA, 19 nt, Homo sapiens
gaaccagcgauggcaacua

SEQ ID NO: 1560357 - RNA, 19 nt, Homo sapiens
uguuauaagucgaacugaa

SEQ ID NO: 1560358 - RNA, 19 nt, Homo sapiens
cuacaagcaagacauaugu

SEQ ID NO: 1560359 - RNA, 19 nt, Homo sapiens
ugaugauaaugcucugauu

SEQ ID NO: 1560360 - RNA, 19 nt, Homo sapiens
uaauauguggcaucacuug

SEQ ID NO: 1560361 - RNA, 19 nt, Homo sapiens
uuaaagaagcagauuaugg

SEQ ID NO: 1560362 - RNA, 19 nt, Homo sapiens
uggauaauauguggcauca

SEQ ID NO: 1560363 - RNA, 19 nt, Homo sapiens
gcaagacauauguuauaag

SEQ ID NO: 1560364 - RNA, 19 nt, Homo sapiens
aaucuacaagcaagacaua

SEQ ID NO: 1560365 - RNA, 19 nt, Homo sapiens
gacgaaagaagaauauacu

SEQ ID NO: 1560366 - RNA, 19 nt, Homo sapiens
ccugugugcauuauaaauu

SEQ ID NO: 1560367 - RNA, 19 nt, Homo sapiens
caucucccucugcgacuua

SEQ ID NO: 1560368 - RNA, 19 nt, Homo sapiens
gcauuaucccuguaugaca

SEQ ID NO: 1560369 - RNA, 19 nt, Homo sapiens
gcucaguugaauauggaua

SEQ ID NO: 1560370 - RNA, 19 nt, Homo sapiens
ucuccucgcugaaccuuag

SEQ ID NO: 1560371 - RNA, 19 nt, Homo sapiens
ucaccaaugcgcagacgaa

SEQ ID NO: 1560372 - RNA, 19 nt, Homo sapiens
guucuacauuugucugucu

SEQ ID NO: 1560373 - RNA, 19 nt, Homo sapiens
cuaaggaacaugaugacau

SEQ ID NO: 1560374 - RNA, 19 nt, Homo sapiens
uagcauuaucccuguauga

SEQ ID NO: 1560375 - RNA, 19 nt, Homo sapiens
aaccagcgauggcaacuac

SEQ ID NO: 1560376 - RNA, 19 nt, Homo sapiens
cgacuuaaagaagcagauu

SEQ ID NO: 1560377 - RNA, 19 nt, Homo sapiens
ucgcugaaccuuaggaauc

SEQ ID NO: 1560378 - RNA, 19 nt, Homo sapiens
ccauguccugugugcauua

SEQ ID NO: 1560379 - RNA, 19 nt, Homo sapiens
gguaauuugugcccguaac

SEQ ID NO: 1560380 - RNA, 19 nt, Homo sapiens
acagcucaguugaauaugg

SEQ ID NO: 1560381 - RNA, 19 nt, Homo sapiens
gauaccgucaccuuugaug

SEQ ID NO: 1560382 - RNA, 19 nt, Homo sapiens
augauaccgucaccuuuga

SEQ ID NO: 1560383 - RNA, 19 nt, Homo sapiens
cacauugcuuuuaccuuua

SEQ ID NO: 1560384 - RNA, 19 nt, Homo sapiens
guaauuugugcccguaaca

SEQ ID NO: 1560385 - RNA, 19 nt, Homo sapiens
cugaucauaguacauauug

SEQ ID NO: 1560386 - RNA, 19 nt, Homo sapiens
guuauaagucgaacugaac

SEQ ID NO: 1560387 - RNA, 19 nt, Homo sapiens
ggagguguuaaaucuacaa

SEQ ID NO: 1560388 - RNA, 19 nt, Homo sapiens
cagcgauggcaacuacaaa

SEQ ID NO: 1560389 - RNA, 19 nt, Homo sapiens
guccuucggugucuuugag

SEQ ID NO: 1560390 - RNA, 19 nt, Homo sapiens
agacgaaagaagaauauac

SEQ ID NO: 1560391 - RNA, 19 nt, Homo sapiens
cagacgaaagaagaauaua

SEQ ID NO: 1560392 - RNA, 19 nt, Homo sapiens
gaccugcagaucaccaaug

SEQ ID NO: 1560393 - RNA, 19 nt, Homo sapiens
gaggagagcuguggauuga

SEQ ID NO: 1560394 - RNA, 19 nt, Homo sapiens
gaaauuauugcaacaggaa

SEQ ID NO: 1560395 - RNA, 19 nt, Homo sapiens
gcagauguaguuuccauuu

SEQ ID NO: 1560396 - RNA, 19 nt, Homo sapiens
gagcagaucucagcuuucu

SEQ ID NO: 1560397 - RNA, 19 nt, Homo sapiens
gaacccaagguacuagaua

SEQ ID NO: 1560398 - RNA, 19 nt, Homo sapiens
gacagggucuugcuauguu

SEQ ID NO: 1560399 - RNA, 19 nt, Homo sapiens
ggacuacaguggcacaauc

SEQ ID NO: 1560400 - RNA, 19 nt, Homo sapiens
cauaugaacuguggcuuug

SEQ ID NO: 1560401 - RNA, 19 nt, Homo sapiens
caacaggaaucuuuuguau

SEQ ID NO: 1560402 - RNA, 19 nt, Homo sapiens
cauauuaguuuaccaucug

SEQ ID NO: 1560403 - RNA, 19 nt, Homo sapiens
ucacuucuguaaauggaaa

SEQ ID NO: 1560404 - RNA, 19 nt, Homo sapiens
ggcaggagaugacaggaau

SEQ ID NO: 1560405 - RNA, 19 nt, Homo sapiens
caccucaaccucuagaaua

SEQ ID NO: 1560406 - RNA, 19 nt, Homo sapiens
gaugacaggaauccaguuu

SEQ ID NO: 1560407 - RNA, 19 nt, Homo sapiens
gcuccacccuacagaaaug

SEQ ID NO: 1560408 - RNA, 19 nt, Homo sapiens
uggagcagaucucagcuuu

SEQ ID NO: 1560409 - RNA, 19 nt, Homo sapiens
gagcagggcaacucccaaa

SEQ ID NO: 1560410 - RNA, 19 nt, Homo sapiens
ggaggagagcuguggauug

SEQ ID NO: 1560411 - RNA, 19 nt, Homo sapiens
guacccaaucuucccuuua

SEQ ID NO: 1560412 - RNA, 19 nt, Homo sapiens
cccaaacugugaccucuga

SEQ ID NO: 1560413 - RNA, 19 nt, Homo sapiens
ccaccaauaccaaagagaa

SEQ ID NO: 1560414 - RNA, 19 nt, Homo sapiens
ccaccuucuuucaguguuu

SEQ ID NO: 1560415 - RNA, 19 nt, Homo sapiens
acaggaaucuuuuguauca

SEQ ID NO: 1560416 - RNA, 19 nt, Homo sapiens
ccaccacaccuggcuauuu

SEQ ID NO: 1560417 - RNA, 19 nt, Homo sapiens
cagcagauguaguuuccau

SEQ ID NO: 1560418 - RNA, 19 nt, Homo sapiens
gugagcagcagauguaguu

SEQ ID NO: 1560419 - RNA, 19 nt, Homo sapiens
ugaagaacccaagguacua

SEQ ID NO: 1560420 - RNA, 19 nt, Homo sapiens
uaucacuucuguaaaugga

SEQ ID NO: 1560421 - RNA, 19 nt, Homo sapiens
gaacuccugggcuuaagug

SEQ ID NO: 1560422 - RNA, 19 nt, Homo sapiens
ccaccacgcccagcuaauu

SEQ ID NO: 1560423 - RNA, 19 nt, Homo sapiens
cagauguaguuuccauuuc

SEQ ID NO: 1560424 - RNA, 19 nt, Homo sapiens
uacccaaucuucccuuuag

SEQ ID NO: 1560425 - RNA, 19 nt, Homo sapiens
gggccuagagucagagaaa

SEQ ID NO: 1560426 - RNA, 19 nt, Homo sapiens
cacaaauccuguucuccuu

SEQ ID NO: 1560427 - RNA, 19 nt, Homo sapiens
caccacaccuggcuauuuu

SEQ ID NO: 1560428 - RNA, 19 nt, Homo sapiens
ggccaaacuucagccuuga

SEQ ID NO: 1560429 - RNA, 19 nt, Homo sapiens
gcacaaucucaacucacua

SEQ ID NO: 1560430 - RNA, 19 nt, Homo sapiens
cagggcaacucccaaacug

SEQ ID NO: 1560431 - RNA, 19 nt, Homo sapiens
caccuucuuucaguguuua

SEQ ID NO: 1560432 - RNA, 19 nt, Homo sapiens
ucucagaguguugggauua

SEQ ID NO: 1560433 - RNA, 19 nt, Homo sapiens
ggcacaaucucaacucacu

SEQ ID NO: 1560434 - RNA, 19 nt, Homo sapiens
agagacagauuugccacaa

SEQ ID NO: 1560435 - RNA, 19 nt, Homo sapiens
gaagaacccaagguacuag

SEQ ID NO: 1560436 - RNA, 19 nt, Homo sapiens
gagcagcagauguaguuuc

SEQ ID NO: 1560437 - RNA, 19 nt, Homo sapiens
ugccaucaauagaagguaa

SEQ ID NO: 1560438 - RNA, 19 nt, Homo sapiens
gaaaaccagucucauuugc

SEQ ID NO: 1560439 - RNA, 19 nt, Homo sapiens
ucauaugaacuguggcuuu

SEQ ID NO: 1560440 - RNA, 19 nt, Homo sapiens
caccacgcccagcuaauuu

SEQ ID NO: 1560441 - RNA, 19 nt, Homo sapiens
ugggugagcagcagaugua

SEQ ID NO: 1560442 - RNA, 19 nt, Homo sapiens
gagacagauuugccacaag

SEQ ID NO: 1560443 - RNA, 19 nt, Homo sapiens
ggaaaaccagucucauuug

SEQ ID NO: 1560444 - RNA, 19 nt, Homo sapiens
cccagggacugacccaaga

SEQ ID NO: 1560445 - RNA, 19 nt, Homo sapiens
ccauauuaguuuaccaucu

SEQ ID NO: 1560446 - RNA, 19 nt, Homo sapiens
caccucagucucccuagua

SEQ ID NO: 1560447 - RNA, 19 nt, Homo sapiens
aaacugugaccucugauca

SEQ ID NO: 1560448 - RNA, 19 nt, Homo sapiens
ucauuugccaucaauagaa

SEQ ID NO: 1560449 - RNA, 19 nt, Homo sapiens
ccucccaccucaaccucua

SEQ ID NO: 1560450 - RNA, 19 nt, Homo sapiens
gacccaagaugccguugac

SEQ ID NO: 1560451 - RNA, 19 nt, Homo sapiens
agaugaagaacccaaggua

SEQ ID NO: 1560452 - RNA, 19 nt, Homo sapiens
gacacggucucaccauacu

SEQ ID NO: 1560453 - RNA, 19 nt, Homo sapiens
cgaagccaccaauaccaaa

SEQ ID NO: 1560454 - RNA, 19 nt, Homo sapiens
gcaacaggaaucuuuugua

SEQ ID NO: 1560455 - RNA, 19 nt, Homo sapiens
gcuaggcuuacuuauaaug

SEQ ID NO: 1560456 - RNA, 19 nt, Homo sapiens
guccagagagacagauuug

SEQ ID NO: 1560457 - RNA, 19 nt, Homo sapiens
cuccugggcuuaagugauc

SEQ ID NO: 1560458 - RNA, 19 nt, Homo sapiens
ugaaacagggucucacucu

SEQ ID NO: 1560459 - RNA, 19 nt, Homo sapiens
gaggccagcguccaguuug

SEQ ID NO: 1560460 - RNA, 19 nt, Homo sapiens
cagugccucugcucagcua

SEQ ID NO: 1560461 - RNA, 19 nt, Homo sapiens
uauugcaacaggaaucuuu

SEQ ID NO: 1560462 - RNA, 19 nt, Homo sapiens
cuacagccucgaacuccua

SEQ ID NO: 1560463 - RNA, 19 nt, Homo sapiens
ccucaccaccgcuguguug

SEQ ID NO: 1560464 - RNA, 19 nt, Homo sapiens
gcagggcaacucccaaacu

SEQ ID NO: 1560465 - RNA, 19 nt, Homo sapiens
cauuugccaucaauagaag

SEQ ID NO: 1560466 - RNA, 19 nt, Homo sapiens
cuccugggcucaagugauc

SEQ ID NO: 1560467 - RNA, 19 nt, Homo sapiens
gaagccaccaauaccaaag

SEQ ID NO: 1560468 - RNA, 19 nt, Homo sapiens
gaccagccaccuccaccuu

SEQ ID NO: 1560469 - RNA, 19 nt, Homo sapiens
uguaucacuucuguaaaug

SEQ ID NO: 1560470 - RNA, 19 nt, Homo sapiens
uaguuuaccaucuguacaa

SEQ ID NO: 1560471 - RNA, 19 nt, Homo sapiens
ccaccucagucucccuagu

SEQ ID NO: 1560472 - RNA, 19 nt, Homo sapiens
augcugggauuacagguau

SEQ ID NO: 1560473 - RNA, 19 nt, Homo sapiens
ccaccucaaccucuagaau

SEQ ID NO: 1560474 - RNA, 19 nt, Homo sapiens
guggcacaaucucaacuca

SEQ ID NO: 1560475 - RNA, 19 nt, Homo sapiens
cuaggaaaauacacaaaga

SEQ ID NO: 1560476 - RNA, 19 nt, Homo sapiens
gugaaggccggaccagugu

SEQ ID NO: 1560477 - RNA, 19 nt, Homo sapiens
ccaaaaugcugggauuaca

SEQ ID NO: 1560478 - RNA, 19 nt, Homo sapiens
ccaccuccaccuucuuuca

SEQ ID NO: 1560479 - RNA, 19 nt, Homo sapiens
aacccaagguacuagauag

SEQ ID NO: 1560480 - RNA, 19 nt, Homo sapiens
uggaaaaccagucucauuu

SEQ ID NO: 1560481 - RNA, 19 nt, Homo sapiens
acagggucuugcuauguug

SEQ ID NO: 1560482 - RNA, 19 nt, Homo sapiens
caacuccugggcucaagug

SEQ ID NO: 1560483 - RNA, 19 nt, Homo sapiens
gcucugaggacugguaugg

SEQ ID NO: 1560484 - RNA, 19 nt, Homo sapiens
ccagccaccuccaccuucu

SEQ ID NO: 1560485 - RNA, 19 nt, Homo sapiens
gccaggcuauguggacuag

SEQ ID NO: 1560486 - RNA, 19 nt, Homo sapiens
cuacaguggcacaaucuca

SEQ ID NO: 1560487 - RNA, 19 nt, Homo sapiens
ggacaagaguuuccuccua

SEQ ID NO: 1560488 - RNA, 19 nt, Homo sapiens
gaacguggaugaagacucu

SEQ ID NO: 1560489 - RNA, 19 nt, Homo sapiens
gaggaaagcgcaaaggaaa

SEQ ID NO: 1560490 - RNA, 19 nt, Homo sapiens
ggaaagcgcaaaggaaauu

SEQ ID NO: 1560491 - RNA, 19 nt, Homo sapiens
gcgcaaaggaaauuacuga

SEQ ID NO: 1560492 - RNA, 19 nt, Homo sapiens
gaaagcgcaaaggaaauua

SEQ ID NO: 1560493 - RNA, 19 nt, Homo sapiens
gccacugcaucaucagaua

SEQ ID NO: 1560494 - RNA, 19 nt, Homo sapiens
gcaaaggaaauuacugaag

SEQ ID NO: 1560495 - RNA, 19 nt, Homo sapiens
ucaaguuccucaucuacga

SEQ ID NO: 1560496 - RNA, 19 nt, Homo sapiens
ccacugacacaaccagaaa

SEQ ID NO: 1560497 - RNA, 19 nt, Homo sapiens
uagaccgacuucugcagua

SEQ ID NO: 1560498 - RNA, 19 nt, Homo sapiens
uaaaagggcugcuguacag

SEQ ID NO: 1560499 - RNA, 19 nt, Homo sapiens
gcacacacgaguccagcuu

SEQ ID NO: 1560500 - RNA, 19 nt, Homo sapiens
acgagaacguggaugaaga

SEQ ID NO: 1560501 - RNA, 19 nt, Homo sapiens
gaaaaggcguaaacaugca

SEQ ID NO: 1560502 - RNA, 19 nt, Homo sapiens
ccacugcaucaucagauaa

SEQ ID NO: 1560503 - RNA, 19 nt, Homo sapiens
ucggagguguuuauugaug

SEQ ID NO: 1560504 - RNA, 19 nt, Homo sapiens
ggacgaugccuuggaugga

SEQ ID NO: 1560505 - RNA, 19 nt, Homo sapiens
aaaggaaauuacugaaggu

SEQ ID NO: 1560506 - RNA, 19 nt, Homo sapiens
ugaggaaagcgcaaaggaa

SEQ ID NO: 1560507 - RNA, 19 nt, Homo sapiens
gaagcggaagcucaaguuc

SEQ ID NO: 1560508 - RNA, 19 nt, Homo sapiens
acaagaguuuccuccuaga

SEQ ID NO: 1560509 - RNA, 19 nt, Homo sapiens
cagaaaaggcguaaacaug

SEQ ID NO: 1560510 - RNA, 19 nt, Homo sapiens
gaagcucaaguuccucauc

SEQ ID NO: 1560511 - RNA, 19 nt, Homo sapiens
guacgagaacguggaugaa

SEQ ID NO: 1560512 - RNA, 19 nt, Homo sapiens
ugaagcggaagcucaaguu

SEQ ID NO: 1560513 - RNA, 19 nt, Homo sapiens
gagcugaggaaagcgcaaa

SEQ ID NO: 1560514 - RNA, 19 nt, Homo sapiens
cccauucccuucugacuac

SEQ ID NO: 1560515 - RNA, 19 nt, Homo sapiens
cggcgaaguggacuacaaa

SEQ ID NO: 1560516 - RNA, 19 nt, Homo sapiens
aagcucaaguuccucaucu

SEQ ID NO: 1560517 - RNA, 19 nt, Homo sapiens
gcucaaguuccucaucuac

SEQ ID NO: 1560518 - RNA, 19 nt, Homo sapiens
gaaguuucuguauuaaagg

SEQ ID NO: 1560519 - RNA, 19 nt, Homo sapiens
gcuguacagggcuagguuu

SEQ ID NO: 1560520 - RNA, 19 nt, Homo sapiens
gcaguacgagaacguggau

SEQ ID NO: 1560521 - RNA, 19 nt, Homo sapiens
gaucgacaucccggaguga

SEQ ID NO: 1560522 - RNA, 19 nt, Homo sapiens
ggacgucgcuguugaaaug

SEQ ID NO: 1560523 - RNA, 19 nt, Homo sapiens
gaaaggacgucgcuguuga

SEQ ID NO: 1560524 - RNA, 19 nt, Homo sapiens
gaggauaacuugaaacuag

SEQ ID NO: 1560525 - RNA, 19 nt, Homo sapiens
gaaacccugucucuccuaa

SEQ ID NO: 1560526 - RNA, 19 nt, Homo sapiens
gagaccagccugaccaaua

SEQ ID NO: 1560527 - RNA, 19 nt, Homo sapiens
gaaucagucuugucaaaca

SEQ ID NO: 1560528 - RNA, 19 nt, Homo sapiens
gaaagaggacuacaagcaa

SEQ ID NO: 1560529 - RNA, 19 nt, Homo sapiens
uuacaggucucuauuuaug

SEQ ID NO: 1560530 - RNA, 19 nt, Homo sapiens
ggaacggcuucucaucuuu

SEQ ID NO: 1560531 - RNA, 19 nt, Homo sapiens
gaaaugagggagaggacua

SEQ ID NO: 1560532 - RNA, 19 nt, Homo sapiens
gguguugcaugauugauuu

SEQ ID NO: 1560533 - RNA, 19 nt, Homo sapiens
gggaaucagugucuuacaa

SEQ ID NO: 1560534 - RNA, 19 nt, Homo sapiens
gcgaugggauuaguaguuu

SEQ ID NO: 1560535 - RNA, 19 nt, Homo sapiens
gaaauguagucccaagcuu

SEQ ID NO: 1560536 - RNA, 19 nt, Homo sapiens
gaacgaugacuacaaacaa

SEQ ID NO: 1560537 - RNA, 19 nt, Homo sapiens
gacauacaccugacuagua

SEQ ID NO: 1560538 - RNA, 19 nt, Homo sapiens
caagcaagauggcggaaga

SEQ ID NO: 1560539 - RNA, 19 nt, Homo sapiens
ggaaagaggacuacaagca

SEQ ID NO: 1560540 - RNA, 19 nt, Homo sapiens
aaaauuagcuggacgugua

SEQ ID NO: 1560541 - RNA, 19 nt, Homo sapiens
gacgaagucucgcuauguu

SEQ ID NO: 1560542 - RNA, 19 nt, Homo sapiens
guucacuguucaucauuua

SEQ ID NO: 1560543 - RNA, 19 nt, Homo sapiens
ugaauuugguguugcauga

SEQ ID NO: 1560544 - RNA, 19 nt, Homo sapiens
gaccagcaauggccaguau

SEQ ID NO: 1560545 - RNA, 19 nt, Homo sapiens
gcucacgccuguaaucuca

SEQ ID NO: 1560546 - RNA, 19 nt, Homo sapiens
acaggucucuauuuaugua

SEQ ID NO: 1560547 - RNA, 19 nt, Homo sapiens
caaguucacuguucaucau

SEQ ID NO: 1560548 - RNA, 19 nt, Homo sapiens
gcaggaaucagucuuguca

SEQ ID NO: 1560549 - RNA, 19 nt, Homo sapiens
gugagaggauaacuugaaa

SEQ ID NO: 1560550 - RNA, 19 nt, Homo sapiens
agaccagccugaccaauau

SEQ ID NO: 1560551 - RNA, 19 nt, Homo sapiens
ccuguaaucucagcacuuu

SEQ ID NO: 1560552 - RNA, 19 nt, Homo sapiens
agaguucgcuccugugaga

SEQ ID NO: 1560553 - RNA, 19 nt, Homo sapiens
agaaggaccuggagucaca

SEQ ID NO: 1560554 - RNA, 19 nt, Homo sapiens
ggagagggaacgaugacua

SEQ ID NO: 1560555 - RNA, 19 nt, Homo sapiens
caaacaagauggccuucuc

SEQ ID NO: 1560556 - RNA, 19 nt, Homo sapiens
uauccucacugcuugaauu

SEQ ID NO: 1560557 - RNA, 19 nt, Homo sapiens
ccaauguucuugucaccaa

SEQ ID NO: 1560558 - RNA, 19 nt, Homo sapiens
gcucaggcuuuaucaguca

SEQ ID NO: 1560559 - RNA, 19 nt, Homo sapiens
gcaggcuccucccagauug

SEQ ID NO: 1560560 - RNA, 19 nt, Homo sapiens
gaaggcagcaggaaucagu

SEQ ID NO: 1560561 - RNA, 19 nt, Homo sapiens
gaaggagagggaacgauga

SEQ ID NO: 1560562 - RNA, 19 nt, Homo sapiens
ucaaaccaaucaaucaauc

SEQ ID NO: 1560563 - RNA, 19 nt, Homo sapiens
gagaaaggacgucgcuguu

SEQ ID NO: 1560564 - RNA, 19 nt, Homo sapiens
ccaccaaguucacuguuca

SEQ ID NO: 1560565 - RNA, 19 nt, Homo sapiens
cgacugagguacuacaaac

SEQ ID NO: 1560566 - RNA, 19 nt, Homo sapiens
ggugagaggauaacuugaa

SEQ ID NO: 1560567 - RNA, 19 nt, Homo sapiens
aaagauggcaggcuaccua

SEQ ID NO: 1560568 - RNA, 19 nt, Homo sapiens
gaaaccccaucucuacuaa

SEQ ID NO: 1560569 - RNA, 19 nt, Homo sapiens
ccacuacacccagcuaauu

SEQ ID NO: 1560570 - RNA, 19 nt, Homo sapiens
aggaaucagucuugucaaa

SEQ ID NO: 1560571 - RNA, 19 nt, Homo sapiens
gcuugaggcugagagauug

SEQ ID NO: 1560572 - RNA, 19 nt, Homo sapiens
gaacaauggaaaggugaaa

SEQ ID NO: 1560573 - RNA, 19 nt, Homo sapiens
gaccagccaaggcaacaua

SEQ ID NO: 1560574 - RNA, 19 nt, Homo sapiens
ugaacagccuggcgggaaa

SEQ ID NO: 1560575 - RNA, 19 nt, Homo sapiens
gguggaaugugccuguaau

SEQ ID NO: 1560576 - RNA, 19 nt, Homo sapiens
gaacggcuucucaucuuuc

SEQ ID NO: 1560577 - RNA, 19 nt, Homo sapiens
caaauggaacggcuucuca

SEQ ID NO: 1560578 - RNA, 19 nt, Homo sapiens
ggaacgaugacuacaaaca

SEQ ID NO: 1560579 - RNA, 19 nt, Homo sapiens
agggaacgaugacuacaaa

SEQ ID NO: 1560580 - RNA, 19 nt, Homo sapiens
acauacaccugacuaguag

SEQ ID NO: 1560581 - RNA, 19 nt, Homo sapiens
ccuauaaucccaacacuuc

SEQ ID NO: 1560582 - RNA, 19 nt, Homo sapiens
ccuaaguguugggauuaua

SEQ ID NO: 1560583 - RNA, 19 nt, Homo sapiens
cgaggagacuaccguaaag

SEQ ID NO: 1560584 - RNA, 19 nt, Homo sapiens
gcgaggacuuguugguugu

SEQ ID NO: 1560585 - RNA, 19 nt, Homo sapiens
uggaacggcuucucaucuu

SEQ ID NO: 1560586 - RNA, 19 nt, Homo sapiens
ggagacuaccguaaagaug

SEQ ID NO: 1560587 - RNA, 19 nt, Homo sapiens
ggagaaggaccuggaguca

SEQ ID NO: 1560588 - RNA, 19 nt, Homo sapiens
ggacauacaccugacuagu

SEQ ID NO: 1560589 - RNA, 19 nt, Homo sapiens
gcagcaggaaucagucuug

SEQ ID NO: 1560590 - RNA, 19 nt, Homo sapiens
gccacucgcugcauucaag

SEQ ID NO: 1560591 - RNA, 19 nt, Homo sapiens
gcuggccaguguaguguga

SEQ ID NO: 1560592 - RNA, 19 nt, Homo sapiens
guacuacaaacacgauuuc

SEQ ID NO: 1560593 - RNA, 19 nt, Homo sapiens
ggaaucagugucuuacaag

SEQ ID NO: 1560594 - RNA, 19 nt, Homo sapiens
ccucagaccuccgggaauc

SEQ ID NO: 1560595 - RNA, 19 nt, Homo sapiens
aaauguagucccaagcuuu

SEQ ID NO: 1560596 - RNA, 19 nt, Homo sapiens
gagaggauaacuugaaacu

SEQ ID NO: 1560597 - RNA, 19 nt, Homo sapiens
gaacuccuggccacaagug

SEQ ID NO: 1560598 - RNA, 19 nt, Homo sapiens
guugcaggaucauaguuug

SEQ ID NO: 1560599 - RNA, 19 nt, Homo sapiens
ggacuuguugguugugguu

SEQ ID NO: 1560600 - RNA, 19 nt, Homo sapiens
gagggaacgaugacuacaa

SEQ ID NO: 1560601 - RNA, 19 nt, Homo sapiens
ucaacugccuaugcaaaug

SEQ ID NO: 1560602 - RNA, 19 nt, Homo sapiens
ccauucgacugagguacua

SEQ ID NO: 1560603 - RNA, 19 nt, Homo sapiens
gauccgggaauaaagaaug

SEQ ID NO: 1560604 - RNA, 19 nt, Homo sapiens
ccucacugcuugaauuugg

SEQ ID NO: 1560605 - RNA, 19 nt, Homo sapiens
gguacuacaaacacgauuu

SEQ ID NO: 1560606 - RNA, 19 nt, Homo sapiens
gguccuccagcgucuguua

SEQ ID NO: 1560607 - RNA, 19 nt, Homo sapiens
gggcaccucccacucgauu

SEQ ID NO: 1560608 - RNA, 19 nt, Homo sapiens
gaggugcgaugggauuagu

SEQ ID NO: 1560609 - RNA, 19 nt, Homo sapiens
gcuccuggacauacuacua

SEQ ID NO: 1560610 - RNA, 19 nt, Homo sapiens
gagauugagccugcaguga

SEQ ID NO: 1560611 - RNA, 19 nt, Homo sapiens
guugcaugauugauuucua

SEQ ID NO: 1560612 - RNA, 19 nt, Homo sapiens
ggaaauguagucccaagcu

SEQ ID NO: 1560613 - RNA, 19 nt, Homo sapiens
cagccuggcgggaaaugua

SEQ ID NO: 1560614 - RNA, 19 nt, Homo sapiens
gcauucaagucuagaugac

SEQ ID NO: 1560615 - RNA, 19 nt, Homo sapiens
ugcaguggcucacgccuau

SEQ ID NO: 1560616 - RNA, 19 nt, Homo sapiens
ccaaucaaucaaucaauca

SEQ ID NO: 1560617 - RNA, 19 nt, Homo sapiens
ucaccaaagugcccaacuc

SEQ ID NO: 1560618 - RNA, 19 nt, Homo sapiens
caauguucuugucaccaaa

SEQ ID NO: 1560619 - RNA, 19 nt, Homo sapiens
gacauacuacuaagugcuu

SEQ ID NO: 1560620 - RNA, 19 nt, Homo sapiens
gagguggagguuacaguga

SEQ ID NO: 1560621 - RNA, 19 nt, Homo sapiens
caucucacuucuccaccaa

SEQ ID NO: 1560622 - RNA, 19 nt, Homo sapiens
ucaauuagauggcaaagga

SEQ ID NO: 1560623 - RNA, 19 nt, Homo sapiens
acacacacguggcaucuua

SEQ ID NO: 1560624 - RNA, 19 nt, Homo sapiens
gccaggaggucacuuauug

SEQ ID NO: 1560625 - RNA, 19 nt, Homo sapiens
gauagaagccuuugucugu

SEQ ID NO: 1560626 - RNA, 19 nt, Homo sapiens
gaagccaggaggucacuua

SEQ ID NO: 1560627 - RNA, 19 nt, Homo sapiens
gagcuucccuguggcauga

SEQ ID NO: 1560628 - RNA, 19 nt, Homo sapiens
ucucagaccuugcacaaug

SEQ ID NO: 1560629 - RNA, 19 nt, Homo sapiens
aagaugggcuucaauuaga

SEQ ID NO: 1560630 - RNA, 19 nt, Homo sapiens
gagccaggaugaaauguca

SEQ ID NO: 1560631 - RNA, 19 nt, Homo sapiens
gaacaaccagcgcugcaaa

SEQ ID NO: 1560632 - RNA, 19 nt, Homo sapiens
ggaacaagggccagguuaa

SEQ ID NO: 1560633 - RNA, 19 nt, Homo sapiens
ggccagggagugaguguua

SEQ ID NO: 1560634 - RNA, 19 nt, Homo sapiens
ggacauccucgccuucuau

SEQ ID NO: 1560635 - RNA, 19 nt, Homo sapiens
ucucugaccucacccuauu

SEQ ID NO: 1560636 - RNA, 19 nt, Homo sapiens
cgacggagacugcuucaug

SEQ ID NO: 1560637 - RNA, 19 nt, Homo sapiens
gaacaagggccagguuaag

SEQ ID NO: 1560638 - RNA, 19 nt, Homo sapiens
caccaggccuucaccaguu

SEQ ID NO: 1560639 - RNA, 19 nt, Homo sapiens
cagaggcagacaccuauua

SEQ ID NO: 1560640 - RNA, 19 nt, Homo sapiens
ggaguugucucuuuucaug

SEQ ID NO: 1560641 - RNA, 19 nt, Homo sapiens
uuacagagccaggaugaaa

SEQ ID NO: 1560642 - RNA, 19 nt, Homo sapiens
gaccucacccuauucauca

SEQ ID NO: 1560643 - RNA, 19 nt, Homo sapiens
gcaaaacccgaaaccguua

SEQ ID NO: 1560644 - RNA, 19 nt, Homo sapiens
gcaagugggcuggaacaug

SEQ ID NO: 1560645 - RNA, 19 nt, Homo sapiens
ccugaggccugaccacaug

SEQ ID NO: 1560646 - RNA, 19 nt, Homo sapiens
gaagcagacgggagcagaa

SEQ ID NO: 1560647 - RNA, 19 nt, Homo sapiens
cguuacaucugccaguuug

SEQ ID NO: 1560648 - RNA, 19 nt, Homo sapiens
gggcuuggcguccuuuguu

SEQ ID NO: 1560649 - RNA, 19 nt, Homo sapiens
gaacaggaaggagaguuuc

SEQ ID NO: 1560650 - RNA, 19 nt, Homo sapiens
caagaccaaccuccaucua

SEQ ID NO: 1560651 - RNA, 19 nt, Homo sapiens
caagugagggucuuaaugc

SEQ ID NO: 1560652 - RNA, 19 nt, Homo sapiens
ccauggacgucucaacauc

SEQ ID NO: 1560653 - RNA, 19 nt, Homo sapiens
agaccaaccuccaucuaag

SEQ ID NO: 1560654 - RNA, 19 nt, Homo sapiens
ggaaggagaguuucuugcu

SEQ ID NO: 1560655 - RNA, 19 nt, Homo sapiens
gaucaagagccagaaagug

SEQ ID NO: 1560656 - RNA, 19 nt, Homo sapiens
ggcagacaccuauuacaga

SEQ ID NO: 1560657 - RNA, 19 nt, Homo sapiens
ugaacaggaaggagaguuu

SEQ ID NO: 1560658 - RNA, 19 nt, Homo sapiens
cagcugccuucaacuggaa

SEQ ID NO: 1560659 - RNA, 19 nt, Homo sapiens
ggagugcucgugcgucugu

SEQ ID NO: 1560660 - RNA, 19 nt, Homo sapiens
gccagaaguugggcagaga

SEQ ID NO: 1560661 - RNA, 19 nt, Homo sapiens
uggacacacugauuacuca

SEQ ID NO: 1560662 - RNA, 19 nt, Homo sapiens
gaaguggucagccuauggu

SEQ ID NO: 1560663 - RNA, 19 nt, Homo sapiens
gccagaaagugcaggacau

SEQ ID NO: 1560664 - RNA, 19 nt, Homo sapiens
cauccagccugagaaacaa

SEQ ID NO: 1560665 - RNA, 19 nt, Homo sapiens
gaccuugccugggcuugug

SEQ ID NO: 1560666 - RNA, 19 nt, Homo sapiens
aagaccaaccuccaucuaa

SEQ ID NO: 1560667 - RNA, 19 nt, Homo sapiens
agacaaucguccccuauaa

SEQ ID NO: 1560668 - RNA, 19 nt, Homo sapiens
guggucagccuaugguuug

SEQ ID NO: 1560669 - RNA, 19 nt, Homo sapiens
cucgaaaccacaauuaauu

SEQ ID NO: 1560670 - RNA, 19 nt, Homo sapiens
ggacuccaaggcucauaga

SEQ ID NO: 1560671 - RNA, 19 nt, Homo sapiens
ucaagugagggucuuaaug

SEQ ID NO: 1560672 - RNA, 19 nt, Homo sapiens
gcagauggcaagggugugu

SEQ ID NO: 1560673 - RNA, 19 nt, Homo sapiens
acgaggugauugacaguga

SEQ ID NO: 1560674 - RNA, 19 nt, Homo sapiens
gcaacucucgaaaccacaa

SEQ ID NO: 1560675 - RNA, 19 nt, Homo sapiens
uccuggagauugugaauag

SEQ ID NO: 1560676 - RNA, 19 nt, Homo sapiens
ggaacaaccagcgcugcaa

SEQ ID NO: 1560677 - RNA, 19 nt, Homo sapiens
ggugagugcccagcugauu

SEQ ID NO: 1560678 - RNA, 19 nt, Homo sapiens
gcacacacacguggcaucu

SEQ ID NO: 1560679 - RNA, 19 nt, Homo sapiens
ugucucaggcugcuucaaa

SEQ ID NO: 1560680 - RNA, 19 nt, Homo sapiens
gaggucaacgggaagacaa

SEQ ID NO: 1560681 - RNA, 19 nt, Homo sapiens
uggaacaagggccagguua

SEQ ID NO: 1560682 - RNA, 19 nt, Homo sapiens
ucucgaaaccacaauuaau

SEQ ID NO: 1560683 - RNA, 19 nt, Homo sapiens
gcucgggguuguucaagaa

SEQ ID NO: 1560684 - RNA, 19 nt, Homo sapiens
ccagggcucaccuacaaga

SEQ ID NO: 1560685 - RNA, 19 nt, Homo sapiens
ccagaucaagagccagaaa

SEQ ID NO: 1560686 - RNA, 19 nt, Homo sapiens
ccacuggcaacucucgaaa

SEQ ID NO: 1560687 - RNA, 19 nt, Homo sapiens
ggcuuggcguccuuuguug

SEQ ID NO: 1560688 - RNA, 19 nt, Homo sapiens
ccaggaggucacuuauuga

SEQ ID NO: 1560689 - RNA, 19 nt, Homo sapiens
cuucagaggcagacaccua

SEQ ID NO: 1560690 - RNA, 19 nt, Homo sapiens
gugagugcccagcugauug

SEQ ID NO: 1560691 - RNA, 19 nt, Homo sapiens
caggaaggagaguuucuug

SEQ ID NO: 1560692 - RNA, 19 nt, Homo sapiens
cgaaaccacaauuaauuac

SEQ ID NO: 1560693 - RNA, 19 nt, Homo sapiens
ugaccucacccuauucauc

SEQ ID NO: 1560694 - RNA, 19 nt, Homo sapiens
ccauccagccugagaaaca

SEQ ID NO: 1560695 - RNA, 19 nt, Homo sapiens
ccuacaagaccgccaagga

SEQ ID NO: 1560696 - RNA, 19 nt, Homo sapiens
acucucgaaaccacaauua

SEQ ID NO: 1560697 - RNA, 19 nt, Homo sapiens
ucaccagccucccucuuuu

SEQ ID NO: 1560698 - RNA, 19 nt, Homo sapiens
gcuucauggugucuucaga

SEQ ID NO: 1560699 - RNA, 19 nt, Homo sapiens
ggcuucagcugccuucaac

SEQ ID NO: 1560700 - RNA, 19 nt, Homo sapiens
aggcuggacuggagugaca

SEQ ID NO: 1560701 - RNA, 19 nt, Homo sapiens
acagagccaggaugaaaug

SEQ ID NO: 1560702 - RNA, 19 nt, Homo sapiens
uauuacagagccaggauga

SEQ ID NO: 1560703 - RNA, 19 nt, Homo sapiens
gcccaccugucuggaacaa

SEQ ID NO: 1560704 - RNA, 19 nt, Homo sapiens
ggugauugacagugacuuc

SEQ ID NO: 1560705 - RNA, 19 nt, Homo sapiens
acacugugcaggugaaaca

SEQ ID NO: 1560706 - RNA, 19 nt, Homo sapiens
cauccucgccuucuaucug

SEQ ID NO: 1560707 - RNA, 19 nt, Homo sapiens
gugcacagggagaagagaa

SEQ ID NO: 1560708 - RNA, 19 nt, Homo sapiens
uaaaggagcuccaccaaag

SEQ ID NO: 1560709 - RNA, 19 nt, Homo sapiens
gcaaacggccuccucauug

SEQ ID NO: 1560710 - RNA, 19 nt, Homo sapiens
caaacggccuccucauuga

SEQ ID NO: 1560711 - RNA, 19 nt, Homo sapiens
ccaaauggccugggcaaua

SEQ ID NO: 1560712 - RNA, 19 nt, Homo sapiens
ccaaggagacuucgccaua

SEQ ID NO: 1560713 - RNA, 19 nt, Homo sapiens
gagauuaguucauuuagac

SEQ ID NO: 1560714 - RNA, 19 nt, Homo sapiens
gcagacauuuggacacaug

SEQ ID NO: 1560715 - RNA, 19 nt, Homo sapiens
ucaaugagcuggaggugau

SEQ ID NO: 1560716 - RNA, 19 nt, Homo sapiens
ggugugaugaggucuauua

SEQ ID NO: 1560717 - RNA, 19 nt, Homo sapiens
cauaggaguucacaggaaa

SEQ ID NO: 1560718 - RNA, 19 nt, Homo sapiens
ggaguucacaggaaauauu

SEQ ID NO: 1560719 - RNA, 19 nt, Homo sapiens
gcaucuggcuggacucaau

SEQ ID NO: 1560720 - RNA, 19 nt, Homo sapiens
gcucugcacugccaaaugg

SEQ ID NO: 1560721 - RNA, 19 nt, Homo sapiens
caaauggccugggcaauac

SEQ ID NO: 1560722 - RNA, 19 nt, Homo sapiens
ugacacugauucuuuggaa

SEQ ID NO: 1560723 - RNA, 19 nt, Homo sapiens
caggaaauauugaaauguc

SEQ ID NO: 1560724 - RNA, 19 nt, Homo sapiens
cacaggaaauauugaaaug

SEQ ID NO: 1560725 - RNA, 19 nt, Homo sapiens
gcacagggagacccgcuuu

SEQ ID NO: 1560726 - RNA, 19 nt, Homo sapiens
gcaagguccuccucaugca

SEQ ID NO: 1560727 - RNA, 19 nt, Homo sapiens
caaggagacuucgccauag

SEQ ID NO: 1560728 - RNA, 19 nt, Homo sapiens
ccauaggaguucacaggaa

SEQ ID NO: 1560729 - RNA, 19 nt, Homo sapiens
caacauccuugcccuuguc

SEQ ID NO: 1560730 - RNA, 19 nt, Homo sapiens
gcggaggauuugaugaaga

SEQ ID NO: 1560731 - RNA, 19 nt, Homo sapiens
cggccgaccuggaugugua

SEQ ID NO: 1560732 - RNA, 19 nt, Homo sapiens
gacacugauucuuuggaaa

SEQ ID NO: 1560733 - RNA, 19 nt, Homo sapiens
cggaggauuugaugaagau

SEQ ID NO: 1560734 - RNA, 19 nt, Homo sapiens
gugcagacauuuggacaca

SEQ ID NO: 1560735 - RNA, 19 nt, Homo sapiens
ggucaugguucagcacauc

SEQ ID NO: 1560736 - RNA, 19 nt, Homo sapiens
ugaagauguuaaagcgaaa

SEQ ID NO: 1560737 - RNA, 19 nt, Homo sapiens
gccgguggcuacagcaaga

SEQ ID NO: 1560738 - RNA, 19 nt, Homo sapiens
gcagagguacgaccacuac

SEQ ID NO: 1560739 - RNA, 19 nt, Homo sapiens
cacugauucuuuggaaaua

SEQ ID NO: 1560740 - RNA, 19 nt, Homo sapiens
gaguucacaggaaauauug

SEQ ID NO: 1560741 - RNA, 19 nt, Homo sapiens
gaaauaaagaguggaagcu

SEQ ID NO: 1560742 - RNA, 19 nt, Homo sapiens
cauugaguaugaagacaug

SEQ ID NO: 1560743 - RNA, 19 nt, Homo sapiens
agacuucgccauaggaguu

SEQ ID NO: 1560744 - RNA, 19 nt, Homo sapiens
gagacccgcuuugugaucu

SEQ ID NO: 1560745 - RNA, 19 nt, Homo sapiens
gagggcaacagguauguca

SEQ ID NO: 1560746 - RNA, 19 nt, Homo sapiens
acauggaguuugugcugaa

SEQ ID NO: 1560747 - RNA, 19 nt, Homo sapiens
ugaguaugaagacauguuu

SEQ ID NO: 1560748 - RNA, 19 nt, Homo sapiens
uuaaaggagcuccaccaaa

SEQ ID NO: 1560749 - RNA, 19 nt, Homo sapiens
acacugauucuuuggaaau

SEQ ID NO: 1560750 - RNA, 19 nt, Homo sapiens
aggauuugaugaagauguu

SEQ ID NO: 1560751 - RNA, 19 nt, Homo sapiens
gguacgaccacuacucugu

SEQ ID NO: 1560752 - RNA, 19 nt, Homo sapiens
ggagacccgcuuugugauc

SEQ ID NO: 1560753 - RNA, 19 nt, Homo sapiens
agggagacccgcuuuguga

SEQ ID NO: 1560754 - RNA, 19 nt, Homo sapiens
gagguacgaccacuacucu

SEQ ID NO: 1560755 - RNA, 19 nt, Homo sapiens
gaacagcacggggaaguug

SEQ ID NO: 1560756 - RNA, 19 nt, Homo sapiens
cccugcagcuggcuuucua

SEQ ID NO: 1560757 - RNA, 19 nt, Homo sapiens
ggauuugaugaagauguua

SEQ ID NO: 1560758 - RNA, 19 nt, Homo sapiens
gcuucuacgcggaggauuu

SEQ ID NO: 1560759 - RNA, 19 nt, Homo sapiens
uaggaguucacaggaaaua

SEQ ID NO: 1560760 - RNA, 19 nt, Homo sapiens
cuacacggccgaccuggau

SEQ ID NO: 1560761 - RNA, 19 nt, Homo sapiens
uuaaagcgaaaguggagaa

SEQ ID NO: 1560762 - RNA, 19 nt, Homo sapiens
gaggauuugaugaagaugu

SEQ ID NO: 1560763 - RNA, 19 nt, Homo sapiens
ugcaaacggccuccucauu

SEQ ID NO: 1560764 - RNA, 19 nt, Homo sapiens
cauuucagaugagauuagu

SEQ ID NO: 1560765 - RNA, 19 nt, Homo sapiens
gaggaguggcuggaggaaa

SEQ ID NO: 1560766 - RNA, 19 nt, Homo sapiens
gaaaugcgcugacaaaucu

SEQ ID NO: 1560767 - RNA, 19 nt, Homo sapiens
gcaggaggcuugacuguaa

SEQ ID NO: 1560768 - RNA, 19 nt, Homo sapiens
gagcugggauuacgucuaa

SEQ ID NO: 1560769 - RNA, 19 nt, Homo sapiens
caacuugccucucuauuau

SEQ ID NO: 1560770 - RNA, 19 nt, Homo sapiens
gggauuacgucuaagauuu

SEQ ID NO: 1560771 - RNA, 19 nt, Homo sapiens
gugcagacuuucaacauua

SEQ ID NO: 1560772 - RNA, 19 nt, Homo sapiens
gaucaaggauucggagaaa

SEQ ID NO: 1560773 - RNA, 19 nt, Homo sapiens
aaacagcgaucgagguaaa

SEQ ID NO: 1560774 - RNA, 19 nt, Homo sapiens
gcacugagcugaggaaagg

SEQ ID NO: 1560775 - RNA, 19 nt, Homo sapiens
ggaaugagacaaauaugaa

SEQ ID NO: 1560776 - RNA, 19 nt, Homo sapiens
gcgacaccaugaugauuua

SEQ ID NO: 1560777 - RNA, 19 nt, Homo sapiens
caacagacccaucaaguca

SEQ ID NO: 1560778 - RNA, 19 nt, Homo sapiens
ucaaugugauuccaguuaa

SEQ ID NO: 1560779 - RNA, 19 nt, Homo sapiens
ugaaauacaccuacgguuu

SEQ ID NO: 1560780 - RNA, 19 nt, Homo sapiens
gaacguuauucagaaguug

SEQ ID NO: 1560781 - RNA, 19 nt, Homo sapiens
gaucccagguuacggaaug

SEQ ID NO: 1560782 - RNA, 19 nt, Homo sapiens
gaaggcacucugucucuuu

SEQ ID NO: 1560783 - RNA, 19 nt, Homo sapiens
agucaucaauguacaguaa

SEQ ID NO: 1560784 - RNA, 19 nt, Homo sapiens
ggugcagacuuucaacauu

SEQ ID NO: 1560785 - RNA, 19 nt, Homo sapiens
ucaacgagcucaaugugau

SEQ ID NO: 1560786 - RNA, 19 nt, Homo sapiens
gcagaaagcaucucaaucc

SEQ ID NO: 1560787 - RNA, 19 nt, Homo sapiens
gggaaugagacaaauauga

SEQ ID NO: 1560788 - RNA, 19 nt, Homo sapiens
gagacaaauaugaacguua

SEQ ID NO: 1560789 - RNA, 19 nt, Homo sapiens
gaagguugcguguucaaau

SEQ ID NO: 1560790 - RNA, 19 nt, Homo sapiens
gaaaacagcgaucgaggua

SEQ ID NO: 1560791 - RNA, 19 nt, Homo sapiens
gcaggucccucccuuucug

SEQ ID NO: 1560792 - RNA, 19 nt, Homo sapiens
gugucaagaucccagguua

SEQ ID NO: 1560793 - RNA, 19 nt, Homo sapiens
gggcagcuccggaguaaga

SEQ ID NO: 1560794 - RNA, 19 nt, Homo sapiens
gaagagcuagguccaagga

SEQ ID NO: 1560795 - RNA, 19 nt, Homo sapiens
gcugacaaaucuuaaaggu

SEQ ID NO: 1560796 - RNA, 19 nt, Homo sapiens
gcgcauguaucccuaaggu

SEQ ID NO: 1560797 - RNA, 19 nt, Homo sapiens
gauuuaucaucuccagaaa

SEQ ID NO: 1560798 - RNA, 19 nt, Homo sapiens
uaaagucucagaucaagga

SEQ ID NO: 1560799 - RNA, 19 nt, Homo sapiens
ggauuacgucuaagauuug

SEQ ID NO: 1560800 - RNA, 19 nt, Homo sapiens
ccacuuccuugacgcuauu

SEQ ID NO: 1560801 - RNA, 19 nt, Homo sapiens
gauauaucccuguggcaaa

SEQ ID NO: 1560802 - RNA, 19 nt, Homo sapiens
caaaaugguuccacagaug

SEQ ID NO: 1560803 - RNA, 19 nt, Homo sapiens
agagaaaugcgcugacaaa

SEQ ID NO: 1560804 - RNA, 19 nt, Homo sapiens
gacgauuggugccugaaau

SEQ ID NO: 1560805 - RNA, 19 nt, Homo sapiens
caggacacguggucugcua

SEQ ID NO: 1560806 - RNA, 19 nt, Homo sapiens
ccuaaggucuauaaaagua

SEQ ID NO: 1560807 - RNA, 19 nt, Homo sapiens
caacugggguguagaacaa

SEQ ID NO: 1560808 - RNA, 19 nt, Homo sapiens
gcccagcgcgcaauuguga

SEQ ID NO: 1560809 - RNA, 19 nt, Homo sapiens
gcacgcagaguguaaaguc

SEQ ID NO: 1560810 - RNA, 19 nt, Homo sapiens
gcaccaagucgguaaccaa

SEQ ID NO: 1560811 - RNA, 19 nt, Homo sapiens
ggcaggaagugucaagauc

SEQ ID NO: 1560812 - RNA, 19 nt, Homo sapiens
ccaagucgguaaccaaagg

SEQ ID NO: 1560813 - RNA, 19 nt, Homo sapiens
gcaccgcgguagcagaaag

SEQ ID NO: 1560814 - RNA, 19 nt, Homo sapiens
ggacccagcacuacagcaa

SEQ ID NO: 1560815 - RNA, 19 nt, Homo sapiens
cuacaggucccuccucguu

SEQ ID NO: 1560816 - RNA, 19 nt, Homo sapiens
aaucuauaguuguggauga

SEQ ID NO: 1560817 - RNA, 19 nt, Homo sapiens
agucucagaucaaggauuc

SEQ ID NO: 1560818 - RNA, 19 nt, Homo sapiens
agagugucuucaaggaaua

SEQ ID NO: 1560819 - RNA, 19 nt, Homo sapiens
acuugccucucuauuauuu

SEQ ID NO: 1560820 - RNA, 19 nt, Homo sapiens
gagaaaugcgcugacaaau

SEQ ID NO: 1560821 - RNA, 19 nt, Homo sapiens
gcuggugccucagagaaau

SEQ ID NO: 1560822 - RNA, 19 nt, Homo sapiens
caacgagcucaaugugauu

SEQ ID NO: 1560823 - RNA, 19 nt, Homo sapiens
acgcgucaaucuauaguug

SEQ ID NO: 1560824 - RNA, 19 nt, Homo sapiens
ugagacaaauaugaacguu

SEQ ID NO: 1560825 - RNA, 19 nt, Homo sapiens
agaaaugcgcugacaaauc

SEQ ID NO: 1560826 - RNA, 19 nt, Homo sapiens
uccagaggaugaauuuaau

SEQ ID NO: 1560827 - RNA, 19 nt, Homo sapiens
aaauagaccuacggugaca

SEQ ID NO: 1560828 - RNA, 19 nt, Homo sapiens
gcaacgguagcgcgucuga

SEQ ID NO: 1560829 - RNA, 19 nt, Homo sapiens
gauuacgucuaagauuugu

SEQ ID NO: 1560830 - RNA, 19 nt, Homo sapiens
caaugugauuccaguuaag

SEQ ID NO: 1560831 - RNA, 19 nt, Homo sapiens
ggucccuccucguuaguau

SEQ ID NO: 1560832 - RNA, 19 nt, Homo sapiens
uguaaagucucagaucaag

SEQ ID NO: 1560833 - RNA, 19 nt, Homo sapiens
aguguaaagucucagauca

SEQ ID NO: 1560834 - RNA, 19 nt, Homo sapiens
ugaaggcacucugucucuu

SEQ ID NO: 1560835 - RNA, 19 nt, Homo sapiens
gcgucaaucuauaguugug

SEQ ID NO: 1560836 - RNA, 19 nt, Homo sapiens
uagcagaaagcaucucaau

SEQ ID NO: 1560837 - RNA, 19 nt, Homo sapiens
gaucagaagguugcguguu

SEQ ID NO: 1560838 - RNA, 19 nt, Homo sapiens
cugggcagcuccggaguaa

SEQ ID NO: 1560839 - RNA, 19 nt, Homo sapiens
gcagcgacaccaugaugau

SEQ ID NO: 1560840 - RNA, 19 nt, Homo sapiens
acaggucccuccucguuag

SEQ ID NO: 1560841 - RNA, 19 nt, Homo sapiens
gacgagcccuccuuuaccu

SEQ ID NO: 1560842 - RNA, 19 nt, Homo sapiens
cuacagacgaggaaaccaa

SEQ ID NO: 1560843 - RNA, 19 nt, Homo sapiens
caccaagucgguaaccaaa

SEQ ID NO: 1560844 - RNA, 19 nt, Homo sapiens
uaagccaaaugcgccuaaa

SEQ ID NO: 1560845 - RNA, 19 nt, Homo sapiens
gagaggucccggguucaaa

SEQ ID NO: 1560846 - RNA, 19 nt, Homo sapiens
gaccguuccgccaugcaua

SEQ ID NO: 1560847 - RNA, 19 nt, Homo sapiens
aagguugcguguucaaauc

SEQ ID NO: 1560848 - RNA, 19 nt, Homo sapiens
ucagaagguugcguguuca

SEQ ID NO: 1560849 - RNA, 19 nt, Homo sapiens
cucaaugugauuccaguua

SEQ ID NO: 1560850 - RNA, 19 nt, Homo sapiens
cggcagagcugggauuacg

SEQ ID NO: 1560851 - RNA, 19 nt, Homo sapiens
uggcaaaacugcgcaugua

SEQ ID NO: 1560852 - RNA, 19 nt, Homo sapiens
gaaugagacaaauaugaac

SEQ ID NO: 1560853 - RNA, 19 nt, Homo sapiens
guuaugcccagucuacaga

SEQ ID NO: 1560854 - RNA, 19 nt, Homo sapiens
gauuggugccugaaauaca

SEQ ID NO: 1560855 - RNA, 19 nt, Homo sapiens
caggaacugucaaaacuug

SEQ ID NO: 1560856 - RNA, 19 nt, Homo sapiens
gagcccaggaacugucaaa

SEQ ID NO: 1560857 - RNA, 19 nt, Homo sapiens
cagccugguuucgcuuuga

SEQ ID NO: 1560858 - RNA, 19 nt, Homo sapiens
gcugggauuacgucuaaga

SEQ ID NO: 1560859 - RNA, 19 nt, Homo sapiens
guaggguuaugcccagucu

SEQ ID NO: 1560860 - RNA, 19 nt, Homo sapiens
gguuucuggucagcguuua

SEQ ID NO: 1560861 - RNA, 19 nt, Homo sapiens
ucaacagacccaucaaguc

SEQ ID NO: 1560862 - RNA, 19 nt, Homo sapiens
gcgcugacaaaucuuaaag

SEQ ID NO: 1560863 - RNA, 19 nt, Homo sapiens
cagcaugcucugcaacgaa

SEQ ID NO: 1560864 - RNA, 19 nt, Homo sapiens
uacaggucccuccucguua

SEQ ID NO: 1560865 - RNA, 19 nt, Homo sapiens
acgauuggugccugaaaua

SEQ ID NO: 1560866 - RNA, 19 nt, Homo sapiens
gagaagagcuggcauguua

SEQ ID NO: 1560867 - RNA, 19 nt, Homo sapiens
caacaucccugccaucaaa

SEQ ID NO: 1560868 - RNA, 19 nt, Homo sapiens
aaucagagcucucaaugaa

SEQ ID NO: 1560869 - RNA, 19 nt, Homo sapiens
guacaaaucucaucguucu

SEQ ID NO: 1560870 - RNA, 19 nt, Homo sapiens
ccacauacauuuccuguca

SEQ ID NO: 1560871 - RNA, 19 nt, Homo sapiens
gaccaacucuggacacuga

SEQ ID NO: 1560872 - RNA, 19 nt, Homo sapiens
ccucguaccugaaguuuaa

SEQ ID NO: 1560873 - RNA, 19 nt, Homo sapiens
ggagcuggcuggagagaaa

SEQ ID NO: 1560874 - RNA, 19 nt, Homo sapiens
uagaugagcucugaaguuu

SEQ ID NO: 1560875 - RNA, 19 nt, Homo sapiens
gcuauaaucuccagcucua

SEQ ID NO: 1560876 - RNA, 19 nt, Homo sapiens
gaaggugccugcccugaga

SEQ ID NO: 1560877 - RNA, 19 nt, Homo sapiens
gaauggagcucuggguuug

SEQ ID NO: 1560878 - RNA, 19 nt, Homo sapiens
cagauacacuuuaguaaga

SEQ ID NO: 1560879 - RNA, 19 nt, Homo sapiens
ccacugagcugcacacauc

SEQ ID NO: 1560880 - RNA, 19 nt, Homo sapiens
ccacagcgauguccucaga

SEQ ID NO: 1560881 - RNA, 19 nt, Homo sapiens
gaaagcgcauuguguuuua

SEQ ID NO: 1560882 - RNA, 19 nt, Homo sapiens
gcaaauauuccucuaguuc

SEQ ID NO: 1560883 - RNA, 19 nt, Homo sapiens
aaacccaucuuguaaauca

SEQ ID NO: 1560884 - RNA, 19 nt, Homo sapiens
agagauaccuugucuguca

SEQ ID NO: 1560885 - RNA, 19 nt, Homo sapiens
gaauauccaugccaacauc

SEQ ID NO: 1560886 - RNA, 19 nt, Homo sapiens
cauggaagcccucuuguaa

SEQ ID NO: 1560887 - RNA, 19 nt, Homo sapiens
caagaaagcgcauuguguu

SEQ ID NO: 1560888 - RNA, 19 nt, Homo sapiens
cuacuuaccugucaaagca

SEQ ID NO: 1560889 - RNA, 19 nt, Homo sapiens
gauaacccacucuggaaua

SEQ ID NO: 1560890 - RNA, 19 nt, Homo sapiens
caaagacuccuauccuuga

SEQ ID NO: 1560891 - RNA, 19 nt, Homo sapiens
gagggcagcugggaaauuc

SEQ ID NO: 1560892 - RNA, 19 nt, Homo sapiens
ucaaacccaucuuguaaau

SEQ ID NO: 1560893 - RNA, 19 nt, Homo sapiens
uuucaggguuccaauguua

SEQ ID NO: 1560894 - RNA, 19 nt, Homo sapiens
ccuaaaccauccuaaguga

SEQ ID NO: 1560895 - RNA, 19 nt, Homo sapiens
aauggcagauucaauauga

SEQ ID NO: 1560896 - RNA, 19 nt, Homo sapiens
uauguaagccucaugguaa

SEQ ID NO: 1560897 - RNA, 19 nt, Homo sapiens
ggaauggagcucuggguuu

SEQ ID NO: 1560898 - RNA, 19 nt, Homo sapiens
gcauuagcccaauuuauga

SEQ ID NO: 1560899 - RNA, 19 nt, Homo sapiens
gaauauguguccugaagac

SEQ ID NO: 1560900 - RNA, 19 nt, Homo sapiens
gggaggcgguuccaauuuc

SEQ ID NO: 1560901 - RNA, 19 nt, Homo sapiens
ccaucaaacucaauccauu

SEQ ID NO: 1560902 - RNA, 19 nt, Homo sapiens
gccaaagacuccuauccuu

SEQ ID NO: 1560903 - RNA, 19 nt, Homo sapiens
guaaaucagcaaacacauu

SEQ ID NO: 1560904 - RNA, 19 nt, Homo sapiens
gagaugucauggccuguga

SEQ ID NO: 1560905 - RNA, 19 nt, Homo sapiens
aaauaaagccguuucaaca

SEQ ID NO: 1560906 - RNA, 19 nt, Homo sapiens
agaagacccugcucaacuu

SEQ ID NO: 1560907 - RNA, 19 nt, Homo sapiens
gcagcauacucuaggagaa

SEQ ID NO: 1560908 - RNA, 19 nt, Homo sapiens
ucagagaaauaauguugug

SEQ ID NO: 1560909 - RNA, 19 nt, Homo sapiens
cuaagugacuguggaauuc

SEQ ID NO: 1560910 - RNA, 19 nt, Homo sapiens
aaucucaucguucuacuua

SEQ ID NO: 1560911 - RNA, 19 nt, Homo sapiens
ugggaggacucauucauug

SEQ ID NO: 1560912 - RNA, 19 nt, Homo sapiens
gagaagacccugcucaacu

SEQ ID NO: 1560913 - RNA, 19 nt, Homo sapiens
cauaagggcaugaaguuug

SEQ ID NO: 1560914 - RNA, 19 nt, Homo sapiens
agagaaaggucuggagguu

SEQ ID NO: 1560915 - RNA, 19 nt, Homo sapiens
ggaggcgguuccaauuuca

SEQ ID NO: 1560916 - RNA, 19 nt, Homo sapiens
gaaguuucauccagcucuu

SEQ ID NO: 1560917 - RNA, 19 nt, Homo sapiens
caucaaacucaauccauuu

SEQ ID NO: 1560918 - RNA, 19 nt, Homo sapiens
ucaaagcacauucuacaug

SEQ ID NO: 1560919 - RNA, 19 nt, Homo sapiens
gaagacccugcucaacuuu

SEQ ID NO: 1560920 - RNA, 19 nt, Homo sapiens
gauauucaaacccaucuug

SEQ ID NO: 1560921 - RNA, 19 nt, Homo sapiens
ccaaguuugugauauucaa

SEQ ID NO: 1560922 - RNA, 19 nt, Homo sapiens
gagggaggcgguuccaauu

SEQ ID NO: 1560923 - RNA, 19 nt, Homo sapiens
uggaagcccucuuguaaag

SEQ ID NO: 1560924 - RNA, 19 nt, Homo sapiens
gcuguuguguggcaaugaa

SEQ ID NO: 1560925 - RNA, 19 nt, Homo sapiens
ccaccgcacuccucacuag

SEQ ID NO: 1560926 - RNA, 19 nt, Homo sapiens
gcaguuucuucguuacuca

SEQ ID NO: 1560927 - RNA, 19 nt, Homo sapiens
ggagggaggcgguuccaau

SEQ ID NO: 1560928 - RNA, 19 nt, Homo sapiens
ccaacugugugccauggaa

SEQ ID NO: 1560929 - RNA, 19 nt, Homo sapiens
ggacucauucauuggcuuu

SEQ ID NO: 1560930 - RNA, 19 nt, Homo sapiens
gcacucaucccauccuagu

SEQ ID NO: 1560931 - RNA, 19 nt, Homo sapiens
ucagagcucucaaugaaaa

SEQ ID NO: 1560932 - RNA, 19 nt, Homo sapiens
ugaaagggcugccaaucac

SEQ ID NO: 1560933 - RNA, 19 nt, Homo sapiens
ggccugugauagucaguuu

SEQ ID NO: 1560934 - RNA, 19 nt, Homo sapiens
gaugucauggccugugaua

SEQ ID NO: 1560935 - RNA, 19 nt, Homo sapiens
ggcaaauauuccucuaguu

SEQ ID NO: 1560936 - RNA, 19 nt, Homo sapiens
gcuguguguuuccuuaaug

SEQ ID NO: 1560937 - RNA, 19 nt, Homo sapiens
guggcuguguguuuccuua

SEQ ID NO: 1560938 - RNA, 19 nt, Homo sapiens
acauuaaccuuccaucagu

SEQ ID NO: 1560939 - RNA, 19 nt, Homo sapiens
uggaauauguguccugaag

SEQ ID NO: 1560940 - RNA, 19 nt, Homo sapiens
caacccagccugauguuag

SEQ ID NO: 1560941 - RNA, 19 nt, Homo sapiens
cugcuucucuguacaaauc

SEQ ID NO: 1560942 - RNA, 19 nt, Homo sapiens
ggagaguccaaguuuguga

SEQ ID NO: 1560943 - RNA, 19 nt, Homo sapiens
uuaagggccuaaccauuca

SEQ ID NO: 1560944 - RNA, 19 nt, Homo sapiens
ucaagaaagcgcauugugu

SEQ ID NO: 1560945 - RNA, 19 nt, Homo sapiens
ucacuuauccuccuuuguc

SEQ ID NO: 1560946 - RNA, 19 nt, Homo sapiens
aguccaaguuugugauauu

SEQ ID NO: 1560947 - RNA, 19 nt, Homo sapiens
uuccugggcucuauauuug

SEQ ID NO: 1560948 - RNA, 19 nt, Homo sapiens
ucaccagccuccaacuuca

SEQ ID NO: 1560949 - RNA, 19 nt, Homo sapiens
uggcaaauauuccucuagu

SEQ ID NO: 1560950 - RNA, 19 nt, Homo sapiens
gggccuaaccauucaauag

SEQ ID NO: 1560951 - RNA, 19 nt, Homo sapiens
uauaaucuccagcucuaaa

SEQ ID NO: 1560952 - RNA, 19 nt, Homo sapiens
ugcauuagcccaauuuaug

SEQ ID NO: 1560953 - RNA, 19 nt, Homo sapiens
auucaaacccaucuuguaa

SEQ ID NO: 1560954 - RNA, 19 nt, Homo sapiens
gggcacucaucccauccua

SEQ ID NO: 1560955 - RNA, 19 nt, Homo sapiens
gcuuguguaugucacuuau

SEQ ID NO: 1560956 - RNA, 19 nt, Homo sapiens
ggaauauguguccugaaga

SEQ ID NO: 1560957 - RNA, 19 nt, Homo sapiens
gcucuggguuugagauguc

SEQ ID NO: 1560958 - RNA, 19 nt, Homo sapiens
ccauggaagcccucuugua

SEQ ID NO: 1560959 - RNA, 19 nt, Homo sapiens
ggaaggcagcauacucuag

SEQ ID NO: 1560960 - RNA, 19 nt, Homo sapiens
uaacugcuucucuguacaa

SEQ ID NO: 1560961 - RNA, 19 nt, Homo sapiens
cuagaugagcucugaaguu

SEQ ID NO: 1560962 - RNA, 19 nt, Homo sapiens
gaaauuuugcucuggagua

SEQ ID NO: 1560963 - RNA, 19 nt, Homo sapiens
cuucagagauaccuugucu

SEQ ID NO: 1560964 - RNA, 19 nt, Homo sapiens
caaauauuccucuaguucu

SEQ ID NO: 1560965 - RNA, 19 nt, Homo sapiens
cagcaaacacauuaaccuu

SEQ ID NO: 1560966 - RNA, 19 nt, Homo sapiens
gcaauaaauuccuccaaua

SEQ ID NO: 1560967 - RNA, 19 nt, Homo sapiens
gaugagauguaguaacuua

SEQ ID NO: 1560968 - RNA, 19 nt, Homo sapiens
gcaagacaguuaauacuaa

SEQ ID NO: 1560969 - RNA, 19 nt, Homo sapiens
caagaaggaugaagaaaga

SEQ ID NO: 1560970 - RNA, 19 nt, Homo sapiens
ggaagaugcuggacucauu

SEQ ID NO: 1560971 - RNA, 19 nt, Homo sapiens
gaagaaggacucacagaaa

SEQ ID NO: 1560972 - RNA, 19 nt, Homo sapiens
gauagaaagugaacaggaa

SEQ ID NO: 1560973 - RNA, 19 nt, Homo sapiens
ggaagggaauacaaaggua

SEQ ID NO: 1560974 - RNA, 19 nt, Homo sapiens
ucacagagauguagaggau

SEQ ID NO: 1560975 - RNA, 19 nt, Homo sapiens
gagcuaugcugaacucuuc

SEQ ID NO: 1560976 - RNA, 19 nt, Homo sapiens
gaaagacccugggcaucaa

SEQ ID NO: 1560977 - RNA, 19 nt, Homo sapiens
cacacaagcucuuuuauua

SEQ ID NO: 1560978 - RNA, 19 nt, Homo sapiens
gaaagaagaaggacucaca

SEQ ID NO: 1560979 - RNA, 19 nt, Homo sapiens
ugggacagcugccuaaauu

SEQ ID NO: 1560980 - RNA, 19 nt, Homo sapiens
ccagggaauuugaaugauu

SEQ ID NO: 1560981 - RNA, 19 nt, Homo sapiens
gaaugugguuuguagaauc

SEQ ID NO: 1560982 - RNA, 19 nt, Homo sapiens
ggagguagcaccacaggaa

SEQ ID NO: 1560983 - RNA, 19 nt, Homo sapiens
gaauccacguuaucaaugu

SEQ ID NO: 1560984 - RNA, 19 nt, Homo sapiens
ggaaagacccugggcauca

SEQ ID NO: 1560985 - RNA, 19 nt, Homo sapiens
gaacucaccucuggcucuu

SEQ ID NO: 1560986 - RNA, 19 nt, Homo sapiens
ggaagcugauagaaaguga

SEQ ID NO: 1560987 - RNA, 19 nt, Homo sapiens
caagagggauccgauuaug

SEQ ID NO: 1560988 - RNA, 19 nt, Homo sapiens
acaggaagcugauagaaag

SEQ ID NO: 1560989 - RNA, 19 nt, Homo sapiens
ggcaauaaauuccuccaau

SEQ ID NO: 1560990 - RNA, 19 nt, Homo sapiens
gaacguuuauagacaugga

SEQ ID NO: 1560991 - RNA, 19 nt, Homo sapiens
agacacaggugcagcuuug

SEQ ID NO: 1560992 - RNA, 19 nt, Homo sapiens
gaagcaggcaucacacuug

SEQ ID NO: 1560993 - RNA, 19 nt, Homo sapiens
caaggcauguucuccauuc

SEQ ID NO: 1560994 - RNA, 19 nt, Homo sapiens
ugacccagcugguuucaug

SEQ ID NO: 1560995 - RNA, 19 nt, Homo sapiens
caucaucccucacagagau

SEQ ID NO: 1560996 - RNA, 19 nt, Homo sapiens
gcaagaaggaugaagaaag

SEQ ID NO: 1560997 - RNA, 19 nt, Homo sapiens
gaaaucacacaagcucuuu

SEQ ID NO: 1560998 - RNA, 19 nt, Homo sapiens
acagagauguagaggauga

SEQ ID NO: 1560999 - RNA, 19 nt, Homo sapiens
gcaagagggauccgauuau

SEQ ID NO: 1561000 - RNA, 19 nt, Homo sapiens
caaugcagcugguaucucu

SEQ ID NO: 1561001 - RNA, 19 nt, Homo sapiens
gggcaucaaggcagaauaa

SEQ ID NO: 1561002 - RNA, 19 nt, Homo sapiens
cagggaauuugaaugauug

SEQ ID NO: 1561003 - RNA, 19 nt, Homo sapiens
gcugaacucuucuccaucu

SEQ ID NO: 1561004 - RNA, 19 nt, Homo sapiens
gacaggaagcugauagaaa

SEQ ID NO: 1561005 - RNA, 19 nt, Homo sapiens
gaaaccagaucagaaugca

SEQ ID NO: 1561006 - RNA, 19 nt, Homo sapiens
cuagagaacuggaaugcau

SEQ ID NO: 1561007 - RNA, 19 nt, Homo sapiens
gagauguaguaacuuauag

SEQ ID NO: 1561008 - RNA, 19 nt, Homo sapiens
gcaagccuaugaugaggau

SEQ ID NO: 1561009 - RNA, 19 nt, Homo sapiens
gccagaaugugguuuguag

SEQ ID NO: 1561010 - RNA, 19 nt, Homo sapiens
gaagaugcuggacucauug

SEQ ID NO: 1561011 - RNA, 19 nt, Homo sapiens
gaucagaaugcaagcugua

SEQ ID NO: 1561012 - RNA, 19 nt, Homo sapiens
ggaggcaggcaauaaauuc

SEQ ID NO: 1561013 - RNA, 19 nt, Homo sapiens
uaccugaguuucuguaugu

SEQ ID NO: 1561014 - RNA, 19 nt, Homo sapiens
caaccuuugucuuuacaug

SEQ ID NO: 1561015 - RNA, 19 nt, Homo sapiens
ggacuccagcuguuauuug

SEQ ID NO: 1561016 - RNA, 19 nt, Homo sapiens
cccagcaucuccaagcaua

SEQ ID NO: 1561017 - RNA, 19 nt, Homo sapiens
gaaggaugaagaaagaaga

SEQ ID NO: 1561018 - RNA, 19 nt, Homo sapiens
cauggaacguuuauagaca

SEQ ID NO: 1561019 - RNA, 19 nt, Homo sapiens
ggucuuguguaaacguuug

SEQ ID NO: 1561020 - RNA, 19 nt, Homo sapiens
ccaagcauaggauggauuu

SEQ ID NO: 1561021 - RNA, 19 nt, Homo sapiens
ggacaggaagcugauagaa

SEQ ID NO: 1561022 - RNA, 19 nt, Homo sapiens
guaaacguuugcagacaca

SEQ ID NO: 1561023 - RNA, 19 nt, Homo sapiens
uagaggaugagauguagua

SEQ ID NO: 1561024 - RNA, 19 nt, Homo sapiens
gaccuuaccugaguuucug

SEQ ID NO: 1561025 - RNA, 19 nt, Homo sapiens
gcaaacaggaagugagcaa

SEQ ID NO: 1561026 - RNA, 19 nt, Homo sapiens
gcuaagagaaaccagauca

SEQ ID NO: 1561027 - RNA, 19 nt, Homo sapiens
gcugucagaauccacguua

SEQ ID NO: 1561028 - RNA, 19 nt, Homo sapiens
aaagugaacaggaagcaaa

SEQ ID NO: 1561029 - RNA, 19 nt, Homo sapiens
gaugcuggacucauugaaa

SEQ ID NO: 1561030 - RNA, 19 nt, Homo sapiens
uuaaccaggugacaguaaa

SEQ ID NO: 1561031 - RNA, 19 nt, Homo sapiens
gacuccagcuguuauuugu

SEQ ID NO: 1561032 - RNA, 19 nt, Homo sapiens
aagcaggcaucacacuuga

SEQ ID NO: 1561033 - RNA, 19 nt, Homo sapiens
ggaagcaggcaucacacuu

SEQ ID NO: 1561034 - RNA, 19 nt, Homo sapiens
uaagagaaaccagaucaga

SEQ ID NO: 1561035 - RNA, 19 nt, Homo sapiens
cccagaacccacacacuua

SEQ ID NO: 1561036 - RNA, 19 nt, Homo sapiens
gagaaauggagagcucuuu

SEQ ID NO: 1561037 - RNA, 19 nt, Homo sapiens
cagaaugugguuuguagaa

SEQ ID NO: 1561038 - RNA, 19 nt, Homo sapiens
gagcuuggcuaagagaaac

SEQ ID NO: 1561039 - RNA, 19 nt, Homo sapiens
cagagacuguccaacugaa

SEQ ID NO: 1561040 - RNA, 19 nt, Homo sapiens
gaacccacacacuuacaug

SEQ ID NO: 1561041 - RNA, 19 nt, Homo sapiens
gaugaagaaagaagaagga

SEQ ID NO: 1561042 - RNA, 19 nt, Homo sapiens
ggagacagaaaucacacaa

SEQ ID NO: 1561043 - RNA, 19 nt, Homo sapiens
caagaacguacaaaaguua

SEQ ID NO: 1561044 - RNA, 19 nt, Homo sapiens
gaugcaagaaggaugaaga

SEQ ID NO: 1561045 - RNA, 19 nt, Homo sapiens
ccagcugguuucauguuug

SEQ ID NO: 1561046 - RNA, 19 nt, Homo sapiens
gcaggacuccagcuguuau

SEQ ID NO: 1561047 - RNA, 19 nt, Homo sapiens
cuuccuacuuccuccuuua

SEQ ID NO: 1561048 - RNA, 19 nt, Homo sapiens
agaagaaggacucacagaa

SEQ ID NO: 1561049 - RNA, 19 nt, Homo sapiens
gcaggagacagaaaucaca

SEQ ID NO: 1561050 - RNA, 19 nt, Homo sapiens
agagaaaccagaucagaau

SEQ ID NO: 1561051 - RNA, 19 nt, Homo sapiens
ggagcuuggcuaagagaaa

SEQ ID NO: 1561052 - RNA, 19 nt, Homo sapiens
ccaagaacguacaaaaguu

SEQ ID NO: 1561053 - RNA, 19 nt, Homo sapiens
uaaauuaggagcucuagac

SEQ ID NO: 1561054 - RNA, 19 nt, Homo sapiens
gggacagcugccuaaauua

SEQ ID NO: 1561055 - RNA, 19 nt, Homo sapiens
aggaugagauguaguaacu

SEQ ID NO: 1561056 - RNA, 19 nt, Homo sapiens
gaggacagcuaggauuggu

SEQ ID NO: 1561057 - RNA, 19 nt, Homo sapiens
uggcaggacuccagcuguu

SEQ ID NO: 1561058 - RNA, 19 nt, Homo sapiens
gaacuugcucuugcucaug

SEQ ID NO: 1561059 - RNA, 19 nt, Homo sapiens
cagaauccacguuaucaau

SEQ ID NO: 1561060 - RNA, 19 nt, Homo sapiens
cauggaggcaggcaauaaa

SEQ ID NO: 1561061 - RNA, 19 nt, Homo sapiens
cugaguuucuguaugugua

SEQ ID NO: 1561062 - RNA, 19 nt, Homo sapiens
ggaagcaaacaggaaguga

SEQ ID NO: 1561063 - RNA, 19 nt, Homo sapiens
ugaggaugcucccuacagu

SEQ ID NO: 1561064 - RNA, 19 nt, Homo sapiens
aagaaggacucacagaaaa

SEQ ID NO: 1561065 - RNA, 19 nt, Homo sapiens
gcucuagaccuguuauugg

SEQ ID NO: 1561066 - RNA, 19 nt, Homo sapiens
ccucagagcuauaauguua

SEQ ID NO: 1561067 - RNA, 19 nt, Homo sapiens
gaacaagccacauuugaua

SEQ ID NO: 1561068 - RNA, 19 nt, Homo sapiens
gagcagauauggagggaua

SEQ ID NO: 1561069 - RNA, 19 nt, Homo sapiens
gagaaggacucaugauuuc

SEQ ID NO: 1561070 - RNA, 19 nt, Homo sapiens
gagaggagcuagaaucaga

SEQ ID NO: 1561071 - RNA, 19 nt, Homo sapiens
gcacuuaaccuccguagaa

SEQ ID NO: 1561072 - RNA, 19 nt, Homo sapiens
ggagaaguaugagaaguuu

SEQ ID NO: 1561073 - RNA, 19 nt, Homo sapiens
ggaaagcugugacaagaag

SEQ ID NO: 1561074 - RNA, 19 nt, Homo sapiens
uaaagcaacuucgggagua

SEQ ID NO: 1561075 - RNA, 19 nt, Homo sapiens
gaaagauggucugcuguau

SEQ ID NO: 1561076 - RNA, 19 nt, Homo sapiens
ggaguaguguuucagagaa

SEQ ID NO: 1561077 - RNA, 19 nt, Homo sapiens
gcacuucucuggguucuuc

SEQ ID NO: 1561078 - RNA, 19 nt, Homo sapiens
cuucaggcauccauuaaua

SEQ ID NO: 1561079 - RNA, 19 nt, Homo sapiens
ggaugggcauggugcauaa

SEQ ID NO: 1561080 - RNA, 19 nt, Homo sapiens
ccucuuaacuugcaggaaa

SEQ ID NO: 1561081 - RNA, 19 nt, Homo sapiens
ugucagaggugaaaggaaa

SEQ ID NO: 1561082 - RNA, 19 nt, Homo sapiens
aagauggucugcuguauga

SEQ ID NO: 1561083 - RNA, 19 nt, Homo sapiens
gcagaccccuccacacuua

SEQ ID NO: 1561084 - RNA, 19 nt, Homo sapiens
caagaagcauacagccauu

SEQ ID NO: 1561085 - RNA, 19 nt, Homo sapiens
ggacaacaacucccucuuc

SEQ ID NO: 1561086 - RNA, 19 nt, Homo sapiens
ugaauaaccugucacaaaa

SEQ ID NO: 1561087 - RNA, 19 nt, Homo sapiens
ggacagggugguauccuuu

SEQ ID NO: 1561088 - RNA, 19 nt, Homo sapiens
gaagaagaagguagagaug

SEQ ID NO: 1561089 - RNA, 19 nt, Homo sapiens
gaaauugccaugcuuaaaa

SEQ ID NO: 1561090 - RNA, 19 nt, Homo sapiens
aaacccaacuucagcauca

SEQ ID NO: 1561091 - RNA, 19 nt, Homo sapiens
gaaguuggagcccaguaaa

SEQ ID NO: 1561092 - RNA, 19 nt, Homo sapiens
ggaggguuccgacugauuu

SEQ ID NO: 1561093 - RNA, 19 nt, Homo sapiens
aaagaaauugccaugcuua

SEQ ID NO: 1561094 - RNA, 19 nt, Homo sapiens
agagaaggacucaugauuu

SEQ ID NO: 1561095 - RNA, 19 nt, Homo sapiens
ugacagcucuggcgagaag

SEQ ID NO: 1561096 - RNA, 19 nt, Homo sapiens
aaacugaaacguaugagaa

SEQ ID NO: 1561097 - RNA, 19 nt, Homo sapiens
gaggaggccagcucuguuu

SEQ ID NO: 1561098 - RNA, 19 nt, Homo sapiens
ugaggcagcugcaacuuca

SEQ ID NO: 1561099 - RNA, 19 nt, Homo sapiens
gcagaguccucagagcuau

SEQ ID NO: 1561100 - RNA, 19 nt, Homo sapiens
ugaauucggagaaguauga

SEQ ID NO: 1561101 - RNA, 19 nt, Homo sapiens
caacagcgccugcuuugag

SEQ ID NO: 1561102 - RNA, 19 nt, Homo sapiens
gggagaguccgaacacaaa

SEQ ID NO: 1561103 - RNA, 19 nt, Homo sapiens
ggcagugucuccaguguuc

SEQ ID NO: 1561104 - RNA, 19 nt, Homo sapiens
cuuccuaccucuuaacuug

SEQ ID NO: 1561105 - RNA, 19 nt, Homo sapiens
gauaaagaggugaaagaug

SEQ ID NO: 1561106 - RNA, 19 nt, Homo sapiens
gcuaaagagugacaugaac

SEQ ID NO: 1561107 - RNA, 19 nt, Homo sapiens
agaaacaacagcagaaaga

SEQ ID NO: 1561108 - RNA, 19 nt, Homo sapiens
ugaaagauggucugcugua

SEQ ID NO: 1561109 - RNA, 19 nt, Homo sapiens
gauccugggcuuugacauu

SEQ ID NO: 1561110 - RNA, 19 nt, Homo sapiens
cagagaaggacucaugauu

SEQ ID NO: 1561111 - RNA, 19 nt, Homo sapiens
ggucuuccauuaguuccua

SEQ ID NO: 1561112 - RNA, 19 nt, Homo sapiens
ggaaacaaugugucucuuc

SEQ ID NO: 1561113 - RNA, 19 nt, Homo sapiens
gcgagcaagugagaaagaa

SEQ ID NO: 1561114 - RNA, 19 nt, Homo sapiens
gcaccaucauccagaauac

SEQ ID NO: 1561115 - RNA, 19 nt, Homo sapiens
acaccugacuugcucuuga

SEQ ID NO: 1561116 - RNA, 19 nt, Homo sapiens
acaacucccucuuccagaa

SEQ ID NO: 1561117 - RNA, 19 nt, Homo sapiens
cugcagaaauguuacacuu

SEQ ID NO: 1561118 - RNA, 19 nt, Homo sapiens
acacuuaacccagaagaaa

SEQ ID NO: 1561119 - RNA, 19 nt, Homo sapiens
cuggaaagcugugacaaga

SEQ ID NO: 1561120 - RNA, 19 nt, Homo sapiens
caccuucagugcauacuug

SEQ ID NO: 1561121 - RNA, 19 nt, Homo sapiens
uauccgagcuacucaccaa

SEQ ID NO: 1561122 - RNA, 19 nt, Homo sapiens
gacaugaacaagccacauu

SEQ ID NO: 1561123 - RNA, 19 nt, Homo sapiens
gacuugcucuugaguguca

SEQ ID NO: 1561124 - RNA, 19 nt, Homo sapiens
auauacuggucuuccauua

SEQ ID NO: 1561125 - RNA, 19 nt, Homo sapiens
gcuaugagggacccaugua

SEQ ID NO: 1561126 - RNA, 19 nt, Homo sapiens
gcauggugcauaacucuga

SEQ ID NO: 1561127 - RNA, 19 nt, Homo sapiens
gacagggugguauccuuua

SEQ ID NO: 1561128 - RNA, 19 nt, Homo sapiens
gaucugaggaauaucaauc

SEQ ID NO: 1561129 - RNA, 19 nt, Homo sapiens
ggauaaagaggugaaagau

SEQ ID NO: 1561130 - RNA, 19 nt, Homo sapiens
gauauacuggucuuccauu

SEQ ID NO: 1561131 - RNA, 19 nt, Homo sapiens
augaauaaccugucacaaa

SEQ ID NO: 1561132 - RNA, 19 nt, Homo sapiens
ggugguauccuuuaaaugc

SEQ ID NO: 1561133 - RNA, 19 nt, Homo sapiens
agaagaagguagagaugca

SEQ ID NO: 1561134 - RNA, 19 nt, Homo sapiens
ugaaacguaugagaaggaa

SEQ ID NO: 1561135 - RNA, 19 nt, Homo sapiens
gcuacaacguggagcagau

SEQ ID NO: 1561136 - RNA, 19 nt, Homo sapiens
ugagggaccugcuggugau

SEQ ID NO: 1561137 - RNA, 19 nt, Homo sapiens
ucaggcauccauuaauaaa

SEQ ID NO: 1561138 - RNA, 19 nt, Homo sapiens
auacuggucuuccauuagu

SEQ ID NO: 1561139 - RNA, 19 nt, Homo sapiens
gaugugagaggagcuagaa

SEQ ID NO: 1561140 - RNA, 19 nt, Homo sapiens
uaaagagugacaugaacaa

SEQ ID NO: 1561141 - RNA, 19 nt, Homo sapiens
acagggugguauccuuuaa

SEQ ID NO: 1561142 - RNA, 19 nt, Homo sapiens
uacccgaucugaggaauau

SEQ ID NO: 1561143 - RNA, 19 nt, Homo sapiens
ggaggaggccagcucuguu

SEQ ID NO: 1561144 - RNA, 19 nt, Homo sapiens
ggaaucggcaggcgagcaa

SEQ ID NO: 1561145 - RNA, 19 nt, Homo sapiens
gaggguuccgacugauuua

SEQ ID NO: 1561146 - RNA, 19 nt, Homo sapiens
gagaguacccagccugaag

SEQ ID NO: 1561147 - RNA, 19 nt, Homo sapiens
gggaguaguguuucagaga

SEQ ID NO: 1561148 - RNA, 19 nt, Homo sapiens
ccucugcagugaacguauu

SEQ ID NO: 1561149 - RNA, 19 nt, Homo sapiens
uccaggagcugagacuaaa

SEQ ID NO: 1561150 - RNA, 19 nt, Homo sapiens
gggaugggcauggugcaua

SEQ ID NO: 1561151 - RNA, 19 nt, Homo sapiens
uaagggcacagaauggaaa

SEQ ID NO: 1561152 - RNA, 19 nt, Homo sapiens
uaacuugcaggaaacaaug

SEQ ID NO: 1561153 - RNA, 19 nt, Homo sapiens
cgaaguuggagcccaguaa

SEQ ID NO: 1561154 - RNA, 19 nt, Homo sapiens
aacaguacauccagccauu

SEQ ID NO: 1561155 - RNA, 19 nt, Homo sapiens
ugaagaagaagguagagau

SEQ ID NO: 1561156 - RNA, 19 nt, Homo sapiens
gaaggacucaugauuucca

SEQ ID NO: 1561157 - RNA, 19 nt, Homo sapiens
ugaacaagccacauuugau

SEQ ID NO: 1561158 - RNA, 19 nt, Homo sapiens
cacuuaaccuccguagaaa

SEQ ID NO: 1561159 - RNA, 19 nt, Homo sapiens
ggagaugaggauugaggaa

SEQ ID NO: 1561160 - RNA, 19 nt, Homo sapiens
gaggacgucaucaucaaga

SEQ ID NO: 1561161 - RNA, 19 nt, Homo sapiens
cuaucagccugcagaaaug

SEQ ID NO: 1561162 - RNA, 19 nt, Homo sapiens
ggguagcaguacuaaggaa

SEQ ID NO: 1561163 - RNA, 19 nt, Homo sapiens
uguggaggguuccgacuga

SEQ ID NO: 1561164 - RNA, 19 nt, Homo sapiens
ucugcuguaugacaccuua

SEQ ID NO: 1561165 - RNA, 19 nt, Homo sapiens
ggcaccaucauccagaaua

SEQ ID NO: 1561166 - RNA, 19 nt, Homo sapiens
ggucugagguuacuacuaa

SEQ ID NO: 1561167 - RNA, 19 nt, Homo sapiens
ggagauaaaugcugggauu

SEQ ID NO: 1561168 - RNA, 19 nt, Homo sapiens
caaaggaguuuccaaguug

SEQ ID NO: 1561169 - RNA, 19 nt, Homo sapiens
caaacucucuguccuuaaa

SEQ ID NO: 1561170 - RNA, 19 nt, Homo sapiens
cuacagagcugggucguuu

SEQ ID NO: 1561171 - RNA, 19 nt, Homo sapiens
ccaaaggaguuuccaaguu

SEQ ID NO: 1561172 - RNA, 19 nt, Homo sapiens
ccaagaaacagcagcuuua

SEQ ID NO: 1561173 - RNA, 19 nt, Homo sapiens
uaaagauucugauggugua

SEQ ID NO: 1561174 - RNA, 19 nt, Homo sapiens
ggacauggguacguucuug

SEQ ID NO: 1561175 - RNA, 19 nt, Homo sapiens
gagcccauccaaagaauua

SEQ ID NO: 1561176 - RNA, 19 nt, Homo sapiens
caaaucuacucaucaguug

SEQ ID NO: 1561177 - RNA, 19 nt, Homo sapiens
gcaaacaacccauucaaag

SEQ ID NO: 1561178 - RNA, 19 nt, Homo sapiens
gcaaaggucuuaguaucau

SEQ ID NO: 1561179 - RNA, 19 nt, Homo sapiens
ccacaagucauccauguuu

SEQ ID NO: 1561180 - RNA, 19 nt, Homo sapiens
cagcuuaguuggucaucua

SEQ ID NO: 1561181 - RNA, 19 nt, Homo sapiens
cagaggaacuucucaucuu

SEQ ID NO: 1561182 - RNA, 19 nt, Homo sapiens
cugagucucuucauaagua

SEQ ID NO: 1561183 - RNA, 19 nt, Homo sapiens
ccauuagagucauuucuuu

SEQ ID NO: 1561184 - RNA, 19 nt, Homo sapiens
gacccugagucucuucaua

SEQ ID NO: 1561185 - RNA, 19 nt, Homo sapiens
gcacgaagaggcagugaga

SEQ ID NO: 1561186 - RNA, 19 nt, Homo sapiens
ggaugucucugaggaaaug

SEQ ID NO: 1561187 - RNA, 19 nt, Homo sapiens
cuccagagcccaucuauaa

SEQ ID NO: 1561188 - RNA, 19 nt, Homo sapiens
caaagaauuacgacuacua

SEQ ID NO: 1561189 - RNA, 19 nt, Homo sapiens
cccaaaggaugaagcagua

SEQ ID NO: 1561190 - RNA, 19 nt, Homo sapiens
gcugaauccugaaguugaa

SEQ ID NO: 1561191 - RNA, 19 nt, Homo sapiens
ccagaagaauaacuuacaa

SEQ ID NO: 1561192 - RNA, 19 nt, Homo sapiens
ggugaggaguggcaucuau

SEQ ID NO: 1561193 - RNA, 19 nt, Homo sapiens
gcagggacauggguacguu

SEQ ID NO: 1561194 - RNA, 19 nt, Homo sapiens
caagaaacagcagcuuuaa

SEQ ID NO: 1561195 - RNA, 19 nt, Homo sapiens
aaacugagcccauccaaag

SEQ ID NO: 1561196 - RNA, 19 nt, Homo sapiens
ccgcaaaggucuuaguauc

SEQ ID NO: 1561197 - RNA, 19 nt, Homo sapiens
ccaaaucuacucaucaguu

SEQ ID NO: 1561198 - RNA, 19 nt, Homo sapiens
aaaccaagcccuccgcaaa

SEQ ID NO: 1561199 - RNA, 19 nt, Homo sapiens
ggaguggcaucuauguauc

SEQ ID NO: 1561200 - RNA, 19 nt, Homo sapiens
ggaccugacuccucauggu

SEQ ID NO: 1561201 - RNA, 19 nt, Homo sapiens
cagauggucaagacaaaua

SEQ ID NO: 1561202 - RNA, 19 nt, Homo sapiens
gaauacaagccagccagua

SEQ ID NO: 1561203 - RNA, 19 nt, Homo sapiens
agaggaacuucucaucuug

SEQ ID NO: 1561204 - RNA, 19 nt, Homo sapiens
cgugucaucugguggcuaa

SEQ ID NO: 1561205 - RNA, 19 nt, Homo sapiens
gaaauguacaaucguguca

SEQ ID NO: 1561206 - RNA, 19 nt, Homo sapiens
ucauaaguauucugccuau

SEQ ID NO: 1561207 - RNA, 19 nt, Homo sapiens
ggaugaagcaguacaaacu

SEQ ID NO: 1561208 - RNA, 19 nt, Homo sapiens
agcagacaauggaaaguua

SEQ ID NO: 1561209 - RNA, 19 nt, Homo sapiens
auucaaagguuuacugcuu

SEQ ID NO: 1561210 - RNA, 19 nt, Homo sapiens
cucaaacucucuguccuua

SEQ ID NO: 1561211 - RNA, 19 nt, Homo sapiens
gaagaggcagugagagcaa

SEQ ID NO: 1561212 - RNA, 19 nt, Homo sapiens
ucauuaggauccugaauac

SEQ ID NO: 1561213 - RNA, 19 nt, Homo sapiens
guauaggaauaugaacuug

SEQ ID NO: 1561214 - RNA, 19 nt, Homo sapiens
uaaagagccagaagacuca

SEQ ID NO: 1561215 - RNA, 19 nt, Homo sapiens
aauacaagccagccaguaa

SEQ ID NO: 1561216 - RNA, 19 nt, Homo sapiens
gcaagccuaucaccaccau

SEQ ID NO: 1561217 - RNA, 19 nt, Homo sapiens
gugaggaucugaaguucca

SEQ ID NO: 1561218 - RNA, 19 nt, Homo sapiens
gaauaugaacuuggacuca

SEQ ID NO: 1561219 - RNA, 19 nt, Homo sapiens
gcagaggaacuucucaucu

SEQ ID NO: 1561220 - RNA, 19 nt, Homo sapiens
uucaagaccagaagaauaa

SEQ ID NO: 1561221 - RNA, 19 nt, Homo sapiens
ugaagaagcagaggaacuu

SEQ ID NO: 1561222 - RNA, 19 nt, Homo sapiens
gaggaguggcaucuaugua

SEQ ID NO: 1561223 - RNA, 19 nt, Homo sapiens
caaacaacccauucaaagg

SEQ ID NO: 1561224 - RNA, 19 nt, Homo sapiens
ggucggccaucaugcuuca

SEQ ID NO: 1561225 - RNA, 19 nt, Homo sapiens
aaacaacccauucaaaggu

SEQ ID NO: 1561226 - RNA, 19 nt, Homo sapiens
caagcacaccugcaaacaa

SEQ ID NO: 1561227 - RNA, 19 nt, Homo sapiens
gcccaucuauaaacagcaa

SEQ ID NO: 1561228 - RNA, 19 nt, Homo sapiens
cagagcccaucuauaaaca

SEQ ID NO: 1561229 - RNA, 19 nt, Homo sapiens
auaggaauaugaacuugga

SEQ ID NO: 1561230 - RNA, 19 nt, Homo sapiens
aauacgggaucuacucaga

SEQ ID NO: 1561231 - RNA, 19 nt, Homo sapiens
gggccaagguagcgguuuc

SEQ ID NO: 1561232 - RNA, 19 nt, Homo sapiens
ccuuaaagauucugauggu

SEQ ID NO: 1561233 - RNA, 19 nt, Homo sapiens
ucucuguccuuaaagauuc

SEQ ID NO: 1561234 - RNA, 19 nt, Homo sapiens
gcucaaacucucuguccuu

SEQ ID NO: 1561235 - RNA, 19 nt, Homo sapiens
caaacugagcccauccaaa

SEQ ID NO: 1561236 - RNA, 19 nt, Homo sapiens
uuucaagaccagaagaaua

SEQ ID NO: 1561237 - RNA, 19 nt, Homo sapiens
cuuaguuggucaucuauca

SEQ ID NO: 1561238 - RNA, 19 nt, Homo sapiens
aagcacaccugcaaacaac

SEQ ID NO: 1561239 - RNA, 19 nt, Homo sapiens
agaaacagcagcuuuaaaa

SEQ ID NO: 1561240 - RNA, 19 nt, Homo sapiens
ccuccucgguccuuaccua

SEQ ID NO: 1561241 - RNA, 19 nt, Homo sapiens
ccagaaauuacuuacaugu

SEQ ID NO: 1561242 - RNA, 19 nt, Homo sapiens
cacaagucauccauguuug

SEQ ID NO: 1561243 - RNA, 19 nt, Homo sapiens
ucugagggcucccacaagu

SEQ ID NO: 1561244 - RNA, 19 nt, Homo sapiens
ucagaagggcacaaucuau

SEQ ID NO: 1561245 - RNA, 19 nt, Homo sapiens
guagaagaaucagaaacag

SEQ ID NO: 1561246 - RNA, 19 nt, Homo sapiens
gagagggucugagguuacu

SEQ ID NO: 1561247 - RNA, 19 nt, Homo sapiens
agaggaagcagcacgaaga

SEQ ID NO: 1561248 - RNA, 19 nt, Homo sapiens
ugucuuacccaaaggauga

SEQ ID NO: 1561249 - RNA, 19 nt, Homo sapiens
caagccagccaguaaaaua

SEQ ID NO: 1561250 - RNA, 19 nt, Homo sapiens
agagcugggucguuuagga

SEQ ID NO: 1561251 - RNA, 19 nt, Homo sapiens
caaaggucuuaguaucauc

SEQ ID NO: 1561252 - RNA, 19 nt, Homo sapiens
aaucagaaacagguccuua

SEQ ID NO: 1561253 - RNA, 19 nt, Homo sapiens
ccaucaugcuucaucaauc

SEQ ID NO: 1561254 - RNA, 19 nt, Homo sapiens
cagaagggcacaaucuauc

SEQ ID NO: 1561255 - RNA, 19 nt, Homo sapiens
caucuaaagagccagaaga

SEQ ID NO: 1561256 - RNA, 19 nt, Homo sapiens
aaccgagacuggaccaaga

SEQ ID NO: 1561257 - RNA, 19 nt, Homo sapiens
gauggucaagacaaauaaa

SEQ ID NO: 1561258 - RNA, 19 nt, Homo sapiens
gguaaauauucaggcauca

SEQ ID NO: 1561259 - RNA, 19 nt, Homo sapiens
uaucagacagcccagagaa

SEQ ID NO: 1561260 - RNA, 19 nt, Homo sapiens
acagaaucaucccgccauu

SEQ ID NO: 1561261 - RNA, 19 nt, Homo sapiens
gcaucagacuacccucgau

SEQ ID NO: 1561262 - RNA, 19 nt, Homo sapiens
uuucaagagucuccuuuua

SEQ ID NO: 1561263 - RNA, 19 nt, Homo sapiens
aagguuuacugcuuucuuc

SEQ ID NO: 1561264 - RNA, 19 nt, Homo sapiens
ucaccaccaucaccaccaa

SEQ ID NO: 1561265 - RNA, 19 nt, Homo sapiens
gugcugcagucucccugaa

SEQ ID NO: 1561266 - RNA, 19 nt, Homo sapiens
gcucagaucuuugcaaaua

SEQ ID NO: 1561267 - RNA, 19 nt, Homo sapiens
ccaaaguucugauaccuua

SEQ ID NO: 1561268 - RNA, 19 nt, Homo sapiens
gaagaaccaugaagaggaa

SEQ ID NO: 1561269 - RNA, 19 nt, Homo sapiens
ggaaguaaagggccuauaa

SEQ ID NO: 1561270 - RNA, 19 nt, Homo sapiens
gauauuggauggcaaagug

SEQ ID NO: 1561271 - RNA, 19 nt, Homo sapiens
agauuuaccuucagcuuua

SEQ ID NO: 1561272 - RNA, 19 nt, Homo sapiens
ggacuucaaucuuucaauc

SEQ ID NO: 1561273 - RNA, 19 nt, Homo sapiens
uagaggagcugggcaagua

SEQ ID NO: 1561274 - RNA, 19 nt, Homo sapiens
agacagagcuggccaugug

SEQ ID NO: 1561275 - RNA, 19 nt, Homo sapiens
ccaguuagauuuaccuuca

SEQ ID NO: 1561276 - RNA, 19 nt, Homo sapiens
ggacagugcccacauuguu

SEQ ID NO: 1561277 - RNA, 19 nt, Homo sapiens
gggcucagaucuuugcaaa

SEQ ID NO: 1561278 - RNA, 19 nt, Homo sapiens
ggucuuagccaguuagauu

SEQ ID NO: 1561279 - RNA, 19 nt, Homo sapiens
gaccagugaugccaaaguu

SEQ ID NO: 1561280 - RNA, 19 nt, Homo sapiens
gaaugggagucauccagaa

SEQ ID NO: 1561281 - RNA, 19 nt, Homo sapiens
gauggaucauugcuuaauu

SEQ ID NO: 1561282 - RNA, 19 nt, Homo sapiens
gaaggacacuuggaaacug

SEQ ID NO: 1561283 - RNA, 19 nt, Homo sapiens
guacuggucuccgcagauu

SEQ ID NO: 1561284 - RNA, 19 nt, Homo sapiens
gguuggagcugcugagaug

SEQ ID NO: 1561285 - RNA, 19 nt, Homo sapiens
agugaggacuucaaucuuu

SEQ ID NO: 1561286 - RNA, 19 nt, Homo sapiens
gcacuaggcccaggaguau

SEQ ID NO: 1561287 - RNA, 19 nt, Homo sapiens
gcccuaggguaaucacuuu

SEQ ID NO: 1561288 - RNA, 19 nt, Homo sapiens
cagcagggcccuaggguaa

SEQ ID NO: 1561289 - RNA, 19 nt, Homo sapiens
gaagaagaaccaugaagag

SEQ ID NO: 1561290 - RNA, 19 nt, Homo sapiens
ucacggagcugagacauac

SEQ ID NO: 1561291 - RNA, 19 nt, Homo sapiens
gggagcaggaggccaauaa

SEQ ID NO: 1561292 - RNA, 19 nt, Homo sapiens
gaggagagcaccgcaguug

SEQ ID NO: 1561293 - RNA, 19 nt, Homo sapiens
ugaagaagaaccaugaaga

SEQ ID NO: 1561294 - RNA, 19 nt, Homo sapiens
gaaguaaagggccuauaag

SEQ ID NO: 1561295 - RNA, 19 nt, Homo sapiens
gccagucuguggagaguga

SEQ ID NO: 1561296 - RNA, 19 nt, Homo sapiens
gagaaggaaaccaugcaaa

SEQ ID NO: 1561297 - RNA, 19 nt, Homo sapiens
gcaacuccaugcaaaccau

SEQ ID NO: 1561298 - RNA, 19 nt, Homo sapiens
gacauacaguccaguccuu

SEQ ID NO: 1561299 - RNA, 19 nt, Homo sapiens
gaaccaugaagaggaagua

SEQ ID NO: 1561300 - RNA, 19 nt, Homo sapiens
aggcugagaucgccaccua

SEQ ID NO: 1561301 - RNA, 19 nt, Homo sapiens
gauuuaccuucagcuuuaa

SEQ ID NO: 1561302 - RNA, 19 nt, Homo sapiens
cuacagaauccauaagaug

SEQ ID NO: 1561303 - RNA, 19 nt, Homo sapiens
ugacgaaggacacuuggaa

SEQ ID NO: 1561304 - RNA, 19 nt, Homo sapiens
gcagggcccuaggguaauc

SEQ ID NO: 1561305 - RNA, 19 nt, Homo sapiens
ugagaccagugaugccaaa

SEQ ID NO: 1561306 - RNA, 19 nt, Homo sapiens
ggagagcaccgcaguuguc

SEQ ID NO: 1561307 - RNA, 19 nt, Homo sapiens
aggagcaccuggagaagaa

SEQ ID NO: 1561308 - RNA, 19 nt, Homo sapiens
ggaaacugaacaagcauca

SEQ ID NO: 1561309 - RNA, 19 nt, Homo sapiens
gugaggacuucaaucuuuc

SEQ ID NO: 1561310 - RNA, 19 nt, Homo sapiens
gcuccacccucuccaccaa

SEQ ID NO: 1561311 - RNA, 19 nt, Homo sapiens
ugacaagccuacagaaucc

SEQ ID NO: 1561312 - RNA, 19 nt, Homo sapiens
ggagcaggaggccaauaaa

SEQ ID NO: 1561313 - RNA, 19 nt, Homo sapiens
gggcagagggacagcacua

SEQ ID NO: 1561314 - RNA, 19 nt, Homo sapiens
ccugaguccuguccucuug

SEQ ID NO: 1561315 - RNA, 19 nt, Homo sapiens
gggagguggaggccuguua

SEQ ID NO: 1561316 - RNA, 19 nt, Homo sapiens
agaguuaggagccuggaua

SEQ ID NO: 1561317 - RNA, 19 nt, Homo sapiens
uuaggagccuggauaccaa

SEQ ID NO: 1561318 - RNA, 19 nt, Homo sapiens
ugaucaacaugacgaagga

SEQ ID NO: 1561319 - RNA, 19 nt, Homo sapiens
uagauuuaccuucagcuuu

SEQ ID NO: 1561320 - RNA, 19 nt, Homo sapiens
aaggacacuuggaaacuga

SEQ ID NO: 1561321 - RNA, 19 nt, Homo sapiens
ccuccuaccuggacagagu

SEQ ID NO: 1561322 - RNA, 19 nt, Homo sapiens
ggaucuccauguccugcuu

SEQ ID NO: 1561323 - RNA, 19 nt, Homo sapiens
gacgaaggacacuuggaaa

SEQ ID NO: 1561324 - RNA, 19 nt, Homo sapiens
gaaggaaaccaugcaaagc

SEQ ID NO: 1561325 - RNA, 19 nt, Homo sapiens
ccacauuguucugcagauc

SEQ ID NO: 1561326 - RNA, 19 nt, Homo sapiens
uaaggccuuuguccguuga

SEQ ID NO: 1561327 - RNA, 19 nt, Homo sapiens
cuucaaucuuucaaucuug

SEQ ID NO: 1561328 - RNA, 19 nt, Homo sapiens
gacagugcccacauuguuc

SEQ ID NO: 1561329 - RNA, 19 nt, Homo sapiens
gagccuggauaccaagaac

SEQ ID NO: 1561330 - RNA, 19 nt, Homo sapiens
ccuacagaauccauaagau

SEQ ID NO: 1561331 - RNA, 19 nt, Homo sapiens
ggauccugcugcacuugga

SEQ ID NO: 1561332 - RNA, 19 nt, Homo sapiens
ccaugaagaggaaguaaag

SEQ ID NO: 1561333 - RNA, 19 nt, Homo sapiens
ucagaucuuugcaaauacu

SEQ ID NO: 1561334 - RNA, 19 nt, Homo sapiens
gacuaccaccugccggaua

SEQ ID NO: 1561335 - RNA, 19 nt, Homo sapiens
uggguugacuguggaggua

SEQ ID NO: 1561336 - RNA, 19 nt, Homo sapiens
ucacuuugaucaacaugac

SEQ ID NO: 1561337 - RNA, 19 nt, Homo sapiens
agcagcaacuccaugcaaa

SEQ ID NO: 1561338 - RNA, 19 nt, Homo sapiens
gccaugacuucaagaccau

SEQ ID NO: 1561339 - RNA, 19 nt, Homo sapiens
agaaggaaaccaugcaaag

SEQ ID NO: 1561340 - RNA, 19 nt, Homo sapiens
acuaccaccugccggauau

SEQ ID NO: 1561341 - RNA, 19 nt, Homo sapiens
cagcagcaacuccaugcaa

SEQ ID NO: 1561342 - RNA, 19 nt, Homo sapiens
gguugacuguggagguaga

SEQ ID NO: 1561343 - RNA, 19 nt, Homo sapiens
ucaaggagaagcugcucuu

SEQ ID NO: 1561344 - RNA, 19 nt, Homo sapiens
cauccagaaugagaaggaa

SEQ ID NO: 1561345 - RNA, 19 nt, Homo sapiens
uaccuucagcuuuaacaaa

SEQ ID NO: 1561346 - RNA, 19 nt, Homo sapiens
ucuuagccaguuagauuua

SEQ ID NO: 1561347 - RNA, 19 nt, Homo sapiens
gagcaggaggccaauaaaa

SEQ ID NO: 1561348 - RNA, 19 nt, Homo sapiens
uagguggucucagccaaug

SEQ ID NO: 1561349 - RNA, 19 nt, Homo sapiens
uccaugggcuccacaaggu

SEQ ID NO: 1561350 - RNA, 19 nt, Homo sapiens
gagagcaccgcaguuguca

SEQ ID NO: 1561351 - RNA, 19 nt, Homo sapiens
gccuacagaauccauaaga

SEQ ID NO: 1561352 - RNA, 19 nt, Homo sapiens
acagugaggacuucaaucu

SEQ ID NO: 1561353 - RNA, 19 nt, Homo sapiens
ucaagaccaucgagaaccu

SEQ ID NO: 1561354 - RNA, 19 nt, Homo sapiens
gagacuggagccaugacuu

SEQ ID NO: 1561355 - RNA, 19 nt, Homo sapiens
agaaugagaaggaaaccau

SEQ ID NO: 1561356 - RNA, 19 nt, Homo sapiens
caaaguucugauaccuuaa

SEQ ID NO: 1561357 - RNA, 19 nt, Homo sapiens
ggcaaaguggugucugaga

SEQ ID NO: 1561358 - RNA, 19 nt, Homo sapiens
ucagcaguguggccagugu

SEQ ID NO: 1561359 - RNA, 19 nt, Homo sapiens
aaacugaacaagcaucacu

SEQ ID NO: 1561360 - RNA, 19 nt, Homo sapiens
gcagcuggaagcagagauc

SEQ ID NO: 1561361 - RNA, 19 nt, Homo sapiens
caagccuacagaauccaua

SEQ ID NO: 1561362 - RNA, 19 nt, Homo sapiens
agacuggagccaugacuuc

SEQ ID NO: 1561363 - RNA, 19 nt, Homo sapiens
guuaggagccuggauacca

SEQ ID NO: 1561364 - RNA, 19 nt, Homo sapiens
acgaccaccuggccuccua

SEQ ID NO: 1561365 - RNA, 19 nt, Homo sapiens
ccagugaugccaaaguucu

SEQ ID NO: 1561366 - RNA, 19 nt, Homo sapiens
gcaagaaacucacacagaa

SEQ ID NO: 1561367 - RNA, 19 nt, Homo sapiens
uaagguggcucugauauua

SEQ ID NO: 1561368 - RNA, 19 nt, Homo sapiens
gaaaccaccugaucuugaa

SEQ ID NO: 1561369 - RNA, 19 nt, Homo sapiens
agacagaaauggaguauug

SEQ ID NO: 1561370 - RNA, 19 nt, Homo sapiens
ccagggaucucacaaugua

SEQ ID NO: 1561371 - RNA, 19 nt, Homo sapiens
aaagaaagcugcagagauc

SEQ ID NO: 1561372 - RNA, 19 nt, Homo sapiens
gaauaaagaaggagagaaa

SEQ ID NO: 1561373 - RNA, 19 nt, Homo sapiens
ggaaaugucaggagggaua

SEQ ID NO: 1561374 - RNA, 19 nt, Homo sapiens
aaacacagccucuaagaaa

SEQ ID NO: 1561375 - RNA, 19 nt, Homo sapiens
gaauggaccuuacuacucu

SEQ ID NO: 1561376 - RNA, 19 nt, Homo sapiens
guaauucacuucauacauc

SEQ ID NO: 1561377 - RNA, 19 nt, Homo sapiens
ggccaaaggucaagcauau

SEQ ID NO: 1561378 - RNA, 19 nt, Homo sapiens
gaacuugacccuacgcauu

SEQ ID NO: 1561379 - RNA, 19 nt, Homo sapiens
gccacaaccuucuguaauu

SEQ ID NO: 1561380 - RNA, 19 nt, Homo sapiens
gcagggacauuacaaucaa

SEQ ID NO: 1561381 - RNA, 19 nt, Homo sapiens
gagaauagcuaugagucaa

SEQ ID NO: 1561382 - RNA, 19 nt, Homo sapiens
gcuuccagcuccucuguua

SEQ ID NO: 1561383 - RNA, 19 nt, Homo sapiens
ggaccuuacuacucucuuu

SEQ ID NO: 1561384 - RNA, 19 nt, Homo sapiens
ucucaaagacugaaugaua

SEQ ID NO: 1561385 - RNA, 19 nt, Homo sapiens
cgacacagaugagaaccua

SEQ ID NO: 1561386 - RNA, 19 nt, Homo sapiens
cuaagagucugaaaccauu

SEQ ID NO: 1561387 - RNA, 19 nt, Homo sapiens
ccaaaagccuuccucauaa

SEQ ID NO: 1561388 - RNA, 19 nt, Homo sapiens
cagacuggaucucuucuaa

SEQ ID NO: 1561389 - RNA, 19 nt, Homo sapiens
ccaaaggucaagcauauuu

SEQ ID NO: 1561390 - RNA, 19 nt, Homo sapiens
gaauagcuaugagucaaau

SEQ ID NO: 1561391 - RNA, 19 nt, Homo sapiens
gcacauucuugccaauuuc

SEQ ID NO: 1561392 - RNA, 19 nt, Homo sapiens
ccaggaagcugugccaaug

SEQ ID NO: 1561393 - RNA, 19 nt, Homo sapiens
agaaagaccucagagauag

SEQ ID NO: 1561394 - RNA, 19 nt, Homo sapiens
uuucuuaguucucugguua

SEQ ID NO: 1561395 - RNA, 19 nt, Homo sapiens
caguggaguugccauuaua

SEQ ID NO: 1561396 - RNA, 19 nt, Homo sapiens
caagaaagaccucagagau

SEQ ID NO: 1561397 - RNA, 19 nt, Homo sapiens
gaaaaguucugcucuaucu

SEQ ID NO: 1561398 - RNA, 19 nt, Homo sapiens
gacaagaugcugccaauuc

SEQ ID NO: 1561399 - RNA, 19 nt, Homo sapiens
gagaagagacagaaaugga

SEQ ID NO: 1561400 - RNA, 19 nt, Homo sapiens
ggacaacauucauucaaaa

SEQ ID NO: 1561401 - RNA, 19 nt, Homo sapiens
aagaaagaccucagagaua

SEQ ID NO: 1561402 - RNA, 19 nt, Homo sapiens
ggaguugccauuauaguau

SEQ ID NO: 1561403 - RNA, 19 nt, Homo sapiens
cuucauacauccaucuaaa

SEQ ID NO: 1561404 - RNA, 19 nt, Homo sapiens
cugcagagaucacuguuau

SEQ ID NO: 1561405 - RNA, 19 nt, Homo sapiens
gaagucccauguccuuauc

SEQ ID NO: 1561406 - RNA, 19 nt, Homo sapiens
gaugagaaccuagagaaga

SEQ ID NO: 1561407 - RNA, 19 nt, Homo sapiens
ggugaggcccugcuucuuu

SEQ ID NO: 1561408 - RNA, 19 nt, Homo sapiens
aagccuuccucauaaguua

SEQ ID NO: 1561409 - RNA, 19 nt, Homo sapiens
uaauuuagcuucugguacu

SEQ ID NO: 1561410 - RNA, 19 nt, Homo sapiens
acaguccucucccuauuaa

SEQ ID NO: 1561411 - RNA, 19 nt, Homo sapiens
acaagaugcugccaauuca

SEQ ID NO: 1561412 - RNA, 19 nt, Homo sapiens
ccagaagguuggacaagau

SEQ ID NO: 1561413 - RNA, 19 nt, Homo sapiens
gaguugccauuauaguauu

SEQ ID NO: 1561414 - RNA, 19 nt, Homo sapiens
ccacaaccuucuguaauuc

SEQ ID NO: 1561415 - RNA, 19 nt, Homo sapiens
uaaacuguauccuucuuuc

SEQ ID NO: 1561416 - RNA, 19 nt, Homo sapiens
acacaguccucucccuauu

SEQ ID NO: 1561417 - RNA, 19 nt, Homo sapiens
caagaaacucacacagaaa

SEQ ID NO: 1561418 - RNA, 19 nt, Homo sapiens
caacaagaaagaccucaga

SEQ ID NO: 1561419 - RNA, 19 nt, Homo sapiens
caaagaaagcugcagagau

SEQ ID NO: 1561420 - RNA, 19 nt, Homo sapiens
aauaagaguuuggugagaa

SEQ ID NO: 1561421 - RNA, 19 nt, Homo sapiens
gacaaagauuccagagcaa

SEQ ID NO: 1561422 - RNA, 19 nt, Homo sapiens
cuucacagcugacuucaca

SEQ ID NO: 1561423 - RNA, 19 nt, Homo sapiens
cagcuccucuguuaucuuc

SEQ ID NO: 1561424 - RNA, 19 nt, Homo sapiens
gcacuaugaauggaccuua

SEQ ID NO: 1561425 - RNA, 19 nt, Homo sapiens
ugagaagcaucagagaauu

SEQ ID NO: 1561426 - RNA, 19 nt, Homo sapiens
gagaagcaucagagaauug

SEQ ID NO: 1561427 - RNA, 19 nt, Homo sapiens
uagcagaguuacccucaug

SEQ ID NO: 1561428 - RNA, 19 nt, Homo sapiens
gacagaagacucaaacaca

SEQ ID NO: 1561429 - RNA, 19 nt, Homo sapiens
gagccacaaccuucuguaa

SEQ ID NO: 1561430 - RNA, 19 nt, Homo sapiens
ucaguggaguugccauuau

SEQ ID NO: 1561431 - RNA, 19 nt, Homo sapiens
ggagagaaaacuacaagua

SEQ ID NO: 1561432 - RNA, 19 nt, Homo sapiens
uaccagggaucucacaaug

SEQ ID NO: 1561433 - RNA, 19 nt, Homo sapiens
gaugagcaguggucugucu

SEQ ID NO: 1561434 - RNA, 19 nt, Homo sapiens
cauaaacuguauccuucuu

SEQ ID NO: 1561435 - RNA, 19 nt, Homo sapiens
ucaaaucuaaccugcuuaa

SEQ ID NO: 1561436 - RNA, 19 nt, Homo sapiens
gguacuacauguaucuauc

SEQ ID NO: 1561437 - RNA, 19 nt, Homo sapiens
caaacacagccucuaagaa

SEQ ID NO: 1561438 - RNA, 19 nt, Homo sapiens
gaagaaccugagaaucauu

SEQ ID NO: 1561439 - RNA, 19 nt, Homo sapiens
gauccagaauuccuaaggu

SEQ ID NO: 1561440 - RNA, 19 nt, Homo sapiens
ugaagaaccugagaaucau

SEQ ID NO: 1561441 - RNA, 19 nt, Homo sapiens
gaaaugucaggagggauaa

SEQ ID NO: 1561442 - RNA, 19 nt, Homo sapiens
ugaaaccaccugaucuuga

SEQ ID NO: 1561443 - RNA, 19 nt, Homo sapiens
agucaaaucuaaccugcuu

SEQ ID NO: 1561444 - RNA, 19 nt, Homo sapiens
gugagaagcaucagagaau

SEQ ID NO: 1561445 - RNA, 19 nt, Homo sapiens
ggucuucagccuaaucauu

SEQ ID NO: 1561446 - RNA, 19 nt, Homo sapiens
caucagagaauugcaaaug

SEQ ID NO: 1561447 - RNA, 19 nt, Homo sapiens
gacuggaucucuucuaaaa

SEQ ID NO: 1561448 - RNA, 19 nt, Homo sapiens
ggagaauagcuaugaguca

SEQ ID NO: 1561449 - RNA, 19 nt, Homo sapiens
auagagaguugcauaccuu

SEQ ID NO: 1561450 - RNA, 19 nt, Homo sapiens
gguugacguuuauaagguu

SEQ ID NO: 1561451 - RNA, 19 nt, Homo sapiens
cagaugagaaccuagagaa

SEQ ID NO: 1561452 - RNA, 19 nt, Homo sapiens
uugaagaaccugagaauca

SEQ ID NO: 1561453 - RNA, 19 nt, Homo sapiens
aggacaacauucauucaaa

SEQ ID NO: 1561454 - RNA, 19 nt, Homo sapiens
agguggcucugauauuaua

SEQ ID NO: 1561455 - RNA, 19 nt, Homo sapiens
ucaaacacagccucuaaga

SEQ ID NO: 1561456 - RNA, 19 nt, Homo sapiens
uaauaugggcacauucuug

SEQ ID NO: 1561457 - RNA, 19 nt, Homo sapiens
ccuaaucauugcauccuau

SEQ ID NO: 1561458 - RNA, 19 nt, Homo sapiens
auaagaguuuggugagaaa

SEQ ID NO: 1561459 - RNA, 19 nt, Homo sapiens
ccuaugaugccaacaagaa

SEQ ID NO: 1561460 - RNA, 19 nt, Homo sapiens
cuauaacuccugggaauaa

SEQ ID NO: 1561461 - RNA, 19 nt, Homo sapiens
agucaaccuuguauauuug

SEQ ID NO: 1561462 - RNA, 19 nt, Homo sapiens
gcucugacagcaaaguaaa

SEQ ID NO: 1561463 - RNA, 19 nt, Homo sapiens
acuguauccuucuuucuuu

SEQ ID NO: 1561464 - RNA, 19 nt, Homo sapiens
cuauuaauaugggcacauu

SEQ ID NO: 1561465 - RNA, 19 nt, Homo sapiens
cacaguccucucccuauua

SEQ ID NO: 1561466 - RNA, 19 nt, Homo sapiens
cagaagagcugaucaaguc

SEQ ID NO: 1561467 - RNA, 19 nt, Homo sapiens
ucaagaagcuggaggucaa

SEQ ID NO: 1561468 - RNA, 19 nt, Homo sapiens
ucacugagcucuucuucau

SEQ ID NO: 1561469 - RNA, 19 nt, Homo sapiens
gaacuccacucccagucuu

SEQ ID NO: 1561470 - RNA, 19 nt, Homo sapiens
ggaagacagagcagaauga

SEQ ID NO: 1561471 - RNA, 19 nt, Homo sapiens
ggacguggcucgaguuucc

SEQ ID NO: 1561472 - RNA, 19 nt, Homo sapiens
gagaagacgcgccucaaga

SEQ ID NO: 1561473 - RNA, 19 nt, Homo sapiens
gaacuuccucuuucgcauu

SEQ ID NO: 1561474 - RNA, 19 nt, Homo sapiens
gcaagcugcuggagaaggu

SEQ ID NO: 1561475 - RNA, 19 nt, Homo sapiens
gagcucuucuucauucuca

SEQ ID NO: 1561476 - RNA, 19 nt, Homo sapiens
gcgagaaccuggagaagac

SEQ ID NO: 1561477 - RNA, 19 nt, Homo sapiens
ggacgaagcgguggagguu

SEQ ID NO: 1561478 - RNA, 19 nt, Homo sapiens
gcccaaagaggaaagauug

SEQ ID NO: 1561479 - RNA, 19 nt, Homo sapiens
ggaagggaauggucaaucc

SEQ ID NO: 1561480 - RNA, 19 nt, Homo sapiens
agaggaaauugcagugauu

SEQ ID NO: 1561481 - RNA, 19 nt, Homo sapiens
gucaaucccuguccugguu

SEQ ID NO: 1561482 - RNA, 19 nt, Homo sapiens
ccaaggagaagauggagaa

SEQ ID NO: 1561483 - RNA, 19 nt, Homo sapiens
caagagcgacagcgacuga

SEQ ID NO: 1561484 - RNA, 19 nt, Homo sapiens
gcagagggucccagaggaa

SEQ ID NO: 1561485 - RNA, 19 nt, Homo sapiens
gcaauacggugagcaagcu

SEQ ID NO: 1561486 - RNA, 19 nt, Homo sapiens
gcucaaggccaccgagaug

SEQ ID NO: 1561487 - RNA, 19 nt, Homo sapiens
cagaggaaauugcagugau

SEQ ID NO: 1561488 - RNA, 19 nt, Homo sapiens
caaagaggaaagauugaau

SEQ ID NO: 1561489 - RNA, 19 nt, Homo sapiens
acugagcucuucuucauuc

SEQ ID NO: 1561490 - RNA, 19 nt, Homo sapiens
ccaaagaggaaagauugaa

SEQ ID NO: 1561491 - RNA, 19 nt, Homo sapiens
acgaagcgguggagguuga

SEQ ID NO: 1561492 - RNA, 19 nt, Homo sapiens
agacgucgcgggacaaguu

SEQ ID NO: 1561493 - RNA, 19 nt, Homo sapiens
ggagaagacgcgccucaag

SEQ ID NO: 1561494 - RNA, 19 nt, Homo sapiens
gggacaaguugcgcaaauc

SEQ ID NO: 1561495 - RNA, 19 nt, Homo sapiens
uggagaagcgcaugaacaa

SEQ ID NO: 1561496 - RNA, 19 nt, Homo sapiens
cuaccaggaugaagugaag

SEQ ID NO: 1561497 - RNA, 19 nt, Homo sapiens
gaucuaccaggaugaagug

SEQ ID NO: 1561498 - RNA, 19 nt, Homo sapiens
gaacgcuggagccaagaga

SEQ ID NO: 1561499 - RNA, 19 nt, Homo sapiens
gcagugauuccacgguuag

SEQ ID NO: 1561500 - RNA, 19 nt, Homo sapiens
agacgcgccucaagaccaa

SEQ ID NO: 1561501 - RNA, 19 nt, Homo sapiens
gggaagacagagcagaaug

SEQ ID NO: 1561502 - RNA, 19 nt, Homo sapiens
gaucucagaggaaauugca

SEQ ID NO: 1561503 - RNA, 19 nt, Homo sapiens
cuuccgaacuuccucuuuc

SEQ ID NO: 1561504 - RNA, 19 nt, Homo sapiens
cgggacaaguugcgcaaau

SEQ ID NO: 1561505 - RNA, 19 nt, Homo sapiens
gaagacagagcagaaugag

SEQ ID NO: 1561506 - RNA, 19 nt, Homo sapiens
ugcagugauuccacgguua

SEQ ID NO: 1561507 - RNA, 19 nt, Homo sapiens
gucgggaucucagaggaaa

SEQ ID NO: 1561508 - RNA, 19 nt, Homo sapiens
cuacuagaaggacgugaaa

SEQ ID NO: 1561509 - RNA, 19 nt, Homo sapiens
uuaaagucaugaucuacca

SEQ ID NO: 1561510 - RNA, 19 nt, Homo sapiens
aggagaagauggagaagac

SEQ ID NO: 1561511 - RNA, 19 nt, Homo sapiens
gguggagguugaggagguu

SEQ ID NO: 1561512 - RNA, 19 nt, Homo sapiens
gaggaaauugcagugauuc

SEQ ID NO: 1561513 - RNA, 19 nt, Homo sapiens
ggaacuccacucccagucu

SEQ ID NO: 1561514 - RNA, 19 nt, Homo sapiens
gcgcguggacgacuucaag

SEQ ID NO: 1561515 - RNA, 19 nt, Homo sapiens
ggagguugaggagguuauu

SEQ ID NO: 1561516 - RNA, 19 nt, Homo sapiens
ucaagucggaccaggugaa

SEQ ID NO: 1561517 - RNA, 19 nt, Homo sapiens
agccaaaacugcccaaaga

SEQ ID NO: 1561518 - RNA, 19 nt, Homo sapiens
ggacaaguugcgcaaaucc

SEQ ID NO: 1561519 - RNA, 19 nt, Homo sapiens
gcguggacgacuucaagaa

SEQ ID NO: 1561520 - RNA, 19 nt, Homo sapiens
ccucgcuccuuccgaacuu

SEQ ID NO: 1561521 - RNA, 19 nt, Homo sapiens
acaaguugcgcaaauccuu

SEQ ID NO: 1561522 - RNA, 19 nt, Homo sapiens
gaagacgucgcgggacaag

SEQ ID NO: 1561523 - RNA, 19 nt, Homo sapiens
uggagaaggugcgcaaggu

SEQ ID NO: 1561524 - RNA, 19 nt, Homo sapiens
cgagcaauacggugagcaa

SEQ ID NO: 1561525 - RNA, 19 nt, Homo sapiens
ggagagagccuucuagaau

SEQ ID NO: 1561526 - RNA, 19 nt, Homo sapiens
cgucaagucucuauuuaaa

SEQ ID NO: 1561527 - RNA, 19 nt, Homo sapiens
gacgucaagucucuauuua

SEQ ID NO: 1561528 - RNA, 19 nt, Homo sapiens
gagagagccuucuagaaug

SEQ ID NO: 1561529 - RNA, 19 nt, Homo sapiens
ggaagguucuugucacugu

SEQ ID NO: 1561530 - RNA, 19 nt, Homo sapiens
caaaugacgucaagucucu

SEQ ID NO: 1561531 - RNA, 19 nt, Homo sapiens
gaagagugguuuggagaga

SEQ ID NO: 1561532 - RNA, 19 nt, Homo sapiens
ugaccucacuguucuacua

SEQ ID NO: 1561533 - RNA, 19 nt, Homo sapiens
guacuucucuacccuggaa

SEQ ID NO: 1561534 - RNA, 19 nt, Homo sapiens
ucgcaucucagaauaauua

SEQ ID NO: 1561535 - RNA, 19 nt, Homo sapiens
guguguggauguauguuua

SEQ ID NO: 1561536 - RNA, 19 nt, Homo sapiens
gcagucauuugcagugaau

SEQ ID NO: 1561537 - RNA, 19 nt, Homo sapiens
agugauagcuuuggugauu

SEQ ID NO: 1561538 - RNA, 19 nt, Homo sapiens
agagagccuucuagaauga

SEQ ID NO: 1561539 - RNA, 19 nt, Homo sapiens
ccaaagccuucgcaucuca

SEQ ID NO: 1561540 - RNA, 19 nt, Homo sapiens
aaaccaaggugugucaaau

SEQ ID NO: 1561541 - RNA, 19 nt, Homo sapiens
caucagagaagacuccauu

SEQ ID NO: 1561542 - RNA, 19 nt, Homo sapiens
ugacgucaagucucuauuu

SEQ ID NO: 1561543 - RNA, 19 nt, Homo sapiens
gcagguaacccagggaaga

SEQ ID NO: 1561544 - RNA, 19 nt, Homo sapiens
gaacuccagggcugugaaa

SEQ ID NO: 1561545 - RNA, 19 nt, Homo sapiens
ccucuacucugccuucaug

SEQ ID NO: 1561546 - RNA, 19 nt, Homo sapiens
ggacccagcccuacaacau

SEQ ID NO: 1561547 - RNA, 19 nt, Homo sapiens
ggccaaagccuucgcaucu

SEQ ID NO: 1561548 - RNA, 19 nt, Homo sapiens
ccguagagaugccuucuuc

SEQ ID NO: 1561549 - RNA, 19 nt, Homo sapiens
ggcaugacccucuuuggaa

SEQ ID NO: 1561550 - RNA, 19 nt, Homo sapiens
accaaggugugucaaauga

SEQ ID NO: 1561551 - RNA, 19 nt, Homo sapiens
auaccagccuuucauccua

SEQ ID NO: 1561552 - RNA, 19 nt, Homo sapiens
uaccagccuuucauccuaa

SEQ ID NO: 1561553 - RNA, 19 nt, Homo sapiens
gugauagcuuuggugauuu

SEQ ID NO: 1561554 - RNA, 19 nt, Homo sapiens
agaagcaccugaggcagaa

SEQ ID NO: 1561555 - RNA, 19 nt, Homo sapiens
ccugugggaugacuggaaa

SEQ ID NO: 1561556 - RNA, 19 nt, Homo sapiens
ccuucgaggugacuggaua

SEQ ID NO: 1561557 - RNA, 19 nt, Homo sapiens
ccacuugggugaucauucc

SEQ ID NO: 1561558 - RNA, 19 nt, Homo sapiens
gcuguccgcugaccugaag

SEQ ID NO: 1561559 - RNA, 19 nt, Homo sapiens
gcauugcgguggccaaagc

SEQ ID NO: 1561560 - RNA, 19 nt, Homo sapiens
gaauaauuaccgcaucgau

SEQ ID NO: 1561561 - RNA, 19 nt, Homo sapiens
ugcaguggcugaagaugga

SEQ ID NO: 1561562 - RNA, 19 nt, Homo sapiens
gccuucgcaucucagaaua

SEQ ID NO: 1561563 - RNA, 19 nt, Homo sapiens
agucauuugcagugaauua

SEQ ID NO: 1561564 - RNA, 19 nt, Homo sapiens
uaccugaccucacuguucu

SEQ ID NO: 1561565 - RNA, 19 nt, Homo sapiens
gagcauugcgguggccaaa

SEQ ID NO: 1561566 - RNA, 19 nt, Homo sapiens
uauacauggugcucuggaa

SEQ ID NO: 1561567 - RNA, 19 nt, Homo sapiens
ggaugccgccugauagaca

SEQ ID NO: 1561568 - RNA, 19 nt, Homo sapiens
ugggaugacuggaaaauga

SEQ ID NO: 1561569 - RNA, 19 nt, Homo sapiens
ggucacaggcagcuuugga

SEQ ID NO: 1561570 - RNA, 19 nt, Homo sapiens
gcuggccuaugcugaagug

SEQ ID NO: 1561571 - RNA, 19 nt, Homo sapiens
ccuacaacaucagagaaga

SEQ ID NO: 1561572 - RNA, 19 nt, Homo sapiens
cgaguggaagcaacuagaa

SEQ ID NO: 1561573 - RNA, 19 nt, Homo sapiens
ugaccuuccugcugugcuu

SEQ ID NO: 1561574 - RNA, 19 nt, Homo sapiens
gcuuuggacagaucaagaa

SEQ ID NO: 1561575 - RNA, 19 nt, Homo sapiens
caucggcuuuggacagauc

SEQ ID NO: 1561576 - RNA, 19 nt, Homo sapiens
gucaguguguggauguaug

SEQ ID NO: 1561577 - RNA, 19 nt, Homo sapiens
uagcuuuggugauuuugua

SEQ ID NO: 1561578 - RNA, 19 nt, Homo sapiens
ccaucggucucaccaacau

SEQ ID NO: 1561579 - RNA, 19 nt, Homo sapiens
cuucgcaucucagaauaau

SEQ ID NO: 1561580 - RNA, 19 nt, Homo sapiens
gaugccgccugauagacau

SEQ ID NO: 1561581 - RNA, 19 nt, Homo sapiens
gcacccaugucugcagcau

SEQ ID NO: 1561582 - RNA, 19 nt, Homo sapiens
cuaccugaccucacuguuc

SEQ ID NO: 1561583 - RNA, 19 nt, Homo sapiens
ugggcugcuucguguauuu

SEQ ID NO: 1561584 - RNA, 19 nt, Homo sapiens
ccaacgggacgaucuccuu

SEQ ID NO: 1561585 - RNA, 19 nt, Homo sapiens
uggcaugacccucuuugga

SEQ ID NO: 1561586 - RNA, 19 nt, Homo sapiens
gguaacccagggaagagaa

SEQ ID NO: 1561587 - RNA, 19 nt, Homo sapiens
gcuggaugccgccugauag

SEQ ID NO: 1561588 - RNA, 19 nt, Homo sapiens
cagccaggccugagaccaa

SEQ ID NO: 1561589 - RNA, 19 nt, Homo sapiens
ugauagcuuuggugauuuu

SEQ ID NO: 1561590 - RNA, 19 nt, Homo sapiens
gcgcuggccuaugcugaag

SEQ ID NO: 1561591 - RNA, 19 nt, Homo sapiens
ccuggugucucugcucaug

SEQ ID NO: 1561592 - RNA, 19 nt, Homo sapiens
gccaaagccuucgcaucuc

SEQ ID NO: 1561593 - RNA, 19 nt, Homo sapiens
augcuggccuggcugagaa

SEQ ID NO: 1561594 - RNA, 19 nt, Homo sapiens
acccagcccuacaacauca

SEQ ID NO: 1561595 - RNA, 19 nt, Homo sapiens
gacccagcccuacaacauc

SEQ ID NO: 1561596 - RNA, 19 nt, Homo sapiens
ggcugaagauggauuucgu

SEQ ID NO: 1561597 - RNA, 19 nt, Homo sapiens
uggacuaccugaccucacu

SEQ ID NO: 1561598 - RNA, 19 nt, Homo sapiens
gaugugagcuguuagauuu

SEQ ID NO: 1561599 - RNA, 19 nt, Homo sapiens
ggucuaggauucucaguaa

SEQ ID NO: 1561600 - RNA, 19 nt, Homo sapiens
ggugagaguugaaaugaaa

SEQ ID NO: 1561601 - RNA, 19 nt, Homo sapiens
gaugugaugugagcuguua

SEQ ID NO: 1561602 - RNA, 19 nt, Homo sapiens
cauguuaucucaucuguug

SEQ ID NO: 1561603 - RNA, 19 nt, Homo sapiens
guugcuagcuuguguguuu

SEQ ID NO: 1561604 - RNA, 19 nt, Homo sapiens
gcuagaaccuuugguagaa

SEQ ID NO: 1561605 - RNA, 19 nt, Homo sapiens
gguguuacauugauugauu

SEQ ID NO: 1561606 - RNA, 19 nt, Homo sapiens
aauaugagguguuacauug

SEQ ID NO: 1561607 - RNA, 19 nt, Homo sapiens
ucaguaagaccuuugaaua

SEQ ID NO: 1561608 - RNA, 19 nt, Homo sapiens
uaucucaucuguuggcaua

SEQ ID NO: 1561609 - RNA, 19 nt, Homo sapiens
ggagaguccucagcacuuu

SEQ ID NO: 1561610 - RNA, 19 nt, Homo sapiens
gaacgucccugccuucacu

SEQ ID NO: 1561611 - RNA, 19 nt, Homo sapiens
gaaugugauuugcuuguau

SEQ ID NO: 1561612 - RNA, 19 nt, Homo sapiens
ccagagagacgcuuugaaa

SEQ ID NO: 1561613 - RNA, 19 nt, Homo sapiens
agagagagauugguguuaa

SEQ ID NO: 1561614 - RNA, 19 nt, Homo sapiens
uuacagaccugccgugugu

SEQ ID NO: 1561615 - RNA, 19 nt, Homo sapiens
ggauauuggucugguguuu

SEQ ID NO: 1561616 - RNA, 19 nt, Homo sapiens
gaacaacgcccugcacaag

SEQ ID NO: 1561617 - RNA, 19 nt, Homo sapiens
caguaagaccuuugaauaa

SEQ ID NO: 1561618 - RNA, 19 nt, Homo sapiens
gaagagagagauugguguu

SEQ ID NO: 1561619 - RNA, 19 nt, Homo sapiens
gcugaaggcccacgucgua

SEQ ID NO: 1561620 - RNA, 19 nt, Homo sapiens
ggauaauauuagccucaua

SEQ ID NO: 1561621 - RNA, 19 nt, Homo sapiens
ucaaacaggagcucucuaa

SEQ ID NO: 1561622 - RNA, 19 nt, Homo sapiens
gcccaaaccuugaugugau

SEQ ID NO: 1561623 - RNA, 19 nt, Homo sapiens
gggaacguuugcagucuuu

SEQ ID NO: 1561624 - RNA, 19 nt, Homo sapiens
gagagagauugguguuaau

SEQ ID NO: 1561625 - RNA, 19 nt, Homo sapiens
cuuaaaggguacuggauuu

SEQ ID NO: 1561626 - RNA, 19 nt, Homo sapiens
ugauucugcuguaauguaa

SEQ ID NO: 1561627 - RNA, 19 nt, Homo sapiens
gcagcaaaccuaagugugu

SEQ ID NO: 1561628 - RNA, 19 nt, Homo sapiens
cuaaaugggugagaguuga

SEQ ID NO: 1561629 - RNA, 19 nt, Homo sapiens
uaucuggucuugggucuuu

SEQ ID NO: 1561630 - RNA, 19 nt, Homo sapiens
gagcacacguccuugucuu

SEQ ID NO: 1561631 - RNA, 19 nt, Homo sapiens
ugaaugugauuugcuugua

SEQ ID NO: 1561632 - RNA, 19 nt, Homo sapiens
uggccaagguuagcgauua

SEQ ID NO: 1561633 - RNA, 19 nt, Homo sapiens
gaaagcggcaccuguaguc

SEQ ID NO: 1561634 - RNA, 19 nt, Homo sapiens
ucacuggcaucuucuuuua

SEQ ID NO: 1561635 - RNA, 19 nt, Homo sapiens
ugacguguccuucgugaaa

SEQ ID NO: 1561636 - RNA, 19 nt, Homo sapiens
gauaauauuagccucauag

SEQ ID NO: 1561637 - RNA, 19 nt, Homo sapiens
cuaacucggucauggugua

SEQ ID NO: 1561638 - RNA, 19 nt, Homo sapiens
uggaugggcuggagaacaa

SEQ ID NO: 1561639 - RNA, 19 nt, Homo sapiens
cuaagugugugcucauuuc

SEQ ID NO: 1561640 - RNA, 19 nt, Homo sapiens
gauccuguguucuucuguu

SEQ ID NO: 1561641 - RNA, 19 nt, Homo sapiens
gaucuuaagggaacguuug

SEQ ID NO: 1561642 - RNA, 19 nt, Homo sapiens
gaggaaacgcugucacugu

SEQ ID NO: 1561643 - RNA, 19 nt, Homo sapiens
gguguuaauucuugcuaga

SEQ ID NO: 1561644 - RNA, 19 nt, Homo sapiens
aauguucucuccuccguuu

SEQ ID NO: 1561645 - RNA, 19 nt, Homo sapiens
uagauuggguuaggaaaug

SEQ ID NO: 1561646 - RNA, 19 nt, Homo sapiens
guaaccagaagugcucuua

SEQ ID NO: 1561647 - RNA, 19 nt, Homo sapiens
aaccagaagugcucuuaug

SEQ ID NO: 1561648 - RNA, 19 nt, Homo sapiens
ggccaagguuagcgauuau

SEQ ID NO: 1561649 - RNA, 19 nt, Homo sapiens
caccuaagcccaagaguca

SEQ ID NO: 1561650 - RNA, 19 nt, Homo sapiens
guaagccuaucuggucuug

SEQ ID NO: 1561651 - RNA, 19 nt, Homo sapiens
uagaaccuuugguagaauu

SEQ ID NO: 1561652 - RNA, 19 nt, Homo sapiens
cuuaugaugucuuccuuug

SEQ ID NO: 1561653 - RNA, 19 nt, Homo sapiens
ugguagaauuugccaguaa

SEQ ID NO: 1561654 - RNA, 19 nt, Homo sapiens
uuacucugcugcugaaugu

SEQ ID NO: 1561655 - RNA, 19 nt, Homo sapiens
ggugagagcacacguccuu

SEQ ID NO: 1561656 - RNA, 19 nt, Homo sapiens
agauugguguuaauucuug

SEQ ID NO: 1561657 - RNA, 19 nt, Homo sapiens
auauuagccucauagauug

SEQ ID NO: 1561658 - RNA, 19 nt, Homo sapiens
gcuguuagauuuucaagga

SEQ ID NO: 1561659 - RNA, 19 nt, Homo sapiens
aaugaaagcggcaccugua

SEQ ID NO: 1561660 - RNA, 19 nt, Homo sapiens
gguagaauuugccaguaag

SEQ ID NO: 1561661 - RNA, 19 nt, Homo sapiens
gugauucugcuguaaugua

SEQ ID NO: 1561662 - RNA, 19 nt, Homo sapiens
uaugaugucuuccuuuggu

SEQ ID NO: 1561663 - RNA, 19 nt, Homo sapiens
guccuaauuuguuaagugu

SEQ ID NO: 1561664 - RNA, 19 nt, Homo sapiens
gaacguuugcagucuuuca

SEQ ID NO: 1561665 - RNA, 19 nt, Homo sapiens
acaacgcccugcacaagga

SEQ ID NO: 1561666 - RNA, 19 nt, Homo sapiens
gagagacgcuuugaaaaca

SEQ ID NO: 1561667 - RNA, 19 nt, Homo sapiens
gggugagaguugaaaugaa

SEQ ID NO: 1561668 - RNA, 19 nt, Homo sapiens
cuguuaauaugagguguua

SEQ ID NO: 1561669 - RNA, 19 nt, Homo sapiens
gcucuuaugcccaaaccuu

SEQ ID NO: 1561670 - RNA, 19 nt, Homo sapiens
uagcgauuaugcuucugua

SEQ ID NO: 1561671 - RNA, 19 nt, Homo sapiens
uaugagguguuacauugau

SEQ ID NO: 1561672 - RNA, 19 nt, Homo sapiens
cccaaaccuugaugugauu

SEQ ID NO: 1561673 - RNA, 19 nt, Homo sapiens
gguuagcgauuaugcuucu

SEQ ID NO: 1561674 - RNA, 19 nt, Homo sapiens
gagucacuguauuccuuaa

SEQ ID NO: 1561675 - RNA, 19 nt, Homo sapiens
agagauugguguuaauucu

SEQ ID NO: 1561676 - RNA, 19 nt, Homo sapiens
cauuuacucugcugcugaa

SEQ ID NO: 1561677 - RNA, 19 nt, Homo sapiens
acucggucaugguguauaa

SEQ ID NO: 1561678 - RNA, 19 nt, Homo sapiens
ucauuucugugggcccuua

SEQ ID NO: 1561679 - RNA, 19 nt, Homo sapiens
uuauagaucguucggauug

SEQ ID NO: 1561680 - RNA, 19 nt, Homo sapiens
gagauugguguuaauucuu

SEQ ID NO: 1561681 - RNA, 19 nt, Homo sapiens
gugauuugcuuguauuuug

SEQ ID NO: 1561682 - RNA, 19 nt, Homo sapiens
gagccaguuuccauuugug

SEQ ID NO: 1561683 - RNA, 19 nt, Homo sapiens
cugagucacuguauuccuu

SEQ ID NO: 1561684 - RNA, 19 nt, Homo sapiens
uuuagucacuggcaucuuc

SEQ ID NO: 1561685 - RNA, 19 nt, Homo sapiens
gagagauugguguuaauuc

SEQ ID NO: 1561686 - RNA, 19 nt, Homo sapiens
ccucauagauuggguuagg

SEQ ID NO: 1561687 - RNA, 19 nt, Homo sapiens
guucuucuguuaauaugag

SEQ ID NO: 1561688 - RNA, 19 nt, Homo sapiens
acacguccuugucuuguuc

SEQ ID NO: 1561689 - RNA, 19 nt, Homo sapiens
gcacacguccuugucuugu

SEQ ID NO: 1561690 - RNA, 19 nt, Homo sapiens
gagagcacauccgcaaguc

SEQ ID NO: 1561691 - RNA, 19 nt, Homo sapiens
ccacugggcuugggguuaa

SEQ ID NO: 1561692 - RNA, 19 nt, Homo sapiens
guuaauaugagguguuaca

SEQ ID NO: 1561693 - RNA, 19 nt, Homo sapiens
gaaaacaaaacaggaaaga

SEQ ID NO: 1561694 - RNA, 19 nt, Homo sapiens
guugagccaguuuccauuu

SEQ ID NO: 1561695 - RNA, 19 nt, Homo sapiens
aaacaggagcucucuaagg

SEQ ID NO: 1561696 - RNA, 19 nt, Homo sapiens
gaugugauucugcuguaau

SEQ ID NO: 1561697 - RNA, 19 nt, Homo sapiens
ugagccaguuuccauuugu

SEQ ID NO: 1561698 - RNA, 19 nt, Homo sapiens
ugagagaagucaaguauuu

SEQ ID NO: 1561699 - RNA, 19 nt, Homo sapiens
gaccaggacugccacuuua

SEQ ID NO: 1561700 - RNA, 19 nt, Homo sapiens
gaaaggacaauaagaaaga

SEQ ID NO: 1561701 - RNA, 19 nt, Homo sapiens
uaagaaagaggcccuguua

SEQ ID NO: 1561702 - RNA, 19 nt, Homo sapiens
gcgaagguguguuucagua

SEQ ID NO: 1561703 - RNA, 19 nt, Homo sapiens
ggaauucccuucuucucuu

SEQ ID NO: 1561704 - RNA, 19 nt, Homo sapiens
gaaagaaaggacaauaaga

SEQ ID NO: 1561705 - RNA, 19 nt, Homo sapiens
gcaaagcuccuguacaugu

SEQ ID NO: 1561706 - RNA, 19 nt, Homo sapiens
agacuuggauggaagaauu

SEQ ID NO: 1561707 - RNA, 19 nt, Homo sapiens
gaaagagauuccagacagu

SEQ ID NO: 1561708 - RNA, 19 nt, Homo sapiens
gauaaagacuauagugaac

SEQ ID NO: 1561709 - RNA, 19 nt, Homo sapiens
ccgcaaagcuccuguacau

SEQ ID NO: 1561710 - RNA, 19 nt, Homo sapiens
gaaggaagccaacgacauc

SEQ ID NO: 1561711 - RNA, 19 nt, Homo sapiens
gagauaaagacuauaguga

SEQ ID NO: 1561712 - RNA, 19 nt, Homo sapiens
gaagguguguuucaguaca

SEQ ID NO: 1561713 - RNA, 19 nt, Homo sapiens
ggaccaggacugccacuuu

SEQ ID NO: 1561714 - RNA, 19 nt, Homo sapiens
gcaaauaugaucccuugga

SEQ ID NO: 1561715 - RNA, 19 nt, Homo sapiens
gaauggcgaagguguguuu

SEQ ID NO: 1561716 - RNA, 19 nt, Homo sapiens
gaacuggaagcaauugaug

SEQ ID NO: 1561717 - RNA, 19 nt, Homo sapiens
gcucaucguuggcugguau

SEQ ID NO: 1561718 - RNA, 19 nt, Homo sapiens
gcaaccaaaucaucgagau

SEQ ID NO: 1561719 - RNA, 19 nt, Homo sapiens
gcgcugaaacgacauuauu

SEQ ID NO: 1561720 - RNA, 19 nt, Homo sapiens
ucagaaguaugacgagaug

SEQ ID NO: 1561721 - RNA, 19 nt, Homo sapiens
ugaccuaucagaaguauga

SEQ ID NO: 1561722 - RNA, 19 nt, Homo sapiens
gaauucccuucuucucuug

SEQ ID NO: 1561723 - RNA, 19 nt, Homo sapiens
gaacaugaagcuuuucuuu

SEQ ID NO: 1561724 - RNA, 19 nt, Homo sapiens
gaagauccaagccaugguu

SEQ ID NO: 1561725 - RNA, 19 nt, Homo sapiens
agaaagaggcccuguuaga

SEQ ID NO: 1561726 - RNA, 19 nt, Homo sapiens
gcaucucccuggcuguaaa

SEQ ID NO: 1561727 - RNA, 19 nt, Homo sapiens
ggcuagagguguccaugaa

SEQ ID NO: 1561728 - RNA, 19 nt, Homo sapiens
gcuagacaaugcuaagauc

SEQ ID NO: 1561729 - RNA, 19 nt, Homo sapiens
agacaaugcuaagaucuug

SEQ ID NO: 1561730 - RNA, 19 nt, Homo sapiens
gcccagguauucagucaug

SEQ ID NO: 1561731 - RNA, 19 nt, Homo sapiens
gaauuucccaggcuaugaa

SEQ ID NO: 1561732 - RNA, 19 nt, Homo sapiens
agucagaacuggaagcaau

SEQ ID NO: 1561733 - RNA, 19 nt, Homo sapiens
aggccaagcugaccuauca

SEQ ID NO: 1561734 - RNA, 19 nt, Homo sapiens
gaaagaggcccuguuagac

SEQ ID NO: 1561735 - RNA, 19 nt, Homo sapiens
caaagcuccuguacaugug

SEQ ID NO: 1561736 - RNA, 19 nt, Homo sapiens
caggaguucugcaaccaaa

SEQ ID NO: 1561737 - RNA, 19 nt, Homo sapiens
guauuugaauuuccagcaa

SEQ ID NO: 1561738 - RNA, 19 nt, Homo sapiens
ccauugaggaacucuauaa

SEQ ID NO: 1561739 - RNA, 19 nt, Homo sapiens
uggcugguauaaugagaua

SEQ ID NO: 1561740 - RNA, 19 nt, Homo sapiens
uaucuaugaugaggucuuu

SEQ ID NO: 1561741 - RNA, 19 nt, Homo sapiens
ccaacccgcuguuugaaag

SEQ ID NO: 1561742 - RNA, 19 nt, Homo sapiens
gacugcagcuguaucaagu

SEQ ID NO: 1561743 - RNA, 19 nt, Homo sapiens
caauugaguuucugaagcu

SEQ ID NO: 1561744 - RNA, 19 nt, Homo sapiens
cgacaucgugcucuauuug

SEQ ID NO: 1561745 - RNA, 19 nt, Homo sapiens
gcaaaaggcaaaacaaaau

SEQ ID NO: 1561746 - RNA, 19 nt, Homo sapiens
aaacgacauuauucuggaa

SEQ ID NO: 1561747 - RNA, 19 nt, Homo sapiens
agugaacgcaguagaauuu

SEQ ID NO: 1561748 - RNA, 19 nt, Homo sapiens
gcugguauaaugagauaaa

SEQ ID NO: 1561749 - RNA, 19 nt, Homo sapiens
ccaccucugaguacuauaa

SEQ ID NO: 1561750 - RNA, 19 nt, Homo sapiens
gacaccaucugcuucaucu

SEQ ID NO: 1561751 - RNA, 19 nt, Homo sapiens
gagagaagucaaguauuug

SEQ ID NO: 1561752 - RNA, 19 nt, Homo sapiens
ugacccguaucuaugauga

SEQ ID NO: 1561753 - RNA, 19 nt, Homo sapiens
gaagaauugccaaccucaa

SEQ ID NO: 1561754 - RNA, 19 nt, Homo sapiens
ggccaccucugaguacuau

SEQ ID NO: 1561755 - RNA, 19 nt, Homo sapiens
ugaaagaaaggacaauaag

SEQ ID NO: 1561756 - RNA, 19 nt, Homo sapiens
ccacgucaacuucagcaaa

SEQ ID NO: 1561757 - RNA, 19 nt, Homo sapiens
gaaguaugacgagaugaug

SEQ ID NO: 1561758 - RNA, 19 nt, Homo sapiens
uuugaugacugcagcugua

SEQ ID NO: 1561759 - RNA, 19 nt, Homo sapiens
gcagggaggagagaguaaa

SEQ ID NO: 1561760 - RNA, 19 nt, Homo sapiens
aagaggcccuguuagacuu

SEQ ID NO: 1561761 - RNA, 19 nt, Homo sapiens
caagaggugcgagaaauuc

SEQ ID NO: 1561762 - RNA, 19 nt, Homo sapiens
ucaagaggugcgagaaauu

SEQ ID NO: 1561763 - RNA, 19 nt, Homo sapiens
gcccgugccuugggaauuc

SEQ ID NO: 1561764 - RNA, 19 nt, Homo sapiens
gaauugccaaccucaacaa

SEQ ID NO: 1561765 - RNA, 19 nt, Homo sapiens
gaugacugcagcuguauca

SEQ ID NO: 1561766 - RNA, 19 nt, Homo sapiens
gcgcccagguauucaguca

SEQ ID NO: 1561767 - RNA, 19 nt, Homo sapiens
gaccauugaggaacucuau

SEQ ID NO: 1561768 - RNA, 19 nt, Homo sapiens
gggcuggagauuucauaaa

SEQ ID NO: 1561769 - RNA, 19 nt, Homo sapiens
aauaaagucagaacuggaa

SEQ ID NO: 1561770 - RNA, 19 nt, Homo sapiens
ggcuggagauuucauaaaa

SEQ ID NO: 1561771 - RNA, 19 nt, Homo sapiens
ggaguucugcaaccaaauc

SEQ ID NO: 1561772 - RNA, 19 nt, Homo sapiens
uauagugaacgcaguagaa

SEQ ID NO: 1561773 - RNA, 19 nt, Homo sapiens
caaccuggagcucaucguu

SEQ ID NO: 1561774 - RNA, 19 nt, Homo sapiens
gcuagagguguccaugaaa

SEQ ID NO: 1561775 - RNA, 19 nt, Homo sapiens
augcuaagaucuuguacga

SEQ ID NO: 1561776 - RNA, 19 nt, Homo sapiens
ucuuugagcuggugaaggu

SEQ ID NO: 1561777 - RNA, 19 nt, Homo sapiens
gacaucgugcucuauuuga

SEQ ID NO: 1561778 - RNA, 19 nt, Homo sapiens
acgcugagcuagacaaugc

SEQ ID NO: 1561779 - RNA, 19 nt, Homo sapiens
gauggaacaagccgacuuc

SEQ ID NO: 1561780 - RNA, 19 nt, Homo sapiens
ggacaccaucugcuucauc

SEQ ID NO: 1561781 - RNA, 19 nt, Homo sapiens
ugagauaaagacuauagug

SEQ ID NO: 1561782 - RNA, 19 nt, Homo sapiens
ucugagagaagucaaguau

SEQ ID NO: 1561783 - RNA, 19 nt, Homo sapiens
caucgugcucuauuugaaa

SEQ ID NO: 1561784 - RNA, 19 nt, Homo sapiens
gcaaggugaaaucgaggaa

SEQ ID NO: 1561785 - RNA, 19 nt, Homo sapiens
cuguaaaugugcugaagga

SEQ ID NO: 1561786 - RNA, 19 nt, Homo sapiens
cagggaugcuggagugaag

SEQ ID NO: 1561787 - RNA, 19 nt, Homo sapiens
gagcuagacaaugcuaaga

SEQ ID NO: 1561788 - RNA, 19 nt, Homo sapiens
ucacugaagggcugaagga

SEQ ID NO: 1561789 - RNA, 19 nt, Homo sapiens
cacgucaacuucagcaaag

SEQ ID NO: 1561790 - RNA, 19 nt, Homo sapiens
acaucgugcucuauuugaa

SEQ ID NO: 1561791 - RNA, 19 nt, Homo sapiens
uaucaaguccuccgcaaag

SEQ ID NO: 1561792 - RNA, 19 nt, Homo sapiens
cagcgcauccagaccauug

SEQ ID NO: 1561793 - RNA, 19 nt, Homo sapiens
cggccaacccgcuguuuga

SEQ ID NO: 1561794 - RNA, 19 nt, Homo sapiens
gcugaaacgacauuauucu

SEQ ID NO: 1561795 - RNA, 19 nt, Homo sapiens
gacuauagugaacgcagua

SEQ ID NO: 1561796 - RNA, 19 nt, Homo sapiens
aaggugaaaucgaggaagu

SEQ ID NO: 1561797 - RNA, 19 nt, Homo sapiens
cuagagguguccaugaaac

SEQ ID NO: 1561798 - RNA, 19 nt, Homo sapiens
gaaagccacugcucuuauu

SEQ ID NO: 1561799 - RNA, 19 nt, Homo sapiens
caaauaaggugaagaucaa

SEQ ID NO: 1561800 - RNA, 19 nt, Homo sapiens
gcagggacaugucgcauuu

SEQ ID NO: 1561801 - RNA, 19 nt, Homo sapiens
uaacaucgcuucagcacaa

SEQ ID NO: 1561802 - RNA, 19 nt, Homo sapiens
gugaagaacugcuacauau

SEQ ID NO: 1561803 - RNA, 19 nt, Homo sapiens
gagaagccuuaucaaauuu

SEQ ID NO: 1561804 - RNA, 19 nt, Homo sapiens
caaagaagauuguuguauc

SEQ ID NO: 1561805 - RNA, 19 nt, Homo sapiens
ggagauccgugucaugauu

SEQ ID NO: 1561806 - RNA, 19 nt, Homo sapiens
agagaagccuuaucaaauu

SEQ ID NO: 1561807 - RNA, 19 nt, Homo sapiens
ggauugaacuuugcauaaa

SEQ ID NO: 1561808 - RNA, 19 nt, Homo sapiens
gauagcaguuccaagauga

SEQ ID NO: 1561809 - RNA, 19 nt, Homo sapiens
gaagaacugcuacauauuc

SEQ ID NO: 1561810 - RNA, 19 nt, Homo sapiens
gaacgcaaggagaauaaua

SEQ ID NO: 1561811 - RNA, 19 nt, Homo sapiens
gaacgaagccacacaacga

SEQ ID NO: 1561812 - RNA, 19 nt, Homo sapiens
caaccaaagucaaagaaga

SEQ ID NO: 1561813 - RNA, 19 nt, Homo sapiens
ccagaagaaucauagauau

SEQ ID NO: 1561814 - RNA, 19 nt, Homo sapiens
gcaaggagaauaauacuca

SEQ ID NO: 1561815 - RNA, 19 nt, Homo sapiens
guagagaagccuuaucaaa

SEQ ID NO: 1561816 - RNA, 19 nt, Homo sapiens
ugacuggccuugucuucua

SEQ ID NO: 1561817 - RNA, 19 nt, Homo sapiens
acacaacgauagaaucuug

SEQ ID NO: 1561818 - RNA, 19 nt, Homo sapiens
ggauagcaguuccaagaug

SEQ ID NO: 1561819 - RNA, 19 nt, Homo sapiens
gcaaagggccgaccaggau

SEQ ID NO: 1561820 - RNA, 19 nt, Homo sapiens
gcaauguugagacaaauaa

SEQ ID NO: 1561821 - RNA, 19 nt, Homo sapiens
ggacugacucuaacuaugu

SEQ ID NO: 1561822 - RNA, 19 nt, Homo sapiens
uuucacagcucuucucuga

SEQ ID NO: 1561823 - RNA, 19 nt, Homo sapiens
uaagaaauuuaccgguuga

SEQ ID NO: 1561824 - RNA, 19 nt, Homo sapiens
gugaguggauugccuagaa

SEQ ID NO: 1561825 - RNA, 19 nt, Homo sapiens
caaacgcccugaguccuuu

SEQ ID NO: 1561826 - RNA, 19 nt, Homo sapiens
uagagaagccuuaucaaau

SEQ ID NO: 1561827 - RNA, 19 nt, Homo sapiens
gaaauuuaccgguugaaag

SEQ ID NO: 1561828 - RNA, 19 nt, Homo sapiens
ggacucaugcaauaagaaa

SEQ ID NO: 1561829 - RNA, 19 nt, Homo sapiens
gaagaagaagcuaggaaug

SEQ ID NO: 1561830 - RNA, 19 nt, Homo sapiens
acaaucauaugguagagaa

SEQ ID NO: 1561831 - RNA, 19 nt, Homo sapiens
ggcuuggacucaugcaaua

SEQ ID NO: 1561832 - RNA, 19 nt, Homo sapiens
gcucuuggcuuccauacgu

SEQ ID NO: 1561833 - RNA, 19 nt, Homo sapiens
gaaagucagggauccaaug

SEQ ID NO: 1561834 - RNA, 19 nt, Homo sapiens
gaagggaggcaucagugaa

SEQ ID NO: 1561835 - RNA, 19 nt, Homo sapiens
ccuaugggcugcucucuca

SEQ ID NO: 1561836 - RNA, 19 nt, Homo sapiens
ggacaagucaccaguuugg

SEQ ID NO: 1561837 - RNA, 19 nt, Homo sapiens
ucagcacaaucauauggua

SEQ ID NO: 1561838 - RNA, 19 nt, Homo sapiens
ggagaauaauacucauaag

SEQ ID NO: 1561839 - RNA, 19 nt, Homo sapiens
ggacugacuccuugaaucu

SEQ ID NO: 1561840 - RNA, 19 nt, Homo sapiens
gaacugcuacauauucuac

SEQ ID NO: 1561841 - RNA, 19 nt, Homo sapiens
gaggaacgcaaggagaaua

SEQ ID NO: 1561842 - RNA, 19 nt, Homo sapiens
gauuguuucucccuccaaa

SEQ ID NO: 1561843 - RNA, 19 nt, Homo sapiens
gcucauggguggacugacu

SEQ ID NO: 1561844 - RNA, 19 nt, Homo sapiens
ccgauggcauggugcuaua

SEQ ID NO: 1561845 - RNA, 19 nt, Homo sapiens
cuaacuaugugaagaacug

SEQ ID NO: 1561846 - RNA, 19 nt, Homo sapiens
aaugggagauggcaacaau

SEQ ID NO: 1561847 - RNA, 19 nt, Homo sapiens
ccugaggcuuggcaaagua

SEQ ID NO: 1561848 - RNA, 19 nt, Homo sapiens
acaaauaaggugaagauca

SEQ ID NO: 1561849 - RNA, 19 nt, Homo sapiens
cccagaagaaucauagaua

SEQ ID NO: 1561850 - RNA, 19 nt, Homo sapiens
gauugaacuuugcauaaac

SEQ ID NO: 1561851 - RNA, 19 nt, Homo sapiens
ggagccaaccaaagucaaa

SEQ ID NO: 1561852 - RNA, 19 nt, Homo sapiens
gggccuugauguuucuuga

SEQ ID NO: 1561853 - RNA, 19 nt, Homo sapiens
caaagucaaagaagauugu

SEQ ID NO: 1561854 - RNA, 19 nt, Homo sapiens
ccaaggaccugccccagaa

SEQ ID NO: 1561855 - RNA, 19 nt, Homo sapiens
gcuguaugacuguguguuu

SEQ ID NO: 1561856 - RNA, 19 nt, Homo sapiens
agacaaauaaggugaagau

SEQ ID NO: 1561857 - RNA, 19 nt, Homo sapiens
ucaauggcacucuggguaa

SEQ ID NO: 1561858 - RNA, 19 nt, Homo sapiens
gcucuggccucugcucugu

SEQ ID NO: 1561859 - RNA, 19 nt, Homo sapiens
ugaaagccacugcucuuau

SEQ ID NO: 1561860 - RNA, 19 nt, Homo sapiens
ugaagaacugcuacauauu

SEQ ID NO: 1561861 - RNA, 19 nt, Homo sapiens
ggaucaauaugaccacacu

SEQ ID NO: 1561862 - RNA, 19 nt, Homo sapiens
ccuauucucuccucucucu

SEQ ID NO: 1561863 - RNA, 19 nt, Homo sapiens
ggagaagggaggcaucagu

SEQ ID NO: 1561864 - RNA, 19 nt, Homo sapiens
gcacaaucauaugguagag

SEQ ID NO: 1561865 - RNA, 19 nt, Homo sapiens
uagcuuggucuccauguuu

SEQ ID NO: 1561866 - RNA, 19 nt, Homo sapiens
ugaagaagaagcuaggaau

SEQ ID NO: 1561867 - RNA, 19 nt, Homo sapiens
ugugaagaacugcuacaua

SEQ ID NO: 1561868 - RNA, 19 nt, Homo sapiens
uggauugaacuuugcauaa

SEQ ID NO: 1561869 - RNA, 19 nt, Homo sapiens
caaagucggaucucaagag

SEQ ID NO: 1561870 - RNA, 19 nt, Homo sapiens
gguccaaagucggaucuca

SEQ ID NO: 1561871 - RNA, 19 nt, Homo sapiens
ccacacaacgauagaaucu

SEQ ID NO: 1561872 - RNA, 19 nt, Homo sapiens
caugucgucuggucuuugu

SEQ ID NO: 1561873 - RNA, 19 nt, Homo sapiens
gagaauaauacucauaagc

SEQ ID NO: 1561874 - RNA, 19 nt, Homo sapiens
ggcaauguugagacaaaua

SEQ ID NO: 1561875 - RNA, 19 nt, Homo sapiens
gggcaauguugagacaaau

SEQ ID NO: 1561876 - RNA, 19 nt, Homo sapiens
gggaggcaucagugaauuu

SEQ ID NO: 1561877 - RNA, 19 nt, Homo sapiens
agccacugcucuuauuaaa

SEQ ID NO: 1561878 - RNA, 19 nt, Homo sapiens
aaagccacugcucuuauua

SEQ ID NO: 1561879 - RNA, 19 nt, Homo sapiens
cauauucuacagugcuuaa

SEQ ID NO: 1561880 - RNA, 19 nt, Homo sapiens
ccauaggacugacucuaac

SEQ ID NO: 1561881 - RNA, 19 nt, Homo sapiens
ccaaacgcccugaguccuu

SEQ ID NO: 1561882 - RNA, 19 nt, Homo sapiens
acugacuccuugaaucuuu

SEQ ID NO: 1561883 - RNA, 19 nt, Homo sapiens
cccauaggacugacucuaa

SEQ ID NO: 1561884 - RNA, 19 nt, Homo sapiens
gagccucuguuuucccaua

SEQ ID NO: 1561885 - RNA, 19 nt, Homo sapiens
cuuccugucucauucuuga

SEQ ID NO: 1561886 - RNA, 19 nt, Homo sapiens
guggugagcccauccuuuc

SEQ ID NO: 1561887 - RNA, 19 nt, Homo sapiens
gaagccacacaacgauaga

SEQ ID NO: 1561888 - RNA, 19 nt, Homo sapiens
caaggagaauaauacucau

SEQ ID NO: 1561889 - RNA, 19 nt, Homo sapiens
ugaguggauugccuagaau

SEQ ID NO: 1561890 - RNA, 19 nt, Homo sapiens
gagauccgugucaugauug

SEQ ID NO: 1561891 - RNA, 19 nt, Homo sapiens
gccuugauguuucuugauc

SEQ ID NO: 1561892 - RNA, 19 nt, Homo sapiens
gacugacucuaacuaugug

SEQ ID NO: 1561893 - RNA, 19 nt, Homo sapiens
gugugugugucuccuauuc

SEQ ID NO: 1561894 - RNA, 19 nt, Homo sapiens
gauuagccagggucgauga

SEQ ID NO: 1561895 - RNA, 19 nt, Homo sapiens
gaagccuuaucaaauuugc

SEQ ID NO: 1561896 - RNA, 19 nt, Homo sapiens
guggauugaacuuugcaua

SEQ ID NO: 1561897 - RNA, 19 nt, Homo sapiens
ucucggcguuuccacuuug

SEQ ID NO: 1561898 - RNA, 19 nt, Homo sapiens
gaaccaagccaauguauuu

SEQ ID NO: 1561899 - RNA, 19 nt, Homo sapiens
gcucagaauuaaucucuua

SEQ ID NO: 1561900 - RNA, 19 nt, Homo sapiens
gaacauuccuuuccaugga

SEQ ID NO: 1561901 - RNA, 19 nt, Homo sapiens
gcaauuggaguacuuauaa

SEQ ID NO: 1561902 - RNA, 19 nt, Homo sapiens
caaaugauauaaccaguga

SEQ ID NO: 1561903 - RNA, 19 nt, Homo sapiens
ccacaauccuuuaucuuaa

SEQ ID NO: 1561904 - RNA, 19 nt, Homo sapiens
gagagaagcuugugauacu

SEQ ID NO: 1561905 - RNA, 19 nt, Homo sapiens
gcucaagaauggacagaaa

SEQ ID NO: 1561906 - RNA, 19 nt, Homo sapiens
caagaugucuacagucaga

SEQ ID NO: 1561907 - RNA, 19 nt, Homo sapiens
ugaugucucucccaacuua

SEQ ID NO: 1561908 - RNA, 19 nt, Homo sapiens
gaacuagcaucagucauca

SEQ ID NO: 1561909 - RNA, 19 nt, Homo sapiens
gaaauuguccugcaaaguc

SEQ ID NO: 1561910 - RNA, 19 nt, Homo sapiens
uaacaaugcucaucacucu

SEQ ID NO: 1561911 - RNA, 19 nt, Homo sapiens
gaccaccacuucaacugua

SEQ ID NO: 1561912 - RNA, 19 nt, Homo sapiens
aaagggcaaugaacaaauu

SEQ ID NO: 1561913 - RNA, 19 nt, Homo sapiens
cauauuuggcucagaauua

SEQ ID NO: 1561914 - RNA, 19 nt, Homo sapiens
ucucaggucuucagauaaa

SEQ ID NO: 1561915 - RNA, 19 nt, Homo sapiens
ucucuuagccugugugaua

SEQ ID NO: 1561916 - RNA, 19 nt, Homo sapiens
cuuccuggcuugucucuua

SEQ ID NO: 1561917 - RNA, 19 nt, Homo sapiens
uguauaaucuccaccuauu

SEQ ID NO: 1561918 - RNA, 19 nt, Homo sapiens
aaacuuacuugacaacuca

SEQ ID NO: 1561919 - RNA, 19 nt, Homo sapiens
ccacuucgaccaucucuuu

SEQ ID NO: 1561920 - RNA, 19 nt, Homo sapiens
ggaacacccucuccugcuu

SEQ ID NO: 1561921 - RNA, 19 nt, Homo sapiens
aaaccaaacuguaccuuag

SEQ ID NO: 1561922 - RNA, 19 nt, Homo sapiens
ccacuuaaccuauaacuac

SEQ ID NO: 1561923 - RNA, 19 nt, Homo sapiens
gagauuccucugcacaaua

SEQ ID NO: 1561924 - RNA, 19 nt, Homo sapiens
ucugaagucugcuuucuga

SEQ ID NO: 1561925 - RNA, 19 nt, Homo sapiens
uuucaugguugcagauaua

SEQ ID NO: 1561926 - RNA, 19 nt, Homo sapiens
gaccaucucuuugacugaa

SEQ ID NO: 1561927 - RNA, 19 nt, Homo sapiens
gcuggugucuaccuucaaa

SEQ ID NO: 1561928 - RNA, 19 nt, Homo sapiens
agauuccucugcacaauaa

SEQ ID NO: 1561929 - RNA, 19 nt, Homo sapiens
ugccauaccuugaaauugu

SEQ ID NO: 1561930 - RNA, 19 nt, Homo sapiens
gauaaugacagcaauugga

SEQ ID NO: 1561931 - RNA, 19 nt, Homo sapiens
gagccauggucacucauau

SEQ ID NO: 1561932 - RNA, 19 nt, Homo sapiens
gaaccugcaacuacaaaug

SEQ ID NO: 1561933 - RNA, 19 nt, Homo sapiens
uaucuuaaccugaacauuc

SEQ ID NO: 1561934 - RNA, 19 nt, Homo sapiens
cccuguauauugugacuua

SEQ ID NO: 1561935 - RNA, 19 nt, Homo sapiens
caaauaaucaccacuucga

SEQ ID NO: 1561936 - RNA, 19 nt, Homo sapiens
gcaccuaccgaucauuuau

SEQ ID NO: 1561937 - RNA, 19 nt, Homo sapiens
gcaaguacagccacugaau

SEQ ID NO: 1561938 - RNA, 19 nt, Homo sapiens
cgcaaugacuggucuaugu

SEQ ID NO: 1561939 - RNA, 19 nt, Homo sapiens
gauacuggcagcucaagaa

SEQ ID NO: 1561940 - RNA, 19 nt, Homo sapiens
gccauggucacucauauuu

SEQ ID NO: 1561941 - RNA, 19 nt, Homo sapiens
ugucuaccuucaaaugaua

SEQ ID NO: 1561942 - RNA, 19 nt, Homo sapiens
ggaaacuccacauucugua

SEQ ID NO: 1561943 - RNA, 19 nt, Homo sapiens
cuacuguaacuucuacuua

SEQ ID NO: 1561944 - RNA, 19 nt, Homo sapiens
uccacaauccuuuaucuua

SEQ ID NO: 1561945 - RNA, 19 nt, Homo sapiens
uccaggagauaaucaacua

SEQ ID NO: 1561946 - RNA, 19 nt, Homo sapiens
uaaucugacucuggcauaa

SEQ ID NO: 1561947 - RNA, 19 nt, Homo sapiens
uaacuacuguaacuucuac

SEQ ID NO: 1561948 - RNA, 19 nt, Homo sapiens
acacacagguaaaagaaua

SEQ ID NO: 1561949 - RNA, 19 nt, Homo sapiens
ugacuuacuuucuaaucug

SEQ ID NO: 1561950 - RNA, 19 nt, Homo sapiens
acaaugcucaucacucuuu

SEQ ID NO: 1561951 - RNA, 19 nt, Homo sapiens
ccaagccaauguauuucuu

SEQ ID NO: 1561952 - RNA, 19 nt, Homo sapiens
cuauucaucugaggacuaa

SEQ ID NO: 1561953 - RNA, 19 nt, Homo sapiens
cuacauucccuucaacuga

SEQ ID NO: 1561954 - RNA, 19 nt, Homo sapiens
gacagcaauuggaguacuu

SEQ ID NO: 1561955 - RNA, 19 nt, Homo sapiens
guacaauaugugagucuaa

SEQ ID NO: 1561956 - RNA, 19 nt, Homo sapiens
caagccaauguauuucuua

SEQ ID NO: 1561957 - RNA, 19 nt, Homo sapiens
gaacagccauagccaucac

SEQ ID NO: 1561958 - RNA, 19 nt, Homo sapiens
gaacguugagcacucugaa

SEQ ID NO: 1561959 - RNA, 19 nt, Homo sapiens
cauggucacucauauuugg

SEQ ID NO: 1561960 - RNA, 19 nt, Homo sapiens
ucaaccagaacauguuuaa

SEQ ID NO: 1561961 - RNA, 19 nt, Homo sapiens
ccauggaucucaggucuuc

SEQ ID NO: 1561962 - RNA, 19 nt, Homo sapiens
acaacuacauucccuucaa

SEQ ID NO: 1561963 - RNA, 19 nt, Homo sapiens
aaucauggcugcagucacu

SEQ ID NO: 1561964 - RNA, 19 nt, Homo sapiens
ggacagaaagcauggaaaa

SEQ ID NO: 1561965 - RNA, 19 nt, Homo sapiens
caauaugugagucuaauuc

SEQ ID NO: 1561966 - RNA, 19 nt, Homo sapiens
acucauauuuggcucagaa

SEQ ID NO: 1561967 - RNA, 19 nt, Homo sapiens
guauuugauugaugucuca

SEQ ID NO: 1561968 - RNA, 19 nt, Homo sapiens
gacuuacuuucuaaucuga

SEQ ID NO: 1561969 - RNA, 19 nt, Homo sapiens
caacuacauucccuucaac

SEQ ID NO: 1561970 - RNA, 19 nt, Homo sapiens
uaaacuuacuugacaacuc

SEQ ID NO: 1561971 - RNA, 19 nt, Homo sapiens
ccacugaaucuacaacuuc

SEQ ID NO: 1561972 - RNA, 19 nt, Homo sapiens
cacaaaugauggagagugu

SEQ ID NO: 1561973 - RNA, 19 nt, Homo sapiens
gaaacuccacauucuguag

SEQ ID NO: 1561974 - RNA, 19 nt, Homo sapiens
gggaaacuccacauucugu

SEQ ID NO: 1561975 - RNA, 19 nt, Homo sapiens
ugcaaccacuuccacuuaa

SEQ ID NO: 1561976 - RNA, 19 nt, Homo sapiens
cugcaaccacuuccacuua

SEQ ID NO: 1561977 - RNA, 19 nt, Homo sapiens
caacuuaaacuuacuugac

SEQ ID NO: 1561978 - RNA, 19 nt, Homo sapiens
ugacuggucuauguggaaa

SEQ ID NO: 1561979 - RNA, 19 nt, Homo sapiens
ccugagggcuaugucauga

SEQ ID NO: 1561980 - RNA, 19 nt, Homo sapiens
ggagauaaucaacuaagag

SEQ ID NO: 1561981 - RNA, 19 nt, Homo sapiens
gcucaucacucuuuuccaa

SEQ ID NO: 1561982 - RNA, 19 nt, Homo sapiens
guacagccacugaaucuac

SEQ ID NO: 1561983 - RNA, 19 nt, Homo sapiens
caaucacacauccaaauga

SEQ ID NO: 1561984 - RNA, 19 nt, Homo sapiens
uaugugagucuaauucuug

SEQ ID NO: 1561985 - RNA, 19 nt, Homo sapiens
ggagagaagcuugugauac

SEQ ID NO: 1561986 - RNA, 19 nt, Homo sapiens
gcaaugacuggucuaugug

SEQ ID NO: 1561987 - RNA, 19 nt, Homo sapiens
ggucuaauaagaaacacuu

SEQ ID NO: 1561988 - RNA, 19 nt, Homo sapiens
ccacuuccacuuaaccuau

SEQ ID NO: 1561989 - RNA, 19 nt, Homo sapiens
caaaugauggagagugugu

SEQ ID NO: 1561990 - RNA, 19 nt, Homo sapiens
ugagucuaauucuugcuaa

SEQ ID NO: 1561991 - RNA, 19 nt, Homo sapiens
ccaaucacacauccaaaug

SEQ ID NO: 1561992 - RNA, 19 nt, Homo sapiens
uauaaagggcaaugaacaa

SEQ ID NO: 1561993 - RNA, 19 nt, Homo sapiens
uauaaucuccaccuauuca

SEQ ID NO: 1561994 - RNA, 19 nt, Homo sapiens
ugauugaugucucaugucu

SEQ ID NO: 1561995 - RNA, 19 nt, Homo sapiens
aagaaacacuuuacaaccu

SEQ ID NO: 1561996 - RNA, 19 nt, Homo sapiens
cacuuccacuuaaccuaua

SEQ ID NO: 1561997 - RNA, 19 nt, Homo sapiens
gccacugaaucuacaacuu

SEQ ID NO: 1561998 - RNA, 19 nt, Homo sapiens
gaauaugccugacagcuuu

SEQ ID NO: 1561999 - RNA, 19 nt, Homo sapiens
gaacauaaccaaucccaaa

SEQ ID NO: 1562000 - RNA, 19 nt, Homo sapiens
aaacagacaucuauacuug

SEQ ID NO: 1562001 - RNA, 19 nt, Homo sapiens
ucacugagcucaagauuuc

SEQ ID NO: 1562002 - RNA, 19 nt, Homo sapiens
ucagauagcuuugaaguug

SEQ ID NO: 1562003 - RNA, 19 nt, Homo sapiens
ggaggaauauuugacagua

SEQ ID NO: 1562004 - RNA, 19 nt, Homo sapiens
gaagaaauggauucgguua

SEQ ID NO: 1562005 - RNA, 19 nt, Homo sapiens
guucagacauuagguauaa

SEQ ID NO: 1562006 - RNA, 19 nt, Homo sapiens
gcaugaaacccuagaauga

SEQ ID NO: 1562007 - RNA, 19 nt, Homo sapiens
gacauuagguauaaggaaa

SEQ ID NO: 1562008 - RNA, 19 nt, Homo sapiens
caaagaacaaugacaguaa

SEQ ID NO: 1562009 - RNA, 19 nt, Homo sapiens
gaagcaaguucgccagaga

SEQ ID NO: 1562010 - RNA, 19 nt, Homo sapiens
gugagaaguucagacauua

SEQ ID NO: 1562011 - RNA, 19 nt, Homo sapiens
ggacacuuccuaagaauau

SEQ ID NO: 1562012 - RNA, 19 nt, Homo sapiens
cgacacaucuggacaagca

SEQ ID NO: 1562013 - RNA, 19 nt, Homo sapiens
caacauuagugucagauag

SEQ ID NO: 1562014 - RNA, 19 nt, Homo sapiens
ccaaagacaauuucaaaga

SEQ ID NO: 1562015 - RNA, 19 nt, Homo sapiens
gaaguucagacauuaggua

SEQ ID NO: 1562016 - RNA, 19 nt, Homo sapiens
gaaacagacaucuauacuu

SEQ ID NO: 1562017 - RNA, 19 nt, Homo sapiens
aaaaguggauggucaauaa

SEQ ID NO: 1562018 - RNA, 19 nt, Homo sapiens
gaagauaagccaaguucau

SEQ ID NO: 1562019 - RNA, 19 nt, Homo sapiens
gcauugcgcugccauuugg

SEQ ID NO: 1562020 - RNA, 19 nt, Homo sapiens
gguauaaggaaacucauuu

SEQ ID NO: 1562021 - RNA, 19 nt, Homo sapiens
gccagaaagcggauaauuu

SEQ ID NO: 1562022 - RNA, 19 nt, Homo sapiens
gcucugagauaaacgaaag

SEQ ID NO: 1562023 - RNA, 19 nt, Homo sapiens
uauaaucgguuuccuugug

SEQ ID NO: 1562024 - RNA, 19 nt, Homo sapiens
ggagacugcacauggauuu

SEQ ID NO: 1562025 - RNA, 19 nt, Homo sapiens
ccaagggcaugacaccaaa

SEQ ID NO: 1562026 - RNA, 19 nt, Homo sapiens
caaguucgccagagagaaa

SEQ ID NO: 1562027 - RNA, 19 nt, Homo sapiens
acaaugacaguaaagguua

SEQ ID NO: 1562028 - RNA, 19 nt, Homo sapiens
acagacaucuauacuugaa

SEQ ID NO: 1562029 - RNA, 19 nt, Homo sapiens
gagugcaguuucagauuga

SEQ ID NO: 1562030 - RNA, 19 nt, Homo sapiens
uggauucgguuacauaaga

SEQ ID NO: 1562031 - RNA, 19 nt, Homo sapiens
caaugacaguaaagguuaa

SEQ ID NO: 1562032 - RNA, 19 nt, Homo sapiens
caugagcagugaccagauu

SEQ ID NO: 1562033 - RNA, 19 nt, Homo sapiens
ggaguggacaggauuaguu

SEQ ID NO: 1562034 - RNA, 19 nt, Homo sapiens
uaacugggaggaauauuug

SEQ ID NO: 1562035 - RNA, 19 nt, Homo sapiens
gaacaaugacaguaaaggu

SEQ ID NO: 1562036 - RNA, 19 nt, Homo sapiens
gaaauggauucgguuacau

SEQ ID NO: 1562037 - RNA, 19 nt, Homo sapiens
gagauaacaaagcaugaaa

SEQ ID NO: 1562038 - RNA, 19 nt, Homo sapiens
uguaagagauaacaaagca

SEQ ID NO: 1562039 - RNA, 19 nt, Homo sapiens
uaaccaaucccaaagacaa

SEQ ID NO: 1562040 - RNA, 19 nt, Homo sapiens
aagaagcuauaaucgguuu

SEQ ID NO: 1562041 - RNA, 19 nt, Homo sapiens
agugagaaguucagacauu

SEQ ID NO: 1562042 - RNA, 19 nt, Homo sapiens
ugaaucuucuagccaguuu

SEQ ID NO: 1562043 - RNA, 19 nt, Homo sapiens
ccagaaagcggauaauuuu

SEQ ID NO: 1562044 - RNA, 19 nt, Homo sapiens
ccaguuuccuuuccuuugu

SEQ ID NO: 1562045 - RNA, 19 nt, Homo sapiens
ucaaagaacaaugacagua

SEQ ID NO: 1562046 - RNA, 19 nt, Homo sapiens
gguuugugcucugagauaa

SEQ ID NO: 1562047 - RNA, 19 nt, Homo sapiens
gcagugaccagauugaaag

SEQ ID NO: 1562048 - RNA, 19 nt, Homo sapiens
gagagaacauaaccaaucc

SEQ ID NO: 1562049 - RNA, 19 nt, Homo sapiens
cgagagaacauaaccaauc

SEQ ID NO: 1562050 - RNA, 19 nt, Homo sapiens
agagugcaguuucagauug

SEQ ID NO: 1562051 - RNA, 19 nt, Homo sapiens
caucuucaggccacaaaua

SEQ ID NO: 1562052 - RNA, 19 nt, Homo sapiens
aagccaaguucaucacuga

SEQ ID NO: 1562053 - RNA, 19 nt, Homo sapiens
aaacuaaaccacaucuuca

SEQ ID NO: 1562054 - RNA, 19 nt, Homo sapiens
guugugaccuucuuguaca

SEQ ID NO: 1562055 - RNA, 19 nt, Homo sapiens
agaaauggauucgguuaca

SEQ ID NO: 1562056 - RNA, 19 nt, Homo sapiens
ggccacaaauagaacaaau

SEQ ID NO: 1562057 - RNA, 19 nt, Homo sapiens
cuacagcgagagaacauaa

SEQ ID NO: 1562058 - RNA, 19 nt, Homo sapiens
gaacauggagacugcacau

SEQ ID NO: 1562059 - RNA, 19 nt, Homo sapiens
agacaucuauacuugaaca

SEQ ID NO: 1562060 - RNA, 19 nt, Homo sapiens
ggacaagcaggaauggaau

SEQ ID NO: 1562061 - RNA, 19 nt, Homo sapiens
gcuuugaaguugugaccuu

SEQ ID NO: 1562062 - RNA, 19 nt, Homo sapiens
caaacacacacuacagaga

SEQ ID NO: 1562063 - RNA, 19 nt, Homo sapiens
aaauggauucgguuacaua

SEQ ID NO: 1562064 - RNA, 19 nt, Homo sapiens
uuagccaccucuacacauu

SEQ ID NO: 1562065 - RNA, 19 nt, Homo sapiens
uagaaugagugagaaguuc

SEQ ID NO: 1562066 - RNA, 19 nt, Homo sapiens
gccacaaauagaacaaaua

SEQ ID NO: 1562067 - RNA, 19 nt, Homo sapiens
uuaacugggaggaauauuu

SEQ ID NO: 1562068 - RNA, 19 nt, Homo sapiens
guucaucacugagcucaag

SEQ ID NO: 1562069 - RNA, 19 nt, Homo sapiens
acauaagagugcaguuuca

SEQ ID NO: 1562070 - RNA, 19 nt, Homo sapiens
gaaagcggauaauuuugug

SEQ ID NO: 1562071 - RNA, 19 nt, Homo sapiens
aaacucauuugcagacucu

SEQ ID NO: 1562072 - RNA, 19 nt, Homo sapiens
guauaaggaaacucauuug

SEQ ID NO: 1562073 - RNA, 19 nt, Homo sapiens
gaggaauauuugacaguac

SEQ ID NO: 1562074 - RNA, 19 nt, Homo sapiens
gagauaaacgaaagcuaca

SEQ ID NO: 1562075 - RNA, 19 nt, Homo sapiens
uuacauaagagugcaguuu

SEQ ID NO: 1562076 - RNA, 19 nt, Homo sapiens
gaaaaguggauggucaaua

SEQ ID NO: 1562077 - RNA, 19 nt, Homo sapiens
ccaagaaugcuuccugucu

SEQ ID NO: 1562078 - RNA, 19 nt, Homo sapiens
caguuuccuuuccuuugua

SEQ ID NO: 1562079 - RNA, 19 nt, Homo sapiens
ucccaaagacaauuucaaa

SEQ ID NO: 1562080 - RNA, 19 nt, Homo sapiens
ggagaagaagcuauaaucg

SEQ ID NO: 1562081 - RNA, 19 nt, Homo sapiens
gcuuaucuuucaacugcaa

SEQ ID NO: 1562082 - RNA, 19 nt, Homo sapiens
ggaauccuccagcaaacga

SEQ ID NO: 1562083 - RNA, 19 nt, Homo sapiens
gauugaagauaagccaagu

SEQ ID NO: 1562084 - RNA, 19 nt, Homo sapiens
ggugguggauccaaaacua

SEQ ID NO: 1562085 - RNA, 19 nt, Homo sapiens
gaaacccuagaaugaguga

SEQ ID NO: 1562086 - RNA, 19 nt, Homo sapiens
cagauagcuuugaaguugu

SEQ ID NO: 1562087 - RNA, 19 nt, Homo sapiens
ccaaucccaaagacaauuu

SEQ ID NO: 1562088 - RNA, 19 nt, Homo sapiens
cgaaagcuacagcgagaga

SEQ ID NO: 1562089 - RNA, 19 nt, Homo sapiens
ggguuugugcucugagaua

SEQ ID NO: 1562090 - RNA, 19 nt, Homo sapiens
gggcaugacaccaaacaca

SEQ ID NO: 1562091 - RNA, 19 nt, Homo sapiens
guggcacccuccugcauug

SEQ ID NO: 1562092 - RNA, 19 nt, Homo sapiens
gagcagugaccagauugaa

SEQ ID NO: 1562093 - RNA, 19 nt, Homo sapiens
uaagagugcaguuucagau

SEQ ID NO: 1562094 - RNA, 19 nt, Homo sapiens
gugaccuucuuguacauga

SEQ ID NO: 1562095 - RNA, 19 nt, Homo sapiens
guugcaaacuagauuguac

SEQ ID NO: 1562096 - RNA, 19 nt, Homo sapiens
cauaaccaaucccaaagac

SEQ ID NO: 1562097 - RNA, 19 nt, Homo sapiens
caacugcacgauggucuga

SEQ ID NO: 1562098 - RNA, 19 nt, Homo sapiens
aaagggcgcuugauaguaa

SEQ ID NO: 1562099 - RNA, 19 nt, Homo sapiens
gcggagaccugguuuguga

SEQ ID NO: 1562100 - RNA, 19 nt, Homo sapiens
ggaaaacgcuuacauucaa

SEQ ID NO: 1562101 - RNA, 19 nt, Homo sapiens
caucugacaucaacuauuc

SEQ ID NO: 1562102 - RNA, 19 nt, Homo sapiens
gaaccgauuuguugguguu

SEQ ID NO: 1562103 - RNA, 19 nt, Homo sapiens
ugaaaucucuuggcuguga

SEQ ID NO: 1562104 - RNA, 19 nt, Homo sapiens
ccaaacugcucaagaaauc

SEQ ID NO: 1562105 - RNA, 19 nt, Homo sapiens
cagccaaacugcucaagaa

SEQ ID NO: 1562106 - RNA, 19 nt, Homo sapiens
gaaagggcgcuugauagua

SEQ ID NO: 1562107 - RNA, 19 nt, Homo sapiens
accauuaccuuucuaagua

SEQ ID NO: 1562108 - RNA, 19 nt, Homo sapiens
gcaaagugccauguaauug

SEQ ID NO: 1562109 - RNA, 19 nt, Homo sapiens
gaauaggucucuccuucuc

SEQ ID NO: 1562110 - RNA, 19 nt, Homo sapiens
ggaaccugcucuucugaug

SEQ ID NO: 1562111 - RNA, 19 nt, Homo sapiens
uaacgcaucugacaucaac

SEQ ID NO: 1562112 - RNA, 19 nt, Homo sapiens
gaacauugccagccaaacu

SEQ ID NO: 1562113 - RNA, 19 nt, Homo sapiens
gcuucuuccugaaccauua

SEQ ID NO: 1562114 - RNA, 19 nt, Homo sapiens
gugaaacccgaguaucuua

SEQ ID NO: 1562115 - RNA, 19 nt, Homo sapiens
guaagguguuaaugaauag

SEQ ID NO: 1562116 - RNA, 19 nt, Homo sapiens
gaaccugcucuucugauga

SEQ ID NO: 1562117 - RNA, 19 nt, Homo sapiens
gaaaaugggcacuuuaugu

SEQ ID NO: 1562118 - RNA, 19 nt, Homo sapiens
caguuaagccucccuuuga

SEQ ID NO: 1562119 - RNA, 19 nt, Homo sapiens
cauauuccgugcugucaau

SEQ ID NO: 1562120 - RNA, 19 nt, Homo sapiens
gaaaacgcuuacauucaaa

SEQ ID NO: 1562121 - RNA, 19 nt, Homo sapiens
cacuuuaugucucagaauu

SEQ ID NO: 1562122 - RNA, 19 nt, Homo sapiens
ugugaaagcaggaacauug

SEQ ID NO: 1562123 - RNA, 19 nt, Homo sapiens
cgaaagggcgcuugauagu

SEQ ID NO: 1562124 - RNA, 19 nt, Homo sapiens
aaagugccauguaauugga

SEQ ID NO: 1562125 - RNA, 19 nt, Homo sapiens
ccauuaccuuucuaaguau

SEQ ID NO: 1562126 - RNA, 19 nt, Homo sapiens
guuuaucucuggcuaccaa

SEQ ID NO: 1562127 - RNA, 19 nt, Homo sapiens
gaucguccuaucaacuaua

SEQ ID NO: 1562128 - RNA, 19 nt, Homo sapiens
caaagugccauguaauugg

SEQ ID NO: 1562129 - RNA, 19 nt, Homo sapiens
guaguugaauuaccucacu

SEQ ID NO: 1562130 - RNA, 19 nt, Homo sapiens
gcccuaggccucucugcua

SEQ ID NO: 1562131 - RNA, 19 nt, Homo sapiens
ucucagaauuacucaaauc

SEQ ID NO: 1562132 - RNA, 19 nt, Homo sapiens
uacgaaagggcgcuugaua

SEQ ID NO: 1562133 - RNA, 19 nt, Homo sapiens
gugucgauguggucuauga

SEQ ID NO: 1562134 - RNA, 19 nt, Homo sapiens
guccggaaccgauuuguug

SEQ ID NO: 1562135 - RNA, 19 nt, Homo sapiens
caacuccagugcccucagu

SEQ ID NO: 1562136 - RNA, 19 nt, Homo sapiens
gagcggagaccugguuugu

SEQ ID NO: 1562137 - RNA, 19 nt, Homo sapiens
aaccugcucuucugaugaa

SEQ ID NO: 1562138 - RNA, 19 nt, Homo sapiens
ccagagggcagguuuacug

SEQ ID NO: 1562139 - RNA, 19 nt, Homo sapiens
uagacgcccuggcuacgaa

SEQ ID NO: 1562140 - RNA, 19 nt, Homo sapiens
gaaaucucuuggcugugau

SEQ ID NO: 1562141 - RNA, 19 nt, Homo sapiens
uaaaucaagggagaaagaa

SEQ ID NO: 1562142 - RNA, 19 nt, Homo sapiens
ucaguuaagccucccuuug

SEQ ID NO: 1562143 - RNA, 19 nt, Homo sapiens
gcuaugaccccucaguuaa

SEQ ID NO: 1562144 - RNA, 19 nt, Homo sapiens
gccaaacugcucaagaaau

SEQ ID NO: 1562145 - RNA, 19 nt, Homo sapiens
gcaucugacaucaacuauu

SEQ ID NO: 1562146 - RNA, 19 nt, Homo sapiens
gguguuaacgcaucugaca

SEQ ID NO: 1562147 - RNA, 19 nt, Homo sapiens
uaauaaaacuucccuccau

SEQ ID NO: 1562148 - RNA, 19 nt, Homo sapiens
guaauuggaaccugcucuu

SEQ ID NO: 1562149 - RNA, 19 nt, Homo sapiens
auaaaucaagggagaaaga

SEQ ID NO: 1562150 - RNA, 19 nt, Homo sapiens
gauguggucuaugaaucug

SEQ ID NO: 1562151 - RNA, 19 nt, Homo sapiens
uaagccucccuuugacaua

SEQ ID NO: 1562152 - RNA, 19 nt, Homo sapiens
ugucucagaauuacucaaa

SEQ ID NO: 1562153 - RNA, 19 nt, Homo sapiens
uccgugcugucaauuauau

SEQ ID NO: 1562154 - RNA, 19 nt, Homo sapiens
gccacuugcucgagaugug

SEQ ID NO: 1562155 - RNA, 19 nt, Homo sapiens
ccugaaccauuaccuuucu

SEQ ID NO: 1562156 - RNA, 19 nt, Homo sapiens
gaaaucugccagcguacag

SEQ ID NO: 1562157 - RNA, 19 nt, Homo sapiens
guuaacgcaucugacauca

SEQ ID NO: 1562158 - RNA, 19 nt, Homo sapiens
gaaccauuaccuuucuaag

SEQ ID NO: 1562159 - RNA, 19 nt, Homo sapiens
guagguaccguccuuaagc

SEQ ID NO: 1562160 - RNA, 19 nt, Homo sapiens
gcacuuuaugucucagaau

SEQ ID NO: 1562161 - RNA, 19 nt, Homo sapiens
ggcacuuuaugucucagaa

SEQ ID NO: 1562162 - RNA, 19 nt, Homo sapiens
gaauuaccucacucuguca

SEQ ID NO: 1562163 - RNA, 19 nt, Homo sapiens
ugaaccauuaccuuucuaa

SEQ ID NO: 1562164 - RNA, 19 nt, Homo sapiens
uuucaaagaaggcaaagug

SEQ ID NO: 1562165 - RNA, 19 nt, Homo sapiens
cauggcaccugguucuuuu

SEQ ID NO: 1562166 - RNA, 19 nt, Homo sapiens
ucgauguggucuaugaauc

SEQ ID NO: 1562167 - RNA, 19 nt, Homo sapiens
cagugaaacccgaguaucu

SEQ ID NO: 1562168 - RNA, 19 nt, Homo sapiens
gggaaaacgcuuacauuca

SEQ ID NO: 1562169 - RNA, 19 nt, Homo sapiens
gagggaaaacgcuuacauu

SEQ ID NO: 1562170 - RNA, 19 nt, Homo sapiens
cagcguacagggcuucuuc

SEQ ID NO: 1562171 - RNA, 19 nt, Homo sapiens
uagguaccguccuuaagca

SEQ ID NO: 1562172 - RNA, 19 nt, Homo sapiens
aguaauaggguuuaucucu

SEQ ID NO: 1562173 - RNA, 19 nt, Homo sapiens
uguggucuaugaaucuguu

SEQ ID NO: 1562174 - RNA, 19 nt, Homo sapiens
ccagugcccucagugaaac

SEQ ID NO: 1562175 - RNA, 19 nt, Homo sapiens
aaaucaagggagaaagaaa

SEQ ID NO: 1562176 - RNA, 19 nt, Homo sapiens
gugcugucaauuauaugua

SEQ ID NO: 1562177 - RNA, 19 nt, Homo sapiens
gcuacgaaagggcgcuuga

SEQ ID NO: 1562178 - RNA, 19 nt, Homo sapiens
auacacaguuggccaagcu

SEQ ID NO: 1562179 - RNA, 19 nt, Homo sapiens
uuaccucacucugucaaca

SEQ ID NO: 1562180 - RNA, 19 nt, Homo sapiens
gcugucaauuauauguaca

SEQ ID NO: 1562181 - RNA, 19 nt, Homo sapiens
auuccgugcugucaauuau

SEQ ID NO: 1562182 - RNA, 19 nt, Homo sapiens
gaacaccugugaacuauug

SEQ ID NO: 1562183 - RNA, 19 nt, Homo sapiens
gaagcaauuucaacagaua

SEQ ID NO: 1562184 - RNA, 19 nt, Homo sapiens
gaacuuagugucuuuauug

SEQ ID NO: 1562185 - RNA, 19 nt, Homo sapiens
ggacaugccuauuucuuug

SEQ ID NO: 1562186 - RNA, 19 nt, Homo sapiens
gaaaccaugugcuaccaua

SEQ ID NO: 1562187 - RNA, 19 nt, Homo sapiens
gaaacugacuguauaucuu

SEQ ID NO: 1562188 - RNA, 19 nt, Homo sapiens
uaucuaagcuucggucuaa

SEQ ID NO: 1562189 - RNA, 19 nt, Homo sapiens
uggaacagcugaauucuga

SEQ ID NO: 1562190 - RNA, 19 nt, Homo sapiens
guauagauaugaaggagaa

SEQ ID NO: 1562191 - RNA, 19 nt, Homo sapiens
ggaaagagggagagaagaa

SEQ ID NO: 1562192 - RNA, 19 nt, Homo sapiens
cauguaaacuccaggauau

SEQ ID NO: 1562193 - RNA, 19 nt, Homo sapiens
gcagacaagugauaauaag

SEQ ID NO: 1562194 - RNA, 19 nt, Homo sapiens
gaacugcagaggccguuua

SEQ ID NO: 1562195 - RNA, 19 nt, Homo sapiens
gacauguccucuccucuaa

SEQ ID NO: 1562196 - RNA, 19 nt, Homo sapiens
ggucuaauguggagccaaa

SEQ ID NO: 1562197 - RNA, 19 nt, Homo sapiens
caagauugagcacaacuua

SEQ ID NO: 1562198 - RNA, 19 nt, Homo sapiens
gaacagcugaauucugaaa

SEQ ID NO: 1562199 - RNA, 19 nt, Homo sapiens
gaggauaugacacuuauug

SEQ ID NO: 1562200 - RNA, 19 nt, Homo sapiens
uaggguguguguaaacuua

SEQ ID NO: 1562201 - RNA, 19 nt, Homo sapiens
gauaauaagaguucuggaa

SEQ ID NO: 1562202 - RNA, 19 nt, Homo sapiens
gauguuaucaugcaagauu

SEQ ID NO: 1562203 - RNA, 19 nt, Homo sapiens
gaaagcaucgccuggcauu

SEQ ID NO: 1562204 - RNA, 19 nt, Homo sapiens
ggacaucagcaaauuucua

SEQ ID NO: 1562205 - RNA, 19 nt, Homo sapiens
uaaaggaaaucaucagcau

SEQ ID NO: 1562206 - RNA, 19 nt, Homo sapiens
ucaauugaaugcaccugua

SEQ ID NO: 1562207 - RNA, 19 nt, Homo sapiens
aauaagaguucuggaauug

SEQ ID NO: 1562208 - RNA, 19 nt, Homo sapiens
guaacuuccugucugauau

SEQ ID NO: 1562209 - RNA, 19 nt, Homo sapiens
cagaggauaugacacuuau

SEQ ID NO: 1562210 - RNA, 19 nt, Homo sapiens
gaagacacauuggaacuac

SEQ ID NO: 1562211 - RNA, 19 nt, Homo sapiens
gcuggaaacugaagacaca

SEQ ID NO: 1562212 - RNA, 19 nt, Homo sapiens
cagcauuucccgcuaauaa

SEQ ID NO: 1562213 - RNA, 19 nt, Homo sapiens
uaucagcauuucccuguuu

SEQ ID NO: 1562214 - RNA, 19 nt, Homo sapiens
uaagcagauugguuaagua

SEQ ID NO: 1562215 - RNA, 19 nt, Homo sapiens
aagugaaacugacuguaua

SEQ ID NO: 1562216 - RNA, 19 nt, Homo sapiens
uggcagggcucaucaggaa

SEQ ID NO: 1562217 - RNA, 19 nt, Homo sapiens
ccaaaccaaucaaacugaa

SEQ ID NO: 1562218 - RNA, 19 nt, Homo sapiens
ugucaugccuacaaucaaa

SEQ ID NO: 1562219 - RNA, 19 nt, Homo sapiens
guacagcugcauuaggaua

SEQ ID NO: 1562220 - RNA, 19 nt, Homo sapiens
caucagcauuucccgcuaa

SEQ ID NO: 1562221 - RNA, 19 nt, Homo sapiens
uaaaucagacugugaagug

SEQ ID NO: 1562222 - RNA, 19 nt, Homo sapiens
cugcuacgcugaucucauu

SEQ ID NO: 1562223 - RNA, 19 nt, Homo sapiens
gcaagagguacucaucauu

SEQ ID NO: 1562224 - RNA, 19 nt, Homo sapiens
gcagauugguuaaguaucc

SEQ ID NO: 1562225 - RNA, 19 nt, Homo sapiens
gcauuaggauacuuaacug

SEQ ID NO: 1562226 - RNA, 19 nt, Homo sapiens
gugauuacguuauuauugg

SEQ ID NO: 1562227 - RNA, 19 nt, Homo sapiens
caauaaacacgacacaguu

SEQ ID NO: 1562228 - RNA, 19 nt, Homo sapiens
uagaaacagugaaagugaa

SEQ ID NO: 1562229 - RNA, 19 nt, Homo sapiens
ugaaggauguuaucaugca

SEQ ID NO: 1562230 - RNA, 19 nt, Homo sapiens
aguauucucugcaagauug

SEQ ID NO: 1562231 - RNA, 19 nt, Homo sapiens
caggauauccguucauuca

SEQ ID NO: 1562232 - RNA, 19 nt, Homo sapiens
gaaggauguuaucaugcaa

SEQ ID NO: 1562233 - RNA, 19 nt, Homo sapiens
guaguaaccacacuuuaau

SEQ ID NO: 1562234 - RNA, 19 nt, Homo sapiens
gcagaggccguuuauucaa

SEQ ID NO: 1562235 - RNA, 19 nt, Homo sapiens
ggaaacugaagacacauug

SEQ ID NO: 1562236 - RNA, 19 nt, Homo sapiens
caagagguacucaucauuc

SEQ ID NO: 1562237 - RNA, 19 nt, Homo sapiens
gaacuauugaaggauguua

SEQ ID NO: 1562238 - RNA, 19 nt, Homo sapiens
gaaagugaaacugacugua

SEQ ID NO: 1562239 - RNA, 19 nt, Homo sapiens
caagugauaauaagaguuc

SEQ ID NO: 1562240 - RNA, 19 nt, Homo sapiens
uagcagacaagugauaaua

SEQ ID NO: 1562241 - RNA, 19 nt, Homo sapiens
ucaggaaacucggucauca

SEQ ID NO: 1562242 - RNA, 19 nt, Homo sapiens
gcagcguccucuaguggaa

SEQ ID NO: 1562243 - RNA, 19 nt, Homo sapiens
guacucaucauucccagaa

SEQ ID NO: 1562244 - RNA, 19 nt, Homo sapiens
gaggacaucagcaaauuuc

SEQ ID NO: 1562245 - RNA, 19 nt, Homo sapiens
aaagugaaacugacuguau

SEQ ID NO: 1562246 - RNA, 19 nt, Homo sapiens
gcuaauaaaggaaaucauc

SEQ ID NO: 1562247 - RNA, 19 nt, Homo sapiens
gaagcaagagguacucauc

SEQ ID NO: 1562248 - RNA, 19 nt, Homo sapiens
ugaaauugauggcauucug

SEQ ID NO: 1562249 - RNA, 19 nt, Homo sapiens
gacaucagcaaauuucuau

SEQ ID NO: 1562250 - RNA, 19 nt, Homo sapiens
gaaagagggagagaagaau

SEQ ID NO: 1562251 - RNA, 19 nt, Homo sapiens
cagaggccguuuauucaau

SEQ ID NO: 1562252 - RNA, 19 nt, Homo sapiens
ggaauugcuuacagaggau

SEQ ID NO: 1562253 - RNA, 19 nt, Homo sapiens
gacaagugauaauaagagu

SEQ ID NO: 1562254 - RNA, 19 nt, Homo sapiens
acagguagcagacaaguga

SEQ ID NO: 1562255 - RNA, 19 nt, Homo sapiens
cagcugugcauguauuuaa

SEQ ID NO: 1562256 - RNA, 19 nt, Homo sapiens
ccugugaacuauugaagga

SEQ ID NO: 1562257 - RNA, 19 nt, Homo sapiens
cauguccucuccucuaaug

SEQ ID NO: 1562258 - RNA, 19 nt, Homo sapiens
ugaaugcaccuguaacuuc

SEQ ID NO: 1562259 - RNA, 19 nt, Homo sapiens
gagccuaugucaacagcau

SEQ ID NO: 1562260 - RNA, 19 nt, Homo sapiens
uaucagagccuaugucaac

SEQ ID NO: 1562261 - RNA, 19 nt, Homo sapiens
gaaacuacuccugguguug

SEQ ID NO: 1562262 - RNA, 19 nt, Homo sapiens
uauauguacagcugcauua

SEQ ID NO: 1562263 - RNA, 19 nt, Homo sapiens
aagcuguuguggccuauuu

SEQ ID NO: 1562264 - RNA, 19 nt, Homo sapiens
gguugacguuggugcagua

SEQ ID NO: 1562265 - RNA, 19 nt, Homo sapiens
aaaguaauuuccagcagau

SEQ ID NO: 1562266 - RNA, 19 nt, Homo sapiens
ccaauaaacacgacacagu

SEQ ID NO: 1562267 - RNA, 19 nt, Homo sapiens
gugcauguauuuaagaaac

SEQ ID NO: 1562268 - RNA, 19 nt, Homo sapiens
uggaacaccugugaacuau

SEQ ID NO: 1562269 - RNA, 19 nt, Homo sapiens
aaacgcuucucccuguuga

SEQ ID NO: 1562270 - RNA, 19 nt, Homo sapiens
cuuagugucuuuauugcuu

SEQ ID NO: 1562271 - RNA, 19 nt, Homo sapiens
gacuguguauugguuaauu

SEQ ID NO: 1562272 - RNA, 19 nt, Homo sapiens
cguuauuauuggacacuua

SEQ ID NO: 1562273 - RNA, 19 nt, Homo sapiens
ugucugauauugggaaaga

SEQ ID NO: 1562274 - RNA, 19 nt, Homo sapiens
caauugaaugcaccuguaa

SEQ ID NO: 1562275 - RNA, 19 nt, Homo sapiens
gagaaaccaugugcuacca

SEQ ID NO: 1562276 - RNA, 19 nt, Homo sapiens
guugggagcccuuggagaa

SEQ ID NO: 1562277 - RNA, 19 nt, Homo sapiens
agacauguccucuccucua

SEQ ID NO: 1562278 - RNA, 19 nt, Homo sapiens
gugaagugcuugaaguuuu

SEQ ID NO: 1562279 - RNA, 19 nt, Homo sapiens
uagaaaagacuguguauug

SEQ ID NO: 1562280 - RNA, 19 nt, Homo sapiens
ccuguaacuuccugucuga

SEQ ID NO: 1562281 - RNA, 19 nt, Homo sapiens
ucauguaaacuccaggaua

SEQ ID NO: 1562282 - RNA, 19 nt, Homo sapiens
ccacuaggauccaccauaa

SEQ ID NO: 1562283 - RNA, 19 nt, Homo sapiens
ccacuaggauccaccauaa

SEQ ID NO: 1562284 - RNA, 19 nt, Homo sapiens
ccacuaggauccaccauaa

SEQ ID NO: 1562285 - RNA, 19 nt, Homo sapiens
ccacuaggauccaccauaa

SEQ ID NO: 1562286 - RNA, 19 nt, Homo sapiens
ccacuaguauccaccauaa

SEQ ID NO: 1562287 - RNA, 19 nt, Homo sapiens
gcacacaaacccaugcaua

SEQ ID NO: 1562288 - RNA, 19 nt, Homo sapiens
ccacuaggauccaccauga

SEQ ID NO: 1562289 - RNA, 19 nt, Homo sapiens
gggagaagauaaauaguuc

SEQ ID NO: 1562290 - RNA, 19 nt, Homo sapiens
gacauuaccuuccagaauc

SEQ ID NO: 1562291 - RNA, 19 nt, Homo sapiens
gcacaaucuucccucaauu

SEQ ID NO: 1562292 - RNA, 19 nt, Homo sapiens
cuacuaggauccaccauga

SEQ ID NO: 1562293 - RNA, 19 nt, Homo sapiens
ccacuaggauccgccauaa

SEQ ID NO: 1562294 - RNA, 19 nt, Homo sapiens
gagacauccucuacugaaa

SEQ ID NO: 1562295 - RNA, 19 nt, Homo sapiens
cuacugaaauccacuagga

SEQ ID NO: 1562296 - RNA, 19 nt, Homo sapiens
gagcagguguguacugaca

SEQ ID NO: 1562297 - RNA, 19 nt, Homo sapiens
gagcugcgacuugguauuu

SEQ ID NO: 1562298 - RNA, 19 nt, Homo sapiens
ccagcaaccucucauuauc

SEQ ID NO: 1562299 - RNA, 19 nt, Homo sapiens
gggagcagguguguacuga

SEQ ID NO: 1562300 - RNA, 19 nt, Homo sapiens
ggauuucauucaaacaugu

SEQ ID NO: 1562301 - RNA, 19 nt, Homo sapiens
gcagguguguacugacaau

SEQ ID NO: 1562302 - RNA, 19 nt, Homo sapiens
caccagagaggaagcauuu

SEQ ID NO: 1562303 - RNA, 19 nt, Homo sapiens
acuuacaguuguucacuua

SEQ ID NO: 1562304 - RNA, 19 nt, Homo sapiens
gaggagcugcgacuuggua

SEQ ID NO: 1562305 - RNA, 19 nt, Homo sapiens
ccauaacccuggugucauc

SEQ ID NO: 1562306 - RNA, 19 nt, Homo sapiens
cuauuaggauccaccauga

SEQ ID NO: 1562307 - RNA, 19 nt, Homo sapiens
ccauaacccuggugucauc

SEQ ID NO: 1562308 - RNA, 19 nt, Homo sapiens
ccauaacccuggugucauc

SEQ ID NO: 1562309 - RNA, 19 nt, Homo sapiens
ccauaacccuggugucauc

SEQ ID NO: 1562310 - RNA, 19 nt, Homo sapiens
ccauaacccuggugucauc

SEQ ID NO: 1562311 - RNA, 19 nt, Homo sapiens
ccauaacccuggugucauc

SEQ ID NO: 1562312 - RNA, 19 nt, Homo sapiens
ccaccacacugaggaaaug

SEQ ID NO: 1562313 - RNA, 19 nt, Homo sapiens
ccacuacaccugacagaga

SEQ ID NO: 1562314 - RNA, 19 nt, Homo sapiens
ccacuaggacugaugauuc

SEQ ID NO: 1562315 - RNA, 19 nt, Homo sapiens
caugaccagugaugacauu

SEQ ID NO: 1562316 - RNA, 19 nt, Homo sapiens
gcaugguacuuacaguugu

SEQ ID NO: 1562317 - RNA, 19 nt, Homo sapiens
uccaugagguccaguguug

SEQ ID NO: 1562318 - RNA, 19 nt, Homo sapiens
uccaugagguccaguguug

SEQ ID NO: 1562319 - RNA, 19 nt, Homo sapiens
caucuccugugauccauga

SEQ ID NO: 1562320 - RNA, 19 nt, Homo sapiens
caucuccugugauccauga

SEQ ID NO: 1562321 - RNA, 19 nt, Homo sapiens
ccaauagugucaucaucau

SEQ ID NO: 1562322 - RNA, 19 nt, Homo sapiens
gacauccucuacugaaauc

SEQ ID NO: 1562323 - RNA, 19 nt, Homo sapiens
gcugggaccucgucaucug

SEQ ID NO: 1562324 - RNA, 19 nt, Homo sapiens
gcaucaaucccaccacaga

SEQ ID NO: 1562325 - RNA, 19 nt, Homo sapiens
guaaccaugugccaucauc

SEQ ID NO: 1562326 - RNA, 19 nt, Homo sapiens
cagcacaacaggccauauu

SEQ ID NO: 1562327 - RNA, 19 nt, Homo sapiens
gaaauccacuaggacugau

SEQ ID NO: 1562328 - RNA, 19 nt, Homo sapiens
ggucugggccuuucagcuu

SEQ ID NO: 1562329 - RNA, 19 nt, Homo sapiens
gaucucaaauaagccauag

SEQ ID NO: 1562330 - RNA, 19 nt, Homo sapiens
ugacauuaccuuccagaau

SEQ ID NO: 1562331 - RNA, 19 nt, Homo sapiens
ccaguguugucaccaucua

SEQ ID NO: 1562332 - RNA, 19 nt, Homo sapiens
ccaguguugucaccaucua

SEQ ID NO: 1562333 - RNA, 19 nt, Homo sapiens
gcacugcucaggccaacug

SEQ ID NO: 1562334 - RNA, 19 nt, Homo sapiens
aaucuucccucaauucucu

SEQ ID NO: 1562335 - RNA, 19 nt, Homo sapiens
ccaugacccugguguuauc

SEQ ID NO: 1562336 - RNA, 19 nt, Homo sapiens
ccaugacccugguguuauc

SEQ ID NO: 1562337 - RNA, 19 nt, Homo sapiens
gacccaugaugcccaauag

SEQ ID NO: 1562338 - RNA, 19 nt, Homo sapiens
cagggacacuggagagcaa

SEQ ID NO: 1562339 - RNA, 19 nt, Homo sapiens
ggccuucagugcugucuuc

SEQ ID NO: 1562340 - RNA, 19 nt, Homo sapiens
cauauucccguuuccacua

SEQ ID NO: 1562341 - RNA, 19 nt, Homo sapiens
acaaacccaugcauacaca

SEQ ID NO: 1562342 - RNA, 19 nt, Homo sapiens
ggacugaugauuccaccau

SEQ ID NO: 1562343 - RNA, 19 nt, Homo sapiens
ccucaauucucuuuguaca

SEQ ID NO: 1562344 - RNA, 19 nt, Homo sapiens
ccagaggagcugcgacuug

SEQ ID NO: 1562345 - RNA, 19 nt, Homo sapiens
acagggagaagauaaauag

SEQ ID NO: 1562346 - RNA, 19 nt, Homo sapiens
gagcugggaccucgucauc

SEQ ID NO: 1562347 - RNA, 19 nt, Homo sapiens
ccagagaggaagcauuuca

SEQ ID NO: 1562348 - RNA, 19 nt, Homo sapiens
acugaugauuccaccauuu

SEQ ID NO: 1562349 - RNA, 19 nt, Homo sapiens
ugaaauccacuaggacuga

SEQ ID NO: 1562350 - RNA, 19 nt, Homo sapiens
cacuucaacuaugguguua

SEQ ID NO: 1562351 - RNA, 19 nt, Homo sapiens
gccaccaccucccaggauu

SEQ ID NO: 1562352 - RNA, 19 nt, Homo sapiens
gcggaacacucagcuuucu

SEQ ID NO: 1562353 - RNA, 19 nt, Homo sapiens
cagaaaggagccagcuuga

SEQ ID NO: 1562354 - RNA, 19 nt, Homo sapiens
cagcaaccucucauuauca

SEQ ID NO: 1562355 - RNA, 19 nt, Homo sapiens
ucacccagccaucugauug

SEQ ID NO: 1562356 - RNA, 19 nt, Homo sapiens
caugguacuuacaguuguu

SEQ ID NO: 1562357 - RNA, 19 nt, Homo sapiens
uaacccuggugucaucuuc

SEQ ID NO: 1562358 - RNA, 19 nt, Homo sapiens
gagguccagugcugucugu

SEQ ID NO: 1562359 - RNA, 19 nt, Homo sapiens
gccacuaccucccaguauc

SEQ ID NO: 1562360 - RNA, 19 nt, Homo sapiens
gacugaugauuccaccauu

SEQ ID NO: 1562361 - RNA, 19 nt, Homo sapiens
gcaccucacacuccuucuu

SEQ ID NO: 1562362 - RNA, 19 nt, Homo sapiens
gacgggcuguauuucaguu

SEQ ID NO: 1562363 - RNA, 19 nt, Homo sapiens
gugaugacauuaccuucca

SEQ ID NO: 1562364 - RNA, 19 nt, Homo sapiens
cuucaacuaugguguuauc

SEQ ID NO: 1562365 - RNA, 19 nt, Homo sapiens
ccacuucaacuaugguguu

SEQ ID NO: 1562366 - RNA, 19 nt, Homo sapiens
ucccaggauuucauucaaa

SEQ ID NO: 1562367 - RNA, 19 nt, Homo sapiens
ccgcggaacacucagcuuu

SEQ ID NO: 1562368 - RNA, 19 nt, Homo sapiens
gcccaaucccugucacuug

SEQ ID NO: 1562369 - RNA, 19 nt, Homo sapiens
uuacaguuguucacuuaag

SEQ ID NO: 1562370 - RNA, 19 nt, Homo sapiens
ccaguauccacuucaacua

SEQ ID NO: 1562371 - RNA, 19 nt, Homo sapiens
gcccaauagugucaucauc

SEQ ID NO: 1562372 - RNA, 19 nt, Homo sapiens
gaagacccuccaacagcuu

SEQ ID NO: 1562373 - RNA, 19 nt, Homo sapiens
ugcacaaucuucccucaau

SEQ ID NO: 1562374 - RNA, 19 nt, Homo sapiens
ccaaugcugucaccaucca

SEQ ID NO: 1562375 - RNA, 19 nt, Homo sapiens
ggauccacuucaaccaugu

SEQ ID NO: 1562376 - RNA, 19 nt, Homo sapiens
gauuccaccauuucccaua

SEQ ID NO: 1562377 - RNA, 19 nt, Homo sapiens
gucugggccuuucagcuuu

SEQ ID NO: 1562378 - RNA, 19 nt, Homo sapiens
guguugucaccaucuauua

SEQ ID NO: 1562379 - RNA, 19 nt, Homo sapiens
gagaagauaaauaguucca

SEQ ID NO: 1562380 - RNA, 19 nt, Homo sapiens
ggugggagcagguguguac

SEQ ID NO: 1562381 - RNA, 19 nt, Homo sapiens
ucccucaauucucuuugua

SEQ ID NO: 1562382 - RNA, 19 nt, Homo sapiens
gcacugagaacuaguauua

SEQ ID NO: 1562383 - RNA, 19 nt, Homo sapiens
ugaaguacaugccacauaa

SEQ ID NO: 1562384 - RNA, 19 nt, Homo sapiens
ggaaagaggccuuaugguu

SEQ ID NO: 1562385 - RNA, 19 nt, Homo sapiens
ccaaagcccugucuaucua

SEQ ID NO: 1562386 - RNA, 19 nt, Homo sapiens
ccaaagaguuuacacugaa

SEQ ID NO: 1562387 - RNA, 19 nt, Homo sapiens
ggaaaggucuacacucagu

SEQ ID NO: 1562388 - RNA, 19 nt, Homo sapiens
gggaaauucuuuauggaaa

SEQ ID NO: 1562389 - RNA, 19 nt, Homo sapiens
gaaagguccacacucaaua

SEQ ID NO: 1562390 - RNA, 19 nt, Homo sapiens
caaagaauauccugaacuc

SEQ ID NO: 1562391 - RNA, 19 nt, Homo sapiens
cagcaaaugugggauauug

SEQ ID NO: 1562392 - RNA, 19 nt, Homo sapiens
ggaggaagaccgacauuug

SEQ ID NO: 1562393 - RNA, 19 nt, Homo sapiens
acauguagcucacuucuga

SEQ ID NO: 1562394 - RNA, 19 nt, Homo sapiens
agaauauccugaacucuuu

SEQ ID NO: 1562395 - RNA, 19 nt, Homo sapiens
gggaaauucuucagcuuga

SEQ ID NO: 1562396 - RNA, 19 nt, Homo sapiens
ucaaaccucuuuaggcauu

SEQ ID NO: 1562397 - RNA, 19 nt, Homo sapiens
gaacaacacccagaaaucu

SEQ ID NO: 1562398 - RNA, 19 nt, Homo sapiens
ccacguaugugccuugaau

SEQ ID NO: 1562399 - RNA, 19 nt, Homo sapiens
ggagaaaggccuuaugagu

SEQ ID NO: 1562400 - RNA, 19 nt, Homo sapiens
ggagaaaggccuuaugagu

SEQ ID NO: 1562401 - RNA, 19 nt, Homo sapiens
ggagaaaggccuuaugagu

SEQ ID NO: 1562402 - RNA, 19 nt, Homo sapiens
gagcaaagaauauccugaa

SEQ ID NO: 1562403 - RNA, 19 nt, Homo sapiens
ccacaaacauaaacuuucu

SEQ ID NO: 1562404 - RNA, 19 nt, Homo sapiens
guagaaagugguaaagauu

SEQ ID NO: 1562405 - RNA, 19 nt, Homo sapiens
gaaugugggaaauuguuua

SEQ ID NO: 1562406 - RNA, 19 nt, Homo sapiens
ggaaagguccacacucaau

SEQ ID NO: 1562407 - RNA, 19 nt, Homo sapiens
gcaaaugugggauauuguu

SEQ ID NO: 1562408 - RNA, 19 nt, Homo sapiens
uugaagacguggccauaua

SEQ ID NO: 1562409 - RNA, 19 nt, Homo sapiens
gauucaacaugcaagauug

SEQ ID NO: 1562410 - RNA, 19 nt, Homo sapiens
gaaugugggaaguucuuua

SEQ ID NO: 1562411 - RNA, 19 nt, Homo sapiens
aaacaauggugaaguacau

SEQ ID NO: 1562412 - RNA, 19 nt, Homo sapiens
gugaaagucuucugaguac

SEQ ID NO: 1562413 - RNA, 19 nt, Homo sapiens
guaugugccuugaauguag

SEQ ID NO: 1562414 - RNA, 19 nt, Homo sapiens
caugcaagauuguacuuau

SEQ ID NO: 1562415 - RNA, 19 nt, Homo sapiens
gaccgacauuugugaagaa

SEQ ID NO: 1562416 - RNA, 19 nt, Homo sapiens
gggauauuguuuauggaaa

SEQ ID NO: 1562417 - RNA, 19 nt, Homo sapiens
ggaagaccgacauuuguga

SEQ ID NO: 1562418 - RNA, 19 nt, Homo sapiens
ggaaguucuuuaagugcaa

SEQ ID NO: 1562419 - RNA, 19 nt, Homo sapiens
gaagacguggccauauauu

SEQ ID NO: 1562420 - RNA, 19 nt, Homo sapiens
cagauuagagagaaacuuu

SEQ ID NO: 1562421 - RNA, 19 nt, Homo sapiens
gaauauccugaacucuuua

SEQ ID NO: 1562422 - RNA, 19 nt, Homo sapiens
cagaauauccacacuagug

SEQ ID NO: 1562423 - RNA, 19 nt, Homo sapiens
gcaaugaaugugggaaauu

SEQ ID NO: 1562424 - RNA, 19 nt, Homo sapiens
gaggaagaccgacauuugu

SEQ ID NO: 1562425 - RNA, 19 nt, Homo sapiens
ggaugaggaggcaccuuua

SEQ ID NO: 1562426 - RNA, 19 nt, Homo sapiens
gaaacucuauaaccaccau

SEQ ID NO: 1562427 - RNA, 19 nt, Homo sapiens
ggauauuguuuauggaaag

SEQ ID NO: 1562428 - RNA, 19 nt, Homo sapiens
gaaguacaugccacauaaa

SEQ ID NO: 1562429 - RNA, 19 nt, Homo sapiens
gugggaaguucuuuaagug

SEQ ID NO: 1562430 - RNA, 19 nt, Homo sapiens
gaaauccguccucauucaa

SEQ ID NO: 1562431 - RNA, 19 nt, Homo sapiens
gguccacacucaauagaca

SEQ ID NO: 1562432 - RNA, 19 nt, Homo sapiens
caaaugugggauauuguuu

SEQ ID NO: 1562433 - RNA, 19 nt, Homo sapiens
gccuuuagccacaaacaua

SEQ ID NO: 1562434 - RNA, 19 nt, Homo sapiens
gaagaccgacauuugugaa

SEQ ID NO: 1562435 - RNA, 19 nt, Homo sapiens
ccugaacucuuuaucuugu

SEQ ID NO: 1562436 - RNA, 19 nt, Homo sapiens
gcaagauuguacuuauugg

SEQ ID NO: 1562437 - RNA, 19 nt, Homo sapiens
agaaagugguaaagauuca

SEQ ID NO: 1562438 - RNA, 19 nt, Homo sapiens
ugugggaaauuguuuaugu

SEQ ID NO: 1562439 - RNA, 19 nt, Homo sapiens
gaguacagcaaauguguga

SEQ ID NO: 1562440 - RNA, 19 nt, Homo sapiens
gaaaggucuacacucagua

SEQ ID NO: 1562441 - RNA, 19 nt, Homo sapiens
ccacacucauuacacauca

SEQ ID NO: 1562442 - RNA, 19 nt, Homo sapiens
ggagcagauuagagagaaa

SEQ ID NO: 1562443 - RNA, 19 nt, Homo sapiens
gagaacuaguauuauaugg

SEQ ID NO: 1562444 - RNA, 19 nt, Homo sapiens
guaaagauucaacaugcaa

SEQ ID NO: 1562445 - RNA, 19 nt, Homo sapiens
gguaaagauucaacaugca

SEQ ID NO: 1562446 - RNA, 19 nt, Homo sapiens
guacaugccacauaaaauu

SEQ ID NO: 1562447 - RNA, 19 nt, Homo sapiens
gcuguaccgugaugugaug

SEQ ID NO: 1562448 - RNA, 19 nt, Homo sapiens
gaugaacaacacccagaaa

SEQ ID NO: 1562449 - RNA, 19 nt, Homo sapiens
gugaaguacaugccacaua

SEQ ID NO: 1562450 - RNA, 19 nt, Homo sapiens
ccacacuacuuagacauca

SEQ ID NO: 1562451 - RNA, 19 nt, Homo sapiens
gaguuuacacugaagaaga

SEQ ID NO: 1562452 - RNA, 19 nt, Homo sapiens
caaagaguuuacacugaag

SEQ ID NO: 1562453 - RNA, 19 nt, Homo sapiens
gauuuagcacugagaacua

SEQ ID NO: 1562454 - RNA, 19 nt, Homo sapiens
gaauauccacacuagugaa

SEQ ID NO: 1562455 - RNA, 19 nt, Homo sapiens
aguagaaagugguaaagau

SEQ ID NO: 1562456 - RNA, 19 nt, Homo sapiens
gugaugugaugcuggagaa

SEQ ID NO: 1562457 - RNA, 19 nt, Homo sapiens
cagugaaugugggaaauug

SEQ ID NO: 1562458 - RNA, 19 nt, Homo sapiens
cgacauuugugaagaacca

SEQ ID NO: 1562459 - RNA, 19 nt, Homo sapiens
gcaaagaauauccugaacu

SEQ ID NO: 1562460 - RNA, 19 nt, Homo sapiens
caaaccucuuuaggcauua

SEQ ID NO: 1562461 - RNA, 19 nt, Homo sapiens
gugcaacucaaaccucuuu

SEQ ID NO: 1562462 - RNA, 19 nt, Homo sapiens
guccuugucuugccuuugu

SEQ ID NO: 1562463 - RNA, 19 nt, Homo sapiens
gaugugaugcuggagaauu

SEQ ID NO: 1562464 - RNA, 19 nt, Homo sapiens
gaauguagccaaaaugaug

SEQ ID NO: 1562465 - RNA, 19 nt, Homo sapiens
agagccagguguuucugua

SEQ ID NO: 1562466 - RNA, 19 nt, Homo sapiens
guacuuauugggcuucaga

SEQ ID NO: 1562467 - RNA, 19 nt, Homo sapiens
cuugaaauccguccucauu

SEQ ID NO: 1562468 - RNA, 19 nt, Homo sapiens
gcagugaaugugggaaauu

SEQ ID NO: 1562469 - RNA, 19 nt, Homo sapiens
guuccacacucauuacaca

SEQ ID NO: 1562470 - RNA, 19 nt, Homo sapiens
gcagugaaugugggaaauu

SEQ ID NO: 1562471 - RNA, 19 nt, Homo sapiens
guacacguguccagcacau

SEQ ID NO: 1562472 - RNA, 19 nt, Homo sapiens
gaaagucuucugaguacag

SEQ ID NO: 1562473 - RNA, 19 nt, Homo sapiens
accaaagaguuuacacuga

SEQ ID NO: 1562474 - RNA, 19 nt, Homo sapiens
caauagacaucagagaacu

SEQ ID NO: 1562475 - RNA, 19 nt, Homo sapiens
ugugggaaauucuuuaugg

SEQ ID NO: 1562476 - RNA, 19 nt, Homo sapiens
gaacucacacuggagaaag

SEQ ID NO: 1562477 - RNA, 19 nt, Homo sapiens
ugugggauauuguuuaugg

SEQ ID NO: 1562478 - RNA, 19 nt, Homo sapiens
agacguggccauauauuuc

SEQ ID NO: 1562479 - RNA, 19 nt, Homo sapiens
uuugccaucuuaacuauug

SEQ ID NO: 1562480 - RNA, 19 nt, Homo sapiens
guacagcaaaugugugaca

SEQ ID NO: 1562481 - RNA, 19 nt, Homo sapiens
caguagacaucagagaguu

SEQ ID NO: 1562482 - RNA, 19 nt, Homo sapiens
ggaaagacauucacuagaa

SEQ ID NO: 1562483 - RNA, 19 nt, Homo sapiens
ggaaagcacuuaugaguau

SEQ ID NO: 1562484 - RNA, 19 nt, Homo sapiens
ggaaaucacuguauacgaa

SEQ ID NO: 1562485 - RNA, 19 nt, Homo sapiens
ggagaaaggccacauaaua

SEQ ID NO: 1562486 - RNA, 19 nt, Homo sapiens
cagaagagcugcauuacua

SEQ ID NO: 1562487 - RNA, 19 nt, Homo sapiens
gagaaagacccuauaguua

SEQ ID NO: 1562488 - RNA, 19 nt, Homo sapiens
gaaaugaugucacucugaa

SEQ ID NO: 1562489 - RNA, 19 nt, Homo sapiens
gaaauuaccuaacaagaag

SEQ ID NO: 1562490 - RNA, 19 nt, Homo sapiens
gagaaaggccacauaauaa

SEQ ID NO: 1562491 - RNA, 19 nt, Homo sapiens
gaaagacccuauaguuaug

SEQ ID NO: 1562492 - RNA, 19 nt, Homo sapiens
agaaagaccuuaugaaugu

SEQ ID NO: 1562493 - RNA, 19 nt, Homo sapiens
gauauguuguugcuucuua

SEQ ID NO: 1562494 - RNA, 19 nt, Homo sapiens
ggaaaucguuuaaucacaa

SEQ ID NO: 1562495 - RNA, 19 nt, Homo sapiens
gaauuagcauuucuaggua

SEQ ID NO: 1562496 - RNA, 19 nt, Homo sapiens
ggagaaagacccuauaguu

SEQ ID NO: 1562497 - RNA, 19 nt, Homo sapiens
gacaaucacugaauuacaa

SEQ ID NO: 1562498 - RNA, 19 nt, Homo sapiens
caaguaauccucuagcaua

SEQ ID NO: 1562499 - RNA, 19 nt, Homo sapiens
ggaaauuaccuaacaagaa

SEQ ID NO: 1562500 - RNA, 19 nt, Homo sapiens
agaaagaccuuaucagugu

SEQ ID NO: 1562501 - RNA, 19 nt, Homo sapiens
guaagaaguuugagacuag

SEQ ID NO: 1562502 - RNA, 19 nt, Homo sapiens
ugacaaauauggcacauuc

SEQ ID NO: 1562503 - RNA, 19 nt, Homo sapiens
ggagaaagaccuuaugaau

SEQ ID NO: 1562504 - RNA, 19 nt, Homo sapiens
gaaagacccuaugagugua

SEQ ID NO: 1562505 - RNA, 19 nt, Homo sapiens
gaauucaucugcuuaugga

SEQ ID NO: 1562506 - RNA, 19 nt, Homo sapiens
caaccuauauugaauguca

SEQ ID NO: 1562507 - RNA, 19 nt, Homo sapiens
ccagauaguucuuucaaau

SEQ ID NO: 1562508 - RNA, 19 nt, Homo sapiens
gaaaggccacauaauaauu

SEQ ID NO: 1562509 - RNA, 19 nt, Homo sapiens
cagaauagauguggccuuu

SEQ ID NO: 1562510 - RNA, 19 nt, Homo sapiens
uccaguagcugcauaaauu

SEQ ID NO: 1562511 - RNA, 19 nt, Homo sapiens
ccugagcccuauuuauuua

SEQ ID NO: 1562512 - RNA, 19 nt, Homo sapiens
gguaagaaguuugagacua

SEQ ID NO: 1562513 - RNA, 19 nt, Homo sapiens
ucacauaaccuauuuguca

SEQ ID NO: 1562514 - RNA, 19 nt, Homo sapiens
gcucauaaguauuugguau

SEQ ID NO: 1562515 - RNA, 19 nt, Homo sapiens
gcaaauauggaaagacauu

SEQ ID NO: 1562516 - RNA, 19 nt, Homo sapiens
gagaaagaccuuaugaaug

SEQ ID NO: 1562517 - RNA, 19 nt, Homo sapiens
gaaagacauucacuagaag

SEQ ID NO: 1562518 - RNA, 19 nt, Homo sapiens
ggaauaaaacugcuuguua

SEQ ID NO: 1562519 - RNA, 19 nt, Homo sapiens
ggagaaagaccuuaucagu

SEQ ID NO: 1562520 - RNA, 19 nt, Homo sapiens
uggcagaucuguugguaaa

SEQ ID NO: 1562521 - RNA, 19 nt, Homo sapiens
ggagaaagacaucaugaau

SEQ ID NO: 1562522 - RNA, 19 nt, Homo sapiens
cagccagcauuccaauuua

SEQ ID NO: 1562523 - RNA, 19 nt, Homo sapiens
gaauagauguggccuuugc

SEQ ID NO: 1562524 - RNA, 19 nt, Homo sapiens
gggcuucacucuucuuuca

SEQ ID NO: 1562525 - RNA, 19 nt, Homo sapiens
gaaaggccauaugacugua

SEQ ID NO: 1562526 - RNA, 19 nt, Homo sapiens
gaaaggccauaugagugua

SEQ ID NO: 1562527 - RNA, 19 nt, Homo sapiens
gagaaugugggaaauguuu

SEQ ID NO: 1562528 - RNA, 19 nt, Homo sapiens
gagaaugugggaaauguuu

SEQ ID NO: 1562529 - RNA, 19 nt, Homo sapiens
ggagaaaggccauaugagu

SEQ ID NO: 1562530 - RNA, 19 nt, Homo sapiens
ggagaaagacccuaugagu

SEQ ID NO: 1562531 - RNA, 19 nt, Homo sapiens
cuugaaagcacuaggauua

SEQ ID NO: 1562532 - RNA, 19 nt, Homo sapiens
agaaaggccucaacagugu

SEQ ID NO: 1562533 - RNA, 19 nt, Homo sapiens
uagcaaauauggaaagaca

SEQ ID NO: 1562534 - RNA, 19 nt, Homo sapiens
agaaagacccuauaguuau

SEQ ID NO: 1562535 - RNA, 19 nt, Homo sapiens
gagaaagacaucaugaaug

SEQ ID NO: 1562536 - RNA, 19 nt, Homo sapiens
ggagaaaggccacaugagu

SEQ ID NO: 1562537 - RNA, 19 nt, Homo sapiens
ggagaaaggccacaugagu

SEQ ID NO: 1562538 - RNA, 19 nt, Homo sapiens
gugggaauauuacuucuug

SEQ ID NO: 1562539 - RNA, 19 nt, Homo sapiens
cuauggaaaucacuguaua

SEQ ID NO: 1562540 - RNA, 19 nt, Homo sapiens
gaaaauccuuugugggaaa

SEQ ID NO: 1562541 - RNA, 19 nt, Homo sapiens
gaagagcugcauuacuauu

SEQ ID NO: 1562542 - RNA, 19 nt, Homo sapiens
gaaauccuguacauagaag

SEQ ID NO: 1562543 - RNA, 19 nt, Homo sapiens
cauuaaacaucaacgaguu

SEQ ID NO: 1562544 - RNA, 19 nt, Homo sapiens
gaaaccucauuaaacauca

SEQ ID NO: 1562545 - RNA, 19 nt, Homo sapiens
gaaugugggaaaucguuua

SEQ ID NO: 1562546 - RNA, 19 nt, Homo sapiens
ccagacaaucacugaauua

SEQ ID NO: 1562547 - RNA, 19 nt, Homo sapiens
guuaggagagucaauguaa

SEQ ID NO: 1562548 - RNA, 19 nt, Homo sapiens
ggaaaugaugucacucuga

SEQ ID NO: 1562549 - RNA, 19 nt, Homo sapiens
caaauauggcacauucuuu

SEQ ID NO: 1562550 - RNA, 19 nt, Homo sapiens
gaaagcccuucucagugaa

SEQ ID NO: 1562551 - RNA, 19 nt, Homo sapiens
gagcaacucccaccuaaag

SEQ ID NO: 1562552 - RNA, 19 nt, Homo sapiens
aauaugacaugcuauggaa

SEQ ID NO: 1562553 - RNA, 19 nt, Homo sapiens
gagaguucaugcuagagaa

SEQ ID NO: 1562554 - RNA, 19 nt, Homo sapiens
ccauaugacuguaaggaau

SEQ ID NO: 1562555 - RNA, 19 nt, Homo sapiens
agaaagacccuaugagugu

SEQ ID NO: 1562556 - RNA, 19 nt, Homo sapiens
gcaugugggaaguuauuua

SEQ ID NO: 1562557 - RNA, 19 nt, Homo sapiens
gaauaugacaugcuaugga

SEQ ID NO: 1562558 - RNA, 19 nt, Homo sapiens
caaguucacacuagagaaa

SEQ ID NO: 1562559 - RNA, 19 nt, Homo sapiens
gcauuacuauucaucagau

SEQ ID NO: 1562560 - RNA, 19 nt, Homo sapiens
caugauauaugaguaguuc

SEQ ID NO: 1562561 - RNA, 19 nt, Homo sapiens
ggaaaccucauuaaacauc

SEQ ID NO: 1562562 - RNA, 19 nt, Homo sapiens
gagaauguggaaaguguuu

SEQ ID NO: 1562563 - RNA, 19 nt, Homo sapiens
cuuagaauaugacaugcua

SEQ ID NO: 1562564 - RNA, 19 nt, Homo sapiens
gcucugcccugcaaguuca

SEQ ID NO: 1562565 - RNA, 19 nt, Homo sapiens
caggagaguucaugcuaga

SEQ ID NO: 1562566 - RNA, 19 nt, Homo sapiens
agggaaaccucauuaaaca

SEQ ID NO: 1562567 - RNA, 19 nt, Homo sapiens
ccagccagcauuccaauuu

SEQ ID NO: 1562568 - RNA, 19 nt, Homo sapiens
gaaaucguuuaaucacaag

SEQ ID NO: 1562569 - RNA, 19 nt, Homo sapiens
uagaagcucugcccugcaa

SEQ ID NO: 1562570 - RNA, 19 nt, Homo sapiens
ggaaaucuuuuagccauaa

SEQ ID NO: 1562571 - RNA, 19 nt, Homo sapiens
aaagggaaaccucauuaaa

SEQ ID NO: 1562572 - RNA, 19 nt, Homo sapiens
ccauaugaguguagagaau

SEQ ID NO: 1562573 - RNA, 19 nt, Homo sapiens
ucaacaguguagcaaauau

SEQ ID NO: 1562574 - RNA, 19 nt, Homo sapiens
gggaaaucguuuaaucaca

SEQ ID NO: 1562575 - RNA, 19 nt, Homo sapiens
gaauguaugaaauccugua

SEQ ID NO: 1562576 - RNA, 19 nt, Homo sapiens
gagaaugugggaaaucguu

SEQ ID NO: 1562577 - RNA, 19 nt, Homo sapiens
gaguauugcuugagguaag

SEQ ID NO: 1562578 - RNA, 19 nt, Homo sapiens
gagagucaauguaaaauca

SEQ ID NO: 1562579 - RNA, 19 nt, Homo sapiens
gaaagaccuuaugaaugug

SEQ ID NO: 1562580 - RNA, 19 nt, Homo sapiens
ccucaacaguguagcaaau

SEQ ID NO: 1562581 - RNA, 19 nt, Homo sapiens
gaaaggccucaacagugua

SEQ ID NO: 1562582 - RNA, 19 nt, Homo sapiens
gaaguugccugucuacaug

SEQ ID NO: 1562583 - RNA, 19 nt, Homo sapiens
gauugcagcuggaguauga

SEQ ID NO: 1562584 - RNA, 19 nt, Homo sapiens
ccacacaacuuauaaaaug

SEQ ID NO: 1562585 - RNA, 19 nt, Homo sapiens
agaacauccuccucuauuu

SEQ ID NO: 1562586 - RNA, 19 nt, Homo sapiens
gcugucaggugguaucaga

SEQ ID NO: 1562587 - RNA, 19 nt, Homo sapiens
cuacgaggcggaauucuuu

SEQ ID NO: 1562588 - RNA, 19 nt, Homo sapiens
cuucuccgcugaugaguuu

SEQ ID NO: 1562589 - RNA, 19 nt, Homo sapiens
gcaacgagagugugaagau

SEQ ID NO: 1562590 - RNA, 19 nt, Homo sapiens
ccgcucaggugauggauug

SEQ ID NO: 1562591 - RNA, 19 nt, Homo sapiens
cagaacauccuccucuauu

SEQ ID NO: 1562592 - RNA, 19 nt, Homo sapiens
gccaagugcugucagaaca

SEQ ID NO: 1562593 - RNA, 19 nt, Homo sapiens
cuuccucucuuguuacuuu

SEQ ID NO: 1562594 - RNA, 19 nt, Homo sapiens
gaacauccuccucuauuuu

SEQ ID NO: 1562595 - RNA, 19 nt, Homo sapiens
gcccauggcguguuucuga

SEQ ID NO: 1562596 - RNA, 19 nt, Homo sapiens
caacgagagugugaagauc

SEQ ID NO: 1562597 - RNA, 19 nt, Homo sapiens
gaacaaccaggucaucaac

SEQ ID NO: 1562598 - RNA, 19 nt, Homo sapiens
gcgacucggugcccaacuu

SEQ ID NO: 1562599 - RNA, 19 nt, Homo sapiens
uuuguuuccucucggauua

SEQ ID NO: 1562600 - RNA, 19 nt, Homo sapiens
gguccugagccuccuauuu

SEQ ID NO: 1562601 - RNA, 19 nt, Homo sapiens
ggguguuccugacaagauu

SEQ ID NO: 1562602 - RNA, 19 nt, Homo sapiens
gucagaacauccuccucua

SEQ ID NO: 1562603 - RNA, 19 nt, Homo sapiens
gaggccaagugcugucaga

SEQ ID NO: 1562604 - RNA, 19 nt, Homo sapiens
ggauggauauugcgaugcu

SEQ ID NO: 1562605 - RNA, 19 nt, Homo sapiens
gagccaauccgcugacaag

SEQ ID NO: 1562606 - RNA, 19 nt, Homo sapiens
cgucagcggccaacaagaa

SEQ ID NO: 1562607 - RNA, 19 nt, Homo sapiens
cugcgacacuuuccugaga

SEQ ID NO: 1562608 - RNA, 19 nt, Homo sapiens
caaccucaccacccaguau

SEQ ID NO: 1562609 - RNA, 19 nt, Homo sapiens
gagaacaaccaggucauca

SEQ ID NO: 1562610 - RNA, 19 nt, Homo sapiens
cgacuggacuuccguuucc

SEQ ID NO: 1562611 - RNA, 19 nt, Homo sapiens
guucugcuaugcugugcuu

SEQ ID NO: 1562612 - RNA, 19 nt, Homo sapiens
uguacacgcucacccaugu

SEQ ID NO: 1562613 - RNA, 19 nt, Homo sapiens
caagugcugucagaacauc

SEQ ID NO: 1562614 - RNA, 19 nt, Homo sapiens
gaaacccucccucggaucu

SEQ ID NO: 1562615 - RNA, 19 nt, Homo sapiens
uauacccucugguucuuug

SEQ ID NO: 1562616 - RNA, 19 nt, Homo sapiens
cgacacuucuccgcugaug

SEQ ID NO: 1562617 - RNA, 19 nt, Homo sapiens
ucuucuuccucucuuguua

SEQ ID NO: 1562618 - RNA, 19 nt, Homo sapiens
gcagcuggaguaugagaug

SEQ ID NO: 1562619 - RNA, 19 nt, Homo sapiens
caacuucacggagcucuuc

SEQ ID NO: 1562620 - RNA, 19 nt, Homo sapiens
ugaaguugccugucuacau

SEQ ID NO: 1562621 - RNA, 19 nt, Homo sapiens
ggacuggguguuccugaca

SEQ ID NO: 1562622 - RNA, 19 nt, Homo sapiens
ugaccuuccuccucaucuu

SEQ ID NO: 1562623 - RNA, 19 nt, Homo sapiens
acaagaacuucccguacca

SEQ ID NO: 1562624 - RNA, 19 nt, Homo sapiens
gcccuucuuugcugccuau

SEQ ID NO: 1562625 - RNA, 19 nt, Homo sapiens
gcuccacacaacuuauaaa

SEQ ID NO: 1562626 - RNA, 19 nt, Homo sapiens
agacagaugugaccuuccu

SEQ ID NO: 1562627 - RNA, 19 nt, Homo sapiens
ggagaacaaccaggucauc

SEQ ID NO: 1562628 - RNA, 19 nt, Homo sapiens
cauggcguguuucugauca

SEQ ID NO: 1562629 - RNA, 19 nt, Homo sapiens
ccuauacccucugguucuu

SEQ ID NO: 1562630 - RNA, 19 nt, Homo sapiens
ucagaacauccuccucuau

SEQ ID NO: 1562631 - RNA, 19 nt, Homo sapiens
caaggaggacuggguguuc

SEQ ID NO: 1562632 - RNA, 19 nt, Homo sapiens
guccugagccuccuauuuu

SEQ ID NO: 1562633 - RNA, 19 nt, Homo sapiens
ccgugaaguugccugucua

SEQ ID NO: 1562634 - RNA, 19 nt, Homo sapiens
uggccaagcugcucuucuc

SEQ ID NO: 1562635 - RNA, 19 nt, Homo sapiens
gacuggguguuccugacaa

SEQ ID NO: 1562636 - RNA, 19 nt, Homo sapiens
cauggccgcagcaggagua

SEQ ID NO: 1562637 - RNA, 19 nt, Homo sapiens
agaacaaccaggucaucaa

SEQ ID NO: 1562638 - RNA, 19 nt, Homo sapiens
auucugggcucccgcuguu

SEQ ID NO: 1562639 - RNA, 19 nt, Homo sapiens
gcgacacuuuccugagaag

SEQ ID NO: 1562640 - RNA, 19 nt, Homo sapiens
cuuuggauauuugcugaaa

SEQ ID NO: 1562641 - RNA, 19 nt, Homo sapiens
caucuucauccucaucuuc

SEQ ID NO: 1562642 - RNA, 19 nt, Homo sapiens
ggccaaggagucagugauc

SEQ ID NO: 1562643 - RNA, 19 nt, Homo sapiens
ccaaggaggacuggguguu

SEQ ID NO: 1562644 - RNA, 19 nt, Homo sapiens
acgagagugugaagaucuu

SEQ ID NO: 1562645 - RNA, 19 nt, Homo sapiens
gaccuuccuccucaucuuc

SEQ ID NO: 1562646 - RNA, 19 nt, Homo sapiens
guccggcugucagguggua

SEQ ID NO: 1562647 - RNA, 19 nt, Homo sapiens
gcaagggauuggccauuua

SEQ ID NO: 1562648 - RNA, 19 nt, Homo sapiens
gaaaugagguugggcucua

SEQ ID NO: 1562649 - RNA, 19 nt, Homo sapiens
aaacuggugucuccacuuu

SEQ ID NO: 1562650 - RNA, 19 nt, Homo sapiens
gacgguaucuaagaaauug

SEQ ID NO: 1562651 - RNA, 19 nt, Homo sapiens
uguaugagcucgccucuuc

SEQ ID NO: 1562652 - RNA, 19 nt, Homo sapiens
gcaagaagggcgcaguuga

SEQ ID NO: 1562653 - RNA, 19 nt, Homo sapiens
ggcaagggauuggccauuu

SEQ ID NO: 1562654 - RNA, 19 nt, Homo sapiens
gcaaggaaccagugaccaa

SEQ ID NO: 1562655 - RNA, 19 nt, Homo sapiens
agccagggaugaaauuuaa

SEQ ID NO: 1562656 - RNA, 19 nt, Homo sapiens
uaagaggugggauuucuaa

SEQ ID NO: 1562657 - RNA, 19 nt, Homo sapiens
acacuuacauggcaaaggu

SEQ ID NO: 1562658 - RNA, 19 nt, Homo sapiens
gagcucgccucuuccagau

SEQ ID NO: 1562659 - RNA, 19 nt, Homo sapiens
gggcaaacaggcucucuug

SEQ ID NO: 1562660 - RNA, 19 nt, Homo sapiens
gcucgccucuuccagauag

SEQ ID NO: 1562661 - RNA, 19 nt, Homo sapiens
gaggugggauuucuaagac

SEQ ID NO: 1562662 - RNA, 19 nt, Homo sapiens
gaaauuuaacggcaagaag

SEQ ID NO: 1562663 - RNA, 19 nt, Homo sapiens
ccacuuguaggaauuuauu

SEQ ID NO: 1562664 - RNA, 19 nt, Homo sapiens
ucucaacucuuccacuugu

SEQ ID NO: 1562665 - RNA, 19 nt, Homo sapiens
gaagcccgaggaacucuuu

SEQ ID NO: 1562666 - RNA, 19 nt, Homo sapiens
gcacugcgcaugcuuucug

SEQ ID NO: 1562667 - RNA, 19 nt, Homo sapiens
gcagaagcccagccaguca

SEQ ID NO: 1562668 - RNA, 19 nt, Homo sapiens
cauaugacgguaucuaaga

SEQ ID NO: 1562669 - RNA, 19 nt, Homo sapiens
cgccagcccuagccaguaa

SEQ ID NO: 1562670 - RNA, 19 nt, Homo sapiens
ggacguggagcugugguuu

SEQ ID NO: 1562671 - RNA, 19 nt, Homo sapiens
ucuaagaccgacuguauga

SEQ ID NO: 1562672 - RNA, 19 nt, Homo sapiens
gcuuacugcuccuucauca

SEQ ID NO: 1562673 - RNA, 19 nt, Homo sapiens
gugacaaggccuucucgua

SEQ ID NO: 1562674 - RNA, 19 nt, Homo sapiens
gaugaggauugugggcaaa

SEQ ID NO: 1562675 - RNA, 19 nt, Homo sapiens
guaagaggugggauuucua

SEQ ID NO: 1562676 - RNA, 19 nt, Homo sapiens
ccaguaagaggugggauuu

SEQ ID NO: 1562677 - RNA, 19 nt, Homo sapiens
ccccaaggcuuucucauuu

SEQ ID NO: 1562678 - RNA, 19 nt, Homo sapiens
cggcgucaaugaaaugaga

SEQ ID NO: 1562679 - RNA, 19 nt, Homo sapiens
ugucucaacucuuccacuu

SEQ ID NO: 1562680 - RNA, 19 nt, Homo sapiens
gccauaugacgguaucuaa

SEQ ID NO: 1562681 - RNA, 19 nt, Homo sapiens
ggagaucucaaaccaugga

SEQ ID NO: 1562682 - RNA, 19 nt, Homo sapiens
ucaaugaaaugagacuaag

SEQ ID NO: 1562683 - RNA, 19 nt, Homo sapiens
caaggaaccagugaccaaa

SEQ ID NO: 1562684 - RNA, 19 nt, Homo sapiens
caagggauuggccauuuau

SEQ ID NO: 1562685 - RNA, 19 nt, Homo sapiens
gucaaugaaaugagacuaa

SEQ ID NO: 1562686 - RNA, 19 nt, Homo sapiens
aagccagggaugaaauuua

SEQ ID NO: 1562687 - RNA, 19 nt, Homo sapiens
ggauuggccauuuauacug

SEQ ID NO: 1562688 - RNA, 19 nt, Homo sapiens
guggagcugugguuugaca

SEQ ID NO: 1562689 - RNA, 19 nt, Homo sapiens
ccaagccagggaugaaauu

SEQ ID NO: 1562690 - RNA, 19 nt, Homo sapiens
gaaccagugaccaaagaag

SEQ ID NO: 1562691 - RNA, 19 nt, Homo sapiens
ggaaccagugaccaaagaa

SEQ ID NO: 1562692 - RNA, 19 nt, Homo sapiens
cauacaugcuugucucaac

SEQ ID NO: 1562693 - RNA, 19 nt, Homo sapiens
ugacgguaucuaagaaauu

SEQ ID NO: 1562694 - RNA, 19 nt, Homo sapiens
aggaaccagugaccaaaga

SEQ ID NO: 1562695 - RNA, 19 nt, Homo sapiens
auaugacgguaucuaagaa

SEQ ID NO: 1562696 - RNA, 19 nt, Homo sapiens
ugucuccacuuuggccaua

SEQ ID NO: 1562697 - RNA, 19 nt, Homo sapiens
uuucuaagaccgacuguau

SEQ ID NO: 1562698 - RNA, 19 nt, Homo sapiens
augcuugucucaacucuuc

SEQ ID NO: 1562699 - RNA, 19 nt, Homo sapiens
aguaagaggugggauuucu

SEQ ID NO: 1562700 - RNA, 19 nt, Homo sapiens
acguggagcugugguuuga

SEQ ID NO: 1562701 - RNA, 19 nt, Homo sapiens
gggauuggccauuuauacu

SEQ ID NO: 1562702 - RNA, 19 nt, Homo sapiens
gagggcagggcaagggauu

SEQ ID NO: 1562703 - RNA, 19 nt, Homo sapiens
agaggugggauuucuaaga

SEQ ID NO: 1562704 - RNA, 19 nt, Homo sapiens
caagccagggaugaaauuu

SEQ ID NO: 1562705 - RNA, 19 nt, Homo sapiens
cccaaggcuuucucauuuc

SEQ ID NO: 1562706 - RNA, 19 nt, Homo sapiens
aaaugagguugggcucuau

SEQ ID NO: 1562707 - RNA, 19 nt, Homo sapiens
caagaagggcgcaguugac

SEQ ID NO: 1562708 - RNA, 19 nt, Homo sapiens
gcucucuuguuaaaaguuu

SEQ ID NO: 1562709 - RNA, 19 nt, Homo sapiens
ggccauaugacgguaucua

SEQ ID NO: 1562710 - RNA, 19 nt, Homo sapiens
gggcaagggauuggccauu

SEQ ID NO: 1562711 - RNA, 19 nt, Homo sapiens
gccaguaagaggugggauu

SEQ ID NO: 1562712 - RNA, 19 nt, Homo sapiens
gacgcuuacugcuccuuca

SEQ ID NO: 1562713 - RNA, 19 nt, Homo sapiens
ccaaggcuuucucauuucc

SEQ ID NO: 1562714 - RNA, 19 nt, Homo sapiens
gaaauucacugcucacuug

SEQ ID NO: 1562715 - RNA, 19 nt, Homo sapiens
gcaagacgguccugaugua

SEQ ID NO: 1562716 - RNA, 19 nt, Homo sapiens
guacgaaguugcucucaaa

SEQ ID NO: 1562717 - RNA, 19 nt, Homo sapiens
uguacaagcuugauugaaa

SEQ ID NO: 1562718 - RNA, 19 nt, Homo sapiens
ggaaaagguuuaagaaaga

SEQ ID NO: 1562719 - RNA, 19 nt, Homo sapiens
guacaagcuugauugaaau

SEQ ID NO: 1562720 - RNA, 19 nt, Homo sapiens
cgaaguugcucucaaagau

SEQ ID NO: 1562721 - RNA, 19 nt, Homo sapiens
ggucgugguuugacauuug

SEQ ID NO: 1562722 - RNA, 19 nt, Homo sapiens
ccacaggcuuccagacuug

SEQ ID NO: 1562723 - RNA, 19 nt, Homo sapiens
ggcaugaacuguacgaagu

SEQ ID NO: 1562724 - RNA, 19 nt, Homo sapiens
ccuggaagcugguggcuau

SEQ ID NO: 1562725 - RNA, 19 nt, Homo sapiens
gggcuggucuguagcuuuc

SEQ ID NO: 1562726 - RNA, 19 nt, Homo sapiens
ucccgaaacuggucgaauu

SEQ ID NO: 1562727 - RNA, 19 nt, Homo sapiens
cuugauacguuauucagaa

SEQ ID NO: 1562728 - RNA, 19 nt, Homo sapiens
gcacugugacgucaugaug

SEQ ID NO: 1562729 - RNA, 19 nt, Homo sapiens
gaaguugcucucaaagaug

SEQ ID NO: 1562730 - RNA, 19 nt, Homo sapiens
gcccagacacuguaaauag

SEQ ID NO: 1562731 - RNA, 19 nt, Homo sapiens
gaugcagccucccuucugu

SEQ ID NO: 1562732 - RNA, 19 nt, Homo sapiens
ucaaagcccagacacugua

SEQ ID NO: 1562733 - RNA, 19 nt, Homo sapiens
uguguuguguggcaguuua

SEQ ID NO: 1562734 - RNA, 19 nt, Homo sapiens
auucacugcucacuugaua

SEQ ID NO: 1562735 - RNA, 19 nt, Homo sapiens
agacgguccugauguacaa

SEQ ID NO: 1562736 - RNA, 19 nt, Homo sapiens
ugaaaugugugaacguuuu

SEQ ID NO: 1562737 - RNA, 19 nt, Homo sapiens
cccagacacuguaaauaga

SEQ ID NO: 1562738 - RNA, 19 nt, Homo sapiens
ggcuaugucuccuccuuug

SEQ ID NO: 1562739 - RNA, 19 nt, Homo sapiens
gaaggaaaagguuuaagaa

SEQ ID NO: 1562740 - RNA, 19 nt, Homo sapiens
cugcucacuugauacguua

SEQ ID NO: 1562741 - RNA, 19 nt, Homo sapiens
gauguacaagcuugauuga

SEQ ID NO: 1562742 - RNA, 19 nt, Homo sapiens
gaucccgccucauugcaau

SEQ ID NO: 1562743 - RNA, 19 nt, Homo sapiens
guuguguggcaguuuauua

SEQ ID NO: 1562744 - RNA, 19 nt, Homo sapiens
gaaaacaaaaccaacaguu

SEQ ID NO: 1562745 - RNA, 19 nt, Homo sapiens
ggaagcugguggcuauguc

SEQ ID NO: 1562746 - RNA, 19 nt, Homo sapiens
uuuaugacgucacacaaga

SEQ ID NO: 1562747 - RNA, 19 nt, Homo sapiens
gcgggcuccugauuuguga

SEQ ID NO: 1562748 - RNA, 19 nt, Homo sapiens
cccuguaagucuauuuaaa

SEQ ID NO: 1562749 - RNA, 19 nt, Homo sapiens
ggauguggcagcccugaau

SEQ ID NO: 1562750 - RNA, 19 nt, Homo sapiens
ccgagauccuggccacuau

SEQ ID NO: 1562751 - RNA, 19 nt, Homo sapiens
ccagacacuguaaauagaa

SEQ ID NO: 1562752 - RNA, 19 nt, Homo sapiens
caaauacuggcacaucauc

SEQ ID NO: 1562753 - RNA, 19 nt, Homo sapiens
gggacuacgcgcacuguga

SEQ ID NO: 1562754 - RNA, 19 nt, Homo sapiens
cagccucugugccuuuguu

SEQ ID NO: 1562755 - RNA, 19 nt, Homo sapiens
ggaacaugccgccuucucu

SEQ ID NO: 1562756 - RNA, 19 nt, Homo sapiens
gaccuucguugcaacuucu

SEQ ID NO: 1562757 - RNA, 19 nt, Homo sapiens
cacccucccuguaagucua

SEQ ID NO: 1562758 - RNA, 19 nt, Homo sapiens
caaagcccagacacuguaa

SEQ ID NO: 1562759 - RNA, 19 nt, Homo sapiens
ggaugcagccucccuucug

SEQ ID NO: 1562760 - RNA, 19 nt, Homo sapiens
ccucagccaucccaagaag

SEQ ID NO: 1562761 - RNA, 19 nt, Homo sapiens
ugucguggcaugaacugua

SEQ ID NO: 1562762 - RNA, 19 nt, Homo sapiens
ugaccuucguugcaacuuc

SEQ ID NO: 1562763 - RNA, 19 nt, Homo sapiens
ugauguacaagcuugauug

SEQ ID NO: 1562764 - RNA, 19 nt, Homo sapiens
ggcaagacgguccugaugu

SEQ ID NO: 1562765 - RNA, 19 nt, Homo sapiens
ucagaaacccaaggaaugg

SEQ ID NO: 1562766 - RNA, 19 nt, Homo sapiens
gauagaugucguggcauga

SEQ ID NO: 1562767 - RNA, 19 nt, Homo sapiens
uaccuggacugcggugcua

SEQ ID NO: 1562768 - RNA, 19 nt, Homo sapiens
aacaguuaguggagucaaa

SEQ ID NO: 1562769 - RNA, 19 nt, Homo sapiens
ucacuuugacacuggacua

SEQ ID NO: 1562770 - RNA, 19 nt, Homo sapiens
guggcuaugucuccuccuu

SEQ ID NO: 1562771 - RNA, 19 nt, Homo sapiens
gcucacugcucuggaacca

SEQ ID NO: 1562772 - RNA, 19 nt, Homo sapiens
gaguagagcccgagauccu

SEQ ID NO: 1562773 - RNA, 19 nt, Homo sapiens
ccaaauacuggcacaucau

SEQ ID NO: 1562774 - RNA, 19 nt, Homo sapiens
gcucacuugauacguuauu

SEQ ID NO: 1562775 - RNA, 19 nt, Homo sapiens
ggcagaggcaugaaagagu

SEQ ID NO: 1562776 - RNA, 19 nt, Homo sapiens
acugcucacuugauacguu

SEQ ID NO: 1562777 - RNA, 19 nt, Homo sapiens
uguacgaaguugcucucaa

SEQ ID NO: 1562778 - RNA, 19 nt, Homo sapiens
aggaaaagguuuaagaaag

SEQ ID NO: 1562779 - RNA, 19 nt, Homo sapiens
uccacaggcuuccagacuu

SEQ ID NO: 1562780 - RNA, 19 nt, Homo sapiens
gggucgugguuugacauuu

SEQ ID NO: 1562781 - RNA, 19 nt, Homo sapiens
gggcagaggcaugaaagag

SEQ ID NO: 1562782 - RNA, 19 nt, Homo sapiens
cuuugacacuggacuagga

SEQ ID NO: 1562783 - RNA, 19 nt, Homo sapiens
ucauugagcgccuggagau

SEQ ID NO: 1562784 - RNA, 19 nt, Homo sapiens
aaacaaaaccaacaguuag

SEQ ID NO: 1562785 - RNA, 19 nt, Homo sapiens
aguccuucuucgccaaaua

SEQ ID NO: 1562786 - RNA, 19 nt, Homo sapiens
gauggaacaggcccagaag

SEQ ID NO: 1562787 - RNA, 19 nt, Homo sapiens
gauguggcagcccugaaug

SEQ ID NO: 1562788 - RNA, 19 nt, Homo sapiens
gcaauaacaucccucugua

SEQ ID NO: 1562789 - RNA, 19 nt, Homo sapiens
gaaggcauggcuugcaaua

SEQ ID NO: 1562790 - RNA, 19 nt, Homo sapiens
uaacaucccucuguaccuu

SEQ ID NO: 1562791 - RNA, 19 nt, Homo sapiens
ccaaacagcggaacucaga

SEQ ID NO: 1562792 - RNA, 19 nt, Homo sapiens
ccaagcaccuccaaggaau

SEQ ID NO: 1562793 - RNA, 19 nt, Homo sapiens
caaguccggugguguccua

SEQ ID NO: 1562794 - RNA, 19 nt, Homo sapiens
cauacacccucgaggauga

SEQ ID NO: 1562795 - RNA, 19 nt, Homo sapiens
gggaaggcauggcuugcaa

SEQ ID NO: 1562796 - RNA, 19 nt, Homo sapiens
ggagccguguccuaccuaa

SEQ ID NO: 1562797 - RNA, 19 nt, Homo sapiens
gaauagcacccgaggucuu

SEQ ID NO: 1562798 - RNA, 19 nt, Homo sapiens
aggcauggcuugcaauaac

SEQ ID NO: 1562799 - RNA, 19 nt, Homo sapiens
caguguggcuaguuugugu

SEQ ID NO: 1562800 - RNA, 19 nt, Homo sapiens
caagcaccuccaaggaaua

SEQ ID NO: 1562801 - RNA, 19 nt, Homo sapiens
ggacgccagcgacuugaug

SEQ ID NO: 1562802 - RNA, 19 nt, Homo sapiens
ggcauggcuugcaauaaca

SEQ ID NO: 1562803 - RNA, 19 nt, Homo sapiens
cagcaccgcccagcauuug

SEQ ID NO: 1562804 - RNA, 19 nt, Homo sapiens
ccagugggcaugugaagca

SEQ ID NO: 1562805 - RNA, 19 nt, Homo sapiens
aaaccucucagccucagaa

SEQ ID NO: 1562806 - RNA, 19 nt, Homo sapiens
cagcgaggcggacauccaa

SEQ ID NO: 1562807 - RNA, 19 nt, Homo sapiens
ucggcaguguggcuaguuu

SEQ ID NO: 1562808 - RNA, 19 nt, Homo sapiens
cccaagcaccuccaaggaa

SEQ ID NO: 1562809 - RNA, 19 nt, Homo sapiens
ugcaauaacaucccucugu

SEQ ID NO: 1562810 - RNA, 19 nt, Homo sapiens
ggaaggcauggcuugcaau

SEQ ID NO: 1562811 - RNA, 19 nt, Homo sapiens
gcaccuccaaggaauagca

SEQ ID NO: 1562812 - RNA, 19 nt, Homo sapiens
gaacaggccuucacgauga

SEQ ID NO: 1562813 - RNA, 19 nt, Homo sapiens
guaaagagcuucugcuguu

SEQ ID NO: 1562814 - RNA, 19 nt, Homo sapiens
gaaagaagcaggcgaagaa

SEQ ID NO: 1562815 - RNA, 19 nt, Homo sapiens
gaacaucacaugacccaua

SEQ ID NO: 1562816 - RNA, 19 nt, Homo sapiens
gaagacacacuuuguaauu

SEQ ID NO: 1562817 - RNA, 19 nt, Homo sapiens
gaauguaaguuccaagaga

SEQ ID NO: 1562818 - RNA, 19 nt, Homo sapiens
gaauaggugguuacucuua

SEQ ID NO: 1562819 - RNA, 19 nt, Homo sapiens
gaaaugggcaugagacuuc

SEQ ID NO: 1562820 - RNA, 19 nt, Homo sapiens
cuacugaugucaagaaaga

SEQ ID NO: 1562821 - RNA, 19 nt, Homo sapiens
gccauuaucccuggaauua

SEQ ID NO: 1562822 - RNA, 19 nt, Homo sapiens
gaaaaguacuguucagaga

SEQ ID NO: 1562823 - RNA, 19 nt, Homo sapiens
gauccagggugcuaucuau

SEQ ID NO: 1562824 - RNA, 19 nt, Homo sapiens
ccacauccucuuucaguua

SEQ ID NO: 1562825 - RNA, 19 nt, Homo sapiens
acacaucccuugacacuca

SEQ ID NO: 1562826 - RNA, 19 nt, Homo sapiens
gacuuugucugccuuguuu

SEQ ID NO: 1562827 - RNA, 19 nt, Homo sapiens
aggaggagcuggaugcuaa

SEQ ID NO: 1562828 - RNA, 19 nt, Homo sapiens
aaagagcucuaaagucaga

SEQ ID NO: 1562829 - RNA, 19 nt, Homo sapiens
gagggaagucaccauguua

SEQ ID NO: 1562830 - RNA, 19 nt, Homo sapiens
agacacacuuuguaauuug

SEQ ID NO: 1562831 - RNA, 19 nt, Homo sapiens
ugucagagccaguguagua

SEQ ID NO: 1562832 - RNA, 19 nt, Homo sapiens
gauggcagccuccaaguga

SEQ ID NO: 1562833 - RNA, 19 nt, Homo sapiens
ccagauagucuaacaaugu

SEQ ID NO: 1562834 - RNA, 19 nt, Homo sapiens
gcaauaccagauagucuaa

SEQ ID NO: 1562835 - RNA, 19 nt, Homo sapiens
aaacggaacccaugcuuug

SEQ ID NO: 1562836 - RNA, 19 nt, Homo sapiens
ggagcuggaugcuaagauc

SEQ ID NO: 1562837 - RNA, 19 nt, Homo sapiens
caagauucauuggagcuuu

SEQ ID NO: 1562838 - RNA, 19 nt, Homo sapiens
uauccugacucccuuagaa

SEQ ID NO: 1562839 - RNA, 19 nt, Homo sapiens
ugagggaagucaccauguu

SEQ ID NO: 1562840 - RNA, 19 nt, Homo sapiens
aaaguacuguucagagaug

SEQ ID NO: 1562841 - RNA, 19 nt, Homo sapiens
gguaucagcucaacuucag

SEQ ID NO: 1562842 - RNA, 19 nt, Homo sapiens
uggacaagaucuuucauuc

SEQ ID NO: 1562843 - RNA, 19 nt, Homo sapiens
caauaugaaucaaguccau

SEQ ID NO: 1562844 - RNA, 19 nt, Homo sapiens
cagcuaagccuguggaaca

SEQ ID NO: 1562845 - RNA, 19 nt, Homo sapiens
cagauagucuaacaaugug

SEQ ID NO: 1562846 - RNA, 19 nt, Homo sapiens
aauguaaguuccaagagaa

SEQ ID NO: 1562847 - RNA, 19 nt, Homo sapiens
ggagcuuuaucuuguagga

SEQ ID NO: 1562848 - RNA, 19 nt, Homo sapiens
ugacacucauucuccauug

SEQ ID NO: 1562849 - RNA, 19 nt, Homo sapiens
gcuuugagcauccuacuga

SEQ ID NO: 1562850 - RNA, 19 nt, Homo sapiens
ugacuuggcuaaagauacu

SEQ ID NO: 1562851 - RNA, 19 nt, Homo sapiens
uacaagagcgccaggcuuu

SEQ ID NO: 1562852 - RNA, 19 nt, Homo sapiens
ucaaguccaucagcaaguu

SEQ ID NO: 1562853 - RNA, 19 nt, Homo sapiens
cauuaucccuggaauuaca

SEQ ID NO: 1562854 - RNA, 19 nt, Homo sapiens
ucaccucacuccuucugaa

SEQ ID NO: 1562855 - RNA, 19 nt, Homo sapiens
augcuaagauccaccauga

SEQ ID NO: 1562856 - RNA, 19 nt, Homo sapiens
caagagaacagggacuuug

SEQ ID NO: 1562857 - RNA, 19 nt, Homo sapiens
uagaaccucugaagacaca

SEQ ID NO: 1562858 - RNA, 19 nt, Homo sapiens
gauagaaucccaacuucag

SEQ ID NO: 1562859 - RNA, 19 nt, Homo sapiens
gacacucauucuccauuga

SEQ ID NO: 1562860 - RNA, 19 nt, Homo sapiens
gagaaugggugaaaaguac

SEQ ID NO: 1562861 - RNA, 19 nt, Homo sapiens
gugacaauaugaaucaagu

SEQ ID NO: 1562862 - RNA, 19 nt, Homo sapiens
uugaauaggugguuacucu

SEQ ID NO: 1562863 - RNA, 19 nt, Homo sapiens
ucacaaaacccucucaauu

SEQ ID NO: 1562864 - RNA, 19 nt, Homo sapiens
uaacugaagagccagaaau

SEQ ID NO: 1562865 - RNA, 19 nt, Homo sapiens
ugacucccuuagaauguaa

SEQ ID NO: 1562866 - RNA, 19 nt, Homo sapiens
cugcuaagcugcucaacuc

SEQ ID NO: 1562867 - RNA, 19 nt, Homo sapiens
ggacuuugucugccuuguu

SEQ ID NO: 1562868 - RNA, 19 nt, Homo sapiens
gauuuagaguggaagcaau

SEQ ID NO: 1562869 - RNA, 19 nt, Homo sapiens
gaaucaaguccaucagcaa

SEQ ID NO: 1562870 - RNA, 19 nt, Homo sapiens
ccuggaggcuguaauaaac

SEQ ID NO: 1562871 - RNA, 19 nt, Homo sapiens
gacacacuuuguaauuugu

SEQ ID NO: 1562872 - RNA, 19 nt, Homo sapiens
uaaagagcuucugcuguuc

SEQ ID NO: 1562873 - RNA, 19 nt, Homo sapiens
caaaugguaucagcucaac

SEQ ID NO: 1562874 - RNA, 19 nt, Homo sapiens
ggcccugaaugccaagauu

SEQ ID NO: 1562875 - RNA, 19 nt, Homo sapiens
cugaagacacacuuuguaa

SEQ ID NO: 1562876 - RNA, 19 nt, Homo sapiens
gaauuacaaagaucugcaa

SEQ ID NO: 1562877 - RNA, 19 nt, Homo sapiens
uaucuaugcgggaauugua

SEQ ID NO: 1562878 - RNA, 19 nt, Homo sapiens
cuuuggagcuuuaucuugu

SEQ ID NO: 1562879 - RNA, 19 nt, Homo sapiens
caaguccaucagcaaguua

SEQ ID NO: 1562880 - RNA, 19 nt, Homo sapiens
cacgauggaggcccaauaa

SEQ ID NO: 1562881 - RNA, 19 nt, Homo sapiens
cacccagaaugaugccuaa

SEQ ID NO: 1562882 - RNA, 19 nt, Homo sapiens
caugugacaauaugaauca

SEQ ID NO: 1562883 - RNA, 19 nt, Homo sapiens
uuauagcgcucacagaaac

SEQ ID NO: 1562884 - RNA, 19 nt, Homo sapiens
guggaagcaauaccagaua

SEQ ID NO: 1562885 - RNA, 19 nt, Homo sapiens
gauaaacgagccagcuaag

SEQ ID NO: 1562886 - RNA, 19 nt, Homo sapiens
ccucucauagugaaacaua

SEQ ID NO: 1562887 - RNA, 19 nt, Homo sapiens
ccauaugguucugauguca

SEQ ID NO: 1562888 - RNA, 19 nt, Homo sapiens
gaagcaauaccagauaguc

SEQ ID NO: 1562889 - RNA, 19 nt, Homo sapiens
cagagaugcaggugagaaa

SEQ ID NO: 1562890 - RNA, 19 nt, Homo sapiens
caagagcgccaggcuuuca

SEQ ID NO: 1562891 - RNA, 19 nt, Homo sapiens
ugagauacaccuacaagag

SEQ ID NO: 1562892 - RNA, 19 nt, Homo sapiens
gagagccggauauuggaaa

SEQ ID NO: 1562893 - RNA, 19 nt, Homo sapiens
gaaagcugcagcgaucaga

SEQ ID NO: 1562894 - RNA, 19 nt, Homo sapiens
ccuccucccucucauagug

SEQ ID NO: 1562895 - RNA, 19 nt, Homo sapiens
gacagaagccccugacuug

SEQ ID NO: 1562896 - RNA, 19 nt, Homo sapiens
aacaucacaugacccauau

SEQ ID NO: 1562897 - RNA, 19 nt, Homo sapiens
ggacucuccucagcucaca

SEQ ID NO: 1562898 - RNA, 19 nt, Homo sapiens
agucagagcaagccaagaa

SEQ ID NO: 1562899 - RNA, 19 nt, Homo sapiens
cagagccaguguaguaaag

SEQ ID NO: 1562900 - RNA, 19 nt, Homo sapiens
ccagaaugaugccuaaaau

SEQ ID NO: 1562901 - RNA, 19 nt, Homo sapiens
ucaccagcacccagaauga

SEQ ID NO: 1562902 - RNA, 19 nt, Homo sapiens
ggagaaugggugaaaagua

SEQ ID NO: 1562903 - RNA, 19 nt, Homo sapiens
cuugguggcugucuaucuu

SEQ ID NO: 1562904 - RNA, 19 nt, Homo sapiens
uuucaagccuucauaucug

SEQ ID NO: 1562905 - RNA, 19 nt, Homo sapiens
uaccuggagucgccauuau

SEQ ID NO: 1562906 - RNA, 19 nt, Homo sapiens
gagccaguguaguaaagag

SEQ ID NO: 1562907 - RNA, 19 nt, Homo sapiens
aagauucauuggagcuuug

SEQ ID NO: 1562908 - RNA, 19 nt, Homo sapiens
aaucccaacuucagugcuu

SEQ ID NO: 1562909 - RNA, 19 nt, Homo sapiens
ugaagacacacuuuguaau

SEQ ID NO: 1562910 - RNA, 19 nt, Homo sapiens
ucugaagacacacuuugua

SEQ ID NO: 1562911 - RNA, 19 nt, Homo sapiens
gugcagcuguuccuuccau

SEQ ID NO: 1562912 - RNA, 19 nt, Homo sapiens
ggaggucguuuauguauuu

SEQ ID NO: 1562913 - RNA, 19 nt, Homo sapiens
gaagcagucuacccagaua

SEQ ID NO: 1562914 - RNA, 19 nt, Homo sapiens
gacccugucucuacaaaua

SEQ ID NO: 1562915 - RNA, 19 nt, Homo sapiens
gcaguaacccucugaagaa

SEQ ID NO: 1562916 - RNA, 19 nt, Homo sapiens
gaagaaagacaucguagug

SEQ ID NO: 1562917 - RNA, 19 nt, Homo sapiens
gggagaagcugcccucugu

SEQ ID NO: 1562918 - RNA, 19 nt, Homo sapiens
gcagugagcugugauugug

SEQ ID NO: 1562919 - RNA, 19 nt, Homo sapiens
gaaacaucaucagugaaua

SEQ ID NO: 1562920 - RNA, 19 nt, Homo sapiens
gcaguggccuaaccuguga

SEQ ID NO: 1562921 - RNA, 19 nt, Homo sapiens
ggaaacaucaucagugaau

SEQ ID NO: 1562922 - RNA, 19 nt, Homo sapiens
gaugggaaguacauaguga

SEQ ID NO: 1562923 - RNA, 19 nt, Homo sapiens
ggcaguaccuucugugugu

SEQ ID NO: 1562924 - RNA, 19 nt, Homo sapiens
gaaaggaaaccuggaaaca

SEQ ID NO: 1562925 - RNA, 19 nt, Homo sapiens
ucaaggacaucaauagagu

SEQ ID NO: 1562926 - RNA, 19 nt, Homo sapiens
gaacagcaguggccuaacc

SEQ ID NO: 1562927 - RNA, 19 nt, Homo sapiens
uuaacaagcucacauuugg

SEQ ID NO: 1562928 - RNA, 19 nt, Homo sapiens
gccaggagcucaucuucug

SEQ ID NO: 1562929 - RNA, 19 nt, Homo sapiens
gaaggugcuuggcaucaca

SEQ ID NO: 1562930 - RNA, 19 nt, Homo sapiens
aaggaaaccuggaaacauc

SEQ ID NO: 1562931 - RNA, 19 nt, Homo sapiens
agaagagggugcuggagaa

SEQ ID NO: 1562932 - RNA, 19 nt, Homo sapiens
gcacaacaacaucuucugu

SEQ ID NO: 1562933 - RNA, 19 nt, Homo sapiens
ucacuugaguccaggaguu

SEQ ID NO: 1562934 - RNA, 19 nt, Homo sapiens
agaaguggaucaaccugaa

SEQ ID NO: 1562935 - RNA, 19 nt, Homo sapiens
ccuguaaucccaacacuuu

SEQ ID NO: 1562936 - RNA, 19 nt, Homo sapiens
gaggacauaugagcagaga

SEQ ID NO: 1562937 - RNA, 19 nt, Homo sapiens
cuggaaacaucaucaguga

SEQ ID NO: 1562938 - RNA, 19 nt, Homo sapiens
gaagcugcccucugucaug

SEQ ID NO: 1562939 - RNA, 19 nt, Homo sapiens
gaugcuaggccacaaguau

SEQ ID NO: 1562940 - RNA, 19 nt, Homo sapiens
uuccacagcuccuacguuu

SEQ ID NO: 1562941 - RNA, 19 nt, Homo sapiens
caacacuuugggaaucuua

SEQ ID NO: 1562942 - RNA, 19 nt, Homo sapiens
caguaacccucugaagaaa

SEQ ID NO: 1562943 - RNA, 19 nt, Homo sapiens
gagaagcugcccucuguca

SEQ ID NO: 1562944 - RNA, 19 nt, Homo sapiens
ccacagcuccuacguuugg

SEQ ID NO: 1562945 - RNA, 19 nt, Homo sapiens
gaccacagcaucuacaucu

SEQ ID NO: 1562946 - RNA, 19 nt, Homo sapiens
ggaagcagucuacccagau

SEQ ID NO: 1562947 - RNA, 19 nt, Homo sapiens
ggaagaaagacaucguagu

SEQ ID NO: 1562948 - RNA, 19 nt, Homo sapiens
agaaucagguggcggagau

SEQ ID NO: 1562949 - RNA, 19 nt, Homo sapiens
gcgggaggaucacuugagu

SEQ ID NO: 1562950 - RNA, 19 nt, Homo sapiens
caugugagguucugguucu

SEQ ID NO: 1562951 - RNA, 19 nt, Homo sapiens
guugggaaccgccauguga

SEQ ID NO: 1562952 - RNA, 19 nt, Homo sapiens
cagcagcacaucuuuaaca

SEQ ID NO: 1562953 - RNA, 19 nt, Homo sapiens
ggucccagcuacucaagag

SEQ ID NO: 1562954 - RNA, 19 nt, Homo sapiens
cagaacagcaguggccuaa

SEQ ID NO: 1562955 - RNA, 19 nt, Homo sapiens
agagggugcuggagaagug

SEQ ID NO: 1562956 - RNA, 19 nt, Homo sapiens
ugggcgagcugcacaacaa

SEQ ID NO: 1562957 - RNA, 19 nt, Homo sapiens
ggagugagaccugcaacug

SEQ ID NO: 1562958 - RNA, 19 nt, Homo sapiens
gcaggugguauucuagaga

SEQ ID NO: 1562959 - RNA, 19 nt, Homo sapiens
caucaucagugaauaacac

SEQ ID NO: 1562960 - RNA, 19 nt, Homo sapiens
gaacaagcagcagcacauc

SEQ ID NO: 1562961 - RNA, 19 nt, Homo sapiens
aacaugcacuccacagaga

SEQ ID NO: 1562962 - RNA, 19 nt, Homo sapiens
gugaauaacacgccaagca

SEQ ID NO: 1562963 - RNA, 19 nt, Homo sapiens
caaaaucccugcccuuaac

SEQ ID NO: 1562964 - RNA, 19 nt, Homo sapiens
gcacuccacagagagcuuu

SEQ ID NO: 1562965 - RNA, 19 nt, Homo sapiens
ggaaaggaaaccuggaaac

SEQ ID NO: 1562966 - RNA, 19 nt, Homo sapiens
cagaggacagcagcuauuu

SEQ ID NO: 1562967 - RNA, 19 nt, Homo sapiens
gggaaaggaaaccuggaaa

SEQ ID NO: 1562968 - RNA, 19 nt, Homo sapiens
ggaaggcggaagcagucua

SEQ ID NO: 1562969 - RNA, 19 nt, Homo sapiens
gguaucuuguagagucauu

SEQ ID NO: 1562970 - RNA, 19 nt, Homo sapiens
guggaggucguuuauguau

SEQ ID NO: 1562971 - RNA, 19 nt, Homo sapiens
aagcagcagcacaucuuua

SEQ ID NO: 1562972 - RNA, 19 nt, Homo sapiens
gagaaggugcuuggcauca

SEQ ID NO: 1562973 - RNA, 19 nt, Homo sapiens
caagcagcagcacaucuuu

SEQ ID NO: 1562974 - RNA, 19 nt, Homo sapiens
ugaagcacaucguguccau

SEQ ID NO: 1562975 - RNA, 19 nt, Homo sapiens
cuguggaggucguuuaugu

SEQ ID NO: 1562976 - RNA, 19 nt, Homo sapiens
ucagaggacagcagcuauu

SEQ ID NO: 1562977 - RNA, 19 nt, Homo sapiens
ucugggauguggaggagaa

SEQ ID NO: 1562978 - RNA, 19 nt, Homo sapiens
gguggaggcaggaagauca

SEQ ID NO: 1562979 - RNA, 19 nt, Homo sapiens
aaauuagccaggcauggua

SEQ ID NO: 1562980 - RNA, 19 nt, Homo sapiens
gggugucacucgagaaggu

SEQ ID NO: 1562981 - RNA, 19 nt, Homo sapiens
ccgaggagacggugcagaa

SEQ ID NO: 1562982 - RNA, 19 nt, Homo sapiens
cugaaggucucccugucuu

SEQ ID NO: 1562983 - RNA, 19 nt, Homo sapiens
gaggacagcagcuauuuug

SEQ ID NO: 1562984 - RNA, 19 nt, Homo sapiens
gaggcaggaagaucacuug

SEQ ID NO: 1562985 - RNA, 19 nt, Homo sapiens
cuuaacaagcucacauuug

SEQ ID NO: 1562986 - RNA, 19 nt, Homo sapiens
acaagcagcagcacaucuu

SEQ ID NO: 1562987 - RNA, 19 nt, Homo sapiens
uaacaagcucacauuugga

SEQ ID NO: 1562988 - RNA, 19 nt, Homo sapiens
ggccuccucugccaguuca

SEQ ID NO: 1562989 - RNA, 19 nt, Homo sapiens
gagguucugguucuuggaa

SEQ ID NO: 1562990 - RNA, 19 nt, Homo sapiens
ggacuggaagaaagacauc

SEQ ID NO: 1562991 - RNA, 19 nt, Homo sapiens
guggccuucucacccaaua

SEQ ID NO: 1562992 - RNA, 19 nt, Homo sapiens
ggagaaccacaagcacaga

SEQ ID NO: 1562993 - RNA, 19 nt, Homo sapiens
aaaggaaaccuggaaacau

SEQ ID NO: 1562994 - RNA, 19 nt, Homo sapiens
gaaggcggaagcagucuac

SEQ ID NO: 1562995 - RNA, 19 nt, Homo sapiens
gggauguggaggagaagaa

SEQ ID NO: 1562996 - RNA, 19 nt, Homo sapiens
ucaauagagugggcaaggu

SEQ ID NO: 1562997 - RNA, 19 nt, Homo sapiens
ucagugcucuggccuucuc

SEQ ID NO: 1562998 - RNA, 19 nt, Homo sapiens
ggaggcaggaagaucacuu

SEQ ID NO: 1562999 - RNA, 19 nt, Homo sapiens
uggaggucguuuauguauu

SEQ ID NO: 1563000 - RNA, 19 nt, Homo sapiens
gcugugugguggugauuuu

SEQ ID NO: 1563001 - RNA, 19 nt, Homo sapiens
acauuuggaugggaaagga

SEQ ID NO: 1563002 - RNA, 19 nt, Homo sapiens
gcagcuauuuugucacugu

SEQ ID NO: 1563003 - RNA, 19 nt, Homo sapiens
agcagcagcacaucuuuaa

SEQ ID NO: 1563004 - RNA, 19 nt, Homo sapiens
uggaggcccuguccuaggu

SEQ ID NO: 1563005 - RNA, 19 nt, Homo sapiens
uggcuguccugcguguaua

SEQ ID NO: 1563006 - RNA, 19 nt, Homo sapiens
gaaguggaucaaccugaag

SEQ ID NO: 1563007 - RNA, 19 nt, Homo sapiens
cguaguggccuccaacaag

SEQ ID NO: 1563008 - RNA, 19 nt, Homo sapiens
ggaccacagcaucuacauc

SEQ ID NO: 1563009 - RNA, 19 nt, Homo sapiens
uggcugcacagaugggaua

SEQ ID NO: 1563010 - RNA, 19 nt, Homo sapiens
gaagagggugcuggagaag

SEQ ID NO: 1563011 - RNA, 19 nt, Homo sapiens
gagcugcacaacaacaucu

SEQ ID NO: 1563012 - RNA, 19 nt, Homo sapiens
guacagagaugucauguug

SEQ ID NO: 1563013 - RNA, 19 nt, Homo sapiens
ggagagaccucaagaagga

SEQ ID NO: 1563014 - RNA, 19 nt, Homo sapiens
gaacugaugccauguagaa

SEQ ID NO: 1563015 - RNA, 19 nt, Homo sapiens
uaacugcucugugcuauaa

SEQ ID NO: 1563016 - RNA, 19 nt, Homo sapiens
caacuuauuucacaucaga

SEQ ID NO: 1563017 - RNA, 19 nt, Homo sapiens
gauaaacccuaugaaugua

SEQ ID NO: 1563018 - RNA, 19 nt, Homo sapiens
ucacugggaugcuucauuu

SEQ ID NO: 1563019 - RNA, 19 nt, Homo sapiens
gggaauaccuggacuugga

SEQ ID NO: 1563020 - RNA, 19 nt, Homo sapiens
gagaaacccuaugaaugua

SEQ ID NO: 1563021 - RNA, 19 nt, Homo sapiens
gagaaacccuaugaaugua

SEQ ID NO: 1563022 - RNA, 19 nt, Homo sapiens
agacuuaauucaucccuua

SEQ ID NO: 1563023 - RNA, 19 nt, Homo sapiens
aggaaggccuuuagacuua

SEQ ID NO: 1563024 - RNA, 19 nt, Homo sapiens
caagauaccagacauuuga

SEQ ID NO: 1563025 - RNA, 19 nt, Homo sapiens
gagaagcccuaugaaugua

SEQ ID NO: 1563026 - RNA, 19 nt, Homo sapiens
gaaaggaagaagacaauau

SEQ ID NO: 1563027 - RNA, 19 nt, Homo sapiens
gcugaacccugucuucuug

SEQ ID NO: 1563028 - RNA, 19 nt, Homo sapiens
guacaucacaaacuucaua

SEQ ID NO: 1563029 - RNA, 19 nt, Homo sapiens
ggaagauaauggaaagaau

SEQ ID NO: 1563030 - RNA, 19 nt, Homo sapiens
gaagacaauauccagauuu

SEQ ID NO: 1563031 - RNA, 19 nt, Homo sapiens
guucagugauguauccaua

SEQ ID NO: 1563032 - RNA, 19 nt, Homo sapiens
gagaaacccuaugugugua

SEQ ID NO: 1563033 - RNA, 19 nt, Homo sapiens
gaagagaccacaugaagag

SEQ ID NO: 1563034 - RNA, 19 nt, Homo sapiens
ccaaauuucugacccacaa

SEQ ID NO: 1563035 - RNA, 19 nt, Homo sapiens
ugagaaacccuaugaaugu

SEQ ID NO: 1563036 - RNA, 19 nt, Homo sapiens
ugagaaacccuaugaaugu

SEQ ID NO: 1563037 - RNA, 19 nt, Homo sapiens
gaucuuagaguacaucaga

SEQ ID NO: 1563038 - RNA, 19 nt, Homo sapiens
caacaucugagaauucauu

SEQ ID NO: 1563039 - RNA, 19 nt, Homo sapiens
gugagaaaccuuauaaaug

SEQ ID NO: 1563040 - RNA, 19 nt, Homo sapiens
caacuaacacuccaucaga

SEQ ID NO: 1563041 - RNA, 19 nt, Homo sapiens
gggauggccuucagacaga

SEQ ID NO: 1563042 - RNA, 19 nt, Homo sapiens
gaagaggcccugaaacuac

SEQ ID NO: 1563043 - RNA, 19 nt, Homo sapiens
ggaaggccuuuagacuuaa

SEQ ID NO: 1563044 - RNA, 19 nt, Homo sapiens
caucagaguauucauauug

SEQ ID NO: 1563045 - RNA, 19 nt, Homo sapiens
caucagaguauucauauug

SEQ ID NO: 1563046 - RNA, 19 nt, Homo sapiens
gaaucuacaucccucuguu

SEQ ID NO: 1563047 - RNA, 19 nt, Homo sapiens
uagaguacaucacaaacuu

SEQ ID NO: 1563048 - RNA, 19 nt, Homo sapiens
gaagcccuaugaauguaaa

SEQ ID NO: 1563049 - RNA, 19 nt, Homo sapiens
ggugagaaaccuuauaaau

SEQ ID NO: 1563050 - RNA, 19 nt, Homo sapiens
ucacacagcaucagaguau

SEQ ID NO: 1563051 - RNA, 19 nt, Homo sapiens
ucacaucagaguauucaua

SEQ ID NO: 1563052 - RNA, 19 nt, Homo sapiens
cagaugugauuuccucauu

SEQ ID NO: 1563053 - RNA, 19 nt, Homo sapiens
ucagugauguucagugaug

SEQ ID NO: 1563054 - RNA, 19 nt, Homo sapiens
cauguagaauggaagaauu

SEQ ID NO: 1563055 - RNA, 19 nt, Homo sapiens
gugagaagcccuaugaaug

SEQ ID NO: 1563056 - RNA, 19 nt, Homo sapiens
ugauaaacccuaugaaugu

SEQ ID NO: 1563057 - RNA, 19 nt, Homo sapiens
gguguccucuuaccagaaa

SEQ ID NO: 1563058 - RNA, 19 nt, Homo sapiens
gagcgucgguccugguaau

SEQ ID NO: 1563059 - RNA, 19 nt, Homo sapiens
gaaaagagccuuggaaagu

SEQ ID NO: 1563060 - RNA, 19 nt, Homo sapiens
gagaugucauguuggagaa

SEQ ID NO: 1563061 - RNA, 19 nt, Homo sapiens
caucagagcauucauacug

SEQ ID NO: 1563062 - RNA, 19 nt, Homo sapiens
aaagagccuuggaaaguug

SEQ ID NO: 1563063 - RNA, 19 nt, Homo sapiens
caucagaagcuuaauagug

SEQ ID NO: 1563064 - RNA, 19 nt, Homo sapiens
gaaacccuauguguguaaa

SEQ ID NO: 1563065 - RNA, 19 nt, Homo sapiens
ugagaaacccuaugugugu

SEQ ID NO: 1563066 - RNA, 19 nt, Homo sapiens
gaccaguucuugaauuucu

SEQ ID NO: 1563067 - RNA, 19 nt, Homo sapiens
cugaaaagguguccucuua

SEQ ID NO: 1563068 - RNA, 19 nt, Homo sapiens
ggaaaggaagaagacaaua

SEQ ID NO: 1563069 - RNA, 19 nt, Homo sapiens
guacugcugugcugguuuc

SEQ ID NO: 1563070 - RNA, 19 nt, Homo sapiens
gaauguaaggaauguaaga

SEQ ID NO: 1563071 - RNA, 19 nt, Homo sapiens
acagagaugucauguugga

SEQ ID NO: 1563072 - RNA, 19 nt, Homo sapiens
cagcaucagaguauucaua

SEQ ID NO: 1563073 - RNA, 19 nt, Homo sapiens
ggagaacuacagcaacuug

SEQ ID NO: 1563074 - RNA, 19 nt, Homo sapiens
gacucagacuuuacuggua

SEQ ID NO: 1563075 - RNA, 19 nt, Homo sapiens
gaauguaggaaggccuuua

SEQ ID NO: 1563076 - RNA, 19 nt, Homo sapiens
cuacaucagagcauucaua

SEQ ID NO: 1563077 - RNA, 19 nt, Homo sapiens
gaaacccuaugaauguaag

SEQ ID NO: 1563078 - RNA, 19 nt, Homo sapiens
gaaacccuaugaauguaag

SEQ ID NO: 1563079 - RNA, 19 nt, Homo sapiens
ccaaguaugagaccaagaa

SEQ ID NO: 1563080 - RNA, 19 nt, Homo sapiens
aagacaauauccagauuug

SEQ ID NO: 1563081 - RNA, 19 nt, Homo sapiens
agaagacaauauccagauu

SEQ ID NO: 1563082 - RNA, 19 nt, Homo sapiens
uaagagugcagcaguuuga

SEQ ID NO: 1563083 - RNA, 19 nt, Homo sapiens
uggcaaggccuuuagauug

SEQ ID NO: 1563084 - RNA, 19 nt, Homo sapiens
gcaucagaguauucauauu

SEQ ID NO: 1563085 - RNA, 19 nt, Homo sapiens
gugagaaacccuaugaaug

SEQ ID NO: 1563086 - RNA, 19 nt, Homo sapiens
gugagaaacccuaugaaug

SEQ ID NO: 1563087 - RNA, 19 nt, Homo sapiens
ugagaagcccuaugaaugu

SEQ ID NO: 1563088 - RNA, 19 nt, Homo sapiens
ucagugauguauccauaga

SEQ ID NO: 1563089 - RNA, 19 nt, Homo sapiens
gaugugauuuccucauugg

SEQ ID NO: 1563090 - RNA, 19 nt, Homo sapiens
ccagugagcgacuugguaa

SEQ ID NO: 1563091 - RNA, 19 nt, Homo sapiens
ugaagaggcccugaaacua

SEQ ID NO: 1563092 - RNA, 19 nt, Homo sapiens
gaauguggcaaggccuuua

SEQ ID NO: 1563093 - RNA, 19 nt, Homo sapiens
gcugguuucuugacucaga

SEQ ID NO: 1563094 - RNA, 19 nt, Homo sapiens
aggcaacauucacaccuua

SEQ ID NO: 1563095 - RNA, 19 nt, Homo sapiens
gccuuuagauugcgccaaa

SEQ ID NO: 1563096 - RNA, 19 nt, Homo sapiens
acucacaacuuauuucaca

SEQ ID NO: 1563097 - RNA, 19 nt, Homo sapiens
gauucauacuggugagaaa

SEQ ID NO: 1563098 - RNA, 19 nt, Homo sapiens
gugcagaucuuagaguaca

SEQ ID NO: 1563099 - RNA, 19 nt, Homo sapiens
cgacaucagagacuucauu

SEQ ID NO: 1563100 - RNA, 19 nt, Homo sapiens
ccacaucagagacuucauu

SEQ ID NO: 1563101 - RNA, 19 nt, Homo sapiens
ugacacacuuucaaucaag

SEQ ID NO: 1563102 - RNA, 19 nt, Homo sapiens
guuaagcccuaugacugua

SEQ ID NO: 1563103 - RNA, 19 nt, Homo sapiens
caucagagaauucauacug

SEQ ID NO: 1563104 - RNA, 19 nt, Homo sapiens
uuucuugacucagacuuua

SEQ ID NO: 1563105 - RNA, 19 nt, Homo sapiens
cgucaucccuaucccauca

SEQ ID NO: 1563106 - RNA, 19 nt, Homo sapiens
gaaggccuuuagacuuaau

SEQ ID NO: 1563107 - RNA, 19 nt, Homo sapiens
aaacuuacucuacaucaga

SEQ ID NO: 1563108 - RNA, 19 nt, Homo sapiens
ggugagaaacccuaugaau

SEQ ID NO: 1563109 - RNA, 19 nt, Homo sapiens
ggugagaaacccuaugaau

SEQ ID NO: 1563110 - RNA, 19 nt, Homo sapiens
agacagacugcacaccuua

SEQ ID NO: 1563111 - RNA, 19 nt, Homo sapiens
ggaaaguugugaggaaagg

SEQ ID NO: 1563112 - RNA, 19 nt, Homo sapiens
gcacauaguccaauuauuu

SEQ ID NO: 1563113 - RNA, 19 nt, Homo sapiens
gcacacagcaggcauauaa

SEQ ID NO: 1563114 - RNA, 19 nt, Homo sapiens
ggacagagacggcgaaguu

SEQ ID NO: 1563115 - RNA, 19 nt, Homo sapiens
ucauagaccugggauauug

SEQ ID NO: 1563116 - RNA, 19 nt, Homo sapiens
guauugacauucucauaga

SEQ ID NO: 1563117 - RNA, 19 nt, Homo sapiens
gaagagaaccgcgaucugu

SEQ ID NO: 1563118 - RNA, 19 nt, Homo sapiens
caauaaaggcaucaaagaa

SEQ ID NO: 1563119 - RNA, 19 nt, Homo sapiens
caacugacccugccuucuu

SEQ ID NO: 1563120 - RNA, 19 nt, Homo sapiens
ugaagucuguauugacauu

SEQ ID NO: 1563121 - RNA, 19 nt, Homo sapiens
acacagcaggcauauaaua

SEQ ID NO: 1563122 - RNA, 19 nt, Homo sapiens
gggaaacgauccuuauugc

SEQ ID NO: 1563123 - RNA, 19 nt, Homo sapiens
gaaguuugacggucuggaa

SEQ ID NO: 1563124 - RNA, 19 nt, Homo sapiens
gcagcacauaguccaauua

SEQ ID NO: 1563125 - RNA, 19 nt, Homo sapiens
ucaauaaaggcaucaaaga

SEQ ID NO: 1563126 - RNA, 19 nt, Homo sapiens
auaagcauguguugaauca

SEQ ID NO: 1563127 - RNA, 19 nt, Homo sapiens
cgugaagucuguauugaca

SEQ ID NO: 1563128 - RNA, 19 nt, Homo sapiens
gcaggcauauaauaagcau

SEQ ID NO: 1563129 - RNA, 19 nt, Homo sapiens
cacagcaggcauauaauaa

SEQ ID NO: 1563130 - RNA, 19 nt, Homo sapiens
ccacgugaagucuguauug

SEQ ID NO: 1563131 - RNA, 19 nt, Homo sapiens
cuuauugccucaccauuuc

SEQ ID NO: 1563132 - RNA, 19 nt, Homo sapiens
cagagacggcgaaguuuga

SEQ ID NO: 1563133 - RNA, 19 nt, Homo sapiens
ggaaugaggcugguuugca

SEQ ID NO: 1563134 - RNA, 19 nt, Homo sapiens
caagcuccauuucaucaag

SEQ ID NO: 1563135 - RNA, 19 nt, Homo sapiens
gaccugggauauugugucu

SEQ ID NO: 1563136 - RNA, 19 nt, Homo sapiens
cuacugacaggucuauuug

SEQ ID NO: 1563137 - RNA, 19 nt, Homo sapiens
gaaccgcgaucuguuucag

SEQ ID NO: 1563138 - RNA, 19 nt, Homo sapiens
agagaaccgcgaucuguuu

SEQ ID NO: 1563139 - RNA, 19 nt, Homo sapiens
cagcacauaguccaauuau

SEQ ID NO: 1563140 - RNA, 19 nt, Homo sapiens
cacgugaagucuguauuga

SEQ ID NO: 1563141 - RNA, 19 nt, Homo sapiens
gacgugggaugccgggaau

SEQ ID NO: 1563142 - RNA, 19 nt, Homo sapiens
ccuuauugccucaccauuu

SEQ ID NO: 1563143 - RNA, 19 nt, Homo sapiens
gagaaccgcgaucuguuuc

SEQ ID NO: 1563144 - RNA, 19 nt, Homo sapiens
ucucauagaccugggauau

SEQ ID NO: 1563145 - RNA, 19 nt, Homo sapiens
gacagagacggcgaaguuu

SEQ ID NO: 1563146 - RNA, 19 nt, Homo sapiens
gagaagagaaccgcgaucu

SEQ ID NO: 1563147 - RNA, 19 nt, Homo sapiens
gcauauaauaagcaugugu

SEQ ID NO: 1563148 - RNA, 19 nt, Homo sapiens
cagcaggcauauaauaagc

SEQ ID NO: 1563149 - RNA, 19 nt, Homo sapiens
ucuauuugucucccuguua

SEQ ID NO: 1563150 - RNA, 19 nt, Homo sapiens
ucuacugacaggucuauuu

SEQ ID NO: 1563151 - RNA, 19 nt, Homo sapiens
gcaagcuccauuucaucaa

SEQ ID NO: 1563152 - RNA, 19 nt, Homo sapiens
ucugcaagcuccauuucau

SEQ ID NO: 1563153 - RNA, 19 nt, Homo sapiens
cgugagggcagaaacaaug

SEQ ID NO: 1563154 - RNA, 19 nt, Homo sapiens
cuauuugucucccuguuac

SEQ ID NO: 1563155 - RNA, 19 nt, Homo sapiens
acagagacggcgaaguuug

SEQ ID NO: 1563156 - RNA, 19 nt, Homo sapiens
gguuggcgcauggacauuu

SEQ ID NO: 1563157 - RNA, 19 nt, Homo sapiens
agggaaacgauccuuauug

SEQ ID NO: 1563158 - RNA, 19 nt, Homo sapiens
aggcauauaauaagcaugu

SEQ ID NO: 1563159 - RNA, 19 nt, Homo sapiens
aagagaaccgcgaucuguu

SEQ ID NO: 1563160 - RNA, 19 nt, Homo sapiens
ugcagcacauaguccaauu

SEQ ID NO: 1563161 - RNA, 19 nt, Homo sapiens
uguauugacauucucauag

SEQ ID NO: 1563162 - RNA, 19 nt, Homo sapiens
caagauugcuccugaguau

SEQ ID NO: 1563163 - RNA, 19 nt, Homo sapiens
gcaccgaccuggcugucua

SEQ ID NO: 1563164 - RNA, 19 nt, Homo sapiens
gaacaugucacacaacaag

SEQ ID NO: 1563165 - RNA, 19 nt, Homo sapiens
gucaagaccuuacucauca

SEQ ID NO: 1563166 - RNA, 19 nt, Homo sapiens
gaauuacuucuguggaaua

SEQ ID NO: 1563167 - RNA, 19 nt, Homo sapiens
guacgaagccaugaagaaa

SEQ ID NO: 1563168 - RNA, 19 nt, Homo sapiens
gaagccagguguccuaacu

SEQ ID NO: 1563169 - RNA, 19 nt, Homo sapiens
caacaaggaauaaagagau

SEQ ID NO: 1563170 - RNA, 19 nt, Homo sapiens
gagccaagguguacaugca

SEQ ID NO: 1563171 - RNA, 19 nt, Homo sapiens
ggacagagccaagguguac

SEQ ID NO: 1563172 - RNA, 19 nt, Homo sapiens
gcaucaacgugcucaagau

SEQ ID NO: 1563173 - RNA, 19 nt, Homo sapiens
gaagaaaacccugggcaua

SEQ ID NO: 1563174 - RNA, 19 nt, Homo sapiens
acaacaaccuugaacaucu

SEQ ID NO: 1563175 - RNA, 19 nt, Homo sapiens
uuacuucuguggaauacaa

SEQ ID NO: 1563176 - RNA, 19 nt, Homo sapiens
ccacaugcaugacaacaac

SEQ ID NO: 1563177 - RNA, 19 nt, Homo sapiens
cgacacagccuaggcagaa

SEQ ID NO: 1563178 - RNA, 19 nt, Homo sapiens
aaacaacugcuuagggauu

SEQ ID NO: 1563179 - RNA, 19 nt, Homo sapiens
cagaacacuugcucuagga

SEQ ID NO: 1563180 - RNA, 19 nt, Homo sapiens
caacaaccuugaacaucuc

SEQ ID NO: 1563181 - RNA, 19 nt, Homo sapiens
gcgaaauggugaacauguc

SEQ ID NO: 1563182 - RNA, 19 nt, Homo sapiens
cgaccuggcugucuaugag

SEQ ID NO: 1563183 - RNA, 19 nt, Homo sapiens
gcagguggcaucagcuaug

SEQ ID NO: 1563184 - RNA, 19 nt, Homo sapiens
acacaacaaggaauaaaga

SEQ ID NO: 1563185 - RNA, 19 nt, Homo sapiens
ccaucaaguucuccguauu

SEQ ID NO: 1563186 - RNA, 19 nt, Homo sapiens
gccaucaaguucuccguau

SEQ ID NO: 1563187 - RNA, 19 nt, Homo sapiens
gcucuaggauccagacacu

SEQ ID NO: 1563188 - RNA, 19 nt, Homo sapiens
ggaauaaagagaugguuuu

SEQ ID NO: 1563189 - RNA, 19 nt, Homo sapiens
gggaaccucagaacacuug

SEQ ID NO: 1563190 - RNA, 19 nt, Homo sapiens
agaaaacccugggcauaua

SEQ ID NO: 1563191 - RNA, 19 nt, Homo sapiens
gucagucugucgucuguga

SEQ ID NO: 1563192 - RNA, 19 nt, Homo sapiens
ucgagcagugcaagaauua

SEQ ID NO: 1563193 - RNA, 19 nt, Homo sapiens
ccucagaacacuugcucua

SEQ ID NO: 1563194 - RNA, 19 nt, Homo sapiens
caucaacgugcucaagauu

SEQ ID NO: 1563195 - RNA, 19 nt, Homo sapiens
ucagcuaugugguguacga

SEQ ID NO: 1563196 - RNA, 19 nt, Homo sapiens
caucaaguucuccguauuc

SEQ ID NO: 1563197 - RNA, 19 nt, Homo sapiens
guggaaguuucuacucuca

SEQ ID NO: 1563198 - RNA, 19 nt, Homo sapiens
guacgcguuuggccacaug

SEQ ID NO: 1563199 - RNA, 19 nt, Homo sapiens
ugucacacaacaaggaaua

SEQ ID NO: 1563200 - RNA, 19 nt, Homo sapiens
aacaacugcuuagggauuu

SEQ ID NO: 1563201 - RNA, 19 nt, Homo sapiens
ccauggaggugcugaagac

SEQ ID NO: 1563202 - RNA, 19 nt, Homo sapiens
gaagucaggcagggauaug

SEQ ID NO: 1563203 - RNA, 19 nt, Homo sapiens
gacaacaaccuugaacauc

SEQ ID NO: 1563204 - RNA, 19 nt, Homo sapiens
ugacaacaaccuugaacau

SEQ ID NO: 1563205 - RNA, 19 nt, Homo sapiens
gacacagccuaggcagaaa

SEQ ID NO: 1563206 - RNA, 19 nt, Homo sapiens
gcaccaggcagaucuugca

SEQ ID NO: 1563207 - RNA, 19 nt, Homo sapiens
ugaagacgcgguugaccuu

SEQ ID NO: 1563208 - RNA, 19 nt, Homo sapiens
ucaagauugcuccugagua

SEQ ID NO: 1563209 - RNA, 19 nt, Homo sapiens
ucacacaacaaggaauaaa

SEQ ID NO: 1563210 - RNA, 19 nt, Homo sapiens
ccaagacgaacuucaccaa

SEQ ID NO: 1563211 - RNA, 19 nt, Homo sapiens
uugaacaucucccgucaca

SEQ ID NO: 1563212 - RNA, 19 nt, Homo sapiens
aacaaggaauaaagagaug

SEQ ID NO: 1563213 - RNA, 19 nt, Homo sapiens
caucagcuaugugguguac

SEQ ID NO: 1563214 - RNA, 19 nt, Homo sapiens
caagaccuuacucaucaaa

SEQ ID NO: 1563215 - RNA, 19 nt, Homo sapiens
ucaacgugcucaagauugc

SEQ ID NO: 1563216 - RNA, 19 nt, Homo sapiens
cgaaauggugaacauguca

SEQ ID NO: 1563217 - RNA, 19 nt, Homo sapiens
ucaagaccuuacucaucaa

SEQ ID NO: 1563218 - RNA, 19 nt, Homo sapiens
gcagugcaagaauuacuuc

SEQ ID NO: 1563219 - RNA, 19 nt, Homo sapiens
ccacgcuacugaaggucuu

SEQ ID NO: 1563220 - RNA, 19 nt, Homo sapiens
ggugcagccugagacaaga

SEQ ID NO: 1563221 - RNA, 19 nt, Homo sapiens
ggaugcaggcccaagauac

SEQ ID NO: 1563222 - RNA, 19 nt, Homo sapiens
cugaguaugccaucaaguu

SEQ ID NO: 1563223 - RNA, 19 nt, Homo sapiens
gcaugacaacaaccuugaa

SEQ ID NO: 1563224 - RNA, 19 nt, Homo sapiens
cagcagguggcaucagcua

SEQ ID NO: 1563225 - RNA, 19 nt, Homo sapiens
ggcaucaacgugcucaaga

SEQ ID NO: 1563226 - RNA, 19 nt, Homo sapiens
caggagagcagcugauggu

SEQ ID NO: 1563227 - RNA, 19 nt, Homo sapiens
acaacaaggaauaaagaga

SEQ ID NO: 1563228 - RNA, 19 nt, Homo sapiens
gaugaccccuggccccaaa

SEQ ID NO: 1563229 - RNA, 19 nt, Homo sapiens
cagguggcaucagcuaugu

SEQ ID NO: 1563230 - RNA, 19 nt, Homo sapiens
uuucuacucucaggagcua

SEQ ID NO: 1563231 - RNA, 19 nt, Homo sapiens
ggcgaaauggugaacaugu

SEQ ID NO: 1563232 - RNA, 19 nt, Homo sapiens
caacugcuuagggauuuga

SEQ ID NO: 1563233 - RNA, 19 nt, Homo sapiens
ugaguaugccaucaaguuc

SEQ ID NO: 1563234 - RNA, 19 nt, Homo sapiens
aggaauaaagagaugguuu

SEQ ID NO: 1563235 - RNA, 19 nt, Homo sapiens
uguacgaagccaugaagaa

SEQ ID NO: 1563236 - RNA, 19 nt, Homo sapiens
gagcagugcaagaauuacu

SEQ ID NO: 1563237 - RNA, 19 nt, Homo sapiens
ggaaguccuggaaguggau

SEQ ID NO: 1563238 - RNA, 19 nt, Homo sapiens
gagaugcuccagugcuucu

SEQ ID NO: 1563239 - RNA, 19 nt, Homo sapiens
gaaguccuggaaguggaua

SEQ ID NO: 1563240 - RNA, 19 nt, Homo sapiens
ccaggaugcaggcccaaga

SEQ ID NO: 1563241 - RNA, 19 nt, Homo sapiens
ucuaggauccagacacugu

SEQ ID NO: 1563242 - RNA, 19 nt, Homo sapiens
agccagguguccuaacuuc

SEQ ID NO: 1563243 - RNA, 19 nt, Homo sapiens
gagaguucaugcuuaauaa

SEQ ID NO: 1563244 - RNA, 19 nt, Homo sapiens
gagagaagcccuacaaaug

SEQ ID NO: 1563245 - RNA, 19 nt, Homo sapiens
guagaaauauagacuguga

SEQ ID NO: 1563246 - RNA, 19 nt, Homo sapiens
ccagagaguucaugcuuaa

SEQ ID NO: 1563247 - RNA, 19 nt, Homo sapiens
gcucacaucuuacuaaaca

SEQ ID NO: 1563248 - RNA, 19 nt, Homo sapiens
gaaaucauauuggugagaa

SEQ ID NO: 1563249 - RNA, 19 nt, Homo sapiens
cuacaaaugugaagaaugu

SEQ ID NO: 1563250 - RNA, 19 nt, Homo sapiens
cuacaaaugugaagaaugu

SEQ ID NO: 1563251 - RNA, 19 nt, Homo sapiens
cuacaaaugugaagaaugu

SEQ ID NO: 1563252 - RNA, 19 nt, Homo sapiens
cuacaaaugugaagaaugu

SEQ ID NO: 1563253 - RNA, 19 nt, Homo sapiens
cuacaaaugugaagaaugu

SEQ ID NO: 1563254 - RNA, 19 nt, Homo sapiens
cuacaaaugugaagaaugu

SEQ ID NO: 1563255 - RNA, 19 nt, Homo sapiens
cuacaaaugugaagaaugu

SEQ ID NO: 1563256 - RNA, 19 nt, Homo sapiens
cuacaaaugugaagaaugu

SEQ ID NO: 1563257 - RNA, 19 nt, Homo sapiens
uggcaaagauuucuauuga

SEQ ID NO: 1563258 - RNA, 19 nt, Homo sapiens
ccucaaaccuuauuaaaca

SEQ ID NO: 1563259 - RNA, 19 nt, Homo sapiens
gagagaaacccuaugauug

SEQ ID NO: 1563260 - RNA, 19 nt, Homo sapiens
agagaaaccuugcaaaugu

SEQ ID NO: 1563261 - RNA, 19 nt, Homo sapiens
gaucuucaauccuuaguau

SEQ ID NO: 1563262 - RNA, 19 nt, Homo sapiens
gagagaaacccuacaaaug

SEQ ID NO: 1563263 - RNA, 19 nt, Homo sapiens
gagagaaacccuacaaaug

SEQ ID NO: 1563264 - RNA, 19 nt, Homo sapiens
gaagagaaacccuacaaau

SEQ ID NO: 1563265 - RNA, 19 nt, Homo sapiens
cuacagaugugaagaaugu

SEQ ID NO: 1563266 - RNA, 19 nt, Homo sapiens
cuacaaacgugaagaaugu

SEQ ID NO: 1563267 - RNA, 19 nt, Homo sapiens
gagagaaacccuacaaaug

SEQ ID NO: 1563268 - RNA, 19 nt, Homo sapiens
gaagagaaacccuacaaau

SEQ ID NO: 1563269 - RNA, 19 nt, Homo sapiens
gaagagaaacccuacaaau

SEQ ID NO: 1563270 - RNA, 19 nt, Homo sapiens
ggagagaaacccuaugauu

SEQ ID NO: 1563271 - RNA, 19 nt, Homo sapiens
uaagaaacccuacaaaugu

SEQ ID NO: 1563272 - RNA, 19 nt, Homo sapiens
gaacaauguggcaaaguuu

SEQ ID NO: 1563273 - RNA, 19 nt, Homo sapiens
uaaccgaucuucaauccuu

SEQ ID NO: 1563274 - RNA, 19 nt, Homo sapiens
gagaaacccuacaaaugug

SEQ ID NO: 1563275 - RNA, 19 nt, Homo sapiens
gagaaacccuacaaaugug

SEQ ID NO: 1563276 - RNA, 19 nt, Homo sapiens
gagaaacccuacaaaugug

SEQ ID NO: 1563277 - RNA, 19 nt, Homo sapiens
gagaaauccuacaaauaug

SEQ ID NO: 1563278 - RNA, 19 nt, Homo sapiens
gagaaacccuacaaaugug

SEQ ID NO: 1563279 - RNA, 19 nt, Homo sapiens
cuacaaaugugaagcaugu

SEQ ID NO: 1563280 - RNA, 19 nt, Homo sapiens
gagaaacccuacaaaugug

SEQ ID NO: 1563281 - RNA, 19 nt, Homo sapiens
gcaaauucauaguguacaa

SEQ ID NO: 1563282 - RNA, 19 nt, Homo sapiens
gaauguggcaaauccuuua

SEQ ID NO: 1563283 - RNA, 19 nt, Homo sapiens
gagaaacccuacaaaugug

SEQ ID NO: 1563284 - RNA, 19 nt, Homo sapiens
ggugagaaauccuagaaau

SEQ ID NO: 1563285 - RNA, 19 nt, Homo sapiens
gauaagaaacccuacaaau

SEQ ID NO: 1563286 - RNA, 19 nt, Homo sapiens
aauaucugcucacaucuua

SEQ ID NO: 1563287 - RNA, 19 nt, Homo sapiens
cuagaaauguggagaaugu

SEQ ID NO: 1563288 - RNA, 19 nt, Homo sapiens
caccaguacuuuacccuua

SEQ ID NO: 1563289 - RNA, 19 nt, Homo sapiens
gcaaauccuuuaguguauu

SEQ ID NO: 1563290 - RNA, 19 nt, Homo sapiens
gagaagcccuacaaaugug

SEQ ID NO: 1563291 - RNA, 19 nt, Homo sapiens
ccuauucccuuacuaaaga

SEQ ID NO: 1563292 - RNA, 19 nt, Homo sapiens
agacaaacccuacaaaugu

SEQ ID NO: 1563293 - RNA, 19 nt, Homo sapiens
gagacaaacccuacaaaug

SEQ ID NO: 1563294 - RNA, 19 nt, Homo sapiens
gaucuucaacccuuacuaa

SEQ ID NO: 1563295 - RNA, 19 nt, Homo sapiens
acacaaacccuacaaaugu

SEQ ID NO: 1563296 - RNA, 19 nt, Homo sapiens
ggagagaaacccuacaaau

SEQ ID NO: 1563297 - RNA, 19 nt, Homo sapiens
ggagagaaacccuacaaau

SEQ ID NO: 1563298 - RNA, 19 nt, Homo sapiens
ugaagaauguggcaaagau

SEQ ID NO: 1563299 - RNA, 19 nt, Homo sapiens
ggagagaaacccuacaaau

SEQ ID NO: 1563300 - RNA, 19 nt, Homo sapiens
ggagagaaaccuugcaaau

SEQ ID NO: 1563301 - RNA, 19 nt, Homo sapiens
guacaaaagugaagaaugu

SEQ ID NO: 1563302 - RNA, 19 nt, Homo sapiens
caagcaaauucauagugua

SEQ ID NO: 1563303 - RNA, 19 nt, Homo sapiens
gaaacccuaugauugugaa

SEQ ID NO: 1563304 - RNA, 19 nt, Homo sapiens
ggcaaauccuuuaguguau

SEQ ID NO: 1563305 - RNA, 19 nt, Homo sapiens
ggacacaaacccuacaaau

SEQ ID NO: 1563306 - RNA, 19 nt, Homo sapiens
uaaccaguccucaaacuuu

SEQ ID NO: 1563307 - RNA, 19 nt, Homo sapiens
ggagagaagcccuacaaau

SEQ ID NO: 1563308 - RNA, 19 nt, Homo sapiens
cuacaaaugugaggaaugu

SEQ ID NO: 1563309 - RNA, 19 nt, Homo sapiens
gagagaaaccuugcaaaug

SEQ ID NO: 1563310 - RNA, 19 nt, Homo sapiens
gucaauaucugcucacauc

SEQ ID NO: 1563311 - RNA, 19 nt, Homo sapiens
uggagaauguaacaaagua

SEQ ID NO: 1563312 - RNA, 19 nt, Homo sapiens
gagaaauccuagaaaugug

SEQ ID NO: 1563313 - RNA, 19 nt, Homo sapiens
gaaacucuacaaaccagua

SEQ ID NO: 1563314 - RNA, 19 nt, Homo sapiens
aggaaugucucaaagcuuu

SEQ ID NO: 1563315 - RNA, 19 nt, Homo sapiens
gaagagaaacccuacaaac

SEQ ID NO: 1563316 - RNA, 19 nt, Homo sapiens
gacaaacccuacaaaugug

SEQ ID NO: 1563317 - RNA, 19 nt, Homo sapiens
gagaaaccuugcaaaugug

SEQ ID NO: 1563318 - RNA, 19 nt, Homo sapiens
agaacaauguggcaaaguu

SEQ ID NO: 1563319 - RNA, 19 nt, Homo sapiens
gacaacaucucaaacuuuu

SEQ ID NO: 1563320 - RNA, 19 nt, Homo sapiens
gcaaagcuuuuaaccaauu

SEQ ID NO: 1563321 - RNA, 19 nt, Homo sapiens
ggaaaccuuacaaauauga

SEQ ID NO: 1563322 - RNA, 19 nt, Homo sapiens
agagaaacccuacaaaugu

SEQ ID NO: 1563323 - RNA, 19 nt, Homo sapiens
agagaaacccuacaaaugu

SEQ ID NO: 1563324 - RNA, 19 nt, Homo sapiens
agagaaacccuacaaaugu

SEQ ID NO: 1563325 - RNA, 19 nt, Homo sapiens
ucucaacccuuacuaaaca

SEQ ID NO: 1563326 - RNA, 19 nt, Homo sapiens
ucucaucccuuacuaaaca

SEQ ID NO: 1563327 - RNA, 19 nt, Homo sapiens
aaacgaucuucaacccuua

SEQ ID NO: 1563328 - RNA, 19 nt, Homo sapiens
agagaaacccuacaaaugu

SEQ ID NO: 1563329 - RNA, 19 nt, Homo sapiens
agagaaacccuacaaaugu

SEQ ID NO: 1563330 - RNA, 19 nt, Homo sapiens
agauaaugcuggagagaaa

SEQ ID NO: 1563331 - RNA, 19 nt, Homo sapiens
gcaaagcuuuucaccagua

SEQ ID NO: 1563332 - RNA, 19 nt, Homo sapiens
uaaagaauguggcaaagcu

SEQ ID NO: 1563333 - RNA, 19 nt, Homo sapiens
aaccauuccucaaaccuua

SEQ ID NO: 1563334 - RNA, 19 nt, Homo sapiens
agagaaacccuacaaaugu

SEQ ID NO: 1563335 - RNA, 19 nt, Homo sapiens
ucucaacccuuacuaaaca

SEQ ID NO: 1563336 - RNA, 19 nt, Homo sapiens
ucucaacccuuacuaaaca

SEQ ID NO: 1563337 - RNA, 19 nt, Homo sapiens
uaaagaauguggcaaaucc

SEQ ID NO: 1563338 - RNA, 19 nt, Homo sapiens
aaacgaucuucaacccuua

SEQ ID NO: 1563339 - RNA, 19 nt, Homo sapiens
aaccaguccucaaacuuua

SEQ ID NO: 1563340 - RNA, 19 nt, Homo sapiens
gaaauucuacagaugugaa

SEQ ID NO: 1563341 - RNA, 19 nt, Homo sapiens
gagaaacccuaugauugug

SEQ ID NO: 1563342 - RNA, 19 nt, Homo sapiens
auacaacugugaagaaugu

SEQ ID NO: 1563343 - RNA, 19 nt, Homo sapiens
ggacagagcucacaaaaua

SEQ ID NO: 1563344 - RNA, 19 nt, Homo sapiens
caaaugauccucagaaaga

SEQ ID NO: 1563345 - RNA, 19 nt, Homo sapiens
gcaaguauccagagaguuu

SEQ ID NO: 1563346 - RNA, 19 nt, Homo sapiens
caaaggguguggacuaauu

SEQ ID NO: 1563347 - RNA, 19 nt, Homo sapiens
agacagagcuauuguuaau

SEQ ID NO: 1563348 - RNA, 19 nt, Homo sapiens
gcaaaucacccugcaagua

SEQ ID NO: 1563349 - RNA, 19 nt, Homo sapiens
ggaguuuacuguuugauau

SEQ ID NO: 1563350 - RNA, 19 nt, Homo sapiens
gaacugagcccuaauuggu

SEQ ID NO: 1563351 - RNA, 19 nt, Homo sapiens
guagacagagcuauuguua

SEQ ID NO: 1563352 - RNA, 19 nt, Homo sapiens
gcauggaucugugaacaaa

SEQ ID NO: 1563353 - RNA, 19 nt, Homo sapiens
ucacaaggcuucaaucaag

SEQ ID NO: 1563354 - RNA, 19 nt, Homo sapiens
gcgagaaucagcccucuua

SEQ ID NO: 1563355 - RNA, 19 nt, Homo sapiens
ccauuuagaucaccuguug

SEQ ID NO: 1563356 - RNA, 19 nt, Homo sapiens
ccaacucucuagaauauug

SEQ ID NO: 1563357 - RNA, 19 nt, Homo sapiens
cagcaucccuuauaagugu

SEQ ID NO: 1563358 - RNA, 19 nt, Homo sapiens
ugagaacacuugugaacuu

SEQ ID NO: 1563359 - RNA, 19 nt, Homo sapiens
cugcaugaaugguuaauaa

SEQ ID NO: 1563360 - RNA, 19 nt, Homo sapiens
aauggcagcuuguguuuaa

SEQ ID NO: 1563361 - RNA, 19 nt, Homo sapiens
acgcaacacugucaacaua

SEQ ID NO: 1563362 - RNA, 19 nt, Homo sapiens
caaaucacccugcaaguau

SEQ ID NO: 1563363 - RNA, 19 nt, Homo sapiens
gccaggacccgaccauuua

SEQ ID NO: 1563364 - RNA, 19 nt, Homo sapiens
ccagaacgcuuggcaccua

SEQ ID NO: 1563365 - RNA, 19 nt, Homo sapiens
ccacuaugcccaacuaauu

SEQ ID NO: 1563366 - RNA, 19 nt, Homo sapiens
ccaagugacuguaguugug

SEQ ID NO: 1563367 - RNA, 19 nt, Homo sapiens
gaacuugagaggcccagua

SEQ ID NO: 1563368 - RNA, 19 nt, Homo sapiens
gcacuacacgauagaacua

SEQ ID NO: 1563369 - RNA, 19 nt, Homo sapiens
acaagagacuccaacaaga

SEQ ID NO: 1563370 - RNA, 19 nt, Homo sapiens
gaacaucagcaucccuuau

SEQ ID NO: 1563371 - RNA, 19 nt, Homo sapiens
ugaaggauuuguucugaga

SEQ ID NO: 1563372 - RNA, 19 nt, Homo sapiens
ccacaaagugcugggauua

SEQ ID NO: 1563373 - RNA, 19 nt, Homo sapiens
guaccggugugacuagaaa

SEQ ID NO: 1563374 - RNA, 19 nt, Homo sapiens
gagaacacuugugaacuug

SEQ ID NO: 1563375 - RNA, 19 nt, Homo sapiens
gagcugcccucagauccua

SEQ ID NO: 1563376 - RNA, 19 nt, Homo sapiens
uagaucaccuguuguuaga

SEQ ID NO: 1563377 - RNA, 19 nt, Homo sapiens
ugucaacguuggcucauuu

SEQ ID NO: 1563378 - RNA, 19 nt, Homo sapiens
ugccaacucucuagaauau

SEQ ID NO: 1563379 - RNA, 19 nt, Homo sapiens
ucaccuagguuguuugcaa

SEQ ID NO: 1563380 - RNA, 19 nt, Homo sapiens
aaaccacuaugcccaacua

SEQ ID NO: 1563381 - RNA, 19 nt, Homo sapiens
aaucagcccucuuaaguca

SEQ ID NO: 1563382 - RNA, 19 nt, Homo sapiens
gaucaccuguuguuagaca

SEQ ID NO: 1563383 - RNA, 19 nt, Homo sapiens
ccaguuacuuuccagagaa

SEQ ID NO: 1563384 - RNA, 19 nt, Homo sapiens
caccuuugcuguauucuau

SEQ ID NO: 1563385 - RNA, 19 nt, Homo sapiens
gcaacacugucaacauagu

SEQ ID NO: 1563386 - RNA, 19 nt, Homo sapiens
gcuguuaccuuugcugguu

SEQ ID NO: 1563387 - RNA, 19 nt, Homo sapiens
uaagucagcccucucuauu

SEQ ID NO: 1563388 - RNA, 19 nt, Homo sapiens
gccacugcaugaaugguua

SEQ ID NO: 1563389 - RNA, 19 nt, Homo sapiens
gcuuggcaccuaucaguua

SEQ ID NO: 1563390 - RNA, 19 nt, Homo sapiens
gaacacuugugaacuugag

SEQ ID NO: 1563391 - RNA, 19 nt, Homo sapiens
ggaggauccugguuuuaua

SEQ ID NO: 1563392 - RNA, 19 nt, Homo sapiens
gucaaaugauccucagaaa

SEQ ID NO: 1563393 - RNA, 19 nt, Homo sapiens
ccuaauugguucuuucaga

SEQ ID NO: 1563394 - RNA, 19 nt, Homo sapiens
gcauucugauuagugguua

SEQ ID NO: 1563395 - RNA, 19 nt, Homo sapiens
guauuuccauauuccauga

SEQ ID NO: 1563396 - RNA, 19 nt, Homo sapiens
gcagcugcauucugauuag

SEQ ID NO: 1563397 - RNA, 19 nt, Homo sapiens
gcagguugauuucagucuu

SEQ ID NO: 1563398 - RNA, 19 nt, Homo sapiens
ccacuagcacuacacgaua

SEQ ID NO: 1563399 - RNA, 19 nt, Homo sapiens
ugucagggcuccauguuca

SEQ ID NO: 1563400 - RNA, 19 nt, Homo sapiens
ggaauaaucaaagcaaauc

SEQ ID NO: 1563401 - RNA, 19 nt, Homo sapiens
uuaauacacuguucugagu

SEQ ID NO: 1563402 - RNA, 19 nt, Homo sapiens
guacuugggauccaucuug

SEQ ID NO: 1563403 - RNA, 19 nt, Homo sapiens
gauuagugguuagaacuga

SEQ ID NO: 1563404 - RNA, 19 nt, Homo sapiens
gaaagacuucauucaggaa

SEQ ID NO: 1563405 - RNA, 19 nt, Homo sapiens
gugcaguggugccaucuug

SEQ ID NO: 1563406 - RNA, 19 nt, Homo sapiens
cagguugauuucagucuuu

SEQ ID NO: 1563407 - RNA, 19 nt, Homo sapiens
aagcauggcauuuaccuaa

SEQ ID NO: 1563408 - RNA, 19 nt, Homo sapiens
ucauggaguuuacuguuug

SEQ ID NO: 1563409 - RNA, 19 nt, Homo sapiens
caacaagagacuccaacaa

SEQ ID NO: 1563410 - RNA, 19 nt, Homo sapiens
gaaaggacagagcucacaa

SEQ ID NO: 1563411 - RNA, 19 nt, Homo sapiens
uaauucacauuuccacuag

SEQ ID NO: 1563412 - RNA, 19 nt, Homo sapiens
acacacacacacauguuua

SEQ ID NO: 1563413 - RNA, 19 nt, Homo sapiens
ccaggaccaugucaacguu

SEQ ID NO: 1563414 - RNA, 19 nt, Homo sapiens
ccaguaaggcagagugaaa

SEQ ID NO: 1563415 - RNA, 19 nt, Homo sapiens
gcaaucccgugcaggcaau

SEQ ID NO: 1563416 - RNA, 19 nt, Homo sapiens
ugaaaucguggaauaauca

SEQ ID NO: 1563417 - RNA, 19 nt, Homo sapiens
gcucugauuggcugcuuua

SEQ ID NO: 1563418 - RNA, 19 nt, Homo sapiens
cuaauugguucuuucagau

SEQ ID NO: 1563419 - RNA, 19 nt, Homo sapiens
gauccugguuuuauaguaa

SEQ ID NO: 1563420 - RNA, 19 nt, Homo sapiens
aaguuaaucuccacauuuc

SEQ ID NO: 1563421 - RNA, 19 nt, Homo sapiens
caucaccuuugcuguauuc

SEQ ID NO: 1563422 - RNA, 19 nt, Homo sapiens
aaaguaaucaacagaguga

SEQ ID NO: 1563423 - RNA, 19 nt, Homo sapiens
ccaaucagguccauuuuau

SEQ ID NO: 1563424 - RNA, 19 nt, Homo sapiens
caaaaguucucugaaaaga

SEQ ID NO: 1563425 - RNA, 19 nt, Homo sapiens
ggagcagguugauuucagu

SEQ ID NO: 1563426 - RNA, 19 nt, Homo sapiens
agucagcccucucuauuuc

SEQ ID NO: 1563427 - RNA, 19 nt, Homo sapiens
agaaucagcccucuuaagu

SEQ ID NO: 1563428 - RNA, 19 nt, Homo sapiens
aaaccaagaaauacgcaua

SEQ ID NO: 1563429 - RNA, 19 nt, Homo sapiens
cauccuaccaucucaugua

SEQ ID NO: 1563430 - RNA, 19 nt, Homo sapiens
acaucagcaucccuuauaa

SEQ ID NO: 1563431 - RNA, 19 nt, Homo sapiens
aaagggaggauccugguuu

SEQ ID NO: 1563432 - RNA, 19 nt, Homo sapiens
ggaauuguuaaaccaagaa

SEQ ID NO: 1563433 - RNA, 19 nt, Homo sapiens
guggaauaaucaaagcaaa

SEQ ID NO: 1563434 - RNA, 19 nt, Homo sapiens
ggaacaucagcaucccuua

SEQ ID NO: 1563435 - RNA, 19 nt, Homo sapiens
aaaggguguggacuaauua

SEQ ID NO: 1563436 - RNA, 19 nt, Homo sapiens
cagaggugguccaugcauu

SEQ ID NO: 1563437 - RNA, 19 nt, Homo sapiens
caccuagguuguuugcaaa

SEQ ID NO: 1563438 - RNA, 19 nt, Homo sapiens
aaucaaagcaaaucaaugg

SEQ ID NO: 1563439 - RNA, 19 nt, Homo sapiens
acaaagugcugggauuaca

SEQ ID NO: 1563440 - RNA, 19 nt, Homo sapiens
gagaaucagcccucuuaag

SEQ ID NO: 1563441 - RNA, 19 nt, Homo sapiens
cacaaggcuucaaucaaga

SEQ ID NO: 1563442 - RNA, 19 nt, Homo sapiens
ccucugagucuuacacauu

SEQ ID NO: 1563443 - RNA, 19 nt, Homo sapiens
gaaauggaaucacacuuca

SEQ ID NO: 1563444 - RNA, 19 nt, Homo sapiens
ggaaucacacuucaaauga

SEQ ID NO: 1563445 - RNA, 19 nt, Homo sapiens
caagaugacuaaccaaauc

SEQ ID NO: 1563446 - RNA, 19 nt, Homo sapiens
gagcaggguuguccaauag

SEQ ID NO: 1563447 - RNA, 19 nt, Homo sapiens
auacuugggucuaugaaua

SEQ ID NO: 1563448 - RNA, 19 nt, Homo sapiens
caauauugcugaugaacug

SEQ ID NO: 1563449 - RNA, 19 nt, Homo sapiens
gaaguuauauaugcaugug

SEQ ID NO: 1563450 - RNA, 19 nt, Homo sapiens
gcaggguuguccaauagaa

SEQ ID NO: 1563451 - RNA, 19 nt, Homo sapiens
cuucuugccuguacagaua

SEQ ID NO: 1563452 - RNA, 19 nt, Homo sapiens
caagauggcguacaacuuc

SEQ ID NO: 1563453 - RNA, 19 nt, Homo sapiens
gaggagaguguuugggaua

SEQ ID NO: 1563454 - RNA, 19 nt, Homo sapiens
acaagccucuuucuccuuu

SEQ ID NO: 1563455 - RNA, 19 nt, Homo sapiens
ggagaguguuugggauauu

SEQ ID NO: 1563456 - RNA, 19 nt, Homo sapiens
cuagggcuauugaccauuu

SEQ ID NO: 1563457 - RNA, 19 nt, Homo sapiens
ggacagcacauucuuagag

SEQ ID NO: 1563458 - RNA, 19 nt, Homo sapiens
gaagggcucugcucuacac

SEQ ID NO: 1563459 - RNA, 19 nt, Homo sapiens
auauuucucuugugccuua

SEQ ID NO: 1563460 - RNA, 19 nt, Homo sapiens
agagcaggguuguccaaua

SEQ ID NO: 1563461 - RNA, 19 nt, Homo sapiens
aaaugcacaugcuaaggua

SEQ ID NO: 1563462 - RNA, 19 nt, Homo sapiens
ggcguguucugaaggcuua

SEQ ID NO: 1563463 - RNA, 19 nt, Homo sapiens
acauuuaacuguagugauc

SEQ ID NO: 1563464 - RNA, 19 nt, Homo sapiens
ugaagacccucucgaaagg

SEQ ID NO: 1563465 - RNA, 19 nt, Homo sapiens
gagaguguuugggauauuc

SEQ ID NO: 1563466 - RNA, 19 nt, Homo sapiens
ucuaucauaugcacucaaa

SEQ ID NO: 1563467 - RNA, 19 nt, Homo sapiens
gauguggugugcaaagcuu

SEQ ID NO: 1563468 - RNA, 19 nt, Homo sapiens
caacacauuuaacuguagu

SEQ ID NO: 1563469 - RNA, 19 nt, Homo sapiens
guacagauacuugggucua

SEQ ID NO: 1563470 - RNA, 19 nt, Homo sapiens
uauccuauccgcaugagua

SEQ ID NO: 1563471 - RNA, 19 nt, Homo sapiens
guacauuuaagcagucaaa

SEQ ID NO: 1563472 - RNA, 19 nt, Homo sapiens
ucagccagcucucccuuau

SEQ ID NO: 1563473 - RNA, 19 nt, Homo sapiens
gcugaugaacugaaaauua

SEQ ID NO: 1563474 - RNA, 19 nt, Homo sapiens
gucagugucuauaguguug

SEQ ID NO: 1563475 - RNA, 19 nt, Homo sapiens
gaccauggcguguucugaa

SEQ ID NO: 1563476 - RNA, 19 nt, Homo sapiens
guggguaacucggccauga

SEQ ID NO: 1563477 - RNA, 19 nt, Homo sapiens
ccagccauguugcuucuug

SEQ ID NO: 1563478 - RNA, 19 nt, Homo sapiens
ucuacagccugaggaauaa

SEQ ID NO: 1563479 - RNA, 19 nt, Homo sapiens
gcaggucuagggcuauuga

SEQ ID NO: 1563480 - RNA, 19 nt, Homo sapiens
acacaccgauguacuuucu

SEQ ID NO: 1563481 - RNA, 19 nt, Homo sapiens
ccaaaucaaacuggaauau

SEQ ID NO: 1563482 - RNA, 19 nt, Homo sapiens
gugaagacccucucgaaag

SEQ ID NO: 1563483 - RNA, 19 nt, Homo sapiens
ccgauguacuuucuucuca

SEQ ID NO: 1563484 - RNA, 19 nt, Homo sapiens
ggacaaaacacauuucaag

SEQ ID NO: 1563485 - RNA, 19 nt, Homo sapiens
guaaguacaagccucuuuc

SEQ ID NO: 1563486 - RNA, 19 nt, Homo sapiens
guaacucggccaugauuca

SEQ ID NO: 1563487 - RNA, 19 nt, Homo sapiens
agaaauggaaucacacuuc

SEQ ID NO: 1563488 - RNA, 19 nt, Homo sapiens
uauuuccucuuuccaaguu

SEQ ID NO: 1563489 - RNA, 19 nt, Homo sapiens
caccauuucaacacauuua

SEQ ID NO: 1563490 - RNA, 19 nt, Homo sapiens
ccacacaccgauguacuuu

SEQ ID NO: 1563491 - RNA, 19 nt, Homo sapiens
gacagaagagcacacacaa

SEQ ID NO: 1563492 - RNA, 19 nt, Homo sapiens
ucaacacauuuaacuguag

SEQ ID NO: 1563493 - RNA, 19 nt, Homo sapiens
ggccuacgaccguuauuug

SEQ ID NO: 1563494 - RNA, 19 nt, Homo sapiens
uuauggaccugauguacau

SEQ ID NO: 1563495 - RNA, 19 nt, Homo sapiens
acaccgauguacuuucuuc

SEQ ID NO: 1563496 - RNA, 19 nt, Homo sapiens
ccaagaugacuaaccaaau

SEQ ID NO: 1563497 - RNA, 19 nt, Homo sapiens
cagaagagcacacacaaaa

SEQ ID NO: 1563498 - RNA, 19 nt, Homo sapiens
ucuucaaagucuuguguuu

SEQ ID NO: 1563499 - RNA, 19 nt, Homo sapiens
gcagugcagcuuggacaaa

SEQ ID NO: 1563500 - RNA, 19 nt, Homo sapiens
uguuugggauauucucuuu

SEQ ID NO: 1563501 - RNA, 19 nt, Homo sapiens
ucaccaccauuucaacaca

SEQ ID NO: 1563502 - RNA, 19 nt, Homo sapiens
ccuauuugcugucuaucau

SEQ ID NO: 1563503 - RNA, 19 nt, Homo sapiens
ucauuggcaucacuucuuc

SEQ ID NO: 1563504 - RNA, 19 nt, Homo sapiens
uggaaucacacuucaaaug

SEQ ID NO: 1563505 - RNA, 19 nt, Homo sapiens
aauggaaucacacuucaaa

SEQ ID NO: 1563506 - RNA, 19 nt, Homo sapiens
cccaaucaauaguuucaga

SEQ ID NO: 1563507 - RNA, 19 nt, Homo sapiens
cauucuaagucuucaaagu

SEQ ID NO: 1563508 - RNA, 19 nt, Homo sapiens
ucaauaugcugggcaggau

SEQ ID NO: 1563509 - RNA, 19 nt, Homo sapiens
gaagagcacacacaaaaca

SEQ ID NO: 1563510 - RNA, 19 nt, Homo sapiens
cugccacucucucuauuau

SEQ ID NO: 1563511 - RNA, 19 nt, Homo sapiens
ccaagauggcguacaacuu

SEQ ID NO: 1563512 - RNA, 19 nt, Homo sapiens
guuggacagcacauucuua

SEQ ID NO: 1563513 - RNA, 19 nt, Homo sapiens
gacaagauccuggcagucu

SEQ ID NO: 1563514 - RNA, 19 nt, Homo sapiens
caaacuggaauauuucucu

SEQ ID NO: 1563515 - RNA, 19 nt, Homo sapiens
ggucuaugaauauaugguu

SEQ ID NO: 1563516 - RNA, 19 nt, Homo sapiens
ccaguagucagugucuaua

SEQ ID NO: 1563517 - RNA, 19 nt, Homo sapiens
gcuaugaggagaguguuug

SEQ ID NO: 1563518 - RNA, 19 nt, Homo sapiens
gauccuggcagucuucuac

SEQ ID NO: 1563519 - RNA, 19 nt, Homo sapiens
caucugccacucucucuau

SEQ ID NO: 1563520 - RNA, 19 nt, Homo sapiens
ggguaacucggccaugauu

SEQ ID NO: 1563521 - RNA, 19 nt, Homo sapiens
gcgugaagacccucucgaa

SEQ ID NO: 1563522 - RNA, 19 nt, Homo sapiens
ccaaucaauaguuucagaa

SEQ ID NO: 1563523 - RNA, 19 nt, Homo sapiens
cccuuuguauuuccucuuu

SEQ ID NO: 1563524 - RNA, 19 nt, Homo sapiens
guagucagugucuauagug

SEQ ID NO: 1563525 - RNA, 19 nt, Homo sapiens
ggagaaauggaaucacacu

SEQ ID NO: 1563526 - RNA, 19 nt, Homo sapiens
uuacucuguuugcauucua

SEQ ID NO: 1563527 - RNA, 19 nt, Homo sapiens
cgugaagacccucucgaaa

SEQ ID NO: 1563528 - RNA, 19 nt, Homo sapiens
ucaaucccauuaucuacag

SEQ ID NO: 1563529 - RNA, 19 nt, Homo sapiens
ccugggauguggugugcaa

SEQ ID NO: 1563530 - RNA, 19 nt, Homo sapiens
gagaaauggaaucacacuu

SEQ ID NO: 1563531 - RNA, 19 nt, Homo sapiens
cagauacuugggucuauga

SEQ ID NO: 1563532 - RNA, 19 nt, Homo sapiens
aaaaugaugugugugaaga

SEQ ID NO: 1563533 - RNA, 19 nt, Homo sapiens
ugaguaaaaugaugugugu

SEQ ID NO: 1563534 - RNA, 19 nt, Homo sapiens
ugaccuccauggccuacga

SEQ ID NO: 1563535 - RNA, 19 nt, Homo sapiens
caagugcccaguagucagu

SEQ ID NO: 1563536 - RNA, 19 nt, Homo sapiens
ccaguuacagcagaaaguu

SEQ ID NO: 1563537 - RNA, 19 nt, Homo sapiens
acagauacuugggucuaug

SEQ ID NO: 1563538 - RNA, 19 nt, Homo sapiens
gggcucugcucuacacacu

SEQ ID NO: 1563539 - RNA, 19 nt, Homo sapiens
ugaugugugugaagaugau

SEQ ID NO: 1563540 - RNA, 19 nt, Homo sapiens
cacaaaacaugaccucuca

SEQ ID NO: 1563541 - RNA, 19 nt, Homo sapiens
acuggaauauuucucuugu

SEQ ID NO: 1563542 - RNA, 19 nt, Homo sapiens
gaagacccucucgaaagga

SEQ ID NO: 1563543 - RNA, 19 nt, Homo sapiens
ggagggagauauacagaaa

SEQ ID NO: 1563544 - RNA, 19 nt, Homo sapiens
ccaccgaccugaaccuuua

SEQ ID NO: 1563545 - RNA, 19 nt, Homo sapiens
ggaaguugcuguucucaga

SEQ ID NO: 1563546 - RNA, 19 nt, Homo sapiens
aaagauggcuucacuauag

SEQ ID NO: 1563547 - RNA, 19 nt, Homo sapiens
ggacaaagauggcuucacu

SEQ ID NO: 1563548 - RNA, 19 nt, Homo sapiens
gaggaaagcucacgaucug

SEQ ID NO: 1563549 - RNA, 19 nt, Homo sapiens
gcacugggaccaagacuaa

SEQ ID NO: 1563550 - RNA, 19 nt, Homo sapiens
cgagauaggugcucaguca

SEQ ID NO: 1563551 - RNA, 19 nt, Homo sapiens
gcgugaggcuucucuguuu

SEQ ID NO: 1563552 - RNA, 19 nt, Homo sapiens
gcaaagagaaggaauagag

SEQ ID NO: 1563553 - RNA, 19 nt, Homo sapiens
gaugugcacugcuuuccaa

SEQ ID NO: 1563554 - RNA, 19 nt, Homo sapiens
caaagauggcuucacuaua

SEQ ID NO: 1563555 - RNA, 19 nt, Homo sapiens
gagcagggcuuuuguuaau

SEQ ID NO: 1563556 - RNA, 19 nt, Homo sapiens
gaccaucugucuucugugu

SEQ ID NO: 1563557 - RNA, 19 nt, Homo sapiens
ccagugcucuguaggaguu

SEQ ID NO: 1563558 - RNA, 19 nt, Homo sapiens
gacaauuccucuguaaaug

SEQ ID NO: 1563559 - RNA, 19 nt, Homo sapiens
gaccugaaccuuuaccauu

SEQ ID NO: 1563560 - RNA, 19 nt, Homo sapiens
gaccacagguauccucuuc

SEQ ID NO: 1563561 - RNA, 19 nt, Homo sapiens
gcaugaagaggcagauaaa

SEQ ID NO: 1563562 - RNA, 19 nt, Homo sapiens
ggacgcuccugcagaagug

SEQ ID NO: 1563563 - RNA, 19 nt, Homo sapiens
gacaggaugugcacugcuu

SEQ ID NO: 1563564 - RNA, 19 nt, Homo sapiens
ggugauggagggagauaua

SEQ ID NO: 1563565 - RNA, 19 nt, Homo sapiens
gccgguggcugaaugagaa

SEQ ID NO: 1563566 - RNA, 19 nt, Homo sapiens
gcucacagccagacuccua

SEQ ID NO: 1563567 - RNA, 19 nt, Homo sapiens
caucccagguagagaauga

SEQ ID NO: 1563568 - RNA, 19 nt, Homo sapiens
gagcuuacuucuggugaug

SEQ ID NO: 1563569 - RNA, 19 nt, Homo sapiens
gaccagaacgugcguaaca

SEQ ID NO: 1563570 - RNA, 19 nt, Homo sapiens
acacacaggugggcucuga

SEQ ID NO: 1563571 - RNA, 19 nt, Homo sapiens
uaagcaaagagaaggaaua

SEQ ID NO: 1563572 - RNA, 19 nt, Homo sapiens
ccacagguauccucuucau

SEQ ID NO: 1563573 - RNA, 19 nt, Homo sapiens
cacauuggcuggugagcuu

SEQ ID NO: 1563574 - RNA, 19 nt, Homo sapiens
ccacaucccagguagagaa

SEQ ID NO: 1563575 - RNA, 19 nt, Homo sapiens
aaugaaacuuguacccaaa

SEQ ID NO: 1563576 - RNA, 19 nt, Homo sapiens
gcacugacuucuguaucau

SEQ ID NO: 1563577 - RNA, 19 nt, Homo sapiens
acaaagauggcuucacuau

SEQ ID NO: 1563578 - RNA, 19 nt, Homo sapiens
agacaauuccucuguaaau

SEQ ID NO: 1563579 - RNA, 19 nt, Homo sapiens
gagggucugucccaaugga

SEQ ID NO: 1563580 - RNA, 19 nt, Homo sapiens
acagguauccucuucauca

SEQ ID NO: 1563581 - RNA, 19 nt, Homo sapiens
ccugaaccuuuaccauuga

SEQ ID NO: 1563582 - RNA, 19 nt, Homo sapiens
gcaggaagggucccaagca

SEQ ID NO: 1563583 - RNA, 19 nt, Homo sapiens
ggaguuugaccacagguau

SEQ ID NO: 1563584 - RNA, 19 nt, Homo sapiens
gaccaagacuaauaaaaca

SEQ ID NO: 1563585 - RNA, 19 nt, Homo sapiens
ugaaacuuguacccaaaug

SEQ ID NO: 1563586 - RNA, 19 nt, Homo sapiens
gagagcagggcuuuuguua

SEQ ID NO: 1563587 - RNA, 19 nt, Homo sapiens
gagaccagaacgugcguaa

SEQ ID NO: 1563588 - RNA, 19 nt, Homo sapiens
aagaagguguuuccaaguc

SEQ ID NO: 1563589 - RNA, 19 nt, Homo sapiens
uguaucaugucagggauuu

SEQ ID NO: 1563590 - RNA, 19 nt, Homo sapiens
agaaguggguggguugaga

SEQ ID NO: 1563591 - RNA, 19 nt, Homo sapiens
gaagaaguggguggguuga

SEQ ID NO: 1563592 - RNA, 19 nt, Homo sapiens
guccucaccugccauguca

SEQ ID NO: 1563593 - RNA, 19 nt, Homo sapiens
caacuugcccgugccuuug

SEQ ID NO: 1563594 - RNA, 19 nt, Homo sapiens
gugaccggcugcuccagaa

SEQ ID NO: 1563595 - RNA, 19 nt, Homo sapiens
gguagcaggcccucuguca

SEQ ID NO: 1563596 - RNA, 19 nt, Homo sapiens
gcagggcuuuuguuaauuc

SEQ ID NO: 1563597 - RNA, 19 nt, Homo sapiens
aaagagaaggaauagaguu

SEQ ID NO: 1563598 - RNA, 19 nt, Homo sapiens
caaagagaaggaauagagu

SEQ ID NO: 1563599 - RNA, 19 nt, Homo sapiens
gcacaucccagacaauucc

SEQ ID NO: 1563600 - RNA, 19 nt, Homo sapiens
gcuggaaguugcuguucuc

SEQ ID NO: 1563601 - RNA, 19 nt, Homo sapiens
gacaaagauggcuucacua

SEQ ID NO: 1563602 - RNA, 19 nt, Homo sapiens
ccacgucagcucacucuca

SEQ ID NO: 1563603 - RNA, 19 nt, Homo sapiens
aagauggcuucacuauaga

SEQ ID NO: 1563604 - RNA, 19 nt, Homo sapiens
caagaagguguuuccaagu

SEQ ID NO: 1563605 - RNA, 19 nt, Homo sapiens
uggaccaucugucuucugu

SEQ ID NO: 1563606 - RNA, 19 nt, Homo sapiens
gugagugcguggcauccuu

SEQ ID NO: 1563607 - RNA, 19 nt, Homo sapiens
gugcagucgcuguguguuu

SEQ ID NO: 1563608 - RNA, 19 nt, Homo sapiens
gaaacuuguacccaaaugg

SEQ ID NO: 1563609 - RNA, 19 nt, Homo sapiens
ggaugcuccugcagacaca

SEQ ID NO: 1563610 - RNA, 19 nt, Homo sapiens
accugaaccuuuaccauug

SEQ ID NO: 1563611 - RNA, 19 nt, Homo sapiens
ggagauauacagaaaagau

SEQ ID NO: 1563612 - RNA, 19 nt, Homo sapiens
ugaagaggcagauaaagac

SEQ ID NO: 1563613 - RNA, 19 nt, Homo sapiens
caccggcaaucccacaugu

SEQ ID NO: 1563614 - RNA, 19 nt, Homo sapiens
cagaugugacgguguaugu

SEQ ID NO: 1563615 - RNA, 19 nt, Homo sapiens
gagguuaagcaaagagaag

SEQ ID NO: 1563616 - RNA, 19 nt, Homo sapiens
caauuccucuguaaaugcu

SEQ ID NO: 1563617 - RNA, 19 nt, Homo sapiens
cggcacaucccagacaauu

SEQ ID NO: 1563618 - RNA, 19 nt, Homo sapiens
ggaccaagacuaauaaaac

SEQ ID NO: 1563619 - RNA, 19 nt, Homo sapiens
acugggaccaagacuaaua

SEQ ID NO: 1563620 - RNA, 19 nt, Homo sapiens
uuuauucuguuucccaugu

SEQ ID NO: 1563621 - RNA, 19 nt, Homo sapiens
gcuuacuucuggugaugga

SEQ ID NO: 1563622 - RNA, 19 nt, Homo sapiens
ccagugaagacguccuuau

SEQ ID NO: 1563623 - RNA, 19 nt, Homo sapiens
augaagaggcagauaaaga

SEQ ID NO: 1563624 - RNA, 19 nt, Homo sapiens
cguggcaucuguccuaagg

SEQ ID NO: 1563625 - RNA, 19 nt, Homo sapiens
gcuguucucagaccugguu

SEQ ID NO: 1563626 - RNA, 19 nt, Homo sapiens
gggcugccgugaugcaacu

SEQ ID NO: 1563627 - RNA, 19 nt, Homo sapiens
ggucaggggcugugguaua

SEQ ID NO: 1563628 - RNA, 19 nt, Homo sapiens
cuguguggcugcugaggaa

SEQ ID NO: 1563629 - RNA, 19 nt, Homo sapiens
agcacugacuucuguauca

SEQ ID NO: 1563630 - RNA, 19 nt, Homo sapiens
gaccggcugcuccagaaga

SEQ ID NO: 1563631 - RNA, 19 nt, Homo sapiens
gagcccagaugugguacag

SEQ ID NO: 1563632 - RNA, 19 nt, Homo sapiens
ggcguggcaucuguccuaa

SEQ ID NO: 1563633 - RNA, 19 nt, Homo sapiens
ggcgugaggcuucucuguu

SEQ ID NO: 1563634 - RNA, 19 nt, Homo sapiens
ggacaguggcguggcaucu

SEQ ID NO: 1563635 - RNA, 19 nt, Homo sapiens
cugcuccacugaccacuca

SEQ ID NO: 1563636 - RNA, 19 nt, Homo sapiens
cucggacgcuccugcagaa

SEQ ID NO: 1563637 - RNA, 19 nt, Homo sapiens
uggcguggcaucuguccua

SEQ ID NO: 1563638 - RNA, 19 nt, Homo sapiens
ggcacccucucugacauug

SEQ ID NO: 1563639 - RNA, 19 nt, Homo sapiens
ggagagagauggggaagcu

SEQ ID NO: 1563640 - RNA, 19 nt, Homo sapiens
ugcaugaagaggcagauaa

SEQ ID NO: 1563641 - RNA, 19 nt, Homo sapiens
cagugaagacguccuuauc

SEQ ID NO: 1563642 - RNA, 19 nt, Homo sapiens
gcggcacccucucugacau

SEQ ID NO: 1563643 - RNA, 19 nt, Homo sapiens
caacagagcugcuacuuua

SEQ ID NO: 1563644 - RNA, 19 nt, Homo sapiens
ggacagagucucacuauua

SEQ ID NO: 1563645 - RNA, 19 nt, Homo sapiens
gaacacagccuuaccuaaa

SEQ ID NO: 1563646 - RNA, 19 nt, Homo sapiens
gaacugaaaucugacuuug

SEQ ID NO: 1563647 - RNA, 19 nt, Homo sapiens
ggccagagcugcugccuuu

SEQ ID NO: 1563648 - RNA, 19 nt, Homo sapiens
gaaacugacuucacauuac

SEQ ID NO: 1563649 - RNA, 19 nt, Homo sapiens
gacagagucucacuauuau

SEQ ID NO: 1563650 - RNA, 19 nt, Homo sapiens
aaaccucaaugaaugcuua

SEQ ID NO: 1563651 - RNA, 19 nt, Homo sapiens
gaaacuagaacagaucuuu

SEQ ID NO: 1563652 - RNA, 19 nt, Homo sapiens
caauacaccugcaggaaga

SEQ ID NO: 1563653 - RNA, 19 nt, Homo sapiens
cuaauaagguggaacugaa

SEQ ID NO: 1563654 - RNA, 19 nt, Homo sapiens
cagauggagucgaauguaa

SEQ ID NO: 1563655 - RNA, 19 nt, Homo sapiens
uagaaagaguggaauaaga

SEQ ID NO: 1563656 - RNA, 19 nt, Homo sapiens
ucagacaucuuuaaacauc

SEQ ID NO: 1563657 - RNA, 19 nt, Homo sapiens
ggaaacaccuucauauacc

SEQ ID NO: 1563658 - RNA, 19 nt, Homo sapiens
ggagugagaguuuccuaaa

SEQ ID NO: 1563659 - RNA, 19 nt, Homo sapiens
gcaauccuguacccugaaa

SEQ ID NO: 1563660 - RNA, 19 nt, Homo sapiens
gaaaucugacuuugaccua

SEQ ID NO: 1563661 - RNA, 19 nt, Homo sapiens
uagaugagcauguccuaua

SEQ ID NO: 1563662 - RNA, 19 nt, Homo sapiens
ucucagacaucuuuaaaca

SEQ ID NO: 1563663 - RNA, 19 nt, Homo sapiens
ccacccagaugcccugaaa

SEQ ID NO: 1563664 - RNA, 19 nt, Homo sapiens
uaggaaacaccuucauaua

SEQ ID NO: 1563665 - RNA, 19 nt, Homo sapiens
gcaacagagcugcuacuuu

SEQ ID NO: 1563666 - RNA, 19 nt, Homo sapiens
uagcagugcaggucuaaua

SEQ ID NO: 1563667 - RNA, 19 nt, Homo sapiens
gccucagccucccaaauua

SEQ ID NO: 1563668 - RNA, 19 nt, Homo sapiens
ggaacugaaaucugacuuu

SEQ ID NO: 1563669 - RNA, 19 nt, Homo sapiens
agaaggcuauucccacauu

SEQ ID NO: 1563670 - RNA, 19 nt, Homo sapiens
ggaacacagccuuaccuaa

SEQ ID NO: 1563671 - RNA, 19 nt, Homo sapiens
gaucuauucaugaaacuga

SEQ ID NO: 1563672 - RNA, 19 nt, Homo sapiens
gcagauggagucgaaugua

SEQ ID NO: 1563673 - RNA, 19 nt, Homo sapiens
cagagcugcuacuuuauau

SEQ ID NO: 1563674 - RNA, 19 nt, Homo sapiens
cauauaccguacucuauuc

SEQ ID NO: 1563675 - RNA, 19 nt, Homo sapiens
uagaacagaucuuugacau

SEQ ID NO: 1563676 - RNA, 19 nt, Homo sapiens
gaaggcuauucccacauug

SEQ ID NO: 1563677 - RNA, 19 nt, Homo sapiens
ucagggagauuaggaaaca

SEQ ID NO: 1563678 - RNA, 19 nt, Homo sapiens
gagacagggucccacuaug

SEQ ID NO: 1563679 - RNA, 19 nt, Homo sapiens
gcuagaaagaguggaauaa

SEQ ID NO: 1563680 - RNA, 19 nt, Homo sapiens
aaugagcccuagauuauuc

SEQ ID NO: 1563681 - RNA, 19 nt, Homo sapiens
ucuuugacaucucuaauga

SEQ ID NO: 1563682 - RNA, 19 nt, Homo sapiens
ccaaauuacugggauuaca

SEQ ID NO: 1563683 - RNA, 19 nt, Homo sapiens
acagagcugcuacuuuaua

SEQ ID NO: 1563684 - RNA, 19 nt, Homo sapiens
cauuaggccuggagugaga

SEQ ID NO: 1563685 - RNA, 19 nt, Homo sapiens
gaguuugucuggugaaugc

SEQ ID NO: 1563686 - RNA, 19 nt, Homo sapiens
ccuaugagcugggaaaguc

SEQ ID NO: 1563687 - RNA, 19 nt, Homo sapiens
gacuucacauuacuuccua

SEQ ID NO: 1563688 - RNA, 19 nt, Homo sapiens
ucauuacuguuccuucuau

SEQ ID NO: 1563689 - RNA, 19 nt, Homo sapiens
gggacagagucucacuauu

SEQ ID NO: 1563690 - RNA, 19 nt, Homo sapiens
gagcugcuacuuuauaucu

SEQ ID NO: 1563691 - RNA, 19 nt, Homo sapiens
gcagggcuccucauuacug

SEQ ID NO: 1563692 - RNA, 19 nt, Homo sapiens
aaacugacuucacauuacu

SEQ ID NO: 1563693 - RNA, 19 nt, Homo sapiens
ucauauaccguacucuauu

SEQ ID NO: 1563694 - RNA, 19 nt, Homo sapiens
ggaagagcucgaucagguu

SEQ ID NO: 1563695 - RNA, 19 nt, Homo sapiens
agguggaacugaaaucuga

SEQ ID NO: 1563696 - RNA, 19 nt, Homo sapiens
gacagggucccacuauguu

SEQ ID NO: 1563697 - RNA, 19 nt, Homo sapiens
gcugcuacuuuauaucugu

SEQ ID NO: 1563698 - RNA, 19 nt, Homo sapiens
ccugaaaccagcuagauga

SEQ ID NO: 1563699 - RNA, 19 nt, Homo sapiens
ccagagcugcugccuuuga

SEQ ID NO: 1563700 - RNA, 19 nt, Homo sapiens
cugcagggcuccucauuac

SEQ ID NO: 1563701 - RNA, 19 nt, Homo sapiens
ggaugucagugccaauuuu

SEQ ID NO: 1563702 - RNA, 19 nt, Homo sapiens
guuaagaaacuagaacaga

SEQ ID NO: 1563703 - RNA, 19 nt, Homo sapiens
ggucaaggcacgcugcaau

SEQ ID NO: 1563704 - RNA, 19 nt, Homo sapiens
ucaggcaccuucaggaucu

SEQ ID NO: 1563705 - RNA, 19 nt, Homo sapiens
uaauaagguggaacugaaa

SEQ ID NO: 1563706 - RNA, 19 nt, Homo sapiens
guacucuauucuugccaaa

SEQ ID NO: 1563707 - RNA, 19 nt, Homo sapiens
gccgucagcuugucaacuc

SEQ ID NO: 1563708 - RNA, 19 nt, Homo sapiens
uuaggaaacaccuucauau

SEQ ID NO: 1563709 - RNA, 19 nt, Homo sapiens
gcaauacgcagaguuuguc

SEQ ID NO: 1563710 - RNA, 19 nt, Homo sapiens
gcagcuagaaagaguggaa

SEQ ID NO: 1563711 - RNA, 19 nt, Homo sapiens
gcuugcagcuagaaagagu

SEQ ID NO: 1563712 - RNA, 19 nt, Homo sapiens
auaccguacucuauucuug

SEQ ID NO: 1563713 - RNA, 19 nt, Homo sapiens
guuugcagauggagucgaa

SEQ ID NO: 1563714 - RNA, 19 nt, Homo sapiens
aaucugacuuugaccuaug

SEQ ID NO: 1563715 - RNA, 19 nt, Homo sapiens
cuuggaaagugacauaaca

SEQ ID NO: 1563716 - RNA, 19 nt, Homo sapiens
gagccuagcacagcauuag

SEQ ID NO: 1563717 - RNA, 19 nt, Homo sapiens
gaccaugaucuccuuggaa

SEQ ID NO: 1563718 - RNA, 19 nt, Homo sapiens
uaagaaacuagaacagauc

SEQ ID NO: 1563719 - RNA, 19 nt, Homo sapiens
agacagggucccacuaugu

SEQ ID NO: 1563720 - RNA, 19 nt, Homo sapiens
gagcagccgucagcuuguc

SEQ ID NO: 1563721 - RNA, 19 nt, Homo sapiens
uaccuaaagcagcuccuua

SEQ ID NO: 1563722 - RNA, 19 nt, Homo sapiens
aaacuagaacagaucuuug

SEQ ID NO: 1563723 - RNA, 19 nt, Homo sapiens
uuacaggcaugaggcauca

SEQ ID NO: 1563724 - RNA, 19 nt, Homo sapiens
ugccucagccucccaaauu

SEQ ID NO: 1563725 - RNA, 19 nt, Homo sapiens
agaugagcauguccuauag

SEQ ID NO: 1563726 - RNA, 19 nt, Homo sapiens
gacuaggaacacagccuua

SEQ ID NO: 1563727 - RNA, 19 nt, Homo sapiens
cucaaugaaugcuuaaagu

SEQ ID NO: 1563728 - RNA, 19 nt, Homo sapiens
ucugugcuauggagacuug

SEQ ID NO: 1563729 - RNA, 19 nt, Homo sapiens
gcaccuucaggaucuggua

SEQ ID NO: 1563730 - RNA, 19 nt, Homo sapiens
cuucauauaccguacucua

SEQ ID NO: 1563731 - RNA, 19 nt, Homo sapiens
ccucauuacuguuccuucu

SEQ ID NO: 1563732 - RNA, 19 nt, Homo sapiens
acugaaaucugacuuugac

SEQ ID NO: 1563733 - RNA, 19 nt, Homo sapiens
ggcaauacgcagaguuugu

SEQ ID NO: 1563734 - RNA, 19 nt, Homo sapiens
ccugcagggcuccucauua

SEQ ID NO: 1563735 - RNA, 19 nt, Homo sapiens
gaugagcauguccuauaga

SEQ ID NO: 1563736 - RNA, 19 nt, Homo sapiens
gaagcagggacaguaacuu

SEQ ID NO: 1563737 - RNA, 19 nt, Homo sapiens
ggaagcagggacaguaacu

SEQ ID NO: 1563738 - RNA, 19 nt, Homo sapiens
cgugucggguuucccacua

SEQ ID NO: 1563739 - RNA, 19 nt, Homo sapiens
gagugcccaucugaaggua

SEQ ID NO: 1563740 - RNA, 19 nt, Homo sapiens
cagugcaggucuaauaagg

SEQ ID NO: 1563741 - RNA, 19 nt, Homo sapiens
uucaggaucugguacuguu

SEQ ID NO: 1563742 - RNA, 19 nt, Homo sapiens
aggaaacaccuucauauac

SEQ ID NO: 1563743 - RNA, 19 nt, Homo sapiens
gagaagugcugcuguaauu

SEQ ID NO: 1563744 - RNA, 19 nt, Homo sapiens
ccaaauagccugcucagua

SEQ ID NO: 1563745 - RNA, 19 nt, Homo sapiens
gaaagugaauaaagcagaa

SEQ ID NO: 1563746 - RNA, 19 nt, Homo sapiens
gcacgaagcugagauugug

SEQ ID NO: 1563747 - RNA, 19 nt, Homo sapiens
caaauagccugcucaguag

SEQ ID NO: 1563748 - RNA, 19 nt, Homo sapiens
ggcagaaucuauauacuga

SEQ ID NO: 1563749 - RNA, 19 nt, Homo sapiens
ggacaauccugcccaaagg

SEQ ID NO: 1563750 - RNA, 19 nt, Homo sapiens
cagaaagaguucagugcua

SEQ ID NO: 1563751 - RNA, 19 nt, Homo sapiens
caucuaugcuuagcuauga

SEQ ID NO: 1563752 - RNA, 19 nt, Homo sapiens
ggguuaaccugacuuugaa

SEQ ID NO: 1563753 - RNA, 19 nt, Homo sapiens
ccugaugauuggcauguua

SEQ ID NO: 1563754 - RNA, 19 nt, Homo sapiens
cagggcagcuuguuaggaa

SEQ ID NO: 1563755 - RNA, 19 nt, Homo sapiens
gggagaggcagaaucuaua

SEQ ID NO: 1563756 - RNA, 19 nt, Homo sapiens
gacagggaauuucaagaga

SEQ ID NO: 1563757 - RNA, 19 nt, Homo sapiens
ggugaccacuggcaucuau

SEQ ID NO: 1563758 - RNA, 19 nt, Homo sapiens
gagggauucuggucagcua

SEQ ID NO: 1563759 - RNA, 19 nt, Homo sapiens
uaagauuccugaugauugg

SEQ ID NO: 1563760 - RNA, 19 nt, Homo sapiens
gaagggacagggaauuuca

SEQ ID NO: 1563761 - RNA, 19 nt, Homo sapiens
ggacagggaauuucaagag

SEQ ID NO: 1563762 - RNA, 19 nt, Homo sapiens
ggauucuggucagcuauaa

SEQ ID NO: 1563763 - RNA, 19 nt, Homo sapiens
gcaaggacuggguugguuu

SEQ ID NO: 1563764 - RNA, 19 nt, Homo sapiens
aagcugagauugugguuuc

SEQ ID NO: 1563765 - RNA, 19 nt, Homo sapiens
gcagggcaguggauggaau

SEQ ID NO: 1563766 - RNA, 19 nt, Homo sapiens
ggagugggccagaagauca

SEQ ID NO: 1563767 - RNA, 19 nt, Homo sapiens
guccacauauacaaccaua

SEQ ID NO: 1563768 - RNA, 19 nt, Homo sapiens
ggagaggcagaaucuauau

SEQ ID NO: 1563769 - RNA, 19 nt, Homo sapiens
gcauguuacccaaauuuga

SEQ ID NO: 1563770 - RNA, 19 nt, Homo sapiens
auacaaccauacauacuug

SEQ ID NO: 1563771 - RNA, 19 nt, Homo sapiens
gaggccugcuucagccaua

SEQ ID NO: 1563772 - RNA, 19 nt, Homo sapiens
gagaggcagaaucuauaua

SEQ ID NO: 1563773 - RNA, 19 nt, Homo sapiens
agacaacacuucccagcau

SEQ ID NO: 1563774 - RNA, 19 nt, Homo sapiens
ucaaaccccuguccacaua

SEQ ID NO: 1563775 - RNA, 19 nt, Homo sapiens
gugcguaggcuuccaguga

SEQ ID NO: 1563776 - RNA, 19 nt, Homo sapiens
gagccaggccugugccaaa

SEQ ID NO: 1563777 - RNA, 19 nt, Homo sapiens
gcucugcucugaagucaac

SEQ ID NO: 1563778 - RNA, 19 nt, Homo sapiens
gcuuagcuaugaaagugaa

SEQ ID NO: 1563779 - RNA, 19 nt, Homo sapiens
cagaaucuauauacugaag

SEQ ID NO: 1563780 - RNA, 19 nt, Homo sapiens
uccaauccauccaugcaua

SEQ ID NO: 1563781 - RNA, 19 nt, Homo sapiens
ggcaaggacuggguugguu

SEQ ID NO: 1563782 - RNA, 19 nt, Homo sapiens
gcccagcaguacacacuug

SEQ ID NO: 1563783 - RNA, 19 nt, Homo sapiens
ccacauauacaaccauaca

SEQ ID NO: 1563784 - RNA, 19 nt, Homo sapiens
gggagaaugccaacaggaa

SEQ ID NO: 1563785 - RNA, 19 nt, Homo sapiens
gcuaugaaagugaauaaag

SEQ ID NO: 1563786 - RNA, 19 nt, Homo sapiens
gcaagaagggacagggaau

SEQ ID NO: 1563787 - RNA, 19 nt, Homo sapiens
ggcaguggauggaauaacu

SEQ ID NO: 1563788 - RNA, 19 nt, Homo sapiens
gagccagagucuaaauuuu

SEQ ID NO: 1563789 - RNA, 19 nt, Homo sapiens
gcagaugggagccaagcuu

SEQ ID NO: 1563790 - RNA, 19 nt, Homo sapiens
gcaguacacacuugguuuc

SEQ ID NO: 1563791 - RNA, 19 nt, Homo sapiens
ccaggcccaugcagaaaga

SEQ ID NO: 1563792 - RNA, 19 nt, Homo sapiens
acacgggccuugcucuugu

SEQ ID NO: 1563793 - RNA, 19 nt, Homo sapiens
ugagccagagucuaaauuu

SEQ ID NO: 1563794 - RNA, 19 nt, Homo sapiens
ucuauauccuuguuacuca

SEQ ID NO: 1563795 - RNA, 19 nt, Homo sapiens
gugaggguuuggcgaggua

SEQ ID NO: 1563796 - RNA, 19 nt, Homo sapiens
uuugagaagugcugcugua

SEQ ID NO: 1563797 - RNA, 19 nt, Homo sapiens
caagaagggacagggaauu

SEQ ID NO: 1563798 - RNA, 19 nt, Homo sapiens
guacacacgcagacacaga

SEQ ID NO: 1563799 - RNA, 19 nt, Homo sapiens
aauaacuccuuguggcauu

SEQ ID NO: 1563800 - RNA, 19 nt, Homo sapiens
gggauucuggucagcuaua

SEQ ID NO: 1563801 - RNA, 19 nt, Homo sapiens
ucacagggcagcuuguuag

SEQ ID NO: 1563802 - RNA, 19 nt, Homo sapiens
acacacacauacacacaca

SEQ ID NO: 1563803 - RNA, 19 nt, Homo sapiens
gugcuacucugcgugauuc

SEQ ID NO: 1563804 - RNA, 19 nt, Homo sapiens
gcaagaucgagcacuguga

SEQ ID NO: 1563805 - RNA, 19 nt, Homo sapiens
gacaugaacaagugcauca

SEQ ID NO: 1563806 - RNA, 19 nt, Homo sapiens
agacaaggaagaaaacuua

SEQ ID NO: 1563807 - RNA, 19 nt, Homo sapiens
uuaagauuccugaugauug

SEQ ID NO: 1563808 - RNA, 19 nt, Homo sapiens
gucaacggcugccucaagu

SEQ ID NO: 1563809 - RNA, 19 nt, Homo sapiens
ugaacaagugcaucaaaug

SEQ ID NO: 1563810 - RNA, 19 nt, Homo sapiens
ggcaaagcauacacacaca

SEQ ID NO: 1563811 - RNA, 19 nt, Homo sapiens
acccggaggugcacaguga

SEQ ID NO: 1563812 - RNA, 19 nt, Homo sapiens
caugaacaagugcaucaaa

SEQ ID NO: 1563813 - RNA, 19 nt, Homo sapiens
cggcagcaguguugucaca

SEQ ID NO: 1563814 - RNA, 19 nt, Homo sapiens
ucccagcugugugacuuua

SEQ ID NO: 1563815 - RNA, 19 nt, Homo sapiens
gauggaauaacuccuugug

SEQ ID NO: 1563816 - RNA, 19 nt, Homo sapiens
gugguuuccuggugauuca

SEQ ID NO: 1563817 - RNA, 19 nt, Homo sapiens
gaaaauaggcaugcaccaa

SEQ ID NO: 1563818 - RNA, 19 nt, Homo sapiens
aaggaggacuuuccaucug

SEQ ID NO: 1563819 - RNA, 19 nt, Homo sapiens
ccagcugugugacuuuauc

SEQ ID NO: 1563820 - RNA, 19 nt, Homo sapiens
cuggugaccugggaagaaa

SEQ ID NO: 1563821 - RNA, 19 nt, Homo sapiens
cuaugaaagugaauaaagc

SEQ ID NO: 1563822 - RNA, 19 nt, Homo sapiens
gggacaauccugcccaaag

SEQ ID NO: 1563823 - RNA, 19 nt, Homo sapiens
gaagcugagauugugguuu

SEQ ID NO: 1563824 - RNA, 19 nt, Homo sapiens
gaggcagaaucuauauacu

SEQ ID NO: 1563825 - RNA, 19 nt, Homo sapiens
aagaagggacagggaauuu

SEQ ID NO: 1563826 - RNA, 19 nt, Homo sapiens
aggguuaaccugacuuuga

SEQ ID NO: 1563827 - RNA, 19 nt, Homo sapiens
ccaguggacaugucagaga

SEQ ID NO: 1563828 - RNA, 19 nt, Homo sapiens
gacaccacacacacacaua

SEQ ID NO: 1563829 - RNA, 19 nt, Homo sapiens
ggugcuggcucucgaagac

SEQ ID NO: 1563830 - RNA, 19 nt, Homo sapiens
gcguaggcuuccagugaug

SEQ ID NO: 1563831 - RNA, 19 nt, Homo sapiens
agacacaggcaccacauuc

SEQ ID NO: 1563832 - RNA, 19 nt, Homo sapiens
caagacacacacgcucaaa

SEQ ID NO: 1563833 - RNA, 19 nt, Homo sapiens
guaguccugcgcaauguga

SEQ ID NO: 1563834 - RNA, 19 nt, Homo sapiens
uggcauguuacccaaauuu

SEQ ID NO: 1563835 - RNA, 19 nt, Homo sapiens
uuguuacccuuccaggaua

SEQ ID NO: 1563836 - RNA, 19 nt, Homo sapiens
acacauacacacacacaca

SEQ ID NO: 1563837 - RNA, 19 nt, Homo sapiens
ccacacacacacauacaca

SEQ ID NO: 1563838 - RNA, 19 nt, Homo sapiens
augaacaagugcaucaaau

SEQ ID NO: 1563839 - RNA, 19 nt, Homo sapiens
augcuuagcuaugaaagug

SEQ ID NO: 1563840 - RNA, 19 nt, Homo sapiens
gaagugcugcuguaauucc

SEQ ID NO: 1563841 - RNA, 19 nt, Homo sapiens
uacccaaauuugagaagug

SEQ ID NO: 1563842 - RNA, 19 nt, Homo sapiens
cuuuaucguuggagaguau

SEQ ID NO: 1563843 - RNA, 19 nt, Homo sapiens
gcacaggccuucucguuua

SEQ ID NO: 1563844 - RNA, 19 nt, Homo sapiens
gaaauugacuggcuaagga

SEQ ID NO: 1563845 - RNA, 19 nt, Homo sapiens
ggacugcacugccaaguaa

SEQ ID NO: 1563846 - RNA, 19 nt, Homo sapiens
gaacagaccucucauucuc

SEQ ID NO: 1563847 - RNA, 19 nt, Homo sapiens
gagcguagguggcaauuga

SEQ ID NO: 1563848 - RNA, 19 nt, Homo sapiens
ggagagcccugaagucuug

SEQ ID NO: 1563849 - RNA, 19 nt, Homo sapiens
aaacagagccucagagaga

SEQ ID NO: 1563850 - RNA, 19 nt, Homo sapiens
ugagugaacuuacuagaug

SEQ ID NO: 1563851 - RNA, 19 nt, Homo sapiens
caacucacauucuaugaca

SEQ ID NO: 1563852 - RNA, 19 nt, Homo sapiens
cugaguagcugggauuaua

SEQ ID NO: 1563853 - RNA, 19 nt, Homo sapiens
ggagugcacuggcuugauc

SEQ ID NO: 1563854 - RNA, 19 nt, Homo sapiens
gagcuaggauuugaauuca

SEQ ID NO: 1563855 - RNA, 19 nt, Homo sapiens
cuaaaggaagucauucuua

SEQ ID NO: 1563856 - RNA, 19 nt, Homo sapiens
agaugaagcugaacacaga

SEQ ID NO: 1563857 - RNA, 19 nt, Homo sapiens
ggaagucauucuuaucucu

SEQ ID NO: 1563858 - RNA, 19 nt, Homo sapiens
gcaccaccaugcccagcua

SEQ ID NO: 1563859 - RNA, 19 nt, Homo sapiens
gggagauccuucauguuga

SEQ ID NO: 1563860 - RNA, 19 nt, Homo sapiens
ggagcuaggauuugaauuc

SEQ ID NO: 1563861 - RNA, 19 nt, Homo sapiens
gaagaaacagagccucaga

SEQ ID NO: 1563862 - RNA, 19 nt, Homo sapiens
ucuacuaccuggaaacuga

SEQ ID NO: 1563863 - RNA, 19 nt, Homo sapiens
caagugauccaccuaccua

SEQ ID NO: 1563864 - RNA, 19 nt, Homo sapiens
gcugcagacuggcuggaua

SEQ ID NO: 1563865 - RNA, 19 nt, Homo sapiens
gaagaucacaucccacucu

SEQ ID NO: 1563866 - RNA, 19 nt, Homo sapiens
gaaguugcacuagaugauu

SEQ ID NO: 1563867 - RNA, 19 nt, Homo sapiens
aaguugcacuagaugauua

SEQ ID NO: 1563868 - RNA, 19 nt, Homo sapiens
gaagucauucuuaucucua

SEQ ID NO: 1563869 - RNA, 19 nt, Homo sapiens
ccugaagucuuguggaguu

SEQ ID NO: 1563870 - RNA, 19 nt, Homo sapiens
gagugaacuuacuagauga

SEQ ID NO: 1563871 - RNA, 19 nt, Homo sapiens
ggcaauaaaggaagucauu

SEQ ID NO: 1563872 - RNA, 19 nt, Homo sapiens
cauuagggaucuauaucuu

SEQ ID NO: 1563873 - RNA, 19 nt, Homo sapiens
caacgucuacuaccuggaa

SEQ ID NO: 1563874 - RNA, 19 nt, Homo sapiens
ggagauccuucauguugag

SEQ ID NO: 1563875 - RNA, 19 nt, Homo sapiens
caccaugcccagcuaauuu

SEQ ID NO: 1563876 - RNA, 19 nt, Homo sapiens
ccaaugagugaacuuacua

SEQ ID NO: 1563877 - RNA, 19 nt, Homo sapiens
gagagagugugcccuagag

SEQ ID NO: 1563878 - RNA, 19 nt, Homo sapiens
agagagggauugggaaguu

SEQ ID NO: 1563879 - RNA, 19 nt, Homo sapiens
ggaaguugcacuagaugau

SEQ ID NO: 1563880 - RNA, 19 nt, Homo sapiens
gagagggauugggaaguug

SEQ ID NO: 1563881 - RNA, 19 nt, Homo sapiens
ggaacagaccucucauucu

SEQ ID NO: 1563882 - RNA, 19 nt, Homo sapiens
uuagggaucuauaucuuag

SEQ ID NO: 1563883 - RNA, 19 nt, Homo sapiens
cugcgaagguauccaguug

SEQ ID NO: 1563884 - RNA, 19 nt, Homo sapiens
acacagaggugcgcgagau

SEQ ID NO: 1563885 - RNA, 19 nt, Homo sapiens
gaucagcggcguggaugaa

SEQ ID NO: 1563886 - RNA, 19 nt, Homo sapiens
caggccuucucguuuauuu

SEQ ID NO: 1563887 - RNA, 19 nt, Homo sapiens
gaugaaauugacuggcuaa

SEQ ID NO: 1563888 - RNA, 19 nt, Homo sapiens
ccaggagcguggugacuuc

SEQ ID NO: 1563889 - RNA, 19 nt, Homo sapiens
ggauugggaaguugcacua

SEQ ID NO: 1563890 - RNA, 19 nt, Homo sapiens
ugcacuagaugauuacgaa

SEQ ID NO: 1563891 - RNA, 19 nt, Homo sapiens
gagucucucuugcucuguu

SEQ ID NO: 1563892 - RNA, 19 nt, Homo sapiens
gggauugguugcauuacag

SEQ ID NO: 1563893 - RNA, 19 nt, Homo sapiens
ucacagaugaagaaacaga

SEQ ID NO: 1563894 - RNA, 19 nt, Homo sapiens
ucaaacuccugaccucaag

SEQ ID NO: 1563895 - RNA, 19 nt, Homo sapiens
aaauaaggagucucucuug

SEQ ID NO: 1563896 - RNA, 19 nt, Homo sapiens
gcauaaggaagaacucuac

SEQ ID NO: 1563897 - RNA, 19 nt, Homo sapiens
ggccuucucguuuauuuau

SEQ ID NO: 1563898 - RNA, 19 nt, Homo sapiens
gggccaaugagugaacuua

SEQ ID NO: 1563899 - RNA, 19 nt, Homo sapiens
guagguggcaauugagaga

SEQ ID NO: 1563900 - RNA, 19 nt, Homo sapiens
ucacaucccacucucugaa

SEQ ID NO: 1563901 - RNA, 19 nt, Homo sapiens
agaaacagagccucagaga

SEQ ID NO: 1563902 - RNA, 19 nt, Homo sapiens
caccgugccuggccuaaag

SEQ ID NO: 1563903 - RNA, 19 nt, Homo sapiens
gcauuagggaucuauaucu

SEQ ID NO: 1563904 - RNA, 19 nt, Homo sapiens
gccaaugagugaacuuacu

SEQ ID NO: 1563905 - RNA, 19 nt, Homo sapiens
ggagaucagcggcguggau

SEQ ID NO: 1563906 - RNA, 19 nt, Homo sapiens
ggauacagagggugaugau

SEQ ID NO: 1563907 - RNA, 19 nt, Homo sapiens
cccagucacggaccaaaua

SEQ ID NO: 1563908 - RNA, 19 nt, Homo sapiens
ccaaggagagcccugaagu

SEQ ID NO: 1563909 - RNA, 19 nt, Homo sapiens
cuacagcagcccaaucuuc

SEQ ID NO: 1563910 - RNA, 19 nt, Homo sapiens
gaaauggggagcuaggauu

SEQ ID NO: 1563911 - RNA, 19 nt, Homo sapiens
ccaccaugcccagcuaauu

SEQ ID NO: 1563912 - RNA, 19 nt, Homo sapiens
ggggagauccuucauguug

SEQ ID NO: 1563913 - RNA, 19 nt, Homo sapiens
ucucugaacuacaaucacu

SEQ ID NO: 1563914 - RNA, 19 nt, Homo sapiens
cccacucucugaacuacaa

SEQ ID NO: 1563915 - RNA, 19 nt, Homo sapiens
cagagccucagagagauua

SEQ ID NO: 1563916 - RNA, 19 nt, Homo sapiens
cacaggccuucucguuuau

SEQ ID NO: 1563917 - RNA, 19 nt, Homo sapiens
agucagggccaaugaguga

SEQ ID NO: 1563918 - RNA, 19 nt, Homo sapiens
gggaaguugcacuagauga

SEQ ID NO: 1563919 - RNA, 19 nt, Homo sapiens
cuccugaccucaagugauc

SEQ ID NO: 1563920 - RNA, 19 nt, Homo sapiens
acuagaugauuacgaagau

SEQ ID NO: 1563921 - RNA, 19 nt, Homo sapiens
ccucagugcauaaggaaga

SEQ ID NO: 1563922 - RNA, 19 nt, Homo sapiens
gcccaacucacauucuaug

SEQ ID NO: 1563923 - RNA, 19 nt, Homo sapiens
uugcccaacucacauucua

SEQ ID NO: 1563924 - RNA, 19 nt, Homo sapiens
guaccaagugugcaaugug

SEQ ID NO: 1563925 - RNA, 19 nt, Homo sapiens
gaugaugggguuauuaaug

SEQ ID NO: 1563926 - RNA, 19 nt, Homo sapiens
ucucuugccuguggcuuug

SEQ ID NO: 1563927 - RNA, 19 nt, Homo sapiens
aaaggaagucauucuuauc

SEQ ID NO: 1563928 - RNA, 19 nt, Homo sapiens
ccuaaaggaagucauucuu

SEQ ID NO: 1563929 - RNA, 19 nt, Homo sapiens
ccuccuggguucaagcaau

SEQ ID NO: 1563930 - RNA, 19 nt, Homo sapiens
caaggagagcccugaaguc

SEQ ID NO: 1563931 - RNA, 19 nt, Homo sapiens
aggaacagaccucucauuc

SEQ ID NO: 1563932 - RNA, 19 nt, Homo sapiens
ugggugagcgcaagaugaa

SEQ ID NO: 1563933 - RNA, 19 nt, Homo sapiens
ggaccgccgaggaaguuau

SEQ ID NO: 1563934 - RNA, 19 nt, Homo sapiens
cuccuggguucaagcaauu

SEQ ID NO: 1563935 - RNA, 19 nt, Homo sapiens
gaagucuuguggaguuucc

SEQ ID NO: 1563936 - RNA, 19 nt, Homo sapiens
ugggauugguugcauuaca

SEQ ID NO: 1563937 - RNA, 19 nt, Homo sapiens
uacagcagcccaaucuuca

SEQ ID NO: 1563938 - RNA, 19 nt, Homo sapiens
gaccuucaacgucuacuac

SEQ ID NO: 1563939 - RNA, 19 nt, Homo sapiens
ggacucuggagcccaagga

SEQ ID NO: 1563940 - RNA, 19 nt, Homo sapiens
agagugugcccuagaggaa

SEQ ID NO: 1563941 - RNA, 19 nt, Homo sapiens
uugggaaguugcacuagau

SEQ ID NO: 1563942 - RNA, 19 nt, Homo sapiens
ggauugguugcauuacaga

SEQ ID NO: 1563943 - RNA, 19 nt, Homo sapiens
gaaccuggcuacaacauua

SEQ ID NO: 1563944 - RNA, 19 nt, Homo sapiens
ccacagagcaucuuaaauu

SEQ ID NO: 1563945 - RNA, 19 nt, Homo sapiens
caggauugcuucugaguua

SEQ ID NO: 1563946 - RNA, 19 nt, Homo sapiens
gcaagcaguuggcuauuca

SEQ ID NO: 1563947 - RNA, 19 nt, Homo sapiens
agaaggcccucaccacuuu

SEQ ID NO: 1563948 - RNA, 19 nt, Homo sapiens
caaauaggcagacuggaaa

SEQ ID NO: 1563949 - RNA, 19 nt, Homo sapiens
ggacuucuguggcauugau

SEQ ID NO: 1563950 - RNA, 19 nt, Homo sapiens
ccagacaccuucuccuaug

SEQ ID NO: 1563951 - RNA, 19 nt, Homo sapiens
gcagagagcgucuauacca

SEQ ID NO: 1563952 - RNA, 19 nt, Homo sapiens
ccaaauaggcagacuggaa

SEQ ID NO: 1563953 - RNA, 19 nt, Homo sapiens
ugaccaggcaugcaacuua

SEQ ID NO: 1563954 - RNA, 19 nt, Homo sapiens
cacagagcaucuuaaauug

SEQ ID NO: 1563955 - RNA, 19 nt, Homo sapiens
uuaagugaauuccugcuuu

SEQ ID NO: 1563956 - RNA, 19 nt, Homo sapiens
acaacaggauugcuucuga

SEQ ID NO: 1563957 - RNA, 19 nt, Homo sapiens
gagagcgucuauaccauca

SEQ ID NO: 1563958 - RNA, 19 nt, Homo sapiens
cauggacgauggcuccuuu

SEQ ID NO: 1563959 - RNA, 19 nt, Homo sapiens
gaaggagucccauggaaag

SEQ ID NO: 1563960 - RNA, 19 nt, Homo sapiens
ucugacaucugccaucuga

SEQ ID NO: 1563961 - RNA, 19 nt, Homo sapiens
gugaaggagucccauggaa

SEQ ID NO: 1563962 - RNA, 19 nt, Homo sapiens
caucuuaaauugcaucaac

SEQ ID NO: 1563963 - RNA, 19 nt, Homo sapiens
cagagcaucuuaaauugca

SEQ ID NO: 1563964 - RNA, 19 nt, Homo sapiens
gaccaggcaugcaacuuag

SEQ ID NO: 1563965 - RNA, 19 nt, Homo sapiens
ugaggcaaaugcuaauguu

SEQ ID NO: 1563966 - RNA, 19 nt, Homo sapiens
aaacaucaccucucugaca

SEQ ID NO: 1563967 - RNA, 19 nt, Homo sapiens
uggccuagcuuugugguuu

SEQ ID NO: 1563968 - RNA, 19 nt, Homo sapiens
gaaacuagaaaucccaucu

SEQ ID NO: 1563969 - RNA, 19 nt, Homo sapiens
gcuacaacauuaacaacag

SEQ ID NO: 1563970 - RNA, 19 nt, Homo sapiens
ugaaggagucccauggaaa

SEQ ID NO: 1563971 - RNA, 19 nt, Homo sapiens
gcacagaaacuagaaaucc

SEQ ID NO: 1563972 - RNA, 19 nt, Homo sapiens
caacauuaacaacaggauu

SEQ ID NO: 1563973 - RNA, 19 nt, Homo sapiens
ggcaagcaguuggcuauuc

SEQ ID NO: 1563974 - RNA, 19 nt, Homo sapiens
gcccacagagcaucuuaaa

SEQ ID NO: 1563975 - RNA, 19 nt, Homo sapiens
gcccgaaccuggcuacaac

SEQ ID NO: 1563976 - RNA, 19 nt, Homo sapiens
uggcagcauuuaaaccaaa

SEQ ID NO: 1563977 - RNA, 19 nt, Homo sapiens
ggauugcuucugaguuaaa

SEQ ID NO: 1563978 - RNA, 19 nt, Homo sapiens
auaaacaucaccucucuga

SEQ ID NO: 1563979 - RNA, 19 nt, Homo sapiens
agauaaacaucaccucucu

SEQ ID NO: 1563980 - RNA, 19 nt, Homo sapiens
gcuccuuugugguguguga

SEQ ID NO: 1563981 - RNA, 19 nt, Homo sapiens
ggacgauggcuccuuugug

SEQ ID NO: 1563982 - RNA, 19 nt, Homo sapiens
caucugggcacucagcauu

SEQ ID NO: 1563983 - RNA, 19 nt, Homo sapiens
uaagugaauuccugcuuuu

SEQ ID NO: 1563984 - RNA, 19 nt, Homo sapiens
gagcgucuauaccaucaac

SEQ ID NO: 1563985 - RNA, 19 nt, Homo sapiens
cagaaggcccucaccacuu

SEQ ID NO: 1563986 - RNA, 19 nt, Homo sapiens
ugauuucauuugcacagaa

SEQ ID NO: 1563987 - RNA, 19 nt, Homo sapiens
uaggcagacuggaaagaug

SEQ ID NO: 1563988 - RNA, 19 nt, Homo sapiens
uguccuugcugccaaauag

SEQ ID NO: 1563989 - RNA, 19 nt, Homo sapiens
ggcaagagauaaacaucac

SEQ ID NO: 1563990 - RNA, 19 nt, Homo sapiens
ucaacaaauucuggacguu

SEQ ID NO: 1563991 - RNA, 19 nt, Homo sapiens
uggcauugaucuccuuauc

SEQ ID NO: 1563992 - RNA, 19 nt, Homo sapiens
ugacaucugccaucugauc

SEQ ID NO: 1563993 - RNA, 19 nt, Homo sapiens
gaugugggugggaucauug

SEQ ID NO: 1563994 - RNA, 19 nt, Homo sapiens
ugcccuaccuguuccagaa

SEQ ID NO: 1563995 - RNA, 19 nt, Homo sapiens
aacagugggucuaccucua

SEQ ID NO: 1563996 - RNA, 19 nt, Homo sapiens
cagagagcgucuauaccau

SEQ ID NO: 1563997 - RNA, 19 nt, Homo sapiens
caucaccucucugacaucu

SEQ ID NO: 1563998 - RNA, 19 nt, Homo sapiens
gccagacaccuucuccuau

SEQ ID NO: 1563999 - RNA, 19 nt, Homo sapiens
ugggaucauugcagacuau

SEQ ID NO: 1564000 - RNA, 19 nt, Homo sapiens
cuauucagguguccaacau

SEQ ID NO: 1564001 - RNA, 19 nt, Homo sapiens
ccauguccuugcugccaaa

SEQ ID NO: 1564002 - RNA, 19 nt, Homo sapiens
gaggcaaaugcuaauguug

SEQ ID NO: 1564003 - RNA, 19 nt, Homo sapiens
ucagguguccaacauccua

SEQ ID NO: 1564004 - RNA, 19 nt, Homo sapiens
cagaacaaggcaagcaguu

SEQ ID NO: 1564005 - RNA, 19 nt, Homo sapiens
ggacggaugcagagcaacu

SEQ ID NO: 1564006 - RNA, 19 nt, Homo sapiens
gugggaucauugcagacua

SEQ ID NO: 1564007 - RNA, 19 nt, Homo sapiens
agaugugggugggaucauu

SEQ ID NO: 1564008 - RNA, 19 nt, Homo sapiens
caccucggccuccagcuaa

SEQ ID NO: 1564009 - RNA, 19 nt, Homo sapiens
uggugggcaugaagacuuu

SEQ ID NO: 1564010 - RNA, 19 nt, Homo sapiens
gcucagggaguugcagaga

SEQ ID NO: 1564011 - RNA, 19 nt, Homo sapiens
ugugugaggcaaaugcuaa

SEQ ID NO: 1564012 - RNA, 19 nt, Homo sapiens
ucaccacuuucccggaugu

SEQ ID NO: 1564013 - RNA, 19 nt, Homo sapiens
cgaugugcccuaccuguuc

SEQ ID NO: 1564014 - RNA, 19 nt, Homo sapiens
gugauuucauuugcacaga

SEQ ID NO: 1564015 - RNA, 19 nt, Homo sapiens
gccuccagcuaaaccagaa

SEQ ID NO: 1564016 - RNA, 19 nt, Homo sapiens
cagacuauaccauguccuu

SEQ ID NO: 1564017 - RNA, 19 nt, Homo sapiens
ccuaccuguuccagaagua

SEQ ID NO: 1564018 - RNA, 19 nt, Homo sapiens
uuaagcaaauggccuagcu

SEQ ID NO: 1564019 - RNA, 19 nt, Homo sapiens
aaaccaaauccuacugcuu

SEQ ID NO: 1564020 - RNA, 19 nt, Homo sapiens
aacauuaacaacaggauug

SEQ ID NO: 1564021 - RNA, 19 nt, Homo sapiens
cacccucagugcagucaga

SEQ ID NO: 1564022 - RNA, 19 nt, Homo sapiens
ugccagacaccuucuccua

SEQ ID NO: 1564023 - RNA, 19 nt, Homo sapiens
cagacaccuucuccuaugg

SEQ ID NO: 1564024 - RNA, 19 nt, Homo sapiens
gcuacccagucguggugaa

SEQ ID NO: 1564025 - RNA, 19 nt, Homo sapiens
cuaacgaugauuuaagcaa

SEQ ID NO: 1564026 - RNA, 19 nt, Homo sapiens
cgaaccuggcuacaacauu

SEQ ID NO: 1564027 - RNA, 19 nt, Homo sapiens
gugaggcaaaugcuaaugu

SEQ ID NO: 1564028 - RNA, 19 nt, Homo sapiens
caagaacuggcuggacaug

SEQ ID NO: 1564029 - RNA, 19 nt, Homo sapiens
aacaucaccucucugacau

SEQ ID NO: 1564030 - RNA, 19 nt, Homo sapiens
gaauguagaaucagcauaa

SEQ ID NO: 1564031 - RNA, 19 nt, Homo sapiens
gaaacaccuuugagggaua

SEQ ID NO: 1564032 - RNA, 19 nt, Homo sapiens
ucaucgagcuugcuuguuu

SEQ ID NO: 1564033 - RNA, 19 nt, Homo sapiens
gcacauaggaaaugccaaa

SEQ ID NO: 1564034 - RNA, 19 nt, Homo sapiens
gagcugaagccacagagua

SEQ ID NO: 1564035 - RNA, 19 nt, Homo sapiens
gaaaucucaugucccaguu

SEQ ID NO: 1564036 - RNA, 19 nt, Homo sapiens
gggagcagcuucugagauc

SEQ ID NO: 1564037 - RNA, 19 nt, Homo sapiens
ggguagagcuggagucaca

SEQ ID NO: 1564038 - RNA, 19 nt, Homo sapiens
uccaaagggugaauuaauu

SEQ ID NO: 1564039 - RNA, 19 nt, Homo sapiens
uaaaaucgcccucagaaua

SEQ ID NO: 1564040 - RNA, 19 nt, Homo sapiens
cauaggaaaugccaaaaua

SEQ ID NO: 1564041 - RNA, 19 nt, Homo sapiens
gagggcaccuggaacaaug

SEQ ID NO: 1564042 - RNA, 19 nt, Homo sapiens
aaagggaacugaugagagu

SEQ ID NO: 1564043 - RNA, 19 nt, Homo sapiens
gaaacaagacaaugaagca

SEQ ID NO: 1564044 - RNA, 19 nt, Homo sapiens
cagcagacccuuagcagaa

SEQ ID NO: 1564045 - RNA, 19 nt, Homo sapiens
caaugaaacaagacaauga

SEQ ID NO: 1564046 - RNA, 19 nt, Homo sapiens
cagaguaggagagaaguua

SEQ ID NO: 1564047 - RNA, 19 nt, Homo sapiens
aagcagcggugccaaguau

SEQ ID NO: 1564048 - RNA, 19 nt, Homo sapiens
gagauccaauggccuuguu

SEQ ID NO: 1564049 - RNA, 19 nt, Homo sapiens
gaacaguaaauaagacaag

SEQ ID NO: 1564050 - RNA, 19 nt, Homo sapiens
gagcacagcagacccuuag

SEQ ID NO: 1564051 - RNA, 19 nt, Homo sapiens
ggagggauguguuaaaauc

SEQ ID NO: 1564052 - RNA, 19 nt, Homo sapiens
gauggagggauguguuaaa

SEQ ID NO: 1564053 - RNA, 19 nt, Homo sapiens
ugccagacaugauuccauu

SEQ ID NO: 1564054 - RNA, 19 nt, Homo sapiens
agaauauggucgagacaau

SEQ ID NO: 1564055 - RNA, 19 nt, Homo sapiens
ggaacaauggccugcaaga

SEQ ID NO: 1564056 - RNA, 19 nt, Homo sapiens
gcagcggugccaaguauga

SEQ ID NO: 1564057 - RNA, 19 nt, Homo sapiens
gaaccuuuccuuccugcuu

SEQ ID NO: 1564058 - RNA, 19 nt, Homo sapiens
cagcauaauuuaaccucau

SEQ ID NO: 1564059 - RNA, 19 nt, Homo sapiens
gacaugauuccauuucgaa

SEQ ID NO: 1564060 - RNA, 19 nt, Homo sapiens
ggcaugggcugggcauaga

SEQ ID NO: 1564061 - RNA, 19 nt, Homo sapiens
gggcaacacugaccuuucc

SEQ ID NO: 1564062 - RNA, 19 nt, Homo sapiens
aaauuggaauccuuuaugg

SEQ ID NO: 1564063 - RNA, 19 nt, Homo sapiens
aauuuaaccucaucuugga

SEQ ID NO: 1564064 - RNA, 19 nt, Homo sapiens
ggaggauauuugaggacaa

SEQ ID NO: 1564065 - RNA, 19 nt, Homo sapiens
gaauauggucgagacaaug

SEQ ID NO: 1564066 - RNA, 19 nt, Homo sapiens
ugauucaugugcccgauug

SEQ ID NO: 1564067 - RNA, 19 nt, Homo sapiens
uaagacaagacuuugauuc

SEQ ID NO: 1564068 - RNA, 19 nt, Homo sapiens
ucgagacaaugaaacaaga

SEQ ID NO: 1564069 - RNA, 19 nt, Homo sapiens
aacuuucacucccugcuua

SEQ ID NO: 1564070 - RNA, 19 nt, Homo sapiens
gcacagcagacccuuagca

SEQ ID NO: 1564071 - RNA, 19 nt, Homo sapiens
cgagaccuaugcugaugga

SEQ ID NO: 1564072 - RNA, 19 nt, Homo sapiens
gcuuaaagggaacugauga

SEQ ID NO: 1564073 - RNA, 19 nt, Homo sapiens
gacuuugauucgcuuaguu

SEQ ID NO: 1564074 - RNA, 19 nt, Homo sapiens
gacaaugaaacaagacaau

SEQ ID NO: 1564075 - RNA, 19 nt, Homo sapiens
ggacuuugaaccuuuccuu

SEQ ID NO: 1564076 - RNA, 19 nt, Homo sapiens
agacaugauuccauuucga

SEQ ID NO: 1564077 - RNA, 19 nt, Homo sapiens
gaaccauagcugucacugu

SEQ ID NO: 1564078 - RNA, 19 nt, Homo sapiens
caagggacgcuacggaauc

SEQ ID NO: 1564079 - RNA, 19 nt, Homo sapiens
ccacagaguaggagagaag

SEQ ID NO: 1564080 - RNA, 19 nt, Homo sapiens
ugagguggcaggugucuau

SEQ ID NO: 1564081 - RNA, 19 nt, Homo sapiens
ccaagggccagggcgaaua

SEQ ID NO: 1564082 - RNA, 19 nt, Homo sapiens
ggaggguuauccuuguucu

SEQ ID NO: 1564083 - RNA, 19 nt, Homo sapiens
gcuuaguucugccuugagu

SEQ ID NO: 1564084 - RNA, 19 nt, Homo sapiens
gacuuuggaacaguaaaua

SEQ ID NO: 1564085 - RNA, 19 nt, Homo sapiens
ccauagcugucacugucuu

SEQ ID NO: 1564086 - RNA, 19 nt, Homo sapiens
gcuauggcaccgagaccua

SEQ ID NO: 1564087 - RNA, 19 nt, Homo sapiens
ccagaaggagggcaggauu

SEQ ID NO: 1564088 - RNA, 19 nt, Homo sapiens
aaccuuuccuuccugcuuu

SEQ ID NO: 1564089 - RNA, 19 nt, Homo sapiens
uaaagagaucacaccguuu

SEQ ID NO: 1564090 - RNA, 19 nt, Homo sapiens
caugaggaaugccgagucu

SEQ ID NO: 1564091 - RNA, 19 nt, Homo sapiens
gcagacccuuagcagaaca

SEQ ID NO: 1564092 - RNA, 19 nt, Homo sapiens
gaacaauggccugcaagac

SEQ ID NO: 1564093 - RNA, 19 nt, Homo sapiens
caucgagcuugcuuguuuc

SEQ ID NO: 1564094 - RNA, 19 nt, Homo sapiens
ccagacaugauuccauuuc

SEQ ID NO: 1564095 - RNA, 19 nt, Homo sapiens
caagcagcggugccaagua

SEQ ID NO: 1564096 - RNA, 19 nt, Homo sapiens
guggacacauggcuucaag

SEQ ID NO: 1564097 - RNA, 19 nt, Homo sapiens
cagaaggagggcaggauug

SEQ ID NO: 1564098 - RNA, 19 nt, Homo sapiens
gcggaccguauuagucuuu

SEQ ID NO: 1564099 - RNA, 19 nt, Homo sapiens
aaucucaugucccaguuca

SEQ ID NO: 1564100 - RNA, 19 nt, Homo sapiens
ucgcuuaguucugccuuga

SEQ ID NO: 1564101 - RNA, 19 nt, Homo sapiens
uuuccuuccugcuuucuuu

SEQ ID NO: 1564102 - RNA, 19 nt, Homo sapiens
acccuuagcagaacagaaa

SEQ ID NO: 1564103 - RNA, 19 nt, Homo sapiens
cuugaguccugccagugua

SEQ ID NO: 1564104 - RNA, 19 nt, Homo sapiens
aauauggucgagacaauga

SEQ ID NO: 1564105 - RNA, 19 nt, Homo sapiens
cagaaaagcggaccguauu

SEQ ID NO: 1564106 - RNA, 19 nt, Homo sapiens
ggaacaguaaauaagacaa

SEQ ID NO: 1564107 - RNA, 19 nt, Homo sapiens
gaauggaagggagcucuca

SEQ ID NO: 1564108 - RNA, 19 nt, Homo sapiens
gggcuaugaugagaugagu

SEQ ID NO: 1564109 - RNA, 19 nt, Homo sapiens
aaagagaucacaccguuuu

SEQ ID NO: 1564110 - RNA, 19 nt, Homo sapiens
gaaggagggcaggauugga

SEQ ID NO: 1564111 - RNA, 19 nt, Homo sapiens
uauauucccguauuuccuu

SEQ ID NO: 1564112 - RNA, 19 nt, Homo sapiens
gcugauggagggauguguu

SEQ ID NO: 1564113 - RNA, 19 nt, Homo sapiens
ggccaggaaugagcaccuu

SEQ ID NO: 1564114 - RNA, 19 nt, Homo sapiens
gauccaauggccuuguuag

SEQ ID NO: 1564115 - RNA, 19 nt, Homo sapiens
gaaucagcauaauuuaacc

SEQ ID NO: 1564116 - RNA, 19 nt, Homo sapiens
cugauggagggauguguua

SEQ ID NO: 1564117 - RNA, 19 nt, Homo sapiens
ccuggaacuuuggcuuuga

SEQ ID NO: 1564118 - RNA, 19 nt, Homo sapiens
cagcccaggugugcuagga

SEQ ID NO: 1564119 - RNA, 19 nt, Homo sapiens
cgaauguagaaucagcaua

SEQ ID NO: 1564120 - RNA, 19 nt, Homo sapiens
gcccagcggaaacaccuuu

SEQ ID NO: 1564121 - RNA, 19 nt, Homo sapiens
uaacuuucacucccugcuu

SEQ ID NO: 1564122 - RNA, 19 nt, Homo sapiens
cagcuucugggcauucuau

SEQ ID NO: 1564123 - RNA, 19 nt, Homo sapiens
aaaucgcccucagaauaug

SEQ ID NO: 1564124 - RNA, 19 nt, Homo sapiens
ggaauccggcagagcucaa

SEQ ID NO: 1564125 - RNA, 19 nt, Homo sapiens
agacuuugauucgcuuagu

SEQ ID NO: 1564126 - RNA, 19 nt, Homo sapiens
ggagggcaggauuggagaa

SEQ ID NO: 1564127 - RNA, 19 nt, Homo sapiens
gagacaaugaaacaagaca

SEQ ID NO: 1564128 - RNA, 19 nt, Homo sapiens
uuaaagggaacugaugaga

SEQ ID NO: 1564129 - RNA, 19 nt, Homo sapiens
uauccuuguucucaccuau

SEQ ID NO: 1564130 - RNA, 19 nt, Homo sapiens
ggaagaaccucucaguuaa

SEQ ID NO: 1564131 - RNA, 19 nt, Homo sapiens
gaaccucucaguuaaauua

SEQ ID NO: 1564132 - RNA, 19 nt, Homo sapiens
ucagacagcuguuucauuu

SEQ ID NO: 1564133 - RNA, 19 nt, Homo sapiens
gggaagaaccucucaguua

SEQ ID NO: 1564134 - RNA, 19 nt, Homo sapiens
ucacguugcuggugcauua

SEQ ID NO: 1564135 - RNA, 19 nt, Homo sapiens
ggagggaaauucaagagaa

SEQ ID NO: 1564136 - RNA, 19 nt, Homo sapiens
ggacuaggaugugucuuaa

SEQ ID NO: 1564137 - RNA, 19 nt, Homo sapiens
uagcaaacauucagcaauu

SEQ ID NO: 1564138 - RNA, 19 nt, Homo sapiens
gcagaggcuuggcucauuu

SEQ ID NO: 1564139 - RNA, 19 nt, Homo sapiens
cgaaacggauauagaugua

SEQ ID NO: 1564140 - RNA, 19 nt, Homo sapiens
gaguauagaugccaaugga

SEQ ID NO: 1564141 - RNA, 19 nt, Homo sapiens
ucacacggcucaacauuca

SEQ ID NO: 1564142 - RNA, 19 nt, Homo sapiens
gaagaaccucucaguuaaa

SEQ ID NO: 1564143 - RNA, 19 nt, Homo sapiens
gugaauggauggaugaaug

SEQ ID NO: 1564144 - RNA, 19 nt, Homo sapiens
gagggaagacggguaaaua

SEQ ID NO: 1564145 - RNA, 19 nt, Homo sapiens
ccaaacggcugucugagau

SEQ ID NO: 1564146 - RNA, 19 nt, Homo sapiens
ggaaacaacgcacaucugu

SEQ ID NO: 1564147 - RNA, 19 nt, Homo sapiens
gauuagaggagauagcaua

SEQ ID NO: 1564148 - RNA, 19 nt, Homo sapiens
gaaccuauuuccucaucug

SEQ ID NO: 1564149 - RNA, 19 nt, Homo sapiens
uuuaagaccuggaguauag

SEQ ID NO: 1564150 - RNA, 19 nt, Homo sapiens
ccuauuuccucaucuguaa

SEQ ID NO: 1564151 - RNA, 19 nt, Homo sapiens
gcugauagcgaaacggaua

SEQ ID NO: 1564152 - RNA, 19 nt, Homo sapiens
ggauguaaagcccuugaua

SEQ ID NO: 1564153 - RNA, 19 nt, Homo sapiens
gcaaagacacaaucaacau

SEQ ID NO: 1564154 - RNA, 19 nt, Homo sapiens
aaacggcugucugagauaa

SEQ ID NO: 1564155 - RNA, 19 nt, Homo sapiens
gaagacggguaaauaaagc

SEQ ID NO: 1564156 - RNA, 19 nt, Homo sapiens
gcagagggaagacggguaa

SEQ ID NO: 1564157 - RNA, 19 nt, Homo sapiens
gaacuuggucucuggaauc

SEQ ID NO: 1564158 - RNA, 19 nt, Homo sapiens
gggaagacggguaaauaaa

SEQ ID NO: 1564159 - RNA, 19 nt, Homo sapiens
gcaaacauucagcaauuau

SEQ ID NO: 1564160 - RNA, 19 nt, Homo sapiens
ggacagagggccagggaau

SEQ ID NO: 1564161 - RNA, 19 nt, Homo sapiens
caaagacacaaucaacauu

SEQ ID NO: 1564162 - RNA, 19 nt, Homo sapiens
ggaugugucuuaagaucau

SEQ ID NO: 1564163 - RNA, 19 nt, Homo sapiens
ggaagacggguaaauaaag

SEQ ID NO: 1564164 - RNA, 19 nt, Homo sapiens
ccacgucucugcaccuugu

SEQ ID NO: 1564165 - RNA, 19 nt, Homo sapiens
cacagugucucuuaaagga

SEQ ID NO: 1564166 - RNA, 19 nt, Homo sapiens
guucuacuauuaucucuca

SEQ ID NO: 1564167 - RNA, 19 nt, Homo sapiens
ucacgugccucuugcuuuc

SEQ ID NO: 1564168 - RNA, 19 nt, Homo sapiens
guacauuccacgcauagaa

SEQ ID NO: 1564169 - RNA, 19 nt, Homo sapiens
ggcagaggcuuggcucauu

SEQ ID NO: 1564170 - RNA, 19 nt, Homo sapiens
ugaauggguuagugaaugu

SEQ ID NO: 1564171 - RNA, 19 nt, Homo sapiens
ggaaauggcagaggcugaa

SEQ ID NO: 1564172 - RNA, 19 nt, Homo sapiens
acuaggaugugucuuaaga

SEQ ID NO: 1564173 - RNA, 19 nt, Homo sapiens
uaaaauuggugacagguuu

SEQ ID NO: 1564174 - RNA, 19 nt, Homo sapiens
ggacugcggucagcuuugg

SEQ ID NO: 1564175 - RNA, 19 nt, Homo sapiens
cuaagugacugguuacucu

SEQ ID NO: 1564176 - RNA, 19 nt, Homo sapiens
ggcucaggcucacuccuua

SEQ ID NO: 1564177 - RNA, 19 nt, Homo sapiens
ggccugaucuccugacucu

SEQ ID NO: 1564178 - RNA, 19 nt, Homo sapiens
ggagacaggacuaggaugu

SEQ ID NO: 1564179 - RNA, 19 nt, Homo sapiens
ggacagcccaggucauaag

SEQ ID NO: 1564180 - RNA, 19 nt, Homo sapiens
gagauagcauagaggagau

SEQ ID NO: 1564181 - RNA, 19 nt, Homo sapiens
gugacagguuuguuucuga

SEQ ID NO: 1564182 - RNA, 19 nt, Homo sapiens
ggcuagaaagcauguguua

SEQ ID NO: 1564183 - RNA, 19 nt, Homo sapiens
gcgaaacggauauagaugu

SEQ ID NO: 1564184 - RNA, 19 nt, Homo sapiens
uaacguauccacccaccuu

SEQ ID NO: 1564185 - RNA, 19 nt, Homo sapiens
ggaagcaccguccuguuuc

SEQ ID NO: 1564186 - RNA, 19 nt, Homo sapiens
uagaggagauagcauagag

SEQ ID NO: 1564187 - RNA, 19 nt, Homo sapiens
caaacaggaauaugugaug

SEQ ID NO: 1564188 - RNA, 19 nt, Homo sapiens
gugacugguuacucuuuaa

SEQ ID NO: 1564189 - RNA, 19 nt, Homo sapiens
uggaagcaccguccuguuu

SEQ ID NO: 1564190 - RNA, 19 nt, Homo sapiens
ucucugcuccugugucaua

SEQ ID NO: 1564191 - RNA, 19 nt, Homo sapiens
caucucugcuccuguguca

SEQ ID NO: 1564192 - RNA, 19 nt, Homo sapiens
gauagcauagaggagauua

SEQ ID NO: 1564193 - RNA, 19 nt, Homo sapiens
ccucuugcuuucuuucuga

SEQ ID NO: 1564194 - RNA, 19 nt, Homo sapiens
agcaaacauucagcaauua

SEQ ID NO: 1564195 - RNA, 19 nt, Homo sapiens
gcccaggucauaaggcuaa

SEQ ID NO: 1564196 - RNA, 19 nt, Homo sapiens
cacccuuaauccacaauuu

SEQ ID NO: 1564197 - RNA, 19 nt, Homo sapiens
ggggacacauuuuggauuu

SEQ ID NO: 1564198 - RNA, 19 nt, Homo sapiens
aagaaccucucaguuaaau

SEQ ID NO: 1564199 - RNA, 19 nt, Homo sapiens
uaggaugugucuuaagauc

SEQ ID NO: 1564200 - RNA, 19 nt, Homo sapiens
cgugagacgucuuuacagu

SEQ ID NO: 1564201 - RNA, 19 nt, Homo sapiens
acagguaggugggugaaug

SEQ ID NO: 1564202 - RNA, 19 nt, Homo sapiens
aauaugugaugcacuggaa

SEQ ID NO: 1564203 - RNA, 19 nt, Homo sapiens
gauguaaagcccuugauac

SEQ ID NO: 1564204 - RNA, 19 nt, Homo sapiens
ccucaugucucuucaucuc

SEQ ID NO: 1564205 - RNA, 19 nt, Homo sapiens
caucaaacaggaauaugug

SEQ ID NO: 1564206 - RNA, 19 nt, Homo sapiens
gaagcaccguccuguuucg

SEQ ID NO: 1564207 - RNA, 19 nt, Homo sapiens
caaacggcugucugagaua

SEQ ID NO: 1564208 - RNA, 19 nt, Homo sapiens
agugacugguuacucuuua

SEQ ID NO: 1564209 - RNA, 19 nt, Homo sapiens
agacaggacuaggaugugu

SEQ ID NO: 1564210 - RNA, 19 nt, Homo sapiens
uagcgaaacggauauagau

SEQ ID NO: 1564211 - RNA, 19 nt, Homo sapiens
uugcuucuaucgacaggua

SEQ ID NO: 1564212 - RNA, 19 nt, Homo sapiens
aaggacagcccaggucaua

SEQ ID NO: 1564213 - RNA, 19 nt, Homo sapiens
gagauuagaggagauagca

SEQ ID NO: 1564214 - RNA, 19 nt, Homo sapiens
ggugacagguuuguuucug

SEQ ID NO: 1564215 - RNA, 19 nt, Homo sapiens
gaugaauggguuagugaau

SEQ ID NO: 1564216 - RNA, 19 nt, Homo sapiens
ggaugaauggguuagugaa

SEQ ID NO: 1564217 - RNA, 19 nt, Homo sapiens
ccagagagcggggagauua

SEQ ID NO: 1564218 - RNA, 19 nt, Homo sapiens
gccagggaaugacagaauc

SEQ ID NO: 1564219 - RNA, 19 nt, Homo sapiens
aggacuaggaugugucuua

SEQ ID NO: 1564220 - RNA, 19 nt, Homo sapiens
cuagaaagcauguguuacu

SEQ ID NO: 1564221 - RNA, 19 nt, Homo sapiens
caauggaugacuugguuga

SEQ ID NO: 1564222 - RNA, 19 nt, Homo sapiens
uauagaugccaauggauga

SEQ ID NO: 1564223 - RNA, 19 nt, Homo sapiens
gacacaaucaacauuuaug

SEQ ID NO: 1564224 - RNA, 19 nt, Homo sapiens
agggaagacggguaaauaa

SEQ ID NO: 1564225 - RNA, 19 nt, Homo sapiens
uagaaagcauguguuacug

SEQ ID NO: 1564226 - RNA, 19 nt, Homo sapiens
uucccuaagugacugguua

SEQ ID NO: 1564227 - RNA, 19 nt, Homo sapiens
ggcagaggcugaagaaacc

SEQ ID NO: 1564228 - RNA, 19 nt, Homo sapiens
ccagagugcaggacuagga

SEQ ID NO: 1564229 - RNA, 19 nt, Homo sapiens
ccaucaaacaggaauaugu

SEQ ID NO: 1564230 - RNA, 19 nt, Homo sapiens
gaaaucagcccucacagua

SEQ ID NO: 1564231 - RNA, 19 nt, Homo sapiens
gagaaacccuauaaaugua

SEQ ID NO: 1564232 - RNA, 19 nt, Homo sapiens
ucaaauaacuggugugguu

SEQ ID NO: 1564233 - RNA, 19 nt, Homo sapiens
gagagaaagucuaugauug

SEQ ID NO: 1564234 - RNA, 19 nt, Homo sapiens
ggccaucugugaacuaaua

SEQ ID NO: 1564235 - RNA, 19 nt, Homo sapiens
gagaaagucuaugauugua

SEQ ID NO: 1564236 - RNA, 19 nt, Homo sapiens
gagaaacacuaugaaugua

SEQ ID NO: 1564237 - RNA, 19 nt, Homo sapiens
gaaggaaucuugccucacu

SEQ ID NO: 1564238 - RNA, 19 nt, Homo sapiens
gagaaagccuugaagaagu

SEQ ID NO: 1564239 - RNA, 19 nt, Homo sapiens
caaguccuguuauauagua

SEQ ID NO: 1564240 - RNA, 19 nt, Homo sapiens
gaaagucuaugauuguaag

SEQ ID NO: 1564241 - RNA, 19 nt, Homo sapiens
ccagagaccuacuuaacaa

SEQ ID NO: 1564242 - RNA, 19 nt, Homo sapiens
uaagaaaugugggaaauuc

SEQ ID NO: 1564243 - RNA, 19 nt, Homo sapiens
uguaaagacuccugcuaua

SEQ ID NO: 1564244 - RNA, 19 nt, Homo sapiens
ucagagaacucaggagaaa

SEQ ID NO: 1564245 - RNA, 19 nt, Homo sapiens
gaacucacaugggagagaa

SEQ ID NO: 1564246 - RNA, 19 nt, Homo sapiens
ggagagaaagucuaugauu

SEQ ID NO: 1564247 - RNA, 19 nt, Homo sapiens
gggaaaaccuucuaugaaa

SEQ ID NO: 1564248 - RNA, 19 nt, Homo sapiens
ggucagcccucaccaaaca

SEQ ID NO: 1564249 - RNA, 19 nt, Homo sapiens
gaaauggaagucauaauag

SEQ ID NO: 1564250 - RNA, 19 nt, Homo sapiens
cauuagacaucaaaucuga

SEQ ID NO: 1564251 - RNA, 19 nt, Homo sapiens
ugagaaacccuauaaaugu

SEQ ID NO: 1564252 - RNA, 19 nt, Homo sapiens
aaucaaaccuuacucaaca

SEQ ID NO: 1564253 - RNA, 19 nt, Homo sapiens
gaaggaagacauacaaagu

SEQ ID NO: 1564254 - RNA, 19 nt, Homo sapiens
ggagaucuuucuaugugaa

SEQ ID NO: 1564255 - RNA, 19 nt, Homo sapiens
gugauuaggucaugagugu

SEQ ID NO: 1564256 - RNA, 19 nt, Homo sapiens
caacgguacaccuaaauaa

SEQ ID NO: 1564257 - RNA, 19 nt, Homo sapiens
ugacuuaugucuguucaaa

SEQ ID NO: 1564258 - RNA, 19 nt, Homo sapiens
caccaaacaucaaaggaaa

SEQ ID NO: 1564259 - RNA, 19 nt, Homo sapiens
gaaaugugggaaauucuuu

SEQ ID NO: 1564260 - RNA, 19 nt, Homo sapiens
gcuauagacuggauaacug

SEQ ID NO: 1564261 - RNA, 19 nt, Homo sapiens
uguaagcgcuugcucuuga

SEQ ID NO: 1564262 - RNA, 19 nt, Homo sapiens
cuacagauguccugagugu

SEQ ID NO: 1564263 - RNA, 19 nt, Homo sapiens
ugugugaaaucaaaccuua

SEQ ID NO: 1564264 - RNA, 19 nt, Homo sapiens
gagagaaacacuaugaaug

SEQ ID NO: 1564265 - RNA, 19 nt, Homo sapiens
gaaacacacucaacaucag

SEQ ID NO: 1564266 - RNA, 19 nt, Homo sapiens
gcaacgguacaccuaaaua

SEQ ID NO: 1564267 - RNA, 19 nt, Homo sapiens
gaaguuauaccauacucaa

SEQ ID NO: 1564268 - RNA, 19 nt, Homo sapiens
gaagacauacaaaguacuu

SEQ ID NO: 1564269 - RNA, 19 nt, Homo sapiens
acacagugcucaagugaau

SEQ ID NO: 1564270 - RNA, 19 nt, Homo sapiens
uuucagcgguuauguaauu

SEQ ID NO: 1564271 - RNA, 19 nt, Homo sapiens
gaacaucccgagacaagau

SEQ ID NO: 1564272 - RNA, 19 nt, Homo sapiens
gaagaaaacccuaugaaug

SEQ ID NO: 1564273 - RNA, 19 nt, Homo sapiens
gcaaguguaaugauaguga

SEQ ID NO: 1564274 - RNA, 19 nt, Homo sapiens
ggaaaaccuucuaugaaaa

SEQ ID NO: 1564275 - RNA, 19 nt, Homo sapiens
gugagaaacccuauaaaug

SEQ ID NO: 1564276 - RNA, 19 nt, Homo sapiens
gaaaucaaaccuuacucaa

SEQ ID NO: 1564277 - RNA, 19 nt, Homo sapiens
uaaagacuccugcuauaga

SEQ ID NO: 1564278 - RNA, 19 nt, Homo sapiens
gaacaucagagaacucaca

SEQ ID NO: 1564279 - RNA, 19 nt, Homo sapiens
agaaagccuugaagaaguu

SEQ ID NO: 1564280 - RNA, 19 nt, Homo sapiens
ugucggagguugccaagaa

SEQ ID NO: 1564281 - RNA, 19 nt, Homo sapiens
ggagagaaacacuaugaau

SEQ ID NO: 1564282 - RNA, 19 nt, Homo sapiens
aagauaauguccuucagaa

SEQ ID NO: 1564283 - RNA, 19 nt, Homo sapiens
caauaaauguggagaaagc

SEQ ID NO: 1564284 - RNA, 19 nt, Homo sapiens
ggugagaaacccuauaaau

SEQ ID NO: 1564285 - RNA, 19 nt, Homo sapiens
ucaaaucugaugacacuuu

SEQ ID NO: 1564286 - RNA, 19 nt, Homo sapiens
gaagacacagugagaagau

SEQ ID NO: 1564287 - RNA, 19 nt, Homo sapiens
ccugaugaguguaaagaaa

SEQ ID NO: 1564288 - RNA, 19 nt, Homo sapiens
uaccuacucuugacuuuau

SEQ ID NO: 1564289 - RNA, 19 nt, Homo sapiens
uaaggcagcccucauuaga

SEQ ID NO: 1564290 - RNA, 19 nt, Homo sapiens
gaaagauaauguccuucag

SEQ ID NO: 1564291 - RNA, 19 nt, Homo sapiens
gguaauaaaugugagaaac

SEQ ID NO: 1564292 - RNA, 19 nt, Homo sapiens
uaacacagugcucaaguga

SEQ ID NO: 1564293 - RNA, 19 nt, Homo sapiens
uaauaaggcagcccucauu

SEQ ID NO: 1564294 - RNA, 19 nt, Homo sapiens
cuggauaacugcuucaugu

SEQ ID NO: 1564295 - RNA, 19 nt, Homo sapiens
uaacuggugugguuucucu

SEQ ID NO: 1564296 - RNA, 19 nt, Homo sapiens
cugaauaacucaucauguc

SEQ ID NO: 1564297 - RNA, 19 nt, Homo sapiens
cccagcaaguguaaugaua

SEQ ID NO: 1564298 - RNA, 19 nt, Homo sapiens
ugaagaaguuauaccauac

SEQ ID NO: 1564299 - RNA, 19 nt, Homo sapiens
ccuauucuaugaaauggaa

SEQ ID NO: 1564300 - RNA, 19 nt, Homo sapiens
uguggaaccuucaugaaug

SEQ ID NO: 1564301 - RNA, 19 nt, Homo sapiens
cagggagggucagagaaua

SEQ ID NO: 1564302 - RNA, 19 nt, Homo sapiens
gauaauguccuucagaaaa

SEQ ID NO: 1564303 - RNA, 19 nt, Homo sapiens
cuuuauaccugguuaacaa

SEQ ID NO: 1564304 - RNA, 19 nt, Homo sapiens
aauaaugggcguaaugaaa

SEQ ID NO: 1564305 - RNA, 19 nt, Homo sapiens
caaguguaaugauagugaa

SEQ ID NO: 1564306 - RNA, 19 nt, Homo sapiens
aagcaugccuuacucaaca

SEQ ID NO: 1564307 - RNA, 19 nt, Homo sapiens
agaccuacuuaacaacuuu

SEQ ID NO: 1564308 - RNA, 19 nt, Homo sapiens
agagaaacacuaugaaugu

SEQ ID NO: 1564309 - RNA, 19 nt, Homo sapiens
gagaccuacuuaacaacuu

SEQ ID NO: 1564310 - RNA, 19 nt, Homo sapiens
ggaaaacacacaagaagaa

SEQ ID NO: 1564311 - RNA, 19 nt, Homo sapiens
aagguuaaaugaaggaaga

SEQ ID NO: 1564312 - RNA, 19 nt, Homo sapiens
ccuagaacuguaagaaaua

SEQ ID NO: 1564313 - RNA, 19 nt, Homo sapiens
gaaaacuaauccccaaugu

SEQ ID NO: 1564314 - RNA, 19 nt, Homo sapiens
ccucagcagugacaagaga

SEQ ID NO: 1564315 - RNA, 19 nt, Homo sapiens
cuggagaucuuucuaugug

SEQ ID NO: 1564316 - RNA, 19 nt, Homo sapiens
caggagagaaagucuauga

SEQ ID NO: 1564317 - RNA, 19 nt, Homo sapiens
gaaaaccuaugacugcaau

SEQ ID NO: 1564318 - RNA, 19 nt, Homo sapiens
ugaaacacacucaacauca

SEQ ID NO: 1564319 - RNA, 19 nt, Homo sapiens
ucagagaacccacacaaca

SEQ ID NO: 1564320 - RNA, 19 nt, Homo sapiens
aaucaaacuuuacccaaca

SEQ ID NO: 1564321 - RNA, 19 nt, Homo sapiens
guaauugugccucauuuua

SEQ ID NO: 1564322 - RNA, 19 nt, Homo sapiens
ccacugcccauucauaugu

SEQ ID NO: 1564323 - RNA, 19 nt, Homo sapiens
guaaagacuccugcuauag

SEQ ID NO: 1564324 - RNA, 19 nt, Homo sapiens
cgguacaccuaaauaaaga

SEQ ID NO: 1564325 - RNA, 19 nt, Homo sapiens
guaaugauagugaaagagu

SEQ ID NO: 1564326 - RNA, 19 nt, Homo sapiens
aaggaagacauacaaagua

SEQ ID NO: 1564327 - RNA, 19 nt, Homo sapiens
gcuaugcuuggcuuuauuu

SEQ ID NO: 1564328 - RNA, 19 nt, Homo sapiens
gaagucauaauaguagcua

SEQ ID NO: 1564329 - RNA, 19 nt, Homo sapiens
cccuagaacuguaagaaau

SEQ ID NO: 1564330 - RNA, 19 nt, Homo sapiens
ggaaagagcuagagugaaa

SEQ ID NO: 1564331 - RNA, 19 nt, Homo sapiens
gaaaugaucuccuuagaau

SEQ ID NO: 1564332 - RNA, 19 nt, Homo sapiens
gaacugucaucaucuuaua

SEQ ID NO: 1564333 - RNA, 19 nt, Homo sapiens
guucagcacuucuagaaua

SEQ ID NO: 1564334 - RNA, 19 nt, Homo sapiens
gcacagcagucauugagaa

SEQ ID NO: 1564335 - RNA, 19 nt, Homo sapiens
caaauaaacccuuggauug

SEQ ID NO: 1564336 - RNA, 19 nt, Homo sapiens
gcaaaguucugcaccaaau

SEQ ID NO: 1564337 - RNA, 19 nt, Homo sapiens
gcaauaaccacuccauaaa

SEQ ID NO: 1564338 - RNA, 19 nt, Homo sapiens
gcucauauguuuagaaugg

SEQ ID NO: 1564339 - RNA, 19 nt, Homo sapiens
caaacuaccuuccggaaau

SEQ ID NO: 1564340 - RNA, 19 nt, Homo sapiens
ucagagauguuguaaaugu

SEQ ID NO: 1564341 - RNA, 19 nt, Homo sapiens
uaaaggcucugcaaaguuc

SEQ ID NO: 1564342 - RNA, 19 nt, Homo sapiens
caagacaaguuucucaaug

SEQ ID NO: 1564343 - RNA, 19 nt, Homo sapiens
ugauucagcuguuccauuu

SEQ ID NO: 1564344 - RNA, 19 nt, Homo sapiens
gaacuggcuucucagcauu

SEQ ID NO: 1564345 - RNA, 19 nt, Homo sapiens
gucaagcaaucccaacuua

SEQ ID NO: 1564346 - RNA, 19 nt, Homo sapiens
guacuugugucccuuccua

SEQ ID NO: 1564347 - RNA, 19 nt, Homo sapiens
caagagagcugggaaacuc

SEQ ID NO: 1564348 - RNA, 19 nt, Homo sapiens
uaacacagguuggcauuuc

SEQ ID NO: 1564349 - RNA, 19 nt, Homo sapiens
uaaaagagcuccagguguu

SEQ ID NO: 1564350 - RNA, 19 nt, Homo sapiens
gaaaucgcguggacugcaa

SEQ ID NO: 1564351 - RNA, 19 nt, Homo sapiens
ccaaugccauguuuccaaa

SEQ ID NO: 1564352 - RNA, 19 nt, Homo sapiens
uccauauucucccuuauua

SEQ ID NO: 1564353 - RNA, 19 nt, Homo sapiens
gaaugaaccaugcaaacuu

SEQ ID NO: 1564354 - RNA, 19 nt, Homo sapiens
uuacugaacugucaucauc

SEQ ID NO: 1564355 - RNA, 19 nt, Homo sapiens
uaaaauaucugcguacuug

SEQ ID NO: 1564356 - RNA, 19 nt, Homo sapiens
ucaagcacauacugcauuu

SEQ ID NO: 1564357 - RNA, 19 nt, Homo sapiens
ugagucuucuuauccaaua

SEQ ID NO: 1564358 - RNA, 19 nt, Homo sapiens
gcuguuccauuuccauauu

SEQ ID NO: 1564359 - RNA, 19 nt, Homo sapiens
aaucucaguucaucucuuu

SEQ ID NO: 1564360 - RNA, 19 nt, Homo sapiens
ggucuccucuuccggcuuu

SEQ ID NO: 1564361 - RNA, 19 nt, Homo sapiens
ucaccaucguguuuaauuu

SEQ ID NO: 1564362 - RNA, 19 nt, Homo sapiens
aaugaaccaugcaaacuuu

SEQ ID NO: 1564363 - RNA, 19 nt, Homo sapiens
guuaaggaauccagauguu

SEQ ID NO: 1564364 - RNA, 19 nt, Homo sapiens
caacacagacaguacaaug

SEQ ID NO: 1564365 - RNA, 19 nt, Homo sapiens
gaauuguuguugucuuuag

SEQ ID NO: 1564366 - RNA, 19 nt, Homo sapiens
acacacagguacuuucaga

SEQ ID NO: 1564367 - RNA, 19 nt, Homo sapiens
gacaguacaaugacaaauu

SEQ ID NO: 1564368 - RNA, 19 nt, Homo sapiens
gagauguuguaaaugugua

SEQ ID NO: 1564369 - RNA, 19 nt, Homo sapiens
uuaaagccauucagagaug

SEQ ID NO: 1564370 - RNA, 19 nt, Homo sapiens
uagagcacuuuguauauug

SEQ ID NO: 1564371 - RNA, 19 nt, Homo sapiens
gcacuuauucaagcacaua

SEQ ID NO: 1564372 - RNA, 19 nt, Homo sapiens
acaaucuucucgacaauga

SEQ ID NO: 1564373 - RNA, 19 nt, Homo sapiens
cauggagucuugugaaauc

SEQ ID NO: 1564374 - RNA, 19 nt, Homo sapiens
guucaucucuuugagcuau

SEQ ID NO: 1564375 - RNA, 19 nt, Homo sapiens
caagcaaucccaacuuaug

SEQ ID NO: 1564376 - RNA, 19 nt, Homo sapiens
caauguuccucuucauaug

SEQ ID NO: 1564377 - RNA, 19 nt, Homo sapiens
ccaauguucauaacuguuu

SEQ ID NO: 1564378 - RNA, 19 nt, Homo sapiens
ugagauagucauuguugua

SEQ ID NO: 1564379 - RNA, 19 nt, Homo sapiens
uggaauuguuguugucuuu

SEQ ID NO: 1564380 - RNA, 19 nt, Homo sapiens
aauaaccacuccauaaaca

SEQ ID NO: 1564381 - RNA, 19 nt, Homo sapiens
uagagagugugcugugaaa

SEQ ID NO: 1564382 - RNA, 19 nt, Homo sapiens
aaaccacacugcuuuacug

SEQ ID NO: 1564383 - RNA, 19 nt, Homo sapiens
gagaucauacugaauauac

SEQ ID NO: 1564384 - RNA, 19 nt, Homo sapiens
acauugagaucauacugaa

SEQ ID NO: 1564385 - RNA, 19 nt, Homo sapiens
cauauucucccuuauuaga

SEQ ID NO: 1564386 - RNA, 19 nt, Homo sapiens
ggaauuguuguugucuuua

SEQ ID NO: 1564387 - RNA, 19 nt, Homo sapiens
ggaaacucuuggacaguca

SEQ ID NO: 1564388 - RNA, 19 nt, Homo sapiens
gcaagacaaguuucucaau

SEQ ID NO: 1564389 - RNA, 19 nt, Homo sapiens
gccacaggcugaaguguca

SEQ ID NO: 1564390 - RNA, 19 nt, Homo sapiens
uaaccacuccauaaacaaa

SEQ ID NO: 1564391 - RNA, 19 nt, Homo sapiens
ccacacugcuuuacugaac

SEQ ID NO: 1564392 - RNA, 19 nt, Homo sapiens
ugaaaugaucuccuuagaa

SEQ ID NO: 1564393 - RNA, 19 nt, Homo sapiens
caaaguucugcaccaaaua

SEQ ID NO: 1564394 - RNA, 19 nt, Homo sapiens
ccuauaaucucaguucauc

SEQ ID NO: 1564395 - RNA, 19 nt, Homo sapiens
acaaugagauagaaugaac

SEQ ID NO: 1564396 - RNA, 19 nt, Homo sapiens
cgacaaugagauagaauga

SEQ ID NO: 1564397 - RNA, 19 nt, Homo sapiens
ucugaugguugcccuguuu

SEQ ID NO: 1564398 - RNA, 19 nt, Homo sapiens
aaaguucugcaccaaauaa

SEQ ID NO: 1564399 - RNA, 19 nt, Homo sapiens
ccaaggggcugaagauaga

SEQ ID NO: 1564400 - RNA, 19 nt, Homo sapiens
ucaaacaacacagacagua

SEQ ID NO: 1564401 - RNA, 19 nt, Homo sapiens
gagauagucauuguuguau

SEQ ID NO: 1564402 - RNA, 19 nt, Homo sapiens
uguuagagcacuuuguaua

SEQ ID NO: 1564403 - RNA, 19 nt, Homo sapiens
uaugacugguuuccaacua

SEQ ID NO: 1564404 - RNA, 19 nt, Homo sapiens
uaggaaagagcuagaguga

SEQ ID NO: 1564405 - RNA, 19 nt, Homo sapiens
gaauaaagucaugcaauac

SEQ ID NO: 1564406 - RNA, 19 nt, Homo sapiens
auucuugucugauugcuuu

SEQ ID NO: 1564407 - RNA, 19 nt, Homo sapiens
guuagagcacuuuguauau

SEQ ID NO: 1564408 - RNA, 19 nt, Homo sapiens
ucaauguuccucuucauau

SEQ ID NO: 1564409 - RNA, 19 nt, Homo sapiens
ugcaauaaccacuccauaa

SEQ ID NO: 1564410 - RNA, 19 nt, Homo sapiens
guuuaaagccauucagaga

SEQ ID NO: 1564411 - RNA, 19 nt, Homo sapiens
gauugauaaugaccuugaa

SEQ ID NO: 1564412 - RNA, 19 nt, Homo sapiens
caauauauuucaccaucgu

SEQ ID NO: 1564413 - RNA, 19 nt, Homo sapiens
aauuggagaucagcucuaa

SEQ ID NO: 1564414 - RNA, 19 nt, Homo sapiens
guaugucuuuauugcauug

SEQ ID NO: 1564415 - RNA, 19 nt, Homo sapiens
ugucaacacuucaaacaac

SEQ ID NO: 1564416 - RNA, 19 nt, Homo sapiens
uuaaggaauccagauguua

SEQ ID NO: 1564417 - RNA, 19 nt, Homo sapiens
ggaacacccagcugugaga

SEQ ID NO: 1564418 - RNA, 19 nt, Homo sapiens
ugaccacuauauuauguuc

SEQ ID NO: 1564419 - RNA, 19 nt, Homo sapiens
cauguaacccuuuguucuu

SEQ ID NO: 1564420 - RNA, 19 nt, Homo sapiens
cugaaaugaucuccuuaga

SEQ ID NO: 1564421 - RNA, 19 nt, Homo sapiens
cuccagguguugucuguuu

SEQ ID NO: 1564422 - RNA, 19 nt, Homo sapiens
ucucccauauuugcucuua

SEQ ID NO: 1564423 - RNA, 19 nt, Homo sapiens
gaagaaacacacagguacu

SEQ ID NO: 1564424 - RNA, 19 nt, Homo sapiens
uccugcaaauguauuguua

SEQ ID NO: 1564425 - RNA, 19 nt, Homo sapiens
ccuaaaugcuuacuaugac

SEQ ID NO: 1564426 - RNA, 19 nt, Homo sapiens
cuucugaaaugaucuccuu

SEQ ID NO: 1564427 - RNA, 19 nt, Homo sapiens
aaacacacagguacuuuca

SEQ ID NO: 1564428 - RNA, 19 nt, Homo sapiens
cagguuggcauuucuucua

SEQ ID NO: 1564429 - RNA, 19 nt, Homo sapiens
cagcacuucuagaauaaag

SEQ ID NO: 1564430 - RNA, 19 nt, Homo sapiens
gaacaaagaugaauagaug

SEQ ID NO: 1564431 - RNA, 19 nt, Homo sapiens
gaagaaagauggauagaug

SEQ ID NO: 1564432 - RNA, 19 nt, Homo sapiens
gaaccaaggugaggaauug

SEQ ID NO: 1564433 - RNA, 19 nt, Homo sapiens
gaacauaacgcuccuuuua

SEQ ID NO: 1564434 - RNA, 19 nt, Homo sapiens
gaaguaagguaggaagaaa

SEQ ID NO: 1564435 - RNA, 19 nt, Homo sapiens
gcaaggcuauggagaagaa

SEQ ID NO: 1564436 - RNA, 19 nt, Homo sapiens
gaaagacaaagcaacaaua

SEQ ID NO: 1564437 - RNA, 19 nt, Homo sapiens
gaacacaaauaacaacagu

SEQ ID NO: 1564438 - RNA, 19 nt, Homo sapiens
gaaagaaggaggaaauaug

SEQ ID NO: 1564439 - RNA, 19 nt, Homo sapiens
gaagaaggaugggucaaug

SEQ ID NO: 1564440 - RNA, 19 nt, Homo sapiens
ggucuuaguugaugucuug

SEQ ID NO: 1564441 - RNA, 19 nt, Homo sapiens
gcaaauggauggaugaaaa

SEQ ID NO: 1564442 - RNA, 19 nt, Homo sapiens
uaaauaccaugcacuaugu

SEQ ID NO: 1564443 - RNA, 19 nt, Homo sapiens
gaaggaacaaagaugaaua

SEQ ID NO: 1564444 - RNA, 19 nt, Homo sapiens
gaaggaagaaagauggaua

SEQ ID NO: 1564445 - RNA, 19 nt, Homo sapiens
gaaaggaagaaguaaggua

SEQ ID NO: 1564446 - RNA, 19 nt, Homo sapiens
ccacacugcuacuccauuu

SEQ ID NO: 1564447 - RNA, 19 nt, Homo sapiens
gggaagaaaggaagaagua

SEQ ID NO: 1564448 - RNA, 19 nt, Homo sapiens
gaaagaggaagucaaggaa

SEQ ID NO: 1564449 - RNA, 19 nt, Homo sapiens
gaagcaaggcuauggagaa

SEQ ID NO: 1564450 - RNA, 19 nt, Homo sapiens
gaaagaagggagagaggaa

SEQ ID NO: 1564451 - RNA, 19 nt, Homo sapiens
gaaagaagggagagaggaa

SEQ ID NO: 1564452 - RNA, 19 nt, Homo sapiens
ggaaagaggaagucaagga

SEQ ID NO: 1564453 - RNA, 19 nt, Homo sapiens
caaaagaaguuggagauuu

SEQ ID NO: 1564454 - RNA, 19 nt, Homo sapiens
guaaauaccaugcacuaug

SEQ ID NO: 1564455 - RNA, 19 nt, Homo sapiens
gaacuaaucaaaagccuua

SEQ ID NO: 1564456 - RNA, 19 nt, Homo sapiens
gaaggaggaaauauggaua

SEQ ID NO: 1564457 - RNA, 19 nt, Homo sapiens
cacguucucuuauauacua

SEQ ID NO: 1564458 - RNA, 19 nt, Homo sapiens
gaaggaaggauauauggau

SEQ ID NO: 1564459 - RNA, 19 nt, Homo sapiens
gaaauuuccacccaaugaa

SEQ ID NO: 1564460 - RNA, 19 nt, Homo sapiens
gcacucguguggugauaau

SEQ ID NO: 1564461 - RNA, 19 nt, Homo sapiens
aacuggagcugcaacaaua

SEQ ID NO: 1564462 - RNA, 19 nt, Homo sapiens
ccaaugaaaggaagaacua

SEQ ID NO: 1564463 - RNA, 19 nt, Homo sapiens
gaaggaaggaagaaagaug

SEQ ID NO: 1564464 - RNA, 19 nt, Homo sapiens
ucaguuggcaauugauuua

SEQ ID NO: 1564465 - RNA, 19 nt, Homo sapiens
auaauucaguccaguguuu

SEQ ID NO: 1564466 - RNA, 19 nt, Homo sapiens
gguuuggccuggaaauauu

SEQ ID NO: 1564467 - RNA, 19 nt, Homo sapiens
ggacagaacauuagguuuu

SEQ ID NO: 1564468 - RNA, 19 nt, Homo sapiens
ggaaggauauauggaugga

SEQ ID NO: 1564469 - RNA, 19 nt, Homo sapiens
ggaaagacaaagcaacaau

SEQ ID NO: 1564470 - RNA, 19 nt, Homo sapiens
ggaaagaaggaggaaauau

SEQ ID NO: 1564471 - RNA, 19 nt, Homo sapiens
gaggaaggaacaaagauga

SEQ ID NO: 1564472 - RNA, 19 nt, Homo sapiens
gaagaaggaggaaggaaca

SEQ ID NO: 1564473 - RNA, 19 nt, Homo sapiens
gaaggaaggaaggauauau

SEQ ID NO: 1564474 - RNA, 19 nt, Homo sapiens
cuucauaugucaagguauu

SEQ ID NO: 1564475 - RNA, 19 nt, Homo sapiens
ggucuguacuguugugaug

SEQ ID NO: 1564476 - RNA, 19 nt, Homo sapiens
gagaaggaaggaagaaaga

SEQ ID NO: 1564477 - RNA, 19 nt, Homo sapiens
gaaggaugggucaaugaaa

SEQ ID NO: 1564478 - RNA, 19 nt, Homo sapiens
gaaagauggauagauggua

SEQ ID NO: 1564479 - RNA, 19 nt, Homo sapiens
guuaauagcccauuuugua

SEQ ID NO: 1564480 - RNA, 19 nt, Homo sapiens
guacuguugugauggaaau

SEQ ID NO: 1564481 - RNA, 19 nt, Homo sapiens
uagccuaggucucucuauu

SEQ ID NO: 1564482 - RNA, 19 nt, Homo sapiens
caaauuucccugauucuuc

SEQ ID NO: 1564483 - RNA, 19 nt, Homo sapiens
augaauagauggauagaug

SEQ ID NO: 1564484 - RNA, 19 nt, Homo sapiens
ggaagaaaggaagaaguaa

SEQ ID NO: 1564485 - RNA, 19 nt, Homo sapiens
gguccuaggcccagaauau

SEQ ID NO: 1564486 - RNA, 19 nt, Homo sapiens
gguguuggccaaacucuuu

SEQ ID NO: 1564487 - RNA, 19 nt, Homo sapiens
gaagaaaggaagaaguaag

SEQ ID NO: 1564488 - RNA, 19 nt, Homo sapiens
ggaaggaaggaaggauaua

SEQ ID NO: 1564489 - RNA, 19 nt, Homo sapiens
caagcaucaucagauauuu

SEQ ID NO: 1564490 - RNA, 19 nt, Homo sapiens
auucaagcaucaucagaua

SEQ ID NO: 1564491 - RNA, 19 nt, Homo sapiens
gccaauagaaaucaagaaa

SEQ ID NO: 1564492 - RNA, 19 nt, Homo sapiens
gcaacaauagcucuacaga

SEQ ID NO: 1564493 - RNA, 19 nt, Homo sapiens
cugaguggguucuaauaaa

SEQ ID NO: 1564494 - RNA, 19 nt, Homo sapiens
cauaccacaucuucacauu

SEQ ID NO: 1564495 - RNA, 19 nt, Homo sapiens
ggaacaaagaugaauagau

SEQ ID NO: 1564496 - RNA, 19 nt, Homo sapiens
ucaagcaucaucagauauu

SEQ ID NO: 1564497 - RNA, 19 nt, Homo sapiens
cauaugcugccaauacuuu

SEQ ID NO: 1564498 - RNA, 19 nt, Homo sapiens
gcaguuuguuggaaugaca

SEQ ID NO: 1564499 - RNA, 19 nt, Homo sapiens
cuaggucucucuauuucuu

SEQ ID NO: 1564500 - RNA, 19 nt, Homo sapiens
guagaaacuuuagauuugg

SEQ ID NO: 1564501 - RNA, 19 nt, Homo sapiens
ugucaggcaucccuagaaa

SEQ ID NO: 1564502 - RNA, 19 nt, Homo sapiens
ugucaaauuucccugauuc

SEQ ID NO: 1564503 - RNA, 19 nt, Homo sapiens
caucauggagugggucuua

SEQ ID NO: 1564504 - RNA, 19 nt, Homo sapiens
cuuaguugaugucuuguuu

SEQ ID NO: 1564505 - RNA, 19 nt, Homo sapiens
ggagagaggagagaaggaa

SEQ ID NO: 1564506 - RNA, 19 nt, Homo sapiens
caucaggagccaauagaaa

SEQ ID NO: 1564507 - RNA, 19 nt, Homo sapiens
gcguuaggcucaaaagaua

SEQ ID NO: 1564508 - RNA, 19 nt, Homo sapiens
ggaaggcucacaugcacaa

SEQ ID NO: 1564509 - RNA, 19 nt, Homo sapiens
gaauggauggcaagaagga

SEQ ID NO: 1564510 - RNA, 19 nt, Homo sapiens
aaauuucccugauucuuca

SEQ ID NO: 1564511 - RNA, 19 nt, Homo sapiens
ggaaggaaggaaagaagga

SEQ ID NO: 1564512 - RNA, 19 nt, Homo sapiens
ggaaggaaggaaugaagga

SEQ ID NO: 1564513 - RNA, 19 nt, Homo sapiens
ggaccuaucagcuccacuu

SEQ ID NO: 1564514 - RNA, 19 nt, Homo sapiens
acaaauaacaacaguggaa

SEQ ID NO: 1564515 - RNA, 19 nt, Homo sapiens
ggaagaaggaugggucaau

SEQ ID NO: 1564516 - RNA, 19 nt, Homo sapiens
ggaggaaggaacaaagaug

SEQ ID NO: 1564517 - RNA, 19 nt, Homo sapiens
gccuaggucucucuauuuc

SEQ ID NO: 1564518 - RNA, 19 nt, Homo sapiens
guaauuccgaugucaguga

SEQ ID NO: 1564519 - RNA, 19 nt, Homo sapiens
ugaguggguucuaauaaag

SEQ ID NO: 1564520 - RNA, 19 nt, Homo sapiens
ucacauugguucugaucug

SEQ ID NO: 1564521 - RNA, 19 nt, Homo sapiens
gagagaggaaggaaggaaa

SEQ ID NO: 1564522 - RNA, 19 nt, Homo sapiens
gagagaggaaggaaggaaa

SEQ ID NO: 1564523 - RNA, 19 nt, Homo sapiens
gaggaaagaggaagucaag

SEQ ID NO: 1564524 - RNA, 19 nt, Homo sapiens
gaaagaggaaagaggaagu

SEQ ID NO: 1564525 - RNA, 19 nt, Homo sapiens
ggccugccacguucucuua

SEQ ID NO: 1564526 - RNA, 19 nt, Homo sapiens
gaaggaaugaaggaaagaa

SEQ ID NO: 1564527 - RNA, 19 nt, Homo sapiens
gaaggaaggaaugaaggaa

SEQ ID NO: 1564528 - RNA, 19 nt, Homo sapiens
gaauagauggauagaugga

SEQ ID NO: 1564529 - RNA, 19 nt, Homo sapiens
ggaaggaacaaagaugaau

SEQ ID NO: 1564530 - RNA, 19 nt, Homo sapiens
cagcaaaccaucuagauua

SEQ ID NO: 1564531 - RNA, 19 nt, Homo sapiens
gaaacccugucucuacuaa

SEQ ID NO: 1564532 - RNA, 19 nt, Homo sapiens
gcugcgagcucgaaacuuu

SEQ ID NO: 1564533 - RNA, 19 nt, Homo sapiens
gcagaaauccgaagacaug

SEQ ID NO: 1564534 - RNA, 19 nt, Homo sapiens
gcauauacguagagucuga

SEQ ID NO: 1564535 - RNA, 19 nt, Homo sapiens
gcaggaagauugugauucu

SEQ ID NO: 1564536 - RNA, 19 nt, Homo sapiens
ugagaacgcugaagaugau

SEQ ID NO: 1564537 - RNA, 19 nt, Homo sapiens
ccaagugccugaccaagau

SEQ ID NO: 1564538 - RNA, 19 nt, Homo sapiens
ucaagucguucaugaguga

SEQ ID NO: 1564539 - RNA, 19 nt, Homo sapiens
cugagacccugaagaauuu

SEQ ID NO: 1564540 - RNA, 19 nt, Homo sapiens
gaagcaaauuauccugaga

SEQ ID NO: 1564541 - RNA, 19 nt, Homo sapiens
ugaccaagaucaacuaugg

SEQ ID NO: 1564542 - RNA, 19 nt, Homo sapiens
ggaagcaggagcugacaaa

SEQ ID NO: 1564543 - RNA, 19 nt, Homo sapiens
gagcagagaagcccuguuc

SEQ ID NO: 1564544 - RNA, 19 nt, Homo sapiens
gcaguuugcuucagauggu

SEQ ID NO: 1564545 - RNA, 19 nt, Homo sapiens
caaaccaucuagauuaaac

SEQ ID NO: 1564546 - RNA, 19 nt, Homo sapiens
gcaggagaaucgcuuguac

SEQ ID NO: 1564547 - RNA, 19 nt, Homo sapiens
gcagagugcuagggagaug

SEQ ID NO: 1564548 - RNA, 19 nt, Homo sapiens
gagcugcuguugcaugagu

SEQ ID NO: 1564549 - RNA, 19 nt, Homo sapiens
agaaugcggcugagaauga

SEQ ID NO: 1564550 - RNA, 19 nt, Homo sapiens
gcgcuacaaugcccacaug

SEQ ID NO: 1564551 - RNA, 19 nt, Homo sapiens
gagacacgcaggaagauug

SEQ ID NO: 1564552 - RNA, 19 nt, Homo sapiens
gaggagacacgcaggaaga

SEQ ID NO: 1564553 - RNA, 19 nt, Homo sapiens
gcccaaugcugaugacuac

SEQ ID NO: 1564554 - RNA, 19 nt, Homo sapiens
ccugagacccugaagaauu

SEQ ID NO: 1564555 - RNA, 19 nt, Homo sapiens
agcaaaccaucuagauuaa

SEQ ID NO: 1564556 - RNA, 19 nt, Homo sapiens
gugcucagguggcaguuug

SEQ ID NO: 1564557 - RNA, 19 nt, Homo sapiens
gugagcugcuguugcauga

SEQ ID NO: 1564558 - RNA, 19 nt, Homo sapiens
aggaagcgcuggccagguu

SEQ ID NO: 1564559 - RNA, 19 nt, Homo sapiens
aacaagaccuggacaacau

SEQ ID NO: 1564560 - RNA, 19 nt, Homo sapiens
gguggcaguuugcuucaga

SEQ ID NO: 1564561 - RNA, 19 nt, Homo sapiens
ccacgaggcauuccuguuc

SEQ ID NO: 1564562 - RNA, 19 nt, Homo sapiens
gcaaaccaucuagauuaaa

SEQ ID NO: 1564563 - RNA, 19 nt, Homo sapiens
agaaacagcaaaccaucua

SEQ ID NO: 1564564 - RNA, 19 nt, Homo sapiens
aaagaacauuggacaugga

SEQ ID NO: 1564565 - RNA, 19 nt, Homo sapiens
ggugaaacccugucucuac

SEQ ID NO: 1564566 - RNA, 19 nt, Homo sapiens
ccuauaaucccagcaguuu

SEQ ID NO: 1564567 - RNA, 19 nt, Homo sapiens
ccagcugccuguggaguuu

SEQ ID NO: 1564568 - RNA, 19 nt, Homo sapiens
caacaagaccuggacaaca

SEQ ID NO: 1564569 - RNA, 19 nt, Homo sapiens
gaaugagaacgcugaagau

SEQ ID NO: 1564570 - RNA, 19 nt, Homo sapiens
ugacucggguggucuuugu

SEQ ID NO: 1564571 - RNA, 19 nt, Homo sapiens
caucuagauuaaacuccua

SEQ ID NO: 1564572 - RNA, 19 nt, Homo sapiens
ggaggucuaccagcaguuu

SEQ ID NO: 1564573 - RNA, 19 nt, Homo sapiens
uacgaaggcugcccugugu

SEQ ID NO: 1564574 - RNA, 19 nt, Homo sapiens
gugauccugccaacauuua

SEQ ID NO: 1564575 - RNA, 19 nt, Homo sapiens
agaaugagaacgcugaaga

SEQ ID NO: 1564576 - RNA, 19 nt, Homo sapiens
aggugaggcugcaguauga

SEQ ID NO: 1564577 - RNA, 19 nt, Homo sapiens
caggugcucugcugcuaga

SEQ ID NO: 1564578 - RNA, 19 nt, Homo sapiens
gaaugcggcugagaaugag

SEQ ID NO: 1564579 - RNA, 19 nt, Homo sapiens
agaaagaacauuggacaug

SEQ ID NO: 1564580 - RNA, 19 nt, Homo sapiens
caaugcugaugacuacuuc

SEQ ID NO: 1564581 - RNA, 19 nt, Homo sapiens
gugaaacccugucucuacu

SEQ ID NO: 1564582 - RNA, 19 nt, Homo sapiens
gcccuguucucugcaugua

SEQ ID NO: 1564583 - RNA, 19 nt, Homo sapiens
cagagaaugcggcugagaa

SEQ ID NO: 1564584 - RNA, 19 nt, Homo sapiens
ggucaagucguucaugagu

SEQ ID NO: 1564585 - RNA, 19 nt, Homo sapiens
agauggcgcugaugguguu

SEQ ID NO: 1564586 - RNA, 19 nt, Homo sapiens
ucugugagcugcuguugca

SEQ ID NO: 1564587 - RNA, 19 nt, Homo sapiens
gacuccgucucuaaacaaa

SEQ ID NO: 1564588 - RNA, 19 nt, Homo sapiens
gcaccuguaaucccagcua

SEQ ID NO: 1564589 - RNA, 19 nt, Homo sapiens
gaaacuuugaccugcagaa

SEQ ID NO: 1564590 - RNA, 19 nt, Homo sapiens
cuuggcagcugcaccauuc

SEQ ID NO: 1564591 - RNA, 19 nt, Homo sapiens
gcugugauccugccaacau

SEQ ID NO: 1564592 - RNA, 19 nt, Homo sapiens
gcuagaaacagcaaaccau

SEQ ID NO: 1564593 - RNA, 19 nt, Homo sapiens
gugcauauacguagagucu

SEQ ID NO: 1564594 - RNA, 19 nt, Homo sapiens
cauagcccaugcugaagau

SEQ ID NO: 1564595 - RNA, 19 nt, Homo sapiens
aaacagcaaaccaucuaga

SEQ ID NO: 1564596 - RNA, 19 nt, Homo sapiens
gaaacagcaaaccaucuag

SEQ ID NO: 1564597 - RNA, 19 nt, Homo sapiens
gaagcccuguucucugcau

SEQ ID NO: 1564598 - RNA, 19 nt, Homo sapiens
ggagacacgcaggaagauu

SEQ ID NO: 1564599 - RNA, 19 nt, Homo sapiens
ccuguguacuucaacauca

SEQ ID NO: 1564600 - RNA, 19 nt, Homo sapiens
cugccaacauuuagcuuug

SEQ ID NO: 1564601 - RNA, 19 nt, Homo sapiens
ggguaaccaucagaggaaa

SEQ ID NO: 1564602 - RNA, 19 nt, Homo sapiens
acuuugaccugcagaaauc

SEQ ID NO: 1564603 - RNA, 19 nt, Homo sapiens
agcaggagcugacaaaauu

SEQ ID NO: 1564604 - RNA, 19 nt, Homo sapiens
ccaaugcugaugacuacuu

SEQ ID NO: 1564605 - RNA, 19 nt, Homo sapiens
gcaugagugugagcugcaa

SEQ ID NO: 1564606 - RNA, 19 nt, Homo sapiens
acagcaaaccaucuagauu

SEQ ID NO: 1564607 - RNA, 19 nt, Homo sapiens
gugaggugcccaagagcua

SEQ ID NO: 1564608 - RNA, 19 nt, Homo sapiens
aaacuuugaccugcagaaa

SEQ ID NO: 1564609 - RNA, 19 nt, Homo sapiens
ccaggaggcggagguugua

SEQ ID NO: 1564610 - RNA, 19 nt, Homo sapiens
ugccaccacuggauggaaa

SEQ ID NO: 1564611 - RNA, 19 nt, Homo sapiens
guucaugagugaggagaca

SEQ ID NO: 1564612 - RNA, 19 nt, Homo sapiens
cucagaagcugggcaggaa

SEQ ID NO: 1564613 - RNA, 19 nt, Homo sapiens
gauccggaagcgcaucaaa

SEQ ID NO: 1564614 - RNA, 19 nt, Homo sapiens
uugaguggguaacgacuga

SEQ ID NO: 1564615 - RNA, 19 nt, Homo sapiens
ggcaggagaaucgcuugua

SEQ ID NO: 1564616 - RNA, 19 nt, Homo sapiens
gcaacaagaccuggacaac

SEQ ID NO: 1564617 - RNA, 19 nt, Homo sapiens
acauuuagcuuugguucuc

SEQ ID NO: 1564618 - RNA, 19 nt, Homo sapiens
ggaggcggagguuguagug

SEQ ID NO: 1564619 - RNA, 19 nt, Homo sapiens
ccacgucaccauuucaucu

SEQ ID NO: 1564620 - RNA, 19 nt, Homo sapiens
gcugaugguguuugacaug

SEQ ID NO: 1564621 - RNA, 19 nt, Homo sapiens
gaggucauccagcuguaug

SEQ ID NO: 1564622 - RNA, 19 nt, Homo sapiens
ccaguugaguggguaacga

SEQ ID NO: 1564623 - RNA, 19 nt, Homo sapiens
gagaaugcggcugagaaug

SEQ ID NO: 1564624 - RNA, 19 nt, Homo sapiens
gucaccauuucaucucauu

SEQ ID NO: 1564625 - RNA, 19 nt, Homo sapiens
caggugaggcugcaguaug

SEQ ID NO: 1564626 - RNA, 19 nt, Homo sapiens
cauccuggaagcaaauuau

SEQ ID NO: 1564627 - RNA, 19 nt, Homo sapiens
gcauccuggaagcaaauua

SEQ ID NO: 1564628 - RNA, 19 nt, Homo sapiens
gcgcugaugguguuugaca

SEQ ID NO: 1564629 - RNA, 19 nt, Homo sapiens
caagaccuggacaacauug

SEQ ID NO: 1564630 - RNA, 19 nt, Homo sapiens
uaacaaaccugcacaugua

SEQ ID NO: 1564631 - RNA, 19 nt, Homo sapiens
gauagagaaucaagcauua

SEQ ID NO: 1564632 - RNA, 19 nt, Homo sapiens
cagguaagcuaaaucauua

SEQ ID NO: 1564633 - RNA, 19 nt, Homo sapiens
gaacagaaccgauuucagu

SEQ ID NO: 1564634 - RNA, 19 nt, Homo sapiens
gaacacaaugcacaucuua

SEQ ID NO: 1564635 - RNA, 19 nt, Homo sapiens
acacaaauccuaacguuua

SEQ ID NO: 1564636 - RNA, 19 nt, Homo sapiens
ggccacagauagugaauuu

SEQ ID NO: 1564637 - RNA, 19 nt, Homo sapiens
agaaauggauuacugaaga

SEQ ID NO: 1564638 - RNA, 19 nt, Homo sapiens
cacaugaguugcccacuua

SEQ ID NO: 1564639 - RNA, 19 nt, Homo sapiens
caacuacuaccacagaaua

SEQ ID NO: 1564640 - RNA, 19 nt, Homo sapiens
cagcagaugucauucagaa

SEQ ID NO: 1564641 - RNA, 19 nt, Homo sapiens
gaaccgauuucaguuaaug

SEQ ID NO: 1564642 - RNA, 19 nt, Homo sapiens
ugacacaaguuuaccugua

SEQ ID NO: 1564643 - RNA, 19 nt, Homo sapiens
cuaaacgacuaucuaauug

SEQ ID NO: 1564644 - RNA, 19 nt, Homo sapiens
cagaaccgauuucaguuaa

SEQ ID NO: 1564645 - RNA, 19 nt, Homo sapiens
ggaauauagugacucaaau

SEQ ID NO: 1564646 - RNA, 19 nt, Homo sapiens
caccagaaauguaggauug

SEQ ID NO: 1564647 - RNA, 19 nt, Homo sapiens
acaacaaacuugaaggaaa

SEQ ID NO: 1564648 - RNA, 19 nt, Homo sapiens
gcccuuauauuaacaacaa

SEQ ID NO: 1564649 - RNA, 19 nt, Homo sapiens
gagaacacauuuaacugau

SEQ ID NO: 1564650 - RNA, 19 nt, Homo sapiens
gcagagcaguggaaguuuc

SEQ ID NO: 1564651 - RNA, 19 nt, Homo sapiens
gcacauguaucccugaacu

SEQ ID NO: 1564652 - RNA, 19 nt, Homo sapiens
gacacaaguuuaccuguau

SEQ ID NO: 1564653 - RNA, 19 nt, Homo sapiens
auaccugggugaugaaaua

SEQ ID NO: 1564654 - RNA, 19 nt, Homo sapiens
caacgaagugaaugaagua

SEQ ID NO: 1564655 - RNA, 19 nt, Homo sapiens
acucaaauguacaagcuua

SEQ ID NO: 1564656 - RNA, 19 nt, Homo sapiens
ggaaccugauauuaacuuu

SEQ ID NO: 1564657 - RNA, 19 nt, Homo sapiens
gcaugaggcugacgugcuu

SEQ ID NO: 1564658 - RNA, 19 nt, Homo sapiens
ccacagauagugaauuuga

SEQ ID NO: 1564659 - RNA, 19 nt, Homo sapiens
gcacagguaagcuaaauca

SEQ ID NO: 1564660 - RNA, 19 nt, Homo sapiens
auacuaggcuucuaagaga

SEQ ID NO: 1564661 - RNA, 19 nt, Homo sapiens
caacaaacuugaaggaaaa

SEQ ID NO: 1564662 - RNA, 19 nt, Homo sapiens
aaacaaagagugaguuaug

SEQ ID NO: 1564663 - RNA, 19 nt, Homo sapiens
gaauauagugacucaaaug

SEQ ID NO: 1564664 - RNA, 19 nt, Homo sapiens
gggaauauagugacucaaa

SEQ ID NO: 1564665 - RNA, 19 nt, Homo sapiens
uaggauugcugcucauuga

SEQ ID NO: 1564666 - RNA, 19 nt, Homo sapiens
guuaaugacugcaggaauc

SEQ ID NO: 1564667 - RNA, 19 nt, Homo sapiens
ccaaacaaagagugaguua

SEQ ID NO: 1564668 - RNA, 19 nt, Homo sapiens
gaaauggauuacugaagag

SEQ ID NO: 1564669 - RNA, 19 nt, Homo sapiens
gcagaugucauucagaaau

SEQ ID NO: 1564670 - RNA, 19 nt, Homo sapiens
gguaaaugcuguuaauucg

SEQ ID NO: 1564671 - RNA, 19 nt, Homo sapiens
cacaucaucuacucaguuu

SEQ ID NO: 1564672 - RNA, 19 nt, Homo sapiens
uaacugauguagcuuuagu

SEQ ID NO: 1564673 - RNA, 19 nt, Homo sapiens
ggcacaagaugcagaguau

SEQ ID NO: 1564674 - RNA, 19 nt, Homo sapiens
cagauauucuucaaggaaa

SEQ ID NO: 1564675 - RNA, 19 nt, Homo sapiens
gcaguggaaguuucauuaa

SEQ ID NO: 1564676 - RNA, 19 nt, Homo sapiens
cagaauacauacaugaaca

SEQ ID NO: 1564677 - RNA, 19 nt, Homo sapiens
ggauugcugcucauugaua

SEQ ID NO: 1564678 - RNA, 19 nt, Homo sapiens
ccacaugaguugcccacuu

SEQ ID NO: 1564679 - RNA, 19 nt, Homo sapiens
cuuaauaccugggugauga

SEQ ID NO: 1564680 - RNA, 19 nt, Homo sapiens
uugaaagccuugaagauga

SEQ ID NO: 1564681 - RNA, 19 nt, Homo sapiens
ugaaucagcccgcaucuau

SEQ ID NO: 1564682 - RNA, 19 nt, Homo sapiens
gcaagcacagguaagcuaa

SEQ ID NO: 1564683 - RNA, 19 nt, Homo sapiens
gaaucaagcauuaagcaau

SEQ ID NO: 1564684 - RNA, 19 nt, Homo sapiens
gaaauucaggaacggauug

SEQ ID NO: 1564685 - RNA, 19 nt, Homo sapiens
acacaaguuuaccuguaua

SEQ ID NO: 1564686 - RNA, 19 nt, Homo sapiens
ccugaagacuuugcuguuu

SEQ ID NO: 1564687 - RNA, 19 nt, Homo sapiens
cacaagaugcagaguauaa

SEQ ID NO: 1564688 - RNA, 19 nt, Homo sapiens
ggcggugguugcuguauuu

SEQ ID NO: 1564689 - RNA, 19 nt, Homo sapiens
ucaccagcccuuauauuaa

SEQ ID NO: 1564690 - RNA, 19 nt, Homo sapiens
ucacagaacuaauguugac

SEQ ID NO: 1564691 - RNA, 19 nt, Homo sapiens
caaagagugaguuauguga

SEQ ID NO: 1564692 - RNA, 19 nt, Homo sapiens
uguacaagcuuauggaaca

SEQ ID NO: 1564693 - RNA, 19 nt, Homo sapiens
uauagugacucaaauguac

SEQ ID NO: 1564694 - RNA, 19 nt, Homo sapiens
uacaagcucuuaaacuuca

SEQ ID NO: 1564695 - RNA, 19 nt, Homo sapiens
gaucauaagcagccagaau

SEQ ID NO: 1564696 - RNA, 19 nt, Homo sapiens
auacacaaauccuaacguu

SEQ ID NO: 1564697 - RNA, 19 nt, Homo sapiens
cgaagugaaugaaguaaaa

SEQ ID NO: 1564698 - RNA, 19 nt, Homo sapiens
gaauuaaacaacgaaguga

SEQ ID NO: 1564699 - RNA, 19 nt, Homo sapiens
gcauuuggguagugaucuu

SEQ ID NO: 1564700 - RNA, 19 nt, Homo sapiens
acaagcuuauggaacaaua

SEQ ID NO: 1564701 - RNA, 19 nt, Homo sapiens
uaacaacaaacuugaagga

SEQ ID NO: 1564702 - RNA, 19 nt, Homo sapiens
ugaaccaucucacugacaa

SEQ ID NO: 1564703 - RNA, 19 nt, Homo sapiens
augcacaucuuaacgguaa

SEQ ID NO: 1564704 - RNA, 19 nt, Homo sapiens
cagacuaucacaaagcaua

SEQ ID NO: 1564705 - RNA, 19 nt, Homo sapiens
gaugcagaguauaaacuug

SEQ ID NO: 1564706 - RNA, 19 nt, Homo sapiens
gcucagacccaccagaaau

SEQ ID NO: 1564707 - RNA, 19 nt, Homo sapiens
caaauaaaggaaaccauuc

SEQ ID NO: 1564708 - RNA, 19 nt, Homo sapiens
ccugggugaugaaauaauu

SEQ ID NO: 1564709 - RNA, 19 nt, Homo sapiens
ccagauauucuucaaggaa

SEQ ID NO: 1564710 - RNA, 19 nt, Homo sapiens
aaguuuagcagcaguauuu

SEQ ID NO: 1564711 - RNA, 19 nt, Homo sapiens
acagaaccgauuucaguua

SEQ ID NO: 1564712 - RNA, 19 nt, Homo sapiens
uaagcagccagaauacaua

SEQ ID NO: 1564713 - RNA, 19 nt, Homo sapiens
aaacgacagcagccuauaa

SEQ ID NO: 1564714 - RNA, 19 nt, Homo sapiens
ucacgucacauacaucauu

SEQ ID NO: 1564715 - RNA, 19 nt, Homo sapiens
uggaugccauuaucuuuga

SEQ ID NO: 1564716 - RNA, 19 nt, Homo sapiens
gauacuaggcuucuaagag

SEQ ID NO: 1564717 - RNA, 19 nt, Homo sapiens
cagcaguauuugaggauga

SEQ ID NO: 1564718 - RNA, 19 nt, Homo sapiens
acauguaucccugaacuua

SEQ ID NO: 1564719 - RNA, 19 nt, Homo sapiens
caaguuuaccuguauaaca

SEQ ID NO: 1564720 - RNA, 19 nt, Homo sapiens
agagaacacauuuaacuga

SEQ ID NO: 1564721 - RNA, 19 nt, Homo sapiens
agacuacucuucaaaccau

SEQ ID NO: 1564722 - RNA, 19 nt, Homo sapiens
ccaucucacugacaagcua

SEQ ID NO: 1564723 - RNA, 19 nt, Homo sapiens
aaacgacuaucuaauugag

SEQ ID NO: 1564724 - RNA, 19 nt, Homo sapiens
uaauacaccacaugaguug

SEQ ID NO: 1564725 - RNA, 19 nt, Homo sapiens
ugacuuggaguaaggauga

SEQ ID NO: 1564726 - RNA, 19 nt, Homo sapiens
ccauuuagagaacacauuu

SEQ ID NO: 1564727 - RNA, 19 nt, Homo sapiens
uaaacaacgaagugaauga

SEQ ID NO: 1564728 - RNA, 19 nt, Homo sapiens
gcacaagaugcagaguaua

SEQ ID NO: 1564729 - RNA, 19 nt, Homo sapiens
cgucuaaacgacuaucuaa

SEQ ID NO: 1564730 - RNA, 19 nt, Homo sapiens
gcucaaaucugaucuaagu

SEQ ID NO: 1564731 - RNA, 19 nt, Homo sapiens
guacugagauagagaagga

SEQ ID NO: 1564732 - RNA, 19 nt, Homo sapiens
agaaaucacccucuuguua

SEQ ID NO: 1564733 - RNA, 19 nt, Homo sapiens
acagagcgcucaagaacua

SEQ ID NO: 1564734 - RNA, 19 nt, Homo sapiens
gagcaagaguaaucuauuc

SEQ ID NO: 1564735 - RNA, 19 nt, Homo sapiens
gggaugaccuaauaauguu

SEQ ID NO: 1564736 - RNA, 19 nt, Homo sapiens
agagaaggauuguuguuaa

SEQ ID NO: 1564737 - RNA, 19 nt, Homo sapiens
uagggaaucuuuagagaaa

SEQ ID NO: 1564738 - RNA, 19 nt, Homo sapiens
ggaaggagccuagacuuga

SEQ ID NO: 1564739 - RNA, 19 nt, Homo sapiens
cuucacagcucaaaucuga

SEQ ID NO: 1564740 - RNA, 19 nt, Homo sapiens
gggaauauuugguuucuag

SEQ ID NO: 1564741 - RNA, 19 nt, Homo sapiens
ugacagagcuaggaaagga

SEQ ID NO: 1564742 - RNA, 19 nt, Homo sapiens
gagaaggauuguuguuaau

SEQ ID NO: 1564743 - RNA, 19 nt, Homo sapiens
gaaaucacccucuuguuag

SEQ ID NO: 1564744 - RNA, 19 nt, Homo sapiens
gaucaacaguggagguaga

SEQ ID NO: 1564745 - RNA, 19 nt, Homo sapiens
gaaggagccuagacuugau

SEQ ID NO: 1564746 - RNA, 19 nt, Homo sapiens
acugagggaugaccuaaua

SEQ ID NO: 1564747 - RNA, 19 nt, Homo sapiens
uaaaguggccaguguuauu

SEQ ID NO: 1564748 - RNA, 19 nt, Homo sapiens
cuaaggaccugaagcuguu

SEQ ID NO: 1564749 - RNA, 19 nt, Homo sapiens
caaaggaugagaauaguug

SEQ ID NO: 1564750 - RNA, 19 nt, Homo sapiens
gauggauaguuguaaggua

SEQ ID NO: 1564751 - RNA, 19 nt, Homo sapiens
gaacaucuuucggcugcaa

SEQ ID NO: 1564752 - RNA, 19 nt, Homo sapiens
guagugaauuacuguguga

SEQ ID NO: 1564753 - RNA, 19 nt, Homo sapiens
auaaagcaguuuccaggua

SEQ ID NO: 1564754 - RNA, 19 nt, Homo sapiens
gaucccaaauucuuaaagu

SEQ ID NO: 1564755 - RNA, 19 nt, Homo sapiens
cuagacaucuggcuugaau

SEQ ID NO: 1564756 - RNA, 19 nt, Homo sapiens
aagaugaggugcaaagguu

SEQ ID NO: 1564757 - RNA, 19 nt, Homo sapiens
caucaugguuuacacugaa

SEQ ID NO: 1564758 - RNA, 19 nt, Homo sapiens
acaucuggcuugaauauug

SEQ ID NO: 1564759 - RNA, 19 nt, Homo sapiens
gaauuacugugugaaguuc

SEQ ID NO: 1564760 - RNA, 19 nt, Homo sapiens
caaaucugaucuaaguaug

SEQ ID NO: 1564761 - RNA, 19 nt, Homo sapiens
cagcucaaaucugaucuaa

SEQ ID NO: 1564762 - RNA, 19 nt, Homo sapiens
gaagacaaggcacaagaug

SEQ ID NO: 1564763 - RNA, 19 nt, Homo sapiens
ucugaaagaucgacugaau

SEQ ID NO: 1564764 - RNA, 19 nt, Homo sapiens
cgaaugugccgucuugaaa

SEQ ID NO: 1564765 - RNA, 19 nt, Homo sapiens
gaagcaauuugugcaggaa

SEQ ID NO: 1564766 - RNA, 19 nt, Homo sapiens
gaaagucauuaguccuauc

SEQ ID NO: 1564767 - RNA, 19 nt, Homo sapiens
gcuguugcaucucgaaguu

SEQ ID NO: 1564768 - RNA, 19 nt, Homo sapiens
gagaauaguugaggaacag

SEQ ID NO: 1564769 - RNA, 19 nt, Homo sapiens
cagcaaaggaugagaauag

SEQ ID NO: 1564770 - RNA, 19 nt, Homo sapiens
caugucagauucuccauuc

SEQ ID NO: 1564771 - RNA, 19 nt, Homo sapiens
aaagaagaguuggagauug

SEQ ID NO: 1564772 - RNA, 19 nt, Homo sapiens
aaucgaaugugccgucuug

SEQ ID NO: 1564773 - RNA, 19 nt, Homo sapiens
gggcagugcuucaugugau

SEQ ID NO: 1564774 - RNA, 19 nt, Homo sapiens
guagagauggauaguugua

SEQ ID NO: 1564775 - RNA, 19 nt, Homo sapiens
uagagaaggauuguuguua

SEQ ID NO: 1564776 - RNA, 19 nt, Homo sapiens
ggaagcuccagacuguuua

SEQ ID NO: 1564777 - RNA, 19 nt, Homo sapiens
ucacaguacuucagcaaag

SEQ ID NO: 1564778 - RNA, 19 nt, Homo sapiens
gguuuaaaaugcuguguua

SEQ ID NO: 1564779 - RNA, 19 nt, Homo sapiens
ggacagccagaaagucauu

SEQ ID NO: 1564780 - RNA, 19 nt, Homo sapiens
gggaaucuuuagagaaauc

SEQ ID NO: 1564781 - RNA, 19 nt, Homo sapiens
cagaaagucauuaguccua

SEQ ID NO: 1564782 - RNA, 19 nt, Homo sapiens
gacagaggucacagaguua

SEQ ID NO: 1564783 - RNA, 19 nt, Homo sapiens
ucggucauauuucuucuaa

SEQ ID NO: 1564784 - RNA, 19 nt, Homo sapiens
agaaguaccuuagggaauc

SEQ ID NO: 1564785 - RNA, 19 nt, Homo sapiens
ugaaugcaauacaggaaga

SEQ ID NO: 1564786 - RNA, 19 nt, Homo sapiens
gcaagaguaaucuauucaa

SEQ ID NO: 1564787 - RNA, 19 nt, Homo sapiens
uauuugacccuguuaauug

SEQ ID NO: 1564788 - RNA, 19 nt, Homo sapiens
gcaaaggaugagaauaguu

SEQ ID NO: 1564789 - RNA, 19 nt, Homo sapiens
caucaacgcuacagcuucu

SEQ ID NO: 1564790 - RNA, 19 nt, Homo sapiens
gguguucggucauauuucu

SEQ ID NO: 1564791 - RNA, 19 nt, Homo sapiens
gcuccagacuguuuagaag

SEQ ID NO: 1564792 - RNA, 19 nt, Homo sapiens
cuacgugauucuauacaga

SEQ ID NO: 1564793 - RNA, 19 nt, Homo sapiens
gaagauugccucgcagaca

SEQ ID NO: 1564794 - RNA, 19 nt, Homo sapiens
ggucauauuucuucuaacc

SEQ ID NO: 1564795 - RNA, 19 nt, Homo sapiens
uuguagagauggauaguug

SEQ ID NO: 1564796 - RNA, 19 nt, Homo sapiens
gaugacuuauggauucugu

SEQ ID NO: 1564797 - RNA, 19 nt, Homo sapiens
guacuucagcaaaggauga

SEQ ID NO: 1564798 - RNA, 19 nt, Homo sapiens
gagaaguaccuuagggaau

SEQ ID NO: 1564799 - RNA, 19 nt, Homo sapiens
gaccuaauaauguuggauu

SEQ ID NO: 1564800 - RNA, 19 nt, Homo sapiens
gggagcggguugguuuaaa

SEQ ID NO: 1564801 - RNA, 19 nt, Homo sapiens
gaugagaauaguugaggaa

SEQ ID NO: 1564802 - RNA, 19 nt, Homo sapiens
gcucaggagaaguaccuua

SEQ ID NO: 1564803 - RNA, 19 nt, Homo sapiens
ggaagaagacaaggcacaa

SEQ ID NO: 1564804 - RNA, 19 nt, Homo sapiens
aaagaucgacugaaugcaa

SEQ ID NO: 1564805 - RNA, 19 nt, Homo sapiens
gaaguucucaccgacaaug

SEQ ID NO: 1564806 - RNA, 19 nt, Homo sapiens
ggcagugcuucaugugauu

SEQ ID NO: 1564807 - RNA, 19 nt, Homo sapiens
gcauugcucuacgugauuc

SEQ ID NO: 1564808 - RNA, 19 nt, Homo sapiens
gagggaugaccuaauaaug

SEQ ID NO: 1564809 - RNA, 19 nt, Homo sapiens
caaugccccuggauaauuu

SEQ ID NO: 1564810 - RNA, 19 nt, Homo sapiens
agacaucuggcuugaauau

SEQ ID NO: 1564811 - RNA, 19 nt, Homo sapiens
gcaguacugagauagagaa

SEQ ID NO: 1564812 - RNA, 19 nt, Homo sapiens
uaccugcaguacugagaua

SEQ ID NO: 1564813 - RNA, 19 nt, Homo sapiens
aggaagagcauucuaagga

SEQ ID NO: 1564814 - RNA, 19 nt, Homo sapiens
ugaauuacugugugaaguu

SEQ ID NO: 1564815 - RNA, 19 nt, Homo sapiens
gugcuucaugugauuaaua

SEQ ID NO: 1564816 - RNA, 19 nt, Homo sapiens
gcagugcuucaugugauua

SEQ ID NO: 1564817 - RNA, 19 nt, Homo sapiens
caguggagguagaacgaaa

SEQ ID NO: 1564818 - RNA, 19 nt, Homo sapiens
caucagccaugcuccucaa

SEQ ID NO: 1564819 - RNA, 19 nt, Homo sapiens
aagauugccucgcagacaa

SEQ ID NO: 1564820 - RNA, 19 nt, Homo sapiens
agauagagaaggauuguug

SEQ ID NO: 1564821 - RNA, 19 nt, Homo sapiens
guaaaacauugcagauuuc

SEQ ID NO: 1564822 - RNA, 19 nt, Homo sapiens
gaagaguuggagauugcua

SEQ ID NO: 1564823 - RNA, 19 nt, Homo sapiens
aagaagaguuggagauugc

SEQ ID NO: 1564824 - RNA, 19 nt, Homo sapiens
cuacagcuucugaaacauu

SEQ ID NO: 1564825 - RNA, 19 nt, Homo sapiens
ccacaaaacguaaaaugaa

SEQ ID NO: 1564826 - RNA, 19 nt, Homo sapiens
caagguguucggucauauu

SEQ ID NO: 1564827 - RNA, 19 nt, Homo sapiens
cccaagguguucggucaua

SEQ ID NO: 1564828 - RNA, 19 nt, Homo sapiens
gauucuccauucuucaugu

SEQ ID NO: 1564829 - RNA, 19 nt, Homo sapiens
cgcuacagcuucugaaaca

SEQ ID NO: 1564830 - RNA, 19 nt, Homo sapiens
gaacacagguugcaagaaa

SEQ ID NO: 1564831 - RNA, 19 nt, Homo sapiens
cgaaaugcguucuguguaa

SEQ ID NO: 1564832 - RNA, 19 nt, Homo sapiens
gcaaaugguuccucgagaa

SEQ ID NO: 1564833 - RNA, 19 nt, Homo sapiens
ggagugcuguuaauaugua

SEQ ID NO: 1564834 - RNA, 19 nt, Homo sapiens
caagaaagaaccaacguua

SEQ ID NO: 1564835 - RNA, 19 nt, Homo sapiens
ugagaagcuugguaaauua

SEQ ID NO: 1564836 - RNA, 19 nt, Homo sapiens
ccuauucccuccuaauuua

SEQ ID NO: 1564837 - RNA, 19 nt, Homo sapiens
ggaggaaagugauguuuua

SEQ ID NO: 1564838 - RNA, 19 nt, Homo sapiens
gaugggcacuuacagguuu

SEQ ID NO: 1564839 - RNA, 19 nt, Homo sapiens
ugcauuagcuguccuuuaa

SEQ ID NO: 1564840 - RNA, 19 nt, Homo sapiens
gggaauaucaguagaacua

SEQ ID NO: 1564841 - RNA, 19 nt, Homo sapiens
uaauguaacugucauggaa

SEQ ID NO: 1564842 - RNA, 19 nt, Homo sapiens
gcggaugcaugcaaugaua

SEQ ID NO: 1564843 - RNA, 19 nt, Homo sapiens
ggaaagugauguuuuauga

SEQ ID NO: 1564844 - RNA, 19 nt, Homo sapiens
caguagaacuauugaauug

SEQ ID NO: 1564845 - RNA, 19 nt, Homo sapiens
gcauagaaaugugcuaaau

SEQ ID NO: 1564846 - RNA, 19 nt, Homo sapiens
gccaucaacuuuaaauaga

SEQ ID NO: 1564847 - RNA, 19 nt, Homo sapiens
gaaaaugcaugcugauaau

SEQ ID NO: 1564848 - RNA, 19 nt, Homo sapiens
gaaagaaccaacguuauuc

SEQ ID NO: 1564849 - RNA, 19 nt, Homo sapiens
gaaaugcguucuguguaau

SEQ ID NO: 1564850 - RNA, 19 nt, Homo sapiens
ggaaaagaguacugccuua

SEQ ID NO: 1564851 - RNA, 19 nt, Homo sapiens
uaaaggagugcuguuaaua

SEQ ID NO: 1564852 - RNA, 19 nt, Homo sapiens
gaacauccagagagcauga

SEQ ID NO: 1564853 - RNA, 19 nt, Homo sapiens
agaaagaaccaacguuauu

SEQ ID NO: 1564854 - RNA, 19 nt, Homo sapiens
uugagaagcuugguaaauu

SEQ ID NO: 1564855 - RNA, 19 nt, Homo sapiens
acacugacaugguacaaga

SEQ ID NO: 1564856 - RNA, 19 nt, Homo sapiens
caagauaggcugcaugcuu

SEQ ID NO: 1564857 - RNA, 19 nt, Homo sapiens
gaagagcgacuaccacaag

SEQ ID NO: 1564858 - RNA, 19 nt, Homo sapiens
caacguuauuccugacauu

SEQ ID NO: 1564859 - RNA, 19 nt, Homo sapiens
ggaaaacacugagggcuaa

SEQ ID NO: 1564860 - RNA, 19 nt, Homo sapiens
cagagagcaugaugaguga

SEQ ID NO: 1564861 - RNA, 19 nt, Homo sapiens
ggccuuaccuccaguucaa

SEQ ID NO: 1564862 - RNA, 19 nt, Homo sapiens
gggcuaaggauaaugauau

SEQ ID NO: 1564863 - RNA, 19 nt, Homo sapiens
caagaagggccagaaauug

SEQ ID NO: 1564864 - RNA, 19 nt, Homo sapiens
aaagaugaauccgaauuug

SEQ ID NO: 1564865 - RNA, 19 nt, Homo sapiens
gcagggagauguuuuaaag

SEQ ID NO: 1564866 - RNA, 19 nt, Homo sapiens
gaagcuugguaaauuaucu

SEQ ID NO: 1564867 - RNA, 19 nt, Homo sapiens
gagugugucucaccugaug

SEQ ID NO: 1564868 - RNA, 19 nt, Homo sapiens
gguguucauuccaaaggua

SEQ ID NO: 1564869 - RNA, 19 nt, Homo sapiens
acaagaagggccagaaauu

SEQ ID NO: 1564870 - RNA, 19 nt, Homo sapiens
ggagauguuuuaaagauga

SEQ ID NO: 1564871 - RNA, 19 nt, Homo sapiens
guacaagaagggccagaaa

SEQ ID NO: 1564872 - RNA, 19 nt, Homo sapiens
ggaagguucuccagugacu

SEQ ID NO: 1564873 - RNA, 19 nt, Homo sapiens
gcuccugccugaagacaug

SEQ ID NO: 1564874 - RNA, 19 nt, Homo sapiens
aaguguaucuccagucuga

SEQ ID NO: 1564875 - RNA, 19 nt, Homo sapiens
aaggagugcuguuaauaug

SEQ ID NO: 1564876 - RNA, 19 nt, Homo sapiens
ggcuaaggauaaugauauu

SEQ ID NO: 1564877 - RNA, 19 nt, Homo sapiens
acacugagggcuaaggaua

SEQ ID NO: 1564878 - RNA, 19 nt, Homo sapiens
gcaagaaagaaccaacguu

SEQ ID NO: 1564879 - RNA, 19 nt, Homo sapiens
ugacaucggcauagaaaug

SEQ ID NO: 1564880 - RNA, 19 nt, Homo sapiens
caaauuuucuggagcguuu

SEQ ID NO: 1564881 - RNA, 19 nt, Homo sapiens
gguuugacauuggaggaua

SEQ ID NO: 1564882 - RNA, 19 nt, Homo sapiens
cagggugguuugcuagaaa

SEQ ID NO: 1564883 - RNA, 19 nt, Homo sapiens
gcugacaucggcauagaaa

SEQ ID NO: 1564884 - RNA, 19 nt, Homo sapiens
gagaagcuugguaaauuau

SEQ ID NO: 1564885 - RNA, 19 nt, Homo sapiens
ccaaguguaucuccagucu

SEQ ID NO: 1564886 - RNA, 19 nt, Homo sapiens
ucacaagaguaaacuggau

SEQ ID NO: 1564887 - RNA, 19 nt, Homo sapiens
aaaggagugcuguuaauau

SEQ ID NO: 1564888 - RNA, 19 nt, Homo sapiens
cauacuuguuuggcuaaua

SEQ ID NO: 1564889 - RNA, 19 nt, Homo sapiens
gcaaagcaucucccaccaa

SEQ ID NO: 1564890 - RNA, 19 nt, Homo sapiens
gacaaggcauucgguguuc

SEQ ID NO: 1564891 - RNA, 19 nt, Homo sapiens
agacuuccauuaugauuac

SEQ ID NO: 1564892 - RNA, 19 nt, Homo sapiens
cuggagcguuuaauauauu

SEQ ID NO: 1564893 - RNA, 19 nt, Homo sapiens
ucuggagcguuuaauauau

SEQ ID NO: 1564894 - RNA, 19 nt, Homo sapiens
gagcagcaauguguaacca

SEQ ID NO: 1564895 - RNA, 19 nt, Homo sapiens
gaaguugaaguaacaggau

SEQ ID NO: 1564896 - RNA, 19 nt, Homo sapiens
guacugccuuacacagaau

SEQ ID NO: 1564897 - RNA, 19 nt, Homo sapiens
gcuagaaacacgggagaaa

SEQ ID NO: 1564898 - RNA, 19 nt, Homo sapiens
guagggaauaucaguagaa

SEQ ID NO: 1564899 - RNA, 19 nt, Homo sapiens
uuaagggcgugcagaugaa

SEQ ID NO: 1564900 - RNA, 19 nt, Homo sapiens
ccacugcuaggugaaauaa

SEQ ID NO: 1564901 - RNA, 19 nt, Homo sapiens
gaaggcugacaucggcaua

SEQ ID NO: 1564902 - RNA, 19 nt, Homo sapiens
agccuacacugacauggua

SEQ ID NO: 1564903 - RNA, 19 nt, Homo sapiens
uagcugaccaggcaccuaa

SEQ ID NO: 1564904 - RNA, 19 nt, Homo sapiens
cguuauuccugacauucua

SEQ ID NO: 1564905 - RNA, 19 nt, Homo sapiens
agacaaggcauucgguguu

SEQ ID NO: 1564906 - RNA, 19 nt, Homo sapiens
uacauugacuugcuaaagg

SEQ ID NO: 1564907 - RNA, 19 nt, Homo sapiens
gcaugcugauaauaacuuc

SEQ ID NO: 1564908 - RNA, 19 nt, Homo sapiens
ucccucagccuucacauaa

SEQ ID NO: 1564909 - RNA, 19 nt, Homo sapiens
cuugggcaauugagaguuu

SEQ ID NO: 1564910 - RNA, 19 nt, Homo sapiens
ugauuacauugacuugcua

SEQ ID NO: 1564911 - RNA, 19 nt, Homo sapiens
gccuauucccuccuaauuu

SEQ ID NO: 1564912 - RNA, 19 nt, Homo sapiens
gcagcaaaauuauucuaug

SEQ ID NO: 1564913 - RNA, 19 nt, Homo sapiens
cuugguaaauuaucuguag

SEQ ID NO: 1564914 - RNA, 19 nt, Homo sapiens
gagugcuguuaauauguaa

SEQ ID NO: 1564915 - RNA, 19 nt, Homo sapiens
ggaagagcgacuaccacaa

SEQ ID NO: 1564916 - RNA, 19 nt, Homo sapiens
ucacggguuugacauugga

SEQ ID NO: 1564917 - RNA, 19 nt, Homo sapiens
gggaagaauaugagugugu

SEQ ID NO: 1564918 - RNA, 19 nt, Homo sapiens
gcuccugucuaauguaacu

SEQ ID NO: 1564919 - RNA, 19 nt, Homo sapiens
gcccaggaaucuguucuuc

SEQ ID NO: 1564920 - RNA, 19 nt, Homo sapiens
aauuaaaggagugcuguua

SEQ ID NO: 1564921 - RNA, 19 nt, Homo sapiens
uuaaacaucuggaaaaugg

SEQ ID NO: 1564922 - RNA, 19 nt, Homo sapiens
guaauuucaacguagacua

SEQ ID NO: 1564923 - RNA, 19 nt, Homo sapiens
acauugacuugcuaaagga

SEQ ID NO: 1564924 - RNA, 19 nt, Homo sapiens
ucucaugugccuaaagaaa

SEQ ID NO: 1564925 - RNA, 19 nt, Homo sapiens
cacaagaguaaacuggaua

SEQ ID NO: 1564926 - RNA, 19 nt, Homo sapiens
guucaucaucuaccucuug

SEQ ID NO: 1564927 - RNA, 19 nt, Homo sapiens
aggcuccugucuaauguaa

SEQ ID NO: 1564928 - RNA, 19 nt, Homo sapiens
caugaugagugaagugcau

SEQ ID NO: 1564929 - RNA, 19 nt, Homo sapiens
aagcagacaauauucaaug

SEQ ID NO: 1564930 - RNA, 19 nt, Homo sapiens
gcucugagguccuaaauaa

SEQ ID NO: 1564931 - RNA, 19 nt, Homo sapiens
uaaaugaucuuccgcagua

SEQ ID NO: 1564932 - RNA, 19 nt, Homo sapiens
ggagcaagguggccacaua

SEQ ID NO: 1564933 - RNA, 19 nt, Homo sapiens
gaaaggagagggaggagua

SEQ ID NO: 1564934 - RNA, 19 nt, Homo sapiens
guucaaagauucccaacaa

SEQ ID NO: 1564935 - RNA, 19 nt, Homo sapiens
ccuauuaaauccagugaua

SEQ ID NO: 1564936 - RNA, 19 nt, Homo sapiens
gcucaacaguucaaagauu

SEQ ID NO: 1564937 - RNA, 19 nt, Homo sapiens
gaaggaugguggagaauag

SEQ ID NO: 1564938 - RNA, 19 nt, Homo sapiens
gagagagacuccugcuuga

SEQ ID NO: 1564939 - RNA, 19 nt, Homo sapiens
gagaauagcauuaacagau

SEQ ID NO: 1564940 - RNA, 19 nt, Homo sapiens
gaagugcucugagguccua

SEQ ID NO: 1564941 - RNA, 19 nt, Homo sapiens
gaaaacaccucuguaagaa

SEQ ID NO: 1564942 - RNA, 19 nt, Homo sapiens
gcacacuaguugacaaaga

SEQ ID NO: 1564943 - RNA, 19 nt, Homo sapiens
gaaacaauccaguccuaaa

SEQ ID NO: 1564944 - RNA, 19 nt, Homo sapiens
gaagaaucccuauuaaauc

SEQ ID NO: 1564945 - RNA, 19 nt, Homo sapiens
ggacagaauucagcuagug

SEQ ID NO: 1564946 - RNA, 19 nt, Homo sapiens
guauuucgcucaacaguuc

SEQ ID NO: 1564947 - RNA, 19 nt, Homo sapiens
ggacuuaggguacacaaga

SEQ ID NO: 1564948 - RNA, 19 nt, Homo sapiens
guagacaguuaacucauga

SEQ ID NO: 1564949 - RNA, 19 nt, Homo sapiens
cccaauaaauuccuaaguu

SEQ ID NO: 1564950 - RNA, 19 nt, Homo sapiens
guauaugccuccugacuuc

SEQ ID NO: 1564951 - RNA, 19 nt, Homo sapiens
caacauuucuagacacauc

SEQ ID NO: 1564952 - RNA, 19 nt, Homo sapiens
gagaauccacugccuuaaa

SEQ ID NO: 1564953 - RNA, 19 nt, Homo sapiens
ggaaagaggcacugaagag

SEQ ID NO: 1564954 - RNA, 19 nt, Homo sapiens
ggcauuggcuccuggaugu

SEQ ID NO: 1564955 - RNA, 19 nt, Homo sapiens
gaacaccauuauccacaca

SEQ ID NO: 1564956 - RNA, 19 nt, Homo sapiens
gcaagguggccacauagaa

SEQ ID NO: 1564957 - RNA, 19 nt, Homo sapiens
acaauccaguccuaaauga

SEQ ID NO: 1564958 - RNA, 19 nt, Homo sapiens
agagaaggaugguggagaa

SEQ ID NO: 1564959 - RNA, 19 nt, Homo sapiens
ugagugaacauuaguggua

SEQ ID NO: 1564960 - RNA, 19 nt, Homo sapiens
acaauuauccacacaagaa

SEQ ID NO: 1564961 - RNA, 19 nt, Homo sapiens
aagaaacaauccaguccua

SEQ ID NO: 1564962 - RNA, 19 nt, Homo sapiens
uaaaggggauuuugucuug

SEQ ID NO: 1564963 - RNA, 19 nt, Homo sapiens
gaaagcaacacaggacaga

SEQ ID NO: 1564964 - RNA, 19 nt, Homo sapiens
gaauagcauuaacagauac

SEQ ID NO: 1564965 - RNA, 19 nt, Homo sapiens
gagccuugagugaacauua

SEQ ID NO: 1564966 - RNA, 19 nt, Homo sapiens
gaagagccuugagugaaca

SEQ ID NO: 1564967 - RNA, 19 nt, Homo sapiens
caagauucaucaccuacug

SEQ ID NO: 1564968 - RNA, 19 nt, Homo sapiens
gacaacauuucuagacaca

SEQ ID NO: 1564969 - RNA, 19 nt, Homo sapiens
ggcccuagcucccagacaa

SEQ ID NO: 1564970 - RNA, 19 nt, Homo sapiens
cugcaccaguucccaaaua

SEQ ID NO: 1564971 - RNA, 19 nt, Homo sapiens
gaucagucacuucagcuuu

SEQ ID NO: 1564972 - RNA, 19 nt, Homo sapiens
ugauagcaaccuacaauuu

SEQ ID NO: 1564973 - RNA, 19 nt, Homo sapiens
guauagaguacccaauaaa

SEQ ID NO: 1564974 - RNA, 19 nt, Homo sapiens
uaguauagaguacccaaua

SEQ ID NO: 1564975 - RNA, 19 nt, Homo sapiens
cacaagaccuagugagaca

SEQ ID NO: 1564976 - RNA, 19 nt, Homo sapiens
caagaaaacaccucuguaa

SEQ ID NO: 1564977 - RNA, 19 nt, Homo sapiens
uagaguacccaauaaauuc

SEQ ID NO: 1564978 - RNA, 19 nt, Homo sapiens
aagagaauccacugccuua

SEQ ID NO: 1564979 - RNA, 19 nt, Homo sapiens
gcucagccacagcagaaua

SEQ ID NO: 1564980 - RNA, 19 nt, Homo sapiens
caagagagaggccuuccuu

SEQ ID NO: 1564981 - RNA, 19 nt, Homo sapiens
accauuauccacacaauua

SEQ ID NO: 1564982 - RNA, 19 nt, Homo sapiens
gagaggaggccaccaugga

SEQ ID NO: 1564983 - RNA, 19 nt, Homo sapiens
caucacagcuucgaaacca

SEQ ID NO: 1564984 - RNA, 19 nt, Homo sapiens
aguauagaguacccaauaa

SEQ ID NO: 1564985 - RNA, 19 nt, Homo sapiens
cgaguggcauagagagauu

SEQ ID NO: 1564986 - RNA, 19 nt, Homo sapiens
cagcuacaguggucacaga

SEQ ID NO: 1564987 - RNA, 19 nt, Homo sapiens
cagacaacauuucuagaca

SEQ ID NO: 1564988 - RNA, 19 nt, Homo sapiens
gaagaggguaggguagaaa

SEQ ID NO: 1564989 - RNA, 19 nt, Homo sapiens
gauagcaaccuacaauuuu

SEQ ID NO: 1564990 - RNA, 19 nt, Homo sapiens
ugaagagccuugagugaac

SEQ ID NO: 1564991 - RNA, 19 nt, Homo sapiens
agaauccacugccuuaaag

SEQ ID NO: 1564992 - RNA, 19 nt, Homo sapiens
acauagaacccuccaguga

SEQ ID NO: 1564993 - RNA, 19 nt, Homo sapiens
gagugaacauuagugguau

SEQ ID NO: 1564994 - RNA, 19 nt, Homo sapiens
gcaguggacuuaggguaca

SEQ ID NO: 1564995 - RNA, 19 nt, Homo sapiens
ccaacaaccuauuuuauuc

SEQ ID NO: 1564996 - RNA, 19 nt, Homo sapiens
acaaagaucagucacuuca

SEQ ID NO: 1564997 - RNA, 19 nt, Homo sapiens
ugaagaggguaggguagaa

SEQ ID NO: 1564998 - RNA, 19 nt, Homo sapiens
aaacaauccaguccuaaau

SEQ ID NO: 1564999 - RNA, 19 nt, Homo sapiens
uggcauagagagauucuuu

SEQ ID NO: 1565000 - RNA, 19 nt, Homo sapiens
gcccauggagggagcauuu

SEQ ID NO: 1565001 - RNA, 19 nt, Homo sapiens
caacacaggacagaauuca

SEQ ID NO: 1565002 - RNA, 19 nt, Homo sapiens
ggaucgcaauaccagguuu

SEQ ID NO: 1565003 - RNA, 19 nt, Homo sapiens
ccacacaauuauccacaca

SEQ ID NO: 1565004 - RNA, 19 nt, Homo sapiens
gcuccuggaugucauuucu

SEQ ID NO: 1565005 - RNA, 19 nt, Homo sapiens
cucacaagcugacugaaga

SEQ ID NO: 1565006 - RNA, 19 nt, Homo sapiens
ccugguggguggagaauca

SEQ ID NO: 1565007 - RNA, 19 nt, Homo sapiens
gcucagaggcaguggacuu

SEQ ID NO: 1565008 - RNA, 19 nt, Homo sapiens
gcacuagccagccaggaau

SEQ ID NO: 1565009 - RNA, 19 nt, Homo sapiens
cacacuaguugacaaagau

SEQ ID NO: 1565010 - RNA, 19 nt, Homo sapiens
gcuacuuacucauucaaag

SEQ ID NO: 1565011 - RNA, 19 nt, Homo sapiens
aaagccaccucuugugcaa

SEQ ID NO: 1565012 - RNA, 19 nt, Homo sapiens
uggcaagauucaucaccua

SEQ ID NO: 1565013 - RNA, 19 nt, Homo sapiens
ggagaauagcauuaacaga

SEQ ID NO: 1565014 - RNA, 19 nt, Homo sapiens
uguagacaguuaacucaug

SEQ ID NO: 1565015 - RNA, 19 nt, Homo sapiens
ugacuuccuggaccuguua

SEQ ID NO: 1565016 - RNA, 19 nt, Homo sapiens
gcauagagagauucuuucu

SEQ ID NO: 1565017 - RNA, 19 nt, Homo sapiens
gaggacuugucuugaaucu

SEQ ID NO: 1565018 - RNA, 19 nt, Homo sapiens
gcauuuagaccagcacuag

SEQ ID NO: 1565019 - RNA, 19 nt, Homo sapiens
gcauuaacagauacuccua

SEQ ID NO: 1565020 - RNA, 19 nt, Homo sapiens
auagaacccuccagugauc

SEQ ID NO: 1565021 - RNA, 19 nt, Homo sapiens
uccaggagcuguguauuuc

SEQ ID NO: 1565022 - RNA, 19 nt, Homo sapiens
gagagaggccuuccuuuug

SEQ ID NO: 1565023 - RNA, 19 nt, Homo sapiens
gguccuaaauaagcuugaa

SEQ ID NO: 1565024 - RNA, 19 nt, Homo sapiens
acacaauuauccacacaag

SEQ ID NO: 1565025 - RNA, 19 nt, Homo sapiens
ccagugcugugcugcuuca

SEQ ID NO: 1565026 - RNA, 19 nt, Homo sapiens
gaguaaagaggacuugucu

SEQ ID NO: 1565027 - RNA, 19 nt, Homo sapiens
gaacaccgugcugccugua

SEQ ID NO: 1565028 - RNA, 19 nt, Homo sapiens
uccuggaccuguuaaagaa

SEQ ID NO: 1565029 - RNA, 19 nt, Homo sapiens
uaaagagaaggacccaguu

SEQ ID NO: 1565030 - RNA, 19 nt, Homo sapiens
ugacaucacugaaggcaaa

SEQ ID NO: 1565031 - RNA, 19 nt, Homo sapiens
ccaaggcuauuaccagaag

SEQ ID NO: 1565032 - RNA, 19 nt, Homo sapiens
gcucaagggcuuccucuuc

SEQ ID NO: 1565033 - RNA, 19 nt, Homo sapiens
ggacgucuggguucugcua

SEQ ID NO: 1565034 - RNA, 19 nt, Homo sapiens
gcuccagccucuuccuaug

SEQ ID NO: 1565035 - RNA, 19 nt, Homo sapiens
gcagcagcauccagaccuu

SEQ ID NO: 1565036 - RNA, 19 nt, Homo sapiens
caaccguguucuacugugu

SEQ ID NO: 1565037 - RNA, 19 nt, Homo sapiens
agucuucgaugucauaaag

SEQ ID NO: 1565038 - RNA, 19 nt, Homo sapiens
ucacugaaggcaaagagaa

SEQ ID NO: 1565039 - RNA, 19 nt, Homo sapiens
caagggcuuccucuucaaa

SEQ ID NO: 1565040 - RNA, 19 nt, Homo sapiens
cucaagggcuuccucuuca

SEQ ID NO: 1565041 - RNA, 19 nt, Homo sapiens
ucaccagcaucuucaccaa

SEQ ID NO: 1565042 - RNA, 19 nt, Homo sapiens
ucaagggcuuccucuucaa

SEQ ID NO: 1565043 - RNA, 19 nt, Homo sapiens
ggaucuacccgcagcaagu

SEQ ID NO: 1565044 - RNA, 19 nt, Homo sapiens
uacgaggacuucuggaucu

SEQ ID NO: 1565045 - RNA, 19 nt, Homo sapiens
gcaggcuggucuugcacau

SEQ ID NO: 1565046 - RNA, 19 nt, Homo sapiens
gaucuacccgcagcaagug

SEQ ID NO: 1565047 - RNA, 19 nt, Homo sapiens
uggcaaggguggcguuguc

SEQ ID NO: 1565048 - RNA, 19 nt, Homo sapiens
cgccaaccguguucuacug

SEQ ID NO: 1565049 - RNA, 19 nt, Homo sapiens
ggagcgccaacgccacaaa

SEQ ID NO: 1565050 - RNA, 19 nt, Homo sapiens
cuauguguguaacuucaau

SEQ ID NO: 1565051 - RNA, 19 nt, Homo sapiens
ggaucuggguguccaugac

SEQ ID NO: 1565052 - RNA, 19 nt, Homo sapiens
gcccuguggccacuaaaga

SEQ ID NO: 1565053 - RNA, 19 nt, Homo sapiens
caaggguggcguugucauc

SEQ ID NO: 1565054 - RNA, 19 nt, Homo sapiens
caacgcagcucaugccaua

SEQ ID NO: 1565055 - RNA, 19 nt, Homo sapiens
gcagaaauauucaaagaga

SEQ ID NO: 1565056 - RNA, 19 nt, Homo sapiens
gagaaaggcuaaagaaugu

SEQ ID NO: 1565057 - RNA, 19 nt, Homo sapiens
ugaaauaugugaucuggaa

SEQ ID NO: 1565058 - RNA, 19 nt, Homo sapiens
ccaagagccugauaacuga

SEQ ID NO: 1565059 - RNA, 19 nt, Homo sapiens
ggagaaaggcuaaagaaug

SEQ ID NO: 1565060 - RNA, 19 nt, Homo sapiens
gcacccaccuggcuuaaga

SEQ ID NO: 1565061 - RNA, 19 nt, Homo sapiens
gcaggccaauugacauaua

SEQ ID NO: 1565062 - RNA, 19 nt, Homo sapiens
gcuaaagaaugucaguaaa

SEQ ID NO: 1565063 - RNA, 19 nt, Homo sapiens
cagcagaaauauucaaaga

SEQ ID NO: 1565064 - RNA, 19 nt, Homo sapiens
ggucacagccuacuaauuc

SEQ ID NO: 1565065 - RNA, 19 nt, Homo sapiens
gguagucauuccaucuuua

SEQ ID NO: 1565066 - RNA, 19 nt, Homo sapiens
cagaagcacugaugacguu

SEQ ID NO: 1565067 - RNA, 19 nt, Homo sapiens
guacucugcucacuuguug

SEQ ID NO: 1565068 - RNA, 19 nt, Homo sapiens
gaucaugucuacugugaag

SEQ ID NO: 1565069 - RNA, 19 nt, Homo sapiens
gcaucagccucauuccuaa

SEQ ID NO: 1565070 - RNA, 19 nt, Homo sapiens
gcaacucuguguaccaaga

SEQ ID NO: 1565071 - RNA, 19 nt, Homo sapiens
gaaaauaucagcagaaugu

SEQ ID NO: 1565072 - RNA, 19 nt, Homo sapiens
cagcuugccuccauccuuu

SEQ ID NO: 1565073 - RNA, 19 nt, Homo sapiens
gagccgagaucgcgccauu

SEQ ID NO: 1565074 - RNA, 19 nt, Homo sapiens
guaaggacaucaccucuac

SEQ ID NO: 1565075 - RNA, 19 nt, Homo sapiens
ggacagacccagagguguu

SEQ ID NO: 1565076 - RNA, 19 nt, Homo sapiens
cgagugcauuugaggcuua

SEQ ID NO: 1565077 - RNA, 19 nt, Homo sapiens
uuuaagagaugaagaagga

SEQ ID NO: 1565078 - RNA, 19 nt, Homo sapiens
cuacagccauuccgcauug

SEQ ID NO: 1565079 - RNA, 19 nt, Homo sapiens
cagaucaugucuacuguga

SEQ ID NO: 1565080 - RNA, 19 nt, Homo sapiens
auaaggaucucaagaaucu

SEQ ID NO: 1565081 - RNA, 19 nt, Homo sapiens
gggaauauaucuguaugau

SEQ ID NO: 1565082 - RNA, 19 nt, Homo sapiens
cgacaagaauccagggaau

SEQ ID NO: 1565083 - RNA, 19 nt, Homo sapiens
ucaagcagcagaaauauuc

SEQ ID NO: 1565084 - RNA, 19 nt, Homo sapiens
gaagaaggcgucagauacu

SEQ ID NO: 1565085 - RNA, 19 nt, Homo sapiens
gguaucaucccgacaagaa

SEQ ID NO: 1565086 - RNA, 19 nt, Homo sapiens
ggacuaggagaaaggcuaa

SEQ ID NO: 1565087 - RNA, 19 nt, Homo sapiens
gaaaauagcgaagaugauu

SEQ ID NO: 1565088 - RNA, 19 nt, Homo sapiens
gugaagaaggcgucagaua

SEQ ID NO: 1565089 - RNA, 19 nt, Homo sapiens
cuaagaagcggaaaauuua

SEQ ID NO: 1565090 - RNA, 19 nt, Homo sapiens
gaaacuggccuugcgguau

SEQ ID NO: 1565091 - RNA, 19 nt, Homo sapiens
guauggaguugguuucauc

SEQ ID NO: 1565092 - RNA, 19 nt, Homo sapiens
cauuaauucucccuuguug

SEQ ID NO: 1565093 - RNA, 19 nt, Homo sapiens
aaagugagaugagccucua

SEQ ID NO: 1565094 - RNA, 19 nt, Homo sapiens
ggguagucauuccaucuuu

SEQ ID NO: 1565095 - RNA, 19 nt, Homo sapiens
ggaguugguuucaucuucu

SEQ ID NO: 1565096 - RNA, 19 nt, Homo sapiens
ggucaggagccaaauguga

SEQ ID NO: 1565097 - RNA, 19 nt, Homo sapiens
gagaacgacucccagaaaa

SEQ ID NO: 1565098 - RNA, 19 nt, Homo sapiens
cgaccagcauggcucauug

SEQ ID NO: 1565099 - RNA, 19 nt, Homo sapiens
gaaaggcuaaagaauguca

SEQ ID NO: 1565100 - RNA, 19 nt, Homo sapiens
ccaccuggcuuaagagaac

SEQ ID NO: 1565101 - RNA, 19 nt, Homo sapiens
gaaggcgucagauacuauu

SEQ ID NO: 1565102 - RNA, 19 nt, Homo sapiens
caggccaauugacauauaa

SEQ ID NO: 1565103 - RNA, 19 nt, Homo sapiens
aaacuggccuugcgguauc

SEQ ID NO: 1565104 - RNA, 19 nt, Homo sapiens
ggcuaaagaaugucaguaa

SEQ ID NO: 1565105 - RNA, 19 nt, Homo sapiens
ugacauugacccugauuug

SEQ ID NO: 1565106 - RNA, 19 nt, Homo sapiens
aaacugcgagugcauuuga

SEQ ID NO: 1565107 - RNA, 19 nt, Homo sapiens
gagcugcugcacccauuaa

SEQ ID NO: 1565108 - RNA, 19 nt, Homo sapiens
gauuugaccccucuucuua

SEQ ID NO: 1565109 - RNA, 19 nt, Homo sapiens
gcgugcaccuguaaucuca

SEQ ID NO: 1565110 - RNA, 19 nt, Homo sapiens
gaacgacucccagaaaauu

SEQ ID NO: 1565111 - RNA, 19 nt, Homo sapiens
ccucauuccuaagccaaua

SEQ ID NO: 1565112 - RNA, 19 nt, Homo sapiens
uguguacucugcucacuug

SEQ ID NO: 1565113 - RNA, 19 nt, Homo sapiens
gaaauaugugaucuggaaa

SEQ ID NO: 1565114 - RNA, 19 nt, Homo sapiens
agagaacgacucccagaaa

SEQ ID NO: 1565115 - RNA, 19 nt, Homo sapiens
aggcagugguggcagauuu

SEQ ID NO: 1565116 - RNA, 19 nt, Homo sapiens
gagaaaauaucagcagaau

SEQ ID NO: 1565117 - RNA, 19 nt, Homo sapiens
aagaaggcgucagauacua

SEQ ID NO: 1565118 - RNA, 19 nt, Homo sapiens
augcagugcuggaucuuaa

SEQ ID NO: 1565119 - RNA, 19 nt, Homo sapiens
uguacuuucuggacucuuu

SEQ ID NO: 1565120 - RNA, 19 nt, Homo sapiens
gccaauaacgccuguaugg

SEQ ID NO: 1565121 - RNA, 19 nt, Homo sapiens
gacauugacccugauuuga

SEQ ID NO: 1565122 - RNA, 19 nt, Homo sapiens
gaauaguuguugguucaag

SEQ ID NO: 1565123 - RNA, 19 nt, Homo sapiens
ugaagaaggcgucagauac

SEQ ID NO: 1565124 - RNA, 19 nt, Homo sapiens
gcauggcucauugggaaua

SEQ ID NO: 1565125 - RNA, 19 nt, Homo sapiens
uccugugucugccuuguua

SEQ ID NO: 1565126 - RNA, 19 nt, Homo sapiens
gcaccuguaaucucagcua

SEQ ID NO: 1565127 - RNA, 19 nt, Homo sapiens
ucaguugcagucccaauuu

SEQ ID NO: 1565128 - RNA, 19 nt, Homo sapiens
gcccagcuacucuuccuuu

SEQ ID NO: 1565129 - RNA, 19 nt, Homo sapiens
uaggagaaaggcuaaagaa

SEQ ID NO: 1565130 - RNA, 19 nt, Homo sapiens
cuacuaauuccucaaacuu

SEQ ID NO: 1565131 - RNA, 19 nt, Homo sapiens
aaaauaggggcaugaaaua

SEQ ID NO: 1565132 - RNA, 19 nt, Homo sapiens
ggagcugcugcacccauua

SEQ ID NO: 1565133 - RNA, 19 nt, Homo sapiens
auacugagcgacucuaaga

SEQ ID NO: 1565134 - RNA, 19 nt, Homo sapiens
gaaaacugcgagugcauuu

SEQ ID NO: 1565135 - RNA, 19 nt, Homo sapiens
gaagcacugaugacguuga

SEQ ID NO: 1565136 - RNA, 19 nt, Homo sapiens
cuuauaaggaucucaagaa

SEQ ID NO: 1565137 - RNA, 19 nt, Homo sapiens
uagauuauccuuggacuuc

SEQ ID NO: 1565138 - RNA, 19 nt, Homo sapiens
cagcuacucuuccuuucag

SEQ ID NO: 1565139 - RNA, 19 nt, Homo sapiens
ggcgucagauacuauuuua

SEQ ID NO: 1565140 - RNA, 19 nt, Homo sapiens
ggaauauaucuguaugauc

SEQ ID NO: 1565141 - RNA, 19 nt, Homo sapiens
gcagugcuggaucuuaaga

SEQ ID NO: 1565142 - RNA, 19 nt, Homo sapiens
cagggucacagccuacuaa

SEQ ID NO: 1565143 - RNA, 19 nt, Homo sapiens
uuguggagcugucugauuc

SEQ ID NO: 1565144 - RNA, 19 nt, Homo sapiens
gccuugguccuguagguua

SEQ ID NO: 1565145 - RNA, 19 nt, Homo sapiens
gcucaagcagcagaaauau

SEQ ID NO: 1565146 - RNA, 19 nt, Homo sapiens
cauuagccuugguccugua

SEQ ID NO: 1565147 - RNA, 19 nt, Homo sapiens
uggaguugguuucaucuuc

SEQ ID NO: 1565148 - RNA, 19 nt, Homo sapiens
aauaguuguugguucaaga

SEQ ID NO: 1565149 - RNA, 19 nt, Homo sapiens
cauugggaauauaucugua

SEQ ID NO: 1565150 - RNA, 19 nt, Homo sapiens
gaucgcgccauuacacuuc

SEQ ID NO: 1565151 - RNA, 19 nt, Homo sapiens
uaacgccuguauggaguug

SEQ ID NO: 1565152 - RNA, 19 nt, Homo sapiens
gacagacccagagguguuu

SEQ ID NO: 1565153 - RNA, 19 nt, Homo sapiens
gcacaccggcuguccaaaa

SEQ ID NO: 1565154 - RNA, 19 nt, Homo sapiens
gaagaacacuuaagagcua

SEQ ID NO: 1565155 - RNA, 19 nt, Homo sapiens
gaacaacgccuauuccuaa

SEQ ID NO: 1565156 - RNA, 19 nt, Homo sapiens
gcaaggacuucaugucuaa

SEQ ID NO: 1565157 - RNA, 19 nt, Homo sapiens
caacuuuacugucgguuua

SEQ ID NO: 1565158 - RNA, 19 nt, Homo sapiens
gaguaaaucuugcauucua

SEQ ID NO: 1565159 - RNA, 19 nt, Homo sapiens
gaaacaagaucuucuagag

SEQ ID NO: 1565160 - RNA, 19 nt, Homo sapiens
uaaauuaccuugggcagua

SEQ ID NO: 1565161 - RNA, 19 nt, Homo sapiens
ucacaucccuuguaaguug

SEQ ID NO: 1565162 - RNA, 19 nt, Homo sapiens
aaagagauguuacuucuga

SEQ ID NO: 1565163 - RNA, 19 nt, Homo sapiens
gcuacucucuuucuacaua

SEQ ID NO: 1565164 - RNA, 19 nt, Homo sapiens
gaaagagacugcguugaga

SEQ ID NO: 1565165 - RNA, 19 nt, Homo sapiens
gaaguugcuuaucagcuua

SEQ ID NO: 1565166 - RNA, 19 nt, Homo sapiens
aaacucagcuucuguuguu

SEQ ID NO: 1565167 - RNA, 19 nt, Homo sapiens
gaagaggaauggaagacaa

SEQ ID NO: 1565168 - RNA, 19 nt, Homo sapiens
caagauggauuaaagacuu

SEQ ID NO: 1565169 - RNA, 19 nt, Homo sapiens
uaaguuggauuccuaggua

SEQ ID NO: 1565170 - RNA, 19 nt, Homo sapiens
ggaauguucuucuauuugu

SEQ ID NO: 1565171 - RNA, 19 nt, Homo sapiens
uaaaugcauucucagcuua

SEQ ID NO: 1565172 - RNA, 19 nt, Homo sapiens
gauagaggagguauaaaua

SEQ ID NO: 1565173 - RNA, 19 nt, Homo sapiens
gaaacuaccaucagaguga

SEQ ID NO: 1565174 - RNA, 19 nt, Homo sapiens
caacuaacauuuacugagu

SEQ ID NO: 1565175 - RNA, 19 nt, Homo sapiens
gcucaggguucuuacagua

SEQ ID NO: 1565176 - RNA, 19 nt, Homo sapiens
gguauuaaaugcauucuca

SEQ ID NO: 1565177 - RNA, 19 nt, Homo sapiens
gauaagagcaauaaaggaa

SEQ ID NO: 1565178 - RNA, 19 nt, Homo sapiens
uaaccagaaucuacaauga

SEQ ID NO: 1565179 - RNA, 19 nt, Homo sapiens
gaagucagguagugugaug

SEQ ID NO: 1565180 - RNA, 19 nt, Homo sapiens
caucauagaagccuuuaua

SEQ ID NO: 1565181 - RNA, 19 nt, Homo sapiens
aaagagagaugggauggua

SEQ ID NO: 1565182 - RNA, 19 nt, Homo sapiens
gaagaaaaccuaggcauua

SEQ ID NO: 1565183 - RNA, 19 nt, Homo sapiens
ucagauaguuguagauaug

SEQ ID NO: 1565184 - RNA, 19 nt, Homo sapiens
ugacaaggauggcagaaga

SEQ ID NO: 1565185 - RNA, 19 nt, Homo sapiens
caaggagaaucauauacaa

SEQ ID NO: 1565186 - RNA, 19 nt, Homo sapiens
ccacaacuuuauuaaggua

SEQ ID NO: 1565187 - RNA, 19 nt, Homo sapiens
gaugauagaggagguauaa

SEQ ID NO: 1565188 - RNA, 19 nt, Homo sapiens
gagaagagaggauagaaga

SEQ ID NO: 1565189 - RNA, 19 nt, Homo sapiens
gaucagauaguuguagaua

SEQ ID NO: 1565190 - RNA, 19 nt, Homo sapiens
ccacaccacaacuuuauua

SEQ ID NO: 1565191 - RNA, 19 nt, Homo sapiens
gaugaggcauagauauuug

SEQ ID NO: 1565192 - RNA, 19 nt, Homo sapiens
caguauacuuggaaagaua

SEQ ID NO: 1565193 - RNA, 19 nt, Homo sapiens
gaagaacaacagcauagaa

SEQ ID NO: 1565194 - RNA, 19 nt, Homo sapiens
aggcauagauauuuggaua

SEQ ID NO: 1565195 - RNA, 19 nt, Homo sapiens
cagcaguaauuauugagua

SEQ ID NO: 1565196 - RNA, 19 nt, Homo sapiens
gagaagagagugacaggaa

SEQ ID NO: 1565197 - RNA, 19 nt, Homo sapiens
gaacaacagcauagaaaca

SEQ ID NO: 1565198 - RNA, 19 nt, Homo sapiens
gaacagacacuucucaaaa

SEQ ID NO: 1565199 - RNA, 19 nt, Homo sapiens
ugacaaaugggaucuaauu

SEQ ID NO: 1565200 - RNA, 19 nt, Homo sapiens
gagcagcgguuuguaguuc

SEQ ID NO: 1565201 - RNA, 19 nt, Homo sapiens
ggagacaaaugcugauugg

SEQ ID NO: 1565202 - RNA, 19 nt, Homo sapiens
gaagagaaggagacaaaug

SEQ ID NO: 1565203 - RNA, 19 nt, Homo sapiens
ggauggcauugaaucuaua

SEQ ID NO: 1565204 - RNA, 19 nt, Homo sapiens
gagcuacucucuuucuaca

SEQ ID NO: 1565205 - RNA, 19 nt, Homo sapiens
ggcaaggacuucaugucua

SEQ ID NO: 1565206 - RNA, 19 nt, Homo sapiens
gggauggcauugaaucuau

SEQ ID NO: 1565207 - RNA, 19 nt, Homo sapiens
gcucuguucuguuccauug

SEQ ID NO: 1565208 - RNA, 19 nt, Homo sapiens
guagauaugcggcguuauu

SEQ ID NO: 1565209 - RNA, 19 nt, Homo sapiens
ugucaaagaucagauaguu

SEQ ID NO: 1565210 - RNA, 19 nt, Homo sapiens
gcaagccaauuaacauauc

SEQ ID NO: 1565211 - RNA, 19 nt, Homo sapiens
ggaaguggguauguguaaa

SEQ ID NO: 1565212 - RNA, 19 nt, Homo sapiens
gaggagguauaaauauuuc

SEQ ID NO: 1565213 - RNA, 19 nt, Homo sapiens
gacaaaugggaucuaauua

SEQ ID NO: 1565214 - RNA, 19 nt, Homo sapiens
ccuaauggauagagaagaa

SEQ ID NO: 1565215 - RNA, 19 nt, Homo sapiens
ccauugaucuauaucuuug

SEQ ID NO: 1565216 - RNA, 19 nt, Homo sapiens
uaacauauccucacuucau

SEQ ID NO: 1565217 - RNA, 19 nt, Homo sapiens
acaauuggcuaaucaagau

SEQ ID NO: 1565218 - RNA, 19 nt, Homo sapiens
uagauauggugcuaaguuu

SEQ ID NO: 1565219 - RNA, 19 nt, Homo sapiens
ggagaaucauauacaacuu

SEQ ID NO: 1565220 - RNA, 19 nt, Homo sapiens
cagcuucuguuguuuauca

SEQ ID NO: 1565221 - RNA, 19 nt, Homo sapiens
ugaaguugcuuaucagcuu

SEQ ID NO: 1565222 - RNA, 19 nt, Homo sapiens
cauggaauguucuucuauu

SEQ ID NO: 1565223 - RNA, 19 nt, Homo sapiens
ggaaagagaaugcauagac

SEQ ID NO: 1565224 - RNA, 19 nt, Homo sapiens
ucaggguucuuacaguaua

SEQ ID NO: 1565225 - RNA, 19 nt, Homo sapiens
uggaacacauggugaauga

SEQ ID NO: 1565226 - RNA, 19 nt, Homo sapiens
auacagaggucaagaugga

SEQ ID NO: 1565227 - RNA, 19 nt, Homo sapiens
caaaagcaauggcaacaaa

SEQ ID NO: 1565228 - RNA, 19 nt, Homo sapiens
gaacacauggugaaugaca

SEQ ID NO: 1565229 - RNA, 19 nt, Homo sapiens
uaacggagaagauauagga

SEQ ID NO: 1565230 - RNA, 19 nt, Homo sapiens
gcaagauacuggcuuuaac

SEQ ID NO: 1565231 - RNA, 19 nt, Homo sapiens
ugaaggacaugaacagaca

SEQ ID NO: 1565232 - RNA, 19 nt, Homo sapiens
ugauuuggcucucuguuug

SEQ ID NO: 1565233 - RNA, 19 nt, Homo sapiens
ugaaggaucagaaggaauu

SEQ ID NO: 1565234 - RNA, 19 nt, Homo sapiens
guugagacaugaaggauca

SEQ ID NO: 1565235 - RNA, 19 nt, Homo sapiens
gauggaagaccaaccaaga

SEQ ID NO: 1565236 - RNA, 19 nt, Homo sapiens
ugaaugacauacagcaaau

SEQ ID NO: 1565237 - RNA, 19 nt, Homo sapiens
ggccaagguucaauuacuu

SEQ ID NO: 1565238 - RNA, 19 nt, Homo sapiens
gaagagagugacaggaaga

SEQ ID NO: 1565239 - RNA, 19 nt, Homo sapiens
ccacaagcaagccaauuaa

SEQ ID NO: 1565240 - RNA, 19 nt, Homo sapiens
caccacaacuuuauuaagg

SEQ ID NO: 1565241 - RNA, 19 nt, Homo sapiens
caacgccuauuccuaaugg

SEQ ID NO: 1565242 - RNA, 19 nt, Homo sapiens
caaaagagauguuacuucu

SEQ ID NO: 1565243 - RNA, 19 nt, Homo sapiens
ggacaugaacagacacuuc

SEQ ID NO: 1565244 - RNA, 19 nt, Homo sapiens
gguggcagaagaacacuua

SEQ ID NO: 1565245 - RNA, 19 nt, Homo sapiens
aggcagauguacaggauaa

SEQ ID NO: 1565246 - RNA, 19 nt, Homo sapiens
gcuaauaaccagaaucuac

SEQ ID NO: 1565247 - RNA, 19 nt, Homo sapiens
caacaaaagccaaaauuga

SEQ ID NO: 1565248 - RNA, 19 nt, Homo sapiens
aaacuuacucuucguagaa

SEQ ID NO: 1565249 - RNA, 19 nt, Homo sapiens
uaaccuggaucccuuccuu

SEQ ID NO: 1565250 - RNA, 19 nt, Homo sapiens
ugagggcucuguucuguuc

SEQ ID NO: 1565251 - RNA, 19 nt, Homo sapiens
ucaaagaucagauaguugu

SEQ ID NO: 1565252 - RNA, 19 nt, Homo sapiens
guaaaguguucaccacaag

SEQ ID NO: 1565253 - RNA, 19 nt, Homo sapiens
guacucauauccuuauacu

SEQ ID NO: 1565254 - RNA, 19 nt, Homo sapiens
gaagaaagauuacugauuc

SEQ ID NO: 1565255 - RNA, 19 nt, Homo sapiens
gaagaaggaucaaagugaa

SEQ ID NO: 1565256 - RNA, 19 nt, Homo sapiens
ggaaacagguuaguauuug

SEQ ID NO: 1565257 - RNA, 19 nt, Homo sapiens
ucaaagggaugcacuaauu

SEQ ID NO: 1565258 - RNA, 19 nt, Homo sapiens
gacaaagacugaugaagaa

SEQ ID NO: 1565259 - RNA, 19 nt, Homo sapiens
ggaagaaggaucaaaguga

SEQ ID NO: 1565260 - RNA, 19 nt, Homo sapiens
gcacagcguucuugcucua

SEQ ID NO: 1565261 - RNA, 19 nt, Homo sapiens
gaccauaacucacuuaaaa

SEQ ID NO: 1565262 - RNA, 19 nt, Homo sapiens
gagcagauaugacaucagu

SEQ ID NO: 1565263 - RNA, 19 nt, Homo sapiens
gaaaugggcaugccagaug

SEQ ID NO: 1565264 - RNA, 19 nt, Homo sapiens
ggccagaguuuccaaguug

SEQ ID NO: 1565265 - RNA, 19 nt, Homo sapiens
ggacauccauucuguacca

SEQ ID NO: 1565266 - RNA, 19 nt, Homo sapiens
gaaacagguuaguauuugu

SEQ ID NO: 1565267 - RNA, 19 nt, Homo sapiens
gcuagcagcagaagcaaua

SEQ ID NO: 1565268 - RNA, 19 nt, Homo sapiens
ccuuucaggugauaaauaa

SEQ ID NO: 1565269 - RNA, 19 nt, Homo sapiens
gaaagauuacugauucgaa

SEQ ID NO: 1565270 - RNA, 19 nt, Homo sapiens
agacaaagacugaugaaga

SEQ ID NO: 1565271 - RNA, 19 nt, Homo sapiens
ggagaucugcuguggauga

SEQ ID NO: 1565272 - RNA, 19 nt, Homo sapiens
ccucacagcuggcauaugg

SEQ ID NO: 1565273 - RNA, 19 nt, Homo sapiens
uaauggcccuggagacaaa

SEQ ID NO: 1565274 - RNA, 19 nt, Homo sapiens
aaucggcacuggugacuuu

SEQ ID NO: 1565275 - RNA, 19 nt, Homo sapiens
cuaaauaaacucccaguau

SEQ ID NO: 1565276 - RNA, 19 nt, Homo sapiens
cauaccauuugcucuauuu

SEQ ID NO: 1565277 - RNA, 19 nt, Homo sapiens
gaacagaaccucaaaaguc

SEQ ID NO: 1565278 - RNA, 19 nt, Homo sapiens
ggaaaauggucucaaauag

SEQ ID NO: 1565279 - RNA, 19 nt, Homo sapiens
aaagcuuuguucucuguua

SEQ ID NO: 1565280 - RNA, 19 nt, Homo sapiens
caacagauuacauaccauu

SEQ ID NO: 1565281 - RNA, 19 nt, Homo sapiens
gaucugcuguggaugaauc

SEQ ID NO: 1565282 - RNA, 19 nt, Homo sapiens
aaagacugaugaagaaaga

SEQ ID NO: 1565283 - RNA, 19 nt, Homo sapiens
caaagggaugcacuaauuu

SEQ ID NO: 1565284 - RNA, 19 nt, Homo sapiens
caucaaucauccuuuccua

SEQ ID NO: 1565285 - RNA, 19 nt, Homo sapiens
gaaaagcuuuguucucugu

SEQ ID NO: 1565286 - RNA, 19 nt, Homo sapiens
gagaucccaucgcugagaa

SEQ ID NO: 1565287 - RNA, 19 nt, Homo sapiens
cccagaagcugaaaacaua

SEQ ID NO: 1565288 - RNA, 19 nt, Homo sapiens
caucuuagcucugauugag

SEQ ID NO: 1565289 - RNA, 19 nt, Homo sapiens
ucagggacauccauucugu

SEQ ID NO: 1565290 - RNA, 19 nt, Homo sapiens
acauuccaguucaaaguua

SEQ ID NO: 1565291 - RNA, 19 nt, Homo sapiens
ucgaagggcaugaacauuu

SEQ ID NO: 1565292 - RNA, 19 nt, Homo sapiens
gagguaggguuggaacaga

SEQ ID NO: 1565293 - RNA, 19 nt, Homo sapiens
uauggaggcuguuaauaag

SEQ ID NO: 1565294 - RNA, 19 nt, Homo sapiens
uuacauaccauuugcucua

SEQ ID NO: 1565295 - RNA, 19 nt, Homo sapiens
gagaucugcuguggaugaa

SEQ ID NO: 1565296 - RNA, 19 nt, Homo sapiens
gaucuagcagugaccagua

SEQ ID NO: 1565297 - RNA, 19 nt, Homo sapiens
gauaauggcccuggagaca

SEQ ID NO: 1565298 - RNA, 19 nt, Homo sapiens
ucaagcgacuaacuaggaa

SEQ ID NO: 1565299 - RNA, 19 nt, Homo sapiens
gaagcaauagaaauggaaa

SEQ ID NO: 1565300 - RNA, 19 nt, Homo sapiens
cagaagcaauagaaaugga

SEQ ID NO: 1565301 - RNA, 19 nt, Homo sapiens
uaaacucccaguauucuug

SEQ ID NO: 1565302 - RNA, 19 nt, Homo sapiens
auauggaggcuguuaauaa

SEQ ID NO: 1565303 - RNA, 19 nt, Homo sapiens
cagcugugaugcagaugaa

SEQ ID NO: 1565304 - RNA, 19 nt, Homo sapiens
gccaguagcccugagauga

SEQ ID NO: 1565305 - RNA, 19 nt, Homo sapiens
ccagaagaaagauuacuga

SEQ ID NO: 1565306 - RNA, 19 nt, Homo sapiens
ccaguauucuugaccaaca

SEQ ID NO: 1565307 - RNA, 19 nt, Homo sapiens
ggaagaacaacugaacaug

SEQ ID NO: 1565308 - RNA, 19 nt, Homo sapiens
cgaagggcaugaacauuuu

SEQ ID NO: 1565309 - RNA, 19 nt, Homo sapiens
gcauauggaggcuguuaau

SEQ ID NO: 1565310 - RNA, 19 nt, Homo sapiens
caucaagaggccagaguuu

SEQ ID NO: 1565311 - RNA, 19 nt, Homo sapiens
gcuugcaucuuagcucuga

SEQ ID NO: 1565312 - RNA, 19 nt, Homo sapiens
acacugacgccaagaauuc

SEQ ID NO: 1565313 - RNA, 19 nt, Homo sapiens
gaucagaggcucacauucc

SEQ ID NO: 1565314 - RNA, 19 nt, Homo sapiens
cuaggaaacagguuaguau

SEQ ID NO: 1565315 - RNA, 19 nt, Homo sapiens
caaucauccuuuccuaaca

SEQ ID NO: 1565316 - RNA, 19 nt, Homo sapiens
ugggagaucugcuguggau

SEQ ID NO: 1565317 - RNA, 19 nt, Homo sapiens
gaaaguaggagccccagaa

SEQ ID NO: 1565318 - RNA, 19 nt, Homo sapiens
aagcuuuguucucuguuaa

SEQ ID NO: 1565319 - RNA, 19 nt, Homo sapiens
uaauagggcauuggaaguu

SEQ ID NO: 1565320 - RNA, 19 nt, Homo sapiens
gacccucuuuggacuaaau

SEQ ID NO: 1565321 - RNA, 19 nt, Homo sapiens
cagcagaagcaauagaaau

SEQ ID NO: 1565322 - RNA, 19 nt, Homo sapiens
ggagacaaagacugaugaa

SEQ ID NO: 1565323 - RNA, 19 nt, Homo sapiens
ugacucuuggccuaaauua

SEQ ID NO: 1565324 - RNA, 19 nt, Homo sapiens
uaugguugcuaacacaaga

SEQ ID NO: 1565325 - RNA, 19 nt, Homo sapiens
gaaaauggucucaaauagu

SEQ ID NO: 1565326 - RNA, 19 nt, Homo sapiens
gcagcagaagcaauagaaa

SEQ ID NO: 1565327 - RNA, 19 nt, Homo sapiens
ugagagggguguacuggua

SEQ ID NO: 1565328 - RNA, 19 nt, Homo sapiens
cuuaagagcagauaugaca

SEQ ID NO: 1565329 - RNA, 19 nt, Homo sapiens
uagauucccagaagaaaga

SEQ ID NO: 1565330 - RNA, 19 nt, Homo sapiens
cagauuacauaccauuugc

SEQ ID NO: 1565331 - RNA, 19 nt, Homo sapiens
cucauuaucuucuuucucu

SEQ ID NO: 1565332 - RNA, 19 nt, Homo sapiens
cuucaccgaugucagcauu

SEQ ID NO: 1565333 - RNA, 19 nt, Homo sapiens
ucagugcaguugugaaguc

SEQ ID NO: 1565334 - RNA, 19 nt, Homo sapiens
gggaagaaggaucaaagug

SEQ ID NO: 1565335 - RNA, 19 nt, Homo sapiens
aggaaacagguuaguauuu

SEQ ID NO: 1565336 - RNA, 19 nt, Homo sapiens
aaaauggucucaaauaguc

SEQ ID NO: 1565337 - RNA, 19 nt, Homo sapiens
cauauggaggcuguuaaua

SEQ ID NO: 1565338 - RNA, 19 nt, Homo sapiens
gaagaucagaggcucacau

SEQ ID NO: 1565339 - RNA, 19 nt, Homo sapiens
ccaaggugaccauaacuca

SEQ ID NO: 1565340 - RNA, 19 nt, Homo sapiens
gcccauucauugccaguag

SEQ ID NO: 1565341 - RNA, 19 nt, Homo sapiens
gguaugaccacccgagauc

SEQ ID NO: 1565342 - RNA, 19 nt, Homo sapiens
gcaucaagaggccagaguu

SEQ ID NO: 1565343 - RNA, 19 nt, Homo sapiens
aagcuggaccuuugacuug

SEQ ID NO: 1565344 - RNA, 19 nt, Homo sapiens
cuugauuuguuuacacuga

SEQ ID NO: 1565345 - RNA, 19 nt, Homo sapiens
caaagacugaugaagaaag

SEQ ID NO: 1565346 - RNA, 19 nt, Homo sapiens
uaugccaacuaauaaagug

SEQ ID NO: 1565347 - RNA, 19 nt, Homo sapiens
ccugaaagcuguuuuaugc

SEQ ID NO: 1565348 - RNA, 19 nt, Homo sapiens
guaaggaaugaaaguagga

SEQ ID NO: 1565349 - RNA, 19 nt, Homo sapiens
ccuaacacaugaaucuuuu

SEQ ID NO: 1565350 - RNA, 19 nt, Homo sapiens
gcaacagauuacauaccau

SEQ ID NO: 1565351 - RNA, 19 nt, Homo sapiens
acacaugaaucuuuuggaa

SEQ ID NO: 1565352 - RNA, 19 nt, Homo sapiens
ucccaucgcugagaaagau

SEQ ID NO: 1565353 - RNA, 19 nt, Homo sapiens
guucaaaguuagagaaacc

SEQ ID NO: 1565354 - RNA, 19 nt, Homo sapiens
ggaacagggugauauauug

SEQ ID NO: 1565355 - RNA, 19 nt, Homo sapiens
gcacuuugacucucacuua

SEQ ID NO: 1565356 - RNA, 19 nt, Homo sapiens
ggacgaaagugugaacuau

SEQ ID NO: 1565357 - RNA, 19 nt, Homo sapiens
gaacaagggaaauugauga

SEQ ID NO: 1565358 - RNA, 19 nt, Homo sapiens
gaaaugaccacugaagauu

SEQ ID NO: 1565359 - RNA, 19 nt, Homo sapiens
gaguaugccuucacuaugu

SEQ ID NO: 1565360 - RNA, 19 nt, Homo sapiens
caagacaguacaacaaaua

SEQ ID NO: 1565361 - RNA, 19 nt, Homo sapiens
ugagguaggugcccauaaa

SEQ ID NO: 1565362 - RNA, 19 nt, Homo sapiens
gggagacuuucaaugguua

SEQ ID NO: 1565363 - RNA, 19 nt, Homo sapiens
gaagaacaagggaaauuga

SEQ ID NO: 1565364 - RNA, 19 nt, Homo sapiens
ccacaaguacccaaauuaa

SEQ ID NO: 1565365 - RNA, 19 nt, Homo sapiens
ggcaugagguuuggccuua

SEQ ID NO: 1565366 - RNA, 19 nt, Homo sapiens
auaaaccucuugacucuuu

SEQ ID NO: 1565367 - RNA, 19 nt, Homo sapiens
gcgagcugccuacaaauua

SEQ ID NO: 1565368 - RNA, 19 nt, Homo sapiens
aagcuuagguuuauguuga

SEQ ID NO: 1565369 - RNA, 19 nt, Homo sapiens
caagggaaauugaugaaag

SEQ ID NO: 1565370 - RNA, 19 nt, Homo sapiens
acgaaagugugaacuauaa

SEQ ID NO: 1565371 - RNA, 19 nt, Homo sapiens
caacaagacaguacaacaa

SEQ ID NO: 1565372 - RNA, 19 nt, Homo sapiens
gaccaaaaccuuucuguua

SEQ ID NO: 1565373 - RNA, 19 nt, Homo sapiens
ccucuugacucuuuaauuc

SEQ ID NO: 1565374 - RNA, 19 nt, Homo sapiens
cuagagagguccacuuugu

SEQ ID NO: 1565375 - RNA, 19 nt, Homo sapiens
gagaguaugccuucacuau

SEQ ID NO: 1565376 - RNA, 19 nt, Homo sapiens
ggaauugugugagcuagga

SEQ ID NO: 1565377 - RNA, 19 nt, Homo sapiens
ccaaagcuuucaacccauu

SEQ ID NO: 1565378 - RNA, 19 nt, Homo sapiens
ccauaaaccucuugacucu

SEQ ID NO: 1565379 - RNA, 19 nt, Homo sapiens
gugguucccuguacuauau

SEQ ID NO: 1565380 - RNA, 19 nt, Homo sapiens
gaaagugugaacuauaaga

SEQ ID NO: 1565381 - RNA, 19 nt, Homo sapiens
gaugagagaugagguaggu

SEQ ID NO: 1565382 - RNA, 19 nt, Homo sapiens
ggaagaacaagggaaauug

SEQ ID NO: 1565383 - RNA, 19 nt, Homo sapiens
ggugggagaugagagauga

SEQ ID NO: 1565384 - RNA, 19 nt, Homo sapiens
aaauuacucugucuccaaa

SEQ ID NO: 1565385 - RNA, 19 nt, Homo sapiens
ggucacaucaugauacuug

SEQ ID NO: 1565386 - RNA, 19 nt, Homo sapiens
ggagaugagagaugaggua

SEQ ID NO: 1565387 - RNA, 19 nt, Homo sapiens
caacaaauaaucucuagag

SEQ ID NO: 1565388 - RNA, 19 nt, Homo sapiens
gaacagggugauauauugu

SEQ ID NO: 1565389 - RNA, 19 nt, Homo sapiens
guucaucucccaaagcuuu

SEQ ID NO: 1565390 - RNA, 19 nt, Homo sapiens
ggacugagaacgggaagaa

SEQ ID NO: 1565391 - RNA, 19 nt, Homo sapiens
gggaacagggugauauauu

SEQ ID NO: 1565392 - RNA, 19 nt, Homo sapiens
gcucagcgcucugcaccuu

SEQ ID NO: 1565393 - RNA, 19 nt, Homo sapiens
gacgaaagugugaacuaua

SEQ ID NO: 1565394 - RNA, 19 nt, Homo sapiens
ucucuugggaucagaauua

SEQ ID NO: 1565395 - RNA, 19 nt, Homo sapiens
gugguggacuugaaauuuc

SEQ ID NO: 1565396 - RNA, 19 nt, Homo sapiens
caaauuacucugucuccaa

SEQ ID NO: 1565397 - RNA, 19 nt, Homo sapiens
gcaacaagacaguacaaca

SEQ ID NO: 1565398 - RNA, 19 nt, Homo sapiens
guacccaaauuaaagucaa

SEQ ID NO: 1565399 - RNA, 19 nt, Homo sapiens
uuucaugacuauucaguug

SEQ ID NO: 1565400 - RNA, 19 nt, Homo sapiens
gauugucuaugggcaguuu

SEQ ID NO: 1565401 - RNA, 19 nt, Homo sapiens
gggaagaacaagggaaauu

SEQ ID NO: 1565402 - RNA, 19 nt, Homo sapiens
caaugaagcggacgaaagu

SEQ ID NO: 1565403 - RNA, 19 nt, Homo sapiens
caguuugaauuucugguuu

SEQ ID NO: 1565404 - RNA, 19 nt, Homo sapiens
gagagaaaauguagaucaa

SEQ ID NO: 1565405 - RNA, 19 nt, Homo sapiens
gagauguuuucaugaguua

SEQ ID NO: 1565406 - RNA, 19 nt, Homo sapiens
cacuuugacucucacuuaa

SEQ ID NO: 1565407 - RNA, 19 nt, Homo sapiens
gaaaugauggggaggaaaa

SEQ ID NO: 1565408 - RNA, 19 nt, Homo sapiens
ucacagccaagagagauua

SEQ ID NO: 1565409 - RNA, 19 nt, Homo sapiens
gguuaaggcuccauuucuc

SEQ ID NO: 1565410 - RNA, 19 nt, Homo sapiens
gcuuaucauuguacuuuca

SEQ ID NO: 1565411 - RNA, 19 nt, Homo sapiens
ucaguuguguguguuuauu

SEQ ID NO: 1565412 - RNA, 19 nt, Homo sapiens
cuuugacucucacuuaauu

SEQ ID NO: 1565413 - RNA, 19 nt, Homo sapiens
gacaguacaacaaauaauc

SEQ ID NO: 1565414 - RNA, 19 nt, Homo sapiens
gaaauuucccguucaucuc

SEQ ID NO: 1565415 - RNA, 19 nt, Homo sapiens
cgacugauaacguucaaug

SEQ ID NO: 1565416 - RNA, 19 nt, Homo sapiens
acacgcuucuguauuucua

SEQ ID NO: 1565417 - RNA, 19 nt, Homo sapiens
gaagguaaacuugggagau

SEQ ID NO: 1565418 - RNA, 19 nt, Homo sapiens
acaaguacccaaauuaaag

SEQ ID NO: 1565419 - RNA, 19 nt, Homo sapiens
gaagcggacgaaaguguga

SEQ ID NO: 1565420 - RNA, 19 nt, Homo sapiens
uauaaacaccacaagaaga

SEQ ID NO: 1565421 - RNA, 19 nt, Homo sapiens
cacaaguacccaaauuaaa

SEQ ID NO: 1565422 - RNA, 19 nt, Homo sapiens
gguuuggccuuagguauuc

SEQ ID NO: 1565423 - RNA, 19 nt, Homo sapiens
acaagacaguacaacaaau

SEQ ID NO: 1565424 - RNA, 19 nt, Homo sapiens
gcaguuugaauuucugguu

SEQ ID NO: 1565425 - RNA, 19 nt, Homo sapiens
cuaggcgacugauaacguu

SEQ ID NO: 1565426 - RNA, 19 nt, Homo sapiens
ggagauguuuucaugaguu

SEQ ID NO: 1565427 - RNA, 19 nt, Homo sapiens
uguuaaugcugaagguaaa

SEQ ID NO: 1565428 - RNA, 19 nt, Homo sapiens
ucccguaggucacaucaug

SEQ ID NO: 1565429 - RNA, 19 nt, Homo sapiens
gugcuacucuccgacaaga

SEQ ID NO: 1565430 - RNA, 19 nt, Homo sapiens
cagaaaugaccacugaaga

SEQ ID NO: 1565431 - RNA, 19 nt, Homo sapiens
gaauuagcacuuugacucu

SEQ ID NO: 1565432 - RNA, 19 nt, Homo sapiens
agaaaugaccacugaagau

SEQ ID NO: 1565433 - RNA, 19 nt, Homo sapiens
ucuaugggcaguuugaauu

SEQ ID NO: 1565434 - RNA, 19 nt, Homo sapiens
gaagcuuagguuuauguug

SEQ ID NO: 1565435 - RNA, 19 nt, Homo sapiens
aagguaaacuugggagaug

SEQ ID NO: 1565436 - RNA, 19 nt, Homo sapiens
acagggugauauauuguau

SEQ ID NO: 1565437 - RNA, 19 nt, Homo sapiens
aaggcuccauuucucauuu

SEQ ID NO: 1565438 - RNA, 19 nt, Homo sapiens
caaagugguagccgcagaa

SEQ ID NO: 1565439 - RNA, 19 nt, Homo sapiens
caaguacccaaauuaaagu

SEQ ID NO: 1565440 - RNA, 19 nt, Homo sapiens
ggcgagcugccuacaaauu

SEQ ID NO: 1565441 - RNA, 19 nt, Homo sapiens
aaauggaggcacgcacuua

SEQ ID NO: 1565442 - RNA, 19 nt, Homo sapiens
agggugauauauuguauuc

SEQ ID NO: 1565443 - RNA, 19 nt, Homo sapiens
gauugaauuagcacuuuga

SEQ ID NO: 1565444 - RNA, 19 nt, Homo sapiens
ccaagagagauuagagaga

SEQ ID NO: 1565445 - RNA, 19 nt, Homo sapiens
agagagguccacuuuguug

SEQ ID NO: 1565446 - RNA, 19 nt, Homo sapiens
cuauaagacugguccuaag

SEQ ID NO: 1565447 - RNA, 19 nt, Homo sapiens
cauuguacuuucauugcuu

SEQ ID NO: 1565448 - RNA, 19 nt, Homo sapiens
aaacuugcuuacugaccuu

SEQ ID NO: 1565449 - RNA, 19 nt, Homo sapiens
gaggaugggcaugagguuu

SEQ ID NO: 1565450 - RNA, 19 nt, Homo sapiens
gaggggaagcuuagguuua

SEQ ID NO: 1565451 - RNA, 19 nt, Homo sapiens
aagggaaauugaugaaagu

SEQ ID NO: 1565452 - RNA, 19 nt, Homo sapiens
gaaaauuacacgcuucugu

SEQ ID NO: 1565453 - RNA, 19 nt, Homo sapiens
ucaugacuauucaguugug

SEQ ID NO: 1565454 - RNA, 19 nt, Homo sapiens
ggaaaucgcugauaaagau

SEQ ID NO: 1565455 - RNA, 19 nt, Homo sapiens
gcaaguauucuccuaauua

SEQ ID NO: 1565456 - RNA, 19 nt, Homo sapiens
gaagauuacuggaucauau

SEQ ID NO: 1565457 - RNA, 19 nt, Homo sapiens
gcugauggcugaaguguaa

SEQ ID NO: 1565458 - RNA, 19 nt, Homo sapiens
cuaaaguccugauacauua

SEQ ID NO: 1565459 - RNA, 19 nt, Homo sapiens
gcacuucuguuaggaauuu

SEQ ID NO: 1565460 - RNA, 19 nt, Homo sapiens
gaagaaugguuaucagaau

SEQ ID NO: 1565461 - RNA, 19 nt, Homo sapiens
gaaagcaaguauucuccua

SEQ ID NO: 1565462 - RNA, 19 nt, Homo sapiens
ugagggagguacuaauuua

SEQ ID NO: 1565463 - RNA, 19 nt, Homo sapiens
acacucagaucaccaguua

SEQ ID NO: 1565464 - RNA, 19 nt, Homo sapiens
gaacuaguaucuacaacau

SEQ ID NO: 1565465 - RNA, 19 nt, Homo sapiens
uaaauaugguggucuguaa

SEQ ID NO: 1565466 - RNA, 19 nt, Homo sapiens
guucugaucugguuggaua

SEQ ID NO: 1565467 - RNA, 19 nt, Homo sapiens
ccuaagagacuuucuguua

SEQ ID NO: 1565468 - RNA, 19 nt, Homo sapiens
uauaaaggcccauaacaua

SEQ ID NO: 1565469 - RNA, 19 nt, Homo sapiens
gcucagagguucgacuuaa

SEQ ID NO: 1565470 - RNA, 19 nt, Homo sapiens
ccaguaagcuagauguuga

SEQ ID NO: 1565471 - RNA, 19 nt, Homo sapiens
cauauaaggucauuucugu

SEQ ID NO: 1565472 - RNA, 19 nt, Homo sapiens
gcaggacucuugauugugu

SEQ ID NO: 1565473 - RNA, 19 nt, Homo sapiens
caacugaucuuaguguaga

SEQ ID NO: 1565474 - RNA, 19 nt, Homo sapiens
gaauugauguggguuuauu

SEQ ID NO: 1565475 - RNA, 19 nt, Homo sapiens
uaagcuagauguugaaugu

SEQ ID NO: 1565476 - RNA, 19 nt, Homo sapiens
gaaaguccuuaaaguugaa

SEQ ID NO: 1565477 - RNA, 19 nt, Homo sapiens
uaacgugucuucccucuuc

SEQ ID NO: 1565478 - RNA, 19 nt, Homo sapiens
gcacagaaccgguuugaag

SEQ ID NO: 1565479 - RNA, 19 nt, Homo sapiens
uaagagacuuucuguuaga

SEQ ID NO: 1565480 - RNA, 19 nt, Homo sapiens
guaccuaaauucagucaga

SEQ ID NO: 1565481 - RNA, 19 nt, Homo sapiens
uagaggaaaugguguauau

SEQ ID NO: 1565482 - RNA, 19 nt, Homo sapiens
ggacauauaaggucauuuc

SEQ ID NO: 1565483 - RNA, 19 nt, Homo sapiens
caacaaugcuaaucgauac

SEQ ID NO: 1565484 - RNA, 19 nt, Homo sapiens
gggcaggacucuugauugu

SEQ ID NO: 1565485 - RNA, 19 nt, Homo sapiens
gcauuuaaaucaaguugug

SEQ ID NO: 1565486 - RNA, 19 nt, Homo sapiens
uauccaagccuucaauaua

SEQ ID NO: 1565487 - RNA, 19 nt, Homo sapiens
ucagugcuuuguacauuua

SEQ ID NO: 1565488 - RNA, 19 nt, Homo sapiens
gaacacaucagagcuauca

SEQ ID NO: 1565489 - RNA, 19 nt, Homo sapiens
gaaacgauucuuuggcuuu

SEQ ID NO: 1565490 - RNA, 19 nt, Homo sapiens
gaggaaaugguguauauga

SEQ ID NO: 1565491 - RNA, 19 nt, Homo sapiens
gcaaccaacugaucuuagu

SEQ ID NO: 1565492 - RNA, 19 nt, Homo sapiens
guacugaccuugauuucuc

SEQ ID NO: 1565493 - RNA, 19 nt, Homo sapiens
caggaaugauugacacuuu

SEQ ID NO: 1565494 - RNA, 19 nt, Homo sapiens
gaaacagccucugccauca

SEQ ID NO: 1565495 - RNA, 19 nt, Homo sapiens
aguauuggauccugaauuu

SEQ ID NO: 1565496 - RNA, 19 nt, Homo sapiens
caucagaguuguuuauagu

SEQ ID NO: 1565497 - RNA, 19 nt, Homo sapiens
auuagaaccugaacuagua

SEQ ID NO: 1565498 - RNA, 19 nt, Homo sapiens
gagauucugcuaugacuuu

SEQ ID NO: 1565499 - RNA, 19 nt, Homo sapiens
gccaggaaguucuugauga

SEQ ID NO: 1565500 - RNA, 19 nt, Homo sapiens
gguuugaaguccugaguuu

SEQ ID NO: 1565501 - RNA, 19 nt, Homo sapiens
ggaagaaugguuaucagaa

SEQ ID NO: 1565502 - RNA, 19 nt, Homo sapiens
caaguauucuccuaauuag

SEQ ID NO: 1565503 - RNA, 19 nt, Homo sapiens
agaaaguccuuaaaguuga

SEQ ID NO: 1565504 - RNA, 19 nt, Homo sapiens
cagaauugauguggguuua

SEQ ID NO: 1565505 - RNA, 19 nt, Homo sapiens
gggaauauauuggguuuua

SEQ ID NO: 1565506 - RNA, 19 nt, Homo sapiens
caauuuguguaccuucuaa

SEQ ID NO: 1565507 - RNA, 19 nt, Homo sapiens
ugaugcagaugaaggauuu

SEQ ID NO: 1565508 - RNA, 19 nt, Homo sapiens
cagaaaguccuuaaaguug

SEQ ID NO: 1565509 - RNA, 19 nt, Homo sapiens
ccagaaaguccuuaaaguu

SEQ ID NO: 1565510 - RNA, 19 nt, Homo sapiens
gauaaagaugggaacaaua

SEQ ID NO: 1565511 - RNA, 19 nt, Homo sapiens
ggaaaggaacauuauacuu

SEQ ID NO: 1565512 - RNA, 19 nt, Homo sapiens
uaaguuauccuuccacaga

SEQ ID NO: 1565513 - RNA, 19 nt, Homo sapiens
uaucugcaguuccucauuu

SEQ ID NO: 1565514 - RNA, 19 nt, Homo sapiens
gcugaucggucccauuuca

SEQ ID NO: 1565515 - RNA, 19 nt, Homo sapiens
guaaauggcagucaagcaa

SEQ ID NO: 1565516 - RNA, 19 nt, Homo sapiens
uaucagaauucaaggcauu

SEQ ID NO: 1565517 - RNA, 19 nt, Homo sapiens
ggaacugaccguuguguug

SEQ ID NO: 1565518 - RNA, 19 nt, Homo sapiens
uaucagugcuuuguacauu

SEQ ID NO: 1565519 - RNA, 19 nt, Homo sapiens
ggucauuucuguccuucaa

SEQ ID NO: 1565520 - RNA, 19 nt, Homo sapiens
gcuaaucgauacucaacug

SEQ ID NO: 1565521 - RNA, 19 nt, Homo sapiens
ccagcccucuauaaaguua

SEQ ID NO: 1565522 - RNA, 19 nt, Homo sapiens
aaagaggaguagaagguaa

SEQ ID NO: 1565523 - RNA, 19 nt, Homo sapiens
uggcugaaguguaacagua

SEQ ID NO: 1565524 - RNA, 19 nt, Homo sapiens
ugagagcccucgagauuca

SEQ ID NO: 1565525 - RNA, 19 nt, Homo sapiens
cgucauagauggagaagag

SEQ ID NO: 1565526 - RNA, 19 nt, Homo sapiens
guaaggaaaggaacauuau

SEQ ID NO: 1565527 - RNA, 19 nt, Homo sapiens
ccaacaaugcuaaucgaua

SEQ ID NO: 1565528 - RNA, 19 nt, Homo sapiens
ucagaguuguuuauaguga

SEQ ID NO: 1565529 - RNA, 19 nt, Homo sapiens
caguacaucuucagguaaa

SEQ ID NO: 1565530 - RNA, 19 nt, Homo sapiens
gaggguacauuagaggaaa

SEQ ID NO: 1565531 - RNA, 19 nt, Homo sapiens
ucccucaucuuucugcuua

SEQ ID NO: 1565532 - RNA, 19 nt, Homo sapiens
gagcugacaccaaugaaga

SEQ ID NO: 1565533 - RNA, 19 nt, Homo sapiens
agaacucuguggucgaaua

SEQ ID NO: 1565534 - RNA, 19 nt, Homo sapiens
ggaacauuauacuuaccua

SEQ ID NO: 1565535 - RNA, 19 nt, Homo sapiens
acuaguaucuacaacauug

SEQ ID NO: 1565536 - RNA, 19 nt, Homo sapiens
gaggagaggagucuguaaa

SEQ ID NO: 1565537 - RNA, 19 nt, Homo sapiens
gccagaaaguccuuaaagu

SEQ ID NO: 1565538 - RNA, 19 nt, Homo sapiens
aaagaacucuguggucgaa

SEQ ID NO: 1565539 - RNA, 19 nt, Homo sapiens
ggaaaugguguauaugauc

SEQ ID NO: 1565540 - RNA, 19 nt, Homo sapiens
ugacaccaaugaagaaaca

SEQ ID NO: 1565541 - RNA, 19 nt, Homo sapiens
uguaugguguguauaugua

SEQ ID NO: 1565542 - RNA, 19 nt, Homo sapiens
gcugggaacugaccguugu

SEQ ID NO: 1565543 - RNA, 19 nt, Homo sapiens
ccuaaaguccugauacauu

SEQ ID NO: 1565544 - RNA, 19 nt, Homo sapiens
cagcugcuuucuagaugua

SEQ ID NO: 1565545 - RNA, 19 nt, Homo sapiens
aacaguacaucuucaggua

SEQ ID NO: 1565546 - RNA, 19 nt, Homo sapiens
gcacugagggagguacuaa

SEQ ID NO: 1565547 - RNA, 19 nt, Homo sapiens
ccaggaaguucuugaugau

SEQ ID NO: 1565548 - RNA, 19 nt, Homo sapiens
gaauuuauggugcaacuuc

SEQ ID NO: 1565549 - RNA, 19 nt, Homo sapiens
gaacugaccguuguguugu

SEQ ID NO: 1565550 - RNA, 19 nt, Homo sapiens
ucaccuaucccuuguaaau

SEQ ID NO: 1565551 - RNA, 19 nt, Homo sapiens
gaucucaucagaguuguuu

SEQ ID NO: 1565552 - RNA, 19 nt, Homo sapiens
ugauaaagaugggaacaau

SEQ ID NO: 1565553 - RNA, 19 nt, Homo sapiens
gccuuuguguuuaauguaa

SEQ ID NO: 1565554 - RNA, 19 nt, Homo sapiens
caaaugauguuuaccacua

SEQ ID NO: 1565555 - RNA, 19 nt, Homo sapiens
gaacagagccaaugaugug

SEQ ID NO: 1565556 - RNA, 19 nt, Homo sapiens
gagagacagucaaggguua

SEQ ID NO: 1565557 - RNA, 19 nt, Homo sapiens
gagagaguguguugaauga

SEQ ID NO: 1565558 - RNA, 19 nt, Homo sapiens
caacucugcugguuaauau

SEQ ID NO: 1565559 - RNA, 19 nt, Homo sapiens
caucaacucugcugguuaa

SEQ ID NO: 1565560 - RNA, 19 nt, Homo sapiens
gauguggaaugcauuguaa

SEQ ID NO: 1565561 - RNA, 19 nt, Homo sapiens
uaauaucacugaccaaguu

SEQ ID NO: 1565562 - RNA, 19 nt, Homo sapiens
gagcauaaauuggagagaa

SEQ ID NO: 1565563 - RNA, 19 nt, Homo sapiens
gauaguugcuguucucuuc

SEQ ID NO: 1565564 - RNA, 19 nt, Homo sapiens
ucacuucuauucuggauuu

SEQ ID NO: 1565565 - RNA, 19 nt, Homo sapiens
caacaucaauccucaucaa

SEQ ID NO: 1565566 - RNA, 19 nt, Homo sapiens
caacuaaaguggcaguguu

SEQ ID NO: 1565567 - RNA, 19 nt, Homo sapiens
aaucuucgcuggcucauuu

SEQ ID NO: 1565568 - RNA, 19 nt, Homo sapiens
ucauuucacugacuguuua

SEQ ID NO: 1565569 - RNA, 19 nt, Homo sapiens
ucaaggaaaugcuauacuu

SEQ ID NO: 1565570 - RNA, 19 nt, Homo sapiens
gggaaugcccagcuauuua

SEQ ID NO: 1565571 - RNA, 19 nt, Homo sapiens
gcaaugguguauggccuua

SEQ ID NO: 1565572 - RNA, 19 nt, Homo sapiens
gcucggcucuucagaaugu

SEQ ID NO: 1565573 - RNA, 19 nt, Homo sapiens
gagaguguguugaaugaug

SEQ ID NO: 1565574 - RNA, 19 nt, Homo sapiens
guaggaccauuccaagaaa

SEQ ID NO: 1565575 - RNA, 19 nt, Homo sapiens
ggacuugacucccauuugc

SEQ ID NO: 1565576 - RNA, 19 nt, Homo sapiens
ggauauagucuaaagaaga

SEQ ID NO: 1565577 - RNA, 19 nt, Homo sapiens
gacaagugguggagcauga

SEQ ID NO: 1565578 - RNA, 19 nt, Homo sapiens
gauguaaucacaaguaaug

SEQ ID NO: 1565579 - RNA, 19 nt, Homo sapiens
gauauagucuaaagaagag

SEQ ID NO: 1565580 - RNA, 19 nt, Homo sapiens
gaaagcuucugagaguaaa

SEQ ID NO: 1565581 - RNA, 19 nt, Homo sapiens
gcacuguugaccaaauuua

SEQ ID NO: 1565582 - RNA, 19 nt, Homo sapiens
gcauuugccuuagcuauuc

SEQ ID NO: 1565583 - RNA, 19 nt, Homo sapiens
gaacugccaucuccugcau

SEQ ID NO: 1565584 - RNA, 19 nt, Homo sapiens
gaugacauuugauccagaa

SEQ ID NO: 1565585 - RNA, 19 nt, Homo sapiens
ugaaggagguagggaauga

SEQ ID NO: 1565586 - RNA, 19 nt, Homo sapiens
ggaaaugcuauacuugaaa

SEQ ID NO: 1565587 - RNA, 19 nt, Homo sapiens
gaaauaagucagcacaaca

SEQ ID NO: 1565588 - RNA, 19 nt, Homo sapiens
cagauguaaucacaaguaa

SEQ ID NO: 1565589 - RNA, 19 nt, Homo sapiens
ggaagcaaauaacuuggau

SEQ ID NO: 1565590 - RNA, 19 nt, Homo sapiens
ccauaguccuuacauauuc

SEQ ID NO: 1565591 - RNA, 19 nt, Homo sapiens
agaccaacaugauagcuuu

SEQ ID NO: 1565592 - RNA, 19 nt, Homo sapiens
gaugaacuagccauaaauu

SEQ ID NO: 1565593 - RNA, 19 nt, Homo sapiens
gaggagcaaugguguaugg

SEQ ID NO: 1565594 - RNA, 19 nt, Homo sapiens
gccagagccugcaacauau

SEQ ID NO: 1565595 - RNA, 19 nt, Homo sapiens
ugccagagccugcaacaua

SEQ ID NO: 1565596 - RNA, 19 nt, Homo sapiens
guuccagaaucauaucuuu

SEQ ID NO: 1565597 - RNA, 19 nt, Homo sapiens
ggagagaguguguugaaug

SEQ ID NO: 1565598 - RNA, 19 nt, Homo sapiens
acacucaagcuaaguauaa

SEQ ID NO: 1565599 - RNA, 19 nt, Homo sapiens
gguagggaaugacaucuuc

SEQ ID NO: 1565600 - RNA, 19 nt, Homo sapiens
gaaauccagauguucauau

SEQ ID NO: 1565601 - RNA, 19 nt, Homo sapiens
ggugugcccugcccuaaau

SEQ ID NO: 1565602 - RNA, 19 nt, Homo sapiens
ucacugaccaaguuuauga

SEQ ID NO: 1565603 - RNA, 19 nt, Homo sapiens
gcccagcuauuuaguaagu

SEQ ID NO: 1565604 - RNA, 19 nt, Homo sapiens
ggaaugcccagcuauuuag

SEQ ID NO: 1565605 - RNA, 19 nt, Homo sapiens
ugaagggaaugcccagcua

SEQ ID NO: 1565606 - RNA, 19 nt, Homo sapiens
uuaauuggcaugaagagua

SEQ ID NO: 1565607 - RNA, 19 nt, Homo sapiens
ccaggaagcaaauaacuug

SEQ ID NO: 1565608 - RNA, 19 nt, Homo sapiens
ggacuaauuuuacgauaug

SEQ ID NO: 1565609 - RNA, 19 nt, Homo sapiens
gaguaucaguuucaacauc

SEQ ID NO: 1565610 - RNA, 19 nt, Homo sapiens
ugaauuaauuggcaugaag

SEQ ID NO: 1565611 - RNA, 19 nt, Homo sapiens
ugaauggugugguccgauu

SEQ ID NO: 1565612 - RNA, 19 nt, Homo sapiens
cauuauaccuacaacaauc

SEQ ID NO: 1565613 - RNA, 19 nt, Homo sapiens
ccuagcaccucuugaaauc

SEQ ID NO: 1565614 - RNA, 19 nt, Homo sapiens
cagcaccacuuucaagcuu

SEQ ID NO: 1565615 - RNA, 19 nt, Homo sapiens
gacagcagccauucugauu

SEQ ID NO: 1565616 - RNA, 19 nt, Homo sapiens
aggaugaacuagccauaaa

SEQ ID NO: 1565617 - RNA, 19 nt, Homo sapiens
ggccauaguccuuacauau

SEQ ID NO: 1565618 - RNA, 19 nt, Homo sapiens
gcuaugugcaucaauuauu

SEQ ID NO: 1565619 - RNA, 19 nt, Homo sapiens
gggcauuucugcugcgaau

SEQ ID NO: 1565620 - RNA, 19 nt, Homo sapiens
gaggagcgaucgcauuugc

SEQ ID NO: 1565621 - RNA, 19 nt, Homo sapiens
uuaccaagcugugugaguu

SEQ ID NO: 1565622 - RNA, 19 nt, Homo sapiens
cagcacuguugaccaaauu

SEQ ID NO: 1565623 - RNA, 19 nt, Homo sapiens
gcaguggccauaguccuua

SEQ ID NO: 1565624 - RNA, 19 nt, Homo sapiens
ugacagugcuggccauuuu

SEQ ID NO: 1565625 - RNA, 19 nt, Homo sapiens
caugcaggauauagucuaa

SEQ ID NO: 1565626 - RNA, 19 nt, Homo sapiens
aaugguguauggccuuaua

SEQ ID NO: 1565627 - RNA, 19 nt, Homo sapiens
agucaaggguuaugucaga

SEQ ID NO: 1565628 - RNA, 19 nt, Homo sapiens
acccaaagcuuaaaaguaa

SEQ ID NO: 1565629 - RNA, 19 nt, Homo sapiens
cuucuuggcauccuucuua

SEQ ID NO: 1565630 - RNA, 19 nt, Homo sapiens
guaaacauuuugcuccuaa

SEQ ID NO: 1565631 - RNA, 19 nt, Homo sapiens
gcaaggaaaacauuuauga

SEQ ID NO: 1565632 - RNA, 19 nt, Homo sapiens
gccauaguccuuacauauu

SEQ ID NO: 1565633 - RNA, 19 nt, Homo sapiens
gcuaugaugagucugcuuu

SEQ ID NO: 1565634 - RNA, 19 nt, Homo sapiens
gcaugaagaguacagaugu

SEQ ID NO: 1565635 - RNA, 19 nt, Homo sapiens
gaauuaauuggcaugaaga

SEQ ID NO: 1565636 - RNA, 19 nt, Homo sapiens
gugcucggcucuucagaau

SEQ ID NO: 1565637 - RNA, 19 nt, Homo sapiens
ugacuuggcuucagaucag

SEQ ID NO: 1565638 - RNA, 19 nt, Homo sapiens
caggauauagucuaaagaa

SEQ ID NO: 1565639 - RNA, 19 nt, Homo sapiens
gcugaccacuguuuguuag

SEQ ID NO: 1565640 - RNA, 19 nt, Homo sapiens
gaagcaaauaacuuggaua

SEQ ID NO: 1565641 - RNA, 19 nt, Homo sapiens
cacagaaucucagcccaaa

SEQ ID NO: 1565642 - RNA, 19 nt, Homo sapiens
caaggagaauccaaaugca

SEQ ID NO: 1565643 - RNA, 19 nt, Homo sapiens
aaacuaacuuucaguccau

SEQ ID NO: 1565644 - RNA, 19 nt, Homo sapiens
aaaguggaacugucuauga

SEQ ID NO: 1565645 - RNA, 19 nt, Homo sapiens
ccagcuauuuaguaaguga

SEQ ID NO: 1565646 - RNA, 19 nt, Homo sapiens
cagcagccauucugauuac

SEQ ID NO: 1565647 - RNA, 19 nt, Homo sapiens
gagaaucaaagccuuguca

SEQ ID NO: 1565648 - RNA, 19 nt, Homo sapiens
gaacuuucagcacaugaug

SEQ ID NO: 1565649 - RNA, 19 nt, Homo sapiens
cugaccaaguuuaugaaua

SEQ ID NO: 1565650 - RNA, 19 nt, Homo sapiens
gcaccacuuucaagcuuag

SEQ ID NO: 1565651 - RNA, 19 nt, Homo sapiens
cuaaaugcagcaccacuuu

SEQ ID NO: 1565652 - RNA, 19 nt, Homo sapiens
gaaucucagcccaaacaaa

SEQ ID NO: 1565653 - RNA, 19 nt, Homo sapiens
gaaaguggaacugucuaug

SEQ ID NO: 1565654 - RNA, 19 nt, Homo sapiens
gaagagaagaaaccacuua

SEQ ID NO: 1565655 - RNA, 19 nt, Homo sapiens
gaugaaagacucuccauuu

SEQ ID NO: 1565656 - RNA, 19 nt, Homo sapiens
ggaauauacuggucaauag

SEQ ID NO: 1565657 - RNA, 19 nt, Homo sapiens
gaagaaaccacuuacagaa

SEQ ID NO: 1565658 - RNA, 19 nt, Homo sapiens
caacugaccucuuccaaac

SEQ ID NO: 1565659 - RNA, 19 nt, Homo sapiens
gaacauguccaacuuuaag

SEQ ID NO: 1565660 - RNA, 19 nt, Homo sapiens
gggaagguauuuaaugugu

SEQ ID NO: 1565661 - RNA, 19 nt, Homo sapiens
ggaagguauuuaaugugua

SEQ ID NO: 1565662 - RNA, 19 nt, Homo sapiens
aaacaucauucgccuagaa

SEQ ID NO: 1565663 - RNA, 19 nt, Homo sapiens
ccacauggaucggcaaaga

SEQ ID NO: 1565664 - RNA, 19 nt, Homo sapiens
aaacuguacuggcuuaaug

SEQ ID NO: 1565665 - RNA, 19 nt, Homo sapiens
gcaagagacugagaaccaa

SEQ ID NO: 1565666 - RNA, 19 nt, Homo sapiens
aaacuacaauggaagaaga

SEQ ID NO: 1565667 - RNA, 19 nt, Homo sapiens
gaagagauuuucuaagaga

SEQ ID NO: 1565668 - RNA, 19 nt, Homo sapiens
gaucccaguugccauuaaa

SEQ ID NO: 1565669 - RNA, 19 nt, Homo sapiens
gagaauggaucccuagacu

SEQ ID NO: 1565670 - RNA, 19 nt, Homo sapiens
aagagaagcuaguaucaug

SEQ ID NO: 1565671 - RNA, 19 nt, Homo sapiens
agaaaccacuuacagaaug

SEQ ID NO: 1565672 - RNA, 19 nt, Homo sapiens
ccucugcuauucugcauaa

SEQ ID NO: 1565673 - RNA, 19 nt, Homo sapiens
uugaacauguccaacuuua

SEQ ID NO: 1565674 - RNA, 19 nt, Homo sapiens
uaaugauugugguggaaua

SEQ ID NO: 1565675 - RNA, 19 nt, Homo sapiens
cauccucacuuuauucuuc

SEQ ID NO: 1565676 - RNA, 19 nt, Homo sapiens
uggaauauauggagaaugg

SEQ ID NO: 1565677 - RNA, 19 nt, Homo sapiens
uacaacaacugaccucuuc

SEQ ID NO: 1565678 - RNA, 19 nt, Homo sapiens
caucaggcaugaaguaucu

SEQ ID NO: 1565679 - RNA, 19 nt, Homo sapiens
ugaaacaggagaugaaaga

SEQ ID NO: 1565680 - RNA, 19 nt, Homo sapiens
caacuagacaucugccaaa

SEQ ID NO: 1565681 - RNA, 19 nt, Homo sapiens
acacuuaaccucugcuauu

SEQ ID NO: 1565682 - RNA, 19 nt, Homo sapiens
gauggccacuucacaguca

SEQ ID NO: 1565683 - RNA, 19 nt, Homo sapiens
gcagaccaguaaugauugu

SEQ ID NO: 1565684 - RNA, 19 nt, Homo sapiens
gaaaccacuuacagaaugg

SEQ ID NO: 1565685 - RNA, 19 nt, Homo sapiens
ggaagaugauccagaagcu

SEQ ID NO: 1565686 - RNA, 19 nt, Homo sapiens
gcaugaaguaucuuucuga

SEQ ID NO: 1565687 - RNA, 19 nt, Homo sapiens
ugacauggcagcagaacaa

SEQ ID NO: 1565688 - RNA, 19 nt, Homo sapiens
cugcuauucugcauaaauu

SEQ ID NO: 1565689 - RNA, 19 nt, Homo sapiens
ccuagcggcucggaauaua

SEQ ID NO: 1565690 - RNA, 19 nt, Homo sapiens
gaauucguauugagagagu

SEQ ID NO: 1565691 - RNA, 19 nt, Homo sapiens
uccaaacucuaacacuuaa

SEQ ID NO: 1565692 - RNA, 19 nt, Homo sapiens
cggaauauacuggucaaua

SEQ ID NO: 1565693 - RNA, 19 nt, Homo sapiens
ugauugugguggaauauau

SEQ ID NO: 1565694 - RNA, 19 nt, Homo sapiens
gagaagaaaccacuuacag

SEQ ID NO: 1565695 - RNA, 19 nt, Homo sapiens
aagccaagaugaagucaga

SEQ ID NO: 1565696 - RNA, 19 nt, Homo sapiens
gucaauagcaacuuaguau

SEQ ID NO: 1565697 - RNA, 19 nt, Homo sapiens
gaaagguggccacauggau

SEQ ID NO: 1565698 - RNA, 19 nt, Homo sapiens
cagaagagaagagaagaaa

SEQ ID NO: 1565699 - RNA, 19 nt, Homo sapiens
ggacagauucucgugauag

SEQ ID NO: 1565700 - RNA, 19 nt, Homo sapiens
gcagaacaaggacagauuc

SEQ ID NO: 1565701 - RNA, 19 nt, Homo sapiens
ggucaauagcaacuuagua

SEQ ID NO: 1565702 - RNA, 19 nt, Homo sapiens
acauugauccagauacaua

SEQ ID NO: 1565703 - RNA, 19 nt, Homo sapiens
uuacauugauccagauaca

SEQ ID NO: 1565704 - RNA, 19 nt, Homo sapiens
cugcagguauggaacauga

SEQ ID NO: 1565705 - RNA, 19 nt, Homo sapiens
gauucuccuucaccuaauu

SEQ ID NO: 1565706 - RNA, 19 nt, Homo sapiens
gaucggcaaagaagagauu

SEQ ID NO: 1565707 - RNA, 19 nt, Homo sapiens
gaaaagagagaucccaguu

SEQ ID NO: 1565708 - RNA, 19 nt, Homo sapiens
agaagaaaccacuuacaga

SEQ ID NO: 1565709 - RNA, 19 nt, Homo sapiens
gaagucagaagagaagaga

SEQ ID NO: 1565710 - RNA, 19 nt, Homo sapiens
uggcuacagucagaaauuu

SEQ ID NO: 1565711 - RNA, 19 nt, Homo sapiens
uaagccagccaccaaauau

SEQ ID NO: 1565712 - RNA, 19 nt, Homo sapiens
gaauauauggagaauggau

SEQ ID NO: 1565713 - RNA, 19 nt, Homo sapiens
uggcagaccaguaaugauu

SEQ ID NO: 1565714 - RNA, 19 nt, Homo sapiens
ccuagcaguccaugaauuu

SEQ ID NO: 1565715 - RNA, 19 nt, Homo sapiens
ugagaacugcgacaggaua

SEQ ID NO: 1565716 - RNA, 19 nt, Homo sapiens
uacaguggcuacagucaga

SEQ ID NO: 1565717 - RNA, 19 nt, Homo sapiens
ugauauggguuauguucau

SEQ ID NO: 1565718 - RNA, 19 nt, Homo sapiens
uuugaaagguggccacaug

SEQ ID NO: 1565719 - RNA, 19 nt, Homo sapiens
gcaggugaauuuggagaag

SEQ ID NO: 1565720 - RNA, 19 nt, Homo sapiens
gcuacagucagaaauuuga

SEQ ID NO: 1565721 - RNA, 19 nt, Homo sapiens
caugaaguaucuuucugau

SEQ ID NO: 1565722 - RNA, 19 nt, Homo sapiens
gaagagaagagaagaaacc

SEQ ID NO: 1565723 - RNA, 19 nt, Homo sapiens
cuuccaaacucuaacacuu

SEQ ID NO: 1565724 - RNA, 19 nt, Homo sapiens
acuggucaauagcaacuua

SEQ ID NO: 1565725 - RNA, 19 nt, Homo sapiens
ccucaagcccugccucuga

SEQ ID NO: 1565726 - RNA, 19 nt, Homo sapiens
gaugaagucagaagagaag

SEQ ID NO: 1565727 - RNA, 19 nt, Homo sapiens
aagaaaacguccucaacua

SEQ ID NO: 1565728 - RNA, 19 nt, Homo sapiens
caaauuuucugucggucua

SEQ ID NO: 1565729 - RNA, 19 nt, Homo sapiens
gaaaacguccucaacuaga

SEQ ID NO: 1565730 - RNA, 19 nt, Homo sapiens
gcaauucacgcaagagacu

SEQ ID NO: 1565731 - RNA, 19 nt, Homo sapiens
gauauggguuauguucauc

SEQ ID NO: 1565732 - RNA, 19 nt, Homo sapiens
gaaagcuaagacaaacaaa

SEQ ID NO: 1565733 - RNA, 19 nt, Homo sapiens
aagaugaagucagaagaga

SEQ ID NO: 1565734 - RNA, 19 nt, Homo sapiens
gaccuagcggcucggaaua

SEQ ID NO: 1565735 - RNA, 19 nt, Homo sapiens
acaaaacuguacuggcuua

SEQ ID NO: 1565736 - RNA, 19 nt, Homo sapiens
uuaagccagccaccaaaua

SEQ ID NO: 1565737 - RNA, 19 nt, Homo sapiens
cacuuaaccucugcuauuc

SEQ ID NO: 1565738 - RNA, 19 nt, Homo sapiens
ggcauugcaucaggcauga

SEQ ID NO: 1565739 - RNA, 19 nt, Homo sapiens
gagaucccaguugccauua

SEQ ID NO: 1565740 - RNA, 19 nt, Homo sapiens
gacucuccauuucaaguga

SEQ ID NO: 1565741 - RNA, 19 nt, Homo sapiens
uuccaaacucuaacacuua

SEQ ID NO: 1565742 - RNA, 19 nt, Homo sapiens
gguggaauauauggagaau

SEQ ID NO: 1565743 - RNA, 19 nt, Homo sapiens
ccuugaacauguccaacuu

SEQ ID NO: 1565744 - RNA, 19 nt, Homo sapiens
ggcaugaaguaucuuucug

SEQ ID NO: 1565745 - RNA, 19 nt, Homo sapiens
cagcugaccuacucuucca

SEQ ID NO: 1565746 - RNA, 19 nt, Homo sapiens
caauagcaacuuaguaugc

SEQ ID NO: 1565747 - RNA, 19 nt, Homo sapiens
uguccaacuuuaagaacuu

SEQ ID NO: 1565748 - RNA, 19 nt, Homo sapiens
ugaacauguccaacuuuaa

SEQ ID NO: 1565749 - RNA, 19 nt, Homo sapiens
uuuagguguuugugaauug

SEQ ID NO: 1565750 - RNA, 19 nt, Homo sapiens
guaugcaaaguuucugauu

SEQ ID NO: 1565751 - RNA, 19 nt, Homo sapiens
caagaugaagucagaagag

SEQ ID NO: 1565752 - RNA, 19 nt, Homo sapiens
guccaacuuuaagaacuuu

SEQ ID NO: 1565753 - RNA, 19 nt, Homo sapiens
caucaucacaggucuuaag

SEQ ID NO: 1565754 - RNA, 19 nt, Homo sapiens
caacugaaauugaaggaaa

SEQ ID NO: 1565755 - RNA, 19 nt, Homo sapiens
caaguauucugaaagcuua

SEQ ID NO: 1565756 - RNA, 19 nt, Homo sapiens
ucugaaagcuuaaugcaaa

SEQ ID NO: 1565757 - RNA, 19 nt, Homo sapiens
caaccuagauucacaugga

SEQ ID NO: 1565758 - RNA, 19 nt, Homo sapiens
ggacuaccauggagcagaa

SEQ ID NO: 1565759 - RNA, 19 nt, Homo sapiens
cagaaacucuuccaaauac

SEQ ID NO: 1565760 - RNA, 19 nt, Homo sapiens
gaagaauucugucauuggu

SEQ ID NO: 1565761 - RNA, 19 nt, Homo sapiens
ccaaugaaguacgacauaa

SEQ ID NO: 1565762 - RNA, 19 nt, Homo sapiens
ggacugaaaugugcaucuu

SEQ ID NO: 1565763 - RNA, 19 nt, Homo sapiens
ccaccgagaaguuauauuu

SEQ ID NO: 1565764 - RNA, 19 nt, Homo sapiens
ggacucagcuuuucagaga

SEQ ID NO: 1565765 - RNA, 19 nt, Homo sapiens
gaaacucuuccaaauacua

SEQ ID NO: 1565766 - RNA, 19 nt, Homo sapiens
acagaaacucuuccaaaua

SEQ ID NO: 1565767 - RNA, 19 nt, Homo sapiens
ggacauccaccuauuucaa

SEQ ID NO: 1565768 - RNA, 19 nt, Homo sapiens
uacagaaacucuuccaaau

SEQ ID NO: 1565769 - RNA, 19 nt, Homo sapiens
cagaggacauccaccuauu

SEQ ID NO: 1565770 - RNA, 19 nt, Homo sapiens
ggaccaaguuugagguagu

SEQ ID NO: 1565771 - RNA, 19 nt, Homo sapiens
gagaauacuuggaaaauca

SEQ ID NO: 1565772 - RNA, 19 nt, Homo sapiens
gaaacgccagagccaguua

SEQ ID NO: 1565773 - RNA, 19 nt, Homo sapiens
gcaaguauucugaaagcuu

SEQ ID NO: 1565774 - RNA, 19 nt, Homo sapiens
ggacuacagacuuacauau

SEQ ID NO: 1565775 - RNA, 19 nt, Homo sapiens
ggacaacgacgagaucaug

SEQ ID NO: 1565776 - RNA, 19 nt, Homo sapiens
aaccacaacugaaauugaa

SEQ ID NO: 1565777 - RNA, 19 nt, Homo sapiens
cuaaagcgcuaaguacugu

SEQ ID NO: 1565778 - RNA, 19 nt, Homo sapiens
uuaccgaaaccaucuguua

SEQ ID NO: 1565779 - RNA, 19 nt, Homo sapiens
ccaagaugcuguucaugca

SEQ ID NO: 1565780 - RNA, 19 nt, Homo sapiens
caaccacaacugaaauuga

SEQ ID NO: 1565781 - RNA, 19 nt, Homo sapiens
cgaaaccaucuguuaaauu

SEQ ID NO: 1565782 - RNA, 19 nt, Homo sapiens
gcaggugaaagaagauaaa

SEQ ID NO: 1565783 - RNA, 19 nt, Homo sapiens
ugaacaaagugaucuagag

SEQ ID NO: 1565784 - RNA, 19 nt, Homo sapiens
gcacuuccggugucuguug

SEQ ID NO: 1565785 - RNA, 19 nt, Homo sapiens
ggcaugaugugaagcuuag

SEQ ID NO: 1565786 - RNA, 19 nt, Homo sapiens
caaaagagaacuggguuua

SEQ ID NO: 1565787 - RNA, 19 nt, Homo sapiens
gaggacauccaccuauuuc

SEQ ID NO: 1565788 - RNA, 19 nt, Homo sapiens
auacagaaacucuuccaaa

SEQ ID NO: 1565789 - RNA, 19 nt, Homo sapiens
uaaccuacuuggccuacug

SEQ ID NO: 1565790 - RNA, 19 nt, Homo sapiens
guaaucacuguauguggua

SEQ ID NO: 1565791 - RNA, 19 nt, Homo sapiens
gaaaucgugagccuucguu

SEQ ID NO: 1565792 - RNA, 19 nt, Homo sapiens
cgccagagccaguuacaaa

SEQ ID NO: 1565793 - RNA, 19 nt, Homo sapiens
caccgagaaguuauauuua

SEQ ID NO: 1565794 - RNA, 19 nt, Homo sapiens
cagcaaguauucugaaagc

SEQ ID NO: 1565795 - RNA, 19 nt, Homo sapiens
acuacagacuuacauauca

SEQ ID NO: 1565796 - RNA, 19 nt, Homo sapiens
ccgaaaccaucuguuaaau

SEQ ID NO: 1565797 - RNA, 19 nt, Homo sapiens
cagcacuucuggcaugaug

SEQ ID NO: 1565798 - RNA, 19 nt, Homo sapiens
ggagggcugccguaaccua

SEQ ID NO: 1565799 - RNA, 19 nt, Homo sapiens
uacaacacaucagaacaaa

SEQ ID NO: 1565800 - RNA, 19 nt, Homo sapiens
ucuuuggacuucuuaauuc

SEQ ID NO: 1565801 - RNA, 19 nt, Homo sapiens
aaagcaaccacaacugaaa

SEQ ID NO: 1565802 - RNA, 19 nt, Homo sapiens
cuagaggccuuuuauaaug

SEQ ID NO: 1565803 - RNA, 19 nt, Homo sapiens
uuacaacacaucagaacaa

SEQ ID NO: 1565804 - RNA, 19 nt, Homo sapiens
aaaguccaccgagaaguua

SEQ ID NO: 1565805 - RNA, 19 nt, Homo sapiens
cagucaaagugcagaagaa

SEQ ID NO: 1565806 - RNA, 19 nt, Homo sapiens
cguuugcugucacuaguaa

SEQ ID NO: 1565807 - RNA, 19 nt, Homo sapiens
gcaaaagauuacuggcaaa

SEQ ID NO: 1565808 - RNA, 19 nt, Homo sapiens
uuaaguacuuggcaacaca

SEQ ID NO: 1565809 - RNA, 19 nt, Homo sapiens
gaccaaguuugagguagug

SEQ ID NO: 1565810 - RNA, 19 nt, Homo sapiens
gggcugccguaaccuacuu

SEQ ID NO: 1565811 - RNA, 19 nt, Homo sapiens
caacacaucagaacaaaau

SEQ ID NO: 1565812 - RNA, 19 nt, Homo sapiens
aacagcaggugaaagaaga

SEQ ID NO: 1565813 - RNA, 19 nt, Homo sapiens
ccagagccaguuacaaaga

SEQ ID NO: 1565814 - RNA, 19 nt, Homo sapiens
ccgagaaguuauauuuaag

SEQ ID NO: 1565815 - RNA, 19 nt, Homo sapiens
cuacagacuuacauaucau

SEQ ID NO: 1565816 - RNA, 19 nt, Homo sapiens
caacagcaggugaaagaag

SEQ ID NO: 1565817 - RNA, 19 nt, Homo sapiens
gcaaccacaacugaaauug

SEQ ID NO: 1565818 - RNA, 19 nt, Homo sapiens
ucaugugaauacuuaccua

SEQ ID NO: 1565819 - RNA, 19 nt, Homo sapiens
uaccgaaaccaucuguuaa

SEQ ID NO: 1565820 - RNA, 19 nt, Homo sapiens
gcacuucuggcaugaugug

SEQ ID NO: 1565821 - RNA, 19 nt, Homo sapiens
caaaagcaaccacaacuga

SEQ ID NO: 1565822 - RNA, 19 nt, Homo sapiens
ccuugcuccuggaacauua

SEQ ID NO: 1565823 - RNA, 19 nt, Homo sapiens
caaugaaguacgacauaau

SEQ ID NO: 1565824 - RNA, 19 nt, Homo sapiens
gacagaggacauccaccua

SEQ ID NO: 1565825 - RNA, 19 nt, Homo sapiens
ggaaacgccagagccaguu

SEQ ID NO: 1565826 - RNA, 19 nt, Homo sapiens
agacauugcugaacaaaag

SEQ ID NO: 1565827 - RNA, 19 nt, Homo sapiens
ggagaauacuuggaaaauc

SEQ ID NO: 1565828 - RNA, 19 nt, Homo sapiens
ggacuucuuaauucucaga

SEQ ID NO: 1565829 - RNA, 19 nt, Homo sapiens
caaguuugagguaguggaa

SEQ ID NO: 1565830 - RNA, 19 nt, Homo sapiens
cauuguugccgucgucuuu

SEQ ID NO: 1565831 - RNA, 19 nt, Homo sapiens
ugcuguucaugcaauauua

SEQ ID NO: 1565832 - RNA, 19 nt, Homo sapiens
gacuacagacuuacauauc

SEQ ID NO: 1565833 - RNA, 19 nt, Homo sapiens
aaugaaguacgacauaaug

SEQ ID NO: 1565834 - RNA, 19 nt, Homo sapiens
aagaugcuguucaugcaau

SEQ ID NO: 1565835 - RNA, 19 nt, Homo sapiens
uaggaccaccucaagauga

SEQ ID NO: 1565836 - RNA, 19 nt, Homo sapiens
agaggacauccaccuauuu

SEQ ID NO: 1565837 - RNA, 19 nt, Homo sapiens
ccucaggaccgccaagaug

SEQ ID NO: 1565838 - RNA, 19 nt, Homo sapiens
gcagcaaguauucugaaag

SEQ ID NO: 1565839 - RNA, 19 nt, Homo sapiens
aaagagaacuggguuuacc

SEQ ID NO: 1565840 - RNA, 19 nt, Homo sapiens
ugagguaguggaaaugaga

SEQ ID NO: 1565841 - RNA, 19 nt, Homo sapiens
gaugucgggacucagcuuu

SEQ ID NO: 1565842 - RNA, 19 nt, Homo sapiens
gaucuagaggccuuuuaua

SEQ ID NO: 1565843 - RNA, 19 nt, Homo sapiens
ccgccaagaugcuguucau

SEQ ID NO: 1565844 - RNA, 19 nt, Homo sapiens
agaugcuguucaugcaaua

SEQ ID NO: 1565845 - RNA, 19 nt, Homo sapiens
gaugugaagcuuagguuuu

SEQ ID NO: 1565846 - RNA, 19 nt, Homo sapiens
aggaccaccucaagaugaa

SEQ ID NO: 1565847 - RNA, 19 nt, Homo sapiens
caagaugcuguucaugcaa

SEQ ID NO: 1565848 - RNA, 19 nt, Homo sapiens
uuacaaagacagaggacau

SEQ ID NO: 1565849 - RNA, 19 nt, Homo sapiens
ugcagcaaguauucugaaa

SEQ ID NO: 1565850 - RNA, 19 nt, Homo sapiens
gacgagaucauggcccuau

SEQ ID NO: 1565851 - RNA, 19 nt, Homo sapiens
uguaugugguaccaaugaa

SEQ ID NO: 1565852 - RNA, 19 nt, Homo sapiens
uggcaugaugugaagcuua

SEQ ID NO: 1565853 - RNA, 19 nt, Homo sapiens
ccuggaacauuaccgaaac

SEQ ID NO: 1565854 - RNA, 19 nt, Homo sapiens
gcagauguauuaugaaaug

SEQ ID NO: 1565855 - RNA, 19 nt, Homo sapiens
gaauauguguucugcagua

SEQ ID NO: 1565856 - RNA, 19 nt, Homo sapiens
caaagaugcuguuaauguu

SEQ ID NO: 1565857 - RNA, 19 nt, Homo sapiens
acagauagcuuugggcuua

SEQ ID NO: 1565858 - RNA, 19 nt, Homo sapiens
gaagauguuucuauccaaa

SEQ ID NO: 1565859 - RNA, 19 nt, Homo sapiens
gcaaagaugcuguuaaugu

SEQ ID NO: 1565860 - RNA, 19 nt, Homo sapiens
gcaaagaccucuggagauc

SEQ ID NO: 1565861 - RNA, 19 nt, Homo sapiens
caacagguaguucuaauuu

SEQ ID NO: 1565862 - RNA, 19 nt, Homo sapiens
caucaaaggugaauaugug

SEQ ID NO: 1565863 - RNA, 19 nt, Homo sapiens
gaacaagacgugucaagga

SEQ ID NO: 1565864 - RNA, 19 nt, Homo sapiens
ggaaacacauccagaaguc

SEQ ID NO: 1565865 - RNA, 19 nt, Homo sapiens
gguaugaaauugcuguauu

SEQ ID NO: 1565866 - RNA, 19 nt, Homo sapiens
caacuugcauuuacagaug

SEQ ID NO: 1565867 - RNA, 19 nt, Homo sapiens
caaggaagauguuucuauc

SEQ ID NO: 1565868 - RNA, 19 nt, Homo sapiens
gcagaggugucccuaacuu

SEQ ID NO: 1565869 - RNA, 19 nt, Homo sapiens
uauaggacuuucacagaua

SEQ ID NO: 1565870 - RNA, 19 nt, Homo sapiens
ggaacucacucugugcuuu

SEQ ID NO: 1565871 - RNA, 19 nt, Homo sapiens
guuguucucugcuaucuuu

SEQ ID NO: 1565872 - RNA, 19 nt, Homo sapiens
uaaagggaauugugaguca

SEQ ID NO: 1565873 - RNA, 19 nt, Homo sapiens
ucaccaaggaguuuacuua

SEQ ID NO: 1565874 - RNA, 19 nt, Homo sapiens
ggaagauguuucuauccaa

SEQ ID NO: 1565875 - RNA, 19 nt, Homo sapiens
auaaauaccucaacugucu

SEQ ID NO: 1565876 - RNA, 19 nt, Homo sapiens
uuaaaggacuguguucauu

SEQ ID NO: 1565877 - RNA, 19 nt, Homo sapiens
ggaaagagaggagagcaaa

SEQ ID NO: 1565878 - RNA, 19 nt, Homo sapiens
gcaucauucugaaaucauu

SEQ ID NO: 1565879 - RNA, 19 nt, Homo sapiens
cugauacgcuugucucauu

SEQ ID NO: 1565880 - RNA, 19 nt, Homo sapiens
guacacauaaggaaagaaa

SEQ ID NO: 1565881 - RNA, 19 nt, Homo sapiens
ggacccacgugucugcaaa

SEQ ID NO: 1565882 - RNA, 19 nt, Homo sapiens
gguaauuccuaguguuguu

SEQ ID NO: 1565883 - RNA, 19 nt, Homo sapiens
ugacaggacuccacauucu

SEQ ID NO: 1565884 - RNA, 19 nt, Homo sapiens
uaagagagcagcuauaguc

SEQ ID NO: 1565885 - RNA, 19 nt, Homo sapiens
gcauaaauaccucaacugu

SEQ ID NO: 1565886 - RNA, 19 nt, Homo sapiens
ggacaacagguaguucuaa

SEQ ID NO: 1565887 - RNA, 19 nt, Homo sapiens
gcacacacagaauuacaaa

SEQ ID NO: 1565888 - RNA, 19 nt, Homo sapiens
gcagaaacagcaucccaaa

SEQ ID NO: 1565889 - RNA, 19 nt, Homo sapiens
caagacgugucaaggaaga

SEQ ID NO: 1565890 - RNA, 19 nt, Homo sapiens
ggaauugugagucauguga

SEQ ID NO: 1565891 - RNA, 19 nt, Homo sapiens
gagaggagagcaaaggaaa

SEQ ID NO: 1565892 - RNA, 19 nt, Homo sapiens
gaugguaauuccuaguguu

SEQ ID NO: 1565893 - RNA, 19 nt, Homo sapiens
gacaacagguaguucuaau

SEQ ID NO: 1565894 - RNA, 19 nt, Homo sapiens
gaagaaaggcuguuuuaau

SEQ ID NO: 1565895 - RNA, 19 nt, Homo sapiens
guucugcaguaucaacuaa

SEQ ID NO: 1565896 - RNA, 19 nt, Homo sapiens
gcgaggauuuacccuagaa

SEQ ID NO: 1565897 - RNA, 19 nt, Homo sapiens
gcaaaacuccgucucaaaa

SEQ ID NO: 1565898 - RNA, 19 nt, Homo sapiens
gaaaagaaacguuacuguu

SEQ ID NO: 1565899 - RNA, 19 nt, Homo sapiens
ccaugcacaucuauugauu

SEQ ID NO: 1565900 - RNA, 19 nt, Homo sapiens
gaaugaggauggguagcaa

SEQ ID NO: 1565901 - RNA, 19 nt, Homo sapiens
gaaccagaaagcugaaguu

SEQ ID NO: 1565902 - RNA, 19 nt, Homo sapiens
gaaauucaacagugagcaa

SEQ ID NO: 1565903 - RNA, 19 nt, Homo sapiens
agucagaacucaggaaaug

SEQ ID NO: 1565904 - RNA, 19 nt, Homo sapiens
gagucgagaucacgccauu

SEQ ID NO: 1565905 - RNA, 19 nt, Homo sapiens
acaauguaguguaucauga

SEQ ID NO: 1565906 - RNA, 19 nt, Homo sapiens
gaugacaggacuccacauu

SEQ ID NO: 1565907 - RNA, 19 nt, Homo sapiens
uguaguguaucaugaagaa

SEQ ID NO: 1565908 - RNA, 19 nt, Homo sapiens
gaaaccccaucucuacuaa

SEQ ID NO: 1565909 - RNA, 19 nt, Homo sapiens
ggacuguguucauucugau

SEQ ID NO: 1565910 - RNA, 19 nt, Homo sapiens
gcaggcaucauucugaaau

SEQ ID NO: 1565911 - RNA, 19 nt, Homo sapiens
gagaggcaccagcagguaa

SEQ ID NO: 1565912 - RNA, 19 nt, Homo sapiens
aacaagacgugucaaggaa

SEQ ID NO: 1565913 - RNA, 19 nt, Homo sapiens
cacgaaagaguauuugaaa

SEQ ID NO: 1565914 - RNA, 19 nt, Homo sapiens
ccacgaaagaguauuugaa

SEQ ID NO: 1565915 - RNA, 19 nt, Homo sapiens
gcaggagaaucgcuugaac

SEQ ID NO: 1565916 - RNA, 19 nt, Homo sapiens
gaaguuucaccaaggaguu

SEQ ID NO: 1565917 - RNA, 19 nt, Homo sapiens
aaaggaaacacauccagaa

SEQ ID NO: 1565918 - RNA, 19 nt, Homo sapiens
ucaaggaagauguuucuau

SEQ ID NO: 1565919 - RNA, 19 nt, Homo sapiens
ggaaagaaaauggcuuaua

SEQ ID NO: 1565920 - RNA, 19 nt, Homo sapiens
ggucuucggacaacaggua

SEQ ID NO: 1565921 - RNA, 19 nt, Homo sapiens
cuauaggacuuucacagau

SEQ ID NO: 1565922 - RNA, 19 nt, Homo sapiens
caaaaucccuauaggacuu

SEQ ID NO: 1565923 - RNA, 19 nt, Homo sapiens
gaacucaggaaaugugucu

SEQ ID NO: 1565924 - RNA, 19 nt, Homo sapiens
gaagagaauguuccaugca

SEQ ID NO: 1565925 - RNA, 19 nt, Homo sapiens
acagguaguucuaauuucu

SEQ ID NO: 1565926 - RNA, 19 nt, Homo sapiens
gcuuugggcuuaaggucuu

SEQ ID NO: 1565927 - RNA, 19 nt, Homo sapiens
gaagaaaccccaucucuac

SEQ ID NO: 1565928 - RNA, 19 nt, Homo sapiens
uauguguucugcaguauca

SEQ ID NO: 1565929 - RNA, 19 nt, Homo sapiens
cuuaagagcaacuuccuuu

SEQ ID NO: 1565930 - RNA, 19 nt, Homo sapiens
gugagcaagugcagaaaca

SEQ ID NO: 1565931 - RNA, 19 nt, Homo sapiens
caaaggugaauauguguuc

SEQ ID NO: 1565932 - RNA, 19 nt, Homo sapiens
gugcagaggugucccuaac

SEQ ID NO: 1565933 - RNA, 19 nt, Homo sapiens
ugugugguguugacaauau

SEQ ID NO: 1565934 - RNA, 19 nt, Homo sapiens
caauguaguguaucaugaa

SEQ ID NO: 1565935 - RNA, 19 nt, Homo sapiens
ccauuggugugcuguacaa

SEQ ID NO: 1565936 - RNA, 19 nt, Homo sapiens
ucccaaaggcgaggauuua

SEQ ID NO: 1565937 - RNA, 19 nt, Homo sapiens
uuucaaaugugugguguug

SEQ ID NO: 1565938 - RNA, 19 nt, Homo sapiens
ggacuccacauucuagcuu

SEQ ID NO: 1565939 - RNA, 19 nt, Homo sapiens
gugcauaaauaccucaacu

SEQ ID NO: 1565940 - RNA, 19 nt, Homo sapiens
uaaaggacuguguucauuc

SEQ ID NO: 1565941 - RNA, 19 nt, Homo sapiens
gaggagagcaaaggaaaca

SEQ ID NO: 1565942 - RNA, 19 nt, Homo sapiens
ggaaugaggauggguagca

SEQ ID NO: 1565943 - RNA, 19 nt, Homo sapiens
gacaggacuccacauucua

SEQ ID NO: 1565944 - RNA, 19 nt, Homo sapiens
gcagcuauaguccucauuc

SEQ ID NO: 1565945 - RNA, 19 nt, Homo sapiens
aaaggacuguguucauucu

SEQ ID NO: 1565946 - RNA, 19 nt, Homo sapiens
gacacugacuucgguaaca

SEQ ID NO: 1565947 - RNA, 19 nt, Homo sapiens
gagcagcuauaguccucau

SEQ ID NO: 1565948 - RNA, 19 nt, Homo sapiens
ugauuggucuuggcaguug

SEQ ID NO: 1565949 - RNA, 19 nt, Homo sapiens
uaaguuuucuugacacuga

SEQ ID NO: 1565950 - RNA, 19 nt, Homo sapiens
ggagagcaaaggaaacaca

SEQ ID NO: 1565951 - RNA, 19 nt, Homo sapiens
gcccaucaaaggugaauau

SEQ ID NO: 1565952 - RNA, 19 nt, Homo sapiens
gugugguguugacaauaua

SEQ ID NO: 1565953 - RNA, 19 nt, Homo sapiens
ucaacugucugggcugaga

SEQ ID NO: 1565954 - RNA, 19 nt, Homo sapiens
gcacacaucucauuacaaa

SEQ ID NO: 1565955 - RNA, 19 nt, Homo sapiens
ggagaaaccuuaugaaugu

SEQ ID NO: 1565956 - RNA, 19 nt, Homo sapiens
ggacaagccuucagucaaa

SEQ ID NO: 1565957 - RNA, 19 nt, Homo sapiens
gagaagcccuuuaaaugua

SEQ ID NO: 1565958 - RNA, 19 nt, Homo sapiens
ggaagaaacucaucaaugg

SEQ ID NO: 1565959 - RNA, 19 nt, Homo sapiens
ggagaaaccuuaugagugu

SEQ ID NO: 1565960 - RNA, 19 nt, Homo sapiens
gggaaagccuucaguugua

SEQ ID NO: 1565961 - RNA, 19 nt, Homo sapiens
gggaagacauucagucaaa

SEQ ID NO: 1565962 - RNA, 19 nt, Homo sapiens
gggaacaacucuacaaaug

SEQ ID NO: 1565963 - RNA, 19 nt, Homo sapiens
caucagaaguggcauacua

SEQ ID NO: 1565964 - RNA, 19 nt, Homo sapiens
gggaagaguuugaguucua

SEQ ID NO: 1565965 - RNA, 19 nt, Homo sapiens
gguaaaaccuucaguuaua

SEQ ID NO: 1565966 - RNA, 19 nt, Homo sapiens
gggaaaaccuucagauaua

SEQ ID NO: 1565967 - RNA, 19 nt, Homo sapiens
ggacagaggcccuaugaau

SEQ ID NO: 1565968 - RNA, 19 nt, Homo sapiens
ggagauagccaggaaauug

SEQ ID NO: 1565969 - RNA, 19 nt, Homo sapiens
gggagaagcccuuuaaaug

SEQ ID NO: 1565970 - RNA, 19 nt, Homo sapiens
caacccacauucagacuuu

SEQ ID NO: 1565971 - RNA, 19 nt, Homo sapiens
gagaagcccuaugaaugua

SEQ ID NO: 1565972 - RNA, 19 nt, Homo sapiens
ggagaagcccuuuaaaugu

SEQ ID NO: 1565973 - RNA, 19 nt, Homo sapiens
ggaagaguuugaguucuaa

SEQ ID NO: 1565974 - RNA, 19 nt, Homo sapiens
ggucuugucuuguauaagu

SEQ ID NO: 1565975 - RNA, 19 nt, Homo sapiens
ggagaagcccuaugaaugu

SEQ ID NO: 1565976 - RNA, 19 nt, Homo sapiens
gggaaagccuucagaugga

SEQ ID NO: 1565977 - RNA, 19 nt, Homo sapiens
ggagaaacccuaugaaugc

SEQ ID NO: 1565978 - RNA, 19 nt, Homo sapiens
gggagaagcccuaugaaug

SEQ ID NO: 1565979 - RNA, 19 nt, Homo sapiens
aaaccaagacugagaauga

SEQ ID NO: 1565980 - RNA, 19 nt, Homo sapiens
caaaccagaucugauauuc

SEQ ID NO: 1565981 - RNA, 19 nt, Homo sapiens
ccacuggucuccugauugu

SEQ ID NO: 1565982 - RNA, 19 nt, Homo sapiens
ccucuggucuugucuugua

SEQ ID NO: 1565983 - RNA, 19 nt, Homo sapiens
gggagaaaccuuaugaaug

SEQ ID NO: 1565984 - RNA, 19 nt, Homo sapiens
ggagaauuaugcaaaugug

SEQ ID NO: 1565985 - RNA, 19 nt, Homo sapiens
ggaaagccuucagauggaa

SEQ ID NO: 1565986 - RNA, 19 nt, Homo sapiens
gcaguucgguauuucuuca

SEQ ID NO: 1565987 - RNA, 19 nt, Homo sapiens
gggaggagauagccaggaa

SEQ ID NO: 1565988 - RNA, 19 nt, Homo sapiens
gagagaaaccauacucaug

SEQ ID NO: 1565989 - RNA, 19 nt, Homo sapiens
ggauguggcuguguacuuc

SEQ ID NO: 1565990 - RNA, 19 nt, Homo sapiens
gggagaaacccuaugaaug

SEQ ID NO: 1565991 - RNA, 19 nt, Homo sapiens
gagaaaccuuaugaaugua

SEQ ID NO: 1565992 - RNA, 19 nt, Homo sapiens
gagaaaccauacucaugug

SEQ ID NO: 1565993 - RNA, 19 nt, Homo sapiens
ggaaaaccuucagauauaa

SEQ ID NO: 1565994 - RNA, 19 nt, Homo sapiens
ucagagaguucacacuaau

SEQ ID NO: 1565995 - RNA, 19 nt, Homo sapiens
cugauugugucuauugaua

SEQ ID NO: 1565996 - RNA, 19 nt, Homo sapiens
ggaaagccuucaguuguag

SEQ ID NO: 1565997 - RNA, 19 nt, Homo sapiens
caucagagaguucacacua

SEQ ID NO: 1565998 - RNA, 19 nt, Homo sapiens
ggaacaacucuacaaaugu

SEQ ID NO: 1565999 - RNA, 19 nt, Homo sapiens
gagaagcccuacacaugca

SEQ ID NO: 1566000 - RNA, 19 nt, Homo sapiens
gaaauuggaagaaaguagu

SEQ ID NO: 1566001 - RNA, 19 nt, Homo sapiens
gaagaaacucaucaaugga

SEQ ID NO: 1566002 - RNA, 19 nt, Homo sapiens
gaguuugaguucuaauuca

SEQ ID NO: 1566003 - RNA, 19 nt, Homo sapiens
gcacagcuaaacauuucua

SEQ ID NO: 1566004 - RNA, 19 nt, Homo sapiens
ggagugcaauggcgugauc

SEQ ID NO: 1566005 - RNA, 19 nt, Homo sapiens
ucagauggaaugcaaguuu

SEQ ID NO: 1566006 - RNA, 19 nt, Homo sapiens
gacagaggcccuaugaaug

SEQ ID NO: 1566007 - RNA, 19 nt, Homo sapiens
gccaggaaauuggaagaaa

SEQ ID NO: 1566008 - RNA, 19 nt, Homo sapiens
caucagagaauccacaaug

SEQ ID NO: 1566009 - RNA, 19 nt, Homo sapiens
cagcacacaucucauuaca

SEQ ID NO: 1566010 - RNA, 19 nt, Homo sapiens
aggugaugcuggagaauua

SEQ ID NO: 1566011 - RNA, 19 nt, Homo sapiens
agaagcccuuuaaauguaa

SEQ ID NO: 1566012 - RNA, 19 nt, Homo sapiens
cugcacagcuaaacauuuc

SEQ ID NO: 1566013 - RNA, 19 nt, Homo sapiens
gcuggagaauuaugcaaau

SEQ ID NO: 1566014 - RNA, 19 nt, Homo sapiens
caaguuucauccagcauca

SEQ ID NO: 1566015 - RNA, 19 nt, Homo sapiens
gagaaaccuuaugagugua

SEQ ID NO: 1566016 - RNA, 19 nt, Homo sapiens
cugcuucccucaucugaaa

SEQ ID NO: 1566017 - RNA, 19 nt, Homo sapiens
gggaggugaugcuggagaa

SEQ ID NO: 1566018 - RNA, 19 nt, Homo sapiens
cccuucaccuguccaaaua

SEQ ID NO: 1566019 - RNA, 19 nt, Homo sapiens
uuauaaauguggugagugu

SEQ ID NO: 1566020 - RNA, 19 nt, Homo sapiens
cagcuaaacauuucuaaag

SEQ ID NO: 1566021 - RNA, 19 nt, Homo sapiens
gcaaaugugacuuccuugu

SEQ ID NO: 1566022 - RNA, 19 nt, Homo sapiens
gggccucccuuaucuucuu

SEQ ID NO: 1566023 - RNA, 19 nt, Homo sapiens
cagaggcccuaugaaugua

SEQ ID NO: 1566024 - RNA, 19 nt, Homo sapiens
ugacuucaaggacagguua

SEQ ID NO: 1566025 - RNA, 19 nt, Homo sapiens
acagggcuauccgcaguua

SEQ ID NO: 1566026 - RNA, 19 nt, Homo sapiens
cagauggaaugcaaguuuc

SEQ ID NO: 1566027 - RNA, 19 nt, Homo sapiens
ccaggaaauuggaagaaag

SEQ ID NO: 1566028 - RNA, 19 nt, Homo sapiens
gcccgaauccuuugucuca

SEQ ID NO: 1566029 - RNA, 19 nt, Homo sapiens
caucagagaauccauacug

SEQ ID NO: 1566030 - RNA, 19 nt, Homo sapiens
ggagagaaaccauacucau

SEQ ID NO: 1566031 - RNA, 19 nt, Homo sapiens
ggaaauuggaagaaaguag

SEQ ID NO: 1566032 - RNA, 19 nt, Homo sapiens
gaggagauagccaggaaau

SEQ ID NO: 1566033 - RNA, 19 nt, Homo sapiens
cuccgcagguucuuacuuu

SEQ ID NO: 1566034 - RNA, 19 nt, Homo sapiens
agaaguggcauacuaggaa

SEQ ID NO: 1566035 - RNA, 19 nt, Homo sapiens
gaauguacugacuguggua

SEQ ID NO: 1566036 - RNA, 19 nt, Homo sapiens
agagaaaccauacucaugu

SEQ ID NO: 1566037 - RNA, 19 nt, Homo sapiens
acagaggcccuaugaaugu

SEQ ID NO: 1566038 - RNA, 19 nt, Homo sapiens
gagaauuaugcaaauguga

SEQ ID NO: 1566039 - RNA, 19 nt, Homo sapiens
gaagcccuaugaauguaag

SEQ ID NO: 1566040 - RNA, 19 nt, Homo sapiens
aaacaaagauaggggauug

SEQ ID NO: 1566041 - RNA, 19 nt, Homo sapiens
agaagucacagcuacauga

SEQ ID NO: 1566042 - RNA, 19 nt, Homo sapiens
ccaaaccagaucugauauu

SEQ ID NO: 1566043 - RNA, 19 nt, Homo sapiens
uaaauucucacgcuuaagg

SEQ ID NO: 1566044 - RNA, 19 nt, Homo sapiens
cuucagagcccgaauccuu

SEQ ID NO: 1566045 - RNA, 19 nt, Homo sapiens
ugacaguccaggaucauga

SEQ ID NO: 1566046 - RNA, 19 nt, Homo sapiens
agucacagcuacaugauac

SEQ ID NO: 1566047 - RNA, 19 nt, Homo sapiens
gaagucacagcuacaugau

SEQ ID NO: 1566048 - RNA, 19 nt, Homo sapiens
gaggugaugcuggagaauu

SEQ ID NO: 1566049 - RNA, 19 nt, Homo sapiens
ucaaggacagguuagagaa

SEQ ID NO: 1566050 - RNA, 19 nt, Homo sapiens
aaccagaucugauauucca

SEQ ID NO: 1566051 - RNA, 19 nt, Homo sapiens
ucacucugguucagcauca

SEQ ID NO: 1566052 - RNA, 19 nt, Homo sapiens
gccaguaaccuuugaggau

SEQ ID NO: 1566053 - RNA, 19 nt, Homo sapiens
ugauauuccucuggucuug

SEQ ID NO: 1566054 - RNA, 19 nt, Homo sapiens
guacacgacuuaacaaaua

SEQ ID NO: 1566055 - RNA, 19 nt, Homo sapiens
gaacuaggauucuuggauu

SEQ ID NO: 1566056 - RNA, 19 nt, Homo sapiens
gagaagaccugcuacauag

SEQ ID NO: 1566057 - RNA, 19 nt, Homo sapiens
caaacaaucucugucauuu

SEQ ID NO: 1566058 - RNA, 19 nt, Homo sapiens
ggacuaauagccagaguua

SEQ ID NO: 1566059 - RNA, 19 nt, Homo sapiens
gaauuacacucauccuuug

SEQ ID NO: 1566060 - RNA, 19 nt, Homo sapiens
acacaggaaugccuaauaa

SEQ ID NO: 1566061 - RNA, 19 nt, Homo sapiens
gaaaugucccuuagcuaua

SEQ ID NO: 1566062 - RNA, 19 nt, Homo sapiens
caagaacaguuugcugaua

SEQ ID NO: 1566063 - RNA, 19 nt, Homo sapiens
guacuuagcugcagguucu

SEQ ID NO: 1566064 - RNA, 19 nt, Homo sapiens
aaagucaacuccugaaaug

SEQ ID NO: 1566065 - RNA, 19 nt, Homo sapiens
gaaaggaagugacaauacg

SEQ ID NO: 1566066 - RNA, 19 nt, Homo sapiens
acucauugcugaaagcuua

SEQ ID NO: 1566067 - RNA, 19 nt, Homo sapiens
uuaaagagccuucauuaug

SEQ ID NO: 1566068 - RNA, 19 nt, Homo sapiens
cauaaucacuccaaagcuu

SEQ ID NO: 1566069 - RNA, 19 nt, Homo sapiens
ggaagaggcggacuaauag

SEQ ID NO: 1566070 - RNA, 19 nt, Homo sapiens
aagaacaguuugcugauaa

SEQ ID NO: 1566071 - RNA, 19 nt, Homo sapiens
ggaaauagguaggguaaaa

SEQ ID NO: 1566072 - RNA, 19 nt, Homo sapiens
uggaagaggcggacuaaua

SEQ ID NO: 1566073 - RNA, 19 nt, Homo sapiens
uuaauugucuccaccauug

SEQ ID NO: 1566074 - RNA, 19 nt, Homo sapiens
cauuaaagagccuucauua

SEQ ID NO: 1566075 - RNA, 19 nt, Homo sapiens
gaacagcaauaccagaaaa

SEQ ID NO: 1566076 - RNA, 19 nt, Homo sapiens
guaaaagccuuguguaaau

SEQ ID NO: 1566077 - RNA, 19 nt, Homo sapiens
caagagcaguauucuacaa

SEQ ID NO: 1566078 - RNA, 19 nt, Homo sapiens
gaagaccugcuacauagaa

SEQ ID NO: 1566079 - RNA, 19 nt, Homo sapiens
aaaugucccuuagcuauaa

SEQ ID NO: 1566080 - RNA, 19 nt, Homo sapiens
uaagguugcugcuauauac

SEQ ID NO: 1566081 - RNA, 19 nt, Homo sapiens
acaggaaugccuaauaaua

SEQ ID NO: 1566082 - RNA, 19 nt, Homo sapiens
gccuagaacuggaggguuu

SEQ ID NO: 1566083 - RNA, 19 nt, Homo sapiens
aauaagaaguccucccaaa

SEQ ID NO: 1566084 - RNA, 19 nt, Homo sapiens
gaccugcuacauagaauua

SEQ ID NO: 1566085 - RNA, 19 nt, Homo sapiens
gcaacacauuuacaugaau

SEQ ID NO: 1566086 - RNA, 19 nt, Homo sapiens
ggaacggucuuguuaacca

SEQ ID NO: 1566087 - RNA, 19 nt, Homo sapiens
ugaauuacacucauccuuu

SEQ ID NO: 1566088 - RNA, 19 nt, Homo sapiens
gcacaaauccacgguacuu

SEQ ID NO: 1566089 - RNA, 19 nt, Homo sapiens
gcacaagagcaguauucua

SEQ ID NO: 1566090 - RNA, 19 nt, Homo sapiens
gagaacagcaauaccagaa

SEQ ID NO: 1566091 - RNA, 19 nt, Homo sapiens
aaacaaagcgccaugaagu

SEQ ID NO: 1566092 - RNA, 19 nt, Homo sapiens
agagaagaccugcuacaua

SEQ ID NO: 1566093 - RNA, 19 nt, Homo sapiens
gcacaagggcagugagaga

SEQ ID NO: 1566094 - RNA, 19 nt, Homo sapiens
uacgggagguccaaacuuu

SEQ ID NO: 1566095 - RNA, 19 nt, Homo sapiens
agacucagguguugggaaa

SEQ ID NO: 1566096 - RNA, 19 nt, Homo sapiens
ggaccagauucaugaaaca

SEQ ID NO: 1566097 - RNA, 19 nt, Homo sapiens
ugaaaugucccuuagcuau

SEQ ID NO: 1566098 - RNA, 19 nt, Homo sapiens
cagcaacacauuuacauga

SEQ ID NO: 1566099 - RNA, 19 nt, Homo sapiens
gaaacaaagcgccaugaag

SEQ ID NO: 1566100 - RNA, 19 nt, Homo sapiens
cagaguucaugauuacaaa

SEQ ID NO: 1566101 - RNA, 19 nt, Homo sapiens
acuaauagccagaguuaaa

SEQ ID NO: 1566102 - RNA, 19 nt, Homo sapiens
uugauaaggucauagagaa

SEQ ID NO: 1566103 - RNA, 19 nt, Homo sapiens
cagaagagaagaccugcua

SEQ ID NO: 1566104 - RNA, 19 nt, Homo sapiens
ucccuuagcuauaaucaga

SEQ ID NO: 1566105 - RNA, 19 nt, Homo sapiens
ccaaacaaucucugucauu

SEQ ID NO: 1566106 - RNA, 19 nt, Homo sapiens
ggugccaacuggagucuug

SEQ ID NO: 1566107 - RNA, 19 nt, Homo sapiens
gaugucagaguucaugauu

SEQ ID NO: 1566108 - RNA, 19 nt, Homo sapiens
gaagagaagaccugcuaca

SEQ ID NO: 1566109 - RNA, 19 nt, Homo sapiens
guaaauaugagauguuguc

SEQ ID NO: 1566110 - RNA, 19 nt, Homo sapiens
gauaaggucauagagaaga

SEQ ID NO: 1566111 - RNA, 19 nt, Homo sapiens
caugaauuaugaacuagga

SEQ ID NO: 1566112 - RNA, 19 nt, Homo sapiens
gggcagugagagacauuua

SEQ ID NO: 1566113 - RNA, 19 nt, Homo sapiens
caggaaugccuaauaauag

SEQ ID NO: 1566114 - RNA, 19 nt, Homo sapiens
guguaaauaugagauguug

SEQ ID NO: 1566115 - RNA, 19 nt, Homo sapiens
acaaagcgccaugaaguuu

SEQ ID NO: 1566116 - RNA, 19 nt, Homo sapiens
gaaaagcacaagagcagua

SEQ ID NO: 1566117 - RNA, 19 nt, Homo sapiens
ugucagaguucaugauuac

SEQ ID NO: 1566118 - RNA, 19 nt, Homo sapiens
acagcucccucacucuuaa

SEQ ID NO: 1566119 - RNA, 19 nt, Homo sapiens
ccucuucucuccuuugcaa

SEQ ID NO: 1566120 - RNA, 19 nt, Homo sapiens
aaugagcaaugacagugua

SEQ ID NO: 1566121 - RNA, 19 nt, Homo sapiens
augcuacccuucagccuua

SEQ ID NO: 1566122 - RNA, 19 nt, Homo sapiens
acaguuugcugauaaccaa

SEQ ID NO: 1566123 - RNA, 19 nt, Homo sapiens
gacagcucccucacucuua

SEQ ID NO: 1566124 - RNA, 19 nt, Homo sapiens
aauuuacucuugccuagaa

SEQ ID NO: 1566125 - RNA, 19 nt, Homo sapiens
guauuuauggagagaagua

SEQ ID NO: 1566126 - RNA, 19 nt, Homo sapiens
caagauggcgucccuggau

SEQ ID NO: 1566127 - RNA, 19 nt, Homo sapiens
cuccguaaaugguauuauu

SEQ ID NO: 1566128 - RNA, 19 nt, Homo sapiens
gccuuacccuuuaauggaa

SEQ ID NO: 1566129 - RNA, 19 nt, Homo sapiens
ccagauucaugaaacaaag

SEQ ID NO: 1566130 - RNA, 19 nt, Homo sapiens
gcagugagagacauuuaca

SEQ ID NO: 1566131 - RNA, 19 nt, Homo sapiens
acacucauccuuuggaaga

SEQ ID NO: 1566132 - RNA, 19 nt, Homo sapiens
ugacugaauuacacucauc

SEQ ID NO: 1566133 - RNA, 19 nt, Homo sapiens
uaagagaagguaaucagau

SEQ ID NO: 1566134 - RNA, 19 nt, Homo sapiens
gguaauagggacuaaacug

SEQ ID NO: 1566135 - RNA, 19 nt, Homo sapiens
ggauuaugaucaagaacag

SEQ ID NO: 1566136 - RNA, 19 nt, Homo sapiens
cacaagagcaguauucuac

SEQ ID NO: 1566137 - RNA, 19 nt, Homo sapiens
gaggggaacggucuuguua

SEQ ID NO: 1566138 - RNA, 19 nt, Homo sapiens
ccuucagccuuacccuuua

SEQ ID NO: 1566139 - RNA, 19 nt, Homo sapiens
gagcaagcaguggcaguuu

SEQ ID NO: 1566140 - RNA, 19 nt, Homo sapiens
ucuuaagguugcugcuaua

SEQ ID NO: 1566141 - RNA, 19 nt, Homo sapiens
gaugcaaaaugguguuauu

SEQ ID NO: 1566142 - RNA, 19 nt, Homo sapiens
ugcaguaaaugagcaauga

SEQ ID NO: 1566143 - RNA, 19 nt, Homo sapiens
guugggaaaucuucguuag

SEQ ID NO: 1566144 - RNA, 19 nt, Homo sapiens
gagcaguauucuacaacuc

SEQ ID NO: 1566145 - RNA, 19 nt, Homo sapiens
gcugcuauauacagucuag

SEQ ID NO: 1566146 - RNA, 19 nt, Homo sapiens
guaaaugagcaaugacagu

SEQ ID NO: 1566147 - RNA, 19 nt, Homo sapiens
aaaauaaguuccacagcaa

SEQ ID NO: 1566148 - RNA, 19 nt, Homo sapiens
ccuuagcuauaaucagaaa

SEQ ID NO: 1566149 - RNA, 19 nt, Homo sapiens
gggugaagguacugguguu

SEQ ID NO: 1566150 - RNA, 19 nt, Homo sapiens
cuauauacagucuagguuu

SEQ ID NO: 1566151 - RNA, 19 nt, Homo sapiens
guacugcagagaaaauuua

SEQ ID NO: 1566152 - RNA, 19 nt, Homo sapiens
ugggaaaucuucguuaguc

SEQ ID NO: 1566153 - RNA, 19 nt, Homo sapiens
gauaaccaaauaccacugu

SEQ ID NO: 1566154 - RNA, 19 nt, Homo sapiens
gaacaacugcuccuuaaua

SEQ ID NO: 1566155 - RNA, 19 nt, Homo sapiens
gcuaaaaccuucccaauua

SEQ ID NO: 1566156 - RNA, 19 nt, Homo sapiens
uaaacuacguggacgauua

SEQ ID NO: 1566157 - RNA, 19 nt, Homo sapiens
ggccauagcuggaauaaug

SEQ ID NO: 1566158 - RNA, 19 nt, Homo sapiens
uaaguuggcuggaguagaa

SEQ ID NO: 1566159 - RNA, 19 nt, Homo sapiens
gagaaugguuuagaaauug

SEQ ID NO: 1566160 - RNA, 19 nt, Homo sapiens
gcuaaugugugaagagaaa

SEQ ID NO: 1566161 - RNA, 19 nt, Homo sapiens
gggaaggcaugguuacaaa

SEQ ID NO: 1566162 - RNA, 19 nt, Homo sapiens
cgacugacaucaaaauuua

SEQ ID NO: 1566163 - RNA, 19 nt, Homo sapiens
uuaccaggcugaaugauuu

SEQ ID NO: 1566164 - RNA, 19 nt, Homo sapiens
gucaagaaaucuagaggua

SEQ ID NO: 1566165 - RNA, 19 nt, Homo sapiens
ggaaagacaacaugaacaa

SEQ ID NO: 1566166 - RNA, 19 nt, Homo sapiens
gagaagaggccuuggcaaa

SEQ ID NO: 1566167 - RNA, 19 nt, Homo sapiens
ggaaggaugaaacacuuua

SEQ ID NO: 1566168 - RNA, 19 nt, Homo sapiens
gggcugccauauugaauuu

SEQ ID NO: 1566169 - RNA, 19 nt, Homo sapiens
gcaaaacuguucuuguuaa

SEQ ID NO: 1566170 - RNA, 19 nt, Homo sapiens
gaaguuaccaggcugaaug

SEQ ID NO: 1566171 - RNA, 19 nt, Homo sapiens
gcauucgacugacaucaaa

SEQ ID NO: 1566172 - RNA, 19 nt, Homo sapiens
aaagauuccuggagagaaa

SEQ ID NO: 1566173 - RNA, 19 nt, Homo sapiens
gaugaaacacuuuaugaga

SEQ ID NO: 1566174 - RNA, 19 nt, Homo sapiens
cgcauaaacuuucguagaa

SEQ ID NO: 1566175 - RNA, 19 nt, Homo sapiens
cacagaaacuuacuuaaag

SEQ ID NO: 1566176 - RNA, 19 nt, Homo sapiens
gaguaaggguggauauuuc

SEQ ID NO: 1566177 - RNA, 19 nt, Homo sapiens
gugaaacggucaagaaauc

SEQ ID NO: 1566178 - RNA, 19 nt, Homo sapiens
gcgugaaucugaaugaaga

SEQ ID NO: 1566179 - RNA, 19 nt, Homo sapiens
ggacgauuacgccgaauaa

SEQ ID NO: 1566180 - RNA, 19 nt, Homo sapiens
gaaaagauccucccacuuc

SEQ ID NO: 1566181 - RNA, 19 nt, Homo sapiens
ccaaaugaucaaaguguua

SEQ ID NO: 1566182 - RNA, 19 nt, Homo sapiens
gcuaucuucuggugaguaa

SEQ ID NO: 1566183 - RNA, 19 nt, Homo sapiens
gugcuuugcugguuaaguu

SEQ ID NO: 1566184 - RNA, 19 nt, Homo sapiens
ggagaauucagcacucuuu

SEQ ID NO: 1566185 - RNA, 19 nt, Homo sapiens
gaacaucagcacuggaaug

SEQ ID NO: 1566186 - RNA, 19 nt, Homo sapiens
caagaaaucuagagguaac

SEQ ID NO: 1566187 - RNA, 19 nt, Homo sapiens
gaauaacugagaaugguuu

SEQ ID NO: 1566188 - RNA, 19 nt, Homo sapiens
uuuacaagcucuucggaua

SEQ ID NO: 1566189 - RNA, 19 nt, Homo sapiens
guguuuauguuuccaguuu

SEQ ID NO: 1566190 - RNA, 19 nt, Homo sapiens
ccaaagagugaaauaugua

SEQ ID NO: 1566191 - RNA, 19 nt, Homo sapiens
ccaaguaccugggauuaca

SEQ ID NO: 1566192 - RNA, 19 nt, Homo sapiens
guucacagaaacuuacuua

SEQ ID NO: 1566193 - RNA, 19 nt, Homo sapiens
ggacuuaugaaauauggaa

SEQ ID NO: 1566194 - RNA, 19 nt, Homo sapiens
gagaaggcguuucgcucuu

SEQ ID NO: 1566195 - RNA, 19 nt, Homo sapiens
gaucaaaguguuaguccaa

SEQ ID NO: 1566196 - RNA, 19 nt, Homo sapiens
caacugcuccuuaauacug

SEQ ID NO: 1566197 - RNA, 19 nt, Homo sapiens
gagaagcauucgacugaca

SEQ ID NO: 1566198 - RNA, 19 nt, Homo sapiens
gaaacggucaagaaaucua

SEQ ID NO: 1566199 - RNA, 19 nt, Homo sapiens
gggcuuaaauaugauucua

SEQ ID NO: 1566200 - RNA, 19 nt, Homo sapiens
ggagugcaauggcgugauc

SEQ ID NO: 1566201 - RNA, 19 nt, Homo sapiens
ggagugcaguggcguuauc

SEQ ID NO: 1566202 - RNA, 19 nt, Homo sapiens
gagaaggaauauggaagga

SEQ ID NO: 1566203 - RNA, 19 nt, Homo sapiens
aaacuguucuuguuaaagg

SEQ ID NO: 1566204 - RNA, 19 nt, Homo sapiens
gaagaaauuuugagaagag

SEQ ID NO: 1566205 - RNA, 19 nt, Homo sapiens
gcuggaauaauguuacuuu

SEQ ID NO: 1566206 - RNA, 19 nt, Homo sapiens
caugaacaacugcuccuua

SEQ ID NO: 1566207 - RNA, 19 nt, Homo sapiens
ugaaacacuuuaugagaag

SEQ ID NO: 1566208 - RNA, 19 nt, Homo sapiens
uaggaaggaugaaacacuu

SEQ ID NO: 1566209 - RNA, 19 nt, Homo sapiens
gccaaaugaucaaaguguu

SEQ ID NO: 1566210 - RNA, 19 nt, Homo sapiens
augaacaacugcuccuuaa

SEQ ID NO: 1566211 - RNA, 19 nt, Homo sapiens
uacaagcucuucggauauu

SEQ ID NO: 1566212 - RNA, 19 nt, Homo sapiens
aaacaacaggaucagauuu

SEQ ID NO: 1566213 - RNA, 19 nt, Homo sapiens
ugaguaaggguggauauuu

SEQ ID NO: 1566214 - RNA, 19 nt, Homo sapiens
ugccugagccucccaagua

SEQ ID NO: 1566215 - RNA, 19 nt, Homo sapiens
gcaguggcguuaucuuggu

SEQ ID NO: 1566216 - RNA, 19 nt, Homo sapiens
uaacugagaaugguuuaga

SEQ ID NO: 1566217 - RNA, 19 nt, Homo sapiens
gugcuaaugugugaagaga

SEQ ID NO: 1566218 - RNA, 19 nt, Homo sapiens
cuaaagugcugggauuaca

SEQ ID NO: 1566219 - RNA, 19 nt, Homo sapiens
gaaggaugaaacacuuuau

SEQ ID NO: 1566220 - RNA, 19 nt, Homo sapiens
ucaaaguguuaguccaaug

SEQ ID NO: 1566221 - RNA, 19 nt, Homo sapiens
gcacuggaauggccauagc

SEQ ID NO: 1566222 - RNA, 19 nt, Homo sapiens
uccaaagagugaaauaugu

SEQ ID NO: 1566223 - RNA, 19 nt, Homo sapiens
gaauggccauagcuggaau

SEQ ID NO: 1566224 - RNA, 19 nt, Homo sapiens
uuacuaugguuccaacuuc

SEQ ID NO: 1566225 - RNA, 19 nt, Homo sapiens
gaaggcguuucgcucuugu

SEQ ID NO: 1566226 - RNA, 19 nt, Homo sapiens
ccgaauaacugagaauggu

SEQ ID NO: 1566227 - RNA, 19 nt, Homo sapiens
cagaacaucagcacuggaa

SEQ ID NO: 1566228 - RNA, 19 nt, Homo sapiens
ggaauggccauagcuggaa

SEQ ID NO: 1566229 - RNA, 19 nt, Homo sapiens
ggaucagauuucagcuuga

SEQ ID NO: 1566230 - RNA, 19 nt, Homo sapiens
gacauggaguuucgcucuu

SEQ ID NO: 1566231 - RNA, 19 nt, Homo sapiens
auauagugcuaauguguga

SEQ ID NO: 1566232 - RNA, 19 nt, Homo sapiens
cauauauagugcuaaugug

SEQ ID NO: 1566233 - RNA, 19 nt, Homo sapiens
gggugaaacggucaagaaa

SEQ ID NO: 1566234 - RNA, 19 nt, Homo sapiens
cguggugcuuugcugguua

SEQ ID NO: 1566235 - RNA, 19 nt, Homo sapiens
ggaugaaacacuuuaugag

SEQ ID NO: 1566236 - RNA, 19 nt, Homo sapiens
ggugaaacggucaagaaau

SEQ ID NO: 1566237 - RNA, 19 nt, Homo sapiens
uggcaaaacuguucuuguu

SEQ ID NO: 1566238 - RNA, 19 nt, Homo sapiens
cagcgugaaucugaaugaa

SEQ ID NO: 1566239 - RNA, 19 nt, Homo sapiens
cugaguagcugggauuaca

SEQ ID NO: 1566240 - RNA, 19 nt, Homo sapiens
ucaagaaaucuagagguaa

SEQ ID NO: 1566241 - RNA, 19 nt, Homo sapiens
caaagauuccuggagagaa

SEQ ID NO: 1566242 - RNA, 19 nt, Homo sapiens
cuucggauauuccaguaga

SEQ ID NO: 1566243 - RNA, 19 nt, Homo sapiens
agaaggcguuucgcucuug

SEQ ID NO: 1566244 - RNA, 19 nt, Homo sapiens
gcuccuuaauacugaaguu

SEQ ID NO: 1566245 - RNA, 19 nt, Homo sapiens
ggaaggaagacucugaaaa

SEQ ID NO: 1566246 - RNA, 19 nt, Homo sapiens
uugagaagcauucgacuga

SEQ ID NO: 1566247 - RNA, 19 nt, Homo sapiens
gauauguguuuauguuucc

SEQ ID NO: 1566248 - RNA, 19 nt, Homo sapiens
gugcaguggcguuaucuug

SEQ ID NO: 1566249 - RNA, 19 nt, Homo sapiens
guuaguccaaugguauuua

SEQ ID NO: 1566250 - RNA, 19 nt, Homo sapiens
caaaugaucaaaguguuag

SEQ ID NO: 1566251 - RNA, 19 nt, Homo sapiens
cgauuacgccgaauaacug

SEQ ID NO: 1566252 - RNA, 19 nt, Homo sapiens
guaaccuucuccaaagagu

SEQ ID NO: 1566253 - RNA, 19 nt, Homo sapiens
aagacaacaugaacaacug

SEQ ID NO: 1566254 - RNA, 19 nt, Homo sapiens
ccaaagagcucuaagaaau

SEQ ID NO: 1566255 - RNA, 19 nt, Homo sapiens
gaguauagcucugaaauaa

SEQ ID NO: 1566256 - RNA, 19 nt, Homo sapiens
gaaauuagauaaccaccaa

SEQ ID NO: 1566257 - RNA, 19 nt, Homo sapiens
gaacucaugucuacaauuc

SEQ ID NO: 1566258 - RNA, 19 nt, Homo sapiens
gaacauauccaaagcuuga

SEQ ID NO: 1566259 - RNA, 19 nt, Homo sapiens
caacucagcuuacauuuua

SEQ ID NO: 1566260 - RNA, 19 nt, Homo sapiens
gaauauuacucucuucuug

SEQ ID NO: 1566261 - RNA, 19 nt, Homo sapiens
gaaaagaacuagaucguuu

SEQ ID NO: 1566262 - RNA, 19 nt, Homo sapiens
ucucagaacuguuacauaa

SEQ ID NO: 1566263 - RNA, 19 nt, Homo sapiens
gaagagcauuagaaaguaa

SEQ ID NO: 1566264 - RNA, 19 nt, Homo sapiens
gaaaguaaaggagauguua

SEQ ID NO: 1566265 - RNA, 19 nt, Homo sapiens
gcaaaucuccagugguuua

SEQ ID NO: 1566266 - RNA, 19 nt, Homo sapiens
guauagcucugaaauaaug

SEQ ID NO: 1566267 - RNA, 19 nt, Homo sapiens
cagcaaaucuccagugguu

SEQ ID NO: 1566268 - RNA, 19 nt, Homo sapiens
gagaagccauuaaguaaca

SEQ ID NO: 1566269 - RNA, 19 nt, Homo sapiens
gaaaagaaaggaagaguua

SEQ ID NO: 1566270 - RNA, 19 nt, Homo sapiens
gaaguugacguacauauau

SEQ ID NO: 1566271 - RNA, 19 nt, Homo sapiens
ccuaacaacuguacuuaaa

SEQ ID NO: 1566272 - RNA, 19 nt, Homo sapiens
uuagugaggugauucauuu

SEQ ID NO: 1566273 - RNA, 19 nt, Homo sapiens
aagaacaguuugccacuua

SEQ ID NO: 1566274 - RNA, 19 nt, Homo sapiens
acaugcaucuguauaguua

SEQ ID NO: 1566275 - RNA, 19 nt, Homo sapiens
guaagagacuucuagaaca

SEQ ID NO: 1566276 - RNA, 19 nt, Homo sapiens
ugaacugucucaucaauug

SEQ ID NO: 1566277 - RNA, 19 nt, Homo sapiens
caaagagcucuaagaaaua

SEQ ID NO: 1566278 - RNA, 19 nt, Homo sapiens
ucaaaugggacaagucuua

SEQ ID NO: 1566279 - RNA, 19 nt, Homo sapiens
uaagagacuucuagaacaa

SEQ ID NO: 1566280 - RNA, 19 nt, Homo sapiens
gaaagggaaaucaaugaaa

SEQ ID NO: 1566281 - RNA, 19 nt, Homo sapiens
gcaaaaggguguacaauca

SEQ ID NO: 1566282 - RNA, 19 nt, Homo sapiens
gagaagauauuuccacacu

SEQ ID NO: 1566283 - RNA, 19 nt, Homo sapiens
uacagaauccucaguaaua

SEQ ID NO: 1566284 - RNA, 19 nt, Homo sapiens
guauacaaaugguggauug

SEQ ID NO: 1566285 - RNA, 19 nt, Homo sapiens
gaccaaauaagcuaucuuu

SEQ ID NO: 1566286 - RNA, 19 nt, Homo sapiens
ugccagaacucaauuaaug

SEQ ID NO: 1566287 - RNA, 19 nt, Homo sapiens
gaaagauugccaaguuauu

SEQ ID NO: 1566288 - RNA, 19 nt, Homo sapiens
ugaagagcauuagaaagua

SEQ ID NO: 1566289 - RNA, 19 nt, Homo sapiens
ggagagguaugugugugua

SEQ ID NO: 1566290 - RNA, 19 nt, Homo sapiens
auccaaagcuugaauacua

SEQ ID NO: 1566291 - RNA, 19 nt, Homo sapiens
gagcccagcauuucuagua

SEQ ID NO: 1566292 - RNA, 19 nt, Homo sapiens
aaggaagaguuaaagguua

SEQ ID NO: 1566293 - RNA, 19 nt, Homo sapiens
gaaaccaacucagcuuaca

SEQ ID NO: 1566294 - RNA, 19 nt, Homo sapiens
ggucucacauucagaguau

SEQ ID NO: 1566295 - RNA, 19 nt, Homo sapiens
gaaggauucuacaauaguc

SEQ ID NO: 1566296 - RNA, 19 nt, Homo sapiens
cagaggaggcugaugauuu

SEQ ID NO: 1566297 - RNA, 19 nt, Homo sapiens
acaaauguuucccauaaga

SEQ ID NO: 1566298 - RNA, 19 nt, Homo sapiens
gaaauaauggaacucaugu

SEQ ID NO: 1566299 - RNA, 19 nt, Homo sapiens
guuucuaacugcugcuuua

SEQ ID NO: 1566300 - RNA, 19 nt, Homo sapiens
uaagauaccuucgggcaau

SEQ ID NO: 1566301 - RNA, 19 nt, Homo sapiens
gccaguaauugacaguuaa

SEQ ID NO: 1566302 - RNA, 19 nt, Homo sapiens
ggguugggcuggagaggua

SEQ ID NO: 1566303 - RNA, 19 nt, Homo sapiens
gaaaggaagaguuaaaggu

SEQ ID NO: 1566304 - RNA, 19 nt, Homo sapiens
gagagaacaugaaaagaaa

SEQ ID NO: 1566305 - RNA, 19 nt, Homo sapiens
gaccugaucucuggauuca

SEQ ID NO: 1566306 - RNA, 19 nt, Homo sapiens
gcagucugauaaccaguuu

SEQ ID NO: 1566307 - RNA, 19 nt, Homo sapiens
gagguuaugucuagagaag

SEQ ID NO: 1566308 - RNA, 19 nt, Homo sapiens
uaauggaacucaugucuac

SEQ ID NO: 1566309 - RNA, 19 nt, Homo sapiens
cgaaguugacguacauaua

SEQ ID NO: 1566310 - RNA, 19 nt, Homo sapiens
gcccagcauuucuaguaua

SEQ ID NO: 1566311 - RNA, 19 nt, Homo sapiens
ugaggugauucauuuguuu

SEQ ID NO: 1566312 - RNA, 19 nt, Homo sapiens
gucauaagcagucugauaa

SEQ ID NO: 1566313 - RNA, 19 nt, Homo sapiens
caaaacaggugauugauag

SEQ ID NO: 1566314 - RNA, 19 nt, Homo sapiens
gauggagaccuuuguauuc

SEQ ID NO: 1566315 - RNA, 19 nt, Homo sapiens
uuugaaagauugccaaguu

SEQ ID NO: 1566316 - RNA, 19 nt, Homo sapiens
guggccagcugcauaguuu

SEQ ID NO: 1566317 - RNA, 19 nt, Homo sapiens
gaaugaaucagaaaggaau

SEQ ID NO: 1566318 - RNA, 19 nt, Homo sapiens
ggcaaacacuauccaggaa

SEQ ID NO: 1566319 - RNA, 19 nt, Homo sapiens
caacaugcaucuguauagu

SEQ ID NO: 1566320 - RNA, 19 nt, Homo sapiens
auacaggcaucaacaaaga

SEQ ID NO: 1566321 - RNA, 19 nt, Homo sapiens
gcuccaagcuugcaugaac

SEQ ID NO: 1566322 - RNA, 19 nt, Homo sapiens
gcacaguguuauauauucu

SEQ ID NO: 1566323 - RNA, 19 nt, Homo sapiens
uggagaagccauuaaguaa

SEQ ID NO: 1566324 - RNA, 19 nt, Homo sapiens
cagcauuucuaguauacaa

SEQ ID NO: 1566325 - RNA, 19 nt, Homo sapiens
uugaaagauugccaaguua

SEQ ID NO: 1566326 - RNA, 19 nt, Homo sapiens
ucaaggacccugaugaaga

SEQ ID NO: 1566327 - RNA, 19 nt, Homo sapiens
ccaaauaaugggagugaaa

SEQ ID NO: 1566328 - RNA, 19 nt, Homo sapiens
ugaaacgugugcauuaaca

SEQ ID NO: 1566329 - RNA, 19 nt, Homo sapiens
aaagagcucuaagaaauag

SEQ ID NO: 1566330 - RNA, 19 nt, Homo sapiens
auauaaaggucucacauuc

SEQ ID NO: 1566331 - RNA, 19 nt, Homo sapiens
gccauuaaguaacacagaa

SEQ ID NO: 1566332 - RNA, 19 nt, Homo sapiens
caauugcaacucucagaua

SEQ ID NO: 1566333 - RNA, 19 nt, Homo sapiens
caagucuuauuacuccuuu

SEQ ID NO: 1566334 - RNA, 19 nt, Homo sapiens
aaaccaggcuucaagucuu

SEQ ID NO: 1566335 - RNA, 19 nt, Homo sapiens
caagauggagaccuuugua

SEQ ID NO: 1566336 - RNA, 19 nt, Homo sapiens
aaaugauccuuaacaguga

SEQ ID NO: 1566337 - RNA, 19 nt, Homo sapiens
ggguguacaaucauauuua

SEQ ID NO: 1566338 - RNA, 19 nt, Homo sapiens
uaauacagaauccucagua

SEQ ID NO: 1566339 - RNA, 19 nt, Homo sapiens
uauugaaacgugugcauua

SEQ ID NO: 1566340 - RNA, 19 nt, Homo sapiens
gaaagacuagaaggacuaa

SEQ ID NO: 1566341 - RNA, 19 nt, Homo sapiens
ggagaccuuuguauuccuu

SEQ ID NO: 1566342 - RNA, 19 nt, Homo sapiens
gaacucgggcauuuuaaua

SEQ ID NO: 1566343 - RNA, 19 nt, Homo sapiens
gcuuagcacagcagaauuu

SEQ ID NO: 1566344 - RNA, 19 nt, Homo sapiens
guagaaagggaaaucaaug

SEQ ID NO: 1566345 - RNA, 19 nt, Homo sapiens
uaagauaggaggaucacuu

SEQ ID NO: 1566346 - RNA, 19 nt, Homo sapiens
uauaaagagcccagcauuu

SEQ ID NO: 1566347 - RNA, 19 nt, Homo sapiens
gaagaauuacagccaguau

SEQ ID NO: 1566348 - RNA, 19 nt, Homo sapiens
caaggacccugaugaagac

SEQ ID NO: 1566349 - RNA, 19 nt, Homo sapiens
gaaaccaggcuucaagucu

SEQ ID NO: 1566350 - RNA, 19 nt, Homo sapiens
acagaauccucaguaauau

SEQ ID NO: 1566351 - RNA, 19 nt, Homo sapiens
aauacagaauccucaguaa

SEQ ID NO: 1566352 - RNA, 19 nt, Homo sapiens
guucagaccauucaggauu

SEQ ID NO: 1566353 - RNA, 19 nt, Homo sapiens
gcaaacacuauccaggaaa

SEQ ID NO: 1566354 - RNA, 19 nt, Homo sapiens
gagaaacccuauaaaugua

SEQ ID NO: 1566355 - RNA, 19 nt, Homo sapiens
gagaaacccuauaaaugua

SEQ ID NO: 1566356 - RNA, 19 nt, Homo sapiens
ggagaaacccuauaaaugu

SEQ ID NO: 1566357 - RNA, 19 nt, Homo sapiens
gagaaacccuauaagugua

SEQ ID NO: 1566358 - RNA, 19 nt, Homo sapiens
agagaaaccuuacaaaugu

SEQ ID NO: 1566359 - RNA, 19 nt, Homo sapiens
gacggaagauaaugacaua

SEQ ID NO: 1566360 - RNA, 19 nt, Homo sapiens
gagagaaacccuauaaaug

SEQ ID NO: 1566361 - RNA, 19 nt, Homo sapiens
gagagaaaccuuacaaaug

SEQ ID NO: 1566362 - RNA, 19 nt, Homo sapiens
gagagaagccuuaugaaug

SEQ ID NO: 1566363 - RNA, 19 nt, Homo sapiens
ggagaaagacaagaaauuu

SEQ ID NO: 1566364 - RNA, 19 nt, Homo sapiens
ggagaaaacuuaugaaugu

SEQ ID NO: 1566365 - RNA, 19 nt, Homo sapiens
ggaaagagaagacuagaga

SEQ ID NO: 1566366 - RNA, 19 nt, Homo sapiens
gggaaugccuuuagucaga

SEQ ID NO: 1566367 - RNA, 19 nt, Homo sapiens
ggagaaagaaaccucauaa

SEQ ID NO: 1566368 - RNA, 19 nt, Homo sapiens
gggaaagccuaucgguaua

SEQ ID NO: 1566369 - RNA, 19 nt, Homo sapiens
caacauaugucuacacaac

SEQ ID NO: 1566370 - RNA, 19 nt, Homo sapiens
gaaaggcacguaguauaua

SEQ ID NO: 1566371 - RNA, 19 nt, Homo sapiens
gaauauggauggugaaacu

SEQ ID NO: 1566372 - RNA, 19 nt, Homo sapiens
ugaaaugaaugaugagcua

SEQ ID NO: 1566373 - RNA, 19 nt, Homo sapiens
ggagagaaacccuauaaau

SEQ ID NO: 1566374 - RNA, 19 nt, Homo sapiens
guucaaaccuuacucaaca

SEQ ID NO: 1566375 - RNA, 19 nt, Homo sapiens
gcucuaaccuuguuguuca

SEQ ID NO: 1566376 - RNA, 19 nt, Homo sapiens
caagagaauuccacagaga

SEQ ID NO: 1566377 - RNA, 19 nt, Homo sapiens
ggaagauaaugacauacaa

SEQ ID NO: 1566378 - RNA, 19 nt, Homo sapiens
guucacagcuuauucaaca

SEQ ID NO: 1566379 - RNA, 19 nt, Homo sapiens
caagcugacuuuagaguug

SEQ ID NO: 1566380 - RNA, 19 nt, Homo sapiens
gagagaaacccuauaagug

SEQ ID NO: 1566381 - RNA, 19 nt, Homo sapiens
agagaagccuuaugaaugu

SEQ ID NO: 1566382 - RNA, 19 nt, Homo sapiens
gaaucauacucuacuucua

SEQ ID NO: 1566383 - RNA, 19 nt, Homo sapiens
ggaaaacucuuaaugaaca

SEQ ID NO: 1566384 - RNA, 19 nt, Homo sapiens
ggagagaagccuuaugaau

SEQ ID NO: 1566385 - RNA, 19 nt, Homo sapiens
ggagagaaacccuauaagu

SEQ ID NO: 1566386 - RNA, 19 nt, Homo sapiens
gaucaucucugggcgauag

SEQ ID NO: 1566387 - RNA, 19 nt, Homo sapiens
caaagcaucauuccugaaa

SEQ ID NO: 1566388 - RNA, 19 nt, Homo sapiens
aagacaagcugacuuuaga

SEQ ID NO: 1566389 - RNA, 19 nt, Homo sapiens
ggaaaugauuggauaagac

SEQ ID NO: 1566390 - RNA, 19 nt, Homo sapiens
ggguugaaaugaaugauga

SEQ ID NO: 1566391 - RNA, 19 nt, Homo sapiens
gaaacauaaugaggagaaa

SEQ ID NO: 1566392 - RNA, 19 nt, Homo sapiens
cgguauaguucacagcuua

SEQ ID NO: 1566393 - RNA, 19 nt, Homo sapiens
gaaaagagacaguauguau

SEQ ID NO: 1566394 - RNA, 19 nt, Homo sapiens
ggaaacauaaugaggagaa

SEQ ID NO: 1566395 - RNA, 19 nt, Homo sapiens
gaggaggaguuaauuccaa

SEQ ID NO: 1566396 - RNA, 19 nt, Homo sapiens
gggaaaugauuggauaaga

SEQ ID NO: 1566397 - RNA, 19 nt, Homo sapiens
agagaaacccuauaaaugu

SEQ ID NO: 1566398 - RNA, 19 nt, Homo sapiens
aguggaaagucacaucuua

SEQ ID NO: 1566399 - RNA, 19 nt, Homo sapiens
ggacugaggaggaguuaau

SEQ ID NO: 1566400 - RNA, 19 nt, Homo sapiens
uagagcguguuuccuguua

SEQ ID NO: 1566401 - RNA, 19 nt, Homo sapiens
gcauuuagcagcaguggaa

SEQ ID NO: 1566402 - RNA, 19 nt, Homo sapiens
gaugagcuauccauaugau

SEQ ID NO: 1566403 - RNA, 19 nt, Homo sapiens
gagaaagaaaccucauaaa

SEQ ID NO: 1566404 - RNA, 19 nt, Homo sapiens
gaagcccuauucuuguauu

SEQ ID NO: 1566405 - RNA, 19 nt, Homo sapiens
gugcaaaccucacaguaca

SEQ ID NO: 1566406 - RNA, 19 nt, Homo sapiens
caccagagacuucaucgua

SEQ ID NO: 1566407 - RNA, 19 nt, Homo sapiens
gaaaacaugugguucuaau

SEQ ID NO: 1566408 - RNA, 19 nt, Homo sapiens
caacaccagaggaaacaua

SEQ ID NO: 1566409 - RNA, 19 nt, Homo sapiens
ggagugaccaagaaucuga

SEQ ID NO: 1566410 - RNA, 19 nt, Homo sapiens
ugaaaggcacguaguauau

SEQ ID NO: 1566411 - RNA, 19 nt, Homo sapiens
acaauaaaguacucacaga

SEQ ID NO: 1566412 - RNA, 19 nt, Homo sapiens
ggaguuaauuccaaagcau

SEQ ID NO: 1566413 - RNA, 19 nt, Homo sapiens
gcaaugaagacgugcuuau

SEQ ID NO: 1566414 - RNA, 19 nt, Homo sapiens
cuaaggagaaacccuauaa

SEQ ID NO: 1566415 - RNA, 19 nt, Homo sapiens
cuaccuaggcuucaucuuu

SEQ ID NO: 1566416 - RNA, 19 nt, Homo sapiens
uggauaagacggaagauaa

SEQ ID NO: 1566417 - RNA, 19 nt, Homo sapiens
uuacaggguugaaaugaau

SEQ ID NO: 1566418 - RNA, 19 nt, Homo sapiens
gaacccacacuaaggagaa

SEQ ID NO: 1566419 - RNA, 19 nt, Homo sapiens
ccagagacuucaucguaga

SEQ ID NO: 1566420 - RNA, 19 nt, Homo sapiens
ggacugaagcccuauacau

SEQ ID NO: 1566421 - RNA, 19 nt, Homo sapiens
gcugugacccugcaacaaa

SEQ ID NO: 1566422 - RNA, 19 nt, Homo sapiens
gaagggaaagagaagacua

SEQ ID NO: 1566423 - RNA, 19 nt, Homo sapiens
ggaaagucacaucuuauuc

SEQ ID NO: 1566424 - RNA, 19 nt, Homo sapiens
agaagggagugaccaagaa

SEQ ID NO: 1566425 - RNA, 19 nt, Homo sapiens
cauaaacaccgauccuuug

SEQ ID NO: 1566426 - RNA, 19 nt, Homo sapiens
cguguuuccuguuaaguaa

SEQ ID NO: 1566427 - RNA, 19 nt, Homo sapiens
gagaaggaaguaaaccaaa

SEQ ID NO: 1566428 - RNA, 19 nt, Homo sapiens
gaaagucacaucuuauucg

SEQ ID NO: 1566429 - RNA, 19 nt, Homo sapiens
gcaagucccuuccuuuuag

SEQ ID NO: 1566430 - RNA, 19 nt, Homo sapiens
gaaugaugagcuauccaua

SEQ ID NO: 1566431 - RNA, 19 nt, Homo sapiens
uauaucacaucacagaguu

SEQ ID NO: 1566432 - RNA, 19 nt, Homo sapiens
ggccuuauaucacaucaca

SEQ ID NO: 1566433 - RNA, 19 nt, Homo sapiens
agagaaacccuauaagugu

SEQ ID NO: 1566434 - RNA, 19 nt, Homo sapiens
uuagaaggcuccucugaag

SEQ ID NO: 1566435 - RNA, 19 nt, Homo sapiens
guagagagaaaccuuacaa

SEQ ID NO: 1566436 - RNA, 19 nt, Homo sapiens
acucagcaguguuaugaaa

SEQ ID NO: 1566437 - RNA, 19 nt, Homo sapiens
ggauaagacggaagauaau

SEQ ID NO: 1566438 - RNA, 19 nt, Homo sapiens
agccguaguucaaaccuua

SEQ ID NO: 1566439 - RNA, 19 nt, Homo sapiens
aaagagacaguauguaugu

SEQ ID NO: 1566440 - RNA, 19 nt, Homo sapiens
caauaaaguacucacagaa

SEQ ID NO: 1566441 - RNA, 19 nt, Homo sapiens
agaggacacugguauguuc

SEQ ID NO: 1566442 - RNA, 19 nt, Homo sapiens
aaugaagacgugcuuauuu

SEQ ID NO: 1566443 - RNA, 19 nt, Homo sapiens
guucgggccuuauaucaca

SEQ ID NO: 1566444 - RNA, 19 nt, Homo sapiens
ucauagcucuaaccuuguu

SEQ ID NO: 1566445 - RNA, 19 nt, Homo sapiens
uuaggaacuucuucacuga

SEQ ID NO: 1566446 - RNA, 19 nt, Homo sapiens
guauguauguacugagugu

SEQ ID NO: 1566447 - RNA, 19 nt, Homo sapiens
cauacauacuuucaagaga

SEQ ID NO: 1566448 - RNA, 19 nt, Homo sapiens
gacugaagcccuauacaug

SEQ ID NO: 1566449 - RNA, 19 nt, Homo sapiens
ucauaaacaccgauccuuu

SEQ ID NO: 1566450 - RNA, 19 nt, Homo sapiens
caaugaagacgugcuuauu

SEQ ID NO: 1566451 - RNA, 19 nt, Homo sapiens
aaaggcacguaguauauag

SEQ ID NO: 1566452 - RNA, 19 nt, Homo sapiens
gaacaccagagacuucauc

SEQ ID NO: 1566453 - RNA, 19 nt, Homo sapiens
gugaaugugggaaaucuuu

SEQ ID NO: 1566454 - RNA, 19 nt, Homo sapiens
caggagagcugacguuguu

SEQ ID NO: 1566455 - RNA, 19 nt, Homo sapiens
ggaugaagcccuccucaga

SEQ ID NO: 1566456 - RNA, 19 nt, Homo sapiens
cuagucgccuccagaagua

SEQ ID NO: 1566457 - RNA, 19 nt, Homo sapiens
gaacaagccacagggucua

SEQ ID NO: 1566458 - RNA, 19 nt, Homo sapiens
gggcuccgcuuacaauagu

SEQ ID NO: 1566459 - RNA, 19 nt, Homo sapiens
ccacagggucuaccaguga

SEQ ID NO: 1566460 - RNA, 19 nt, Homo sapiens
agacaaaccuaagaucaca

SEQ ID NO: 1566461 - RNA, 19 nt, Homo sapiens
caauaguccucccucuguu

SEQ ID NO: 1566462 - RNA, 19 nt, Homo sapiens
gaaacuggaacacauugau

SEQ ID NO: 1566463 - RNA, 19 nt, Homo sapiens
ucucuggacuugugauaau

SEQ ID NO: 1566464 - RNA, 19 nt, Homo sapiens
cggaaaggaccucuaguga

SEQ ID NO: 1566465 - RNA, 19 nt, Homo sapiens
ccgagcaucugggaaagaa

SEQ ID NO: 1566466 - RNA, 19 nt, Homo sapiens
gcuagucgccuccagaagu

SEQ ID NO: 1566467 - RNA, 19 nt, Homo sapiens
gaacaacaagccccaaaga

SEQ ID NO: 1566468 - RNA, 19 nt, Homo sapiens
ccuggaaggugucaagaag

SEQ ID NO: 1566469 - RNA, 19 nt, Homo sapiens
cuacugugcugucacugau

SEQ ID NO: 1566470 - RNA, 19 nt, Homo sapiens
ucagacaaaccuaagauca

SEQ ID NO: 1566471 - RNA, 19 nt, Homo sapiens
uuaccucucuggacuugug

SEQ ID NO: 1566472 - RNA, 19 nt, Homo sapiens
acaauaguccucccucugu

SEQ ID NO: 1566473 - RNA, 19 nt, Homo sapiens
ggaccucuagugacguuga

SEQ ID NO: 1566474 - RNA, 19 nt, Homo sapiens
gagcaucugggaaagaaag

SEQ ID NO: 1566475 - RNA, 19 nt, Homo sapiens
agcaggagcuucagguugu

SEQ ID NO: 1566476 - RNA, 19 nt, Homo sapiens
uaaaaguuccuaccucaaa

SEQ ID NO: 1566477 - RNA, 19 nt, Homo sapiens
ccaccuacaucggcuccuu

SEQ ID NO: 1566478 - RNA, 19 nt, Homo sapiens
gaccucuagugacguugaa

SEQ ID NO: 1566479 - RNA, 19 nt, Homo sapiens
ggagcaggagcuucagguu

SEQ ID NO: 1566480 - RNA, 19 nt, Homo sapiens
ucagggagcaggagcuuca

SEQ ID NO: 1566481 - RNA, 19 nt, Homo sapiens
aaacuggaacacauugaug

SEQ ID NO: 1566482 - RNA, 19 nt, Homo sapiens
aaaaguuccuaccucaaaa

SEQ ID NO: 1566483 - RNA, 19 nt, Homo sapiens
gcagucagacaaaccuaag

SEQ ID NO: 1566484 - RNA, 19 nt, Homo sapiens
gaccggaaaggaccucuag

SEQ ID NO: 1566485 - RNA, 19 nt, Homo sapiens
cagcuagucgccuccagaa

SEQ ID NO: 1566486 - RNA, 19 nt, Homo sapiens
ggaccggaaaggaccucua

SEQ ID NO: 1566487 - RNA, 19 nt, Homo sapiens
ggucuaccagugacaggaa

SEQ ID NO: 1566488 - RNA, 19 nt, Homo sapiens
aaggaccucuagugacguu

SEQ ID NO: 1566489 - RNA, 19 nt, Homo sapiens
ccggaaaggaccucuagug

SEQ ID NO: 1566490 - RNA, 19 nt, Homo sapiens
uggaaggugucaagaagac

SEQ ID NO: 1566491 - RNA, 19 nt, Homo sapiens
ggagagcugacguuguucu

SEQ ID NO: 1566492 - RNA, 19 nt, Homo sapiens
ccugaaacuggaacacauu

SEQ ID NO: 1566493 - RNA, 19 nt, Homo sapiens
uguccgagcaucugggaaa

SEQ ID NO: 1566494 - RNA, 19 nt, Homo sapiens
cuggacuugugauaauaaa

SEQ ID NO: 1566495 - RNA, 19 nt, Homo sapiens
cagucacuuucguguggua

SEQ ID NO: 1566496 - RNA, 19 nt, Homo sapiens
gcaggagcuucagguuguc

SEQ ID NO: 1566497 - RNA, 19 nt, Homo sapiens
ccaaauaaacagugcguua

SEQ ID NO: 1566498 - RNA, 19 nt, Homo sapiens
ggaaaucacagaucaggaa

SEQ ID NO: 1566499 - RNA, 19 nt, Homo sapiens
cuaaguaccuuucuuccuu

SEQ ID NO: 1566500 - RNA, 19 nt, Homo sapiens
gcacgcgggucacucauuc

SEQ ID NO: 1566501 - RNA, 19 nt, Homo sapiens
ucaaauaucaggaauggaa

SEQ ID NO: 1566502 - RNA, 19 nt, Homo sapiens
gaccagagcuaagagacaa

SEQ ID NO: 1566503 - RNA, 19 nt, Homo sapiens
uagagccgcuuuccuggua

SEQ ID NO: 1566504 - RNA, 19 nt, Homo sapiens
acacacagauauagacaug

SEQ ID NO: 1566505 - RNA, 19 nt, Homo sapiens
ucacagcgcugcgggagaa

SEQ ID NO: 1566506 - RNA, 19 nt, Homo sapiens
cugcgacccucuccaauaa

SEQ ID NO: 1566507 - RNA, 19 nt, Homo sapiens
gaccaacagucucuucauc

SEQ ID NO: 1566508 - RNA, 19 nt, Homo sapiens
uggaggagcuguacaaguc

SEQ ID NO: 1566509 - RNA, 19 nt, Homo sapiens
ccaauaaacacuccaaucu

SEQ ID NO: 1566510 - RNA, 19 nt, Homo sapiens
gcugcgacccucuccaaua

SEQ ID NO: 1566511 - RNA, 19 nt, Homo sapiens
ugcguuagcuuucugcaaa

SEQ ID NO: 1566512 - RNA, 19 nt, Homo sapiens
ugaaggaggccaucaagga

SEQ ID NO: 1566513 - RNA, 19 nt, Homo sapiens
ucacagaucaggaacacaa

SEQ ID NO: 1566514 - RNA, 19 nt, Homo sapiens
gagccuaaguaccuuucuu

SEQ ID NO: 1566515 - RNA, 19 nt, Homo sapiens
ccaacagucucuucaucga

SEQ ID NO: 1566516 - RNA, 19 nt, Homo sapiens
ucaaggacauccacaugag

SEQ ID NO: 1566517 - RNA, 19 nt, Homo sapiens
cgucaaauaucaggaaugg

SEQ ID NO: 1566518 - RNA, 19 nt, Homo sapiens
uaaacagugcguuagcuuu

SEQ ID NO: 1566519 - RNA, 19 nt, Homo sapiens
ggcuguagcugcucucaca

SEQ ID NO: 1566520 - RNA, 19 nt, Homo sapiens
ggaccacccucuggacaca

SEQ ID NO: 1566521 - RNA, 19 nt, Homo sapiens
ggccaguccuguccuguca

SEQ ID NO: 1566522 - RNA, 19 nt, Homo sapiens
caaauaaacagugcguuag

SEQ ID NO: 1566523 - RNA, 19 nt, Homo sapiens
caagcacgccuuaaacaca

SEQ ID NO: 1566524 - RNA, 19 nt, Homo sapiens
aaacagugcguuagcuuuc

SEQ ID NO: 1566525 - RNA, 19 nt, Homo sapiens
uaucaggaauggaaagaac

SEQ ID NO: 1566526 - RNA, 19 nt, Homo sapiens
caugcaagcacgccuuaaa

SEQ ID NO: 1566527 - RNA, 19 nt, Homo sapiens
ggucacucauucccacuca

SEQ ID NO: 1566528 - RNA, 19 nt, Homo sapiens
caaauaucaggaauggaaa

SEQ ID NO: 1566529 - RNA, 19 nt, Homo sapiens
acaugagccuggagaagga

SEQ ID NO: 1566530 - RNA, 19 nt, Homo sapiens
ccuuaaacacacagauaua

SEQ ID NO: 1566531 - RNA, 19 nt, Homo sapiens
acacagauauagacaugac

SEQ ID NO: 1566532 - RNA, 19 nt, Homo sapiens
ggaccagagcuaagagaca

SEQ ID NO: 1566533 - RNA, 19 nt, Homo sapiens
gcauagaugggccguccuu

SEQ ID NO: 1566534 - RNA, 19 nt, Homo sapiens
aggcagggcucugacucua

SEQ ID NO: 1566535 - RNA, 19 nt, Homo sapiens
caauaaacacuccaaucuc

SEQ ID NO: 1566536 - RNA, 19 nt, Homo sapiens
gcgacccucuccaauaaac

SEQ ID NO: 1566537 - RNA, 19 nt, Homo sapiens
ucacugccaugaccaacag

SEQ ID NO: 1566538 - RNA, 19 nt, Homo sapiens
cgccuuaaacacacagaua

SEQ ID NO: 1566539 - RNA, 19 nt, Homo sapiens
cugguaggauccuuucaug

SEQ ID NO: 1566540 - RNA, 19 nt, Homo sapiens
acuccaaucuccacacaca

SEQ ID NO: 1566541 - RNA, 19 nt, Homo sapiens
gccuuaaacacacagauau

SEQ ID NO: 1566542 - RNA, 19 nt, Homo sapiens
guucuuggaccagagcuaa

SEQ ID NO: 1566543 - RNA, 19 nt, Homo sapiens
cuccuuccgucaaauauca

SEQ ID NO: 1566544 - RNA, 19 nt, Homo sapiens
ggugccuccuuccgucaaa

SEQ ID NO: 1566545 - RNA, 19 nt, Homo sapiens
gcaagcacgccuuaaacac

SEQ ID NO: 1566546 - RNA, 19 nt, Homo sapiens
acacuccaaucuccacaca

SEQ ID NO: 1566547 - RNA, 19 nt, Homo sapiens
ccucaaggacauccacaug

SEQ ID NO: 1566548 - RNA, 19 nt, Homo sapiens
aaacacacagauauagaca

SEQ ID NO: 1566549 - RNA, 19 nt, Homo sapiens
guacugccugggccucuga

SEQ ID NO: 1566550 - RNA, 19 nt, Homo sapiens
gcacugaaggaggccauca

SEQ ID NO: 1566551 - RNA, 19 nt, Homo sapiens
ugcgggaaaucacagauca

SEQ ID NO: 1566552 - RNA, 19 nt, Homo sapiens
uaaacacacagauauagac

SEQ ID NO: 1566553 - RNA, 19 nt, Homo sapiens
gagcuguacaaguccauca

SEQ ID NO: 1566554 - RNA, 19 nt, Homo sapiens
caacgugguggcacugaag

SEQ ID NO: 1566555 - RNA, 19 nt, Homo sapiens
acaacgugguggcacugaa

SEQ ID NO: 1566556 - RNA, 19 nt, Homo sapiens
caucaaggacaaggaggaa

SEQ ID NO: 1566557 - RNA, 19 nt, Homo sapiens
guaggaauauuagggauga

SEQ ID NO: 1566558 - RNA, 19 nt, Homo sapiens
uuucuuggcuucuaaguuu

SEQ ID NO: 1566559 - RNA, 19 nt, Homo sapiens
gagauaacguaggaauauu

SEQ ID NO: 1566560 - RNA, 19 nt, Homo sapiens
uuucauggaugcugauuaa

SEQ ID NO: 1566561 - RNA, 19 nt, Homo sapiens
gaucuuccuuucaugaguu

SEQ ID NO: 1566562 - RNA, 19 nt, Homo sapiens
ccucagaucuuccuuucau

SEQ ID NO: 1566563 - RNA, 19 nt, Homo sapiens
cgagauaacguaggaauau

SEQ ID NO: 1566564 - RNA, 19 nt, Homo sapiens
gcuguuaccguacauucua

SEQ ID NO: 1566565 - RNA, 19 nt, Homo sapiens
caugagcccucgcuuugug

SEQ ID NO: 1566566 - RNA, 19 nt, Homo sapiens
caugaguuauguaguugaa

SEQ ID NO: 1566567 - RNA, 19 nt, Homo sapiens
ugccuucacuucuuacuug

SEQ ID NO: 1566568 - RNA, 19 nt, Homo sapiens
gggcaucucguuccucaga

SEQ ID NO: 1566569 - RNA, 19 nt, Homo sapiens
ggaagaggagaggguguuu

SEQ ID NO: 1566570 - RNA, 19 nt, Homo sapiens
ccuuugccuucacuucuua

SEQ ID NO: 1566571 - RNA, 19 nt, Homo sapiens
gauaacguaggaauauuag

SEQ ID NO: 1566572 - RNA, 19 nt, Homo sapiens
gcauggugguucuguaggu

SEQ ID NO: 1566573 - RNA, 19 nt, Homo sapiens
gaauauuagggaugagaug

SEQ ID NO: 1566574 - RNA, 19 nt, Homo sapiens
aaucuuucuuggcuucuaa

SEQ ID NO: 1566575 - RNA, 19 nt, Homo sapiens
ucagaucuuccuuucauga

SEQ ID NO: 1566576 - RNA, 19 nt, Homo sapiens
gugcccaccugcucacaug

SEQ ID NO: 1566577 - RNA, 19 nt, Homo sapiens
ucauugaucuacuucuagu

SEQ ID NO: 1566578 - RNA, 19 nt, Homo sapiens
uauuagggaugagauggaa

SEQ ID NO: 1566579 - RNA, 19 nt, Homo sapiens
caaucuuucuuggcuucua

SEQ ID NO: 1566580 - RNA, 19 nt, Homo sapiens
ggaauauuagggaugagau

SEQ ID NO: 1566581 - RNA, 19 nt, Homo sapiens
gccuuugccuucacuucuu

SEQ ID NO: 1566582 - RNA, 19 nt, Homo sapiens
gugcccaccugcucaugug

SEQ ID NO: 1566583 - RNA, 19 nt, Homo sapiens
gugccugccugcucacaca

SEQ ID NO: 1566584 - RNA, 19 nt, Homo sapiens
gugcccauguggaguguuc

SEQ ID NO: 1566585 - RNA, 19 nt, Homo sapiens
ugcaugagcccucgcuuug

SEQ ID NO: 1566586 - RNA, 19 nt, Homo sapiens
gcugccaacugugccuuug

SEQ ID NO: 1566587 - RNA, 19 nt, Homo sapiens
cauggugguucuguagguu

SEQ ID NO: 1566588 - RNA, 19 nt, Homo sapiens
ucgagauaacguaggaaua

SEQ ID NO: 1566589 - RNA, 19 nt, Homo sapiens
uaccguacauucuacucau

SEQ ID NO: 1566590 - RNA, 19 nt, Homo sapiens
gcaugagcccucgcuuugu

SEQ ID NO: 1566591 - RNA, 19 nt, Homo sapiens
gcucacgugcccauaugga

SEQ ID NO: 1566592 - RNA, 19 nt, Homo sapiens
cugcucacgugcccauaug

SEQ ID NO: 1566593 - RNA, 19 nt, Homo sapiens
gugcauagguuccauguga

SEQ ID NO: 1566594 - RNA, 19 nt, Homo sapiens
ggcaagaaguggaagagua

SEQ ID NO: 1566595 - RNA, 19 nt, Homo sapiens
gcaaugauguccucgucuu

SEQ ID NO: 1566596 - RNA, 19 nt, Homo sapiens
gcagucacaccaccuguua

SEQ ID NO: 1566597 - RNA, 19 nt, Homo sapiens
ccaagcggauucaucuuug

SEQ ID NO: 1566598 - RNA, 19 nt, Homo sapiens
guggaggacucaagguaaa

SEQ ID NO: 1566599 - RNA, 19 nt, Homo sapiens
gcggaaccaugacagaaga

SEQ ID NO: 1566600 - RNA, 19 nt, Homo sapiens
gcaagaaguggaagaguag

SEQ ID NO: 1566601 - RNA, 19 nt, Homo sapiens
ccagacacuguuuguaaua

SEQ ID NO: 1566602 - RNA, 19 nt, Homo sapiens
gcagaucagcuuccuguuc

SEQ ID NO: 1566603 - RNA, 19 nt, Homo sapiens
gcagcagccugacgcuaga

SEQ ID NO: 1566604 - RNA, 19 nt, Homo sapiens
gaaccaugacagaagauga

SEQ ID NO: 1566605 - RNA, 19 nt, Homo sapiens
caagcggauucaucuuuga

SEQ ID NO: 1566606 - RNA, 19 nt, Homo sapiens
gccaagcggauucaucuuu

SEQ ID NO: 1566607 - RNA, 19 nt, Homo sapiens
ccagcagccucucguccua

SEQ ID NO: 1566608 - RNA, 19 nt, Homo sapiens
acugucagcuguuucuaaa

SEQ ID NO: 1566609 - RNA, 19 nt, Homo sapiens
agacacuguuuguaauaga

SEQ ID NO: 1566610 - RNA, 19 nt, Homo sapiens
ucugcuggcuccugucuga

SEQ ID NO: 1566611 - RNA, 19 nt, Homo sapiens
cccagcagcucccugugaa

SEQ ID NO: 1566612 - RNA, 19 nt, Homo sapiens
caccaccuguuaagcauca

SEQ ID NO: 1566613 - RNA, 19 nt, Homo sapiens
cagacacuguuuguaauag

SEQ ID NO: 1566614 - RNA, 19 nt, Homo sapiens
cccagacacuguuuguaau

SEQ ID NO: 1566615 - RNA, 19 nt, Homo sapiens
acccagacacuguuuguaa

SEQ ID NO: 1566616 - RNA, 19 nt, Homo sapiens
ucacaccaccuguuaagca

SEQ ID NO: 1566617 - RNA, 19 nt, Homo sapiens
cagaugaacugggcucacu

SEQ ID NO: 1566618 - RNA, 19 nt, Homo sapiens
ggacaagucggagcguauc

SEQ ID NO: 1566619 - RNA, 19 nt, Homo sapiens
ccaaugcucagcugcuuca

SEQ ID NO: 1566620 - RNA, 19 nt, Homo sapiens
ccagauggcagaggaagug

SEQ ID NO: 1566621 - RNA, 19 nt, Homo sapiens
ggcaguggaagcugucuga

SEQ ID NO: 1566622 - RNA, 19 nt, Homo sapiens
gcgcggaaccaugacagaa

SEQ ID NO: 1566623 - RNA, 19 nt, Homo sapiens
ucggcgaggugcauagguu

SEQ ID NO: 1566624 - RNA, 19 nt, Homo sapiens
ccaucaugcugggcuuuga

SEQ ID NO: 1566625 - RNA, 19 nt, Homo sapiens
gcauagguuccaugugaca

SEQ ID NO: 1566626 - RNA, 19 nt, Homo sapiens
ggaggaaggggcugacuug

SEQ ID NO: 1566627 - RNA, 19 nt, Homo sapiens
gacacaccacgcagccuuu

SEQ ID NO: 1566628 - RNA, 19 nt, Homo sapiens
caaugauguccucgucuug

SEQ ID NO: 1566629 - RNA, 19 nt, Homo sapiens
gacacuguuuguaauagac

SEQ ID NO: 1566630 - RNA, 19 nt, Homo sapiens
agacuggugcucuguguuc

SEQ ID NO: 1566631 - RNA, 19 nt, Homo sapiens
uguggaggacucaagguaa

SEQ ID NO: 1566632 - RNA, 19 nt, Homo sapiens
ccgcauggccagagcaauc

SEQ ID NO: 1566633 - RNA, 19 nt, Homo sapiens
uccacacgcuggccauugu

SEQ ID NO: 1566634 - RNA, 19 nt, Homo sapiens
cacaccaccuguuaagcau

SEQ ID NO: 1566635 - RNA, 19 nt, Homo sapiens
gugccaagcggauucaucu

SEQ ID NO: 1566636 - RNA, 19 nt, Homo sapiens
cgacauaggcucacaagua

SEQ ID NO: 1566637 - RNA, 19 nt, Homo sapiens
ugacagaagugcuuuaugu

SEQ ID NO: 1566638 - RNA, 19 nt, Homo sapiens
ggacuggacugccuuagau

SEQ ID NO: 1566639 - RNA, 19 nt, Homo sapiens
caacgugaauuccauaaau

SEQ ID NO: 1566640 - RNA, 19 nt, Homo sapiens
ggaaacaagauacagauuu

SEQ ID NO: 1566641 - RNA, 19 nt, Homo sapiens
gauagaauauucagauugg

SEQ ID NO: 1566642 - RNA, 19 nt, Homo sapiens
gagcaucccugugucguuu

SEQ ID NO: 1566643 - RNA, 19 nt, Homo sapiens
ggaggcaucuugguguaua

SEQ ID NO: 1566644 - RNA, 19 nt, Homo sapiens
gacauaggcucacaaguag

SEQ ID NO: 1566645 - RNA, 19 nt, Homo sapiens
guagauaucugccaauugc

SEQ ID NO: 1566646 - RNA, 19 nt, Homo sapiens
guaaguauuugugcaugua

SEQ ID NO: 1566647 - RNA, 19 nt, Homo sapiens
gcaccugcacuucuaguua

SEQ ID NO: 1566648 - RNA, 19 nt, Homo sapiens
cgaaagcccucuggauuga

SEQ ID NO: 1566649 - RNA, 19 nt, Homo sapiens
ggucugcucuguucuaauc

SEQ ID NO: 1566650 - RNA, 19 nt, Homo sapiens
aaacagacacguugaaaga

SEQ ID NO: 1566651 - RNA, 19 nt, Homo sapiens
ggaaauacacacacacuca

SEQ ID NO: 1566652 - RNA, 19 nt, Homo sapiens
guaacacaaugguaaguau

SEQ ID NO: 1566653 - RNA, 19 nt, Homo sapiens
cagcuuaccuugaggacuu

SEQ ID NO: 1566654 - RNA, 19 nt, Homo sapiens
gagcugcuguuuucuuuua

SEQ ID NO: 1566655 - RNA, 19 nt, Homo sapiens
cuucgucuguuuauacuua

SEQ ID NO: 1566656 - RNA, 19 nt, Homo sapiens
cagacacguugaaagaaua

SEQ ID NO: 1566657 - RNA, 19 nt, Homo sapiens
gggauagaauauucagauu

SEQ ID NO: 1566658 - RNA, 19 nt, Homo sapiens
gagggauucuucuauggaa

SEQ ID NO: 1566659 - RNA, 19 nt, Homo sapiens
gcaacuuccuggugagaau

SEQ ID NO: 1566660 - RNA, 19 nt, Homo sapiens
gcaaacagacacguugaaa

SEQ ID NO: 1566661 - RNA, 19 nt, Homo sapiens
cagccuaaaugaaucuauu

SEQ ID NO: 1566662 - RNA, 19 nt, Homo sapiens
ugaaguggaucuuguugug

SEQ ID NO: 1566663 - RNA, 19 nt, Homo sapiens
uauaugccgucuauucuug

SEQ ID NO: 1566664 - RNA, 19 nt, Homo sapiens
caccugcacuuccacauga

SEQ ID NO: 1566665 - RNA, 19 nt, Homo sapiens
agauacagauuucagaaug

SEQ ID NO: 1566666 - RNA, 19 nt, Homo sapiens
gaacuuacucaaaccuaga

SEQ ID NO: 1566667 - RNA, 19 nt, Homo sapiens
gagaaucccuugggcaucu

SEQ ID NO: 1566668 - RNA, 19 nt, Homo sapiens
ggauagaauauucagauug

SEQ ID NO: 1566669 - RNA, 19 nt, Homo sapiens
ccauaaauuuacacuccua

SEQ ID NO: 1566670 - RNA, 19 nt, Homo sapiens
guagagcucuucgucuguu

SEQ ID NO: 1566671 - RNA, 19 nt, Homo sapiens
cagcaucgcagccuaaaug

SEQ ID NO: 1566672 - RNA, 19 nt, Homo sapiens
ucacacacauccacacaca

SEQ ID NO: 1566673 - RNA, 19 nt, Homo sapiens
acacagagucagcgacaua

SEQ ID NO: 1566674 - RNA, 19 nt, Homo sapiens
gcacagacacacacacaca

SEQ ID NO: 1566675 - RNA, 19 nt, Homo sapiens
gcacagacacacacacaca

SEQ ID NO: 1566676 - RNA, 19 nt, Homo sapiens
uacaaggucugcucuguuc

SEQ ID NO: 1566677 - RNA, 19 nt, Homo sapiens
cauagaaacaguguaguaa

SEQ ID NO: 1566678 - RNA, 19 nt, Homo sapiens
caagauacagauuucagaa

SEQ ID NO: 1566679 - RNA, 19 nt, Homo sapiens
gcucuguucuaaucuuaug

SEQ ID NO: 1566680 - RNA, 19 nt, Homo sapiens
gcaucauagugugaacuua

SEQ ID NO: 1566681 - RNA, 19 nt, Homo sapiens
gaauagacaaggaccacuu

SEQ ID NO: 1566682 - RNA, 19 nt, Homo sapiens
gcaauuacugauacaucua

SEQ ID NO: 1566683 - RNA, 19 nt, Homo sapiens
caucgcagccuaaaugaau

SEQ ID NO: 1566684 - RNA, 19 nt, Homo sapiens
aaacauagaaacaguguag

SEQ ID NO: 1566685 - RNA, 19 nt, Homo sapiens
caccugcacuucuaguuau

SEQ ID NO: 1566686 - RNA, 19 nt, Homo sapiens
gauacagauuucagaaugg

SEQ ID NO: 1566687 - RNA, 19 nt, Homo sapiens
ggugugaaguggaucuugu

SEQ ID NO: 1566688 - RNA, 19 nt, Homo sapiens
ccacacgccugggcuguau

SEQ ID NO: 1566689 - RNA, 19 nt, Homo sapiens
acagacacguugaaagaau

SEQ ID NO: 1566690 - RNA, 19 nt, Homo sapiens
acugauacaucuaaguuug

SEQ ID NO: 1566691 - RNA, 19 nt, Homo sapiens
gguaaguauuugugcaugu

SEQ ID NO: 1566692 - RNA, 19 nt, Homo sapiens
gagcaaacagacacguuga

SEQ ID NO: 1566693 - RNA, 19 nt, Homo sapiens
acacacacaugcacagaca

SEQ ID NO: 1566694 - RNA, 19 nt, Homo sapiens
acacacacaugcacagaca

SEQ ID NO: 1566695 - RNA, 19 nt, Homo sapiens
ccagguaacugcauuugcu

SEQ ID NO: 1566696 - RNA, 19 nt, Homo sapiens
gugcagacuucuugguuca

SEQ ID NO: 1566697 - RNA, 19 nt, Homo sapiens
guacaaggucugcucuguu

SEQ ID NO: 1566698 - RNA, 19 nt, Homo sapiens
gcccuugccucucuuaguc

SEQ ID NO: 1566699 - RNA, 19 nt, Homo sapiens
acaagcauaugcauacaca

SEQ ID NO: 1566700 - RNA, 19 nt, Homo sapiens
ucaccaacugucaauauuu

SEQ ID NO: 1566701 - RNA, 19 nt, Homo sapiens
ugccuuagaucacaugugu

SEQ ID NO: 1566702 - RNA, 19 nt, Homo sapiens
caaggucugcucuguucua

SEQ ID NO: 1566703 - RNA, 19 nt, Homo sapiens
acauagaaacaguguagua

SEQ ID NO: 1566704 - RNA, 19 nt, Homo sapiens
acacacaagcauaugcaua

SEQ ID NO: 1566705 - RNA, 19 nt, Homo sapiens
gcagacuucuugguucauc

SEQ ID NO: 1566706 - RNA, 19 nt, Homo sapiens
ccgaaagcccucuggauug

SEQ ID NO: 1566707 - RNA, 19 nt, Homo sapiens
acacaaugguaaguauuug

SEQ ID NO: 1566708 - RNA, 19 nt, Homo sapiens
ugagcucaaucaauaaaca

SEQ ID NO: 1566709 - RNA, 19 nt, Homo sapiens
uaucccggcuuggagauuu

SEQ ID NO: 1566710 - RNA, 19 nt, Homo sapiens
guacauggaaauacacaca

SEQ ID NO: 1566711 - RNA, 19 nt, Homo sapiens
gaauggugcaggugauugu

SEQ ID NO: 1566712 - RNA, 19 nt, Homo sapiens
gcaccugcacuuccacaug

SEQ ID NO: 1566713 - RNA, 19 nt, Homo sapiens
ggacugccuuagaucacau

SEQ ID NO: 1566714 - RNA, 19 nt, Homo sapiens
cagaauggcaccugaacau

SEQ ID NO: 1566715 - RNA, 19 nt, Homo sapiens
cugcucuguucuaaucuua

SEQ ID NO: 1566716 - RNA, 19 nt, Homo sapiens
caggcagggugguacugua

SEQ ID NO: 1566717 - RNA, 19 nt, Homo sapiens
caccaacugucaauauuuu

SEQ ID NO: 1566718 - RNA, 19 nt, Homo sapiens
cacuguauaugccgucuau

SEQ ID NO: 1566719 - RNA, 19 nt, Homo sapiens
ggacagcuccagguaacug

SEQ ID NO: 1566720 - RNA, 19 nt, Homo sapiens
ccauuucucuaauuaugca

SEQ ID NO: 1566721 - RNA, 19 nt, Homo sapiens
gauaucugccaauugcuau

SEQ ID NO: 1566722 - RNA, 19 nt, Homo sapiens
ccucugcgaugccauagca

SEQ ID NO: 1566723 - RNA, 19 nt, Homo sapiens
cagggaugguucugaggaa

SEQ ID NO: 1566724 - RNA, 19 nt, Homo sapiens
gcaccugcacucccagaug

SEQ ID NO: 1566725 - RNA, 19 nt, Homo sapiens
gcucuucgucuguuuauac

SEQ ID NO: 1566726 - RNA, 19 nt, Homo sapiens
guggauaaugggaggauuu

SEQ ID NO: 1566727 - RNA, 19 nt, Homo sapiens
gccaauugcuauccaacgu

SEQ ID NO: 1566728 - RNA, 19 nt, Homo sapiens
gcauacacacauauauaca

SEQ ID NO: 1566729 - RNA, 19 nt, Homo sapiens
guauaugccgucuauucuu

SEQ ID NO: 1566730 - RNA, 19 nt, Homo sapiens
ggacuuucgagcaaacaga

SEQ ID NO: 1566731 - RNA, 19 nt, Homo sapiens
cuugaggacuuucgagcaa

SEQ ID NO: 1566732 - RNA, 19 nt, Homo sapiens
acacacacacacagacaaa

SEQ ID NO: 1566733 - RNA, 19 nt, Homo sapiens
cagagcuccucgcuuacuu

SEQ ID NO: 1566734 - RNA, 19 nt, Homo sapiens
acacauauacacauacagu

SEQ ID NO: 1566735 - RNA, 19 nt, Homo sapiens
gacagaagugcuuuaugug

SEQ ID NO: 1566736 - RNA, 19 nt, Homo sapiens
gaacauacauugaucuuga

SEQ ID NO: 1566737 - RNA, 19 nt, Homo sapiens
gcugagauguuucuuauua

SEQ ID NO: 1566738 - RNA, 19 nt, Homo sapiens
ccaguuacuugcuuauuua

SEQ ID NO: 1566739 - RNA, 19 nt, Homo sapiens
guaaaguaguccaugcaua

SEQ ID NO: 1566740 - RNA, 19 nt, Homo sapiens
gugaaacgcuaucaaagaa

SEQ ID NO: 1566741 - RNA, 19 nt, Homo sapiens
ccagauauauuugacagua

SEQ ID NO: 1566742 - RNA, 19 nt, Homo sapiens
gauagagguuuaauacaga

SEQ ID NO: 1566743 - RNA, 19 nt, Homo sapiens
gaauaggguuagcuacuga

SEQ ID NO: 1566744 - RNA, 19 nt, Homo sapiens
ggcaauuccuaguuaauaa

SEQ ID NO: 1566745 - RNA, 19 nt, Homo sapiens
caaagugccugucucuguu

SEQ ID NO: 1566746 - RNA, 19 nt, Homo sapiens
cagcugagauguuucuuau

SEQ ID NO: 1566747 - RNA, 19 nt, Homo sapiens
caagugaucugcccaccuu

SEQ ID NO: 1566748 - RNA, 19 nt, Homo sapiens
gaaauucagauguuacuug

SEQ ID NO: 1566749 - RNA, 19 nt, Homo sapiens
ggauucagcuuccaaugug

SEQ ID NO: 1566750 - RNA, 19 nt, Homo sapiens
agacauauuugcugccuuu

SEQ ID NO: 1566751 - RNA, 19 nt, Homo sapiens
gaaacccugucuguacuaa

SEQ ID NO: 1566752 - RNA, 19 nt, Homo sapiens
cagaaacuccuuauaaaga

SEQ ID NO: 1566753 - RNA, 19 nt, Homo sapiens
ccacuuggauucugccuau

SEQ ID NO: 1566754 - RNA, 19 nt, Homo sapiens
gcauucagauuguuuaguc

SEQ ID NO: 1566755 - RNA, 19 nt, Homo sapiens
gaacugcugaccucaacua

SEQ ID NO: 1566756 - RNA, 19 nt, Homo sapiens
ggcuauauauguaugguuu

SEQ ID NO: 1566757 - RNA, 19 nt, Homo sapiens
gagaaggcuauaaaucaua

SEQ ID NO: 1566758 - RNA, 19 nt, Homo sapiens
acaagucccuaacauggua

SEQ ID NO: 1566759 - RNA, 19 nt, Homo sapiens
cauauuugcugccuuuaau

SEQ ID NO: 1566760 - RNA, 19 nt, Homo sapiens
caagucagauucagaaacu

SEQ ID NO: 1566761 - RNA, 19 nt, Homo sapiens
uaagaagucuggaauacag

SEQ ID NO: 1566762 - RNA, 19 nt, Homo sapiens
gcaccaccaugcccagcua

SEQ ID NO: 1566763 - RNA, 19 nt, Homo sapiens
gauguuacuugauuuccuu

SEQ ID NO: 1566764 - RNA, 19 nt, Homo sapiens
gaaacgcuaucaaagaaaa

SEQ ID NO: 1566765 - RNA, 19 nt, Homo sapiens
ugaggaggcuaauuucaga

SEQ ID NO: 1566766 - RNA, 19 nt, Homo sapiens
gagaugccaggcucacuua

SEQ ID NO: 1566767 - RNA, 19 nt, Homo sapiens
ggauccaguuacuugcuua

SEQ ID NO: 1566768 - RNA, 19 nt, Homo sapiens
aggguuagcuacugaauga

SEQ ID NO: 1566769 - RNA, 19 nt, Homo sapiens
uaaauuguggauccaguua

SEQ ID NO: 1566770 - RNA, 19 nt, Homo sapiens
gcauacaagucccuaacau

SEQ ID NO: 1566771 - RNA, 19 nt, Homo sapiens
ccagaacuuuggagaauag

SEQ ID NO: 1566772 - RNA, 19 nt, Homo sapiens
gcaguauguuugugaaagu

SEQ ID NO: 1566773 - RNA, 19 nt, Homo sapiens
ccugaggucuggaguuuga

SEQ ID NO: 1566774 - RNA, 19 nt, Homo sapiens
acugaaugauggcaaguua

SEQ ID NO: 1566775 - RNA, 19 nt, Homo sapiens
aauaugaggaggcuaauuu

SEQ ID NO: 1566776 - RNA, 19 nt, Homo sapiens
gaaacuccuuauaaagaca

SEQ ID NO: 1566777 - RNA, 19 nt, Homo sapiens
caauuguucucuacugguu

SEQ ID NO: 1566778 - RNA, 19 nt, Homo sapiens
caaagccacuguguugguu

SEQ ID NO: 1566779 - RNA, 19 nt, Homo sapiens
gaggcuaauuucagagcua

SEQ ID NO: 1566780 - RNA, 19 nt, Homo sapiens
ugagaaggcuauaaaucau

SEQ ID NO: 1566781 - RNA, 19 nt, Homo sapiens
uaucaaguauggcagguau

SEQ ID NO: 1566782 - RNA, 19 nt, Homo sapiens
ugauagagguuuaauacag

SEQ ID NO: 1566783 - RNA, 19 nt, Homo sapiens
ccaaagugcugggauuaca

SEQ ID NO: 1566784 - RNA, 19 nt, Homo sapiens
caacuaauccacccuccuu

SEQ ID NO: 1566785 - RNA, 19 nt, Homo sapiens
uauguccgcuggauuguga

SEQ ID NO: 1566786 - RNA, 19 nt, Homo sapiens
ccucaucaauuguucucua

SEQ ID NO: 1566787 - RNA, 19 nt, Homo sapiens
aaauuggaaugucucguuu

SEQ ID NO: 1566788 - RNA, 19 nt, Homo sapiens
uccaguuacuugcuuauuu

SEQ ID NO: 1566789 - RNA, 19 nt, Homo sapiens
gugcccagcugagauguuu

SEQ ID NO: 1566790 - RNA, 19 nt, Homo sapiens
uggcuaggcuggucuugaa

SEQ ID NO: 1566791 - RNA, 19 nt, Homo sapiens
ccaaguaucugggauugca

SEQ ID NO: 1566792 - RNA, 19 nt, Homo sapiens
gccugucucuguuuauaaa

SEQ ID NO: 1566793 - RNA, 19 nt, Homo sapiens
gugccugucucuguuuaua

SEQ ID NO: 1566794 - RNA, 19 nt, Homo sapiens
uaacugccacccuuucaaa

SEQ ID NO: 1566795 - RNA, 19 nt, Homo sapiens
cugcugaccucaacuaauc

SEQ ID NO: 1566796 - RNA, 19 nt, Homo sapiens
ggagugcaguggcgcaauc

SEQ ID NO: 1566797 - RNA, 19 nt, Homo sapiens
ugaaugauggcaaguuaaa

SEQ ID NO: 1566798 - RNA, 19 nt, Homo sapiens
ccaaagugccugucucugu

SEQ ID NO: 1566799 - RNA, 19 nt, Homo sapiens
gagcugagaucaccccauu

SEQ ID NO: 1566800 - RNA, 19 nt, Homo sapiens
caaugucgguguugaugau

SEQ ID NO: 1566801 - RNA, 19 nt, Homo sapiens
ccagcuaaguuuuguauuu

SEQ ID NO: 1566802 - RNA, 19 nt, Homo sapiens
uaccagaacuuuggagaau

SEQ ID NO: 1566803 - RNA, 19 nt, Homo sapiens
aggagucacuaucaucuaa

SEQ ID NO: 1566804 - RNA, 19 nt, Homo sapiens
gaccaagucagauucagaa

SEQ ID NO: 1566805 - RNA, 19 nt, Homo sapiens
cgaauaccaucgaccaagu

SEQ ID NO: 1566806 - RNA, 19 nt, Homo sapiens
uaaaguaguccaugcauac

SEQ ID NO: 1566807 - RNA, 19 nt, Homo sapiens
gagucacuaucaucuaaau

SEQ ID NO: 1566808 - RNA, 19 nt, Homo sapiens
gcucacuuaucuaaagaau

SEQ ID NO: 1566809 - RNA, 19 nt, Homo sapiens
gcugcguucuccuggauuu

SEQ ID NO: 1566810 - RNA, 19 nt, Homo sapiens
uaaccaagaaguugcaguu

SEQ ID NO: 1566811 - RNA, 19 nt, Homo sapiens
caauguggaucuucauguc

SEQ ID NO: 1566812 - RNA, 19 nt, Homo sapiens
ucaaguauggcagguauuu

SEQ ID NO: 1566813 - RNA, 19 nt, Homo sapiens
cagauuguuuagucaaaga

SEQ ID NO: 1566814 - RNA, 19 nt, Homo sapiens
gcccugcucagaaagaaua

SEQ ID NO: 1566815 - RNA, 19 nt, Homo sapiens
gcaggagaaucgcuugaac

SEQ ID NO: 1566816 - RNA, 19 nt, Homo sapiens
ccaagaaguugcaguucgu

SEQ ID NO: 1566817 - RNA, 19 nt, Homo sapiens
ucccuaacaugguagauga

SEQ ID NO: 1566818 - RNA, 19 nt, Homo sapiens
ggugaaacccugucuguac

SEQ ID NO: 1566819 - RNA, 19 nt, Homo sapiens
gcaccagucucugcaguac

SEQ ID NO: 1566820 - RNA, 19 nt, Homo sapiens
gagauaacugccacccuuu

SEQ ID NO: 1566821 - RNA, 19 nt, Homo sapiens
caucaauuguucucuacug

SEQ ID NO: 1566822 - RNA, 19 nt, Homo sapiens
acgguacccucaucaauug

SEQ ID NO: 1566823 - RNA, 19 nt, Homo sapiens
gccaggcucacuuaucuaa

SEQ ID NO: 1566824 - RNA, 19 nt, Homo sapiens
caacgguacccucaucaau

SEQ ID NO: 1566825 - RNA, 19 nt, Homo sapiens
gcaaugucgguguugauga

SEQ ID NO: 1566826 - RNA, 19 nt, Homo sapiens
guuagcuacugguggaauu

SEQ ID NO: 1566827 - RNA, 19 nt, Homo sapiens
uggaaaaucuuaagcauuc

SEQ ID NO: 1566828 - RNA, 19 nt, Homo sapiens
ccaccacgcccagcuaauu

SEQ ID NO: 1566829 - RNA, 19 nt, Homo sapiens
aauaagaggaucagugaga

SEQ ID NO: 1566830 - RNA, 19 nt, Homo sapiens
caguauguuugugaaagua

SEQ ID NO: 1566831 - RNA, 19 nt, Homo sapiens
agagugaaacgcuaucaaa

SEQ ID NO: 1566832 - RNA, 19 nt, Homo sapiens
gcuugaaccuggaauacag

SEQ ID NO: 1566833 - RNA, 19 nt, Homo sapiens
caacuuugccgaauaccau

SEQ ID NO: 1566834 - RNA, 19 nt, Homo sapiens
uuucaaagccacuguguug

SEQ ID NO: 1566835 - RNA, 19 nt, Homo sapiens
ucgccaacuuugccgaaua

SEQ ID NO: 1566836 - RNA, 19 nt, Homo sapiens
cuacauggcuuccacuaua

SEQ ID NO: 1566837 - RNA, 19 nt, Homo sapiens
gcaaagagaaaguugauuu

SEQ ID NO: 1566838 - RNA, 19 nt, Homo sapiens
gagaugaucccaaguguuu

SEQ ID NO: 1566839 - RNA, 19 nt, Homo sapiens
gaagaagggcucauugaaa

SEQ ID NO: 1566840 - RNA, 19 nt, Homo sapiens
ugaagaggaugaucaguaa

SEQ ID NO: 1566841 - RNA, 19 nt, Homo sapiens
gacaauggcuggcugaaug

SEQ ID NO: 1566842 - RNA, 19 nt, Homo sapiens
gggauguucuccguuauua

SEQ ID NO: 1566843 - RNA, 19 nt, Homo sapiens
gaaaacaccuaccagcuuu

SEQ ID NO: 1566844 - RNA, 19 nt, Homo sapiens
gaucccaaguguuuagaaa

SEQ ID NO: 1566845 - RNA, 19 nt, Homo sapiens
aagagaagcugaacaaugg

SEQ ID NO: 1566846 - RNA, 19 nt, Homo sapiens
uggauuggcuucguuauuu

SEQ ID NO: 1566847 - RNA, 19 nt, Homo sapiens
ccuaccagcuuuccuguaa

SEQ ID NO: 1566848 - RNA, 19 nt, Homo sapiens
gcgaucauguuuacaaugu

SEQ ID NO: 1566849 - RNA, 19 nt, Homo sapiens
ggagagacuuugccgagau

SEQ ID NO: 1566850 - RNA, 19 nt, Homo sapiens
aaacucagcuaugcauuug

SEQ ID NO: 1566851 - RNA, 19 nt, Homo sapiens
ggcauuaacuauucacuag

SEQ ID NO: 1566852 - RNA, 19 nt, Homo sapiens
gacaauaucugugcagucu

SEQ ID NO: 1566853 - RNA, 19 nt, Homo sapiens
gaucauguuuacaaugugu

SEQ ID NO: 1566854 - RNA, 19 nt, Homo sapiens
gaagcugaacaauggaaua

SEQ ID NO: 1566855 - RNA, 19 nt, Homo sapiens
gcagcucucucauacaaag

SEQ ID NO: 1566856 - RNA, 19 nt, Homo sapiens
caauaucugugcagucugu

SEQ ID NO: 1566857 - RNA, 19 nt, Homo sapiens
caaacucagcuaugcauuu

SEQ ID NO: 1566858 - RNA, 19 nt, Homo sapiens
agagaaaguugauuugaag

SEQ ID NO: 1566859 - RNA, 19 nt, Homo sapiens
gaagaucauuguggagcuu

SEQ ID NO: 1566860 - RNA, 19 nt, Homo sapiens
guucaaggcauuaacuauu

SEQ ID NO: 1566861 - RNA, 19 nt, Homo sapiens
gagcuuaucggacaauauc

SEQ ID NO: 1566862 - RNA, 19 nt, Homo sapiens
ggaauaguucaaggcauua

SEQ ID NO: 1566863 - RNA, 19 nt, Homo sapiens
aggaauaguucaaggcauu

SEQ ID NO: 1566864 - RNA, 19 nt, Homo sapiens
cauuugguguuguggguua

SEQ ID NO: 1566865 - RNA, 19 nt, Homo sapiens
gcugaacaauggaauaaac

SEQ ID NO: 1566866 - RNA, 19 nt, Homo sapiens
aaagagaagcugaacaaug

SEQ ID NO: 1566867 - RNA, 19 nt, Homo sapiens
cagcuuuccuguaaucaug

SEQ ID NO: 1566868 - RNA, 19 nt, Homo sapiens
gcuagagauuccauggauu

SEQ ID NO: 1566869 - RNA, 19 nt, Homo sapiens
uuaaagagaagcugaacaa

SEQ ID NO: 1566870 - RNA, 19 nt, Homo sapiens
cuagagauuccauggauuu

SEQ ID NO: 1566871 - RNA, 19 nt, Homo sapiens
ggaaggacaccacgauugg

SEQ ID NO: 1566872 - RNA, 19 nt, Homo sapiens
cacuagggcuggaauagga

SEQ ID NO: 1566873 - RNA, 19 nt, Homo sapiens
aagaagggcucauugaaaa

SEQ ID NO: 1566874 - RNA, 19 nt, Homo sapiens
ugaagaagggcucauugaa

SEQ ID NO: 1566875 - RNA, 19 nt, Homo sapiens
gucuacaaaugguuucuuu

SEQ ID NO: 1566876 - RNA, 19 nt, Homo sapiens
caagcaauuuguccaugug

SEQ ID NO: 1566877 - RNA, 19 nt, Homo sapiens
ucaagcaauuuguccaugu

SEQ ID NO: 1566878 - RNA, 19 nt, Homo sapiens
aaacuuuguugucaagcaa

SEQ ID NO: 1566879 - RNA, 19 nt, Homo sapiens
gagagacuuugccgagauc

SEQ ID NO: 1566880 - RNA, 19 nt, Homo sapiens
uacaauguguggauucaau

SEQ ID NO: 1566881 - RNA, 19 nt, Homo sapiens
cacgauuggucuacaaaug

SEQ ID NO: 1566882 - RNA, 19 nt, Homo sapiens
ccuacaaucuggugaccuu

SEQ ID NO: 1566883 - RNA, 19 nt, Homo sapiens
gcacacauuuucuguaugg

SEQ ID NO: 1566884 - RNA, 19 nt, Homo sapiens
ccugggagcgcacacauuu

SEQ ID NO: 1566885 - RNA, 19 nt, Homo sapiens
uuacuuggcgaucauguuu

SEQ ID NO: 1566886 - RNA, 19 nt, Homo sapiens
ucuccguuauuaccaguua

SEQ ID NO: 1566887 - RNA, 19 nt, Homo sapiens
caggagaggauguacaaga

SEQ ID NO: 1566888 - RNA, 19 nt, Homo sapiens
cauacugcaugguugaaau

SEQ ID NO: 1566889 - RNA, 19 nt, Homo sapiens
gaauaguucaaggcauuaa

SEQ ID NO: 1566890 - RNA, 19 nt, Homo sapiens
gauguggguuguccccuua

SEQ ID NO: 1566891 - RNA, 19 nt, Homo sapiens
ucaaggcauuaacuauuca

SEQ ID NO: 1566892 - RNA, 19 nt, Homo sapiens
gcgcacacauuuucuguau

SEQ ID NO: 1566893 - RNA, 19 nt, Homo sapiens
uaaacuuuguugucaagca

SEQ ID NO: 1566894 - RNA, 19 nt, Homo sapiens
uagagaugaucccaagugu

SEQ ID NO: 1566895 - RNA, 19 nt, Homo sapiens
uugaagaggaugaucagua

SEQ ID NO: 1566896 - RNA, 19 nt, Homo sapiens
uuguggagcuugaugaaga

SEQ ID NO: 1566897 - RNA, 19 nt, Homo sapiens
guagggcucaggacgcuuu

SEQ ID NO: 1566898 - RNA, 19 nt, Homo sapiens
gaucuacaaacucagcuau

SEQ ID NO: 1566899 - RNA, 19 nt, Homo sapiens
gagaagcugaacaauggaa

SEQ ID NO: 1566900 - RNA, 19 nt, Homo sapiens
gcacguggaaaugaucuug

SEQ ID NO: 1566901 - RNA, 19 nt, Homo sapiens
cuauaggguucuacagugu

SEQ ID NO: 1566902 - RNA, 19 nt, Homo sapiens
guucuacggccucuacuau

SEQ ID NO: 1566903 - RNA, 19 nt, Homo sapiens
ggagaggauguacaagaug

SEQ ID NO: 1566904 - RNA, 19 nt, Homo sapiens
gguggcgguuucugucuau

SEQ ID NO: 1566905 - RNA, 19 nt, Homo sapiens
ccaguuacauccucuucag

SEQ ID NO: 1566906 - RNA, 19 nt, Homo sapiens
gaugaucccaaguguuuag

SEQ ID NO: 1566907 - RNA, 19 nt, Homo sapiens
ggucauugcccagauagug

SEQ ID NO: 1566908 - RNA, 19 nt, Homo sapiens
uucaaggcauuaacuauuc

SEQ ID NO: 1566909 - RNA, 19 nt, Homo sapiens
ggugauaggaauaguucaa

SEQ ID NO: 1566910 - RNA, 19 nt, Homo sapiens
gagaaaguugauuugaaga

SEQ ID NO: 1566911 - RNA, 19 nt, Homo sapiens
aggagaggauguacaagau

SEQ ID NO: 1566912 - RNA, 19 nt, Homo sapiens
guggaaagaauuuaaagag

SEQ ID NO: 1566913 - RNA, 19 nt, Homo sapiens
cuucagagcuacccgaaaa

SEQ ID NO: 1566914 - RNA, 19 nt, Homo sapiens
aagcugaacaauggaauaa

SEQ ID NO: 1566915 - RNA, 19 nt, Homo sapiens
ccauguggaaagaauuuaa

SEQ ID NO: 1566916 - RNA, 19 nt, Homo sapiens
cugcaugguugaaauccuu

SEQ ID NO: 1566917 - RNA, 19 nt, Homo sapiens
gaauucugcauccgagguu

SEQ ID NO: 1566918 - RNA, 19 nt, Homo sapiens
caaggagcuuaucggacaa

SEQ ID NO: 1566919 - RNA, 19 nt, Homo sapiens
gcauugugucuuuguucua

SEQ ID NO: 1566920 - RNA, 19 nt, Homo sapiens
cuggcaaccuguggugaua

SEQ ID NO: 1566921 - RNA, 19 nt, Homo sapiens
gauuugaagaggaugauca

SEQ ID NO: 1566922 - RNA, 19 nt, Homo sapiens
uaccagcuuuccuguaauc

SEQ ID NO: 1566923 - RNA, 19 nt, Homo sapiens
caaccuguggugauaggaa

SEQ ID NO: 1566924 - RNA, 19 nt, Homo sapiens
gaagaggaugaucaguaau

SEQ ID NO: 1566925 - RNA, 19 nt, Homo sapiens
ccucugcguucuggucauu

SEQ ID NO: 1566926 - RNA, 19 nt, Homo sapiens
aaagcagacuugcccuuac

SEQ ID NO: 1566927 - RNA, 19 nt, Homo sapiens
ccuguaaucaugucuuuca

SEQ ID NO: 1566928 - RNA, 19 nt, Homo sapiens
ccaugcacguggaaaugau

SEQ ID NO: 1566929 - RNA, 19 nt, Homo sapiens
cauggccgauccuacaauc

SEQ ID NO: 1566930 - RNA, 19 nt, Homo sapiens
ggcauugugucuuuguucu

SEQ ID NO: 1566931 - RNA, 19 nt, Homo sapiens
uacauggcuuccacuauag

SEQ ID NO: 1566932 - RNA, 19 nt, Homo sapiens
ucuacggccucuacuaugg

SEQ ID NO: 1566933 - RNA, 19 nt, Homo sapiens
ggagcuuaucggacaauau

SEQ ID NO: 1566934 - RNA, 19 nt, Homo sapiens
gucagccgguugccuacaa

SEQ ID NO: 1566935 - RNA, 19 nt, Homo sapiens
ccccuuauauuucacgaua

SEQ ID NO: 1566936 - RNA, 19 nt, Homo sapiens
gcaaauuccuguuccguaa

SEQ ID NO: 1566937 - RNA, 19 nt, Homo sapiens
ucaaacuccugauuucuua

SEQ ID NO: 1566938 - RNA, 19 nt, Homo sapiens
caaguuagaauucgcaaua

SEQ ID NO: 1566939 - RNA, 19 nt, Homo sapiens
cuaagcaagucccgauuua

SEQ ID NO: 1566940 - RNA, 19 nt, Homo sapiens
ccuaggaagucacuguuua

SEQ ID NO: 1566941 - RNA, 19 nt, Homo sapiens
gcagcgagguuaucagugu

SEQ ID NO: 1566942 - RNA, 19 nt, Homo sapiens
ccauggcuguuucuucuua

SEQ ID NO: 1566943 - RNA, 19 nt, Homo sapiens
cguagcaaguugagaguua

SEQ ID NO: 1566944 - RNA, 19 nt, Homo sapiens
guacgucggcuacagauaa

SEQ ID NO: 1566945 - RNA, 19 nt, Homo sapiens
gcugacaaauauaauggua

SEQ ID NO: 1566946 - RNA, 19 nt, Homo sapiens
aaccaugccuacauaauuu

SEQ ID NO: 1566947 - RNA, 19 nt, Homo sapiens
guuuagugcugacaaauau

SEQ ID NO: 1566948 - RNA, 19 nt, Homo sapiens
ccaagucagaguuuaguua

SEQ ID NO: 1566949 - RNA, 19 nt, Homo sapiens
uaaccaugccuacauaauu

SEQ ID NO: 1566950 - RNA, 19 nt, Homo sapiens
guauuaaucuagguacuga

SEQ ID NO: 1566951 - RNA, 19 nt, Homo sapiens
ccaaauaacuagccaaaau

SEQ ID NO: 1566952 - RNA, 19 nt, Homo sapiens
gcaauuucuuucuguuugu

SEQ ID NO: 1566953 - RNA, 19 nt, Homo sapiens
aaauuccuguuccguaaua

SEQ ID NO: 1566954 - RNA, 19 nt, Homo sapiens
uaacaauucuggcuuuaac

SEQ ID NO: 1566955 - RNA, 19 nt, Homo sapiens
uaaucuagguacugaagaa

SEQ ID NO: 1566956 - RNA, 19 nt, Homo sapiens
uaggaugcuuuguauguuu

SEQ ID NO: 1566957 - RNA, 19 nt, Homo sapiens
gguaggaucucaccauucg

SEQ ID NO: 1566958 - RNA, 19 nt, Homo sapiens
guaggaugcuuuguauguu

SEQ ID NO: 1566959 - RNA, 19 nt, Homo sapiens
gacaggauuucgccauguu

SEQ ID NO: 1566960 - RNA, 19 nt, Homo sapiens
ggucucaaacuccugauuu

SEQ ID NO: 1566961 - RNA, 19 nt, Homo sapiens
caaaauggauguuguccuu

SEQ ID NO: 1566962 - RNA, 19 nt, Homo sapiens
uagaauaaauguggcguau

SEQ ID NO: 1566963 - RNA, 19 nt, Homo sapiens
ugaagacauuaggaaguua

SEQ ID NO: 1566964 - RNA, 19 nt, Homo sapiens
uagccgaucugagggauuu

SEQ ID NO: 1566965 - RNA, 19 nt, Homo sapiens
guugagaguuauuccaguu

SEQ ID NO: 1566966 - RNA, 19 nt, Homo sapiens
gaagacauuaggaaguuau

SEQ ID NO: 1566967 - RNA, 19 nt, Homo sapiens
guacugaagaaugcaauuu

SEQ ID NO: 1566968 - RNA, 19 nt, Homo sapiens
gguuuagugcugacaaaua

SEQ ID NO: 1566969 - RNA, 19 nt, Homo sapiens
ggucgcagaaccucucuuu

SEQ ID NO: 1566970 - RNA, 19 nt, Homo sapiens
ugagaguuauuccaguuug

SEQ ID NO: 1566971 - RNA, 19 nt, Homo sapiens
caagucagaguuuaguuau

SEQ ID NO: 1566972 - RNA, 19 nt, Homo sapiens
uguaacaauucuggcuuua

SEQ ID NO: 1566973 - RNA, 19 nt, Homo sapiens
ugccugggcuggucucaaa

SEQ ID NO: 1566974 - RNA, 19 nt, Homo sapiens
gcacuuguugcaccgaauu

SEQ ID NO: 1566975 - RNA, 19 nt, Homo sapiens
ugucgcaaauaccgguuua

SEQ ID NO: 1566976 - RNA, 19 nt, Homo sapiens
gcccgucguuggcuucuug

SEQ ID NO: 1566977 - RNA, 19 nt, Homo sapiens
cuuuaaccaugccuacaua

SEQ ID NO: 1566978 - RNA, 19 nt, Homo sapiens
guaacaauucuggcuuuaa

SEQ ID NO: 1566979 - RNA, 19 nt, Homo sapiens
guagcaaguugagaguuau

SEQ ID NO: 1566980 - RNA, 19 nt, Homo sapiens
ccuagcaaguuucgauuuc

SEQ ID NO: 1566981 - RNA, 19 nt, Homo sapiens
gcaagaggcacggguuuag

SEQ ID NO: 1566982 - RNA, 19 nt, Homo sapiens
uugaagacauuaggaaguu

SEQ ID NO: 1566983 - RNA, 19 nt, Homo sapiens
ugcaauuucuuucuguuug

SEQ ID NO: 1566984 - RNA, 19 nt, Homo sapiens
ccucuuguccaaauaacua

SEQ ID NO: 1566985 - RNA, 19 nt, Homo sapiens
gaucugagggauuuggaau

SEQ ID NO: 1566986 - RNA, 19 nt, Homo sapiens
cgaggaaacuucggauagg

SEQ ID NO: 1566987 - RNA, 19 nt, Homo sapiens
aaccauggcuguuucuucu

SEQ ID NO: 1566988 - RNA, 19 nt, Homo sapiens
guuccucggugccuccauu

SEQ ID NO: 1566989 - RNA, 19 nt, Homo sapiens
uuuguaggaugcuuuguau

SEQ ID NO: 1566990 - RNA, 19 nt, Homo sapiens
gcgcaagaggcacggguuu

SEQ ID NO: 1566991 - RNA, 19 nt, Homo sapiens
ccuaagcaagucccgauuu

SEQ ID NO: 1566992 - RNA, 19 nt, Homo sapiens
uguaggaugcuuuguaugu

SEQ ID NO: 1566993 - RNA, 19 nt, Homo sapiens
guuuguaggaugcuuugua

SEQ ID NO: 1566994 - RNA, 19 nt, Homo sapiens
uuagcagugucuggaauuu

SEQ ID NO: 1566995 - RNA, 19 nt, Homo sapiens
cauggcuguuucuucuuaa

SEQ ID NO: 1566996 - RNA, 19 nt, Homo sapiens
ccaugcgugcgguuuauaa

SEQ ID NO: 1566997 - RNA, 19 nt, Homo sapiens
guccaaauaacuagccaaa

SEQ ID NO: 1566998 - RNA, 19 nt, Homo sapiens
uggcguauuucuucuacug

SEQ ID NO: 1566999 - RNA, 19 nt, Homo sapiens
uaaccauggcuguuucuuc

SEQ ID NO: 1567000 - RNA, 19 nt, Homo sapiens
ccggcuggcgucacucuua

SEQ ID NO: 1567001 - RNA, 19 nt, Homo sapiens
guuuaaccauggcuguuuc

SEQ ID NO: 1567002 - RNA, 19 nt, Homo sapiens
ggucgcggcacaucuuguu

SEQ ID NO: 1567003 - RNA, 19 nt, Homo sapiens
gucucaaacuccugauuuc

SEQ ID NO: 1567004 - RNA, 19 nt, Homo sapiens
gagaguuauuccaguuugc

SEQ ID NO: 1567005 - RNA, 19 nt, Homo sapiens
accgugcgauggugacuuu

SEQ ID NO: 1567006 - RNA, 19 nt, Homo sapiens
cggguuuagugcugacaaa

SEQ ID NO: 1567007 - RNA, 19 nt, Homo sapiens
agacaggauuucgccaugu

SEQ ID NO: 1567008 - RNA, 19 nt, Homo sapiens
cuaccucuuguccaaauaa

SEQ ID NO: 1567009 - RNA, 19 nt, Homo sapiens
gguccuagcaaguuucgau

SEQ ID NO: 1567010 - RNA, 19 nt, Homo sapiens
ggucccagcaccgccauuu

SEQ ID NO: 1567011 - RNA, 19 nt, Homo sapiens
uagccaugcgugcgguuua

SEQ ID NO: 1567012 - RNA, 19 nt, Homo sapiens
cgacccuguuugcaauuuc

SEQ ID NO: 1567013 - RNA, 19 nt, Homo sapiens
cgcaagaggcacggguuua

SEQ ID NO: 1567014 - RNA, 19 nt, Homo sapiens
guuagaauucgcaauaguc

SEQ ID NO: 1567015 - RNA, 19 nt, Homo sapiens
ucuagguacugaagaaugc

SEQ ID NO: 1567016 - RNA, 19 nt, Homo sapiens
caaauuccuguuccguaau

SEQ ID NO: 1567017 - RNA, 19 nt, Homo sapiens
gacccuguuugcaauuucu

SEQ ID NO: 1567018 - RNA, 19 nt, Homo sapiens
cgucggcuacagauaauug

SEQ ID NO: 1567019 - RNA, 19 nt, Homo sapiens
caaauaacuagccaaaaug

SEQ ID NO: 1567020 - RNA, 19 nt, Homo sapiens
guuugcaauuucuuucugu

SEQ ID NO: 1567021 - RNA, 19 nt, Homo sapiens
uuucacucauguagaaguu

SEQ ID NO: 1567022 - RNA, 19 nt, Homo sapiens
uggcuaugcuggcgauuuu

SEQ ID NO: 1567023 - RNA, 19 nt, Homo sapiens
guuauuccaguuugcgauu

SEQ ID NO: 1567024 - RNA, 19 nt, Homo sapiens
gucagaguuuaguuauuuc

SEQ ID NO: 1567025 - RNA, 19 nt, Homo sapiens
gcgagguuaucaguguguu

SEQ ID NO: 1567026 - RNA, 19 nt, Homo sapiens
cggcuacagauaauuguug

SEQ ID NO: 1567027 - RNA, 19 nt, Homo sapiens
gcuuuaaccaugccuacau

SEQ ID NO: 1567028 - RNA, 19 nt, Homo sapiens
gaccaagucagaguuuagu

SEQ ID NO: 1567029 - RNA, 19 nt, Homo sapiens
gauuuagggcaucggucua

SEQ ID NO: 1567030 - RNA, 19 nt, Homo sapiens
gcagccaguugcgcagagu

SEQ ID NO: 1567031 - RNA, 19 nt, Homo sapiens
ggaauguccugaaauguug

SEQ ID NO: 1567032 - RNA, 19 nt, Homo sapiens
ccagaaagcccaagaagaa

SEQ ID NO: 1567033 - RNA, 19 nt, Homo sapiens
ggacaaagacacagagaga

SEQ ID NO: 1567034 - RNA, 19 nt, Homo sapiens
ccacagaaguucacaugau

SEQ ID NO: 1567035 - RNA, 19 nt, Homo sapiens
uucaggagcuguccaguua

SEQ ID NO: 1567036 - RNA, 19 nt, Homo sapiens
gguggaauguccugaaaug

SEQ ID NO: 1567037 - RNA, 19 nt, Homo sapiens
agagagacauugagaugaa

SEQ ID NO: 1567038 - RNA, 19 nt, Homo sapiens
gaugugcgaagauguauuu

SEQ ID NO: 1567039 - RNA, 19 nt, Homo sapiens
uacgggagcuccaccuaua

SEQ ID NO: 1567040 - RNA, 19 nt, Homo sapiens
guuggaggcuucuguaugu

SEQ ID NO: 1567041 - RNA, 19 nt, Homo sapiens
gaagacauccuugggaguu

SEQ ID NO: 1567042 - RNA, 19 nt, Homo sapiens
gaagacauccuugggaguu

SEQ ID NO: 1567043 - RNA, 19 nt, Homo sapiens
gguuugaggacaugauuua

SEQ ID NO: 1567044 - RNA, 19 nt, Homo sapiens
aagaagcacugaaaugugu

SEQ ID NO: 1567045 - RNA, 19 nt, Homo sapiens
acacuaggguugacaugaa

SEQ ID NO: 1567046 - RNA, 19 nt, Homo sapiens
cagaggaggugaagacauc

SEQ ID NO: 1567047 - RNA, 19 nt, Homo sapiens
gcagaagaagcaacagaaa

SEQ ID NO: 1567048 - RNA, 19 nt, Homo sapiens
gaucagggauguacuucag

SEQ ID NO: 1567049 - RNA, 19 nt, Homo sapiens
gcgaagauguauuuuguuu

SEQ ID NO: 1567050 - RNA, 19 nt, Homo sapiens
gauccaagaagcacugaaa

SEQ ID NO: 1567051 - RNA, 19 nt, Homo sapiens
gagaacaugcuccaggaaa

SEQ ID NO: 1567052 - RNA, 19 nt, Homo sapiens
gagagacauugagaugaaa

SEQ ID NO: 1567053 - RNA, 19 nt, Homo sapiens
ccaagaagcacugaaaugu

SEQ ID NO: 1567054 - RNA, 19 nt, Homo sapiens
gcaaagcaauuggaagacu

SEQ ID NO: 1567055 - RNA, 19 nt, Homo sapiens
ggcaaagagugaccuggaa

SEQ ID NO: 1567056 - RNA, 19 nt, Homo sapiens
cacagaaguucacaugaug

SEQ ID NO: 1567057 - RNA, 19 nt, Homo sapiens
caacagggagcaucacuag

SEQ ID NO: 1567058 - RNA, 19 nt, Homo sapiens
ugaggaagccacagaaguu

SEQ ID NO: 1567059 - RNA, 19 nt, Homo sapiens
gaacaucucccugaagcau

SEQ ID NO: 1567060 - RNA, 19 nt, Homo sapiens
gguaugcuuuccaucagaa

SEQ ID NO: 1567061 - RNA, 19 nt, Homo sapiens
ggaggcuucuguauguaga

SEQ ID NO: 1567062 - RNA, 19 nt, Homo sapiens
ccaggaagcccagcaagaa

SEQ ID NO: 1567063 - RNA, 19 nt, Homo sapiens
gcacauggaagaaguacca

SEQ ID NO: 1567064 - RNA, 19 nt, Homo sapiens
ggaagacuccaccauuaca

SEQ ID NO: 1567065 - RNA, 19 nt, Homo sapiens
gccaggcucugugaagaaa

SEQ ID NO: 1567066 - RNA, 19 nt, Homo sapiens
guacguugaugugcgaaga

SEQ ID NO: 1567067 - RNA, 19 nt, Homo sapiens
acagggagcaucacuaguu

SEQ ID NO: 1567068 - RNA, 19 nt, Homo sapiens
gaacaugcuccaggaaaca

SEQ ID NO: 1567069 - RNA, 19 nt, Homo sapiens
gaccaaaguggaagaggaa

SEQ ID NO: 1567070 - RNA, 19 nt, Homo sapiens
acacagagagagacauuga

SEQ ID NO: 1567071 - RNA, 19 nt, Homo sapiens
ucagggccaugcucacuug

SEQ ID NO: 1567072 - RNA, 19 nt, Homo sapiens
cagagucuccucacuguug

SEQ ID NO: 1567073 - RNA, 19 nt, Homo sapiens
gagaugaaacggcaacuac

SEQ ID NO: 1567074 - RNA, 19 nt, Homo sapiens
caagaagcacugaaaugug

SEQ ID NO: 1567075 - RNA, 19 nt, Homo sapiens
caagggcuuugcacugugu

SEQ ID NO: 1567076 - RNA, 19 nt, Homo sapiens
gaucaucuagaggaguuua

SEQ ID NO: 1567077 - RNA, 19 nt, Homo sapiens
gagagagacauugagauga

SEQ ID NO: 1567078 - RNA, 19 nt, Homo sapiens
cagcagaugucagcaaguc

SEQ ID NO: 1567079 - RNA, 19 nt, Homo sapiens
caacaaaaccaacccuuga

SEQ ID NO: 1567080 - RNA, 19 nt, Homo sapiens
gcucaccaacaucucauuu

SEQ ID NO: 1567081 - RNA, 19 nt, Homo sapiens
aaccaacggugaccuggaa

SEQ ID NO: 1567082 - RNA, 19 nt, Homo sapiens
caaagagugaccuggaaga

SEQ ID NO: 1567083 - RNA, 19 nt, Homo sapiens
gagguuggaggcuucugua

SEQ ID NO: 1567084 - RNA, 19 nt, Homo sapiens
agagagagacauugagaug

SEQ ID NO: 1567085 - RNA, 19 nt, Homo sapiens
acaaagacacagagagaga

SEQ ID NO: 1567086 - RNA, 19 nt, Homo sapiens
gaggagacacuaggguuga

SEQ ID NO: 1567087 - RNA, 19 nt, Homo sapiens
uccacaggcugcuuaguga

SEQ ID NO: 1567088 - RNA, 19 nt, Homo sapiens
uggaauguccugaaauguu

SEQ ID NO: 1567089 - RNA, 19 nt, Homo sapiens
guugaugugcgaagaugua

SEQ ID NO: 1567090 - RNA, 19 nt, Homo sapiens
cagggagcaucacuaguuc

SEQ ID NO: 1567091 - RNA, 19 nt, Homo sapiens
gaaggaugcccugagaaca

SEQ ID NO: 1567092 - RNA, 19 nt, Homo sapiens
uggcaaagcaauuggaaga

SEQ ID NO: 1567093 - RNA, 19 nt, Homo sapiens
ggguaugcuuuccaucaga

SEQ ID NO: 1567094 - RNA, 19 nt, Homo sapiens
ccgguggaauguccugaaa

SEQ ID NO: 1567095 - RNA, 19 nt, Homo sapiens
agauauagaaguacguuga

SEQ ID NO: 1567096 - RNA, 19 nt, Homo sapiens
caggagcuguccaguuaca

SEQ ID NO: 1567097 - RNA, 19 nt, Homo sapiens
aaacagacacccacuccau

SEQ ID NO: 1567098 - RNA, 19 nt, Homo sapiens
gugcgaagauguauuuugu

SEQ ID NO: 1567099 - RNA, 19 nt, Homo sapiens
cauggaagaaguaccaaga

SEQ ID NO: 1567100 - RNA, 19 nt, Homo sapiens
agacacagagagagacauu

SEQ ID NO: 1567101 - RNA, 19 nt, Homo sapiens
gcaggacuccaagggcuuu

SEQ ID NO: 1567102 - RNA, 19 nt, Homo sapiens
gauauagaaguacguugau

SEQ ID NO: 1567103 - RNA, 19 nt, Homo sapiens
agugaaggaugcccugaga

SEQ ID NO: 1567104 - RNA, 19 nt, Homo sapiens
caggaagcccagcaagaaa

SEQ ID NO: 1567105 - RNA, 19 nt, Homo sapiens
cagaaagcccaagaagaaa

SEQ ID NO: 1567106 - RNA, 19 nt, Homo sapiens
cuauacagcacauggaaga

SEQ ID NO: 1567107 - RNA, 19 nt, Homo sapiens
caaaguggaagaggaagug

SEQ ID NO: 1567108 - RNA, 19 nt, Homo sapiens
gcagaacaucucccugaag

SEQ ID NO: 1567109 - RNA, 19 nt, Homo sapiens
uccaagggcuuugcacugu

SEQ ID NO: 1567110 - RNA, 19 nt, Homo sapiens
gcguucauaugguggacaa

SEQ ID NO: 1567111 - RNA, 19 nt, Homo sapiens
ccacagggguucacaugau

SEQ ID NO: 1567112 - RNA, 19 nt, Homo sapiens
ccacagggguucacaugau

SEQ ID NO: 1567113 - RNA, 19 nt, Homo sapiens
acagagagagacauugaga

SEQ ID NO: 1567114 - RNA, 19 nt, Homo sapiens
aaccaacccuugaagacau

SEQ ID NO: 1567115 - RNA, 19 nt, Homo sapiens
ccacacuggcaaagcaauu

SEQ ID NO: 1567116 - RNA, 19 nt, Homo sapiens
acaacguggugaccuggaa

SEQ ID NO: 1567117 - RNA, 19 nt, Homo sapiens
cagcaggcccucaguaggu

SEQ ID NO: 1567118 - RNA, 19 nt, Homo sapiens
gacacuaggguugacauga

SEQ ID NO: 1567119 - RNA, 19 nt, Homo sapiens
uauagaaguacguugaugu

SEQ ID NO: 1567120 - RNA, 19 nt, Homo sapiens
gaggaagccacagaaguuc

SEQ ID NO: 1567121 - RNA, 19 nt, Homo sapiens
aacagacacccacuccaua

SEQ ID NO: 1567122 - RNA, 19 nt, Homo sapiens
caacagaaaagaccaaagu

SEQ ID NO: 1567123 - RNA, 19 nt, Homo sapiens
gcagacgcaggcacccaaa

SEQ ID NO: 1567124 - RNA, 19 nt, Homo sapiens
gguuggaggcuucuguaug

SEQ ID NO: 1567125 - RNA, 19 nt, Homo sapiens
cacuaggguugacaugaau

SEQ ID NO: 1567126 - RNA, 19 nt, Homo sapiens
gcccuccacaggcugcuua

SEQ ID NO: 1567127 - RNA, 19 nt, Homo sapiens
gggaggguuugaggacaug

SEQ ID NO: 1567128 - RNA, 19 nt, Homo sapiens
aaaccaacccuugaagaca

SEQ ID NO: 1567129 - RNA, 19 nt, Homo sapiens
uguguugucugcaguaacu

SEQ ID NO: 1567130 - RNA, 19 nt, Homo sapiens
agaacaugcuccaggaaac

SEQ ID NO: 1567131 - RNA, 19 nt, Homo sapiens
gcaaggagcuuucugaaga

SEQ ID NO: 1567132 - RNA, 19 nt, Homo sapiens
gaaaauagcuggaaucaug

SEQ ID NO: 1567133 - RNA, 19 nt, Homo sapiens
ggacugaauuucuggaguu

SEQ ID NO: 1567134 - RNA, 19 nt, Homo sapiens
gcaagcugcugcucucgua

SEQ ID NO: 1567135 - RNA, 19 nt, Homo sapiens
gauagugucuggcucauuc

SEQ ID NO: 1567136 - RNA, 19 nt, Homo sapiens
gagauugugugccuucauu

SEQ ID NO: 1567137 - RNA, 19 nt, Homo sapiens
ucaauuugcugucuaguug

SEQ ID NO: 1567138 - RNA, 19 nt, Homo sapiens
ggaggugguuuccuaauuc

SEQ ID NO: 1567139 - RNA, 19 nt, Homo sapiens
gagaggauuucccuuaugu

SEQ ID NO: 1567140 - RNA, 19 nt, Homo sapiens
ggauuucccuuaugugaau

SEQ ID NO: 1567141 - RNA, 19 nt, Homo sapiens
aaagggaggugguuuccua

SEQ ID NO: 1567142 - RNA, 19 nt, Homo sapiens
ucucuuaccuguacaguga

SEQ ID NO: 1567143 - RNA, 19 nt, Homo sapiens
gaauguggauccagcuuuc

SEQ ID NO: 1567144 - RNA, 19 nt, Homo sapiens
gggaggugguuuccuaauu

SEQ ID NO: 1567145 - RNA, 19 nt, Homo sapiens
ggagaggauuucccuuaug

SEQ ID NO: 1567146 - RNA, 19 nt, Homo sapiens
ucucuugacuacagaauaa

SEQ ID NO: 1567147 - RNA, 19 nt, Homo sapiens
gagcugugcaccucaauuu

SEQ ID NO: 1567148 - RNA, 19 nt, Homo sapiens
guacaucacucagccuuuc

SEQ ID NO: 1567149 - RNA, 19 nt, Homo sapiens
gcaaagaggagccuguugu

SEQ ID NO: 1567150 - RNA, 19 nt, Homo sapiens
gaaugacaaugagauaaca

SEQ ID NO: 1567151 - RNA, 19 nt, Homo sapiens
guucuaggcucuguuucua

SEQ ID NO: 1567152 - RNA, 19 nt, Homo sapiens
gauauucacccaccaaaca

SEQ ID NO: 1567153 - RNA, 19 nt, Homo sapiens
ugucgucgauaucauagua

SEQ ID NO: 1567154 - RNA, 19 nt, Homo sapiens
gaggauuucccuuauguga

SEQ ID NO: 1567155 - RNA, 19 nt, Homo sapiens
gcucuguacugacacuuau

SEQ ID NO: 1567156 - RNA, 19 nt, Homo sapiens
caacaaccacaaauggauu

SEQ ID NO: 1567157 - RNA, 19 nt, Homo sapiens
caucagugcacauuccaua

SEQ ID NO: 1567158 - RNA, 19 nt, Homo sapiens
gacuacagaauaacugaua

SEQ ID NO: 1567159 - RNA, 19 nt, Homo sapiens
ggaauguggauccagcuuu

SEQ ID NO: 1567160 - RNA, 19 nt, Homo sapiens
guacugcugcugcuucauu

SEQ ID NO: 1567161 - RNA, 19 nt, Homo sapiens
cauaguacuuuacauggau

SEQ ID NO: 1567162 - RNA, 19 nt, Homo sapiens
gaaccuggccauccuagca

SEQ ID NO: 1567163 - RNA, 19 nt, Homo sapiens
caguguaggugucagaaau

SEQ ID NO: 1567164 - RNA, 19 nt, Homo sapiens
guacugacacuuauuaucg

SEQ ID NO: 1567165 - RNA, 19 nt, Homo sapiens
ccucagaacugcauuuuau

SEQ ID NO: 1567166 - RNA, 19 nt, Homo sapiens
acaaugagauaacauacag

SEQ ID NO: 1567167 - RNA, 19 nt, Homo sapiens
uugaaggacuggcucugua

SEQ ID NO: 1567168 - RNA, 19 nt, Homo sapiens
gaucagcccaauugaagga

SEQ ID NO: 1567169 - RNA, 19 nt, Homo sapiens
guugaaagggugcaaauuc

SEQ ID NO: 1567170 - RNA, 19 nt, Homo sapiens
ccagcuuucccuucucuua

SEQ ID NO: 1567171 - RNA, 19 nt, Homo sapiens
gcgaucagcccaauugaag

SEQ ID NO: 1567172 - RNA, 19 nt, Homo sapiens
ucauaguacuuuacaugga

SEQ ID NO: 1567173 - RNA, 19 nt, Homo sapiens
ggauccagcuuucccuucu

SEQ ID NO: 1567174 - RNA, 19 nt, Homo sapiens
cuaaaucaacaaccacaaa

SEQ ID NO: 1567175 - RNA, 19 nt, Homo sapiens
agaggagccuguugucugu

SEQ ID NO: 1567176 - RNA, 19 nt, Homo sapiens
caugaaugacaaugagaua

SEQ ID NO: 1567177 - RNA, 19 nt, Homo sapiens
gcucaauccuccacuacag

SEQ ID NO: 1567178 - RNA, 19 nt, Homo sapiens
aggagccuguugucuguua

SEQ ID NO: 1567179 - RNA, 19 nt, Homo sapiens
caaguuggacugaauuucu

SEQ ID NO: 1567180 - RNA, 19 nt, Homo sapiens
ugucagaaauacuccuaga

SEQ ID NO: 1567181 - RNA, 19 nt, Homo sapiens
acaagcugcuggacaagga

SEQ ID NO: 1567182 - RNA, 19 nt, Homo sapiens
ccauaguucuccagugcuu

SEQ ID NO: 1567183 - RNA, 19 nt, Homo sapiens
caaauuccuucuggguaga

SEQ ID NO: 1567184 - RNA, 19 nt, Homo sapiens
ucuggaaacugcucuugga

SEQ ID NO: 1567185 - RNA, 19 nt, Homo sapiens
cagugcacauuccauaguu

SEQ ID NO: 1567186 - RNA, 19 nt, Homo sapiens
cauggcagcauuucccuuu

SEQ ID NO: 1567187 - RNA, 19 nt, Homo sapiens
ugucaagaccauaguugua

SEQ ID NO: 1567188 - RNA, 19 nt, Homo sapiens
ggucuacaggcuaucgaua

SEQ ID NO: 1567189 - RNA, 19 nt, Homo sapiens
ccacuuggcccaggauguu

SEQ ID NO: 1567190 - RNA, 19 nt, Homo sapiens
cuaauucggagaugccuuu

SEQ ID NO: 1567191 - RNA, 19 nt, Homo sapiens
gcaccucaauuugcugucu

SEQ ID NO: 1567192 - RNA, 19 nt, Homo sapiens
uauuaucgguacaggcaaa

SEQ ID NO: 1567193 - RNA, 19 nt, Homo sapiens
uggaugugcugguguuugu

SEQ ID NO: 1567194 - RNA, 19 nt, Homo sapiens
ggaaggaaggagccugugu

SEQ ID NO: 1567195 - RNA, 19 nt, Homo sapiens
ugacacagcaagccuuugu

SEQ ID NO: 1567196 - RNA, 19 nt, Homo sapiens
ucuguacugacacuuauua

SEQ ID NO: 1567197 - RNA, 19 nt, Homo sapiens
cuggguagauaagaaauga

SEQ ID NO: 1567198 - RNA, 19 nt, Homo sapiens
gaagaccucccugccuuuc

SEQ ID NO: 1567199 - RNA, 19 nt, Homo sapiens
gacuggcucuguacugaca

SEQ ID NO: 1567200 - RNA, 19 nt, Homo sapiens
gggauggccuuggguacau

SEQ ID NO: 1567201 - RNA, 19 nt, Homo sapiens
uguauuaugugauccuaag

SEQ ID NO: 1567202 - RNA, 19 nt, Homo sapiens
gucgauaucauaguacuuu

SEQ ID NO: 1567203 - RNA, 19 nt, Homo sapiens
ugcacaagcugcuggacaa

SEQ ID NO: 1567204 - RNA, 19 nt, Homo sapiens
gacaaugagauaacauaca

SEQ ID NO: 1567205 - RNA, 19 nt, Homo sapiens
ugagcgaggccaugaguau

SEQ ID NO: 1567206 - RNA, 19 nt, Homo sapiens
gcaggacccaccuuugaag

SEQ ID NO: 1567207 - RNA, 19 nt, Homo sapiens
caaggagcuuucugaagac

SEQ ID NO: 1567208 - RNA, 19 nt, Homo sapiens
ggugacacagcaagccuuu

SEQ ID NO: 1567209 - RNA, 19 nt, Homo sapiens
ggccaagaaccaugcagaa

SEQ ID NO: 1567210 - RNA, 19 nt, Homo sapiens
gcugucuaguugagaauag

SEQ ID NO: 1567211 - RNA, 19 nt, Homo sapiens
caaagaggagccuguuguc

SEQ ID NO: 1567212 - RNA, 19 nt, Homo sapiens
gaccugagcgaggccauga

SEQ ID NO: 1567213 - RNA, 19 nt, Homo sapiens
guagauaagaaaugacucu

SEQ ID NO: 1567214 - RNA, 19 nt, Homo sapiens
gucuacaggcuaucgauaa

SEQ ID NO: 1567215 - RNA, 19 nt, Homo sapiens
ucaacaaccacaaauggau

SEQ ID NO: 1567216 - RNA, 19 nt, Homo sapiens
cugcaggacccaccuuuga

SEQ ID NO: 1567217 - RNA, 19 nt, Homo sapiens
gccagccucucuugacuac

SEQ ID NO: 1567218 - RNA, 19 nt, Homo sapiens
caccucaauuugcugucua

SEQ ID NO: 1567219 - RNA, 19 nt, Homo sapiens
ggagcugugcaccucaauu

SEQ ID NO: 1567220 - RNA, 19 nt, Homo sapiens
gguguugaccucagaacug

SEQ ID NO: 1567221 - RNA, 19 nt, Homo sapiens
gugccagugcccauguuua

SEQ ID NO: 1567222 - RNA, 19 nt, Homo sapiens
cagccucucuugacuacag

SEQ ID NO: 1567223 - RNA, 19 nt, Homo sapiens
ugugugccuucauuucauu

SEQ ID NO: 1567224 - RNA, 19 nt, Homo sapiens
gauugugugccuucauuuc

SEQ ID NO: 1567225 - RNA, 19 nt, Homo sapiens
aggacuggcucuguacuga

SEQ ID NO: 1567226 - RNA, 19 nt, Homo sapiens
ggcccaggauguugaaagg

SEQ ID NO: 1567227 - RNA, 19 nt, Homo sapiens
uagcaaggagcuuucugaa

SEQ ID NO: 1567228 - RNA, 19 nt, Homo sapiens
cuagcaaggagcuuucuga

SEQ ID NO: 1567229 - RNA, 19 nt, Homo sapiens
aaucaacaaccacaaaugg

SEQ ID NO: 1567230 - RNA, 19 nt, Homo sapiens
gagcgaggccaugaguaug

SEQ ID NO: 1567231 - RNA, 19 nt, Homo sapiens
gagcaacuaugaaauacua

SEQ ID NO: 1567232 - RNA, 19 nt, Homo sapiens
gcucauggauaucaaagua

SEQ ID NO: 1567233 - RNA, 19 nt, Homo sapiens
gaagauaauuccucuaugg

SEQ ID NO: 1567234 - RNA, 19 nt, Homo sapiens
gagauacaguccgaaauua

SEQ ID NO: 1567235 - RNA, 19 nt, Homo sapiens
gagcagaucuucagugaca

SEQ ID NO: 1567236 - RNA, 19 nt, Homo sapiens
ugaccuacauuguuuguua

SEQ ID NO: 1567237 - RNA, 19 nt, Homo sapiens
ggaaagaaguuauugugau

SEQ ID NO: 1567238 - RNA, 19 nt, Homo sapiens
uguaauagcucauggauau

SEQ ID NO: 1567239 - RNA, 19 nt, Homo sapiens
agaauaaacuguuggcuaa

SEQ ID NO: 1567240 - RNA, 19 nt, Homo sapiens
ggacgucucuucauucugu

SEQ ID NO: 1567241 - RNA, 19 nt, Homo sapiens
uaaagaaacuuaccuggau

SEQ ID NO: 1567242 - RNA, 19 nt, Homo sapiens
ggauugggaugaugaauau

SEQ ID NO: 1567243 - RNA, 19 nt, Homo sapiens
aaacuuaccuggauacugu

SEQ ID NO: 1567244 - RNA, 19 nt, Homo sapiens
uuccaaagcuaaagcauua

SEQ ID NO: 1567245 - RNA, 19 nt, Homo sapiens
gguuaaaucucacugcaaa

SEQ ID NO: 1567246 - RNA, 19 nt, Homo sapiens
cuuagugucuucugaaaua

SEQ ID NO: 1567247 - RNA, 19 nt, Homo sapiens
ugacaacucuucaggaaau

SEQ ID NO: 1567248 - RNA, 19 nt, Homo sapiens
guggaagacugguacauuu

SEQ ID NO: 1567249 - RNA, 19 nt, Homo sapiens
gagcugcaguucagagaaa

SEQ ID NO: 1567250 - RNA, 19 nt, Homo sapiens
aagcacauauacucaguua

SEQ ID NO: 1567251 - RNA, 19 nt, Homo sapiens
aaagaaacuuaccuggaua

SEQ ID NO: 1567252 - RNA, 19 nt, Homo sapiens
caagauuuguugaagaaug

SEQ ID NO: 1567253 - RNA, 19 nt, Homo sapiens
ucaaaacacugcaagauuu

SEQ ID NO: 1567254 - RNA, 19 nt, Homo sapiens
acacauauaagcuccuuua

SEQ ID NO: 1567255 - RNA, 19 nt, Homo sapiens
gaccuacauuguuuguuaa

SEQ ID NO: 1567256 - RNA, 19 nt, Homo sapiens
uugaauggcuaacuaacua

SEQ ID NO: 1567257 - RNA, 19 nt, Homo sapiens
gaacugcuuuccuucuuac

SEQ ID NO: 1567258 - RNA, 19 nt, Homo sapiens
uggcuaaucuucuguggaa

SEQ ID NO: 1567259 - RNA, 19 nt, Homo sapiens
uaugugggaugauauaaga

SEQ ID NO: 1567260 - RNA, 19 nt, Homo sapiens
gacauuggauuuacuuugg

SEQ ID NO: 1567261 - RNA, 19 nt, Homo sapiens
gaucuucagugacauugau

SEQ ID NO: 1567262 - RNA, 19 nt, Homo sapiens
cagaagaaauggcaaaauu

SEQ ID NO: 1567263 - RNA, 19 nt, Homo sapiens
cuucgacgcuucuuaguga

SEQ ID NO: 1567264 - RNA, 19 nt, Homo sapiens
aacaacaacugacugcuuu

SEQ ID NO: 1567265 - RNA, 19 nt, Homo sapiens
uaagcuccuuuaucuguuu

SEQ ID NO: 1567266 - RNA, 19 nt, Homo sapiens
guacaucugaaucaucuuu

SEQ ID NO: 1567267 - RNA, 19 nt, Homo sapiens
gaauggcuaacuaacuaua

SEQ ID NO: 1567268 - RNA, 19 nt, Homo sapiens
caaaguacaaugcuuaagu

SEQ ID NO: 1567269 - RNA, 19 nt, Homo sapiens
gaacaucuuuccauuuccu

SEQ ID NO: 1567270 - RNA, 19 nt, Homo sapiens
ucuaggacgucucuucauu

SEQ ID NO: 1567271 - RNA, 19 nt, Homo sapiens
gcaaauuacaaagccauaa

SEQ ID NO: 1567272 - RNA, 19 nt, Homo sapiens
uauccagaaucagaaguua

SEQ ID NO: 1567273 - RNA, 19 nt, Homo sapiens
uugcugaaguuacuagaaa

SEQ ID NO: 1567274 - RNA, 19 nt, Homo sapiens
ucaagucuaugugggauga

SEQ ID NO: 1567275 - RNA, 19 nt, Homo sapiens
cuauggaugucaagucuau

SEQ ID NO: 1567276 - RNA, 19 nt, Homo sapiens
ugcaagauuuguugaagaa

SEQ ID NO: 1567277 - RNA, 19 nt, Homo sapiens
acaacugacugcuuugaau

SEQ ID NO: 1567278 - RNA, 19 nt, Homo sapiens
gaauggauugggaugauga

SEQ ID NO: 1567279 - RNA, 19 nt, Homo sapiens
aaacguugcugaaguuacu

SEQ ID NO: 1567280 - RNA, 19 nt, Homo sapiens
agagauacaguccgaaauu

SEQ ID NO: 1567281 - RNA, 19 nt, Homo sapiens
ggaagacugguacauuuua

SEQ ID NO: 1567282 - RNA, 19 nt, Homo sapiens
gacaacucuucaggaaaua

SEQ ID NO: 1567283 - RNA, 19 nt, Homo sapiens
caacucuuguuucuuuauc

SEQ ID NO: 1567284 - RNA, 19 nt, Homo sapiens
gcauaugacaaacaguauu

SEQ ID NO: 1567285 - RNA, 19 nt, Homo sapiens
ccacagcagcguuucauuc

SEQ ID NO: 1567286 - RNA, 19 nt, Homo sapiens
gcagaucuucagugacauu

SEQ ID NO: 1567287 - RNA, 19 nt, Homo sapiens
caguacaucugaaucaucu

SEQ ID NO: 1567288 - RNA, 19 nt, Homo sapiens
caacugacugcuuugaaug

SEQ ID NO: 1567289 - RNA, 19 nt, Homo sapiens
guauuguaguugauuagga

SEQ ID NO: 1567290 - RNA, 19 nt, Homo sapiens
ccaaagcuaaagcauuauu

SEQ ID NO: 1567291 - RNA, 19 nt, Homo sapiens
gcaguauacauuucucaug

SEQ ID NO: 1567292 - RNA, 19 nt, Homo sapiens
aaaucucacugcaaacaug

SEQ ID NO: 1567293 - RNA, 19 nt, Homo sapiens
caacaacugacugcuuuga

SEQ ID NO: 1567294 - RNA, 19 nt, Homo sapiens
uugagcagaucuucaguga

SEQ ID NO: 1567295 - RNA, 19 nt, Homo sapiens
uccagaaucagaaguuaua

SEQ ID NO: 1567296 - RNA, 19 nt, Homo sapiens
cuucuuagugagcaaauua

SEQ ID NO: 1567297 - RNA, 19 nt, Homo sapiens
ugaagauaauuccucuaug

SEQ ID NO: 1567298 - RNA, 19 nt, Homo sapiens
aaacaacaacugacugcuu

SEQ ID NO: 1567299 - RNA, 19 nt, Homo sapiens
aaagagauacaguccgaaa

SEQ ID NO: 1567300 - RNA, 19 nt, Homo sapiens
ucagugacauugaugaaaa

SEQ ID NO: 1567301 - RNA, 19 nt, Homo sapiens
uagaauggauugggaugau

SEQ ID NO: 1567302 - RNA, 19 nt, Homo sapiens
gguggaagacugguacauu

SEQ ID NO: 1567303 - RNA, 19 nt, Homo sapiens
guaguugauuaggaaggua

SEQ ID NO: 1567304 - RNA, 19 nt, Homo sapiens
cauuguaucuuccaaagcu

SEQ ID NO: 1567305 - RNA, 19 nt, Homo sapiens
agauacaguccgaaauuaa

SEQ ID NO: 1567306 - RNA, 19 nt, Homo sapiens
ucauggauaucaaaguaca

SEQ ID NO: 1567307 - RNA, 19 nt, Homo sapiens
aauaaacuguuggcuaauc

SEQ ID NO: 1567308 - RNA, 19 nt, Homo sapiens
ugacauuggauuuacuuug

SEQ ID NO: 1567309 - RNA, 19 nt, Homo sapiens
cuggagacuuggaguuuga

SEQ ID NO: 1567310 - RNA, 19 nt, Homo sapiens
uggauugggaugaugaaua

SEQ ID NO: 1567311 - RNA, 19 nt, Homo sapiens
gcuuuggguuagugacauu

SEQ ID NO: 1567312 - RNA, 19 nt, Homo sapiens
gugcuuacaacaacucuug

SEQ ID NO: 1567313 - RNA, 19 nt, Homo sapiens
gugaaacuguguguauaca

SEQ ID NO: 1567314 - RNA, 19 nt, Homo sapiens
guauacauuucucaugcau

SEQ ID NO: 1567315 - RNA, 19 nt, Homo sapiens
gggucaggcucuugcuaga

SEQ ID NO: 1567316 - RNA, 19 nt, Homo sapiens
gucaggcucuugcuagauc

SEQ ID NO: 1567317 - RNA, 19 nt, Homo sapiens
cugcaagauuuguugaaga

SEQ ID NO: 1567318 - RNA, 19 nt, Homo sapiens
gaccaguucauucuuagug

SEQ ID NO: 1567319 - RNA, 19 nt, Homo sapiens
gauugcauaugacaaacag

SEQ ID NO: 1567320 - RNA, 19 nt, Homo sapiens
gcauagaggagcagugcau

SEQ ID NO: 1567321 - RNA, 19 nt, Homo sapiens
gauguaauagcucauggau

SEQ ID NO: 1567322 - RNA, 19 nt, Homo sapiens
ucauucccaucaacccuaa

SEQ ID NO: 1567323 - RNA, 19 nt, Homo sapiens
guccgaaauuaacaaacaa

SEQ ID NO: 1567324 - RNA, 19 nt, Homo sapiens
aguccgaaauuaacaaaca

SEQ ID NO: 1567325 - RNA, 19 nt, Homo sapiens
gcuccuuuaucuguuuauu

SEQ ID NO: 1567326 - RNA, 19 nt, Homo sapiens
gaaacuuaccuggauacug

SEQ ID NO: 1567327 - RNA, 19 nt, Homo sapiens
ccaucaacccuaaguggaa

SEQ ID NO: 1567328 - RNA, 19 nt, Homo sapiens
uuacaguacaucugaauca

SEQ ID NO: 1567329 - RNA, 19 nt, Homo sapiens
gauacaguccgaaauuaac

SEQ ID NO: 1567330 - RNA, 19 nt, Homo sapiens
aagcuccuuuaucuguuua

SEQ ID NO: 1567331 - RNA, 19 nt, Homo sapiens
gaaguuacucgaagaauua

SEQ ID NO: 1567332 - RNA, 19 nt, Homo sapiens
ugucugcacuguuuaauua

SEQ ID NO: 1567333 - RNA, 19 nt, Homo sapiens
ggaagaaugcuuggaguua

SEQ ID NO: 1567334 - RNA, 19 nt, Homo sapiens
gagaccaucuaguacuuua

SEQ ID NO: 1567335 - RNA, 19 nt, Homo sapiens
cgaauuaacuacccacuca

SEQ ID NO: 1567336 - RNA, 19 nt, Homo sapiens
gauuagugcuagcugauuu

SEQ ID NO: 1567337 - RNA, 19 nt, Homo sapiens
uaaggaagguuugagcuaa

SEQ ID NO: 1567338 - RNA, 19 nt, Homo sapiens
cuauaucccuguuuaguuu

SEQ ID NO: 1567339 - RNA, 19 nt, Homo sapiens
guaagugacuauuccaaug

SEQ ID NO: 1567340 - RNA, 19 nt, Homo sapiens
agaauagucuggugaaguu

SEQ ID NO: 1567341 - RNA, 19 nt, Homo sapiens
gaggcugacucacccauuu

SEQ ID NO: 1567342 - RNA, 19 nt, Homo sapiens
gcugugaacuacugauuau

SEQ ID NO: 1567343 - RNA, 19 nt, Homo sapiens
guuaaguccuuguaaguga

SEQ ID NO: 1567344 - RNA, 19 nt, Homo sapiens
ugaaguuacucgaagaauu

SEQ ID NO: 1567345 - RNA, 19 nt, Homo sapiens
gucaaagacuuguuaaugu

SEQ ID NO: 1567346 - RNA, 19 nt, Homo sapiens
gaagaaugcuuggaguuac

SEQ ID NO: 1567347 - RNA, 19 nt, Homo sapiens
cagguacaguaucacauua

SEQ ID NO: 1567348 - RNA, 19 nt, Homo sapiens
uaaccaagccauccgaauu

SEQ ID NO: 1567349 - RNA, 19 nt, Homo sapiens
gaagaauuaaggaagguuu

SEQ ID NO: 1567350 - RNA, 19 nt, Homo sapiens
gcagguuaauguuguggaa

SEQ ID NO: 1567351 - RNA, 19 nt, Homo sapiens
uaagggagacgacucacua

SEQ ID NO: 1567352 - RNA, 19 nt, Homo sapiens
auaaaucccacccuaguua

SEQ ID NO: 1567353 - RNA, 19 nt, Homo sapiens
ucaaagacuuguuaauguc

SEQ ID NO: 1567354 - RNA, 19 nt, Homo sapiens
gcuuggaguuaccauguuu

SEQ ID NO: 1567355 - RNA, 19 nt, Homo sapiens
cagucuauaucccuguuua

SEQ ID NO: 1567356 - RNA, 19 nt, Homo sapiens
cgccucagcucucggagua

SEQ ID NO: 1567357 - RNA, 19 nt, Homo sapiens
uaauacaagucguuaaguc

SEQ ID NO: 1567358 - RNA, 19 nt, Homo sapiens
gauuauauucucccuauuc

SEQ ID NO: 1567359 - RNA, 19 nt, Homo sapiens
gguacaguaucacauuaau

SEQ ID NO: 1567360 - RNA, 19 nt, Homo sapiens
aaccaagccauccgaauua

SEQ ID NO: 1567361 - RNA, 19 nt, Homo sapiens
gcauaaaucccacccuagu

SEQ ID NO: 1567362 - RNA, 19 nt, Homo sapiens
ucauucagguucuauuugu

SEQ ID NO: 1567363 - RNA, 19 nt, Homo sapiens
cagauauuguccacuuuau

SEQ ID NO: 1567364 - RNA, 19 nt, Homo sapiens
guaggagcguuaaguugug

SEQ ID NO: 1567365 - RNA, 19 nt, Homo sapiens
uauauucucccuauuccua

SEQ ID NO: 1567366 - RNA, 19 nt, Homo sapiens
cugcagaucacaucaguuu

SEQ ID NO: 1567367 - RNA, 19 nt, Homo sapiens
uaaagaauagucuggugaa

SEQ ID NO: 1567368 - RNA, 19 nt, Homo sapiens
cugauuauauucucccuau

SEQ ID NO: 1567369 - RNA, 19 nt, Homo sapiens
acagauauuguccacuuua

SEQ ID NO: 1567370 - RNA, 19 nt, Homo sapiens
gagugugguugguuacuuc

SEQ ID NO: 1567371 - RNA, 19 nt, Homo sapiens
gcuuacugauaacaacuuu

SEQ ID NO: 1567372 - RNA, 19 nt, Homo sapiens
ugagaugucuuaccguuuu

SEQ ID NO: 1567373 - RNA, 19 nt, Homo sapiens
caucuaguacuuuagugua

SEQ ID NO: 1567374 - RNA, 19 nt, Homo sapiens
caaaucccagccagacuuu

SEQ ID NO: 1567375 - RNA, 19 nt, Homo sapiens
ucgugugucuucuguguuu

SEQ ID NO: 1567376 - RNA, 19 nt, Homo sapiens
aaggaagguuugagcuaaa

SEQ ID NO: 1567377 - RNA, 19 nt, Homo sapiens
cagccagacuuuguuguau

SEQ ID NO: 1567378 - RNA, 19 nt, Homo sapiens
cugauuugcugaaccuuug

SEQ ID NO: 1567379 - RNA, 19 nt, Homo sapiens
ccagccagacuuuguugua

SEQ ID NO: 1567380 - RNA, 19 nt, Homo sapiens
caagagcagacagauauug

SEQ ID NO: 1567381 - RNA, 19 nt, Homo sapiens
ggagacgacucacuaaaag

SEQ ID NO: 1567382 - RNA, 19 nt, Homo sapiens
uggauucccuuuuaagaua

SEQ ID NO: 1567383 - RNA, 19 nt, Homo sapiens
aaauggagcccuucaccaa

SEQ ID NO: 1567384 - RNA, 19 nt, Homo sapiens
gaaccuuugccuacagaau

SEQ ID NO: 1567385 - RNA, 19 nt, Homo sapiens
gagcuaaaaugaacuagag

SEQ ID NO: 1567386 - RNA, 19 nt, Homo sapiens
gaauagucuggugaaguua

SEQ ID NO: 1567387 - RNA, 19 nt, Homo sapiens
cauucagguucuauuugua

SEQ ID NO: 1567388 - RNA, 19 nt, Homo sapiens
ccaaaucccagccagacuu

SEQ ID NO: 1567389 - RNA, 19 nt, Homo sapiens
uauuuaugcugccacgaaa

SEQ ID NO: 1567390 - RNA, 19 nt, Homo sapiens
ucagguacaguaucacauu

SEQ ID NO: 1567391 - RNA, 19 nt, Homo sapiens
caaagacuuguuaauguca

SEQ ID NO: 1567392 - RNA, 19 nt, Homo sapiens
ccuaauguagaaugcuuua

SEQ ID NO: 1567393 - RNA, 19 nt, Homo sapiens
ggauucagucucugguuga

SEQ ID NO: 1567394 - RNA, 19 nt, Homo sapiens
aaaguuggcagcucagguu

SEQ ID NO: 1567395 - RNA, 19 nt, Homo sapiens
accuuugccuacagaauua

SEQ ID NO: 1567396 - RNA, 19 nt, Homo sapiens
uaagugacuauuccaaugu

SEQ ID NO: 1567397 - RNA, 19 nt, Homo sapiens
uguaugcugugcuucauuc

SEQ ID NO: 1567398 - RNA, 19 nt, Homo sapiens
ugggaggcuuggcagguua

SEQ ID NO: 1567399 - RNA, 19 nt, Homo sapiens
ggcugugaacuacugauua

SEQ ID NO: 1567400 - RNA, 19 nt, Homo sapiens
cucaagagcagacagauau

SEQ ID NO: 1567401 - RNA, 19 nt, Homo sapiens
ugccagagccacaauauag

SEQ ID NO: 1567402 - RNA, 19 nt, Homo sapiens
cauaaaucccacccuaguu

SEQ ID NO: 1567403 - RNA, 19 nt, Homo sapiens
gcugauuugcugaaccuuu

SEQ ID NO: 1567404 - RNA, 19 nt, Homo sapiens
ggcgugacuuuuccuaaua

SEQ ID NO: 1567405 - RNA, 19 nt, Homo sapiens
uuaaggaagguuugagcua

SEQ ID NO: 1567406 - RNA, 19 nt, Homo sapiens
uuauucuacugccaucuuu

SEQ ID NO: 1567407 - RNA, 19 nt, Homo sapiens
gguguugaguguguggauu

SEQ ID NO: 1567408 - RNA, 19 nt, Homo sapiens
gugggaggcuuggcagguu

SEQ ID NO: 1567409 - RNA, 19 nt, Homo sapiens
ucacccauuuggucaagau

SEQ ID NO: 1567410 - RNA, 19 nt, Homo sapiens
guguguggauucccuuuua

SEQ ID NO: 1567411 - RNA, 19 nt, Homo sapiens
gugccagagccacaauaua

SEQ ID NO: 1567412 - RNA, 19 nt, Homo sapiens
caagccauccgaauuaacu

SEQ ID NO: 1567413 - RNA, 19 nt, Homo sapiens
ucucauucagguucuauuu

SEQ ID NO: 1567414 - RNA, 19 nt, Homo sapiens
gggcugugaacuacugauu

SEQ ID NO: 1567415 - RNA, 19 nt, Homo sapiens
gaccaucuaguacuuuagu

SEQ ID NO: 1567416 - RNA, 19 nt, Homo sapiens
gaagugccagagccacaau

SEQ ID NO: 1567417 - RNA, 19 nt, Homo sapiens
uguaggagcguuaaguugu

SEQ ID NO: 1567418 - RNA, 19 nt, Homo sapiens
ggugaaguuacucgaagaa

SEQ ID NO: 1567419 - RNA, 19 nt, Homo sapiens
cuuucugucugcacuguuu

SEQ ID NO: 1567420 - RNA, 19 nt, Homo sapiens
ccacucaagagcagacaga

SEQ ID NO: 1567421 - RNA, 19 nt, Homo sapiens
ucuauaucccuguuuaguu

SEQ ID NO: 1567422 - RNA, 19 nt, Homo sapiens
ugagugugguugguuacuu

SEQ ID NO: 1567423 - RNA, 19 nt, Homo sapiens
gggagacgacucacuaaaa

SEQ ID NO: 1567424 - RNA, 19 nt, Homo sapiens
agccacagcccuucacuga

SEQ ID NO: 1567425 - RNA, 19 nt, Homo sapiens
augcugugcuucauucaug

SEQ ID NO: 1567426 - RNA, 19 nt, Homo sapiens
accaagccauccgaauuaa

SEQ ID NO: 1567427 - RNA, 19 nt, Homo sapiens
aaccuuugccuacagaauu

SEQ ID NO: 1567428 - RNA, 19 nt, Homo sapiens
gcugaaccuuugccuacag

SEQ ID NO: 1567429 - RNA, 19 nt, Homo sapiens
cccauuuggucaagauuag

SEQ ID NO: 1567430 - RNA, 19 nt, Homo sapiens
uacaagucguuaaguccuu

SEQ ID NO: 1567431 - RNA, 19 nt, Homo sapiens
gaacucagcuaauaugauu

SEQ ID NO: 1567432 - RNA, 19 nt, Homo sapiens
gagcauacaccaaugauua

SEQ ID NO: 1567433 - RNA, 19 nt, Homo sapiens
gcacaagucuacugcaauu

SEQ ID NO: 1567434 - RNA, 19 nt, Homo sapiens
ccaaacaggugcaauuaaa

SEQ ID NO: 1567435 - RNA, 19 nt, Homo sapiens
gaaugagaauugcauacua

SEQ ID NO: 1567436 - RNA, 19 nt, Homo sapiens
gaagucugguacauuaaua

SEQ ID NO: 1567437 - RNA, 19 nt, Homo sapiens
ggaaguaaaccaaauauuc

SEQ ID NO: 1567438 - RNA, 19 nt, Homo sapiens
gaaggaaguaaaccaaaua

SEQ ID NO: 1567439 - RNA, 19 nt, Homo sapiens
agaaagagauccugaacuu

SEQ ID NO: 1567440 - RNA, 19 nt, Homo sapiens
ccggaagucugguacauua

SEQ ID NO: 1567441 - RNA, 19 nt, Homo sapiens
gcauaucucuacccacuug

SEQ ID NO: 1567442 - RNA, 19 nt, Homo sapiens
aaagagugcuggcuucuau

SEQ ID NO: 1567443 - RNA, 19 nt, Homo sapiens
uuaaagaggugcauguaau

SEQ ID NO: 1567444 - RNA, 19 nt, Homo sapiens
auacuaaucuuacccagaa

SEQ ID NO: 1567445 - RNA, 19 nt, Homo sapiens
gggcugaagcugcuaauuu

SEQ ID NO: 1567446 - RNA, 19 nt, Homo sapiens
ggacaaguguaaagugaag

SEQ ID NO: 1567447 - RNA, 19 nt, Homo sapiens
ugauuuaagcgcucuauua

SEQ ID NO: 1567448 - RNA, 19 nt, Homo sapiens
ggcugaagcugcuaauuug

SEQ ID NO: 1567449 - RNA, 19 nt, Homo sapiens
guauaaugcuggucacaau

SEQ ID NO: 1567450 - RNA, 19 nt, Homo sapiens
gaagaaggaaguaaaccaa

SEQ ID NO: 1567451 - RNA, 19 nt, Homo sapiens
gaacaggcuuauugacucu

SEQ ID NO: 1567452 - RNA, 19 nt, Homo sapiens
gcacacauuuucauuugua

SEQ ID NO: 1567453 - RNA, 19 nt, Homo sapiens
gaagaaaauuguuguagug

SEQ ID NO: 1567454 - RNA, 19 nt, Homo sapiens
gaagaaugagaauugcaua

SEQ ID NO: 1567455 - RNA, 19 nt, Homo sapiens
uagcuuaacugucuucauc

SEQ ID NO: 1567456 - RNA, 19 nt, Homo sapiens
caggacaaguguaaaguga

SEQ ID NO: 1567457 - RNA, 19 nt, Homo sapiens
cuaaaccaaugccaaagaa

SEQ ID NO: 1567458 - RNA, 19 nt, Homo sapiens
uaagauuccuacaucaguu

SEQ ID NO: 1567459 - RNA, 19 nt, Homo sapiens
auaauuagguguagaccaa

SEQ ID NO: 1567460 - RNA, 19 nt, Homo sapiens
gguguuguguccauuaaug

SEQ ID NO: 1567461 - RNA, 19 nt, Homo sapiens
ggaugcagccgacuaauag

SEQ ID NO: 1567462 - RNA, 19 nt, Homo sapiens
uggcuucuauuguugauuu

SEQ ID NO: 1567463 - RNA, 19 nt, Homo sapiens
gaagaggggauuuuguuua

SEQ ID NO: 1567464 - RNA, 19 nt, Homo sapiens
gaacgguguuguguccauu

SEQ ID NO: 1567465 - RNA, 19 nt, Homo sapiens
ggugcuagcuuaacugucu

SEQ ID NO: 1567466 - RNA, 19 nt, Homo sapiens
gcguacaguuccucuacua

SEQ ID NO: 1567467 - RNA, 19 nt, Homo sapiens
ggucacaauuagaaugcua

SEQ ID NO: 1567468 - RNA, 19 nt, Homo sapiens
guuuaugacuucuagaguu

SEQ ID NO: 1567469 - RNA, 19 nt, Homo sapiens
gguguagaccaauaauaua

SEQ ID NO: 1567470 - RNA, 19 nt, Homo sapiens
gagaauugcauacuaaucu

SEQ ID NO: 1567471 - RNA, 19 nt, Homo sapiens
gcuuaacugucuucaucua

SEQ ID NO: 1567472 - RNA, 19 nt, Homo sapiens
gcagaaagaggcacgaaca

SEQ ID NO: 1567473 - RNA, 19 nt, Homo sapiens
aagguaaacuugguaacua

SEQ ID NO: 1567474 - RNA, 19 nt, Homo sapiens
uguaaucacucuggauaaa

SEQ ID NO: 1567475 - RNA, 19 nt, Homo sapiens
uaaagaggugcauguaauu

SEQ ID NO: 1567476 - RNA, 19 nt, Homo sapiens
caagucuacugcaauuaug

SEQ ID NO: 1567477 - RNA, 19 nt, Homo sapiens
caaauuugaacucagcuaa

SEQ ID NO: 1567478 - RNA, 19 nt, Homo sapiens
caccaaugauuauuucuca

SEQ ID NO: 1567479 - RNA, 19 nt, Homo sapiens
cagcacaagucuacugcaa

SEQ ID NO: 1567480 - RNA, 19 nt, Homo sapiens
cagcuaauaugauuuaagc

SEQ ID NO: 1567481 - RNA, 19 nt, Homo sapiens
agaaggaaguaaaccaaau

SEQ ID NO: 1567482 - RNA, 19 nt, Homo sapiens
uagcauuucuagucaguau

SEQ ID NO: 1567483 - RNA, 19 nt, Homo sapiens
ucuauuaauugcccugauu

SEQ ID NO: 1567484 - RNA, 19 nt, Homo sapiens
gaagaaagagauccugaac

SEQ ID NO: 1567485 - RNA, 19 nt, Homo sapiens
ggaagucugguacauuaau

SEQ ID NO: 1567486 - RNA, 19 nt, Homo sapiens
guguuaaguuguaaggaaa

SEQ ID NO: 1567487 - RNA, 19 nt, Homo sapiens
gaaaauuguuguaguggau

SEQ ID NO: 1567488 - RNA, 19 nt, Homo sapiens
ugaagcugcuaauuuggaa

SEQ ID NO: 1567489 - RNA, 19 nt, Homo sapiens
aacaugccauuuaaaggua

SEQ ID NO: 1567490 - RNA, 19 nt, Homo sapiens
uuuccuguaucuaguguua

SEQ ID NO: 1567491 - RNA, 19 nt, Homo sapiens
ucauugaacaggcuuauug

SEQ ID NO: 1567492 - RNA, 19 nt, Homo sapiens
guuaaggucuguagguuuu

SEQ ID NO: 1567493 - RNA, 19 nt, Homo sapiens
uaacugucuucaucuaaca

SEQ ID NO: 1567494 - RNA, 19 nt, Homo sapiens
ucuacccacuuguacauaa

SEQ ID NO: 1567495 - RNA, 19 nt, Homo sapiens
ugugauagguuagaaguuc

SEQ ID NO: 1567496 - RNA, 19 nt, Homo sapiens
aaacaugccauuuaaaggu

SEQ ID NO: 1567497 - RNA, 19 nt, Homo sapiens
ggaacgguguuguguccau

SEQ ID NO: 1567498 - RNA, 19 nt, Homo sapiens
gugcuggcuucuauuguug

SEQ ID NO: 1567499 - RNA, 19 nt, Homo sapiens
gcugagauuuuguauagaa

SEQ ID NO: 1567500 - RNA, 19 nt, Homo sapiens
ugacucugguaaacuuauu

SEQ ID NO: 1567501 - RNA, 19 nt, Homo sapiens
uauugacucugguaaacuu

SEQ ID NO: 1567502 - RNA, 19 nt, Homo sapiens
ucagcauggugcccaaauu

SEQ ID NO: 1567503 - RNA, 19 nt, Homo sapiens
gugcagcuguugcucuuuc

SEQ ID NO: 1567504 - RNA, 19 nt, Homo sapiens
aggcugagaugugagaauu

SEQ ID NO: 1567505 - RNA, 19 nt, Homo sapiens
gggaaacuaugcagaaaau

SEQ ID NO: 1567506 - RNA, 19 nt, Homo sapiens
ggauuagacucauuaaaag

SEQ ID NO: 1567507 - RNA, 19 nt, Homo sapiens
guacauaauucagcaucca

SEQ ID NO: 1567508 - RNA, 19 nt, Homo sapiens
aauuagguguagaccaaua

SEQ ID NO: 1567509 - RNA, 19 nt, Homo sapiens
cggaugcagccgacuaaua

SEQ ID NO: 1567510 - RNA, 19 nt, Homo sapiens
aguguuaaguuguaaggaa

SEQ ID NO: 1567511 - RNA, 19 nt, Homo sapiens
guuuauccuucuacaauca

SEQ ID NO: 1567512 - RNA, 19 nt, Homo sapiens
cauuagcucacaccuguaa

SEQ ID NO: 1567513 - RNA, 19 nt, Homo sapiens
cuucuagaguuuccuguau

SEQ ID NO: 1567514 - RNA, 19 nt, Homo sapiens
aaagaggugcauguaauuu

SEQ ID NO: 1567515 - RNA, 19 nt, Homo sapiens
guccugacuuuacaguuug

SEQ ID NO: 1567516 - RNA, 19 nt, Homo sapiens
ucagaaaguguguuugugu

SEQ ID NO: 1567517 - RNA, 19 nt, Homo sapiens
uauagagcauacaccaaug

SEQ ID NO: 1567518 - RNA, 19 nt, Homo sapiens
acaagucuacugcaauuau

SEQ ID NO: 1567519 - RNA, 19 nt, Homo sapiens
cagcgcacccucugcauau

SEQ ID NO: 1567520 - RNA, 19 nt, Homo sapiens
gcauuucuagucaguaugu

SEQ ID NO: 1567521 - RNA, 19 nt, Homo sapiens
gcauacaccaaugauuauu

SEQ ID NO: 1567522 - RNA, 19 nt, Homo sapiens
gggaaaauauuugcugaga

SEQ ID NO: 1567523 - RNA, 19 nt, Homo sapiens
gguaaacuugguaacuauu

SEQ ID NO: 1567524 - RNA, 19 nt, Homo sapiens
gggauuuuguuuagucuuu

SEQ ID NO: 1567525 - RNA, 19 nt, Homo sapiens
ccaaagaacaaacgcaaac

SEQ ID NO: 1567526 - RNA, 19 nt, Homo sapiens
gaucggucgucgcuucagu

SEQ ID NO: 1567527 - RNA, 19 nt, Homo sapiens
gcuaaggacauuuucuaua

SEQ ID NO: 1567528 - RNA, 19 nt, Homo sapiens
ccauggagucgcagaaaga

SEQ ID NO: 1567529 - RNA, 19 nt, Homo sapiens
gcugagaugugagaauugc

SEQ ID NO: 1567530 - RNA, 19 nt, Homo sapiens
ccagcgcacccucugcaua

SEQ ID NO: 1567531 - RNA, 19 nt, Homo sapiens
uaaauccgcucagaccauu

SEQ ID NO: 1567532 - RNA, 19 nt, Homo sapiens
caacaugggcuauauaugc

SEQ ID NO: 1567533 - RNA, 19 nt, Homo sapiens
gcuauggacugcacgaaca

SEQ ID NO: 1567534 - RNA, 19 nt, Homo sapiens
cccaacaccucgcuccaua

SEQ ID NO: 1567535 - RNA, 19 nt, Homo sapiens
ugaggacgaugacaugaau

SEQ ID NO: 1567536 - RNA, 19 nt, Homo sapiens
caaaugggcagccaagcaa

SEQ ID NO: 1567537 - RNA, 19 nt, Homo sapiens
ucauugugcugauggacua

SEQ ID NO: 1567538 - RNA, 19 nt, Homo sapiens
gcaaaugggcagccaagca

SEQ ID NO: 1567539 - RNA, 19 nt, Homo sapiens
gccacgugcucaagaagaa

SEQ ID NO: 1567540 - RNA, 19 nt, Homo sapiens
acaccucgcuccauaugau

SEQ ID NO: 1567541 - RNA, 19 nt, Homo sapiens
caacaccucgcuccauaug

SEQ ID NO: 1567542 - RNA, 19 nt, Homo sapiens
gucaauaaauccgcucaga

SEQ ID NO: 1567543 - RNA, 19 nt, Homo sapiens
cagugcagcuguccagugu

SEQ ID NO: 1567544 - RNA, 19 nt, Homo sapiens
gagcagggaguaugugagu

SEQ ID NO: 1567545 - RNA, 19 nt, Homo sapiens
caagcaaaccagacacuuc

SEQ ID NO: 1567546 - RNA, 19 nt, Homo sapiens
ugacaugaaugaggacaca

SEQ ID NO: 1567547 - RNA, 19 nt, Homo sapiens
ggacacaguagagaggauu

SEQ ID NO: 1567548 - RNA, 19 nt, Homo sapiens
ugaaugaggacacaguaga

SEQ ID NO: 1567549 - RNA, 19 nt, Homo sapiens
gggaccagcucuacuucca

SEQ ID NO: 1567550 - RNA, 19 nt, Homo sapiens
uaugugagucuccuucauu

SEQ ID NO: 1567551 - RNA, 19 nt, Homo sapiens
ccacagggagcagggagua

SEQ ID NO: 1567552 - RNA, 19 nt, Homo sapiens
gaaugaggacacaguagag

SEQ ID NO: 1567553 - RNA, 19 nt, Homo sapiens
ugagggaccagcucuacuu

SEQ ID NO: 1567554 - RNA, 19 nt, Homo sapiens
gcagggaguaugugagucu

SEQ ID NO: 1567555 - RNA, 19 nt, Homo sapiens
gaagggaaccccagagcuu

SEQ ID NO: 1567556 - RNA, 19 nt, Homo sapiens
agaccacuguguucucugu

SEQ ID NO: 1567557 - RNA, 19 nt, Homo sapiens
caugaaugaggacacagua

SEQ ID NO: 1567558 - RNA, 19 nt, Homo sapiens
cauccagaaugaagccaau

SEQ ID NO: 1567559 - RNA, 19 nt, Homo sapiens
gugagucuccuucauugug

SEQ ID NO: 1567560 - RNA, 19 nt, Homo sapiens
guaugugagucuccuucau

SEQ ID NO: 1567561 - RNA, 19 nt, Homo sapiens
gggagcagggaguauguga

SEQ ID NO: 1567562 - RNA, 19 nt, Homo sapiens
guacagaauggaggacuca

SEQ ID NO: 1567563 - RNA, 19 nt, Homo sapiens
ucagggacgcuccaaggaa

SEQ ID NO: 1567564 - RNA, 19 nt, Homo sapiens
cugguaggcuucaugaucu

SEQ ID NO: 1567565 - RNA, 19 nt, Homo sapiens
uucgugcccuuuauucauu

SEQ ID NO: 1567566 - RNA, 19 nt, Homo sapiens
ccaaugcugaggccuugaa

SEQ ID NO: 1567567 - RNA, 19 nt, Homo sapiens
ccacucaagaggcaaaugg

SEQ ID NO: 1567568 - RNA, 19 nt, Homo sapiens
gagggaccagcucuacuuc

SEQ ID NO: 1567569 - RNA, 19 nt, Homo sapiens
ccugguaggcuucaugauc

SEQ ID NO: 1567570 - RNA, 19 nt, Homo sapiens
ggacucagcuucagugauu

SEQ ID NO: 1567571 - RNA, 19 nt, Homo sapiens
ccacacaguuggagaauaa

SEQ ID NO: 1567572 - RNA, 19 nt, Homo sapiens
ggaacugucuacugcuuua

SEQ ID NO: 1567573 - RNA, 19 nt, Homo sapiens
ucacacugcuuuguaauua

SEQ ID NO: 1567574 - RNA, 19 nt, Homo sapiens
gaaaauaccuuugugcuuu

SEQ ID NO: 1567575 - RNA, 19 nt, Homo sapiens
ggaaaguacuacacuaaau

SEQ ID NO: 1567576 - RNA, 19 nt, Homo sapiens
uuacagcgguauuacauua

SEQ ID NO: 1567577 - RNA, 19 nt, Homo sapiens
ucagauugcuugccucuuu

SEQ ID NO: 1567578 - RNA, 19 nt, Homo sapiens
guauggcucuuucccaaua

SEQ ID NO: 1567579 - RNA, 19 nt, Homo sapiens
guuaaagccugcuaaauca

SEQ ID NO: 1567580 - RNA, 19 nt, Homo sapiens
gcacugaucacacugcuuu

SEQ ID NO: 1567581 - RNA, 19 nt, Homo sapiens
caaagggaauuucucaguu

SEQ ID NO: 1567582 - RNA, 19 nt, Homo sapiens
caaguaaacuguuauugag

SEQ ID NO: 1567583 - RNA, 19 nt, Homo sapiens
ggucacuacuuaagacuuu

SEQ ID NO: 1567584 - RNA, 19 nt, Homo sapiens
aggaaugggucacuacuua

SEQ ID NO: 1567585 - RNA, 19 nt, Homo sapiens
uaaaggccuuguugcauuu

SEQ ID NO: 1567586 - RNA, 19 nt, Homo sapiens
cuaaaggccuuguugcauu

SEQ ID NO: 1567587 - RNA, 19 nt, Homo sapiens
ccaaguaaacuguuauuga

SEQ ID NO: 1567588 - RNA, 19 nt, Homo sapiens
gacaaggcauauagggaua

SEQ ID NO: 1567589 - RNA, 19 nt, Homo sapiens
gagaauaauugaugcugau

SEQ ID NO: 1567590 - RNA, 19 nt, Homo sapiens
gcacauugauaaaguuucu

SEQ ID NO: 1567591 - RNA, 19 nt, Homo sapiens
uaaggaaaguacuacacua

SEQ ID NO: 1567592 - RNA, 19 nt, Homo sapiens
uaaaugcgcuuuguguguu

SEQ ID NO: 1567593 - RNA, 19 nt, Homo sapiens
uaaagugugagcuguguua

SEQ ID NO: 1567594 - RNA, 19 nt, Homo sapiens
gugcucugcugcauuuaua

SEQ ID NO: 1567595 - RNA, 19 nt, Homo sapiens
ugagaggaguaaaguguuu

SEQ ID NO: 1567596 - RNA, 19 nt, Homo sapiens
gaauuaaugaggcaugauu

SEQ ID NO: 1567597 - RNA, 19 nt, Homo sapiens
guaaggggcuagugugaua

SEQ ID NO: 1567598 - RNA, 19 nt, Homo sapiens
aaacugcuaugcccucuau

SEQ ID NO: 1567599 - RNA, 19 nt, Homo sapiens
gaagaauaaaugaggguaa

SEQ ID NO: 1567600 - RNA, 19 nt, Homo sapiens
ucacuucccuauguucuuu

SEQ ID NO: 1567601 - RNA, 19 nt, Homo sapiens
ggaggaaguuagacaagca

SEQ ID NO: 1567602 - RNA, 19 nt, Homo sapiens
gcagucauccuguguaauc

SEQ ID NO: 1567603 - RNA, 19 nt, Homo sapiens
ugaguaccaugaagaagaa

SEQ ID NO: 1567604 - RNA, 19 nt, Homo sapiens
uaaugaggcaugauucuaa

SEQ ID NO: 1567605 - RNA, 19 nt, Homo sapiens
cauuucagcuacacauaaa

SEQ ID NO: 1567606 - RNA, 19 nt, Homo sapiens
aaauuucucuccuuugguu

SEQ ID NO: 1567607 - RNA, 19 nt, Homo sapiens
uauagagagugucaaguga

SEQ ID NO: 1567608 - RNA, 19 nt, Homo sapiens
ccacauaaggaaaguacua

SEQ ID NO: 1567609 - RNA, 19 nt, Homo sapiens
gguaggcccuuaguaaugu

SEQ ID NO: 1567610 - RNA, 19 nt, Homo sapiens
guugguaaacuccauauuu

SEQ ID NO: 1567611 - RNA, 19 nt, Homo sapiens
ccaagugaauaccuaccua

SEQ ID NO: 1567612 - RNA, 19 nt, Homo sapiens
gcaaagggaauuucucagu

SEQ ID NO: 1567613 - RNA, 19 nt, Homo sapiens
gauguuaacuaggcuuuua

SEQ ID NO: 1567614 - RNA, 19 nt, Homo sapiens
ccaaaacucuguuaaagga

SEQ ID NO: 1567615 - RNA, 19 nt, Homo sapiens
ggaaugggucacuacuuaa

SEQ ID NO: 1567616 - RNA, 19 nt, Homo sapiens
cuucaaauuucucuccuuu

SEQ ID NO: 1567617 - RNA, 19 nt, Homo sapiens
caugguaggcccuuaguaa

SEQ ID NO: 1567618 - RNA, 19 nt, Homo sapiens
ugaucacacugcuuuguaa

SEQ ID NO: 1567619 - RNA, 19 nt, Homo sapiens
ccuagacccugaggauaua

SEQ ID NO: 1567620 - RNA, 19 nt, Homo sapiens
guacuacacuaaauucacu

SEQ ID NO: 1567621 - RNA, 19 nt, Homo sapiens
gauucuaaaugccaaacuu

SEQ ID NO: 1567622 - RNA, 19 nt, Homo sapiens
gcacacaucauuacuucug

SEQ ID NO: 1567623 - RNA, 19 nt, Homo sapiens
ccuuugugcuuucuaagua

SEQ ID NO: 1567624 - RNA, 19 nt, Homo sapiens
gguguucuuucauguuauu

SEQ ID NO: 1567625 - RNA, 19 nt, Homo sapiens
ggaaguuagacaagcauuu

SEQ ID NO: 1567626 - RNA, 19 nt, Homo sapiens
ccacagacuaucccucuuu

SEQ ID NO: 1567627 - RNA, 19 nt, Homo sapiens
aaagggaauuucucaguuc

SEQ ID NO: 1567628 - RNA, 19 nt, Homo sapiens
gagaugauaccauguuaca

SEQ ID NO: 1567629 - RNA, 19 nt, Homo sapiens
uaacuaggcuuuuagacuu

SEQ ID NO: 1567630 - RNA, 19 nt, Homo sapiens
ugaauucucucaugguuac

SEQ ID NO: 1567631 - RNA, 19 nt, Homo sapiens
caagugaugaguaccauga

SEQ ID NO: 1567632 - RNA, 19 nt, Homo sapiens
ucacugguugguacaauua

SEQ ID NO: 1567633 - RNA, 19 nt, Homo sapiens
cauguuauuucuucuagug

SEQ ID NO: 1567634 - RNA, 19 nt, Homo sapiens
cugguguucuuucauguua

SEQ ID NO: 1567635 - RNA, 19 nt, Homo sapiens
cacaauaacuuuacauucc

SEQ ID NO: 1567636 - RNA, 19 nt, Homo sapiens
guaccaugaagaagaauaa

SEQ ID NO: 1567637 - RNA, 19 nt, Homo sapiens
ugugugcucugcugcauuu

SEQ ID NO: 1567638 - RNA, 19 nt, Homo sapiens
ucacucaacuauuguaugc

SEQ ID NO: 1567639 - RNA, 19 nt, Homo sapiens
gugcaaaucaugacuaaag

SEQ ID NO: 1567640 - RNA, 19 nt, Homo sapiens
guauagagagugucaagug

SEQ ID NO: 1567641 - RNA, 19 nt, Homo sapiens
guauuccgcacauugauaa

SEQ ID NO: 1567642 - RNA, 19 nt, Homo sapiens
ccaugaagaagaauaaaug

SEQ ID NO: 1567643 - RNA, 19 nt, Homo sapiens
ccuaccauaugccagauuu

SEQ ID NO: 1567644 - RNA, 19 nt, Homo sapiens
gauauaugccauccugaga

SEQ ID NO: 1567645 - RNA, 19 nt, Homo sapiens
uaaagccugcuaaaucauu

SEQ ID NO: 1567646 - RNA, 19 nt, Homo sapiens
uagagcauccugaucaauu

SEQ ID NO: 1567647 - RNA, 19 nt, Homo sapiens
uuacagggcuccuuuucua

SEQ ID NO: 1567648 - RNA, 19 nt, Homo sapiens
ccacaauaacuuuacauuc

SEQ ID NO: 1567649 - RNA, 19 nt, Homo sapiens
uagagagugucaagugaug

SEQ ID NO: 1567650 - RNA, 19 nt, Homo sapiens
aaugaggcaugauucuaaa

SEQ ID NO: 1567651 - RNA, 19 nt, Homo sapiens
cagcuucagugauucuguu

SEQ ID NO: 1567652 - RNA, 19 nt, Homo sapiens
uaguuucacuucccuaugu

SEQ ID NO: 1567653 - RNA, 19 nt, Homo sapiens
uguagaccauggcaguuaa

SEQ ID NO: 1567654 - RNA, 19 nt, Homo sapiens
gguguucauuaaaguguga

SEQ ID NO: 1567655 - RNA, 19 nt, Homo sapiens
gcuaaugguugagugauac

SEQ ID NO: 1567656 - RNA, 19 nt, Homo sapiens
agagcauccugaucaauug

SEQ ID NO: 1567657 - RNA, 19 nt, Homo sapiens
ccaugucucugcagucauc

SEQ ID NO: 1567658 - RNA, 19 nt, Homo sapiens
ggguuucucuucgguuuga

SEQ ID NO: 1567659 - RNA, 19 nt, Homo sapiens
gacuuuaucauuucagcua

SEQ ID NO: 1567660 - RNA, 19 nt, Homo sapiens
agaaugaaguaaccucaag

SEQ ID NO: 1567661 - RNA, 19 nt, Homo sapiens
ccuuuguucugguccuuua

SEQ ID NO: 1567662 - RNA, 19 nt, Homo sapiens
gugaccaagugaauaccua

SEQ ID NO: 1567663 - RNA, 19 nt, Homo sapiens
gggcugcugagaauaauug

SEQ ID NO: 1567664 - RNA, 19 nt, Homo sapiens
gaaguuagacaagcauuuu

SEQ ID NO: 1567665 - RNA, 19 nt, Homo sapiens
aaggaaaguacuacacuaa

SEQ ID NO: 1567666 - RNA, 19 nt, Homo sapiens
guauacauagugcuuaaug

SEQ ID NO: 1567667 - RNA, 19 nt, Homo sapiens
ucucuccuuugguuauaua

SEQ ID NO: 1567668 - RNA, 19 nt, Homo sapiens
uguuaaagccugcuaaauc

SEQ ID NO: 1567669 - RNA, 19 nt, Homo sapiens
uuacucugguguauuauag

SEQ ID NO: 1567670 - RNA, 19 nt, Homo sapiens
gaacuuagauucacagaaa

SEQ ID NO: 1567671 - RNA, 19 nt, Homo sapiens
gaacaaacaugcauuacuc

SEQ ID NO: 1567672 - RNA, 19 nt, Homo sapiens
gaaacuguguucugacauu

SEQ ID NO: 1567673 - RNA, 19 nt, Homo sapiens
caaauagcauuaagcauga

SEQ ID NO: 1567674 - RNA, 19 nt, Homo sapiens
gguacaagcuuagauauga

SEQ ID NO: 1567675 - RNA, 19 nt, Homo sapiens
ggaaaggaauggaaaguag

SEQ ID NO: 1567676 - RNA, 19 nt, Homo sapiens
ggaagagacuauuaggaaa

SEQ ID NO: 1567677 - RNA, 19 nt, Homo sapiens
gaaaguaaaucaagaaucc

SEQ ID NO: 1567678 - RNA, 19 nt, Homo sapiens
gacucaagcugguuuauuu

SEQ ID NO: 1567679 - RNA, 19 nt, Homo sapiens
gcagaacaaacaugcauua

SEQ ID NO: 1567680 - RNA, 19 nt, Homo sapiens
gcucaccuaucaauucuaa

SEQ ID NO: 1567681 - RNA, 19 nt, Homo sapiens
agacacagaucacagauga

SEQ ID NO: 1567682 - RNA, 19 nt, Homo sapiens
cuuccaaccuccucaauua

SEQ ID NO: 1567683 - RNA, 19 nt, Homo sapiens
gaaagcaagcaaccagaua

SEQ ID NO: 1567684 - RNA, 19 nt, Homo sapiens
caacucaaauuccuucaau

SEQ ID NO: 1567685 - RNA, 19 nt, Homo sapiens
aaacaugcauuacuccaaa

SEQ ID NO: 1567686 - RNA, 19 nt, Homo sapiens
gaauagggauagaaagcaa

SEQ ID NO: 1567687 - RNA, 19 nt, Homo sapiens
gaggaggcuuuguaucuuu

SEQ ID NO: 1567688 - RNA, 19 nt, Homo sapiens
caagcugguuuauuuguuu

SEQ ID NO: 1567689 - RNA, 19 nt, Homo sapiens
gcacugcgauagagacaga

SEQ ID NO: 1567690 - RNA, 19 nt, Homo sapiens
guagaacauuaccacuuua

SEQ ID NO: 1567691 - RNA, 19 nt, Homo sapiens
gaacaucauuuaccuuggu

SEQ ID NO: 1567692 - RNA, 19 nt, Homo sapiens
guacaaggauguuuauugc

SEQ ID NO: 1567693 - RNA, 19 nt, Homo sapiens
gaaaauccaugaacuuaga

SEQ ID NO: 1567694 - RNA, 19 nt, Homo sapiens
aaacuaugguacaagcuua

SEQ ID NO: 1567695 - RNA, 19 nt, Homo sapiens
uuacuucccuucaaucaaa

SEQ ID NO: 1567696 - RNA, 19 nt, Homo sapiens
agacagaguucaagcagaa

SEQ ID NO: 1567697 - RNA, 19 nt, Homo sapiens
gaacauuaccacuuuaaca

SEQ ID NO: 1567698 - RNA, 19 nt, Homo sapiens
gaugagguauuagaaagaa

SEQ ID NO: 1567699 - RNA, 19 nt, Homo sapiens
gcuuagauaugacucugua

SEQ ID NO: 1567700 - RNA, 19 nt, Homo sapiens
ccauacacuuuacaguuua

SEQ ID NO: 1567701 - RNA, 19 nt, Homo sapiens
caaugugccuugaggauau

SEQ ID NO: 1567702 - RNA, 19 nt, Homo sapiens
cggaacugcugcucaauuu

SEQ ID NO: 1567703 - RNA, 19 nt, Homo sapiens
ccaggaaacuguguucuga

SEQ ID NO: 1567704 - RNA, 19 nt, Homo sapiens
caagcaaccagauagaaua

SEQ ID NO: 1567705 - RNA, 19 nt, Homo sapiens
cuaaguugauuguguugua

SEQ ID NO: 1567706 - RNA, 19 nt, Homo sapiens
aaacggaacugcugcucaa

SEQ ID NO: 1567707 - RNA, 19 nt, Homo sapiens
cccauacacuuuacaguuu

SEQ ID NO: 1567708 - RNA, 19 nt, Homo sapiens
ccaugggccucacauauau

SEQ ID NO: 1567709 - RNA, 19 nt, Homo sapiens
gaacggagcagagagacaa

SEQ ID NO: 1567710 - RNA, 19 nt, Homo sapiens
agacuaaguugauuguguu

SEQ ID NO: 1567711 - RNA, 19 nt, Homo sapiens
gggcuugucucaggaggua

SEQ ID NO: 1567712 - RNA, 19 nt, Homo sapiens
gaguugacaugcaccagaa

SEQ ID NO: 1567713 - RNA, 19 nt, Homo sapiens
aauguuagcugacuguguu

SEQ ID NO: 1567714 - RNA, 19 nt, Homo sapiens
gagcagagagacaaauaga

SEQ ID NO: 1567715 - RNA, 19 nt, Homo sapiens
gaucugaccgcugaaguuu

SEQ ID NO: 1567716 - RNA, 19 nt, Homo sapiens
uauccauggugcugucuua

SEQ ID NO: 1567717 - RNA, 19 nt, Homo sapiens
gcugaugccucucauuaag

SEQ ID NO: 1567718 - RNA, 19 nt, Homo sapiens
caaccaugauguucucaau

SEQ ID NO: 1567719 - RNA, 19 nt, Homo sapiens
cugcguaacuuguucagaa

SEQ ID NO: 1567720 - RNA, 19 nt, Homo sapiens
gcaagcaaccagauagaau

SEQ ID NO: 1567721 - RNA, 19 nt, Homo sapiens
ggagugcaguggcauuauc

SEQ ID NO: 1567722 - RNA, 19 nt, Homo sapiens
caaguuacguucagcacau

SEQ ID NO: 1567723 - RNA, 19 nt, Homo sapiens
ucacauauauggcaguuuu

SEQ ID NO: 1567724 - RNA, 19 nt, Homo sapiens
gagaauauggacccaagaa

SEQ ID NO: 1567725 - RNA, 19 nt, Homo sapiens
aaucaagaauccauccaaa

SEQ ID NO: 1567726 - RNA, 19 nt, Homo sapiens
gcauuaagcaugauucaag

SEQ ID NO: 1567727 - RNA, 19 nt, Homo sapiens
gaauaaacccauggaaaca

SEQ ID NO: 1567728 - RNA, 19 nt, Homo sapiens
guaaucaaguccauaacca

SEQ ID NO: 1567729 - RNA, 19 nt, Homo sapiens
caugauguucucaauguua

SEQ ID NO: 1567730 - RNA, 19 nt, Homo sapiens
gaaagaauaagcucauacu

SEQ ID NO: 1567731 - RNA, 19 nt, Homo sapiens
cagugcagcuucuauacuu

SEQ ID NO: 1567732 - RNA, 19 nt, Homo sapiens
gaacacuggacccugcuuu

SEQ ID NO: 1567733 - RNA, 19 nt, Homo sapiens
cacacuugcucucacauuu

SEQ ID NO: 1567734 - RNA, 19 nt, Homo sapiens
acaaauagaggaacggaaa

SEQ ID NO: 1567735 - RNA, 19 nt, Homo sapiens
gcuggcaccacucuucuua

SEQ ID NO: 1567736 - RNA, 19 nt, Homo sapiens
ccaaagugcugggauuaca

SEQ ID NO: 1567737 - RNA, 19 nt, Homo sapiens
gcugguaguuuacucuugu

SEQ ID NO: 1567738 - RNA, 19 nt, Homo sapiens
gaagagacuauuaggaaag

SEQ ID NO: 1567739 - RNA, 19 nt, Homo sapiens
ggaaacagugagacaucua

SEQ ID NO: 1567740 - RNA, 19 nt, Homo sapiens
gcaggaaggaagccaaguu

SEQ ID NO: 1567741 - RNA, 19 nt, Homo sapiens
uaucguacaaggauguuua

SEQ ID NO: 1567742 - RNA, 19 nt, Homo sapiens
acaagguuauuacgaaaga

SEQ ID NO: 1567743 - RNA, 19 nt, Homo sapiens
aaacuguguucugacauuu

SEQ ID NO: 1567744 - RNA, 19 nt, Homo sapiens
cuacucgaaugcuugcuaa

SEQ ID NO: 1567745 - RNA, 19 nt, Homo sapiens
cuuacaagguuauuacgaa

SEQ ID NO: 1567746 - RNA, 19 nt, Homo sapiens
ggugcugucuuacaagguu

SEQ ID NO: 1567747 - RNA, 19 nt, Homo sapiens
ccauggugcugucuuacaa

SEQ ID NO: 1567748 - RNA, 19 nt, Homo sapiens
uggaagagacuauuaggaa

SEQ ID NO: 1567749 - RNA, 19 nt, Homo sapiens
cacagaaaguaaaucaaga

SEQ ID NO: 1567750 - RNA, 19 nt, Homo sapiens
uggcugaugccucucauua

SEQ ID NO: 1567751 - RNA, 19 nt, Homo sapiens
gcaccacucuucuuaugcu

SEQ ID NO: 1567752 - RNA, 19 nt, Homo sapiens
ugugugcggugaauaugua

SEQ ID NO: 1567753 - RNA, 19 nt, Homo sapiens
ggaagacuaaguugauugu

SEQ ID NO: 1567754 - RNA, 19 nt, Homo sapiens
agaguuaccuaaagugcuu

SEQ ID NO: 1567755 - RNA, 19 nt, Homo sapiens
caagcagaguuaccuaaag

SEQ ID NO: 1567756 - RNA, 19 nt, Homo sapiens
cacagaugaucaaguaguu

SEQ ID NO: 1567757 - RNA, 19 nt, Homo sapiens
ugagacaucuacagagaca

SEQ ID NO: 1567758 - RNA, 19 nt, Homo sapiens
gcaagguaaucaaguccau

SEQ ID NO: 1567759 - RNA, 19 nt, Homo sapiens
gaacccaccaugguaagaa

SEQ ID NO: 1567760 - RNA, 19 nt, Homo sapiens
gggaguugcuaugugauga

SEQ ID NO: 1567761 - RNA, 19 nt, Homo sapiens
acugccagcugguaguuua

SEQ ID NO: 1567762 - RNA, 19 nt, Homo sapiens
acacuugcucucacauuua

SEQ ID NO: 1567763 - RNA, 19 nt, Homo sapiens
ucaagcugguuuauuuguu

SEQ ID NO: 1567764 - RNA, 19 nt, Homo sapiens
caaaauguguaggagaaua

SEQ ID NO: 1567765 - RNA, 19 nt, Homo sapiens
ggaaccuacucgaaugcuu

SEQ ID NO: 1567766 - RNA, 19 nt, Homo sapiens
aagcagaguuaccuaaagu

SEQ ID NO: 1567767 - RNA, 19 nt, Homo sapiens
caagaacggagcagagaga

SEQ ID NO: 1567768 - RNA, 19 nt, Homo sapiens
ucagaaaacucauuagcuu

SEQ ID NO: 1567769 - RNA, 19 nt, Homo sapiens
gaaaggaauggaaaguagu

SEQ ID NO: 1567770 - RNA, 19 nt, Homo sapiens
gcaaauaccucacuauggu

SEQ ID NO: 1567771 - RNA, 19 nt, Homo sapiens
gcagguagaugaucaugaa

SEQ ID NO: 1567772 - RNA, 19 nt, Homo sapiens
ccacuaaaguaaaugcuua

SEQ ID NO: 1567773 - RNA, 19 nt, Homo sapiens
uaacugagacuuuggcuua

SEQ ID NO: 1567774 - RNA, 19 nt, Homo sapiens
cuagaaagguuuacugauu

SEQ ID NO: 1567775 - RNA, 19 nt, Homo sapiens
uuacaaaugugccauauug

SEQ ID NO: 1567776 - RNA, 19 nt, Homo sapiens
guaccugccuccuuuguuu

SEQ ID NO: 1567777 - RNA, 19 nt, Homo sapiens
uaacuccucuuaacauaug

SEQ ID NO: 1567778 - RNA, 19 nt, Homo sapiens
caccaaagauugcaaauac

SEQ ID NO: 1567779 - RNA, 19 nt, Homo sapiens
gaugucagcaguacaagua

SEQ ID NO: 1567780 - RNA, 19 nt, Homo sapiens
gaaaucagcuaaguauacu

SEQ ID NO: 1567781 - RNA, 19 nt, Homo sapiens
gcaggugaauucaugauag

SEQ ID NO: 1567782 - RNA, 19 nt, Homo sapiens
ccagggaguugcaucauga

SEQ ID NO: 1567783 - RNA, 19 nt, Homo sapiens
guagaagcaucgaacauca

SEQ ID NO: 1567784 - RNA, 19 nt, Homo sapiens
gaauaaauugcaggcauua

SEQ ID NO: 1567785 - RNA, 19 nt, Homo sapiens
gaagauagcgaugaagaga

SEQ ID NO: 1567786 - RNA, 19 nt, Homo sapiens
caucgaacaucaaccaaug

SEQ ID NO: 1567787 - RNA, 19 nt, Homo sapiens
ucuaguaccugccuccuuu

SEQ ID NO: 1567788 - RNA, 19 nt, Homo sapiens
uuaaugugcuguaacugua

SEQ ID NO: 1567789 - RNA, 19 nt, Homo sapiens
ugaauaaauugcaggcauu

SEQ ID NO: 1567790 - RNA, 19 nt, Homo sapiens
gcaccaaagauugcaaaua

SEQ ID NO: 1567791 - RNA, 19 nt, Homo sapiens
gagaaugaagaacugaaua

SEQ ID NO: 1567792 - RNA, 19 nt, Homo sapiens
aaagcaaguuucacacuga

SEQ ID NO: 1567793 - RNA, 19 nt, Homo sapiens
uagaaagguuuacugauuc

SEQ ID NO: 1567794 - RNA, 19 nt, Homo sapiens
uuaauggucuugacuagga

SEQ ID NO: 1567795 - RNA, 19 nt, Homo sapiens
gcaauaaaucacagccuuu

SEQ ID NO: 1567796 - RNA, 19 nt, Homo sapiens
caacaugggucaucuaccu

SEQ ID NO: 1567797 - RNA, 19 nt, Homo sapiens
gcagagaugaugcugaguu

SEQ ID NO: 1567798 - RNA, 19 nt, Homo sapiens
gagauuaguucagccuguu

SEQ ID NO: 1567799 - RNA, 19 nt, Homo sapiens
cauuaucccucuggcaaua

SEQ ID NO: 1567800 - RNA, 19 nt, Homo sapiens
gcuuacccaugcuuaaauu

SEQ ID NO: 1567801 - RNA, 19 nt, Homo sapiens
guggauacccucaguaaga

SEQ ID NO: 1567802 - RNA, 19 nt, Homo sapiens
cagagaugaugcugaguug

SEQ ID NO: 1567803 - RNA, 19 nt, Homo sapiens
aaaucagucuuguuacuug

SEQ ID NO: 1567804 - RNA, 19 nt, Homo sapiens
gcccuuauguccacuaaag

SEQ ID NO: 1567805 - RNA, 19 nt, Homo sapiens
acacugaacuuaacguuuu

SEQ ID NO: 1567806 - RNA, 19 nt, Homo sapiens
uagaagaugcagcugcuua

SEQ ID NO: 1567807 - RNA, 19 nt, Homo sapiens
ugaagagaaugaagaacug

SEQ ID NO: 1567808 - RNA, 19 nt, Homo sapiens
gaucaguguuacuuugcuu

SEQ ID NO: 1567809 - RNA, 19 nt, Homo sapiens
ggaguugcaucaugaaagc

SEQ ID NO: 1567810 - RNA, 19 nt, Homo sapiens
ugaauggugucugcaggua

SEQ ID NO: 1567811 - RNA, 19 nt, Homo sapiens
ccuuggaauuugcuauaua

SEQ ID NO: 1567812 - RNA, 19 nt, Homo sapiens
gaagcuuguuucuaugagu

SEQ ID NO: 1567813 - RNA, 19 nt, Homo sapiens
ucaucuaccuagcaguuaa

SEQ ID NO: 1567814 - RNA, 19 nt, Homo sapiens
ucagucuuguuacuugaua

SEQ ID NO: 1567815 - RNA, 19 nt, Homo sapiens
gcuuucaacccuuccauaa

SEQ ID NO: 1567816 - RNA, 19 nt, Homo sapiens
aagcuuguuucuaugagua

SEQ ID NO: 1567817 - RNA, 19 nt, Homo sapiens
agauagcgaugaagagaau

SEQ ID NO: 1567818 - RNA, 19 nt, Homo sapiens
guacaaguagugaagauag

SEQ ID NO: 1567819 - RNA, 19 nt, Homo sapiens
ugaaaucagcuaaguauac

SEQ ID NO: 1567820 - RNA, 19 nt, Homo sapiens
gauugcaaauaccucacua

SEQ ID NO: 1567821 - RNA, 19 nt, Homo sapiens
auacuuagguagcccuuau

SEQ ID NO: 1567822 - RNA, 19 nt, Homo sapiens
uaguaagucugcagagaug

SEQ ID NO: 1567823 - RNA, 19 nt, Homo sapiens
gaagagaaugaagaacuga

SEQ ID NO: 1567824 - RNA, 19 nt, Homo sapiens
guuaguaagucugcagaga

SEQ ID NO: 1567825 - RNA, 19 nt, Homo sapiens
uaguucagccuguuaguaa

SEQ ID NO: 1567826 - RNA, 19 nt, Homo sapiens
agaugcagcugcuuaaugg

SEQ ID NO: 1567827 - RNA, 19 nt, Homo sapiens
ccaaugaugaagcaaggua

SEQ ID NO: 1567828 - RNA, 19 nt, Homo sapiens
ggucaucuaccuagcaguu

SEQ ID NO: 1567829 - RNA, 19 nt, Homo sapiens
gcacagcaccaaagauugc

SEQ ID NO: 1567830 - RNA, 19 nt, Homo sapiens
guaaaugcuuauguuguag

SEQ ID NO: 1567831 - RNA, 19 nt, Homo sapiens
ugucagagcaggcuguaaa

SEQ ID NO: 1567832 - RNA, 19 nt, Homo sapiens
uaaauaggucuuacucauc

SEQ ID NO: 1567833 - RNA, 19 nt, Homo sapiens
uaaccucacaggcuagaaa

SEQ ID NO: 1567834 - RNA, 19 nt, Homo sapiens
gcuuaauggucuugacuag

SEQ ID NO: 1567835 - RNA, 19 nt, Homo sapiens
ucacagccuuuuccauaua

SEQ ID NO: 1567836 - RNA, 19 nt, Homo sapiens
ggaaaagcauucuucuaca

SEQ ID NO: 1567837 - RNA, 19 nt, Homo sapiens
uacccaugcuuaaauucua

SEQ ID NO: 1567838 - RNA, 19 nt, Homo sapiens
ugaguacuguggaaaauuu

SEQ ID NO: 1567839 - RNA, 19 nt, Homo sapiens
gguaagggguaauguuuug

SEQ ID NO: 1567840 - RNA, 19 nt, Homo sapiens
gcgaugaagagaaugaaga

SEQ ID NO: 1567841 - RNA, 19 nt, Homo sapiens
ucagggagccuuauaacuc

SEQ ID NO: 1567842 - RNA, 19 nt, Homo sapiens
ggugaauucaugauaguga

SEQ ID NO: 1567843 - RNA, 19 nt, Homo sapiens
ccaaguauagcuauuugug

SEQ ID NO: 1567844 - RNA, 19 nt, Homo sapiens
ccuaauaguucugaauucu

SEQ ID NO: 1567845 - RNA, 19 nt, Homo sapiens
ccuuauaacuccucuuaac

SEQ ID NO: 1567846 - RNA, 19 nt, Homo sapiens
auggugcgcuuagaaauuu

SEQ ID NO: 1567847 - RNA, 19 nt, Homo sapiens
uggcacagcaccaaagauu

SEQ ID NO: 1567848 - RNA, 19 nt, Homo sapiens
gccagggaguugcaucaug

SEQ ID NO: 1567849 - RNA, 19 nt, Homo sapiens
gaugcugaguugguuguga

SEQ ID NO: 1567850 - RNA, 19 nt, Homo sapiens
ccuagcaguuaaugaguau

SEQ ID NO: 1567851 - RNA, 19 nt, Homo sapiens
gugaagauagcgaugaaga

SEQ ID NO: 1567852 - RNA, 19 nt, Homo sapiens
uggcaugucuuacagugau

SEQ ID NO: 1567853 - RNA, 19 nt, Homo sapiens
gaagaugcagcugcuuaau

SEQ ID NO: 1567854 - RNA, 19 nt, Homo sapiens
uagugaagauagcgaugaa

SEQ ID NO: 1567855 - RNA, 19 nt, Homo sapiens
ugcuguaacuguaaaguau

SEQ ID NO: 1567856 - RNA, 19 nt, Homo sapiens
gaggacacuucaaaacaaa

SEQ ID NO: 1567857 - RNA, 19 nt, Homo sapiens
ccacagcccucugcauugc

SEQ ID NO: 1567858 - RNA, 19 nt, Homo sapiens
caauguggauacccucagu

SEQ ID NO: 1567859 - RNA, 19 nt, Homo sapiens
cauauuggcaugucuuaca

SEQ ID NO: 1567860 - RNA, 19 nt, Homo sapiens
gagaugaugcugaguuggu

SEQ ID NO: 1567861 - RNA, 19 nt, Homo sapiens
gaggacacuucaaaacaaa

SEQ ID NO: 1567862 - RNA, 19 nt, Homo sapiens
gcgggaagcaagcgccuuu

SEQ ID NO: 1567863 - RNA, 19 nt, Homo sapiens
caggugaauucaugauagu

SEQ ID NO: 1567864 - RNA, 19 nt, Homo sapiens
agauacggcugcaggugaa

SEQ ID NO: 1567865 - RNA, 19 nt, Homo sapiens
gaagcaagguaagggguaa

SEQ ID NO: 1567866 - RNA, 19 nt, Homo sapiens
gugcuguaacuguaaagua

SEQ ID NO: 1567867 - RNA, 19 nt, Homo sapiens
caccuaauaguucugaauu

SEQ ID NO: 1567868 - RNA, 19 nt, Homo sapiens
cgaugaagagaaugaagaa

SEQ ID NO: 1567869 - RNA, 19 nt, Homo sapiens
ccuuauguccacuaaagua

SEQ ID NO: 1567870 - RNA, 19 nt, Homo sapiens
ucaaggaacugaagaaaua

SEQ ID NO: 1567871 - RNA, 19 nt, Homo sapiens
gaaagccucucuccauaga

SEQ ID NO: 1567872 - RNA, 19 nt, Homo sapiens
aaagaaagcucacauacug

SEQ ID NO: 1567873 - RNA, 19 nt, Homo sapiens
gaaagaaacagaccaacaa

SEQ ID NO: 1567874 - RNA, 19 nt, Homo sapiens
gaggaaaguucauagaguu

SEQ ID NO: 1567875 - RNA, 19 nt, Homo sapiens
ggaaagcguuggcgaggaa

SEQ ID NO: 1567876 - RNA, 19 nt, Homo sapiens
agaauuaccuucaguacuu

SEQ ID NO: 1567877 - RNA, 19 nt, Homo sapiens
ccaccagugugacaaauaa

SEQ ID NO: 1567878 - RNA, 19 nt, Homo sapiens
ccaaugggauucaauaaag

SEQ ID NO: 1567879 - RNA, 19 nt, Homo sapiens
aaauaaaccuggacucuca

SEQ ID NO: 1567880 - RNA, 19 nt, Homo sapiens
caagugaguuccugugaau

SEQ ID NO: 1567881 - RNA, 19 nt, Homo sapiens
gacaugaaguugcuuggaa

SEQ ID NO: 1567882 - RNA, 19 nt, Homo sapiens
gagggaagaaucaagguua

SEQ ID NO: 1567883 - RNA, 19 nt, Homo sapiens
caaagcaggcagaagaaua

SEQ ID NO: 1567884 - RNA, 19 nt, Homo sapiens
gcaaacagacagccuaaau

SEQ ID NO: 1567885 - RNA, 19 nt, Homo sapiens
gcagguggcuuucucacau

SEQ ID NO: 1567886 - RNA, 19 nt, Homo sapiens
gaaguucgaaucacaauca

SEQ ID NO: 1567887 - RNA, 19 nt, Homo sapiens
gcagaugucuagcuuggau

SEQ ID NO: 1567888 - RNA, 19 nt, Homo sapiens
gaaucaagguuauguagac

SEQ ID NO: 1567889 - RNA, 19 nt, Homo sapiens
gaaguugcuuggaauugug

SEQ ID NO: 1567890 - RNA, 19 nt, Homo sapiens
gaagaaucaagguuaugua

SEQ ID NO: 1567891 - RNA, 19 nt, Homo sapiens
acaaugaaaucaagaugga

SEQ ID NO: 1567892 - RNA, 19 nt, Homo sapiens
guagacccauacagaauug

SEQ ID NO: 1567893 - RNA, 19 nt, Homo sapiens
gaaagaaagcucacauacu

SEQ ID NO: 1567894 - RNA, 19 nt, Homo sapiens
cuuuaaccgugaagaauua

SEQ ID NO: 1567895 - RNA, 19 nt, Homo sapiens
ggacauggagaaccuuuau

SEQ ID NO: 1567896 - RNA, 19 nt, Homo sapiens
cccaaaggcuaaugaaguu

SEQ ID NO: 1567897 - RNA, 19 nt, Homo sapiens
caaacagacagccuaaauu

SEQ ID NO: 1567898 - RNA, 19 nt, Homo sapiens
guuaaaugccuacaucaaa

SEQ ID NO: 1567899 - RNA, 19 nt, Homo sapiens
gaccaagcccucagucaaa

SEQ ID NO: 1567900 - RNA, 19 nt, Homo sapiens
ggaaagaaagcucacauac

SEQ ID NO: 1567901 - RNA, 19 nt, Homo sapiens
ggaaagaaacagaccaaca

SEQ ID NO: 1567902 - RNA, 19 nt, Homo sapiens
gcaggcagaagaauagaaa

SEQ ID NO: 1567903 - RNA, 19 nt, Homo sapiens
aaacagacagccuaaauuc

SEQ ID NO: 1567904 - RNA, 19 nt, Homo sapiens
ucaagcaacuagugccauu

SEQ ID NO: 1567905 - RNA, 19 nt, Homo sapiens
aaacaagaauuccaguaca

SEQ ID NO: 1567906 - RNA, 19 nt, Homo sapiens
caaugggauucaauaaaga

SEQ ID NO: 1567907 - RNA, 19 nt, Homo sapiens
gaguggagcugauccuaag

SEQ ID NO: 1567908 - RNA, 19 nt, Homo sapiens
gggaaagaaagcucacaua

SEQ ID NO: 1567909 - RNA, 19 nt, Homo sapiens
agaaacagaccaacaaguu

SEQ ID NO: 1567910 - RNA, 19 nt, Homo sapiens
ccagugaucuugggacaug

SEQ ID NO: 1567911 - RNA, 19 nt, Homo sapiens
gcagaagaauagaaauaac

SEQ ID NO: 1567912 - RNA, 19 nt, Homo sapiens
ggaaaguucauagaguuaa

SEQ ID NO: 1567913 - RNA, 19 nt, Homo sapiens
gaucuugggacaugaaguu

SEQ ID NO: 1567914 - RNA, 19 nt, Homo sapiens
gaagaaauaagaacacacu

SEQ ID NO: 1567915 - RNA, 19 nt, Homo sapiens
gguaagaggaaaguucaua

SEQ ID NO: 1567916 - RNA, 19 nt, Homo sapiens
ccaagugaguuccugugaa

SEQ ID NO: 1567917 - RNA, 19 nt, Homo sapiens
gggauucaauaaagagaga

SEQ ID NO: 1567918 - RNA, 19 nt, Homo sapiens
uaaugaaguucgaaucaca

SEQ ID NO: 1567919 - RNA, 19 nt, Homo sapiens
gauacacucccuauugcua

SEQ ID NO: 1567920 - RNA, 19 nt, Homo sapiens
ggcagaagaauagaaauaa

SEQ ID NO: 1567921 - RNA, 19 nt, Homo sapiens
aaaaugaacucccaaagga

SEQ ID NO: 1567922 - RNA, 19 nt, Homo sapiens
ggaagaaucaagguuaugu

SEQ ID NO: 1567923 - RNA, 19 nt, Homo sapiens
auacugcggugaccaggua

SEQ ID NO: 1567924 - RNA, 19 nt, Homo sapiens
uaaauucacaccucaagga

SEQ ID NO: 1567925 - RNA, 19 nt, Homo sapiens
ccagguaacucuguucaca

SEQ ID NO: 1567926 - RNA, 19 nt, Homo sapiens
uaaaccauuucuugcauca

SEQ ID NO: 1567927 - RNA, 19 nt, Homo sapiens
auucuuggguuaacaauga

SEQ ID NO: 1567928 - RNA, 19 nt, Homo sapiens
gucaaauacuaucuucuga

SEQ ID NO: 1567929 - RNA, 19 nt, Homo sapiens
ugaaguugcuuggaauugu

SEQ ID NO: 1567930 - RNA, 19 nt, Homo sapiens
gcuaaugaaguucgaauca

SEQ ID NO: 1567931 - RNA, 19 nt, Homo sapiens
ggaaagccucucuccauag

SEQ ID NO: 1567932 - RNA, 19 nt, Homo sapiens
ccucaaaacuaugcaaaua

SEQ ID NO: 1567933 - RNA, 19 nt, Homo sapiens
cuaacacacuuucauacug

SEQ ID NO: 1567934 - RNA, 19 nt, Homo sapiens
cagcugggcuccugagucu

SEQ ID NO: 1567935 - RNA, 19 nt, Homo sapiens
gccaaugggauucaauaaa

SEQ ID NO: 1567936 - RNA, 19 nt, Homo sapiens
ggauucagccaaugggauu

SEQ ID NO: 1567937 - RNA, 19 nt, Homo sapiens
gcgaggaaguuacuaagcu

SEQ ID NO: 1567938 - RNA, 19 nt, Homo sapiens
gaauuaccuucaguacuuc

SEQ ID NO: 1567939 - RNA, 19 nt, Homo sapiens
agaguuaaaugccuacauc

SEQ ID NO: 1567940 - RNA, 19 nt, Homo sapiens
gaacugaagaaauaagaac

SEQ ID NO: 1567941 - RNA, 19 nt, Homo sapiens
ugaaucacccgcuuugaga

SEQ ID NO: 1567942 - RNA, 19 nt, Homo sapiens
gguuaacaaugaaaucaag

SEQ ID NO: 1567943 - RNA, 19 nt, Homo sapiens
agaacacacuaaagccaaa

SEQ ID NO: 1567944 - RNA, 19 nt, Homo sapiens
agaggaaaguucauagagu

SEQ ID NO: 1567945 - RNA, 19 nt, Homo sapiens
gcuuuaaccgugaagaauu

SEQ ID NO: 1567946 - RNA, 19 nt, Homo sapiens
ggaacugaagaaauaagaa

SEQ ID NO: 1567947 - RNA, 19 nt, Homo sapiens
aaaggaagccucaaaacua

SEQ ID NO: 1567948 - RNA, 19 nt, Homo sapiens
ucagucaaauacuaucuuc

SEQ ID NO: 1567949 - RNA, 19 nt, Homo sapiens
gaaaacaagaauuccagua

SEQ ID NO: 1567950 - RNA, 19 nt, Homo sapiens
cagccaaugggauucaaua

SEQ ID NO: 1567951 - RNA, 19 nt, Homo sapiens
guggagagucgaagaauuc

SEQ ID NO: 1567952 - RNA, 19 nt, Homo sapiens
ggaaguuacuaagcugaag

SEQ ID NO: 1567953 - RNA, 19 nt, Homo sapiens
gaggaaagaaacagaccaa

SEQ ID NO: 1567954 - RNA, 19 nt, Homo sapiens
ccuggacucucagcaauga

SEQ ID NO: 1567955 - RNA, 19 nt, Homo sapiens
gaaucacuuucaagcagau

SEQ ID NO: 1567956 - RNA, 19 nt, Homo sapiens
uaagaggaaaguucauaga

SEQ ID NO: 1567957 - RNA, 19 nt, Homo sapiens
gcauccaauucucugcauu

SEQ ID NO: 1567958 - RNA, 19 nt, Homo sapiens
ggcagcagcauccaaguga

SEQ ID NO: 1567959 - RNA, 19 nt, Homo sapiens
aggcagaagaauagaaaua

SEQ ID NO: 1567960 - RNA, 19 nt, Homo sapiens
gaaucacccgcuuugagaa

SEQ ID NO: 1567961 - RNA, 19 nt, Homo sapiens
auauuaaaccucugggaua

SEQ ID NO: 1567962 - RNA, 19 nt, Homo sapiens
cagguggcuuucucacauu

SEQ ID NO: 1567963 - RNA, 19 nt, Homo sapiens
caaggaacugaagaaauaa

SEQ ID NO: 1567964 - RNA, 19 nt, Homo sapiens
ggagggaagaaucaagguu

SEQ ID NO: 1567965 - RNA, 19 nt, Homo sapiens
gcuaguuaacaaucucuuu

SEQ ID NO: 1567966 - RNA, 19 nt, Homo sapiens
gcaggcauuuggcagacau

SEQ ID NO: 1567967 - RNA, 19 nt, Homo sapiens
guaagaggaaaguucauag

SEQ ID NO: 1567968 - RNA, 19 nt, Homo sapiens
caaucucuuugacauauac

SEQ ID NO: 1567969 - RNA, 19 nt, Homo sapiens
ggacaugaaguugcuugga

SEQ ID NO: 1567970 - RNA, 19 nt, Homo sapiens
gaugcaaccucaagucuua

SEQ ID NO: 1567971 - RNA, 19 nt, Homo sapiens
ggaagaaacuccagacaca

SEQ ID NO: 1567972 - RNA, 19 nt, Homo sapiens
gcucacaccucuaauccua

SEQ ID NO: 1567973 - RNA, 19 nt, Homo sapiens
aacgguagcucuuugauua

SEQ ID NO: 1567974 - RNA, 19 nt, Homo sapiens
gcagugaacuaugaucaaa

SEQ ID NO: 1567975 - RNA, 19 nt, Homo sapiens
gugacaaacuguaaccaua

SEQ ID NO: 1567976 - RNA, 19 nt, Homo sapiens
ucacuuugcuuaccuguug

SEQ ID NO: 1567977 - RNA, 19 nt, Homo sapiens
caauaaauauccucaacug

SEQ ID NO: 1567978 - RNA, 19 nt, Homo sapiens
ggaagaaagacucauauuc

SEQ ID NO: 1567979 - RNA, 19 nt, Homo sapiens
cuaaacaucugaaggaaca

SEQ ID NO: 1567980 - RNA, 19 nt, Homo sapiens
ggagaaaggcaaagucaga

SEQ ID NO: 1567981 - RNA, 19 nt, Homo sapiens
gaagaugcguucacuuugc

SEQ ID NO: 1567982 - RNA, 19 nt, Homo sapiens
guagaacucucugaauuca

SEQ ID NO: 1567983 - RNA, 19 nt, Homo sapiens
ggaacaaacucuggacaca

SEQ ID NO: 1567984 - RNA, 19 nt, Homo sapiens
caaaugggcaucuaggaaa

SEQ ID NO: 1567985 - RNA, 19 nt, Homo sapiens
gcuaauagagcuaaacaga

SEQ ID NO: 1567986 - RNA, 19 nt, Homo sapiens
ccaaucagcucugugucua

SEQ ID NO: 1567987 - RNA, 19 nt, Homo sapiens
gaagaaagacucauauucc

SEQ ID NO: 1567988 - RNA, 19 nt, Homo sapiens
caaacuguaaccauacuua

SEQ ID NO: 1567989 - RNA, 19 nt, Homo sapiens
gaaccggagugacaaacug

SEQ ID NO: 1567990 - RNA, 19 nt, Homo sapiens
gcuagaggauuauaaaugc

SEQ ID NO: 1567991 - RNA, 19 nt, Homo sapiens
gaacuaacugaaagagauu

SEQ ID NO: 1567992 - RNA, 19 nt, Homo sapiens
ggaacaaacuccggacaca

SEQ ID NO: 1567993 - RNA, 19 nt, Homo sapiens
caaagccugugcaaaugaa

SEQ ID NO: 1567994 - RNA, 19 nt, Homo sapiens
gcaaagccugugcaaauga

SEQ ID NO: 1567995 - RNA, 19 nt, Homo sapiens
guccguggcuucauucuug

SEQ ID NO: 1567996 - RNA, 19 nt, Homo sapiens
gagggucuguggcuucauu

SEQ ID NO: 1567997 - RNA, 19 nt, Homo sapiens
caauuggaguugcugguuu

SEQ ID NO: 1567998 - RNA, 19 nt, Homo sapiens
gaacaguuucagucgauuu

SEQ ID NO: 1567999 - RNA, 19 nt, Homo sapiens
ugacaacgguagcucuuug

SEQ ID NO: 1568000 - RNA, 19 nt, Homo sapiens
gaggguccguggcuucauu

SEQ ID NO: 1568001 - RNA, 19 nt, Homo sapiens
agaacuaacugaaagagau

SEQ ID NO: 1568002 - RNA, 19 nt, Homo sapiens
ccagacacaucuaaacauc

SEQ ID NO: 1568003 - RNA, 19 nt, Homo sapiens
gcagucaaaugggcaucua

SEQ ID NO: 1568004 - RNA, 19 nt, Homo sapiens
aaagucagauggaggauag

SEQ ID NO: 1568005 - RNA, 19 nt, Homo sapiens
cuagagaacuaacugaaag

SEQ ID NO: 1568006 - RNA, 19 nt, Homo sapiens
cgauggagcugcagguugu

SEQ ID NO: 1568007 - RNA, 19 nt, Homo sapiens
ggaagaugcguucacuuug

SEQ ID NO: 1568008 - RNA, 19 nt, Homo sapiens
ccaaucagcacucuguaaa

SEQ ID NO: 1568009 - RNA, 19 nt, Homo sapiens
uaggaaacaugaccaagau

SEQ ID NO: 1568010 - RNA, 19 nt, Homo sapiens
ggcaaagccugugcaaaug

SEQ ID NO: 1568011 - RNA, 19 nt, Homo sapiens
caccuaagccacuccauaa

SEQ ID NO: 1568012 - RNA, 19 nt, Homo sapiens
uaauggaggccaccaauau

SEQ ID NO: 1568013 - RNA, 19 nt, Homo sapiens
gaaaccaaguaccuauuuu

SEQ ID NO: 1568014 - RNA, 19 nt, Homo sapiens
gggaagcaaagcagauuaa

SEQ ID NO: 1568015 - RNA, 19 nt, Homo sapiens
gaauacaauugagaaccaa

SEQ ID NO: 1568016 - RNA, 19 nt, Homo sapiens
agaacucucugaauucaau

SEQ ID NO: 1568017 - RNA, 19 nt, Homo sapiens
gggcacaccaccuuuaaga

SEQ ID NO: 1568018 - RNA, 19 nt, Homo sapiens
ggaccaaucagcaggaugu

SEQ ID NO: 1568019 - RNA, 19 nt, Homo sapiens
ccaaucagcacuccguaaa

SEQ ID NO: 1568020 - RNA, 19 nt, Homo sapiens
gcaccaaucagcacucugu

SEQ ID NO: 1568021 - RNA, 19 nt, Homo sapiens
gcaccaaucagcucugugu

SEQ ID NO: 1568022 - RNA, 19 nt, Homo sapiens
ugaaaccaaguaccuauuu

SEQ ID NO: 1568023 - RNA, 19 nt, Homo sapiens
cagaacaguuucagucgau

SEQ ID NO: 1568024 - RNA, 19 nt, Homo sapiens
caucuaaacaucugaagga

SEQ ID NO: 1568025 - RNA, 19 nt, Homo sapiens
gcugaagguuuguaaaugc

SEQ ID NO: 1568026 - RNA, 19 nt, Homo sapiens
ggaggaugcucucggaacu

SEQ ID NO: 1568027 - RNA, 19 nt, Homo sapiens
uggcaaagccugugcaaau

SEQ ID NO: 1568028 - RNA, 19 nt, Homo sapiens
uuguagaacucucugaauu

SEQ ID NO: 1568029 - RNA, 19 nt, Homo sapiens
gccucgaggugaugaauga

SEQ ID NO: 1568030 - RNA, 19 nt, Homo sapiens
ccucaacuguuaccuuugu

SEQ ID NO: 1568031 - RNA, 19 nt, Homo sapiens
gugcaaaugaaaccaagua

SEQ ID NO: 1568032 - RNA, 19 nt, Homo sapiens
cuacuaaugacagcuaaua

SEQ ID NO: 1568033 - RNA, 19 nt, Homo sapiens
ucuauuccuucacuacuaa

SEQ ID NO: 1568034 - RNA, 19 nt, Homo sapiens
cuaagccacuccauaaagu

SEQ ID NO: 1568035 - RNA, 19 nt, Homo sapiens
ccaccuaagccacuccaua

SEQ ID NO: 1568036 - RNA, 19 nt, Homo sapiens
ccucaacccugcccagugu

SEQ ID NO: 1568037 - RNA, 19 nt, Homo sapiens
gggaagaaagacucauauu

SEQ ID NO: 1568038 - RNA, 19 nt, Homo sapiens
agacacaucuaaacaucug

SEQ ID NO: 1568039 - RNA, 19 nt, Homo sapiens
gaucagugcuuuguaaaau

SEQ ID NO: 1568040 - RNA, 19 nt, Homo sapiens
gugucuagcugaagguuug

SEQ ID NO: 1568041 - RNA, 19 nt, Homo sapiens
gaacuugggagaggaagga

SEQ ID NO: 1568042 - RNA, 19 nt, Homo sapiens
ugaccaagaucugcauuag

SEQ ID NO: 1568043 - RNA, 19 nt, Homo sapiens
ugaugucugugcuuuaaug

SEQ ID NO: 1568044 - RNA, 19 nt, Homo sapiens
ccaccaauauugagaagac

SEQ ID NO: 1568045 - RNA, 19 nt, Homo sapiens
ggaagcaaagcagauuaaa

SEQ ID NO: 1568046 - RNA, 19 nt, Homo sapiens
ggaaacaugaccaagaucu

SEQ ID NO: 1568047 - RNA, 19 nt, Homo sapiens
gggcaucuaggaaacauga

SEQ ID NO: 1568048 - RNA, 19 nt, Homo sapiens
gaguuaaggcagucaaaug

SEQ ID NO: 1568049 - RNA, 19 nt, Homo sapiens
uauaagggaacuacgauga

SEQ ID NO: 1568050 - RNA, 19 nt, Homo sapiens
caacgguagcucuuugauu

SEQ ID NO: 1568051 - RNA, 19 nt, Homo sapiens
gaagucagggagaccaaga

SEQ ID NO: 1568052 - RNA, 19 nt, Homo sapiens
ccacagggaggaacaaaca

SEQ ID NO: 1568053 - RNA, 19 nt, Homo sapiens
ccuucacucuucaugauaa

SEQ ID NO: 1568054 - RNA, 19 nt, Homo sapiens
ucaaaugggcaucuaggaa

SEQ ID NO: 1568055 - RNA, 19 nt, Homo sapiens
gaggaaggagggaagagaa

SEQ ID NO: 1568056 - RNA, 19 nt, Homo sapiens
ucauauuccuccugagaug

SEQ ID NO: 1568057 - RNA, 19 nt, Homo sapiens
gguccgcacuaccuuuaug

SEQ ID NO: 1568058 - RNA, 19 nt, Homo sapiens
uugagucccuuuccacauu

SEQ ID NO: 1568059 - RNA, 19 nt, Homo sapiens
caaacgaguugcgcaccuu

SEQ ID NO: 1568060 - RNA, 19 nt, Homo sapiens
ggcaagagggacauacaaa

SEQ ID NO: 1568061 - RNA, 19 nt, Homo sapiens
aggaagaugcguucacuuu

SEQ ID NO: 1568062 - RNA, 19 nt, Homo sapiens
aggcugcagugaacuauga

SEQ ID NO: 1568063 - RNA, 19 nt, Homo sapiens
gcuggaggcugcagugaac

SEQ ID NO: 1568064 - RNA, 19 nt, Homo sapiens
gaacccaccggaaggaaca

SEQ ID NO: 1568065 - RNA, 19 nt, Homo sapiens
uuugaugucugugcuuuaa

SEQ ID NO: 1568066 - RNA, 19 nt, Homo sapiens
cuaaacagaauaccacaau

SEQ ID NO: 1568067 - RNA, 19 nt, Homo sapiens
ccaccaugauuguaagcuu

SEQ ID NO: 1568068 - RNA, 19 nt, Homo sapiens
uggaaccguuggauaagaa

SEQ ID NO: 1568069 - RNA, 19 nt, Homo sapiens
guaggaagaugcguucacu

SEQ ID NO: 1568070 - RNA, 19 nt, Homo sapiens
gcgaaaggguuaagaauga

SEQ ID NO: 1568071 - RNA, 19 nt, Homo sapiens
ugaacuagguuucuaauug

SEQ ID NO: 1568072 - RNA, 19 nt, Homo sapiens
gcacugguuuccugagaua

SEQ ID NO: 1568073 - RNA, 19 nt, Homo sapiens
cauagaccaucucaucuua

SEQ ID NO: 1568074 - RNA, 19 nt, Homo sapiens
gaacuagguuucuaauugg

SEQ ID NO: 1568075 - RNA, 19 nt, Homo sapiens
ccgaggagguuaauaauug

SEQ ID NO: 1568076 - RNA, 19 nt, Homo sapiens
gaaaagcaauuaacaguug

SEQ ID NO: 1568077 - RNA, 19 nt, Homo sapiens
gagaaacacugacaaaauu

SEQ ID NO: 1568078 - RNA, 19 nt, Homo sapiens
aggcagaccuguuuaguaa

SEQ ID NO: 1568079 - RNA, 19 nt, Homo sapiens
aaacaugugugguauacuu

SEQ ID NO: 1568080 - RNA, 19 nt, Homo sapiens
ugagauaaauggacaggaa

SEQ ID NO: 1568081 - RNA, 19 nt, Homo sapiens
ggccucagguuaacaguuu

SEQ ID NO: 1568082 - RNA, 19 nt, Homo sapiens
ugacguaucaggaaacaua

SEQ ID NO: 1568083 - RNA, 19 nt, Homo sapiens
gcagugacguaucaggaaa

SEQ ID NO: 1568084 - RNA, 19 nt, Homo sapiens
gaaguggguguucugaaua

SEQ ID NO: 1568085 - RNA, 19 nt, Homo sapiens
gaagaaauccauguucaga

SEQ ID NO: 1568086 - RNA, 19 nt, Homo sapiens
ucagaacuuucaaggauaa

SEQ ID NO: 1568087 - RNA, 19 nt, Homo sapiens
gcaagcggcucccaaaugc

SEQ ID NO: 1568088 - RNA, 19 nt, Homo sapiens
gaccaucucaucuuacuuu

SEQ ID NO: 1568089 - RNA, 19 nt, Homo sapiens
ggagguuaauaauuggaua

SEQ ID NO: 1568090 - RNA, 19 nt, Homo sapiens
ccucagaacuuucaaggau

SEQ ID NO: 1568091 - RNA, 19 nt, Homo sapiens
gcagagcagcaauauguaa

SEQ ID NO: 1568092 - RNA, 19 nt, Homo sapiens
guaaacgugguucuaauuu

SEQ ID NO: 1568093 - RNA, 19 nt, Homo sapiens
guucagauuuaucagauga

SEQ ID NO: 1568094 - RNA, 19 nt, Homo sapiens
gaaaggguuaagaaugaua

SEQ ID NO: 1568095 - RNA, 19 nt, Homo sapiens
ggucuguguucguuuguuu

SEQ ID NO: 1568096 - RNA, 19 nt, Homo sapiens
guuaacaguuucagucaga

SEQ ID NO: 1568097 - RNA, 19 nt, Homo sapiens
ugaaguggguguucugaau

SEQ ID NO: 1568098 - RNA, 19 nt, Homo sapiens
gagaggaccuaugaacuag

SEQ ID NO: 1568099 - RNA, 19 nt, Homo sapiens
gaccagaacccucccaguu

SEQ ID NO: 1568100 - RNA, 19 nt, Homo sapiens
augacuagcugccaguuua

SEQ ID NO: 1568101 - RNA, 19 nt, Homo sapiens
uaagagaaacacugacaaa

SEQ ID NO: 1568102 - RNA, 19 nt, Homo sapiens
ggaaaaggcagaccuguuu

SEQ ID NO: 1568103 - RNA, 19 nt, Homo sapiens
ugaccgaggagguuaauaa

SEQ ID NO: 1568104 - RNA, 19 nt, Homo sapiens
gguuaagaaugauaaggaa

SEQ ID NO: 1568105 - RNA, 19 nt, Homo sapiens
uaaccuguguguaaucuca

SEQ ID NO: 1568106 - RNA, 19 nt, Homo sapiens
gcuauaaagggccuaguuu

SEQ ID NO: 1568107 - RNA, 19 nt, Homo sapiens
aaggauaacuuccaaacau

SEQ ID NO: 1568108 - RNA, 19 nt, Homo sapiens
ugacaagacucaagcuuuu

SEQ ID NO: 1568109 - RNA, 19 nt, Homo sapiens
ggaauuucuuauuggaaug

SEQ ID NO: 1568110 - RNA, 19 nt, Homo sapiens
gauguuugauucuucagau

SEQ ID NO: 1568111 - RNA, 19 nt, Homo sapiens
gugcuacugcuacaaauaa

SEQ ID NO: 1568112 - RNA, 19 nt, Homo sapiens
gaaauacuuacgacuguuc

SEQ ID NO: 1568113 - RNA, 19 nt, Homo sapiens
agagaggaccuaugaacua

SEQ ID NO: 1568114 - RNA, 19 nt, Homo sapiens
aaauuuagcuuaccaugac

SEQ ID NO: 1568115 - RNA, 19 nt, Homo sapiens
ccaaacaugcaaaguagaa

SEQ ID NO: 1568116 - RNA, 19 nt, Homo sapiens
gcacccagcgaacuucaaa

SEQ ID NO: 1568117 - RNA, 19 nt, Homo sapiens
acacauagaccaucucauc

SEQ ID NO: 1568118 - RNA, 19 nt, Homo sapiens
gaauguaaacgugguucua

SEQ ID NO: 1568119 - RNA, 19 nt, Homo sapiens
cuacaaauaaggcaaguau

SEQ ID NO: 1568120 - RNA, 19 nt, Homo sapiens
gaacuuucaaggauaacuu

SEQ ID NO: 1568121 - RNA, 19 nt, Homo sapiens
ccacaaaaccacacacaua

SEQ ID NO: 1568122 - RNA, 19 nt, Homo sapiens
ugggaaggcugcacugguu

SEQ ID NO: 1568123 - RNA, 19 nt, Homo sapiens
ggccacucauagauaauaa

SEQ ID NO: 1568124 - RNA, 19 nt, Homo sapiens
ccuggccacucauagauaa

SEQ ID NO: 1568125 - RNA, 19 nt, Homo sapiens
ucucagggccucagguuaa

SEQ ID NO: 1568126 - RNA, 19 nt, Homo sapiens
ccagaacccucccaguuac

SEQ ID NO: 1568127 - RNA, 19 nt, Homo sapiens
gaaaugcaccacggacuuc

SEQ ID NO: 1568128 - RNA, 19 nt, Homo sapiens
gaaaucgggcuagcuggaa

SEQ ID NO: 1568129 - RNA, 19 nt, Homo sapiens
ccaugauccuugcaacuau

SEQ ID NO: 1568130 - RNA, 19 nt, Homo sapiens
gagcgaaaggguuaagaau

SEQ ID NO: 1568131 - RNA, 19 nt, Homo sapiens
ggagcgaaaggguuaagaa

SEQ ID NO: 1568132 - RNA, 19 nt, Homo sapiens
ccacacacauagaccaucu

SEQ ID NO: 1568133 - RNA, 19 nt, Homo sapiens
aggcaaguauaccuucuuu

SEQ ID NO: 1568134 - RNA, 19 nt, Homo sapiens
gauccucaccucagaacuu

SEQ ID NO: 1568135 - RNA, 19 nt, Homo sapiens
gaagugacccaugauccuu

SEQ ID NO: 1568136 - RNA, 19 nt, Homo sapiens
cuaaacaugugugguauac

SEQ ID NO: 1568137 - RNA, 19 nt, Homo sapiens
ugucuaaacauguguggua

SEQ ID NO: 1568138 - RNA, 19 nt, Homo sapiens
ggcagucagugcuaauuca

SEQ ID NO: 1568139 - RNA, 19 nt, Homo sapiens
uuacuaaccucuugaugac

SEQ ID NO: 1568140 - RNA, 19 nt, Homo sapiens
aaguggguguucugaauaa

SEQ ID NO: 1568141 - RNA, 19 nt, Homo sapiens
cuucaaggcaccaguguuu

SEQ ID NO: 1568142 - RNA, 19 nt, Homo sapiens
gaaaaggcagaccuguuua

SEQ ID NO: 1568143 - RNA, 19 nt, Homo sapiens
ggacccacauccucuacca

SEQ ID NO: 1568144 - RNA, 19 nt, Homo sapiens
ggguaucagugaccucaug

SEQ ID NO: 1568145 - RNA, 19 nt, Homo sapiens
auauguaaccuguguguaa

SEQ ID NO: 1568146 - RNA, 19 nt, Homo sapiens
gauuuggaagcuauaguaa

SEQ ID NO: 1568147 - RNA, 19 nt, Homo sapiens
acaaauaaggcaaguauac

SEQ ID NO: 1568148 - RNA, 19 nt, Homo sapiens
ggcaagcggcucccaaaug

SEQ ID NO: 1568149 - RNA, 19 nt, Homo sapiens
gaaacuaauacuguacaga

SEQ ID NO: 1568150 - RNA, 19 nt, Homo sapiens
caguuuauguggucugugu

SEQ ID NO: 1568151 - RNA, 19 nt, Homo sapiens
accagaacccucccaguua

SEQ ID NO: 1568152 - RNA, 19 nt, Homo sapiens
gcuaagagaaacacugaca

SEQ ID NO: 1568153 - RNA, 19 nt, Homo sapiens
agucagaagcuaagagaaa

SEQ ID NO: 1568154 - RNA, 19 nt, Homo sapiens
cguaucaggaaacauauuu

SEQ ID NO: 1568155 - RNA, 19 nt, Homo sapiens
ugaaauacuuacgacuguu

SEQ ID NO: 1568156 - RNA, 19 nt, Homo sapiens
uauguaaccuguguguaau

SEQ ID NO: 1568157 - RNA, 19 nt, Homo sapiens
cacaguggugguuuaguua

SEQ ID NO: 1568158 - RNA, 19 nt, Homo sapiens
gcauaugugugugacucuu

SEQ ID NO: 1568159 - RNA, 19 nt, Homo sapiens
cgaaaggguuaagaaugau

SEQ ID NO: 1568160 - RNA, 19 nt, Homo sapiens
agaaugauaaggaagaaga

SEQ ID NO: 1568161 - RNA, 19 nt, Homo sapiens
uggguguucugaauaaaga

SEQ ID NO: 1568162 - RNA, 19 nt, Homo sapiens
cucagaacuuucaaggaua

SEQ ID NO: 1568163 - RNA, 19 nt, Homo sapiens
auucagccauuaguaagua

SEQ ID NO: 1568164 - RNA, 19 nt, Homo sapiens
guagagaggaccuaugaac

SEQ ID NO: 1568165 - RNA, 19 nt, Homo sapiens
cuaauacuguacagagauc

SEQ ID NO: 1568166 - RNA, 19 nt, Homo sapiens
uuacgacuguucucuugau

SEQ ID NO: 1568167 - RNA, 19 nt, Homo sapiens
uugaaauacuuacgacugu

SEQ ID NO: 1568168 - RNA, 19 nt, Homo sapiens
ggguuaagaaugauaagga

SEQ ID NO: 1568169 - RNA, 19 nt, Homo sapiens
uguaaacgugguucuaauu

SEQ ID NO: 1568170 - RNA, 19 nt, Homo sapiens
gaacaaaucuccaaacuga

SEQ ID NO: 1568171 - RNA, 19 nt, Homo sapiens
gaaguuaccucuccuaaga

SEQ ID NO: 1568172 - RNA, 19 nt, Homo sapiens
gcagauaucuuaagcuaaa

SEQ ID NO: 1568173 - RNA, 19 nt, Homo sapiens
gaagaagccuuuaauccaa

SEQ ID NO: 1568174 - RNA, 19 nt, Homo sapiens
gaacacaagcugaagauaa

SEQ ID NO: 1568175 - RNA, 19 nt, Homo sapiens
gaagauaaccugaacauuc

SEQ ID NO: 1568176 - RNA, 19 nt, Homo sapiens
gaagacagcuacccuaaag

SEQ ID NO: 1568177 - RNA, 19 nt, Homo sapiens
ccaaauagccaagcucuua

SEQ ID NO: 1568178 - RNA, 19 nt, Homo sapiens
gaagcugggcauuaaauua

SEQ ID NO: 1568179 - RNA, 19 nt, Homo sapiens
gaaggaaacugaaagucau

SEQ ID NO: 1568180 - RNA, 19 nt, Homo sapiens
caaaugaaauugagaagag

SEQ ID NO: 1568181 - RNA, 19 nt, Homo sapiens
ucauaaaccuccagaaaga

SEQ ID NO: 1568182 - RNA, 19 nt, Homo sapiens
gaagaagcaucaagacagu

SEQ ID NO: 1568183 - RNA, 19 nt, Homo sapiens
aaagaguguuucagacuua

SEQ ID NO: 1568184 - RNA, 19 nt, Homo sapiens
gaaaauggauccucacuuc

SEQ ID NO: 1568185 - RNA, 19 nt, Homo sapiens
cuaaagcacuccaaggaaa

SEQ ID NO: 1568186 - RNA, 19 nt, Homo sapiens
gaacaucagcguaagcuau

SEQ ID NO: 1568187 - RNA, 19 nt, Homo sapiens
guaggaagcuaucauaaac

SEQ ID NO: 1568188 - RNA, 19 nt, Homo sapiens
cagcaaaacugucaccuua

SEQ ID NO: 1568189 - RNA, 19 nt, Homo sapiens
cagcagcuuucauccaaua

SEQ ID NO: 1568190 - RNA, 19 nt, Homo sapiens
gaacaugauccuagaacaa

SEQ ID NO: 1568191 - RNA, 19 nt, Homo sapiens
agaggaagcugggcauuaa

SEQ ID NO: 1568192 - RNA, 19 nt, Homo sapiens
gaacuacugaaacaaauga

SEQ ID NO: 1568193 - RNA, 19 nt, Homo sapiens
gaaauucacgguaguaugg

SEQ ID NO: 1568194 - RNA, 19 nt, Homo sapiens
acaugaaguugcaguauuu

SEQ ID NO: 1568195 - RNA, 19 nt, Homo sapiens
gagaagcagcacaguauaa

SEQ ID NO: 1568196 - RNA, 19 nt, Homo sapiens
gcaccaagaacuacugaaa

SEQ ID NO: 1568197 - RNA, 19 nt, Homo sapiens
aagaugagcuggaccaaau

SEQ ID NO: 1568198 - RNA, 19 nt, Homo sapiens
gaacaacuuccugguguaa

SEQ ID NO: 1568199 - RNA, 19 nt, Homo sapiens
agaugaagcuguaugcaaa

SEQ ID NO: 1568200 - RNA, 19 nt, Homo sapiens
guguaugcaugcuuuauaa

SEQ ID NO: 1568201 - RNA, 19 nt, Homo sapiens
uauguaauguccaucagua

SEQ ID NO: 1568202 - RNA, 19 nt, Homo sapiens
caagaacuacugaaacaaa

SEQ ID NO: 1568203 - RNA, 19 nt, Homo sapiens
gagaagcaacuagaauaua

SEQ ID NO: 1568204 - RNA, 19 nt, Homo sapiens
uagccaagcucuuauuuua

SEQ ID NO: 1568205 - RNA, 19 nt, Homo sapiens
guaauguccaucaguauaa

SEQ ID NO: 1568206 - RNA, 19 nt, Homo sapiens
uuagagcugugaaauguuu

SEQ ID NO: 1568207 - RNA, 19 nt, Homo sapiens
ccugguggguuccaaauaa

SEQ ID NO: 1568208 - RNA, 19 nt, Homo sapiens
ugaauugucuaaagugguu

SEQ ID NO: 1568209 - RNA, 19 nt, Homo sapiens
ucagaaagaucauuuagcu

SEQ ID NO: 1568210 - RNA, 19 nt, Homo sapiens
guaaccucaucuugucuua

SEQ ID NO: 1568211 - RNA, 19 nt, Homo sapiens
guucaaaacucaaagauga

SEQ ID NO: 1568212 - RNA, 19 nt, Homo sapiens
aaugugaacuagaguguuu

SEQ ID NO: 1568213 - RNA, 19 nt, Homo sapiens
gauccucacuucuucacuu

SEQ ID NO: 1568214 - RNA, 19 nt, Homo sapiens
ggagagaacacaagcugaa

SEQ ID NO: 1568215 - RNA, 19 nt, Homo sapiens
ucagugagaccuugaauug

SEQ ID NO: 1568216 - RNA, 19 nt, Homo sapiens
uaaugaacuuugucaguga

SEQ ID NO: 1568217 - RNA, 19 nt, Homo sapiens
gaaugguucucaacguaga

SEQ ID NO: 1568218 - RNA, 19 nt, Homo sapiens
uagagaagcaacuagaaua

SEQ ID NO: 1568219 - RNA, 19 nt, Homo sapiens
gaaccuauagcuacuuaau

SEQ ID NO: 1568220 - RNA, 19 nt, Homo sapiens
aauauagacugccgacauu

SEQ ID NO: 1568221 - RNA, 19 nt, Homo sapiens
cgaccaccuuggcaaauuu

SEQ ID NO: 1568222 - RNA, 19 nt, Homo sapiens
gaaugaaccaucucagaau

SEQ ID NO: 1568223 - RNA, 19 nt, Homo sapiens
gaagauaauggauucugaa

SEQ ID NO: 1568224 - RNA, 19 nt, Homo sapiens
gagcauggagcaccaagaa

SEQ ID NO: 1568225 - RNA, 19 nt, Homo sapiens
gaaugaaacaaaugagaga

SEQ ID NO: 1568226 - RNA, 19 nt, Homo sapiens
ccagaaagaguauuuguuc

SEQ ID NO: 1568227 - RNA, 19 nt, Homo sapiens
uaucauaaaccuccagaaa

SEQ ID NO: 1568228 - RNA, 19 nt, Homo sapiens
ugaagauaauggauucuga

SEQ ID NO: 1568229 - RNA, 19 nt, Homo sapiens
acaagaaaguauagaggaa

SEQ ID NO: 1568230 - RNA, 19 nt, Homo sapiens
gaccuugaauugucuaaag

SEQ ID NO: 1568231 - RNA, 19 nt, Homo sapiens
ccuaaaggaucaaagaaca

SEQ ID NO: 1568232 - RNA, 19 nt, Homo sapiens
caaaugaaggaaacugaaa

SEQ ID NO: 1568233 - RNA, 19 nt, Homo sapiens
cuucuucacuuggauauaa

SEQ ID NO: 1568234 - RNA, 19 nt, Homo sapiens
ggcauuaaauuaccucauc

SEQ ID NO: 1568235 - RNA, 19 nt, Homo sapiens
cauagaaugugaacuagag

SEQ ID NO: 1568236 - RNA, 19 nt, Homo sapiens
ccacauauccuucagaaac

SEQ ID NO: 1568237 - RNA, 19 nt, Homo sapiens
caacaucgugacccacaua

SEQ ID NO: 1568238 - RNA, 19 nt, Homo sapiens
aagaucagaugaagcugua

SEQ ID NO: 1568239 - RNA, 19 nt, Homo sapiens
uugcagauaucuuaagcua

SEQ ID NO: 1568240 - RNA, 19 nt, Homo sapiens
uaacgugacugagacuaga

SEQ ID NO: 1568241 - RNA, 19 nt, Homo sapiens
ugaaaagcuugaugucuua

SEQ ID NO: 1568242 - RNA, 19 nt, Homo sapiens
gcaacuagaauauacaaag

SEQ ID NO: 1568243 - RNA, 19 nt, Homo sapiens
gagaaugaaacaaaugaga

SEQ ID NO: 1568244 - RNA, 19 nt, Homo sapiens
cagagaagcagcacaguau

SEQ ID NO: 1568245 - RNA, 19 nt, Homo sapiens
gaguauuuguucccucauu

SEQ ID NO: 1568246 - RNA, 19 nt, Homo sapiens
gcaaaacugucaccuuaau

SEQ ID NO: 1568247 - RNA, 19 nt, Homo sapiens
aagauaaccugaacauucu

SEQ ID NO: 1568248 - RNA, 19 nt, Homo sapiens
gcagaaauucacgguagua

SEQ ID NO: 1568249 - RNA, 19 nt, Homo sapiens
ugaaacaaaugaaggaaac

SEQ ID NO: 1568250 - RNA, 19 nt, Homo sapiens
caacaggcccagcuucaga

SEQ ID NO: 1568251 - RNA, 19 nt, Homo sapiens
agaagcaacuagaauauac

SEQ ID NO: 1568252 - RNA, 19 nt, Homo sapiens
ggaaauuaaaggagaacaa

SEQ ID NO: 1568253 - RNA, 19 nt, Homo sapiens
aagaagaacaucagcguaa

SEQ ID NO: 1568254 - RNA, 19 nt, Homo sapiens
gaggacaagauuaaacauu

SEQ ID NO: 1568255 - RNA, 19 nt, Homo sapiens
aaugaaccaucucagaauu

SEQ ID NO: 1568256 - RNA, 19 nt, Homo sapiens
caauacgaguucauaaucu

SEQ ID NO: 1568257 - RNA, 19 nt, Homo sapiens
gaauauacaaagagaaugg

SEQ ID NO: 1568258 - RNA, 19 nt, Homo sapiens
ggaagcugggcauuaaauu

SEQ ID NO: 1568259 - RNA, 19 nt, Homo sapiens
guccaucaguauaaauuga

SEQ ID NO: 1568260 - RNA, 19 nt, Homo sapiens
uaaauccaagcuacaagua

SEQ ID NO: 1568261 - RNA, 19 nt, Homo sapiens
cagcuacccuaaaggauca

SEQ ID NO: 1568262 - RNA, 19 nt, Homo sapiens
aaagcuugaugucuuagaa

SEQ ID NO: 1568263 - RNA, 19 nt, Homo sapiens
acgguaguaugguauauuu

SEQ ID NO: 1568264 - RNA, 19 nt, Homo sapiens
guggugcccucccucaauu

SEQ ID NO: 1568265 - RNA, 19 nt, Homo sapiens
ugaaggaaacugaaaguca

SEQ ID NO: 1568266 - RNA, 19 nt, Homo sapiens
ccagagaagcagcacagua

SEQ ID NO: 1568267 - RNA, 19 nt, Homo sapiens
ugaacauucuuuccagaga

SEQ ID NO: 1568268 - RNA, 19 nt, Homo sapiens
guuuagagcuggagagaac

SEQ ID NO: 1568269 - RNA, 19 nt, Homo sapiens
ugaagaagccuuuaaucca

SEQ ID NO: 1568270 - RNA, 19 nt, Homo sapiens
guacacagcuccagaaaga

SEQ ID NO: 1568271 - RNA, 19 nt, Homo sapiens
gcagauggcuugagugcua

SEQ ID NO: 1568272 - RNA, 19 nt, Homo sapiens
caagggagcuguccugcua

SEQ ID NO: 1568273 - RNA, 19 nt, Homo sapiens
gcaaacaacuuauuuccau

SEQ ID NO: 1568274 - RNA, 19 nt, Homo sapiens
ccacuaaucuacuuucugu

SEQ ID NO: 1568275 - RNA, 19 nt, Homo sapiens
guagacagauauucuccua

SEQ ID NO: 1568276 - RNA, 19 nt, Homo sapiens
caaaggaagccauucuuaa

SEQ ID NO: 1568277 - RNA, 19 nt, Homo sapiens
gaaccaggaugacuacuac

SEQ ID NO: 1568278 - RNA, 19 nt, Homo sapiens
caucaucacuaccuaauuc

SEQ ID NO: 1568279 - RNA, 19 nt, Homo sapiens
ucucugagguggaugauaa

SEQ ID NO: 1568280 - RNA, 19 nt, Homo sapiens
caacuuauuuccaucaaca

SEQ ID NO: 1568281 - RNA, 19 nt, Homo sapiens
gacaauagcaauacauuug

SEQ ID NO: 1568282 - RNA, 19 nt, Homo sapiens
gccauuacauugagaaaga

SEQ ID NO: 1568283 - RNA, 19 nt, Homo sapiens
caauggacccucugccuua

SEQ ID NO: 1568284 - RNA, 19 nt, Homo sapiens
acacuuagcucggcucuau

SEQ ID NO: 1568285 - RNA, 19 nt, Homo sapiens
gaggaagccuugagugauc

SEQ ID NO: 1568286 - RNA, 19 nt, Homo sapiens
ggacaauagcaauacauuu

SEQ ID NO: 1568287 - RNA, 19 nt, Homo sapiens
gauuugcugugcuguauga

SEQ ID NO: 1568288 - RNA, 19 nt, Homo sapiens
uagcucggcucuauaaaga

SEQ ID NO: 1568289 - RNA, 19 nt, Homo sapiens
caaacaaacaaacaccaua

SEQ ID NO: 1568290 - RNA, 19 nt, Homo sapiens
gaaacaaggccaagacucu

SEQ ID NO: 1568291 - RNA, 19 nt, Homo sapiens
ccagccaccuccuguguuu

SEQ ID NO: 1568292 - RNA, 19 nt, Homo sapiens
gccagcuucuugacaguua

SEQ ID NO: 1568293 - RNA, 19 nt, Homo sapiens
ucugaggccuguucacuuu

SEQ ID NO: 1568294 - RNA, 19 nt, Homo sapiens
acaaaggaagccauucuua

SEQ ID NO: 1568295 - RNA, 19 nt, Homo sapiens
ccugaggccugguacagua

SEQ ID NO: 1568296 - RNA, 19 nt, Homo sapiens
gcucacaccuguaaucacu

SEQ ID NO: 1568297 - RNA, 19 nt, Homo sapiens
gcucggcucuauaaagaau

SEQ ID NO: 1568298 - RNA, 19 nt, Homo sapiens
gguggaugauaaccaaauu

SEQ ID NO: 1568299 - RNA, 19 nt, Homo sapiens
ccaaagcccuagagcaucu

SEQ ID NO: 1568300 - RNA, 19 nt, Homo sapiens
caaccaucaucacuaccua

SEQ ID NO: 1568301 - RNA, 19 nt, Homo sapiens
uugaagaguuccaucugua

SEQ ID NO: 1568302 - RNA, 19 nt, Homo sapiens
gagaggaucaucuggacaa

SEQ ID NO: 1568303 - RNA, 19 nt, Homo sapiens
aagaaacguuguacccauu

SEQ ID NO: 1568304 - RNA, 19 nt, Homo sapiens
uguaaucacugcacuccaa

SEQ ID NO: 1568305 - RNA, 19 nt, Homo sapiens
gaaucaauguaugaccaaa

SEQ ID NO: 1568306 - RNA, 19 nt, Homo sapiens
ugagguggaugauaaccaa

SEQ ID NO: 1568307 - RNA, 19 nt, Homo sapiens
caauagcaauacauuugga

SEQ ID NO: 1568308 - RNA, 19 nt, Homo sapiens
gaaacguuguacccauuag

SEQ ID NO: 1568309 - RNA, 19 nt, Homo sapiens
ucucuuuccuaucucuuua

SEQ ID NO: 1568310 - RNA, 19 nt, Homo sapiens
cagcagguguacuucuauu

SEQ ID NO: 1568311 - RNA, 19 nt, Homo sapiens
cagauuugcugugcuguau

SEQ ID NO: 1568312 - RNA, 19 nt, Homo sapiens
ggagcuguccugcuaaugu

SEQ ID NO: 1568313 - RNA, 19 nt, Homo sapiens
cauuagcaguuacuuacuu

SEQ ID NO: 1568314 - RNA, 19 nt, Homo sapiens
gagcuguccugcuaauguc

SEQ ID NO: 1568315 - RNA, 19 nt, Homo sapiens
ccaaacuucuggaacucuu

SEQ ID NO: 1568316 - RNA, 19 nt, Homo sapiens
caucuggacaauagcaaua

SEQ ID NO: 1568317 - RNA, 19 nt, Homo sapiens
aggaucaucuggacaauag

SEQ ID NO: 1568318 - RNA, 19 nt, Homo sapiens
gaaagaaaggggucacaaa

SEQ ID NO: 1568319 - RNA, 19 nt, Homo sapiens
ccacagcguccaauucaug

SEQ ID NO: 1568320 - RNA, 19 nt, Homo sapiens
caaccuggcaacagaguga

SEQ ID NO: 1568321 - RNA, 19 nt, Homo sapiens
augccaagcugcucagaaa

SEQ ID NO: 1568322 - RNA, 19 nt, Homo sapiens
agacagauauucuccuacu

SEQ ID NO: 1568323 - RNA, 19 nt, Homo sapiens
agauaggccugcuggcauu

SEQ ID NO: 1568324 - RNA, 19 nt, Homo sapiens
augcagauguggacagauu

SEQ ID NO: 1568325 - RNA, 19 nt, Homo sapiens
gugcaaccaucaucacuac

SEQ ID NO: 1568326 - RNA, 19 nt, Homo sapiens
ggagauggguuuugaagag

SEQ ID NO: 1568327 - RNA, 19 nt, Homo sapiens
gaguauguccagaggcuuu

SEQ ID NO: 1568328 - RNA, 19 nt, Homo sapiens
gcagauguggacagauuug

SEQ ID NO: 1568329 - RNA, 19 nt, Homo sapiens
aaaggaagccauucuuaag

SEQ ID NO: 1568330 - RNA, 19 nt, Homo sapiens
ggacuuccccuuaauauag

SEQ ID NO: 1568331 - RNA, 19 nt, Homo sapiens
gaggaucaucuggacaaua

SEQ ID NO: 1568332 - RNA, 19 nt, Homo sapiens
gcucuugucuuagccaucu

SEQ ID NO: 1568333 - RNA, 19 nt, Homo sapiens
ugaggccuguucacuuuga

SEQ ID NO: 1568334 - RNA, 19 nt, Homo sapiens
gaagaguuccaucuguauc

SEQ ID NO: 1568335 - RNA, 19 nt, Homo sapiens
guggucggguagacagaua

SEQ ID NO: 1568336 - RNA, 19 nt, Homo sapiens
cuaaucuacuuucuguuuc

SEQ ID NO: 1568337 - RNA, 19 nt, Homo sapiens
uccuacugcucuugucuua

SEQ ID NO: 1568338 - RNA, 19 nt, Homo sapiens
ggacaguggucggguagac

SEQ ID NO: 1568339 - RNA, 19 nt, Homo sapiens
gccaccggcugauagaaau

SEQ ID NO: 1568340 - RNA, 19 nt, Homo sapiens
agaaacguuguacccauua

SEQ ID NO: 1568341 - RNA, 19 nt, Homo sapiens
ucauuaaggccuaccaaga

SEQ ID NO: 1568342 - RNA, 19 nt, Homo sapiens
acuccaaccuggcaacaga

SEQ ID NO: 1568343 - RNA, 19 nt, Homo sapiens
cagccugcaugacagagaa

SEQ ID NO: 1568344 - RNA, 19 nt, Homo sapiens
aaagaucuguuuucagcua

SEQ ID NO: 1568345 - RNA, 19 nt, Homo sapiens
uaccuuagcacaagugaug

SEQ ID NO: 1568346 - RNA, 19 nt, Homo sapiens
gcaaccacuaaucuacuuu

SEQ ID NO: 1568347 - RNA, 19 nt, Homo sapiens
uuucuuccuuuccuuguuu

SEQ ID NO: 1568348 - RNA, 19 nt, Homo sapiens
gcacagaagcuggcugcau

SEQ ID NO: 1568349 - RNA, 19 nt, Homo sapiens
uccagcagguguacuucua

SEQ ID NO: 1568350 - RNA, 19 nt, Homo sapiens
ccaccuccuguguuuauaa

SEQ ID NO: 1568351 - RNA, 19 nt, Homo sapiens
gugcugcucuuggagaugu

SEQ ID NO: 1568352 - RNA, 19 nt, Homo sapiens
gaacgucagcgggaguaug

SEQ ID NO: 1568353 - RNA, 19 nt, Homo sapiens
cuacugcucuugucuuagc

SEQ ID NO: 1568354 - RNA, 19 nt, Homo sapiens
aagcagcucuucuggaaaa

SEQ ID NO: 1568355 - RNA, 19 nt, Homo sapiens
gugcuaaucagcucaaugg

SEQ ID NO: 1568356 - RNA, 19 nt, Homo sapiens
caucaccuccaccagcuaa

SEQ ID NO: 1568357 - RNA, 19 nt, Homo sapiens
cagauggcuugagugcuaa

SEQ ID NO: 1568358 - RNA, 19 nt, Homo sapiens
ggagaaccaggaugacuac

SEQ ID NO: 1568359 - RNA, 19 nt, Homo sapiens
ucauggaguucucggaagu

SEQ ID NO: 1568360 - RNA, 19 nt, Homo sapiens
ccaugcagauguggacaga

SEQ ID NO: 1568361 - RNA, 19 nt, Homo sapiens
ccauuacauugagaaagaa

SEQ ID NO: 1568362 - RNA, 19 nt, Homo sapiens
ccuacuuucucuuuccuau

SEQ ID NO: 1568363 - RNA, 19 nt, Homo sapiens
ugaagaguuccaucuguau

SEQ ID NO: 1568364 - RNA, 19 nt, Homo sapiens
ggaaguggagaaccaggau

SEQ ID NO: 1568365 - RNA, 19 nt, Homo sapiens
agaaaggggucacaaagug

SEQ ID NO: 1568366 - RNA, 19 nt, Homo sapiens
acgcaggcuugaaggauga

SEQ ID NO: 1568367 - RNA, 19 nt, Homo sapiens
cucuuuaucuuccuuacuu

SEQ ID NO: 1568368 - RNA, 19 nt, Homo sapiens
uggagaaccaggaugacua

SEQ ID NO: 1568369 - RNA, 19 nt, Homo sapiens
gaccagccaccuccugugu

SEQ ID NO: 1568370 - RNA, 19 nt, Homo sapiens
gaacagaagugcuuaaaca

SEQ ID NO: 1568371 - RNA, 19 nt, Homo sapiens
gcaagcaacuccuuaucua

SEQ ID NO: 1568372 - RNA, 19 nt, Homo sapiens
cugagaaucugaagaauaa

SEQ ID NO: 1568373 - RNA, 19 nt, Homo sapiens
gcauaagacuacauuacaa

SEQ ID NO: 1568374 - RNA, 19 nt, Homo sapiens
gaauaaucauccauccaaa

SEQ ID NO: 1568375 - RNA, 19 nt, Homo sapiens
cagaauggcuggauacaag

SEQ ID NO: 1568376 - RNA, 19 nt, Homo sapiens
gaaagaccaauacauaugu

SEQ ID NO: 1568377 - RNA, 19 nt, Homo sapiens
gggauauaguugacauuaa

SEQ ID NO: 1568378 - RNA, 19 nt, Homo sapiens
gaauuugcauggcaucaau

SEQ ID NO: 1568379 - RNA, 19 nt, Homo sapiens
gauuuaugguccaacauuu

SEQ ID NO: 1568380 - RNA, 19 nt, Homo sapiens
caagcaugauuucguguuu

SEQ ID NO: 1568381 - RNA, 19 nt, Homo sapiens
gaauauucuuccucuguga

SEQ ID NO: 1568382 - RNA, 19 nt, Homo sapiens
gauaauggagagucgauuu

SEQ ID NO: 1568383 - RNA, 19 nt, Homo sapiens
uaagagacaccaagcauga

SEQ ID NO: 1568384 - RNA, 19 nt, Homo sapiens
gaucagcuguuuguggauu

SEQ ID NO: 1568385 - RNA, 19 nt, Homo sapiens
gcugagaaucugaagaaua

SEQ ID NO: 1568386 - RNA, 19 nt, Homo sapiens
aaucauccauccaaauuug

SEQ ID NO: 1568387 - RNA, 19 nt, Homo sapiens
aaugaaaccugggaauauu

SEQ ID NO: 1568388 - RNA, 19 nt, Homo sapiens
caacgggucacaauucuau

SEQ ID NO: 1568389 - RNA, 19 nt, Homo sapiens
gcuauacugugaugugugu

SEQ ID NO: 1568390 - RNA, 19 nt, Homo sapiens
ggacauuuguauugauucu

SEQ ID NO: 1568391 - RNA, 19 nt, Homo sapiens
gaaggaacagaagugcuua

SEQ ID NO: 1568392 - RNA, 19 nt, Homo sapiens
gaagauccuauauuaguuc

SEQ ID NO: 1568393 - RNA, 19 nt, Homo sapiens
cagaagugcuuaaacaacu

SEQ ID NO: 1568394 - RNA, 19 nt, Homo sapiens
ugaaagaccaauacauaug

SEQ ID NO: 1568395 - RNA, 19 nt, Homo sapiens
gggauauaguguauggaaa

SEQ ID NO: 1568396 - RNA, 19 nt, Homo sapiens
gcaacugauugaaggaaca

SEQ ID NO: 1568397 - RNA, 19 nt, Homo sapiens
caacguggcauaagacuac

SEQ ID NO: 1568398 - RNA, 19 nt, Homo sapiens
gagcuauacugugaugugu

SEQ ID NO: 1568399 - RNA, 19 nt, Homo sapiens
guccaacauuugaagauga

SEQ ID NO: 1568400 - RNA, 19 nt, Homo sapiens
agaagugcuuaaacaacua

SEQ ID NO: 1568401 - RNA, 19 nt, Homo sapiens
gguccaacauuugaagaug

SEQ ID NO: 1568402 - RNA, 19 nt, Homo sapiens
gaaugaaagaccaauacau

SEQ ID NO: 1568403 - RNA, 19 nt, Homo sapiens
gaauuaguuccaacacaga

SEQ ID NO: 1568404 - RNA, 19 nt, Homo sapiens
ggcauaagacuacauuaca

SEQ ID NO: 1568405 - RNA, 19 nt, Homo sapiens
agaauaaucauccauccaa

SEQ ID NO: 1568406 - RNA, 19 nt, Homo sapiens
cagcaacgggucacaauuc

SEQ ID NO: 1568407 - RNA, 19 nt, Homo sapiens
gagacaccaagcaugauuu

SEQ ID NO: 1568408 - RNA, 19 nt, Homo sapiens
aaaugaaaccugggaauau

SEQ ID NO: 1568409 - RNA, 19 nt, Homo sapiens
gagaaucugaagaauaauc

SEQ ID NO: 1568410 - RNA, 19 nt, Homo sapiens
ugaaggaacagaagugcuu

SEQ ID NO: 1568411 - RNA, 19 nt, Homo sapiens
auuaaacccucugcacuuu

SEQ ID NO: 1568412 - RNA, 19 nt, Homo sapiens
ucagcuguuuguggauuua

SEQ ID NO: 1568413 - RNA, 19 nt, Homo sapiens
aaagaggaguacuuggaau

SEQ ID NO: 1568414 - RNA, 19 nt, Homo sapiens
uagaauuaguuccaacaca

SEQ ID NO: 1568415 - RNA, 19 nt, Homo sapiens
gggucacaauucuauauca

SEQ ID NO: 1568416 - RNA, 19 nt, Homo sapiens
ccgcugagaaucugaagaa

SEQ ID NO: 1568417 - RNA, 19 nt, Homo sapiens
auaauggagagucgauuua

SEQ ID NO: 1568418 - RNA, 19 nt, Homo sapiens
cuuccucugugauuucuuu

SEQ ID NO: 1568419 - RNA, 19 nt, Homo sapiens
gcaacgggucacaauucua

SEQ ID NO: 1568420 - RNA, 19 nt, Homo sapiens
caucgaauaguacagaaug

SEQ ID NO: 1568421 - RNA, 19 nt, Homo sapiens
uaucugaucagcuguuugu

SEQ ID NO: 1568422 - RNA, 19 nt, Homo sapiens
uggagauccuuaugcuuga

SEQ ID NO: 1568423 - RNA, 19 nt, Homo sapiens
cauuaaacccucugcacuu

SEQ ID NO: 1568424 - RNA, 19 nt, Homo sapiens
aaagaccaauacauaugug

SEQ ID NO: 1568425 - RNA, 19 nt, Homo sapiens
aagcaacuccuuaucuaga

SEQ ID NO: 1568426 - RNA, 19 nt, Homo sapiens
aucaauaucuacaggagaa

SEQ ID NO: 1568427 - RNA, 19 nt, Homo sapiens
cgauuuaugguccaacauu

SEQ ID NO: 1568428 - RNA, 19 nt, Homo sapiens
ugggauauaguugacauua

SEQ ID NO: 1568429 - RNA, 19 nt, Homo sapiens
guacagaauggcuggauac

SEQ ID NO: 1568430 - RNA, 19 nt, Homo sapiens
ugcauggcaucaauaucua

SEQ ID NO: 1568431 - RNA, 19 nt, Homo sapiens
ggagauccuuaugcuugau

SEQ ID NO: 1568432 - RNA, 19 nt, Homo sapiens
aauggagagucgauuuaug

SEQ ID NO: 1568433 - RNA, 19 nt, Homo sapiens
ggauauaguguauggaaaa

SEQ ID NO: 1568434 - RNA, 19 nt, Homo sapiens
guuucugggugaugcauug

SEQ ID NO: 1568435 - RNA, 19 nt, Homo sapiens
uccaacauuugaagaugaa

SEQ ID NO: 1568436 - RNA, 19 nt, Homo sapiens
aguacagaauggcuggaua

SEQ ID NO: 1568437 - RNA, 19 nt, Homo sapiens
cagaaugaaagaccaauac

SEQ ID NO: 1568438 - RNA, 19 nt, Homo sapiens
acagaaugaaagaccaaua

SEQ ID NO: 1568439 - RNA, 19 nt, Homo sapiens
gugcuuaaacaacuagaau

SEQ ID NO: 1568440 - RNA, 19 nt, Homo sapiens
caagcaacuccuuaucuag

SEQ ID NO: 1568441 - RNA, 19 nt, Homo sapiens
uaauggagagucgauuuau

SEQ ID NO: 1568442 - RNA, 19 nt, Homo sapiens
gcuguuuguggauuuaauu

SEQ ID NO: 1568443 - RNA, 19 nt, Homo sapiens
gaagugcuuaaacaacuag

SEQ ID NO: 1568444 - RNA, 19 nt, Homo sapiens
gauugaaggaacagaagug

SEQ ID NO: 1568445 - RNA, 19 nt, Homo sapiens
ggucacaauucuauaucac

SEQ ID NO: 1568446 - RNA, 19 nt, Homo sapiens
gagauaauggagagucgau

SEQ ID NO: 1568447 - RNA, 19 nt, Homo sapiens
cgaggugugggauauaguu

SEQ ID NO: 1568448 - RNA, 19 nt, Homo sapiens
gagauccuuaugcuugauu

SEQ ID NO: 1568449 - RNA, 19 nt, Homo sapiens
guuccaacacagaaugaaa

SEQ ID NO: 1568450 - RNA, 19 nt, Homo sapiens
ggaacagaagugcuuaaac

SEQ ID NO: 1568451 - RNA, 19 nt, Homo sapiens
acaaaggccgucacagcaa

SEQ ID NO: 1568452 - RNA, 19 nt, Homo sapiens
uaaaagaggaguacuugga

SEQ ID NO: 1568453 - RNA, 19 nt, Homo sapiens
ugacaguggagauccuuau

SEQ ID NO: 1568454 - RNA, 19 nt, Homo sapiens
gaauggcuggauacaagga

SEQ ID NO: 1568455 - RNA, 19 nt, Homo sapiens
uguauugauucuucuccaa

SEQ ID NO: 1568456 - RNA, 19 nt, Homo sapiens
agagacaccaagcaugauu

SEQ ID NO: 1568457 - RNA, 19 nt, Homo sapiens
cuauauuaguuccucuuca

SEQ ID NO: 1568458 - RNA, 19 nt, Homo sapiens
ccaagcaugauuucguguu

SEQ ID NO: 1568459 - RNA, 19 nt, Homo sapiens
aaaaugaaaccugggaaua

SEQ ID NO: 1568460 - RNA, 19 nt, Homo sapiens
gcauuggaucugcagaaau

SEQ ID NO: 1568461 - RNA, 19 nt, Homo sapiens
uguaucugaucagcuguuu

SEQ ID NO: 1568462 - RNA, 19 nt, Homo sapiens
gacaguggagauccuuaug

SEQ ID NO: 1568463 - RNA, 19 nt, Homo sapiens
cacgaggugugggauauag

SEQ ID NO: 1568464 - RNA, 19 nt, Homo sapiens
caguggagauccuuaugcu

SEQ ID NO: 1568465 - RNA, 19 nt, Homo sapiens
gggcaacugauugaaggaa

SEQ ID NO: 1568466 - RNA, 19 nt, Homo sapiens
uauaucacacugcaagcaa

SEQ ID NO: 1568467 - RNA, 19 nt, Homo sapiens
gaggggauauaguguaugg

SEQ ID NO: 1568468 - RNA, 19 nt, Homo sapiens
uugcauggcaucaauaucu

SEQ ID NO: 1568469 - RNA, 19 nt, Homo sapiens
gaggugugggauauaguug

SEQ ID NO: 1568470 - RNA, 19 nt, Homo sapiens
ggacauggcuucaguagga

SEQ ID NO: 1568471 - RNA, 19 nt, Homo sapiens
gaucagaccuuugucauuu

SEQ ID NO: 1568472 - RNA, 19 nt, Homo sapiens
caauauagcugcacuaauc

SEQ ID NO: 1568473 - RNA, 19 nt, Homo sapiens
gaagugaaaugacacaaga

SEQ ID NO: 1568474 - RNA, 19 nt, Homo sapiens
guagguaacucaaagauau

SEQ ID NO: 1568475 - RNA, 19 nt, Homo sapiens
acacugagcuucuuucauu

SEQ ID NO: 1568476 - RNA, 19 nt, Homo sapiens
guaaguaugugguaaguau

SEQ ID NO: 1568477 - RNA, 19 nt, Homo sapiens
gaagaucucuguaccucaa

SEQ ID NO: 1568478 - RNA, 19 nt, Homo sapiens
gcauggaguuuauacaauu

SEQ ID NO: 1568479 - RNA, 19 nt, Homo sapiens
gaaaguagguuggcaugga

SEQ ID NO: 1568480 - RNA, 19 nt, Homo sapiens
gcagaaagcaggaaagaga

SEQ ID NO: 1568481 - RNA, 19 nt, Homo sapiens
cuguuuagcucauuacuua

SEQ ID NO: 1568482 - RNA, 19 nt, Homo sapiens
gcugagagggauuuaauua

SEQ ID NO: 1568483 - RNA, 19 nt, Homo sapiens
gagaugagauggcagaaag

SEQ ID NO: 1568484 - RNA, 19 nt, Homo sapiens
cccaugagguuuccaauuu

SEQ ID NO: 1568485 - RNA, 19 nt, Homo sapiens
gaaaagauguuuaccuguu

SEQ ID NO: 1568486 - RNA, 19 nt, Homo sapiens
gacagugugugcucagaua

SEQ ID NO: 1568487 - RNA, 19 nt, Homo sapiens
gcucauuacuuaacacaau

SEQ ID NO: 1568488 - RNA, 19 nt, Homo sapiens
gcucucacuuggaaagaua

SEQ ID NO: 1568489 - RNA, 19 nt, Homo sapiens
ggucagagacuacaccaaa

SEQ ID NO: 1568490 - RNA, 19 nt, Homo sapiens
gaccagagcugcaauugac

SEQ ID NO: 1568491 - RNA, 19 nt, Homo sapiens
gcacugacuuccuguugug

SEQ ID NO: 1568492 - RNA, 19 nt, Homo sapiens
gagcugcaauugacagaug

SEQ ID NO: 1568493 - RNA, 19 nt, Homo sapiens
gaagaauaccucuguuuag

SEQ ID NO: 1568494 - RNA, 19 nt, Homo sapiens
gagaagaauaccucuguuu

SEQ ID NO: 1568495 - RNA, 19 nt, Homo sapiens
gaguauugguuuccuagaa

SEQ ID NO: 1568496 - RNA, 19 nt, Homo sapiens
ggacaaauuacaaugcauu

SEQ ID NO: 1568497 - RNA, 19 nt, Homo sapiens
agaagaauaccucuguuua

SEQ ID NO: 1568498 - RNA, 19 nt, Homo sapiens
guaaguaugcuugucauuu

SEQ ID NO: 1568499 - RNA, 19 nt, Homo sapiens
guugaucgcugccuggauu

SEQ ID NO: 1568500 - RNA, 19 nt, Homo sapiens
gcagaaagccugggaaugg

SEQ ID NO: 1568501 - RNA, 19 nt, Homo sapiens
aagcaaauguggauacaga

SEQ ID NO: 1568502 - RNA, 19 nt, Homo sapiens
aggcaaauguuucuucuga

SEQ ID NO: 1568503 - RNA, 19 nt, Homo sapiens
acuaaucugugcuuucuaa

SEQ ID NO: 1568504 - RNA, 19 nt, Homo sapiens
ccuagaaaccuaauauuga

SEQ ID NO: 1568505 - RNA, 19 nt, Homo sapiens
ggaaaugucgaguuuguuc

SEQ ID NO: 1568506 - RNA, 19 nt, Homo sapiens
gaguguguauccagaggua

SEQ ID NO: 1568507 - RNA, 19 nt, Homo sapiens
aguaggaaaugucgaguuu

SEQ ID NO: 1568508 - RNA, 19 nt, Homo sapiens
gaaaaugccagacuauauu

SEQ ID NO: 1568509 - RNA, 19 nt, Homo sapiens
uaugcaaccuuguggauug

SEQ ID NO: 1568510 - RNA, 19 nt, Homo sapiens
ugaaaugacacaagaaugu

SEQ ID NO: 1568511 - RNA, 19 nt, Homo sapiens
agacuucacuggccuuaau

SEQ ID NO: 1568512 - RNA, 19 nt, Homo sapiens
ucacuagcacuuaauauug

SEQ ID NO: 1568513 - RNA, 19 nt, Homo sapiens
ggaauggguucggcaggaa

SEQ ID NO: 1568514 - RNA, 19 nt, Homo sapiens
uaggaaaugucgaguuugu

SEQ ID NO: 1568515 - RNA, 19 nt, Homo sapiens
gagagggauuuaauuacug

SEQ ID NO: 1568516 - RNA, 19 nt, Homo sapiens
caaaggcuguuagggaaga

SEQ ID NO: 1568517 - RNA, 19 nt, Homo sapiens
caucuucuuuccucucaaa

SEQ ID NO: 1568518 - RNA, 19 nt, Homo sapiens
ccacaugugucuacuucau

SEQ ID NO: 1568519 - RNA, 19 nt, Homo sapiens
gauauucaggguuguuaaa

SEQ ID NO: 1568520 - RNA, 19 nt, Homo sapiens
acaugugucuacuucauuu

SEQ ID NO: 1568521 - RNA, 19 nt, Homo sapiens
caaauguggauacagauga

SEQ ID NO: 1568522 - RNA, 19 nt, Homo sapiens
ugagagggauuuaauuacu

SEQ ID NO: 1568523 - RNA, 19 nt, Homo sapiens
ggaaaccagccaaggcauu

SEQ ID NO: 1568524 - RNA, 19 nt, Homo sapiens
augcaacgcuuacaccaaa

SEQ ID NO: 1568525 - RNA, 19 nt, Homo sapiens
gaaccaggguccucaaacc

SEQ ID NO: 1568526 - RNA, 19 nt, Homo sapiens
gguaacucauagauauuga

SEQ ID NO: 1568527 - RNA, 19 nt, Homo sapiens
ggcauggaguuuauacaau

SEQ ID NO: 1568528 - RNA, 19 nt, Homo sapiens
gcaaauguggauacagaug

SEQ ID NO: 1568529 - RNA, 19 nt, Homo sapiens
gacuauauuucaucagcaa

SEQ ID NO: 1568530 - RNA, 19 nt, Homo sapiens
ugggauugcuggaucauau

SEQ ID NO: 1568531 - RNA, 19 nt, Homo sapiens
ccucccgacuuguugguua

SEQ ID NO: 1568532 - RNA, 19 nt, Homo sapiens
gccaagaucccacugugaa

SEQ ID NO: 1568533 - RNA, 19 nt, Homo sapiens
gaaaauuagugcucuuaag

SEQ ID NO: 1568534 - RNA, 19 nt, Homo sapiens
gaaaccagccaaggcauuc

SEQ ID NO: 1568535 - RNA, 19 nt, Homo sapiens
uaaagauucucuggcacaa

SEQ ID NO: 1568536 - RNA, 19 nt, Homo sapiens
cacuagcacuuaauauugu

SEQ ID NO: 1568537 - RNA, 19 nt, Homo sapiens
caucggagaguuccaguug

SEQ ID NO: 1568538 - RNA, 19 nt, Homo sapiens
uggaaugaguaaauaccua

SEQ ID NO: 1568539 - RNA, 19 nt, Homo sapiens
ucagaaagagggacccaaa

SEQ ID NO: 1568540 - RNA, 19 nt, Homo sapiens
ggcaggaggagauuugaaa

SEQ ID NO: 1568541 - RNA, 19 nt, Homo sapiens
guugaagggucagagacua

SEQ ID NO: 1568542 - RNA, 19 nt, Homo sapiens
ggaguggaguuuccuagcu

SEQ ID NO: 1568543 - RNA, 19 nt, Homo sapiens
aaauaccaguuaucacaga

SEQ ID NO: 1568544 - RNA, 19 nt, Homo sapiens
gaaagauauucaggguugu

SEQ ID NO: 1568545 - RNA, 19 nt, Homo sapiens
ugauggacgugaagaaagu

SEQ ID NO: 1568546 - RNA, 19 nt, Homo sapiens
cagcaugaguauugguuuc

SEQ ID NO: 1568547 - RNA, 19 nt, Homo sapiens
gaugcugugucucccaaug

SEQ ID NO: 1568548 - RNA, 19 nt, Homo sapiens
cacugagcuucuuucauua

SEQ ID NO: 1568549 - RNA, 19 nt, Homo sapiens
ccuaggaggcucucacuug

SEQ ID NO: 1568550 - RNA, 19 nt, Homo sapiens
gaaggacaaauuacaaugc

SEQ ID NO: 1568551 - RNA, 19 nt, Homo sapiens
uguccucucuugagccuuu

SEQ ID NO: 1568552 - RNA, 19 nt, Homo sapiens
gagacuacaccaaagacuu

SEQ ID NO: 1568553 - RNA, 19 nt, Homo sapiens
aagaaugucuccacugcau

SEQ ID NO: 1568554 - RNA, 19 nt, Homo sapiens
gccagacuauauuucauca

SEQ ID NO: 1568555 - RNA, 19 nt, Homo sapiens
gucauauacuuuguaggua

SEQ ID NO: 1568556 - RNA, 19 nt, Homo sapiens
gauuugaaaccacaugugu

SEQ ID NO: 1568557 - RNA, 19 nt, Homo sapiens
gagcuucuuucauuaucuc

SEQ ID NO: 1568558 - RNA, 19 nt, Homo sapiens
gaaaugucgaguuuguuca

SEQ ID NO: 1568559 - RNA, 19 nt, Homo sapiens
accaaacucuguucgauuc

SEQ ID NO: 1568560 - RNA, 19 nt, Homo sapiens
ggacguuguuacagauuuu

SEQ ID NO: 1568561 - RNA, 19 nt, Homo sapiens
gccaaggcauucucucucu

SEQ ID NO: 1568562 - RNA, 19 nt, Homo sapiens
ggaagugaaaugacacaag

SEQ ID NO: 1568563 - RNA, 19 nt, Homo sapiens
gagaaccaggguccucaaa

SEQ ID NO: 1568564 - RNA, 19 nt, Homo sapiens
gcuggugccuguccucucu

SEQ ID NO: 1568565 - RNA, 19 nt, Homo sapiens
caugaguauugguuuccua

SEQ ID NO: 1568566 - RNA, 19 nt, Homo sapiens
agagguaaguaugugguaa

SEQ ID NO: 1568567 - RNA, 19 nt, Homo sapiens
aaccacaugugucuacuuc

SEQ ID NO: 1568568 - RNA, 19 nt, Homo sapiens
uguuucuucugaccauuua

SEQ ID NO: 1568569 - RNA, 19 nt, Homo sapiens
aggaggcucucacuuggaa

SEQ ID NO: 1568570 - RNA, 19 nt, Homo sapiens
gaagaaacauccacaggaa

SEQ ID NO: 1568571 - RNA, 19 nt, Homo sapiens
gacaagcgauuucuguuua

SEQ ID NO: 1568572 - RNA, 19 nt, Homo sapiens
caagugauauggcagguua

SEQ ID NO: 1568573 - RNA, 19 nt, Homo sapiens
gcaaagggaucagucgaua

SEQ ID NO: 1568574 - RNA, 19 nt, Homo sapiens
guagauggauauagagaua

SEQ ID NO: 1568575 - RNA, 19 nt, Homo sapiens
gaaagaagaugagacaauc

SEQ ID NO: 1568576 - RNA, 19 nt, Homo sapiens
ggaacgagcuagccauuau

SEQ ID NO: 1568577 - RNA, 19 nt, Homo sapiens
gcaccaguguuucaacuaa

SEQ ID NO: 1568578 - RNA, 19 nt, Homo sapiens
ggaauaugguagauggaua

SEQ ID NO: 1568579 - RNA, 19 nt, Homo sapiens
gaagaccuauaaaggaauu

SEQ ID NO: 1568580 - RNA, 19 nt, Homo sapiens
gaaaggaaguccguaugga

SEQ ID NO: 1568581 - RNA, 19 nt, Homo sapiens
cagcgaccauccagauuua

SEQ ID NO: 1568582 - RNA, 19 nt, Homo sapiens
caacaaagggcaguaaauu

SEQ ID NO: 1568583 - RNA, 19 nt, Homo sapiens
guuggaagcagauuaaaua

SEQ ID NO: 1568584 - RNA, 19 nt, Homo sapiens
ggagacauuucugggaaua

SEQ ID NO: 1568585 - RNA, 19 nt, Homo sapiens
ggaagcagauuaaauaucc

SEQ ID NO: 1568586 - RNA, 19 nt, Homo sapiens
gaagacagaauacagcaaa

SEQ ID NO: 1568587 - RNA, 19 nt, Homo sapiens
guggacaccuagugacuua

SEQ ID NO: 1568588 - RNA, 19 nt, Homo sapiens
gaaagaagaagaagaaagg

SEQ ID NO: 1568589 - RNA, 19 nt, Homo sapiens
acaaagggcaguaaauuaa

SEQ ID NO: 1568590 - RNA, 19 nt, Homo sapiens
gcucauugguugccagauu

SEQ ID NO: 1568591 - RNA, 19 nt, Homo sapiens
gaacacaagugaaguaacc

SEQ ID NO: 1568592 - RNA, 19 nt, Homo sapiens
aaaguuagaucucaucaca

SEQ ID NO: 1568593 - RNA, 19 nt, Homo sapiens
caacuaagaaagaagauga

SEQ ID NO: 1568594 - RNA, 19 nt, Homo sapiens
gagaguggcuggagaucga

SEQ ID NO: 1568595 - RNA, 19 nt, Homo sapiens
gaaguaaccguccgcuuug

SEQ ID NO: 1568596 - RNA, 19 nt, Homo sapiens
gaccugugcuucugacuau

SEQ ID NO: 1568597 - RNA, 19 nt, Homo sapiens
gaagaaaggaaguccguau

SEQ ID NO: 1568598 - RNA, 19 nt, Homo sapiens
gcacaaugacaucuaagaa

SEQ ID NO: 1568599 - RNA, 19 nt, Homo sapiens
gugcaaagcugccauccau

SEQ ID NO: 1568600 - RNA, 19 nt, Homo sapiens
uaugguagauggauauaga

SEQ ID NO: 1568601 - RNA, 19 nt, Homo sapiens
ugaaguaaccguccgcuuu

SEQ ID NO: 1568602 - RNA, 19 nt, Homo sapiens
caccuaugcugucucuaua

SEQ ID NO: 1568603 - RNA, 19 nt, Homo sapiens
uggaagaccuauaaaggaa

SEQ ID NO: 1568604 - RNA, 19 nt, Homo sapiens
agaaacauccacaggaaua

SEQ ID NO: 1568605 - RNA, 19 nt, Homo sapiens
gcagcgaccauccagauuu

SEQ ID NO: 1568606 - RNA, 19 nt, Homo sapiens
cagauuaaauaucccuuug

SEQ ID NO: 1568607 - RNA, 19 nt, Homo sapiens
caggguaacucuaacuuuc

SEQ ID NO: 1568608 - RNA, 19 nt, Homo sapiens
gaaccugacgggcaaauca

SEQ ID NO: 1568609 - RNA, 19 nt, Homo sapiens
ggagaugacacaaaaguua

SEQ ID NO: 1568610 - RNA, 19 nt, Homo sapiens
caaagggcaguaaauuaaa

SEQ ID NO: 1568611 - RNA, 19 nt, Homo sapiens
gaaacauccacaggaauaa

SEQ ID NO: 1568612 - RNA, 19 nt, Homo sapiens
cuaaguggaagaccuauaa

SEQ ID NO: 1568613 - RNA, 19 nt, Homo sapiens
ggaauuaggaccacaggau

SEQ ID NO: 1568614 - RNA, 19 nt, Homo sapiens
guaugacuguucccaaaga

SEQ ID NO: 1568615 - RNA, 19 nt, Homo sapiens
gagaaggagaugacacaaa

SEQ ID NO: 1568616 - RNA, 19 nt, Homo sapiens
gaagaugagacaaucacaa

SEQ ID NO: 1568617 - RNA, 19 nt, Homo sapiens
agucaaagcaccaguguuu

SEQ ID NO: 1568618 - RNA, 19 nt, Homo sapiens
agacguagcaggagacauu

SEQ ID NO: 1568619 - RNA, 19 nt, Homo sapiens
gccauuauuugaagacaga

SEQ ID NO: 1568620 - RNA, 19 nt, Homo sapiens
gaccauccagauuuaauaa

SEQ ID NO: 1568621 - RNA, 19 nt, Homo sapiens
ccuaugcugucucuauaaa

SEQ ID NO: 1568622 - RNA, 19 nt, Homo sapiens
aacaaagggcaguaaauua

SEQ ID NO: 1568623 - RNA, 19 nt, Homo sapiens
gagcuagccauuauuugaa

SEQ ID NO: 1568624 - RNA, 19 nt, Homo sapiens
gaacgagcuagccauuauu

SEQ ID NO: 1568625 - RNA, 19 nt, Homo sapiens
ccacaggaauaaacauuac

SEQ ID NO: 1568626 - RNA, 19 nt, Homo sapiens
uaagaaagaagaugagaca

SEQ ID NO: 1568627 - RNA, 19 nt, Homo sapiens
cgagcuagccauuauuuga

SEQ ID NO: 1568628 - RNA, 19 nt, Homo sapiens
gaacuagguggccagauca

SEQ ID NO: 1568629 - RNA, 19 nt, Homo sapiens
ugaacuagguggccagauc

SEQ ID NO: 1568630 - RNA, 19 nt, Homo sapiens
caggaauaauugcugauga

SEQ ID NO: 1568631 - RNA, 19 nt, Homo sapiens
caccagcucuucagaucaa

SEQ ID NO: 1568632 - RNA, 19 nt, Homo sapiens
caacaacaaagggcaguaa

SEQ ID NO: 1568633 - RNA, 19 nt, Homo sapiens
gcagauuaaauaucccuuu

SEQ ID NO: 1568634 - RNA, 19 nt, Homo sapiens
gaucuacacagucgaacuu

SEQ ID NO: 1568635 - RNA, 19 nt, Homo sapiens
ugccauccaugcaggaaua

SEQ ID NO: 1568636 - RNA, 19 nt, Homo sapiens
cgaccauccagauuuaaua

SEQ ID NO: 1568637 - RNA, 19 nt, Homo sapiens
agaaggagaugacacaaaa

SEQ ID NO: 1568638 - RNA, 19 nt, Homo sapiens
gaucuuugcagccuuuaga

SEQ ID NO: 1568639 - RNA, 19 nt, Homo sapiens
cucauugguugccagauua

SEQ ID NO: 1568640 - RNA, 19 nt, Homo sapiens
ccauccagauuuaauaaca

SEQ ID NO: 1568641 - RNA, 19 nt, Homo sapiens
aaagacugauucugagguu

SEQ ID NO: 1568642 - RNA, 19 nt, Homo sapiens
aggaauaauugcugaugaa

SEQ ID NO: 1568643 - RNA, 19 nt, Homo sapiens
caggauaguggcacaauga

SEQ ID NO: 1568644 - RNA, 19 nt, Homo sapiens
gagcagcgaccauccagau

SEQ ID NO: 1568645 - RNA, 19 nt, Homo sapiens
guacaguuaccgauuaauc

SEQ ID NO: 1568646 - RNA, 19 nt, Homo sapiens
gcuaugauaaugagaagga

SEQ ID NO: 1568647 - RNA, 19 nt, Homo sapiens
caacgguggcuauuccauu

SEQ ID NO: 1568648 - RNA, 19 nt, Homo sapiens
gaaaauaacaggaauuagg

SEQ ID NO: 1568649 - RNA, 19 nt, Homo sapiens
agacaagcgauuucuguuu

SEQ ID NO: 1568650 - RNA, 19 nt, Homo sapiens
gggaaaagacugauucuga

SEQ ID NO: 1568651 - RNA, 19 nt, Homo sapiens
ccuagugacuuaucaggau

SEQ ID NO: 1568652 - RNA, 19 nt, Homo sapiens
gugcagcccuccgcaucua

SEQ ID NO: 1568653 - RNA, 19 nt, Homo sapiens
agacauuucugggaauaug

SEQ ID NO: 1568654 - RNA, 19 nt, Homo sapiens
guggcacaaugacaucuaa

SEQ ID NO: 1568655 - RNA, 19 nt, Homo sapiens
aaguaugacuguucccaaa

SEQ ID NO: 1568656 - RNA, 19 nt, Homo sapiens
aaacaccuaugcugucucu

SEQ ID NO: 1568657 - RNA, 19 nt, Homo sapiens
ucaaagcaccaguguuuca

SEQ ID NO: 1568658 - RNA, 19 nt, Homo sapiens
caaugagaguggagaccaa

SEQ ID NO: 1568659 - RNA, 19 nt, Homo sapiens
gaucagcagaggcucagaa

SEQ ID NO: 1568660 - RNA, 19 nt, Homo sapiens
ccagauaugugcggguugu

SEQ ID NO: 1568661 - RNA, 19 nt, Homo sapiens
gauaguggcacaaugacau

SEQ ID NO: 1568662 - RNA, 19 nt, Homo sapiens
aaagggcaguaaauuaaag

SEQ ID NO: 1568663 - RNA, 19 nt, Homo sapiens
gaagaagaagaaaggaagu

SEQ ID NO: 1568664 - RNA, 19 nt, Homo sapiens
agaaagaagaugagacaau

SEQ ID NO: 1568665 - RNA, 19 nt, Homo sapiens
guggaagaccuauaaagga

SEQ ID NO: 1568666 - RNA, 19 nt, Homo sapiens
gcagcagauccuugaguuu

SEQ ID NO: 1568667 - RNA, 19 nt, Homo sapiens
aaagggaucagucgauaug

SEQ ID NO: 1568668 - RNA, 19 nt, Homo sapiens
gaaaagacaauuacaguac

SEQ ID NO: 1568669 - RNA, 19 nt, Homo sapiens
guugaacacaagugaagua

SEQ ID NO: 1568670 - RNA, 19 nt, Homo sapiens
gaagagaugugaauauaca

SEQ ID NO: 1568671 - RNA, 19 nt, Homo sapiens
ggacaacuuuccauaacua

SEQ ID NO: 1568672 - RNA, 19 nt, Homo sapiens
ggacauacuuaaagaagaa

SEQ ID NO: 1568673 - RNA, 19 nt, Homo sapiens
caaaggacauuaccuguug

SEQ ID NO: 1568674 - RNA, 19 nt, Homo sapiens
cuaaauugcuggucuguuu

SEQ ID NO: 1568675 - RNA, 19 nt, Homo sapiens
ccaaugaacucuaccuuug

SEQ ID NO: 1568676 - RNA, 19 nt, Homo sapiens
ccacagagccucaccauug

SEQ ID NO: 1568677 - RNA, 19 nt, Homo sapiens
gaaaggaaucuucagcuaa

SEQ ID NO: 1568678 - RNA, 19 nt, Homo sapiens
gauaucagcucaaugucaa

SEQ ID NO: 1568679 - RNA, 19 nt, Homo sapiens
aaaggaaucuucagcuaaa

SEQ ID NO: 1568680 - RNA, 19 nt, Homo sapiens
gauguuagaucaaagagau

SEQ ID NO: 1568681 - RNA, 19 nt, Homo sapiens
uaugauaucugcaauggaa

SEQ ID NO: 1568682 - RNA, 19 nt, Homo sapiens
gcaauguguuuaccucuug

SEQ ID NO: 1568683 - RNA, 19 nt, Homo sapiens
gaagaucccucaguguuuc

SEQ ID NO: 1568684 - RNA, 19 nt, Homo sapiens
acagaguccugguuaauaa

SEQ ID NO: 1568685 - RNA, 19 nt, Homo sapiens
guauuuacccuguugcuua

SEQ ID NO: 1568686 - RNA, 19 nt, Homo sapiens
caaaguauuuacccuguug

SEQ ID NO: 1568687 - RNA, 19 nt, Homo sapiens
gaaaugaucacuaggcaau

SEQ ID NO: 1568688 - RNA, 19 nt, Homo sapiens
uaauguggcucuccuuuau

SEQ ID NO: 1568689 - RNA, 19 nt, Homo sapiens
uccaaucacugcugcauua

SEQ ID NO: 1568690 - RNA, 19 nt, Homo sapiens
uagcagacauuucagacua

SEQ ID NO: 1568691 - RNA, 19 nt, Homo sapiens
gauuaugccucguuuagga

SEQ ID NO: 1568692 - RNA, 19 nt, Homo sapiens
gacauuaccuguugauucu

SEQ ID NO: 1568693 - RNA, 19 nt, Homo sapiens
ggaagaucccucaguguuu

SEQ ID NO: 1568694 - RNA, 19 nt, Homo sapiens
gcauggaucuucugacagu

SEQ ID NO: 1568695 - RNA, 19 nt, Homo sapiens
guaaauuccuacuccuuug

SEQ ID NO: 1568696 - RNA, 19 nt, Homo sapiens
aggaagagaugugaauaua

SEQ ID NO: 1568697 - RNA, 19 nt, Homo sapiens
gcuaaagugucuacgauca

SEQ ID NO: 1568698 - RNA, 19 nt, Homo sapiens
ucccauggcugcuucauuu

SEQ ID NO: 1568699 - RNA, 19 nt, Homo sapiens
gaauauacaggaaaugaga

SEQ ID NO: 1568700 - RNA, 19 nt, Homo sapiens
ggacauuaccuguugauuc

SEQ ID NO: 1568701 - RNA, 19 nt, Homo sapiens
agaaaggaaucuucagcua

SEQ ID NO: 1568702 - RNA, 19 nt, Homo sapiens
uugcauagcuuuccauugu

SEQ ID NO: 1568703 - RNA, 19 nt, Homo sapiens
ugucauuguucuagacuua

SEQ ID NO: 1568704 - RNA, 19 nt, Homo sapiens
agaaguaccugugucauug

SEQ ID NO: 1568705 - RNA, 19 nt, Homo sapiens
aggauucucuuucuuguaa

SEQ ID NO: 1568706 - RNA, 19 nt, Homo sapiens
aaauggaccuuaacaaagu

SEQ ID NO: 1568707 - RNA, 19 nt, Homo sapiens
gggcauggaucuucugaca

SEQ ID NO: 1568708 - RNA, 19 nt, Homo sapiens
caauggaaaugaucacuag

SEQ ID NO: 1568709 - RNA, 19 nt, Homo sapiens
uaagauagguaugggaaug

SEQ ID NO: 1568710 - RNA, 19 nt, Homo sapiens
ccuagaacgucuuagauug

SEQ ID NO: 1568711 - RNA, 19 nt, Homo sapiens
cauaaucacuagguggaua

SEQ ID NO: 1568712 - RNA, 19 nt, Homo sapiens
gcagaggugugaagaaggu

SEQ ID NO: 1568713 - RNA, 19 nt, Homo sapiens
gacaaaggaauuagagaaa

SEQ ID NO: 1568714 - RNA, 19 nt, Homo sapiens
gaguauggcugugauaagu

SEQ ID NO: 1568715 - RNA, 19 nt, Homo sapiens
ucagcucaaugucaauaua

SEQ ID NO: 1568716 - RNA, 19 nt, Homo sapiens
guguguaugugcuauaauu

SEQ ID NO: 1568717 - RNA, 19 nt, Homo sapiens
ccuacuccuuugucaauua

SEQ ID NO: 1568718 - RNA, 19 nt, Homo sapiens
guucuagacuuaguucaaa

SEQ ID NO: 1568719 - RNA, 19 nt, Homo sapiens
gcuaagacauucacugacu

SEQ ID NO: 1568720 - RNA, 19 nt, Homo sapiens
gcaauuacuuaaagcuagu

SEQ ID NO: 1568721 - RNA, 19 nt, Homo sapiens
ucaaguggguuauuuagag

SEQ ID NO: 1568722 - RNA, 19 nt, Homo sapiens
gguaaauuccuacuccuuu

SEQ ID NO: 1568723 - RNA, 19 nt, Homo sapiens
ccaguccucuugcaaguga

SEQ ID NO: 1568724 - RNA, 19 nt, Homo sapiens
cuacagccuuucacacaaa

SEQ ID NO: 1568725 - RNA, 19 nt, Homo sapiens
guacaaugaccuuaauuca

SEQ ID NO: 1568726 - RNA, 19 nt, Homo sapiens
ggaaaugagauccuuaaag

SEQ ID NO: 1568727 - RNA, 19 nt, Homo sapiens
ggaaugauuuaaggaagau

SEQ ID NO: 1568728 - RNA, 19 nt, Homo sapiens
gcaauggaaaugaucacua

SEQ ID NO: 1568729 - RNA, 19 nt, Homo sapiens
gcauagcuuuccauugugu

SEQ ID NO: 1568730 - RNA, 19 nt, Homo sapiens
aaucacugcugcauuaaga

SEQ ID NO: 1568731 - RNA, 19 nt, Homo sapiens
agaaguaucuuagaaaguc

SEQ ID NO: 1568732 - RNA, 19 nt, Homo sapiens
gcaaggaagagaugugaau

SEQ ID NO: 1568733 - RNA, 19 nt, Homo sapiens
ugaaacuccuuuggaauga

SEQ ID NO: 1568734 - RNA, 19 nt, Homo sapiens
uuauauaacucccaugcuu

SEQ ID NO: 1568735 - RNA, 19 nt, Homo sapiens
ccauguaaauguuaugcaa

SEQ ID NO: 1568736 - RNA, 19 nt, Homo sapiens
ccucaguguuucagaguaa

SEQ ID NO: 1568737 - RNA, 19 nt, Homo sapiens
gaacuucaugcuuauaaca

SEQ ID NO: 1568738 - RNA, 19 nt, Homo sapiens
gccauacuuucuugaugua

SEQ ID NO: 1568739 - RNA, 19 nt, Homo sapiens
gggcuaaguucugcugcua

SEQ ID NO: 1568740 - RNA, 19 nt, Homo sapiens
cuuauaacauccugacuau

SEQ ID NO: 1568741 - RNA, 19 nt, Homo sapiens
ccucuuggguaaauacauu

SEQ ID NO: 1568742 - RNA, 19 nt, Homo sapiens
gacaauggcguccaaguuc

SEQ ID NO: 1568743 - RNA, 19 nt, Homo sapiens
gcugcuaucucuagagcuu

SEQ ID NO: 1568744 - RNA, 19 nt, Homo sapiens
guccagauguuagaucaaa

SEQ ID NO: 1568745 - RNA, 19 nt, Homo sapiens
uaaagugucuacgaucaau

SEQ ID NO: 1568746 - RNA, 19 nt, Homo sapiens
cagcuaaagugucuacgau

SEQ ID NO: 1568747 - RNA, 19 nt, Homo sapiens
aaugaucacuaggcaauuu

SEQ ID NO: 1568748 - RNA, 19 nt, Homo sapiens
gccaugcaauuaaugaaau

SEQ ID NO: 1568749 - RNA, 19 nt, Homo sapiens
ugacaaaggaauuagagaa

SEQ ID NO: 1568750 - RNA, 19 nt, Homo sapiens
gcaugugacaaaggaauua

SEQ ID NO: 1568751 - RNA, 19 nt, Homo sapiens
uaaauggaccuuaacaaag

SEQ ID NO: 1568752 - RNA, 19 nt, Homo sapiens
ggagugucauuguucuaga

SEQ ID NO: 1568753 - RNA, 19 nt, Homo sapiens
uauuuacccuguugcuuaa

SEQ ID NO: 1568754 - RNA, 19 nt, Homo sapiens
agagucaaguggaaucaaa

SEQ ID NO: 1568755 - RNA, 19 nt, Homo sapiens
cagccgugcuuccuguuaa

SEQ ID NO: 1568756 - RNA, 19 nt, Homo sapiens
gauguguccuuguucuuuc

SEQ ID NO: 1568757 - RNA, 19 nt, Homo sapiens
guaggcaaagucacauaua

SEQ ID NO: 1568758 - RNA, 19 nt, Homo sapiens
uagaggaucagauuauuug

SEQ ID NO: 1568759 - RNA, 19 nt, Homo sapiens
gaacaccuggcauccuuug

SEQ ID NO: 1568760 - RNA, 19 nt, Homo sapiens
caaggaagagaugugaaua

SEQ ID NO: 1568761 - RNA, 19 nt, Homo sapiens
ugucuacgaucaauucaga

SEQ ID NO: 1568762 - RNA, 19 nt, Homo sapiens
gaacagagucaaguggaau

SEQ ID NO: 1568763 - RNA, 19 nt, Homo sapiens
cgaacagagucaaguggaa

SEQ ID NO: 1568764 - RNA, 19 nt, Homo sapiens
caggugauguguccuuguu

SEQ ID NO: 1568765 - RNA, 19 nt, Homo sapiens
gcuuauaacauccugacua

SEQ ID NO: 1568766 - RNA, 19 nt, Homo sapiens
gcuaaguucugcugcuauc

SEQ ID NO: 1568767 - RNA, 19 nt, Homo sapiens
gaugggugguccagcuauu

SEQ ID NO: 1568768 - RNA, 19 nt, Homo sapiens
ccauauguuugaagaaauc

SEQ ID NO: 1568769 - RNA, 19 nt, Homo sapiens
guucaaggcauacugaguu

SEQ ID NO: 1568770 - RNA, 19 nt, Homo sapiens
gcaaagugcugaaagcuua

SEQ ID NO: 1568771 - RNA, 19 nt, Homo sapiens
ggacauggcuuuaaaugaa

SEQ ID NO: 1568772 - RNA, 19 nt, Homo sapiens
ggagaauguugaagaauua

SEQ ID NO: 1568773 - RNA, 19 nt, Homo sapiens
gaagagucauuacuacaua

SEQ ID NO: 1568774 - RNA, 19 nt, Homo sapiens
aaacaagccugaagauuaa

SEQ ID NO: 1568775 - RNA, 19 nt, Homo sapiens
gagccaaacuggauaagua

SEQ ID NO: 1568776 - RNA, 19 nt, Homo sapiens
uaaacaagccugaagauua

SEQ ID NO: 1568777 - RNA, 19 nt, Homo sapiens
ggagagaugcugaaauuua

SEQ ID NO: 1568778 - RNA, 19 nt, Homo sapiens
gaagaggguuaaagaacua

SEQ ID NO: 1568779 - RNA, 19 nt, Homo sapiens
gaacuacagaugaagauua

SEQ ID NO: 1568780 - RNA, 19 nt, Homo sapiens
ccaugcaggugauauauua

SEQ ID NO: 1568781 - RNA, 19 nt, Homo sapiens
gaagaaagacagaaacuga

SEQ ID NO: 1568782 - RNA, 19 nt, Homo sapiens
guaguaaccuguauuuaga

SEQ ID NO: 1568783 - RNA, 19 nt, Homo sapiens
gauagaaucacaaccuuua

SEQ ID NO: 1568784 - RNA, 19 nt, Homo sapiens
guacaugacugaaaugcaa

SEQ ID NO: 1568785 - RNA, 19 nt, Homo sapiens
ucaauaagcuaaaggagaa

SEQ ID NO: 1568786 - RNA, 19 nt, Homo sapiens
gaaauugucucaacuuggu

SEQ ID NO: 1568787 - RNA, 19 nt, Homo sapiens
cagcauaucuuccuugaga

SEQ ID NO: 1568788 - RNA, 19 nt, Homo sapiens
gaucaaggcuaauuaugug

SEQ ID NO: 1568789 - RNA, 19 nt, Homo sapiens
aaacugaaaucuagacuug

SEQ ID NO: 1568790 - RNA, 19 nt, Homo sapiens
uaaaugaagucuugcagaa

SEQ ID NO: 1568791 - RNA, 19 nt, Homo sapiens
gcaacagacucauugaaga

SEQ ID NO: 1568792 - RNA, 19 nt, Homo sapiens
guggagagaugcugaaauu

SEQ ID NO: 1568793 - RNA, 19 nt, Homo sapiens
gacagaaacugaaaucuag

SEQ ID NO: 1568794 - RNA, 19 nt, Homo sapiens
gaagguuagugauauaaug

SEQ ID NO: 1568795 - RNA, 19 nt, Homo sapiens
uuaagaagaucaaggcuaa

SEQ ID NO: 1568796 - RNA, 19 nt, Homo sapiens
caagaaagaagaagaggua

SEQ ID NO: 1568797 - RNA, 19 nt, Homo sapiens
caaggaguaugaaaugauu

SEQ ID NO: 1568798 - RNA, 19 nt, Homo sapiens
gcugaauccugcagauaua

SEQ ID NO: 1568799 - RNA, 19 nt, Homo sapiens
ccuccaagcuucuuaugua

SEQ ID NO: 1568800 - RNA, 19 nt, Homo sapiens
gaguaugaauccacacuuu

SEQ ID NO: 1568801 - RNA, 19 nt, Homo sapiens
auaaagagcuacugaaaca

SEQ ID NO: 1568802 - RNA, 19 nt, Homo sapiens
gaaugacaaggaaauguua

SEQ ID NO: 1568803 - RNA, 19 nt, Homo sapiens
caacaguuaugaacaagga

SEQ ID NO: 1568804 - RNA, 19 nt, Homo sapiens
caagaacuccaguguagua

SEQ ID NO: 1568805 - RNA, 19 nt, Homo sapiens
ggccacagcuucugcuuug

SEQ ID NO: 1568806 - RNA, 19 nt, Homo sapiens
gaaaauuacucaacgaaug

SEQ ID NO: 1568807 - RNA, 19 nt, Homo sapiens
ugagaagguuagugauaua

SEQ ID NO: 1568808 - RNA, 19 nt, Homo sapiens
gagagaugcugaaauuuac

SEQ ID NO: 1568809 - RNA, 19 nt, Homo sapiens
guagaaagcaugucagaau

SEQ ID NO: 1568810 - RNA, 19 nt, Homo sapiens
gaaagguacaugacugaaa

SEQ ID NO: 1568811 - RNA, 19 nt, Homo sapiens
gaagaucaaggcuaauuau

SEQ ID NO: 1568812 - RNA, 19 nt, Homo sapiens
ggucauagacugugauuca

SEQ ID NO: 1568813 - RNA, 19 nt, Homo sapiens
gcaaauacagaccaacuug

SEQ ID NO: 1568814 - RNA, 19 nt, Homo sapiens
gccugaagauuaaacagua

SEQ ID NO: 1568815 - RNA, 19 nt, Homo sapiens
gcaagacucauuuaaggaa

SEQ ID NO: 1568816 - RNA, 19 nt, Homo sapiens
guaagucaguauuuagaga

SEQ ID NO: 1568817 - RNA, 19 nt, Homo sapiens
ugaaugagauaagugcuuu

SEQ ID NO: 1568818 - RNA, 19 nt, Homo sapiens
gauaaguaccacagucuaa

SEQ ID NO: 1568819 - RNA, 19 nt, Homo sapiens
gccaggacaucaucaauuc

SEQ ID NO: 1568820 - RNA, 19 nt, Homo sapiens
aaaggagaauguugaagaa

SEQ ID NO: 1568821 - RNA, 19 nt, Homo sapiens
aaagagcuacugaaacaua

SEQ ID NO: 1568822 - RNA, 19 nt, Homo sapiens
guuaaaggaucaauuagag

SEQ ID NO: 1568823 - RNA, 19 nt, Homo sapiens
aaagguacaugacugaaau

SEQ ID NO: 1568824 - RNA, 19 nt, Homo sapiens
ggaaugacaaggaaauguu

SEQ ID NO: 1568825 - RNA, 19 nt, Homo sapiens
uaaaggagaauguugaaga

SEQ ID NO: 1568826 - RNA, 19 nt, Homo sapiens
gaccaaaggcuugcaauau

SEQ ID NO: 1568827 - RNA, 19 nt, Homo sapiens
caacagacucauugaagaa

SEQ ID NO: 1568828 - RNA, 19 nt, Homo sapiens
gacaaaaccuuaagcaaga

SEQ ID NO: 1568829 - RNA, 19 nt, Homo sapiens
cagcaaguguucauugaug

SEQ ID NO: 1568830 - RNA, 19 nt, Homo sapiens
caaggaaucugcccucaac

SEQ ID NO: 1568831 - RNA, 19 nt, Homo sapiens
ugacagagaagccagaauu

SEQ ID NO: 1568832 - RNA, 19 nt, Homo sapiens
gagaguuaauugcuaagga

SEQ ID NO: 1568833 - RNA, 19 nt, Homo sapiens
gugagaagguuagugauau

SEQ ID NO: 1568834 - RNA, 19 nt, Homo sapiens
cuucagauccuguacauuu

SEQ ID NO: 1568835 - RNA, 19 nt, Homo sapiens
guggauacuucucaugaaa

SEQ ID NO: 1568836 - RNA, 19 nt, Homo sapiens
gauugaaagugagaacaaa

SEQ ID NO: 1568837 - RNA, 19 nt, Homo sapiens
agaaauugcucacucaagu

SEQ ID NO: 1568838 - RNA, 19 nt, Homo sapiens
aagaggacauggcuuuaaa

SEQ ID NO: 1568839 - RNA, 19 nt, Homo sapiens
cagaaauugucucaacuug

SEQ ID NO: 1568840 - RNA, 19 nt, Homo sapiens
ggagauuccugagauguca

SEQ ID NO: 1568841 - RNA, 19 nt, Homo sapiens
uagaagcauuugaugauga

SEQ ID NO: 1568842 - RNA, 19 nt, Homo sapiens
ucaauuagaggaagucuug

SEQ ID NO: 1568843 - RNA, 19 nt, Homo sapiens
agacagaaacugaaaucua

SEQ ID NO: 1568844 - RNA, 19 nt, Homo sapiens
ccaggaagagucauuacua

SEQ ID NO: 1568845 - RNA, 19 nt, Homo sapiens
gaaaugauugaaagugaga

SEQ ID NO: 1568846 - RNA, 19 nt, Homo sapiens
aaaguuuggugucucguuu

SEQ ID NO: 1568847 - RNA, 19 nt, Homo sapiens
caaagagagugagaagguu

SEQ ID NO: 1568848 - RNA, 19 nt, Homo sapiens
gaaauugcucacucaaguu

SEQ ID NO: 1568849 - RNA, 19 nt, Homo sapiens
agacugcaguuccuucaaa

SEQ ID NO: 1568850 - RNA, 19 nt, Homo sapiens
gcaaaucaacgaaguaaaa

SEQ ID NO: 1568851 - RNA, 19 nt, Homo sapiens
guagaagcauuugaugaug

SEQ ID NO: 1568852 - RNA, 19 nt, Homo sapiens
gaagguuacaucauaugaa

SEQ ID NO: 1568853 - RNA, 19 nt, Homo sapiens
ggagugaagagcaaaauua

SEQ ID NO: 1568854 - RNA, 19 nt, Homo sapiens
agaugaagauuaccaaaca

SEQ ID NO: 1568855 - RNA, 19 nt, Homo sapiens
agucagauauuaccaagga

SEQ ID NO: 1568856 - RNA, 19 nt, Homo sapiens
aggagaauguugaagaauu

SEQ ID NO: 1568857 - RNA, 19 nt, Homo sapiens
gguagaagcauuugaugau

SEQ ID NO: 1568858 - RNA, 19 nt, Homo sapiens
gcacuaauucagccaguug

SEQ ID NO: 1568859 - RNA, 19 nt, Homo sapiens
ggaagagucauuacuacau

SEQ ID NO: 1568860 - RNA, 19 nt, Homo sapiens
ugacaaguaucaaagacau

SEQ ID NO: 1568861 - RNA, 19 nt, Homo sapiens
gucuugaagucagauauua

SEQ ID NO: 1568862 - RNA, 19 nt, Homo sapiens
aaauugcucacucaaguua

SEQ ID NO: 1568863 - RNA, 19 nt, Homo sapiens
gaaagaagaagagguagag

SEQ ID NO: 1568864 - RNA, 19 nt, Homo sapiens
gaagauuaccaaacagcaa

SEQ ID NO: 1568865 - RNA, 19 nt, Homo sapiens
aaugaagucuugcagaaau

SEQ ID NO: 1568866 - RNA, 19 nt, Homo sapiens
caagaggacauggcuuuaa

SEQ ID NO: 1568867 - RNA, 19 nt, Homo sapiens
uaagguauuccaaggagua

SEQ ID NO: 1568868 - RNA, 19 nt, Homo sapiens
aaagagagugagaagguua

SEQ ID NO: 1568869 - RNA, 19 nt, Homo sapiens
guuaaagaacuacagauga

SEQ ID NO: 1568870 - RNA, 19 nt, Homo sapiens
gccaauaacugguuuaaug

SEQ ID NO: 1568871 - RNA, 19 nt, Homo sapiens
ggaaaccgcucggcugauu

SEQ ID NO: 1568872 - RNA, 19 nt, Homo sapiens
ggugagcccuggucaauga

SEQ ID NO: 1568873 - RNA, 19 nt, Homo sapiens
ggaggcugauuucuacaua

SEQ ID NO: 1568874 - RNA, 19 nt, Homo sapiens
gaauuaagcaacugagaaa

SEQ ID NO: 1568875 - RNA, 19 nt, Homo sapiens
ggaauuaagcaacugagaa

SEQ ID NO: 1568876 - RNA, 19 nt, Homo sapiens
gguccuacauucgugauuu

SEQ ID NO: 1568877 - RNA, 19 nt, Homo sapiens
ggugggagcgccucucuuu

SEQ ID NO: 1568878 - RNA, 19 nt, Homo sapiens
gaaaccgcucggcugauua

SEQ ID NO: 1568879 - RNA, 19 nt, Homo sapiens
ccgcucggcugauuacauu

SEQ ID NO: 1568880 - RNA, 19 nt, Homo sapiens
gcugauuucuacauauuuc

SEQ ID NO: 1568881 - RNA, 19 nt, Homo sapiens
guaaagcuccuccgcuguu

SEQ ID NO: 1568882 - RNA, 19 nt, Homo sapiens
aaucagauaaggcugguua

SEQ ID NO: 1568883 - RNA, 19 nt, Homo sapiens
ucaacgagcggcacaggua

SEQ ID NO: 1568884 - RNA, 19 nt, Homo sapiens
gaaggaugagaaggaaaua

SEQ ID NO: 1568885 - RNA, 19 nt, Homo sapiens
uaaagcuccuccgcuguuu

SEQ ID NO: 1568886 - RNA, 19 nt, Homo sapiens
cuagaaggaugagaaggaa

SEQ ID NO: 1568887 - RNA, 19 nt, Homo sapiens
ccauguaucugagaauauc

SEQ ID NO: 1568888 - RNA, 19 nt, Homo sapiens
gaggcugauuucuacauau

SEQ ID NO: 1568889 - RNA, 19 nt, Homo sapiens
ucacaccggugguaucuac

SEQ ID NO: 1568890 - RNA, 19 nt, Homo sapiens
ccaauaacugguuuaaugu

SEQ ID NO: 1568891 - RNA, 19 nt, Homo sapiens
aggcugauuucuacauauu

SEQ ID NO: 1568892 - RNA, 19 nt, Homo sapiens
gguauuagacaucccugaa

SEQ ID NO: 1568893 - RNA, 19 nt, Homo sapiens
guauuagacaucccugaaa

SEQ ID NO: 1568894 - RNA, 19 nt, Homo sapiens
cuaacuagaaggaugagaa

SEQ ID NO: 1568895 - RNA, 19 nt, Homo sapiens
gcuaacuggaggcugauuu

SEQ ID NO: 1568896 - RNA, 19 nt, Homo sapiens
ugggagcgccucucuuuga

SEQ ID NO: 1568897 - RNA, 19 nt, Homo sapiens
cuccuccgcuguuucguaa

SEQ ID NO: 1568898 - RNA, 19 nt, Homo sapiens
aggaugagaaggaaauaaa

SEQ ID NO: 1568899 - RNA, 19 nt, Homo sapiens
cgaauuuccagucuccaaa

SEQ ID NO: 1568900 - RNA, 19 nt, Homo sapiens
uuccauguaucugagaaua

SEQ ID NO: 1568901 - RNA, 19 nt, Homo sapiens
gguacgacgacguggagua

SEQ ID NO: 1568902 - RNA, 19 nt, Homo sapiens
gcuccuccgcuguuucgua

SEQ ID NO: 1568903 - RNA, 19 nt, Homo sapiens
gggagcgccucucuuugag

SEQ ID NO: 1568904 - RNA, 19 nt, Homo sapiens
uuucguaaccauauccuuu

SEQ ID NO: 1568905 - RNA, 19 nt, Homo sapiens
uauuagacaucccugaaac

SEQ ID NO: 1568906 - RNA, 19 nt, Homo sapiens
agaaggaugagaaggaaau

SEQ ID NO: 1568907 - RNA, 19 nt, Homo sapiens
acuggaggcugauuucuac

SEQ ID NO: 1568908 - RNA, 19 nt, Homo sapiens
gaauuuccagucuccaaag

SEQ ID NO: 1568909 - RNA, 19 nt, Homo sapiens
ucaguuaaccgaauuucca

SEQ ID NO: 1568910 - RNA, 19 nt, Homo sapiens
uaacuagaaggaugagaag

SEQ ID NO: 1568911 - RNA, 19 nt, Homo sapiens
gcgcgcuucucccugaauc

SEQ ID NO: 1568912 - RNA, 19 nt, Homo sapiens
gggaauuaagcaacugaga

SEQ ID NO: 1568913 - RNA, 19 nt, Homo sapiens
uuuggucgcugggauguga

SEQ ID NO: 1568914 - RNA, 19 nt, Homo sapiens
uaaggcugguuauaaaaga

SEQ ID NO: 1568915 - RNA, 19 nt, Homo sapiens
gaagcgucaucuggagaag

SEQ ID NO: 1568916 - RNA, 19 nt, Homo sapiens
ccacucuggccuccucuug

SEQ ID NO: 1568917 - RNA, 19 nt, Homo sapiens
acuagaaggaugagaagga

SEQ ID NO: 1568918 - RNA, 19 nt, Homo sapiens
cauauuucuuccauguauc

SEQ ID NO: 1568919 - RNA, 19 nt, Homo sapiens
uuaagcaacugagaaaaug

SEQ ID NO: 1568920 - RNA, 19 nt, Homo sapiens
gaaacuccaucucuacuaa

SEQ ID NO: 1568921 - RNA, 19 nt, Homo sapiens
gaaugcagaauguguaaua

SEQ ID NO: 1568922 - RNA, 19 nt, Homo sapiens
gcaccagucucuccacuug

SEQ ID NO: 1568923 - RNA, 19 nt, Homo sapiens
gcagugagcaugucuaaug

SEQ ID NO: 1568924 - RNA, 19 nt, Homo sapiens
ggaaguguacugccagaua

SEQ ID NO: 1568925 - RNA, 19 nt, Homo sapiens
uguaauagcucacaauaag

SEQ ID NO: 1568926 - RNA, 19 nt, Homo sapiens
gaaguguacugccagauag

SEQ ID NO: 1568927 - RNA, 19 nt, Homo sapiens
gagccuccauuuccuguaa

SEQ ID NO: 1568928 - RNA, 19 nt, Homo sapiens
gauguaaauugcuucauag

SEQ ID NO: 1568929 - RNA, 19 nt, Homo sapiens
uaaaugugaucgaugaugu

SEQ ID NO: 1568930 - RNA, 19 nt, Homo sapiens
gcugaaugcuguuuaucuu

SEQ ID NO: 1568931 - RNA, 19 nt, Homo sapiens
cuuagucagucaacacuua

SEQ ID NO: 1568932 - RNA, 19 nt, Homo sapiens
gcagacacuugaauucaca

SEQ ID NO: 1568933 - RNA, 19 nt, Homo sapiens
caaacugggugaauaaggu

SEQ ID NO: 1568934 - RNA, 19 nt, Homo sapiens
ggagagcccugcugaagac

SEQ ID NO: 1568935 - RNA, 19 nt, Homo sapiens
gcaccaagacugcgccauu

SEQ ID NO: 1568936 - RNA, 19 nt, Homo sapiens
ccacacaaccucacaagga

SEQ ID NO: 1568937 - RNA, 19 nt, Homo sapiens
aauguaggccugcuucuua

SEQ ID NO: 1568938 - RNA, 19 nt, Homo sapiens
uaagggcccuagucaaugu

SEQ ID NO: 1568939 - RNA, 19 nt, Homo sapiens
ccagaucccuacacucuca

SEQ ID NO: 1568940 - RNA, 19 nt, Homo sapiens
ggagggcaguccacaaugg

SEQ ID NO: 1568941 - RNA, 19 nt, Homo sapiens
ugugaucgaugauguaaau

SEQ ID NO: 1568942 - RNA, 19 nt, Homo sapiens
cauaaaguugugagaguua

SEQ ID NO: 1568943 - RNA, 19 nt, Homo sapiens
gaacagacacauccgacau

SEQ ID NO: 1568944 - RNA, 19 nt, Homo sapiens
ggaauagaggagaguguaa

SEQ ID NO: 1568945 - RNA, 19 nt, Homo sapiens
caacuccacuuucucuaag

SEQ ID NO: 1568946 - RNA, 19 nt, Homo sapiens
ccaaggaggagcucauuga

SEQ ID NO: 1568947 - RNA, 19 nt, Homo sapiens
gacucaaacugggugaaua

SEQ ID NO: 1568948 - RNA, 19 nt, Homo sapiens
aaacaaaacuagacaagug

SEQ ID NO: 1568949 - RNA, 19 nt, Homo sapiens
gcaugucuaauguuccuua

SEQ ID NO: 1568950 - RNA, 19 nt, Homo sapiens
guaagauggugcagaugau

SEQ ID NO: 1568951 - RNA, 19 nt, Homo sapiens
gaucaugguugggacacuu

SEQ ID NO: 1568952 - RNA, 19 nt, Homo sapiens
guuaagggcccuagucaau

SEQ ID NO: 1568953 - RNA, 19 nt, Homo sapiens
gaucgaugauguaaauugc

SEQ ID NO: 1568954 - RNA, 19 nt, Homo sapiens
ccacuggccucuucaacuc

SEQ ID NO: 1568955 - RNA, 19 nt, Homo sapiens
acagacacauccgacauaa

SEQ ID NO: 1568956 - RNA, 19 nt, Homo sapiens
cagcaagccuuauguaacg

SEQ ID NO: 1568957 - RNA, 19 nt, Homo sapiens
gugagcaugucuaauguuc

SEQ ID NO: 1568958 - RNA, 19 nt, Homo sapiens
guacgaggaugcaguuuug

SEQ ID NO: 1568959 - RNA, 19 nt, Homo sapiens
ucauaaaguugugagaguu

SEQ ID NO: 1568960 - RNA, 19 nt, Homo sapiens
gagauugggcuuuggaaca

SEQ ID NO: 1568961 - RNA, 19 nt, Homo sapiens
caccaagacugcgccauug

SEQ ID NO: 1568962 - RNA, 19 nt, Homo sapiens
aguuaaaugugaucgauga

SEQ ID NO: 1568963 - RNA, 19 nt, Homo sapiens
gagcccugcugaagacuca

SEQ ID NO: 1568964 - RNA, 19 nt, Homo sapiens
gaggucaggaguucaagaa

SEQ ID NO: 1568965 - RNA, 19 nt, Homo sapiens
ggagaugauugagcugcuu

SEQ ID NO: 1568966 - RNA, 19 nt, Homo sapiens
ggaacuaggccaagaacag

SEQ ID NO: 1568967 - RNA, 19 nt, Homo sapiens
gcaugccaccuguaucauu

SEQ ID NO: 1568968 - RNA, 19 nt, Homo sapiens
gaacucgcccuuggcaaug

SEQ ID NO: 1568969 - RNA, 19 nt, Homo sapiens
gagcagcuuugggaacugu

SEQ ID NO: 1568970 - RNA, 19 nt, Homo sapiens
gagcaugucuaauguuccu

SEQ ID NO: 1568971 - RNA, 19 nt, Homo sapiens
gaaaaggcuucccaagaca

SEQ ID NO: 1568972 - RNA, 19 nt, Homo sapiens
ggaggaacuaggccaagaa

SEQ ID NO: 1568973 - RNA, 19 nt, Homo sapiens
ucaacuccacuuucucuaa

SEQ ID NO: 1568974 - RNA, 19 nt, Homo sapiens
ggaaggagccacacaaccu

SEQ ID NO: 1568975 - RNA, 19 nt, Homo sapiens
ccuguaagauggugcagau

SEQ ID NO: 1568976 - RNA, 19 nt, Homo sapiens
caugccaccuguaucauuc

SEQ ID NO: 1568977 - RNA, 19 nt, Homo sapiens
caggaugacccacgcauug

SEQ ID NO: 1568978 - RNA, 19 nt, Homo sapiens
gaacagccugaccaacaug

SEQ ID NO: 1568979 - RNA, 19 nt, Homo sapiens
ugauugagcugcuucuacu

SEQ ID NO: 1568980 - RNA, 19 nt, Homo sapiens
gcaccuguaaucucagcua

SEQ ID NO: 1568981 - RNA, 19 nt, Homo sapiens
gcggcugaaugcuguuuau

SEQ ID NO: 1568982 - RNA, 19 nt, Homo sapiens
uggccgaggugaagaaauc

SEQ ID NO: 1568983 - RNA, 19 nt, Homo sapiens
uggugauccugcacgauua

SEQ ID NO: 1568984 - RNA, 19 nt, Homo sapiens
uuucagaguucacguccaa

SEQ ID NO: 1568985 - RNA, 19 nt, Homo sapiens
ccuggacucuggcaaaaua

SEQ ID NO: 1568986 - RNA, 19 nt, Homo sapiens
cuacgugacacucaaaugu

SEQ ID NO: 1568987 - RNA, 19 nt, Homo sapiens
gugugcaccuguaaucuca

SEQ ID NO: 1568988 - RNA, 19 nt, Homo sapiens
ugaaacuccaucucuacua

SEQ ID NO: 1568989 - RNA, 19 nt, Homo sapiens
uggugaaacuccaucucua

SEQ ID NO: 1568990 - RNA, 19 nt, Homo sapiens
aagaacagccugaccaaca

SEQ ID NO: 1568991 - RNA, 19 nt, Homo sapiens
cagugagcaugucuaaugu

SEQ ID NO: 1568992 - RNA, 19 nt, Homo sapiens
gugcagugagcaugucuaa

SEQ ID NO: 1568993 - RNA, 19 nt, Homo sapiens
caaagugcagugagcaugu

SEQ ID NO: 1568994 - RNA, 19 nt, Homo sapiens
ugaaggaaaccgucagcaa

SEQ ID NO: 1568995 - RNA, 19 nt, Homo sapiens
ugaauucacaugcgaguca

SEQ ID NO: 1568996 - RNA, 19 nt, Homo sapiens
agaacagccugaccaacau

SEQ ID NO: 1568997 - RNA, 19 nt, Homo sapiens
uguaagauggugcagauga

SEQ ID NO: 1568998 - RNA, 19 nt, Homo sapiens
uagaaugcagaauguguaa

SEQ ID NO: 1568999 - RNA, 19 nt, Homo sapiens
ucgaugauguaaauugcuu

SEQ ID NO: 1569000 - RNA, 19 nt, Homo sapiens
acucaaacugggugaauaa

SEQ ID NO: 1569001 - RNA, 19 nt, Homo sapiens
gguacaaccgucuggauca

SEQ ID NO: 1569002 - RNA, 19 nt, Homo sapiens
ugagcugcuucuacuaaga

SEQ ID NO: 1569003 - RNA, 19 nt, Homo sapiens
gagcugcuucuacuaagau

SEQ ID NO: 1569004 - RNA, 19 nt, Homo sapiens
aaauuaaccaggcuugaug

SEQ ID NO: 1569005 - RNA, 19 nt, Homo sapiens
cuucauagaaugcagaaug

SEQ ID NO: 1569006 - RNA, 19 nt, Homo sapiens
agacacauccgacauaaaa

SEQ ID NO: 1569007 - RNA, 19 nt, Homo sapiens
gaauagaggagaguguaag

SEQ ID NO: 1569008 - RNA, 19 nt, Homo sapiens
caugucuaauguuccuuaa

SEQ ID NO: 1569009 - RNA, 19 nt, Homo sapiens
cuccacaccugguucauca

SEQ ID NO: 1569010 - RNA, 19 nt, Homo sapiens
cugaaugcuguuuaucuua

SEQ ID NO: 1569011 - RNA, 19 nt, Homo sapiens
ggaugacccacgcauuguu

SEQ ID NO: 1569012 - RNA, 19 nt, Homo sapiens
gguguacuguggccucauc

SEQ ID NO: 1569013 - RNA, 19 nt, Homo sapiens
ccuguaaucccagcacuuu

SEQ ID NO: 1569014 - RNA, 19 nt, Homo sapiens
agacaaguggcaccagaaa

SEQ ID NO: 1569015 - RNA, 19 nt, Homo sapiens
uagcucuucuugucucuuc

SEQ ID NO: 1569016 - RNA, 19 nt, Homo sapiens
guguaauagcucacaauaa

SEQ ID NO: 1569017 - RNA, 19 nt, Homo sapiens
cauagaaugcagaaugugu

SEQ ID NO: 1569018 - RNA, 19 nt, Homo sapiens
ugaugaggcaguuucugua

SEQ ID NO: 1569019 - RNA, 19 nt, Homo sapiens
agaguuaaaugugaucgau

SEQ ID NO: 1569020 - RNA, 19 nt, Homo sapiens
aaacagacaucucacauuu

SEQ ID NO: 1569021 - RNA, 19 nt, Homo sapiens
gaaagcacaguuccuauua

SEQ ID NO: 1569022 - RNA, 19 nt, Homo sapiens
ggagaauccucauguacaa

SEQ ID NO: 1569023 - RNA, 19 nt, Homo sapiens
ggucuaggcuuucuucuca

SEQ ID NO: 1569024 - RNA, 19 nt, Homo sapiens
ugacagaccugccgagaug

SEQ ID NO: 1569025 - RNA, 19 nt, Homo sapiens
gcacaguuccuauuauuug

SEQ ID NO: 1569026 - RNA, 19 nt, Homo sapiens
ccaaauguguugagaugaa

SEQ ID NO: 1569027 - RNA, 19 nt, Homo sapiens
ccaaagcaauucacauuuc

SEQ ID NO: 1569028 - RNA, 19 nt, Homo sapiens
guucaggcauucucucuuu

SEQ ID NO: 1569029 - RNA, 19 nt, Homo sapiens
cugcagcgcuucugucuuu

SEQ ID NO: 1569030 - RNA, 19 nt, Homo sapiens
aagaggagcugacacaaga

SEQ ID NO: 1569031 - RNA, 19 nt, Homo sapiens
gcagucagcuguucaagac

SEQ ID NO: 1569032 - RNA, 19 nt, Homo sapiens
caucgaaagccaagaauuu

SEQ ID NO: 1569033 - RNA, 19 nt, Homo sapiens
gagaugaaccauuguggaa

SEQ ID NO: 1569034 - RNA, 19 nt, Homo sapiens
caauucacauuucuucuuc

SEQ ID NO: 1569035 - RNA, 19 nt, Homo sapiens
gcaauucacauuucuucuu

SEQ ID NO: 1569036 - RNA, 19 nt, Homo sapiens
aagcacaguuccuauuauu

SEQ ID NO: 1569037 - RNA, 19 nt, Homo sapiens
guguugagaugaaccauug

SEQ ID NO: 1569038 - RNA, 19 nt, Homo sapiens
guauagauuucucauccuu

SEQ ID NO: 1569039 - RNA, 19 nt, Homo sapiens
gaccuaauaugugaccauu

SEQ ID NO: 1569040 - RNA, 19 nt, Homo sapiens
caaagcaauucacauuucu

SEQ ID NO: 1569041 - RNA, 19 nt, Homo sapiens
guaagaaacugugggaacu

SEQ ID NO: 1569042 - RNA, 19 nt, Homo sapiens
ucagugggauuucacauag

SEQ ID NO: 1569043 - RNA, 19 nt, Homo sapiens
cagaggaugggaaagaaua

SEQ ID NO: 1569044 - RNA, 19 nt, Homo sapiens
ccacuggacauaaugauug

SEQ ID NO: 1569045 - RNA, 19 nt, Homo sapiens
uggcauaaaucucagacuu

SEQ ID NO: 1569046 - RNA, 19 nt, Homo sapiens
gaacuugauggcauaaauc

SEQ ID NO: 1569047 - RNA, 19 nt, Homo sapiens
aaccaaauguguugagaug

SEQ ID NO: 1569048 - RNA, 19 nt, Homo sapiens
acgcggagcuucccuguuc

SEQ ID NO: 1569049 - RNA, 19 nt, Homo sapiens
ggaugaagaaggcuauuuc

SEQ ID NO: 1569050 - RNA, 19 nt, Homo sapiens
ggacauaaugauugagugu

SEQ ID NO: 1569051 - RNA, 19 nt, Homo sapiens
aagaaacugugggaacuuu

SEQ ID NO: 1569052 - RNA, 19 nt, Homo sapiens
uucaagaccuaauauguga

SEQ ID NO: 1569053 - RNA, 19 nt, Homo sapiens
gaggauagaaagcacaguu

SEQ ID NO: 1569054 - RNA, 19 nt, Homo sapiens
gaauugagcacuauaucag

SEQ ID NO: 1569055 - RNA, 19 nt, Homo sapiens
gaugaaccauuguggaacu

SEQ ID NO: 1569056 - RNA, 19 nt, Homo sapiens
aaagcacaguuccuauuau

SEQ ID NO: 1569057 - RNA, 19 nt, Homo sapiens
caaaucccagugucuguaa

SEQ ID NO: 1569058 - RNA, 19 nt, Homo sapiens
gccaaagcaauucacauuu

SEQ ID NO: 1569059 - RNA, 19 nt, Homo sapiens
gaucaagaaugcaaaaucu

SEQ ID NO: 1569060 - RNA, 19 nt, Homo sapiens
gaccacaguucaggcauuc

SEQ ID NO: 1569061 - RNA, 19 nt, Homo sapiens
caaaguguagccaucgaaa

SEQ ID NO: 1569062 - RNA, 19 nt, Homo sapiens
agaacuugauggcauaaau

SEQ ID NO: 1569063 - RNA, 19 nt, Homo sapiens
uuuagaacuugauggcaua

SEQ ID NO: 1569064 - RNA, 19 nt, Homo sapiens
uauuucugaugcacgauua

SEQ ID NO: 1569065 - RNA, 19 nt, Homo sapiens
auagauuucucauccuuga

SEQ ID NO: 1569066 - RNA, 19 nt, Homo sapiens
guucaagaccuaauaugug

SEQ ID NO: 1569067 - RNA, 19 nt, Homo sapiens
cagccugaauugagcacua

SEQ ID NO: 1569068 - RNA, 19 nt, Homo sapiens
ucaaagaggagcugacaca

SEQ ID NO: 1569069 - RNA, 19 nt, Homo sapiens
cuucuuggccgaaagcaua

SEQ ID NO: 1569070 - RNA, 19 nt, Homo sapiens
gaacgaggacgcggagcuu

SEQ ID NO: 1569071 - RNA, 19 nt, Homo sapiens
agaaagcacaguuccuauu

SEQ ID NO: 1569072 - RNA, 19 nt, Homo sapiens
gaauacuaccugaggauag

SEQ ID NO: 1569073 - RNA, 19 nt, Homo sapiens
uaagcuacagccugaauug

SEQ ID NO: 1569074 - RNA, 19 nt, Homo sapiens
ugaaacaggaggugauugu

SEQ ID NO: 1569075 - RNA, 19 nt, Homo sapiens
aauacuaccugaggauaga

SEQ ID NO: 1569076 - RNA, 19 nt, Homo sapiens
cacaagagaccacaguuca

SEQ ID NO: 1569077 - RNA, 19 nt, Homo sapiens
caaguccauuccuguuuua

SEQ ID NO: 1569078 - RNA, 19 nt, Homo sapiens
acauaaugauugagugugu

SEQ ID NO: 1569079 - RNA, 19 nt, Homo sapiens
ggcauaaaucucagacuug

SEQ ID NO: 1569080 - RNA, 19 nt, Homo sapiens
uaucagaggaugggaaaga

SEQ ID NO: 1569081 - RNA, 19 nt, Homo sapiens
ugaauugagcacuauauca

SEQ ID NO: 1569082 - RNA, 19 nt, Homo sapiens
ccaugugguucugaugaaa

SEQ ID NO: 1569083 - RNA, 19 nt, Homo sapiens
ugccaaagcaauucacauu

SEQ ID NO: 1569084 - RNA, 19 nt, Homo sapiens
gaauuuagugagcuugauc

SEQ ID NO: 1569085 - RNA, 19 nt, Homo sapiens
ccuaauaugugaccauucc

SEQ ID NO: 1569086 - RNA, 19 nt, Homo sapiens
agaccacaguucaggcauu

SEQ ID NO: 1569087 - RNA, 19 nt, Homo sapiens
cauaaugauugaguguguu

SEQ ID NO: 1569088 - RNA, 19 nt, Homo sapiens
ucaaaucccagugucugua

SEQ ID NO: 1569089 - RNA, 19 nt, Homo sapiens
caaacugacgauugccaaa

SEQ ID NO: 1569090 - RNA, 19 nt, Homo sapiens
cuuggagaauccucaugua

SEQ ID NO: 1569091 - RNA, 19 nt, Homo sapiens
aaacaggaggugauugugu

SEQ ID NO: 1569092 - RNA, 19 nt, Homo sapiens
cgagaugccaaccaaaugu

SEQ ID NO: 1569093 - RNA, 19 nt, Homo sapiens
gaauccucauguacaaagu

SEQ ID NO: 1569094 - RNA, 19 nt, Homo sapiens
gaggagcugacacaagaga

SEQ ID NO: 1569095 - RNA, 19 nt, Homo sapiens
ucaaguccauuccuguuuu

SEQ ID NO: 1569096 - RNA, 19 nt, Homo sapiens
cacuggacauaaugauuga

SEQ ID NO: 1569097 - RNA, 19 nt, Homo sapiens
cacaguuccuauuauuugu

SEQ ID NO: 1569098 - RNA, 19 nt, Homo sapiens
auagaaagcacaguuccua

SEQ ID NO: 1569099 - RNA, 19 nt, Homo sapiens
gagaauccucauguacaaa

SEQ ID NO: 1569100 - RNA, 19 nt, Homo sapiens
uugauugaguccaggcuuu

SEQ ID NO: 1569101 - RNA, 19 nt, Homo sapiens
gaaacaggaggugauugug

SEQ ID NO: 1569102 - RNA, 19 nt, Homo sapiens
cgauuacacccaugugguu

SEQ ID NO: 1569103 - RNA, 19 nt, Homo sapiens
guccauuccuguuuuaauu

SEQ ID NO: 1569104 - RNA, 19 nt, Homo sapiens
auugacagcuugugcaaca

SEQ ID NO: 1569105 - RNA, 19 nt, Homo sapiens
uauaucagaggaugggaaa

SEQ ID NO: 1569106 - RNA, 19 nt, Homo sapiens
gaaggcuauuucugaugca

SEQ ID NO: 1569107 - RNA, 19 nt, Homo sapiens
cuucggaguccuuauagaa

SEQ ID NO: 1569108 - RNA, 19 nt, Homo sapiens
uugccaagauuguaaaguc

SEQ ID NO: 1569109 - RNA, 19 nt, Homo sapiens
caguuccuauuauuuguuc

SEQ ID NO: 1569110 - RNA, 19 nt, Homo sapiens
agaauacuaccugaggaua

SEQ ID NO: 1569111 - RNA, 19 nt, Homo sapiens
caaauguguugagaugaac

SEQ ID NO: 1569112 - RNA, 19 nt, Homo sapiens
gccgagaugccaaccaaau

SEQ ID NO: 1569113 - RNA, 19 nt, Homo sapiens
gugaaagcaucaaaacaga

SEQ ID NO: 1569114 - RNA, 19 nt, Homo sapiens
acaaccaacucagggaugu

SEQ ID NO: 1569115 - RNA, 19 nt, Homo sapiens
cggccaaacugacgauugc

SEQ ID NO: 1569116 - RNA, 19 nt, Homo sapiens
ggugaucgcgcugauguuc

SEQ ID NO: 1569117 - RNA, 19 nt, Homo sapiens
caaagaggagcugacacaa

SEQ ID NO: 1569118 - RNA, 19 nt, Homo sapiens
gagaugccaaccaaaugug

SEQ ID NO: 1569119 - RNA, 19 nt, Homo sapiens
caauugacagcuugugcaa

SEQ ID NO: 1569120 - RNA, 19 nt, Homo sapiens
gaagaaccgcucucagaua

SEQ ID NO: 1569121 - RNA, 19 nt, Homo sapiens
gaagaaccgcucucacaua

SEQ ID NO: 1569122 - RNA, 19 nt, Homo sapiens
ggacaugagcuguguguuu

SEQ ID NO: 1569123 - RNA, 19 nt, Homo sapiens
ggucuaaggugaucagaug

SEQ ID NO: 1569124 - RNA, 19 nt, Homo sapiens
gaacuuuauuccaaugcua

SEQ ID NO: 1569125 - RNA, 19 nt, Homo sapiens
gaugagaguuauaguuguu

SEQ ID NO: 1569126 - RNA, 19 nt, Homo sapiens
gacgaggacuccaaacaaa

SEQ ID NO: 1569127 - RNA, 19 nt, Homo sapiens
gaagaaccgcucucgcaua

SEQ ID NO: 1569128 - RNA, 19 nt, Homo sapiens
gcugugugaugguauuaua

SEQ ID NO: 1569129 - RNA, 19 nt, Homo sapiens
agaagaaccuggaccauuc

SEQ ID NO: 1569130 - RNA, 19 nt, Homo sapiens
ccacagauuguaacagaua

SEQ ID NO: 1569131 - RNA, 19 nt, Homo sapiens
ucagaaagauggcuuagag

SEQ ID NO: 1569132 - RNA, 19 nt, Homo sapiens
gaggauguguguucuaaag

SEQ ID NO: 1569133 - RNA, 19 nt, Homo sapiens
gaaccuggaccauucuuga

SEQ ID NO: 1569134 - RNA, 19 nt, Homo sapiens
acaguggccugguuucuuu

SEQ ID NO: 1569135 - RNA, 19 nt, Homo sapiens
ggauguguguucuaaagga

SEQ ID NO: 1569136 - RNA, 19 nt, Homo sapiens
gaaccgcucucagauaguc

SEQ ID NO: 1569137 - RNA, 19 nt, Homo sapiens
ugaauacagugaucacguu

SEQ ID NO: 1569138 - RNA, 19 nt, Homo sapiens
ugauggagcugaauacagu

SEQ ID NO: 1569139 - RNA, 19 nt, Homo sapiens
aaagauggcuuagagaagu

SEQ ID NO: 1569140 - RNA, 19 nt, Homo sapiens
ggaaauuguuguacuuuug

SEQ ID NO: 1569141 - RNA, 19 nt, Homo sapiens
ggaagaaccgcucucagau

SEQ ID NO: 1569142 - RNA, 19 nt, Homo sapiens
ugaggauccugucauuaaa

SEQ ID NO: 1569143 - RNA, 19 nt, Homo sapiens
ccuaaauucugacgauaga

SEQ ID NO: 1569144 - RNA, 19 nt, Homo sapiens
caagagaacaauagagugu

SEQ ID NO: 1569145 - RNA, 19 nt, Homo sapiens
gaaagauggcuuagagaag

SEQ ID NO: 1569146 - RNA, 19 nt, Homo sapiens
gcuugaggauccugucauu

SEQ ID NO: 1569147 - RNA, 19 nt, Homo sapiens
agaugaagcugaagcaaca

SEQ ID NO: 1569148 - RNA, 19 nt, Homo sapiens
aagaggauguguguucuaa

SEQ ID NO: 1569149 - RNA, 19 nt, Homo sapiens
guuugugacugaauuguga

SEQ ID NO: 1569150 - RNA, 19 nt, Homo sapiens
gugaugguauuauaacugu

SEQ ID NO: 1569151 - RNA, 19 nt, Homo sapiens
aagaaccgcucucagauag

SEQ ID NO: 1569152 - RNA, 19 nt, Homo sapiens
ggacgacgaggacuccaaa

SEQ ID NO: 1569153 - RNA, 19 nt, Homo sapiens
gaacuuuucucaccuucaa

SEQ ID NO: 1569154 - RNA, 19 nt, Homo sapiens
gcauacccuugcuccguaa

SEQ ID NO: 1569155 - RNA, 19 nt, Homo sapiens
gacaugagcuguguguuuu

SEQ ID NO: 1569156 - RNA, 19 nt, Homo sapiens
gauuggcacagaauucuuu

SEQ ID NO: 1569157 - RNA, 19 nt, Homo sapiens
ccacaguccaggagcauuu

SEQ ID NO: 1569158 - RNA, 19 nt, Homo sapiens
ccaggaguguuuccaguuc

SEQ ID NO: 1569159 - RNA, 19 nt, Homo sapiens
gcucucagauaguccuguu

SEQ ID NO: 1569160 - RNA, 19 nt, Homo sapiens
ggaagaaccgcucucacau

SEQ ID NO: 1569161 - RNA, 19 nt, Homo sapiens
uguaacagauagcuucaug

SEQ ID NO: 1569162 - RNA, 19 nt, Homo sapiens
gaaauaucagugccacaga

SEQ ID NO: 1569163 - RNA, 19 nt, Homo sapiens
ccacaaggacuucaacagu

SEQ ID NO: 1569164 - RNA, 19 nt, Homo sapiens
guaggucccuuggcuggaa

SEQ ID NO: 1569165 - RNA, 19 nt, Homo sapiens
uuaaagaggauguguguuc

SEQ ID NO: 1569166 - RNA, 19 nt, Homo sapiens
auaaagcugugugauggua

SEQ ID NO: 1569167 - RNA, 19 nt, Homo sapiens
uugaauagaugcuguuucu

SEQ ID NO: 1569168 - RNA, 19 nt, Homo sapiens
gggcucagauuggcacaga

SEQ ID NO: 1569169 - RNA, 19 nt, Homo sapiens
cuggagguccuguuucuua

SEQ ID NO: 1569170 - RNA, 19 nt, Homo sapiens
cagaggaguuggaggagau

SEQ ID NO: 1569171 - RNA, 19 nt, Homo sapiens
cgacgaggacuccaaacaa

SEQ ID NO: 1569172 - RNA, 19 nt, Homo sapiens
ugugugggcucaagaugaa

SEQ ID NO: 1569173 - RNA, 19 nt, Homo sapiens
gugaucagaugcagaagca

SEQ ID NO: 1569174 - RNA, 19 nt, Homo sapiens
gauuuggcauguuuguaug

SEQ ID NO: 1569175 - RNA, 19 nt, Homo sapiens
uauuauaugugcuccugaa

SEQ ID NO: 1569176 - RNA, 19 nt, Homo sapiens
ugccacagauuguaacaga

SEQ ID NO: 1569177 - RNA, 19 nt, Homo sapiens
ugugagaauucagauguaa

SEQ ID NO: 1569178 - RNA, 19 nt, Homo sapiens
aaacgucgguuccacuucu

SEQ ID NO: 1569179 - RNA, 19 nt, Homo sapiens
aagaaccgcucucacauac

SEQ ID NO: 1569180 - RNA, 19 nt, Homo sapiens
agaaagauggcuuagagaa

SEQ ID NO: 1569181 - RNA, 19 nt, Homo sapiens
uugaggauccugucauuaa

SEQ ID NO: 1569182 - RNA, 19 nt, Homo sapiens
gaagcaacagcgaguguca

SEQ ID NO: 1569183 - RNA, 19 nt, Homo sapiens
uaaagaggauguguguucu

SEQ ID NO: 1569184 - RNA, 19 nt, Homo sapiens
uaacagauagcuucaugca

SEQ ID NO: 1569185 - RNA, 19 nt, Homo sapiens
gaaaugugagaauucagau

SEQ ID NO: 1569186 - RNA, 19 nt, Homo sapiens
gcugaagggagcaugguuu

SEQ ID NO: 1569187 - RNA, 19 nt, Homo sapiens
aaagcugugugaugguauu

SEQ ID NO: 1569188 - RNA, 19 nt, Homo sapiens
gagaauucaguugugauuu

SEQ ID NO: 1569189 - RNA, 19 nt, Homo sapiens
uagaagaaccuggaccauu

SEQ ID NO: 1569190 - RNA, 19 nt, Homo sapiens
gaggagaggaaccauuugu

SEQ ID NO: 1569191 - RNA, 19 nt, Homo sapiens
aagcgucgguuccaguuau

SEQ ID NO: 1569192 - RNA, 19 nt, Homo sapiens
aagaaccgcucucgcauac

SEQ ID NO: 1569193 - RNA, 19 nt, Homo sapiens
aaauaucagugccacagau

SEQ ID NO: 1569194 - RNA, 19 nt, Homo sapiens
ccaacgccuucauuucuuc

SEQ ID NO: 1569195 - RNA, 19 nt, Homo sapiens
agagaacaauagagugugu

SEQ ID NO: 1569196 - RNA, 19 nt, Homo sapiens
caucuauguuugaaaugug

SEQ ID NO: 1569197 - RNA, 19 nt, Homo sapiens
ggagcugaauacagugauc

SEQ ID NO: 1569198 - RNA, 19 nt, Homo sapiens
agauaguccuguuccagaa

SEQ ID NO: 1569199 - RNA, 19 nt, Homo sapiens
ugauuuggcauguuuguau

SEQ ID NO: 1569200 - RNA, 19 nt, Homo sapiens
ugagaauucaguugugauu

SEQ ID NO: 1569201 - RNA, 19 nt, Homo sapiens
gcgcucgccuuuccuagag

SEQ ID NO: 1569202 - RNA, 19 nt, Homo sapiens
gaggagauccaggcuuaug

SEQ ID NO: 1569203 - RNA, 19 nt, Homo sapiens
gauaguccuguuccagaaa

SEQ ID NO: 1569204 - RNA, 19 nt, Homo sapiens
gugacugaauugugagaau

SEQ ID NO: 1569205 - RNA, 19 nt, Homo sapiens
guaagaaaccaggaguguu

SEQ ID NO: 1569206 - RNA, 19 nt, Homo sapiens
ccaggaaggaggagaggaa

SEQ ID NO: 1569207 - RNA, 19 nt, Homo sapiens
caguuacgccguugcauga

SEQ ID NO: 1569208 - RNA, 19 nt, Homo sapiens
gaagagggaguggucagau

SEQ ID NO: 1569209 - RNA, 19 nt, Homo sapiens
caauaccaacgccuucauu

SEQ ID NO: 1569210 - RNA, 19 nt, Homo sapiens
uguguggccucaagaugaa

SEQ ID NO: 1569211 - RNA, 19 nt, Homo sapiens
ggccugguuucuuuacuca

SEQ ID NO: 1569212 - RNA, 19 nt, Homo sapiens
uuagguuugugacugaauu

SEQ ID NO: 1569213 - RNA, 19 nt, Homo sapiens
ggaagagggaguggucaga

SEQ ID NO: 1569214 - RNA, 19 nt, Homo sapiens
aggaagaaccgcucucaga

SEQ ID NO: 1569215 - RNA, 19 nt, Homo sapiens
caucuuccacuuccuguau

SEQ ID NO: 1569216 - RNA, 19 nt, Homo sapiens
ugugagaauucaguuguga

SEQ ID NO: 1569217 - RNA, 19 nt, Homo sapiens
ggucaucggccugagagaa

SEQ ID NO: 1569218 - RNA, 19 nt, Homo sapiens
gcucagauuggcacagaau

SEQ ID NO: 1569219 - RNA, 19 nt, Homo sapiens
ggaaccauuugugcagauc

SEQ ID NO: 1569220 - RNA, 19 nt, Homo sapiens
ggauuacccuuauuuauga

SEQ ID NO: 1569221 - RNA, 19 nt, Homo sapiens
ggaguaagaugugcaagaa

SEQ ID NO: 1569222 - RNA, 19 nt, Homo sapiens
guaaagguccagcacauua

SEQ ID NO: 1569223 - RNA, 19 nt, Homo sapiens
gugaagggauuaauauuga

SEQ ID NO: 1569224 - RNA, 19 nt, Homo sapiens
aacagaagcuucacuauug

SEQ ID NO: 1569225 - RNA, 19 nt, Homo sapiens
caggauagauauugaagaa

SEQ ID NO: 1569226 - RNA, 19 nt, Homo sapiens
gaaagaaacagaagcuuca

SEQ ID NO: 1569227 - RNA, 19 nt, Homo sapiens
gaaacaaaguugagagaac

SEQ ID NO: 1569228 - RNA, 19 nt, Homo sapiens
gaggucaucucauccuuga

SEQ ID NO: 1569229 - RNA, 19 nt, Homo sapiens
gaacaugcuggccuaauug

SEQ ID NO: 1569230 - RNA, 19 nt, Homo sapiens
ggaccgggauuacccuuau

SEQ ID NO: 1569231 - RNA, 19 nt, Homo sapiens
uaaugggucugcccuauug

SEQ ID NO: 1569232 - RNA, 19 nt, Homo sapiens
gauauuugcccaucacauu

SEQ ID NO: 1569233 - RNA, 19 nt, Homo sapiens
guuguuggauucuuaugua

SEQ ID NO: 1569234 - RNA, 19 nt, Homo sapiens
gaguguuguuggauucuua

SEQ ID NO: 1569235 - RNA, 19 nt, Homo sapiens
gaaguucccaggaguaaga

SEQ ID NO: 1569236 - RNA, 19 nt, Homo sapiens
ggagugaagggauuaauau

SEQ ID NO: 1569237 - RNA, 19 nt, Homo sapiens
ggagaaaguuugcaguaac

SEQ ID NO: 1569238 - RNA, 19 nt, Homo sapiens
gggauuacccuuauuuaug

SEQ ID NO: 1569239 - RNA, 19 nt, Homo sapiens
aaacagaagcuucacuauu

SEQ ID NO: 1569240 - RNA, 19 nt, Homo sapiens
caagcgacguucuuaaaca

SEQ ID NO: 1569241 - RNA, 19 nt, Homo sapiens
gaauuagaacugagucauu

SEQ ID NO: 1569242 - RNA, 19 nt, Homo sapiens
agaacaugcuggccuaauu

SEQ ID NO: 1569243 - RNA, 19 nt, Homo sapiens
aaaccaaucagcuucauuu

SEQ ID NO: 1569244 - RNA, 19 nt, Homo sapiens
gcgaugaauccaaugauaa

SEQ ID NO: 1569245 - RNA, 19 nt, Homo sapiens
uuauucaccuuccugguua

SEQ ID NO: 1569246 - RNA, 19 nt, Homo sapiens
ugcaagacguggaaacuuu

SEQ ID NO: 1569247 - RNA, 19 nt, Homo sapiens
gauauaggaccaagaggaa

SEQ ID NO: 1569248 - RNA, 19 nt, Homo sapiens
gucaagaucuggaggaauc

SEQ ID NO: 1569249 - RNA, 19 nt, Homo sapiens
ggauucacuuugcaucuug

SEQ ID NO: 1569250 - RNA, 19 nt, Homo sapiens
guacagaagcagccacuug

SEQ ID NO: 1569251 - RNA, 19 nt, Homo sapiens
gugaauccauugaaacuag

SEQ ID NO: 1569252 - RNA, 19 nt, Homo sapiens
gcagcaagcgacguucuua

SEQ ID NO: 1569253 - RNA, 19 nt, Homo sapiens
ugaaaaccauugugaagua

SEQ ID NO: 1569254 - RNA, 19 nt, Homo sapiens
caucacauuucucauuuca

SEQ ID NO: 1569255 - RNA, 19 nt, Homo sapiens
caccuagacuccacucuga

SEQ ID NO: 1569256 - RNA, 19 nt, Homo sapiens
guacgaacaccacagaaug

SEQ ID NO: 1569257 - RNA, 19 nt, Homo sapiens
gcaggaaaaucuaucuauu

SEQ ID NO: 1569258 - RNA, 19 nt, Homo sapiens
gaaacagaagcuucacuau

SEQ ID NO: 1569259 - RNA, 19 nt, Homo sapiens
caaauuaugcagucgaguu

SEQ ID NO: 1569260 - RNA, 19 nt, Homo sapiens
gcaaagccagcaaccuuga

SEQ ID NO: 1569261 - RNA, 19 nt, Homo sapiens
uaaacaggccuaaguaaag

SEQ ID NO: 1569262 - RNA, 19 nt, Homo sapiens
ccaaucagcuucauuuuca

SEQ ID NO: 1569263 - RNA, 19 nt, Homo sapiens
ggugugagcuucaaaugcu

SEQ ID NO: 1569264 - RNA, 19 nt, Homo sapiens
caccacaacuggaaguguu

SEQ ID NO: 1569265 - RNA, 19 nt, Homo sapiens
cccaucacauuucucauuu

SEQ ID NO: 1569266 - RNA, 19 nt, Homo sapiens
gcuuuaacauuguaugcuu

SEQ ID NO: 1569267 - RNA, 19 nt, Homo sapiens
ccugccagcuuuaacauug

SEQ ID NO: 1569268 - RNA, 19 nt, Homo sapiens
gaauaccgcagaccauugu

SEQ ID NO: 1569269 - RNA, 19 nt, Homo sapiens
gcugagagaguguacagaa

SEQ ID NO: 1569270 - RNA, 19 nt, Homo sapiens
caacuacacaggagaaagu

SEQ ID NO: 1569271 - RNA, 19 nt, Homo sapiens
ccaaguggguaaggucuga

SEQ ID NO: 1569272 - RNA, 19 nt, Homo sapiens
cagcugcgaugaauccaau

SEQ ID NO: 1569273 - RNA, 19 nt, Homo sapiens
cagcaaagccagcaaccuu

SEQ ID NO: 1569274 - RNA, 19 nt, Homo sapiens
gggcuaggcagugucuuua

SEQ ID NO: 1569275 - RNA, 19 nt, Homo sapiens
aaagaguguuguuggauuc

SEQ ID NO: 1569276 - RNA, 19 nt, Homo sapiens
uuaaacaggccuaaguaaa

SEQ ID NO: 1569277 - RNA, 19 nt, Homo sapiens
gaagaacagaagcaggaaa

SEQ ID NO: 1569278 - RNA, 19 nt, Homo sapiens
aagcuucccuguuggagaa

SEQ ID NO: 1569279 - RNA, 19 nt, Homo sapiens
gagcaggugugagcuucaa

SEQ ID NO: 1569280 - RNA, 19 nt, Homo sapiens
ugcgaugaauccaaugaua

SEQ ID NO: 1569281 - RNA, 19 nt, Homo sapiens
uuaagguccugccagcuuu

SEQ ID NO: 1569282 - RNA, 19 nt, Homo sapiens
gcccaucacauuucucauu

SEQ ID NO: 1569283 - RNA, 19 nt, Homo sapiens
gagagaguguacagaagca

SEQ ID NO: 1569284 - RNA, 19 nt, Homo sapiens
caggagaaaguuugcagua

SEQ ID NO: 1569285 - RNA, 19 nt, Homo sapiens
caaagcagcaagcgacguu

SEQ ID NO: 1569286 - RNA, 19 nt, Homo sapiens
gaaaccaaucagcuucauu

SEQ ID NO: 1569287 - RNA, 19 nt, Homo sapiens
caagaggaaagaaacagaa

SEQ ID NO: 1569288 - RNA, 19 nt, Homo sapiens
gcuaggcagugucuuuaag

SEQ ID NO: 1569289 - RNA, 19 nt, Homo sapiens
agaaacagaagcuucacua

SEQ ID NO: 1569290 - RNA, 19 nt, Homo sapiens
gaaggccggagaacuguau

SEQ ID NO: 1569291 - RNA, 19 nt, Homo sapiens
aggagaaaguuugcaguaa

SEQ ID NO: 1569292 - RNA, 19 nt, Homo sapiens
ugaggccuaugaaauguug

SEQ ID NO: 1569293 - RNA, 19 nt, Homo sapiens
guucugaggccuaugaaau

SEQ ID NO: 1569294 - RNA, 19 nt, Homo sapiens
aagcuucacuauugggaaa

SEQ ID NO: 1569295 - RNA, 19 nt, Homo sapiens
gcagaccauuguaauucau

SEQ ID NO: 1569296 - RNA, 19 nt, Homo sapiens
aaacagcuggccuuuauca

SEQ ID NO: 1569297 - RNA, 19 nt, Homo sapiens
gcaucagguuggaucaugu

SEQ ID NO: 1569298 - RNA, 19 nt, Homo sapiens
aagcgacguucuuaaacaa

SEQ ID NO: 1569299 - RNA, 19 nt, Homo sapiens
aauuagaacugagucauuc

SEQ ID NO: 1569300 - RNA, 19 nt, Homo sapiens
aaacaggccuaaguaaagg

SEQ ID NO: 1569301 - RNA, 19 nt, Homo sapiens
gagugaagggauuaauauu

SEQ ID NO: 1569302 - RNA, 19 nt, Homo sapiens
gaaauguugaugggaagaa

SEQ ID NO: 1569303 - RNA, 19 nt, Homo sapiens
gcgaaguucccaggaguaa

SEQ ID NO: 1569304 - RNA, 19 nt, Homo sapiens
gguaaggucugaggauugc

SEQ ID NO: 1569305 - RNA, 19 nt, Homo sapiens
guacuuugacgaccuagau

SEQ ID NO: 1569306 - RNA, 19 nt, Homo sapiens
cuacacaggagaaaguuug

SEQ ID NO: 1569307 - RNA, 19 nt, Homo sapiens
gaacaccacagaauguacu

SEQ ID NO: 1569308 - RNA, 19 nt, Homo sapiens
gaccgggauuacccuuauu

SEQ ID NO: 1569309 - RNA, 19 nt, Homo sapiens
guccagcacauuauuuauu

SEQ ID NO: 1569310 - RNA, 19 nt, Homo sapiens
gaagaacaugcuggccuaa

SEQ ID NO: 1569311 - RNA, 19 nt, Homo sapiens
gaugauauaggaccaagag

SEQ ID NO: 1569312 - RNA, 19 nt, Homo sapiens
gcacugccggcacaacaga

SEQ ID NO: 1569313 - RNA, 19 nt, Homo sapiens
ugagagggcuaggcagugu

SEQ ID NO: 1569314 - RNA, 19 nt, Homo sapiens
gaaaaccauugugaaguau

SEQ ID NO: 1569315 - RNA, 19 nt, Homo sapiens
gcauggggcuguacugaau

SEQ ID NO: 1569316 - RNA, 19 nt, Homo sapiens
uaaagguccagcacauuau

SEQ ID NO: 1569317 - RNA, 19 nt, Homo sapiens
gagaaaccaaucagcuuca

SEQ ID NO: 1569318 - RNA, 19 nt, Homo sapiens
ggaccaagaggaaagaaac

SEQ ID NO: 1569319 - RNA, 19 nt, Homo sapiens
aaauuaugcagucgaguuu

SEQ ID NO: 1569320 - RNA, 19 nt, Homo sapiens
ggacagcccuggaaacaua

SEQ ID NO: 1569321 - RNA, 19 nt, Homo sapiens
ggaaacauaucuacaggua

SEQ ID NO: 1569322 - RNA, 19 nt, Homo sapiens
gcaaggcgcucucucaauu

SEQ ID NO: 1569323 - RNA, 19 nt, Homo sapiens
ccuaauaaguguuccauaa

SEQ ID NO: 1569324 - RNA, 19 nt, Homo sapiens
ggaacaaggugacaagugu

SEQ ID NO: 1569325 - RNA, 19 nt, Homo sapiens
guacuucacugacaccuau

SEQ ID NO: 1569326 - RNA, 19 nt, Homo sapiens
ccagugaacuccuucuuau

SEQ ID NO: 1569327 - RNA, 19 nt, Homo sapiens
cuaagcagcugcaggaguu

SEQ ID NO: 1569328 - RNA, 19 nt, Homo sapiens
gaaacucuguuagacauuc

SEQ ID NO: 1569329 - RNA, 19 nt, Homo sapiens
cuaagaaggugcccaagau

SEQ ID NO: 1569330 - RNA, 19 nt, Homo sapiens
gaggccaccuguaaccuuu

SEQ ID NO: 1569331 - RNA, 19 nt, Homo sapiens
ggagaucaauggaaucaac

SEQ ID NO: 1569332 - RNA, 19 nt, Homo sapiens
gaacaaggugacaagugua

SEQ ID NO: 1569333 - RNA, 19 nt, Homo sapiens
cuacugaggccaccuguaa

SEQ ID NO: 1569334 - RNA, 19 nt, Homo sapiens
gcucugugcucccaagaug

SEQ ID NO: 1569335 - RNA, 19 nt, Homo sapiens
ucaaugagauggacaugag

SEQ ID NO: 1569336 - RNA, 19 nt, Homo sapiens
gguucaaggucucuaagaa

SEQ ID NO: 1569337 - RNA, 19 nt, Homo sapiens
aaacauaucuacagguacu

SEQ ID NO: 1569338 - RNA, 19 nt, Homo sapiens
cugcaacgcugauccaguu

SEQ ID NO: 1569339 - RNA, 19 nt, Homo sapiens
gguggugcuucuuggguua

SEQ ID NO: 1569340 - RNA, 19 nt, Homo sapiens
guucuuggucuccuaauaa

SEQ ID NO: 1569341 - RNA, 19 nt, Homo sapiens
ggacagagaccgguucaag

SEQ ID NO: 1569342 - RNA, 19 nt, Homo sapiens
ucacucaccuucugauuuu

SEQ ID NO: 1569343 - RNA, 19 nt, Homo sapiens
ccucacagcugcuuguaca

SEQ ID NO: 1569344 - RNA, 19 nt, Homo sapiens
acaaggugcucuccagguu

SEQ ID NO: 1569345 - RNA, 19 nt, Homo sapiens
caacgcugauccaguuugu

SEQ ID NO: 1569346 - RNA, 19 nt, Homo sapiens
ccacgagaaugggaacuug

SEQ ID NO: 1569347 - RNA, 19 nt, Homo sapiens
agacauuccugcagcugaa

SEQ ID NO: 1569348 - RNA, 19 nt, Homo sapiens
ccucauggauggagugaca

SEQ ID NO: 1569349 - RNA, 19 nt, Homo sapiens
gagaaugggaacuuggaaa

SEQ ID NO: 1569350 - RNA, 19 nt, Homo sapiens
ugacagugccaaccacaaa

SEQ ID NO: 1569351 - RNA, 19 nt, Homo sapiens
guaucaaugccuacaauga

SEQ ID NO: 1569352 - RNA, 19 nt, Homo sapiens
gcucuugcccucauugguu

SEQ ID NO: 1569353 - RNA, 19 nt, Homo sapiens
agaggcagaugcaggagaa

SEQ ID NO: 1569354 - RNA, 19 nt, Homo sapiens
agagcugucuggcaaaguu

SEQ ID NO: 1569355 - RNA, 19 nt, Homo sapiens
ucucagagcuggacaucag

SEQ ID NO: 1569356 - RNA, 19 nt, Homo sapiens
ucacagcucuugcccucau

SEQ ID NO: 1569357 - RNA, 19 nt, Homo sapiens
aaugauugcugggugagua

SEQ ID NO: 1569358 - RNA, 19 nt, Homo sapiens
ggugcagccuuccuacaga

SEQ ID NO: 1569359 - RNA, 19 nt, Homo sapiens
aaugacaccuugacugcaa

SEQ ID NO: 1569360 - RNA, 19 nt, Homo sapiens
ggaccugcuccuccaguuu

SEQ ID NO: 1569361 - RNA, 19 nt, Homo sapiens
uggcaaaguugagaguuga

SEQ ID NO: 1569362 - RNA, 19 nt, Homo sapiens
ggaaucaacccaggcaaca

SEQ ID NO: 1569363 - RNA, 19 nt, Homo sapiens
caauguaagaggaaaugaa

SEQ ID NO: 1569364 - RNA, 19 nt, Homo sapiens
gaccugcuccuccaguuug

SEQ ID NO: 1569365 - RNA, 19 nt, Homo sapiens
gcugcaaggcguacaguga

SEQ ID NO: 1569366 - RNA, 19 nt, Homo sapiens
gcuggaugcauucaggaua

SEQ ID NO: 1569367 - RNA, 19 nt, Homo sapiens
gcugauccaguuugugaaa

SEQ ID NO: 1569368 - RNA, 19 nt, Homo sapiens
agugaacuccuucuuauug

SEQ ID NO: 1569369 - RNA, 19 nt, Homo sapiens
cuacagguacugagcagaa

SEQ ID NO: 1569370 - RNA, 19 nt, Homo sapiens
ggccagacaggcaaaguug

SEQ ID NO: 1569371 - RNA, 19 nt, Homo sapiens
guaacaucauccucaacug

SEQ ID NO: 1569372 - RNA, 19 nt, Homo sapiens
ccuggcggcugcucacuau

SEQ ID NO: 1569373 - RNA, 19 nt, Homo sapiens
cccagugaacuccuucuua

SEQ ID NO: 1569374 - RNA, 19 nt, Homo sapiens
ggacaacaucauccugaca

SEQ ID NO: 1569375 - RNA, 19 nt, Homo sapiens
gagcgggagaggagaauca

SEQ ID NO: 1569376 - RNA, 19 nt, Homo sapiens
gugaacuccuucuuauugg

SEQ ID NO: 1569377 - RNA, 19 nt, Homo sapiens
uggcuucccugguaacauc

SEQ ID NO: 1569378 - RNA, 19 nt, Homo sapiens
gaauggcaccugucucacu

SEQ ID NO: 1569379 - RNA, 19 nt, Homo sapiens
gggaacaaggugacaagug

SEQ ID NO: 1569380 - RNA, 19 nt, Homo sapiens
ugaacuccuucuuauugga

SEQ ID NO: 1569381 - RNA, 19 nt, Homo sapiens
cauugcugcugcugcguuu

SEQ ID NO: 1569382 - RNA, 19 nt, Homo sapiens
ccucugggaugagaugaug

SEQ ID NO: 1569383 - RNA, 19 nt, Homo sapiens
caagaucccacuccauguc

SEQ ID NO: 1569384 - RNA, 19 nt, Homo sapiens
gcaacgcugauccaguuug

SEQ ID NO: 1569385 - RNA, 19 nt, Homo sapiens
uguucuuggucuccuaaua

SEQ ID NO: 1569386 - RNA, 19 nt, Homo sapiens
gagagaauggcaccugucu

SEQ ID NO: 1569387 - RNA, 19 nt, Homo sapiens
gcugagcccuucccuuucc

SEQ ID NO: 1569388 - RNA, 19 nt, Homo sapiens
cauacuacaagcuggguaa

SEQ ID NO: 1569389 - RNA, 19 nt, Homo sapiens
gcccugugccugucacuau

SEQ ID NO: 1569390 - RNA, 19 nt, Homo sapiens
gaaucaacccaggcaacaa

SEQ ID NO: 1569391 - RNA, 19 nt, Homo sapiens
ccguggagaucaauggaau

SEQ ID NO: 1569392 - RNA, 19 nt, Homo sapiens
gcacaggucaagccagaac

SEQ ID NO: 1569393 - RNA, 19 nt, Homo sapiens
gcaauguaagaggaaauga

SEQ ID NO: 1569394 - RNA, 19 nt, Homo sapiens
gugcagccuuccuacagau

SEQ ID NO: 1569395 - RNA, 19 nt, Homo sapiens
gcaaaguugagaguugaug

SEQ ID NO: 1569396 - RNA, 19 nt, Homo sapiens
gguaacaucauccucaacu

SEQ ID NO: 1569397 - RNA, 19 nt, Homo sapiens
ccuguaaccuuuggucagu

SEQ ID NO: 1569398 - RNA, 19 nt, Homo sapiens
aaagagcugucuggcaaag

SEQ ID NO: 1569399 - RNA, 19 nt, Homo sapiens
uuggcuggcuucccuggua

SEQ ID NO: 1569400 - RNA, 19 nt, Homo sapiens
gaucuguguccucuccuau

SEQ ID NO: 1569401 - RNA, 19 nt, Homo sapiens
uggcuuggcuccauuucuc

SEQ ID NO: 1569402 - RNA, 19 nt, Homo sapiens
ccuggcaccucuaguaaac

SEQ ID NO: 1569403 - RNA, 19 nt, Homo sapiens
cugugugacuggaauguau

SEQ ID NO: 1569404 - RNA, 19 nt, Homo sapiens
ggccugaggguacagauag

SEQ ID NO: 1569405 - RNA, 19 nt, Homo sapiens
cuggcaaaguugagaguug

SEQ ID NO: 1569406 - RNA, 19 nt, Homo sapiens
caucauccucaacugcuuu

SEQ ID NO: 1569407 - RNA, 19 nt, Homo sapiens
gggcccuucuugcucaaug

SEQ ID NO: 1569408 - RNA, 19 nt, Homo sapiens
cagguacugagcagaaauu

SEQ ID NO: 1569409 - RNA, 19 nt, Homo sapiens
uccaugagcugggccacaa

SEQ ID NO: 1569410 - RNA, 19 nt, Homo sapiens
gugaaggagaucaucaaug

SEQ ID NO: 1569411 - RNA, 19 nt, Homo sapiens
acagugacaaggaggcuaa

SEQ ID NO: 1569412 - RNA, 19 nt, Homo sapiens
ggggugaacacaaaucuaa

SEQ ID NO: 1569413 - RNA, 19 nt, Homo sapiens
acgcugauccaguuuguga

SEQ ID NO: 1569414 - RNA, 19 nt, Homo sapiens
uacagguacugagcagaaa

SEQ ID NO: 1569415 - RNA, 19 nt, Homo sapiens
ccacaccgaugaccuuacc

SEQ ID NO: 1569416 - RNA, 19 nt, Homo sapiens
uggcuggcuucccugguaa

SEQ ID NO: 1569417 - RNA, 19 nt, Homo sapiens
ucacagcugcuuguacaug

SEQ ID NO: 1569418 - RNA, 19 nt, Homo sapiens
guucaaggucucuaagaag

SEQ ID NO: 1569419 - RNA, 19 nt, Homo sapiens
acagagaccgguucaaggu

SEQ ID NO: 1569420 - RNA, 19 nt, Homo sapiens
ccacaaagacccagaguaa

SEQ ID NO: 1569421 - RNA, 19 nt, Homo sapiens
ucacggagcuuugaaacuu

SEQ ID NO: 1569422 - RNA, 19 nt, Homo sapiens
gagaugaacgccacaaaga

SEQ ID NO: 1569423 - RNA, 19 nt, Homo sapiens
ccagggaggugacuucuca

SEQ ID NO: 1569424 - RNA, 19 nt, Homo sapiens
gccaugggcucaagacaga

SEQ ID NO: 1569425 - RNA, 19 nt, Homo sapiens
gcauuagcauguuccaaau

SEQ ID NO: 1569426 - RNA, 19 nt, Homo sapiens
ggaggugacuucucaaagc

SEQ ID NO: 1569427 - RNA, 19 nt, Homo sapiens
agacgugccuggagaugaa

SEQ ID NO: 1569428 - RNA, 19 nt, Homo sapiens
ggcauuagcauguuccaaa

SEQ ID NO: 1569429 - RNA, 19 nt, Homo sapiens
ccacagcugucccucuugu

SEQ ID NO: 1569430 - RNA, 19 nt, Homo sapiens
ucaccaaagggaccuguua

SEQ ID NO: 1569431 - RNA, 19 nt, Homo sapiens
ccaccugccuggaucugaa

SEQ ID NO: 1569432 - RNA, 19 nt, Homo sapiens
ggaaguggaagguucuuuc

SEQ ID NO: 1569433 - RNA, 19 nt, Homo sapiens
ugacuuggcauuagcaugu

SEQ ID NO: 1569434 - RNA, 19 nt, Homo sapiens
gcccaugacuuggcauuag

SEQ ID NO: 1569435 - RNA, 19 nt, Homo sapiens
ccugaaagcuggguuggau

SEQ ID NO: 1569436 - RNA, 19 nt, Homo sapiens
guccacagcugucccucuu

SEQ ID NO: 1569437 - RNA, 19 nt, Homo sapiens
acacugaccucucucuaac

SEQ ID NO: 1569438 - RNA, 19 nt, Homo sapiens
ggagaugaacgccacaaag

SEQ ID NO: 1569439 - RNA, 19 nt, Homo sapiens
caccaggaguguccaguuc

SEQ ID NO: 1569440 - RNA, 19 nt, Homo sapiens
cuagacagagcuucagaaa

SEQ ID NO: 1569441 - RNA, 19 nt, Homo sapiens
ccaggaguguccaguucuu

SEQ ID NO: 1569442 - RNA, 19 nt, Homo sapiens
gggcccugcucacagacua

SEQ ID NO: 1569443 - RNA, 19 nt, Homo sapiens
gagccugcccugacucaug

SEQ ID NO: 1569444 - RNA, 19 nt, Homo sapiens
acaaagacccagaguaacu

SEQ ID NO: 1569445 - RNA, 19 nt, Homo sapiens
gagcaacggcaggagugua

SEQ ID NO: 1569446 - RNA, 19 nt, Homo sapiens
cauuagcauguuccaaaua

SEQ ID NO: 1569447 - RNA, 19 nt, Homo sapiens
cacacugaccucucucuaa

SEQ ID NO: 1569448 - RNA, 19 nt, Homo sapiens
ggagcgacgucggacuugu

SEQ ID NO: 1569449 - RNA, 19 nt, Homo sapiens
uuggguggguggauaagaa

SEQ ID NO: 1569450 - RNA, 19 nt, Homo sapiens
gcagccuggugccaucugu

SEQ ID NO: 1569451 - RNA, 19 nt, Homo sapiens
guguuuggguggguggaua

SEQ ID NO: 1569452 - RNA, 19 nt, Homo sapiens
ccuguggggugcaguguua

SEQ ID NO: 1569453 - RNA, 19 nt, Homo sapiens
guucuuucccugccaguga

SEQ ID NO: 1569454 - RNA, 19 nt, Homo sapiens
caaagacccagaguaacug

SEQ ID NO: 1569455 - RNA, 19 nt, Homo sapiens
ccacacugaccucucucua

SEQ ID NO: 1569456 - RNA, 19 nt, Homo sapiens
gagcgacgucggacuugug

SEQ ID NO: 1569457 - RNA, 19 nt, Homo sapiens
ggcccaagacacuguauuc

SEQ ID NO: 1569458 - RNA, 19 nt, Homo sapiens
aaacugcaccugugucaac

SEQ ID NO: 1569459 - RNA, 19 nt, Homo sapiens
acgcugggcucugugaaug

SEQ ID NO: 1569460 - RNA, 19 nt, Homo sapiens
uagcauguuccaaauaaag

SEQ ID NO: 1569461 - RNA, 19 nt, Homo sapiens
gccaaccagugcccacaca

SEQ ID NO: 1569462 - RNA, 19 nt, Homo sapiens
gugugccgaucuccucuug

SEQ ID NO: 1569463 - RNA, 19 nt, Homo sapiens
gccacaaagacccagagua

SEQ ID NO: 1569464 - RNA, 19 nt, Homo sapiens
acagcugucccucuuguga

SEQ ID NO: 1569465 - RNA, 19 nt, Homo sapiens
gacuuggcauuagcauguu

SEQ ID NO: 1569466 - RNA, 19 nt, Homo sapiens
gguggguggauaagaaaga

SEQ ID NO: 1569467 - RNA, 19 nt, Homo sapiens
gcugggcucugugaaugca

SEQ ID NO: 1569468 - RNA, 19 nt, Homo sapiens
ccagugccaaugccucuug

SEQ ID NO: 1569469 - RNA, 19 nt, Homo sapiens
gcauguuccaaauaaagug

SEQ ID NO: 1569470 - RNA, 19 nt, Homo sapiens
aggcugcuguggcugagaa

SEQ ID NO: 1569471 - RNA, 19 nt, Homo sapiens
gagcugggcuggugaugaa

SEQ ID NO: 1569472 - RNA, 19 nt, Homo sapiens
ggacaaggagaacaucuuu

SEQ ID NO: 1569473 - RNA, 19 nt, Homo sapiens
ggaguucccguuaaccuua

SEQ ID NO: 1569474 - RNA, 19 nt, Homo sapiens
agucaaagauggcaggaaa

SEQ ID NO: 1569475 - RNA, 19 nt, Homo sapiens
cgucguagacauccaauaa

SEQ ID NO: 1569476 - RNA, 19 nt, Homo sapiens
cggcgagggucacuuugua

SEQ ID NO: 1569477 - RNA, 19 nt, Homo sapiens
gcaagagcuucagccagaa

SEQ ID NO: 1569478 - RNA, 19 nt, Homo sapiens
cgagggagagccaagcaua

SEQ ID NO: 1569479 - RNA, 19 nt, Homo sapiens
ggucgucgcugaacaucca

SEQ ID NO: 1569480 - RNA, 19 nt, Homo sapiens
cguagacauccaauaaaua

SEQ ID NO: 1569481 - RNA, 19 nt, Homo sapiens
ucguagacauccaauaaau

SEQ ID NO: 1569482 - RNA, 19 nt, Homo sapiens
ggugugaaguggcuuaggu

SEQ ID NO: 1569483 - RNA, 19 nt, Homo sapiens
acaaggagaacaucuuuca

SEQ ID NO: 1569484 - RNA, 19 nt, Homo sapiens
ggucgucccugaagaucca

SEQ ID NO: 1569485 - RNA, 19 nt, Homo sapiens
gaugugaccacccucuuca

SEQ ID NO: 1569486 - RNA, 19 nt, Homo sapiens
gcacgucguagacauccaa

SEQ ID NO: 1569487 - RNA, 19 nt, Homo sapiens
gagggagagccaagcauau

SEQ ID NO: 1569488 - RNA, 19 nt, Homo sapiens
ccacugcuggcacgucgua

SEQ ID NO: 1569489 - RNA, 19 nt, Homo sapiens
gcaagugcggcaagagcuu

SEQ ID NO: 1569490 - RNA, 19 nt, Homo sapiens
gggagagccaagcauauuc

SEQ ID NO: 1569491 - RNA, 19 nt, Homo sapiens
ggaugugaccacccucuuc

SEQ ID NO: 1569492 - RNA, 19 nt, Homo sapiens
cugaagggcugagaacagu

SEQ ID NO: 1569493 - RNA, 19 nt, Homo sapiens
ggaccgguggauuccuuaa

SEQ ID NO: 1569494 - RNA, 19 nt, Homo sapiens
ggagcugggcuggugauga

SEQ ID NO: 1569495 - RNA, 19 nt, Homo sapiens
aaccuuagccacaaaguca

SEQ ID NO: 1569496 - RNA, 19 nt, Homo sapiens
gcgagggucacuuuguaug

SEQ ID NO: 1569497 - RNA, 19 nt, Homo sapiens
aaagggugcugggaaaggu

SEQ ID NO: 1569498 - RNA, 19 nt, Homo sapiens
gccagaagcccaacuugac

SEQ ID NO: 1569499 - RNA, 19 nt, Homo sapiens
gaguucccguuaaccuuag

SEQ ID NO: 1569500 - RNA, 19 nt, Homo sapiens
gaaggacaaggagaacauc

SEQ ID NO: 1569501 - RNA, 19 nt, Homo sapiens
uggagaaggacaaggagaa

SEQ ID NO: 1569502 - RNA, 19 nt, Homo sapiens
gcuggcacgucguagacau

SEQ ID NO: 1569503 - RNA, 19 nt, Homo sapiens
ccguuaaccuuagccacaa

SEQ ID NO: 1569504 - RNA, 19 nt, Homo sapiens
aggccaugcuuguggagaa

SEQ ID NO: 1569505 - RNA, 19 nt, Homo sapiens
ucuagaagcgucccaaagg

SEQ ID NO: 1569506 - RNA, 19 nt, Homo sapiens
cgggaccgguggauuccuu

SEQ ID NO: 1569507 - RNA, 19 nt, Homo sapiens
gagaaggacaaggagaaca

SEQ ID NO: 1569508 - RNA, 19 nt, Homo sapiens
ggagugcagugcugugaua

SEQ ID NO: 1569509 - RNA, 19 nt, Homo sapiens
gagaaucacuugaacuugu

SEQ ID NO: 1569510 - RNA, 19 nt, Homo sapiens
ggauuacaauguucucuuu

SEQ ID NO: 1569511 - RNA, 19 nt, Homo sapiens
gaaaugggaaggagagauu

SEQ ID NO: 1569512 - RNA, 19 nt, Homo sapiens
ucaccaagaucuacagcua

SEQ ID NO: 1569513 - RNA, 19 nt, Homo sapiens
gagaagccguggccugaug

SEQ ID NO: 1569514 - RNA, 19 nt, Homo sapiens
gugcagugcugugauauug

SEQ ID NO: 1569515 - RNA, 19 nt, Homo sapiens
ggaagacacugggauguac

SEQ ID NO: 1569516 - RNA, 19 nt, Homo sapiens
ccacagugcucucccuauc

SEQ ID NO: 1569517 - RNA, 19 nt, Homo sapiens
cagcugggacaauuuauuu

SEQ ID NO: 1569518 - RNA, 19 nt, Homo sapiens
gaaccuggacaguuucuuc

SEQ ID NO: 1569519 - RNA, 19 nt, Homo sapiens
guuggugggugcacuagaa

SEQ ID NO: 1569520 - RNA, 19 nt, Homo sapiens
gcaggagaaucacuugaac

SEQ ID NO: 1569521 - RNA, 19 nt, Homo sapiens
ccaccacgcccugcuauuu

SEQ ID NO: 1569522 - RNA, 19 nt, Homo sapiens
gggaagacacugggaugua

SEQ ID NO: 1569523 - RNA, 19 nt, Homo sapiens
aacaacagcucccauccuu

SEQ ID NO: 1569524 - RNA, 19 nt, Homo sapiens
ggaauggcuuugccugcau

SEQ ID NO: 1569525 - RNA, 19 nt, Homo sapiens
ucugcaaccucuucagcua

SEQ ID NO: 1569526 - RNA, 19 nt, Homo sapiens
gagugaaacugggcugaag

SEQ ID NO: 1569527 - RNA, 19 nt, Homo sapiens
ggagaaucacuugaacuug

SEQ ID NO: 1569528 - RNA, 19 nt, Homo sapiens
gacagggucugggucuuuc

SEQ ID NO: 1569529 - RNA, 19 nt, Homo sapiens
ggcaggagaaucacuugaa

SEQ ID NO: 1569530 - RNA, 19 nt, Homo sapiens
agaaucacuugaacuugug

SEQ ID NO: 1569531 - RNA, 19 nt, Homo sapiens
ccacgaacugccagacauu

SEQ ID NO: 1569532 - RNA, 19 nt, Homo sapiens
ccaugaggcaggagaauca

SEQ ID NO: 1569533 - RNA, 19 nt, Homo sapiens
gaagggaagggaagacacu

SEQ ID NO: 1569534 - RNA, 19 nt, Homo sapiens
ggaucuccaucuucucucu

SEQ ID NO: 1569535 - RNA, 19 nt, Homo sapiens
gaggaucuccaucuucucu

SEQ ID NO: 1569536 - RNA, 19 nt, Homo sapiens
gcacuagaaaugggaagga

SEQ ID NO: 1569537 - RNA, 19 nt, Homo sapiens
ggaaagcugagugaaacug

SEQ ID NO: 1569538 - RNA, 19 nt, Homo sapiens
ugggaaagcugagugaaac

SEQ ID NO: 1569539 - RNA, 19 nt, Homo sapiens
gcccuuugaucccugaaca

SEQ ID NO: 1569540 - RNA, 19 nt, Homo sapiens
gcggguaggcccuuugauc

SEQ ID NO: 1569541 - RNA, 19 nt, Homo sapiens
ggugggugcacuagaaaug

SEQ ID NO: 1569542 - RNA, 19 nt, Homo sapiens
augcguggauuacaauguu

SEQ ID NO: 1569543 - RNA, 19 nt, Homo sapiens
ucccauccuuccaaccuuu

SEQ ID NO: 1569544 - RNA, 19 nt, Homo sapiens
ccagcugggacaauuuauu

SEQ ID NO: 1569545 - RNA, 19 nt, Homo sapiens
gggcugaagugagguuugc

SEQ ID NO: 1569546 - RNA, 19 nt, Homo sapiens
ucaaaugagaucugacagu

SEQ ID NO: 1569547 - RNA, 19 nt, Homo sapiens
ggcucaaccugcaaugaca

SEQ ID NO: 1569548 - RNA, 19 nt, Homo sapiens
gauuacaauguucucuuug

SEQ ID NO: 1569549 - RNA, 19 nt, Homo sapiens
uggcuuugccugcaucuug

SEQ ID NO: 1569550 - RNA, 19 nt, Homo sapiens
aggagaaucacuugaacuu

SEQ ID NO: 1569551 - RNA, 19 nt, Homo sapiens
uugcagccuucaaaugaga

SEQ ID NO: 1569552 - RNA, 19 nt, Homo sapiens
caaccaaccaaguaaccau

SEQ ID NO: 1569553 - RNA, 19 nt, Homo sapiens
gacaggggcuucucagucu

SEQ ID NO: 1569554 - RNA, 19 nt, Homo sapiens
gccuucaaaugagaucuga

SEQ ID NO: 1569555 - RNA, 19 nt, Homo sapiens
gggcugggaguguaaagca

SEQ ID NO: 1569556 - RNA, 19 nt, Homo sapiens
gugaaacugggcugaagug

SEQ ID NO: 1569557 - RNA, 19 nt, Homo sapiens
gcuucuggcugguccaacu

SEQ ID NO: 1569558 - RNA, 19 nt, Homo sapiens
aaccaaccaaguaaccaua

SEQ ID NO: 1569559 - RNA, 19 nt, Homo sapiens
cuucacaaccuuccuccuu

SEQ ID NO: 1569560 - RNA, 19 nt, Homo sapiens
cgaggcuccuggcaucaca

SEQ ID NO: 1569561 - RNA, 19 nt, Homo sapiens
caaauaagcugacaacuug

SEQ ID NO: 1569562 - RNA, 19 nt, Homo sapiens
ggacauaaauccaucugua

SEQ ID NO: 1569563 - RNA, 19 nt, Homo sapiens
gaacaggcaugguuuaaau

SEQ ID NO: 1569564 - RNA, 19 nt, Homo sapiens
caaaugggauugacucuaa

SEQ ID NO: 1569565 - RNA, 19 nt, Homo sapiens
gaucugagcucuucugguu

SEQ ID NO: 1569566 - RNA, 19 nt, Homo sapiens
aagaagaccugacaacuaa

SEQ ID NO: 1569567 - RNA, 19 nt, Homo sapiens
ggacaaagaccaacuaaag

SEQ ID NO: 1569568 - RNA, 19 nt, Homo sapiens
gaguaaacauugucacauu

SEQ ID NO: 1569569 - RNA, 19 nt, Homo sapiens
gaagaacaggcaugguuua

SEQ ID NO: 1569570 - RNA, 19 nt, Homo sapiens
ugaggaggcuauaggaaua

SEQ ID NO: 1569571 - RNA, 19 nt, Homo sapiens
uagaagagcuggugacauc

SEQ ID NO: 1569572 - RNA, 19 nt, Homo sapiens
ggacugaccacguauauca

SEQ ID NO: 1569573 - RNA, 19 nt, Homo sapiens
gcccaugguuuguauauug

SEQ ID NO: 1569574 - RNA, 19 nt, Homo sapiens
gaaugaagucuguaauuug

SEQ ID NO: 1569575 - RNA, 19 nt, Homo sapiens
gcuagaagguucccagugu

SEQ ID NO: 1569576 - RNA, 19 nt, Homo sapiens
cagaagagaugauggcaau

SEQ ID NO: 1569577 - RNA, 19 nt, Homo sapiens
gggaacggcuucacagguu

SEQ ID NO: 1569578 - RNA, 19 nt, Homo sapiens
uaagaagaccugacaacua

SEQ ID NO: 1569579 - RNA, 19 nt, Homo sapiens
gagcugggucccuaaguua

SEQ ID NO: 1569580 - RNA, 19 nt, Homo sapiens
ggagcugggucccuaaguu

SEQ ID NO: 1569581 - RNA, 19 nt, Homo sapiens
ggaagaacaggcaugguuu

SEQ ID NO: 1569582 - RNA, 19 nt, Homo sapiens
gaaaugcccaugguuugua

SEQ ID NO: 1569583 - RNA, 19 nt, Homo sapiens
uaaagaccauggacccaaa

SEQ ID NO: 1569584 - RNA, 19 nt, Homo sapiens
ggaggcaggcacugaauaa

SEQ ID NO: 1569585 - RNA, 19 nt, Homo sapiens
ggugacaucugaaugaagu

SEQ ID NO: 1569586 - RNA, 19 nt, Homo sapiens
gggauugacucuaauaaaa

SEQ ID NO: 1569587 - RNA, 19 nt, Homo sapiens
ggaauacuuacaaccauuu

SEQ ID NO: 1569588 - RNA, 19 nt, Homo sapiens
gaggcuauaggaauacuua

SEQ ID NO: 1569589 - RNA, 19 nt, Homo sapiens
ccacggugcuuuaucuuca

SEQ ID NO: 1569590 - RNA, 19 nt, Homo sapiens
ggaacggcuucacagguuu

SEQ ID NO: 1569591 - RNA, 19 nt, Homo sapiens
aggcaugguuuaaaucuuu

SEQ ID NO: 1569592 - RNA, 19 nt, Homo sapiens
gacaaagaccaacuaaaga

SEQ ID NO: 1569593 - RNA, 19 nt, Homo sapiens
caacuuggcuacugcuuuu

SEQ ID NO: 1569594 - RNA, 19 nt, Homo sapiens
gacuaaagcagcagaaguu

SEQ ID NO: 1569595 - RNA, 19 nt, Homo sapiens
gaugaacuuccaaccauuu

SEQ ID NO: 1569596 - RNA, 19 nt, Homo sapiens
ggcacuagaugaagcaaau

SEQ ID NO: 1569597 - RNA, 19 nt, Homo sapiens
caaggacagcagagucuua

SEQ ID NO: 1569598 - RNA, 19 nt, Homo sapiens
ggacagggucaccaccuuu

SEQ ID NO: 1569599 - RNA, 19 nt, Homo sapiens
acaaauaagcugacaacuu

SEQ ID NO: 1569600 - RNA, 19 nt, Homo sapiens
guuguuaucuggccaucuu

SEQ ID NO: 1569601 - RNA, 19 nt, Homo sapiens
acacagcccuccagaccuu

SEQ ID NO: 1569602 - RNA, 19 nt, Homo sapiens
gagaccaauuucaagagaa

SEQ ID NO: 1569603 - RNA, 19 nt, Homo sapiens
gauuuaagaugaacuucca

SEQ ID NO: 1569604 - RNA, 19 nt, Homo sapiens
gcucauauccucaauacag

SEQ ID NO: 1569605 - RNA, 19 nt, Homo sapiens
gaagaccugacaacuaaau

SEQ ID NO: 1569606 - RNA, 19 nt, Homo sapiens
cagcagagucuuauggauu

SEQ ID NO: 1569607 - RNA, 19 nt, Homo sapiens
ggucuuagcagaucucaca

SEQ ID NO: 1569608 - RNA, 19 nt, Homo sapiens
cagggaaccaacacaaaua

SEQ ID NO: 1569609 - RNA, 19 nt, Homo sapiens
gcaaaugggauugacucua

SEQ ID NO: 1569610 - RNA, 19 nt, Homo sapiens
caacacaaauaagcugaca

SEQ ID NO: 1569611 - RNA, 19 nt, Homo sapiens
agcagagucuuauggauuu

SEQ ID NO: 1569612 - RNA, 19 nt, Homo sapiens
ggacagcagagucuuaugg

SEQ ID NO: 1569613 - RNA, 19 nt, Homo sapiens
gaccauggacccaaauugu

SEQ ID NO: 1569614 - RNA, 19 nt, Homo sapiens
ccacuucuaagcagucuuu

SEQ ID NO: 1569615 - RNA, 19 nt, Homo sapiens
gcuauaggaauacuuacaa

SEQ ID NO: 1569616 - RNA, 19 nt, Homo sapiens
ggaaaugcccaugguuugu

SEQ ID NO: 1569617 - RNA, 19 nt, Homo sapiens
uccaggaggucaucucuau

SEQ ID NO: 1569618 - RNA, 19 nt, Homo sapiens
aagaugaacuuccaaccau

SEQ ID NO: 1569619 - RNA, 19 nt, Homo sapiens
aaugaagucuguaauuugg

SEQ ID NO: 1569620 - RNA, 19 nt, Homo sapiens
uaaagcagcagaaguuugg

SEQ ID NO: 1569621 - RNA, 19 nt, Homo sapiens
gcuggugacaucugaauga

SEQ ID NO: 1569622 - RNA, 19 nt, Homo sapiens
agccugaggucuccuacua

SEQ ID NO: 1569623 - RNA, 19 nt, Homo sapiens
ggcaggcacugaauaaggu

SEQ ID NO: 1569624 - RNA, 19 nt, Homo sapiens
ugcuuuaucuucauucuga

SEQ ID NO: 1569625 - RNA, 19 nt, Homo sapiens
guaaacauugucacauuuc

SEQ ID NO: 1569626 - RNA, 19 nt, Homo sapiens
gagaguaaacauugucaca

SEQ ID NO: 1569627 - RNA, 19 nt, Homo sapiens
gagcucuucugguuggaau

SEQ ID NO: 1569628 - RNA, 19 nt, Homo sapiens
agagaccaauuucaagaga

SEQ ID NO: 1569629 - RNA, 19 nt, Homo sapiens
gcugacaacuuggcuacug

SEQ ID NO: 1569630 - RNA, 19 nt, Homo sapiens
ccaaugcgaugagggaaca

SEQ ID NO: 1569631 - RNA, 19 nt, Homo sapiens
aagagaagcugggccuguu

SEQ ID NO: 1569632 - RNA, 19 nt, Homo sapiens
ugagagaccaauuucaaga

SEQ ID NO: 1569633 - RNA, 19 nt, Homo sapiens
ccugaggucuccuacuaau

SEQ ID NO: 1569634 - RNA, 19 nt, Homo sapiens
cuucuucucucuccucuuc

SEQ ID NO: 1569635 - RNA, 19 nt, Homo sapiens
gaacggcuucacagguuug

SEQ ID NO: 1569636 - RNA, 19 nt, Homo sapiens
auggagggauuuaagauga

SEQ ID NO: 1569637 - RNA, 19 nt, Homo sapiens
gauggagggauuuaagaug

SEQ ID NO: 1569638 - RNA, 19 nt, Homo sapiens
uaacuaggacaaagaccaa

SEQ ID NO: 1569639 - RNA, 19 nt, Homo sapiens
gaaccaacacaaauaagcu

SEQ ID NO: 1569640 - RNA, 19 nt, Homo sapiens
gaagagaugauggcaaugc

SEQ ID NO: 1569641 - RNA, 19 nt, Homo sapiens
gcagaaguuuggagaaccu

SEQ ID NO: 1569642 - RNA, 19 nt, Homo sapiens
gacccgcacucuucuaagg

SEQ ID NO: 1569643 - RNA, 19 nt, Homo sapiens
ugagacaccauaacuagga

SEQ ID NO: 1569644 - RNA, 19 nt, Homo sapiens
ccagggaaccaacacaaau

SEQ ID NO: 1569645 - RNA, 19 nt, Homo sapiens
gaugaggaggcuauaggaa

SEQ ID NO: 1569646 - RNA, 19 nt, Homo sapiens
gaagagcuggugacaucug

SEQ ID NO: 1569647 - RNA, 19 nt, Homo sapiens
gcacucuucuaagguguca

SEQ ID NO: 1569648 - RNA, 19 nt, Homo sapiens
gcuccuugcccuggaauuu

SEQ ID NO: 1569649 - RNA, 19 nt, Homo sapiens
ggauggagggauuuaagau

SEQ ID NO: 1569650 - RNA, 19 nt, Homo sapiens
caccauaacuaggacaaag

SEQ ID NO: 1569651 - RNA, 19 nt, Homo sapiens
ugagggaacagaagagaug

SEQ ID NO: 1569652 - RNA, 19 nt, Homo sapiens
cagcagaaguuuggagaac

SEQ ID NO: 1569653 - RNA, 19 nt, Homo sapiens
aggaauacuuacaaccauu

SEQ ID NO: 1569654 - RNA, 19 nt, Homo sapiens
ccagggagaggacaguuau

SEQ ID NO: 1569655 - RNA, 19 nt, Homo sapiens
ggacccgggaacaguagua

SEQ ID NO: 1569656 - RNA, 19 nt, Homo sapiens
gcgaugagggaacagaaga

SEQ ID NO: 1569657 - RNA, 19 nt, Homo sapiens
gagaugaggaggcuauagg

SEQ ID NO: 1569658 - RNA, 19 nt, Homo sapiens
ccagagaugaggaggcuau

SEQ ID NO: 1569659 - RNA, 19 nt, Homo sapiens
aaaugcccaugguuuguau

SEQ ID NO: 1569660 - RNA, 19 nt, Homo sapiens
agaugaacuuccaaccauu

SEQ ID NO: 1569661 - RNA, 19 nt, Homo sapiens
ggagauuucuguacacaua

SEQ ID NO: 1569662 - RNA, 19 nt, Homo sapiens
caacagaacugcuggguau

SEQ ID NO: 1569663 - RNA, 19 nt, Homo sapiens
gcaaguauguucaacgauu

SEQ ID NO: 1569664 - RNA, 19 nt, Homo sapiens
gagaaggacuauuaacauu

SEQ ID NO: 1569665 - RNA, 19 nt, Homo sapiens
gaagagaacugcaaacacu

SEQ ID NO: 1569666 - RNA, 19 nt, Homo sapiens
aaacagcacuugcaagaaa

SEQ ID NO: 1569667 - RNA, 19 nt, Homo sapiens
uguaauaacugacccauuu

SEQ ID NO: 1569668 - RNA, 19 nt, Homo sapiens
caaauaagcuuucuuucca

SEQ ID NO: 1569669 - RNA, 19 nt, Homo sapiens
guacacauagucaguaaua

SEQ ID NO: 1569670 - RNA, 19 nt, Homo sapiens
caaugaugcucuuauacua

SEQ ID NO: 1569671 - RNA, 19 nt, Homo sapiens
gggcuaugauguaugaaua

SEQ ID NO: 1569672 - RNA, 19 nt, Homo sapiens
gcccuuaggugcugaguuu

SEQ ID NO: 1569673 - RNA, 19 nt, Homo sapiens
gcacuugcaagaaauauaa

SEQ ID NO: 1569674 - RNA, 19 nt, Homo sapiens
gauaucgaauguuugcaua

SEQ ID NO: 1569675 - RNA, 19 nt, Homo sapiens
uaaaggagauuucuguaca

SEQ ID NO: 1569676 - RNA, 19 nt, Homo sapiens
uguaaagccucuucuguuu

SEQ ID NO: 1569677 - RNA, 19 nt, Homo sapiens
gaaggacuauuaacauucu

SEQ ID NO: 1569678 - RNA, 19 nt, Homo sapiens
caaguauguucaacgauuu

SEQ ID NO: 1569679 - RNA, 19 nt, Homo sapiens
gcacuguguugugucuuua

SEQ ID NO: 1569680 - RNA, 19 nt, Homo sapiens
ggauuugauuccacuguuu

SEQ ID NO: 1569681 - RNA, 19 nt, Homo sapiens
gcccauagcacacguauau

SEQ ID NO: 1569682 - RNA, 19 nt, Homo sapiens
gacacuugcuugccuguuu

SEQ ID NO: 1569683 - RNA, 19 nt, Homo sapiens
guagggaucguguacauuu

SEQ ID NO: 1569684 - RNA, 19 nt, Homo sapiens
caacacaaagcaauuauuc

SEQ ID NO: 1569685 - RNA, 19 nt, Homo sapiens
guagaucauuuaugggauu

SEQ ID NO: 1569686 - RNA, 19 nt, Homo sapiens
gacaggauauucuaaagca

SEQ ID NO: 1569687 - RNA, 19 nt, Homo sapiens
ugacguuccuuugguauuu

SEQ ID NO: 1569688 - RNA, 19 nt, Homo sapiens
ucaaauggcuggagaagcu

SEQ ID NO: 1569689 - RNA, 19 nt, Homo sapiens
ucuaugaguugcuacagua

SEQ ID NO: 1569690 - RNA, 19 nt, Homo sapiens
ucgcaaugaugcucuuaua

SEQ ID NO: 1569691 - RNA, 19 nt, Homo sapiens
gaucauccauggcggaaca

SEQ ID NO: 1569692 - RNA, 19 nt, Homo sapiens
acgauuaguuccaucauuu

SEQ ID NO: 1569693 - RNA, 19 nt, Homo sapiens
aaagaacgacaucaguuua

SEQ ID NO: 1569694 - RNA, 19 nt, Homo sapiens
caacaacgauuaguuccau

SEQ ID NO: 1569695 - RNA, 19 nt, Homo sapiens
gcaauuauucuuccuaucu

SEQ ID NO: 1569696 - RNA, 19 nt, Homo sapiens
gugggaagccuuaaauuga

SEQ ID NO: 1569697 - RNA, 19 nt, Homo sapiens
gcaaaacucucuggugauu

SEQ ID NO: 1569698 - RNA, 19 nt, Homo sapiens
gugcugaguuucauuaagu

SEQ ID NO: 1569699 - RNA, 19 nt, Homo sapiens
uccagucgcuguauguaua

SEQ ID NO: 1569700 - RNA, 19 nt, Homo sapiens
caugugauauuguguaaag

SEQ ID NO: 1569701 - RNA, 19 nt, Homo sapiens
cuuccuaucugauuauuug

SEQ ID NO: 1569702 - RNA, 19 nt, Homo sapiens
caccaaguguagaucauuu

SEQ ID NO: 1569703 - RNA, 19 nt, Homo sapiens
cacaauacuuaaucaguga

SEQ ID NO: 1569704 - RNA, 19 nt, Homo sapiens
guaaggacaggauauucua

SEQ ID NO: 1569705 - RNA, 19 nt, Homo sapiens
caacaaauacaacacaaag

SEQ ID NO: 1569706 - RNA, 19 nt, Homo sapiens
gauuugauuccacuguuua

SEQ ID NO: 1569707 - RNA, 19 nt, Homo sapiens
gauguaagacgaacuugga

SEQ ID NO: 1569708 - RNA, 19 nt, Homo sapiens
gguagacauuuaucacaug

SEQ ID NO: 1569709 - RNA, 19 nt, Homo sapiens
ggugggaagccuuaaauug

SEQ ID NO: 1569710 - RNA, 19 nt, Homo sapiens
caacugccuuaugcccuua

SEQ ID NO: 1569711 - RNA, 19 nt, Homo sapiens
aggcugagaaggacuauua

SEQ ID NO: 1569712 - RNA, 19 nt, Homo sapiens
caaagucuugccagagaua

SEQ ID NO: 1569713 - RNA, 19 nt, Homo sapiens
guuuggugcuucugucuuu

SEQ ID NO: 1569714 - RNA, 19 nt, Homo sapiens
ugacuggcaacaacgauua

SEQ ID NO: 1569715 - RNA, 19 nt, Homo sapiens
agauugacaugccaagaaa

SEQ ID NO: 1569716 - RNA, 19 nt, Homo sapiens
gcaaugaugcucuuauacu

SEQ ID NO: 1569717 - RNA, 19 nt, Homo sapiens
ccucuucuguuuccauuug

SEQ ID NO: 1569718 - RNA, 19 nt, Homo sapiens
cuacugggcuaugauguau

SEQ ID NO: 1569719 - RNA, 19 nt, Homo sapiens
gcuaugauguaugaauaug

SEQ ID NO: 1569720 - RNA, 19 nt, Homo sapiens
gcaguaggcauucgauauc

SEQ ID NO: 1569721 - RNA, 19 nt, Homo sapiens
gccauggccuucuggauca

SEQ ID NO: 1569722 - RNA, 19 nt, Homo sapiens
gacaggaggcugagaagga

SEQ ID NO: 1569723 - RNA, 19 nt, Homo sapiens
ccucuuugcuuccaucuuc

SEQ ID NO: 1569724 - RNA, 19 nt, Homo sapiens
uaacugacccauuucaaag

SEQ ID NO: 1569725 - RNA, 19 nt, Homo sapiens
ucacaaccccuucaaauaa

SEQ ID NO: 1569726 - RNA, 19 nt, Homo sapiens
ccauagcacacguauauau

SEQ ID NO: 1569727 - RNA, 19 nt, Homo sapiens
agaacgacaucaguuuaaa

SEQ ID NO: 1569728 - RNA, 19 nt, Homo sapiens
cacauucguuucccaguga

SEQ ID NO: 1569729 - RNA, 19 nt, Homo sapiens
gauuggugcugauugaaag

SEQ ID NO: 1569730 - RNA, 19 nt, Homo sapiens
ggauuggugcugauugaaa

SEQ ID NO: 1569731 - RNA, 19 nt, Homo sapiens
guaagacgaacuuggauca

SEQ ID NO: 1569732 - RNA, 19 nt, Homo sapiens
gaacgacaucaguuuaaag

SEQ ID NO: 1569733 - RNA, 19 nt, Homo sapiens
cuugaaggcugauuaugug

SEQ ID NO: 1569734 - RNA, 19 nt, Homo sapiens
ggagauccucuucaacaug

SEQ ID NO: 1569735 - RNA, 19 nt, Homo sapiens
acaagaagagcaugagcua

SEQ ID NO: 1569736 - RNA, 19 nt, Homo sapiens
gugcuagccuccuaucaca

SEQ ID NO: 1569737 - RNA, 19 nt, Homo sapiens
caauuauucuuccuaucug

SEQ ID NO: 1569738 - RNA, 19 nt, Homo sapiens
aaguguagaucauuuaugg

SEQ ID NO: 1569739 - RNA, 19 nt, Homo sapiens
gagaugaagagaacugcaa

SEQ ID NO: 1569740 - RNA, 19 nt, Homo sapiens
cagcuugggaugcucauuu

SEQ ID NO: 1569741 - RNA, 19 nt, Homo sapiens
ggguauauccgcaccaugu

SEQ ID NO: 1569742 - RNA, 19 nt, Homo sapiens
ccauuugggugaggauuug

SEQ ID NO: 1569743 - RNA, 19 nt, Homo sapiens
gcuucugucuuucaccauu

SEQ ID NO: 1569744 - RNA, 19 nt, Homo sapiens
guguaaagccucuucuguu

SEQ ID NO: 1569745 - RNA, 19 nt, Homo sapiens
cugauuaugugccauuuua

SEQ ID NO: 1569746 - RNA, 19 nt, Homo sapiens
gcuacuugaaggcugauua

SEQ ID NO: 1569747 - RNA, 19 nt, Homo sapiens
cacauaagaaacaguauug

SEQ ID NO: 1569748 - RNA, 19 nt, Homo sapiens
caacaccgccacaccaaca

SEQ ID NO: 1569749 - RNA, 19 nt, Homo sapiens
guagacaggaggcugagaa

SEQ ID NO: 1569750 - RNA, 19 nt, Homo sapiens
caucccgagugaucucuuu

SEQ ID NO: 1569751 - RNA, 19 nt, Homo sapiens
gggaagccuuaaauugauc

SEQ ID NO: 1569752 - RNA, 19 nt, Homo sapiens
caggauauucuaaagcaaa

SEQ ID NO: 1569753 - RNA, 19 nt, Homo sapiens
caaauacaacacaaagcaa

SEQ ID NO: 1569754 - RNA, 19 nt, Homo sapiens
gaagggcggacucgauauc

SEQ ID NO: 1569755 - RNA, 19 nt, Homo sapiens
ugggaagccuuaaauugau

SEQ ID NO: 1569756 - RNA, 19 nt, Homo sapiens
auuaaguacugucacguuu

SEQ ID NO: 1569757 - RNA, 19 nt, Homo sapiens
acggaccacuccucuauga

SEQ ID NO: 1569758 - RNA, 19 nt, Homo sapiens
ugagaaggacuauuaacau

SEQ ID NO: 1569759 - RNA, 19 nt, Homo sapiens
guaaagccucuucuguuuc

SEQ ID NO: 1569760 - RNA, 19 nt, Homo sapiens
aagaacgacaucaguuuaa

SEQ ID NO: 1569761 - RNA, 19 nt, Homo sapiens
cuagagaucucaucaaaua

SEQ ID NO: 1569762 - RNA, 19 nt, Homo sapiens
gaaauaaccaccaucauug

SEQ ID NO: 1569763 - RNA, 19 nt, Homo sapiens
gauacucccuucuuucaua

SEQ ID NO: 1569764 - RNA, 19 nt, Homo sapiens
ggaauuaccuucuggagau

SEQ ID NO: 1569765 - RNA, 19 nt, Homo sapiens
gaacauguauucacccaau

SEQ ID NO: 1569766 - RNA, 19 nt, Homo sapiens
gcaagacucugucgcuaaa

SEQ ID NO: 1569767 - RNA, 19 nt, Homo sapiens
ggucaaacacagcaaauua

SEQ ID NO: 1569768 - RNA, 19 nt, Homo sapiens
aaacaaacccuuccucaaa

SEQ ID NO: 1569769 - RNA, 19 nt, Homo sapiens
ccaaaggguuuccauauca

SEQ ID NO: 1569770 - RNA, 19 nt, Homo sapiens
gcaaaugucucuuauugac

SEQ ID NO: 1569771 - RNA, 19 nt, Homo sapiens
acaagggaauacacaauua

SEQ ID NO: 1569772 - RNA, 19 nt, Homo sapiens
ggacagcuccaagagauua

SEQ ID NO: 1569773 - RNA, 19 nt, Homo sapiens
agaaggcccucaucagaua

SEQ ID NO: 1569774 - RNA, 19 nt, Homo sapiens
uaacuagccuccuaucuca

SEQ ID NO: 1569775 - RNA, 19 nt, Homo sapiens
aaucacaggugccuucaua

SEQ ID NO: 1569776 - RNA, 19 nt, Homo sapiens
uaagagaccuggagggaau

SEQ ID NO: 1569777 - RNA, 19 nt, Homo sapiens
ggacuagacuauaacaagu

SEQ ID NO: 1569778 - RNA, 19 nt, Homo sapiens
aaacuaaugcucagagaua

SEQ ID NO: 1569779 - RNA, 19 nt, Homo sapiens
ucagauacguuauuuguuc

SEQ ID NO: 1569780 - RNA, 19 nt, Homo sapiens
guacacaggucccagaauc

SEQ ID NO: 1569781 - RNA, 19 nt, Homo sapiens
acaggugccuucauauuaa

SEQ ID NO: 1569782 - RNA, 19 nt, Homo sapiens
ugaccagaaucaaacuuua

SEQ ID NO: 1569783 - RNA, 19 nt, Homo sapiens
guagucagauacguuauuu

SEQ ID NO: 1569784 - RNA, 19 nt, Homo sapiens
ugaaauaaccaccaucauu

SEQ ID NO: 1569785 - RNA, 19 nt, Homo sapiens
uaacagauaaggaaacuga

SEQ ID NO: 1569786 - RNA, 19 nt, Homo sapiens
ugagucaacuggacccaua

SEQ ID NO: 1569787 - RNA, 19 nt, Homo sapiens
ggccugagcgagcauauua

SEQ ID NO: 1569788 - RNA, 19 nt, Homo sapiens
caagaaggcccucaucaga

SEQ ID NO: 1569789 - RNA, 19 nt, Homo sapiens
ggaaagaccaaccaacaga

SEQ ID NO: 1569790 - RNA, 19 nt, Homo sapiens
caaaucaugucuauucucu

SEQ ID NO: 1569791 - RNA, 19 nt, Homo sapiens
ggaaaaggcugaugcuuca

SEQ ID NO: 1569792 - RNA, 19 nt, Homo sapiens
acaaauagcagauuaguca

SEQ ID NO: 1569793 - RNA, 19 nt, Homo sapiens
uaacauagcaagacucugu

SEQ ID NO: 1569794 - RNA, 19 nt, Homo sapiens
uugcaaaugucucuuauug

SEQ ID NO: 1569795 - RNA, 19 nt, Homo sapiens
aaucaugucuauucucuga

SEQ ID NO: 1569796 - RNA, 19 nt, Homo sapiens
uaaggacaaucuaaggaaa

SEQ ID NO: 1569797 - RNA, 19 nt, Homo sapiens
caaguauacucaccacaga

SEQ ID NO: 1569798 - RNA, 19 nt, Homo sapiens
caaccugucugcuggcuau

SEQ ID NO: 1569799 - RNA, 19 nt, Homo sapiens
cacaggugccuucauauua

SEQ ID NO: 1569800 - RNA, 19 nt, Homo sapiens
gcucagugcuggaucuuag

SEQ ID NO: 1569801 - RNA, 19 nt, Homo sapiens
caacuggacccauacauuc

SEQ ID NO: 1569802 - RNA, 19 nt, Homo sapiens
ugagggaacuaaagcuuga

SEQ ID NO: 1569803 - RNA, 19 nt, Homo sapiens
gauuugagcacaacuuuau

SEQ ID NO: 1569804 - RNA, 19 nt, Homo sapiens
gauuaaaggagaucaguga

SEQ ID NO: 1569805 - RNA, 19 nt, Homo sapiens
cgagugaaauuacugaaca

SEQ ID NO: 1569806 - RNA, 19 nt, Homo sapiens
cuauggacauccucccuua

SEQ ID NO: 1569807 - RNA, 19 nt, Homo sapiens
ucuauccacugacuauuaa

SEQ ID NO: 1569808 - RNA, 19 nt, Homo sapiens
gcauuacauuucugagcua

SEQ ID NO: 1569809 - RNA, 19 nt, Homo sapiens
ugacacagcauuacauuuc

SEQ ID NO: 1569810 - RNA, 19 nt, Homo sapiens
guauucacccaaugcauua

SEQ ID NO: 1569811 - RNA, 19 nt, Homo sapiens
caagagcuccauugaguug

SEQ ID NO: 1569812 - RNA, 19 nt, Homo sapiens
gcagauuagucacauguac

SEQ ID NO: 1569813 - RNA, 19 nt, Homo sapiens
ccagugcucuuugaacuug

SEQ ID NO: 1569814 - RNA, 19 nt, Homo sapiens
cgaggcugauugacuuuaa

SEQ ID NO: 1569815 - RNA, 19 nt, Homo sapiens
cuggaggacuagacuauaa

SEQ ID NO: 1569816 - RNA, 19 nt, Homo sapiens
gaauuaccuucuggagauu

SEQ ID NO: 1569817 - RNA, 19 nt, Homo sapiens
agaagagacuggaaucauc

SEQ ID NO: 1569818 - RNA, 19 nt, Homo sapiens
aagcaaaucaugucuauuc

SEQ ID NO: 1569819 - RNA, 19 nt, Homo sapiens
gagcuaagaggcugaguca

SEQ ID NO: 1569820 - RNA, 19 nt, Homo sapiens
caaauaagcaagcccagau

SEQ ID NO: 1569821 - RNA, 19 nt, Homo sapiens
cauuaacacugaccagaau

SEQ ID NO: 1569822 - RNA, 19 nt, Homo sapiens
ucaaagacaagaaacagaa

SEQ ID NO: 1569823 - RNA, 19 nt, Homo sapiens
cugauugacuuuaagcaaa

SEQ ID NO: 1569824 - RNA, 19 nt, Homo sapiens
gcauuaacacugaccagaa

SEQ ID NO: 1569825 - RNA, 19 nt, Homo sapiens
gcuuggccaugaacaguuu

SEQ ID NO: 1569826 - RNA, 19 nt, Homo sapiens
uuacauuucugagcuaaga

SEQ ID NO: 1569827 - RNA, 19 nt, Homo sapiens
cccaaugcauuaacacuga

SEQ ID NO: 1569828 - RNA, 19 nt, Homo sapiens
ggaacuaaagcuugagguu

SEQ ID NO: 1569829 - RNA, 19 nt, Homo sapiens
cgacgacuuucucaagguu

SEQ ID NO: 1569830 - RNA, 19 nt, Homo sapiens
cccuagagaucucaucaaa

SEQ ID NO: 1569831 - RNA, 19 nt, Homo sapiens
ccuccagccuccauaacua

SEQ ID NO: 1569832 - RNA, 19 nt, Homo sapiens
caaacaaacccuuccucaa

SEQ ID NO: 1569833 - RNA, 19 nt, Homo sapiens
acuauuaacuagccuccua

SEQ ID NO: 1569834 - RNA, 19 nt, Homo sapiens
ucacaggugccuucauauu

SEQ ID NO: 1569835 - RNA, 19 nt, Homo sapiens
gucaaacacagcaaauuaa

SEQ ID NO: 1569836 - RNA, 19 nt, Homo sapiens
ugucaagaagcaauaguua

SEQ ID NO: 1569837 - RNA, 19 nt, Homo sapiens
aacaaacccuuccucaaau

SEQ ID NO: 1569838 - RNA, 19 nt, Homo sapiens
acaaggaauuacuaagaga

SEQ ID NO: 1569839 - RNA, 19 nt, Homo sapiens
cguuugagcccaugaguuu

SEQ ID NO: 1569840 - RNA, 19 nt, Homo sapiens
cuaccacucuauccacuga

SEQ ID NO: 1569841 - RNA, 19 nt, Homo sapiens
aggacaaucuaaggaaaua

SEQ ID NO: 1569842 - RNA, 19 nt, Homo sapiens
caugugaaaucgacgacuu

SEQ ID NO: 1569843 - RNA, 19 nt, Homo sapiens
gcacgagugaaauuacuga

SEQ ID NO: 1569844 - RNA, 19 nt, Homo sapiens
gaagagacuggaaucaucu

SEQ ID NO: 1569845 - RNA, 19 nt, Homo sapiens
caaaggguuuccauaucau

SEQ ID NO: 1569846 - RNA, 19 nt, Homo sapiens
gagugaaauuacugaacaa

SEQ ID NO: 1569847 - RNA, 19 nt, Homo sapiens
aaggacagcuccaagagau

SEQ ID NO: 1569848 - RNA, 19 nt, Homo sapiens
gcagaagcagccauaagga

SEQ ID NO: 1569849 - RNA, 19 nt, Homo sapiens
ggaccuccagccuccauaa

SEQ ID NO: 1569850 - RNA, 19 nt, Homo sapiens
agauacggcuccucaacuu

SEQ ID NO: 1569851 - RNA, 19 nt, Homo sapiens
ggaaacugagggaacuaaa

SEQ ID NO: 1569852 - RNA, 19 nt, Homo sapiens
ggagaucagugagaguaca

SEQ ID NO: 1569853 - RNA, 19 nt, Homo sapiens
guugaaacuuugaauggau

SEQ ID NO: 1569854 - RNA, 19 nt, Homo sapiens
gguugaaacuuugaaugga

SEQ ID NO: 1569855 - RNA, 19 nt, Homo sapiens
gcuaagaggcugagucaac

SEQ ID NO: 1569856 - RNA, 19 nt, Homo sapiens
agacaggagucaucacaag

SEQ ID NO: 1569857 - RNA, 19 nt, Homo sapiens
gcaagaaggcccucaucag

SEQ ID NO: 1569858 - RNA, 19 nt, Homo sapiens
caggugccuucauauuaaa

SEQ ID NO: 1569859 - RNA, 19 nt, Homo sapiens
ggacauccucccuuaccuu

SEQ ID NO: 1569860 - RNA, 19 nt, Homo sapiens
gaaacugagggaacuaaag

SEQ ID NO: 1569861 - RNA, 19 nt, Homo sapiens
caacagaaaugcaaucaua

SEQ ID NO: 1569862 - RNA, 19 nt, Homo sapiens
gaaagaagaacguccagaa

SEQ ID NO: 1569863 - RNA, 19 nt, Homo sapiens
gcuguucaaucuacaauaa

SEQ ID NO: 1569864 - RNA, 19 nt, Homo sapiens
gcaacuaaaccauuaugua

SEQ ID NO: 1569865 - RNA, 19 nt, Homo sapiens
ugaaagaacuaaagaagca

SEQ ID NO: 1569866 - RNA, 19 nt, Homo sapiens
gaacagaaggaguggauga

SEQ ID NO: 1569867 - RNA, 19 nt, Homo sapiens
cagagaagcugacggaaca

SEQ ID NO: 1569868 - RNA, 19 nt, Homo sapiens
ggaugaagauauaauugug

SEQ ID NO: 1569869 - RNA, 19 nt, Homo sapiens
gaagugaguagugaauaua

SEQ ID NO: 1569870 - RNA, 19 nt, Homo sapiens
gaaaugaagaagccaguga

SEQ ID NO: 1569871 - RNA, 19 nt, Homo sapiens
guuagggacuggcugcaua

SEQ ID NO: 1569872 - RNA, 19 nt, Homo sapiens
gcacuuagaagggcaauug

SEQ ID NO: 1569873 - RNA, 19 nt, Homo sapiens
gaagaggacgccauuguuc

SEQ ID NO: 1569874 - RNA, 19 nt, Homo sapiens
uguaaaggcuguucaaucu

SEQ ID NO: 1569875 - RNA, 19 nt, Homo sapiens
caaaggaggaaaugaagaa

SEQ ID NO: 1569876 - RNA, 19 nt, Homo sapiens
gagcaagaauucugaugca

SEQ ID NO: 1569877 - RNA, 19 nt, Homo sapiens
ugaagugaguagugaauau

SEQ ID NO: 1569878 - RNA, 19 nt, Homo sapiens
ggacguuccaguucaaauu

SEQ ID NO: 1569879 - RNA, 19 nt, Homo sapiens
gaagggcaauugagaacca

SEQ ID NO: 1569880 - RNA, 19 nt, Homo sapiens
aggaguggaugaagauaua

SEQ ID NO: 1569881 - RNA, 19 nt, Homo sapiens
gaugcagacuuucaaaaua

SEQ ID NO: 1569882 - RNA, 19 nt, Homo sapiens
ugagaaccauaacaagaaa

SEQ ID NO: 1569883 - RNA, 19 nt, Homo sapiens
cagaaggaguggaugaaga

SEQ ID NO: 1569884 - RNA, 19 nt, Homo sapiens
acaaggcaaugguugaauu

SEQ ID NO: 1569885 - RNA, 19 nt, Homo sapiens
uaaaggcuguucaaucuac

SEQ ID NO: 1569886 - RNA, 19 nt, Homo sapiens
caaaguuacacaacagaaa

SEQ ID NO: 1569887 - RNA, 19 nt, Homo sapiens
caacugguuucaucuccuu

SEQ ID NO: 1569888 - RNA, 19 nt, Homo sapiens
gaacuaaagaagcaaugug

SEQ ID NO: 1569889 - RNA, 19 nt, Homo sapiens
agacugaagugaguaguga

SEQ ID NO: 1569890 - RNA, 19 nt, Homo sapiens
gcaauguggucuucaagcu

SEQ ID NO: 1569891 - RNA, 19 nt, Homo sapiens
gguugaauuugcuacauug

SEQ ID NO: 1569892 - RNA, 19 nt, Homo sapiens
ggguaaaacuuguugcuuu

SEQ ID NO: 1569893 - RNA, 19 nt, Homo sapiens
cugcauagcauacuuguug

SEQ ID NO: 1569894 - RNA, 19 nt, Homo sapiens
ggacaaggcaaugguugaa

SEQ ID NO: 1569895 - RNA, 19 nt, Homo sapiens
caauugagaaccauaacaa

SEQ ID NO: 1569896 - RNA, 19 nt, Homo sapiens
ccacacggauauaagaaag

SEQ ID NO: 1569897 - RNA, 19 nt, Homo sapiens
uuacaaaggaggaaaugaa

SEQ ID NO: 1569898 - RNA, 19 nt, Homo sapiens
ugaauuugcuacauuggau

SEQ ID NO: 1569899 - RNA, 19 nt, Homo sapiens
gauauaauugugacccaaa

SEQ ID NO: 1569900 - RNA, 19 nt, Homo sapiens
uuaaacaacagcugaaaga

SEQ ID NO: 1569901 - RNA, 19 nt, Homo sapiens
aaagaagaacguccagaaa

SEQ ID NO: 1569902 - RNA, 19 nt, Homo sapiens
gaucggcaacuaaaccauu

SEQ ID NO: 1569903 - RNA, 19 nt, Homo sapiens
caaggcaaugguugaauuu

SEQ ID NO: 1569904 - RNA, 19 nt, Homo sapiens
gaaaagacaucgucauucc

SEQ ID NO: 1569905 - RNA, 19 nt, Homo sapiens
gauauaagaaagucagauc

SEQ ID NO: 1569906 - RNA, 19 nt, Homo sapiens
ggacuggcugcauagcaua

SEQ ID NO: 1569907 - RNA, 19 nt, Homo sapiens
aggguaaucucucuccaaa

SEQ ID NO: 1569908 - RNA, 19 nt, Homo sapiens
guaaaggcuguucaaucua

SEQ ID NO: 1569909 - RNA, 19 nt, Homo sapiens
gugaguagugaauauagua

SEQ ID NO: 1569910 - RNA, 19 nt, Homo sapiens
gggacuggcugcauagcau

SEQ ID NO: 1569911 - RNA, 19 nt, Homo sapiens
gaaggaguggaugaagaua

SEQ ID NO: 1569912 - RNA, 19 nt, Homo sapiens
gcugaaagaacuaaagaag

SEQ ID NO: 1569913 - RNA, 19 nt, Homo sapiens
caacagcugaaagaacuaa

SEQ ID NO: 1569914 - RNA, 19 nt, Homo sapiens
acacuuaccuuccccauau

SEQ ID NO: 1569915 - RNA, 19 nt, Homo sapiens
gccaggacguuccaguuca

SEQ ID NO: 1569916 - RNA, 19 nt, Homo sapiens
gggcaauugagaaccauaa

SEQ ID NO: 1569917 - RNA, 19 nt, Homo sapiens
ugaagaggacgccauuguu

SEQ ID NO: 1569918 - RNA, 19 nt, Homo sapiens
aacaacagcugaaagaacu

SEQ ID NO: 1569919 - RNA, 19 nt, Homo sapiens
ccaggacguuccaguucaa

SEQ ID NO: 1569920 - RNA, 19 nt, Homo sapiens
gcaauugagaaccauaaca

SEQ ID NO: 1569921 - RNA, 19 nt, Homo sapiens
ucuucaagcugacagagaa

SEQ ID NO: 1569922 - RNA, 19 nt, Homo sapiens
uacauuggaucggcaacua

SEQ ID NO: 1569923 - RNA, 19 nt, Homo sapiens
gugaauauaguauggacaa

SEQ ID NO: 1569924 - RNA, 19 nt, Homo sapiens
gacaucgucauuccgagua

SEQ ID NO: 1569925 - RNA, 19 nt, Homo sapiens
gaaagucagaucuuaucca

SEQ ID NO: 1569926 - RNA, 19 nt, Homo sapiens
gccuauugcccucaaauug

SEQ ID NO: 1569927 - RNA, 19 nt, Homo sapiens
uuacacaacagaaaugcaa

SEQ ID NO: 1569928 - RNA, 19 nt, Homo sapiens
gaagcugacggaacagaag

SEQ ID NO: 1569929 - RNA, 19 nt, Homo sapiens
cagcugaaagaacuaaaga

SEQ ID NO: 1569930 - RNA, 19 nt, Homo sapiens
uaaacaacagcugaaagaa

SEQ ID NO: 1569931 - RNA, 19 nt, Homo sapiens
cagcuuggacuaccagaau

SEQ ID NO: 1569932 - RNA, 19 nt, Homo sapiens
ccagaaucaagcacucuuu

SEQ ID NO: 1569933 - RNA, 19 nt, Homo sapiens
gaaagaacuaaagaagcaa

SEQ ID NO: 1569934 - RNA, 19 nt, Homo sapiens
cgccauuguucgcaugauu

SEQ ID NO: 1569935 - RNA, 19 nt, Homo sapiens
gaggguaaucucucuccaa

SEQ ID NO: 1569936 - RNA, 19 nt, Homo sapiens
uugagaaccauaacaagaa

SEQ ID NO: 1569937 - RNA, 19 nt, Homo sapiens
caggaugaagcacuuagaa

SEQ ID NO: 1569938 - RNA, 19 nt, Homo sapiens
ggaguggaugaagauauaa

SEQ ID NO: 1569939 - RNA, 19 nt, Homo sapiens
aaacaacagcugaaagaac

SEQ ID NO: 1569940 - RNA, 19 nt, Homo sapiens
ggaaaggaggugggucuag

SEQ ID NO: 1569941 - RNA, 19 nt, Homo sapiens
ugguugaauuugcuacauu

SEQ ID NO: 1569942 - RNA, 19 nt, Homo sapiens
cagcuucuaguguugcuuu

SEQ ID NO: 1569943 - RNA, 19 nt, Homo sapiens
acacggauauaagaaaguc

SEQ ID NO: 1569944 - RNA, 19 nt, Homo sapiens
gcuguagccacacggauau

SEQ ID NO: 1569945 - RNA, 19 nt, Homo sapiens
gcccagguacuaauuucaa

SEQ ID NO: 1569946 - RNA, 19 nt, Homo sapiens
gaucuuguggaaagucaga

SEQ ID NO: 1569947 - RNA, 19 nt, Homo sapiens
uguaucaacucugguaugg

SEQ ID NO: 1569948 - RNA, 19 nt, Homo sapiens
guggaugaagauauaauug

SEQ ID NO: 1569949 - RNA, 19 nt, Homo sapiens
aucggcaacuaaaccauua

SEQ ID NO: 1569950 - RNA, 19 nt, Homo sapiens
ucaaaguuacacaacagaa

SEQ ID NO: 1569951 - RNA, 19 nt, Homo sapiens
ggacuaccagaaucaagca

SEQ ID NO: 1569952 - RNA, 19 nt, Homo sapiens
caguucaaauucagguuca

SEQ ID NO: 1569953 - RNA, 19 nt, Homo sapiens
agucugcucucuccuccuu

SEQ ID NO: 1569954 - RNA, 19 nt, Homo sapiens
uuagaagggcaauugagaa

SEQ ID NO: 1569955 - RNA, 19 nt, Homo sapiens
gacguuccaguucaaauuc

SEQ ID NO: 1569956 - RNA, 19 nt, Homo sapiens
agaaggaguggaugaagau

SEQ ID NO: 1569957 - RNA, 19 nt, Homo sapiens
gagaagcugacggaacaga

SEQ ID NO: 1569958 - RNA, 19 nt, Homo sapiens
cauuggaucggcaacuaaa

SEQ ID NO: 1569959 - RNA, 19 nt, Homo sapiens
gguauggacacagcuucua

SEQ ID NO: 1569960 - RNA, 19 nt, Homo sapiens
gccacacggauauaagaaa

SEQ ID NO: 1569961 - RNA, 19 nt, Homo sapiens
ggagagaggugacaaguuc

SEQ ID NO: 1569962 - RNA, 19 nt, Homo sapiens
ggauggaacugaccuuuau

SEQ ID NO: 1569963 - RNA, 19 nt, Homo sapiens
aaccaucucuucugaaaua

SEQ ID NO: 1569964 - RNA, 19 nt, Homo sapiens
ccagaugccuguacuaguu

SEQ ID NO: 1569965 - RNA, 19 nt, Homo sapiens
ggaggucacugcagaagga

SEQ ID NO: 1569966 - RNA, 19 nt, Homo sapiens
ccaaccaucucuucugaaa

SEQ ID NO: 1569967 - RNA, 19 nt, Homo sapiens
gaggauaaagugagauuaa

SEQ ID NO: 1569968 - RNA, 19 nt, Homo sapiens
gcacaaggaaugaggaaga

SEQ ID NO: 1569969 - RNA, 19 nt, Homo sapiens
caucauuagugguuaagaa

SEQ ID NO: 1569970 - RNA, 19 nt, Homo sapiens
gaaauaaugcauccaaagg

SEQ ID NO: 1569971 - RNA, 19 nt, Homo sapiens
ccugggaacugaauaacuu

SEQ ID NO: 1569972 - RNA, 19 nt, Homo sapiens
ccaaaggguugauauucug

SEQ ID NO: 1569973 - RNA, 19 nt, Homo sapiens
gcaaugguaugcauaucuc

SEQ ID NO: 1569974 - RNA, 19 nt, Homo sapiens
gggacaaccugggaacuga

SEQ ID NO: 1569975 - RNA, 19 nt, Homo sapiens
uaagcagucuggucaggaa

SEQ ID NO: 1569976 - RNA, 19 nt, Homo sapiens
caucucuucugaaauaaug

SEQ ID NO: 1569977 - RNA, 19 nt, Homo sapiens
guauuuaugcgcaauggua

SEQ ID NO: 1569978 - RNA, 19 nt, Homo sapiens
gaagacugcacaaggaaug

SEQ ID NO: 1569979 - RNA, 19 nt, Homo sapiens
guuuacaggucuuaauuca

SEQ ID NO: 1569980 - RNA, 19 nt, Homo sapiens
caaccugggaacugaauaa

SEQ ID NO: 1569981 - RNA, 19 nt, Homo sapiens
gggaggcacucuuucucaa

SEQ ID NO: 1569982 - RNA, 19 nt, Homo sapiens
ccugaagacugcacaagga

SEQ ID NO: 1569983 - RNA, 19 nt, Homo sapiens
uugcagauguguauuuaug

SEQ ID NO: 1569984 - RNA, 19 nt, Homo sapiens
cugaaucuuucuccucuaa

SEQ ID NO: 1569985 - RNA, 19 nt, Homo sapiens
cuaccucacagacuuguua

SEQ ID NO: 1569986 - RNA, 19 nt, Homo sapiens
ggaggcacucuuucucaaa

SEQ ID NO: 1569987 - RNA, 19 nt, Homo sapiens
gucgagggcugaaucuuuc

SEQ ID NO: 1569988 - RNA, 19 nt, Homo sapiens
aaccggaucugcuggagaa

SEQ ID NO: 1569989 - RNA, 19 nt, Homo sapiens
ggaggcagacacagaccua

SEQ ID NO: 1569990 - RNA, 19 nt, Homo sapiens
ugaggaagaucagggacaa

SEQ ID NO: 1569991 - RNA, 19 nt, Homo sapiens
caaggaaugaggaagauca

SEQ ID NO: 1569992 - RNA, 19 nt, Homo sapiens
uguugcagauguguauuua

SEQ ID NO: 1569993 - RNA, 19 nt, Homo sapiens
ccucacagacuuguuauga

SEQ ID NO: 1569994 - RNA, 19 nt, Homo sapiens
gcauguugcagauguguau

SEQ ID NO: 1569995 - RNA, 19 nt, Homo sapiens
aaugaugccugcccuaucu

SEQ ID NO: 1569996 - RNA, 19 nt, Homo sapiens
gaagaccuuuaugccauca

SEQ ID NO: 1569997 - RNA, 19 nt, Homo sapiens
ggagccaacguaccacuug

SEQ ID NO: 1569998 - RNA, 19 nt, Homo sapiens
caaaccagaugccuguacu

SEQ ID NO: 1569999 - RNA, 19 nt, Homo sapiens
gaggcacucuuucucaaac

SEQ ID NO: 1570000 - RNA, 19 nt, Homo sapiens
gcguuuacaggucuuaauu

SEQ ID NO: 1570001 - RNA, 19 nt, Homo sapiens
gaaucuuucuccucuaagc

SEQ ID NO: 1570002 - RNA, 19 nt, Homo sapiens
agagaacgguguggcuuug

SEQ ID NO: 1570003 - RNA, 19 nt, Homo sapiens
ucccugggcuuccacaaug

SEQ ID NO: 1570004 - RNA, 19 nt, Homo sapiens
cuaucuaccucacagacuu

SEQ ID NO: 1570005 - RNA, 19 nt, Homo sapiens
ggacaaccugggaacugaa

SEQ ID NO: 1570006 - RNA, 19 nt, Homo sapiens
gcagggaggcacucuuucu

SEQ ID NO: 1570007 - RNA, 19 nt, Homo sapiens
cagagaacgguguggcuuu

SEQ ID NO: 1570008 - RNA, 19 nt, Homo sapiens
cugaaauaaugcauccaaa

SEQ ID NO: 1570009 - RNA, 19 nt, Homo sapiens
gaccuuuaugccaucauua

SEQ ID NO: 1570010 - RNA, 19 nt, Homo sapiens
agaccuuuaugccaucauu

SEQ ID NO: 1570011 - RNA, 19 nt, Homo sapiens
ggauaaagugagauuaaac

SEQ ID NO: 1570012 - RNA, 19 nt, Homo sapiens
cggcagggaggcacucuuu

SEQ ID NO: 1570013 - RNA, 19 nt, Homo sapiens
gcugaaucuuucuccucua

SEQ ID NO: 1570014 - RNA, 19 nt, Homo sapiens
ggaggggacuugcugugaa

SEQ ID NO: 1570015 - RNA, 19 nt, Homo sapiens
uccaaaggguugauauucu

SEQ ID NO: 1570016 - RNA, 19 nt, Homo sapiens
cauuagugguuaagaagca

SEQ ID NO: 1570017 - RNA, 19 nt, Homo sapiens
cauccaaaggguugauauu

SEQ ID NO: 1570018 - RNA, 19 nt, Homo sapiens
ugaaauaaugcauccaaag

SEQ ID NO: 1570019 - RNA, 19 nt, Homo sapiens
gauccaaccaucucuucug

SEQ ID NO: 1570020 - RNA, 19 nt, Homo sapiens
aggacucccuggacuuuga

SEQ ID NO: 1570021 - RNA, 19 nt, Homo sapiens
cacaaggaaugaggaagau

SEQ ID NO: 1570022 - RNA, 19 nt, Homo sapiens
gggagagaggugacaaguu

SEQ ID NO: 1570023 - RNA, 19 nt, Homo sapiens
aagcaagccugagcgugaa

SEQ ID NO: 1570024 - RNA, 19 nt, Homo sapiens
gauggaacugaccuuuauu

SEQ ID NO: 1570025 - RNA, 19 nt, Homo sapiens
agucgagggcugaaucuuu

SEQ ID NO: 1570026 - RNA, 19 nt, Homo sapiens
ggcagggucuucgcuaucu

SEQ ID NO: 1570027 - RNA, 19 nt, Homo sapiens
guuaagaagcaacgagcaa

SEQ ID NO: 1570028 - RNA, 19 nt, Homo sapiens
cagaugccuguacuaguuu

SEQ ID NO: 1570029 - RNA, 19 nt, Homo sapiens
aggauggaacugaccuuua

SEQ ID NO: 1570030 - RNA, 19 nt, Homo sapiens
gcgcaaugguaugcauauc

SEQ ID NO: 1570031 - RNA, 19 nt, Homo sapiens
ggagucaccagcaccuaca

SEQ ID NO: 1570032 - RNA, 19 nt, Homo sapiens
ccauggaggcagacacaga

SEQ ID NO: 1570033 - RNA, 19 nt, Homo sapiens
auccaaccaucucuucuga

SEQ ID NO: 1570034 - RNA, 19 nt, Homo sapiens
agaaaucccugggcuucca

SEQ ID NO: 1570035 - RNA, 19 nt, Homo sapiens
uuaagaagcaacgagcaaa

SEQ ID NO: 1570036 - RNA, 19 nt, Homo sapiens
ugccaucauuagugguuaa

SEQ ID NO: 1570037 - RNA, 19 nt, Homo sapiens
ggaguggagauggcaguug

SEQ ID NO: 1570038 - RNA, 19 nt, Homo sapiens
gcagggucuucgcuaucug

SEQ ID NO: 1570039 - RNA, 19 nt, Homo sapiens
gcauccaaaggguugauau

SEQ ID NO: 1570040 - RNA, 19 nt, Homo sapiens
cccagcauguugcagaugu

SEQ ID NO: 1570041 - RNA, 19 nt, Homo sapiens
ggacucccuggacuuugaa

SEQ ID NO: 1570042 - RNA, 19 nt, Homo sapiens
ugaggauaaagugagauua

SEQ ID NO: 1570043 - RNA, 19 nt, Homo sapiens
ggcaacaggaguccaugga

SEQ ID NO: 1570044 - RNA, 19 nt, Homo sapiens
gaaccucauucaaggauua

SEQ ID NO: 1570045 - RNA, 19 nt, Homo sapiens
ggaaagccuucaagcagaa

SEQ ID NO: 1570046 - RNA, 19 nt, Homo sapiens
gcagugagguggccauauc

SEQ ID NO: 1570047 - RNA, 19 nt, Homo sapiens
gaaccuguuugcaugaguu

SEQ ID NO: 1570048 - RNA, 19 nt, Homo sapiens
caagagacauugugaucau

SEQ ID NO: 1570049 - RNA, 19 nt, Homo sapiens
gacgagaucugcccuccuu

SEQ ID NO: 1570050 - RNA, 19 nt, Homo sapiens
ggacguggccaucuacuuc

SEQ ID NO: 1570051 - RNA, 19 nt, Homo sapiens
gagcugcagugagaaguug

SEQ ID NO: 1570052 - RNA, 19 nt, Homo sapiens
agggagagcugcagugaga

SEQ ID NO: 1570053 - RNA, 19 nt, Homo sapiens
ggaguacaguggcgugauc

SEQ ID NO: 1570054 - RNA, 19 nt, Homo sapiens
ggucagagccugggucaug

SEQ ID NO: 1570055 - RNA, 19 nt, Homo sapiens
ggaagcagcgcgcaguaga

SEQ ID NO: 1570056 - RNA, 19 nt, Homo sapiens
cgaggcagcugugagcauu

SEQ ID NO: 1570057 - RNA, 19 nt, Homo sapiens
guagagcugucguucaucu

SEQ ID NO: 1570058 - RNA, 19 nt, Homo sapiens
caguagagcugucguucau

SEQ ID NO: 1570059 - RNA, 19 nt, Homo sapiens
ggagugggcgugucuggaa

SEQ ID NO: 1570060 - RNA, 19 nt, Homo sapiens
ucagggacguggccaucua

SEQ ID NO: 1570061 - RNA, 19 nt, Homo sapiens
ugacggcccuuuaggauac

SEQ ID NO: 1570062 - RNA, 19 nt, Homo sapiens
gaaagagccagggaaggaa

SEQ ID NO: 1570063 - RNA, 19 nt, Homo sapiens
ggucuggcuucccuucuug

SEQ ID NO: 1570064 - RNA, 19 nt, Homo sapiens
gcaaagccuuccggaccaa

SEQ ID NO: 1570065 - RNA, 19 nt, Homo sapiens
gcgcugggccguagaaaca

SEQ ID NO: 1570066 - RNA, 19 nt, Homo sapiens
gcuuauccagccagaaaua

SEQ ID NO: 1570067 - RNA, 19 nt, Homo sapiens
gauuaggaguggugguuag

SEQ ID NO: 1570068 - RNA, 19 nt, Homo sapiens
caagagccuuuguaauacu

SEQ ID NO: 1570069 - RNA, 19 nt, Homo sapiens
cgagaaguuuacugggaaa

SEQ ID NO: 1570070 - RNA, 19 nt, Homo sapiens
ccucgucucucgccuggaa

SEQ ID NO: 1570071 - RNA, 19 nt, Homo sapiens
gcagugagaaguugcucuu

SEQ ID NO: 1570072 - RNA, 19 nt, Homo sapiens
ucuguagggucuagaguga

SEQ ID NO: 1570073 - RNA, 19 nt, Homo sapiens
ggauuaggaguggugguua

SEQ ID NO: 1570074 - RNA, 19 nt, Homo sapiens
agaaagagccagggaagga

SEQ ID NO: 1570075 - RNA, 19 nt, Homo sapiens
ugacgaagagguucuacga

SEQ ID NO: 1570076 - RNA, 19 nt, Homo sapiens
gaaccacacgcgcgagaag

SEQ ID NO: 1570077 - RNA, 19 nt, Homo sapiens
aaacuuaaggugucugcuu

SEQ ID NO: 1570078 - RNA, 19 nt, Homo sapiens
gcaguagagcugucguuca

SEQ ID NO: 1570079 - RNA, 19 nt, Homo sapiens
guagaaacaagagccuuug

SEQ ID NO: 1570080 - RNA, 19 nt, Homo sapiens
cguagaaacaagagccuuu

SEQ ID NO: 1570081 - RNA, 19 nt, Homo sapiens
gaaaaucaaccugaauuca

SEQ ID NO: 1570082 - RNA, 19 nt, Homo sapiens
ggugaccucuuuguuuuaa

SEQ ID NO: 1570083 - RNA, 19 nt, Homo sapiens
ggucaugcaccuggaguug

SEQ ID NO: 1570084 - RNA, 19 nt, Homo sapiens
gagccuuuguaauacugaa

SEQ ID NO: 1570085 - RNA, 19 nt, Homo sapiens
guaauacugaaccucauuc

SEQ ID NO: 1570086 - RNA, 19 nt, Homo sapiens
aguccaaccuucucagaca

SEQ ID NO: 1570087 - RNA, 19 nt, Homo sapiens
gaggagccguggguugaag

SEQ ID NO: 1570088 - RNA, 19 nt, Homo sapiens
gggacgugaugcuggacaa

SEQ ID NO: 1570089 - RNA, 19 nt, Homo sapiens
ccacgugcggcgagaaaga

SEQ ID NO: 1570090 - RNA, 19 nt, Homo sapiens
ccaagagacauugugauca

SEQ ID NO: 1570091 - RNA, 19 nt, Homo sapiens
cugcuuauccagccagaaa

SEQ ID NO: 1570092 - RNA, 19 nt, Homo sapiens
ggagagcugcagugagaag

SEQ ID NO: 1570093 - RNA, 19 nt, Homo sapiens
cuacucguguggcgacugu

SEQ ID NO: 1570094 - RNA, 19 nt, Homo sapiens
ggaggcugcaccugacgaa

SEQ ID NO: 1570095 - RNA, 19 nt, Homo sapiens
gcugaaccuguuugcauga

SEQ ID NO: 1570096 - RNA, 19 nt, Homo sapiens
ggaggagccguggguugaa

SEQ ID NO: 1570097 - RNA, 19 nt, Homo sapiens
uguagggucuagagugaca

SEQ ID NO: 1570098 - RNA, 19 nt, Homo sapiens
uuaggauacuuccaugucu

SEQ ID NO: 1570099 - RNA, 19 nt, Homo sapiens
gaagcagcgcgcaguagag

SEQ ID NO: 1570100 - RNA, 19 nt, Homo sapiens
ggaguugggagaucaagcu

SEQ ID NO: 1570101 - RNA, 19 nt, Homo sapiens
gauacuuccaugucuguag

SEQ ID NO: 1570102 - RNA, 19 nt, Homo sapiens
ggaaaaucaaccugaauuc

SEQ ID NO: 1570103 - RNA, 19 nt, Homo sapiens
ugagggagagcugcaguga

SEQ ID NO: 1570104 - RNA, 19 nt, Homo sapiens
gagacauugugaucaucca

SEQ ID NO: 1570105 - RNA, 19 nt, Homo sapiens
ggacagagcuacacuccau

SEQ ID NO: 1570106 - RNA, 19 nt, Homo sapiens
ccaucaacauuuccuauua

SEQ ID NO: 1570107 - RNA, 19 nt, Homo sapiens
gcgaugaaccauacuguua

SEQ ID NO: 1570108 - RNA, 19 nt, Homo sapiens
gaaccauacuguuagucua

SEQ ID NO: 1570109 - RNA, 19 nt, Homo sapiens
gcucauggguucuuuaagu

SEQ ID NO: 1570110 - RNA, 19 nt, Homo sapiens
ccauaugucugcaggaauu

SEQ ID NO: 1570111 - RNA, 19 nt, Homo sapiens
gggcugaucuggaagacaa

SEQ ID NO: 1570112 - RNA, 19 nt, Homo sapiens
gcaagaaagcuccaagaga

SEQ ID NO: 1570113 - RNA, 19 nt, Homo sapiens
caacuaggacgucugguuu

SEQ ID NO: 1570114 - RNA, 19 nt, Homo sapiens
caguguagcugaaacuuug

SEQ ID NO: 1570115 - RNA, 19 nt, Homo sapiens
gaacaccuuucggcuagaa

SEQ ID NO: 1570116 - RNA, 19 nt, Homo sapiens
gauacaaagugggaacaaa

SEQ ID NO: 1570117 - RNA, 19 nt, Homo sapiens
ucaccuaucuaguccauau

SEQ ID NO: 1570118 - RNA, 19 nt, Homo sapiens
gaaccuaggaggcagaguu

SEQ ID NO: 1570119 - RNA, 19 nt, Homo sapiens
ucaagaccauccuggcuaa

SEQ ID NO: 1570120 - RNA, 19 nt, Homo sapiens
gaucaacgguaauucaaac

SEQ ID NO: 1570121 - RNA, 19 nt, Homo sapiens
gggaagcgaugaaccauac

SEQ ID NO: 1570122 - RNA, 19 nt, Homo sapiens
ggagagagggcaaggauuc

SEQ ID NO: 1570123 - RNA, 19 nt, Homo sapiens
gcacgggacuccucacaac

SEQ ID NO: 1570124 - RNA, 19 nt, Homo sapiens
ggaaccaccuucucuacuc

SEQ ID NO: 1570125 - RNA, 19 nt, Homo sapiens
caaucaaucucccgcucua

SEQ ID NO: 1570126 - RNA, 19 nt, Homo sapiens
ccauacuguuagucuauua

SEQ ID NO: 1570127 - RNA, 19 nt, Homo sapiens
ggacaacucaccaugcaau

SEQ ID NO: 1570128 - RNA, 19 nt, Homo sapiens
ccaauugggugcucuuucu

SEQ ID NO: 1570129 - RNA, 19 nt, Homo sapiens
acaaguaacaucuuccuuu

SEQ ID NO: 1570130 - RNA, 19 nt, Homo sapiens
cagcacaccuccaggaaca

SEQ ID NO: 1570131 - RNA, 19 nt, Homo sapiens
caaguaacaucuuccuuuu

SEQ ID NO: 1570132 - RNA, 19 nt, Homo sapiens
gagaauggcgaaccuagga

SEQ ID NO: 1570133 - RNA, 19 nt, Homo sapiens
gaaccaccuucucuacucu

SEQ ID NO: 1570134 - RNA, 19 nt, Homo sapiens
caaccuggcuggcuuucca

SEQ ID NO: 1570135 - RNA, 19 nt, Homo sapiens
gaugaaccauacuguuagu

SEQ ID NO: 1570136 - RNA, 19 nt, Homo sapiens
ucuuaacgaucaacgguaa

SEQ ID NO: 1570137 - RNA, 19 nt, Homo sapiens
uagagaugcuggucugugu

SEQ ID NO: 1570138 - RNA, 19 nt, Homo sapiens
gaacaccccugggauguau

SEQ ID NO: 1570139 - RNA, 19 nt, Homo sapiens
caaggcggguggaucacaa

SEQ ID NO: 1570140 - RNA, 19 nt, Homo sapiens
caacucaccaugcaaucaa

SEQ ID NO: 1570141 - RNA, 19 nt, Homo sapiens
gcaagagaauggcgaaccu

SEQ ID NO: 1570142 - RNA, 19 nt, Homo sapiens
aaacuccgcuuccggugau

SEQ ID NO: 1570143 - RNA, 19 nt, Homo sapiens
gcggguggaucacaaaguc

SEQ ID NO: 1570144 - RNA, 19 nt, Homo sapiens
gcacaccuccaggaacaaa

SEQ ID NO: 1570145 - RNA, 19 nt, Homo sapiens
gcucuuucuuugcgacuga

SEQ ID NO: 1570146 - RNA, 19 nt, Homo sapiens
guaauucaaacgucccaaa

SEQ ID NO: 1570147 - RNA, 19 nt, Homo sapiens
gggcucauggguucuuuaa

SEQ ID NO: 1570148 - RNA, 19 nt, Homo sapiens
cagaggaagccgcucauga

SEQ ID NO: 1570149 - RNA, 19 nt, Homo sapiens
ugaaaccccuccucuacua

SEQ ID NO: 1570150 - RNA, 19 nt, Homo sapiens
ugcaggaauuauacugaua

SEQ ID NO: 1570151 - RNA, 19 nt, Homo sapiens
gguggugggugccuguaau

SEQ ID NO: 1570152 - RNA, 19 nt, Homo sapiens
caaagucgggagaucaaga

SEQ ID NO: 1570153 - RNA, 19 nt, Homo sapiens
caugggaagccuuuaauca

SEQ ID NO: 1570154 - RNA, 19 nt, Homo sapiens
guccauaugucugcaggaa

SEQ ID NO: 1570155 - RNA, 19 nt, Homo sapiens
ucucuacucucacugaaca

SEQ ID NO: 1570156 - RNA, 19 nt, Homo sapiens
gaaaagccacaccagaauu

SEQ ID NO: 1570157 - RNA, 19 nt, Homo sapiens
gaggcagaguuugcaguga

SEQ ID NO: 1570158 - RNA, 19 nt, Homo sapiens
ccuguaaucccagaacuuu

SEQ ID NO: 1570159 - RNA, 19 nt, Homo sapiens
ggucaccuaucuaguccau

SEQ ID NO: 1570160 - RNA, 19 nt, Homo sapiens
ucacaaagucgggagauca

SEQ ID NO: 1570161 - RNA, 19 nt, Homo sapiens
gaccaucaacauuuccuau

SEQ ID NO: 1570162 - RNA, 19 nt, Homo sapiens
ggaagccuuuaaucacucu

SEQ ID NO: 1570163 - RNA, 19 nt, Homo sapiens
ccugggauguaucuguaaa

SEQ ID NO: 1570164 - RNA, 19 nt, Homo sapiens
ucuuuuaccuggaguauuu

SEQ ID NO: 1570165 - RNA, 19 nt, Homo sapiens
gaccugugcccguggaaga

SEQ ID NO: 1570166 - RNA, 19 nt, Homo sapiens
cuaccaaacgcugggaaua

SEQ ID NO: 1570167 - RNA, 19 nt, Homo sapiens
gguaucaagaggugcauug

SEQ ID NO: 1570168 - RNA, 19 nt, Homo sapiens
gaggaagccgcucaugaca

SEQ ID NO: 1570169 - RNA, 19 nt, Homo sapiens
gggacucacugccaaagac

SEQ ID NO: 1570170 - RNA, 19 nt, Homo sapiens
gaaagcuccaagagaguca

SEQ ID NO: 1570171 - RNA, 19 nt, Homo sapiens
cucauggguucuuuaaguu

SEQ ID NO: 1570172 - RNA, 19 nt, Homo sapiens
ggaacaccuuucggcuaga

SEQ ID NO: 1570173 - RNA, 19 nt, Homo sapiens
caagagaauggcgaaccua

SEQ ID NO: 1570174 - RNA, 19 nt, Homo sapiens
ggaccaucaacauuuccua

SEQ ID NO: 1570175 - RNA, 19 nt, Homo sapiens
gcaaucaugccaguucuac

SEQ ID NO: 1570176 - RNA, 19 nt, Homo sapiens
accaaacgcugggaauaug

SEQ ID NO: 1570177 - RNA, 19 nt, Homo sapiens
acugauaaauggacaacuc

SEQ ID NO: 1570178 - RNA, 19 nt, Homo sapiens
ugggaagccuuuaaucacu

SEQ ID NO: 1570179 - RNA, 19 nt, Homo sapiens
ucucaugggaagccuuuaa

SEQ ID NO: 1570180 - RNA, 19 nt, Homo sapiens
ugaccggcaugguuucuac

SEQ ID NO: 1570181 - RNA, 19 nt, Homo sapiens
uaugucugcaggaauuaua

SEQ ID NO: 1570182 - RNA, 19 nt, Homo sapiens
caagagagucaguguagcu

SEQ ID NO: 1570183 - RNA, 19 nt, Homo sapiens
acaccagaauuccugcaau

SEQ ID NO: 1570184 - RNA, 19 nt, Homo sapiens
uaccaaacgcugggaauau

SEQ ID NO: 1570185 - RNA, 19 nt, Homo sapiens
gaagcgaugaaccauacug

SEQ ID NO: 1570186 - RNA, 19 nt, Homo sapiens
gaugcuggucugugugcua

SEQ ID NO: 1570187 - RNA, 19 nt, Homo sapiens
acaacuaggacgucugguu

SEQ ID NO: 1570188 - RNA, 19 nt, Homo sapiens
cugcaggaauuauacugau

SEQ ID NO: 1570189 - RNA, 19 nt, Homo sapiens
cgaucaacgguaauucaaa

SEQ ID NO: 1570190 - RNA, 19 nt, Homo sapiens
cgaugaaccauacuguuag

SEQ ID NO: 1570191 - RNA, 19 nt, Homo sapiens
gucgggagaucaagaccau

SEQ ID NO: 1570192 - RNA, 19 nt, Homo sapiens
ucacugggucaccuaucua

SEQ ID NO: 1570193 - RNA, 19 nt, Homo sapiens
cagcaaucaugccaguucu

SEQ ID NO: 1570194 - RNA, 19 nt, Homo sapiens
gccgugcucuaggugcuuu

SEQ ID NO: 1570195 - RNA, 19 nt, Homo sapiens
uaacaucuuccuuuucuug

SEQ ID NO: 1570196 - RNA, 19 nt, Homo sapiens
gucacugggucaccuaucu

SEQ ID NO: 1570197 - RNA, 19 nt, Homo sapiens
ugaucuggaagacaaguaa

SEQ ID NO: 1570198 - RNA, 19 nt, Homo sapiens
cacaaagucgggagaucaa

SEQ ID NO: 1570199 - RNA, 19 nt, Homo sapiens
caugccaguucuaccacuu

SEQ ID NO: 1570200 - RNA, 19 nt, Homo sapiens
caaagggauuuuacugagu

SEQ ID NO: 1570201 - RNA, 19 nt, Homo sapiens
ccugucagcacaacuagga

SEQ ID NO: 1570202 - RNA, 19 nt, Homo sapiens
cauaugucugcaggaauua

SEQ ID NO: 1570203 - RNA, 19 nt, Homo sapiens
ucagugaggcagcucuuca

SEQ ID NO: 1570204 - RNA, 19 nt, Homo sapiens
ugaggcagcucuucaaaac

SEQ ID NO: 1570205 - RNA, 19 nt, Homo sapiens
gcaagaaguuccagaugaa

SEQ ID NO: 1570206 - RNA, 19 nt, Homo sapiens
gcacaagacagaccacauu

SEQ ID NO: 1570207 - RNA, 19 nt, Homo sapiens
gaagcaagccauugaggaa

SEQ ID NO: 1570208 - RNA, 19 nt, Homo sapiens
gcuccaaucuccugaaaca

SEQ ID NO: 1570209 - RNA, 19 nt, Homo sapiens
ccacucugcuuaagccuuu

SEQ ID NO: 1570210 - RNA, 19 nt, Homo sapiens
gaaauaugcauaagaagca

SEQ ID NO: 1570211 - RNA, 19 nt, Homo sapiens
cuucgacgcuucauuuaaa

SEQ ID NO: 1570212 - RNA, 19 nt, Homo sapiens
gggagaagcccuacgaaug

SEQ ID NO: 1570213 - RNA, 19 nt, Homo sapiens
gcucugacgucaccaaaca

SEQ ID NO: 1570214 - RNA, 19 nt, Homo sapiens
ccagaugaaauaugcauaa

SEQ ID NO: 1570215 - RNA, 19 nt, Homo sapiens
ggagaagcccuacgaaugc

SEQ ID NO: 1570216 - RNA, 19 nt, Homo sapiens
ccaaucuccugaaacauca

SEQ ID NO: 1570217 - RNA, 19 nt, Homo sapiens
gagugugggcggaucuuua

SEQ ID NO: 1570218 - RNA, 19 nt, Homo sapiens
gaacagaacgauggagaag

SEQ ID NO: 1570219 - RNA, 19 nt, Homo sapiens
agaaguuccagaugaaaua

SEQ ID NO: 1570220 - RNA, 19 nt, Homo sapiens
acagagcauuuaccaaguu

SEQ ID NO: 1570221 - RNA, 19 nt, Homo sapiens
agcaagaaguuccagauga

SEQ ID NO: 1570222 - RNA, 19 nt, Homo sapiens
gaucaagacaccgcaguga

SEQ ID NO: 1570223 - RNA, 19 nt, Homo sapiens
ggaacagaacgauggagaa

SEQ ID NO: 1570224 - RNA, 19 nt, Homo sapiens
gacagaaagccaccugaga

SEQ ID NO: 1570225 - RNA, 19 nt, Homo sapiens
gcaucuagggcucuccuuu

SEQ ID NO: 1570226 - RNA, 19 nt, Homo sapiens
gaaguuccagaugaaauau

SEQ ID NO: 1570227 - RNA, 19 nt, Homo sapiens
ucaagacaccgcagugaug

SEQ ID NO: 1570228 - RNA, 19 nt, Homo sapiens
gagaagcccuacgaaugca

SEQ ID NO: 1570229 - RNA, 19 nt, Homo sapiens
gaaaagcagcccagucaga

SEQ ID NO: 1570230 - RNA, 19 nt, Homo sapiens
caagaaguuccagaugaaa

SEQ ID NO: 1570231 - RNA, 19 nt, Homo sapiens
uggauggacuugggacaaa

SEQ ID NO: 1570232 - RNA, 19 nt, Homo sapiens
caccagagaccagggagua

SEQ ID NO: 1570233 - RNA, 19 nt, Homo sapiens
gcaagccauugaggaagug

SEQ ID NO: 1570234 - RNA, 19 nt, Homo sapiens
ccugaguccugaagacgaa

SEQ ID NO: 1570235 - RNA, 19 nt, Homo sapiens
ggacucacacgggagagaa

SEQ ID NO: 1570236 - RNA, 19 nt, Homo sapiens
agaggaagaaacccuauga

SEQ ID NO: 1570237 - RNA, 19 nt, Homo sapiens
cggcuccaaucuccugaaa

SEQ ID NO: 1570238 - RNA, 19 nt, Homo sapiens
ccacagaccagcccagcau

SEQ ID NO: 1570239 - RNA, 19 nt, Homo sapiens
gugauguccacucugcuua

SEQ ID NO: 1570240 - RNA, 19 nt, Homo sapiens
guguuugggucaccucaga

SEQ ID NO: 1570241 - RNA, 19 nt, Homo sapiens
ccagagaccagggaguauu

SEQ ID NO: 1570242 - RNA, 19 nt, Homo sapiens
acaccgcagugauggagaa

SEQ ID NO: 1570243 - RNA, 19 nt, Homo sapiens
cagaugaaauaugcauaag

SEQ ID NO: 1570244 - RNA, 19 nt, Homo sapiens
cagagcauuuaccaaguuc

SEQ ID NO: 1570245 - RNA, 19 nt, Homo sapiens
gugggaagcaagccauuga

SEQ ID NO: 1570246 - RNA, 19 nt, Homo sapiens
gauguccacucugcuuaag

SEQ ID NO: 1570247 - RNA, 19 nt, Homo sapiens
cacagagcauuuaccaagu

SEQ ID NO: 1570248 - RNA, 19 nt, Homo sapiens
ccaaacaccagaggacuca

SEQ ID NO: 1570249 - RNA, 19 nt, Homo sapiens
gaccacauucgccaucaga

SEQ ID NO: 1570250 - RNA, 19 nt, Homo sapiens
aaacgccacccucggaaga

SEQ ID NO: 1570251 - RNA, 19 nt, Homo sapiens
ggauggacuugggacaaag

SEQ ID NO: 1570252 - RNA, 19 nt, Homo sapiens
ucucauccgccaucagaaa

SEQ ID NO: 1570253 - RNA, 19 nt, Homo sapiens
aggcagacgugcagaagag

SEQ ID NO: 1570254 - RNA, 19 nt, Homo sapiens
gacgcuucauuuaaagaug

SEQ ID NO: 1570255 - RNA, 19 nt, Homo sapiens
caucuagggcucuccuuuc

SEQ ID NO: 1570256 - RNA, 19 nt, Homo sapiens
gaaguggggccaacagaga

SEQ ID NO: 1570257 - RNA, 19 nt, Homo sapiens
cacaccacgugcccucuug

SEQ ID NO: 1570258 - RNA, 19 nt, Homo sapiens
ugccuucgacgcuucauuu

SEQ ID NO: 1570259 - RNA, 19 nt, Homo sapiens
cggccugacuuaccuggau

SEQ ID NO: 1570260 - RNA, 19 nt, Homo sapiens
caaggaacagaacgaugga

SEQ ID NO: 1570261 - RNA, 19 nt, Homo sapiens
uaacugcggcuccaaucuc

SEQ ID NO: 1570262 - RNA, 19 nt, Homo sapiens
agugugggcggaucuuuaa

SEQ ID NO: 1570263 - RNA, 19 nt, Homo sapiens
ugauguccacucugcuuaa

SEQ ID NO: 1570264 - RNA, 19 nt, Homo sapiens
aguauucacugccauccau

SEQ ID NO: 1570265 - RNA, 19 nt, Homo sapiens
gccuucgacgcuucauuua

SEQ ID NO: 1570266 - RNA, 19 nt, Homo sapiens
cagagaccagggaguauuc

SEQ ID NO: 1570267 - RNA, 19 nt, Homo sapiens
gaggcagacgugcagaaga

SEQ ID NO: 1570268 - RNA, 19 nt, Homo sapiens
gugggcggaucuuuaagca

SEQ ID NO: 1570269 - RNA, 19 nt, Homo sapiens
ugucucauccgccaucaga

SEQ ID NO: 1570270 - RNA, 19 nt, Homo sapiens
ggaggcagacgugcagaag

SEQ ID NO: 1570271 - RNA, 19 nt, Homo sapiens
aaagcaagaaguuccagau

SEQ ID NO: 1570272 - RNA, 19 nt, Homo sapiens
gcugcugccugccugugau

SEQ ID NO: 1570273 - RNA, 19 nt, Homo sapiens
gaacaaagcuauguaccua

SEQ ID NO: 1570274 - RNA, 19 nt, Homo sapiens
gaacaucucccucgcgaaa

SEQ ID NO: 1570275 - RNA, 19 nt, Homo sapiens
ucaguguucucaucuauaa

SEQ ID NO: 1570276 - RNA, 19 nt, Homo sapiens
guaaagugcuuaugaucau

SEQ ID NO: 1570277 - RNA, 19 nt, Homo sapiens
uaacaggagucuuuaccuu

SEQ ID NO: 1570278 - RNA, 19 nt, Homo sapiens
gaguuaaucuguguaaagu

SEQ ID NO: 1570279 - RNA, 19 nt, Homo sapiens
ugaaugaguuaaucugugu

SEQ ID NO: 1570280 - RNA, 19 nt, Homo sapiens
ggcaaaugcugagaucuga

SEQ ID NO: 1570281 - RNA, 19 nt, Homo sapiens
gggcucaagugucaaagga

SEQ ID NO: 1570282 - RNA, 19 nt, Homo sapiens
cuuauaaggucauugugaa

SEQ ID NO: 1570283 - RNA, 19 nt, Homo sapiens
acaggagucuuuaccuuau

SEQ ID NO: 1570284 - RNA, 19 nt, Homo sapiens
uagcccagcugguauaauc

SEQ ID NO: 1570285 - RNA, 19 nt, Homo sapiens
gcacuggccacauuucuag

SEQ ID NO: 1570286 - RNA, 19 nt, Homo sapiens
gggcaugcguggguucaaa

SEQ ID NO: 1570287 - RNA, 19 nt, Homo sapiens
caggagucuuuaccuuaua

SEQ ID NO: 1570288 - RNA, 19 nt, Homo sapiens
ugacggagcagguguggaa

SEQ ID NO: 1570289 - RNA, 19 nt, Homo sapiens
gggauaacaggagucuuua

SEQ ID NO: 1570290 - RNA, 19 nt, Homo sapiens
ugccacagguugcaucuug

SEQ ID NO: 1570291 - RNA, 19 nt, Homo sapiens
ccucaguguucucaucuau

SEQ ID NO: 1570292 - RNA, 19 nt, Homo sapiens
aacaggagucuuuaccuua

SEQ ID NO: 1570293 - RNA, 19 nt, Homo sapiens
cagcugguauaaucucugu

SEQ ID NO: 1570294 - RNA, 19 nt, Homo sapiens
ggagaacaaagcuauguac

SEQ ID NO: 1570295 - RNA, 19 nt, Homo sapiens
aggagucuuuaccuuauaa

SEQ ID NO: 1570296 - RNA, 19 nt, Homo sapiens
uuagggcucugcuggucua

SEQ ID NO: 1570297 - RNA, 19 nt, Homo sapiens
gugggcaucuucaucuuag

SEQ ID NO: 1570298 - RNA, 19 nt, Homo sapiens
cugcuggucuuccugauuc

SEQ ID NO: 1570299 - RNA, 19 nt, Homo sapiens
gaaccugugugaggauggu

SEQ ID NO: 1570300 - RNA, 19 nt, Homo sapiens
agggauaacaggagucuuu

SEQ ID NO: 1570301 - RNA, 19 nt, Homo sapiens
uaaagugcuuaugaucaug

SEQ ID NO: 1570302 - RNA, 19 nt, Homo sapiens
ccauaaguuuggagguuca

SEQ ID NO: 1570303 - RNA, 19 nt, Homo sapiens
uguguaaagugcuuaugau

SEQ ID NO: 1570304 - RNA, 19 nt, Homo sapiens
gccacagguugcaucuuga

SEQ ID NO: 1570305 - RNA, 19 nt, Homo sapiens
cauggcaaaugcugagauc

SEQ ID NO: 1570306 - RNA, 19 nt, Homo sapiens
ggagagaaaggagagaaag

SEQ ID NO: 1570307 - RNA, 19 nt, Homo sapiens
uguaaagugcuuaugauca

SEQ ID NO: 1570308 - RNA, 19 nt, Homo sapiens
ugaguuaaucuguguaaag

SEQ ID NO: 1570309 - RNA, 19 nt, Homo sapiens
gugaaccggcugaaugaga

SEQ ID NO: 1570310 - RNA, 19 nt, Homo sapiens
ggcccugacucgcaaugug

SEQ ID NO: 1570311 - RNA, 19 nt, Homo sapiens
gaaugaguuaaucugugua

SEQ ID NO: 1570312 - RNA, 19 nt, Homo sapiens
aaugugaaccggcugaaug

SEQ ID NO: 1570313 - RNA, 19 nt, Homo sapiens
gcccugacucgcaauguga

SEQ ID NO: 1570314 - RNA, 19 nt, Homo sapiens
uggauugccuggacuucga

SEQ ID NO: 1570315 - RNA, 19 nt, Homo sapiens
ggaugccaguaaggacauu

SEQ ID NO: 1570316 - RNA, 19 nt, Homo sapiens
ugauggagaacaaagcuau

SEQ ID NO: 1570317 - RNA, 19 nt, Homo sapiens
ggcacuggccacauuucua

SEQ ID NO: 1570318 - RNA, 19 nt, Homo sapiens
agagaaaggagagaaagga

SEQ ID NO: 1570319 - RNA, 19 nt, Homo sapiens
gagagaaaggagagaaagg

SEQ ID NO: 1570320 - RNA, 19 nt, Homo sapiens
gugccucaguguucucauc

SEQ ID NO: 1570321 - RNA, 19 nt, Homo sapiens
ugugggcaucuucaucuua

SEQ ID NO: 1570322 - RNA, 19 nt, Homo sapiens
ugacaccagcuccaucugu

SEQ ID NO: 1570323 - RNA, 19 nt, Homo sapiens
uaaucuguguaaagugcuu

SEQ ID NO: 1570324 - RNA, 19 nt, Homo sapiens
gccgugggauaugguguug

SEQ ID NO: 1570325 - RNA, 19 nt, Homo sapiens
gauaacaggagucuuuacc

SEQ ID NO: 1570326 - RNA, 19 nt, Homo sapiens
ccaagcugaaccuguguga

SEQ ID NO: 1570327 - RNA, 19 nt, Homo sapiens
gauggagaacaaagcuaug

SEQ ID NO: 1570328 - RNA, 19 nt, Homo sapiens
gaacugaggugaugcauua

SEQ ID NO: 1570329 - RNA, 19 nt, Homo sapiens
guacagaccucgauacaua

SEQ ID NO: 1570330 - RNA, 19 nt, Homo sapiens
gcucucaggugaacuaaua

SEQ ID NO: 1570331 - RNA, 19 nt, Homo sapiens
ggaaguagguggacucuca

SEQ ID NO: 1570332 - RNA, 19 nt, Homo sapiens
gaaaacaccucucugaaga

SEQ ID NO: 1570333 - RNA, 19 nt, Homo sapiens
gaaaagagguguacaagca

SEQ ID NO: 1570334 - RNA, 19 nt, Homo sapiens
ggaagaagaagacacauau

SEQ ID NO: 1570335 - RNA, 19 nt, Homo sapiens
ggacaccgaucuaaugaca

SEQ ID NO: 1570336 - RNA, 19 nt, Homo sapiens
ggaggaggcacaucacaua

SEQ ID NO: 1570337 - RNA, 19 nt, Homo sapiens
gcagugcucuuugagaauu

SEQ ID NO: 1570338 - RNA, 19 nt, Homo sapiens
gcaguuggucucagcauua

SEQ ID NO: 1570339 - RNA, 19 nt, Homo sapiens
gcaccucucucuuccucua

SEQ ID NO: 1570340 - RNA, 19 nt, Homo sapiens
caacaucuuccuaaucuuu

SEQ ID NO: 1570341 - RNA, 19 nt, Homo sapiens
gcugagaccugaagaacga

SEQ ID NO: 1570342 - RNA, 19 nt, Homo sapiens
ucaauaggguggccagaaa

SEQ ID NO: 1570343 - RNA, 19 nt, Homo sapiens
gaacagaaccagaaagcau

SEQ ID NO: 1570344 - RNA, 19 nt, Homo sapiens
gcagagaaccucaggagau

SEQ ID NO: 1570345 - RNA, 19 nt, Homo sapiens
gagcucgccuuacaccaaa

SEQ ID NO: 1570346 - RNA, 19 nt, Homo sapiens
gaacgaggagucagugaug

SEQ ID NO: 1570347 - RNA, 19 nt, Homo sapiens
gcagaucuuugacuuccuu

SEQ ID NO: 1570348 - RNA, 19 nt, Homo sapiens
gcugaagcuuuguuuaaug

SEQ ID NO: 1570349 - RNA, 19 nt, Homo sapiens
gggcaucaagcuauuuaua

SEQ ID NO: 1570350 - RNA, 19 nt, Homo sapiens
caaaagccaugaucuuauu

SEQ ID NO: 1570351 - RNA, 19 nt, Homo sapiens
gaagaagaagacacauauu

SEQ ID NO: 1570352 - RNA, 19 nt, Homo sapiens
cuagugcagucuaauauau

SEQ ID NO: 1570353 - RNA, 19 nt, Homo sapiens
caugugaucugcaaguaug

SEQ ID NO: 1570354 - RNA, 19 nt, Homo sapiens
ggaaaggacucaggaagcu

SEQ ID NO: 1570355 - RNA, 19 nt, Homo sapiens
guguaugccuguuauguga

SEQ ID NO: 1570356 - RNA, 19 nt, Homo sapiens
gacauucaauaucucugua

SEQ ID NO: 1570357 - RNA, 19 nt, Homo sapiens
ggcaucaagcuauuuauaa

SEQ ID NO: 1570358 - RNA, 19 nt, Homo sapiens
ucacauagcaagaguggaa

SEQ ID NO: 1570359 - RNA, 19 nt, Homo sapiens
ccuaagaacugaggugaug

SEQ ID NO: 1570360 - RNA, 19 nt, Homo sapiens
gaagaagacacauauucau

SEQ ID NO: 1570361 - RNA, 19 nt, Homo sapiens
gugcugaagcuuuguuuaa

SEQ ID NO: 1570362 - RNA, 19 nt, Homo sapiens
gagggcaucaagcuauuua

SEQ ID NO: 1570363 - RNA, 19 nt, Homo sapiens
ggaggcacaucacauagca

SEQ ID NO: 1570364 - RNA, 19 nt, Homo sapiens
caaauugucacaucaguca

SEQ ID NO: 1570365 - RNA, 19 nt, Homo sapiens
agaugacacuugaacauga

SEQ ID NO: 1570366 - RNA, 19 nt, Homo sapiens
cagagaaccucaggagaug

SEQ ID NO: 1570367 - RNA, 19 nt, Homo sapiens
gcaaguaugcaaacaucuu

SEQ ID NO: 1570368 - RNA, 19 nt, Homo sapiens
gaacaugggccugguugug

SEQ ID NO: 1570369 - RNA, 19 nt, Homo sapiens
cugaagcuuuguuuaauga

SEQ ID NO: 1570370 - RNA, 19 nt, Homo sapiens
ggaggagacaaauaucaaa

SEQ ID NO: 1570371 - RNA, 19 nt, Homo sapiens
gggagggcaucaagcuauu

SEQ ID NO: 1570372 - RNA, 19 nt, Homo sapiens
cugaggugaugcauuauuu

SEQ ID NO: 1570373 - RNA, 19 nt, Homo sapiens
ccuguuaugugaucaguau

SEQ ID NO: 1570374 - RNA, 19 nt, Homo sapiens
ggacgcugcucgcucaucu

SEQ ID NO: 1570375 - RNA, 19 nt, Homo sapiens
caaguaugcaaacaucuuu

SEQ ID NO: 1570376 - RNA, 19 nt, Homo sapiens
uaacagaacagugugauag

SEQ ID NO: 1570377 - RNA, 19 nt, Homo sapiens
caaaggacaccgaucuaau

SEQ ID NO: 1570378 - RNA, 19 nt, Homo sapiens
ggagaugacacuugaacau

SEQ ID NO: 1570379 - RNA, 19 nt, Homo sapiens
ggaaaaggaugugagauca

SEQ ID NO: 1570380 - RNA, 19 nt, Homo sapiens
ucaccaaauugucacauca

SEQ ID NO: 1570381 - RNA, 19 nt, Homo sapiens
aaaggacaccgaucuaaug

SEQ ID NO: 1570382 - RNA, 19 nt, Homo sapiens
ucaaaggacaccgaucuaa

SEQ ID NO: 1570383 - RNA, 19 nt, Homo sapiens
uagguggacucucaaagga

SEQ ID NO: 1570384 - RNA, 19 nt, Homo sapiens
gauccauccucaugacaca

SEQ ID NO: 1570385 - RNA, 19 nt, Homo sapiens
ggagcucgccuuacaccaa

SEQ ID NO: 1570386 - RNA, 19 nt, Homo sapiens
cuuagcaucuuaccuggaa

SEQ ID NO: 1570387 - RNA, 19 nt, Homo sapiens
gagaugacacuugaacaug

SEQ ID NO: 1570388 - RNA, 19 nt, Homo sapiens
gaacuaauagagugagaac

SEQ ID NO: 1570389 - RNA, 19 nt, Homo sapiens
uagagaggcagaucuuuga

SEQ ID NO: 1570390 - RNA, 19 nt, Homo sapiens
agauugccauugcuuugua

SEQ ID NO: 1570391 - RNA, 19 nt, Homo sapiens
gauucaacaucuuccuaau

SEQ ID NO: 1570392 - RNA, 19 nt, Homo sapiens
agaggcagaucuuugacuu

SEQ ID NO: 1570393 - RNA, 19 nt, Homo sapiens
agaagaagacacauauuca

SEQ ID NO: 1570394 - RNA, 19 nt, Homo sapiens
uccaaauacuacucucuuu

SEQ ID NO: 1570395 - RNA, 19 nt, Homo sapiens
aaacaccucucugaagaag

SEQ ID NO: 1570396 - RNA, 19 nt, Homo sapiens
cagacacaaucgauccauu

SEQ ID NO: 1570397 - RNA, 19 nt, Homo sapiens
auccagaugcugcaaauua

SEQ ID NO: 1570398 - RNA, 19 nt, Homo sapiens
gaugacacuugaacaugag

SEQ ID NO: 1570399 - RNA, 19 nt, Homo sapiens
cacuggagaugacacuuga

SEQ ID NO: 1570400 - RNA, 19 nt, Homo sapiens
gcacaucacauagcaagag

SEQ ID NO: 1570401 - RNA, 19 nt, Homo sapiens
ugccauugcuuuguauaaa

SEQ ID NO: 1570402 - RNA, 19 nt, Homo sapiens
cgccuauucuuggaaauuu

SEQ ID NO: 1570403 - RNA, 19 nt, Homo sapiens
aagaagaagacacauauuc

SEQ ID NO: 1570404 - RNA, 19 nt, Homo sapiens
ugaagaagcagcauuugag

SEQ ID NO: 1570405 - RNA, 19 nt, Homo sapiens
ccaaacagacacaaucgau

SEQ ID NO: 1570406 - RNA, 19 nt, Homo sapiens
caacaaguaguuauugaac

SEQ ID NO: 1570407 - RNA, 19 nt, Homo sapiens
gccaugaucuuauuauacc

SEQ ID NO: 1570408 - RNA, 19 nt, Homo sapiens
uccagaugcugcaaauuau

SEQ ID NO: 1570409 - RNA, 19 nt, Homo sapiens
acaccucucugaagaagca

SEQ ID NO: 1570410 - RNA, 19 nt, Homo sapiens
gaggugaugcauuauuuua

SEQ ID NO: 1570411 - RNA, 19 nt, Homo sapiens
cagaugcugcaaauuauug

SEQ ID NO: 1570412 - RNA, 19 nt, Homo sapiens
gagacgucaugcucuuuua

SEQ ID NO: 1570413 - RNA, 19 nt, Homo sapiens
cucaugugcuuccuaagaa

SEQ ID NO: 1570414 - RNA, 19 nt, Homo sapiens
ugucauauuggguuuguuu

SEQ ID NO: 1570415 - RNA, 19 nt, Homo sapiens
ccucaugugcuuccuaaga

SEQ ID NO: 1570416 - RNA, 19 nt, Homo sapiens
uggaagaagaagacacaua

SEQ ID NO: 1570417 - RNA, 19 nt, Homo sapiens
gauugccauugcuuuguau

SEQ ID NO: 1570418 - RNA, 19 nt, Homo sapiens
guuaugugaucaguauuuc

SEQ ID NO: 1570419 - RNA, 19 nt, Homo sapiens
gauauuuucuuccauccuu

SEQ ID NO: 1570420 - RNA, 19 nt, Homo sapiens
gaucauggugcccuaccuu

SEQ ID NO: 1570421 - RNA, 19 nt, Homo sapiens
uucaacaucuuccuaaucu

SEQ ID NO: 1570422 - RNA, 19 nt, Homo sapiens
agaccucgauacauaaugg

SEQ ID NO: 1570423 - RNA, 19 nt, Homo sapiens
ggugaugcauuauuuuaga

SEQ ID NO: 1570424 - RNA, 19 nt, Homo sapiens
uuagagaggcagaucuuug

SEQ ID NO: 1570425 - RNA, 19 nt, Homo sapiens
ccagaugcugcaaauuauu

SEQ ID NO: 1570426 - RNA, 19 nt, Homo sapiens
aagaagacacauauucaug

SEQ ID NO: 1570427 - RNA, 19 nt, Homo sapiens
gaaguagguggacucucaa

SEQ ID NO: 1570428 - RNA, 19 nt, Homo sapiens
guagauccguuuacacuuu

SEQ ID NO: 1570429 - RNA, 19 nt, Homo sapiens
gggcgugucugccguguuu

SEQ ID NO: 1570430 - RNA, 19 nt, Homo sapiens
ggacauugcuacggaagug

SEQ ID NO: 1570431 - RNA, 19 nt, Homo sapiens
ggaggcagcugggaaguca

SEQ ID NO: 1570432 - RNA, 19 nt, Homo sapiens
ggaaacagaggccuagaga

SEQ ID NO: 1570433 - RNA, 19 nt, Homo sapiens
gaucagagaggacgacagu

SEQ ID NO: 1570434 - RNA, 19 nt, Homo sapiens
gcccaaggcugcauguucu

SEQ ID NO: 1570435 - RNA, 19 nt, Homo sapiens
uagaacaaaugucccuuca

SEQ ID NO: 1570436 - RNA, 19 nt, Homo sapiens
aaaccugugucagcuguaa

SEQ ID NO: 1570437 - RNA, 19 nt, Homo sapiens
ucauggaccuggagaugug

SEQ ID NO: 1570438 - RNA, 19 nt, Homo sapiens
ggauagagagggcccugaa

SEQ ID NO: 1570439 - RNA, 19 nt, Homo sapiens
gcauggguguccaguccaa

SEQ ID NO: 1570440 - RNA, 19 nt, Homo sapiens
gaaugucaccugccucgau

SEQ ID NO: 1570441 - RNA, 19 nt, Homo sapiens
gagugcagccugaauguca

SEQ ID NO: 1570442 - RNA, 19 nt, Homo sapiens
gggaaagaaucuggaaguc

SEQ ID NO: 1570443 - RNA, 19 nt, Homo sapiens
gccaguagauccguuuaca

SEQ ID NO: 1570444 - RNA, 19 nt, Homo sapiens
uagagaggcugcggacuuc

SEQ ID NO: 1570445 - RNA, 19 nt, Homo sapiens
gcuugguccuuauccugua

SEQ ID NO: 1570446 - RNA, 19 nt, Homo sapiens
ggaaagaaucuggaagucu

SEQ ID NO: 1570447 - RNA, 19 nt, Homo sapiens
cagggucaguuuacuaagu

SEQ ID NO: 1570448 - RNA, 19 nt, Homo sapiens
gggcuugcuugguccuuau

SEQ ID NO: 1570449 - RNA, 19 nt, Homo sapiens
acagucagcuuuuccuuuu

SEQ ID NO: 1570450 - RNA, 19 nt, Homo sapiens
uggagguccugaaugguuu

SEQ ID NO: 1570451 - RNA, 19 nt, Homo sapiens
gggucaguuuacuaaguua

SEQ ID NO: 1570452 - RNA, 19 nt, Homo sapiens
ggcuggagauggacagugu

SEQ ID NO: 1570453 - RNA, 19 nt, Homo sapiens
gcuguaacuccuaggauau

SEQ ID NO: 1570454 - RNA, 19 nt, Homo sapiens
gguccugaaugguuucuac

SEQ ID NO: 1570455 - RNA, 19 nt, Homo sapiens
uguaacuccuaggauauuu

SEQ ID NO: 1570456 - RNA, 19 nt, Homo sapiens
agcuguaacuccuaggaua

SEQ ID NO: 1570457 - RNA, 19 nt, Homo sapiens
cuggagaugugcccuuuca

SEQ ID NO: 1570458 - RNA, 19 nt, Homo sapiens
cuagagaggcugcggacuu

SEQ ID NO: 1570459 - RNA, 19 nt, Homo sapiens
cagauucuccggccaguuc

SEQ ID NO: 1570460 - RNA, 19 nt, Homo sapiens
ucccugaacuuucucuaca

SEQ ID NO: 1570461 - RNA, 19 nt, Homo sapiens
ggacaugggacugggaagu

SEQ ID NO: 1570462 - RNA, 19 nt, Homo sapiens
gaagcccucuggguugucu

SEQ ID NO: 1570463 - RNA, 19 nt, Homo sapiens
gucuucaacugccgucuga

SEQ ID NO: 1570464 - RNA, 19 nt, Homo sapiens
gggcacacguggguucaca

SEQ ID NO: 1570465 - RNA, 19 nt, Homo sapiens
agggucaguuuacuaaguu

SEQ ID NO: 1570466 - RNA, 19 nt, Homo sapiens
ggaccaccuuucccugaac

SEQ ID NO: 1570467 - RNA, 19 nt, Homo sapiens
ggcgagaggacuugaagga

SEQ ID NO: 1570468 - RNA, 19 nt, Homo sapiens
ggaggagagacucaucuag

SEQ ID NO: 1570469 - RNA, 19 nt, Homo sapiens
ggacgacaguggggaaaga

SEQ ID NO: 1570470 - RNA, 19 nt, Homo sapiens
ugucugccguguuuacugu

SEQ ID NO: 1570471 - RNA, 19 nt, Homo sapiens
cugcagaggccgacucaga

SEQ ID NO: 1570472 - RNA, 19 nt, Homo sapiens
gcgagaggacuugaaggaa

SEQ ID NO: 1570473 - RNA, 19 nt, Homo sapiens
gggagcaacucagggaaac

SEQ ID NO: 1570474 - RNA, 19 nt, Homo sapiens
ggaggggugucugaaugua

SEQ ID NO: 1570475 - RNA, 19 nt, Homo sapiens
gcacacguggguucacagu

SEQ ID NO: 1570476 - RNA, 19 nt, Homo sapiens
ccaccuuucccugaacuuu

SEQ ID NO: 1570477 - RNA, 19 nt, Homo sapiens
ugacagagcaacccuucuc

SEQ ID NO: 1570478 - RNA, 19 nt, Homo sapiens
ggcccaaggcugcauguuc

SEQ ID NO: 1570479 - RNA, 19 nt, Homo sapiens
uuccagggcucgggacauu

SEQ ID NO: 1570480 - RNA, 19 nt, Homo sapiens
gauccuggcagcccgaaag

SEQ ID NO: 1570481 - RNA, 19 nt, Homo sapiens
acacuggcgcugccucuga

SEQ ID NO: 1570482 - RNA, 19 nt, Homo sapiens
cugcuguggucauuuguca

SEQ ID NO: 1570483 - RNA, 19 nt, Homo sapiens
ugugauggguguagcugau

SEQ ID NO: 1570484 - RNA, 19 nt, Homo sapiens
gaugcuagugugagugugu

SEQ ID NO: 1570485 - RNA, 19 nt, Homo sapiens
caguagauccguuuacacu

SEQ ID NO: 1570486 - RNA, 19 nt, Homo sapiens
guucaggaguguguguauc

SEQ ID NO: 1570487 - RNA, 19 nt, Homo sapiens
uccagggucaguuuacuaa

SEQ ID NO: 1570488 - RNA, 19 nt, Homo sapiens
uggguugucugcugaguac

SEQ ID NO: 1570489 - RNA, 19 nt, Homo sapiens
gcagacgcugggauagaga

SEQ ID NO: 1570490 - RNA, 19 nt, Homo sapiens
caaggagugcagccugaau

SEQ ID NO: 1570491 - RNA, 19 nt, Homo sapiens
cggaggagagacucaucua

SEQ ID NO: 1570492 - RNA, 19 nt, Homo sapiens
ggacagaccugaauuggua

SEQ ID NO: 1570493 - RNA, 19 nt, Homo sapiens
gaauuuagcuucccagaug

SEQ ID NO: 1570494 - RNA, 19 nt, Homo sapiens
uaaaggaucugguaaagga

SEQ ID NO: 1570495 - RNA, 19 nt, Homo sapiens
uaagagauuugccacaaua

SEQ ID NO: 1570496 - RNA, 19 nt, Homo sapiens
gaaaugcacugccuucauc

SEQ ID NO: 1570497 - RNA, 19 nt, Homo sapiens
gaaauugcuuccaagauug

SEQ ID NO: 1570498 - RNA, 19 nt, Homo sapiens
gaaaccagcuaucugaaug

SEQ ID NO: 1570499 - RNA, 19 nt, Homo sapiens
uaaaggaauugucagauga

SEQ ID NO: 1570500 - RNA, 19 nt, Homo sapiens
ccacuagucugcuugcuuu

SEQ ID NO: 1570501 - RNA, 19 nt, Homo sapiens
cuaauaguguugcguauaa

SEQ ID NO: 1570502 - RNA, 19 nt, Homo sapiens
guaaaggaauugucagaug

SEQ ID NO: 1570503 - RNA, 19 nt, Homo sapiens
agaaauugcuuccaagauu

SEQ ID NO: 1570504 - RNA, 19 nt, Homo sapiens
ggagguguacuuacuaaua

SEQ ID NO: 1570505 - RNA, 19 nt, Homo sapiens
ggaaaacaguuacagauuu

SEQ ID NO: 1570506 - RNA, 19 nt, Homo sapiens
acaaguaucugcucuacaa

SEQ ID NO: 1570507 - RNA, 19 nt, Homo sapiens
aaagggagccaaugaauuu

SEQ ID NO: 1570508 - RNA, 19 nt, Homo sapiens
gaaagggagccaaugaauu

SEQ ID NO: 1570509 - RNA, 19 nt, Homo sapiens
ccagcuauauaccuucuua

SEQ ID NO: 1570510 - RNA, 19 nt, Homo sapiens
ggaaaagugucaagaauau

SEQ ID NO: 1570511 - RNA, 19 nt, Homo sapiens
ugaacuaacuguugacaug

SEQ ID NO: 1570512 - RNA, 19 nt, Homo sapiens
cuaauggccuuccuauuug

SEQ ID NO: 1570513 - RNA, 19 nt, Homo sapiens
ucuaauggccuuccuauuu

SEQ ID NO: 1570514 - RNA, 19 nt, Homo sapiens
gaccugaauugguaguuaa

SEQ ID NO: 1570515 - RNA, 19 nt, Homo sapiens
ggaagccacuguucaucuu

SEQ ID NO: 1570516 - RNA, 19 nt, Homo sapiens
auagugugcuucugauuua

SEQ ID NO: 1570517 - RNA, 19 nt, Homo sapiens
gaauaccauugaugacuau

SEQ ID NO: 1570518 - RNA, 19 nt, Homo sapiens
gaaaucagucccacaagga

SEQ ID NO: 1570519 - RNA, 19 nt, Homo sapiens
gagguguacuuacuaauag

SEQ ID NO: 1570520 - RNA, 19 nt, Homo sapiens
gauaucaacauuucacuga

SEQ ID NO: 1570521 - RNA, 19 nt, Homo sapiens
ucagacagagaucauauua

SEQ ID NO: 1570522 - RNA, 19 nt, Homo sapiens
gggcagcuauacuaucauu

SEQ ID NO: 1570523 - RNA, 19 nt, Homo sapiens
agacugaauuugcucuuaa

SEQ ID NO: 1570524 - RNA, 19 nt, Homo sapiens
cgaaacguguucuuugaga

SEQ ID NO: 1570525 - RNA, 19 nt, Homo sapiens
gauaaucgguauggcuuga

SEQ ID NO: 1570526 - RNA, 19 nt, Homo sapiens
ggaaagggagccaaugaau

SEQ ID NO: 1570527 - RNA, 19 nt, Homo sapiens
agaaguagcagcuuucauu

SEQ ID NO: 1570528 - RNA, 19 nt, Homo sapiens
ggauaaaucuaagcaacug

SEQ ID NO: 1570529 - RNA, 19 nt, Homo sapiens
agaauaccauugaugacua

SEQ ID NO: 1570530 - RNA, 19 nt, Homo sapiens
caaaauggauguuguaaag

SEQ ID NO: 1570531 - RNA, 19 nt, Homo sapiens
cuaagcaacuguucaaugg

SEQ ID NO: 1570532 - RNA, 19 nt, Homo sapiens
gauuauacucaccgauuua

SEQ ID NO: 1570533 - RNA, 19 nt, Homo sapiens
gcagcuauacuaucauuau

SEQ ID NO: 1570534 - RNA, 19 nt, Homo sapiens
guuaagagauuugccacaa

SEQ ID NO: 1570535 - RNA, 19 nt, Homo sapiens
gaaguagcagcuuucauug

SEQ ID NO: 1570536 - RNA, 19 nt, Homo sapiens
aaauggauguuguaaagga

SEQ ID NO: 1570537 - RNA, 19 nt, Homo sapiens
guuacgauauuaugcaaga

SEQ ID NO: 1570538 - RNA, 19 nt, Homo sapiens
gauauugcccagcuacuga

SEQ ID NO: 1570539 - RNA, 19 nt, Homo sapiens
gcacaucggaaaccagcua

SEQ ID NO: 1570540 - RNA, 19 nt, Homo sapiens
uugaagcgcuggcaaauag

SEQ ID NO: 1570541 - RNA, 19 nt, Homo sapiens
ggaagaacuuuugauguuu

SEQ ID NO: 1570542 - RNA, 19 nt, Homo sapiens
aaacggagaagcaguauca

SEQ ID NO: 1570543 - RNA, 19 nt, Homo sapiens
agaccugaauugguaguua

SEQ ID NO: 1570544 - RNA, 19 nt, Homo sapiens
ggaaaccagcuaucugaau

SEQ ID NO: 1570545 - RNA, 19 nt, Homo sapiens
ggagaaauugcuuccaaga

SEQ ID NO: 1570546 - RNA, 19 nt, Homo sapiens
uaggagaaauugcuuccaa

SEQ ID NO: 1570547 - RNA, 19 nt, Homo sapiens
gacugaauuugcucuuaaa

SEQ ID NO: 1570548 - RNA, 19 nt, Homo sapiens
ggagagaggaaaacaguua

SEQ ID NO: 1570549 - RNA, 19 nt, Homo sapiens
ucaggcauuucuccaguuu

SEQ ID NO: 1570550 - RNA, 19 nt, Homo sapiens
uagcuucccagaugaauaa

SEQ ID NO: 1570551 - RNA, 19 nt, Homo sapiens
gaagcacauuuuggaauua

SEQ ID NO: 1570552 - RNA, 19 nt, Homo sapiens
ggagcugccugccaauagu

SEQ ID NO: 1570553 - RNA, 19 nt, Homo sapiens
gaaguuacgauauuaugca

SEQ ID NO: 1570554 - RNA, 19 nt, Homo sapiens
ucaauggguuaagagauuu

SEQ ID NO: 1570555 - RNA, 19 nt, Homo sapiens
agauuauacucaccgauuu

SEQ ID NO: 1570556 - RNA, 19 nt, Homo sapiens
gggaaagauaucaacauuu

SEQ ID NO: 1570557 - RNA, 19 nt, Homo sapiens
uucaauagaucaggcauuu

SEQ ID NO: 1570558 - RNA, 19 nt, Homo sapiens
ggggaaagauaucaacauu

SEQ ID NO: 1570559 - RNA, 19 nt, Homo sapiens
gcaacuguucaauggguua

SEQ ID NO: 1570560 - RNA, 19 nt, Homo sapiens
ggauucgucuaauaguguu

SEQ ID NO: 1570561 - RNA, 19 nt, Homo sapiens
guaaccgggauauuauuaa

SEQ ID NO: 1570562 - RNA, 19 nt, Homo sapiens
gcaggaaucagcugacaag

SEQ ID NO: 1570563 - RNA, 19 nt, Homo sapiens
ugaggcggauccuguaaug

SEQ ID NO: 1570564 - RNA, 19 nt, Homo sapiens
agaaucauauccacaacug

SEQ ID NO: 1570565 - RNA, 19 nt, Homo sapiens
ggaaaugcacugccuucau

SEQ ID NO: 1570566 - RNA, 19 nt, Homo sapiens
ccacaggucguucugauag

SEQ ID NO: 1570567 - RNA, 19 nt, Homo sapiens
ccaauagugugcuucugau

SEQ ID NO: 1570568 - RNA, 19 nt, Homo sapiens
gccaauagugugcuucuga

SEQ ID NO: 1570569 - RNA, 19 nt, Homo sapiens
gaacuaacuguugacaugu

SEQ ID NO: 1570570 - RNA, 19 nt, Homo sapiens
ggcggauccuguaauggua

SEQ ID NO: 1570571 - RNA, 19 nt, Homo sapiens
uucaauggguuaagagauu

SEQ ID NO: 1570572 - RNA, 19 nt, Homo sapiens
gaagccacuguucaucuuu

SEQ ID NO: 1570573 - RNA, 19 nt, Homo sapiens
caauagaucaggcauuucu

SEQ ID NO: 1570574 - RNA, 19 nt, Homo sapiens
uaucugcucuacaaaccaa

SEQ ID NO: 1570575 - RNA, 19 nt, Homo sapiens
ccacaaguaucugcucuac

SEQ ID NO: 1570576 - RNA, 19 nt, Homo sapiens
gaaucgccuugcugaaaca

SEQ ID NO: 1570577 - RNA, 19 nt, Homo sapiens
aagaucaaguggaauggaa

SEQ ID NO: 1570578 - RNA, 19 nt, Homo sapiens
gagaaauugcuuccaagau

SEQ ID NO: 1570579 - RNA, 19 nt, Homo sapiens
gcagcagcaucgacaaguc

SEQ ID NO: 1570580 - RNA, 19 nt, Homo sapiens
gagauuugccacaauaugg

SEQ ID NO: 1570581 - RNA, 19 nt, Homo sapiens
guucgaaacguguucuuug

SEQ ID NO: 1570582 - RNA, 19 nt, Homo sapiens
acacgaaauuauccagaau

SEQ ID NO: 1570583 - RNA, 19 nt, Homo sapiens
gguagccucuucacucucu

SEQ ID NO: 1570584 - RNA, 19 nt, Homo sapiens
ggagaaaccgccucgaaaa

SEQ ID NO: 1570585 - RNA, 19 nt, Homo sapiens
ugauagcagucauucacaa

SEQ ID NO: 1570586 - RNA, 19 nt, Homo sapiens
gauguuacaagcucuggaa

SEQ ID NO: 1570587 - RNA, 19 nt, Homo sapiens
guuacaagcucuggaaagg

SEQ ID NO: 1570588 - RNA, 19 nt, Homo sapiens
cugaauugguaguuaagaa

SEQ ID NO: 1570589 - RNA, 19 nt, Homo sapiens
caaauaggagaaauugcuu

SEQ ID NO: 1570590 - RNA, 19 nt, Homo sapiens
uggaagaacuuuugauguu

SEQ ID NO: 1570591 - RNA, 19 nt, Homo sapiens
gggaaaagugucaagaaua

SEQ ID NO: 1570592 - RNA, 19 nt, Homo sapiens
gcucaggccuguccagcua

SEQ ID NO: 1570593 - RNA, 19 nt, Homo sapiens
ccacgacuccuucgagaua

SEQ ID NO: 1570594 - RNA, 19 nt, Homo sapiens
caagaaagaagaugaagau

SEQ ID NO: 1570595 - RNA, 19 nt, Homo sapiens
agaaugaccucucggacuu

SEQ ID NO: 1570596 - RNA, 19 nt, Homo sapiens
gagaagcccuuugcacucu

SEQ ID NO: 1570597 - RNA, 19 nt, Homo sapiens
caaacucucgaaauucuuu

SEQ ID NO: 1570598 - RNA, 19 nt, Homo sapiens
gaugauggacucaauaaac

SEQ ID NO: 1570599 - RNA, 19 nt, Homo sapiens
ugugaugaguggcgucuuu

SEQ ID NO: 1570600 - RNA, 19 nt, Homo sapiens
cgcgcaaacucucgaaauu

SEQ ID NO: 1570601 - RNA, 19 nt, Homo sapiens
ccaagaauagccgggaaua

SEQ ID NO: 1570602 - RNA, 19 nt, Homo sapiens
ggaggaggaggaagaggaa

SEQ ID NO: 1570603 - RNA, 19 nt, Homo sapiens
aagaauagccgggaauaug

SEQ ID NO: 1570604 - RNA, 19 nt, Homo sapiens
aaggcuggcuccucaagaa

SEQ ID NO: 1570605 - RNA, 19 nt, Homo sapiens
gcuggcuccucaagaaaga

SEQ ID NO: 1570606 - RNA, 19 nt, Homo sapiens
ucacaguggugcccaagag

SEQ ID NO: 1570607 - RNA, 19 nt, Homo sapiens
agccagcccuguauuucua

SEQ ID NO: 1570608 - RNA, 19 nt, Homo sapiens
gcgagccagcccuguauuu

SEQ ID NO: 1570609 - RNA, 19 nt, Homo sapiens
cgcaaacucucgaaauucu

SEQ ID NO: 1570610 - RNA, 19 nt, Homo sapiens
gccauucccuguccugucu

SEQ ID NO: 1570611 - RNA, 19 nt, Homo sapiens
ggaagaggaagaggaggaa

SEQ ID NO: 1570612 - RNA, 19 nt, Homo sapiens
gcgcaaacucucgaaauuc

SEQ ID NO: 1570613 - RNA, 19 nt, Homo sapiens
gaauagccgggaauaugug

SEQ ID NO: 1570614 - RNA, 19 nt, Homo sapiens
gcagaccacauuugaguac

SEQ ID NO: 1570615 - RNA, 19 nt, Homo sapiens
agaauagccgggaauaugu

SEQ ID NO: 1570616 - RNA, 19 nt, Homo sapiens
augauggacucaauaaaca

SEQ ID NO: 1570617 - RNA, 19 nt, Homo sapiens
ucaagaaagaagaugaaga

SEQ ID NO: 1570618 - RNA, 19 nt, Homo sapiens
gcagcaacaccuucacagu

SEQ ID NO: 1570619 - RNA, 19 nt, Homo sapiens
caagaauagccgggaauau

SEQ ID NO: 1570620 - RNA, 19 nt, Homo sapiens
gcaaacucucgaaauucuu

SEQ ID NO: 1570621 - RNA, 19 nt, Homo sapiens
gagccagcccuguauuucu

SEQ ID NO: 1570622 - RNA, 19 nt, Homo sapiens
cugaugauggacucaauaa

SEQ ID NO: 1570623 - RNA, 19 nt, Homo sapiens
cauucuguccucucacuuu

SEQ ID NO: 1570624 - RNA, 19 nt, Homo sapiens
uggaggccauggugagaug

SEQ ID NO: 1570625 - RNA, 19 nt, Homo sapiens
ccucaagaaagaagaugaa

SEQ ID NO: 1570626 - RNA, 19 nt, Homo sapiens
cagcgagccagcccuguau

SEQ ID NO: 1570627 - RNA, 19 nt, Homo sapiens
ggaggaggaggaggaggaa

SEQ ID NO: 1570628 - RNA, 19 nt, Homo sapiens
gaucuccuucaacgacaaa

SEQ ID NO: 1570629 - RNA, 19 nt, Homo sapiens
caugagaucgaggugauug

SEQ ID NO: 1570630 - RNA, 19 nt, Homo sapiens
ugcaugagaucgaggugau

SEQ ID NO: 1570631 - RNA, 19 nt, Homo sapiens
ggacaguggaagccaaagg

SEQ ID NO: 1570632 - RNA, 19 nt, Homo sapiens
ucuguggccuucagcaagu

SEQ ID NO: 1570633 - RNA, 19 nt, Homo sapiens
gaagugggguggggaacug

SEQ ID NO: 1570634 - RNA, 19 nt, Homo sapiens
gcaggaccagcacuucagu

SEQ ID NO: 1570635 - RNA, 19 nt, Homo sapiens
gaaagugaauucuaucuug

SEQ ID NO: 1570636 - RNA, 19 nt, Homo sapiens
ggaaauguuuguugccuua

SEQ ID NO: 1570637 - RNA, 19 nt, Homo sapiens
caacagugauugaugauaa

SEQ ID NO: 1570638 - RNA, 19 nt, Homo sapiens
gaacaugcuuauaccuauu

SEQ ID NO: 1570639 - RNA, 19 nt, Homo sapiens
ggagcacacuuauaucaug

SEQ ID NO: 1570640 - RNA, 19 nt, Homo sapiens
guagggagauuucuuuaag

SEQ ID NO: 1570641 - RNA, 19 nt, Homo sapiens
gaaagaaugcaaugaagau

SEQ ID NO: 1570642 - RNA, 19 nt, Homo sapiens
uaagauagcaacagugauu

SEQ ID NO: 1570643 - RNA, 19 nt, Homo sapiens
gguggaaagugaauucuau

SEQ ID NO: 1570644 - RNA, 19 nt, Homo sapiens
aagcuugacuugugcauuu

SEQ ID NO: 1570645 - RNA, 19 nt, Homo sapiens
ccacaaauaaucaugcuuu

SEQ ID NO: 1570646 - RNA, 19 nt, Homo sapiens
gauaaucaagccacacuaa

SEQ ID NO: 1570647 - RNA, 19 nt, Homo sapiens
uagcaacagugauugauga

SEQ ID NO: 1570648 - RNA, 19 nt, Homo sapiens
ggcaggauuugucagauaa

SEQ ID NO: 1570649 - RNA, 19 nt, Homo sapiens
ucagugcccuucaguuaaa

SEQ ID NO: 1570650 - RNA, 19 nt, Homo sapiens
gcaaagaaagaaugcaaug

SEQ ID NO: 1570651 - RNA, 19 nt, Homo sapiens
ugaauucuaucuugcaaug

SEQ ID NO: 1570652 - RNA, 19 nt, Homo sapiens
gauuguaacuucaaagaac

SEQ ID NO: 1570653 - RNA, 19 nt, Homo sapiens
cagaugauguuauauaagg

SEQ ID NO: 1570654 - RNA, 19 nt, Homo sapiens
gcagcuaaauggacacaca

SEQ ID NO: 1570655 - RNA, 19 nt, Homo sapiens
acauggaggucugcacuua

SEQ ID NO: 1570656 - RNA, 19 nt, Homo sapiens
guacaaucaugauguuagu

SEQ ID NO: 1570657 - RNA, 19 nt, Homo sapiens
gcacacuuauaucauggaa

SEQ ID NO: 1570658 - RNA, 19 nt, Homo sapiens
gcuuauaccuauuaacaag

SEQ ID NO: 1570659 - RNA, 19 nt, Homo sapiens
uaaguggacuguuuucuuu

SEQ ID NO: 1570660 - RNA, 19 nt, Homo sapiens
gaaaggguauugcuaaaag

SEQ ID NO: 1570661 - RNA, 19 nt, Homo sapiens
uggcaggauuugucagaua

SEQ ID NO: 1570662 - RNA, 19 nt, Homo sapiens
gauuagaacaugcuuauac

SEQ ID NO: 1570663 - RNA, 19 nt, Homo sapiens
ggaaaacucuaugcaaaga

SEQ ID NO: 1570664 - RNA, 19 nt, Homo sapiens
ggaaagugaauucuaucuu

SEQ ID NO: 1570665 - RNA, 19 nt, Homo sapiens
gguuacagcauuaaacuau

SEQ ID NO: 1570666 - RNA, 19 nt, Homo sapiens
auaauguucuucccacaaa

SEQ ID NO: 1570667 - RNA, 19 nt, Homo sapiens
uauaagauagcaacaguga

SEQ ID NO: 1570668 - RNA, 19 nt, Homo sapiens
agaacaugcuuauaccuau

SEQ ID NO: 1570669 - RNA, 19 nt, Homo sapiens
aagaaaggcuggaaaacua

SEQ ID NO: 1570670 - RNA, 19 nt, Homo sapiens
ggaaaaccauuacaacaca

SEQ ID NO: 1570671 - RNA, 19 nt, Homo sapiens
gggaauauggcuuuuaaua

SEQ ID NO: 1570672 - RNA, 19 nt, Homo sapiens
agucagugcccuucaguua

SEQ ID NO: 1570673 - RNA, 19 nt, Homo sapiens
gauaauacuguacuucauc

SEQ ID NO: 1570674 - RNA, 19 nt, Homo sapiens
guggaaaggguauugcuaa

SEQ ID NO: 1570675 - RNA, 19 nt, Homo sapiens
ccaguagggagauuucuuu

SEQ ID NO: 1570676 - RNA, 19 nt, Homo sapiens
caaagaaagaaugcaauga

SEQ ID NO: 1570677 - RNA, 19 nt, Homo sapiens
uggaaaggguauugcuaaa

SEQ ID NO: 1570678 - RNA, 19 nt, Homo sapiens
ucaaagggguggaaaguga

SEQ ID NO: 1570679 - RNA, 19 nt, Homo sapiens
acacauaugcagcagcuaa

SEQ ID NO: 1570680 - RNA, 19 nt, Homo sapiens
gcaacagugauugaugaua

SEQ ID NO: 1570681 - RNA, 19 nt, Homo sapiens
cuaaaaggauguuuccaaa

SEQ ID NO: 1570682 - RNA, 19 nt, Homo sapiens
gcaaggcacggauggacuu

SEQ ID NO: 1570683 - RNA, 19 nt, Homo sapiens
guuguacaaucaugauguu

SEQ ID NO: 1570684 - RNA, 19 nt, Homo sapiens
guaacuaaagguuguacaa

SEQ ID NO: 1570685 - RNA, 19 nt, Homo sapiens
gcaaugaacgaggaaggaa

SEQ ID NO: 1570686 - RNA, 19 nt, Homo sapiens
uaaugcugcucaaguggaa

SEQ ID NO: 1570687 - RNA, 19 nt, Homo sapiens
uagaacaugcuuauaccua

SEQ ID NO: 1570688 - RNA, 19 nt, Homo sapiens
ggagggaguuugggaucga

SEQ ID NO: 1570689 - RNA, 19 nt, Homo sapiens
aaucaagccacacuaacua

SEQ ID NO: 1570690 - RNA, 19 nt, Homo sapiens
acacugcauuaaagaaaga

SEQ ID NO: 1570691 - RNA, 19 nt, Homo sapiens
caaaaggggauuccuguaa

SEQ ID NO: 1570692 - RNA, 19 nt, Homo sapiens
uaaauggacacacaaugga

SEQ ID NO: 1570693 - RNA, 19 nt, Homo sapiens
aagaaagaaugcaaugaag

SEQ ID NO: 1570694 - RNA, 19 nt, Homo sapiens
gacaguggcaguucggauu

SEQ ID NO: 1570695 - RNA, 19 nt, Homo sapiens
ucaagccacacuaacuaua

SEQ ID NO: 1570696 - RNA, 19 nt, Homo sapiens
gacacugcauuaaagaaag

SEQ ID NO: 1570697 - RNA, 19 nt, Homo sapiens
agacacugcauuaaagaaa

SEQ ID NO: 1570698 - RNA, 19 nt, Homo sapiens
uaagacacugcauuaaaga

SEQ ID NO: 1570699 - RNA, 19 nt, Homo sapiens
caggagcacacuuauauca

SEQ ID NO: 1570700 - RNA, 19 nt, Homo sapiens
gagcaggcaccuaucuugu

SEQ ID NO: 1570701 - RNA, 19 nt, Homo sapiens
ggauucggguccagauucu

SEQ ID NO: 1570702 - RNA, 19 nt, Homo sapiens
agucucagcuuucucaucu

SEQ ID NO: 1570703 - RNA, 19 nt, Homo sapiens
ggauuagaacaugcuuaua

SEQ ID NO: 1570704 - RNA, 19 nt, Homo sapiens
gacuugugcauuuauguuu

SEQ ID NO: 1570705 - RNA, 19 nt, Homo sapiens
agaaagaaugcaaugaaga

SEQ ID NO: 1570706 - RNA, 19 nt, Homo sapiens
aaggaaaacucuaugcaaa

SEQ ID NO: 1570707 - RNA, 19 nt, Homo sapiens
ucaucuuacuugccacaaa

SEQ ID NO: 1570708 - RNA, 19 nt, Homo sapiens
guugggacaaguacaguaa

SEQ ID NO: 1570709 - RNA, 19 nt, Homo sapiens
caagccacacuaacuauag

SEQ ID NO: 1570710 - RNA, 19 nt, Homo sapiens
gcagaugauguuauauaag

SEQ ID NO: 1570711 - RNA, 19 nt, Homo sapiens
gaaauguuuguugccuuaa

SEQ ID NO: 1570712 - RNA, 19 nt, Homo sapiens
cuaaauggacacacaaugg

SEQ ID NO: 1570713 - RNA, 19 nt, Homo sapiens
gcuaaauggacacacaaug

SEQ ID NO: 1570714 - RNA, 19 nt, Homo sapiens
agggagauuucuuuaagug

SEQ ID NO: 1570715 - RNA, 19 nt, Homo sapiens
gaaggaaaacucuaugcaa

SEQ ID NO: 1570716 - RNA, 19 nt, Homo sapiens
caaugaacgaggaaggaaa

SEQ ID NO: 1570717 - RNA, 19 nt, Homo sapiens
uccuaugguuacagcauua

SEQ ID NO: 1570718 - RNA, 19 nt, Homo sapiens
caguagggagauuucuuua

SEQ ID NO: 1570719 - RNA, 19 nt, Homo sapiens
caccaggagcacacuuaua

SEQ ID NO: 1570720 - RNA, 19 nt, Homo sapiens
gucagugcccuucaguuaa

SEQ ID NO: 1570721 - RNA, 19 nt, Homo sapiens
guucuucccacaaauaauc

SEQ ID NO: 1570722 - RNA, 19 nt, Homo sapiens
caucuuacuugccacaaaa

SEQ ID NO: 1570723 - RNA, 19 nt, Homo sapiens
aagccacacuaacuauaga

SEQ ID NO: 1570724 - RNA, 19 nt, Homo sapiens
acagcccacuuucuuccua

SEQ ID NO: 1570725 - RNA, 19 nt, Homo sapiens
ucucagcuuucucaucugu

SEQ ID NO: 1570726 - RNA, 19 nt, Homo sapiens
aauguucuucccacaaaua

SEQ ID NO: 1570727 - RNA, 19 nt, Homo sapiens
gaugauaauacuguacuuc

SEQ ID NO: 1570728 - RNA, 19 nt, Homo sapiens
caaaaguacaggauuagaa

SEQ ID NO: 1570729 - RNA, 19 nt, Homo sapiens
accaggagcacacuuauau

SEQ ID NO: 1570730 - RNA, 19 nt, Homo sapiens
ugacuugugcauuuauguu

SEQ ID NO: 1570731 - RNA, 19 nt, Homo sapiens
uagggagauuucuuuaagu

SEQ ID NO: 1570732 - RNA, 19 nt, Homo sapiens
ggaaaggguauugcuaaaa

SEQ ID NO: 1570733 - RNA, 19 nt, Homo sapiens
cauaugcagcagcuaaaug

SEQ ID NO: 1570734 - RNA, 19 nt, Homo sapiens
cauggaggucugcacuuaa

SEQ ID NO: 1570735 - RNA, 19 nt, Homo sapiens
gaaaugggauuccagguuu

SEQ ID NO: 1570736 - RNA, 19 nt, Homo sapiens
gaaacaggcucaccaaaga

SEQ ID NO: 1570737 - RNA, 19 nt, Homo sapiens
gcaaaggcauugaaagaca

SEQ ID NO: 1570738 - RNA, 19 nt, Homo sapiens
ggacaguguugauaauaau

SEQ ID NO: 1570739 - RNA, 19 nt, Homo sapiens
gaacgacccuucggugaga

SEQ ID NO: 1570740 - RNA, 19 nt, Homo sapiens
gggacaguguugauaauaa

SEQ ID NO: 1570741 - RNA, 19 nt, Homo sapiens
gcaacaaccaucccuguaa

SEQ ID NO: 1570742 - RNA, 19 nt, Homo sapiens
ggaaggagagggcuaguug

SEQ ID NO: 1570743 - RNA, 19 nt, Homo sapiens
ggaaagaaacacacagaga

SEQ ID NO: 1570744 - RNA, 19 nt, Homo sapiens
ggaugguucuccuugcuuu

SEQ ID NO: 1570745 - RNA, 19 nt, Homo sapiens
ggacugguuucuaagacaa

SEQ ID NO: 1570746 - RNA, 19 nt, Homo sapiens
ggagacacacacacacaua

SEQ ID NO: 1570747 - RNA, 19 nt, Homo sapiens
gguuuaagauagcuccuuu

SEQ ID NO: 1570748 - RNA, 19 nt, Homo sapiens
gcuuaaggcugcagacuag

SEQ ID NO: 1570749 - RNA, 19 nt, Homo sapiens
gaacugacccucacaucuc

SEQ ID NO: 1570750 - RNA, 19 nt, Homo sapiens
caacaaccaucccuguaag

SEQ ID NO: 1570751 - RNA, 19 nt, Homo sapiens
ggagaaaccgcuugugcuu

SEQ ID NO: 1570752 - RNA, 19 nt, Homo sapiens
cacagagucuuauagcaaa

SEQ ID NO: 1570753 - RNA, 19 nt, Homo sapiens
gaaaggaacuauuuuacag

SEQ ID NO: 1570754 - RNA, 19 nt, Homo sapiens
uagcaaaggcauugaaaga

SEQ ID NO: 1570755 - RNA, 19 nt, Homo sapiens
caucucccuuccugaauuu

SEQ ID NO: 1570756 - RNA, 19 nt, Homo sapiens
acacacacacagagucuua

SEQ ID NO: 1570757 - RNA, 19 nt, Homo sapiens
gcuccaaacucccgaaagg

SEQ ID NO: 1570758 - RNA, 19 nt, Homo sapiens
gaagagagaaugggagaca

SEQ ID NO: 1570759 - RNA, 19 nt, Homo sapiens
aaaugggauuccagguuua

SEQ ID NO: 1570760 - RNA, 19 nt, Homo sapiens
gauuccagguuuaagauag

SEQ ID NO: 1570761 - RNA, 19 nt, Homo sapiens
acagagagagggaaagaaa

SEQ ID NO: 1570762 - RNA, 19 nt, Homo sapiens
gcagaaacaggcucaccaa

SEQ ID NO: 1570763 - RNA, 19 nt, Homo sapiens
cugagaggguaacugcuua

SEQ ID NO: 1570764 - RNA, 19 nt, Homo sapiens
ucacaucucccuuccugaa

SEQ ID NO: 1570765 - RNA, 19 nt, Homo sapiens
acacagagacugagagaca

SEQ ID NO: 1570766 - RNA, 19 nt, Homo sapiens
ggaaaaggaaccaaauuug

SEQ ID NO: 1570767 - RNA, 19 nt, Homo sapiens
acacagagucuuauagcaa

SEQ ID NO: 1570768 - RNA, 19 nt, Homo sapiens
ggauuccagguuuaagaua

SEQ ID NO: 1570769 - RNA, 19 nt, Homo sapiens
gaucaccgcgucacgacuu

SEQ ID NO: 1570770 - RNA, 19 nt, Homo sapiens
gggaaaaggaaccaaauuu

SEQ ID NO: 1570771 - RNA, 19 nt, Homo sapiens
acacacacagagucuuaua

SEQ ID NO: 1570772 - RNA, 19 nt, Homo sapiens
acacacacauacacacaca

SEQ ID NO: 1570773 - RNA, 19 nt, Homo sapiens
cgacagagagagggaaaga

SEQ ID NO: 1570774 - RNA, 19 nt, Homo sapiens
acacaaaccgacagagaga

SEQ ID NO: 1570775 - RNA, 19 nt, Homo sapiens
acaucucccuuccugaauu

SEQ ID NO: 1570776 - RNA, 19 nt, Homo sapiens
gaacgccaccgcugagaac

SEQ ID NO: 1570777 - RNA, 19 nt, Homo sapiens
gggacugguuucuaagaca

SEQ ID NO: 1570778 - RNA, 19 nt, Homo sapiens
ggauggggauauuucaauu

SEQ ID NO: 1570779 - RNA, 19 nt, Homo sapiens
gaugguucuccuugcuuua

SEQ ID NO: 1570780 - RNA, 19 nt, Homo sapiens
gaccucaguccuucaccua

SEQ ID NO: 1570781 - RNA, 19 nt, Homo sapiens
acacagacacacacacaga

SEQ ID NO: 1570782 - RNA, 19 nt, Homo sapiens
agaaacacacagagacuga

SEQ ID NO: 1570783 - RNA, 19 nt, Homo sapiens
acacacaaaccgacagaga

SEQ ID NO: 1570784 - RNA, 19 nt, Homo sapiens
gcacacgggcacacacaca

SEQ ID NO: 1570785 - RNA, 19 nt, Homo sapiens
gaaggagagggcuaguugu

SEQ ID NO: 1570786 - RNA, 19 nt, Homo sapiens
cgccaccgcugagaacuga

SEQ ID NO: 1570787 - RNA, 19 nt, Homo sapiens
caccaacaccguccagaga

SEQ ID NO: 1570788 - RNA, 19 nt, Homo sapiens
agaaacaggcucaccaaag

SEQ ID NO: 1570789 - RNA, 19 nt, Homo sapiens
gagggcuaguugucugaga

SEQ ID NO: 1570790 - RNA, 19 nt, Homo sapiens
gagagggcuaguugucuga

SEQ ID NO: 1570791 - RNA, 19 nt, Homo sapiens
uauagcaaaggcauugaaa

SEQ ID NO: 1570792 - RNA, 19 nt, Homo sapiens
cagaaacaggcucaccaaa

SEQ ID NO: 1570793 - RNA, 19 nt, Homo sapiens
gcuccaaaccugcccaucu

SEQ ID NO: 1570794 - RNA, 19 nt, Homo sapiens
gagaacugacccucacauc

SEQ ID NO: 1570795 - RNA, 19 nt, Homo sapiens
acacauacacacacagaca

SEQ ID NO: 1570796 - RNA, 19 nt, Homo sapiens
acacacauacacacacaga

SEQ ID NO: 1570797 - RNA, 19 nt, Homo sapiens
agacugagagacagagaga

SEQ ID NO: 1570798 - RNA, 19 nt, Homo sapiens
aaacacacagagacugaga

SEQ ID NO: 1570799 - RNA, 19 nt, Homo sapiens
agagagagggaaagaaaca

SEQ ID NO: 1570800 - RNA, 19 nt, Homo sapiens
gggcacauucggccaagga

SEQ ID NO: 1570801 - RNA, 19 nt, Homo sapiens
ccucaguccuucaccuagu

SEQ ID NO: 1570802 - RNA, 19 nt, Homo sapiens
gggauuccagguuuaagau

SEQ ID NO: 1570803 - RNA, 19 nt, Homo sapiens
ugccuggccuggcuccaaa

SEQ ID NO: 1570804 - RNA, 19 nt, Homo sapiens
gagacacacacacacauac

SEQ ID NO: 1570805 - RNA, 19 nt, Homo sapiens
gacagagagagaagagaga

SEQ ID NO: 1570806 - RNA, 19 nt, Homo sapiens
acacacagagacugagaga

SEQ ID NO: 1570807 - RNA, 19 nt, Homo sapiens
caaaccugcccaucucauc

SEQ ID NO: 1570808 - RNA, 19 nt, Homo sapiens
acacacagacacacacaca

SEQ ID NO: 1570809 - RNA, 19 nt, Homo sapiens
agagagagaagagagaaug

SEQ ID NO: 1570810 - RNA, 19 nt, Homo sapiens
uccaaacucccgaaaggaa

SEQ ID NO: 1570811 - RNA, 19 nt, Homo sapiens
agacagaggagcuccaaac

SEQ ID NO: 1570812 - RNA, 19 nt, Homo sapiens
ccuguucggcccuuuguga

SEQ ID NO: 1570813 - RNA, 19 nt, Homo sapiens
ugagaggguaacugcuuaa

SEQ ID NO: 1570814 - RNA, 19 nt, Homo sapiens
cuuggcauccggagacuuu

SEQ ID NO: 1570815 - RNA, 19 nt, Homo sapiens
cacacagagucuuauagca

SEQ ID NO: 1570816 - RNA, 19 nt, Homo sapiens
gagagagaagagagaaugg

SEQ ID NO: 1570817 - RNA, 19 nt, Homo sapiens
aggcagagaggcagaaaca

SEQ ID NO: 1570818 - RNA, 19 nt, Homo sapiens
cagacuaggaaaugggauu

SEQ ID NO: 1570819 - RNA, 19 nt, Homo sapiens
uaaggcugcagacuaggaa

SEQ ID NO: 1570820 - RNA, 19 nt, Homo sapiens
gagagacagagagagaaga

SEQ ID NO: 1570821 - RNA, 19 nt, Homo sapiens
guacagcuguuauacuuua

SEQ ID NO: 1570822 - RNA, 19 nt, Homo sapiens
gcacaaagccgucucauuc

SEQ ID NO: 1570823 - RNA, 19 nt, Homo sapiens
gaaaggcucugagaaguga

SEQ ID NO: 1570824 - RNA, 19 nt, Homo sapiens
gaagaagguuacagagauu

SEQ ID NO: 1570825 - RNA, 19 nt, Homo sapiens
gagcggagguuuaauagau

SEQ ID NO: 1570826 - RNA, 19 nt, Homo sapiens
gaaguugggucuccauuuc

SEQ ID NO: 1570827 - RNA, 19 nt, Homo sapiens
ggacgaagcccacauagug

SEQ ID NO: 1570828 - RNA, 19 nt, Homo sapiens
gcacagcccucugcaguga

SEQ ID NO: 1570829 - RNA, 19 nt, Homo sapiens
gaaagaacaccacgaacaa

SEQ ID NO: 1570830 - RNA, 19 nt, Homo sapiens
ggacaaacacgaggacuuu

SEQ ID NO: 1570831 - RNA, 19 nt, Homo sapiens
uaaaggagguaauucugaa

SEQ ID NO: 1570832 - RNA, 19 nt, Homo sapiens
uuacagagauuucccguau

SEQ ID NO: 1570833 - RNA, 19 nt, Homo sapiens
cauaguaucauccugaaua

SEQ ID NO: 1570834 - RNA, 19 nt, Homo sapiens
caucacacccggcuaauuu

SEQ ID NO: 1570835 - RNA, 19 nt, Homo sapiens
ggguacagcuguuauacuu

SEQ ID NO: 1570836 - RNA, 19 nt, Homo sapiens
caaguuagacaaggauuua

SEQ ID NO: 1570837 - RNA, 19 nt, Homo sapiens
gagaaccugcccuaaauaa

SEQ ID NO: 1570838 - RNA, 19 nt, Homo sapiens
caagggauccuccugcuuu

SEQ ID NO: 1570839 - RNA, 19 nt, Homo sapiens
uggaagaggucaaguuaga

SEQ ID NO: 1570840 - RNA, 19 nt, Homo sapiens
gaaccugcccuaaauaaag

SEQ ID NO: 1570841 - RNA, 19 nt, Homo sapiens
gaggaggccacucguauuu

SEQ ID NO: 1570842 - RNA, 19 nt, Homo sapiens
ucaaguagcugggauuaca

SEQ ID NO: 1570843 - RNA, 19 nt, Homo sapiens
cgaacaaagucuucagaug

SEQ ID NO: 1570844 - RNA, 19 nt, Homo sapiens
agaagaagguuacagagau

SEQ ID NO: 1570845 - RNA, 19 nt, Homo sapiens
gagaagguccugugagguu

SEQ ID NO: 1570846 - RNA, 19 nt, Homo sapiens
cagcagacacacugaauuu

SEQ ID NO: 1570847 - RNA, 19 nt, Homo sapiens
gcauuugccucagaccuuu

SEQ ID NO: 1570848 - RNA, 19 nt, Homo sapiens
gaagaggaggccacucgua

SEQ ID NO: 1570849 - RNA, 19 nt, Homo sapiens
cagcagcccuuauagaaag

SEQ ID NO: 1570850 - RNA, 19 nt, Homo sapiens
aaagagaaauuagccaugu

SEQ ID NO: 1570851 - RNA, 19 nt, Homo sapiens
gcagaugaaaggcuuaaga

SEQ ID NO: 1570852 - RNA, 19 nt, Homo sapiens
guaucauccugaauaguuu

SEQ ID NO: 1570853 - RNA, 19 nt, Homo sapiens
gcagcagcccuuauagaaa

SEQ ID NO: 1570854 - RNA, 19 nt, Homo sapiens
gcagacacacugaauuuua

SEQ ID NO: 1570855 - RNA, 19 nt, Homo sapiens
ucuaagcucuguacucugu

SEQ ID NO: 1570856 - RNA, 19 nt, Homo sapiens
gaugguaucuaagcucugu

SEQ ID NO: 1570857 - RNA, 19 nt, Homo sapiens
acagagauuucccguaugu

SEQ ID NO: 1570858 - RNA, 19 nt, Homo sapiens
gauuuagguucacagcaaa

SEQ ID NO: 1570859 - RNA, 19 nt, Homo sapiens
cugagaaccugcccuaaau

SEQ ID NO: 1570860 - RNA, 19 nt, Homo sapiens
caaaggcucccguguauac

SEQ ID NO: 1570861 - RNA, 19 nt, Homo sapiens
uaucuaagcucuguacucu

SEQ ID NO: 1570862 - RNA, 19 nt, Homo sapiens
agagggcaguggcacaaua

SEQ ID NO: 1570863 - RNA, 19 nt, Homo sapiens
ggcagcagcccuuauagaa

SEQ ID NO: 1570864 - RNA, 19 nt, Homo sapiens
ggaaaggcucugagaagug

SEQ ID NO: 1570865 - RNA, 19 nt, Homo sapiens
gaagaggucaaguuagaca

SEQ ID NO: 1570866 - RNA, 19 nt, Homo sapiens
gaugaaaggcuuaagaaaa

SEQ ID NO: 1570867 - RNA, 19 nt, Homo sapiens
ccaaagugcugggaugaca

SEQ ID NO: 1570868 - RNA, 19 nt, Homo sapiens
cagcuguuauacuuuauga

SEQ ID NO: 1570869 - RNA, 19 nt, Homo sapiens
acaaagccgucucauucaa

SEQ ID NO: 1570870 - RNA, 19 nt, Homo sapiens
cguggaagaggucaaguua

SEQ ID NO: 1570871 - RNA, 19 nt, Homo sapiens
uaggagcggagguuuaaua

SEQ ID NO: 1570872 - RNA, 19 nt, Homo sapiens
uagagcagauuuagguuca

SEQ ID NO: 1570873 - RNA, 19 nt, Homo sapiens
ccucugugcuccaggauau

SEQ ID NO: 1570874 - RNA, 19 nt, Homo sapiens
caaccacacucccguucug

SEQ ID NO: 1570875 - RNA, 19 nt, Homo sapiens
ugaaagaacaccacgaaca

SEQ ID NO: 1570876 - RNA, 19 nt, Homo sapiens
agauuuagguucacagcaa

SEQ ID NO: 1570877 - RNA, 19 nt, Homo sapiens
gaacaccacgaacaaaguc

SEQ ID NO: 1570878 - RNA, 19 nt, Homo sapiens
gcaucuagcccaaacuugu

SEQ ID NO: 1570879 - RNA, 19 nt, Homo sapiens
gcuuuagccucucaaguag

SEQ ID NO: 1570880 - RNA, 19 nt, Homo sapiens
gagggcaguggcacaauaa

SEQ ID NO: 1570881 - RNA, 19 nt, Homo sapiens
cagaugaaaggcuuaagaa

SEQ ID NO: 1570882 - RNA, 19 nt, Homo sapiens
gcagcagacacacugaauu

SEQ ID NO: 1570883 - RNA, 19 nt, Homo sapiens
uucaaaggcucccguguau

SEQ ID NO: 1570884 - RNA, 19 nt, Homo sapiens
aagggauccuccugcuuua

SEQ ID NO: 1570885 - RNA, 19 nt, Homo sapiens
gagcagauuuagguucaca

SEQ ID NO: 1570886 - RNA, 19 nt, Homo sapiens
ggaggcaucuagcccaaac

SEQ ID NO: 1570887 - RNA, 19 nt, Homo sapiens
gagggaguuucgccauguu

SEQ ID NO: 1570888 - RNA, 19 nt, Homo sapiens
acagcucacugcagucuug

SEQ ID NO: 1570889 - RNA, 19 nt, Homo sapiens
gcucugagaagugaaagaa

SEQ ID NO: 1570890 - RNA, 19 nt, Homo sapiens
guuggcagcagcccuuaua

SEQ ID NO: 1570891 - RNA, 19 nt, Homo sapiens
gacaaacacgaggacuuua

SEQ ID NO: 1570892 - RNA, 19 nt, Homo sapiens
gcucuguacucuguugaga

SEQ ID NO: 1570893 - RNA, 19 nt, Homo sapiens
uaagcucuguacucuguug

SEQ ID NO: 1570894 - RNA, 19 nt, Homo sapiens
ugagaaccugcccuaaaua

SEQ ID NO: 1570895 - RNA, 19 nt, Homo sapiens
ucugagaagugaaagaaca

SEQ ID NO: 1570896 - RNA, 19 nt, Homo sapiens
aaaggaagcagaugaaagg

SEQ ID NO: 1570897 - RNA, 19 nt, Homo sapiens
gugcugggaugacaguugu

SEQ ID NO: 1570898 - RNA, 19 nt, Homo sapiens
gaacuccugagcucaagug

SEQ ID NO: 1570899 - RNA, 19 nt, Homo sapiens
ugaagcggcuacauugucu

SEQ ID NO: 1570900 - RNA, 19 nt, Homo sapiens
cuccugagcucaagugauc

SEQ ID NO: 1570901 - RNA, 19 nt, Homo sapiens
uagaagaagguuacagaga

SEQ ID NO: 1570902 - RNA, 19 nt, Homo sapiens
cagagugacaggagagaaa

SEQ ID NO: 1570903 - RNA, 19 nt, Homo sapiens
uacauugucuggucuacau

SEQ ID NO: 1570904 - RNA, 19 nt, Homo sapiens
ucacugcagucuugaacuc

SEQ ID NO: 1570905 - RNA, 19 nt, Homo sapiens
ggagcucggccacaggaaa

SEQ ID NO: 1570906 - RNA, 19 nt, Homo sapiens
gcccaaacuuguggucuuc

SEQ ID NO: 1570907 - RNA, 19 nt, Homo sapiens
ucucucuucuccaagcaua

SEQ ID NO: 1570908 - RNA, 19 nt, Homo sapiens
gcggagguuuaauagauag

SEQ ID NO: 1570909 - RNA, 19 nt, Homo sapiens
gggcuccauugauucauuc

SEQ ID NO: 1570910 - RNA, 19 nt, Homo sapiens
guacucuguugagaaguug

SEQ ID NO: 1570911 - RNA, 19 nt, Homo sapiens
ugcuuuagccucucaagua

SEQ ID NO: 1570912 - RNA, 19 nt, Homo sapiens
gcaagguggcgggugguaa

SEQ ID NO: 1570913 - RNA, 19 nt, Homo sapiens
ggaaaaggaagcagaugaa

SEQ ID NO: 1570914 - RNA, 19 nt, Homo sapiens
gcaggagcaggagaacuaa

SEQ ID NO: 1570915 - RNA, 19 nt, Homo sapiens
uguacucuguugagaaguu

SEQ ID NO: 1570916 - RNA, 19 nt, Homo sapiens
cccagaguccacagauuua

SEQ ID NO: 1570917 - RNA, 19 nt, Homo sapiens
ucugagaaccugcccuaaa

SEQ ID NO: 1570918 - RNA, 19 nt, Homo sapiens
caggaaaggcucugagaag

SEQ ID NO: 1570919 - RNA, 19 nt, Homo sapiens
ggauuuaagagcugaccaa

SEQ ID NO: 1570920 - RNA, 19 nt, Homo sapiens
gagcaggagaacuaaggaa

SEQ ID NO: 1570921 - RNA, 19 nt, Homo sapiens
gcaacgauuugaacuauuu

SEQ ID NO: 1570922 - RNA, 19 nt, Homo sapiens
gggaaaugauuguguguaa

SEQ ID NO: 1570923 - RNA, 19 nt, Homo sapiens
gaauaugugucaagauaga

SEQ ID NO: 1570924 - RNA, 19 nt, Homo sapiens
gaagaaaggcacacucauu

SEQ ID NO: 1570925 - RNA, 19 nt, Homo sapiens
gagcaacgauuugaacuau

SEQ ID NO: 1570926 - RNA, 19 nt, Homo sapiens
gaaagaagacacagaugga

SEQ ID NO: 1570927 - RNA, 19 nt, Homo sapiens
gagcauauaucccaagcau

SEQ ID NO: 1570928 - RNA, 19 nt, Homo sapiens
ccaggaaccucucagucua

SEQ ID NO: 1570929 - RNA, 19 nt, Homo sapiens
caagauagagugaauggaa

SEQ ID NO: 1570930 - RNA, 19 nt, Homo sapiens
ggagggagccggagaagau

SEQ ID NO: 1570931 - RNA, 19 nt, Homo sapiens
ccaagaauaugugucaaga

SEQ ID NO: 1570932 - RNA, 19 nt, Homo sapiens
gaacgugugacuccagauu

SEQ ID NO: 1570933 - RNA, 19 nt, Homo sapiens
cgacauagacuccauccuu

SEQ ID NO: 1570934 - RNA, 19 nt, Homo sapiens
caacagggcaggagagaau

SEQ ID NO: 1570935 - RNA, 19 nt, Homo sapiens
acaggucacucaucagaaa

SEQ ID NO: 1570936 - RNA, 19 nt, Homo sapiens
aaggcacacucauuucuua

SEQ ID NO: 1570937 - RNA, 19 nt, Homo sapiens
guauguaggcuuccaugua

SEQ ID NO: 1570938 - RNA, 19 nt, Homo sapiens
uuacccagauugcaaauau

SEQ ID NO: 1570939 - RNA, 19 nt, Homo sapiens
ugacaucaguaguucaaga

SEQ ID NO: 1570940 - RNA, 19 nt, Homo sapiens
gagccucaguuuccucuau

SEQ ID NO: 1570941 - RNA, 19 nt, Homo sapiens
gcaggaaggcagccaagaa

SEQ ID NO: 1570942 - RNA, 19 nt, Homo sapiens
gugaauggaacaaagauuu

SEQ ID NO: 1570943 - RNA, 19 nt, Homo sapiens
caucccaggugguuacaaa

SEQ ID NO: 1570944 - RNA, 19 nt, Homo sapiens
aagaaaggcacacucauuu

SEQ ID NO: 1570945 - RNA, 19 nt, Homo sapiens
ucuaaggagucuaggaauu

SEQ ID NO: 1570946 - RNA, 19 nt, Homo sapiens
gagaagaaaggcacacuca

SEQ ID NO: 1570947 - RNA, 19 nt, Homo sapiens
gcaaaggcagccaucagaa

SEQ ID NO: 1570948 - RNA, 19 nt, Homo sapiens
ggaaacagcaaagauagau

SEQ ID NO: 1570949 - RNA, 19 nt, Homo sapiens
gaaaugauuguguguaagg

SEQ ID NO: 1570950 - RNA, 19 nt, Homo sapiens
cagcugcccuccugcgaaa

SEQ ID NO: 1570951 - RNA, 19 nt, Homo sapiens
cugaaucccuaccuuuaaa

SEQ ID NO: 1570952 - RNA, 19 nt, Homo sapiens
gggcucuucuguacauuug

SEQ ID NO: 1570953 - RNA, 19 nt, Homo sapiens
gaacuauuucuucuacuuc

SEQ ID NO: 1570954 - RNA, 19 nt, Homo sapiens
ggagcaacgauuugaacua

SEQ ID NO: 1570955 - RNA, 19 nt, Homo sapiens
cuaaggagucuaggaauuu

SEQ ID NO: 1570956 - RNA, 19 nt, Homo sapiens
caaaguguguucuggaaaa

SEQ ID NO: 1570957 - RNA, 19 nt, Homo sapiens
gcugggacguccuggcaaa

SEQ ID NO: 1570958 - RNA, 19 nt, Homo sapiens
gcaggagaaucacuugaac

SEQ ID NO: 1570959 - RNA, 19 nt, Homo sapiens
gaaaccccauccuuacuaa

SEQ ID NO: 1570960 - RNA, 19 nt, Homo sapiens
gaaacagcaaagauagauu

SEQ ID NO: 1570961 - RNA, 19 nt, Homo sapiens
cugaagggcuggugucuag

SEQ ID NO: 1570962 - RNA, 19 nt, Homo sapiens
ccagauuugccuaucguua

SEQ ID NO: 1570963 - RNA, 19 nt, Homo sapiens
cagcaaagauagauuucag

SEQ ID NO: 1570964 - RNA, 19 nt, Homo sapiens
ggcggaaacagcaaagaua

SEQ ID NO: 1570965 - RNA, 19 nt, Homo sapiens
ggaaaugauuguguguaag

SEQ ID NO: 1570966 - RNA, 19 nt, Homo sapiens
gaacccaggaggcagaguu

SEQ ID NO: 1570967 - RNA, 19 nt, Homo sapiens
ucacuugacaucaguaguu

SEQ ID NO: 1570968 - RNA, 19 nt, Homo sapiens
uauguaggcuuccauguac

SEQ ID NO: 1570969 - RNA, 19 nt, Homo sapiens
gaaggagggagccggagaa

SEQ ID NO: 1570970 - RNA, 19 nt, Homo sapiens
uacaaaguguguucuggaa

SEQ ID NO: 1570971 - RNA, 19 nt, Homo sapiens
ggucaaccaauagaacaua

SEQ ID NO: 1570972 - RNA, 19 nt, Homo sapiens
ggagagaauaaagacauuu

SEQ ID NO: 1570973 - RNA, 19 nt, Homo sapiens
ugagguggguggaucacuu

SEQ ID NO: 1570974 - RNA, 19 nt, Homo sapiens
cgagaucucagacaggaaa

SEQ ID NO: 1570975 - RNA, 19 nt, Homo sapiens
ucaaagaaagguucagcaa

SEQ ID NO: 1570976 - RNA, 19 nt, Homo sapiens
uuagacuggucagcaaaua

SEQ ID NO: 1570977 - RNA, 19 nt, Homo sapiens
uguggacgcucacucaaug

SEQ ID NO: 1570978 - RNA, 19 nt, Homo sapiens
gggcaggagagaauaaaga

SEQ ID NO: 1570979 - RNA, 19 nt, Homo sapiens
caacgggcaucuguucauc

SEQ ID NO: 1570980 - RNA, 19 nt, Homo sapiens
gaucuugagugggagaaca

SEQ ID NO: 1570981 - RNA, 19 nt, Homo sapiens
ggcaaaggcagccaucaga

SEQ ID NO: 1570982 - RNA, 19 nt, Homo sapiens
ggugaaagaagacacagau

SEQ ID NO: 1570983 - RNA, 19 nt, Homo sapiens
ccuuacaggucacucauca

SEQ ID NO: 1570984 - RNA, 19 nt, Homo sapiens
gcaugggucuugggacaca

SEQ ID NO: 1570985 - RNA, 19 nt, Homo sapiens
caagaucacgccacuguac

SEQ ID NO: 1570986 - RNA, 19 nt, Homo sapiens
gccaagaucacgccacugu

SEQ ID NO: 1570987 - RNA, 19 nt, Homo sapiens
caaccaauagaacauacuu

SEQ ID NO: 1570988 - RNA, 19 nt, Homo sapiens
aaaggcagccaucagaaga

SEQ ID NO: 1570989 - RNA, 19 nt, Homo sapiens
uagagugaauggaacaaag

SEQ ID NO: 1570990 - RNA, 19 nt, Homo sapiens
ccaggugguuacaaagugu

SEQ ID NO: 1570991 - RNA, 19 nt, Homo sapiens
uacccagauugcaaauaua

SEQ ID NO: 1570992 - RNA, 19 nt, Homo sapiens
gcuggugugucagaaguug

SEQ ID NO: 1570993 - RNA, 19 nt, Homo sapiens
ggcaggagaaucacuugaa

SEQ ID NO: 1570994 - RNA, 19 nt, Homo sapiens
gcaccuguaaucccagcua

SEQ ID NO: 1570995 - RNA, 19 nt, Homo sapiens
uguguuagcccaagucuuc

SEQ ID NO: 1570996 - RNA, 19 nt, Homo sapiens
gcugcaagguagaaagaag

SEQ ID NO: 1570997 - RNA, 19 nt, Homo sapiens
uuacaggucacucaucaga

SEQ ID NO: 1570998 - RNA, 19 nt, Homo sapiens
gcggaaacagcaaagauag

SEQ ID NO: 1570999 - RNA, 19 nt, Homo sapiens
cagccgaccuugccuacca

SEQ ID NO: 1571000 - RNA, 19 nt, Homo sapiens
uggguguccuggagucuuu

SEQ ID NO: 1571001 - RNA, 19 nt, Homo sapiens
guggguggaucacuugaca

SEQ ID NO: 1571002 - RNA, 19 nt, Homo sapiens
gcaacgggcaucuguucau

SEQ ID NO: 1571003 - RNA, 19 nt, Homo sapiens
caaaggcagccaucagaag

SEQ ID NO: 1571004 - RNA, 19 nt, Homo sapiens
gauuguguguaaggaaaga

SEQ ID NO: 1571005 - RNA, 19 nt, Homo sapiens
gagccaccacugagcauau

SEQ ID NO: 1571006 - RNA, 19 nt, Homo sapiens
ccuguaaucccagcacuuu

SEQ ID NO: 1571007 - RNA, 19 nt, Homo sapiens
gcaaauaucaaaacgagau

SEQ ID NO: 1571008 - RNA, 19 nt, Homo sapiens
ucugaaucccuaccuuuaa

SEQ ID NO: 1571009 - RNA, 19 nt, Homo sapiens
gacgcucacucaaugucuu

SEQ ID NO: 1571010 - RNA, 19 nt, Homo sapiens
cauagacuccauccuuguu

SEQ ID NO: 1571011 - RNA, 19 nt, Homo sapiens
aggagagaauaaagacauu

SEQ ID NO: 1571012 - RNA, 19 nt, Homo sapiens
cuacuucacccacauugau

SEQ ID NO: 1571013 - RNA, 19 nt, Homo sapiens
guggaucacuugacaucag

SEQ ID NO: 1571014 - RNA, 19 nt, Homo sapiens
cagauggagccaccacuga

SEQ ID NO: 1571015 - RNA, 19 nt, Homo sapiens
acgcuuggcucuccauucu

SEQ ID NO: 1571016 - RNA, 19 nt, Homo sapiens
gccuaucguuacccagauu

SEQ ID NO: 1571017 - RNA, 19 nt, Homo sapiens
gugcuggugugucagaagu

SEQ ID NO: 1571018 - RNA, 19 nt, Homo sapiens
cgauuugaacuauuucuuc

SEQ ID NO: 1571019 - RNA, 19 nt, Homo sapiens
gagguggguggaucacuug

SEQ ID NO: 1571020 - RNA, 19 nt, Homo sapiens
ccucugaaucccuaccuuu

SEQ ID NO: 1571021 - RNA, 19 nt, Homo sapiens
ggccaaagcuguaaguuaa

SEQ ID NO: 1571022 - RNA, 19 nt, Homo sapiens
gaaauggucuaacucuaaa

SEQ ID NO: 1571023 - RNA, 19 nt, Homo sapiens
ggacugcaauauuacauuu

SEQ ID NO: 1571024 - RNA, 19 nt, Homo sapiens
aaaugggacugcaauauua

SEQ ID NO: 1571025 - RNA, 19 nt, Homo sapiens
uggcaugccuguacuauua

SEQ ID NO: 1571026 - RNA, 19 nt, Homo sapiens
gaaugugaaugccaucuuu

SEQ ID NO: 1571027 - RNA, 19 nt, Homo sapiens
ggaaauggucuaacucuaa

SEQ ID NO: 1571028 - RNA, 19 nt, Homo sapiens
gaaagaaagacaaggagua

SEQ ID NO: 1571029 - RNA, 19 nt, Homo sapiens
gaaagagauugcauuuaug

SEQ ID NO: 1571030 - RNA, 19 nt, Homo sapiens
caacuugccuuuuccauua

SEQ ID NO: 1571031 - RNA, 19 nt, Homo sapiens
gaauggcaaugauacauga

SEQ ID NO: 1571032 - RNA, 19 nt, Homo sapiens
gaacuagaaggaagguuua

SEQ ID NO: 1571033 - RNA, 19 nt, Homo sapiens
gcaguaaggugguuuaaac

SEQ ID NO: 1571034 - RNA, 19 nt, Homo sapiens
gaagaugaauguugucucu

SEQ ID NO: 1571035 - RNA, 19 nt, Homo sapiens
caaaugcugucuucuguau

SEQ ID NO: 1571036 - RNA, 19 nt, Homo sapiens
ugaaauagaccgugcagua

SEQ ID NO: 1571037 - RNA, 19 nt, Homo sapiens
uagagaggcuuguuuaaug

SEQ ID NO: 1571038 - RNA, 19 nt, Homo sapiens
gcaaugccaugcuacaguu

SEQ ID NO: 1571039 - RNA, 19 nt, Homo sapiens
uaacugaccuuaguaaagu

SEQ ID NO: 1571040 - RNA, 19 nt, Homo sapiens
agaugaauguugucucuua

SEQ ID NO: 1571041 - RNA, 19 nt, Homo sapiens
caaccgcuguccauuguuu

SEQ ID NO: 1571042 - RNA, 19 nt, Homo sapiens
gcaaugagaaugaauagau

SEQ ID NO: 1571043 - RNA, 19 nt, Homo sapiens
ggacguggauaaaucacuu

SEQ ID NO: 1571044 - RNA, 19 nt, Homo sapiens
gaugaauguugucucuuaa

SEQ ID NO: 1571045 - RNA, 19 nt, Homo sapiens
ucaaaugggugcucuuuua

SEQ ID NO: 1571046 - RNA, 19 nt, Homo sapiens
ugacagugguuacagcuaa

SEQ ID NO: 1571047 - RNA, 19 nt, Homo sapiens
cagcaacaguauaaaugua

SEQ ID NO: 1571048 - RNA, 19 nt, Homo sapiens
gauguuaccuacuaaacug

SEQ ID NO: 1571049 - RNA, 19 nt, Homo sapiens
gaaauagaccgugcaguau

SEQ ID NO: 1571050 - RNA, 19 nt, Homo sapiens
cagaagccauuccaucauu

SEQ ID NO: 1571051 - RNA, 19 nt, Homo sapiens
ccacaugguuggcuauaau

SEQ ID NO: 1571052 - RNA, 19 nt, Homo sapiens
caggaaagcuuuugauauu

SEQ ID NO: 1571053 - RNA, 19 nt, Homo sapiens
gaggaagaaauauagcuua

SEQ ID NO: 1571054 - RNA, 19 nt, Homo sapiens
ugucuagaguucacaauaa

SEQ ID NO: 1571055 - RNA, 19 nt, Homo sapiens
gguuguuguugcuguauua

SEQ ID NO: 1571056 - RNA, 19 nt, Homo sapiens
gcagaucgaauaacuugaa

SEQ ID NO: 1571057 - RNA, 19 nt, Homo sapiens
gggaaauggucuaacucua

SEQ ID NO: 1571058 - RNA, 19 nt, Homo sapiens
gaaguuaugcaaugagaau

SEQ ID NO: 1571059 - RNA, 19 nt, Homo sapiens
ggcuuuaguuagaguaaua

SEQ ID NO: 1571060 - RNA, 19 nt, Homo sapiens
ggacaguguucuucuuugg

SEQ ID NO: 1571061 - RNA, 19 nt, Homo sapiens
gugaagaggaagaaauaua

SEQ ID NO: 1571062 - RNA, 19 nt, Homo sapiens
guuaaucccuucuguuuac

SEQ ID NO: 1571063 - RNA, 19 nt, Homo sapiens
gcaucagacagaauaguua

SEQ ID NO: 1571064 - RNA, 19 nt, Homo sapiens
guauuggaguuaaucugua

SEQ ID NO: 1571065 - RNA, 19 nt, Homo sapiens
agaagccauuccaucauua

SEQ ID NO: 1571066 - RNA, 19 nt, Homo sapiens
cuacguuguugcuuucuaa

SEQ ID NO: 1571067 - RNA, 19 nt, Homo sapiens
ccauaucuacuuacacaua

SEQ ID NO: 1571068 - RNA, 19 nt, Homo sapiens
cauuugcucucauauauca

SEQ ID NO: 1571069 - RNA, 19 nt, Homo sapiens
ccaaagcuguaaguuaaga

SEQ ID NO: 1571070 - RNA, 19 nt, Homo sapiens
ugccaggguucaucacuua

SEQ ID NO: 1571071 - RNA, 19 nt, Homo sapiens
caagagagccacaguagag

SEQ ID NO: 1571072 - RNA, 19 nt, Homo sapiens
aauguugucucuuaacuug

SEQ ID NO: 1571073 - RNA, 19 nt, Homo sapiens
caaugcaucagacagaaua

SEQ ID NO: 1571074 - RNA, 19 nt, Homo sapiens
gaacuuugugaauggauuu

SEQ ID NO: 1571075 - RNA, 19 nt, Homo sapiens
aaaccacucucaugucuag

SEQ ID NO: 1571076 - RNA, 19 nt, Homo sapiens
gauuuagaguuaugucuca

SEQ ID NO: 1571077 - RNA, 19 nt, Homo sapiens
aauaacugguugcauguaa

SEQ ID NO: 1571078 - RNA, 19 nt, Homo sapiens
gcucucauauaucaguauu

SEQ ID NO: 1571079 - RNA, 19 nt, Homo sapiens
ggaaaaguauuggaguuaa

SEQ ID NO: 1571080 - RNA, 19 nt, Homo sapiens
ccauguaacugaccuuagu

SEQ ID NO: 1571081 - RNA, 19 nt, Homo sapiens
cuugaacgcuuauguggaa

SEQ ID NO: 1571082 - RNA, 19 nt, Homo sapiens
guacauaaggaauacuuga

SEQ ID NO: 1571083 - RNA, 19 nt, Homo sapiens
guggauaaaucacuuugug

SEQ ID NO: 1571084 - RNA, 19 nt, Homo sapiens
aaagaaagacaaggaguaa

SEQ ID NO: 1571085 - RNA, 19 nt, Homo sapiens
ccauauggcacauuugauu

SEQ ID NO: 1571086 - RNA, 19 nt, Homo sapiens
ggacagggaaauggucuaa

SEQ ID NO: 1571087 - RNA, 19 nt, Homo sapiens
ucuuaaacuuggccaauuu

SEQ ID NO: 1571088 - RNA, 19 nt, Homo sapiens
cuaaugucuugguagaaua

SEQ ID NO: 1571089 - RNA, 19 nt, Homo sapiens
gaaagcaagaauacuuaga

SEQ ID NO: 1571090 - RNA, 19 nt, Homo sapiens
caucucaggauacuugaua

SEQ ID NO: 1571091 - RNA, 19 nt, Homo sapiens
cgaauaacuugaaauagac

SEQ ID NO: 1571092 - RNA, 19 nt, Homo sapiens
gcaguaccauuggagaguu

SEQ ID NO: 1571093 - RNA, 19 nt, Homo sapiens
acaugucauucacaacuua

SEQ ID NO: 1571094 - RNA, 19 nt, Homo sapiens
gccauuccaucauuauaga

SEQ ID NO: 1571095 - RNA, 19 nt, Homo sapiens
agaauucuggcuuuaguua

SEQ ID NO: 1571096 - RNA, 19 nt, Homo sapiens
caguagagaggcuuguuua

SEQ ID NO: 1571097 - RNA, 19 nt, Homo sapiens
aagaaagcaugaagaaaca

SEQ ID NO: 1571098 - RNA, 19 nt, Homo sapiens
caacagagaauguauuuug

SEQ ID NO: 1571099 - RNA, 19 nt, Homo sapiens
gaggaauuauuuggccuuu

SEQ ID NO: 1571100 - RNA, 19 nt, Homo sapiens
guagagaggcuuguuuaau

SEQ ID NO: 1571101 - RNA, 19 nt, Homo sapiens
uugacuaacugaacuagaa

SEQ ID NO: 1571102 - RNA, 19 nt, Homo sapiens
caaaugauucucuuaagca

SEQ ID NO: 1571103 - RNA, 19 nt, Homo sapiens
gucuagaguucacaauaaa

SEQ ID NO: 1571104 - RNA, 19 nt, Homo sapiens
caggauacuugauaugcaa

SEQ ID NO: 1571105 - RNA, 19 nt, Homo sapiens
ggaauuauuuggccuuuuc

SEQ ID NO: 1571106 - RNA, 19 nt, Homo sapiens
uugaggauguuaccuacua

SEQ ID NO: 1571107 - RNA, 19 nt, Homo sapiens
caauguaaucacccuauuu

SEQ ID NO: 1571108 - RNA, 19 nt, Homo sapiens
uuggagaguuaacagaaua

SEQ ID NO: 1571109 - RNA, 19 nt, Homo sapiens
ucaauguaaucacccuauu

SEQ ID NO: 1571110 - RNA, 19 nt, Homo sapiens
gacaagagagccacaguag

SEQ ID NO: 1571111 - RNA, 19 nt, Homo sapiens
ggaaagguauacggaaacu

SEQ ID NO: 1571112 - RNA, 19 nt, Homo sapiens
uauuguaccuugauuugga

SEQ ID NO: 1571113 - RNA, 19 nt, Homo sapiens
uaguuaaucccuucuguuu

SEQ ID NO: 1571114 - RNA, 19 nt, Homo sapiens
uagaaguuaugcaaugaga

SEQ ID NO: 1571115 - RNA, 19 nt, Homo sapiens
cuaaaccacucucaugucu

SEQ ID NO: 1571116 - RNA, 19 nt, Homo sapiens
aaagaaagcaugaagaaac

SEQ ID NO: 1571117 - RNA, 19 nt, Homo sapiens
ugaacugccuauguuauug

SEQ ID NO: 1571118 - RNA, 19 nt, Homo sapiens
gagauucuucugauaguau

SEQ ID NO: 1571119 - RNA, 19 nt, Homo sapiens
uagcagaucgaauaacuug

SEQ ID NO: 1571120 - RNA, 19 nt, Homo sapiens
caguaccauuggagaguua

SEQ ID NO: 1571121 - RNA, 19 nt, Homo sapiens
gcagagcccuagcuguuua

SEQ ID NO: 1571122 - RNA, 19 nt, Homo sapiens
gaaaucaccauuccuauga

SEQ ID NO: 1571123 - RNA, 19 nt, Homo sapiens
ggagguauuugauaacuga

SEQ ID NO: 1571124 - RNA, 19 nt, Homo sapiens
gcccuuauuugucuaauuu

SEQ ID NO: 1571125 - RNA, 19 nt, Homo sapiens
ggagaaaucaccauuccua

SEQ ID NO: 1571126 - RNA, 19 nt, Homo sapiens
aaucaggaaugggaaauua

SEQ ID NO: 1571127 - RNA, 19 nt, Homo sapiens
gcagagguguuugucauug

SEQ ID NO: 1571128 - RNA, 19 nt, Homo sapiens
uaaacacauugccuuauga

SEQ ID NO: 1571129 - RNA, 19 nt, Homo sapiens
gguauuugauaacugagua

SEQ ID NO: 1571130 - RNA, 19 nt, Homo sapiens
uuugacagcuccacauuaa

SEQ ID NO: 1571131 - RNA, 19 nt, Homo sapiens
gaauugaaagcacaucuga

SEQ ID NO: 1571132 - RNA, 19 nt, Homo sapiens
ggaagcacauagauacauc

SEQ ID NO: 1571133 - RNA, 19 nt, Homo sapiens
cacauugccuuaugacuau

SEQ ID NO: 1571134 - RNA, 19 nt, Homo sapiens
gaauaugccucucuuuuca

SEQ ID NO: 1571135 - RNA, 19 nt, Homo sapiens
uuaaacacauugccuuaug

SEQ ID NO: 1571136 - RNA, 19 nt, Homo sapiens
uugaggaacugauguuuga

SEQ ID NO: 1571137 - RNA, 19 nt, Homo sapiens
ugaaagcacaucugaaaga

SEQ ID NO: 1571138 - RNA, 19 nt, Homo sapiens
aaaugaaucuguucgcaau

SEQ ID NO: 1571139 - RNA, 19 nt, Homo sapiens
cauuaaugcugcaaagaga

SEQ ID NO: 1571140 - RNA, 19 nt, Homo sapiens
acacauugccuuaugacua

SEQ ID NO: 1571141 - RNA, 19 nt, Homo sapiens
gugcagcucuuaaacacau

SEQ ID NO: 1571142 - RNA, 19 nt, Homo sapiens
ugacagcuccacauuaaau

SEQ ID NO: 1571143 - RNA, 19 nt, Homo sapiens
gaggaacugauguuugaaa

SEQ ID NO: 1571144 - RNA, 19 nt, Homo sapiens
ccaucacccucaacucaaa

SEQ ID NO: 1571145 - RNA, 19 nt, Homo sapiens
ucuaaaagcuguugggaaa

SEQ ID NO: 1571146 - RNA, 19 nt, Homo sapiens
gaaggagaaaucaccauuc

SEQ ID NO: 1571147 - RNA, 19 nt, Homo sapiens
uugcaggccuuucagauau

SEQ ID NO: 1571148 - RNA, 19 nt, Homo sapiens
caaguugaauagaguugau

SEQ ID NO: 1571149 - RNA, 19 nt, Homo sapiens
ggaugauucucaccuuuac

SEQ ID NO: 1571150 - RNA, 19 nt, Homo sapiens
gagucaccgugguccauuu

SEQ ID NO: 1571151 - RNA, 19 nt, Homo sapiens
ggagaaggagggccaagau

SEQ ID NO: 1571152 - RNA, 19 nt, Homo sapiens
gcaggccuuucagauauau

SEQ ID NO: 1571153 - RNA, 19 nt, Homo sapiens
cuacacacaguauauaaug

SEQ ID NO: 1571154 - RNA, 19 nt, Homo sapiens
ccgcagagcccuagcuguu

SEQ ID NO: 1571155 - RNA, 19 nt, Homo sapiens
gauguuugccuggucuaua

SEQ ID NO: 1571156 - RNA, 19 nt, Homo sapiens
gagaaaucaccauuccuau

SEQ ID NO: 1571157 - RNA, 19 nt, Homo sapiens
caucuuacaaguugaauag

SEQ ID NO: 1571158 - RNA, 19 nt, Homo sapiens
guauauaaugccuccuuaa

SEQ ID NO: 1571159 - RNA, 19 nt, Homo sapiens
aguauauaaugccuccuua

SEQ ID NO: 1571160 - RNA, 19 nt, Homo sapiens
aaauacaugugcauacuac

SEQ ID NO: 1571161 - RNA, 19 nt, Homo sapiens
ggugacaaccagugacuug

SEQ ID NO: 1571162 - RNA, 19 nt, Homo sapiens
gaguaggugaggagauuaa

SEQ ID NO: 1571163 - RNA, 19 nt, Homo sapiens
ucaggaaugggaaauuaaa

SEQ ID NO: 1571164 - RNA, 19 nt, Homo sapiens
cugaguaggugaggagauu

SEQ ID NO: 1571165 - RNA, 19 nt, Homo sapiens
gaaagaugcaauucaccau

SEQ ID NO: 1571166 - RNA, 19 nt, Homo sapiens
guaaaucaggaaugggaaa

SEQ ID NO: 1571167 - RNA, 19 nt, Homo sapiens
ccaauuugcagagguguuu

SEQ ID NO: 1571168 - RNA, 19 nt, Homo sapiens
gcccuuugauccuuugugu

SEQ ID NO: 1571169 - RNA, 19 nt, Homo sapiens
uuugagagauugggauuug

SEQ ID NO: 1571170 - RNA, 19 nt, Homo sapiens
gcuguucuuuucucucuua

SEQ ID NO: 1571171 - RNA, 19 nt, Homo sapiens
gagaaggagggccaagaug

SEQ ID NO: 1571172 - RNA, 19 nt, Homo sapiens
uggaugauucucaccuuua

SEQ ID NO: 1571173 - RNA, 19 nt, Homo sapiens
ugugcuggguuacuguaua

SEQ ID NO: 1571174 - RNA, 19 nt, Homo sapiens
cagagguguuugucauugu

SEQ ID NO: 1571175 - RNA, 19 nt, Homo sapiens
ccuuugauccuuuguguga

SEQ ID NO: 1571176 - RNA, 19 nt, Homo sapiens
agaaaucaccauuccuaug

SEQ ID NO: 1571177 - RNA, 19 nt, Homo sapiens
auauauccaucucacaaga

SEQ ID NO: 1571178 - RNA, 19 nt, Homo sapiens
gcaauucaccauggagcuu

SEQ ID NO: 1571179 - RNA, 19 nt, Homo sapiens
auugaaagcacaucugaaa

SEQ ID NO: 1571180 - RNA, 19 nt, Homo sapiens
guuugacagcuccacauua

SEQ ID NO: 1571181 - RNA, 19 nt, Homo sapiens
ugcaggccuuucagauaua

SEQ ID NO: 1571182 - RNA, 19 nt, Homo sapiens
gaucucgcauccgggaguu

SEQ ID NO: 1571183 - RNA, 19 nt, Homo sapiens
gauacaucuuacaaguuga

SEQ ID NO: 1571184 - RNA, 19 nt, Homo sapiens
ggcccuuauuugucuaauu

SEQ ID NO: 1571185 - RNA, 19 nt, Homo sapiens
agaaggagaaaucaccauu

SEQ ID NO: 1571186 - RNA, 19 nt, Homo sapiens
gagacucugcagauaguga

SEQ ID NO: 1571187 - RNA, 19 nt, Homo sapiens
ucuuaaacacauugccuua

SEQ ID NO: 1571188 - RNA, 19 nt, Homo sapiens
aaucaccauuccuaugaga

SEQ ID NO: 1571189 - RNA, 19 nt, Homo sapiens
gcacugucaccccuuauuu

SEQ ID NO: 1571190 - RNA, 19 nt, Homo sapiens
gauauauccaucucacaag

SEQ ID NO: 1571191 - RNA, 19 nt, Homo sapiens
guucaggugcagcucuuaa

SEQ ID NO: 1571192 - RNA, 19 nt, Homo sapiens
uauauaaugccuccuuaag

SEQ ID NO: 1571193 - RNA, 19 nt, Homo sapiens
gugcuggguuacuguauac

SEQ ID NO: 1571194 - RNA, 19 nt, Homo sapiens
uaccaucacccucaacuca

SEQ ID NO: 1571195 - RNA, 19 nt, Homo sapiens
guuugucauugucugguuu

SEQ ID NO: 1571196 - RNA, 19 nt, Homo sapiens
ggagucaccgugguccauu

SEQ ID NO: 1571197 - RNA, 19 nt, Homo sapiens
guuggaugauucucaccuu

SEQ ID NO: 1571198 - RNA, 19 nt, Homo sapiens
cuagcuguuuauccuguuu

SEQ ID NO: 1571199 - RNA, 19 nt, Homo sapiens
gccucugugugcuggguua

SEQ ID NO: 1571200 - RNA, 19 nt, Homo sapiens
cuuacaaguugaauagagu

SEQ ID NO: 1571201 - RNA, 19 nt, Homo sapiens
guucuuuucucucuuaaug

SEQ ID NO: 1571202 - RNA, 19 nt, Homo sapiens
uugcagagguguuugucau

SEQ ID NO: 1571203 - RNA, 19 nt, Homo sapiens
caauucaccauggagcuuu

SEQ ID NO: 1571204 - RNA, 19 nt, Homo sapiens
uuggaugauucucaccuuu

SEQ ID NO: 1571205 - RNA, 19 nt, Homo sapiens
uagaauaugccucucuuuu

SEQ ID NO: 1571206 - RNA, 19 nt, Homo sapiens
uuugcaggccuuucagaua

SEQ ID NO: 1571207 - RNA, 19 nt, Homo sapiens
gggaagcacauagauacau

SEQ ID NO: 1571208 - RNA, 19 nt, Homo sapiens
gggagaaggagggccaaga

SEQ ID NO: 1571209 - RNA, 19 nt, Homo sapiens
ugucugguuuggugcaguu

SEQ ID NO: 1571210 - RNA, 19 nt, Homo sapiens
cuggguuacuguauacuuc

SEQ ID NO: 1571211 - RNA, 19 nt, Homo sapiens
cauugccuuaugacuauua

SEQ ID NO: 1571212 - RNA, 19 nt, Homo sapiens
caguucaggugcagcucuu

SEQ ID NO: 1571213 - RNA, 19 nt, Homo sapiens
ucuuacaaguugaauagag

SEQ ID NO: 1571214 - RNA, 19 nt, Homo sapiens
cuugggaagcacauagaua

SEQ ID NO: 1571215 - RNA, 19 nt, Homo sapiens
aaggagaaaucaccauucc

SEQ ID NO: 1571216 - RNA, 19 nt, Homo sapiens
uuggagggaacauaucuuu

SEQ ID NO: 1571217 - RNA, 19 nt, Homo sapiens
gaaauuaugucuuccacua

SEQ ID NO: 1571218 - RNA, 19 nt, Homo sapiens
gaacaaagagacagaagaa

SEQ ID NO: 1571219 - RNA, 19 nt, Homo sapiens
uauaagagguggauugaaa

SEQ ID NO: 1571220 - RNA, 19 nt, Homo sapiens
gcaaagggaaacuuauuua

SEQ ID NO: 1571221 - RNA, 19 nt, Homo sapiens
gaacaauuccuuucucuug

SEQ ID NO: 1571222 - RNA, 19 nt, Homo sapiens
gaacaaaggcacacuacuu

SEQ ID NO: 1571223 - RNA, 19 nt, Homo sapiens
gaucaugggucucuggaaa

SEQ ID NO: 1571224 - RNA, 19 nt, Homo sapiens
ggacuucgccuuugugauu

SEQ ID NO: 1571225 - RNA, 19 nt, Homo sapiens
aagaguaucugcacaauug

SEQ ID NO: 1571226 - RNA, 19 nt, Homo sapiens
ggauugaaauuaugucuuc

SEQ ID NO: 1571227 - RNA, 19 nt, Homo sapiens
ucugagagauggauaguaa

SEQ ID NO: 1571228 - RNA, 19 nt, Homo sapiens
cuacagauauacaagguuu

SEQ ID NO: 1571229 - RNA, 19 nt, Homo sapiens
ccuauuggcuucugucauu

SEQ ID NO: 1571230 - RNA, 19 nt, Homo sapiens
gaagauaugcccucagugu

SEQ ID NO: 1571231 - RNA, 19 nt, Homo sapiens
gcucaaggaggauguauuu

SEQ ID NO: 1571232 - RNA, 19 nt, Homo sapiens
gaaauacaggugugucuga

SEQ ID NO: 1571233 - RNA, 19 nt, Homo sapiens
gagaauacucgacauguga

SEQ ID NO: 1571234 - RNA, 19 nt, Homo sapiens
ggaugaauaucuuaagaag

SEQ ID NO: 1571235 - RNA, 19 nt, Homo sapiens
caucuaaaccugugucauu

SEQ ID NO: 1571236 - RNA, 19 nt, Homo sapiens
gauguuaucccuucugaga

SEQ ID NO: 1571237 - RNA, 19 nt, Homo sapiens
caacuccauuugcaacauu

SEQ ID NO: 1571238 - RNA, 19 nt, Homo sapiens
gauauucaguuugcuuguu

SEQ ID NO: 1571239 - RNA, 19 nt, Homo sapiens
agagguggauugaaauuau

SEQ ID NO: 1571240 - RNA, 19 nt, Homo sapiens
caauucaucuggauaagca

SEQ ID NO: 1571241 - RNA, 19 nt, Homo sapiens
cugcacaauugccugauua

SEQ ID NO: 1571242 - RNA, 19 nt, Homo sapiens
ccagcaacauauauucuga

SEQ ID NO: 1571243 - RNA, 19 nt, Homo sapiens
agccaauucuuccuaauaa

SEQ ID NO: 1571244 - RNA, 19 nt, Homo sapiens
ggacaucugauuccagguu

SEQ ID NO: 1571245 - RNA, 19 nt, Homo sapiens
gaagaguaucugcacaauu

SEQ ID NO: 1571246 - RNA, 19 nt, Homo sapiens
gcaguggccagaacaaaga

SEQ ID NO: 1571247 - RNA, 19 nt, Homo sapiens
gagguggauugaaauuaug

SEQ ID NO: 1571248 - RNA, 19 nt, Homo sapiens
gacaucugauuccagguuu

SEQ ID NO: 1571249 - RNA, 19 nt, Homo sapiens
gugccauacugcagcaaua

SEQ ID NO: 1571250 - RNA, 19 nt, Homo sapiens
ggcauggacagauguauuu

SEQ ID NO: 1571251 - RNA, 19 nt, Homo sapiens
aaacgggcauggacagaug

SEQ ID NO: 1571252 - RNA, 19 nt, Homo sapiens
gaaccagaagauuauaaga

SEQ ID NO: 1571253 - RNA, 19 nt, Homo sapiens
cagccaauucuuccuaaua

SEQ ID NO: 1571254 - RNA, 19 nt, Homo sapiens
uaagaagacuagagauggu

SEQ ID NO: 1571255 - RNA, 19 nt, Homo sapiens
gauuauaagagguggauug

SEQ ID NO: 1571256 - RNA, 19 nt, Homo sapiens
gaaaacugcauucuuacua

SEQ ID NO: 1571257 - RNA, 19 nt, Homo sapiens
gccaauucuuccuaauaaa

SEQ ID NO: 1571258 - RNA, 19 nt, Homo sapiens
cacuguagcuucccugguu

SEQ ID NO: 1571259 - RNA, 19 nt, Homo sapiens
ucacuugccaccucaguuu

SEQ ID NO: 1571260 - RNA, 19 nt, Homo sapiens
gcacaauugccugauuauu

SEQ ID NO: 1571261 - RNA, 19 nt, Homo sapiens
ccauacugcagcaauaaua

SEQ ID NO: 1571262 - RNA, 19 nt, Homo sapiens
gugaguuccuguacaccua

SEQ ID NO: 1571263 - RNA, 19 nt, Homo sapiens
ucacauguccugccagaau

SEQ ID NO: 1571264 - RNA, 19 nt, Homo sapiens
ccaccucaguuucaaguca

SEQ ID NO: 1571265 - RNA, 19 nt, Homo sapiens
ugagaauacucgacaugug

SEQ ID NO: 1571266 - RNA, 19 nt, Homo sapiens
ucucacaguggaauuaaua

SEQ ID NO: 1571267 - RNA, 19 nt, Homo sapiens
ucaaggaggauguauuuca

SEQ ID NO: 1571268 - RNA, 19 nt, Homo sapiens
uaauucaacuccauuugca

SEQ ID NO: 1571269 - RNA, 19 nt, Homo sapiens
auacaccacuagcaaauuc

SEQ ID NO: 1571270 - RNA, 19 nt, Homo sapiens
ugacuuugacguggaaaua

SEQ ID NO: 1571271 - RNA, 19 nt, Homo sapiens
gaauacucgacaugugaua

SEQ ID NO: 1571272 - RNA, 19 nt, Homo sapiens
aaaccacccucuccugcuu

SEQ ID NO: 1571273 - RNA, 19 nt, Homo sapiens
caaaauacaccaaaaguca

SEQ ID NO: 1571274 - RNA, 19 nt, Homo sapiens
uaagagguggauugaaauu

SEQ ID NO: 1571275 - RNA, 19 nt, Homo sapiens
cacauguccugccagaauu

SEQ ID NO: 1571276 - RNA, 19 nt, Homo sapiens
cuucuggacuuucucaaug

SEQ ID NO: 1571277 - RNA, 19 nt, Homo sapiens
gaugugcugcuccauuuga

SEQ ID NO: 1571278 - RNA, 19 nt, Homo sapiens
gggcauggacagauguauu

SEQ ID NO: 1571279 - RNA, 19 nt, Homo sapiens
uaagaccauuuaugaugug

SEQ ID NO: 1571280 - RNA, 19 nt, Homo sapiens
cagaaugacuuuuccaaau

SEQ ID NO: 1571281 - RNA, 19 nt, Homo sapiens
ugagaagguuguaaaugca

SEQ ID NO: 1571282 - RNA, 19 nt, Homo sapiens
aacaauuccuuucucuuga

SEQ ID NO: 1571283 - RNA, 19 nt, Homo sapiens
aagucaaucuuuaccugua

SEQ ID NO: 1571284 - RNA, 19 nt, Homo sapiens
agacauacaccacuagcaa

SEQ ID NO: 1571285 - RNA, 19 nt, Homo sapiens
gacuagagaugguguuuug

SEQ ID NO: 1571286 - RNA, 19 nt, Homo sapiens
augaugugcugcuccauuu

SEQ ID NO: 1571287 - RNA, 19 nt, Homo sapiens
ccacuagcaaauucaauga

SEQ ID NO: 1571288 - RNA, 19 nt, Homo sapiens
ugaagaguaucugcacaau

SEQ ID NO: 1571289 - RNA, 19 nt, Homo sapiens
gggagccuauugcccauuc

SEQ ID NO: 1571290 - RNA, 19 nt, Homo sapiens
gagagauggauaguaaauu

SEQ ID NO: 1571291 - RNA, 19 nt, Homo sapiens
caaggaggauguauuucac

SEQ ID NO: 1571292 - RNA, 19 nt, Homo sapiens
gacauacaccacuagcaaa

SEQ ID NO: 1571293 - RNA, 19 nt, Homo sapiens
uguuaucccuucugagaga

SEQ ID NO: 1571294 - RNA, 19 nt, Homo sapiens
gcauccagcaacauauauu

SEQ ID NO: 1571295 - RNA, 19 nt, Homo sapiens
gcuugaaccagaagauuau

SEQ ID NO: 1571296 - RNA, 19 nt, Homo sapiens
aaacaucagaggaagauca

SEQ ID NO: 1571297 - RNA, 19 nt, Homo sapiens
aagauguuaucccuucuga

SEQ ID NO: 1571298 - RNA, 19 nt, Homo sapiens
auggacagauguauuucua

SEQ ID NO: 1571299 - RNA, 19 nt, Homo sapiens
uugagaagguuguaaaugc

SEQ ID NO: 1571300 - RNA, 19 nt, Homo sapiens
acuagcaaauucaaugaug

SEQ ID NO: 1571301 - RNA, 19 nt, Homo sapiens
aggaagauaugcccucagu

SEQ ID NO: 1571302 - RNA, 19 nt, Homo sapiens
ugagagauggauaguaaau

SEQ ID NO: 1571303 - RNA, 19 nt, Homo sapiens
gguaauucaacuccauuug

SEQ ID NO: 1571304 - RNA, 19 nt, Homo sapiens
ccuuucagauggucuuguu

SEQ ID NO: 1571305 - RNA, 19 nt, Homo sapiens
gaauggggccugcacugua

SEQ ID NO: 1571306 - RNA, 19 nt, Homo sapiens
ugaggguguuuccaaagga

SEQ ID NO: 1571307 - RNA, 19 nt, Homo sapiens
gcaaacgggcauggacaga

SEQ ID NO: 1571308 - RNA, 19 nt, Homo sapiens
guaauucaacuccauuugc

SEQ ID NO: 1571309 - RNA, 19 nt, Homo sapiens
ugaaggaccccauucuuuu

SEQ ID NO: 1571310 - RNA, 19 nt, Homo sapiens
guggaaguacugccugaaa

SEQ ID NO: 1571311 - RNA, 19 nt, Homo sapiens
uggcaauucaucuggauaa

SEQ ID NO: 1571312 - RNA, 19 nt, Homo sapiens
ccaaucuucuuuucuguga

SEQ ID NO: 1571313 - RNA, 19 nt, Homo sapiens
guucagccaauucuuccua

SEQ ID NO: 1571314 - RNA, 19 nt, Homo sapiens
cuaccaggaugcuaaacca

SEQ ID NO: 1571315 - RNA, 19 nt, Homo sapiens
caaagauguuaucccuucu

SEQ ID NO: 1571316 - RNA, 19 nt, Homo sapiens
gcucucacaguggaauuaa

SEQ ID NO: 1571317 - RNA, 19 nt, Homo sapiens
gcagaaacgugauuauaua

SEQ ID NO: 1571318 - RNA, 19 nt, Homo sapiens
gaagaggaagaacuaauua

SEQ ID NO: 1571319 - RNA, 19 nt, Homo sapiens
gaaagaacuugaaccuaug

SEQ ID NO: 1571320 - RNA, 19 nt, Homo sapiens
agaaagaacuugaaccuau

SEQ ID NO: 1571321 - RNA, 19 nt, Homo sapiens
ucuaugaucuguugaauga

SEQ ID NO: 1571322 - RNA, 19 nt, Homo sapiens
acagugaacuugauaacua

SEQ ID NO: 1571323 - RNA, 19 nt, Homo sapiens
ggaagaagcaugcaggaaa

SEQ ID NO: 1571324 - RNA, 19 nt, Homo sapiens
gaaagaggaagaagaagaa

SEQ ID NO: 1571325 - RNA, 19 nt, Homo sapiens
gcagaaagaggaagaagaa

SEQ ID NO: 1571326 - RNA, 19 nt, Homo sapiens
gagagaggcugaaagagau

SEQ ID NO: 1571327 - RNA, 19 nt, Homo sapiens
caacugagcaagauauauu

SEQ ID NO: 1571328 - RNA, 19 nt, Homo sapiens
gaagaagcaugcaggaaag

SEQ ID NO: 1571329 - RNA, 19 nt, Homo sapiens
ggaggaagauguaacugau

SEQ ID NO: 1571330 - RNA, 19 nt, Homo sapiens
uggauuauguggaaguuua

SEQ ID NO: 1571331 - RNA, 19 nt, Homo sapiens
ggagagagaggcugaaaga

SEQ ID NO: 1571332 - RNA, 19 nt, Homo sapiens
gaagaaguggcaacaauau

SEQ ID NO: 1571333 - RNA, 19 nt, Homo sapiens
gaacuugaaccuauguuau

SEQ ID NO: 1571334 - RNA, 19 nt, Homo sapiens
gaagacagugaacuugaua

SEQ ID NO: 1571335 - RNA, 19 nt, Homo sapiens
uaaaggcucuugaggacuu

SEQ ID NO: 1571336 - RNA, 19 nt, Homo sapiens
cagaagaaguggcaacaau

SEQ ID NO: 1571337 - RNA, 19 nt, Homo sapiens
gaaagcacaggcauagaaa

SEQ ID NO: 1571338 - RNA, 19 nt, Homo sapiens
gcacaggcauagaaaagua

SEQ ID NO: 1571339 - RNA, 19 nt, Homo sapiens
aagcagggauugcauaguu

SEQ ID NO: 1571340 - RNA, 19 nt, Homo sapiens
uaaacuacaugacaguguu

SEQ ID NO: 1571341 - RNA, 19 nt, Homo sapiens
gaggaagaacuaauuagaa

SEQ ID NO: 1571342 - RNA, 19 nt, Homo sapiens
guuggaggcucaauuuaug

SEQ ID NO: 1571343 - RNA, 19 nt, Homo sapiens
ucugaugacugaagaaaga

SEQ ID NO: 1571344 - RNA, 19 nt, Homo sapiens
gggagaagaggaagaacua

SEQ ID NO: 1571345 - RNA, 19 nt, Homo sapiens
cgguauagcuccucuguca

SEQ ID NO: 1571346 - RNA, 19 nt, Homo sapiens
gcaguuggugcaaauaauu

SEQ ID NO: 1571347 - RNA, 19 nt, Homo sapiens
gcaccuuacugucuguguu

SEQ ID NO: 1571348 - RNA, 19 nt, Homo sapiens
ugccagaccucguuucuau

SEQ ID NO: 1571349 - RNA, 19 nt, Homo sapiens
ucucugaaguugcuaaaug

SEQ ID NO: 1571350 - RNA, 19 nt, Homo sapiens
guagagugcuuuguuuauc

SEQ ID NO: 1571351 - RNA, 19 nt, Homo sapiens
gacaaaagcuaucuuaucu

SEQ ID NO: 1571352 - RNA, 19 nt, Homo sapiens
gcaggaggaucucuugaac

SEQ ID NO: 1571353 - RNA, 19 nt, Homo sapiens
ggcagaaacgugauuauau

SEQ ID NO: 1571354 - RNA, 19 nt, Homo sapiens
gccagaagauacugcaguu

SEQ ID NO: 1571355 - RNA, 19 nt, Homo sapiens
caacuugagcuacaguaaa

SEQ ID NO: 1571356 - RNA, 19 nt, Homo sapiens
acaagaagaagaagacaaa

SEQ ID NO: 1571357 - RNA, 19 nt, Homo sapiens
uuauguacacggucaauua

SEQ ID NO: 1571358 - RNA, 19 nt, Homo sapiens
ccuagacacuucugugaga

SEQ ID NO: 1571359 - RNA, 19 nt, Homo sapiens
gaagaaagaacuugaaccu

SEQ ID NO: 1571360 - RNA, 19 nt, Homo sapiens
gaaguggcaacaauauaga

SEQ ID NO: 1571361 - RNA, 19 nt, Homo sapiens
agaagaaguggcaacaaua

SEQ ID NO: 1571362 - RNA, 19 nt, Homo sapiens
ccaguuggaggcucaauuu

SEQ ID NO: 1571363 - RNA, 19 nt, Homo sapiens
caaaagcuaucuuaucugu

SEQ ID NO: 1571364 - RNA, 19 nt, Homo sapiens
gaaagcagggauugcauag

SEQ ID NO: 1571365 - RNA, 19 nt, Homo sapiens
gaaugaauccuagacacuu

SEQ ID NO: 1571366 - RNA, 19 nt, Homo sapiens
gcugcuacgugaccaauuc

SEQ ID NO: 1571367 - RNA, 19 nt, Homo sapiens
ccaagaagccagaagauac

SEQ ID NO: 1571368 - RNA, 19 nt, Homo sapiens
aggaagauguaacugauga

SEQ ID NO: 1571369 - RNA, 19 nt, Homo sapiens
gcaauuccaaugaaaguag

SEQ ID NO: 1571370 - RNA, 19 nt, Homo sapiens
gagcuacaguaaacuacau

SEQ ID NO: 1571371 - RNA, 19 nt, Homo sapiens
aaucaugucagaacucuuu

SEQ ID NO: 1571372 - RNA, 19 nt, Homo sapiens
cuugauaacuagacauguu

SEQ ID NO: 1571373 - RNA, 19 nt, Homo sapiens
ucacagacgagcagaaaga

SEQ ID NO: 1571374 - RNA, 19 nt, Homo sapiens
gguaugucauuuccacaga

SEQ ID NO: 1571375 - RNA, 19 nt, Homo sapiens
uaaggcaacugagcaagau

SEQ ID NO: 1571376 - RNA, 19 nt, Homo sapiens
uaaagaggcaauuccaaug

SEQ ID NO: 1571377 - RNA, 19 nt, Homo sapiens
gcacguguaguuccagcua

SEQ ID NO: 1571378 - RNA, 19 nt, Homo sapiens
guagaaagcacaggcauag

SEQ ID NO: 1571379 - RNA, 19 nt, Homo sapiens
agaagaggaagaacuaauu

SEQ ID NO: 1571380 - RNA, 19 nt, Homo sapiens
gagaagaggaagaacuaau

SEQ ID NO: 1571381 - RNA, 19 nt, Homo sapiens
cuuacugucuguguucuua

SEQ ID NO: 1571382 - RNA, 19 nt, Homo sapiens
agaaagcacaggcauagaa

SEQ ID NO: 1571383 - RNA, 19 nt, Homo sapiens
ccagaccucguuucuauga

SEQ ID NO: 1571384 - RNA, 19 nt, Homo sapiens
ugaagacagugaacuugau

SEQ ID NO: 1571385 - RNA, 19 nt, Homo sapiens
ugaagaccuuugugacaga

SEQ ID NO: 1571386 - RNA, 19 nt, Homo sapiens
agagagaggcugaaagaga

SEQ ID NO: 1571387 - RNA, 19 nt, Homo sapiens
aaagaggcaauuccaauga

SEQ ID NO: 1571388 - RNA, 19 nt, Homo sapiens
ucacucgucuguuaaaugc

SEQ ID NO: 1571389 - RNA, 19 nt, Homo sapiens
caaccucuguuauucugau

SEQ ID NO: 1571390 - RNA, 19 nt, Homo sapiens
uuccuuagcuuccuuagug

SEQ ID NO: 1571391 - RNA, 19 nt, Homo sapiens
gcuaaauguccuugaagaa

SEQ ID NO: 1571392 - RNA, 19 nt, Homo sapiens
gggaggaagauguaacuga

SEQ ID NO: 1571393 - RNA, 19 nt, Homo sapiens
gauaaagaggcaauuccaa

SEQ ID NO: 1571394 - RNA, 19 nt, Homo sapiens
uguacacggucaauuaaau

SEQ ID NO: 1571395 - RNA, 19 nt, Homo sapiens
caauauagaaguguuagga

SEQ ID NO: 1571396 - RNA, 19 nt, Homo sapiens
cuugauuguucucuaagua

SEQ ID NO: 1571397 - RNA, 19 nt, Homo sapiens
gcagugagccaagauugug

SEQ ID NO: 1571398 - RNA, 19 nt, Homo sapiens
gauuuggccucuguggauu

SEQ ID NO: 1571399 - RNA, 19 nt, Homo sapiens
aagcacaacuugagcuaca

SEQ ID NO: 1571400 - RNA, 19 nt, Homo sapiens
gaugaagacagugaacuug

SEQ ID NO: 1571401 - RNA, 19 nt, Homo sapiens
guugcuaaauguccuugaa

SEQ ID NO: 1571402 - RNA, 19 nt, Homo sapiens
aaacaagggaggaagaugu

SEQ ID NO: 1571403 - RNA, 19 nt, Homo sapiens
ugaugaaugugaggaaaga

SEQ ID NO: 1571404 - RNA, 19 nt, Homo sapiens
agaggcaauuccaaugaaa

SEQ ID NO: 1571405 - RNA, 19 nt, Homo sapiens
aagaggcaauuccaaugaa

SEQ ID NO: 1571406 - RNA, 19 nt, Homo sapiens
ggauuuguaucaguuccaa

SEQ ID NO: 1571407 - RNA, 19 nt, Homo sapiens
ggacuuugaagaccuuugu

SEQ ID NO: 1571408 - RNA, 19 nt, Homo sapiens
agaaagaggaagaagaaga

SEQ ID NO: 1571409 - RNA, 19 nt, Homo sapiens
cauauuggcgucucuagug

SEQ ID NO: 1571410 - RNA, 19 nt, Homo sapiens
agaaagcagggauugcaua

SEQ ID NO: 1571411 - RNA, 19 nt, Homo sapiens
gugcugagccacugguuug

SEQ ID NO: 1571412 - RNA, 19 nt, Homo sapiens
gaaaccccaucucugcuaa

SEQ ID NO: 1571413 - RNA, 19 nt, Homo sapiens
uauguacacggucaauuaa

SEQ ID NO: 1571414 - RNA, 19 nt, Homo sapiens
ugucagaacucuuuuggaa

SEQ ID NO: 1571415 - RNA, 19 nt, Homo sapiens
ggagaagaggaagaacuaa

SEQ ID NO: 1571416 - RNA, 19 nt, Homo sapiens
caucacagacgagcagaaa

SEQ ID NO: 1571417 - RNA, 19 nt, Homo sapiens
acacagagcugacaccaua

SEQ ID NO: 1571418 - RNA, 19 nt, Homo sapiens
ggaaggcacuuuaaucaug

SEQ ID NO: 1571419 - RNA, 19 nt, Homo sapiens
cuaagagccuggagauuua

SEQ ID NO: 1571420 - RNA, 19 nt, Homo sapiens
ccaaguacaucuagaaguu

SEQ ID NO: 1571421 - RNA, 19 nt, Homo sapiens
aaaguuaccugauuuggaa

SEQ ID NO: 1571422 - RNA, 19 nt, Homo sapiens
gaaaucagccuccucuaug

SEQ ID NO: 1571423 - RNA, 19 nt, Homo sapiens
gcacuuuaaucaugccuaa

SEQ ID NO: 1571424 - RNA, 19 nt, Homo sapiens
aaauauagcaggcugaaua

SEQ ID NO: 1571425 - RNA, 19 nt, Homo sapiens
ccaaagauaucagguccua

SEQ ID NO: 1571426 - RNA, 19 nt, Homo sapiens
ggacccaggcuccauauuu

SEQ ID NO: 1571427 - RNA, 19 nt, Homo sapiens
gacccaggcuccauauuug

SEQ ID NO: 1571428 - RNA, 19 nt, Homo sapiens
gcugaacucugucucuuug

SEQ ID NO: 1571429 - RNA, 19 nt, Homo sapiens
gagcaagaccuaacauuuc

SEQ ID NO: 1571430 - RNA, 19 nt, Homo sapiens
uauagcaggcugaauaaua

SEQ ID NO: 1571431 - RNA, 19 nt, Homo sapiens
ggagugaaguggcuacaag

SEQ ID NO: 1571432 - RNA, 19 nt, Homo sapiens
ccagauccgugagagaaua

SEQ ID NO: 1571433 - RNA, 19 nt, Homo sapiens
uggcagaugugaucaaguu

SEQ ID NO: 1571434 - RNA, 19 nt, Homo sapiens
gaccauagaggcagagauu

SEQ ID NO: 1571435 - RNA, 19 nt, Homo sapiens
ccagggucuugcucuauua

SEQ ID NO: 1571436 - RNA, 19 nt, Homo sapiens
gcagaugugaucaaguuaa

SEQ ID NO: 1571437 - RNA, 19 nt, Homo sapiens
ccuaagagccuggagauuu

SEQ ID NO: 1571438 - RNA, 19 nt, Homo sapiens
gaggagacuugaaacagau

SEQ ID NO: 1571439 - RNA, 19 nt, Homo sapiens
guuaaggguuucuaaauac

SEQ ID NO: 1571440 - RNA, 19 nt, Homo sapiens
gugaucaaguuaaggguuu

SEQ ID NO: 1571441 - RNA, 19 nt, Homo sapiens
ggaaguuucuagucucaca

SEQ ID NO: 1571442 - RNA, 19 nt, Homo sapiens
ucagagacaucaucuacug

SEQ ID NO: 1571443 - RNA, 19 nt, Homo sapiens
ccggagaccuugacagaug

SEQ ID NO: 1571444 - RNA, 19 nt, Homo sapiens
auagcaggcugaauaauau

SEQ ID NO: 1571445 - RNA, 19 nt, Homo sapiens
gaaggaaacaccaaguaca

SEQ ID NO: 1571446 - RNA, 19 nt, Homo sapiens
cagagaacauucagagaca

SEQ ID NO: 1571447 - RNA, 19 nt, Homo sapiens
uuagaggucugaagcauca

SEQ ID NO: 1571448 - RNA, 19 nt, Homo sapiens
gaggagacauacagcagau

SEQ ID NO: 1571449 - RNA, 19 nt, Homo sapiens
cauagacccugcccucaug

SEQ ID NO: 1571450 - RNA, 19 nt, Homo sapiens
agaggagacuugaaacaga

SEQ ID NO: 1571451 - RNA, 19 nt, Homo sapiens
gaaacaccaaguacaucua

SEQ ID NO: 1571452 - RNA, 19 nt, Homo sapiens
cuucaacuguucuucauga

SEQ ID NO: 1571453 - RNA, 19 nt, Homo sapiens
caaguuaaggguuucuaaa

SEQ ID NO: 1571454 - RNA, 19 nt, Homo sapiens
ucuagaaguugaugguuga

SEQ ID NO: 1571455 - RNA, 19 nt, Homo sapiens
caacuccacuuccuucaac

SEQ ID NO: 1571456 - RNA, 19 nt, Homo sapiens
gauccaagagcaagaccua

SEQ ID NO: 1571457 - RNA, 19 nt, Homo sapiens
ccacuuccuucaacuguuc

SEQ ID NO: 1571458 - RNA, 19 nt, Homo sapiens
gcaagaugccagucacuca

SEQ ID NO: 1571459 - RNA, 19 nt, Homo sapiens
caccacaccaggcuaauuu

SEQ ID NO: 1571460 - RNA, 19 nt, Homo sapiens
ugucucagccucccaagua

SEQ ID NO: 1571461 - RNA, 19 nt, Homo sapiens
ggucugaagcaucaccaua

SEQ ID NO: 1571462 - RNA, 19 nt, Homo sapiens
ucaaagugcugggauuaca

SEQ ID NO: 1571463 - RNA, 19 nt, Homo sapiens
uacagcagaucgaauccua

SEQ ID NO: 1571464 - RNA, 19 nt, Homo sapiens
caaccuuuccugaagauug

SEQ ID NO: 1571465 - RNA, 19 nt, Homo sapiens
cagccaaccuuuccugaag

SEQ ID NO: 1571466 - RNA, 19 nt, Homo sapiens
agagcaagaccuaacauuu

SEQ ID NO: 1571467 - RNA, 19 nt, Homo sapiens
caccucagccucccacuuu

SEQ ID NO: 1571468 - RNA, 19 nt, Homo sapiens
ggaaacaccaaguacaucu

SEQ ID NO: 1571469 - RNA, 19 nt, Homo sapiens
gggcugaacucugucucuu

SEQ ID NO: 1571470 - RNA, 19 nt, Homo sapiens
aggaccagauucucccuua

SEQ ID NO: 1571471 - RNA, 19 nt, Homo sapiens
aaagauaucagguccuaau

SEQ ID NO: 1571472 - RNA, 19 nt, Homo sapiens
gaccagauucucccuuaga

SEQ ID NO: 1571473 - RNA, 19 nt, Homo sapiens
gcagaggagacuugaaaca

SEQ ID NO: 1571474 - RNA, 19 nt, Homo sapiens
cuccauauuugaucaguga

SEQ ID NO: 1571475 - RNA, 19 nt, Homo sapiens
uuggauaccuacuauacaa

SEQ ID NO: 1571476 - RNA, 19 nt, Homo sapiens
gcacaaucucggcucacua

SEQ ID NO: 1571477 - RNA, 19 nt, Homo sapiens
guggaguggugccaucuug

SEQ ID NO: 1571478 - RNA, 19 nt, Homo sapiens
ggaccagauucucccuuag

SEQ ID NO: 1571479 - RNA, 19 nt, Homo sapiens
caagcagcauguauuggau

SEQ ID NO: 1571480 - RNA, 19 nt, Homo sapiens
gauaccuacuauacaacaa

SEQ ID NO: 1571481 - RNA, 19 nt, Homo sapiens
cagaugugaucaaguuaag

SEQ ID NO: 1571482 - RNA, 19 nt, Homo sapiens
agaaaucagccuccucuau

SEQ ID NO: 1571483 - RNA, 19 nt, Homo sapiens
ucaagcagcauguauugga

SEQ ID NO: 1571484 - RNA, 19 nt, Homo sapiens
aagcaucaccauagccaua

SEQ ID NO: 1571485 - RNA, 19 nt, Homo sapiens
gccuggagauuuauaaagg

SEQ ID NO: 1571486 - RNA, 19 nt, Homo sapiens
gauccggaaggcacuuuaa

SEQ ID NO: 1571487 - RNA, 19 nt, Homo sapiens
gggaggcccuuaagaaaau

SEQ ID NO: 1571488 - RNA, 19 nt, Homo sapiens
ccugugcgcucuggaaguu

SEQ ID NO: 1571489 - RNA, 19 nt, Homo sapiens
aauauagcaggcugaauaa

SEQ ID NO: 1571490 - RNA, 19 nt, Homo sapiens
ucugaaagccaaugagaug

SEQ ID NO: 1571491 - RNA, 19 nt, Homo sapiens
ugaacucugucucuuugug

SEQ ID NO: 1571492 - RNA, 19 nt, Homo sapiens
ucucaaagugcugggauua

SEQ ID NO: 1571493 - RNA, 19 nt, Homo sapiens
cccagggucuugcucuauu

SEQ ID NO: 1571494 - RNA, 19 nt, Homo sapiens
gagccuggagauuuauaaa

SEQ ID NO: 1571495 - RNA, 19 nt, Homo sapiens
ccggaaggcacuuuaauca

SEQ ID NO: 1571496 - RNA, 19 nt, Homo sapiens
aaguacaucuagaaguuga

SEQ ID NO: 1571497 - RNA, 19 nt, Homo sapiens
ccagggauacgguggcaaa

SEQ ID NO: 1571498 - RNA, 19 nt, Homo sapiens
ggacuggauccaagagcaa

SEQ ID NO: 1571499 - RNA, 19 nt, Homo sapiens
gaagguuccauggauguau

SEQ ID NO: 1571500 - RNA, 19 nt, Homo sapiens
ucugguacccuuaauaugu

SEQ ID NO: 1571501 - RNA, 19 nt, Homo sapiens
ugagucuucuccaagcaaa

SEQ ID NO: 1571502 - RNA, 19 nt, Homo sapiens
ccaccuaagcucugucuuc

SEQ ID NO: 1571503 - RNA, 19 nt, Homo sapiens
cauguuucccucagacuuu

SEQ ID NO: 1571504 - RNA, 19 nt, Homo sapiens
gaaaagaccacgugaccau

SEQ ID NO: 1571505 - RNA, 19 nt, Homo sapiens
ucaaguuaaggguuucuaa

SEQ ID NO: 1571506 - RNA, 19 nt, Homo sapiens
gccuacagaugcagcugaa

SEQ ID NO: 1571507 - RNA, 19 nt, Homo sapiens
ucaccuccuuguucuugaa

SEQ ID NO: 1571508 - RNA, 19 nt, Homo sapiens
caccuaagcucugucuucu

SEQ ID NO: 1571509 - RNA, 19 nt, Homo sapiens
gcagaucgaauccuagacu

SEQ ID NO: 1571510 - RNA, 19 nt, Homo sapiens
gaaaagacaaggaccagau

SEQ ID NO: 1571511 - RNA, 19 nt, Homo sapiens
aggcagagauuggagugaa

SEQ ID NO: 1571512 - RNA, 19 nt, Homo sapiens
gccuggaggucagaaauca

SEQ ID NO: 1571513 - RNA, 19 nt, Homo sapiens
ccucagacuuuuauucauu

SEQ ID NO: 1571514 - RNA, 19 nt, Homo sapiens
cagcagaucgaauccuaga

SEQ ID NO: 1571515 - RNA, 19 nt, Homo sapiens
gcuccaggcucauguuucc

SEQ ID NO: 1571516 - RNA, 19 nt, Homo sapiens
aggcagaggagacuugaaa

SEQ ID NO: 1571517 - RNA, 19 nt, Homo sapiens
gaauggagcuugcuugaua

SEQ ID NO: 1571518 - RNA, 19 nt, Homo sapiens
gacaggaguuuacagcaua

SEQ ID NO: 1571519 - RNA, 19 nt, Homo sapiens
gaagaaacagcacaagaaa

SEQ ID NO: 1571520 - RNA, 19 nt, Homo sapiens
gugaugccauguuagauua

SEQ ID NO: 1571521 - RNA, 19 nt, Homo sapiens
gaaauaucaccaucaauga

SEQ ID NO: 1571522 - RNA, 19 nt, Homo sapiens
gcgaguaucuaucuuuguu

SEQ ID NO: 1571523 - RNA, 19 nt, Homo sapiens
guccuuaggucgcuguuua

SEQ ID NO: 1571524 - RNA, 19 nt, Homo sapiens
aaaguuacccugaugauaa

SEQ ID NO: 1571525 - RNA, 19 nt, Homo sapiens
caccaucaaugaaacauaa

SEQ ID NO: 1571526 - RNA, 19 nt, Homo sapiens
uguaaugccuucauauuga

SEQ ID NO: 1571527 - RNA, 19 nt, Homo sapiens
gaugcaaccuggguccuua

SEQ ID NO: 1571528 - RNA, 19 nt, Homo sapiens
auacuggaaucucucauua

SEQ ID NO: 1571529 - RNA, 19 nt, Homo sapiens
gggaagaaguaaagaaaca

SEQ ID NO: 1571530 - RNA, 19 nt, Homo sapiens
caacucccuugguacaaua

SEQ ID NO: 1571531 - RNA, 19 nt, Homo sapiens
gcagagggauuguaaacag

SEQ ID NO: 1571532 - RNA, 19 nt, Homo sapiens
gauggaggaugugcuaauu

SEQ ID NO: 1571533 - RNA, 19 nt, Homo sapiens
caagaaacauaguaagaag

SEQ ID NO: 1571534 - RNA, 19 nt, Homo sapiens
ggagcuugcuugauauuuc

SEQ ID NO: 1571535 - RNA, 19 nt, Homo sapiens
aaaccuagaguguguguua

SEQ ID NO: 1571536 - RNA, 19 nt, Homo sapiens
ccaaauggcauacuuacaa

SEQ ID NO: 1571537 - RNA, 19 nt, Homo sapiens
gaggaugugcuaauuguaa

SEQ ID NO: 1571538 - RNA, 19 nt, Homo sapiens
ggacaggaguuuacagcau

SEQ ID NO: 1571539 - RNA, 19 nt, Homo sapiens
uggcaagccugguuuauau

SEQ ID NO: 1571540 - RNA, 19 nt, Homo sapiens
ucaagcaguucuucagauu

SEQ ID NO: 1571541 - RNA, 19 nt, Homo sapiens
gaaagaagcagcuggaaaa

SEQ ID NO: 1571542 - RNA, 19 nt, Homo sapiens
ggaaagaagcagcuggaaa

SEQ ID NO: 1571543 - RNA, 19 nt, Homo sapiens
gaaaguggagaaccugaaa

SEQ ID NO: 1571544 - RNA, 19 nt, Homo sapiens
ugucauagguacaaaguau

SEQ ID NO: 1571545 - RNA, 19 nt, Homo sapiens
gaaauuuaccucuucuuca

SEQ ID NO: 1571546 - RNA, 19 nt, Homo sapiens
gcaaggacuuaauauugau

SEQ ID NO: 1571547 - RNA, 19 nt, Homo sapiens
ugaaauaucaccaucaaug

SEQ ID NO: 1571548 - RNA, 19 nt, Homo sapiens
gaaagcaagauguuccaaa

SEQ ID NO: 1571549 - RNA, 19 nt, Homo sapiens
ccaaaccucuuguaguuag

SEQ ID NO: 1571550 - RNA, 19 nt, Homo sapiens
uuauagugaugccauguua

SEQ ID NO: 1571551 - RNA, 19 nt, Homo sapiens
aaagaagucuggaucaagu

SEQ ID NO: 1571552 - RNA, 19 nt, Homo sapiens
aaacagcacaagaaacaua

SEQ ID NO: 1571553 - RNA, 19 nt, Homo sapiens
gcaagccaauugagaaugg

SEQ ID NO: 1571554 - RNA, 19 nt, Homo sapiens
aaagcaagauguuccaaau

SEQ ID NO: 1571555 - RNA, 19 nt, Homo sapiens
cauguuagauuaccuugga

SEQ ID NO: 1571556 - RNA, 19 nt, Homo sapiens
ggaguuuacagcauaagua

SEQ ID NO: 1571557 - RNA, 19 nt, Homo sapiens
aaaggaaccuggaaagaag

SEQ ID NO: 1571558 - RNA, 19 nt, Homo sapiens
ugcaaggacuuaauauuga

SEQ ID NO: 1571559 - RNA, 19 nt, Homo sapiens
agaaugaguuugccgaguu

SEQ ID NO: 1571560 - RNA, 19 nt, Homo sapiens
gagcuugcuugauauuuca

SEQ ID NO: 1571561 - RNA, 19 nt, Homo sapiens
uggaaucucucauuaaagu

SEQ ID NO: 1571562 - RNA, 19 nt, Homo sapiens
cuucagcacuguuuacuau

SEQ ID NO: 1571563 - RNA, 19 nt, Homo sapiens
gcuggcaacuucaauauac

SEQ ID NO: 1571564 - RNA, 19 nt, Homo sapiens
uauugaagcugguuacugu

SEQ ID NO: 1571565 - RNA, 19 nt, Homo sapiens
agcauuagcugaauuugaa

SEQ ID NO: 1571566 - RNA, 19 nt, Homo sapiens
acuggaaucucucauuaaa

SEQ ID NO: 1571567 - RNA, 19 nt, Homo sapiens
ccuuggagcuucauaacuu

SEQ ID NO: 1571568 - RNA, 19 nt, Homo sapiens
uaccuucaaucacaaguaa

SEQ ID NO: 1571569 - RNA, 19 nt, Homo sapiens
gaaugaguuugccgaguuc

SEQ ID NO: 1571570 - RNA, 19 nt, Homo sapiens
gaagagaaggugugaagag

SEQ ID NO: 1571571 - RNA, 19 nt, Homo sapiens
gagaauggagcuugcuuga

SEQ ID NO: 1571572 - RNA, 19 nt, Homo sapiens
uuccaaaccucuuguaguu

SEQ ID NO: 1571573 - RNA, 19 nt, Homo sapiens
guggcuagcugaauagugu

SEQ ID NO: 1571574 - RNA, 19 nt, Homo sapiens
guaagaagccucagcaaaa

SEQ ID NO: 1571575 - RNA, 19 nt, Homo sapiens
ccaaagcucuacgcaugaa

SEQ ID NO: 1571576 - RNA, 19 nt, Homo sapiens
caaauggcauacuuacaag

SEQ ID NO: 1571577 - RNA, 19 nt, Homo sapiens
caagaaggacaggaguuua

SEQ ID NO: 1571578 - RNA, 19 nt, Homo sapiens
guaaagaagaagaagaaga

SEQ ID NO: 1571579 - RNA, 19 nt, Homo sapiens
gaugaaacagagaaagaaa

SEQ ID NO: 1571580 - RNA, 19 nt, Homo sapiens
gcagagagaaauuauuaag

SEQ ID NO: 1571581 - RNA, 19 nt, Homo sapiens
gauaaucggguagccuaua

SEQ ID NO: 1571582 - RNA, 19 nt, Homo sapiens
guaucuaucugcuccuguu

SEQ ID NO: 1571583 - RNA, 19 nt, Homo sapiens
agaagaaacagcacaagaa

SEQ ID NO: 1571584 - RNA, 19 nt, Homo sapiens
ucauacaaaucaucccaaa

SEQ ID NO: 1571585 - RNA, 19 nt, Homo sapiens
caacaacucccuugguaca

SEQ ID NO: 1571586 - RNA, 19 nt, Homo sapiens
ucaagcagagggauuguaa

SEQ ID NO: 1571587 - RNA, 19 nt, Homo sapiens
gaugcaaggacuuaauauu

SEQ ID NO: 1571588 - RNA, 19 nt, Homo sapiens
gaaagaaaaggauguaaga

SEQ ID NO: 1571589 - RNA, 19 nt, Homo sapiens
gaagucaaaggaugaaaca

SEQ ID NO: 1571590 - RNA, 19 nt, Homo sapiens
gaaauacuggaaucucuca

SEQ ID NO: 1571591 - RNA, 19 nt, Homo sapiens
agaaacagcacaagaaaca

SEQ ID NO: 1571592 - RNA, 19 nt, Homo sapiens
aagaggaugugcaagcaaa

SEQ ID NO: 1571593 - RNA, 19 nt, Homo sapiens
gggaaccauucuaaacaga

SEQ ID NO: 1571594 - RNA, 19 nt, Homo sapiens
gcucuacgcaugaaucaga

SEQ ID NO: 1571595 - RNA, 19 nt, Homo sapiens
cacuguggcuagcugaaua

SEQ ID NO: 1571596 - RNA, 19 nt, Homo sapiens
gaucaagucacaagucaag

SEQ ID NO: 1571597 - RNA, 19 nt, Homo sapiens
gaagagcgagaacaagcaa

SEQ ID NO: 1571598 - RNA, 19 nt, Homo sapiens
ggaugaaacagagaaagaa

SEQ ID NO: 1571599 - RNA, 19 nt, Homo sapiens
uagccuauaugaauccuau

SEQ ID NO: 1571600 - RNA, 19 nt, Homo sapiens
gaauuuaaggcgaguaucu

SEQ ID NO: 1571601 - RNA, 19 nt, Homo sapiens
gcugauggacuugcaguaa

SEQ ID NO: 1571602 - RNA, 19 nt, Homo sapiens
uuaggucgcuguuuagaag

SEQ ID NO: 1571603 - RNA, 19 nt, Homo sapiens
gaauauggcaaaagcauuu

SEQ ID NO: 1571604 - RNA, 19 nt, Homo sapiens
gaaucucucauuaaaguuc

SEQ ID NO: 1571605 - RNA, 19 nt, Homo sapiens
acaugaaacuacugccaaa

SEQ ID NO: 1571606 - RNA, 19 nt, Homo sapiens
caaaggaugaaacagagaa

SEQ ID NO: 1571607 - RNA, 19 nt, Homo sapiens
caagucacaagucaaggua

SEQ ID NO: 1571608 - RNA, 19 nt, Homo sapiens
cugauggacuugcaguaaa

SEQ ID NO: 1571609 - RNA, 19 nt, Homo sapiens
cagagggauuguaaacaga

SEQ ID NO: 1571610 - RNA, 19 nt, Homo sapiens
gacuuugaguugccuauca

SEQ ID NO: 1571611 - RNA, 19 nt, Homo sapiens
cacaagaaacauaguaaga

SEQ ID NO: 1571612 - RNA, 19 nt, Homo sapiens
agaagaagaagaagaaaca

SEQ ID NO: 1571613 - RNA, 19 nt, Homo sapiens
aaguuacccugaugauaaa

SEQ ID NO: 1571614 - RNA, 19 nt, Homo sapiens
gaguaucuaucuuuguucu

SEQ ID NO: 1571615 - RNA, 19 nt, Homo sapiens
ugacuggagugcugaugga

SEQ ID NO: 1571616 - RNA, 19 nt, Homo sapiens
guaaugucauagguacaaa

SEQ ID NO: 1571617 - RNA, 19 nt, Homo sapiens
gaacacggcauauaucauu

SEQ ID NO: 1571618 - RNA, 19 nt, Homo sapiens
gagaagagcagucaacauu

SEQ ID NO: 1571619 - RNA, 19 nt, Homo sapiens
gaagauccuuuaaacaaga

SEQ ID NO: 1571620 - RNA, 19 nt, Homo sapiens
cgaaagagccaauuacaaa

SEQ ID NO: 1571621 - RNA, 19 nt, Homo sapiens
gaaacgaaagagccaauua

SEQ ID NO: 1571622 - RNA, 19 nt, Homo sapiens
acacacguauugcuauuua

SEQ ID NO: 1571623 - RNA, 19 nt, Homo sapiens
gaggcagucugggaaauua

SEQ ID NO: 1571624 - RNA, 19 nt, Homo sapiens
gcagucaacauucuaagua

SEQ ID NO: 1571625 - RNA, 19 nt, Homo sapiens
gaagagcagucaacauucu

SEQ ID NO: 1571626 - RNA, 19 nt, Homo sapiens
ggugugaucuuucugaaug

SEQ ID NO: 1571627 - RNA, 19 nt, Homo sapiens
gaagguaggaagaaauaaa

SEQ ID NO: 1571628 - RNA, 19 nt, Homo sapiens
gaacaaggaaacacaguau

SEQ ID NO: 1571629 - RNA, 19 nt, Homo sapiens
caaauuagaccucaccuau

SEQ ID NO: 1571630 - RNA, 19 nt, Homo sapiens
aauuagaccucaccuauga

SEQ ID NO: 1571631 - RNA, 19 nt, Homo sapiens
ucaacugccugcacuauug

SEQ ID NO: 1571632 - RNA, 19 nt, Homo sapiens
ggagauaugauaaaguuug

SEQ ID NO: 1571633 - RNA, 19 nt, Homo sapiens
ugaccuaucuuccacauca

SEQ ID NO: 1571634 - RNA, 19 nt, Homo sapiens
gcaaaugcacguuccagaa

SEQ ID NO: 1571635 - RNA, 19 nt, Homo sapiens
ucagaaguaugaaacgaaa

SEQ ID NO: 1571636 - RNA, 19 nt, Homo sapiens
gcgaaaccuuggucugaaa

SEQ ID NO: 1571637 - RNA, 19 nt, Homo sapiens
ugaagaagguaggaagaaa

SEQ ID NO: 1571638 - RNA, 19 nt, Homo sapiens
gaaacuagcaagaugaaag

SEQ ID NO: 1571639 - RNA, 19 nt, Homo sapiens
gcugagggcuggaaagaag

SEQ ID NO: 1571640 - RNA, 19 nt, Homo sapiens
gugagaugauuuagcagua

SEQ ID NO: 1571641 - RNA, 19 nt, Homo sapiens
ggagggaacacggcauaua

SEQ ID NO: 1571642 - RNA, 19 nt, Homo sapiens
ugaaaguccuggaguuugu

SEQ ID NO: 1571643 - RNA, 19 nt, Homo sapiens
ugucaaaggugcccucuuc

SEQ ID NO: 1571644 - RNA, 19 nt, Homo sapiens
gaugaaaguccuggaguuu

SEQ ID NO: 1571645 - RNA, 19 nt, Homo sapiens
uagugucgcuggugcauuu

SEQ ID NO: 1571646 - RNA, 19 nt, Homo sapiens
gaagaagguaggaagaaau

SEQ ID NO: 1571647 - RNA, 19 nt, Homo sapiens
gagggaacacggcauauau

SEQ ID NO: 1571648 - RNA, 19 nt, Homo sapiens
gugcauuucuugcuucaga

SEQ ID NO: 1571649 - RNA, 19 nt, Homo sapiens
caugcuaagugaaaucuga

SEQ ID NO: 1571650 - RNA, 19 nt, Homo sapiens
gcaccuguuucaugcaguu

SEQ ID NO: 1571651 - RNA, 19 nt, Homo sapiens
ugaauaugauggguguaua

SEQ ID NO: 1571652 - RNA, 19 nt, Homo sapiens
caaagggagauaugauaaa

SEQ ID NO: 1571653 - RNA, 19 nt, Homo sapiens
uccaagagcucacgcugaa

SEQ ID NO: 1571654 - RNA, 19 nt, Homo sapiens
gaagaggcagucugggaaa

SEQ ID NO: 1571655 - RNA, 19 nt, Homo sapiens
agggagauaugauaaaguu

SEQ ID NO: 1571656 - RNA, 19 nt, Homo sapiens
ugagaugauuuagcaguaa

SEQ ID NO: 1571657 - RNA, 19 nt, Homo sapiens
uggcuuaguuuacugaaga

SEQ ID NO: 1571658 - RNA, 19 nt, Homo sapiens
ggaaacacaguauuggaau

SEQ ID NO: 1571659 - RNA, 19 nt, Homo sapiens
gaccucaccuaugaugaaa

SEQ ID NO: 1571660 - RNA, 19 nt, Homo sapiens
gaaagagccaauuacaaag

SEQ ID NO: 1571661 - RNA, 19 nt, Homo sapiens
gaaacaugcggccagagaa

SEQ ID NO: 1571662 - RNA, 19 nt, Homo sapiens
gaggcuuguucuucacuuu

SEQ ID NO: 1571663 - RNA, 19 nt, Homo sapiens
aagaagguaggaagaaaua

SEQ ID NO: 1571664 - RNA, 19 nt, Homo sapiens
gaugaaacaaccagugaug

SEQ ID NO: 1571665 - RNA, 19 nt, Homo sapiens
gcaaauuagaccucaccua

SEQ ID NO: 1571666 - RNA, 19 nt, Homo sapiens
acaaagggagauaugauaa

SEQ ID NO: 1571667 - RNA, 19 nt, Homo sapiens
aaugugagaugauuuagca

SEQ ID NO: 1571668 - RNA, 19 nt, Homo sapiens
ugaaacaaccagugaugaa

SEQ ID NO: 1571669 - RNA, 19 nt, Homo sapiens
uuacacacguauugcuauu

SEQ ID NO: 1571670 - RNA, 19 nt, Homo sapiens
gaagagaagagcagucaac

SEQ ID NO: 1571671 - RNA, 19 nt, Homo sapiens
uacaaagggagauaugaua

SEQ ID NO: 1571672 - RNA, 19 nt, Homo sapiens
acaaggaaacacaguauug

SEQ ID NO: 1571673 - RNA, 19 nt, Homo sapiens
ggaguuuguagccaagaua

SEQ ID NO: 1571674 - RNA, 19 nt, Homo sapiens
aaagggagauaugauaaag

SEQ ID NO: 1571675 - RNA, 19 nt, Homo sapiens
gggcgaaaccuuggucuga

SEQ ID NO: 1571676 - RNA, 19 nt, Homo sapiens
caaaggugcccucuucauc

SEQ ID NO: 1571677 - RNA, 19 nt, Homo sapiens
gcaguaaaauuuuggagau

SEQ ID NO: 1571678 - RNA, 19 nt, Homo sapiens
gaaaguccuggaguuugua

SEQ ID NO: 1571679 - RNA, 19 nt, Homo sapiens
ggugcccucuucaucaauu

SEQ ID NO: 1571680 - RNA, 19 nt, Homo sapiens
ggcgaaaccuuggucugaa

SEQ ID NO: 1571681 - RNA, 19 nt, Homo sapiens
gaaacaaccagugaugaag

SEQ ID NO: 1571682 - RNA, 19 nt, Homo sapiens
agaagauccuuuaaacaag

SEQ ID NO: 1571683 - RNA, 19 nt, Homo sapiens
gagcuacgcaggccacugu

SEQ ID NO: 1571684 - RNA, 19 nt, Homo sapiens
agacuggccuccugaugau

SEQ ID NO: 1571685 - RNA, 19 nt, Homo sapiens
gcacuugguguugauuuga

SEQ ID NO: 1571686 - RNA, 19 nt, Homo sapiens
gggaacacggcauauauca

SEQ ID NO: 1571687 - RNA, 19 nt, Homo sapiens
ccggacauguuucucuuga

SEQ ID NO: 1571688 - RNA, 19 nt, Homo sapiens
aaacaaccagugaugaaga

SEQ ID NO: 1571689 - RNA, 19 nt, Homo sapiens
aaacaugcggccagagaaa

SEQ ID NO: 1571690 - RNA, 19 nt, Homo sapiens
ccacaucaucaagcuguua

SEQ ID NO: 1571691 - RNA, 19 nt, Homo sapiens
agaugaaaguccuggaguu

SEQ ID NO: 1571692 - RNA, 19 nt, Homo sapiens
gcuggugcauuucuugcuu

SEQ ID NO: 1571693 - RNA, 19 nt, Homo sapiens
gacuuugguuacacacgua

SEQ ID NO: 1571694 - RNA, 19 nt, Homo sapiens
caugauaccgucccuagug

SEQ ID NO: 1571695 - RNA, 19 nt, Homo sapiens
guagccaagauacaugaua

SEQ ID NO: 1571696 - RNA, 19 nt, Homo sapiens
gcugaaacuagcaagauga

SEQ ID NO: 1571697 - RNA, 19 nt, Homo sapiens
ccucaccuaugaugaaaca

SEQ ID NO: 1571698 - RNA, 19 nt, Homo sapiens
ccaauuacaaagggagaua

SEQ ID NO: 1571699 - RNA, 19 nt, Homo sapiens
ggccggacauguuucucuu

SEQ ID NO: 1571700 - RNA, 19 nt, Homo sapiens
gagcucacgcugaaacuag

SEQ ID NO: 1571701 - RNA, 19 nt, Homo sapiens
aagauuuggugcagcuaaa

SEQ ID NO: 1571702 - RNA, 19 nt, Homo sapiens
ugaaacaugcggccagaga

SEQ ID NO: 1571703 - RNA, 19 nt, Homo sapiens
ggcacuugguguugauuug

SEQ ID NO: 1571704 - RNA, 19 nt, Homo sapiens
aaacaaauugggaaaccuu

SEQ ID NO: 1571705 - RNA, 19 nt, Homo sapiens
ggaguuuuauuguucugua

SEQ ID NO: 1571706 - RNA, 19 nt, Homo sapiens
uagccaagauacaugauac

SEQ ID NO: 1571707 - RNA, 19 nt, Homo sapiens
aaaggugcccucuucauca

SEQ ID NO: 1571708 - RNA, 19 nt, Homo sapiens
acauguuucucuugaccua

SEQ ID NO: 1571709 - RNA, 19 nt, Homo sapiens
gcacugggugugaucuuuc

SEQ ID NO: 1571710 - RNA, 19 nt, Homo sapiens
aacaaccagugaugaagaa

SEQ ID NO: 1571711 - RNA, 19 nt, Homo sapiens
gcacauggagcuggcacuu

SEQ ID NO: 1571712 - RNA, 19 nt, Homo sapiens
ucaggaaggauaaguguca

SEQ ID NO: 1571713 - RNA, 19 nt, Homo sapiens
uaucuucucuuuggugaca

SEQ ID NO: 1571714 - RNA, 19 nt, Homo sapiens
caaauugggaaaccuucuu

SEQ ID NO: 1571715 - RNA, 19 nt, Homo sapiens
ucaagucugaagauuguuu

SEQ ID NO: 1571716 - RNA, 19 nt, Homo sapiens
gcaagugcccaacagugau

SEQ ID NO: 1571717 - RNA, 19 nt, Homo sapiens
ggagggacauuauuacaua

SEQ ID NO: 1571718 - RNA, 19 nt, Homo sapiens
gaacaaaccuagucugcaa

SEQ ID NO: 1571719 - RNA, 19 nt, Homo sapiens
gcaacaaacuacuagauuu

SEQ ID NO: 1571720 - RNA, 19 nt, Homo sapiens
gcuagaagauuuagaaaga

SEQ ID NO: 1571721 - RNA, 19 nt, Homo sapiens
gaaaggaaaucaggacaaa

SEQ ID NO: 1571722 - RNA, 19 nt, Homo sapiens
gcagugauguguuugaauu

SEQ ID NO: 1571723 - RNA, 19 nt, Homo sapiens
gaaaggauguagucuuaau

SEQ ID NO: 1571724 - RNA, 19 nt, Homo sapiens
gaccacagauuacuuaaau

SEQ ID NO: 1571725 - RNA, 19 nt, Homo sapiens
gaagucaaaucccacugua

SEQ ID NO: 1571726 - RNA, 19 nt, Homo sapiens
caaaugaacuccagauucu

SEQ ID NO: 1571727 - RNA, 19 nt, Homo sapiens
uggaaaggauguagucuua

SEQ ID NO: 1571728 - RNA, 19 nt, Homo sapiens
gaagaucgcuuugggaauc

SEQ ID NO: 1571729 - RNA, 19 nt, Homo sapiens
ggauguagucuuaaucuua

SEQ ID NO: 1571730 - RNA, 19 nt, Homo sapiens
gaaacaaacagcacaauuc

SEQ ID NO: 1571731 - RNA, 19 nt, Homo sapiens
cagcauggcuuggcuauga

SEQ ID NO: 1571732 - RNA, 19 nt, Homo sapiens
gaucucagcuuauuacaac

SEQ ID NO: 1571733 - RNA, 19 nt, Homo sapiens
gauaagcagcagaaaguua

SEQ ID NO: 1571734 - RNA, 19 nt, Homo sapiens
gaagcugguuggaagaauu

SEQ ID NO: 1571735 - RNA, 19 nt, Homo sapiens
gcauaguccuggaaacaaa

SEQ ID NO: 1571736 - RNA, 19 nt, Homo sapiens
ucagagagguggaaaggaa

SEQ ID NO: 1571737 - RNA, 19 nt, Homo sapiens
gaaugcugauggcaagaua

SEQ ID NO: 1571738 - RNA, 19 nt, Homo sapiens
guguaaacaugcuucguua

SEQ ID NO: 1571739 - RNA, 19 nt, Homo sapiens
cagagaucauugacauuua

SEQ ID NO: 1571740 - RNA, 19 nt, Homo sapiens
ggagaaggaccacugauga

SEQ ID NO: 1571741 - RNA, 19 nt, Homo sapiens
ggaaagcaacaaacuacua

SEQ ID NO: 1571742 - RNA, 19 nt, Homo sapiens
ggaccaggaugaugacaau

SEQ ID NO: 1571743 - RNA, 19 nt, Homo sapiens
gaauagcucuugggaguuc

SEQ ID NO: 1571744 - RNA, 19 nt, Homo sapiens
guagagaaguauuuaaugg

SEQ ID NO: 1571745 - RNA, 19 nt, Homo sapiens
ugacagagaucauugacau

SEQ ID NO: 1571746 - RNA, 19 nt, Homo sapiens
cuaccuaccuauugacuuu

SEQ ID NO: 1571747 - RNA, 19 nt, Homo sapiens
acacaaagcucugaugaca

SEQ ID NO: 1571748 - RNA, 19 nt, Homo sapiens
ggagaauuauugucgauag

SEQ ID NO: 1571749 - RNA, 19 nt, Homo sapiens
ggacuggacggucggauuu

SEQ ID NO: 1571750 - RNA, 19 nt, Homo sapiens
ggaaacaaacagcacaauu

SEQ ID NO: 1571751 - RNA, 19 nt, Homo sapiens
ggcaaugucucacuguuau

SEQ ID NO: 1571752 - RNA, 19 nt, Homo sapiens
uaacuucccugucuuagag

SEQ ID NO: 1571753 - RNA, 19 nt, Homo sapiens
uuaaagcccuaaaggauga

SEQ ID NO: 1571754 - RNA, 19 nt, Homo sapiens
ucaccuaccuaccuauuga

SEQ ID NO: 1571755 - RNA, 19 nt, Homo sapiens
ccacagauuacuuaaauga

SEQ ID NO: 1571756 - RNA, 19 nt, Homo sapiens
gaaauacaccaauaacagu

SEQ ID NO: 1571757 - RNA, 19 nt, Homo sapiens
gauuuaugcuucuguaaca

SEQ ID NO: 1571758 - RNA, 19 nt, Homo sapiens
guggugcgaucucagcuua

SEQ ID NO: 1571759 - RNA, 19 nt, Homo sapiens
cugcagaaauacaccaaua

SEQ ID NO: 1571760 - RNA, 19 nt, Homo sapiens
aaacagcacaauuccuuua

SEQ ID NO: 1571761 - RNA, 19 nt, Homo sapiens
gaaaaugucauccugcaua

SEQ ID NO: 1571762 - RNA, 19 nt, Homo sapiens
uaagaaacaccauuugaug

SEQ ID NO: 1571763 - RNA, 19 nt, Homo sapiens
cagaauaacugugagagau

SEQ ID NO: 1571764 - RNA, 19 nt, Homo sapiens
gaagccaucugggaagaga

SEQ ID NO: 1571765 - RNA, 19 nt, Homo sapiens
ggauugugauaucaugaaa

SEQ ID NO: 1571766 - RNA, 19 nt, Homo sapiens
caauaaaacuguugaggaa

SEQ ID NO: 1571767 - RNA, 19 nt, Homo sapiens
gaaagcaacaaacuacuag

SEQ ID NO: 1571768 - RNA, 19 nt, Homo sapiens
gcuauuggguauauuucaa

SEQ ID NO: 1571769 - RNA, 19 nt, Homo sapiens
gguauaugcuauuggguau

SEQ ID NO: 1571770 - RNA, 19 nt, Homo sapiens
gggacauuauuacauauga

SEQ ID NO: 1571771 - RNA, 19 nt, Homo sapiens
gguuauugcuuucagaugu

SEQ ID NO: 1571772 - RNA, 19 nt, Homo sapiens
gaaaggaaacacaaagucu

SEQ ID NO: 1571773 - RNA, 19 nt, Homo sapiens
guaaacaugcuucguuaau

SEQ ID NO: 1571774 - RNA, 19 nt, Homo sapiens
gaaggaccacugaugagaa

SEQ ID NO: 1571775 - RNA, 19 nt, Homo sapiens
uagcugggaccacagauua

SEQ ID NO: 1571776 - RNA, 19 nt, Homo sapiens
gagaagccaucugggaaga

SEQ ID NO: 1571777 - RNA, 19 nt, Homo sapiens
aagagaaacucagcaagaa

SEQ ID NO: 1571778 - RNA, 19 nt, Homo sapiens
ccuaaaggaugaagaucuu

SEQ ID NO: 1571779 - RNA, 19 nt, Homo sapiens
guuauugcuuucagaugua

SEQ ID NO: 1571780 - RNA, 19 nt, Homo sapiens
gaccagaggaccaggauga

SEQ ID NO: 1571781 - RNA, 19 nt, Homo sapiens
ccaaggacgccaagccaua

SEQ ID NO: 1571782 - RNA, 19 nt, Homo sapiens
uuacuggacuccuaacuuc

SEQ ID NO: 1571783 - RNA, 19 nt, Homo sapiens
caguugaguuugcuugaaa

SEQ ID NO: 1571784 - RNA, 19 nt, Homo sapiens
agucaaaucccacuguaua

SEQ ID NO: 1571785 - RNA, 19 nt, Homo sapiens
gaagugcuacguugagaau

SEQ ID NO: 1571786 - RNA, 19 nt, Homo sapiens
uggagaagcuaggacuaua

SEQ ID NO: 1571787 - RNA, 19 nt, Homo sapiens
guauagaaacugcuuugaa

SEQ ID NO: 1571788 - RNA, 19 nt, Homo sapiens
cacaaagucucaagugaca

SEQ ID NO: 1571789 - RNA, 19 nt, Homo sapiens
ccaaagugcugggauuaca

SEQ ID NO: 1571790 - RNA, 19 nt, Homo sapiens
caaugaggcuugcagugau

SEQ ID NO: 1571791 - RNA, 19 nt, Homo sapiens
aaagagaaacucagcaaga

SEQ ID NO: 1571792 - RNA, 19 nt, Homo sapiens
ccacugaugagaagucaaa

SEQ ID NO: 1571793 - RNA, 19 nt, Homo sapiens
agacagguuucagcaagua

SEQ ID NO: 1571794 - RNA, 19 nt, Homo sapiens
ggaaaggaaaucaggacaa

SEQ ID NO: 1571795 - RNA, 19 nt, Homo sapiens
ggugcgaucucagcuuauu

SEQ ID NO: 1571796 - RNA, 19 nt, Homo sapiens
gcagagaacaaaccuaguc

SEQ ID NO: 1571797 - RNA, 19 nt, Homo sapiens
ggaaaggaaacacaaaguc

SEQ ID NO: 1571798 - RNA, 19 nt, Homo sapiens
cagcacaauuccuuuaaag

SEQ ID NO: 1571799 - RNA, 19 nt, Homo sapiens
ggacuauaggccuguguaa

SEQ ID NO: 1571800 - RNA, 19 nt, Homo sapiens
gaggcaaugucucacuguu

SEQ ID NO: 1571801 - RNA, 19 nt, Homo sapiens
gagggacauuauuacauau

SEQ ID NO: 1571802 - RNA, 19 nt, Homo sapiens
uggaggagggacauuauua

SEQ ID NO: 1571803 - RNA, 19 nt, Homo sapiens
ggaggggaauccaauguuu

SEQ ID NO: 1571804 - RNA, 19 nt, Homo sapiens
acaaucagccucuggagaa

SEQ ID NO: 1571805 - RNA, 19 nt, Homo sapiens
ccacacaaagcucugauga

SEQ ID NO: 1571806 - RNA, 19 nt, Homo sapiens
aagauaaacccucuagcua

SEQ ID NO: 1571807 - RNA, 19 nt, Homo sapiens
aaugucauccugcauauuu

SEQ ID NO: 1571808 - RNA, 19 nt, Homo sapiens
caaaacugguuauugcuuu

SEQ ID NO: 1571809 - RNA, 19 nt, Homo sapiens
cggcagcucugucugugaa

SEQ ID NO: 1571810 - RNA, 19 nt, Homo sapiens
ggaccacagauuacuuaaa

SEQ ID NO: 1571811 - RNA, 19 nt, Homo sapiens
caacuaugaucugacuuca

SEQ ID NO: 1571812 - RNA, 19 nt, Homo sapiens
uuagucaacugucccaaga

SEQ ID NO: 1571813 - RNA, 19 nt, Homo sapiens
gcaagcauaguccuggaaa

SEQ ID NO: 1571814 - RNA, 19 nt, Homo sapiens
acagagaucauugacauuu

SEQ ID NO: 1571815 - RNA, 19 nt, Homo sapiens
gcuccucucuggaaugcuu

SEQ ID NO: 1571816 - RNA, 19 nt, Homo sapiens
cagaggaccaggaugauga

SEQ ID NO: 1571817 - RNA, 19 nt, Homo sapiens
ggaaaucuauggaguauua

SEQ ID NO: 1571818 - RNA, 19 nt, Homo sapiens
gagcagaucucgugauaaa

SEQ ID NO: 1571819 - RNA, 19 nt, Homo sapiens
gaaggaguguggucauuua

SEQ ID NO: 1571820 - RNA, 19 nt, Homo sapiens
ggaaugacacaguauauaa

SEQ ID NO: 1571821 - RNA, 19 nt, Homo sapiens
gcaaggacccuaucuuuga

SEQ ID NO: 1571822 - RNA, 19 nt, Homo sapiens
ggagaagccaccaccauua

SEQ ID NO: 1571823 - RNA, 19 nt, Homo sapiens
aaagacagcucucauagug

SEQ ID NO: 1571824 - RNA, 19 nt, Homo sapiens
ugaggguccuuucuuguua

SEQ ID NO: 1571825 - RNA, 19 nt, Homo sapiens
gcucacaccuguaaucaca

SEQ ID NO: 1571826 - RNA, 19 nt, Homo sapiens
caacuucuguggcuacuuc

SEQ ID NO: 1571827 - RNA, 19 nt, Homo sapiens
ccaaugguguccuggagua

SEQ ID NO: 1571828 - RNA, 19 nt, Homo sapiens
gcagaucucgugauaaaug

SEQ ID NO: 1571829 - RNA, 19 nt, Homo sapiens
gcaugcugcuccaaauaaa

SEQ ID NO: 1571830 - RNA, 19 nt, Homo sapiens
gacccugacuggaauguga

SEQ ID NO: 1571831 - RNA, 19 nt, Homo sapiens
caguauugcugcugcuaua

SEQ ID NO: 1571832 - RNA, 19 nt, Homo sapiens
aagaaucacuugagacuag

SEQ ID NO: 1571833 - RNA, 19 nt, Homo sapiens
cuuaguagccugagucuuu

SEQ ID NO: 1571834 - RNA, 19 nt, Homo sapiens
ggaaggcaccguagcucua

SEQ ID NO: 1571835 - RNA, 19 nt, Homo sapiens
cgugauaaaugaagugaug

SEQ ID NO: 1571836 - RNA, 19 nt, Homo sapiens
ucaagaggcugaggcagaa

SEQ ID NO: 1571837 - RNA, 19 nt, Homo sapiens
ggaguguggucauuuaguc

SEQ ID NO: 1571838 - RNA, 19 nt, Homo sapiens
ggaaggaguguggucauuu

SEQ ID NO: 1571839 - RNA, 19 nt, Homo sapiens
gggaaugacacaguauaua

SEQ ID NO: 1571840 - RNA, 19 nt, Homo sapiens
gaaagacagcucucauagu

SEQ ID NO: 1571841 - RNA, 19 nt, Homo sapiens
gaucagccugggaaacaua

SEQ ID NO: 1571842 - RNA, 19 nt, Homo sapiens
aaugagaacuugggaaugu

SEQ ID NO: 1571843 - RNA, 19 nt, Homo sapiens
gcgggaaguucgcauagug

SEQ ID NO: 1571844 - RNA, 19 nt, Homo sapiens
gagaggcgcucggagaaag

SEQ ID NO: 1571845 - RNA, 19 nt, Homo sapiens
gggagaagccaccaccauu

SEQ ID NO: 1571846 - RNA, 19 nt, Homo sapiens
ccagugcuguccucaguau

SEQ ID NO: 1571847 - RNA, 19 nt, Homo sapiens
aaaggaaaucuauggagua

SEQ ID NO: 1571848 - RNA, 19 nt, Homo sapiens
gcacuuguagucccagcua

SEQ ID NO: 1571849 - RNA, 19 nt, Homo sapiens
uggaguauuuggagaaaga

SEQ ID NO: 1571850 - RNA, 19 nt, Homo sapiens
gggaauguuuaagaagaaa

SEQ ID NO: 1571851 - RNA, 19 nt, Homo sapiens
cagaucucgugauaaauga

SEQ ID NO: 1571852 - RNA, 19 nt, Homo sapiens
gagaacuugggaauguuua

SEQ ID NO: 1571853 - RNA, 19 nt, Homo sapiens
gacuaggaguucaagauca

SEQ ID NO: 1571854 - RNA, 19 nt, Homo sapiens
uacaagaguuugagauugg

SEQ ID NO: 1571855 - RNA, 19 nt, Homo sapiens
gcacacagaacgcuauguc

SEQ ID NO: 1571856 - RNA, 19 nt, Homo sapiens
gccaggacccauccaauga

SEQ ID NO: 1571857 - RNA, 19 nt, Homo sapiens
cgucauaccaggcagcuuu

SEQ ID NO: 1571858 - RNA, 19 nt, Homo sapiens
aaggaaaucuauggaguau

SEQ ID NO: 1571859 - RNA, 19 nt, Homo sapiens
uaauggacccugacuggaa

SEQ ID NO: 1571860 - RNA, 19 nt, Homo sapiens
aaaguuagaguucgaggaa

SEQ ID NO: 1571861 - RNA, 19 nt, Homo sapiens
auacaagaguuugagauug

SEQ ID NO: 1571862 - RNA, 19 nt, Homo sapiens
gagcaaguccccauuacua

SEQ ID NO: 1571863 - RNA, 19 nt, Homo sapiens
gugguggcaugcacuugua

SEQ ID NO: 1571864 - RNA, 19 nt, Homo sapiens
gagacuaggaguucaagau

SEQ ID NO: 1571865 - RNA, 19 nt, Homo sapiens
guguauuacugcaccauug

SEQ ID NO: 1571866 - RNA, 19 nt, Homo sapiens
gcaagaucaccauccagaa

SEQ ID NO: 1571867 - RNA, 19 nt, Homo sapiens
gaacugcaagucugagucu

SEQ ID NO: 1571868 - RNA, 19 nt, Homo sapiens
ugacauggcgcuucaaguc

SEQ ID NO: 1571869 - RNA, 19 nt, Homo sapiens
ggaguauuauagggacauu

SEQ ID NO: 1571870 - RNA, 19 nt, Homo sapiens
ggcggcagcugaggaagaa

SEQ ID NO: 1571871 - RNA, 19 nt, Homo sapiens
caugaucacacaucuguau

SEQ ID NO: 1571872 - RNA, 19 nt, Homo sapiens
cugcaaggacccuaucuuu

SEQ ID NO: 1571873 - RNA, 19 nt, Homo sapiens
aguuagaguucgaggaauu

SEQ ID NO: 1571874 - RNA, 19 nt, Homo sapiens
ggcuaagaaucacuugaga

SEQ ID NO: 1571875 - RNA, 19 nt, Homo sapiens
uuaaauccuucuugggaau

SEQ ID NO: 1571876 - RNA, 19 nt, Homo sapiens
guuagaguucgaggaauua

SEQ ID NO: 1571877 - RNA, 19 nt, Homo sapiens
ggagaggcgcucggagaaa

SEQ ID NO: 1571878 - RNA, 19 nt, Homo sapiens
gagaagccaccaccauuac

SEQ ID NO: 1571879 - RNA, 19 nt, Homo sapiens
gggaccauggaguguauua

SEQ ID NO: 1571880 - RNA, 19 nt, Homo sapiens
ugggaauguuuaagaagaa

SEQ ID NO: 1571881 - RNA, 19 nt, Homo sapiens
ccucuaucauccucaaaug

SEQ ID NO: 1571882 - RNA, 19 nt, Homo sapiens
agucugagucuaacaguuu

SEQ ID NO: 1571883 - RNA, 19 nt, Homo sapiens
gaggguccuuucuuguuag

SEQ ID NO: 1571884 - RNA, 19 nt, Homo sapiens
agacuacacugcccagaac

SEQ ID NO: 1571885 - RNA, 19 nt, Homo sapiens
gaaugugaucccucaggaa

SEQ ID NO: 1571886 - RNA, 19 nt, Homo sapiens
agaaagacagcucucauag

SEQ ID NO: 1571887 - RNA, 19 nt, Homo sapiens
aggagaagccgccuagcua

SEQ ID NO: 1571888 - RNA, 19 nt, Homo sapiens
gugggaccauggaguguau

SEQ ID NO: 1571889 - RNA, 19 nt, Homo sapiens
ggccaggacccauccaaug

SEQ ID NO: 1571890 - RNA, 19 nt, Homo sapiens
caaggacccuaucuuugac

SEQ ID NO: 1571891 - RNA, 19 nt, Homo sapiens
uugggaauguuuaagaaga

SEQ ID NO: 1571892 - RNA, 19 nt, Homo sapiens
ugagaacuugggaauguuu

SEQ ID NO: 1571893 - RNA, 19 nt, Homo sapiens
gaucacacaucuguauucc

SEQ ID NO: 1571894 - RNA, 19 nt, Homo sapiens
gaaggcaccguagcucuag

SEQ ID NO: 1571895 - RNA, 19 nt, Homo sapiens
agaaagaacugcggaaccu

SEQ ID NO: 1571896 - RNA, 19 nt, Homo sapiens
gaacuugggaauguuuaag

SEQ ID NO: 1571897 - RNA, 19 nt, Homo sapiens
uggaaggaguguggucauu

SEQ ID NO: 1571898 - RNA, 19 nt, Homo sapiens
ugacccagaccaccaauca

SEQ ID NO: 1571899 - RNA, 19 nt, Homo sapiens
gaggaauuaccaacuguag

SEQ ID NO: 1571900 - RNA, 19 nt, Homo sapiens
cuaucauccucaaauguga

SEQ ID NO: 1571901 - RNA, 19 nt, Homo sapiens
guggugacauggcgcuuca

SEQ ID NO: 1571902 - RNA, 19 nt, Homo sapiens
uuauuccugugccuuguuu

SEQ ID NO: 1571903 - RNA, 19 nt, Homo sapiens
ucuugaggguccuuucuug

SEQ ID NO: 1571904 - RNA, 19 nt, Homo sapiens
ggaacuuaguagccugagu

SEQ ID NO: 1571905 - RNA, 19 nt, Homo sapiens
caagaucaccauccagaac

SEQ ID NO: 1571906 - RNA, 19 nt, Homo sapiens
augcugcuccaaauaaaua

SEQ ID NO: 1571907 - RNA, 19 nt, Homo sapiens
cgaggaauuaccaacugua

SEQ ID NO: 1571908 - RNA, 19 nt, Homo sapiens
cuucucggcuccugugugu

SEQ ID NO: 1571909 - RNA, 19 nt, Homo sapiens
cccauacacuggucagaca

SEQ ID NO: 1571910 - RNA, 19 nt, Homo sapiens
ucuugggaaugacacagua

SEQ ID NO: 1571911 - RNA, 19 nt, Homo sapiens
ucacagagaagcaguuuug

SEQ ID NO: 1571912 - RNA, 19 nt, Homo sapiens
ugugaucccucaggaacuu

SEQ ID NO: 1571913 - RNA, 19 nt, Homo sapiens
gcucucuugcauauuuaua

SEQ ID NO: 1571914 - RNA, 19 nt, Homo sapiens
aggcaagaauagcaggaaa

SEQ ID NO: 1571915 - RNA, 19 nt, Homo sapiens
ugaccucaaaggcagauuu

SEQ ID NO: 1571916 - RNA, 19 nt, Homo sapiens
augguguccuggaguauuu

SEQ ID NO: 1571917 - RNA, 19 nt, Homo sapiens
gggaaagaauggacuguuu

SEQ ID NO: 1571918 - RNA, 19 nt, Homo sapiens
gaauguacgugcucgcaaa

SEQ ID NO: 1571919 - RNA, 19 nt, Homo sapiens
gcccaaagcuguugaaguc

SEQ ID NO: 1571920 - RNA, 19 nt, Homo sapiens
cagcaaaguuggccucaaa

SEQ ID NO: 1571921 - RNA, 19 nt, Homo sapiens
gcaacugccucacuuaaca

SEQ ID NO: 1571922 - RNA, 19 nt, Homo sapiens
gccacggccucucaucuua

SEQ ID NO: 1571923 - RNA, 19 nt, Homo sapiens
ucacaguucagaagaaaua

SEQ ID NO: 1571924 - RNA, 19 nt, Homo sapiens
gacaagacccugaaucugu

SEQ ID NO: 1571925 - RNA, 19 nt, Homo sapiens
ggaaagaauggacuguuug

SEQ ID NO: 1571926 - RNA, 19 nt, Homo sapiens
gggaccagguuugggaaua

SEQ ID NO: 1571927 - RNA, 19 nt, Homo sapiens
gcacagacucaaagggaaa

SEQ ID NO: 1571928 - RNA, 19 nt, Homo sapiens
gagcucucguccugccuua

SEQ ID NO: 1571929 - RNA, 19 nt, Homo sapiens
gcaggucaguacagagguu

SEQ ID NO: 1571930 - RNA, 19 nt, Homo sapiens
gaagggacugguuggguuu

SEQ ID NO: 1571931 - RNA, 19 nt, Homo sapiens
gaagucagcauccuuuguc

SEQ ID NO: 1571932 - RNA, 19 nt, Homo sapiens
gaagggcucagcugaagga

SEQ ID NO: 1571933 - RNA, 19 nt, Homo sapiens
gcauuacccucaucaucau

SEQ ID NO: 1571934 - RNA, 19 nt, Homo sapiens
ugucuuagcauggaaauaa

SEQ ID NO: 1571935 - RNA, 19 nt, Homo sapiens
gcucugccgugcacuccua

SEQ ID NO: 1571936 - RNA, 19 nt, Homo sapiens
gggaagggcucagcugaag

SEQ ID NO: 1571937 - RNA, 19 nt, Homo sapiens
ucucacacccacacaaaua

SEQ ID NO: 1571938 - RNA, 19 nt, Homo sapiens
gggaagagcaggucaguac

SEQ ID NO: 1571939 - RNA, 19 nt, Homo sapiens
cagagucaaugccuucaug

SEQ ID NO: 1571940 - RNA, 19 nt, Homo sapiens
gcagagcuccuuccugucu

SEQ ID NO: 1571941 - RNA, 19 nt, Homo sapiens
cgagaggcgugucugugaa

SEQ ID NO: 1571942 - RNA, 19 nt, Homo sapiens
aaacugccaggaugaauga

SEQ ID NO: 1571943 - RNA, 19 nt, Homo sapiens
ggaccagguuugggaauac

SEQ ID NO: 1571944 - RNA, 19 nt, Homo sapiens
caucaugggcaucgucauu

SEQ ID NO: 1571945 - RNA, 19 nt, Homo sapiens
ccucaucauuuccaucaug

SEQ ID NO: 1571946 - RNA, 19 nt, Homo sapiens
gggcgugggucagagaguu

SEQ ID NO: 1571947 - RNA, 19 nt, Homo sapiens
cagcagcaccagcaaaguu

SEQ ID NO: 1571948 - RNA, 19 nt, Homo sapiens
gagcacggaguauuucugu

SEQ ID NO: 1571949 - RNA, 19 nt, Homo sapiens
gaaagaauggacuguuugc

SEQ ID NO: 1571950 - RNA, 19 nt, Homo sapiens
caauggguaacgugguuua

SEQ ID NO: 1571951 - RNA, 19 nt, Homo sapiens
acacugccuucaccaucua

SEQ ID NO: 1571952 - RNA, 19 nt, Homo sapiens
ggagaggacagaaaugaac

SEQ ID NO: 1571953 - RNA, 19 nt, Homo sapiens
cagucuggcuuguuucuca

SEQ ID NO: 1571954 - RNA, 19 nt, Homo sapiens
gcauggaaauaaauaaacc

SEQ ID NO: 1571955 - RNA, 19 nt, Homo sapiens
ucaugggcaucgucauuau

SEQ ID NO: 1571956 - RNA, 19 nt, Homo sapiens
guugaagucagcauccuuu

SEQ ID NO: 1571957 - RNA, 19 nt, Homo sapiens
gggagaggacagaaaugaa

SEQ ID NO: 1571958 - RNA, 19 nt, Homo sapiens
ccagggagaggacagaaau

SEQ ID NO: 1571959 - RNA, 19 nt, Homo sapiens
ccacacaugcccagaccuu

SEQ ID NO: 1571960 - RNA, 19 nt, Homo sapiens
gaagagcaggucaguacag

SEQ ID NO: 1571961 - RNA, 19 nt, Homo sapiens
gggcaucgucauuaucaug

SEQ ID NO: 1571962 - RNA, 19 nt, Homo sapiens
gcucagcauuacccucauc

SEQ ID NO: 1571963 - RNA, 19 nt, Homo sapiens
gcagagaacaaggaugaca

SEQ ID NO: 1571964 - RNA, 19 nt, Homo sapiens
aggcagagaacaaggauga

SEQ ID NO: 1571965 - RNA, 19 nt, Homo sapiens
gacucuaggugcccuugga

SEQ ID NO: 1571966 - RNA, 19 nt, Homo sapiens
ccucacagccagagucaau

SEQ ID NO: 1571967 - RNA, 19 nt, Homo sapiens
gucuggugcugcuuaggua

SEQ ID NO: 1571968 - RNA, 19 nt, Homo sapiens
ccgagaggcgugucuguga

SEQ ID NO: 1571969 - RNA, 19 nt, Homo sapiens
gucuuagcauggaaauaaa

SEQ ID NO: 1571970 - RNA, 19 nt, Homo sapiens
ggugugagcacggaguauu

SEQ ID NO: 1571971 - RNA, 19 nt, Homo sapiens
aagagcaggucaguacaga

SEQ ID NO: 1571972 - RNA, 19 nt, Homo sapiens
ucaccaaggcagagaacaa

SEQ ID NO: 1571973 - RNA, 19 nt, Homo sapiens
gagaggcgaggucgaugga

SEQ ID NO: 1571974 - RNA, 19 nt, Homo sapiens
gaccagguuugggaauaca

SEQ ID NO: 1571975 - RNA, 19 nt, Homo sapiens
ggccccaucuuuuguguuu

SEQ ID NO: 1571976 - RNA, 19 nt, Homo sapiens
gaaagccuggagcgaggaa

SEQ ID NO: 1571977 - RNA, 19 nt, Homo sapiens
cagcauuacccucaucauc

SEQ ID NO: 1571978 - RNA, 19 nt, Homo sapiens
ggcaggcgaggauaacuug

SEQ ID NO: 1571979 - RNA, 19 nt, Homo sapiens
cagccacagccaccgcuua

SEQ ID NO: 1571980 - RNA, 19 nt, Homo sapiens
ggaaggagggaugaugagu

SEQ ID NO: 1571981 - RNA, 19 nt, Homo sapiens
ggaagagcaggucaguaca

SEQ ID NO: 1571982 - RNA, 19 nt, Homo sapiens
gaugacaagacccugaauc

SEQ ID NO: 1571983 - RNA, 19 nt, Homo sapiens
gcccagcccuaugcucugu

SEQ ID NO: 1571984 - RNA, 19 nt, Homo sapiens
ccaaggcagagaacaagga

SEQ ID NO: 1571985 - RNA, 19 nt, Homo sapiens
ugacgccgcugugugucuu

SEQ ID NO: 1571986 - RNA, 19 nt, Homo sapiens
gcgaggauaacuugagagu

SEQ ID NO: 1571987 - RNA, 19 nt, Homo sapiens
aggcgaggauaacuugaga

SEQ ID NO: 1571988 - RNA, 19 nt, Homo sapiens
ggacugguuggguuugcuu

SEQ ID NO: 1571989 - RNA, 19 nt, Homo sapiens
cagagaacaaggaugacaa

SEQ ID NO: 1571990 - RNA, 19 nt, Homo sapiens
acacacacacgcuuguuca

SEQ ID NO: 1571991 - RNA, 19 nt, Homo sapiens
gugugagcacggaguauuu

SEQ ID NO: 1571992 - RNA, 19 nt, Homo sapiens
gcaguccgaguuuccuuca

SEQ ID NO: 1571993 - RNA, 19 nt, Homo sapiens
gaugaugagugggcguuuu

SEQ ID NO: 1571994 - RNA, 19 nt, Homo sapiens
gguuggguuugcuuuaugg

SEQ ID NO: 1571995 - RNA, 19 nt, Homo sapiens
cacacugccuucaccaucu

SEQ ID NO: 1571996 - RNA, 19 nt, Homo sapiens
cuugggcccuggaggagaa

SEQ ID NO: 1571997 - RNA, 19 nt, Homo sapiens
gaugguugagggauuguca

SEQ ID NO: 1571998 - RNA, 19 nt, Homo sapiens
gagaacaaggaugacaaga

SEQ ID NO: 1571999 - RNA, 19 nt, Homo sapiens
ucuucucucugcucucuga

SEQ ID NO: 1572000 - RNA, 19 nt, Homo sapiens
gagcacagagcaggagaag

SEQ ID NO: 1572001 - RNA, 19 nt, Homo sapiens
gcacuccuacacacacaca

SEQ ID NO: 1572002 - RNA, 19 nt, Homo sapiens
caagggcgugggucagaga

SEQ ID NO: 1572003 - RNA, 19 nt, Homo sapiens
caagccagucugccucuuc

SEQ ID NO: 1572004 - RNA, 19 nt, Homo sapiens
aagcacagcgaacccaaug

SEQ ID NO: 1572005 - RNA, 19 nt, Homo sapiens
ugacaagacccugaaucug

SEQ ID NO: 1572006 - RNA, 19 nt, Homo sapiens
acacgcuuguucacacuca

SEQ ID NO: 1572007 - RNA, 19 nt, Homo sapiens
aagaauggacuguuugcau

SEQ ID NO: 1572008 - RNA, 19 nt, Homo sapiens
uuucucauucccacaauuu

SEQ ID NO: 1572009 - RNA, 19 nt, Homo sapiens
gcacacaucuacuuaaaug

SEQ ID NO: 1572010 - RNA, 19 nt, Homo sapiens
ggucucaagugaagguuua

SEQ ID NO: 1572011 - RNA, 19 nt, Homo sapiens
acacacagcugacccuuga

SEQ ID NO: 1572012 - RNA, 19 nt, Homo sapiens
cuacuuaaaugcacucagu

SEQ ID NO: 1572013 - RNA, 19 nt, Homo sapiens
guacuucucuuuucaaauc

SEQ ID NO: 1572014 - RNA, 19 nt, Homo sapiens
ccagccagaucuuucuuga

SEQ ID NO: 1572015 - RNA, 19 nt, Homo sapiens
guacucuccugaacucuca

SEQ ID NO: 1572016 - RNA, 19 nt, Homo sapiens
uaaaugcacucaguacucu

SEQ ID NO: 1572017 - RNA, 19 nt, Homo sapiens
uaaaugcacacaucuacuu

SEQ ID NO: 1572018 - RNA, 19 nt, Homo sapiens
ucagggauccuaagauaga

SEQ ID NO: 1572019 - RNA, 19 nt, Homo sapiens
ggaaaggugagaugaagca

SEQ ID NO: 1572020 - RNA, 19 nt, Homo sapiens
gcagugcuuccucucuuaa

SEQ ID NO: 1572021 - RNA, 19 nt, Homo sapiens
gagcagggucucaagugaa

SEQ ID NO: 1572022 - RNA, 19 nt, Homo sapiens
ugaggcaccugaucuuaag

SEQ ID NO: 1572023 - RNA, 19 nt, Homo sapiens
gaucuuucuugaccacugu

SEQ ID NO: 1572024 - RNA, 19 nt, Homo sapiens
caagugaagguuuaauauc

SEQ ID NO: 1572025 - RNA, 19 nt, Homo sapiens
gaacaucaagaggcaagga

SEQ ID NO: 1572026 - RNA, 19 nt, Homo sapiens
augcacacaucuacuuaaa

SEQ ID NO: 1572027 - RNA, 19 nt, Homo sapiens
aaaugcacacaucuacuua

SEQ ID NO: 1572028 - RNA, 19 nt, Homo sapiens
acacacacauacacacaca

SEQ ID NO: 1572029 - RNA, 19 nt, Homo sapiens
ccuuaucgcuuccguuucu

SEQ ID NO: 1572030 - RNA, 19 nt, Homo sapiens
ccaguuuggagaaauauau

SEQ ID NO: 1572031 - RNA, 19 nt, Homo sapiens
gaaugccacuuuuccaguu

SEQ ID NO: 1572032 - RNA, 19 nt, Homo sapiens
uaaacagggucaggaacau

SEQ ID NO: 1572033 - RNA, 19 nt, Homo sapiens
ggcgagaacuguuuucaug

SEQ ID NO: 1572034 - RNA, 19 nt, Homo sapiens
guccuuaucgcuuccguuu

SEQ ID NO: 1572035 - RNA, 19 nt, Homo sapiens
gaacuguuuucaugguuau

SEQ ID NO: 1572036 - RNA, 19 nt, Homo sapiens
cuccugaacucucauugug

SEQ ID NO: 1572037 - RNA, 19 nt, Homo sapiens
gguugaaaaucugcauaua

SEQ ID NO: 1572038 - RNA, 19 nt, Homo sapiens
cucaagugaagguuuaaua

SEQ ID NO: 1572039 - RNA, 19 nt, Homo sapiens
cugaggcaccugaucuuaa

SEQ ID NO: 1572040 - RNA, 19 nt, Homo sapiens
ugggaaaggugagaugaag

SEQ ID NO: 1572041 - RNA, 19 nt, Homo sapiens
aauuacagaaugccacuuu

SEQ ID NO: 1572042 - RNA, 19 nt, Homo sapiens
acacaucuacuuaaaugca

SEQ ID NO: 1572043 - RNA, 19 nt, Homo sapiens
ucacugaggcaccugaucu

SEQ ID NO: 1572044 - RNA, 19 nt, Homo sapiens
gguuaugaacaauuacaga

SEQ ID NO: 1572045 - RNA, 19 nt, Homo sapiens
ucacacacacauacacaca

SEQ ID NO: 1572046 - RNA, 19 nt, Homo sapiens
gagaacuguuuucaugguu

SEQ ID NO: 1572047 - RNA, 19 nt, Homo sapiens
caacugaaggccuauugcu

SEQ ID NO: 1572048 - RNA, 19 nt, Homo sapiens
agaacuguuuucaugguua

SEQ ID NO: 1572049 - RNA, 19 nt, Homo sapiens
gcucuccagccagaucuuu

SEQ ID NO: 1572050 - RNA, 19 nt, Homo sapiens
gcacauaaaugguguauau

SEQ ID NO: 1572051 - RNA, 19 nt, Homo sapiens
gaaggaagcuuaucuaaca

SEQ ID NO: 1572052 - RNA, 19 nt, Homo sapiens
gaagagagaucagcauuaa

SEQ ID NO: 1572053 - RNA, 19 nt, Homo sapiens
gaaaguuacagcacgauua

SEQ ID NO: 1572054 - RNA, 19 nt, Homo sapiens
gagauguucuucugcauuu

SEQ ID NO: 1572055 - RNA, 19 nt, Homo sapiens
gaagauugguuuucgauua

SEQ ID NO: 1572056 - RNA, 19 nt, Homo sapiens
gaacauaucaagaacauca

SEQ ID NO: 1572057 - RNA, 19 nt, Homo sapiens
ccaccacgguuacauuaua

SEQ ID NO: 1572058 - RNA, 19 nt, Homo sapiens
ccacagaaauuuacagcaa

SEQ ID NO: 1572059 - RNA, 19 nt, Homo sapiens
gacgagagcucuucagcaa

SEQ ID NO: 1572060 - RNA, 19 nt, Homo sapiens
gaagaugauaggcaaauaa

SEQ ID NO: 1572061 - RNA, 19 nt, Homo sapiens
ggaagagagaucagcauua

SEQ ID NO: 1572062 - RNA, 19 nt, Homo sapiens
gaacaaacagccugcaguu

SEQ ID NO: 1572063 - RNA, 19 nt, Homo sapiens
gaacacagaagcagaaaca

SEQ ID NO: 1572064 - RNA, 19 nt, Homo sapiens
caaaagcccuugucaguuu

SEQ ID NO: 1572065 - RNA, 19 nt, Homo sapiens
acaaauagaugcuguggau

SEQ ID NO: 1572066 - RNA, 19 nt, Homo sapiens
gcagauguuucacaauuca

SEQ ID NO: 1572067 - RNA, 19 nt, Homo sapiens
gagaucagcgaagguauua

SEQ ID NO: 1572068 - RNA, 19 nt, Homo sapiens
caagaaaguuaacaagagu

SEQ ID NO: 1572069 - RNA, 19 nt, Homo sapiens
ccaaggaacauaucaagaa

SEQ ID NO: 1572070 - RNA, 19 nt, Homo sapiens
gauaagaaagcuucacaga

SEQ ID NO: 1572071 - RNA, 19 nt, Homo sapiens
gaaauuuacagcaacaaug

SEQ ID NO: 1572072 - RNA, 19 nt, Homo sapiens
ccucuccagucaccaauua

SEQ ID NO: 1572073 - RNA, 19 nt, Homo sapiens
acuaugaaguucucaguaa

SEQ ID NO: 1572074 - RNA, 19 nt, Homo sapiens
ccacggagauguucuucug

SEQ ID NO: 1572075 - RNA, 19 nt, Homo sapiens
ugaaggugauaaugacuuu

SEQ ID NO: 1572076 - RNA, 19 nt, Homo sapiens
gaaccucccucgcaaagac

SEQ ID NO: 1572077 - RNA, 19 nt, Homo sapiens
guuauuggaacgaaaguua

SEQ ID NO: 1572078 - RNA, 19 nt, Homo sapiens
aaaggaaaguugcagaugu

SEQ ID NO: 1572079 - RNA, 19 nt, Homo sapiens
gcacugggcgacagcaauu

SEQ ID NO: 1572080 - RNA, 19 nt, Homo sapiens
ugaagaugauaggcaaaua

SEQ ID NO: 1572081 - RNA, 19 nt, Homo sapiens
gcagaaacacuggcaauca

SEQ ID NO: 1572082 - RNA, 19 nt, Homo sapiens
gcucugacacugaaacauu

SEQ ID NO: 1572083 - RNA, 19 nt, Homo sapiens
uugcagauguuucacaauu

SEQ ID NO: 1572084 - RNA, 19 nt, Homo sapiens
ccagaggguugcaaugguu

SEQ ID NO: 1572085 - RNA, 19 nt, Homo sapiens
gguauuaacccguguguag

SEQ ID NO: 1572086 - RNA, 19 nt, Homo sapiens
ucagggacaugaacacaga

SEQ ID NO: 1572087 - RNA, 19 nt, Homo sapiens
acaagaaaguuaacaagag

SEQ ID NO: 1572088 - RNA, 19 nt, Homo sapiens
uggcggagcucgaccaguu

SEQ ID NO: 1572089 - RNA, 19 nt, Homo sapiens
ucuaacacguggaaugaaa

SEQ ID NO: 1572090 - RNA, 19 nt, Homo sapiens
gaaacacuggcaaucauau

SEQ ID NO: 1572091 - RNA, 19 nt, Homo sapiens
uaccaucccugacuaugaa

SEQ ID NO: 1572092 - RNA, 19 nt, Homo sapiens
cagaaacacuggcaaucau

SEQ ID NO: 1572093 - RNA, 19 nt, Homo sapiens
uacaagcucugcuguggaa

SEQ ID NO: 1572094 - RNA, 19 nt, Homo sapiens
caagugaccagauuaucaa

SEQ ID NO: 1572095 - RNA, 19 nt, Homo sapiens
aaggaaaguugcagauguu

SEQ ID NO: 1572096 - RNA, 19 nt, Homo sapiens
uaacaaacgauaagugaag

SEQ ID NO: 1572097 - RNA, 19 nt, Homo sapiens
ccaagugaccagauuauca

SEQ ID NO: 1572098 - RNA, 19 nt, Homo sapiens
acagcggccuucucgauuu

SEQ ID NO: 1572099 - RNA, 19 nt, Homo sapiens
ggagauguucuucugcauu

SEQ ID NO: 1572100 - RNA, 19 nt, Homo sapiens
cgacugcuuccucaucaua

SEQ ID NO: 1572101 - RNA, 19 nt, Homo sapiens
caaggaacauaucaagaac

SEQ ID NO: 1572102 - RNA, 19 nt, Homo sapiens
cagcggagaacccgucuuu

SEQ ID NO: 1572103 - RNA, 19 nt, Homo sapiens
cgagagcucuucagcaaaa

SEQ ID NO: 1572104 - RNA, 19 nt, Homo sapiens
aaagaaggaagcuuaucua

SEQ ID NO: 1572105 - RNA, 19 nt, Homo sapiens
gaacaucagggacaugaac

SEQ ID NO: 1572106 - RNA, 19 nt, Homo sapiens
gaacacagggccuaaacac

SEQ ID NO: 1572107 - RNA, 19 nt, Homo sapiens
ggacaugaacacagaagca

SEQ ID NO: 1572108 - RNA, 19 nt, Homo sapiens
gauaggacagggcuuggaa

SEQ ID NO: 1572109 - RNA, 19 nt, Homo sapiens
gcucuuacaacaaaggaaa

SEQ ID NO: 1572110 - RNA, 19 nt, Homo sapiens
gcaaugguuccacagaaau

SEQ ID NO: 1572111 - RNA, 19 nt, Homo sapiens
ggaaaggcaggaauacaag

SEQ ID NO: 1572112 - RNA, 19 nt, Homo sapiens
gaauuucuuauccaaguga

SEQ ID NO: 1572113 - RNA, 19 nt, Homo sapiens
gaucacgagcacuaacaaa

SEQ ID NO: 1572114 - RNA, 19 nt, Homo sapiens
cucugacacugaaacauua

SEQ ID NO: 1572115 - RNA, 19 nt, Homo sapiens
ggacagucgccguggagaa

SEQ ID NO: 1572116 - RNA, 19 nt, Homo sapiens
ugagagaucagcgaaggua

SEQ ID NO: 1572117 - RNA, 19 nt, Homo sapiens
guauuucacuuugcguaga

SEQ ID NO: 1572118 - RNA, 19 nt, Homo sapiens
ugcaaugguuccacagaaa

SEQ ID NO: 1572119 - RNA, 19 nt, Homo sapiens
gagcacuaacaaacgauaa

SEQ ID NO: 1572120 - RNA, 19 nt, Homo sapiens
gcggagaacccgucuuuac

SEQ ID NO: 1572121 - RNA, 19 nt, Homo sapiens
agaaacacuggcaaucaua

SEQ ID NO: 1572122 - RNA, 19 nt, Homo sapiens
acgagugguucuauucaaa

SEQ ID NO: 1572123 - RNA, 19 nt, Homo sapiens
ggauucacgcggagauuug

SEQ ID NO: 1572124 - RNA, 19 nt, Homo sapiens
aagaaggaagcuuaucuaa

SEQ ID NO: 1572125 - RNA, 19 nt, Homo sapiens
caaugucaacaccagauaa

SEQ ID NO: 1572126 - RNA, 19 nt, Homo sapiens
aaacagcggccuucucgau

SEQ ID NO: 1572127 - RNA, 19 nt, Homo sapiens
uaucuaacacguggaauga

SEQ ID NO: 1572128 - RNA, 19 nt, Homo sapiens
caaaggaaaguugcagaug

SEQ ID NO: 1572129 - RNA, 19 nt, Homo sapiens
gucaacaccagauaagaaa

SEQ ID NO: 1572130 - RNA, 19 nt, Homo sapiens
caacgacugcuuccucauc

SEQ ID NO: 1572131 - RNA, 19 nt, Homo sapiens
ggagaacccgucuuuacag

SEQ ID NO: 1572132 - RNA, 19 nt, Homo sapiens
gaucagcgaagguauuaac

SEQ ID NO: 1572133 - RNA, 19 nt, Homo sapiens
cuaugaaguucucaguaau

SEQ ID NO: 1572134 - RNA, 19 nt, Homo sapiens
acagaaauuuacagcaaca

SEQ ID NO: 1572135 - RNA, 19 nt, Homo sapiens
ucucaugauucaccaagga

SEQ ID NO: 1572136 - RNA, 19 nt, Homo sapiens
guggauacucuuaaugcua

SEQ ID NO: 1572137 - RNA, 19 nt, Homo sapiens
cauaaaugguguauauacg

SEQ ID NO: 1572138 - RNA, 19 nt, Homo sapiens
ugucaacaccagauaagaa

SEQ ID NO: 1572139 - RNA, 19 nt, Homo sapiens
caaugguuccacagaaauu

SEQ ID NO: 1572140 - RNA, 19 nt, Homo sapiens
uggaaaggcaggaauacaa

SEQ ID NO: 1572141 - RNA, 19 nt, Homo sapiens
caugaacacagaagcagaa

SEQ ID NO: 1572142 - RNA, 19 nt, Homo sapiens
gaugcuguggauacucuua

SEQ ID NO: 1572143 - RNA, 19 nt, Homo sapiens
aaacagaaacggcagaaaa

SEQ ID NO: 1572144 - RNA, 19 nt, Homo sapiens
auaagaaagcuucacagaa

SEQ ID NO: 1572145 - RNA, 19 nt, Homo sapiens
aaguacaguucuuuacaga

SEQ ID NO: 1572146 - RNA, 19 nt, Homo sapiens
ucagaguaacgaaacauga

SEQ ID NO: 1572147 - RNA, 19 nt, Homo sapiens
uauccaagugaccagauua

SEQ ID NO: 1572148 - RNA, 19 nt, Homo sapiens
guguaugucuaaaggaauc

SEQ ID NO: 1572149 - RNA, 19 nt, Homo sapiens
acuaacaaacgauaaguga

SEQ ID NO: 1572150 - RNA, 19 nt, Homo sapiens
guacagaucuugaaacaaa

SEQ ID NO: 1572151 - RNA, 19 nt, Homo sapiens
gcaaugauaugucaaaguu

SEQ ID NO: 1572152 - RNA, 19 nt, Homo sapiens
caagaagagucuccacuua

SEQ ID NO: 1572153 - RNA, 19 nt, Homo sapiens
uaaaugggcuuauucugua

SEQ ID NO: 1572154 - RNA, 19 nt, Homo sapiens
gaacagaaauuggacaaau

SEQ ID NO: 1572155 - RNA, 19 nt, Homo sapiens
guaauacacuaucccauuu

SEQ ID NO: 1572156 - RNA, 19 nt, Homo sapiens
caacuggcauugaaucuuu

SEQ ID NO: 1572157 - RNA, 19 nt, Homo sapiens
gcacuaagggcuauuauug

SEQ ID NO: 1572158 - RNA, 19 nt, Homo sapiens
guacugccaugcucucaua

SEQ ID NO: 1572159 - RNA, 19 nt, Homo sapiens
gaaacagaaucuaguaaca

SEQ ID NO: 1572160 - RNA, 19 nt, Homo sapiens
gauguuggcaaucuaauua

SEQ ID NO: 1572161 - RNA, 19 nt, Homo sapiens
gaauggagcagaacagaaa

SEQ ID NO: 1572162 - RNA, 19 nt, Homo sapiens
gaauauacuccacaaauug

SEQ ID NO: 1572163 - RNA, 19 nt, Homo sapiens
gaucuuacccaucuuauug

SEQ ID NO: 1572164 - RNA, 19 nt, Homo sapiens
gccaugcucucauacauuu

SEQ ID NO: 1572165 - RNA, 19 nt, Homo sapiens
ucaggcaucugguaacuuu

SEQ ID NO: 1572166 - RNA, 19 nt, Homo sapiens
agaagagucuccacuuaaa

SEQ ID NO: 1572167 - RNA, 19 nt, Homo sapiens
caagaagaccauccagaua

SEQ ID NO: 1572168 - RNA, 19 nt, Homo sapiens
gaaggaauuuguguggaaa

SEQ ID NO: 1572169 - RNA, 19 nt, Homo sapiens
ugaaauuuauccucgagua

SEQ ID NO: 1572170 - RNA, 19 nt, Homo sapiens
gaaauuuauccucgaguaa

SEQ ID NO: 1572171 - RNA, 19 nt, Homo sapiens
gcaagaagaccauccagau

SEQ ID NO: 1572172 - RNA, 19 nt, Homo sapiens
gagcagaacagaaauugga

SEQ ID NO: 1572173 - RNA, 19 nt, Homo sapiens
gagagcagcagcuugaauu

SEQ ID NO: 1572174 - RNA, 19 nt, Homo sapiens
aaagaagaauggagcagaa

SEQ ID NO: 1572175 - RNA, 19 nt, Homo sapiens
ugaaggaauuuguguggaa

SEQ ID NO: 1572176 - RNA, 19 nt, Homo sapiens
gguaaagaauauacugugu

SEQ ID NO: 1572177 - RNA, 19 nt, Homo sapiens
aagcuguucuccaguauuu

SEQ ID NO: 1572178 - RNA, 19 nt, Homo sapiens
ucaccugcccugaacauua

SEQ ID NO: 1572179 - RNA, 19 nt, Homo sapiens
agaagaccauccagauauu

SEQ ID NO: 1572180 - RNA, 19 nt, Homo sapiens
gcagcagcuugaauuaaug

SEQ ID NO: 1572181 - RNA, 19 nt, Homo sapiens
gagcagcagcuugaauuaa

SEQ ID NO: 1572182 - RNA, 19 nt, Homo sapiens
ucaagaauauacuccacaa

SEQ ID NO: 1572183 - RNA, 19 nt, Homo sapiens
ggaagcuguucuccaguau

SEQ ID NO: 1572184 - RNA, 19 nt, Homo sapiens
gauccaaggcgauaaggaa

SEQ ID NO: 1572185 - RNA, 19 nt, Homo sapiens
acuaagggcuauuauugaa

SEQ ID NO: 1572186 - RNA, 19 nt, Homo sapiens
ccacaaauugaaagaauga

SEQ ID NO: 1572187 - RNA, 19 nt, Homo sapiens
uaacggcucucugugaugu

SEQ ID NO: 1572188 - RNA, 19 nt, Homo sapiens
cauugaaucuuuaccuguu

SEQ ID NO: 1572189 - RNA, 19 nt, Homo sapiens
gguuagcaaugauauguca

SEQ ID NO: 1572190 - RNA, 19 nt, Homo sapiens
gcacugacaauaucuuuac

SEQ ID NO: 1572191 - RNA, 19 nt, Homo sapiens
uaauggcacugacaauauc

SEQ ID NO: 1572192 - RNA, 19 nt, Homo sapiens
aagccucucuaucuguuua

SEQ ID NO: 1572193 - RNA, 19 nt, Homo sapiens
gaagagucuccacuuaaau

SEQ ID NO: 1572194 - RNA, 19 nt, Homo sapiens
ggucauugccuuaccauag

SEQ ID NO: 1572195 - RNA, 19 nt, Homo sapiens
auggagaccuuuacgaauu

SEQ ID NO: 1572196 - RNA, 19 nt, Homo sapiens
ugucccauauguuauagua

SEQ ID NO: 1572197 - RNA, 19 nt, Homo sapiens
gagcaaacuaagcuuuauu

SEQ ID NO: 1572198 - RNA, 19 nt, Homo sapiens
uagcauggauaaagagcaa

SEQ ID NO: 1572199 - RNA, 19 nt, Homo sapiens
ugaagccucucuaucuguu

SEQ ID NO: 1572200 - RNA, 19 nt, Homo sapiens
gggcuuauucuguacauug

SEQ ID NO: 1572201 - RNA, 19 nt, Homo sapiens
gaaaaugucaaccugaauu

SEQ ID NO: 1572202 - RNA, 19 nt, Homo sapiens
uaucuaacagucugcauaa

SEQ ID NO: 1572203 - RNA, 19 nt, Homo sapiens
aagaagagucuccacuuaa

SEQ ID NO: 1572204 - RNA, 19 nt, Homo sapiens
cugcauaagguaaagaaua

SEQ ID NO: 1572205 - RNA, 19 nt, Homo sapiens
gaauuaauggcacugacaa

SEQ ID NO: 1572206 - RNA, 19 nt, Homo sapiens
aggaagcuguucuccagua

SEQ ID NO: 1572207 - RNA, 19 nt, Homo sapiens
uaccauaggucaacaucau

SEQ ID NO: 1572208 - RNA, 19 nt, Homo sapiens
gaacauuacaggcaaccau

SEQ ID NO: 1572209 - RNA, 19 nt, Homo sapiens
caacaaagaaaugcacaau

SEQ ID NO: 1572210 - RNA, 19 nt, Homo sapiens
gggaaacagaaucuaguaa

SEQ ID NO: 1572211 - RNA, 19 nt, Homo sapiens
caacaucauggucauccua

SEQ ID NO: 1572212 - RNA, 19 nt, Homo sapiens
gaagaccauccagauauug

SEQ ID NO: 1572213 - RNA, 19 nt, Homo sapiens
aagaagaccauccagauau

SEQ ID NO: 1572214 - RNA, 19 nt, Homo sapiens
ggaaacagaaucuaguaac

SEQ ID NO: 1572215 - RNA, 19 nt, Homo sapiens
ggauaaagagcaaacuaag

SEQ ID NO: 1572216 - RNA, 19 nt, Homo sapiens
uuaaaugggcuuauucugu

SEQ ID NO: 1572217 - RNA, 19 nt, Homo sapiens
gaaagaaugaaggaaauac

SEQ ID NO: 1572218 - RNA, 19 nt, Homo sapiens
gacacacacuggacagauc

SEQ ID NO: 1572219 - RNA, 19 nt, Homo sapiens
ugaagauccucguguacug

SEQ ID NO: 1572220 - RNA, 19 nt, Homo sapiens
aagagcaaacuaagcuuua

SEQ ID NO: 1572221 - RNA, 19 nt, Homo sapiens
caacacaucauaaccuuuu

SEQ ID NO: 1572222 - RNA, 19 nt, Homo sapiens
cuaacagucugcauaaggu

SEQ ID NO: 1572223 - RNA, 19 nt, Homo sapiens
gcauguacagaucuugaaa

SEQ ID NO: 1572224 - RNA, 19 nt, Homo sapiens
cgagaucaacaaagaaaug

SEQ ID NO: 1572225 - RNA, 19 nt, Homo sapiens
gugcugcaacuaauauaaa

SEQ ID NO: 1572226 - RNA, 19 nt, Homo sapiens
ucauguuccuggccuggua

SEQ ID NO: 1572227 - RNA, 19 nt, Homo sapiens
uuaauggcacugacaauau

SEQ ID NO: 1572228 - RNA, 19 nt, Homo sapiens
gggcuauuauugaaaagua

SEQ ID NO: 1572229 - RNA, 19 nt, Homo sapiens
uggauaaagagcaaacuaa

SEQ ID NO: 1572230 - RNA, 19 nt, Homo sapiens
auacugaugucgauacucu

SEQ ID NO: 1572231 - RNA, 19 nt, Homo sapiens
aagagucuccacuuaaauu

SEQ ID NO: 1572232 - RNA, 19 nt, Homo sapiens
agcagcagcuugaauuaau

SEQ ID NO: 1572233 - RNA, 19 nt, Homo sapiens
ccuaacggcucucugugau

SEQ ID NO: 1572234 - RNA, 19 nt, Homo sapiens
gaagcuguucuccaguauu

SEQ ID NO: 1572235 - RNA, 19 nt, Homo sapiens
cauuacaggcaaccauuaa

SEQ ID NO: 1572236 - RNA, 19 nt, Homo sapiens
uaacagucugcauaaggua

SEQ ID NO: 1572237 - RNA, 19 nt, Homo sapiens
accacgagaucaacaaaga

SEQ ID NO: 1572238 - RNA, 19 nt, Homo sapiens
aguaauacacuaucccauu

SEQ ID NO: 1572239 - RNA, 19 nt, Homo sapiens
agagcaaacuaagcuuuau

SEQ ID NO: 1572240 - RNA, 19 nt, Homo sapiens
gaacguucucauucccaaa

SEQ ID NO: 1572241 - RNA, 19 nt, Homo sapiens
caccugcccugaacauuac

SEQ ID NO: 1572242 - RNA, 19 nt, Homo sapiens
cacgagaucaacaaagaaa

SEQ ID NO: 1572243 - RNA, 19 nt, Homo sapiens
ugcccuaauugcagaagua

SEQ ID NO: 1572244 - RNA, 19 nt, Homo sapiens
gaagaauggagcagaacag

SEQ ID NO: 1572245 - RNA, 19 nt, Homo sapiens
acaagaagagucuccacuu

SEQ ID NO: 1572246 - RNA, 19 nt, Homo sapiens
agagcagcagcuugaauua

SEQ ID NO: 1572247 - RNA, 19 nt, Homo sapiens
caagaauauacuccacaaa

SEQ ID NO: 1572248 - RNA, 19 nt, Homo sapiens
uggagaccuuuacgaauuc

SEQ ID NO: 1572249 - RNA, 19 nt, Homo sapiens
caucauggucauccuauag

SEQ ID NO: 1572250 - RNA, 19 nt, Homo sapiens
agaagaaucugcugaagua

SEQ ID NO: 1572251 - RNA, 19 nt, Homo sapiens
gaaaacaccuacccauaua

SEQ ID NO: 1572252 - RNA, 19 nt, Homo sapiens
gaaggaaggaucuacuuaa

SEQ ID NO: 1572253 - RNA, 19 nt, Homo sapiens
gcaaucuucuagcaguuua

SEQ ID NO: 1572254 - RNA, 19 nt, Homo sapiens
ggaaggaaggaucuacuua

SEQ ID NO: 1572255 - RNA, 19 nt, Homo sapiens
acaaugaacugacuaagga

SEQ ID NO: 1572256 - RNA, 19 nt, Homo sapiens
gcucaaguauccacugaaa

SEQ ID NO: 1572257 - RNA, 19 nt, Homo sapiens
aauuugagcuugaguauga

SEQ ID NO: 1572258 - RNA, 19 nt, Homo sapiens
ggaaggaucuacuuaaagc

SEQ ID NO: 1572259 - RNA, 19 nt, Homo sapiens
acccauauauucccauuua

SEQ ID NO: 1572260 - RNA, 19 nt, Homo sapiens
agaagaacauguaagauuc

SEQ ID NO: 1572261 - RNA, 19 nt, Homo sapiens
aaacaaccaugaaguucuu

SEQ ID NO: 1572262 - RNA, 19 nt, Homo sapiens
gaucugaauugugguauca

SEQ ID NO: 1572263 - RNA, 19 nt, Homo sapiens
ccacuggucuucuauuugg

SEQ ID NO: 1572264 - RNA, 19 nt, Homo sapiens
aaggaaggaucuacuuaaa

SEQ ID NO: 1572265 - RNA, 19 nt, Homo sapiens
guaguccacuggucuucua

SEQ ID NO: 1572266 - RNA, 19 nt, Homo sapiens
gcugaaguauucccugaga

SEQ ID NO: 1572267 - RNA, 19 nt, Homo sapiens
caagaagaaacugcaaaua

SEQ ID NO: 1572268 - RNA, 19 nt, Homo sapiens
cagcaucucccaagaagaa

SEQ ID NO: 1572269 - RNA, 19 nt, Homo sapiens
uaaagcacauggaaucuac

SEQ ID NO: 1572270 - RNA, 19 nt, Homo sapiens
ugaaaugucaacaguauug

SEQ ID NO: 1572271 - RNA, 19 nt, Homo sapiens
ccacaucaccuccuacuag

SEQ ID NO: 1572272 - RNA, 19 nt, Homo sapiens
gcaauuugagcuugaguau

SEQ ID NO: 1572273 - RNA, 19 nt, Homo sapiens
ggaaucugcucaaguaucc

SEQ ID NO: 1572274 - RNA, 19 nt, Homo sapiens
guccacuggucuucuauuu

SEQ ID NO: 1572275 - RNA, 19 nt, Homo sapiens
gcuugaguaugacuagaaa

SEQ ID NO: 1572276 - RNA, 19 nt, Homo sapiens
ccauuuagaagaacaugua

SEQ ID NO: 1572277 - RNA, 19 nt, Homo sapiens
ggaaaacaccuacccauau

SEQ ID NO: 1572278 - RNA, 19 nt, Homo sapiens
gaaacaaggaccaaacaac

SEQ ID NO: 1572279 - RNA, 19 nt, Homo sapiens
ucugaauugugguaucaua

SEQ ID NO: 1572280 - RNA, 19 nt, Homo sapiens
ggaaacaaggaccaaacaa

SEQ ID NO: 1572281 - RNA, 19 nt, Homo sapiens
cagcaucuaccaagaagaa

SEQ ID NO: 1572282 - RNA, 19 nt, Homo sapiens
aaacaccuacccauauauu

SEQ ID NO: 1572283 - RNA, 19 nt, Homo sapiens
ccaagaagaaucugcugaa

SEQ ID NO: 1572284 - RNA, 19 nt, Homo sapiens
ggauaugccagaucugaau

SEQ ID NO: 1572285 - RNA, 19 nt, Homo sapiens
caagaagaaucugcugaag

SEQ ID NO: 1572286 - RNA, 19 nt, Homo sapiens
ucuggcacaucaugagaua

SEQ ID NO: 1572287 - RNA, 19 nt, Homo sapiens
aagacuguguggaacauuu

SEQ ID NO: 1572288 - RNA, 19 nt, Homo sapiens
ccacuaucucugaaauaua

SEQ ID NO: 1572289 - RNA, 19 nt, Homo sapiens
gauacgaugcaaucuucua

SEQ ID NO: 1572290 - RNA, 19 nt, Homo sapiens
auaaagcacuccuccucuu

SEQ ID NO: 1572291 - RNA, 19 nt, Homo sapiens
uggcaugcuucuugaaaug

SEQ ID NO: 1572292 - RNA, 19 nt, Homo sapiens
ccaagaagaaacugcaaau

SEQ ID NO: 1572293 - RNA, 19 nt, Homo sapiens
ccauauauucccauuuaga

SEQ ID NO: 1572294 - RNA, 19 nt, Homo sapiens
uccacuaucucugaaauau

SEQ ID NO: 1572295 - RNA, 19 nt, Homo sapiens
gauaugccagaucugaauu

SEQ ID NO: 1572296 - RNA, 19 nt, Homo sapiens
auuaacugcugcaauuuga

SEQ ID NO: 1572297 - RNA, 19 nt, Homo sapiens
ccaaacaaccaugaaguuc

SEQ ID NO: 1572298 - RNA, 19 nt, Homo sapiens
ucuaugagccuguggaauc

SEQ ID NO: 1572299 - RNA, 19 nt, Homo sapiens
cuacuuaaagcacauggaa

SEQ ID NO: 1572300 - RNA, 19 nt, Homo sapiens
gagcuugaguaugacuaga

SEQ ID NO: 1572301 - RNA, 19 nt, Homo sapiens
caaacaaccaugaaguucu

SEQ ID NO: 1572302 - RNA, 19 nt, Homo sapiens
uggcacaucaugagauaaa

SEQ ID NO: 1572303 - RNA, 19 nt, Homo sapiens
gaccaaacaaccaugaagu

SEQ ID NO: 1572304 - RNA, 19 nt, Homo sapiens
ggaccaaacaaccaugaag

SEQ ID NO: 1572305 - RNA, 19 nt, Homo sapiens
aaauagauacgaugcaauc

SEQ ID NO: 1572306 - RNA, 19 nt, Homo sapiens
ucucugaaauauagaacug

SEQ ID NO: 1572307 - RNA, 19 nt, Homo sapiens
cuaccagcaucucccaaga

SEQ ID NO: 1572308 - RNA, 19 nt, Homo sapiens
ccagaucugaauuguggua

SEQ ID NO: 1572309 - RNA, 19 nt, Homo sapiens
gggaaacaaggaccaaaca

SEQ ID NO: 1572310 - RNA, 19 nt, Homo sapiens
gaacugacuaaggaaggaa

SEQ ID NO: 1572311 - RNA, 19 nt, Homo sapiens
gcaugcuucuugaaauguc

SEQ ID NO: 1572312 - RNA, 19 nt, Homo sapiens
cuacccauauauucccauu

SEQ ID NO: 1572313 - RNA, 19 nt, Homo sapiens
uggggaaucugcucaagua

SEQ ID NO: 1572314 - RNA, 19 nt, Homo sapiens
gccagcaucuaccaagaag

SEQ ID NO: 1572315 - RNA, 19 nt, Homo sapiens
caucaccuccuacuagcaa

SEQ ID NO: 1572316 - RNA, 19 nt, Homo sapiens
aagaaucugcugaaguauu

SEQ ID NO: 1572317 - RNA, 19 nt, Homo sapiens
ugaacugacuaaggaagga

SEQ ID NO: 1572318 - RNA, 19 nt, Homo sapiens
cuaugagccuguggaauca

SEQ ID NO: 1572319 - RNA, 19 nt, Homo sapiens
uaaagcacuccuccucuuc

SEQ ID NO: 1572320 - RNA, 19 nt, Homo sapiens
aaaagaagacuguguggaa

SEQ ID NO: 1572321 - RNA, 19 nt, Homo sapiens
gggaaucugcucaaguauc

SEQ ID NO: 1572322 - RNA, 19 nt, Homo sapiens
uuaaagcacauggaaucua

SEQ ID NO: 1572323 - RNA, 19 nt, Homo sapiens
aguauucccugagacgaaa

SEQ ID NO: 1572324 - RNA, 19 nt, Homo sapiens
gaagaaucugcugaaguau

SEQ ID NO: 1572325 - RNA, 19 nt, Homo sapiens
gaagacuguguggaacauu

SEQ ID NO: 1572326 - RNA, 19 nt, Homo sapiens
ucuaccacaucaccuccua

SEQ ID NO: 1572327 - RNA, 19 nt, Homo sapiens
ggucuucuauuugggaaac

SEQ ID NO: 1572328 - RNA, 19 nt, Homo sapiens
cugcucaaguauccacuga

SEQ ID NO: 1572329 - RNA, 19 nt, Homo sapiens
uaauuuguguuggauaugc

SEQ ID NO: 1572330 - RNA, 19 nt, Homo sapiens
gaaaacaaugaacugacua

SEQ ID NO: 1572331 - RNA, 19 nt, Homo sapiens
ucuccacuaucucugaaau

SEQ ID NO: 1572332 - RNA, 19 nt, Homo sapiens
ggaucuacuuaaagcacau

SEQ ID NO: 1572333 - RNA, 19 nt, Homo sapiens
gcucuggcacaucaugaga

SEQ ID NO: 1572334 - RNA, 19 nt, Homo sapiens
ucaccuccuacuagcaaua

SEQ ID NO: 1572335 - RNA, 19 nt, Homo sapiens
agaagacuguguggaacau

SEQ ID NO: 1572336 - RNA, 19 nt, Homo sapiens
acgaugcaaucuucuagca

SEQ ID NO: 1572337 - RNA, 19 nt, Homo sapiens
guauugagccaaaagaaga

SEQ ID NO: 1572338 - RNA, 19 nt, Homo sapiens
caacaguauugagccaaaa

SEQ ID NO: 1572339 - RNA, 19 nt, Homo sapiens
gaaggaucuacuuaaagca

SEQ ID NO: 1572340 - RNA, 19 nt, Homo sapiens
gaacaaauaugaggaugaa

SEQ ID NO: 1572341 - RNA, 19 nt, Homo sapiens
gaacaagguugaacugcaa

SEQ ID NO: 1572342 - RNA, 19 nt, Homo sapiens
ggaagcagcuacuccuaug

SEQ ID NO: 1572343 - RNA, 19 nt, Homo sapiens
ggaggcagcuggacaacau

SEQ ID NO: 1572344 - RNA, 19 nt, Homo sapiens
ucaagacccucaacaacaa

SEQ ID NO: 1572345 - RNA, 19 nt, Homo sapiens
ucacuucucucugucuaua

SEQ ID NO: 1572346 - RNA, 19 nt, Homo sapiens
gcaguuccaccaucaagua

SEQ ID NO: 1572347 - RNA, 19 nt, Homo sapiens
gcacagcagcagagaauga

SEQ ID NO: 1572348 - RNA, 19 nt, Homo sapiens
ggagauggcccucaaggau

SEQ ID NO: 1572349 - RNA, 19 nt, Homo sapiens
ggagguggcuucaguucca

SEQ ID NO: 1572350 - RNA, 19 nt, Homo sapiens
cagacacucucacagauga

SEQ ID NO: 1572351 - RNA, 19 nt, Homo sapiens
gaagagcuacaagcacuaa

SEQ ID NO: 1572352 - RNA, 19 nt, Homo sapiens
gaucgaccaugucaagaag

SEQ ID NO: 1572353 - RNA, 19 nt, Homo sapiens
gcagagaaugaauuuguga

SEQ ID NO: 1572354 - RNA, 19 nt, Homo sapiens
accaggagcugaugaaugu

SEQ ID NO: 1572355 - RNA, 19 nt, Homo sapiens
ggagauugcugagaucaac

SEQ ID NO: 1572356 - RNA, 19 nt, Homo sapiens
gaagaaggauguggaugcu

SEQ ID NO: 1572357 - RNA, 19 nt, Homo sapiens
caucaucgcugaggucaag

SEQ ID NO: 1572358 - RNA, 19 nt, Homo sapiens
cagcagagaaugaauuugu

SEQ ID NO: 1572359 - RNA, 19 nt, Homo sapiens
ucaaggaugcuaagaacaa

SEQ ID NO: 1572360 - RNA, 19 nt, Homo sapiens
cacuggagcuucacuuugu

SEQ ID NO: 1572361 - RNA, 19 nt, Homo sapiens
gcaggaagagcuacaagca

SEQ ID NO: 1572362 - RNA, 19 nt, Homo sapiens
gcaguggucuuggcauugg

SEQ ID NO: 1572363 - RNA, 19 nt, Homo sapiens
gcaggagauugcugagauc

SEQ ID NO: 1572364 - RNA, 19 nt, Homo sapiens
ucacagaugagaucaacuu

SEQ ID NO: 1572365 - RNA, 19 nt, Homo sapiens
gaucaagacccucaacaac

SEQ ID NO: 1572366 - RNA, 19 nt, Homo sapiens
gcgcacagcagcagagaau

SEQ ID NO: 1572367 - RNA, 19 nt, Homo sapiens
caaauaugaggaugaaauc

SEQ ID NO: 1572368 - RNA, 19 nt, Homo sapiens
gcugagaucaaccgcauga

SEQ ID NO: 1572369 - RNA, 19 nt, Homo sapiens
ggcagacacucucacagau

SEQ ID NO: 1572370 - RNA, 19 nt, Homo sapiens
agaaugaauuugugacucu

SEQ ID NO: 1572371 - RNA, 19 nt, Homo sapiens
guaguacaguccaccaucu

SEQ ID NO: 1572372 - RNA, 19 nt, Homo sapiens
gcagacacucucacagaug

SEQ ID NO: 1572373 - RNA, 19 nt, Homo sapiens
gaauuugugacucugaaga

SEQ ID NO: 1572374 - RNA, 19 nt, Homo sapiens
ccaagacugugaggcagaa

SEQ ID NO: 1572375 - RNA, 19 nt, Homo sapiens
cugcagagccgucuucuca

SEQ ID NO: 1572376 - RNA, 19 nt, Homo sapiens
augcagagcugucccagau

SEQ ID NO: 1572377 - RNA, 19 nt, Homo sapiens
ggaccucaagaacaaauau

SEQ ID NO: 1572378 - RNA, 19 nt, Homo sapiens
acaacaaguuugccuccuu

SEQ ID NO: 1572379 - RNA, 19 nt, Homo sapiens
ggaagagcuacaagcacua

SEQ ID NO: 1572380 - RNA, 19 nt, Homo sapiens
ccucaaggaugcuaagaac

SEQ ID NO: 1572381 - RNA, 19 nt, Homo sapiens
cugagagccuuguaugaug

SEQ ID NO: 1572382 - RNA, 19 nt, Homo sapiens
caaguuugccuccuucauc

SEQ ID NO: 1572383 - RNA, 19 nt, Homo sapiens
caagucaacgucucuguag

SEQ ID NO: 1572384 - RNA, 19 nt, Homo sapiens
cgaaggcauuggacaaguc

SEQ ID NO: 1572385 - RNA, 19 nt, Homo sapiens
gaugcugccuacaugaaca

SEQ ID NO: 1572386 - RNA, 19 nt, Homo sapiens
acaagguucuggacaccaa

SEQ ID NO: 1572387 - RNA, 19 nt, Homo sapiens
gaggagugcaggcugaaug

SEQ ID NO: 1572388 - RNA, 19 nt, Homo sapiens
cagaugagaucaacuuccu

SEQ ID NO: 1572389 - RNA, 19 nt, Homo sapiens
cagcagcagagaaugaauu

SEQ ID NO: 1572390 - RNA, 19 nt, Homo sapiens
caagaacaaauaugaggau

SEQ ID NO: 1572391 - RNA, 19 nt, Homo sapiens
uccaagaggucacugucaa

SEQ ID NO: 1572392 - RNA, 19 nt, Homo sapiens
ccacuggagcuucacuuug

SEQ ID NO: 1572393 - RNA, 19 nt, Homo sapiens
cauuggagguggcuucagu

SEQ ID NO: 1572394 - RNA, 19 nt, Homo sapiens
agucaacgucucuguagua

SEQ ID NO: 1572395 - RNA, 19 nt, Homo sapiens
gaaggcauuggacaaguca

SEQ ID NO: 1572396 - RNA, 19 nt, Homo sapiens
gcgaaggcauuggacaagu

SEQ ID NO: 1572397 - RNA, 19 nt, Homo sapiens
acacauccguggugcuauc

SEQ ID NO: 1572398 - RNA, 19 nt, Homo sapiens
ugagaucaacuuccugaga

SEQ ID NO: 1572399 - RNA, 19 nt, Homo sapiens
cggccuugcugguggcuuu

SEQ ID NO: 1572400 - RNA, 19 nt, Homo sapiens
gagcuacaagcacuaaagu

SEQ ID NO: 1572401 - RNA, 19 nt, Homo sapiens
uggcaguggucuuggcauu

SEQ ID NO: 1572402 - RNA, 19 nt, Homo sapiens
caaggaugcuaagaacaag

SEQ ID NO: 1572403 - RNA, 19 nt, Homo sapiens
ccucacuucucucugucua

SEQ ID NO: 1572404 - RNA, 19 nt, Homo sapiens
cagaggcagcuauggcuuu

SEQ ID NO: 1572405 - RNA, 19 nt, Homo sapiens
acaagucaacgucucugua

SEQ ID NO: 1572406 - RNA, 19 nt, Homo sapiens
ggguuucagugccaacuca

SEQ ID NO: 1572407 - RNA, 19 nt, Homo sapiens
gcacauccaccaccaucag

SEQ ID NO: 1572408 - RNA, 19 nt, Homo sapiens
ggucacagcaggcagacau

SEQ ID NO: 1572409 - RNA, 19 nt, Homo sapiens
agacacauccguggugcua

SEQ ID NO: 1572410 - RNA, 19 nt, Homo sapiens
acucggagcugagaaacau

SEQ ID NO: 1572411 - RNA, 19 nt, Homo sapiens
gagcgugagcagaucaaga

SEQ ID NO: 1572412 - RNA, 19 nt, Homo sapiens
ugagaucgaccaugucaag

SEQ ID NO: 1572413 - RNA, 19 nt, Homo sapiens
ggaccuggacagcaucauc

SEQ ID NO: 1572414 - RNA, 19 nt, Homo sapiens
agaggcagcuauggcuuug

SEQ ID NO: 1572415 - RNA, 19 nt, Homo sapiens
uguggaugcugccuacaug

SEQ ID NO: 1572416 - RNA, 19 nt, Homo sapiens
gacccucaacaacaaguuu

SEQ ID NO: 1572417 - RNA, 19 nt, Homo sapiens
accaucagaucaaccuuug

SEQ ID NO: 1572418 - RNA, 19 nt, Homo sapiens
caacaccaagcaggagauu

SEQ ID NO: 1572419 - RNA, 19 nt, Homo sapiens
uccaagaggaucuccauug

SEQ ID NO: 1572420 - RNA, 19 nt, Homo sapiens
caccaucagaucaaccuuu

SEQ ID NO: 1572421 - RNA, 19 nt, Homo sapiens
gggaguggauuugguuucg

SEQ ID NO: 1572422 - RNA, 19 nt, Homo sapiens
ggcggcaguuccaccauca

SEQ ID NO: 1572423 - RNA, 19 nt, Homo sapiens
caaggcagacacucucaca

SEQ ID NO: 1572424 - RNA, 19 nt, Homo sapiens
ccugagagccuuguaugau

SEQ ID NO: 1572425 - RNA, 19 nt, Homo sapiens
agagccgucuucucagguu

SEQ ID NO: 1572426 - RNA, 19 nt, Homo sapiens
gggagauggcccucaagga

SEQ ID NO: 1572427 - RNA, 19 nt, Homo sapiens
agaacaaauaugaggauga

SEQ ID NO: 1572428 - RNA, 19 nt, Homo sapiens
agguagagcuggguaugga

SEQ ID NO: 1572429 - RNA, 19 nt, Homo sapiens
cuccuggccucuagucuuc

SEQ ID NO: 1572430 - RNA, 19 nt, Homo sapiens
ccgaggagcgugagcagau

SEQ ID NO: 1572431 - RNA, 19 nt, Homo sapiens
aggcagacacucucacaga

SEQ ID NO: 1572432 - RNA, 19 nt, Homo sapiens
ucaggaggcagcuggacaa

SEQ ID NO: 1572433 - RNA, 19 nt, Homo sapiens
uagagcagcagaacaaggu

SEQ ID NO: 1572434 - RNA, 19 nt, Homo sapiens
cgacaaggugcgguuccua

SEQ ID NO: 1572435 - RNA, 19 nt, Homo sapiens
caccaucuccaguggcuau

SEQ ID NO: 1572436 - RNA, 19 nt, Homo sapiens
cccggcugcugaaggagua

SEQ ID NO: 1572437 - RNA, 19 nt, Homo sapiens
gaaccauggccagcacauc

SEQ ID NO: 1572438 - RNA, 19 nt, Homo sapiens
gagaucgaccaugucaaga

SEQ ID NO: 1572439 - RNA, 19 nt, Homo sapiens
gcaacaccaagcaggagau

SEQ ID NO: 1572440 - RNA, 19 nt, Homo sapiens
gcacguaucuaugaauaua

SEQ ID NO: 1572441 - RNA, 19 nt, Homo sapiens
cgaaagcaauuccaguuua

SEQ ID NO: 1572442 - RNA, 19 nt, Homo sapiens
gaaagucgauugguuguug

SEQ ID NO: 1572443 - RNA, 19 nt, Homo sapiens
uaaggaaagucgauugguu

SEQ ID NO: 1572444 - RNA, 19 nt, Homo sapiens
gaaagcaauuccaguuuac

SEQ ID NO: 1572445 - RNA, 19 nt, Homo sapiens
ucaguuuccucaucuguaa

SEQ ID NO: 1572446 - RNA, 19 nt, Homo sapiens
gaauucggauggauagauc

SEQ ID NO: 1572447 - RNA, 19 nt, Homo sapiens
ggacuucuuauaagcauuu

SEQ ID NO: 1572448 - RNA, 19 nt, Homo sapiens
aauuaaaccucaagucguu

SEQ ID NO: 1572449 - RNA, 19 nt, Homo sapiens
ugaauuguguagcauguga

SEQ ID NO: 1572450 - RNA, 19 nt, Homo sapiens
gggagugacugcugaugga

SEQ ID NO: 1572451 - RNA, 19 nt, Homo sapiens
gauaauguaugugcaagag

SEQ ID NO: 1572452 - RNA, 19 nt, Homo sapiens
ccaucgaauuguacacuuu

SEQ ID NO: 1572453 - RNA, 19 nt, Homo sapiens
caucgaauuguacacuuua

SEQ ID NO: 1572454 - RNA, 19 nt, Homo sapiens
cauguuggccugauaaugu

SEQ ID NO: 1572455 - RNA, 19 nt, Homo sapiens
uuagacaugugaauugugu

SEQ ID NO: 1572456 - RNA, 19 nt, Homo sapiens
uugcacguaucuaugaaua

SEQ ID NO: 1572457 - RNA, 19 nt, Homo sapiens
agacagaguuuccuuuuga

SEQ ID NO: 1572458 - RNA, 19 nt, Homo sapiens
uauaauuccucccaauaag

SEQ ID NO: 1572459 - RNA, 19 nt, Homo sapiens
cuauaauuccucccaauaa

SEQ ID NO: 1572460 - RNA, 19 nt, Homo sapiens
uuguguagcaugugaauua

SEQ ID NO: 1572461 - RNA, 19 nt, Homo sapiens
ugccugggcuggucucaaa

SEQ ID NO: 1572462 - RNA, 19 nt, Homo sapiens
gagccucaguuuccucauc

SEQ ID NO: 1572463 - RNA, 19 nt, Homo sapiens
gaugguugcacguaucuau

SEQ ID NO: 1572464 - RNA, 19 nt, Homo sapiens
gcugauggagacagaguuu

SEQ ID NO: 1572465 - RNA, 19 nt, Homo sapiens
gacuauaauuccucccaau

SEQ ID NO: 1572466 - RNA, 19 nt, Homo sapiens
gcagcagaguaccgacgaa

SEQ ID NO: 1572467 - RNA, 19 nt, Homo sapiens
aauaagggcucaaaacguu

SEQ ID NO: 1572468 - RNA, 19 nt, Homo sapiens
ggaauucggauggauagau

SEQ ID NO: 1572469 - RNA, 19 nt, Homo sapiens
gcugaugguugcacguauc

SEQ ID NO: 1572470 - RNA, 19 nt, Homo sapiens
gauggaugcaaugcucuua

SEQ ID NO: 1572471 - RNA, 19 nt, Homo sapiens
ggauggauagaucauguug

SEQ ID NO: 1572472 - RNA, 19 nt, Homo sapiens
acgaaaggauggaugcaau

SEQ ID NO: 1572473 - RNA, 19 nt, Homo sapiens
gcagaguaccgacgaaagg

SEQ ID NO: 1572474 - RNA, 19 nt, Homo sapiens
gcagagaugcagguauugu

SEQ ID NO: 1572475 - RNA, 19 nt, Homo sapiens
ucaaaacguugucuaagga

SEQ ID NO: 1572476 - RNA, 19 nt, Homo sapiens
gaauuguacacuuuagaca

SEQ ID NO: 1572477 - RNA, 19 nt, Homo sapiens
acuauaauuccucccaaua

SEQ ID NO: 1572478 - RNA, 19 nt, Homo sapiens
uggaugcaaugcucuuaug

SEQ ID NO: 1572479 - RNA, 19 nt, Homo sapiens
ggagacagaguuuccuuuu

SEQ ID NO: 1572480 - RNA, 19 nt, Homo sapiens
uguguagcaugugaauuaa

SEQ ID NO: 1572481 - RNA, 19 nt, Homo sapiens
cacgaaagcaauuccaguu

SEQ ID NO: 1572482 - RNA, 19 nt, Homo sapiens
gagacagaguuuccuuuug

SEQ ID NO: 1572483 - RNA, 19 nt, Homo sapiens
ucggauggauagaucaugu

SEQ ID NO: 1572484 - RNA, 19 nt, Homo sapiens
uguagcaugugaauuaaac

SEQ ID NO: 1572485 - RNA, 19 nt, Homo sapiens
aaaccucaagucguuauuu

SEQ ID NO: 1572486 - RNA, 19 nt, Homo sapiens
gguugcacguaucuaugaa

SEQ ID NO: 1572487 - RNA, 19 nt, Homo sapiens
gaaaggauggaugcaaugc

SEQ ID NO: 1572488 - RNA, 19 nt, Homo sapiens
cgaaaggauggaugcaaug

SEQ ID NO: 1572489 - RNA, 19 nt, Homo sapiens
augcagguauugucauguu

SEQ ID NO: 1572490 - RNA, 19 nt, Homo sapiens
ggaaagucgauugguuguu

SEQ ID NO: 1572491 - RNA, 19 nt, Homo sapiens
agaugcagguauugucaug

SEQ ID NO: 1572492 - RNA, 19 nt, Homo sapiens
auuguacacuuuagacaug

SEQ ID NO: 1572493 - RNA, 19 nt, Homo sapiens
ccacgucccaaacuggauu

SEQ ID NO: 1572494 - RNA, 19 nt, Homo sapiens
caugugaauuaaaccucaa

SEQ ID NO: 1572495 - RNA, 19 nt, Homo sapiens
ugaugagaauguccugaag

SEQ ID NO: 1572496 - RNA, 19 nt, Homo sapiens
acgaaagcaauuccaguuu

SEQ ID NO: 1572497 - RNA, 19 nt, Homo sapiens
acaugugaauuguguagca

SEQ ID NO: 1572498 - RNA, 19 nt, Homo sapiens
guacacuuuagacauguga

SEQ ID NO: 1572499 - RNA, 19 nt, Homo sapiens
auguuggccugauaaugua

SEQ ID NO: 1572500 - RNA, 19 nt, Homo sapiens
ccucaagucguuauuuuaa

SEQ ID NO: 1572501 - RNA, 19 nt, Homo sapiens
ugugaauuguguagcaugu

SEQ ID NO: 1572502 - RNA, 19 nt, Homo sapiens
ucaaacuccuggguucaag

SEQ ID NO: 1572503 - RNA, 19 nt, Homo sapiens
gacgaaaggauggaugcaa

SEQ ID NO: 1572504 - RNA, 19 nt, Homo sapiens
gaauuguguagcaugugaa

SEQ ID NO: 1572505 - RNA, 19 nt, Homo sapiens
uguaacaagggcagaaaug

SEQ ID NO: 1572506 - RNA, 19 nt, Homo sapiens
ggauggaugcaaugcucuu

SEQ ID NO: 1572507 - RNA, 19 nt, Homo sapiens
cagcagaguaccgacgaaa

SEQ ID NO: 1572508 - RNA, 19 nt, Homo sapiens
gcaauaccaucaucacuuu

SEQ ID NO: 1572509 - RNA, 19 nt, Homo sapiens
gagauguuguccucaguua

SEQ ID NO: 1572510 - RNA, 19 nt, Homo sapiens
ccaaugaucccaacuguaa

SEQ ID NO: 1572511 - RNA, 19 nt, Homo sapiens
ggaaacaaccucagacuca

SEQ ID NO: 1572512 - RNA, 19 nt, Homo sapiens
cagaauacguguuuaaagu

SEQ ID NO: 1572513 - RNA, 19 nt, Homo sapiens
caaguucucuuuccacaau

SEQ ID NO: 1572514 - RNA, 19 nt, Homo sapiens
cagcgaagcuccuccaugu

SEQ ID NO: 1572515 - RNA, 19 nt, Homo sapiens
gcaacaggcgcaucgcuua

SEQ ID NO: 1572516 - RNA, 19 nt, Homo sapiens
ggagcucuguggacaaauu

SEQ ID NO: 1572517 - RNA, 19 nt, Homo sapiens
gaaaagagaucagaaaugg

SEQ ID NO: 1572518 - RNA, 19 nt, Homo sapiens
ggacaaauucgggacauaa

SEQ ID NO: 1572519 - RNA, 19 nt, Homo sapiens
caagagcugccaagguuua

SEQ ID NO: 1572520 - RNA, 19 nt, Homo sapiens
cccaagagcugccaagguu

SEQ ID NO: 1572521 - RNA, 19 nt, Homo sapiens
gauaaugaccuaauggaau

SEQ ID NO: 1572522 - RNA, 19 nt, Homo sapiens
ucaaagcaguccgauauga

SEQ ID NO: 1572523 - RNA, 19 nt, Homo sapiens
agacauauacacacacaua

SEQ ID NO: 1572524 - RNA, 19 nt, Homo sapiens
guucaaagcaguccgauau

SEQ ID NO: 1572525 - RNA, 19 nt, Homo sapiens
caucaucacuuuccacaag

SEQ ID NO: 1572526 - RNA, 19 nt, Homo sapiens
gagauggaauucuaugaag

SEQ ID NO: 1572527 - RNA, 19 nt, Homo sapiens
gccaacuucuugcaacuuu

SEQ ID NO: 1572528 - RNA, 19 nt, Homo sapiens
caaaguagacauauacaca

SEQ ID NO: 1572529 - RNA, 19 nt, Homo sapiens
gaaacaaccucagacucau

SEQ ID NO: 1572530 - RNA, 19 nt, Homo sapiens
cauaacagccaacuucuug

SEQ ID NO: 1572531 - RNA, 19 nt, Homo sapiens
cagcaacacugacaagaag

SEQ ID NO: 1572532 - RNA, 19 nt, Homo sapiens
cgagauggauggucugauc

SEQ ID NO: 1572533 - RNA, 19 nt, Homo sapiens
gcgaagcuccuccauguug

SEQ ID NO: 1572534 - RNA, 19 nt, Homo sapiens
gcacucagaaacaaugauu

SEQ ID NO: 1572535 - RNA, 19 nt, Homo sapiens
gcaguccgauaugaaauug

SEQ ID NO: 1572536 - RNA, 19 nt, Homo sapiens
gagcacggcuaccucaagu

SEQ ID NO: 1572537 - RNA, 19 nt, Homo sapiens
ccagguggaugaaguaaag

SEQ ID NO: 1572538 - RNA, 19 nt, Homo sapiens
ggaagaaccgagcuaagug

SEQ ID NO: 1572539 - RNA, 19 nt, Homo sapiens
aagagaagaucaucaugga

SEQ ID NO: 1572540 - RNA, 19 nt, Homo sapiens
uaaacuacgugcccuugga

SEQ ID NO: 1572541 - RNA, 19 nt, Homo sapiens
ucagacucaucacaaagua

SEQ ID NO: 1572542 - RNA, 19 nt, Homo sapiens
uccaugaccucucagcuuu

SEQ ID NO: 1572543 - RNA, 19 nt, Homo sapiens
ggagugauaucugcaaggu

SEQ ID NO: 1572544 - RNA, 19 nt, Homo sapiens
uuacaaccaugaaagugaa

SEQ ID NO: 1572545 - RNA, 19 nt, Homo sapiens
gaacaggacgagaagaucu

SEQ ID NO: 1572546 - RNA, 19 nt, Homo sapiens
guagacauauacacacaca

SEQ ID NO: 1572547 - RNA, 19 nt, Homo sapiens
gaaagagaagaucaucaug

SEQ ID NO: 1572548 - RNA, 19 nt, Homo sapiens
caaagcaguccgauaugaa

SEQ ID NO: 1572549 - RNA, 19 nt, Homo sapiens
gauguuguccucaguuaug

SEQ ID NO: 1572550 - RNA, 19 nt, Homo sapiens
ugauagcaguauucuggua

SEQ ID NO: 1572551 - RNA, 19 nt, Homo sapiens
ccacagggcccaagaaggu

SEQ ID NO: 1572552 - RNA, 19 nt, Homo sapiens
cagacggccucuacaccua

SEQ ID NO: 1572553 - RNA, 19 nt, Homo sapiens
ucacaaaguagacauauac

SEQ ID NO: 1572554 - RNA, 19 nt, Homo sapiens
ccugggcaauggagugaua

SEQ ID NO: 1572555 - RNA, 19 nt, Homo sapiens
agacaaauguuuccaugac

SEQ ID NO: 1572556 - RNA, 19 nt, Homo sapiens
gggaagaaccgagcuaagu

SEQ ID NO: 1572557 - RNA, 19 nt, Homo sapiens
ccaaggaagcccugaagga

SEQ ID NO: 1572558 - RNA, 19 nt, Homo sapiens
cuaauggaauucaacaucu

SEQ ID NO: 1572559 - RNA, 19 nt, Homo sapiens
ggccaaugaucccaacugu

SEQ ID NO: 1572560 - RNA, 19 nt, Homo sapiens
aaaguuagagccaucaaug

SEQ ID NO: 1572561 - RNA, 19 nt, Homo sapiens
ccaugaaagugaacgagau

SEQ ID NO: 1572562 - RNA, 19 nt, Homo sapiens
acaaauugcucugcaccuu

SEQ ID NO: 1572563 - RNA, 19 nt, Homo sapiens
gucauuacuucuccuccua

SEQ ID NO: 1572564 - RNA, 19 nt, Homo sapiens
ccaggaaggucacuuucag

SEQ ID NO: 1572565 - RNA, 19 nt, Homo sapiens
agaugcagcugcccgagaa

SEQ ID NO: 1572566 - RNA, 19 nt, Homo sapiens
ccucauaacagccaacuuc

SEQ ID NO: 1572567 - RNA, 19 nt, Homo sapiens
ugagauggaauucuaugaa

SEQ ID NO: 1572568 - RNA, 19 nt, Homo sapiens
gaaagugaacgagauggau

SEQ ID NO: 1572569 - RNA, 19 nt, Homo sapiens
guuacaaccaugaaaguga

SEQ ID NO: 1572570 - RNA, 19 nt, Homo sapiens
gaucaucauggagcagaua

SEQ ID NO: 1572571 - RNA, 19 nt, Homo sapiens
ccucucagcuuuccaacag

SEQ ID NO: 1572572 - RNA, 19 nt, Homo sapiens
ggaggccggugguaaucau

SEQ ID NO: 1572573 - RNA, 19 nt, Homo sapiens
gcaaccagcacauauacca

SEQ ID NO: 1572574 - RNA, 19 nt, Homo sapiens
aaagcaguccgauaugaaa

SEQ ID NO: 1572575 - RNA, 19 nt, Homo sapiens
gcgauacccagguggauga

SEQ ID NO: 1572576 - RNA, 19 nt, Homo sapiens
ggccggugguaaucaugua

SEQ ID NO: 1572577 - RNA, 19 nt, Homo sapiens
gcugugaaguccucauaac

SEQ ID NO: 1572578 - RNA, 19 nt, Homo sapiens
ccacaacugguacucauuc

SEQ ID NO: 1572579 - RNA, 19 nt, Homo sapiens
ggacaccagcugugaaguc

SEQ ID NO: 1572580 - RNA, 19 nt, Homo sapiens
ucauggagcagauagagaa

SEQ ID NO: 1572581 - RNA, 19 nt, Homo sapiens
aaauggcuuucucaaguug

SEQ ID NO: 1572582 - RNA, 19 nt, Homo sapiens
gaacuucuucauccucauc

SEQ ID NO: 1572583 - RNA, 19 nt, Homo sapiens
ggaugaaguaaagucaaua

SEQ ID NO: 1572584 - RNA, 19 nt, Homo sapiens
uuacuucuccuccuaacaa

SEQ ID NO: 1572585 - RNA, 19 nt, Homo sapiens
cggcugcacucaauaaacu

SEQ ID NO: 1572586 - RNA, 19 nt, Homo sapiens
ccaggcagaaggaaauuga

SEQ ID NO: 1572587 - RNA, 19 nt, Homo sapiens
gagaaagagaagaucauca

SEQ ID NO: 1572588 - RNA, 19 nt, Homo sapiens
uggaugaaguaaagucaau

SEQ ID NO: 1572589 - RNA, 19 nt, Homo sapiens
cuaacaacguacaaaugga

SEQ ID NO: 1572590 - RNA, 19 nt, Homo sapiens
ggagaaagagaagaucauc

SEQ ID NO: 1572591 - RNA, 19 nt, Homo sapiens
ucaccacauucuucaagga

SEQ ID NO: 1572592 - RNA, 19 nt, Homo sapiens
gcugaagaauauccagucu

SEQ ID NO: 1572593 - RNA, 19 nt, Homo sapiens
gauggaauucuaugaaguc

SEQ ID NO: 1572594 - RNA, 19 nt, Homo sapiens
acaaggaggcaaagcgaaa

SEQ ID NO: 1572595 - RNA, 19 nt, Homo sapiens
auccauaccuccuccaaga

SEQ ID NO: 1572596 - RNA, 19 nt, Homo sapiens
caguuaugcuccugucugu

SEQ ID NO: 1572597 - RNA, 19 nt, Homo sapiens
gcuccuccauguuguccuu

SEQ ID NO: 1572598 - RNA, 19 nt, Homo sapiens
cuacgugcccuuggacuuu

SEQ ID NO: 1572599 - RNA, 19 nt, Homo sapiens
gguagaggaggcaucaaga

SEQ ID NO: 1572600 - RNA, 19 nt, Homo sapiens
agaaagagaagaucaucau

SEQ ID NO: 1572601 - RNA, 19 nt, Homo sapiens
ccagccgcaucaucgagua

SEQ ID NO: 1572602 - RNA, 19 nt, Homo sapiens
gacaaauucgggacauaau

SEQ ID NO: 1572603 - RNA, 19 nt, Homo sapiens
cagcugugaaguccucaua

SEQ ID NO: 1572604 - RNA, 19 nt, Homo sapiens
gcagcuuccacaacuggua

SEQ ID NO: 1572605 - RNA, 19 nt, Homo sapiens
cgaagcuccuccauguugu

SEQ ID NO: 1572606 - RNA, 19 nt, Homo sapiens
caacuucuugcaacuuuca

SEQ ID NO: 1572607 - RNA, 19 nt, Homo sapiens
ugucugugcugcaaguuca

SEQ ID NO: 1572608 - RNA, 19 nt, Homo sapiens
gaauuaagcuccuugcaaa

SEQ ID NO: 1572609 - RNA, 19 nt, Homo sapiens
caagggauuucuuccaaua

SEQ ID NO: 1572610 - RNA, 19 nt, Homo sapiens
ggagagaggcgaccacuuu

SEQ ID NO: 1572611 - RNA, 19 nt, Homo sapiens
gcucugcuguacauaguua

SEQ ID NO: 1572612 - RNA, 19 nt, Homo sapiens
guacuaacauucaacuugu

SEQ ID NO: 1572613 - RNA, 19 nt, Homo sapiens
gcaauuaggacucaaagug

SEQ ID NO: 1572614 - RNA, 19 nt, Homo sapiens
ggaaagaguugcuguuagc

SEQ ID NO: 1572615 - RNA, 19 nt, Homo sapiens
gcaaaguucggguguguuu

SEQ ID NO: 1572616 - RNA, 19 nt, Homo sapiens
gaaaagaucuaugaacuuc

SEQ ID NO: 1572617 - RNA, 19 nt, Homo sapiens
agucaacgcuaacacauuu

SEQ ID NO: 1572618 - RNA, 19 nt, Homo sapiens
guaaccaccucagccauaa

SEQ ID NO: 1572619 - RNA, 19 nt, Homo sapiens
gacagcacguccacaguuu

SEQ ID NO: 1572620 - RNA, 19 nt, Homo sapiens
ugacagcacacaaaucuuu

SEQ ID NO: 1572621 - RNA, 19 nt, Homo sapiens
gcccuucacuugguuagua

SEQ ID NO: 1572622 - RNA, 19 nt, Homo sapiens
gcagugcacucagaacuuc

SEQ ID NO: 1572623 - RNA, 19 nt, Homo sapiens
aauaauaucccuccuguga

SEQ ID NO: 1572624 - RNA, 19 nt, Homo sapiens
guauuaugcuaccaaagaa

SEQ ID NO: 1572625 - RNA, 19 nt, Homo sapiens
ccaaaggcuuagaguggua

SEQ ID NO: 1572626 - RNA, 19 nt, Homo sapiens
aaccugauguuucugauuu

SEQ ID NO: 1572627 - RNA, 19 nt, Homo sapiens
gcaagggauuucuuccaau

SEQ ID NO: 1572628 - RNA, 19 nt, Homo sapiens
cgcagcagaugaugaagua

SEQ ID NO: 1572629 - RNA, 19 nt, Homo sapiens
gagauuguguggguuucua

SEQ ID NO: 1572630 - RNA, 19 nt, Homo sapiens
ggagggagagugaagagaa

SEQ ID NO: 1572631 - RNA, 19 nt, Homo sapiens
ugacuucacucuaauuguc

SEQ ID NO: 1572632 - RNA, 19 nt, Homo sapiens
ggauauaauugacuucacu

SEQ ID NO: 1572633 - RNA, 19 nt, Homo sapiens
uaauugcacucuguaaaga

SEQ ID NO: 1572634 - RNA, 19 nt, Homo sapiens
gaugaaguaauaggaguua

SEQ ID NO: 1572635 - RNA, 19 nt, Homo sapiens
gaagaaaaucuacacagua

SEQ ID NO: 1572636 - RNA, 19 nt, Homo sapiens
gaacauuaucugcuuaugg

SEQ ID NO: 1572637 - RNA, 19 nt, Homo sapiens
gcuagugccugcucacaca

SEQ ID NO: 1572638 - RNA, 19 nt, Homo sapiens
gcacugacagcacacaaau

SEQ ID NO: 1572639 - RNA, 19 nt, Homo sapiens
guccuuugcugauugguuu

SEQ ID NO: 1572640 - RNA, 19 nt, Homo sapiens
ggaauguaaaugccucuuu

SEQ ID NO: 1572641 - RNA, 19 nt, Homo sapiens
gcacucagaacuucacugu

SEQ ID NO: 1572642 - RNA, 19 nt, Homo sapiens
cugcucauaugaauuauug

SEQ ID NO: 1572643 - RNA, 19 nt, Homo sapiens
ugaguuuccuuagugauuu

SEQ ID NO: 1572644 - RNA, 19 nt, Homo sapiens
gaagaggagaguaaugcaa

SEQ ID NO: 1572645 - RNA, 19 nt, Homo sapiens
aacauuaucugcuuaugga

SEQ ID NO: 1572646 - RNA, 19 nt, Homo sapiens
acucagaacuucacuguac

SEQ ID NO: 1572647 - RNA, 19 nt, Homo sapiens
gugaacauuuacaaaguug

SEQ ID NO: 1572648 - RNA, 19 nt, Homo sapiens
aaacauuucuaacccgaau

SEQ ID NO: 1572649 - RNA, 19 nt, Homo sapiens
gacccucuguggaaacauu

SEQ ID NO: 1572650 - RNA, 19 nt, Homo sapiens
gugacuagccugccuuuga

SEQ ID NO: 1572651 - RNA, 19 nt, Homo sapiens
guacaaggaggaacacuag

SEQ ID NO: 1572652 - RNA, 19 nt, Homo sapiens
uuaaguagcucugcuguac

SEQ ID NO: 1572653 - RNA, 19 nt, Homo sapiens
guaauaggaguuaguguca

SEQ ID NO: 1572654 - RNA, 19 nt, Homo sapiens
ucacucuaauugucaugua

SEQ ID NO: 1572655 - RNA, 19 nt, Homo sapiens
aaagaucuaugaacuucug

SEQ ID NO: 1572656 - RNA, 19 nt, Homo sapiens
ggaguuagugucaguguuc

SEQ ID NO: 1572657 - RNA, 19 nt, Homo sapiens
gaaguaauaggaguuagug

SEQ ID NO: 1572658 - RNA, 19 nt, Homo sapiens
gcaggaaguuaaaucucau

SEQ ID NO: 1572659 - RNA, 19 nt, Homo sapiens
gacagcacacaaaucuuua

SEQ ID NO: 1572660 - RNA, 19 nt, Homo sapiens
gggcagggccaucugaaga

SEQ ID NO: 1572661 - RNA, 19 nt, Homo sapiens
gaacuucugccccacauaa

SEQ ID NO: 1572662 - RNA, 19 nt, Homo sapiens
agcagaugaugaaguaaua

SEQ ID NO: 1572663 - RNA, 19 nt, Homo sapiens
aagaauaucagauccaguu

SEQ ID NO: 1572664 - RNA, 19 nt, Homo sapiens
gcgcaucaaaucugaagaa

SEQ ID NO: 1572665 - RNA, 19 nt, Homo sapiens
gaacacuagcuuggagaaa

SEQ ID NO: 1572666 - RNA, 19 nt, Homo sapiens
agccgaugcuggucaauuu

SEQ ID NO: 1572667 - RNA, 19 nt, Homo sapiens
uaauaucccuccugugacu

SEQ ID NO: 1572668 - RNA, 19 nt, Homo sapiens
gagacuugaggcuacuuua

SEQ ID NO: 1572669 - RNA, 19 nt, Homo sapiens
aaagggcagugcacucaga

SEQ ID NO: 1572670 - RNA, 19 nt, Homo sapiens
gagacuagcucagaauacg

SEQ ID NO: 1572671 - RNA, 19 nt, Homo sapiens
ccacuuagggcuuucuuuc

SEQ ID NO: 1572672 - RNA, 19 nt, Homo sapiens
gagugcgcaucaaaucuga

SEQ ID NO: 1572673 - RNA, 19 nt, Homo sapiens
cauggagacuagcucagaa

SEQ ID NO: 1572674 - RNA, 19 nt, Homo sapiens
ucauguaggugcaggaagu

SEQ ID NO: 1572675 - RNA, 19 nt, Homo sapiens
ugaauuaagcuccuugcaa

SEQ ID NO: 1572676 - RNA, 19 nt, Homo sapiens
ugacuagccugccuuugag

SEQ ID NO: 1572677 - RNA, 19 nt, Homo sapiens
auaguuggauugcauaaca

SEQ ID NO: 1572678 - RNA, 19 nt, Homo sapiens
gagggagagugaagagaag

SEQ ID NO: 1572679 - RNA, 19 nt, Homo sapiens
gguggcguauggaagauga

SEQ ID NO: 1572680 - RNA, 19 nt, Homo sapiens
uaucagauccaguuagcaa

SEQ ID NO: 1572681 - RNA, 19 nt, Homo sapiens
gccauaauacuuaccauca

SEQ ID NO: 1572682 - RNA, 19 nt, Homo sapiens
uaauuccucuugcaguguu

SEQ ID NO: 1572683 - RNA, 19 nt, Homo sapiens
ugaauuauugggauuguug

SEQ ID NO: 1572684 - RNA, 19 nt, Homo sapiens
uuaagcuccuugcaaaguu

SEQ ID NO: 1572685 - RNA, 19 nt, Homo sapiens
cacuauguguuuguagaua

SEQ ID NO: 1572686 - RNA, 19 nt, Homo sapiens
uguauuaugcuaccaaaga

SEQ ID NO: 1572687 - RNA, 19 nt, Homo sapiens
gaacuuugagugcauucug

SEQ ID NO: 1572688 - RNA, 19 nt, Homo sapiens
gagagaggcgaccacuuug

SEQ ID NO: 1572689 - RNA, 19 nt, Homo sapiens
gaugggcaauuaggacuca

SEQ ID NO: 1572690 - RNA, 19 nt, Homo sapiens
gaauaucagauccaguuag

SEQ ID NO: 1572691 - RNA, 19 nt, Homo sapiens
ccagucggcuuuggaguca

SEQ ID NO: 1572692 - RNA, 19 nt, Homo sapiens
ccugauguuucugauuuaa

SEQ ID NO: 1572693 - RNA, 19 nt, Homo sapiens
uggauugcauaacaugaaa

SEQ ID NO: 1572694 - RNA, 19 nt, Homo sapiens
auaccacacuguacaagga

SEQ ID NO: 1572695 - RNA, 19 nt, Homo sapiens
ccuuugagauguaguuauc

SEQ ID NO: 1572696 - RNA, 19 nt, Homo sapiens
ccauaauacuuaccaucau

SEQ ID NO: 1572697 - RNA, 19 nt, Homo sapiens
ugcaggaaguuaaaucuca

SEQ ID NO: 1572698 - RNA, 19 nt, Homo sapiens
gggauuucuuccaauagga

SEQ ID NO: 1572699 - RNA, 19 nt, Homo sapiens
acacuagcuuggagaaauc

SEQ ID NO: 1572700 - RNA, 19 nt, Homo sapiens
cgaagccgaugcuggucaa

SEQ ID NO: 1572701 - RNA, 19 nt, Homo sapiens
agacuugaggcuacuuuaa

SEQ ID NO: 1572702 - RNA, 19 nt, Homo sapiens
gcagggccaucugaagaca

SEQ ID NO: 1572703 - RNA, 19 nt, Homo sapiens
caaaggguggcguauggaa

SEQ ID NO: 1572704 - RNA, 19 nt, Homo sapiens
ggaacacuagcuuggagaa

SEQ ID NO: 1572705 - RNA, 19 nt, Homo sapiens
ugacaauacugcuuuugaa

SEQ ID NO: 1572706 - RNA, 19 nt, Homo sapiens
gcauaaucgugacaauacu

SEQ ID NO: 1572707 - RNA, 19 nt, Homo sapiens
auacuuaccaucauagguu

SEQ ID NO: 1572708 - RNA, 19 nt, Homo sapiens
ggacgaccguguauaguuu

SEQ ID NO: 1572709 - RNA, 19 nt, Homo sapiens
cagagaagaugacauuaaa

SEQ ID NO: 1572710 - RNA, 19 nt, Homo sapiens
gauguaaagucuccuauuc

SEQ ID NO: 1572711 - RNA, 19 nt, Homo sapiens
ucacucagcuuuaacaguu

SEQ ID NO: 1572712 - RNA, 19 nt, Homo sapiens
ggaauauucuucugugugu

SEQ ID NO: 1572713 - RNA, 19 nt, Homo sapiens
guagacaacggaaauauuu

SEQ ID NO: 1572714 - RNA, 19 nt, Homo sapiens
gcagagaagaugacauuaa

SEQ ID NO: 1572715 - RNA, 19 nt, Homo sapiens
gugcaaccuuccuaaauaa

SEQ ID NO: 1572716 - RNA, 19 nt, Homo sapiens
caacggaaauauuuaugug

SEQ ID NO: 1572717 - RNA, 19 nt, Homo sapiens
gcacaacuguuuaaaauuc

SEQ ID NO: 1572718 - RNA, 19 nt, Homo sapiens
gagccaauguucuuugaau

SEQ ID NO: 1572719 - RNA, 19 nt, Homo sapiens
ugugcaaccuuccuaaaua

SEQ ID NO: 1572720 - RNA, 19 nt, Homo sapiens
gagaauaucaugcuaugga

SEQ ID NO: 1572721 - RNA, 19 nt, Homo sapiens
gguuugggauguucuguuu

SEQ ID NO: 1572722 - RNA, 19 nt, Homo sapiens
caugagagauguaaagucu

SEQ ID NO: 1572723 - RNA, 19 nt, Homo sapiens
gggagaauaucaugcuaug

SEQ ID NO: 1572724 - RNA, 19 nt, Homo sapiens
uggcaugucuaguucauuu

SEQ ID NO: 1572725 - RNA, 19 nt, Homo sapiens
gaaggucuguaccagucua

SEQ ID NO: 1572726 - RNA, 19 nt, Homo sapiens
gggcagagaagaugacauu

SEQ ID NO: 1572727 - RNA, 19 nt, Homo sapiens
gaaagaaugacagcuguug

SEQ ID NO: 1572728 - RNA, 19 nt, Homo sapiens
aggaggaccuuuacauuug

SEQ ID NO: 1572729 - RNA, 19 nt, Homo sapiens
ugauguagcagacuuaauu

SEQ ID NO: 1572730 - RNA, 19 nt, Homo sapiens
caggaggaccuuuacauuu

SEQ ID NO: 1572731 - RNA, 19 nt, Homo sapiens
uaucugagcaugaaucuug

SEQ ID NO: 1572732 - RNA, 19 nt, Homo sapiens
gaacugugcaaccuuccua

SEQ ID NO: 1572733 - RNA, 19 nt, Homo sapiens
cuauggauauucgcuguua

SEQ ID NO: 1572734 - RNA, 19 nt, Homo sapiens
cuaaagauccaucagcaaa

SEQ ID NO: 1572735 - RNA, 19 nt, Homo sapiens
ccacucaggaggaccuuua

SEQ ID NO: 1572736 - RNA, 19 nt, Homo sapiens
ccaaaggaauaaagcaaag

SEQ ID NO: 1572737 - RNA, 19 nt, Homo sapiens
ugggagauauagaggauuu

SEQ ID NO: 1572738 - RNA, 19 nt, Homo sapiens
uuugcuaccucuccuauuu

SEQ ID NO: 1572739 - RNA, 19 nt, Homo sapiens
gcucagcugucaucucagu

SEQ ID NO: 1572740 - RNA, 19 nt, Homo sapiens
gguuauagguuugggaugu

SEQ ID NO: 1572741 - RNA, 19 nt, Homo sapiens
cugcugaacuugaaaauaa

SEQ ID NO: 1572742 - RNA, 19 nt, Homo sapiens
ggucuguaccagucuauaa

SEQ ID NO: 1572743 - RNA, 19 nt, Homo sapiens
gaaguaaggaagccagaca

SEQ ID NO: 1572744 - RNA, 19 nt, Homo sapiens
uaucagcauucuuccauuc

SEQ ID NO: 1572745 - RNA, 19 nt, Homo sapiens
uuugggauguucuguuuaa

SEQ ID NO: 1572746 - RNA, 19 nt, Homo sapiens
ggaggaccuuuacauuugg

SEQ ID NO: 1572747 - RNA, 19 nt, Homo sapiens
gcuguuggcaugucuaguu

SEQ ID NO: 1572748 - RNA, 19 nt, Homo sapiens
cagcauucuuccauucuug

SEQ ID NO: 1572749 - RNA, 19 nt, Homo sapiens
auaaugaacuuccaucacu

SEQ ID NO: 1572750 - RNA, 19 nt, Homo sapiens
gauggacgaccguguauag

SEQ ID NO: 1572751 - RNA, 19 nt, Homo sapiens
gugagccaauguucuuuga

SEQ ID NO: 1572752 - RNA, 19 nt, Homo sapiens
caucaggaucaauagaaua

SEQ ID NO: 1572753 - RNA, 19 nt, Homo sapiens
acuguuaagugaucuguga

SEQ ID NO: 1572754 - RNA, 19 nt, Homo sapiens
aggcagaucuugaaguaag

SEQ ID NO: 1572755 - RNA, 19 nt, Homo sapiens
gacaguagacaacggaaau

SEQ ID NO: 1572756 - RNA, 19 nt, Homo sapiens
ucaggaggaccuuuacauu

SEQ ID NO: 1572757 - RNA, 19 nt, Homo sapiens
cuaccucuccuauuugauu

SEQ ID NO: 1572758 - RNA, 19 nt, Homo sapiens
gauagagaaguggucauuu

SEQ ID NO: 1572759 - RNA, 19 nt, Homo sapiens
ugauggcucugcacaagau

SEQ ID NO: 1572760 - RNA, 19 nt, Homo sapiens
ggaguaaacaaauaauagg

SEQ ID NO: 1572761 - RNA, 19 nt, Homo sapiens
uuuaagagcacacauacuu

SEQ ID NO: 1572762 - RNA, 19 nt, Homo sapiens
cauaggcacaacuguuuaa

SEQ ID NO: 1572763 - RNA, 19 nt, Homo sapiens
ucagugagccaauguucuu

SEQ ID NO: 1572764 - RNA, 19 nt, Homo sapiens
ucaucucagugaccaguuu

SEQ ID NO: 1572765 - RNA, 19 nt, Homo sapiens
aaagucuccuauucaguga

SEQ ID NO: 1572766 - RNA, 19 nt, Homo sapiens
uaaggauuaucaucaggau

SEQ ID NO: 1572767 - RNA, 19 nt, Homo sapiens
gcaaccuuccuaaauaaca

SEQ ID NO: 1572768 - RNA, 19 nt, Homo sapiens
ucaucaggaucaauagaau

SEQ ID NO: 1572769 - RNA, 19 nt, Homo sapiens
caaguggugcuccaaagga

SEQ ID NO: 1572770 - RNA, 19 nt, Homo sapiens
uauaaacccuaaagaucca

SEQ ID NO: 1572771 - RNA, 19 nt, Homo sapiens
ucuauaaacccuaaagauc

SEQ ID NO: 1572772 - RNA, 19 nt, Homo sapiens
acaguuaucagcauucuuc

SEQ ID NO: 1572773 - RNA, 19 nt, Homo sapiens
uuccaucacucagcuuuaa

SEQ ID NO: 1572774 - RNA, 19 nt, Homo sapiens
caggaucaauagaauacau

SEQ ID NO: 1572775 - RNA, 19 nt, Homo sapiens
guuauagguuugggauguu

SEQ ID NO: 1572776 - RNA, 19 nt, Homo sapiens
cacauacauuugagagguu

SEQ ID NO: 1572777 - RNA, 19 nt, Homo sapiens
guggugcuccaaaggaaua

SEQ ID NO: 1572778 - RNA, 19 nt, Homo sapiens
auagagaaguggucauuuu

SEQ ID NO: 1572779 - RNA, 19 nt, Homo sapiens
uguaaagucuccuauucag

SEQ ID NO: 1572780 - RNA, 19 nt, Homo sapiens
caaccuuccuaaauaacag

SEQ ID NO: 1572781 - RNA, 19 nt, Homo sapiens
uuaagugugacucugauuu

SEQ ID NO: 1572782 - RNA, 19 nt, Homo sapiens
ccugaagguuauagguuug

SEQ ID NO: 1572783 - RNA, 19 nt, Homo sapiens
cagcuguuguccaugauag

SEQ ID NO: 1572784 - RNA, 19 nt, Homo sapiens
augugacucuuucuaauga

SEQ ID NO: 1572785 - RNA, 19 nt, Homo sapiens
agaauaucaugcuauggau

SEQ ID NO: 1572786 - RNA, 19 nt, Homo sapiens
ccacaagggagaauaucau

SEQ ID NO: 1572787 - RNA, 19 nt, Homo sapiens
guucuuugaaugccuauau

SEQ ID NO: 1572788 - RNA, 19 nt, Homo sapiens
gcccagccaugagagaugu

SEQ ID NO: 1572789 - RNA, 19 nt, Homo sapiens
ucagcauucuuccauucuu

SEQ ID NO: 1572790 - RNA, 19 nt, Homo sapiens
gauguagcagacuuaauuc

SEQ ID NO: 1572791 - RNA, 19 nt, Homo sapiens
uaugugacucuuucuaaug

SEQ ID NO: 1572792 - RNA, 19 nt, Homo sapiens
gacaacggaaauauuuaug

SEQ ID NO: 1572793 - RNA, 19 nt, Homo sapiens
ugauagagaaguggucauu

SEQ ID NO: 1572794 - RNA, 19 nt, Homo sapiens
gugacaauauggaauucuc

SEQ ID NO: 1572795 - RNA, 19 nt, Homo sapiens
uuauaccucuguggauuug

SEQ ID NO: 1572796 - RNA, 19 nt, Homo sapiens
gacaauauggaauucucuu

SEQ ID NO: 1572797 - RNA, 19 nt, Homo sapiens
acauaggcacaacuguuua

SEQ ID NO: 1572798 - RNA, 19 nt, Homo sapiens
ggauuaucaucaggaucaa

SEQ ID NO: 1572799 - RNA, 19 nt, Homo sapiens
acauacauuugagagguuu

SEQ ID NO: 1572800 - RNA, 19 nt, Homo sapiens
cuaaugaaccuuuuaagug

SEQ ID NO: 1572801 - RNA, 19 nt, Homo sapiens
aggcacaacuguuuaaaau

SEQ ID NO: 1572802 - RNA, 19 nt, Homo sapiens
agcaaaggauucacacagu

SEQ ID NO: 1572803 - RNA, 19 nt, Homo sapiens
aggaauaaagcaaaggauu

SEQ ID NO: 1572804 - RNA, 19 nt, Homo sapiens
aaaggaauaaagcaaagga

SEQ ID NO: 1572805 - RNA, 19 nt, Homo sapiens
aagggagaauaucaugcua

SEQ ID NO: 1572806 - RNA, 19 nt, Homo sapiens
ccuauucagugagccaaug

SEQ ID NO: 1572807 - RNA, 19 nt, Homo sapiens
guaaagucuccuauucagu

SEQ ID NO: 1572808 - RNA, 19 nt, Homo sapiens
gaaaggagauuugggauau

SEQ ID NO: 1572809 - RNA, 19 nt, Homo sapiens
gaacacugcugcacuaauc

SEQ ID NO: 1572810 - RNA, 19 nt, Homo sapiens
gggcagagaugaaaguaaa

SEQ ID NO: 1572811 - RNA, 19 nt, Homo sapiens
caacacaucuguaggaaca

SEQ ID NO: 1572812 - RNA, 19 nt, Homo sapiens
ggaagcaccugccucuuga

SEQ ID NO: 1572813 - RNA, 19 nt, Homo sapiens
guagcugacuccuugguua

SEQ ID NO: 1572814 - RNA, 19 nt, Homo sapiens
gaacagagccauccaaagc

SEQ ID NO: 1572815 - RNA, 19 nt, Homo sapiens
gccagcagcuccaucguuu

SEQ ID NO: 1572816 - RNA, 19 nt, Homo sapiens
gcaaauggagcaacaacaa

SEQ ID NO: 1572817 - RNA, 19 nt, Homo sapiens
gcaccugccucuugagugu

SEQ ID NO: 1572818 - RNA, 19 nt, Homo sapiens
cagaagaaauagacgauuc

SEQ ID NO: 1572819 - RNA, 19 nt, Homo sapiens
acaacaacaucacaaagaa

SEQ ID NO: 1572820 - RNA, 19 nt, Homo sapiens
cagagaccauggcaacuuu

SEQ ID NO: 1572821 - RNA, 19 nt, Homo sapiens
agacgauucuuucaugauu

SEQ ID NO: 1572822 - RNA, 19 nt, Homo sapiens
gauccaggcucugcaguau

SEQ ID NO: 1572823 - RNA, 19 nt, Homo sapiens
caucaccuacguuuauuua

SEQ ID NO: 1572824 - RNA, 19 nt, Homo sapiens
gagcaccuuugcauuaugu

SEQ ID NO: 1572825 - RNA, 19 nt, Homo sapiens
gcaacaacaacaucacaaa

SEQ ID NO: 1572826 - RNA, 19 nt, Homo sapiens
gacgauucuuucaugauuu

SEQ ID NO: 1572827 - RNA, 19 nt, Homo sapiens
aauagacgauucuuucaug

SEQ ID NO: 1572828 - RNA, 19 nt, Homo sapiens
aagccaagauccacagauu

SEQ ID NO: 1572829 - RNA, 19 nt, Homo sapiens
ccagguaguuguuggaauc

SEQ ID NO: 1572830 - RNA, 19 nt, Homo sapiens
gcaccuuugcauuauguua

SEQ ID NO: 1572831 - RNA, 19 nt, Homo sapiens
caacaacaucacaaagaaa

SEQ ID NO: 1572832 - RNA, 19 nt, Homo sapiens
uuauuuagcucucuucgau

SEQ ID NO: 1572833 - RNA, 19 nt, Homo sapiens
gccaagauccacagauuug

SEQ ID NO: 1572834 - RNA, 19 nt, Homo sapiens
gcuggacccuacacuauuc

SEQ ID NO: 1572835 - RNA, 19 nt, Homo sapiens
gcacaaacagcagguacaa

SEQ ID NO: 1572836 - RNA, 19 nt, Homo sapiens
gcacuaaucauugccuguu

SEQ ID NO: 1572837 - RNA, 19 nt, Homo sapiens
ucacaaagaaaggagauuu

SEQ ID NO: 1572838 - RNA, 19 nt, Homo sapiens
gugagcaccuuugcauuau

SEQ ID NO: 1572839 - RNA, 19 nt, Homo sapiens
cuaccagucuccugcuuug

SEQ ID NO: 1572840 - RNA, 19 nt, Homo sapiens
ccaaagcauccuugcauug

SEQ ID NO: 1572841 - RNA, 19 nt, Homo sapiens
gcagguacaacacaucugu

SEQ ID NO: 1572842 - RNA, 19 nt, Homo sapiens
gaagucacaaagucaguau

SEQ ID NO: 1572843 - RNA, 19 nt, Homo sapiens
uuauacaacuggcaaaugg

SEQ ID NO: 1572844 - RNA, 19 nt, Homo sapiens
gggcuggacccuacacuau

SEQ ID NO: 1572845 - RNA, 19 nt, Homo sapiens
ggagagaaacccaccaaac

SEQ ID NO: 1572846 - RNA, 19 nt, Homo sapiens
gggaacagagccauccaaa

SEQ ID NO: 1572847 - RNA, 19 nt, Homo sapiens
ccagucuccugcuuuguau

SEQ ID NO: 1572848 - RNA, 19 nt, Homo sapiens
agaaaggagauuugggaua

SEQ ID NO: 1572849 - RNA, 19 nt, Homo sapiens
acacagcugucuuuucuuu

SEQ ID NO: 1572850 - RNA, 19 nt, Homo sapiens
aaggagauuugggauauug

SEQ ID NO: 1572851 - RNA, 19 nt, Homo sapiens
caacaacaacaucacaaag

SEQ ID NO: 1572852 - RNA, 19 nt, Homo sapiens
ugucuugugucuuuauuuc

SEQ ID NO: 1572853 - RNA, 19 nt, Homo sapiens
uuagcucucuucgauaauu

SEQ ID NO: 1572854 - RNA, 19 nt, Homo sapiens
auuuagcucucuucgauaa

SEQ ID NO: 1572855 - RNA, 19 nt, Homo sapiens
acaaacagcagguacaaca

SEQ ID NO: 1572856 - RNA, 19 nt, Homo sapiens
caacaucacaaagaaagga

SEQ ID NO: 1572857 - RNA, 19 nt, Homo sapiens
ggagauuugggauauuguu

SEQ ID NO: 1572858 - RNA, 19 nt, Homo sapiens
gcagaagaaauagacgauu

SEQ ID NO: 1572859 - RNA, 19 nt, Homo sapiens
cuucaucaccuacguuuau

SEQ ID NO: 1572860 - RNA, 19 nt, Homo sapiens
gagcaacaacaacaucaca

SEQ ID NO: 1572861 - RNA, 19 nt, Homo sapiens
ucacaaagucaguauaugc

SEQ ID NO: 1572862 - RNA, 19 nt, Homo sapiens
gauuugggauauuguucug

SEQ ID NO: 1572863 - RNA, 19 nt, Homo sapiens
aaaggagauuugggauauu

SEQ ID NO: 1572864 - RNA, 19 nt, Homo sapiens
gugcugggccuuccacaug

SEQ ID NO: 1572865 - RNA, 19 nt, Homo sapiens
gagagaaacccaccaaacc

SEQ ID NO: 1572866 - RNA, 19 nt, Homo sapiens
cacuaaucauugccuguuu

SEQ ID NO: 1572867 - RNA, 19 nt, Homo sapiens
caaagcauccuugcauugg

SEQ ID NO: 1572868 - RNA, 19 nt, Homo sapiens
uccaaagcauccuugcauu

SEQ ID NO: 1572869 - RNA, 19 nt, Homo sapiens
uggaagcaccugccucuug

SEQ ID NO: 1572870 - RNA, 19 nt, Homo sapiens
ucaccuacguuuauuuagc

SEQ ID NO: 1572871 - RNA, 19 nt, Homo sapiens
ccagagaccauggcaacuu

SEQ ID NO: 1572872 - RNA, 19 nt, Homo sapiens
cagcgcagccuggcauuug

SEQ ID NO: 1572873 - RNA, 19 nt, Homo sapiens
auagacgauucuuucauga

SEQ ID NO: 1572874 - RNA, 19 nt, Homo sapiens
aacaacaacaucacaaaga

SEQ ID NO: 1572875 - RNA, 19 nt, Homo sapiens
caagauccacagauuugau

SEQ ID NO: 1572876 - RNA, 19 nt, Homo sapiens
cucuuugucuugugucuuu

SEQ ID NO: 1572877 - RNA, 19 nt, Homo sapiens
ggaacagagccauccaaag

SEQ ID NO: 1572878 - RNA, 19 nt, Homo sapiens
acacaucuguaggaacaau

SEQ ID NO: 1572879 - RNA, 19 nt, Homo sapiens
ccuugguuauccuaucuaa

SEQ ID NO: 1572880 - RNA, 19 nt, Homo sapiens
gcauuauguuacgcccuuu

SEQ ID NO: 1572881 - RNA, 19 nt, Homo sapiens
aaacagcagguacaacaca

SEQ ID NO: 1572882 - RNA, 19 nt, Homo sapiens
gagauuugggauauuguuc

SEQ ID NO: 1572883 - RNA, 19 nt, Homo sapiens
acagagccauccaaagcau

SEQ ID NO: 1572884 - RNA, 19 nt, Homo sapiens
guuacgcccuuuccuucau

SEQ ID NO: 1572885 - RNA, 19 nt, Homo sapiens
ugaagucacaaagucagua

SEQ ID NO: 1572886 - RNA, 19 nt, Homo sapiens
uuucuacacucucuugucu

SEQ ID NO: 1572887 - RNA, 19 nt, Homo sapiens
acgauucuuucaugauuuc

SEQ ID NO: 1572888 - RNA, 19 nt, Homo sapiens
ugagcaccuuugcauuaug

SEQ ID NO: 1572889 - RNA, 19 nt, Homo sapiens
agucacaaagucaguauau

SEQ ID NO: 1572890 - RNA, 19 nt, Homo sapiens
ccugcuuuguauccaauaa

SEQ ID NO: 1572891 - RNA, 19 nt, Homo sapiens
uuucaucucuuugucuugu

SEQ ID NO: 1572892 - RNA, 19 nt, Homo sapiens
uccaggcucugcaguaucu

SEQ ID NO: 1572893 - RNA, 19 nt, Homo sapiens
ggcuggacccuacacuauu

SEQ ID NO: 1572894 - RNA, 19 nt, Homo sapiens
uccaguugguggcuaguga

SEQ ID NO: 1572895 - RNA, 19 nt, Homo sapiens
caccuacguuuauuuagcu

SEQ ID NO: 1572896 - RNA, 19 nt, Homo sapiens
ucuacacucucuugucucu

SEQ ID NO: 1572897 - RNA, 19 nt, Homo sapiens
ggccagcagcuccaucguu

SEQ ID NO: 1572898 - RNA, 19 nt, Homo sapiens
gucacaaagucaguauaug

SEQ ID NO: 1572899 - RNA, 19 nt, Homo sapiens
aaauggagcaacaacaaca

SEQ ID NO: 1572900 - RNA, 19 nt, Homo sapiens
ccaagauccacagauuuga

SEQ ID NO: 1572901 - RNA, 19 nt, Homo sapiens
ccaggugggcagagaugaa

SEQ ID NO: 1572902 - RNA, 19 nt, Homo sapiens
caaauggagcaacaacaac

SEQ ID NO: 1572903 - RNA, 19 nt, Homo sapiens
guaaaagccccgacauaca

SEQ ID NO: 1572904 - RNA, 19 nt, Homo sapiens
aagauccacagauuugauu

SEQ ID NO: 1572905 - RNA, 19 nt, Homo sapiens
uagcucucuucgauaauuc

SEQ ID NO: 1572906 - RNA, 19 nt, Homo sapiens
caggugggcagagaugaaa

SEQ ID NO: 1572907 - RNA, 19 nt, Homo sapiens
uagcugacuccuugguuau

SEQ ID NO: 1572908 - RNA, 19 nt, Homo sapiens
gcacaaagacaaaugauua

SEQ ID NO: 1572909 - RNA, 19 nt, Homo sapiens
gaaguuaagaggcaaauua

SEQ ID NO: 1572910 - RNA, 19 nt, Homo sapiens
gauauuggaugcaaauuug

SEQ ID NO: 1572911 - RNA, 19 nt, Homo sapiens
gaagcuacaugcucacaaa

SEQ ID NO: 1572912 - RNA, 19 nt, Homo sapiens
ucagauaguucuccgauuu

SEQ ID NO: 1572913 - RNA, 19 nt, Homo sapiens
gaacaccucugcacugauc

SEQ ID NO: 1572914 - RNA, 19 nt, Homo sapiens
aaacaacaguuacagauga

SEQ ID NO: 1572915 - RNA, 19 nt, Homo sapiens
caaauggccuccaaggauu

SEQ ID NO: 1572916 - RNA, 19 nt, Homo sapiens
ccacagaucugauucucaa

SEQ ID NO: 1572917 - RNA, 19 nt, Homo sapiens
ccacauucauuacauauug

SEQ ID NO: 1572918 - RNA, 19 nt, Homo sapiens
ugaacacgcugguaaauau

SEQ ID NO: 1572919 - RNA, 19 nt, Homo sapiens
acaaauacaucaggucuuu

SEQ ID NO: 1572920 - RNA, 19 nt, Homo sapiens
ggaaguaggagcagaauuc

SEQ ID NO: 1572921 - RNA, 19 nt, Homo sapiens
gcaauaggcaugaucuuau

SEQ ID NO: 1572922 - RNA, 19 nt, Homo sapiens
cuaauaaguuggaacaaug

SEQ ID NO: 1572923 - RNA, 19 nt, Homo sapiens
guuauacucucuaaaggaa

SEQ ID NO: 1572924 - RNA, 19 nt, Homo sapiens
caaugcaacuuuaaaccaa

SEQ ID NO: 1572925 - RNA, 19 nt, Homo sapiens
gcagucaauugcaguguau

SEQ ID NO: 1572926 - RNA, 19 nt, Homo sapiens
uuccuaagcuggucagaua

SEQ ID NO: 1572927 - RNA, 19 nt, Homo sapiens
ggaacaaugcaacuuuaaa

SEQ ID NO: 1572928 - RNA, 19 nt, Homo sapiens
gaauggccguuuguugauu

SEQ ID NO: 1572929 - RNA, 19 nt, Homo sapiens
ggaauuucuuucuucucua

SEQ ID NO: 1572930 - RNA, 19 nt, Homo sapiens
gaacaaugcaacuuuaaac

SEQ ID NO: 1572931 - RNA, 19 nt, Homo sapiens
aaagauucccucagugaua

SEQ ID NO: 1572932 - RNA, 19 nt, Homo sapiens
guugaaagauucccucagu

SEQ ID NO: 1572933 - RNA, 19 nt, Homo sapiens
cacaaacaauggcugcuuu

SEQ ID NO: 1572934 - RNA, 19 nt, Homo sapiens
gggaauuucuuucuucucu

SEQ ID NO: 1572935 - RNA, 19 nt, Homo sapiens
uauaaugaauggccguuug

SEQ ID NO: 1572936 - RNA, 19 nt, Homo sapiens
gaacacgcugguaaauauu

SEQ ID NO: 1572937 - RNA, 19 nt, Homo sapiens
aaaggaaucccacaaacaa

SEQ ID NO: 1572938 - RNA, 19 nt, Homo sapiens
gaauuucuuucuucucuac

SEQ ID NO: 1572939 - RNA, 19 nt, Homo sapiens
cagcauaaauagcacaaag

SEQ ID NO: 1572940 - RNA, 19 nt, Homo sapiens
gcuacaugcucacaaauac

SEQ ID NO: 1572941 - RNA, 19 nt, Homo sapiens
ugaaagauucccucaguga

SEQ ID NO: 1572942 - RNA, 19 nt, Homo sapiens
ggcaugaucuuauuaucuc

SEQ ID NO: 1572943 - RNA, 19 nt, Homo sapiens
ggcagucaauugcagugua

SEQ ID NO: 1572944 - RNA, 19 nt, Homo sapiens
cagauaguucuccgauuua

SEQ ID NO: 1572945 - RNA, 19 nt, Homo sapiens
gcaaguggaacagcauaaa

SEQ ID NO: 1572946 - RNA, 19 nt, Homo sapiens
uuggaacaaugcaacuuua

SEQ ID NO: 1572947 - RNA, 19 nt, Homo sapiens
aaaugggccucuaauaagu

SEQ ID NO: 1572948 - RNA, 19 nt, Homo sapiens
ggaaggaauccacaguuuc

SEQ ID NO: 1572949 - RNA, 19 nt, Homo sapiens
ccacuauaguuuccuuugu

SEQ ID NO: 1572950 - RNA, 19 nt, Homo sapiens
gauuauggauauuguucug

SEQ ID NO: 1572951 - RNA, 19 nt, Homo sapiens
guccugugcuggauucuga

SEQ ID NO: 1572952 - RNA, 19 nt, Homo sapiens
gaaagauucccucagugau

SEQ ID NO: 1572953 - RNA, 19 nt, Homo sapiens
caauugcaguguauauaag

SEQ ID NO: 1572954 - RNA, 19 nt, Homo sapiens
uauguggauugucuucuuu

SEQ ID NO: 1572955 - RNA, 19 nt, Homo sapiens
ucuccuccaucuuuacaua

SEQ ID NO: 1572956 - RNA, 19 nt, Homo sapiens
cacuauaguuuccuuuguu

SEQ ID NO: 1572957 - RNA, 19 nt, Homo sapiens
ucacguaucauaaacaaca

SEQ ID NO: 1572958 - RNA, 19 nt, Homo sapiens
ggaggaaguaggagcagaa

SEQ ID NO: 1572959 - RNA, 19 nt, Homo sapiens
uuacuguucuucuacaugu

SEQ ID NO: 1572960 - RNA, 19 nt, Homo sapiens
uaaaggaaucccacaaaca

SEQ ID NO: 1572961 - RNA, 19 nt, Homo sapiens
acaaauggccuccaaggau

SEQ ID NO: 1572962 - RNA, 19 nt, Homo sapiens
cgauuuauguggauugucu

SEQ ID NO: 1572963 - RNA, 19 nt, Homo sapiens
caaagacaaaugauuaugg

SEQ ID NO: 1572964 - RNA, 19 nt, Homo sapiens
uuucuucucuaccacuaua

SEQ ID NO: 1572965 - RNA, 19 nt, Homo sapiens
gcacugaucacugccuguu

SEQ ID NO: 1572966 - RNA, 19 nt, Homo sapiens
aaguggaacagcauaaaua

SEQ ID NO: 1572967 - RNA, 19 nt, Homo sapiens
uaaacaacaguuacagaug

SEQ ID NO: 1572968 - RNA, 19 nt, Homo sapiens
gagcaccuuguguuacuuu

SEQ ID NO: 1572969 - RNA, 19 nt, Homo sapiens
ggauauuguucuggaggaa

SEQ ID NO: 1572970 - RNA, 19 nt, Homo sapiens
aagauucccucagugauau

SEQ ID NO: 1572971 - RNA, 19 nt, Homo sapiens
cuaaaggaaucccacaaac

SEQ ID NO: 1572972 - RNA, 19 nt, Homo sapiens
gcaccgcaaugggcaguca

SEQ ID NO: 1572973 - RNA, 19 nt, Homo sapiens
ucgcucuccuccaucuuua

SEQ ID NO: 1572974 - RNA, 19 nt, Homo sapiens
ucagugauauuggaugcaa

SEQ ID NO: 1572975 - RNA, 19 nt, Homo sapiens
caacaguuacagaugaaau

SEQ ID NO: 1572976 - RNA, 19 nt, Homo sapiens
cauaaacaacaguuacaga

SEQ ID NO: 1572977 - RNA, 19 nt, Homo sapiens
ugcaauaggcaugaucuua

SEQ ID NO: 1572978 - RNA, 19 nt, Homo sapiens
gacaaauggccuccaagga

SEQ ID NO: 1572979 - RNA, 19 nt, Homo sapiens
caaguggaacagcauaaau

SEQ ID NO: 1572980 - RNA, 19 nt, Homo sapiens
guauauaagacucagaauc

SEQ ID NO: 1572981 - RNA, 19 nt, Homo sapiens
gauuucuuccugcagguua

SEQ ID NO: 1572982 - RNA, 19 nt, Homo sapiens
aauggccguuuguugauuu

SEQ ID NO: 1572983 - RNA, 19 nt, Homo sapiens
uugaacaccucugcacuga

SEQ ID NO: 1572984 - RNA, 19 nt, Homo sapiens
gugagcaccuuguguuacu

SEQ ID NO: 1572985 - RNA, 19 nt, Homo sapiens
gcauaaauagcacaaagac

SEQ ID NO: 1572986 - RNA, 19 nt, Homo sapiens
ucuaaaggaaucccacaaa

SEQ ID NO: 1572987 - RNA, 19 nt, Homo sapiens
ucaagcaccugaccauagc

SEQ ID NO: 1572988 - RNA, 19 nt, Homo sapiens
uauacucucuaaaggaauc

SEQ ID NO: 1572989 - RNA, 19 nt, Homo sapiens
gguuauacucucuaaagga

SEQ ID NO: 1572990 - RNA, 19 nt, Homo sapiens
gucaauugcaguguauaua

SEQ ID NO: 1572991 - RNA, 19 nt, Homo sapiens
gcaugaucuuauuaucuca

SEQ ID NO: 1572992 - RNA, 19 nt, Homo sapiens
aacaacaguuacagaugaa

SEQ ID NO: 1572993 - RNA, 19 nt, Homo sapiens
uuauguggauugucuucuu

SEQ ID NO: 1572994 - RNA, 19 nt, Homo sapiens
cagcagguccagcacauuc

SEQ ID NO: 1572995 - RNA, 19 nt, Homo sapiens
uauauaagacucagaaucc

SEQ ID NO: 1572996 - RNA, 19 nt, Homo sapiens
agauaguucuccgauuuau

SEQ ID NO: 1572997 - RNA, 19 nt, Homo sapiens
uggaacagcauaaauagca

SEQ ID NO: 1572998 - RNA, 19 nt, Homo sapiens
ggaaucccacaaacaaugg

SEQ ID NO: 1572999 - RNA, 19 nt, Homo sapiens
ggagaaguuaagaggcaaa

SEQ ID NO: 1573000 - RNA, 19 nt, Homo sapiens
auaguucuccgauuuaugu

SEQ ID NO: 1573001 - RNA, 19 nt, Homo sapiens
cagaucugauucucaagca

SEQ ID NO: 1573002 - RNA, 19 nt, Homo sapiens
cugaacacgcugguaaaua

SEQ ID NO: 1573003 - RNA, 19 nt, Homo sapiens
augaauggccguuuguuga

SEQ ID NO: 1573004 - RNA, 19 nt, Homo sapiens
cuaagcuggucagauaguu

SEQ ID NO: 1573005 - RNA, 19 nt, Homo sapiens
cuccaaggauuuugcaaua

SEQ ID NO: 1573006 - RNA, 19 nt, Homo sapiens
gcaauggagaaguuaagag

SEQ ID NO: 1573007 - RNA, 19 nt, Homo sapiens
gccguuuguugauuucuuc

SEQ ID NO: 1573008 - RNA, 19 nt, Homo sapiens
ccacagauuugauuguuaa

SEQ ID NO: 1573009 - RNA, 19 nt, Homo sapiens
gcaccuuugugucuucuua

SEQ ID NO: 1573010 - RNA, 19 nt, Homo sapiens
gauuguagccaacuucuua

SEQ ID NO: 1573011 - RNA, 19 nt, Homo sapiens
gcaaauggaacuacacaaa

SEQ ID NO: 1573012 - RNA, 19 nt, Homo sapiens
gcucuugggugcaaacuug

SEQ ID NO: 1573013 - RNA, 19 nt, Homo sapiens
gaacgaggauuugggauac

SEQ ID NO: 1573014 - RNA, 19 nt, Homo sapiens
ucucuguucuucuccauua

SEQ ID NO: 1573015 - RNA, 19 nt, Homo sapiens
gggcaaaacuuaaagagaa

SEQ ID NO: 1573016 - RNA, 19 nt, Homo sapiens
gaacacuucagccuuaaug

SEQ ID NO: 1573017 - RNA, 19 nt, Homo sapiens
gucagcagcuccaugguuu

SEQ ID NO: 1573018 - RNA, 19 nt, Homo sapiens
caucaucuuucccauguau

SEQ ID NO: 1573019 - RNA, 19 nt, Homo sapiens
aaauggaacuacacaaaca

SEQ ID NO: 1573020 - RNA, 19 nt, Homo sapiens
gagcuucucuguucuucuc

SEQ ID NO: 1573021 - RNA, 19 nt, Homo sapiens
gaacuacacaaacaucaca

SEQ ID NO: 1573022 - RNA, 19 nt, Homo sapiens
guaugugacuggcaaaugg

SEQ ID NO: 1573023 - RNA, 19 nt, Homo sapiens
ccaccugccucuugagugu

SEQ ID NO: 1573024 - RNA, 19 nt, Homo sapiens
gacacugcgugcaauguug

SEQ ID NO: 1573025 - RNA, 19 nt, Homo sapiens
guauacagguuuuguuuug

SEQ ID NO: 1573026 - RNA, 19 nt, Homo sapiens
ugaacgaggauuugggaua

SEQ ID NO: 1573027 - RNA, 19 nt, Homo sapiens
cagauuugauuguuaagca

SEQ ID NO: 1573028 - RNA, 19 nt, Homo sapiens
uccauuaucucuccuuuua

SEQ ID NO: 1573029 - RNA, 19 nt, Homo sapiens
gcagugggaaugaucuuau

SEQ ID NO: 1573030 - RNA, 19 nt, Homo sapiens
guauggcucuuuuggauaa

SEQ ID NO: 1573031 - RNA, 19 nt, Homo sapiens
guuaagcaccugauuguag

SEQ ID NO: 1573032 - RNA, 19 nt, Homo sapiens
guuaagguccacagauuug

SEQ ID NO: 1573033 - RNA, 19 nt, Homo sapiens
gauaaucccaauaguuuac

SEQ ID NO: 1573034 - RNA, 19 nt, Homo sapiens
guccacagauuugauuguu

SEQ ID NO: 1573035 - RNA, 19 nt, Homo sapiens
gguuaagguccacagauuu

SEQ ID NO: 1573036 - RNA, 19 nt, Homo sapiens
gaguguauguuucccaacu

SEQ ID NO: 1573037 - RNA, 19 nt, Homo sapiens
cuuaaugaguguauguuuc

SEQ ID NO: 1573038 - RNA, 19 nt, Homo sapiens
ccaauaguuuacuggugaa

SEQ ID NO: 1573039 - RNA, 19 nt, Homo sapiens
uacacucucuccugccuuu

SEQ ID NO: 1573040 - RNA, 19 nt, Homo sapiens
guugguaaacaucaucuuu

SEQ ID NO: 1573041 - RNA, 19 nt, Homo sapiens
ggucagcagcuccaugguu

SEQ ID NO: 1573042 - RNA, 19 nt, Homo sapiens
ggaaauccaggugggcaaa

SEQ ID NO: 1573043 - RNA, 19 nt, Homo sapiens
uccacagauuugauuguua

SEQ ID NO: 1573044 - RNA, 19 nt, Homo sapiens
agguuaagguccacagauu

SEQ ID NO: 1573045 - RNA, 19 nt, Homo sapiens
caaauggaacuacacaaac

SEQ ID NO: 1573046 - RNA, 19 nt, Homo sapiens
gcagcuccaugguuugcau

SEQ ID NO: 1573047 - RNA, 19 nt, Homo sapiens
cccagacaauggcagcuuu

SEQ ID NO: 1573048 - RNA, 19 nt, Homo sapiens
ucuuagcucuccgcuguaa

SEQ ID NO: 1573049 - RNA, 19 nt, Homo sapiens
gauuugggauacuguucug

SEQ ID NO: 1573050 - RNA, 19 nt, Homo sapiens
cauguuggcuuuucuguuc

SEQ ID NO: 1573051 - RNA, 19 nt, Homo sapiens
acggucagcuccaggaaau

SEQ ID NO: 1573052 - RNA, 19 nt, Homo sapiens
gaucgugugcauguuggua

SEQ ID NO: 1573053 - RNA, 19 nt, Homo sapiens
ggcaaaacuuaaagagaaa

SEQ ID NO: 1573054 - RNA, 19 nt, Homo sapiens
cagcggguccagcacauug

SEQ ID NO: 1573055 - RNA, 19 nt, Homo sapiens
gugagcaccuuugugucuu

SEQ ID NO: 1573056 - RNA, 19 nt, Homo sapiens
gggagcuucucuguucuuc

SEQ ID NO: 1573057 - RNA, 19 nt, Homo sapiens
guauguuucccaacucuca

SEQ ID NO: 1573058 - RNA, 19 nt, Homo sapiens
ggcagugggaaugaucuua

SEQ ID NO: 1573059 - RNA, 19 nt, Homo sapiens
cagugggaaugaucuuauc

SEQ ID NO: 1573060 - RNA, 19 nt, Homo sapiens
guuuacuggugaacacuuc

SEQ ID NO: 1573061 - RNA, 19 nt, Homo sapiens
ucuccauuaucucuccuuu

SEQ ID NO: 1573062 - RNA, 19 nt, Homo sapiens
ugagcaccuuugugucuuc

SEQ ID NO: 1573063 - RNA, 19 nt, Homo sapiens
gcagguuaagguccacaga

SEQ ID NO: 1573064 - RNA, 19 nt, Homo sapiens
caaguuuguauggcucuuu

SEQ ID NO: 1573065 - RNA, 19 nt, Homo sapiens
agacacugcgugcaauguu

SEQ ID NO: 1573066 - RNA, 19 nt, Homo sapiens
ccuuaaugaguguauguuu

SEQ ID NO: 1573067 - RNA, 19 nt, Homo sapiens
cacagacacugcgugcaau

SEQ ID NO: 1573068 - RNA, 19 nt, Homo sapiens
gaacauggcagaaauuaug

SEQ ID NO: 1573069 - RNA, 19 nt, Homo sapiens
gaaauuuaaucgccaaugu

SEQ ID NO: 1573070 - RNA, 19 nt, Homo sapiens
gauaaaugauucucugcua

SEQ ID NO: 1573071 - RNA, 19 nt, Homo sapiens
gguguaaucuucugcugua

SEQ ID NO: 1573072 - RNA, 19 nt, Homo sapiens
cugcaaauguuaugguuua

SEQ ID NO: 1573073 - RNA, 19 nt, Homo sapiens
acagauauccuuugcuuua

SEQ ID NO: 1573074 - RNA, 19 nt, Homo sapiens
ccacagauauccuuugcuu

SEQ ID NO: 1573075 - RNA, 19 nt, Homo sapiens
ucaagacucugcaaauguu

SEQ ID NO: 1573076 - RNA, 19 nt, Homo sapiens
ugacauggauaaaugauuc

SEQ ID NO: 1573077 - RNA, 19 nt, Homo sapiens
ggugugacauggauaaaug

SEQ ID NO: 1573078 - RNA, 19 nt, Homo sapiens
gguauaaggucauugucuu

SEQ ID NO: 1573079 - RNA, 19 nt, Homo sapiens
gagaacauggcagaaauua

SEQ ID NO: 1573080 - RNA, 19 nt, Homo sapiens
caaagcucauguugaaauu

SEQ ID NO: 1573081 - RNA, 19 nt, Homo sapiens
caauagcuaugccgcaauu

SEQ ID NO: 1573082 - RNA, 19 nt, Homo sapiens
ggacuuuacguucucauuu

SEQ ID NO: 1573083 - RNA, 19 nt, Homo sapiens
caagucacaucuuaggauu

SEQ ID NO: 1573084 - RNA, 19 nt, Homo sapiens
gcaaacaccauccuucuuc

SEQ ID NO: 1573085 - RNA, 19 nt, Homo sapiens
guccuuugaugcuaauuua

SEQ ID NO: 1573086 - RNA, 19 nt, Homo sapiens
aggaugaucuuagguauaa

SEQ ID NO: 1573087 - RNA, 19 nt, Homo sapiens
cuccaaagcucauguugaa

SEQ ID NO: 1573088 - RNA, 19 nt, Homo sapiens
gaggcuacauggugauuau

SEQ ID NO: 1573089 - RNA, 19 nt, Homo sapiens
uggcagaaauuaugcuauu

SEQ ID NO: 1573090 - RNA, 19 nt, Homo sapiens
caauauugguguccuuaga

SEQ ID NO: 1573091 - RNA, 19 nt, Homo sapiens
ugagggaugucaccuuuau

SEQ ID NO: 1573092 - RNA, 19 nt, Homo sapiens
uaaguccauugacaugaua

SEQ ID NO: 1573093 - RNA, 19 nt, Homo sapiens
guucauugguguaaucuuc

SEQ ID NO: 1573094 - RNA, 19 nt, Homo sapiens
ccauugacaugauaauuag

SEQ ID NO: 1573095 - RNA, 19 nt, Homo sapiens
cagauauccuuugcuuuaa

SEQ ID NO: 1573096 - RNA, 19 nt, Homo sapiens
gcugauaaccaaauauuca

SEQ ID NO: 1573097 - RNA, 19 nt, Homo sapiens
gauaauuagucaccugucu

SEQ ID NO: 1573098 - RNA, 19 nt, Homo sapiens
ccaaagcucauguugaaau

SEQ ID NO: 1573099 - RNA, 19 nt, Homo sapiens
ggaggugugacauggauaa

SEQ ID NO: 1573100 - RNA, 19 nt, Homo sapiens
caauguggcaguacuaaga

SEQ ID NO: 1573101 - RNA, 19 nt, Homo sapiens
gcaaagcucaaacauccuu

SEQ ID NO: 1573102 - RNA, 19 nt, Homo sapiens
gggccagucuucuguuugu

SEQ ID NO: 1573103 - RNA, 19 nt, Homo sapiens
gcaagucacaucuuaggau

SEQ ID NO: 1573104 - RNA, 19 nt, Homo sapiens
ucacaggucuaaguccauu

SEQ ID NO: 1573105 - RNA, 19 nt, Homo sapiens
caaacauccuucugcaagu

SEQ ID NO: 1573106 - RNA, 19 nt, Homo sapiens
caacauguucauuggugua

SEQ ID NO: 1573107 - RNA, 19 nt, Homo sapiens
guauaaggucauugucuuu

SEQ ID NO: 1573108 - RNA, 19 nt, Homo sapiens
cauuagaucucuugcuuuu

SEQ ID NO: 1573109 - RNA, 19 nt, Homo sapiens
cuucuaagaugaucaaacu

SEQ ID NO: 1573110 - RNA, 19 nt, Homo sapiens
ucaggaugaucuuagguau

SEQ ID NO: 1573111 - RNA, 19 nt, Homo sapiens
acaauaagaggcuaucuca

SEQ ID NO: 1573112 - RNA, 19 nt, Homo sapiens
cuaaguccauugacaugau

SEQ ID NO: 1573113 - RNA, 19 nt, Homo sapiens
uuugagggaugucaccuuu

SEQ ID NO: 1573114 - RNA, 19 nt, Homo sapiens
cacagaauacucaggauga

SEQ ID NO: 1573115 - RNA, 19 nt, Homo sapiens
caaacaccauccuucuucu

SEQ ID NO: 1573116 - RNA, 19 nt, Homo sapiens
uaguguggcuccagguuau

SEQ ID NO: 1573117 - RNA, 19 nt, Homo sapiens
aauaagaggcuaucucagu

SEQ ID NO: 1573118 - RNA, 19 nt, Homo sapiens
ucucauggguccucaacau

SEQ ID NO: 1573119 - RNA, 19 nt, Homo sapiens
caagacucugcaaauguua

SEQ ID NO: 1573120 - RNA, 19 nt, Homo sapiens
gaugcuaauuuaugcugau

SEQ ID NO: 1573121 - RNA, 19 nt, Homo sapiens
ucuuacugcuggugaguuu

SEQ ID NO: 1573122 - RNA, 19 nt, Homo sapiens
cucauuagaucucuugcuu

SEQ ID NO: 1573123 - RNA, 19 nt, Homo sapiens
gacuuuacguucucauuuu

SEQ ID NO: 1573124 - RNA, 19 nt, Homo sapiens
cauacuggguggacuuuac

SEQ ID NO: 1573125 - RNA, 19 nt, Homo sapiens
cauguucauugguguaauc

SEQ ID NO: 1573126 - RNA, 19 nt, Homo sapiens
caggaugaucuuagguaua

SEQ ID NO: 1573127 - RNA, 19 nt, Homo sapiens
caggaggugugacauggau

SEQ ID NO: 1573128 - RNA, 19 nt, Homo sapiens
aaauauuugucuccuccaa

SEQ ID NO: 1573129 - RNA, 19 nt, Homo sapiens
ggcagaaauuaugcuauuc

SEQ ID NO: 1573130 - RNA, 19 nt, Homo sapiens
guucaugguccucucaaga

SEQ ID NO: 1573131 - RNA, 19 nt, Homo sapiens
uugagaacauggcagaaau

SEQ ID NO: 1573132 - RNA, 19 nt, Homo sapiens
aaacauccuucugcaaguc

SEQ ID NO: 1573133 - RNA, 19 nt, Homo sapiens
ggcaauauugguguccuua

SEQ ID NO: 1573134 - RNA, 19 nt, Homo sapiens
uuccacaucuucaccuuug

SEQ ID NO: 1573135 - RNA, 19 nt, Homo sapiens
ugagaacauggcagaaauu

SEQ ID NO: 1573136 - RNA, 19 nt, Homo sapiens
auucaagacucugcaaaug

SEQ ID NO: 1573137 - RNA, 19 nt, Homo sapiens
uaaaugauucucugcuagu

SEQ ID NO: 1573138 - RNA, 19 nt, Homo sapiens
gcuacauggugauuauuuu

SEQ ID NO: 1573139 - RNA, 19 nt, Homo sapiens
ggcuacauggugauuauuu

SEQ ID NO: 1573140 - RNA, 19 nt, Homo sapiens
gagggaugucaccuuuaua

SEQ ID NO: 1573141 - RNA, 19 nt, Homo sapiens
cuaguguggcuccagguua

SEQ ID NO: 1573142 - RNA, 19 nt, Homo sapiens
ucuaagaugaucaaacuuc

SEQ ID NO: 1573143 - RNA, 19 nt, Homo sapiens
ggucuaaguccauugacau

SEQ ID NO: 1573144 - RNA, 19 nt, Homo sapiens
guaaucuucugcuguacac

SEQ ID NO: 1573145 - RNA, 19 nt, Homo sapiens
ccacaucuucaccuuuguu

SEQ ID NO: 1573146 - RNA, 19 nt, Homo sapiens
cgcaauuaguccuuugaug

SEQ ID NO: 1573147 - RNA, 19 nt, Homo sapiens
cagcaaacaccauccuucu

SEQ ID NO: 1573148 - RNA, 19 nt, Homo sapiens
ucacaucuuaggauucuuc

SEQ ID NO: 1573149 - RNA, 19 nt, Homo sapiens
uggcaguacuaagaaguga

SEQ ID NO: 1573150 - RNA, 19 nt, Homo sapiens
ugaguuuugucuucacaua

SEQ ID NO: 1573151 - RNA, 19 nt, Homo sapiens
guccucaacauguucauug

SEQ ID NO: 1573152 - RNA, 19 nt, Homo sapiens
gcaauauugguguccuuag

SEQ ID NO: 1573153 - RNA, 19 nt, Homo sapiens
aacaccauccuucuucuuu

SEQ ID NO: 1573154 - RNA, 19 nt, Homo sapiens
aaaugauucucugcuagug

SEQ ID NO: 1573155 - RNA, 19 nt, Homo sapiens
ucacauacuggguggacuu

SEQ ID NO: 1573156 - RNA, 19 nt, Homo sapiens
ucacacuaaugacuuugag

SEQ ID NO: 1573157 - RNA, 19 nt, Homo sapiens
gacaauaagaggcuaucuc

SEQ ID NO: 1573158 - RNA, 19 nt, Homo sapiens
agucacaucuuaggauucu

SEQ ID NO: 1573159 - RNA, 19 nt, Homo sapiens
acagaauacucaggaugau

SEQ ID NO: 1573160 - RNA, 19 nt, Homo sapiens
uucugcaagucacaucuua

SEQ ID NO: 1573161 - RNA, 19 nt, Homo sapiens
gaauuucagcaaacaccau

SEQ ID NO: 1573162 - RNA, 19 nt, Homo sapiens
aauuaguccuuugaugcua

SEQ ID NO: 1573163 - RNA, 19 nt, Homo sapiens
gcuauucucauuagaucuc

SEQ ID NO: 1573164 - RNA, 19 nt, Homo sapiens
ccacauacugcugcucuuc

SEQ ID NO: 1573165 - RNA, 19 nt, Homo sapiens
ccuccaaagcucauguuga

SEQ ID NO: 1573166 - RNA, 19 nt, Homo sapiens
uagcuaugccgcaauuagu

SEQ ID NO: 1573167 - RNA, 19 nt, Homo sapiens
gcuaguguggcuccagguu

SEQ ID NO: 1573168 - RNA, 19 nt, Homo sapiens
gaauguagguggcagauau

SEQ ID NO: 1573169 - RNA, 19 nt, Homo sapiens
gauaugagcuugccuuugg

SEQ ID NO: 1573170 - RNA, 19 nt, Homo sapiens
ggaggccacuguacaagua

SEQ ID NO: 1573171 - RNA, 19 nt, Homo sapiens
ccaaugagaucaacacugu

SEQ ID NO: 1573172 - RNA, 19 nt, Homo sapiens
gaccgaagaugcugaaugu

SEQ ID NO: 1573173 - RNA, 19 nt, Homo sapiens
gcucugaacugcaaacugu

SEQ ID NO: 1573174 - RNA, 19 nt, Homo sapiens
ugaagaagcuaugugugua

SEQ ID NO: 1573175 - RNA, 19 nt, Homo sapiens
gcuaauaugcagucagaua

SEQ ID NO: 1573176 - RNA, 19 nt, Homo sapiens
gcguagaucguguugauua

SEQ ID NO: 1573177 - RNA, 19 nt, Homo sapiens
gaccuccacucaccaauga

SEQ ID NO: 1573178 - RNA, 19 nt, Homo sapiens
gaaugucuccggccucuuu

SEQ ID NO: 1573179 - RNA, 19 nt, Homo sapiens
gaaaggaggccacuguaca

SEQ ID NO: 1573180 - RNA, 19 nt, Homo sapiens
gagguuauuucccuguaaa

SEQ ID NO: 1573181 - RNA, 19 nt, Homo sapiens
cagcuaauaugcagucaga

SEQ ID NO: 1573182 - RNA, 19 nt, Homo sapiens
ggagguuauuucccuguaa

SEQ ID NO: 1573183 - RNA, 19 nt, Homo sapiens
gaggauacuuggguugauu

SEQ ID NO: 1573184 - RNA, 19 nt, Homo sapiens
cagaaaccauugaguagug

SEQ ID NO: 1573185 - RNA, 19 nt, Homo sapiens
gguaugauguuucccaaag

SEQ ID NO: 1573186 - RNA, 19 nt, Homo sapiens
gaagcuauguguguaucaa

SEQ ID NO: 1573187 - RNA, 19 nt, Homo sapiens
ugaacacucugguaugaug

SEQ ID NO: 1573188 - RNA, 19 nt, Homo sapiens
gcaugugguuaaagaguug

SEQ ID NO: 1573189 - RNA, 19 nt, Homo sapiens
gcccugugauuaauaaaug

SEQ ID NO: 1573190 - RNA, 19 nt, Homo sapiens
uggcaaacauagagagaaa

SEQ ID NO: 1573191 - RNA, 19 nt, Homo sapiens
ggacaccaccugcguagau

SEQ ID NO: 1573192 - RNA, 19 nt, Homo sapiens
gaagaagcuauguguguau

SEQ ID NO: 1573193 - RNA, 19 nt, Homo sapiens
cuucccagcuccuuaauga

SEQ ID NO: 1573194 - RNA, 19 nt, Homo sapiens
ccuguaaucuucccacaau

SEQ ID NO: 1573195 - RNA, 19 nt, Homo sapiens
auaaacaucugaacacucu

SEQ ID NO: 1573196 - RNA, 19 nt, Homo sapiens
caagucaccaucuaaaugu

SEQ ID NO: 1573197 - RNA, 19 nt, Homo sapiens
guaccaagucaccaucuaa

SEQ ID NO: 1573198 - RNA, 19 nt, Homo sapiens
uggguugauuuauccauua

SEQ ID NO: 1573199 - RNA, 19 nt, Homo sapiens
ccaagucaccaucuaaaug

SEQ ID NO: 1573200 - RNA, 19 nt, Homo sapiens
ugacagcacaccagagaaa

SEQ ID NO: 1573201 - RNA, 19 nt, Homo sapiens
gcugaugccuggaauugca

SEQ ID NO: 1573202 - RNA, 19 nt, Homo sapiens
ucugaacacucugguauga

SEQ ID NO: 1573203 - RNA, 19 nt, Homo sapiens
guaaucuucccacaauaaa

SEQ ID NO: 1573204 - RNA, 19 nt, Homo sapiens
aaagugugcccugugauua

SEQ ID NO: 1573205 - RNA, 19 nt, Homo sapiens
gguccuggcuggaguuucu

SEQ ID NO: 1573206 - RNA, 19 nt, Homo sapiens
uagaucguguugauuauuc

SEQ ID NO: 1573207 - RNA, 19 nt, Homo sapiens
gugcagcuccugaccauga

SEQ ID NO: 1573208 - RNA, 19 nt, Homo sapiens
cauaguagcccaugaucug

SEQ ID NO: 1573209 - RNA, 19 nt, Homo sapiens
auacuuggguugauuuauc

SEQ ID NO: 1573210 - RNA, 19 nt, Homo sapiens
gauggugggucuggucaug

SEQ ID NO: 1573211 - RNA, 19 nt, Homo sapiens
ggauacuuggguugauuua

SEQ ID NO: 1573212 - RNA, 19 nt, Homo sapiens
caacguggccagagaugau

SEQ ID NO: 1573213 - RNA, 19 nt, Homo sapiens
gugaagaagcuaugugugu

SEQ ID NO: 1573214 - RNA, 19 nt, Homo sapiens
uguaaucuucccacaauaa

SEQ ID NO: 1573215 - RNA, 19 nt, Homo sapiens
gaacccaugugcugauucc

SEQ ID NO: 1573216 - RNA, 19 nt, Homo sapiens
gugguuaaagaguugauua

SEQ ID NO: 1573217 - RNA, 19 nt, Homo sapiens
auaaauggcucuacaaccu

SEQ ID NO: 1573218 - RNA, 19 nt, Homo sapiens
caucugaacacucugguau

SEQ ID NO: 1573219 - RNA, 19 nt, Homo sapiens
ggucuggucaugauaacaa

SEQ ID NO: 1573220 - RNA, 19 nt, Homo sapiens
cgaaaagugugcccuguga

SEQ ID NO: 1573221 - RNA, 19 nt, Homo sapiens
aaagaaaggaggccacugu

SEQ ID NO: 1573222 - RNA, 19 nt, Homo sapiens
ggguugauuuauccauuau

SEQ ID NO: 1573223 - RNA, 19 nt, Homo sapiens
ggaggauacuuggguugau

SEQ ID NO: 1573224 - RNA, 19 nt, Homo sapiens
cagaacccaugugcugauu

SEQ ID NO: 1573225 - RNA, 19 nt, Homo sapiens
aaacauaguagcccaugau

SEQ ID NO: 1573226 - RNA, 19 nt, Homo sapiens
gagcuugccuuugggaacu

SEQ ID NO: 1573227 - RNA, 19 nt, Homo sapiens
cagauucguuuggagaaga

SEQ ID NO: 1573228 - RNA, 19 nt, Homo sapiens
ggaccuccacucaccaaug

SEQ ID NO: 1573229 - RNA, 19 nt, Homo sapiens
cugcguagaucguguugau

SEQ ID NO: 1573230 - RNA, 19 nt, Homo sapiens
ugccuucgaugguguauca

SEQ ID NO: 1573231 - RNA, 19 nt, Homo sapiens
gauguuucccaaaggcuaa

SEQ ID NO: 1573232 - RNA, 19 nt, Homo sapiens
cguagaucguguugauuau

SEQ ID NO: 1573233 - RNA, 19 nt, Homo sapiens
aaaggaggccacuguacaa

SEQ ID NO: 1573234 - RNA, 19 nt, Homo sapiens
cccagcuccuuaaugauuu

SEQ ID NO: 1573235 - RNA, 19 nt, Homo sapiens
cagcugaugccuggaauug

SEQ ID NO: 1573236 - RNA, 19 nt, Homo sapiens
guagaucguguugauuauu

SEQ ID NO: 1573237 - RNA, 19 nt, Homo sapiens
caaaagagccccugcuucu

SEQ ID NO: 1573238 - RNA, 19 nt, Homo sapiens
gcagucagauauaaaaguc

SEQ ID NO: 1573239 - RNA, 19 nt, Homo sapiens
cuccagaaaccauugagua

SEQ ID NO: 1573240 - RNA, 19 nt, Homo sapiens
ucccagcuccuuaaugauu

SEQ ID NO: 1573241 - RNA, 19 nt, Homo sapiens
gaacacucugguaugaugu

SEQ ID NO: 1573242 - RNA, 19 nt, Homo sapiens
ccaaagugaagaagcuaug

SEQ ID NO: 1573243 - RNA, 19 nt, Homo sapiens
ugugcccugugauuaauaa

SEQ ID NO: 1573244 - RNA, 19 nt, Homo sapiens
gggaggauacuuggguuga

SEQ ID NO: 1573245 - RNA, 19 nt, Homo sapiens
ccagcuccuuaaugauuug

SEQ ID NO: 1573246 - RNA, 19 nt, Homo sapiens
cccaaaggcuaauuaaaau

SEQ ID NO: 1573247 - RNA, 19 nt, Homo sapiens
gcaacguggccagagauga

SEQ ID NO: 1573248 - RNA, 19 nt, Homo sapiens
ccucagggcagacuuucuu

SEQ ID NO: 1573249 - RNA, 19 nt, Homo sapiens
aagaaaggaggccacugua

SEQ ID NO: 1573250 - RNA, 19 nt, Homo sapiens
gagcaccccucaaagaaag

SEQ ID NO: 1573251 - RNA, 19 nt, Homo sapiens
gagagcaccccucaaagaa

SEQ ID NO: 1573252 - RNA, 19 nt, Homo sapiens
uggagguuauuucccugua

SEQ ID NO: 1573253 - RNA, 19 nt, Homo sapiens
cuaaauguccccaaaguga

SEQ ID NO: 1573254 - RNA, 19 nt, Homo sapiens
uaccaagucaccaucuaaa

SEQ ID NO: 1573255 - RNA, 19 nt, Homo sapiens
cagauaugagcuugccuuu

SEQ ID NO: 1573256 - RNA, 19 nt, Homo sapiens
acacucugguaugauguuu

SEQ ID NO: 1573257 - RNA, 19 nt, Homo sapiens
ucauaaacaucugaacacu

SEQ ID NO: 1573258 - RNA, 19 nt, Homo sapiens
ccgaagaugcugaaugucu

SEQ ID NO: 1573259 - RNA, 19 nt, Homo sapiens
gacaccaccugcguagauc

SEQ ID NO: 1573260 - RNA, 19 nt, Homo sapiens
ccuagucuccucccuggaa

SEQ ID NO: 1573261 - RNA, 19 nt, Homo sapiens
gcccuucacagcuaauaug

SEQ ID NO: 1573262 - RNA, 19 nt, Homo sapiens
ccauucacgucugaguuga

SEQ ID NO: 1573263 - RNA, 19 nt, Homo sapiens
uguaaauccucaccagaac

SEQ ID NO: 1573264 - RNA, 19 nt, Homo sapiens
gcucuugcccgaggcuauu

SEQ ID NO: 1573265 - RNA, 19 nt, Homo sapiens
guaugauguuucccaaagg

SEQ ID NO: 1573266 - RNA, 19 nt, Homo sapiens
cuguaaauccucaccagaa

SEQ ID NO: 1573267 - RNA, 19 nt, Homo sapiens
gacccacccuggaccaaaa

SEQ ID NO: 1573268 - RNA, 19 nt, Homo sapiens
caauggaaauucagaagua

SEQ ID NO: 1573269 - RNA, 19 nt, Homo sapiens
gaacagaacacuggaauau

SEQ ID NO: 1573270 - RNA, 19 nt, Homo sapiens
gaagaugaauguguguuaa

SEQ ID NO: 1573271 - RNA, 19 nt, Homo sapiens
gaaaggaucucaucgucau

SEQ ID NO: 1573272 - RNA, 19 nt, Homo sapiens
uggaagaacugcccucaua

SEQ ID NO: 1573273 - RNA, 19 nt, Homo sapiens
ggaagaaauugccgugcua

SEQ ID NO: 1573274 - RNA, 19 nt, Homo sapiens
gaugagauucugacuaaua

SEQ ID NO: 1573275 - RNA, 19 nt, Homo sapiens
aagaugagauucugacuaa

SEQ ID NO: 1573276 - RNA, 19 nt, Homo sapiens
agaaguggcugaacagaaa

SEQ ID NO: 1573277 - RNA, 19 nt, Homo sapiens
caauggugaugauggauua

SEQ ID NO: 1573278 - RNA, 19 nt, Homo sapiens
gagaagaucuggacaagcu

SEQ ID NO: 1573279 - RNA, 19 nt, Homo sapiens
ggaagaugaauguguguua

SEQ ID NO: 1573280 - RNA, 19 nt, Homo sapiens
gcaauugaaugaagaagca

SEQ ID NO: 1573281 - RNA, 19 nt, Homo sapiens
gaaauauuccagaugagua

SEQ ID NO: 1573282 - RNA, 19 nt, Homo sapiens
uaaagaagcauggaaguaa

SEQ ID NO: 1573283 - RNA, 19 nt, Homo sapiens
gaaauaccgcucuacacua

SEQ ID NO: 1573284 - RNA, 19 nt, Homo sapiens
ggaacuagaugaaacaaaa

SEQ ID NO: 1573285 - RNA, 19 nt, Homo sapiens
gaagaagcauuaacgaaaa

SEQ ID NO: 1573286 - RNA, 19 nt, Homo sapiens
acagaacacuggaauauca

SEQ ID NO: 1573287 - RNA, 19 nt, Homo sapiens
aaacagcaauccagaacaa

SEQ ID NO: 1573288 - RNA, 19 nt, Homo sapiens
gaggacugcucuacauuug

SEQ ID NO: 1573289 - RNA, 19 nt, Homo sapiens
gaacauggcgcugaucgaa

SEQ ID NO: 1573290 - RNA, 19 nt, Homo sapiens
ucacaaaggcuuaaaguca

SEQ ID NO: 1573291 - RNA, 19 nt, Homo sapiens
gugaauuacuuucugacua

SEQ ID NO: 1573292 - RNA, 19 nt, Homo sapiens
ugaagaagcauuaacgaaa

SEQ ID NO: 1573293 - RNA, 19 nt, Homo sapiens
gaaauaaagaagcauggaa

SEQ ID NO: 1573294 - RNA, 19 nt, Homo sapiens
ccagaugaguauggaaaua

SEQ ID NO: 1573295 - RNA, 19 nt, Homo sapiens
gaacaagagggacaaggaa

SEQ ID NO: 1573296 - RNA, 19 nt, Homo sapiens
gcaaguauagucaaucuuc

SEQ ID NO: 1573297 - RNA, 19 nt, Homo sapiens
aaauaccgcucuacacuau

SEQ ID NO: 1573298 - RNA, 19 nt, Homo sapiens
caugaaaacuccuuuauga

SEQ ID NO: 1573299 - RNA, 19 nt, Homo sapiens
gaaaaugaauucugagcuu

SEQ ID NO: 1573300 - RNA, 19 nt, Homo sapiens
gaaaaugucucaagaacca

SEQ ID NO: 1573301 - RNA, 19 nt, Homo sapiens
gaaaauagccagccagaga

SEQ ID NO: 1573302 - RNA, 19 nt, Homo sapiens
gaagagucacaaaggcuua

SEQ ID NO: 1573303 - RNA, 19 nt, Homo sapiens
auagagagguugaagaaga

SEQ ID NO: 1573304 - RNA, 19 nt, Homo sapiens
ggacugugauagagagguu

SEQ ID NO: 1573305 - RNA, 19 nt, Homo sapiens
gaaaacuccuuuaugaaga

SEQ ID NO: 1573306 - RNA, 19 nt, Homo sapiens
uaagggcuaugcaauugaa

SEQ ID NO: 1573307 - RNA, 19 nt, Homo sapiens
ggaaauugaaagugugaaa

SEQ ID NO: 1573308 - RNA, 19 nt, Homo sapiens
gcagaaaaccugaaaauca

SEQ ID NO: 1573309 - RNA, 19 nt, Homo sapiens
ggaaauaccgcucuacacu

SEQ ID NO: 1573310 - RNA, 19 nt, Homo sapiens
ccacaaaggaggagcagaa

SEQ ID NO: 1573311 - RNA, 19 nt, Homo sapiens
gauaaaggccauacaaugc

SEQ ID NO: 1573312 - RNA, 19 nt, Homo sapiens
gaugguggcugagguuugu

SEQ ID NO: 1573313 - RNA, 19 nt, Homo sapiens
uagagagguugaagaagaa

SEQ ID NO: 1573314 - RNA, 19 nt, Homo sapiens
gagaguaugcuguuucuag

SEQ ID NO: 1573315 - RNA, 19 nt, Homo sapiens
ggagcaagaugggcaagug

SEQ ID NO: 1573316 - RNA, 19 nt, Homo sapiens
ggagcaagaugggcaagug

SEQ ID NO: 1573317 - RNA, 19 nt, Homo sapiens
ggagcaagaugggcaagug

SEQ ID NO: 1573318 - RNA, 19 nt, Homo sapiens
ucuaagggcuaugcaauug

SEQ ID NO: 1573319 - RNA, 19 nt, Homo sapiens
acacugagaaugaagagua

SEQ ID NO: 1573320 - RNA, 19 nt, Homo sapiens
cacgacgacuccuuuauga

SEQ ID NO: 1573321 - RNA, 19 nt, Homo sapiens
gaagaaauugccgugcuaa

SEQ ID NO: 1573322 - RNA, 19 nt, Homo sapiens
gcuaugcaauugaaugaag

SEQ ID NO: 1573323 - RNA, 19 nt, Homo sapiens
gaaugaagaguaucacagu

SEQ ID NO: 1573324 - RNA, 19 nt, Homo sapiens
aaagaagcauggaaguaau

SEQ ID NO: 1573325 - RNA, 19 nt, Homo sapiens
gcucuuauauggugcugau

SEQ ID NO: 1573326 - RNA, 19 nt, Homo sapiens
acuaugcuaucuacaauga

SEQ ID NO: 1573327 - RNA, 19 nt, Homo sapiens
caauccagaacaagacuua

SEQ ID NO: 1573328 - RNA, 19 nt, Homo sapiens
cagacgaugucaacuuaau

SEQ ID NO: 1573329 - RNA, 19 nt, Homo sapiens
gaaauugccgugcuaagac

SEQ ID NO: 1573330 - RNA, 19 nt, Homo sapiens
caagaugagauucugacua

SEQ ID NO: 1573331 - RNA, 19 nt, Homo sapiens
gcaauggugaugauggauu

SEQ ID NO: 1573332 - RNA, 19 nt, Homo sapiens
ccugugggauuaccagaaa

SEQ ID NO: 1573333 - RNA, 19 nt, Homo sapiens
acacuaugcuaucuacaau

SEQ ID NO: 1573334 - RNA, 19 nt, Homo sapiens
acacugacaugaacaagag

SEQ ID NO: 1573335 - RNA, 19 nt, Homo sapiens
ccacguccgucgagaagau

SEQ ID NO: 1573336 - RNA, 19 nt, Homo sapiens
uaaguacaguggacagcuu

SEQ ID NO: 1573337 - RNA, 19 nt, Homo sapiens
gaagaacagaacacuggaa

SEQ ID NO: 1573338 - RNA, 19 nt, Homo sapiens
cagaaaaccugacuaaugg

SEQ ID NO: 1573339 - RNA, 19 nt, Homo sapiens
ugauaaaggccauacaaug

SEQ ID NO: 1573340 - RNA, 19 nt, Homo sapiens
gcaagaugggcaaguguug

SEQ ID NO: 1573341 - RNA, 19 nt, Homo sapiens
gaagaagccauuugaucuc

SEQ ID NO: 1573342 - RNA, 19 nt, Homo sapiens
uggaggaaauugaaagugu

SEQ ID NO: 1573343 - RNA, 19 nt, Homo sapiens
gagcuuucucuuagucaua

SEQ ID NO: 1573344 - RNA, 19 nt, Homo sapiens
ugauagagagguugaagaa

SEQ ID NO: 1573345 - RNA, 19 nt, Homo sapiens
gacgacuccuuuaugaaga

SEQ ID NO: 1573346 - RNA, 19 nt, Homo sapiens
cagcaaguauagucaaucu

SEQ ID NO: 1573347 - RNA, 19 nt, Homo sapiens
ugaagaagccauuugaucu

SEQ ID NO: 1573348 - RNA, 19 nt, Homo sapiens
ggacagacggccagagagu

SEQ ID NO: 1573349 - RNA, 19 nt, Homo sapiens
gcagauagaaguggcugaa

SEQ ID NO: 1573350 - RNA, 19 nt, Homo sapiens
ccacgacgacuccuuuaug

SEQ ID NO: 1573351 - RNA, 19 nt, Homo sapiens
ggauuaauuccacaaagga

SEQ ID NO: 1573352 - RNA, 19 nt, Homo sapiens
gaauaucacaagaugagau

SEQ ID NO: 1573353 - RNA, 19 nt, Homo sapiens
aacagcaaguggugaaauu

SEQ ID NO: 1573354 - RNA, 19 nt, Homo sapiens
acauggcgcugaucgaaau

SEQ ID NO: 1573355 - RNA, 19 nt, Homo sapiens
gggcuaugcaauugaauga

SEQ ID NO: 1573356 - RNA, 19 nt, Homo sapiens
auucugagcuuucucuuag

SEQ ID NO: 1573357 - RNA, 19 nt, Homo sapiens
acacuggaauaucacaaga

SEQ ID NO: 1573358 - RNA, 19 nt, Homo sapiens
aaauaaggacugugauaga

SEQ ID NO: 1573359 - RNA, 19 nt, Homo sapiens
uaaauaaggacugugauag

SEQ ID NO: 1573360 - RNA, 19 nt, Homo sapiens
gaaccagaaauaaauaagg

SEQ ID NO: 1573361 - RNA, 19 nt, Homo sapiens
gcaaaauguugauguaucu

SEQ ID NO: 1573362 - RNA, 19 nt, Homo sapiens
gaagaacugcccucauacu

SEQ ID NO: 1573363 - RNA, 19 nt, Homo sapiens
gaucgaaauauuccagaug

SEQ ID NO: 1573364 - RNA, 19 nt, Homo sapiens
gcacuucuggagaccauga

SEQ ID NO: 1573365 - RNA, 19 nt, Homo sapiens
gaggaaauugaaaguguga

SEQ ID NO: 1573366 - RNA, 19 nt, Homo sapiens
ugauagauauggaagaacu

SEQ ID NO: 1573367 - RNA, 19 nt, Homo sapiens
agauagaaguggcugaaca

SEQ ID NO: 1573368 - RNA, 19 nt, Homo sapiens
gcaagagauuggaaacuua

SEQ ID NO: 1573369 - RNA, 19 nt, Homo sapiens
gaagauggcuuuacauuuu

SEQ ID NO: 1573370 - RNA, 19 nt, Homo sapiens
ggauaaagaugcugaguau

SEQ ID NO: 1573371 - RNA, 19 nt, Homo sapiens
uaaauuagcuguacugagu

SEQ ID NO: 1573372 - RNA, 19 nt, Homo sapiens
gaaagcaccugagucauug

SEQ ID NO: 1573373 - RNA, 19 nt, Homo sapiens
ggaaauugaucauuacugu

SEQ ID NO: 1573374 - RNA, 19 nt, Homo sapiens
cagaggagcuguuuaguau

SEQ ID NO: 1573375 - RNA, 19 nt, Homo sapiens
gaagaaagaaguagaugaa

SEQ ID NO: 1573376 - RNA, 19 nt, Homo sapiens
agucaaagcuugccaauau

SEQ ID NO: 1573377 - RNA, 19 nt, Homo sapiens
cagcagauaucuaggcaua

SEQ ID NO: 1573378 - RNA, 19 nt, Homo sapiens
ggcauguacugaacaauua

SEQ ID NO: 1573379 - RNA, 19 nt, Homo sapiens
gaaaagaacugaaagaaag

SEQ ID NO: 1573380 - RNA, 19 nt, Homo sapiens
gaagagaugauucaaagaa

SEQ ID NO: 1573381 - RNA, 19 nt, Homo sapiens
gaaagaaguagaugaaaug

SEQ ID NO: 1573382 - RNA, 19 nt, Homo sapiens
aacaagaacugcaguagua

SEQ ID NO: 1573383 - RNA, 19 nt, Homo sapiens
gagugguacuguaauaaua

SEQ ID NO: 1573384 - RNA, 19 nt, Homo sapiens
agaaguagaugaaauggaa

SEQ ID NO: 1573385 - RNA, 19 nt, Homo sapiens
aaacaugccagcaaucuua

SEQ ID NO: 1573386 - RNA, 19 nt, Homo sapiens
ggagauaaagggacaguaa

SEQ ID NO: 1573387 - RNA, 19 nt, Homo sapiens
gaauuugucuuccaguaug

SEQ ID NO: 1573388 - RNA, 19 nt, Homo sapiens
caucagaucaguuuaauga

SEQ ID NO: 1573389 - RNA, 19 nt, Homo sapiens
gcagauaucuaggcauaau

SEQ ID NO: 1573390 - RNA, 19 nt, Homo sapiens
guaaagggcaagaguaauu

SEQ ID NO: 1573391 - RNA, 19 nt, Homo sapiens
gagcaagacauaaguacua

SEQ ID NO: 1573392 - RNA, 19 nt, Homo sapiens
gaaccaagaguugcagaua

SEQ ID NO: 1573393 - RNA, 19 nt, Homo sapiens
caacagaugaggaaauuga

SEQ ID NO: 1573394 - RNA, 19 nt, Homo sapiens
gaagagagagcugagaauu

SEQ ID NO: 1573395 - RNA, 19 nt, Homo sapiens
ccacagaaacaaucaaauu

SEQ ID NO: 1573396 - RNA, 19 nt, Homo sapiens
gagaagauggcuuuacauu

SEQ ID NO: 1573397 - RNA, 19 nt, Homo sapiens
gaaaagagaacaugaagaa

SEQ ID NO: 1573398 - RNA, 19 nt, Homo sapiens
ucagacacuucaacucaua

SEQ ID NO: 1573399 - RNA, 19 nt, Homo sapiens
ggaccaauuuacuguuuau

SEQ ID NO: 1573400 - RNA, 19 nt, Homo sapiens
gggcaagaguaauuucuga

SEQ ID NO: 1573401 - RNA, 19 nt, Homo sapiens
gaaaugcaguaccugaagu

SEQ ID NO: 1573402 - RNA, 19 nt, Homo sapiens
cgucugaaauuccuauauu

SEQ ID NO: 1573403 - RNA, 19 nt, Homo sapiens
guucacauauuacgacuau

SEQ ID NO: 1573404 - RNA, 19 nt, Homo sapiens
gcuagucauuaauuccuua

SEQ ID NO: 1573405 - RNA, 19 nt, Homo sapiens
gugaggagauuaaagacaa

SEQ ID NO: 1573406 - RNA, 19 nt, Homo sapiens
auacagaaaucucaucaga

SEQ ID NO: 1573407 - RNA, 19 nt, Homo sapiens
ucaccuggauugaauuuau

SEQ ID NO: 1573408 - RNA, 19 nt, Homo sapiens
aagaagagaugauucaaag

SEQ ID NO: 1573409 - RNA, 19 nt, Homo sapiens
ugaaagcaccugagucauu

SEQ ID NO: 1573410 - RNA, 19 nt, Homo sapiens
ccacgaacgucugaaauuc

SEQ ID NO: 1573411 - RNA, 19 nt, Homo sapiens
guacuucacaagcuauaua

SEQ ID NO: 1573412 - RNA, 19 nt, Homo sapiens
aaacuaaggcucuuucaga

SEQ ID NO: 1573413 - RNA, 19 nt, Homo sapiens
aaagacaacuguagaaacu

SEQ ID NO: 1573414 - RNA, 19 nt, Homo sapiens
accaagaguugcagauaua

SEQ ID NO: 1573415 - RNA, 19 nt, Homo sapiens
uagaauuugucuuccagua

SEQ ID NO: 1573416 - RNA, 19 nt, Homo sapiens
caggaccaauuuacuguuu

SEQ ID NO: 1573417 - RNA, 19 nt, Homo sapiens
gaacaagaacugcaguagu

SEQ ID NO: 1573418 - RNA, 19 nt, Homo sapiens
ggaagucaauagaaaauga

SEQ ID NO: 1573419 - RNA, 19 nt, Homo sapiens
ccagaggagcuguuuagua

SEQ ID NO: 1573420 - RNA, 19 nt, Homo sapiens
gaaauucaaagcagagugu

SEQ ID NO: 1573421 - RNA, 19 nt, Homo sapiens
uagaucaccuggauugaau

SEQ ID NO: 1573422 - RNA, 19 nt, Homo sapiens
ugauagugaugaaguagaa

SEQ ID NO: 1573423 - RNA, 19 nt, Homo sapiens
guggugauccuguuaauau

SEQ ID NO: 1573424 - RNA, 19 nt, Homo sapiens
guugguacuuugauaagaa

SEQ ID NO: 1573425 - RNA, 19 nt, Homo sapiens
cacuucaacucauacauuu

SEQ ID NO: 1573426 - RNA, 19 nt, Homo sapiens
cacaagcuauauauacuga

SEQ ID NO: 1573427 - RNA, 19 nt, Homo sapiens
uaaagaugcugaguaugga

SEQ ID NO: 1573428 - RNA, 19 nt, Homo sapiens
aaacauagugaggagauua

SEQ ID NO: 1573429 - RNA, 19 nt, Homo sapiens
gaguuauacuucuagauca

SEQ ID NO: 1573430 - RNA, 19 nt, Homo sapiens
cauccgaauugaagaaaga

SEQ ID NO: 1573431 - RNA, 19 nt, Homo sapiens
gaaacuggaagccaacaug

SEQ ID NO: 1573432 - RNA, 19 nt, Homo sapiens
guaacuauuuguaggauac

SEQ ID NO: 1573433 - RNA, 19 nt, Homo sapiens
gggauaaagaugcugagua

SEQ ID NO: 1573434 - RNA, 19 nt, Homo sapiens
ucacgugaauauuaugaga

SEQ ID NO: 1573435 - RNA, 19 nt, Homo sapiens
uaggauacacgaaacuaua

SEQ ID NO: 1573436 - RNA, 19 nt, Homo sapiens
ugaguuaugcuaaugcuuu

SEQ ID NO: 1573437 - RNA, 19 nt, Homo sapiens
acacgaaacuauaaaugca

SEQ ID NO: 1573438 - RNA, 19 nt, Homo sapiens
caucagacacuucaacuca

SEQ ID NO: 1573439 - RNA, 19 nt, Homo sapiens
gagauuggaaacuuauuug

SEQ ID NO: 1573440 - RNA, 19 nt, Homo sapiens
cagaucaguuuaaugaaca

SEQ ID NO: 1573441 - RNA, 19 nt, Homo sapiens
gaucaccuggauugaauuu

SEQ ID NO: 1573442 - RNA, 19 nt, Homo sapiens
agagagagcugagaauuuu

SEQ ID NO: 1573443 - RNA, 19 nt, Homo sapiens
aaauguacuucacaagcua

SEQ ID NO: 1573444 - RNA, 19 nt, Homo sapiens
gagauuaaagacaacugua

SEQ ID NO: 1573445 - RNA, 19 nt, Homo sapiens
aauuagcuguacugaguua

SEQ ID NO: 1573446 - RNA, 19 nt, Homo sapiens
acacaugguacaauucuaa

SEQ ID NO: 1573447 - RNA, 19 nt, Homo sapiens
ggacagacuuuugcuagaa

SEQ ID NO: 1573448 - RNA, 19 nt, Homo sapiens
gacaguaagacaaguaaga

SEQ ID NO: 1573449 - RNA, 19 nt, Homo sapiens
acucaaagcagucaauuau

SEQ ID NO: 1573450 - RNA, 19 nt, Homo sapiens
gcagaguguuggcauguac

SEQ ID NO: 1573451 - RNA, 19 nt, Homo sapiens
cgaauugaagaaagaagua

SEQ ID NO: 1573452 - RNA, 19 nt, Homo sapiens
ugugugugcuauuaacuaa

SEQ ID NO: 1573453 - RNA, 19 nt, Homo sapiens
agaaggagaagauggcuuu

SEQ ID NO: 1573454 - RNA, 19 nt, Homo sapiens
gaacgucugaaauuccuau

SEQ ID NO: 1573455 - RNA, 19 nt, Homo sapiens
uuacgacuaucacaaguuc

SEQ ID NO: 1573456 - RNA, 19 nt, Homo sapiens
ucacauauuacgacuauca

SEQ ID NO: 1573457 - RNA, 19 nt, Homo sapiens
uuccaucacuuacuaaaug

SEQ ID NO: 1573458 - RNA, 19 nt, Homo sapiens
gauuaaagacaacuguaga

SEQ ID NO: 1573459 - RNA, 19 nt, Homo sapiens
uaaagggcaagaguaauuu

SEQ ID NO: 1573460 - RNA, 19 nt, Homo sapiens
ucaugagggcauaaauuua

SEQ ID NO: 1573461 - RNA, 19 nt, Homo sapiens
agaagauggcuuuacauuu

SEQ ID NO: 1573462 - RNA, 19 nt, Homo sapiens
caagagauuggaaacuuau

SEQ ID NO: 1573463 - RNA, 19 nt, Homo sapiens
ggacuuucuuuucuuauga

SEQ ID NO: 1573464 - RNA, 19 nt, Homo sapiens
uaaugacucugcuguggau

SEQ ID NO: 1573465 - RNA, 19 nt, Homo sapiens
caaagcagucaauuauuuc

SEQ ID NO: 1573466 - RNA, 19 nt, Homo sapiens
ucgagugccugcucccuuu

SEQ ID NO: 1573467 - RNA, 19 nt, Homo sapiens
gaggagcuguuuaguaucc

SEQ ID NO: 1573468 - RNA, 19 nt, Homo sapiens
ggacugacccugucuuuaa

SEQ ID NO: 1573469 - RNA, 19 nt, Homo sapiens
gcacugggauggcuuucua

SEQ ID NO: 1573470 - RNA, 19 nt, Homo sapiens
gaaacaagauacauacuac

SEQ ID NO: 1573471 - RNA, 19 nt, Homo sapiens
caaaggcucugacucuuga

SEQ ID NO: 1573472 - RNA, 19 nt, Homo sapiens
gaugagaguucuguucuuu

SEQ ID NO: 1573473 - RNA, 19 nt, Homo sapiens
caagugagaucuucagugu

SEQ ID NO: 1573474 - RNA, 19 nt, Homo sapiens
gaccauguauaaacuguaa

SEQ ID NO: 1573475 - RNA, 19 nt, Homo sapiens
ccacugaaauaagcaauaa

SEQ ID NO: 1573476 - RNA, 19 nt, Homo sapiens
ggaaacaagauacauacua

SEQ ID NO: 1573477 - RNA, 19 nt, Homo sapiens
gcagagcgguagaggugua

SEQ ID NO: 1573478 - RNA, 19 nt, Homo sapiens
cagagaggcugucuuccua

SEQ ID NO: 1573479 - RNA, 19 nt, Homo sapiens
agugagaucuucaguguaa

SEQ ID NO: 1573480 - RNA, 19 nt, Homo sapiens
ggugugaccuuuagcaguu

SEQ ID NO: 1573481 - RNA, 19 nt, Homo sapiens
gagcgugucuggccagguu

SEQ ID NO: 1573482 - RNA, 19 nt, Homo sapiens
ggacagagaccaccacuac

SEQ ID NO: 1573483 - RNA, 19 nt, Homo sapiens
ccaaagaaccgcagaguag

SEQ ID NO: 1573484 - RNA, 19 nt, Homo sapiens
gagacaagaagaaauagaa

SEQ ID NO: 1573485 - RNA, 19 nt, Homo sapiens
gcuggcggcucuauucuga

SEQ ID NO: 1573486 - RNA, 19 nt, Homo sapiens
ggacuggaacgucugguuu

SEQ ID NO: 1573487 - RNA, 19 nt, Homo sapiens
caagauacauacuacugau

SEQ ID NO: 1573488 - RNA, 19 nt, Homo sapiens
gugauagugucuacuuuga

SEQ ID NO: 1573489 - RNA, 19 nt, Homo sapiens
caguguaaaugaccaugua

SEQ ID NO: 1573490 - RNA, 19 nt, Homo sapiens
caucaguguuuaaagagaa

SEQ ID NO: 1573491 - RNA, 19 nt, Homo sapiens
ugaggaaacaagauacaua

SEQ ID NO: 1573492 - RNA, 19 nt, Homo sapiens
ugagaacccuccugcuguu

SEQ ID NO: 1573493 - RNA, 19 nt, Homo sapiens
gaaacaggucucugagguu

SEQ ID NO: 1573494 - RNA, 19 nt, Homo sapiens
gcacucggcuucaguuucc

SEQ ID NO: 1573495 - RNA, 19 nt, Homo sapiens
guaagugggugcuggugau

SEQ ID NO: 1573496 - RNA, 19 nt, Homo sapiens
ggaguaacaaacaagauug

SEQ ID NO: 1573497 - RNA, 19 nt, Homo sapiens
ugucacaucucaaacuaau

SEQ ID NO: 1573498 - RNA, 19 nt, Homo sapiens
gcauaaggcccuccucaca

SEQ ID NO: 1573499 - RNA, 19 nt, Homo sapiens
gcaaacaggcccagagaac

SEQ ID NO: 1573500 - RNA, 19 nt, Homo sapiens
gcccguguccucaguagua

SEQ ID NO: 1573501 - RNA, 19 nt, Homo sapiens
guaagcagcccuagcucuu

SEQ ID NO: 1573502 - RNA, 19 nt, Homo sapiens
caaggccacucaccacauc

SEQ ID NO: 1573503 - RNA, 19 nt, Homo sapiens
acuguaaagugcaauagaa

SEQ ID NO: 1573504 - RNA, 19 nt, Homo sapiens
gaucuucaguguaaaugac

SEQ ID NO: 1573505 - RNA, 19 nt, Homo sapiens
gguggaaacaggucucuga

SEQ ID NO: 1573506 - RNA, 19 nt, Homo sapiens
ucacaucucaaacuaauag

SEQ ID NO: 1573507 - RNA, 19 nt, Homo sapiens
gacugacccugucuuuaau

SEQ ID NO: 1573508 - RNA, 19 nt, Homo sapiens
gcgguagagguguauauuu

SEQ ID NO: 1573509 - RNA, 19 nt, Homo sapiens
ccaaguuacuagcuacaca

SEQ ID NO: 1573510 - RNA, 19 nt, Homo sapiens
gaaaucugggcgugcugua

SEQ ID NO: 1573511 - RNA, 19 nt, Homo sapiens
ugagcuagauaaauaaagg

SEQ ID NO: 1573512 - RNA, 19 nt, Homo sapiens
ggagacaagaagaaauaga

SEQ ID NO: 1573513 - RNA, 19 nt, Homo sapiens
gaggaaacaagauacauac

SEQ ID NO: 1573514 - RNA, 19 nt, Homo sapiens
uaaguacgggcuccuggua

SEQ ID NO: 1573515 - RNA, 19 nt, Homo sapiens
gcccgcugcuccuugcuuu

SEQ ID NO: 1573516 - RNA, 19 nt, Homo sapiens
guagaaggugccacaguga

SEQ ID NO: 1573517 - RNA, 19 nt, Homo sapiens
gagaacccuccugcuguua

SEQ ID NO: 1573518 - RNA, 19 nt, Homo sapiens
guuucuaccuucuauucaa

SEQ ID NO: 1573519 - RNA, 19 nt, Homo sapiens
uggaacgucugguuucugu

SEQ ID NO: 1573520 - RNA, 19 nt, Homo sapiens
guggaacauugcuuugaga

SEQ ID NO: 1573521 - RNA, 19 nt, Homo sapiens
ucaaaggcucugacucuug

SEQ ID NO: 1573522 - RNA, 19 nt, Homo sapiens
gccgugggcuguagaaggu

SEQ ID NO: 1573523 - RNA, 19 nt, Homo sapiens
cgccaucucccgccucaua

SEQ ID NO: 1573524 - RNA, 19 nt, Homo sapiens
ccagagaacagccuugaag

SEQ ID NO: 1573525 - RNA, 19 nt, Homo sapiens
caagggcuguggguccauu

SEQ ID NO: 1573526 - RNA, 19 nt, Homo sapiens
gcuuauggcuccaggucau

SEQ ID NO: 1573527 - RNA, 19 nt, Homo sapiens
cgguagagguguauauuuu

SEQ ID NO: 1573528 - RNA, 19 nt, Homo sapiens
gggacugacccugucuuua

SEQ ID NO: 1573529 - RNA, 19 nt, Homo sapiens
gguucugccuuuaguuugu

SEQ ID NO: 1573530 - RNA, 19 nt, Homo sapiens
cagguucugccuuuaguuu

SEQ ID NO: 1573531 - RNA, 19 nt, Homo sapiens
gugaacaccugcugcucau

SEQ ID NO: 1573532 - RNA, 19 nt, Homo sapiens
gcccagagaggcugucuuc

SEQ ID NO: 1573533 - RNA, 19 nt, Homo sapiens
acugucacaucucaaacua

SEQ ID NO: 1573534 - RNA, 19 nt, Homo sapiens
gcgacugucacaucucaaa

SEQ ID NO: 1573535 - RNA, 19 nt, Homo sapiens
guguaaaugaccauguaua

SEQ ID NO: 1573536 - RNA, 19 nt, Homo sapiens
ucacaggauucuggcauca

SEQ ID NO: 1573537 - RNA, 19 nt, Homo sapiens
cacccacacuggacagaga

SEQ ID NO: 1573538 - RNA, 19 nt, Homo sapiens
agggaucaguggaacauug

SEQ ID NO: 1573539 - RNA, 19 nt, Homo sapiens
ggccaccacugaaauaagc

SEQ ID NO: 1573540 - RNA, 19 nt, Homo sapiens
gagcccgugugcaucaugu

SEQ ID NO: 1573541 - RNA, 19 nt, Homo sapiens
ggggagacaagaagaaaua

SEQ ID NO: 1573542 - RNA, 19 nt, Homo sapiens
acaagauacauacuacuga

SEQ ID NO: 1573543 - RNA, 19 nt, Homo sapiens
guuacuagcuacacaucag

SEQ ID NO: 1573544 - RNA, 19 nt, Homo sapiens
gacgccauguaccugagua

SEQ ID NO: 1573545 - RNA, 19 nt, Homo sapiens
cggcgacugucacaucuca

SEQ ID NO: 1573546 - RNA, 19 nt, Homo sapiens
cuacuuugagcuagauaaa

SEQ ID NO: 1573547 - RNA, 19 nt, Homo sapiens
gagcgguagagguguauau

SEQ ID NO: 1573548 - RNA, 19 nt, Homo sapiens
caaacaggcccagagaaca

SEQ ID NO: 1573549 - RNA, 19 nt, Homo sapiens
gacgagacgcugcgacugu

SEQ ID NO: 1573550 - RNA, 19 nt, Homo sapiens
caccacuucuugcccaaau

SEQ ID NO: 1573551 - RNA, 19 nt, Homo sapiens
ggcaucaagugagaucuuc

SEQ ID NO: 1573552 - RNA, 19 nt, Homo sapiens
gagcccguguccucaguag

SEQ ID NO: 1573553 - RNA, 19 nt, Homo sapiens
gcucugacucuugaucuug

SEQ ID NO: 1573554 - RNA, 19 nt, Homo sapiens
gccagguucugccuuuagu

SEQ ID NO: 1573555 - RNA, 19 nt, Homo sapiens
guaaaaggaguaacaaaca

SEQ ID NO: 1573556 - RNA, 19 nt, Homo sapiens
ccacucaucaaacccucua

SEQ ID NO: 1573557 - RNA, 19 nt, Homo sapiens
gcagcagcgacgccaugua

SEQ ID NO: 1573558 - RNA, 19 nt, Homo sapiens
gaacccuccugcuguuacg

SEQ ID NO: 1573559 - RNA, 19 nt, Homo sapiens
aaaggaguaacaaacaaga

SEQ ID NO: 1573560 - RNA, 19 nt, Homo sapiens
acaucaguguuuaaagaga

SEQ ID NO: 1573561 - RNA, 19 nt, Homo sapiens
cagcagcgacgccauguac

SEQ ID NO: 1573562 - RNA, 19 nt, Homo sapiens
gggcucugguuggcuguga

SEQ ID NO: 1573563 - RNA, 19 nt, Homo sapiens
cugcggaucuccugcaaac

SEQ ID NO: 1573564 - RNA, 19 nt, Homo sapiens
gaucaguggaacauugcuu

SEQ ID NO: 1573565 - RNA, 19 nt, Homo sapiens
gcccgugugcaucauguuu

SEQ ID NO: 1573566 - RNA, 19 nt, Homo sapiens
acaggauucuggcaucaag

SEQ ID NO: 1573567 - RNA, 19 nt, Homo sapiens
aggaguaacaaacaagauu

SEQ ID NO: 1573568 - RNA, 19 nt, Homo sapiens
acgaagagcucaacaaguu

SEQ ID NO: 1573569 - RNA, 19 nt, Homo sapiens
uaagaggcuugacaccaua

SEQ ID NO: 1573570 - RNA, 19 nt, Homo sapiens
ggcaagaacaaguaauuaa

SEQ ID NO: 1573571 - RNA, 19 nt, Homo sapiens
gcaagaacaaguaauuaag

SEQ ID NO: 1573572 - RNA, 19 nt, Homo sapiens
ucacaagccuggcaagaac

SEQ ID NO: 1573573 - RNA, 19 nt, Homo sapiens
cgaagagcucaacaaguua

SEQ ID NO: 1573574 - RNA, 19 nt, Homo sapiens
caacuagccgugaggaaug

SEQ ID NO: 1573575 - RNA, 19 nt, Homo sapiens
gcaacuagccgugaggaau

SEQ ID NO: 1573576 - RNA, 19 nt, Homo sapiens
caucaucccucgccaucug

SEQ ID NO: 1573577 - RNA, 19 nt, Homo sapiens
uuaagaggcuugacaccau

SEQ ID NO: 1573578 - RNA, 19 nt, Homo sapiens
guaauuaagaggcuugaca

SEQ ID NO: 1573579 - RNA, 19 nt, Homo sapiens
gaagagcucaacaaguuac

SEQ ID NO: 1573580 - RNA, 19 nt, Homo sapiens
caagaagacgcgcaucauc

SEQ ID NO: 1573581 - RNA, 19 nt, Homo sapiens
guaccugaccgcggaaauu

SEQ ID NO: 1573582 - RNA, 19 nt, Homo sapiens
uggcaagaacaaguaauua

SEQ ID NO: 1573583 - RNA, 19 nt, Homo sapiens
ugacgaagagcucaacaag

SEQ ID NO: 1573584 - RNA, 19 nt, Homo sapiens
gcuguccuguugcccaaga

SEQ ID NO: 1573585 - RNA, 19 nt, Homo sapiens
ggaaugacgaagagcucaa

SEQ ID NO: 1573586 - RNA, 19 nt, Homo sapiens
gcuugacaccauacucauu

SEQ ID NO: 1573587 - RNA, 19 nt, Homo sapiens
cgugaggaaugacgaagag

SEQ ID NO: 1573588 - RNA, 19 nt, Homo sapiens
gcucgggacaacaagaaga

SEQ ID NO: 1573589 - RNA, 19 nt, Homo sapiens
gucacaagccuggcaagaa

SEQ ID NO: 1573590 - RNA, 19 nt, Homo sapiens
gacgaagagcucaacaagu

SEQ ID NO: 1573591 - RNA, 19 nt, Homo sapiens
gaaggaaugucaccgaaga

SEQ ID NO: 1573592 - RNA, 19 nt, Homo sapiens
cagcuccgcuuccugauua

SEQ ID NO: 1573593 - RNA, 19 nt, Homo sapiens
gaaacccugucucuacuaa

SEQ ID NO: 1573594 - RNA, 19 nt, Homo sapiens
ggaggagucugucaaggaa

SEQ ID NO: 1573595 - RNA, 19 nt, Homo sapiens
gcaaugaagccuuaguaaa

SEQ ID NO: 1573596 - RNA, 19 nt, Homo sapiens
cuucagggcuugucacuuu

SEQ ID NO: 1573597 - RNA, 19 nt, Homo sapiens
ggagauagagaccaucauu

SEQ ID NO: 1573598 - RNA, 19 nt, Homo sapiens
ccgaagaccugguuccuau

SEQ ID NO: 1573599 - RNA, 19 nt, Homo sapiens
gagcgcagccuguggguuu

SEQ ID NO: 1573600 - RNA, 19 nt, Homo sapiens
gagccuaacugugucagaa

SEQ ID NO: 1573601 - RNA, 19 nt, Homo sapiens
agagguggcuaccggcuua

SEQ ID NO: 1573602 - RNA, 19 nt, Homo sapiens
gaaguaugccuuuccuguu

SEQ ID NO: 1573603 - RNA, 19 nt, Homo sapiens
ccacauccgugcccugguu

SEQ ID NO: 1573604 - RNA, 19 nt, Homo sapiens
gaccaucauugcuaacaug

SEQ ID NO: 1573605 - RNA, 19 nt, Homo sapiens
uagagaccaucauugcuaa

SEQ ID NO: 1573606 - RNA, 19 nt, Homo sapiens
agaagucucuggccaagga

SEQ ID NO: 1573607 - RNA, 19 nt, Homo sapiens
gcaaaacuccgucucaaaa

SEQ ID NO: 1573608 - RNA, 19 nt, Homo sapiens
ucacacugcuccugaaagu

SEQ ID NO: 1573609 - RNA, 19 nt, Homo sapiens
gcucaugccuguaauucca

SEQ ID NO: 1573610 - RNA, 19 nt, Homo sapiens
caaugaagccuuaguaaaa

SEQ ID NO: 1573611 - RNA, 19 nt, Homo sapiens
ggcacgagcucuccagcaa

SEQ ID NO: 1573612 - RNA, 19 nt, Homo sapiens
gagcaaaguuuucaacauc

SEQ ID NO: 1573613 - RNA, 19 nt, Homo sapiens
gggcaaugaagccuuagua

SEQ ID NO: 1573614 - RNA, 19 nt, Homo sapiens
cgaggcagguggaucacaa

SEQ ID NO: 1573615 - RNA, 19 nt, Homo sapiens
aaguaugccuuuccuguug

SEQ ID NO: 1573616 - RNA, 19 nt, Homo sapiens
ggagagccucguccagaaa

SEQ ID NO: 1573617 - RNA, 19 nt, Homo sapiens
gaaaccccgucucuacuaa

SEQ ID NO: 1573618 - RNA, 19 nt, Homo sapiens
gagauagagaccaucauug

SEQ ID NO: 1573619 - RNA, 19 nt, Homo sapiens
guaaaacggugaaaaguac

SEQ ID NO: 1573620 - RNA, 19 nt, Homo sapiens
ggcauuaaccuugagcuaa

SEQ ID NO: 1573621 - RNA, 19 nt, Homo sapiens
guguggagcugguggugaa

SEQ ID NO: 1573622 - RNA, 19 nt, Homo sapiens
ggcaaugaagccuuaguaa

SEQ ID NO: 1573623 - RNA, 19 nt, Homo sapiens
cggcaucucguccuacuuu

SEQ ID NO: 1573624 - RNA, 19 nt, Homo sapiens
gcaaaguuuucaacaucua

SEQ ID NO: 1573625 - RNA, 19 nt, Homo sapiens
gagaccagccugaccaaca

SEQ ID NO: 1573626 - RNA, 19 nt, Homo sapiens
cccaguaccugagaaccua

SEQ ID NO: 1573627 - RNA, 19 nt, Homo sapiens
gaggcugaccggaugauug

SEQ ID NO: 1573628 - RNA, 19 nt, Homo sapiens
auagagaccaucauugcua

SEQ ID NO: 1573629 - RNA, 19 nt, Homo sapiens
ccauggcgcuguucuacgu

SEQ ID NO: 1573630 - RNA, 19 nt, Homo sapiens
gggcauuaaccuugagcua

SEQ ID NO: 1573631 - RNA, 19 nt, Homo sapiens
gcagcuccgcuuccugauu

SEQ ID NO: 1573632 - RNA, 19 nt, Homo sapiens
gagcaaaacuccgucucaa

SEQ ID NO: 1573633 - RNA, 19 nt, Homo sapiens
caggauggcugcgggcaau

SEQ ID NO: 1573634 - RNA, 19 nt, Homo sapiens
gaucacaaggucaggagau

SEQ ID NO: 1573635 - RNA, 19 nt, Homo sapiens
accuugagcuaauguuaaa

SEQ ID NO: 1573636 - RNA, 19 nt, Homo sapiens
aggguucucugcuucacua

SEQ ID NO: 1573637 - RNA, 19 nt, Homo sapiens
ccuguaaucccagcacuuu

SEQ ID NO: 1573638 - RNA, 19 nt, Homo sapiens
gguggugcaugccuguaau

SEQ ID NO: 1573639 - RNA, 19 nt, Homo sapiens
aggagagccucguccagaa

SEQ ID NO: 1573640 - RNA, 19 nt, Homo sapiens
agaccagccugaccaacau

SEQ ID NO: 1573641 - RNA, 19 nt, Homo sapiens
guucucugcuucacuaacu

SEQ ID NO: 1573642 - RNA, 19 nt, Homo sapiens
ucucgaggguucucugcuu

SEQ ID NO: 1573643 - RNA, 19 nt, Homo sapiens
ccuguaauccagcuacuug

SEQ ID NO: 1573644 - RNA, 19 nt, Homo sapiens
gacacuggccuucgucauc

SEQ ID NO: 1573645 - RNA, 19 nt, Homo sapiens
ugcgggcaaugaagccuua

SEQ ID NO: 1573646 - RNA, 19 nt, Homo sapiens
cacuggauccuguauguga

SEQ ID NO: 1573647 - RNA, 19 nt, Homo sapiens
gaagauccagcugcucauc

SEQ ID NO: 1573648 - RNA, 19 nt, Homo sapiens
guguggacguggcugaguu

SEQ ID NO: 1573649 - RNA, 19 nt, Homo sapiens
cacaaggucaggagauaga

SEQ ID NO: 1573650 - RNA, 19 nt, Homo sapiens
gaagaccugguuccuaucg

SEQ ID NO: 1573651 - RNA, 19 nt, Homo sapiens
gcaggaaaauggcuugaac

SEQ ID NO: 1573652 - RNA, 19 nt, Homo sapiens
aggagucugucaaggaaga

SEQ ID NO: 1573653 - RNA, 19 nt, Homo sapiens
cuaacugugucagaaggaa

SEQ ID NO: 1573654 - RNA, 19 nt, Homo sapiens
ggauggcugcgggcaauga

SEQ ID NO: 1573655 - RNA, 19 nt, Homo sapiens
uggagcugguggugaacua

SEQ ID NO: 1573656 - RNA, 19 nt, Homo sapiens
ccugcagccucagcucuaa

SEQ ID NO: 1573657 - RNA, 19 nt, Homo sapiens
gucaggagauagagaccau

SEQ ID NO: 1573658 - RNA, 19 nt, Homo sapiens
cacacggcaucucguccua

SEQ ID NO: 1573659 - RNA, 19 nt, Homo sapiens
ugaccaacauggagaaacc

SEQ ID NO: 1573660 - RNA, 19 nt, Homo sapiens
gcuuagcgaccucuguguu

SEQ ID NO: 1573661 - RNA, 19 nt, Homo sapiens
aggcugaccggaugauuga

SEQ ID NO: 1573662 - RNA, 19 nt, Homo sapiens
uucacuaacucccgagaga

SEQ ID NO: 1573663 - RNA, 19 nt, Homo sapiens
cuuagcgaccucuguguuu

SEQ ID NO: 1573664 - RNA, 19 nt, Homo sapiens
gagaccaucauugcuaaca

SEQ ID NO: 1573665 - RNA, 19 nt, Homo sapiens
gggcacccgucaugcuuuu

SEQ ID NO: 1573666 - RNA, 19 nt, Homo sapiens
gauagagaccaucauugcu

SEQ ID NO: 1573667 - RNA, 19 nt, Homo sapiens
caaggucaggagauagaga

SEQ ID NO: 1573668 - RNA, 19 nt, Homo sapiens
aaccuugagcuaauguuaa

SEQ ID NO: 1573669 - RNA, 19 nt, Homo sapiens
uggaggagucugucaagga

SEQ ID NO: 1573670 - RNA, 19 nt, Homo sapiens
gaacucccacaggcucuuc

SEQ ID NO: 1573671 - RNA, 19 nt, Homo sapiens
uuagcgaccucuguguuuc

SEQ ID NO: 1573672 - RNA, 19 nt, Homo sapiens
guggagagcugcugguauu

SEQ ID NO: 1573673 - RNA, 19 nt, Homo sapiens
ggccugcgcugauuucuug

SEQ ID NO: 1573674 - RNA, 19 nt, Homo sapiens
guacauaguguuuggcuuu

SEQ ID NO: 1573675 - RNA, 19 nt, Homo sapiens
gugaauggguccuguguga

SEQ ID NO: 1573676 - RNA, 19 nt, Homo sapiens
gaauggguccugugugaaa

SEQ ID NO: 1573677 - RNA, 19 nt, Homo sapiens
cagcaaccaugaauuuguu

SEQ ID NO: 1573678 - RNA, 19 nt, Homo sapiens
gugguagcauuuaugauuu

SEQ ID NO: 1573679 - RNA, 19 nt, Homo sapiens
uauuauaacucagccauga

SEQ ID NO: 1573680 - RNA, 19 nt, Homo sapiens
ucacagugguagcauuuau

SEQ ID NO: 1573681 - RNA, 19 nt, Homo sapiens
ggaaaccuccuggugauga

SEQ ID NO: 1573682 - RNA, 19 nt, Homo sapiens
gcuguuggugugcuuauua

SEQ ID NO: 1573683 - RNA, 19 nt, Homo sapiens
gaucccgggugauucugua

SEQ ID NO: 1573684 - RNA, 19 nt, Homo sapiens
uauuguaacuggucagguu

SEQ ID NO: 1573685 - RNA, 19 nt, Homo sapiens
acgaugggcuggaggaauu

SEQ ID NO: 1573686 - RNA, 19 nt, Homo sapiens
ggucacagugguagcauuu

SEQ ID NO: 1573687 - RNA, 19 nt, Homo sapiens
gaaaccuccuggugaugau

SEQ ID NO: 1573688 - RNA, 19 nt, Homo sapiens
gggcugugcuggcuguguu

SEQ ID NO: 1573689 - RNA, 19 nt, Homo sapiens
acucagccaugaauccuuu

SEQ ID NO: 1573690 - RNA, 19 nt, Homo sapiens
guaucugugucaggaauuu

SEQ ID NO: 1573691 - RNA, 19 nt, Homo sapiens
ggucuauccuaccaaguuc

SEQ ID NO: 1573692 - RNA, 19 nt, Homo sapiens
uuuaugagauuugcuguug

SEQ ID NO: 1573693 - RNA, 19 nt, Homo sapiens
gucagaccguuguaaauca

SEQ ID NO: 1573694 - RNA, 19 nt, Homo sapiens
gaaucauccucagagaguu

SEQ ID NO: 1573695 - RNA, 19 nt, Homo sapiens
gaaaauacugguagcaaga

SEQ ID NO: 1573696 - RNA, 19 nt, Homo sapiens
ucagaccguuguaaaucaa

SEQ ID NO: 1573697 - RNA, 19 nt, Homo sapiens
acagaaucauccucagaga

SEQ ID NO: 1573698 - RNA, 19 nt, Homo sapiens
gugauucuguacauagugu

SEQ ID NO: 1573699 - RNA, 19 nt, Homo sapiens
acucuucucucuuucacuu

SEQ ID NO: 1573700 - RNA, 19 nt, Homo sapiens
uuguuacucuucucucuuu

SEQ ID NO: 1573701 - RNA, 19 nt, Homo sapiens
gagagcugcugguauuuug

SEQ ID NO: 1573702 - RNA, 19 nt, Homo sapiens
agugguagcauuuaugauu

SEQ ID NO: 1573703 - RNA, 19 nt, Homo sapiens
cugaugcccuaaacuguau

SEQ ID NO: 1573704 - RNA, 19 nt, Homo sapiens
aaucauccucagagaguua

SEQ ID NO: 1573705 - RNA, 19 nt, Homo sapiens
ucaucuccaucgacaggua

SEQ ID NO: 1573706 - RNA, 19 nt, Homo sapiens
cuaccaaguucaccguauc

SEQ ID NO: 1573707 - RNA, 19 nt, Homo sapiens
gcugugauguggcauuuug

SEQ ID NO: 1573708 - RNA, 19 nt, Homo sapiens
ugacagauuuucuauccuu

SEQ ID NO: 1573709 - RNA, 19 nt, Homo sapiens
ucugaugcccuaaacugua

SEQ ID NO: 1573710 - RNA, 19 nt, Homo sapiens
cuggaggaauuaucugaug

SEQ ID NO: 1573711 - RNA, 19 nt, Homo sapiens
uaugagauuugcuguuggu

SEQ ID NO: 1573712 - RNA, 19 nt, Homo sapiens
uaccauauagcauugauuc

SEQ ID NO: 1573713 - RNA, 19 nt, Homo sapiens
uuucaauccuccauuucaa

SEQ ID NO: 1573714 - RNA, 19 nt, Homo sapiens
acagugguagcauuuauga

SEQ ID NO: 1573715 - RNA, 19 nt, Homo sapiens
agaaucauccucagagagu

SEQ ID NO: 1573716 - RNA, 19 nt, Homo sapiens
guagcaagacagaaucauc

SEQ ID NO: 1573717 - RNA, 19 nt, Homo sapiens
acagguacauugcgguuac

SEQ ID NO: 1573718 - RNA, 19 nt, Homo sapiens
ucucuggccugcgcugauu

SEQ ID NO: 1573719 - RNA, 19 nt, Homo sapiens
gguagcauuuaugauuuca

SEQ ID NO: 1573720 - RNA, 19 nt, Homo sapiens
agacagaaucauccucaga

SEQ ID NO: 1573721 - RNA, 19 nt, Homo sapiens
guugucagaccguuguaaa

SEQ ID NO: 1573722 - RNA, 19 nt, Homo sapiens
gcaucagcguguccuggau

SEQ ID NO: 1573723 - RNA, 19 nt, Homo sapiens
ccaugaauuuguuuucuga

SEQ ID NO: 1573724 - RNA, 19 nt, Homo sapiens
ucagcaaccaugaauuugu

SEQ ID NO: 1573725 - RNA, 19 nt, Homo sapiens
gggugauucuguacauagu

SEQ ID NO: 1573726 - RNA, 19 nt, Homo sapiens
uaucugaugcccuaaacug

SEQ ID NO: 1573727 - RNA, 19 nt, Homo sapiens
gacagguacauugcgguua

SEQ ID NO: 1573728 - RNA, 19 nt, Homo sapiens
gauucuguacauaguguuu

SEQ ID NO: 1573729 - RNA, 19 nt, Homo sapiens
uaacuggucagguuuuaaa

SEQ ID NO: 1573730 - RNA, 19 nt, Homo sapiens
ccauauagcauugauucau

SEQ ID NO: 1573731 - RNA, 19 nt, Homo sapiens
ccuaccaaguucaccguau

SEQ ID NO: 1573732 - RNA, 19 nt, Homo sapiens
gccuguauuuaugagauuu

SEQ ID NO: 1573733 - RNA, 19 nt, Homo sapiens
uuggaaaccuccuggugau

SEQ ID NO: 1573734 - RNA, 19 nt, Homo sapiens
aaaacuggguguugacaga

SEQ ID NO: 1573735 - RNA, 19 nt, Homo sapiens
ccgggugauucuguacaua

SEQ ID NO: 1573736 - RNA, 19 nt, Homo sapiens
gagguugucagaccguugu

SEQ ID NO: 1573737 - RNA, 19 nt, Homo sapiens
cugcugugauguggcauuu

SEQ ID NO: 1573738 - RNA, 19 nt, Homo sapiens
ugcacucuccgaccaauuu

SEQ ID NO: 1573739 - RNA, 19 nt, Homo sapiens
gggucacagugguagcauu

SEQ ID NO: 1573740 - RNA, 19 nt, Homo sapiens
ccaaguucaccguaucugu

SEQ ID NO: 1573741 - RNA, 19 nt, Homo sapiens
ccucagagaguuacaaagc

SEQ ID NO: 1573742 - RNA, 19 nt, Homo sapiens
acuggguguugacagauuu

SEQ ID NO: 1573743 - RNA, 19 nt, Homo sapiens
ugucagaccguuguaaauc

SEQ ID NO: 1573744 - RNA, 19 nt, Homo sapiens
uacauaguguuuggcuuug

SEQ ID NO: 1573745 - RNA, 19 nt, Homo sapiens
ggucagguuuuaaagaaca

SEQ ID NO: 1573746 - RNA, 19 nt, Homo sapiens
uauaaccccugccuguauu

SEQ ID NO: 1573747 - RNA, 19 nt, Homo sapiens
guuaccauauagcauugau

SEQ ID NO: 1573748 - RNA, 19 nt, Homo sapiens
ugguagcauuuaugauuuc

SEQ ID NO: 1573749 - RNA, 19 nt, Homo sapiens
gguacauugcgguuacuga

SEQ ID NO: 1573750 - RNA, 19 nt, Homo sapiens
ggagagcugcugguauuuu

SEQ ID NO: 1573751 - RNA, 19 nt, Homo sapiens
gaagagguaugaagaagaa

SEQ ID NO: 1573752 - RNA, 19 nt, Homo sapiens
caggaacucucucauguua

SEQ ID NO: 1573753 - RNA, 19 nt, Homo sapiens
gaaguuguaucuuguauag

SEQ ID NO: 1573754 - RNA, 19 nt, Homo sapiens
gaaaucaaguucuucaagu

SEQ ID NO: 1573755 - RNA, 19 nt, Homo sapiens
gagcaucucuuucaaugug

SEQ ID NO: 1573756 - RNA, 19 nt, Homo sapiens
ggaacucucucauguuaga

SEQ ID NO: 1573757 - RNA, 19 nt, Homo sapiens
gcacaacugcugagaauga

SEQ ID NO: 1573758 - RNA, 19 nt, Homo sapiens
cugaacaacugcaagaaua

SEQ ID NO: 1573759 - RNA, 19 nt, Homo sapiens
guauagccacugcauauua

SEQ ID NO: 1573760 - RNA, 19 nt, Homo sapiens
gcucggagauugagagugu

SEQ ID NO: 1573761 - RNA, 19 nt, Homo sapiens
gaggaaggcugucucucaa

SEQ ID NO: 1573762 - RNA, 19 nt, Homo sapiens
gcgcacaacugcugagaau

SEQ ID NO: 1573763 - RNA, 19 nt, Homo sapiens
ggaagaagacuuggccuuu

SEQ ID NO: 1573764 - RNA, 19 nt, Homo sapiens
gaaauuccucugucucauu

SEQ ID NO: 1573765 - RNA, 19 nt, Homo sapiens
caaguucgccuccuucauu

SEQ ID NO: 1573766 - RNA, 19 nt, Homo sapiens
ggugggaaguuguaucuug

SEQ ID NO: 1573767 - RNA, 19 nt, Homo sapiens
gaaauaaacaagcgcacaa

SEQ ID NO: 1573768 - RNA, 19 nt, Homo sapiens
gcaggaggcuauggauuug

SEQ ID NO: 1573769 - RNA, 19 nt, Homo sapiens
ucaaggugcugaacaacaa

SEQ ID NO: 1573770 - RNA, 19 nt, Homo sapiens
gugaagcugucccuggaua

SEQ ID NO: 1573771 - RNA, 19 nt, Homo sapiens
gcgaagugguggaggacua

SEQ ID NO: 1573772 - RNA, 19 nt, Homo sapiens
gaagaagacuuggccuuuu

SEQ ID NO: 1573773 - RNA, 19 nt, Homo sapiens
gagguaugaagaagaaaua

SEQ ID NO: 1573774 - RNA, 19 nt, Homo sapiens
ggcaggaggcuauggauuu

SEQ ID NO: 1573775 - RNA, 19 nt, Homo sapiens
ggaaguuguaucuuguaua

SEQ ID NO: 1573776 - RNA, 19 nt, Homo sapiens
gggaaagaccuuagcucua

SEQ ID NO: 1573777 - RNA, 19 nt, Homo sapiens
agacugcgcucggagauug

SEQ ID NO: 1573778 - RNA, 19 nt, Homo sapiens
caagaagagguaugaagaa

SEQ ID NO: 1573779 - RNA, 19 nt, Homo sapiens
gcuccggacucuucuagga

SEQ ID NO: 1573780 - RNA, 19 nt, Homo sapiens
caagguggaugcccuggau

SEQ ID NO: 1573781 - RNA, 19 nt, Homo sapiens
cggagcaucucuuucaaug

SEQ ID NO: 1573782 - RNA, 19 nt, Homo sapiens
gggaaguuguaucuuguau

SEQ ID NO: 1573783 - RNA, 19 nt, Homo sapiens
caacugcugagaaugaauu

SEQ ID NO: 1573784 - RNA, 19 nt, Homo sapiens
guaacuauuuggccaugug

SEQ ID NO: 1573785 - RNA, 19 nt, Homo sapiens
caggauguccggagaauau

SEQ ID NO: 1573786 - RNA, 19 nt, Homo sapiens
gaauuuguggugcuuaaga

SEQ ID NO: 1573787 - RNA, 19 nt, Homo sapiens
gaaugaauuuguggugcuu

SEQ ID NO: 1573788 - RNA, 19 nt, Homo sapiens
ggacucuucuaggaaauuc

SEQ ID NO: 1573789 - RNA, 19 nt, Homo sapiens
gcauuucggucaucaacag

SEQ ID NO: 1573790 - RNA, 19 nt, Homo sapiens
gcaggaacucucucauguu

SEQ ID NO: 1573791 - RNA, 19 nt, Homo sapiens
gaagcugucccuggauauu

SEQ ID NO: 1573792 - RNA, 19 nt, Homo sapiens
ggacugugcccucaaggau

SEQ ID NO: 1573793 - RNA, 19 nt, Homo sapiens
ggaccuggacagcaucauu

SEQ ID NO: 1573794 - RNA, 19 nt, Homo sapiens
guggaggacuacaagaaga

SEQ ID NO: 1573795 - RNA, 19 nt, Homo sapiens
caagggauuugugcucuuc

SEQ ID NO: 1573796 - RNA, 19 nt, Homo sapiens
aaaucaaguucuucaagug

SEQ ID NO: 1573797 - RNA, 19 nt, Homo sapiens
acaagaagagguaugaaga

SEQ ID NO: 1573798 - RNA, 19 nt, Homo sapiens
ugaacaacugcaagaauaa

SEQ ID NO: 1573799 - RNA, 19 nt, Homo sapiens
ggguacuuguccuuguuua

SEQ ID NO: 1573800 - RNA, 19 nt, Homo sapiens
ugauagaccugcaggaacu

SEQ ID NO: 1573801 - RNA, 19 nt, Homo sapiens
ggcugucucucaaggguaa

SEQ ID NO: 1573802 - RNA, 19 nt, Homo sapiens
uccugugucuuaccaauaa

SEQ ID NO: 1573803 - RNA, 19 nt, Homo sapiens
gauuugugcucuucaucug

SEQ ID NO: 1573804 - RNA, 19 nt, Homo sapiens
auauugagaucgccaccua

SEQ ID NO: 1573805 - RNA, 19 nt, Homo sapiens
ugcaggaacucucucaugu

SEQ ID NO: 1573806 - RNA, 19 nt, Homo sapiens
ugagguccgugcccaguau

SEQ ID NO: 1573807 - RNA, 19 nt, Homo sapiens
gaccuggacagcaucauug

SEQ ID NO: 1573808 - RNA, 19 nt, Homo sapiens
gugggaaguuguaucuugu

SEQ ID NO: 1573809 - RNA, 19 nt, Homo sapiens
guacacaaguuuucagauc

SEQ ID NO: 1573810 - RNA, 19 nt, Homo sapiens
ggauggagaaaucaaguuc

SEQ ID NO: 1573811 - RNA, 19 nt, Homo sapiens
gcccggagcaucucuuuca

SEQ ID NO: 1573812 - RNA, 19 nt, Homo sapiens
agaucaaggugcugaacaa

SEQ ID NO: 1573813 - RNA, 19 nt, Homo sapiens
gcauggggaugaccugaaa

SEQ ID NO: 1573814 - RNA, 19 nt, Homo sapiens
ggagcuggacccugaaauc

SEQ ID NO: 1573815 - RNA, 19 nt, Homo sapiens
acaacaaguucgccuccuu

SEQ ID NO: 1573816 - RNA, 19 nt, Homo sapiens
uauagccacugcauauuac

SEQ ID NO: 1573817 - RNA, 19 nt, Homo sapiens
uucauacccugucucagua

SEQ ID NO: 1573818 - RNA, 19 nt, Homo sapiens
ggacguggacgcagcuuac

SEQ ID NO: 1573819 - RNA, 19 nt, Homo sapiens
gaccugaacaacugcaaga

SEQ ID NO: 1573820 - RNA, 19 nt, Homo sapiens
ucccugcuccugugucuua

SEQ ID NO: 1573821 - RNA, 19 nt, Homo sapiens
guggguacuuguccuuguu

SEQ ID NO: 1573822 - RNA, 19 nt, Homo sapiens
ccucagucuuuguuaaugu

SEQ ID NO: 1573823 - RNA, 19 nt, Homo sapiens
cacagcccauuucccagua

SEQ ID NO: 1573824 - RNA, 19 nt, Homo sapiens
ggcuuuggauucagcaaug

SEQ ID NO: 1573825 - RNA, 19 nt, Homo sapiens
gcuccugugucuuaccaau

SEQ ID NO: 1573826 - RNA, 19 nt, Homo sapiens
ccaagggauuugugcucuu

SEQ ID NO: 1573827 - RNA, 19 nt, Homo sapiens
gcaggauguccggagaaua

SEQ ID NO: 1573828 - RNA, 19 nt, Homo sapiens
cagauccagucccacauca

SEQ ID NO: 1573829 - RNA, 19 nt, Homo sapiens
aagaagagguaugaagaag

SEQ ID NO: 1573830 - RNA, 19 nt, Homo sapiens
gaacaacugcaagaauaac

SEQ ID NO: 1573831 - RNA, 19 nt, Homo sapiens
ccucaucuccuucuugcuu

SEQ ID NO: 1573832 - RNA, 19 nt, Homo sapiens
ggcgaggagugcaggaugu

SEQ ID NO: 1573833 - RNA, 19 nt, Homo sapiens
gcugacccgucucauccaa

SEQ ID NO: 1573834 - RNA, 19 nt, Homo sapiens
cacaacugcugagaaugaa

SEQ ID NO: 1573835 - RNA, 19 nt, Homo sapiens
agauugagagugugaagaa

SEQ ID NO: 1573836 - RNA, 19 nt, Homo sapiens
uacccugucucaguaacua

SEQ ID NO: 1573837 - RNA, 19 nt, Homo sapiens
caucaggucaccaucaaca

SEQ ID NO: 1573838 - RNA, 19 nt, Homo sapiens
gagcuggagcccaucuuuc

SEQ ID NO: 1573839 - RNA, 19 nt, Homo sapiens
agacugcuccggacucuuc

SEQ ID NO: 1573840 - RNA, 19 nt, Homo sapiens
gugcaacacagcccauuuc

SEQ ID NO: 1573841 - RNA, 19 nt, Homo sapiens
cuucaucuguggguacuug

SEQ ID NO: 1573842 - RNA, 19 nt, Homo sapiens
ccugugcugcucuuucaua

SEQ ID NO: 1573843 - RNA, 19 nt, Homo sapiens
gggcaggaggcuauggauu

SEQ ID NO: 1573844 - RNA, 19 nt, Homo sapiens
ccaacuccgugagcauuuc

SEQ ID NO: 1573845 - RNA, 19 nt, Homo sapiens
aauuuguggugcuuaagaa

SEQ ID NO: 1573846 - RNA, 19 nt, Homo sapiens
gaguaccccuugaggcuaa

SEQ ID NO: 1573847 - RNA, 19 nt, Homo sapiens
cugccucagucuuuguuaa

SEQ ID NO: 1573848 - RNA, 19 nt, Homo sapiens
ccucucugccucagucuuu

SEQ ID NO: 1573849 - RNA, 19 nt, Homo sapiens
ugacccgucucauccaaag

SEQ ID NO: 1573850 - RNA, 19 nt, Homo sapiens
augaauuuguggugcuuaa

SEQ ID NO: 1573851 - RNA, 19 nt, Homo sapiens
gaaaggcaguguauucuga

SEQ ID NO: 1573852 - RNA, 19 nt, Homo sapiens
gcaacacgauuuauacauu

SEQ ID NO: 1573853 - RNA, 19 nt, Homo sapiens
gauaucaccugucaaaguu

SEQ ID NO: 1573854 - RNA, 19 nt, Homo sapiens
gcaaacgccuguccuguga

SEQ ID NO: 1573855 - RNA, 19 nt, Homo sapiens
caacacgauuuauacauug

SEQ ID NO: 1573856 - RNA, 19 nt, Homo sapiens
gaacuaacaagguuuacuu

SEQ ID NO: 1573857 - RNA, 19 nt, Homo sapiens
gaggauaucaccugucaaa

SEQ ID NO: 1573858 - RNA, 19 nt, Homo sapiens
gcacuuucagcuucaaaua

SEQ ID NO: 1573859 - RNA, 19 nt, Homo sapiens
cuaacaagguuuacuucaa

SEQ ID NO: 1573860 - RNA, 19 nt, Homo sapiens
gguauugcaacacgauuua

SEQ ID NO: 1573861 - RNA, 19 nt, Homo sapiens
ggauaucaccugucaaagu

SEQ ID NO: 1573862 - RNA, 19 nt, Homo sapiens
ugcaugcgcugauggagua

SEQ ID NO: 1573863 - RNA, 19 nt, Homo sapiens
gagauguuccugcccagua

SEQ ID NO: 1573864 - RNA, 19 nt, Homo sapiens
acagggaacuaacaagguu

SEQ ID NO: 1573865 - RNA, 19 nt, Homo sapiens
gcuggacgguuacguguuc

SEQ ID NO: 1573866 - RNA, 19 nt, Homo sapiens
acgaggugcuggacgguua

SEQ ID NO: 1573867 - RNA, 19 nt, Homo sapiens
caugaaaggcaguguauuc

SEQ ID NO: 1573868 - RNA, 19 nt, Homo sapiens
caaaauacuucaugaaagg

SEQ ID NO: 1573869 - RNA, 19 nt, Homo sapiens
ccaccucucccuucucaaa

SEQ ID NO: 1573870 - RNA, 19 nt, Homo sapiens
uugcagaacuugucagaag

SEQ ID NO: 1573871 - RNA, 19 nt, Homo sapiens
ccgaguacuucgacagcua

SEQ ID NO: 1573872 - RNA, 19 nt, Homo sapiens
uggaggauaucaccuguca

SEQ ID NO: 1573873 - RNA, 19 nt, Homo sapiens
agauguuccugcccaguaa

SEQ ID NO: 1573874 - RNA, 19 nt, Homo sapiens
caagauuugugcgguagau

SEQ ID NO: 1573875 - RNA, 19 nt, Homo sapiens
gcugggagagugcuuaugu

SEQ ID NO: 1573876 - RNA, 19 nt, Homo sapiens
gugcuuauguguggugugu

SEQ ID NO: 1573877 - RNA, 19 nt, Homo sapiens
gacagcacuuucagcuuca

SEQ ID NO: 1573878 - RNA, 19 nt, Homo sapiens
cagcuucaaauacaucauu

SEQ ID NO: 1573879 - RNA, 19 nt, Homo sapiens
uaucaccugucaaaguugu

SEQ ID NO: 1573880 - RNA, 19 nt, Homo sapiens
gcuauuaccacugcaagga

SEQ ID NO: 1573881 - RNA, 19 nt, Homo sapiens
agaagucuuauaacccuua

SEQ ID NO: 1573882 - RNA, 19 nt, Homo sapiens
gcuuaugugugguguguac

SEQ ID NO: 1573883 - RNA, 19 nt, Homo sapiens
cggcugcgcuuccaguucu

SEQ ID NO: 1573884 - RNA, 19 nt, Homo sapiens
ugucagaagucuuauaacc

SEQ ID NO: 1573885 - RNA, 19 nt, Homo sapiens
cuugucagaagucuuauaa

SEQ ID NO: 1573886 - RNA, 19 nt, Homo sapiens
gaagucuuauaacccuuac

SEQ ID NO: 1573887 - RNA, 19 nt, Homo sapiens
ggaguagacgagugagcuu

SEQ ID NO: 1573888 - RNA, 19 nt, Homo sapiens
acuuucagcuucaaauaca

SEQ ID NO: 1573889 - RNA, 19 nt, Homo sapiens
ucuuagagcagaaauaugg

SEQ ID NO: 1573890 - RNA, 19 nt, Homo sapiens
gaguagacgagugagcuuu

SEQ ID NO: 1573891 - RNA, 19 nt, Homo sapiens
uaggugaaagucaguguug

SEQ ID NO: 1573892 - RNA, 19 nt, Homo sapiens
caacauccgcugggagagu

SEQ ID NO: 1573893 - RNA, 19 nt, Homo sapiens
ugauggaguagacgaguga

SEQ ID NO: 1573894 - RNA, 19 nt, Homo sapiens
agggaacuaacaagguuua

SEQ ID NO: 1573895 - RNA, 19 nt, Homo sapiens
ucacugagauucaugagua

SEQ ID NO: 1573896 - RNA, 19 nt, Homo sapiens
ucacauaucucccaaagcu

SEQ ID NO: 1573897 - RNA, 19 nt, Homo sapiens
gaguuaaaccaaugcaaua

SEQ ID NO: 1573898 - RNA, 19 nt, Homo sapiens
cgaacaagguggugacugu

SEQ ID NO: 1573899 - RNA, 19 nt, Homo sapiens
gagugaagcugcagaucug

SEQ ID NO: 1573900 - RNA, 19 nt, Homo sapiens
gaaguggacaggaaacaug

SEQ ID NO: 1573901 - RNA, 19 nt, Homo sapiens
gaauguggaguuagccuuu

SEQ ID NO: 1573902 - RNA, 19 nt, Homo sapiens
ggaccgcaaugcccugaga

SEQ ID NO: 1573903 - RNA, 19 nt, Homo sapiens
cccaugcccuuuccuuuaa

SEQ ID NO: 1573904 - RNA, 19 nt, Homo sapiens
uggcaugaauguggaguua

SEQ ID NO: 1573905 - RNA, 19 nt, Homo sapiens
ggucacauaucucccaaag

SEQ ID NO: 1573906 - RNA, 19 nt, Homo sapiens
gaaacgcucaguccuggaa

SEQ ID NO: 1573907 - RNA, 19 nt, Homo sapiens
caggagauccaaucccaua

SEQ ID NO: 1573908 - RNA, 19 nt, Homo sapiens
gcucugggccucuugcauu

SEQ ID NO: 1573909 - RNA, 19 nt, Homo sapiens
ggucacccauuuccgaguu

SEQ ID NO: 1573910 - RNA, 19 nt, Homo sapiens
gcagucagcggcuccaguu

SEQ ID NO: 1573911 - RNA, 19 nt, Homo sapiens
uguaugacaucaccaacaa

SEQ ID NO: 1573912 - RNA, 19 nt, Homo sapiens
caugggaaguggacaggaa

SEQ ID NO: 1573913 - RNA, 19 nt, Homo sapiens
ggaguccgguagcugaaug

SEQ ID NO: 1573914 - RNA, 19 nt, Homo sapiens
gacaggaucucagaacucu

SEQ ID NO: 1573915 - RNA, 19 nt, Homo sapiens
gaccacguccugcauaaga

SEQ ID NO: 1573916 - RNA, 19 nt, Homo sapiens
aguaugcgcugcacauuuc

SEQ ID NO: 1573917 - RNA, 19 nt, Homo sapiens
gaaguaugcgcugcacauu

SEQ ID NO: 1573918 - RNA, 19 nt, Homo sapiens
ggagauccaaucccauaga

SEQ ID NO: 1573919 - RNA, 19 nt, Homo sapiens
agacgucucugcugguuca

SEQ ID NO: 1573920 - RNA, 19 nt, Homo sapiens
uccgguagcugaaugaaau

SEQ ID NO: 1573921 - RNA, 19 nt, Homo sapiens
caaaucuucuuucgacaac

SEQ ID NO: 1573922 - RNA, 19 nt, Homo sapiens
ccaaugcaauaugaguaaa

SEQ ID NO: 1573923 - RNA, 19 nt, Homo sapiens
gauccgagacuauguagag

SEQ ID NO: 1573924 - RNA, 19 nt, Homo sapiens
gcaacaaggcggauaugag

SEQ ID NO: 1573925 - RNA, 19 nt, Homo sapiens
gagcuggcccugacuucaa

SEQ ID NO: 1573926 - RNA, 19 nt, Homo sapiens
gcaugaauguggaguuagc

SEQ ID NO: 1573927 - RNA, 19 nt, Homo sapiens
gauaugagcagcgaaagag

SEQ ID NO: 1573928 - RNA, 19 nt, Homo sapiens
ggauaugagcagcgaaaga

SEQ ID NO: 1573929 - RNA, 19 nt, Homo sapiens
ugacaucaccaacaaaucu

SEQ ID NO: 1573930 - RNA, 19 nt, Homo sapiens
gagcggacaggaucucaga

SEQ ID NO: 1573931 - RNA, 19 nt, Homo sapiens
gcacauuucugaggcuacu

SEQ ID NO: 1573932 - RNA, 19 nt, Homo sapiens
ccagauccgagacuaugua

SEQ ID NO: 1573933 - RNA, 19 nt, Homo sapiens
cacccaugcuuauuacaga

SEQ ID NO: 1573934 - RNA, 19 nt, Homo sapiens
gcgucacccaugcuuauua

SEQ ID NO: 1573935 - RNA, 19 nt, Homo sapiens
aaagacgucucugcugguu

SEQ ID NO: 1573936 - RNA, 19 nt, Homo sapiens
guggauggcgugagaguga

SEQ ID NO: 1573937 - RNA, 19 nt, Homo sapiens
gacuguggauggcgugaga

SEQ ID NO: 1573938 - RNA, 19 nt, Homo sapiens
ugacauugccagucucuuc

SEQ ID NO: 1573939 - RNA, 19 nt, Homo sapiens
cuacugcauuugcuuucaa

SEQ ID NO: 1573940 - RNA, 19 nt, Homo sapiens
cgaguuaaaccaaugcaau

SEQ ID NO: 1573941 - RNA, 19 nt, Homo sapiens
uauguagagucccagaaga

SEQ ID NO: 1573942 - RNA, 19 nt, Homo sapiens
gagauccaaucccauagac

SEQ ID NO: 1573943 - RNA, 19 nt, Homo sapiens
ggacaggaucucagaacuc

SEQ ID NO: 1573944 - RNA, 19 nt, Homo sapiens
gcaucggauucacgaacaa

SEQ ID NO: 1573945 - RNA, 19 nt, Homo sapiens
gcggauaugagcagcgaaa

SEQ ID NO: 1573946 - RNA, 19 nt, Homo sapiens
ucaccaacaaaucuucuuu

SEQ ID NO: 1573947 - RNA, 19 nt, Homo sapiens
cgucucugcugguucaguu

SEQ ID NO: 1573948 - RNA, 19 nt, Homo sapiens
acccaugcccuuuccuuua

SEQ ID NO: 1573949 - RNA, 19 nt, Homo sapiens
ccaagacuggcaugaaugu

SEQ ID NO: 1573950 - RNA, 19 nt, Homo sapiens
uccuuuaacuucucaaaca

SEQ ID NO: 1573951 - RNA, 19 nt, Homo sapiens
ggcaucggauucacgaaca

SEQ ID NO: 1573952 - RNA, 19 nt, Homo sapiens
gcuacugcauuugcuuuca

SEQ ID NO: 1573953 - RNA, 19 nt, Homo sapiens
guuaaaccaaugcaauaug

SEQ ID NO: 1573954 - RNA, 19 nt, Homo sapiens
gagcagcgaaagagugauc

SEQ ID NO: 1573955 - RNA, 19 nt, Homo sapiens
cagccggacccaaaucuug

SEQ ID NO: 1573956 - RNA, 19 nt, Homo sapiens
ugaccugcaggcaucuuua

SEQ ID NO: 1573957 - RNA, 19 nt, Homo sapiens
uguccuccuuggucacaua

SEQ ID NO: 1573958 - RNA, 19 nt, Homo sapiens
uaacuucucaaacagauac

SEQ ID NO: 1573959 - RNA, 19 nt, Homo sapiens
caacggcggagucgcuguu

SEQ ID NO: 1573960 - RNA, 19 nt, Homo sapiens
agacagcucugggccucuu

SEQ ID NO: 1573961 - RNA, 19 nt, Homo sapiens
gcagggaggaggcugacau

SEQ ID NO: 1573962 - RNA, 19 nt, Homo sapiens
ucgccaaggaacugaaaua

SEQ ID NO: 1573963 - RNA, 19 nt, Homo sapiens
gggaggaggcugacauugc

SEQ ID NO: 1573964 - RNA, 19 nt, Homo sapiens
gucacccauuuccgaguua

SEQ ID NO: 1573965 - RNA, 19 nt, Homo sapiens
uaugacaucaccaacaaau

SEQ ID NO: 1573966 - RNA, 19 nt, Homo sapiens
ugacaguggugugggaaag

SEQ ID NO: 1573967 - RNA, 19 nt, Homo sapiens
ggaaguggacaggaaacau

SEQ ID NO: 1573968 - RNA, 19 nt, Homo sapiens
ucacccauuuccgaguuaa

SEQ ID NO: 1573969 - RNA, 19 nt, Homo sapiens
acgaccacguccugcauaa

SEQ ID NO: 1573970 - RNA, 19 nt, Homo sapiens
gcccuuuccuuuaacuucu

SEQ ID NO: 1573971 - RNA, 19 nt, Homo sapiens
acaaaucuucuuucgacaa

SEQ ID NO: 1573972 - RNA, 19 nt, Homo sapiens
cgucacccaugcuuauuac

SEQ ID NO: 1573973 - RNA, 19 nt, Homo sapiens
cugggccucuugcauuuga

SEQ ID NO: 1573974 - RNA, 19 nt, Homo sapiens
cugcugcuccuucauguga

SEQ ID NO: 1573975 - RNA, 19 nt, Homo sapiens
agagggacguggugaucau

SEQ ID NO: 1573976 - RNA, 19 nt, Homo sapiens
aggccuugcuucugcugua

SEQ ID NO: 1573977 - RNA, 19 nt, Homo sapiens
gucagcggcuccaguuugg

SEQ ID NO: 1573978 - RNA, 19 nt, Homo sapiens
uuucugaggcuacugcauu

SEQ ID NO: 1573979 - RNA, 19 nt, Homo sapiens
gauaccagggccuaaacug

SEQ ID NO: 1573980 - RNA, 19 nt, Homo sapiens
ggagcuggcccugacuuca

SEQ ID NO: 1573981 - RNA, 19 nt, Homo sapiens
ccuugcuucugcuguauga

SEQ ID NO: 1573982 - RNA, 19 nt, Homo sapiens
acagauaccagggccuaaa

SEQ ID NO: 1573983 - RNA, 19 nt, Homo sapiens
caacgaccacguccugcau

SEQ ID NO: 1573984 - RNA, 19 nt, Homo sapiens
aaucuucuuucgacaacau

SEQ ID NO: 1573985 - RNA, 19 nt, Homo sapiens
gacaucaccaacaaaucuu

SEQ ID NO: 1573986 - RNA, 19 nt, Homo sapiens
aaacugcaguauuuuggaa

SEQ ID NO: 1573987 - RNA, 19 nt, Homo sapiens
acaaagucauguggguaug

SEQ ID NO: 1573988 - RNA, 19 nt, Homo sapiens
guccuaagaggcagggauu

SEQ ID NO: 1573989 - RNA, 19 nt, Homo sapiens
aaccaaugcaauaugagua

SEQ ID NO: 1573990 - RNA, 19 nt, Homo sapiens
aaaccaaugcaauaugagu

SEQ ID NO: 1573991 - RNA, 19 nt, Homo sapiens
gcuuccagauccgagacua

SEQ ID NO: 1573992 - RNA, 19 nt, Homo sapiens
ggcaacaaggcggauauga

SEQ ID NO: 1573993 - RNA, 19 nt, Homo sapiens
ccaacaaaucuucuuucga

SEQ ID NO: 1573994 - RNA, 19 nt, Homo sapiens
cucugggccucuugcauuu

SEQ ID NO: 1573995 - RNA, 19 nt, Homo sapiens
gaacaacacuaccacuuga

SEQ ID NO: 1573996 - RNA, 19 nt, Homo sapiens
gacaagauuuggaaguuua

SEQ ID NO: 1573997 - RNA, 19 nt, Homo sapiens
gaauuaaguucagcuauug

SEQ ID NO: 1573998 - RNA, 19 nt, Homo sapiens
gaaaggagacccaaagaug

SEQ ID NO: 1573999 - RNA, 19 nt, Homo sapiens
gcacuuggcuggcuuaugc

SEQ ID NO: 1574000 - RNA, 19 nt, Homo sapiens
ggacaagauuuggaaguuu

SEQ ID NO: 1574001 - RNA, 19 nt, Homo sapiens
ggaaaggcaauauuuauga

SEQ ID NO: 1574002 - RNA, 19 nt, Homo sapiens
aaggauagcugcagauuga

SEQ ID NO: 1574003 - RNA, 19 nt, Homo sapiens
ggaaagacagguaaaguga

SEQ ID NO: 1574004 - RNA, 19 nt, Homo sapiens
gaaguuuagucaccucuga

SEQ ID NO: 1574005 - RNA, 19 nt, Homo sapiens
gaacauucccugucugguu

SEQ ID NO: 1574006 - RNA, 19 nt, Homo sapiens
aaagacagguaaagugauu

SEQ ID NO: 1574007 - RNA, 19 nt, Homo sapiens
gaauuggcauugcaggaaa

SEQ ID NO: 1574008 - RNA, 19 nt, Homo sapiens
cagcaaacauuaccuucuu

SEQ ID NO: 1574009 - RNA, 19 nt, Homo sapiens
aaaaugagguugucaguuu

SEQ ID NO: 1574010 - RNA, 19 nt, Homo sapiens
caaagaugaccaaguguuu

SEQ ID NO: 1574011 - RNA, 19 nt, Homo sapiens
gacaaaggguuuucuagua

SEQ ID NO: 1574012 - RNA, 19 nt, Homo sapiens
uauauucacuugugucuuc

SEQ ID NO: 1574013 - RNA, 19 nt, Homo sapiens
gggaacuacagaugaauua

SEQ ID NO: 1574014 - RNA, 19 nt, Homo sapiens
caccuggccugcaaaguuu

SEQ ID NO: 1574015 - RNA, 19 nt, Homo sapiens
agaaggagcugugcggaaa

SEQ ID NO: 1574016 - RNA, 19 nt, Homo sapiens
gaaaagggccauacauuug

SEQ ID NO: 1574017 - RNA, 19 nt, Homo sapiens
cucagaaacuccuggcuua

SEQ ID NO: 1574018 - RNA, 19 nt, Homo sapiens
ggagggaugugggaaugaa

SEQ ID NO: 1574019 - RNA, 19 nt, Homo sapiens
gagggacucugaaaucaca

SEQ ID NO: 1574020 - RNA, 19 nt, Homo sapiens
ggaaggcggacaagauuug

SEQ ID NO: 1574021 - RNA, 19 nt, Homo sapiens
ccagguauauucacuugug

SEQ ID NO: 1574022 - RNA, 19 nt, Homo sapiens
uaaacagacucagugacua

SEQ ID NO: 1574023 - RNA, 19 nt, Homo sapiens
aacauuaccuucuuaguca

SEQ ID NO: 1574024 - RNA, 19 nt, Homo sapiens
ggauggagaugcugaugag

SEQ ID NO: 1574025 - RNA, 19 nt, Homo sapiens
ugaaaugccuggcgaacuc

SEQ ID NO: 1574026 - RNA, 19 nt, Homo sapiens
caucacauauugacugagu

SEQ ID NO: 1574027 - RNA, 19 nt, Homo sapiens
gcucggcgcugcauuucug

SEQ ID NO: 1574028 - RNA, 19 nt, Homo sapiens
uaaaguauaccacguucaa

SEQ ID NO: 1574029 - RNA, 19 nt, Homo sapiens
uggguuugcucuggaauua

SEQ ID NO: 1574030 - RNA, 19 nt, Homo sapiens
gaacuacagaugaauuaag

SEQ ID NO: 1574031 - RNA, 19 nt, Homo sapiens
ggagaaaggagacccaaag

SEQ ID NO: 1574032 - RNA, 19 nt, Homo sapiens
ggccagguauauucacuug

SEQ ID NO: 1574033 - RNA, 19 nt, Homo sapiens
ggcaggcucuuguccaguu

SEQ ID NO: 1574034 - RNA, 19 nt, Homo sapiens
gggaaaggcaauauuuaug

SEQ ID NO: 1574035 - RNA, 19 nt, Homo sapiens
ccacggcuguauuuauuuc

SEQ ID NO: 1574036 - RNA, 19 nt, Homo sapiens
gagaacaacacuaccacuu

SEQ ID NO: 1574037 - RNA, 19 nt, Homo sapiens
ucagguuguucacagauuu

SEQ ID NO: 1574038 - RNA, 19 nt, Homo sapiens
gagaaaggagacccaaaga

SEQ ID NO: 1574039 - RNA, 19 nt, Homo sapiens
ccaccuggccugcaaaguu

SEQ ID NO: 1574040 - RNA, 19 nt, Homo sapiens
ugccacggcuguauuuauu

SEQ ID NO: 1574041 - RNA, 19 nt, Homo sapiens
gaaggauagcugcagauug

SEQ ID NO: 1574042 - RNA, 19 nt, Homo sapiens
aaaggagacccaaagauga

SEQ ID NO: 1574043 - RNA, 19 nt, Homo sapiens
ggaaggauagcugcagauu

SEQ ID NO: 1574044 - RNA, 19 nt, Homo sapiens
ggaaaaggaauaaaaguug

SEQ ID NO: 1574045 - RNA, 19 nt, Homo sapiens
gaacuccauucagccauca

SEQ ID NO: 1574046 - RNA, 19 nt, Homo sapiens
guucacagauuuggaaugg

SEQ ID NO: 1574047 - RNA, 19 nt, Homo sapiens
gccaucacauauugacuga

SEQ ID NO: 1574048 - RNA, 19 nt, Homo sapiens
agacugauuucuccgaugu

SEQ ID NO: 1574049 - RNA, 19 nt, Homo sapiens
ggccacagccuuccucgaa

SEQ ID NO: 1574050 - RNA, 19 nt, Homo sapiens
gauaugcagccaugaagga

SEQ ID NO: 1574051 - RNA, 19 nt, Homo sapiens
gaccaggagugugugaaug

SEQ ID NO: 1574052 - RNA, 19 nt, Homo sapiens
gcaggagggccagguauau

SEQ ID NO: 1574053 - RNA, 19 nt, Homo sapiens
ccaaagaugaccaaguguu

SEQ ID NO: 1574054 - RNA, 19 nt, Homo sapiens
acccaaagaugaccaagug

SEQ ID NO: 1574055 - RNA, 19 nt, Homo sapiens
gcaggcucuuguccaguuu

SEQ ID NO: 1574056 - RNA, 19 nt, Homo sapiens
gaaacuccuggcuuagauu

SEQ ID NO: 1574057 - RNA, 19 nt, Homo sapiens
cggacaagauuuggaaguu

SEQ ID NO: 1574058 - RNA, 19 nt, Homo sapiens
ggaacuacagaugaauuaa

SEQ ID NO: 1574059 - RNA, 19 nt, Homo sapiens
aaacauuaccuucuuaguc

SEQ ID NO: 1574060 - RNA, 19 nt, Homo sapiens
auucagccaucacauauug

SEQ ID NO: 1574061 - RNA, 19 nt, Homo sapiens
gaaagacagguaaagugau

SEQ ID NO: 1574062 - RNA, 19 nt, Homo sapiens
agcaguggaucgacaagua

SEQ ID NO: 1574063 - RNA, 19 nt, Homo sapiens
cgugggaacuacagaugaa

SEQ ID NO: 1574064 - RNA, 19 nt, Homo sapiens
ugaaagggauggagaugcu

SEQ ID NO: 1574065 - RNA, 19 nt, Homo sapiens
ggaggggaaucaagagaaa

SEQ ID NO: 1574066 - RNA, 19 nt, Homo sapiens
aaacagacucagugacuau

SEQ ID NO: 1574067 - RNA, 19 nt, Homo sapiens
ccgggaggcucacuuaaag

SEQ ID NO: 1574068 - RNA, 19 nt, Homo sapiens
gaaaauccagugcacauug

SEQ ID NO: 1574069 - RNA, 19 nt, Homo sapiens
ggcaagucagcaaacauua

SEQ ID NO: 1574070 - RNA, 19 nt, Homo sapiens
agaaacuccuggcuuagau

SEQ ID NO: 1574071 - RNA, 19 nt, Homo sapiens
gcaaacauuaccuucuuag

SEQ ID NO: 1574072 - RNA, 19 nt, Homo sapiens
aaguucagcuauuggguuu

SEQ ID NO: 1574073 - RNA, 19 nt, Homo sapiens
gguuugcucuggaauuagu

SEQ ID NO: 1574074 - RNA, 19 nt, Homo sapiens
agcaaacauuaccuucuua

SEQ ID NO: 1574075 - RNA, 19 nt, Homo sapiens
ccagauaugcagccaugaa

SEQ ID NO: 1574076 - RNA, 19 nt, Homo sapiens
ggugcucaguguuugcaaa

SEQ ID NO: 1574077 - RNA, 19 nt, Homo sapiens
uccaggagguggcuuuguu

SEQ ID NO: 1574078 - RNA, 19 nt, Homo sapiens
cuuagucacgugcauauuu

SEQ ID NO: 1574079 - RNA, 19 nt, Homo sapiens
gcucccuccugcuaugaaa

SEQ ID NO: 1574080 - RNA, 19 nt, Homo sapiens
gagaugcugaugagaacaa

SEQ ID NO: 1574081 - RNA, 19 nt, Homo sapiens
cggagucggugcucagugu

SEQ ID NO: 1574082 - RNA, 19 nt, Homo sapiens
ggucuuuccggccaucuuu

SEQ ID NO: 1574083 - RNA, 19 nt, Homo sapiens
ccauucagccaucacauau

SEQ ID NO: 1574084 - RNA, 19 nt, Homo sapiens
ggaccagaggcccuugaaa

SEQ ID NO: 1574085 - RNA, 19 nt, Homo sapiens
gccauacauuugccgaaga

SEQ ID NO: 1574086 - RNA, 19 nt, Homo sapiens
gcaagucagcaaacauuac

SEQ ID NO: 1574087 - RNA, 19 nt, Homo sapiens
agaacaacacuaccacuug

SEQ ID NO: 1574088 - RNA, 19 nt, Homo sapiens
gacaggcgaggcucagaaa

SEQ ID NO: 1574089 - RNA, 19 nt, Homo sapiens
gggaaggcggacaagauuu

SEQ ID NO: 1574090 - RNA, 19 nt, Homo sapiens
cuacagaugaauuaaguuc

SEQ ID NO: 1574091 - RNA, 19 nt, Homo sapiens
cagaugaccaggagugugu

SEQ ID NO: 1574092 - RNA, 19 nt, Homo sapiens
ugcagcaucuucagcuuga

SEQ ID NO: 1574093 - RNA, 19 nt, Homo sapiens
gaccagaggcccuugaaaa

SEQ ID NO: 1574094 - RNA, 19 nt, Homo sapiens
ugggaaaggcaauauuuau

SEQ ID NO: 1574095 - RNA, 19 nt, Homo sapiens
ggaagcaccugcagaauua

SEQ ID NO: 1574096 - RNA, 19 nt, Homo sapiens
gcaaagaccugaccuugaa

SEQ ID NO: 1574097 - RNA, 19 nt, Homo sapiens
gcaaauuucuugggcaaug

SEQ ID NO: 1574098 - RNA, 19 nt, Homo sapiens
ggaguacucuuugcuguug

SEQ ID NO: 1574099 - RNA, 19 nt, Homo sapiens
auacagagcugaacugcuu

SEQ ID NO: 1574100 - RNA, 19 nt, Homo sapiens
guaugaagcagaagucuuu

SEQ ID NO: 1574101 - RNA, 19 nt, Homo sapiens
ggagggagaggagagauua

SEQ ID NO: 1574102 - RNA, 19 nt, Homo sapiens
caagaaagaacuucccauu

SEQ ID NO: 1574103 - RNA, 19 nt, Homo sapiens
gaucaacagccaugugaaa

SEQ ID NO: 1574104 - RNA, 19 nt, Homo sapiens
gaaaccauccucccgaaga

SEQ ID NO: 1574105 - RNA, 19 nt, Homo sapiens
ucauuugcaugucuuagua

SEQ ID NO: 1574106 - RNA, 19 nt, Homo sapiens
cacaugcucuuauuucguu

SEQ ID NO: 1574107 - RNA, 19 nt, Homo sapiens
gaagaggaaccugcaaaga

SEQ ID NO: 1574108 - RNA, 19 nt, Homo sapiens
ggacagggcaggagaagag

SEQ ID NO: 1574109 - RNA, 19 nt, Homo sapiens
gcuccaaucuacugugugu

SEQ ID NO: 1574110 - RNA, 19 nt, Homo sapiens
gagaagaggaaccugcaaa

SEQ ID NO: 1574111 - RNA, 19 nt, Homo sapiens
gaaagaacuucccauuccu

SEQ ID NO: 1574112 - RNA, 19 nt, Homo sapiens
ggaagguuguagacauaau

SEQ ID NO: 1574113 - RNA, 19 nt, Homo sapiens
gaauuaaucacaugcucuu

SEQ ID NO: 1574114 - RNA, 19 nt, Homo sapiens
gagacucccugcagguuuc

SEQ ID NO: 1574115 - RNA, 19 nt, Homo sapiens
agaaagaacuucccauucc

SEQ ID NO: 1574116 - RNA, 19 nt, Homo sapiens
uugcaugucuuaguaauga

SEQ ID NO: 1574117 - RNA, 19 nt, Homo sapiens
agaggaaccugcaaagaca

SEQ ID NO: 1574118 - RNA, 19 nt, Homo sapiens
gagaugccguggccuucuu

SEQ ID NO: 1574119 - RNA, 19 nt, Homo sapiens
aauggcaucuuaccuuuau

SEQ ID NO: 1574120 - RNA, 19 nt, Homo sapiens
gagaggagagauuaaagug

SEQ ID NO: 1574121 - RNA, 19 nt, Homo sapiens
gcagguuucuaaagugagu

SEQ ID NO: 1574122 - RNA, 19 nt, Homo sapiens
agggaagguuguagacaua

SEQ ID NO: 1574123 - RNA, 19 nt, Homo sapiens
gaggcuguaugaagcagaa

SEQ ID NO: 1574124 - RNA, 19 nt, Homo sapiens
gcuggaagcaccugcagaa

SEQ ID NO: 1574125 - RNA, 19 nt, Homo sapiens
augucuagcuggagaauaa

SEQ ID NO: 1574126 - RNA, 19 nt, Homo sapiens
ggagaggagagauuaaagu

SEQ ID NO: 1574127 - RNA, 19 nt, Homo sapiens
guuccaaaauggcaucuua

SEQ ID NO: 1574128 - RNA, 19 nt, Homo sapiens
gaaccugcaaagacauauu

SEQ ID NO: 1574129 - RNA, 19 nt, Homo sapiens
gcaggucacugugcauguc

SEQ ID NO: 1574130 - RNA, 19 nt, Homo sapiens
aaagguggauagagguguu

SEQ ID NO: 1574131 - RNA, 19 nt, Homo sapiens
gagccacucacuccagaaa

SEQ ID NO: 1574132 - RNA, 19 nt, Homo sapiens
caagaugaggcaacuggaa

SEQ ID NO: 1574133 - RNA, 19 nt, Homo sapiens
caaauuucuugggcaaugu

SEQ ID NO: 1574134 - RNA, 19 nt, Homo sapiens
gacuuugccuuccgccuau

SEQ ID NO: 1574135 - RNA, 19 nt, Homo sapiens
ugucagggcucaccaacca

SEQ ID NO: 1574136 - RNA, 19 nt, Homo sapiens
uggaagcaccugcagaauu

SEQ ID NO: 1574137 - RNA, 19 nt, Homo sapiens
cugcagguuucuaaaguga

SEQ ID NO: 1574138 - RNA, 19 nt, Homo sapiens
aaaauggcaucuuaccuuu

SEQ ID NO: 1574139 - RNA, 19 nt, Homo sapiens
aaaccauccucccgaagau

SEQ ID NO: 1574140 - RNA, 19 nt, Homo sapiens
gaagguuguagacauaauc

SEQ ID NO: 1574141 - RNA, 19 nt, Homo sapiens
ccuacaaucuggaaaccau

SEQ ID NO: 1574142 - RNA, 19 nt, Homo sapiens
gaggagagagcuacaacca

SEQ ID NO: 1574143 - RNA, 19 nt, Homo sapiens
agagagcuacaaccaagua

SEQ ID NO: 1574144 - RNA, 19 nt, Homo sapiens
ucuaaagugaguugaauga

SEQ ID NO: 1574145 - RNA, 19 nt, Homo sapiens
gcuuugugcugcagaugga

SEQ ID NO: 1574146 - RNA, 19 nt, Homo sapiens
gagagacucccugcagguu

SEQ ID NO: 1574147 - RNA, 19 nt, Homo sapiens
ccucugugcuccaaucuac

SEQ ID NO: 1574148 - RNA, 19 nt, Homo sapiens
caaaauggcaucuuaccuu

SEQ ID NO: 1574149 - RNA, 19 nt, Homo sapiens
cugcagaauuaaucacaug

SEQ ID NO: 1574150 - RNA, 19 nt, Homo sapiens
gcaccugcagaauuaauca

SEQ ID NO: 1574151 - RNA, 19 nt, Homo sapiens
ccacuucccuggccaugcu

SEQ ID NO: 1574152 - RNA, 19 nt, Homo sapiens
aaauggcaucuuaccuuua

SEQ ID NO: 1574153 - RNA, 19 nt, Homo sapiens
aaucacaugcucuuauuuc

SEQ ID NO: 1574154 - RNA, 19 nt, Homo sapiens
gccagaacacugagaaagu

SEQ ID NO: 1574155 - RNA, 19 nt, Homo sapiens
aagggaagguuguagacau

SEQ ID NO: 1574156 - RNA, 19 nt, Homo sapiens
gucaagaggcuguaugaag

SEQ ID NO: 1574157 - RNA, 19 nt, Homo sapiens
gagagcuacaaccaaguaa

SEQ ID NO: 1574158 - RNA, 19 nt, Homo sapiens
cacccugaauauacaagaa

SEQ ID NO: 1574159 - RNA, 19 nt, Homo sapiens
gagggagaggagagauuaa

SEQ ID NO: 1574160 - RNA, 19 nt, Homo sapiens
gugcuccaaucuacugugu

SEQ ID NO: 1574161 - RNA, 19 nt, Homo sapiens
aagaaagaacuucccauuc

SEQ ID NO: 1574162 - RNA, 19 nt, Homo sapiens
gggaagguuguagacauaa

SEQ ID NO: 1574163 - RNA, 19 nt, Homo sapiens
agauuaaagugaggagaga

SEQ ID NO: 1574164 - RNA, 19 nt, Homo sapiens
gaagcaccugcagaauuaa

SEQ ID NO: 1574165 - RNA, 19 nt, Homo sapiens
uaaagugaggagagagcua

SEQ ID NO: 1574166 - RNA, 19 nt, Homo sapiens
caaccaaguaagcaagugu

SEQ ID NO: 1574167 - RNA, 19 nt, Homo sapiens
ucaccaagacccagauucu

SEQ ID NO: 1574168 - RNA, 19 nt, Homo sapiens
gagcuacaaccaaguaagc

SEQ ID NO: 1574169 - RNA, 19 nt, Homo sapiens
ccaugaugcaccagaaaga

SEQ ID NO: 1574170 - RNA, 19 nt, Homo sapiens
ggagaagaggaaccugcaa

SEQ ID NO: 1574171 - RNA, 19 nt, Homo sapiens
gguuguagacauaauccaa

SEQ ID NO: 1574172 - RNA, 19 nt, Homo sapiens
gaagucuuuucuacagauu

SEQ ID NO: 1574173 - RNA, 19 nt, Homo sapiens
gaagacccaagggaagguu

SEQ ID NO: 1574174 - RNA, 19 nt, Homo sapiens
gcugcaggcaaauuucuug

SEQ ID NO: 1574175 - RNA, 19 nt, Homo sapiens
caaggacagggcaggagaa

SEQ ID NO: 1574176 - RNA, 19 nt, Homo sapiens
aaccugcaaagacauauuu

SEQ ID NO: 1574177 - RNA, 19 nt, Homo sapiens
gcuacaaccaaguaagcaa

SEQ ID NO: 1574178 - RNA, 19 nt, Homo sapiens
gaggaucaacagccaugug

SEQ ID NO: 1574179 - RNA, 19 nt, Homo sapiens
gcagcugcaggcaaauuuc

SEQ ID NO: 1574180 - RNA, 19 nt, Homo sapiens
ugacuguucccagcaaaga

SEQ ID NO: 1574181 - RNA, 19 nt, Homo sapiens
gggagaggagagauuaaag

SEQ ID NO: 1574182 - RNA, 19 nt, Homo sapiens
agaggagagauuaaaguga

SEQ ID NO: 1574183 - RNA, 19 nt, Homo sapiens
gcaaugucaagaggcugua

SEQ ID NO: 1574184 - RNA, 19 nt, Homo sapiens
cuauaccgcaggcugguuu

SEQ ID NO: 1574185 - RNA, 19 nt, Homo sapiens
ccugcagguuucuaaagug

SEQ ID NO: 1574186 - RNA, 19 nt, Homo sapiens
ggaucaacagccaugugaa

SEQ ID NO: 1574187 - RNA, 19 nt, Homo sapiens
caagaggcuguaugaagca

SEQ ID NO: 1574188 - RNA, 19 nt, Homo sapiens
gggcggagcugcugaaaug

SEQ ID NO: 1574189 - RNA, 19 nt, Homo sapiens
gaagggauguccgcuauau

SEQ ID NO: 1574190 - RNA, 19 nt, Homo sapiens
uguaugaccugacacaaua

SEQ ID NO: 1574191 - RNA, 19 nt, Homo sapiens
gaaggucggaggaguguua

SEQ ID NO: 1574192 - RNA, 19 nt, Homo sapiens
uaaaggaccugguagagau

SEQ ID NO: 1574193 - RNA, 19 nt, Homo sapiens
ggaccaggcuugcugugaa

SEQ ID NO: 1574194 - RNA, 19 nt, Homo sapiens
caaauaaacgagauggaua

SEQ ID NO: 1574195 - RNA, 19 nt, Homo sapiens
gcaagagucggcacaauga

SEQ ID NO: 1574196 - RNA, 19 nt, Homo sapiens
uaaacgagauggauaaagg

SEQ ID NO: 1574197 - RNA, 19 nt, Homo sapiens
gcuggaggaucucagguuu

SEQ ID NO: 1574198 - RNA, 19 nt, Homo sapiens
gcugugaagugguguaugu

SEQ ID NO: 1574199 - RNA, 19 nt, Homo sapiens
gauguccgcuauauccaaa

SEQ ID NO: 1574200 - RNA, 19 nt, Homo sapiens
acuagccucuccauacuua

SEQ ID NO: 1574201 - RNA, 19 nt, Homo sapiens
cgagauggauaaaggugaa

SEQ ID NO: 1574202 - RNA, 19 nt, Homo sapiens
gcaaauaaacgagauggau

SEQ ID NO: 1574203 - RNA, 19 nt, Homo sapiens
caucaaugcuggcaagagu

SEQ ID NO: 1574204 - RNA, 19 nt, Homo sapiens
gaggaguguuacaggagua

SEQ ID NO: 1574205 - RNA, 19 nt, Homo sapiens
aagaagggauguccgcuau

SEQ ID NO: 1574206 - RNA, 19 nt, Homo sapiens
uaugagcacugcccagaug

SEQ ID NO: 1574207 - RNA, 19 nt, Homo sapiens
gauagcagggccaucauug

SEQ ID NO: 1574208 - RNA, 19 nt, Homo sapiens
cuucuuuaguggcaacuua

SEQ ID NO: 1574209 - RNA, 19 nt, Homo sapiens
cagcccaaauucugaaguu

SEQ ID NO: 1574210 - RNA, 19 nt, Homo sapiens
ccacuagccucuccauacu

SEQ ID NO: 1574211 - RNA, 19 nt, Homo sapiens
gggcugcugugcacugguu

SEQ ID NO: 1574212 - RNA, 19 nt, Homo sapiens
gcagcuaaaggaccuggua

SEQ ID NO: 1574213 - RNA, 19 nt, Homo sapiens
aauuacagcuauuggcaaa

SEQ ID NO: 1574214 - RNA, 19 nt, Homo sapiens
ggacucugcuucuacuacu

SEQ ID NO: 1574215 - RNA, 19 nt, Homo sapiens
ugugggaugucacuacuga

SEQ ID NO: 1574216 - RNA, 19 nt, Homo sapiens
gcacugcccagaugaugug

SEQ ID NO: 1574217 - RNA, 19 nt, Homo sapiens
gugcacugguugugaucua

SEQ ID NO: 1574218 - RNA, 19 nt, Homo sapiens
gccagggacucugcuucua

SEQ ID NO: 1574219 - RNA, 19 nt, Homo sapiens
ggcaagagucggcacaaug

SEQ ID NO: 1574220 - RNA, 19 nt, Homo sapiens
ccaaugucccgggaguuua

SEQ ID NO: 1574221 - RNA, 19 nt, Homo sapiens
gcugugcacugguugugau

SEQ ID NO: 1574222 - RNA, 19 nt, Homo sapiens
cuaaugaccacagcaggua

SEQ ID NO: 1574223 - RNA, 19 nt, Homo sapiens
cagauggccugugggaugu

SEQ ID NO: 1574224 - RNA, 19 nt, Homo sapiens
gaccaggcuugcugugaag

SEQ ID NO: 1574225 - RNA, 19 nt, Homo sapiens
gaauucacccaccuugagu

SEQ ID NO: 1574226 - RNA, 19 nt, Homo sapiens
cuaaaggaccugguagaga

SEQ ID NO: 1574227 - RNA, 19 nt, Homo sapiens
gaccacagcagguauacag

SEQ ID NO: 1574228 - RNA, 19 nt, Homo sapiens
cauacuuacuccucucaca

SEQ ID NO: 1574229 - RNA, 19 nt, Homo sapiens
guuccacccugcccaucaa

SEQ ID NO: 1574230 - RNA, 19 nt, Homo sapiens
ggccaucauuguccggaau

SEQ ID NO: 1574231 - RNA, 19 nt, Homo sapiens
gcuccugcaucgccauauc

SEQ ID NO: 1574232 - RNA, 19 nt, Homo sapiens
gagcacugcccagaugaug

SEQ ID NO: 1574233 - RNA, 19 nt, Homo sapiens
ggagaccacagccuuaagg

SEQ ID NO: 1574234 - RNA, 19 nt, Homo sapiens
ucacagcccaaauucugaa

SEQ ID NO: 1574235 - RNA, 19 nt, Homo sapiens
cugcccagaugaugugcua

SEQ ID NO: 1574236 - RNA, 19 nt, Homo sapiens
gccuuaaggucugcaguuc

SEQ ID NO: 1574237 - RNA, 19 nt, Homo sapiens
cugcuuggcuuccugaaac

SEQ ID NO: 1574238 - RNA, 19 nt, Homo sapiens
aaaggaccugguagagaua

SEQ ID NO: 1574239 - RNA, 19 nt, Homo sapiens
ugaagugguguauguggaa

SEQ ID NO: 1574240 - RNA, 19 nt, Homo sapiens
gcccaaauucugaaguugu

SEQ ID NO: 1574241 - RNA, 19 nt, Homo sapiens
ucucacagcccaaauucug

SEQ ID NO: 1574242 - RNA, 19 nt, Homo sapiens
gagccacgagagccuggua

SEQ ID NO: 1574243 - RNA, 19 nt, Homo sapiens
ccucaguccugcuggucuu

SEQ ID NO: 1574244 - RNA, 19 nt, Homo sapiens
cccaaauucugaaguuguc

SEQ ID NO: 1574245 - RNA, 19 nt, Homo sapiens
cuuaaggucugcaguucca

SEQ ID NO: 1574246 - RNA, 19 nt, Homo sapiens
ugaauucacccaccuugag

SEQ ID NO: 1574247 - RNA, 19 nt, Homo sapiens
gcuaaaggaccugguagag

SEQ ID NO: 1574248 - RNA, 19 nt, Homo sapiens
ugggagggccaggcaguua

SEQ ID NO: 1574249 - RNA, 19 nt, Homo sapiens
uccgcuauauccaaaauua

SEQ ID NO: 1574250 - RNA, 19 nt, Homo sapiens
gauggccugugggauguca

SEQ ID NO: 1574251 - RNA, 19 nt, Homo sapiens
gaccggcugggccuacaaa

SEQ ID NO: 1574252 - RNA, 19 nt, Homo sapiens
cgauagcagggccaucauu

SEQ ID NO: 1574253 - RNA, 19 nt, Homo sapiens
aguggcaacuuaacugaag

SEQ ID NO: 1574254 - RNA, 19 nt, Homo sapiens
cggccuaugagccuaauga

SEQ ID NO: 1574255 - RNA, 19 nt, Homo sapiens
uagcagggccaucauuguc

SEQ ID NO: 1574256 - RNA, 19 nt, Homo sapiens
ggcgauagcagggccauca

SEQ ID NO: 1574257 - RNA, 19 nt, Homo sapiens
uccgagagcagcuaaagga

SEQ ID NO: 1574258 - RNA, 19 nt, Homo sapiens
cagggacucugcuucuacu

SEQ ID NO: 1574259 - RNA, 19 nt, Homo sapiens
guaccgggaccagaacaug

SEQ ID NO: 1574260 - RNA, 19 nt, Homo sapiens
uguccggaauggugaaauc

SEQ ID NO: 1574261 - RNA, 19 nt, Homo sapiens
ggagagaaaugaagugaua

SEQ ID NO: 1574262 - RNA, 19 nt, Homo sapiens
gaaaugaagugauagaaug

SEQ ID NO: 1574263 - RNA, 19 nt, Homo sapiens
gaacagcacuggaugauac

SEQ ID NO: 1574264 - RNA, 19 nt, Homo sapiens
aauacaggcugcauaauua

SEQ ID NO: 1574265 - RNA, 19 nt, Homo sapiens
aaacacagguauagcagua

SEQ ID NO: 1574266 - RNA, 19 nt, Homo sapiens
gaagggacucuguaacaua

SEQ ID NO: 1574267 - RNA, 19 nt, Homo sapiens
gcugaacucuggcuugaaa

SEQ ID NO: 1574268 - RNA, 19 nt, Homo sapiens
ggaccuggcaugaucuuua

SEQ ID NO: 1574269 - RNA, 19 nt, Homo sapiens
ucacaacugucugcuauaa

SEQ ID NO: 1574270 - RNA, 19 nt, Homo sapiens
gaaauccucccacugauga

SEQ ID NO: 1574271 - RNA, 19 nt, Homo sapiens
gaagaugcguucgccguuu

SEQ ID NO: 1574272 - RNA, 19 nt, Homo sapiens
gauauggcaucaccuguau

SEQ ID NO: 1574273 - RNA, 19 nt, Homo sapiens
gaaaguacacauucucguu

SEQ ID NO: 1574274 - RNA, 19 nt, Homo sapiens
cagcaagccuuucuucaga

SEQ ID NO: 1574275 - RNA, 19 nt, Homo sapiens
cuacugaagucaauauguu

SEQ ID NO: 1574276 - RNA, 19 nt, Homo sapiens
gcaagaagagucugcaguu

SEQ ID NO: 1574277 - RNA, 19 nt, Homo sapiens
gauguugacuugaucuuca

SEQ ID NO: 1574278 - RNA, 19 nt, Homo sapiens
ucaaggaaauucaguaugg

SEQ ID NO: 1574279 - RNA, 19 nt, Homo sapiens
caauacaggcugcauaauu

SEQ ID NO: 1574280 - RNA, 19 nt, Homo sapiens
gaggacggcucauugacuu

SEQ ID NO: 1574281 - RNA, 19 nt, Homo sapiens
cgacagagccucaguagca

SEQ ID NO: 1574282 - RNA, 19 nt, Homo sapiens
gauccaaggcaaauacuuu

SEQ ID NO: 1574283 - RNA, 19 nt, Homo sapiens
caaagcagaauguaaaguu

SEQ ID NO: 1574284 - RNA, 19 nt, Homo sapiens
ggaggauggugccacauau

SEQ ID NO: 1574285 - RNA, 19 nt, Homo sapiens
guacacgacucaugaggau

SEQ ID NO: 1574286 - RNA, 19 nt, Homo sapiens
gaagcuuuaugaaacaaug

SEQ ID NO: 1574287 - RNA, 19 nt, Homo sapiens
ggucuuaugacaauuauga

SEQ ID NO: 1574288 - RNA, 19 nt, Homo sapiens
gaaaugggagggcacaaug

SEQ ID NO: 1574289 - RNA, 19 nt, Homo sapiens
gggaggaccuggcaugauc

SEQ ID NO: 1574290 - RNA, 19 nt, Homo sapiens
ggaagggacucuguaacau

SEQ ID NO: 1574291 - RNA, 19 nt, Homo sapiens
ggauauggcaucaccugua

SEQ ID NO: 1574292 - RNA, 19 nt, Homo sapiens
gcaagcauauugagcugau

SEQ ID NO: 1574293 - RNA, 19 nt, Homo sapiens
acacagaagugagcaaaga

SEQ ID NO: 1574294 - RNA, 19 nt, Homo sapiens
aagggacucuguaacauaa

SEQ ID NO: 1574295 - RNA, 19 nt, Homo sapiens
gcuuaaagaugcaauaucg

SEQ ID NO: 1574296 - RNA, 19 nt, Homo sapiens
gcaaauacuuucgccucaa

SEQ ID NO: 1574297 - RNA, 19 nt, Homo sapiens
gcagaggacggcucauuga

SEQ ID NO: 1574298 - RNA, 19 nt, Homo sapiens
caaaauccaugcagccaua

SEQ ID NO: 1574299 - RNA, 19 nt, Homo sapiens
uccaagaccuucacaauag

SEQ ID NO: 1574300 - RNA, 19 nt, Homo sapiens
acaacugucugcuauaaau

SEQ ID NO: 1574301 - RNA, 19 nt, Homo sapiens
gaugcaauaucgacuuuua

SEQ ID NO: 1574302 - RNA, 19 nt, Homo sapiens
ggagugauaccuucuuuca

SEQ ID NO: 1574303 - RNA, 19 nt, Homo sapiens
ccucacaacugucugcuau

SEQ ID NO: 1574304 - RNA, 19 nt, Homo sapiens
cagggaagcuucuauacuc

SEQ ID NO: 1574305 - RNA, 19 nt, Homo sapiens
gaaacgcauucaucacaag

SEQ ID NO: 1574306 - RNA, 19 nt, Homo sapiens
ggaguuuaccucauuguug

SEQ ID NO: 1574307 - RNA, 19 nt, Homo sapiens
ccgaagagcuagaugucaa

SEQ ID NO: 1574308 - RNA, 19 nt, Homo sapiens
gcaagccuuucuucagaga

SEQ ID NO: 1574309 - RNA, 19 nt, Homo sapiens
gaaauguacacgacucaug

SEQ ID NO: 1574310 - RNA, 19 nt, Homo sapiens
ggugaaugccuuagagaaa

SEQ ID NO: 1574311 - RNA, 19 nt, Homo sapiens
agagacagcuuagaagaau

SEQ ID NO: 1574312 - RNA, 19 nt, Homo sapiens
caagagacagcuuagaaga

SEQ ID NO: 1574313 - RNA, 19 nt, Homo sapiens
ccagaggucuuggucuuga

SEQ ID NO: 1574314 - RNA, 19 nt, Homo sapiens
ugacagggaagcuucuaua

SEQ ID NO: 1574315 - RNA, 19 nt, Homo sapiens
caagaagagucugcaguuc

SEQ ID NO: 1574316 - RNA, 19 nt, Homo sapiens
gaaguaggaguggugcaua

SEQ ID NO: 1574317 - RNA, 19 nt, Homo sapiens
caaugacacuuugcugcua

SEQ ID NO: 1574318 - RNA, 19 nt, Homo sapiens
guacuaucccaucaucuuu

SEQ ID NO: 1574319 - RNA, 19 nt, Homo sapiens
gacaacagguguacuaucc

SEQ ID NO: 1574320 - RNA, 19 nt, Homo sapiens
guagagacaauacaauuca

SEQ ID NO: 1574321 - RNA, 19 nt, Homo sapiens
aaagcagaauguaaaguug

SEQ ID NO: 1574322 - RNA, 19 nt, Homo sapiens
gaaaagaaaguacacauuc

SEQ ID NO: 1574323 - RNA, 19 nt, Homo sapiens
gugaaugccuuagagaaau

SEQ ID NO: 1574324 - RNA, 19 nt, Homo sapiens
ggaaauccucccacugaug

SEQ ID NO: 1574325 - RNA, 19 nt, Homo sapiens
aaagugcccugaugagcaa

SEQ ID NO: 1574326 - RNA, 19 nt, Homo sapiens
caucacaagagacagcuua

SEQ ID NO: 1574327 - RNA, 19 nt, Homo sapiens
guaggaguggugcauauuu

SEQ ID NO: 1574328 - RNA, 19 nt, Homo sapiens
caaaaggccugcauaccaa

SEQ ID NO: 1574329 - RNA, 19 nt, Homo sapiens
gaccuggcaugaucuuuag

SEQ ID NO: 1574330 - RNA, 19 nt, Homo sapiens
acacagguauagcaguauu

SEQ ID NO: 1574331 - RNA, 19 nt, Homo sapiens
gggaagggacucuguaaca

SEQ ID NO: 1574332 - RNA, 19 nt, Homo sapiens
ucaugaggauguggaagua

SEQ ID NO: 1574333 - RNA, 19 nt, Homo sapiens
aagaugcaauaucgacuuu

SEQ ID NO: 1574334 - RNA, 19 nt, Homo sapiens
gcaguaagccucucuaccu

SEQ ID NO: 1574335 - RNA, 19 nt, Homo sapiens
ggugucagguacaaucgaa

SEQ ID NO: 1574336 - RNA, 19 nt, Homo sapiens
ccaacgauguagagacaau

SEQ ID NO: 1574337 - RNA, 19 nt, Homo sapiens
uggagaguauuaacaguga

SEQ ID NO: 1574338 - RNA, 19 nt, Homo sapiens
cacaagagacagcuuagaa

SEQ ID NO: 1574339 - RNA, 19 nt, Homo sapiens
cgaacucucuccugacagu

SEQ ID NO: 1574340 - RNA, 19 nt, Homo sapiens
caucaucuuuagccaguau

SEQ ID NO: 1574341 - RNA, 19 nt, Homo sapiens
gaaaacaugugucuuaucc

SEQ ID NO: 1574342 - RNA, 19 nt, Homo sapiens
acucagucauucuccuuua

SEQ ID NO: 1574343 - RNA, 19 nt, Homo sapiens
accacuaccuggacaagua

SEQ ID NO: 1574344 - RNA, 19 nt, Homo sapiens
acaugugucuuaucccaaa

SEQ ID NO: 1574345 - RNA, 19 nt, Homo sapiens
ggugaaagguaccacaaaa

SEQ ID NO: 1574346 - RNA, 19 nt, Homo sapiens
aaacuacucuugguugucu

SEQ ID NO: 1574347 - RNA, 19 nt, Homo sapiens
ugagauucauggagaacuu

SEQ ID NO: 1574348 - RNA, 19 nt, Homo sapiens
ggaguacauuuuggauuua

SEQ ID NO: 1574349 - RNA, 19 nt, Homo sapiens
ugucuggucuuacgagaug

SEQ ID NO: 1574350 - RNA, 19 nt, Homo sapiens
ugaaugccuuagagaaaug

SEQ ID NO: 1574351 - RNA, 19 nt, Homo sapiens
caaauacuuucgccucaac

SEQ ID NO: 1574352 - RNA, 19 nt, Homo sapiens
ucauugugauccuaacuug

SEQ ID NO: 1574353 - RNA, 19 nt, Homo sapiens
ggggaaaacuucuguaugg

SEQ ID NO: 1574354 - RNA, 19 nt, Homo sapiens
gagaguauuaacagugaaa

SEQ ID NO: 1574355 - RNA, 19 nt, Homo sapiens
ggagaguauuaacagugaa

SEQ ID NO: 1574356 - RNA, 19 nt, Homo sapiens
gagaaaugaagugauagaa

SEQ ID NO: 1574357 - RNA, 19 nt, Homo sapiens
caagcucaguaacacagaa

SEQ ID NO: 1574358 - RNA, 19 nt, Homo sapiens
agguauagcaguauucuuu

SEQ ID NO: 1574359 - RNA, 19 nt, Homo sapiens
ccuaagcaguauaagaugu

SEQ ID NO: 1574360 - RNA, 19 nt, Homo sapiens
uauggcaucaccuguauuu

SEQ ID NO: 1574361 - RNA, 19 nt, Homo sapiens
gacacugcuuuccaacuua

SEQ ID NO: 1574362 - RNA, 19 nt, Homo sapiens
gccauuugcucucuacuga

SEQ ID NO: 1574363 - RNA, 19 nt, Homo sapiens
gaaauuugaccucccacuu

SEQ ID NO: 1574364 - RNA, 19 nt, Homo sapiens
agacacugcuuuccaacuu

SEQ ID NO: 1574365 - RNA, 19 nt, Homo sapiens
cagagacacugcuuuccaa

SEQ ID NO: 1574366 - RNA, 19 nt, Homo sapiens
cauuugcucucuacugauu

SEQ ID NO: 1574367 - RNA, 19 nt, Homo sapiens
aaauuugucucagcuggua

SEQ ID NO: 1574368 - RNA, 19 nt, Homo sapiens
ugacacucaugacuuguga

SEQ ID NO: 1574369 - RNA, 19 nt, Homo sapiens
gaagucauggauaugucua

SEQ ID NO: 1574370 - RNA, 19 nt, Homo sapiens
caggagauacucgccauuu

SEQ ID NO: 1574371 - RNA, 19 nt, Homo sapiens
gcuacccgcugggauauag

SEQ ID NO: 1574372 - RNA, 19 nt, Homo sapiens
aaauuugaccucccacuug

SEQ ID NO: 1574373 - RNA, 19 nt, Homo sapiens
ggagauacucgccauuugc

SEQ ID NO: 1574374 - RNA, 19 nt, Homo sapiens
aggagauacucgccauuug

SEQ ID NO: 1574375 - RNA, 19 nt, Homo sapiens
aauuugaccucccacuugu

SEQ ID NO: 1574376 - RNA, 19 nt, Homo sapiens
ccucagagacacugcuuuc

SEQ ID NO: 1574377 - RNA, 19 nt, Homo sapiens
ggcuauggcuucggcuaug

SEQ ID NO: 1574378 - RNA, 19 nt, Homo sapiens
cuccuucaguccucauuug

SEQ ID NO: 1574379 - RNA, 19 nt, Homo sapiens
gcuuucggcuacaggagau

SEQ ID NO: 1574380 - RNA, 19 nt, Homo sapiens
gggcuauggcuucggcuau

SEQ ID NO: 1574381 - RNA, 19 nt, Homo sapiens
gcuauggcuucggcuaugg

SEQ ID NO: 1574382 - RNA, 19 nt, Homo sapiens
acacugcuuuccaacuuac

SEQ ID NO: 1574383 - RNA, 19 nt, Homo sapiens
caauaaaccugcauuaguu

SEQ ID NO: 1574384 - RNA, 19 nt, Homo sapiens
gagcuugucucaccaugua

SEQ ID NO: 1574385 - RNA, 19 nt, Homo sapiens
ggaggacgcugcauuguuc

SEQ ID NO: 1574386 - RNA, 19 nt, Homo sapiens
cgaagaaccugcuaagugu

SEQ ID NO: 1574387 - RNA, 19 nt, Homo sapiens
cgacaaacuaccuguauuu

SEQ ID NO: 1574388 - RNA, 19 nt, Homo sapiens
ggaggagucucuacugucu

SEQ ID NO: 1574389 - RNA, 19 nt, Homo sapiens
caaacuaccuguauuucca

SEQ ID NO: 1574390 - RNA, 19 nt, Homo sapiens
ucaauaaaccugcauuagu

SEQ ID NO: 1574391 - RNA, 19 nt, Homo sapiens
uagcugacccuucuuguga

SEQ ID NO: 1574392 - RNA, 19 nt, Homo sapiens
gcucacuggugcuguguau

SEQ ID NO: 1574393 - RNA, 19 nt, Homo sapiens
gugacuugcucucgacaaa

SEQ ID NO: 1574394 - RNA, 19 nt, Homo sapiens
cuucauagcugacccuucu

SEQ ID NO: 1574395 - RNA, 19 nt, Homo sapiens
caacugcuccacaagaaau

SEQ ID NO: 1574396 - RNA, 19 nt, Homo sapiens
ccgaagaaccugcuaagug

SEQ ID NO: 1574397 - RNA, 19 nt, Homo sapiens
gauguguccagaagcuuua

SEQ ID NO: 1574398 - RNA, 19 nt, Homo sapiens
ggauguguccagaagcuuu

SEQ ID NO: 1574399 - RNA, 19 nt, Homo sapiens
ucaccuugcugcuguaucu

SEQ ID NO: 1574400 - RNA, 19 nt, Homo sapiens
gaacuucaugugucuccaa

SEQ ID NO: 1574401 - RNA, 19 nt, Homo sapiens
ucgacaaacuaccuguauu

SEQ ID NO: 1574402 - RNA, 19 nt, Homo sapiens
ccugacugcuggcuacuau

SEQ ID NO: 1574403 - RNA, 19 nt, Homo sapiens
gcccuaagcuuguuuuaag

SEQ ID NO: 1574404 - RNA, 19 nt, Homo sapiens
guguccagcugccgaagaa

SEQ ID NO: 1574405 - RNA, 19 nt, Homo sapiens
ucucaauaaaccugcauua

SEQ ID NO: 1574406 - RNA, 19 nt, Homo sapiens
ggccagcccuaagcuuguu

SEQ ID NO: 1574407 - RNA, 19 nt, Homo sapiens
gacaaacuaccuguauuuc

SEQ ID NO: 1574408 - RNA, 19 nt, Homo sapiens
gacuugcucucgacaaacu

SEQ ID NO: 1574409 - RNA, 19 nt, Homo sapiens
gucaagagaccugcuguga

SEQ ID NO: 1574410 - RNA, 19 nt, Homo sapiens
gcaucuguuugcccaguuc

SEQ ID NO: 1574411 - RNA, 19 nt, Homo sapiens
ccacgacuuccaccacuga

SEQ ID NO: 1574412 - RNA, 19 nt, Homo sapiens
ccaugcacacgcugucuuu

SEQ ID NO: 1574413 - RNA, 19 nt, Homo sapiens
ccgcucaccuuugucucua

SEQ ID NO: 1574414 - RNA, 19 nt, Homo sapiens
ggcggcaucucuacugucu

SEQ ID NO: 1574415 - RNA, 19 nt, Homo sapiens
uucaacugcuccacaagaa

SEQ ID NO: 1574416 - RNA, 19 nt, Homo sapiens
guuccaguggcccaaguua

SEQ ID NO: 1574417 - RNA, 19 nt, Homo sapiens
cuggaccacugucaagaga

SEQ ID NO: 1574418 - RNA, 19 nt, Homo sapiens
ccagaagcuuuaccaucca

SEQ ID NO: 1574419 - RNA, 19 nt, Homo sapiens
ugggaggagucucuacugu

SEQ ID NO: 1574420 - RNA, 19 nt, Homo sapiens
gcucaccuuugucucuagu

SEQ ID NO: 1574421 - RNA, 19 nt, Homo sapiens
cggcgaacuucaugugucu

SEQ ID NO: 1574422 - RNA, 19 nt, Homo sapiens
gcacacgcugucuuuagca

SEQ ID NO: 1574423 - RNA, 19 nt, Homo sapiens
gccagugagcgaaucaaga

SEQ ID NO: 1574424 - RNA, 19 nt, Homo sapiens
aauaaaccugcauuaguug

SEQ ID NO: 1574425 - RNA, 19 nt, Homo sapiens
ucaacugcuccacaagaaa

SEQ ID NO: 1574426 - RNA, 19 nt, Homo sapiens
ccagugagcgaaucaagac

SEQ ID NO: 1574427 - RNA, 19 nt, Homo sapiens
cuugccagccaaccuguua

SEQ ID NO: 1574428 - RNA, 19 nt, Homo sapiens
gcuugucucaccauguauu

SEQ ID NO: 1574429 - RNA, 19 nt, Homo sapiens
gaucaacgcugacaucuua

SEQ ID NO: 1574430 - RNA, 19 nt, Homo sapiens
gaacagcugcucacagaua

SEQ ID NO: 1574431 - RNA, 19 nt, Homo sapiens
gggaacagcugcucacaga

SEQ ID NO: 1574432 - RNA, 19 nt, Homo sapiens
ucacagauaugcuagaguu

SEQ ID NO: 1574433 - RNA, 19 nt, Homo sapiens
gcagggagcaguuaucaaa

SEQ ID NO: 1574434 - RNA, 19 nt, Homo sapiens
aaacuggacuucaagaaca

SEQ ID NO: 1574435 - RNA, 19 nt, Homo sapiens
gcaucaaacuggacuucaa

SEQ ID NO: 1574436 - RNA, 19 nt, Homo sapiens
caaagaaucaggucaagug

SEQ ID NO: 1574437 - RNA, 19 nt, Homo sapiens
gacaggaguucccaucaug

SEQ ID NO: 1574438 - RNA, 19 nt, Homo sapiens
uaacacugcuguccaccaa

SEQ ID NO: 1574439 - RNA, 19 nt, Homo sapiens
gagcaguuaucaaagaauc

SEQ ID NO: 1574440 - RNA, 19 nt, Homo sapiens
gggagcaguuaucaaagaa

SEQ ID NO: 1574441 - RNA, 19 nt, Homo sapiens
ggacaggacccgagucuac

SEQ ID NO: 1574442 - RNA, 19 nt, Homo sapiens
agucuacuaugacaucuuu

SEQ ID NO: 1574443 - RNA, 19 nt, Homo sapiens
ggaggcaggaagaaauaaa

SEQ ID NO: 1574444 - RNA, 19 nt, Homo sapiens
cgagggaacuguggcugaa

SEQ ID NO: 1574445 - RNA, 19 nt, Homo sapiens
uggaagaucugcucuacgu

SEQ ID NO: 1574446 - RNA, 19 nt, Homo sapiens
cagauaugcuagaguugug

SEQ ID NO: 1574447 - RNA, 19 nt, Homo sapiens
caccaagucuacuaugaca

SEQ ID NO: 1574448 - RNA, 19 nt, Homo sapiens
ccuggaggcugacgucaau

SEQ ID NO: 1574449 - RNA, 19 nt, Homo sapiens
ggaugacggucugaaugug

SEQ ID NO: 1574450 - RNA, 19 nt, Homo sapiens
ggaggcugacgucaaugua

SEQ ID NO: 1574451 - RNA, 19 nt, Homo sapiens
gccuuggccucuugcauug

SEQ ID NO: 1574452 - RNA, 19 nt, Homo sapiens
gguggaagaucugcucuac

SEQ ID NO: 1574453 - RNA, 19 nt, Homo sapiens
ggucaaugccacacaguuc

SEQ ID NO: 1574454 - RNA, 19 nt, Homo sapiens
ccaacaugcucaucucaac

SEQ ID NO: 1574455 - RNA, 19 nt, Homo sapiens
gcucacagauaugcuagag

SEQ ID NO: 1574456 - RNA, 19 nt, Homo sapiens
gggaugacggucugaaugu

SEQ ID NO: 1574457 - RNA, 19 nt, Homo sapiens
ccacacggaaaccaaugua

SEQ ID NO: 1574458 - RNA, 19 nt, Homo sapiens
ggaccaccuucuacauguc

SEQ ID NO: 1574459 - RNA, 19 nt, Homo sapiens
agggagcaguuaucaaaga

SEQ ID NO: 1574460 - RNA, 19 nt, Homo sapiens
uaucaaagaaucaggucaa

SEQ ID NO: 1574461 - RNA, 19 nt, Homo sapiens
ggcaugauccugcugaaca

SEQ ID NO: 1574462 - RNA, 19 nt, Homo sapiens
acaaugacccucccagaca

SEQ ID NO: 1574463 - RNA, 19 nt, Homo sapiens
gguaaaacagcaacaauga

SEQ ID NO: 1574464 - RNA, 19 nt, Homo sapiens
cacggaaaccaauguacua

SEQ ID NO: 1574465 - RNA, 19 nt, Homo sapiens
ccaagucuacuaugacauc

SEQ ID NO: 1574466 - RNA, 19 nt, Homo sapiens
gcugacagaggaaggcaaa

SEQ ID NO: 1574467 - RNA, 19 nt, Homo sapiens
agacaggaguucccaucau

SEQ ID NO: 1574468 - RNA, 19 nt, Homo sapiens
ucauguugguagaaacuga

SEQ ID NO: 1574469 - RNA, 19 nt, Homo sapiens
gaaaaccccgugcccauug

SEQ ID NO: 1574470 - RNA, 19 nt, Homo sapiens
ccaugucgguggaagaucu

SEQ ID NO: 1574471 - RNA, 19 nt, Homo sapiens
ggacuugcuggcucauguu

SEQ ID NO: 1574472 - RNA, 19 nt, Homo sapiens
cccaagccaugguggagaa

SEQ ID NO: 1574473 - RNA, 19 nt, Homo sapiens
acacugcuguccaccaagu

SEQ ID NO: 1574474 - RNA, 19 nt, Homo sapiens
ucccaaggcuacccuaucu

SEQ ID NO: 1574475 - RNA, 19 nt, Homo sapiens
caaacuggacuucaagaac

SEQ ID NO: 1574476 - RNA, 19 nt, Homo sapiens
uggaccaccuucuacaugu

SEQ ID NO: 1574477 - RNA, 19 nt, Homo sapiens
ucaaacuggacuucaagaa

SEQ ID NO: 1574478 - RNA, 19 nt, Homo sapiens
gagacaggaguucccauca

SEQ ID NO: 1574479 - RNA, 19 nt, Homo sapiens
aggcugacgucaauguaga

SEQ ID NO: 1574480 - RNA, 19 nt, Homo sapiens
ggacccgagucuacuacag

SEQ ID NO: 1574481 - RNA, 19 nt, Homo sapiens
uccaccaagucuacuauga

SEQ ID NO: 1574482 - RNA, 19 nt, Homo sapiens
uggcucauguugguagaaa

SEQ ID NO: 1574483 - RNA, 19 nt, Homo sapiens
aacagcugcucacagauau

SEQ ID NO: 1574484 - RNA, 19 nt, Homo sapiens
ggacuucaagaacaucaag

SEQ ID NO: 1574485 - RNA, 19 nt, Homo sapiens
gaauguggaguggcugguu

SEQ ID NO: 1574486 - RNA, 19 nt, Homo sapiens
cugcugagccaaucugaga

SEQ ID NO: 1574487 - RNA, 19 nt, Homo sapiens
ggaucaacgcugacaucuu

SEQ ID NO: 1574488 - RNA, 19 nt, Homo sapiens
gcaugauccugcugaacac

SEQ ID NO: 1574489 - RNA, 19 nt, Homo sapiens
agacacagaaggcaugauc

SEQ ID NO: 1574490 - RNA, 19 nt, Homo sapiens
uaccuacagugacaacaca

SEQ ID NO: 1574491 - RNA, 19 nt, Homo sapiens
gaggcaggaagaaauaaag

SEQ ID NO: 1574492 - RNA, 19 nt, Homo sapiens
ucaacgcugacaucuuaaa

SEQ ID NO: 1574493 - RNA, 19 nt, Homo sapiens
gcagccaacagcaagaaag

SEQ ID NO: 1574494 - RNA, 19 nt, Homo sapiens
cggcacagccaaugagaca

SEQ ID NO: 1574495 - RNA, 19 nt, Homo sapiens
gggaggcaggaagaaauaa

SEQ ID NO: 1574496 - RNA, 19 nt, Homo sapiens
gcugcucacagauaugcua

SEQ ID NO: 1574497 - RNA, 19 nt, Homo sapiens
caauaguccuugccaucac

SEQ ID NO: 1574498 - RNA, 19 nt, Homo sapiens
gacagaggaaggcaaaguc

SEQ ID NO: 1574499 - RNA, 19 nt, Homo sapiens
caggucaaguggguguuug

SEQ ID NO: 1574500 - RNA, 19 nt, Homo sapiens
caacgcugacaucuuaaag

SEQ ID NO: 1574501 - RNA, 19 nt, Homo sapiens
gaggcugacgucaauguag

SEQ ID NO: 1574502 - RNA, 19 nt, Homo sapiens
caucaaacuggacuucaag

SEQ ID NO: 1574503 - RNA, 19 nt, Homo sapiens
ugacagaggaaggcaaagu

SEQ ID NO: 1574504 - RNA, 19 nt, Homo sapiens
cagagagcgucgccauggu

SEQ ID NO: 1574505 - RNA, 19 nt, Homo sapiens
gaaauaagcuaaacccaua

SEQ ID NO: 1574506 - RNA, 19 nt, Homo sapiens
gagaagaccuugaaauaaa

SEQ ID NO: 1574507 - RNA, 19 nt, Homo sapiens
ggaaagaucucuggacaaa

SEQ ID NO: 1574508 - RNA, 19 nt, Homo sapiens
gagaaccacugcucuauaa

SEQ ID NO: 1574509 - RNA, 19 nt, Homo sapiens
caaaugcccuggaagauaa

SEQ ID NO: 1574510 - RNA, 19 nt, Homo sapiens
gaagaaggccuccaaagaa

SEQ ID NO: 1574511 - RNA, 19 nt, Homo sapiens
gaaguccucuugugcagua

SEQ ID NO: 1574512 - RNA, 19 nt, Homo sapiens
gaagcauugucaacauuua

SEQ ID NO: 1574513 - RNA, 19 nt, Homo sapiens
gaacagagcccgacuaaaa

SEQ ID NO: 1574514 - RNA, 19 nt, Homo sapiens
ggacauugcugcuguucuu

SEQ ID NO: 1574515 - RNA, 19 nt, Homo sapiens
gggagaagaccuugaaaua

SEQ ID NO: 1574516 - RNA, 19 nt, Homo sapiens
caaagaagauguagcaaag

SEQ ID NO: 1574517 - RNA, 19 nt, Homo sapiens
ucacaacccucaucugaaa

SEQ ID NO: 1574518 - RNA, 19 nt, Homo sapiens
ucauaaagcucuuaggauu

SEQ ID NO: 1574519 - RNA, 19 nt, Homo sapiens
gaaauaaacucccaaaaca

SEQ ID NO: 1574520 - RNA, 19 nt, Homo sapiens
ggacaaaggcucaggaaga

SEQ ID NO: 1574521 - RNA, 19 nt, Homo sapiens
gagggaauuuggacauaua

SEQ ID NO: 1574522 - RNA, 19 nt, Homo sapiens
gcaaagcccugaaagucuu

SEQ ID NO: 1574523 - RNA, 19 nt, Homo sapiens
ggaagguccugauggaauu

SEQ ID NO: 1574524 - RNA, 19 nt, Homo sapiens
ggagaagaccuugaaauaa

SEQ ID NO: 1574525 - RNA, 19 nt, Homo sapiens
aacaagaacuuccagauuu

SEQ ID NO: 1574526 - RNA, 19 nt, Homo sapiens
ccagaauccucucuccuua

SEQ ID NO: 1574527 - RNA, 19 nt, Homo sapiens
cuacuuacguugcccauaa

SEQ ID NO: 1574528 - RNA, 19 nt, Homo sapiens
ccaaugccuugaaaguuua

SEQ ID NO: 1574529 - RNA, 19 nt, Homo sapiens
gaaugacguugcuguguga

SEQ ID NO: 1574530 - RNA, 19 nt, Homo sapiens
gaaagcauaugaaggaaac

SEQ ID NO: 1574531 - RNA, 19 nt, Homo sapiens
aggaagagaugagaaauaa

SEQ ID NO: 1574532 - RNA, 19 nt, Homo sapiens
ugaaggagcucagaaagga

SEQ ID NO: 1574533 - RNA, 19 nt, Homo sapiens
caacaagaacuuccagauu

SEQ ID NO: 1574534 - RNA, 19 nt, Homo sapiens
gcauguguguggagaauau

SEQ ID NO: 1574535 - RNA, 19 nt, Homo sapiens
caagauagaagagcugaua

SEQ ID NO: 1574536 - RNA, 19 nt, Homo sapiens
cccaaugccuugaaaguuu

SEQ ID NO: 1574537 - RNA, 19 nt, Homo sapiens
ccaaagugaugaauuucuu

SEQ ID NO: 1574538 - RNA, 19 nt, Homo sapiens
ggucuguacuugugugaaa

SEQ ID NO: 1574539 - RNA, 19 nt, Homo sapiens
uugaugggcuguuuccuua

SEQ ID NO: 1574540 - RNA, 19 nt, Homo sapiens
ccaauuauccugagcaguu

SEQ ID NO: 1574541 - RNA, 19 nt, Homo sapiens
gcucagaaaggaagaguuu

SEQ ID NO: 1574542 - RNA, 19 nt, Homo sapiens
gaaggacagguucacauuu

SEQ ID NO: 1574543 - RNA, 19 nt, Homo sapiens
ggaaggacagguucacauu

SEQ ID NO: 1574544 - RNA, 19 nt, Homo sapiens
caaagcugcuggacaaaca

SEQ ID NO: 1574545 - RNA, 19 nt, Homo sapiens
gagaugagaaauaagcuaa

SEQ ID NO: 1574546 - RNA, 19 nt, Homo sapiens
gaagagcaaagcccugaaa

SEQ ID NO: 1574547 - RNA, 19 nt, Homo sapiens
gagaagaucgaagacauuu

SEQ ID NO: 1574548 - RNA, 19 nt, Homo sapiens
gagcaaagcccugaaaguc

SEQ ID NO: 1574549 - RNA, 19 nt, Homo sapiens
guauuucuccuacuucuuu

SEQ ID NO: 1574550 - RNA, 19 nt, Homo sapiens
gcauaugaaggaaacauuu

SEQ ID NO: 1574551 - RNA, 19 nt, Homo sapiens
ugaagaaggccuccaaaga

SEQ ID NO: 1574552 - RNA, 19 nt, Homo sapiens
ucaaaugcccuggaagaua

SEQ ID NO: 1574553 - RNA, 19 nt, Homo sapiens
agaauccucucuccuuauu

SEQ ID NO: 1574554 - RNA, 19 nt, Homo sapiens
agaauugaaugacgcauau

SEQ ID NO: 1574555 - RNA, 19 nt, Homo sapiens
aaagaucucuggacaaagg

SEQ ID NO: 1574556 - RNA, 19 nt, Homo sapiens
gguaugagacuccuccaaa

SEQ ID NO: 1574557 - RNA, 19 nt, Homo sapiens
ggaggaauggguuaucuga

SEQ ID NO: 1574558 - RNA, 19 nt, Homo sapiens
gcacccaggcugcagcaua

SEQ ID NO: 1574559 - RNA, 19 nt, Homo sapiens
ccaaagaagauguagcaaa

SEQ ID NO: 1574560 - RNA, 19 nt, Homo sapiens
gcagcauccucacuguaaa

SEQ ID NO: 1574561 - RNA, 19 nt, Homo sapiens
gaaacaccucuccuuggua

SEQ ID NO: 1574562 - RNA, 19 nt, Homo sapiens
caggaacuauucauugguu

SEQ ID NO: 1574563 - RNA, 19 nt, Homo sapiens
cagagggaauuuggacaua

SEQ ID NO: 1574564 - RNA, 19 nt, Homo sapiens
acagaaagcauaugaagga

SEQ ID NO: 1574565 - RNA, 19 nt, Homo sapiens
gacaaaggcucaggaagag

SEQ ID NO: 1574566 - RNA, 19 nt, Homo sapiens
ugaaacaccucuccuuggu

SEQ ID NO: 1574567 - RNA, 19 nt, Homo sapiens
cagagaagaucgaagacau

SEQ ID NO: 1574568 - RNA, 19 nt, Homo sapiens
aaggacagguucacauuug

SEQ ID NO: 1574569 - RNA, 19 nt, Homo sapiens
gcucaaaugcccuggaaga

SEQ ID NO: 1574570 - RNA, 19 nt, Homo sapiens
gaacauuugguaauagcuu

SEQ ID NO: 1574571 - RNA, 19 nt, Homo sapiens
cagaagaaaucgucagcau

SEQ ID NO: 1574572 - RNA, 19 nt, Homo sapiens
caauuauccugagcaguuu

SEQ ID NO: 1574573 - RNA, 19 nt, Homo sapiens
cuacaaagaaaccaugaaa

SEQ ID NO: 1574574 - RNA, 19 nt, Homo sapiens
gaagagaugagaaauaagc

SEQ ID NO: 1574575 - RNA, 19 nt, Homo sapiens
cauccucacuguaaauuag

SEQ ID NO: 1574576 - RNA, 19 nt, Homo sapiens
acaguuaugugcagcuuug

SEQ ID NO: 1574577 - RNA, 19 nt, Homo sapiens
ccagugaaguuugugaaga

SEQ ID NO: 1574578 - RNA, 19 nt, Homo sapiens
ugacaucuccagugaaguu

SEQ ID NO: 1574579 - RNA, 19 nt, Homo sapiens
gagagaauucuguucauca

SEQ ID NO: 1574580 - RNA, 19 nt, Homo sapiens
aaacuugggcauaaugaaa

SEQ ID NO: 1574581 - RNA, 19 nt, Homo sapiens
uaacgacacuucgcaugug

SEQ ID NO: 1574582 - RNA, 19 nt, Homo sapiens
uaacaacuguauucaaagc

SEQ ID NO: 1574583 - RNA, 19 nt, Homo sapiens
cuguuuaucuugugccaua

SEQ ID NO: 1574584 - RNA, 19 nt, Homo sapiens
caggaagagaugagaaaua

SEQ ID NO: 1574585 - RNA, 19 nt, Homo sapiens
cauccaaugugcaagauag

SEQ ID NO: 1574586 - RNA, 19 nt, Homo sapiens
ggaagaguuuuggaaauuu

SEQ ID NO: 1574587 - RNA, 19 nt, Homo sapiens
uuacguugcccauaaauau

SEQ ID NO: 1574588 - RNA, 19 nt, Homo sapiens
gcugggaaauugucagaag

SEQ ID NO: 1574589 - RNA, 19 nt, Homo sapiens
gaaacuugggcauaaugaa

SEQ ID NO: 1574590 - RNA, 19 nt, Homo sapiens
ccaaaacaccaccuauuua

SEQ ID NO: 1574591 - RNA, 19 nt, Homo sapiens
gaugagaaauaagcuaaac

SEQ ID NO: 1574592 - RNA, 19 nt, Homo sapiens
cugaagacccugaaacuug

SEQ ID NO: 1574593 - RNA, 19 nt, Homo sapiens
gacaaacauuacccaggaa

SEQ ID NO: 1574594 - RNA, 19 nt, Homo sapiens
cauauuuacuucuguguac

SEQ ID NO: 1574595 - RNA, 19 nt, Homo sapiens
gaccuaaagcaggaaauaa

SEQ ID NO: 1574596 - RNA, 19 nt, Homo sapiens
auaaagcucuuaggauuca

SEQ ID NO: 1574597 - RNA, 19 nt, Homo sapiens
ugagaaccacugcucuaua

SEQ ID NO: 1574598 - RNA, 19 nt, Homo sapiens
guaugagacuccuccaaag

SEQ ID NO: 1574599 - RNA, 19 nt, Homo sapiens
gugaacagagcccgacuaa

SEQ ID NO: 1574600 - RNA, 19 nt, Homo sapiens
gaaacugaagacccugaaa

SEQ ID NO: 1574601 - RNA, 19 nt, Homo sapiens
aagaaggccuccaaagaag

SEQ ID NO: 1574602 - RNA, 19 nt, Homo sapiens
gugaugaauuucuuugaag

SEQ ID NO: 1574603 - RNA, 19 nt, Homo sapiens
cucaaugucugugaaauga

SEQ ID NO: 1574604 - RNA, 19 nt, Homo sapiens
ucacgucccugagcauuuc

SEQ ID NO: 1574605 - RNA, 19 nt, Homo sapiens
aaacagcacugacaucuuc

SEQ ID NO: 1574606 - RNA, 19 nt, Homo sapiens
ggagaacgauuucaagaag

SEQ ID NO: 1574607 - RNA, 19 nt, Homo sapiens
ggaagggaaugaugagaug

SEQ ID NO: 1574608 - RNA, 19 nt, Homo sapiens
caccagagguuccuauuug

SEQ ID NO: 1574609 - RNA, 19 nt, Homo sapiens
gaagaaaaguugaagaaga

SEQ ID NO: 1574610 - RNA, 19 nt, Homo sapiens
agacaacucucgccagaaa

SEQ ID NO: 1574611 - RNA, 19 nt, Homo sapiens
gggcaaagauaauauagca

SEQ ID NO: 1574612 - RNA, 19 nt, Homo sapiens
gcagaggcccuuugaagaa

SEQ ID NO: 1574613 - RNA, 19 nt, Homo sapiens
ucacagagccagaauuuau

SEQ ID NO: 1574614 - RNA, 19 nt, Homo sapiens
gcucaggaaacauaauuua

SEQ ID NO: 1574615 - RNA, 19 nt, Homo sapiens
ugagugaccuugaggagaa

SEQ ID NO: 1574616 - RNA, 19 nt, Homo sapiens
cgcaggaucugaagcauuu

SEQ ID NO: 1574617 - RNA, 19 nt, Homo sapiens
ggacagaggaaacaccaaa

SEQ ID NO: 1574618 - RNA, 19 nt, Homo sapiens
gaccagcucagccauauuu

SEQ ID NO: 1574619 - RNA, 19 nt, Homo sapiens
gagaggcaaaguugucuua

SEQ ID NO: 1574620 - RNA, 19 nt, Homo sapiens
gaaggagucccgcagagaa

SEQ ID NO: 1574621 - RNA, 19 nt, Homo sapiens
gcaggaagcaggagucaau

SEQ ID NO: 1574622 - RNA, 19 nt, Homo sapiens
aaaggaggcugugaaaguu

SEQ ID NO: 1574623 - RNA, 19 nt, Homo sapiens
ggagggcaaagauaauaua

SEQ ID NO: 1574624 - RNA, 19 nt, Homo sapiens
gaaacaagcacgucauguc

SEQ ID NO: 1574625 - RNA, 19 nt, Homo sapiens
uauguaagcugcaaagaag

SEQ ID NO: 1574626 - RNA, 19 nt, Homo sapiens
gaggcaaaguugucuuaga

SEQ ID NO: 1574627 - RNA, 19 nt, Homo sapiens
cuacaaagcgugucagguu

SEQ ID NO: 1574628 - RNA, 19 nt, Homo sapiens
aaagacagcuucucgaacu

SEQ ID NO: 1574629 - RNA, 19 nt, Homo sapiens
ccuagcagcugaagggauu

SEQ ID NO: 1574630 - RNA, 19 nt, Homo sapiens
gguggaggcucuauuugau

SEQ ID NO: 1574631 - RNA, 19 nt, Homo sapiens
gagcucaaguucugcuuca

SEQ ID NO: 1574632 - RNA, 19 nt, Homo sapiens
gcaccagagguuccuauuu

SEQ ID NO: 1574633 - RNA, 19 nt, Homo sapiens
uaauauagcaggaacacaa

SEQ ID NO: 1574634 - RNA, 19 nt, Homo sapiens
agaaggagggcaaagauaa

SEQ ID NO: 1574635 - RNA, 19 nt, Homo sapiens
ggaauucucccuguaugaa

SEQ ID NO: 1574636 - RNA, 19 nt, Homo sapiens
gaccugggauuuggaauuc

SEQ ID NO: 1574637 - RNA, 19 nt, Homo sapiens
gcuccuauuucacggauga

SEQ ID NO: 1574638 - RNA, 19 nt, Homo sapiens
cugcugcaccuucuaauua

SEQ ID NO: 1574639 - RNA, 19 nt, Homo sapiens
gagaugacccucacuaugc

SEQ ID NO: 1574640 - RNA, 19 nt, Homo sapiens
gagcucaggaaacauaauu

SEQ ID NO: 1574641 - RNA, 19 nt, Homo sapiens
cagaggcccuuugaagaaa

SEQ ID NO: 1574642 - RNA, 19 nt, Homo sapiens
gaaggagggcaaagauaau

SEQ ID NO: 1574643 - RNA, 19 nt, Homo sapiens
gaccgugccuucgacauug

SEQ ID NO: 1574644 - RNA, 19 nt, Homo sapiens
agaacgauuucaagaaguu

SEQ ID NO: 1574645 - RNA, 19 nt, Homo sapiens
gaggagaacgauuucaaga

SEQ ID NO: 1574646 - RNA, 19 nt, Homo sapiens
aaucacagagccagaauuu

SEQ ID NO: 1574647 - RNA, 19 nt, Homo sapiens
ggaccugggauuuggaauu

SEQ ID NO: 1574648 - RNA, 19 nt, Homo sapiens
gaacgauuucaagaaguua

SEQ ID NO: 1574649 - RNA, 19 nt, Homo sapiens
uaaagaaucugguaaaagg

SEQ ID NO: 1574650 - RNA, 19 nt, Homo sapiens
gguaaaagguauucagaug

SEQ ID NO: 1574651 - RNA, 19 nt, Homo sapiens
gagaacgauuucaagaagu

SEQ ID NO: 1574652 - RNA, 19 nt, Homo sapiens
ccgguuugauuaugucuuu

SEQ ID NO: 1574653 - RNA, 19 nt, Homo sapiens
gcauugcucugggccuuga

SEQ ID NO: 1574654 - RNA, 19 nt, Homo sapiens
gaaacagcacugacaucuu

SEQ ID NO: 1574655 - RNA, 19 nt, Homo sapiens
ggaguuggagggccugauu

SEQ ID NO: 1574656 - RNA, 19 nt, Homo sapiens
cagaaggagggcaaagaua

SEQ ID NO: 1574657 - RNA, 19 nt, Homo sapiens
ggagagaggcaaaguuguc

SEQ ID NO: 1574658 - RNA, 19 nt, Homo sapiens
ggaccuggcagaauuacug

SEQ ID NO: 1574659 - RNA, 19 nt, Homo sapiens
guacuucagcuccuauuuc

SEQ ID NO: 1574660 - RNA, 19 nt, Homo sapiens
ggauucagcaccagagguu

SEQ ID NO: 1574661 - RNA, 19 nt, Homo sapiens
gcagaauuacugauuucaa

SEQ ID NO: 1574662 - RNA, 19 nt, Homo sapiens
gaaaucacagagccagaau

SEQ ID NO: 1574663 - RNA, 19 nt, Homo sapiens
uuaaagaacagauggaauc

SEQ ID NO: 1574664 - RNA, 19 nt, Homo sapiens
gacccucacuaugcaguuu

SEQ ID NO: 1574665 - RNA, 19 nt, Homo sapiens
aaaggcugcuggagguaaa

SEQ ID NO: 1574666 - RNA, 19 nt, Homo sapiens
gcagauggagagaggcaaa

SEQ ID NO: 1574667 - RNA, 19 nt, Homo sapiens
cgguggaccuggcagaauu

SEQ ID NO: 1574668 - RNA, 19 nt, Homo sapiens
ggaaggagucccgcagaga

SEQ ID NO: 1574669 - RNA, 19 nt, Homo sapiens
uggaaucuaugaagcacaa

SEQ ID NO: 1574670 - RNA, 19 nt, Homo sapiens
gagcaggaagggaaugaug

SEQ ID NO: 1574671 - RNA, 19 nt, Homo sapiens
ccgcuuuccugaguaguaa

SEQ ID NO: 1574672 - RNA, 19 nt, Homo sapiens
gggauaugacccugucuga

SEQ ID NO: 1574673 - RNA, 19 nt, Homo sapiens
caaaggcugcuggagguaa

SEQ ID NO: 1574674 - RNA, 19 nt, Homo sapiens
aggcaaaguugucuuagag

SEQ ID NO: 1574675 - RNA, 19 nt, Homo sapiens
cgagguacuucagcuccua

SEQ ID NO: 1574676 - RNA, 19 nt, Homo sapiens
ucaugaaccuguuggaacu

SEQ ID NO: 1574677 - RNA, 19 nt, Homo sapiens
gguggaccuggcagaauua

SEQ ID NO: 1574678 - RNA, 19 nt, Homo sapiens
agcaggagcuggagucugu

SEQ ID NO: 1574679 - RNA, 19 nt, Homo sapiens
uacuucagcuccuauuuca

SEQ ID NO: 1574680 - RNA, 19 nt, Homo sapiens
uggcagaauuacugauuuc

SEQ ID NO: 1574681 - RNA, 19 nt, Homo sapiens
uggaggcucuauuugauuc

SEQ ID NO: 1574682 - RNA, 19 nt, Homo sapiens
gcaugauuacagagaagua

SEQ ID NO: 1574683 - RNA, 19 nt, Homo sapiens
acagagccagaauuuauuu

SEQ ID NO: 1574684 - RNA, 19 nt, Homo sapiens
ucagaugaacaauguauca

SEQ ID NO: 1574685 - RNA, 19 nt, Homo sapiens
ugugaaaguuguccucaag

SEQ ID NO: 1574686 - RNA, 19 nt, Homo sapiens
gcaaaggcugcuggaggua

SEQ ID NO: 1574687 - RNA, 19 nt, Homo sapiens
gcuuacgucuccaccuuuc

SEQ ID NO: 1574688 - RNA, 19 nt, Homo sapiens
uuagagacaccuagaaaca

SEQ ID NO: 1574689 - RNA, 19 nt, Homo sapiens
gacagaaggagggcaaaga

SEQ ID NO: 1574690 - RNA, 19 nt, Homo sapiens
gaagggaaugaugagauga

SEQ ID NO: 1574691 - RNA, 19 nt, Homo sapiens
agagguuccuauuugaaga

SEQ ID NO: 1574692 - RNA, 19 nt, Homo sapiens
ccagagguuccuauuugaa

SEQ ID NO: 1574693 - RNA, 19 nt, Homo sapiens
uggcuuacgucuccaccuu

SEQ ID NO: 1574694 - RNA, 19 nt, Homo sapiens
gauggagagaggcaaaguu

SEQ ID NO: 1574695 - RNA, 19 nt, Homo sapiens
cuucgacauuguacagaaa

SEQ ID NO: 1574696 - RNA, 19 nt, Homo sapiens
ugaccgugccuucgacauu

SEQ ID NO: 1574697 - RNA, 19 nt, Homo sapiens
ggagagggcgagguacuuc

SEQ ID NO: 1574698 - RNA, 19 nt, Homo sapiens
gcacuggaaagacaacucu

SEQ ID NO: 1574699 - RNA, 19 nt, Homo sapiens
ggaagcuucuacuggaaaa

SEQ ID NO: 1574700 - RNA, 19 nt, Homo sapiens
aaggagggcaaagauaaua

SEQ ID NO: 1574701 - RNA, 19 nt, Homo sapiens
cacagagccagaauuuauu

SEQ ID NO: 1574702 - RNA, 19 nt, Homo sapiens
gcgcaggaucugaagcauu

SEQ ID NO: 1574703 - RNA, 19 nt, Homo sapiens
ggagguaaaggagcaggaa

SEQ ID NO: 1574704 - RNA, 19 nt, Homo sapiens
cauauuugucugcaugauu

SEQ ID NO: 1574705 - RNA, 19 nt, Homo sapiens
gaguaaagcuuaugaguga

SEQ ID NO: 1574706 - RNA, 19 nt, Homo sapiens
gaauauggacuaugacuua

SEQ ID NO: 1574707 - RNA, 19 nt, Homo sapiens
gcaaugagaugcuguuuag

SEQ ID NO: 1574708 - RNA, 19 nt, Homo sapiens
gaacugaacuuugccuuug

SEQ ID NO: 1574709 - RNA, 19 nt, Homo sapiens
aaacaagccucccaacuaa

SEQ ID NO: 1574710 - RNA, 19 nt, Homo sapiens
caagagaggaguauauuua

SEQ ID NO: 1574711 - RNA, 19 nt, Homo sapiens
gggaggaccuggccaauuu

SEQ ID NO: 1574712 - RNA, 19 nt, Homo sapiens
caacaagacucacaacuuc

SEQ ID NO: 1574713 - RNA, 19 nt, Homo sapiens
ggaacagaauacagaaaua

SEQ ID NO: 1574714 - RNA, 19 nt, Homo sapiens
gagugaagcuucuguguga

SEQ ID NO: 1574715 - RNA, 19 nt, Homo sapiens
gaacuuugccuuugaagaa

SEQ ID NO: 1574716 - RNA, 19 nt, Homo sapiens
gauaagaggugggccauga

SEQ ID NO: 1574717 - RNA, 19 nt, Homo sapiens
gugaauaucugucaacuuc

SEQ ID NO: 1574718 - RNA, 19 nt, Homo sapiens
aaaggaauauggacuauga

SEQ ID NO: 1574719 - RNA, 19 nt, Homo sapiens
gagaagcuuugcucaauug

SEQ ID NO: 1574720 - RNA, 19 nt, Homo sapiens
gagagaagcuuugcucaau

SEQ ID NO: 1574721 - RNA, 19 nt, Homo sapiens
gaacaacgauuugcaggau

SEQ ID NO: 1574722 - RNA, 19 nt, Homo sapiens
caacuucucuucuacacaa

SEQ ID NO: 1574723 - RNA, 19 nt, Homo sapiens
gaaacugacauuccuuuaa

SEQ ID NO: 1574724 - RNA, 19 nt, Homo sapiens
gagaaagccuggagugugu

SEQ ID NO: 1574725 - RNA, 19 nt, Homo sapiens
uaaagcaguuguugaagaa

SEQ ID NO: 1574726 - RNA, 19 nt, Homo sapiens
uaagacauccaaaguguua

SEQ ID NO: 1574727 - RNA, 19 nt, Homo sapiens
gaaugaagaucgaguaaaa

SEQ ID NO: 1574728 - RNA, 19 nt, Homo sapiens
gcagcuauguucuauaugu

SEQ ID NO: 1574729 - RNA, 19 nt, Homo sapiens
ggaucuggcuucuguuauu

SEQ ID NO: 1574730 - RNA, 19 nt, Homo sapiens
gagagacuguccuuagaaa

SEQ ID NO: 1574731 - RNA, 19 nt, Homo sapiens
gacuaugacuuacguguuu

SEQ ID NO: 1574732 - RNA, 19 nt, Homo sapiens
ccaagucgcugccaaagga

SEQ ID NO: 1574733 - RNA, 19 nt, Homo sapiens
gcuggaaucuugcaaccua

SEQ ID NO: 1574734 - RNA, 19 nt, Homo sapiens
ugaaggaauugugaaguua

SEQ ID NO: 1574735 - RNA, 19 nt, Homo sapiens
cauccaagcuguaaucuuc

SEQ ID NO: 1574736 - RNA, 19 nt, Homo sapiens
cagcagagguuuaaguaug

SEQ ID NO: 1574737 - RNA, 19 nt, Homo sapiens
ggauaucucuacuucuuug

SEQ ID NO: 1574738 - RNA, 19 nt, Homo sapiens
gcaggaugauggagugaaa

SEQ ID NO: 1574739 - RNA, 19 nt, Homo sapiens
gaauuggaccuguaccaua

SEQ ID NO: 1574740 - RNA, 19 nt, Homo sapiens
gaagaaucaccauuaugua

SEQ ID NO: 1574741 - RNA, 19 nt, Homo sapiens
aagcuuugcucaauugaua

SEQ ID NO: 1574742 - RNA, 19 nt, Homo sapiens
gaaauuaaccagcugaaag

SEQ ID NO: 1574743 - RNA, 19 nt, Homo sapiens
cagaauaccuuaggauaug

SEQ ID NO: 1574744 - RNA, 19 nt, Homo sapiens
ggaauacugugguuugaca

SEQ ID NO: 1574745 - RNA, 19 nt, Homo sapiens
caggauaucucuacuucuu

SEQ ID NO: 1574746 - RNA, 19 nt, Homo sapiens
aaucugaugucucuaguuu

SEQ ID NO: 1574747 - RNA, 19 nt, Homo sapiens
aguagccucuuguuuauua

SEQ ID NO: 1574748 - RNA, 19 nt, Homo sapiens
ucagggagcugcuggaguu

SEQ ID NO: 1574749 - RNA, 19 nt, Homo sapiens
ugagauauccaaacuguaa

SEQ ID NO: 1574750 - RNA, 19 nt, Homo sapiens
caaaugaacacuugagaga

SEQ ID NO: 1574751 - RNA, 19 nt, Homo sapiens
ucccaaagguugccauuaa

SEQ ID NO: 1574752 - RNA, 19 nt, Homo sapiens
gaaaguauucaguucacua

SEQ ID NO: 1574753 - RNA, 19 nt, Homo sapiens
ggaguauauuuaccaguuu

SEQ ID NO: 1574754 - RNA, 19 nt, Homo sapiens
gaucuggcuucuguuauuu

SEQ ID NO: 1574755 - RNA, 19 nt, Homo sapiens
guucugugcuucauacaaa

SEQ ID NO: 1574756 - RNA, 19 nt, Homo sapiens
ggugagaaaggcaauguua

SEQ ID NO: 1574757 - RNA, 19 nt, Homo sapiens
aaacaaccuuggugagaaa

SEQ ID NO: 1574758 - RNA, 19 nt, Homo sapiens
gcuguaaucuucaggacuu

SEQ ID NO: 1574759 - RNA, 19 nt, Homo sapiens
ugaauauccugcaucauga

SEQ ID NO: 1574760 - RNA, 19 nt, Homo sapiens
ugacacagaugaagugcuu

SEQ ID NO: 1574761 - RNA, 19 nt, Homo sapiens
cuucaaagcacaaguuaua

SEQ ID NO: 1574762 - RNA, 19 nt, Homo sapiens
ugaagucuccuaaguguaa

SEQ ID NO: 1574763 - RNA, 19 nt, Homo sapiens
caaacuggcuacaagacaa

SEQ ID NO: 1574764 - RNA, 19 nt, Homo sapiens
caaugaauauccugcauca

SEQ ID NO: 1574765 - RNA, 19 nt, Homo sapiens
uggaggagcuaaacaaaga

SEQ ID NO: 1574766 - RNA, 19 nt, Homo sapiens
uaagccagauuguaacuau

SEQ ID NO: 1574767 - RNA, 19 nt, Homo sapiens
gaucucuccucugcucuua

SEQ ID NO: 1574768 - RNA, 19 nt, Homo sapiens
ggagaaggguggugauguc

SEQ ID NO: 1574769 - RNA, 19 nt, Homo sapiens
cuaaagcaguuguugaaga

SEQ ID NO: 1574770 - RNA, 19 nt, Homo sapiens
uauccaaacuguaacauuc

SEQ ID NO: 1574771 - RNA, 19 nt, Homo sapiens
gcaagagaggaguauauuu

SEQ ID NO: 1574772 - RNA, 19 nt, Homo sapiens
gcacuuggcagcugucaga

SEQ ID NO: 1574773 - RNA, 19 nt, Homo sapiens
cugaaucugucaaccaaua

SEQ ID NO: 1574774 - RNA, 19 nt, Homo sapiens
acaagaaucugaugcaucu

SEQ ID NO: 1574775 - RNA, 19 nt, Homo sapiens
cuguuuaccugcuauauuu

SEQ ID NO: 1574776 - RNA, 19 nt, Homo sapiens
gcuaaacaaagaggaauua

SEQ ID NO: 1574777 - RNA, 19 nt, Homo sapiens
gaacagaauacagaaauag

SEQ ID NO: 1574778 - RNA, 19 nt, Homo sapiens
gcucuuaucugcaacaaaa

SEQ ID NO: 1574779 - RNA, 19 nt, Homo sapiens
ugagagaauuggaccugua

SEQ ID NO: 1574780 - RNA, 19 nt, Homo sapiens
ccaaagguugccauuaaua

SEQ ID NO: 1574781 - RNA, 19 nt, Homo sapiens
ggaauugcagagaaagaua

SEQ ID NO: 1574782 - RNA, 19 nt, Homo sapiens
gaugguggaguaaagcuua

SEQ ID NO: 1574783 - RNA, 19 nt, Homo sapiens
uuagaaagcuguggucuca

SEQ ID NO: 1574784 - RNA, 19 nt, Homo sapiens
gaacuaaggcacccaaacu

SEQ ID NO: 1574785 - RNA, 19 nt, Homo sapiens
gugcuuagcuucagauacu

SEQ ID NO: 1574786 - RNA, 19 nt, Homo sapiens
ucauuaagccagauuguaa

SEQ ID NO: 1574787 - RNA, 19 nt, Homo sapiens
gcuggaagcugugggaguu

SEQ ID NO: 1574788 - RNA, 19 nt, Homo sapiens
gcacccaaacuguaaacua

SEQ ID NO: 1574789 - RNA, 19 nt, Homo sapiens
ggcaagaucucuguucugu

SEQ ID NO: 1574790 - RNA, 19 nt, Homo sapiens
ggaucaaacuggcuacaag

SEQ ID NO: 1574791 - RNA, 19 nt, Homo sapiens
gaauaucugucaacuucuc

SEQ ID NO: 1574792 - RNA, 19 nt, Homo sapiens
uaacugugguauuugagaa

SEQ ID NO: 1574793 - RNA, 19 nt, Homo sapiens
ugaagaaucaccauuaugu

SEQ ID NO: 1574794 - RNA, 19 nt, Homo sapiens
cuggaaagccugaagauuu

SEQ ID NO: 1574795 - RNA, 19 nt, Homo sapiens
uagagagacuguccuuaga

SEQ ID NO: 1574796 - RNA, 19 nt, Homo sapiens
guugaagaaucaccauuau

SEQ ID NO: 1574797 - RNA, 19 nt, Homo sapiens
cuuaggauaugaaggaauu

SEQ ID NO: 1574798 - RNA, 19 nt, Homo sapiens
uaccauagcaaccuugaua

SEQ ID NO: 1574799 - RNA, 19 nt, Homo sapiens
guauggaaguauuaggaaa

SEQ ID NO: 1574800 - RNA, 19 nt, Homo sapiens
ggagaggacuuuuaacugu

SEQ ID NO: 1574801 - RNA, 19 nt, Homo sapiens
gcuauguucuauauguuga

SEQ ID NO: 1574802 - RNA, 19 nt, Homo sapiens
cuaagagacuaaagcaguu

SEQ ID NO: 1574803 - RNA, 19 nt, Homo sapiens
ccaguguccuuccucauga

SEQ ID NO: 1574804 - RNA, 19 nt, Homo sapiens
gaaccugaguuugcacugu

SEQ ID NO: 1574805 - RNA, 19 nt, Homo sapiens
gaaagagugucaaggaaua

SEQ ID NO: 1574806 - RNA, 19 nt, Homo sapiens
gaagagugaucucaacuuu

SEQ ID NO: 1574807 - RNA, 19 nt, Homo sapiens
ggaaauggguugauucauc

SEQ ID NO: 1574808 - RNA, 19 nt, Homo sapiens
guaauggaguaguuuguua

SEQ ID NO: 1574809 - RNA, 19 nt, Homo sapiens
gaacagaagcagauggaua

SEQ ID NO: 1574810 - RNA, 19 nt, Homo sapiens
ugaaagagauucuggaaau

SEQ ID NO: 1574811 - RNA, 19 nt, Homo sapiens
gaaaggauaaggcaaauga

SEQ ID NO: 1574812 - RNA, 19 nt, Homo sapiens
gaacauuccuuccugaaca

SEQ ID NO: 1574813 - RNA, 19 nt, Homo sapiens
gaucagaauucaaccuuug

SEQ ID NO: 1574814 - RNA, 19 nt, Homo sapiens
gcugagagguccauaauag

SEQ ID NO: 1574815 - RNA, 19 nt, Homo sapiens
caagagaacugugucauuc

SEQ ID NO: 1574816 - RNA, 19 nt, Homo sapiens
gcauacaguuccuaguuaa

SEQ ID NO: 1574817 - RNA, 19 nt, Homo sapiens
cgagguaguuucuuuggua

SEQ ID NO: 1574818 - RNA, 19 nt, Homo sapiens
caucacaucuauucggaua

SEQ ID NO: 1574819 - RNA, 19 nt, Homo sapiens
caagguggcuuauagaaca

SEQ ID NO: 1574820 - RNA, 19 nt, Homo sapiens
gaucccaaauccugagaua

SEQ ID NO: 1574821 - RNA, 19 nt, Homo sapiens
ggcauacaguuccuaguua

SEQ ID NO: 1574822 - RNA, 19 nt, Homo sapiens
cauuacagcugaugugaaa

SEQ ID NO: 1574823 - RNA, 19 nt, Homo sapiens
ggacaaauacuucuucauc

SEQ ID NO: 1574824 - RNA, 19 nt, Homo sapiens
guucuuauuucaccugaua

SEQ ID NO: 1574825 - RNA, 19 nt, Homo sapiens
gaaauucuguaaggacuga

SEQ ID NO: 1574826 - RNA, 19 nt, Homo sapiens
gcaaugcucuccuugucaa

SEQ ID NO: 1574827 - RNA, 19 nt, Homo sapiens
ccagacacuugccuuauuu

SEQ ID NO: 1574828 - RNA, 19 nt, Homo sapiens
ucagugcucuccuuucuuu

SEQ ID NO: 1574829 - RNA, 19 nt, Homo sapiens
acucauacauguucccuua

SEQ ID NO: 1574830 - RNA, 19 nt, Homo sapiens
ccugagauauugcugauuu

SEQ ID NO: 1574831 - RNA, 19 nt, Homo sapiens
gauaauauuccguccaauu

SEQ ID NO: 1574832 - RNA, 19 nt, Homo sapiens
cuaggagcaucauuuauuu

SEQ ID NO: 1574833 - RNA, 19 nt, Homo sapiens
gaauucaaccuuuguucua

SEQ ID NO: 1574834 - RNA, 19 nt, Homo sapiens
gagcuccagucaccagaua

SEQ ID NO: 1574835 - RNA, 19 nt, Homo sapiens
ucauacauguucccuuaua

SEQ ID NO: 1574836 - RNA, 19 nt, Homo sapiens
ggacucaucacaucuauuc

SEQ ID NO: 1574837 - RNA, 19 nt, Homo sapiens
acaggaaucucuuauguuc

SEQ ID NO: 1574838 - RNA, 19 nt, Homo sapiens
cuacaggaaucucuuaugu

SEQ ID NO: 1574839 - RNA, 19 nt, Homo sapiens
guacugaucucccaaaaga

SEQ ID NO: 1574840 - RNA, 19 nt, Homo sapiens
cauaguggcuacauuacuu

SEQ ID NO: 1574841 - RNA, 19 nt, Homo sapiens
ggacugaucugccauuuuc

SEQ ID NO: 1574842 - RNA, 19 nt, Homo sapiens
gaaugaggauaagaagauu

SEQ ID NO: 1574843 - RNA, 19 nt, Homo sapiens
ucacuaggagcaucauuua

SEQ ID NO: 1574844 - RNA, 19 nt, Homo sapiens
acacuugccuuauuucuuc

SEQ ID NO: 1574845 - RNA, 19 nt, Homo sapiens
agaagcagauggauaugaa

SEQ ID NO: 1574846 - RNA, 19 nt, Homo sapiens
gaugggcuauuuguucuuu

SEQ ID NO: 1574847 - RNA, 19 nt, Homo sapiens
gaaauugcagcaccucuau

SEQ ID NO: 1574848 - RNA, 19 nt, Homo sapiens
agaaggagcuggcaucucu

SEQ ID NO: 1574849 - RNA, 19 nt, Homo sapiens
gcaaagggaacaaugugaa

SEQ ID NO: 1574850 - RNA, 19 nt, Homo sapiens
cgacauguuucacaaauac

SEQ ID NO: 1574851 - RNA, 19 nt, Homo sapiens
ucacaucuauucggauauu

SEQ ID NO: 1574852 - RNA, 19 nt, Homo sapiens
uggaguguguggacaaaua

SEQ ID NO: 1574853 - RNA, 19 nt, Homo sapiens
aggcugagcuuuaauguca

SEQ ID NO: 1574854 - RNA, 19 nt, Homo sapiens
ggacaagaaugaggauaag

SEQ ID NO: 1574855 - RNA, 19 nt, Homo sapiens
cauacuagagcaagaauuu

SEQ ID NO: 1574856 - RNA, 19 nt, Homo sapiens
gacaaauacuucuucaucu

SEQ ID NO: 1574857 - RNA, 19 nt, Homo sapiens
gaucucugcuucauuugug

SEQ ID NO: 1574858 - RNA, 19 nt, Homo sapiens
ucaccuugcugcuguuauu

SEQ ID NO: 1574859 - RNA, 19 nt, Homo sapiens
gagcaucauuuauuuacca

SEQ ID NO: 1574860 - RNA, 19 nt, Homo sapiens
ccuaagggcacagguauua

SEQ ID NO: 1574861 - RNA, 19 nt, Homo sapiens
agauauugcugauuugcua

SEQ ID NO: 1574862 - RNA, 19 nt, Homo sapiens
ggauaaggcaaaugacuga

SEQ ID NO: 1574863 - RNA, 19 nt, Homo sapiens
cauacauguucccuuauaa

SEQ ID NO: 1574864 - RNA, 19 nt, Homo sapiens
ucucuuugcuuucuucuga

SEQ ID NO: 1574865 - RNA, 19 nt, Homo sapiens
cauccaauauuccuucgaa

SEQ ID NO: 1574866 - RNA, 19 nt, Homo sapiens
ggccugcccucccuuuauu

SEQ ID NO: 1574867 - RNA, 19 nt, Homo sapiens
uuucaaggcugagcuuuaa

SEQ ID NO: 1574868 - RNA, 19 nt, Homo sapiens
uaagaugggcuauuuguuc

SEQ ID NO: 1574869 - RNA, 19 nt, Homo sapiens
uguguaagaugggcuauuu

SEQ ID NO: 1574870 - RNA, 19 nt, Homo sapiens
cauguucccuuauaaaucu

SEQ ID NO: 1574871 - RNA, 19 nt, Homo sapiens
gaaaagaagcagaaaauca

SEQ ID NO: 1574872 - RNA, 19 nt, Homo sapiens
gguauuagugucauauuga

SEQ ID NO: 1574873 - RNA, 19 nt, Homo sapiens
ucacaccucuauucacaga

SEQ ID NO: 1574874 - RNA, 19 nt, Homo sapiens
ucacggaaauucuguaagg

SEQ ID NO: 1574875 - RNA, 19 nt, Homo sapiens
gcaauuggccacuccuaau

SEQ ID NO: 1574876 - RNA, 19 nt, Homo sapiens
ccagaaaggauaaggcaaa

SEQ ID NO: 1574877 - RNA, 19 nt, Homo sapiens
ugacugugaugagaaauug

SEQ ID NO: 1574878 - RNA, 19 nt, Homo sapiens
ggacuggguuucuggugau

SEQ ID NO: 1574879 - RNA, 19 nt, Homo sapiens
gguaguuucuuugguauuc

SEQ ID NO: 1574880 - RNA, 19 nt, Homo sapiens
ugacgaugaugaaggagaa

SEQ ID NO: 1574881 - RNA, 19 nt, Homo sapiens
ggauuccagcucauaauaa

SEQ ID NO: 1574882 - RNA, 19 nt, Homo sapiens
uaccauaguggcuacauua

SEQ ID NO: 1574883 - RNA, 19 nt, Homo sapiens
gaauuacugccucucacua

SEQ ID NO: 1574884 - RNA, 19 nt, Homo sapiens
cagcugaugugaaagagau

SEQ ID NO: 1574885 - RNA, 19 nt, Homo sapiens
ccaauauuccuucgaaaga

SEQ ID NO: 1574886 - RNA, 19 nt, Homo sapiens
gcaggacucaucacaucua

SEQ ID NO: 1574887 - RNA, 19 nt, Homo sapiens
ccacuuuccuugggccaua

SEQ ID NO: 1574888 - RNA, 19 nt, Homo sapiens
agacauagccgcagacuac

SEQ ID NO: 1574889 - RNA, 19 nt, Homo sapiens
caaagggaacaaugugaaa

SEQ ID NO: 1574890 - RNA, 19 nt, Homo sapiens
gauuccagcucauaauaag

SEQ ID NO: 1574891 - RNA, 19 nt, Homo sapiens
ccaucaauauaucucagua

SEQ ID NO: 1574892 - RNA, 19 nt, Homo sapiens
gcagaucuccagcccagaa

SEQ ID NO: 1574893 - RNA, 19 nt, Homo sapiens
gaaacaggcaggacacagu

SEQ ID NO: 1574894 - RNA, 19 nt, Homo sapiens
ccaauuccagguuaacuuu

SEQ ID NO: 1574895 - RNA, 19 nt, Homo sapiens
gaggauaagaagauugauu

SEQ ID NO: 1574896 - RNA, 19 nt, Homo sapiens
gagguaguuucuuugguau

SEQ ID NO: 1574897 - RNA, 19 nt, Homo sapiens
uacauuaccucgccacugu

SEQ ID NO: 1574898 - RNA, 19 nt, Homo sapiens
uaaggcaaaugacugaaca

SEQ ID NO: 1574899 - RNA, 19 nt, Homo sapiens
uauguaaacagcaguguaa

SEQ ID NO: 1574900 - RNA, 19 nt, Homo sapiens
gagcucaugcugacuguga

SEQ ID NO: 1574901 - RNA, 19 nt, Homo sapiens
gagcauacucauacauguu

SEQ ID NO: 1574902 - RNA, 19 nt, Homo sapiens
aagaccauguguuugauaa

SEQ ID NO: 1574903 - RNA, 19 nt, Homo sapiens
cauaaaagaccauguguuu

SEQ ID NO: 1574904 - RNA, 19 nt, Homo sapiens
guaggcuccugaagaguga

SEQ ID NO: 1574905 - RNA, 19 nt, Homo sapiens
gauagcagauggaucaaua

SEQ ID NO: 1574906 - RNA, 19 nt, Homo sapiens
gggaagagcugaugagaau

SEQ ID NO: 1574907 - RNA, 19 nt, Homo sapiens
gcagauggaucaauauuag

SEQ ID NO: 1574908 - RNA, 19 nt, Homo sapiens
gcagguaucuugcucucua

SEQ ID NO: 1574909 - RNA, 19 nt, Homo sapiens
ggacgaagauuuucuauug

SEQ ID NO: 1574910 - RNA, 19 nt, Homo sapiens
ugacauagcugaccuuagu

SEQ ID NO: 1574911 - RNA, 19 nt, Homo sapiens
gaauguagacuguauaugu

SEQ ID NO: 1574912 - RNA, 19 nt, Homo sapiens
gaaagaccaccauccuaua

SEQ ID NO: 1574913 - RNA, 19 nt, Homo sapiens
gcaguggucuucaggauuc

SEQ ID NO: 1574914 - RNA, 19 nt, Homo sapiens
ggaacaggaucaagucuuc

SEQ ID NO: 1574915 - RNA, 19 nt, Homo sapiens
ggaaagaccaccauccuau

SEQ ID NO: 1574916 - RNA, 19 nt, Homo sapiens
uaagugaucuugguaguau

SEQ ID NO: 1574917 - RNA, 19 nt, Homo sapiens
gaaauaaaauccugaagug

SEQ ID NO: 1574918 - RNA, 19 nt, Homo sapiens
gaucaugggcaauaucuuu

SEQ ID NO: 1574919 - RNA, 19 nt, Homo sapiens
gaucaagucuuccauacca

SEQ ID NO: 1574920 - RNA, 19 nt, Homo sapiens
gcacgggccucucuguguu

SEQ ID NO: 1574921 - RNA, 19 nt, Homo sapiens
ucacugcuguugcucauuu

SEQ ID NO: 1574922 - RNA, 19 nt, Homo sapiens
gcaaguccauggugugugu

SEQ ID NO: 1574923 - RNA, 19 nt, Homo sapiens
gguccugacuucuguaguu

SEQ ID NO: 1574924 - RNA, 19 nt, Homo sapiens
ggaacccacucacucuuau

SEQ ID NO: 1574925 - RNA, 19 nt, Homo sapiens
gacccugguuggaaauuaa

SEQ ID NO: 1574926 - RNA, 19 nt, Homo sapiens
caccguaacugguacauuc

SEQ ID NO: 1574927 - RNA, 19 nt, Homo sapiens
gcuggaggauggcauuuau

SEQ ID NO: 1574928 - RNA, 19 nt, Homo sapiens
ccuaauugcuguccugaug

SEQ ID NO: 1574929 - RNA, 19 nt, Homo sapiens
uggagacaguggaguauaa

SEQ ID NO: 1574930 - RNA, 19 nt, Homo sapiens
cuacauucccauucacuua

SEQ ID NO: 1574931 - RNA, 19 nt, Homo sapiens
guuacuuagugauguguua

SEQ ID NO: 1574932 - RNA, 19 nt, Homo sapiens
uaacagcucuuuugggauu

SEQ ID NO: 1574933 - RNA, 19 nt, Homo sapiens
cgagacagcugcccauaac

SEQ ID NO: 1574934 - RNA, 19 nt, Homo sapiens
gaacgcugcugagaucaca

SEQ ID NO: 1574935 - RNA, 19 nt, Homo sapiens
uaugaacgcugcugagauc

SEQ ID NO: 1574936 - RNA, 19 nt, Homo sapiens
ucacucacuucucauaaau

SEQ ID NO: 1574937 - RNA, 19 nt, Homo sapiens
uaggacagaugauggauuc

SEQ ID NO: 1574938 - RNA, 19 nt, Homo sapiens
gcaguaagugaucuuggua

SEQ ID NO: 1574939 - RNA, 19 nt, Homo sapiens
gguguuggagguucuauuu

SEQ ID NO: 1574940 - RNA, 19 nt, Homo sapiens
ccucagugccaguuacuua

SEQ ID NO: 1574941 - RNA, 19 nt, Homo sapiens
uaguaucccuggcugcuaa

SEQ ID NO: 1574942 - RNA, 19 nt, Homo sapiens
caauaucuuuggaaaccuu

SEQ ID NO: 1574943 - RNA, 19 nt, Homo sapiens
guuugucugugguguuaua

SEQ ID NO: 1574944 - RNA, 19 nt, Homo sapiens
ggagguucuauuucauuua

SEQ ID NO: 1574945 - RNA, 19 nt, Homo sapiens
cauccucacucacuucuca

SEQ ID NO: 1574946 - RNA, 19 nt, Homo sapiens
ccaccacccuucugaucuu

SEQ ID NO: 1574947 - RNA, 19 nt, Homo sapiens
aacaucagcuuuacagugu

SEQ ID NO: 1574948 - RNA, 19 nt, Homo sapiens
ugacccugguuggaaauua

SEQ ID NO: 1574949 - RNA, 19 nt, Homo sapiens
acagaugcuucccuccaua

SEQ ID NO: 1574950 - RNA, 19 nt, Homo sapiens
cagcaggugugugcaggua

SEQ ID NO: 1574951 - RNA, 19 nt, Homo sapiens
uagcugaccuuaguaucaa

SEQ ID NO: 1574952 - RNA, 19 nt, Homo sapiens
ggagagaggaacccacuca

SEQ ID NO: 1574953 - RNA, 19 nt, Homo sapiens
gguuggaaauuaaacuugu

SEQ ID NO: 1574954 - RNA, 19 nt, Homo sapiens
ggauggcauuuaucucuag

SEQ ID NO: 1574955 - RNA, 19 nt, Homo sapiens
gaggauggcauuuaucucu

SEQ ID NO: 1574956 - RNA, 19 nt, Homo sapiens
agacagcccuaacaaagca

SEQ ID NO: 1574957 - RNA, 19 nt, Homo sapiens
ccagacagcccuaacaaag

SEQ ID NO: 1574958 - RNA, 19 nt, Homo sapiens
gcaggugugugcagguauc

SEQ ID NO: 1574959 - RNA, 19 nt, Homo sapiens
acaaacaggaucugccuaa

SEQ ID NO: 1574960 - RNA, 19 nt, Homo sapiens
aaguuugucugugguguua

SEQ ID NO: 1574961 - RNA, 19 nt, Homo sapiens
uggagguucuauuucauuu

SEQ ID NO: 1574962 - RNA, 19 nt, Homo sapiens
ugacuucuguaguuucugu

SEQ ID NO: 1574963 - RNA, 19 nt, Homo sapiens
guaagugaucuugguagua

SEQ ID NO: 1574964 - RNA, 19 nt, Homo sapiens
guuaggagguugccuuggu

SEQ ID NO: 1574965 - RNA, 19 nt, Homo sapiens
augcuucccuccauacuuu

SEQ ID NO: 1574966 - RNA, 19 nt, Homo sapiens
gcugugaucaugggcaaua

SEQ ID NO: 1574967 - RNA, 19 nt, Homo sapiens
gaacugugaaagagagguu

SEQ ID NO: 1574968 - RNA, 19 nt, Homo sapiens
ugacuggguauucuaauga

SEQ ID NO: 1574969 - RNA, 19 nt, Homo sapiens
gaugauaggacagaugaug

SEQ ID NO: 1574970 - RNA, 19 nt, Homo sapiens
caaacaggaucugccuaau

SEQ ID NO: 1574971 - RNA, 19 nt, Homo sapiens
gaagagcugaugagaaugc

SEQ ID NO: 1574972 - RNA, 19 nt, Homo sapiens
gggugguccuuucuacauu

SEQ ID NO: 1574973 - RNA, 19 nt, Homo sapiens
cugcugagaucacagacaa

SEQ ID NO: 1574974 - RNA, 19 nt, Homo sapiens
aaacaggaucugccuaaug

SEQ ID NO: 1574975 - RNA, 19 nt, Homo sapiens
gauaacgcgaugacuguga

SEQ ID NO: 1574976 - RNA, 19 nt, Homo sapiens
ucuccucucugguagguuu

SEQ ID NO: 1574977 - RNA, 19 nt, Homo sapiens
gcuaaaggacgaagauuuu

SEQ ID NO: 1574978 - RNA, 19 nt, Homo sapiens
gggauaacgcgaugacugu

SEQ ID NO: 1574979 - RNA, 19 nt, Homo sapiens
ccugugggcuccugugugu

SEQ ID NO: 1574980 - RNA, 19 nt, Homo sapiens
gguuagaguggaggaaaua

SEQ ID NO: 1574981 - RNA, 19 nt, Homo sapiens
uccuugaacucuuuccuuu

SEQ ID NO: 1574982 - RNA, 19 nt, Homo sapiens
gcuuagaguguucaacuga

SEQ ID NO: 1574983 - RNA, 19 nt, Homo sapiens
gagauuaagggaagaaggu

SEQ ID NO: 1574984 - RNA, 19 nt, Homo sapiens
ccaccuauaugaccaaucc

SEQ ID NO: 1574985 - RNA, 19 nt, Homo sapiens
ggaucugccuaaugcuaug

SEQ ID NO: 1574986 - RNA, 19 nt, Homo sapiens
guauaagaacaucagcuuu

SEQ ID NO: 1574987 - RNA, 19 nt, Homo sapiens
ggugguccuuucuacauuc

SEQ ID NO: 1574988 - RNA, 19 nt, Homo sapiens
gcaggaacaggaucaaguc

SEQ ID NO: 1574989 - RNA, 19 nt, Homo sapiens
ggcaguaagugaucuuggu

SEQ ID NO: 1574990 - RNA, 19 nt, Homo sapiens
uguuggagguucuauuuca

SEQ ID NO: 1574991 - RNA, 19 nt, Homo sapiens
agaccaccauccuauacaa

SEQ ID NO: 1574992 - RNA, 19 nt, Homo sapiens
ccucuggaauguagacugu

SEQ ID NO: 1574993 - RNA, 19 nt, Homo sapiens
ccaguuacuuagugaugug

SEQ ID NO: 1574994 - RNA, 19 nt, Homo sapiens
guccugacuucuguaguuu

SEQ ID NO: 1574995 - RNA, 19 nt, Homo sapiens
uccaggauaugcuaaagga

SEQ ID NO: 1574996 - RNA, 19 nt, Homo sapiens
caccacccuucugaucuua

SEQ ID NO: 1574997 - RNA, 19 nt, Homo sapiens
ggcaauaucuuuggaaacc

SEQ ID NO: 1574998 - RNA, 19 nt, Homo sapiens
cccaaggguugauauuugu

SEQ ID NO: 1574999 - RNA, 19 nt, Homo sapiens
agaugucaguccuaaauag

SEQ ID NO: 1575000 - RNA, 19 nt, Homo sapiens
uuggaaaccuucucaagag

SEQ ID NO: 1575001 - RNA, 19 nt, Homo sapiens
uagcagauggaucaauauu

SEQ ID NO: 1575002 - RNA, 19 nt, Homo sapiens
gauggcauuuaucucuaga

SEQ ID NO: 1575003 - RNA, 19 nt, Homo sapiens
gcccuucuacucccuguuu

SEQ ID NO: 1575004 - RNA, 19 nt, Homo sapiens
uaauugcuguccugaugau

SEQ ID NO: 1575005 - RNA, 19 nt, Homo sapiens
gaagaagccuugacaauac

SEQ ID NO: 1575006 - RNA, 19 nt, Homo sapiens
agaaguaucugaugguaua

SEQ ID NO: 1575007 - RNA, 19 nt, Homo sapiens
gauaggaugucuucauuug

SEQ ID NO: 1575008 - RNA, 19 nt, Homo sapiens
caaggaggcuuuagguauu

SEQ ID NO: 1575009 - RNA, 19 nt, Homo sapiens
ccaaugccaucgaucaaua

SEQ ID NO: 1575010 - RNA, 19 nt, Homo sapiens
ggaaugaacccacaucaga

SEQ ID NO: 1575011 - RNA, 19 nt, Homo sapiens
ggacagcagucucguauac

SEQ ID NO: 1575012 - RNA, 19 nt, Homo sapiens
gagauaaggcaaacuauug

SEQ ID NO: 1575013 - RNA, 19 nt, Homo sapiens
ggaccaaucuuacaaacca

SEQ ID NO: 1575014 - RNA, 19 nt, Homo sapiens
gagcagaaaucuccaaugc

SEQ ID NO: 1575015 - RNA, 19 nt, Homo sapiens
gcaaacuauugguggcuua

SEQ ID NO: 1575016 - RNA, 19 nt, Homo sapiens
gccaaagucugcaugguuu

SEQ ID NO: 1575017 - RNA, 19 nt, Homo sapiens
aauccuagcucguaauauu

SEQ ID NO: 1575018 - RNA, 19 nt, Homo sapiens
ggaaucauccucgcucaua

SEQ ID NO: 1575019 - RNA, 19 nt, Homo sapiens
gaaggaauggguugagaaa

SEQ ID NO: 1575020 - RNA, 19 nt, Homo sapiens
gucgacaagucauuauuua

SEQ ID NO: 1575021 - RNA, 19 nt, Homo sapiens
ggaugaagauuugauaaag

SEQ ID NO: 1575022 - RNA, 19 nt, Homo sapiens
agaagaagccuugacaaua

SEQ ID NO: 1575023 - RNA, 19 nt, Homo sapiens
ucaaguacacucagucuaa

SEQ ID NO: 1575024 - RNA, 19 nt, Homo sapiens
ucucuuuggucuucauuua

SEQ ID NO: 1575025 - RNA, 19 nt, Homo sapiens
ggaauccuagcucguaaua

SEQ ID NO: 1575026 - RNA, 19 nt, Homo sapiens
ccugaaacuuugaggauaa

SEQ ID NO: 1575027 - RNA, 19 nt, Homo sapiens
ggagauaaggcaaacuauu

SEQ ID NO: 1575028 - RNA, 19 nt, Homo sapiens
aaaccggccuuguggaauu

SEQ ID NO: 1575029 - RNA, 19 nt, Homo sapiens
gccaagaacgggcagguua

SEQ ID NO: 1575030 - RNA, 19 nt, Homo sapiens
ugaggaagucccugaguua

SEQ ID NO: 1575031 - RNA, 19 nt, Homo sapiens
cagaugcccuugagauaug

SEQ ID NO: 1575032 - RNA, 19 nt, Homo sapiens
cacaagugcuuucgaugaa

SEQ ID NO: 1575033 - RNA, 19 nt, Homo sapiens
ggccagcucgccuuauuua

SEQ ID NO: 1575034 - RNA, 19 nt, Homo sapiens
caucacaguucuaaaugga

SEQ ID NO: 1575035 - RNA, 19 nt, Homo sapiens
uaacguagacagagcuaaa

SEQ ID NO: 1575036 - RNA, 19 nt, Homo sapiens
ccacaagugcuuucgauga

SEQ ID NO: 1575037 - RNA, 19 nt, Homo sapiens
acugagagcugcagccaaa

SEQ ID NO: 1575038 - RNA, 19 nt, Homo sapiens
caaucucuaucccuuugua

SEQ ID NO: 1575039 - RNA, 19 nt, Homo sapiens
ggaauggguugagaaacug

SEQ ID NO: 1575040 - RNA, 19 nt, Homo sapiens
ucacucauacggcacaaua

SEQ ID NO: 1575041 - RNA, 19 nt, Homo sapiens
aaaccacgcucgagugaca

SEQ ID NO: 1575042 - RNA, 19 nt, Homo sapiens
gaagaagaagccuugacaa

SEQ ID NO: 1575043 - RNA, 19 nt, Homo sapiens
ucaaggaggcuuuagguau

SEQ ID NO: 1575044 - RNA, 19 nt, Homo sapiens
gacaagucauuauuuagca

SEQ ID NO: 1575045 - RNA, 19 nt, Homo sapiens
cccaggauaugaagaagaa

SEQ ID NO: 1575046 - RNA, 19 nt, Homo sapiens
cugauaggaugucuucauu

SEQ ID NO: 1575047 - RNA, 19 nt, Homo sapiens
gagugacagugguguguga

SEQ ID NO: 1575048 - RNA, 19 nt, Homo sapiens
gcucuuccaccacugauuu

SEQ ID NO: 1575049 - RNA, 19 nt, Homo sapiens
gaggaugaagauuugauaa

SEQ ID NO: 1575050 - RNA, 19 nt, Homo sapiens
cagcucgccuuauuuagug

SEQ ID NO: 1575051 - RNA, 19 nt, Homo sapiens
gccugaaacuuugaggaua

SEQ ID NO: 1575052 - RNA, 19 nt, Homo sapiens
ggagugguguggcguacau

SEQ ID NO: 1575053 - RNA, 19 nt, Homo sapiens
ucacugaggcagagaagaa

SEQ ID NO: 1575054 - RNA, 19 nt, Homo sapiens
uggcgaggaugaagauuug

SEQ ID NO: 1575055 - RNA, 19 nt, Homo sapiens
agagaaguaucugauggua

SEQ ID NO: 1575056 - RNA, 19 nt, Homo sapiens
augcagagcuccgagagua

SEQ ID NO: 1575057 - RNA, 19 nt, Homo sapiens
uagcaauguuguuaccaaa

SEQ ID NO: 1575058 - RNA, 19 nt, Homo sapiens
cgaacucucuuuggucuuc

SEQ ID NO: 1575059 - RNA, 19 nt, Homo sapiens
ccugaccgcucuugguuug

SEQ ID NO: 1575060 - RNA, 19 nt, Homo sapiens
caccauugcugucaaguac

SEQ ID NO: 1575061 - RNA, 19 nt, Homo sapiens
caaaccagaugaaaaugaa

SEQ ID NO: 1575062 - RNA, 19 nt, Homo sapiens
ccuggcagcuggugaagga

SEQ ID NO: 1575063 - RNA, 19 nt, Homo sapiens
ggagacuagacgccaguua

SEQ ID NO: 1575064 - RNA, 19 nt, Homo sapiens
caggagauaaggcaaacua

SEQ ID NO: 1575065 - RNA, 19 nt, Homo sapiens
gcuggaauccuagcucgua

SEQ ID NO: 1575066 - RNA, 19 nt, Homo sapiens
gaaacuauuguguccuuca

SEQ ID NO: 1575067 - RNA, 19 nt, Homo sapiens
ucucugaguugacgggauu

SEQ ID NO: 1575068 - RNA, 19 nt, Homo sapiens
gaaucauccucgcucauac

SEQ ID NO: 1575069 - RNA, 19 nt, Homo sapiens
cgaggaugaagauuugaua

SEQ ID NO: 1575070 - RNA, 19 nt, Homo sapiens
caagugcuuucgaugaagu

SEQ ID NO: 1575071 - RNA, 19 nt, Homo sapiens
gaagaugaggccaaagucu

SEQ ID NO: 1575072 - RNA, 19 nt, Homo sapiens
ggagcaaauugacauuggu

SEQ ID NO: 1575073 - RNA, 19 nt, Homo sapiens
gacauggccagacuugauu

SEQ ID NO: 1575074 - RNA, 19 nt, Homo sapiens
cguaauauuccagaagaua

SEQ ID NO: 1575075 - RNA, 19 nt, Homo sapiens
gauugaggccugcgacgaa

SEQ ID NO: 1575076 - RNA, 19 nt, Homo sapiens
gcaggacagcagucucgua

SEQ ID NO: 1575077 - RNA, 19 nt, Homo sapiens
uaggaugucuucauuuggu

SEQ ID NO: 1575078 - RNA, 19 nt, Homo sapiens
ggccaaagucugcaugguu

SEQ ID NO: 1575079 - RNA, 19 nt, Homo sapiens
ggagugaagagagcagaaa

SEQ ID NO: 1575080 - RNA, 19 nt, Homo sapiens
gauggaccaaucuuacaaa

SEQ ID NO: 1575081 - RNA, 19 nt, Homo sapiens
uggaaacuauuguguccuu

SEQ ID NO: 1575082 - RNA, 19 nt, Homo sapiens
caugguuuaugaucucuau

SEQ ID NO: 1575083 - RNA, 19 nt, Homo sapiens
ggcacaauaugaugaagca

SEQ ID NO: 1575084 - RNA, 19 nt, Homo sapiens
gagacuagacgccaguuag

SEQ ID NO: 1575085 - RNA, 19 nt, Homo sapiens
gaaacuuugaggauaacuu

SEQ ID NO: 1575086 - RNA, 19 nt, Homo sapiens
uugagaaacugacugaagu

SEQ ID NO: 1575087 - RNA, 19 nt, Homo sapiens
agaagauaaugcugacaug

SEQ ID NO: 1575088 - RNA, 19 nt, Homo sapiens
ggaacucaaggaggcuuua

SEQ ID NO: 1575089 - RNA, 19 nt, Homo sapiens
ugacauggccagacuugau

SEQ ID NO: 1575090 - RNA, 19 nt, Homo sapiens
gaacagucacgccugaaac

SEQ ID NO: 1575091 - RNA, 19 nt, Homo sapiens
gaaggcacuguuugaggaa

SEQ ID NO: 1575092 - RNA, 19 nt, Homo sapiens
ugaccgcucuugguuugaa

SEQ ID NO: 1575093 - RNA, 19 nt, Homo sapiens
cgucgacaagucauuauuu

SEQ ID NO: 1575094 - RNA, 19 nt, Homo sapiens
cauuuaagccagaagagaa

SEQ ID NO: 1575095 - RNA, 19 nt, Homo sapiens
ccggccagcucgccuuauu

SEQ ID NO: 1575096 - RNA, 19 nt, Homo sapiens
ccaaagucugcaugguuua

SEQ ID NO: 1575097 - RNA, 19 nt, Homo sapiens
gaaccauuggcgaggauga

SEQ ID NO: 1575098 - RNA, 19 nt, Homo sapiens
uaagccagaagagaaauaa

SEQ ID NO: 1575099 - RNA, 19 nt, Homo sapiens
ugaagaagaagccuugaca

SEQ ID NO: 1575100 - RNA, 19 nt, Homo sapiens
aaacuugugcgaugcuuug

SEQ ID NO: 1575101 - RNA, 19 nt, Homo sapiens
ugaggaggcuguggagcaa

SEQ ID NO: 1575102 - RNA, 19 nt, Homo sapiens
agucacgccugaaacuuug

SEQ ID NO: 1575103 - RNA, 19 nt, Homo sapiens
ugccaucgaucaauaugug

SEQ ID NO: 1575104 - RNA, 19 nt, Homo sapiens
ugcuuucgaugaaguuuaa

SEQ ID NO: 1575105 - RNA, 19 nt, Homo sapiens
gaagacaucauccggaaua

SEQ ID NO: 1575106 - RNA, 19 nt, Homo sapiens
caacagcguuccuagagaa

SEQ ID NO: 1575107 - RNA, 19 nt, Homo sapiens
gaagacaggcuggaagaua

SEQ ID NO: 1575108 - RNA, 19 nt, Homo sapiens
gaaaugggauggacugaac

SEQ ID NO: 1575109 - RNA, 19 nt, Homo sapiens
ccaagaagguggccaguca

SEQ ID NO: 1575110 - RNA, 19 nt, Homo sapiens
ucaaggaaguagaaacaaa

SEQ ID NO: 1575111 - RNA, 19 nt, Homo sapiens
ucacaaaccuacugguguu

SEQ ID NO: 1575112 - RNA, 19 nt, Homo sapiens
acgaugagcugcagacuga

SEQ ID NO: 1575113 - RNA, 19 nt, Homo sapiens
gacaucauccggaauauug

SEQ ID NO: 1575114 - RNA, 19 nt, Homo sapiens
gugaggagcuuagccagaa

SEQ ID NO: 1575115 - RNA, 19 nt, Homo sapiens
cuagagacauggagaagga

SEQ ID NO: 1575116 - RNA, 19 nt, Homo sapiens
cugcacaucuguaaaucua

SEQ ID NO: 1575117 - RNA, 19 nt, Homo sapiens
gagaagacaggcuggaaga

SEQ ID NO: 1575118 - RNA, 19 nt, Homo sapiens
gaauggccuucauaucauc

SEQ ID NO: 1575119 - RNA, 19 nt, Homo sapiens
ccaaagcuguucugacaac

SEQ ID NO: 1575120 - RNA, 19 nt, Homo sapiens
cuccaaagcuguucugaca

SEQ ID NO: 1575121 - RNA, 19 nt, Homo sapiens
uaaauuggaaagcagguuu

SEQ ID NO: 1575122 - RNA, 19 nt, Homo sapiens
uauagcugcuuccagugua

SEQ ID NO: 1575123 - RNA, 19 nt, Homo sapiens
gcaccuacgugaggagcuu

SEQ ID NO: 1575124 - RNA, 19 nt, Homo sapiens
gugacuggcuaaagcuuga

SEQ ID NO: 1575125 - RNA, 19 nt, Homo sapiens
aagacaggcuggaagauag

SEQ ID NO: 1575126 - RNA, 19 nt, Homo sapiens
ucaacagcguuccuagaga

SEQ ID NO: 1575127 - RNA, 19 nt, Homo sapiens
cugugcagguucccacuua

SEQ ID NO: 1575128 - RNA, 19 nt, Homo sapiens
ugaaucugcacaucuguaa

SEQ ID NO: 1575129 - RNA, 19 nt, Homo sapiens
ggaagaauagaggcagauu

SEQ ID NO: 1575130 - RNA, 19 nt, Homo sapiens
ccauuuacacguauuugaa

SEQ ID NO: 1575131 - RNA, 19 nt, Homo sapiens
gcugugacuucuauuuuaa

SEQ ID NO: 1575132 - RNA, 19 nt, Homo sapiens
ggccuacccuagagacaug

SEQ ID NO: 1575133 - RNA, 19 nt, Homo sapiens
acacacggugccuuuauuu

SEQ ID NO: 1575134 - RNA, 19 nt, Homo sapiens
uacacacggugccuuuauu

SEQ ID NO: 1575135 - RNA, 19 nt, Homo sapiens
acaugaaucugcacaucug

SEQ ID NO: 1575136 - RNA, 19 nt, Homo sapiens
acacaugaaucugcacauc

SEQ ID NO: 1575137 - RNA, 19 nt, Homo sapiens
gaaagucaagaagacauca

SEQ ID NO: 1575138 - RNA, 19 nt, Homo sapiens
guuccagccucagggauga

SEQ ID NO: 1575139 - RNA, 19 nt, Homo sapiens
gaagugugacuggcuaaag

SEQ ID NO: 1575140 - RNA, 19 nt, Homo sapiens
gacaguuccagaaguguga

SEQ ID NO: 1575141 - RNA, 19 nt, Homo sapiens
ugaggagcuuagccagaaa

SEQ ID NO: 1575142 - RNA, 19 nt, Homo sapiens
gugcagguucccacuuaaa

SEQ ID NO: 1575143 - RNA, 19 nt, Homo sapiens
cuacacacggugccuuuau

SEQ ID NO: 1575144 - RNA, 19 nt, Homo sapiens
gaaucugcacaucuguaaa

SEQ ID NO: 1575145 - RNA, 19 nt, Homo sapiens
agacggagcccuggcaugu

SEQ ID NO: 1575146 - RNA, 19 nt, Homo sapiens
guauagcugcuuccagugu

SEQ ID NO: 1575147 - RNA, 19 nt, Homo sapiens
ggaaguagaaacaaaauac

SEQ ID NO: 1575148 - RNA, 19 nt, Homo sapiens
aaucugcacaucuguaaau

SEQ ID NO: 1575149 - RNA, 19 nt, Homo sapiens
cccaggccauggacuguga

SEQ ID NO: 1575150 - RNA, 19 nt, Homo sapiens
acggagcccuggcauguca

SEQ ID NO: 1575151 - RNA, 19 nt, Homo sapiens
aagcagguuucaaggaagu

SEQ ID NO: 1575152 - RNA, 19 nt, Homo sapiens
caaggaaguagaaacaaaa

SEQ ID NO: 1575153 - RNA, 19 nt, Homo sapiens
acggacaguuccagaagug

SEQ ID NO: 1575154 - RNA, 19 nt, Homo sapiens
cuugcuccgugaugucuuu

SEQ ID NO: 1575155 - RNA, 19 nt, Homo sapiens
ggacugugaggucaacaac

SEQ ID NO: 1575156 - RNA, 19 nt, Homo sapiens
gagacauggagaaggagaa

SEQ ID NO: 1575157 - RNA, 19 nt, Homo sapiens
gcugcaggccuacccuaga

SEQ ID NO: 1575158 - RNA, 19 nt, Homo sapiens
agacaucauccggaauauu

SEQ ID NO: 1575159 - RNA, 19 nt, Homo sapiens
ugugcagguucccacuuaa

SEQ ID NO: 1575160 - RNA, 19 nt, Homo sapiens
gugccuuuauuuccacugu

SEQ ID NO: 1575161 - RNA, 19 nt, Homo sapiens
gucaacagcguuccuagag

SEQ ID NO: 1575162 - RNA, 19 nt, Homo sapiens
gaggagcuuagccagaaau

SEQ ID NO: 1575163 - RNA, 19 nt, Homo sapiens
ugaugucuuucacacaaca

SEQ ID NO: 1575164 - RNA, 19 nt, Homo sapiens
ggacaggccucuacaacua

SEQ ID NO: 1575165 - RNA, 19 nt, Homo sapiens
gagcuucgcugaugacuuc

SEQ ID NO: 1575166 - RNA, 19 nt, Homo sapiens
gagcggaccuucccagcua

SEQ ID NO: 1575167 - RNA, 19 nt, Homo sapiens
ggacaaccguggcuucaug

SEQ ID NO: 1575168 - RNA, 19 nt, Homo sapiens
gaucaagccugccucaauc

SEQ ID NO: 1575169 - RNA, 19 nt, Homo sapiens
caaccucucccaacuauaa

SEQ ID NO: 1575170 - RNA, 19 nt, Homo sapiens
caaagcggcucccugcuau

SEQ ID NO: 1575171 - RNA, 19 nt, Homo sapiens
gaaauuccaccacaagaug

SEQ ID NO: 1575172 - RNA, 19 nt, Homo sapiens
ccaaagagcagcugaagau

SEQ ID NO: 1575173 - RNA, 19 nt, Homo sapiens
caagaugcgagacgaguua

SEQ ID NO: 1575174 - RNA, 19 nt, Homo sapiens
gcaagcagcacuacaacug

SEQ ID NO: 1575175 - RNA, 19 nt, Homo sapiens
gcagcaagcagcacuacaa

SEQ ID NO: 1575176 - RNA, 19 nt, Homo sapiens
uccaagaacuuauuuguac

SEQ ID NO: 1575177 - RNA, 19 nt, Homo sapiens
ccaaagcggcucccugcua

SEQ ID NO: 1575178 - RNA, 19 nt, Homo sapiens
acacugggaugagaaauuc

SEQ ID NO: 1575179 - RNA, 19 nt, Homo sapiens
aagccugccucaaucagua

SEQ ID NO: 1575180 - RNA, 19 nt, Homo sapiens
gaccugggccauagucauu

SEQ ID NO: 1575181 - RNA, 19 nt, Homo sapiens
caaaggcuccugagacaca

SEQ ID NO: 1575182 - RNA, 19 nt, Homo sapiens
caucgugucuggcguugug

SEQ ID NO: 1575183 - RNA, 19 nt, Homo sapiens
cccaugaccugcagaaaca

SEQ ID NO: 1575184 - RNA, 19 nt, Homo sapiens
ugacugaggccauugacaa

SEQ ID NO: 1575185 - RNA, 19 nt, Homo sapiens
gagaaauuccaccacaaga

SEQ ID NO: 1575186 - RNA, 19 nt, Homo sapiens
ccaagaacuuauuuguaca

SEQ ID NO: 1575187 - RNA, 19 nt, Homo sapiens
gaccuucccagcuagaauu

SEQ ID NO: 1575188 - RNA, 19 nt, Homo sapiens
gccuaagggugacaagaug

SEQ ID NO: 1575189 - RNA, 19 nt, Homo sapiens
aagagcagcugaagaucug

SEQ ID NO: 1575190 - RNA, 19 nt, Homo sapiens
uccaaaggcuccugagaca

SEQ ID NO: 1575191 - RNA, 19 nt, Homo sapiens
caugagccuuuguugcuau

SEQ ID NO: 1575192 - RNA, 19 nt, Homo sapiens
cccaaccucucccaacuau

SEQ ID NO: 1575193 - RNA, 19 nt, Homo sapiens
ucauauuuauagccaggua

SEQ ID NO: 1575194 - RNA, 19 nt, Homo sapiens
gagccuuuguugcuaucaa

SEQ ID NO: 1575195 - RNA, 19 nt, Homo sapiens
cgacuugucacgcauguca

SEQ ID NO: 1575196 - RNA, 19 nt, Homo sapiens
ucaacgccauguucuucaa

SEQ ID NO: 1575197 - RNA, 19 nt, Homo sapiens
gagguaccagccuuggaua

SEQ ID NO: 1575198 - RNA, 19 nt, Homo sapiens
cugaggccauugacaagaa

SEQ ID NO: 1575199 - RNA, 19 nt, Homo sapiens
ugguggaggugacccauga

SEQ ID NO: 1575200 - RNA, 19 nt, Homo sapiens
cauucugccugcccugaaa

SEQ ID NO: 1575201 - RNA, 19 nt, Homo sapiens
gcaagaaggaccuguaccu

SEQ ID NO: 1575202 - RNA, 19 nt, Homo sapiens
ucacgcaugucaggcaaga

SEQ ID NO: 1575203 - RNA, 19 nt, Homo sapiens
gcccucuucugacacuaaa

SEQ ID NO: 1575204 - RNA, 19 nt, Homo sapiens
ugagacacaugggugcuau

SEQ ID NO: 1575205 - RNA, 19 nt, Homo sapiens
gaugcgagacgaguuauag

SEQ ID NO: 1575206 - RNA, 19 nt, Homo sapiens
guaccuggccagcguguuc

SEQ ID NO: 1575207 - RNA, 19 nt, Homo sapiens
gccucaaucaguauucaua

SEQ ID NO: 1575208 - RNA, 19 nt, Homo sapiens
ccuuugaguuggacacaga

SEQ ID NO: 1575209 - RNA, 19 nt, Homo sapiens
gaaaagcugcuaaccaaag

SEQ ID NO: 1575210 - RNA, 19 nt, Homo sapiens
gcuaucaauccaagaacuu

SEQ ID NO: 1575211 - RNA, 19 nt, Homo sapiens
guaccagccuuggauacuc

SEQ ID NO: 1575212 - RNA, 19 nt, Homo sapiens
acaugagccuuuguugcua

SEQ ID NO: 1575213 - RNA, 19 nt, Homo sapiens
gcacugcggagaaguugag

SEQ ID NO: 1575214 - RNA, 19 nt, Homo sapiens
cauggugacucgguccuau

SEQ ID NO: 1575215 - RNA, 19 nt, Homo sapiens
cuaucaauccaagaacuua

SEQ ID NO: 1575216 - RNA, 19 nt, Homo sapiens
ggccuaagggugacaagau

SEQ ID NO: 1575217 - RNA, 19 nt, Homo sapiens
ugcgagcacuccaagauca

SEQ ID NO: 1575218 - RNA, 19 nt, Homo sapiens
uugaaaagcugcuaaccaa

SEQ ID NO: 1575219 - RNA, 19 nt, Homo sapiens
gaucaacuuccgcgacaag

SEQ ID NO: 1575220 - RNA, 19 nt, Homo sapiens
cuagaauucacuccacuug

SEQ ID NO: 1575221 - RNA, 19 nt, Homo sapiens
uaaccaaagagcagcugaa

SEQ ID NO: 1575222 - RNA, 19 nt, Homo sapiens
ggagaacauccugguguca

SEQ ID NO: 1575223 - RNA, 19 nt, Homo sapiens
ccaccgccuuugaguugga

SEQ ID NO: 1575224 - RNA, 19 nt, Homo sapiens
cgccaccgccuuugaguug

SEQ ID NO: 1575225 - RNA, 19 nt, Homo sapiens
cagugagcuucgcugauga

SEQ ID NO: 1575226 - RNA, 19 nt, Homo sapiens
ggaccuucccagcuagaau

SEQ ID NO: 1575227 - RNA, 19 nt, Homo sapiens
gcaugucaggcaagaagga

SEQ ID NO: 1575228 - RNA, 19 nt, Homo sapiens
gcacuccaagaucaacuuc

SEQ ID NO: 1575229 - RNA, 19 nt, Homo sapiens
agaaauuccaccacaagau

SEQ ID NO: 1575230 - RNA, 19 nt, Homo sapiens
ugagaaauuccaccacaag

SEQ ID NO: 1575231 - RNA, 19 nt, Homo sapiens
agacacaugggugcuauug

SEQ ID NO: 1575232 - RNA, 19 nt, Homo sapiens
gcagcagcaagcagcacua

SEQ ID NO: 1575233 - RNA, 19 nt, Homo sapiens
aaagagcagcugaagaucu

SEQ ID NO: 1575234 - RNA, 19 nt, Homo sapiens
agaucaagccugccucaau

SEQ ID NO: 1575235 - RNA, 19 nt, Homo sapiens
ccugaaagucccagaucaa

SEQ ID NO: 1575236 - RNA, 19 nt, Homo sapiens
gcggcucccugcuauucau

SEQ ID NO: 1575237 - RNA, 19 nt, Homo sapiens
ugcccgaggucaccaagga

SEQ ID NO: 1575238 - RNA, 19 nt, Homo sapiens
aaaagcugcuaaccaaaga

SEQ ID NO: 1575239 - RNA, 19 nt, Homo sapiens
cuacuacgacgacgagaag

SEQ ID NO: 1575240 - RNA, 19 nt, Homo sapiens
cacacugggaugagaaauu

SEQ ID NO: 1575241 - RNA, 19 nt, Homo sapiens
ggaccugggccauagucau

SEQ ID NO: 1575242 - RNA, 19 nt, Homo sapiens
gcuagaauucacuccacuu

SEQ ID NO: 1575243 - RNA, 19 nt, Homo sapiens
ugagguaccagccuuggau

SEQ ID NO: 1575244 - RNA, 19 nt, Homo sapiens
guuccacgccaccgccuuu

SEQ ID NO: 1575245 - RNA, 19 nt, Homo sapiens
guugcuaucaauccaagaa

SEQ ID NO: 1575246 - RNA, 19 nt, Homo sapiens
agccagcccucuucugaca

SEQ ID NO: 1575247 - RNA, 19 nt, Homo sapiens
gcagauggcuggaauauua

SEQ ID NO: 1575248 - RNA, 19 nt, Homo sapiens
gaaaggacauggcguauuu

SEQ ID NO: 1575249 - RNA, 19 nt, Homo sapiens
uauauuggcugguaaauug

SEQ ID NO: 1575250 - RNA, 19 nt, Homo sapiens
gcugagagcccuuauuuaa

SEQ ID NO: 1575251 - RNA, 19 nt, Homo sapiens
gcaggaagaugaggccaua

SEQ ID NO: 1575252 - RNA, 19 nt, Homo sapiens
gagcugagagcccuuauuu

SEQ ID NO: 1575253 - RNA, 19 nt, Homo sapiens
ccaaacaaauggaagagaa

SEQ ID NO: 1575254 - RNA, 19 nt, Homo sapiens
gcugacugaugguuaaaua

SEQ ID NO: 1575255 - RNA, 19 nt, Homo sapiens
ggaagaaacggaauagugu

SEQ ID NO: 1575256 - RNA, 19 nt, Homo sapiens
gaggauuucccaaagauuu

SEQ ID NO: 1575257 - RNA, 19 nt, Homo sapiens
ccgaagugcucguccagua

SEQ ID NO: 1575258 - RNA, 19 nt, Homo sapiens
gggaugacgucacgcaguu

SEQ ID NO: 1575259 - RNA, 19 nt, Homo sapiens
gggaggagaucgagcagau

SEQ ID NO: 1575260 - RNA, 19 nt, Homo sapiens
gggagauccuggcgcuaua

SEQ ID NO: 1575261 - RNA, 19 nt, Homo sapiens
ggaacaagaggauucaaug

SEQ ID NO: 1575262 - RNA, 19 nt, Homo sapiens
caaaggugaugaaggaaca

SEQ ID NO: 1575263 - RNA, 19 nt, Homo sapiens
ggacacccauggagugauc

SEQ ID NO: 1575264 - RNA, 19 nt, Homo sapiens
aaagagaaacgccaacaaa

SEQ ID NO: 1575265 - RNA, 19 nt, Homo sapiens
ggacauggcguauuuugua

SEQ ID NO: 1575266 - RNA, 19 nt, Homo sapiens
ccauucagaugcccaagaa

SEQ ID NO: 1575267 - RNA, 19 nt, Homo sapiens
cagcaaccaucaagacuuc

SEQ ID NO: 1575268 - RNA, 19 nt, Homo sapiens
gaagugcucguccaguauu

SEQ ID NO: 1575269 - RNA, 19 nt, Homo sapiens
ugugaaaguuggaauaugu

SEQ ID NO: 1575270 - RNA, 19 nt, Homo sapiens
gagcugagcccggagacua

SEQ ID NO: 1575271 - RNA, 19 nt, Homo sapiens
gggaagaaacggaauagug

SEQ ID NO: 1575272 - RNA, 19 nt, Homo sapiens
ugagagcccuuauuuaaaa

SEQ ID NO: 1575273 - RNA, 19 nt, Homo sapiens
gggaacaucugguggugau

SEQ ID NO: 1575274 - RNA, 19 nt, Homo sapiens
guuaauguguggcauaugg

SEQ ID NO: 1575275 - RNA, 19 nt, Homo sapiens
gaggagaucgagcagauga

SEQ ID NO: 1575276 - RNA, 19 nt, Homo sapiens
gaacaagaggauucaaugg

SEQ ID NO: 1575277 - RNA, 19 nt, Homo sapiens
gaaguuggagucccugguu

SEQ ID NO: 1575278 - RNA, 19 nt, Homo sapiens
gaacagaaggagcuggaau

SEQ ID NO: 1575279 - RNA, 19 nt, Homo sapiens
caugcugacugaugguuaa

SEQ ID NO: 1575280 - RNA, 19 nt, Homo sapiens
ucagggaccucuaggauac

SEQ ID NO: 1575281 - RNA, 19 nt, Homo sapiens
ccacugaguauguucauug

SEQ ID NO: 1575282 - RNA, 19 nt, Homo sapiens
gucaaagaauucagagaug

SEQ ID NO: 1575283 - RNA, 19 nt, Homo sapiens
ggacagaagggcaccaaag

SEQ ID NO: 1575284 - RNA, 19 nt, Homo sapiens
cagaagggccugcgggauu

SEQ ID NO: 1575285 - RNA, 19 nt, Homo sapiens
gacugaugguuaaauaaug

SEQ ID NO: 1575286 - RNA, 19 nt, Homo sapiens
gaagggugaggauggcuuu

SEQ ID NO: 1575287 - RNA, 19 nt, Homo sapiens
ggaaagaccccaaaaccaa

SEQ ID NO: 1575288 - RNA, 19 nt, Homo sapiens
ugaaucaugugaacagaag

SEQ ID NO: 1575289 - RNA, 19 nt, Homo sapiens
caggaggauuucccaaaga

SEQ ID NO: 1575290 - RNA, 19 nt, Homo sapiens
ccaggaggauuucccaaag

SEQ ID NO: 1575291 - RNA, 19 nt, Homo sapiens
gaacccaggcccaguugga

SEQ ID NO: 1575292 - RNA, 19 nt, Homo sapiens
ccacccaggucucauugga

SEQ ID NO: 1575293 - RNA, 19 nt, Homo sapiens
ccauuggccuacaggguuu

SEQ ID NO: 1575294 - RNA, 19 nt, Homo sapiens
agccaaaggugaugaagga

SEQ ID NO: 1575295 - RNA, 19 nt, Homo sapiens
caaaggcccaccugguauu

SEQ ID NO: 1575296 - RNA, 19 nt, Homo sapiens
ucucuuacguggacucaga

SEQ ID NO: 1575297 - RNA, 19 nt, Homo sapiens
gaagggagccaagggagau

SEQ ID NO: 1575298 - RNA, 19 nt, Homo sapiens
gaagggagaaacaggagau

SEQ ID NO: 1575299 - RNA, 19 nt, Homo sapiens
caucuuuggugcccguauu

SEQ ID NO: 1575300 - RNA, 19 nt, Homo sapiens
gcccugagccacugaguau

SEQ ID NO: 1575301 - RNA, 19 nt, Homo sapiens
gauaggaccgucucugucu

SEQ ID NO: 1575302 - RNA, 19 nt, Homo sapiens
gaaggaacaagaggauuca

SEQ ID NO: 1575303 - RNA, 19 nt, Homo sapiens
ugggagcccuggccugaaa

SEQ ID NO: 1575304 - RNA, 19 nt, Homo sapiens
ucccugauccugcaauuaa

SEQ ID NO: 1575305 - RNA, 19 nt, Homo sapiens
cccaaaggcccaccuggua

SEQ ID NO: 1575306 - RNA, 19 nt, Homo sapiens
gcagcaaccaucaagacuu

SEQ ID NO: 1575307 - RNA, 19 nt, Homo sapiens
ucacagagcccagagaucu

SEQ ID NO: 1575308 - RNA, 19 nt, Homo sapiens
ggauggaagccgucugaug

SEQ ID NO: 1575309 - RNA, 19 nt, Homo sapiens
ucagggagcagcaggagaa

SEQ ID NO: 1575310 - RNA, 19 nt, Homo sapiens
ggagagaaggguccucaag

SEQ ID NO: 1575311 - RNA, 19 nt, Homo sapiens
agaagggccugcgggauug

SEQ ID NO: 1575312 - RNA, 19 nt, Homo sapiens
ggguuaauguguggcauau

SEQ ID NO: 1575313 - RNA, 19 nt, Homo sapiens
ccagggaagaaacggaaua

SEQ ID NO: 1575314 - RNA, 19 nt, Homo sapiens
ccaaaggcccaccugguau

SEQ ID NO: 1575315 - RNA, 19 nt, Homo sapiens
aggagagccugcaguguug

SEQ ID NO: 1575316 - RNA, 19 nt, Homo sapiens
uggagccuguuacccguua

SEQ ID NO: 1575317 - RNA, 19 nt, Homo sapiens
gggagaaacaggagaugug

SEQ ID NO: 1575318 - RNA, 19 nt, Homo sapiens
ucaaggguguggacggaau

SEQ ID NO: 1575319 - RNA, 19 nt, Homo sapiens
ggagauguggguccuaugg

SEQ ID NO: 1575320 - RNA, 19 nt, Homo sapiens
ugaaggaacaagaggauuc

SEQ ID NO: 1575321 - RNA, 19 nt, Homo sapiens
gaugaaggaacaagaggau

SEQ ID NO: 1575322 - RNA, 19 nt, Homo sapiens
caaauggaagagaagagaa

SEQ ID NO: 1575323 - RNA, 19 nt, Homo sapiens
gugaagggccagucuguca

SEQ ID NO: 1575324 - RNA, 19 nt, Homo sapiens
gggauaggaccgucucugu

SEQ ID NO: 1575325 - RNA, 19 nt, Homo sapiens
aaggagagccugcaguguu

SEQ ID NO: 1575326 - RNA, 19 nt, Homo sapiens
ugucugauccuguccauuc

SEQ ID NO: 1575327 - RNA, 19 nt, Homo sapiens
gaagggagaucggggacuu

SEQ ID NO: 1575328 - RNA, 19 nt, Homo sapiens
gaacccugguccuguuggu

SEQ ID NO: 1575329 - RNA, 19 nt, Homo sapiens
ugacauaggcgugaaaggu

SEQ ID NO: 1575330 - RNA, 19 nt, Homo sapiens
agacuucacaggccacaaa

SEQ ID NO: 1575331 - RNA, 19 nt, Homo sapiens
gagaaaggacauggcguau

SEQ ID NO: 1575332 - RNA, 19 nt, Homo sapiens
ucacgcaguucucuuacgu

SEQ ID NO: 1575333 - RNA, 19 nt, Homo sapiens
ggaggauuucccaaagauu

SEQ ID NO: 1575334 - RNA, 19 nt, Homo sapiens
gaggagaaguggguuucca

SEQ ID NO: 1575335 - RNA, 19 nt, Homo sapiens
uuuaaaguguggaaagcaa

SEQ ID NO: 1575336 - RNA, 19 nt, Homo sapiens
aaauggaagagaagagaaa

SEQ ID NO: 1575337 - RNA, 19 nt, Homo sapiens
aaacucaccucccaaucac

SEQ ID NO: 1575338 - RNA, 19 nt, Homo sapiens
cugagagcccuuauuuaaa

SEQ ID NO: 1575339 - RNA, 19 nt, Homo sapiens
gcacccacucgccagcuuu

SEQ ID NO: 1575340 - RNA, 19 nt, Homo sapiens
cagauggcuggaauauuaa

SEQ ID NO: 1575341 - RNA, 19 nt, Homo sapiens
aggcacugcugcuacuuga

SEQ ID NO: 1575342 - RNA, 19 nt, Homo sapiens
gcacccacugugaaaguug

SEQ ID NO: 1575343 - RNA, 19 nt, Homo sapiens
ugucaaagaauucagagau

SEQ ID NO: 1575344 - RNA, 19 nt, Homo sapiens
cgaagugcucguccaguau

SEQ ID NO: 1575345 - RNA, 19 nt, Homo sapiens
aaacaaauggaagagaaga

SEQ ID NO: 1575346 - RNA, 19 nt, Homo sapiens
gagacuagccccuauguca

SEQ ID NO: 1575347 - RNA, 19 nt, Homo sapiens
gcagauggcuggaauauua

SEQ ID NO: 1575348 - RNA, 19 nt, Homo sapiens
gaaaggacauggcguauuu

SEQ ID NO: 1575349 - RNA, 19 nt, Homo sapiens
uauauuggcugguaaauug

SEQ ID NO: 1575350 - RNA, 19 nt, Homo sapiens
gcugagagcccuuauuuaa

SEQ ID NO: 1575351 - RNA, 19 nt, Homo sapiens
gcaggaagaugaggccaua

SEQ ID NO: 1575352 - RNA, 19 nt, Homo sapiens
gagcugagagcccuuauuu

SEQ ID NO: 1575353 - RNA, 19 nt, Homo sapiens
ccaaacaaauggaagagaa

SEQ ID NO: 1575354 - RNA, 19 nt, Homo sapiens
gcugacugaugguuaaaua

SEQ ID NO: 1575355 - RNA, 19 nt, Homo sapiens
ggaagaaacggaauagugu

SEQ ID NO: 1575356 - RNA, 19 nt, Homo sapiens
gaggauuucccaaagauuu

SEQ ID NO: 1575357 - RNA, 19 nt, Homo sapiens
ccgaagugcucguccagua

SEQ ID NO: 1575358 - RNA, 19 nt, Homo sapiens
gggaugacgucacgcaguu

SEQ ID NO: 1575359 - RNA, 19 nt, Homo sapiens
cugaagggcccuacgauua

SEQ ID NO: 1575360 - RNA, 19 nt, Homo sapiens
ccacugagucucucuacua

SEQ ID NO: 1575361 - RNA, 19 nt, Homo sapiens
gggaggagaucgagcagau

SEQ ID NO: 1575362 - RNA, 19 nt, Homo sapiens
gggagauccuggcgcuaua

SEQ ID NO: 1575363 - RNA, 19 nt, Homo sapiens
ggaacaagaggauucaaug

SEQ ID NO: 1575364 - RNA, 19 nt, Homo sapiens
caaaggugaugaaggaaca

SEQ ID NO: 1575365 - RNA, 19 nt, Homo sapiens
ggacacccauggagugauc

SEQ ID NO: 1575366 - RNA, 19 nt, Homo sapiens
aaagagaaacgccaacaaa

SEQ ID NO: 1575367 - RNA, 19 nt, Homo sapiens
ggacauggcguauuuugua

SEQ ID NO: 1575368 - RNA, 19 nt, Homo sapiens
cugagucucucuacuauga

SEQ ID NO: 1575369 - RNA, 19 nt, Homo sapiens
ccauucagaugcccaagaa

SEQ ID NO: 1575370 - RNA, 19 nt, Homo sapiens
cagcaaccaucaagacuuc

SEQ ID NO: 1575371 - RNA, 19 nt, Homo sapiens
gaagugcucguccaguauu

SEQ ID NO: 1575372 - RNA, 19 nt, Homo sapiens
ugugaaaguuggaauaugu

SEQ ID NO: 1575373 - RNA, 19 nt, Homo sapiens
gagcugagcccggagacua

SEQ ID NO: 1575374 - RNA, 19 nt, Homo sapiens
gggaagaaacggaauagug

SEQ ID NO: 1575375 - RNA, 19 nt, Homo sapiens
ugagagcccuuauuuaaaa

SEQ ID NO: 1575376 - RNA, 19 nt, Homo sapiens
gggaacaucugguggugau

SEQ ID NO: 1575377 - RNA, 19 nt, Homo sapiens
guuaauguguggcauaugg

SEQ ID NO: 1575378 - RNA, 19 nt, Homo sapiens
gaggagaucgagcagauga

SEQ ID NO: 1575379 - RNA, 19 nt, Homo sapiens
gaacaagaggauucaaugg

SEQ ID NO: 1575380 - RNA, 19 nt, Homo sapiens
gaaguuggagucccugguu

SEQ ID NO: 1575381 - RNA, 19 nt, Homo sapiens
gaacagaaggagcuggaau

SEQ ID NO: 1575382 - RNA, 19 nt, Homo sapiens
caugcugacugaugguuaa

SEQ ID NO: 1575383 - RNA, 19 nt, Homo sapiens
ucagggaccucuaggauac

SEQ ID NO: 1575384 - RNA, 19 nt, Homo sapiens
gcccuacgauuacaccuau

SEQ ID NO: 1575385 - RNA, 19 nt, Homo sapiens
ccacugaguauguucauug

SEQ ID NO: 1575386 - RNA, 19 nt, Homo sapiens
gucaaagaauucagagaug

SEQ ID NO: 1575387 - RNA, 19 nt, Homo sapiens
ggacagaagggcaccaaag

SEQ ID NO: 1575388 - RNA, 19 nt, Homo sapiens
cagaagggccugcgggauu

SEQ ID NO: 1575389 - RNA, 19 nt, Homo sapiens
gaagggcccuacgauuaca

SEQ ID NO: 1575390 - RNA, 19 nt, Homo sapiens
gacugaugguuaaauaaug

SEQ ID NO: 1575391 - RNA, 19 nt, Homo sapiens
gaagggugaggauggcuuu

SEQ ID NO: 1575392 - RNA, 19 nt, Homo sapiens
ggaaagaccccaaaaccaa

SEQ ID NO: 1575393 - RNA, 19 nt, Homo sapiens
ugaaucaugugaacagaag

SEQ ID NO: 1575394 - RNA, 19 nt, Homo sapiens
ccaggaggauuucccaaag

SEQ ID NO: 1575395 - RNA, 19 nt, Homo sapiens
gaacccaggcccaguugga

SEQ ID NO: 1575396 - RNA, 19 nt, Homo sapiens
caggaggauuucccaaaga

SEQ ID NO: 1575397 - RNA, 19 nt, Homo sapiens
ccacccaggucucauugga

SEQ ID NO: 1575398 - RNA, 19 nt, Homo sapiens
ccauuggccuacaggguuu

SEQ ID NO: 1575399 - RNA, 19 nt, Homo sapiens
agccaaaggugaugaagga

SEQ ID NO: 1575400 - RNA, 19 nt, Homo sapiens
caaaggcccaccugguauu

SEQ ID NO: 1575401 - RNA, 19 nt, Homo sapiens
ucucuuacguggacucaga

SEQ ID NO: 1575402 - RNA, 19 nt, Homo sapiens
gaagggagccaagggagau

SEQ ID NO: 1575403 - RNA, 19 nt, Homo sapiens
gaagggagaaacaggagau

SEQ ID NO: 1575404 - RNA, 19 nt, Homo sapiens
caucuuuggugcccguauu

SEQ ID NO: 1575405 - RNA, 19 nt, Homo sapiens
gcccugagccacugaguau

SEQ ID NO: 1575406 - RNA, 19 nt, Homo sapiens
gauaggaccgucucugucu

SEQ ID NO: 1575407 - RNA, 19 nt, Homo sapiens
gaaggaacaagaggauuca

SEQ ID NO: 1575408 - RNA, 19 nt, Homo sapiens
ugggagcccuggccugaaa

SEQ ID NO: 1575409 - RNA, 19 nt, Homo sapiens
ucccugauccugcaauuaa

SEQ ID NO: 1575410 - RNA, 19 nt, Homo sapiens
cccaaaggcccaccuggua

SEQ ID NO: 1575411 - RNA, 19 nt, Homo sapiens
gcagcaaccaucaagacuu

SEQ ID NO: 1575412 - RNA, 19 nt, Homo sapiens
ucacagagcccagagaucu

SEQ ID NO: 1575413 - RNA, 19 nt, Homo sapiens
ggauggaagccgucugaug

SEQ ID NO: 1575414 - RNA, 19 nt, Homo sapiens
ucagggagcagcaggagaa

SEQ ID NO: 1575415 - RNA, 19 nt, Homo sapiens
ggagagaaggguccucaag

SEQ ID NO: 1575416 - RNA, 19 nt, Homo sapiens
agaagggccugcgggauug

SEQ ID NO: 1575417 - RNA, 19 nt, Homo sapiens
ggguuaauguguggcauau

SEQ ID NO: 1575418 - RNA, 19 nt, Homo sapiens
ccagggaagaaacggaaua

SEQ ID NO: 1575419 - RNA, 19 nt, Homo sapiens
ccaaaggcccaccugguau

SEQ ID NO: 1575420 - RNA, 19 nt, Homo sapiens
aggagagccugcaguguug

SEQ ID NO: 1575421 - RNA, 19 nt, Homo sapiens
uggagccuguuacccguua

SEQ ID NO: 1575422 - RNA, 19 nt, Homo sapiens
gggagaaacaggagaugug

SEQ ID NO: 1575423 - RNA, 19 nt, Homo sapiens
ucaaggguguggacggaau

SEQ ID NO: 1575424 - RNA, 19 nt, Homo sapiens
ggagauguggguccuaugg

SEQ ID NO: 1575425 - RNA, 19 nt, Homo sapiens
ugaaggaacaagaggauuc

SEQ ID NO: 1575426 - RNA, 19 nt, Homo sapiens
gaugaaggaacaagaggau

SEQ ID NO: 1575427 - RNA, 19 nt, Homo sapiens
cacugagucucucuacuau

SEQ ID NO: 1575428 - RNA, 19 nt, Homo sapiens
caaauggaagagaagagaa

SEQ ID NO: 1575429 - RNA, 19 nt, Homo sapiens
gggauaggaccgucucugu

SEQ ID NO: 1575430 - RNA, 19 nt, Homo sapiens
gugaagggccagucuguca

SEQ ID NO: 1575431 - RNA, 19 nt, Homo sapiens
aaggagagccugcaguguu

SEQ ID NO: 1575432 - RNA, 19 nt, Homo sapiens
gauuacaccuauggcuaug

SEQ ID NO: 1575433 - RNA, 19 nt, Homo sapiens
ugucugauccuguccauuc

SEQ ID NO: 1575434 - RNA, 19 nt, Homo sapiens
gaagggagaucggggacuu

SEQ ID NO: 1575435 - RNA, 19 nt, Homo sapiens
gaacccugguccuguuggu

SEQ ID NO: 1575436 - RNA, 19 nt, Homo sapiens
ugacauaggcgugaaaggu

SEQ ID NO: 1575437 - RNA, 19 nt, Homo sapiens
agacuucacaggccacaaa

SEQ ID NO: 1575438 - RNA, 19 nt, Homo sapiens
gagaaaggacauggcguau

SEQ ID NO: 1575439 - RNA, 19 nt, Homo sapiens
ucacgcaguucucuuacgu

SEQ ID NO: 1575440 - RNA, 19 nt, Homo sapiens
gaggagaaguggguuucca

SEQ ID NO: 1575441 - RNA, 19 nt, Homo sapiens
ggaggauuucccaaagauu

SEQ ID NO: 1575442 - RNA, 19 nt, Homo sapiens
uuuaaaguguggaaagcaa

SEQ ID NO: 1575443 - RNA, 19 nt, Homo sapiens
aaauggaagagaagagaaa

SEQ ID NO: 1575444 - RNA, 19 nt, Homo sapiens
aaacucaccucccaaucac

SEQ ID NO: 1575445 - RNA, 19 nt, Homo sapiens
cugagagcccuuauuuaaa

SEQ ID NO: 1575446 - RNA, 19 nt, Homo sapiens
gcacccacucgccagcuuu

SEQ ID NO: 1575447 - RNA, 19 nt, Homo sapiens
gcagauggcuggaauauua

SEQ ID NO: 1575448 - RNA, 19 nt, Homo sapiens
gaaaggacauggcguauuu

SEQ ID NO: 1575449 - RNA, 19 nt, Homo sapiens
uauauuggcugguaaauug

SEQ ID NO: 1575450 - RNA, 19 nt, Homo sapiens
gcugagagcccuuauuuaa

SEQ ID NO: 1575451 - RNA, 19 nt, Homo sapiens
gcaggaagaugaggccaua

SEQ ID NO: 1575452 - RNA, 19 nt, Homo sapiens
gagcugagagcccuuauuu

SEQ ID NO: 1575453 - RNA, 19 nt, Homo sapiens
ccaaacaaauggaagagaa

SEQ ID NO: 1575454 - RNA, 19 nt, Homo sapiens
gcugacugaugguuaaaua

SEQ ID NO: 1575455 - RNA, 19 nt, Homo sapiens
ggaagaaacggaauagugu

SEQ ID NO: 1575456 - RNA, 19 nt, Homo sapiens
gaggauuucccaaagauuu

SEQ ID NO: 1575457 - RNA, 19 nt, Homo sapiens
ccgaagugcucguccagua

SEQ ID NO: 1575458 - RNA, 19 nt, Homo sapiens
gggaugacgucacgcaguu

SEQ ID NO: 1575459 - RNA, 19 nt, Homo sapiens
gggaggagaucgagcagau

SEQ ID NO: 1575460 - RNA, 19 nt, Homo sapiens
gggagauccuggcgcuaua

SEQ ID NO: 1575461 - RNA, 19 nt, Homo sapiens
ggaacaagaggauucaaug

SEQ ID NO: 1575462 - RNA, 19 nt, Homo sapiens
caaaggugaugaaggaaca

SEQ ID NO: 1575463 - RNA, 19 nt, Homo sapiens
ggacacccauggagugauc

SEQ ID NO: 1575464 - RNA, 19 nt, Homo sapiens
aaagagaaacgccaacaaa

SEQ ID NO: 1575465 - RNA, 19 nt, Homo sapiens
ggacauggcguauuuugua

SEQ ID NO: 1575466 - RNA, 19 nt, Homo sapiens
ccauucagaugcccaagaa

SEQ ID NO: 1575467 - RNA, 19 nt, Homo sapiens
cagcaaccaucaagacuuc

SEQ ID NO: 1575468 - RNA, 19 nt, Homo sapiens
gaagugcucguccaguauu

SEQ ID NO: 1575469 - RNA, 19 nt, Homo sapiens
ugugaaaguuggaauaugu

SEQ ID NO: 1575470 - RNA, 19 nt, Homo sapiens
gagcugagcccggagacua

SEQ ID NO: 1575471 - RNA, 19 nt, Homo sapiens
gggaagaaacggaauagug

SEQ ID NO: 1575472 - RNA, 19 nt, Homo sapiens
ugagagcccuuauuuaaaa

SEQ ID NO: 1575473 - RNA, 19 nt, Homo sapiens
gggaacaucugguggugau

SEQ ID NO: 1575474 - RNA, 19 nt, Homo sapiens
guuaauguguggcauaugg

SEQ ID NO: 1575475 - RNA, 19 nt, Homo sapiens
gaggagaucgagcagauga

SEQ ID NO: 1575476 - RNA, 19 nt, Homo sapiens
gaacaagaggauucaaugg

SEQ ID NO: 1575477 - RNA, 19 nt, Homo sapiens
gaaguuggagucccugguu

SEQ ID NO: 1575478 - RNA, 19 nt, Homo sapiens
gaacagaaggagcuggaau

SEQ ID NO: 1575479 - RNA, 19 nt, Homo sapiens
caugcugacugaugguuaa

SEQ ID NO: 1575480 - RNA, 19 nt, Homo sapiens
ucagggaccucuaggauac

SEQ ID NO: 1575481 - RNA, 19 nt, Homo sapiens
ccacugaguauguucauug

SEQ ID NO: 1575482 - RNA, 19 nt, Homo sapiens
gucaaagaauucagagaug

SEQ ID NO: 1575483 - RNA, 19 nt, Homo sapiens
ggacagaagggcaccaaag

SEQ ID NO: 1575484 - RNA, 19 nt, Homo sapiens
cagaagggccugcgggauu

SEQ ID NO: 1575485 - RNA, 19 nt, Homo sapiens
ugaggaggcugcccaugga

SEQ ID NO: 1575486 - RNA, 19 nt, Homo sapiens
gacugaugguuaaauaaug

SEQ ID NO: 1575487 - RNA, 19 nt, Homo sapiens
gaagggugaggauggcuuu

SEQ ID NO: 1575488 - RNA, 19 nt, Homo sapiens
ggaaagaccccaaaaccaa

SEQ ID NO: 1575489 - RNA, 19 nt, Homo sapiens
ugaaucaugugaacagaag

SEQ ID NO: 1575490 - RNA, 19 nt, Homo sapiens
caggaggauuucccaaaga

SEQ ID NO: 1575491 - RNA, 19 nt, Homo sapiens
ccaggaggauuucccaaag

SEQ ID NO: 1575492 - RNA, 19 nt, Homo sapiens
gaacccaggcccaguugga

SEQ ID NO: 1575493 - RNA, 19 nt, Homo sapiens
ccacccaggucucauugga

SEQ ID NO: 1575494 - RNA, 19 nt, Homo sapiens
ccauuggccuacaggguuu

SEQ ID NO: 1575495 - RNA, 19 nt, Homo sapiens
agccaaaggugaugaagga

SEQ ID NO: 1575496 - RNA, 19 nt, Homo sapiens
caaaggcccaccugguauu

SEQ ID NO: 1575497 - RNA, 19 nt, Homo sapiens
ucucuuacguggacucaga

SEQ ID NO: 1575498 - RNA, 19 nt, Homo sapiens
gaagggagccaagggagau

SEQ ID NO: 1575499 - RNA, 19 nt, Homo sapiens
gaagggagaaacaggagau

SEQ ID NO: 1575500 - RNA, 19 nt, Homo sapiens
caucuuuggugcccguauu

SEQ ID NO: 1575501 - RNA, 19 nt, Homo sapiens
gcccugagccacugaguau

SEQ ID NO: 1575502 - RNA, 19 nt, Homo sapiens
gauaggaccgucucugucu

SEQ ID NO: 1575503 - RNA, 19 nt, Homo sapiens
gaaggaacaagaggauuca

SEQ ID NO: 1575504 - RNA, 19 nt, Homo sapiens
ugggagcccuggccugaaa

SEQ ID NO: 1575505 - RNA, 19 nt, Homo sapiens
ucccugauccugcaauuaa

SEQ ID NO: 1575506 - RNA, 19 nt, Homo sapiens
cccaaaggcccaccuggua

SEQ ID NO: 1575507 - RNA, 19 nt, Homo sapiens
gcagcaaccaucaagacuu

SEQ ID NO: 1575508 - RNA, 19 nt, Homo sapiens
ucacagagcccagagaucu

SEQ ID NO: 1575509 - RNA, 19 nt, Homo sapiens
ggauggaagccgucugaug

SEQ ID NO: 1575510 - RNA, 19 nt, Homo sapiens
ucagggagcagcaggagaa

SEQ ID NO: 1575511 - RNA, 19 nt, Homo sapiens
ggagagaaggguccucaag

SEQ ID NO: 1575512 - RNA, 19 nt, Homo sapiens
agaagggccugcgggauug

SEQ ID NO: 1575513 - RNA, 19 nt, Homo sapiens
ggguuaauguguggcauau

SEQ ID NO: 1575514 - RNA, 19 nt, Homo sapiens
ccagggaagaaacggaaua

SEQ ID NO: 1575515 - RNA, 19 nt, Homo sapiens
ccaaaggcccaccugguau

SEQ ID NO: 1575516 - RNA, 19 nt, Homo sapiens
aggagagccugcaguguug

SEQ ID NO: 1575517 - RNA, 19 nt, Homo sapiens
uggagccuguuacccguua

SEQ ID NO: 1575518 - RNA, 19 nt, Homo sapiens
gggagaaacaggagaugug

SEQ ID NO: 1575519 - RNA, 19 nt, Homo sapiens
ucaaggguguggacggaau

SEQ ID NO: 1575520 - RNA, 19 nt, Homo sapiens
ggagauguggguccuaugg

SEQ ID NO: 1575521 - RNA, 19 nt, Homo sapiens
ugaaggaacaagaggauuc

SEQ ID NO: 1575522 - RNA, 19 nt, Homo sapiens
gaugaaggaacaagaggau

SEQ ID NO: 1575523 - RNA, 19 nt, Homo sapiens
caaauggaagagaagagaa

SEQ ID NO: 1575524 - RNA, 19 nt, Homo sapiens
gggauaggaccgucucugu

SEQ ID NO: 1575525 - RNA, 19 nt, Homo sapiens
gugaagggccagucuguca

SEQ ID NO: 1575526 - RNA, 19 nt, Homo sapiens
aaggagagccugcaguguu

SEQ ID NO: 1575527 - RNA, 19 nt, Homo sapiens
ugucugauccuguccauuc

SEQ ID NO: 1575528 - RNA, 19 nt, Homo sapiens
gaagggagaucggggacuu

SEQ ID NO: 1575529 - RNA, 19 nt, Homo sapiens
gaacccugguccuguuggu

SEQ ID NO: 1575530 - RNA, 19 nt, Homo sapiens
ugacauaggcgugaaaggu

SEQ ID NO: 1575531 - RNA, 19 nt, Homo sapiens
agacuucacaggccacaaa

SEQ ID NO: 1575532 - RNA, 19 nt, Homo sapiens
gagaaaggacauggcguau

SEQ ID NO: 1575533 - RNA, 19 nt, Homo sapiens
ucacgcaguucucuuacgu

SEQ ID NO: 1575534 - RNA, 19 nt, Homo sapiens
ggaggauuucccaaagauu

SEQ ID NO: 1575535 - RNA, 19 nt, Homo sapiens
gaggagaaguggguuucca

SEQ ID NO: 1575536 - RNA, 19 nt, Homo sapiens
uuuaaaguguggaaagcaa

SEQ ID NO: 1575537 - RNA, 19 nt, Homo sapiens
aaauggaagagaagagaaa

SEQ ID NO: 1575538 - RNA, 19 nt, Homo sapiens
aaacucaccucccaaucac

SEQ ID NO: 1575539 - RNA, 19 nt, Homo sapiens
cugagagcccuuauuuaaa

SEQ ID NO: 1575540 - RNA, 19 nt, Homo sapiens
gcacccacucgccagcuuu

SEQ ID NO: 1575541 - RNA, 19 nt, Homo sapiens
cagauggcuggaauauuaa

SEQ ID NO: 1575542 - RNA, 19 nt, Homo sapiens
aggcacugcugcuacuuga

SEQ ID NO: 1575543 - RNA, 19 nt, Homo sapiens
gcacccacugugaaaguug

SEQ ID NO: 1575544 - RNA, 19 nt, Homo sapiens
ugucaaagaauucagagau

SEQ ID NO: 1575545 - RNA, 19 nt, Homo sapiens
aaacaaauggaagagaaga

SEQ ID NO: 1575546 - RNA, 19 nt, Homo sapiens
gagacuagccccuauguca

SEQ ID NO: 1575547 - RNA, 19 nt, Homo sapiens
caaggaagcuggaaauaua

SEQ ID NO: 1575548 - RNA, 19 nt, Homo sapiens
ugaaagaggugcauaauaa

SEQ ID NO: 1575549 - RNA, 19 nt, Homo sapiens
ggagaaagcucaccacuug

SEQ ID NO: 1575550 - RNA, 19 nt, Homo sapiens
gaaaguagaugaagaaaca

SEQ ID NO: 1575551 - RNA, 19 nt, Homo sapiens
gauauaagguggaauacua

SEQ ID NO: 1575552 - RNA, 19 nt, Homo sapiens
caaagaaacucaaggauga

SEQ ID NO: 1575553 - RNA, 19 nt, Homo sapiens
caagaaauguccaaguaua

SEQ ID NO: 1575554 - RNA, 19 nt, Homo sapiens
gaagaaaguguaccaguua

SEQ ID NO: 1575555 - RNA, 19 nt, Homo sapiens
gaauuucacugccuuauau

SEQ ID NO: 1575556 - RNA, 19 nt, Homo sapiens
ucacaguucuuccuauuua

SEQ ID NO: 1575557 - RNA, 19 nt, Homo sapiens
gcaaagcaaugacuuaugu

SEQ ID NO: 1575558 - RNA, 19 nt, Homo sapiens
ccaagagacuuaagaguuu

SEQ ID NO: 1575559 - RNA, 19 nt, Homo sapiens
caagagagcuucguaaugu

SEQ ID NO: 1575560 - RNA, 19 nt, Homo sapiens
ccucaucucuugcuuguua

SEQ ID NO: 1575561 - RNA, 19 nt, Homo sapiens
ggagagagcagagaaguua

SEQ ID NO: 1575562 - RNA, 19 nt, Homo sapiens
ccaaauaggguccagauua

SEQ ID NO: 1575563 - RNA, 19 nt, Homo sapiens
ggaguacccuuucugauug

SEQ ID NO: 1575564 - RNA, 19 nt, Homo sapiens
gcaaggcccucacguuuau

SEQ ID NO: 1575565 - RNA, 19 nt, Homo sapiens
ggcaagaaauguccaagua

SEQ ID NO: 1575566 - RNA, 19 nt, Homo sapiens
ggagaacacuggagaacuu

SEQ ID NO: 1575567 - RNA, 19 nt, Homo sapiens
ggaaauaauugggacauug

SEQ ID NO: 1575568 - RNA, 19 nt, Homo sapiens
gaacagaguggcaguuaaa

SEQ ID NO: 1575569 - RNA, 19 nt, Homo sapiens
caccaaaguugaagauaua

SEQ ID NO: 1575570 - RNA, 19 nt, Homo sapiens
acaauaagcuucugcauca

SEQ ID NO: 1575571 - RNA, 19 nt, Homo sapiens
gggcaaagcuauccagguu

SEQ ID NO: 1575572 - RNA, 19 nt, Homo sapiens
gaagucgaauuaaagauga

SEQ ID NO: 1575573 - RNA, 19 nt, Homo sapiens
gaggauggcuucagcauuc

SEQ ID NO: 1575574 - RNA, 19 nt, Homo sapiens
gggaugccauugauuauuu

SEQ ID NO: 1575575 - RNA, 19 nt, Homo sapiens
gagagggaauugcauguuu

SEQ ID NO: 1575576 - RNA, 19 nt, Homo sapiens
gaaaugagucuguauggaa

SEQ ID NO: 1575577 - RNA, 19 nt, Homo sapiens
caaguuguccucucauuua

SEQ ID NO: 1575578 - RNA, 19 nt, Homo sapiens
gcgaugaggucaagucuga

SEQ ID NO: 1575579 - RNA, 19 nt, Homo sapiens
gcaguuaaaugcacacaga

SEQ ID NO: 1575580 - RNA, 19 nt, Homo sapiens
ccaaaggucaugauucuua

SEQ ID NO: 1575581 - RNA, 19 nt, Homo sapiens
gaacaugccgugugccuuu

SEQ ID NO: 1575582 - RNA, 19 nt, Homo sapiens
ggugcaaacuguuacauuu

SEQ ID NO: 1575583 - RNA, 19 nt, Homo sapiens
gaaaucagccgcauuccaa

SEQ ID NO: 1575584 - RNA, 19 nt, Homo sapiens
gaccagcacuucccucaaa

SEQ ID NO: 1575585 - RNA, 19 nt, Homo sapiens
cagugaaacucuuagguua

SEQ ID NO: 1575586 - RNA, 19 nt, Homo sapiens
agaggaggaucuacaaaua

SEQ ID NO: 1575587 - RNA, 19 nt, Homo sapiens
gaauuuacccuuucagcua

SEQ ID NO: 1575588 - RNA, 19 nt, Homo sapiens
gaagaugucauguacugua

SEQ ID NO: 1575589 - RNA, 19 nt, Homo sapiens
caaauaggguccagauuag

SEQ ID NO: 1575590 - RNA, 19 nt, Homo sapiens
ggaagaaugucccuaaggu

SEQ ID NO: 1575591 - RNA, 19 nt, Homo sapiens
gaagucaccuugccuuuac

SEQ ID NO: 1575592 - RNA, 19 nt, Homo sapiens
uggaugaucucaccauuaa

SEQ ID NO: 1575593 - RNA, 19 nt, Homo sapiens
uaaagaugauugcaacuga

SEQ ID NO: 1575594 - RNA, 19 nt, Homo sapiens
gaagagaagacaagaguug

SEQ ID NO: 1575595 - RNA, 19 nt, Homo sapiens
ggaauugcauguuuguguu

SEQ ID NO: 1575596 - RNA, 19 nt, Homo sapiens
ggaaauauaacaacugaug

SEQ ID NO: 1575597 - RNA, 19 nt, Homo sapiens
gguagaagaugaauauagu

SEQ ID NO: 1575598 - RNA, 19 nt, Homo sapiens
gaguggagcuguuugcuau

SEQ ID NO: 1575599 - RNA, 19 nt, Homo sapiens
gggauacaguuccauauug

SEQ ID NO: 1575600 - RNA, 19 nt, Homo sapiens
ggaauaacaccaaauggaa

SEQ ID NO: 1575601 - RNA, 19 nt, Homo sapiens
gacagaggcuucacuggaa

SEQ ID NO: 1575602 - RNA, 19 nt, Homo sapiens
cagaagaaguaaagacauu

SEQ ID NO: 1575603 - RNA, 19 nt, Homo sapiens
gaucaaggcacuacauuau

SEQ ID NO: 1575604 - RNA, 19 nt, Homo sapiens
caauaaacaccuucccuua

SEQ ID NO: 1575605 - RNA, 19 nt, Homo sapiens
gcaguggugucaguuuaua

SEQ ID NO: 1575606 - RNA, 19 nt, Homo sapiens
ucaaggcacuacauuauau

SEQ ID NO: 1575607 - RNA, 19 nt, Homo sapiens
gaauaccaauuaugccauu

SEQ ID NO: 1575608 - RNA, 19 nt, Homo sapiens
caaauugccuccacaccuu

SEQ ID NO: 1575609 - RNA, 19 nt, Homo sapiens
ccaaagggaugaacuucuu

SEQ ID NO: 1575610 - RNA, 19 nt, Homo sapiens
ggaaucuccucaucucuug

SEQ ID NO: 1575611 - RNA, 19 nt, Homo sapiens
gaaagaggugcauaauaaa

SEQ ID NO: 1575612 - RNA, 19 nt, Homo sapiens
ugagaggacuggcaagaaa

SEQ ID NO: 1575613 - RNA, 19 nt, Homo sapiens
aacaguaucucgucacaua

SEQ ID NO: 1575614 - RNA, 19 nt, Homo sapiens
ggagaccaccgaagaagua

SEQ ID NO: 1575615 - RNA, 19 nt, Homo sapiens
ccagagaccuuguauuugg

SEQ ID NO: 1575616 - RNA, 19 nt, Homo sapiens
ggacaacuaacaauucaaa

SEQ ID NO: 1575617 - RNA, 19 nt, Homo sapiens
gaccaggagucucuguuaa

SEQ ID NO: 1575618 - RNA, 19 nt, Homo sapiens
ggaagucaccuugccuuua

SEQ ID NO: 1575619 - RNA, 19 nt, Homo sapiens
gacccaagcuggcaugaga

SEQ ID NO: 1575620 - RNA, 19 nt, Homo sapiens
caauacgccuuaucuguga

SEQ ID NO: 1575621 - RNA, 19 nt, Homo sapiens
ggaugccauugauuauuua

SEQ ID NO: 1575622 - RNA, 19 nt, Homo sapiens
gaguuggaguuguucaaua

SEQ ID NO: 1575623 - RNA, 19 nt, Homo sapiens
acaaugagcuugccaacau

SEQ ID NO: 1575624 - RNA, 19 nt, Homo sapiens
gaugaucucaccauuaauu

SEQ ID NO: 1575625 - RNA, 19 nt, Homo sapiens
cauacaauguggcagauuu

SEQ ID NO: 1575626 - RNA, 19 nt, Homo sapiens
caacugaauuaucucaaga

SEQ ID NO: 1575627 - RNA, 19 nt, Homo sapiens
ggagaagacucagccaaug

SEQ ID NO: 1575628 - RNA, 19 nt, Homo sapiens
ggauucagguuucauuugu

SEQ ID NO: 1575629 - RNA, 19 nt, Homo sapiens
ggaccaggagucucuguua

SEQ ID NO: 1575630 - RNA, 19 nt, Homo sapiens
gaccaaaccucuaaacacu

SEQ ID NO: 1575631 - RNA, 19 nt, Homo sapiens
cacgaaaccuucaagugua

SEQ ID NO: 1575632 - RNA, 19 nt, Homo sapiens
ggaauacuauccaguuucu

SEQ ID NO: 1575633 - RNA, 19 nt, Homo sapiens
gguaccaccuauaaaguaa

SEQ ID NO: 1575634 - RNA, 19 nt, Homo sapiens
agacaucacugacacauca

SEQ ID NO: 1575635 - RNA, 19 nt, Homo sapiens
gaaacaguaucucgucaca

SEQ ID NO: 1575636 - RNA, 19 nt, Homo sapiens
gcauugggauugcaaacuu

SEQ ID NO: 1575637 - RNA, 19 nt, Homo sapiens
ggaaugacauccagugaac

SEQ ID NO: 1575638 - RNA, 19 nt, Homo sapiens
gaacauagaauugcugcuu

SEQ ID NO: 1575639 - RNA, 19 nt, Homo sapiens
ccaaguauuugugcaauga

SEQ ID NO: 1575640 - RNA, 19 nt, Homo sapiens
gcagauccuucuagcaaga

SEQ ID NO: 1575641 - RNA, 19 nt, Homo sapiens
cagcagaccuacacccaaa

SEQ ID NO: 1575642 - RNA, 19 nt, Homo sapiens
gcauacaaccugacagaaa

SEQ ID NO: 1575643 - RNA, 19 nt, Homo sapiens
guuguccucucauuuauuu

SEQ ID NO: 1575644 - RNA, 19 nt, Homo sapiens
uaaggaaccugagagugua

SEQ ID NO: 1575645 - RNA, 19 nt, Homo sapiens
caauguguauucuguggua

SEQ ID NO: 1575646 - RNA, 19 nt, Homo sapiens
cgacaaagccaguggagaa

SEQ ID NO: 1575647 - RNA, 19 nt, Homo sapiens
caaggaagcuggaaauaua

SEQ ID NO: 1575648 - RNA, 19 nt, Homo sapiens
ugaaagaggugcauaauaa

SEQ ID NO: 1575649 - RNA, 19 nt, Homo sapiens
gauauaagguggaauacua

SEQ ID NO: 1575650 - RNA, 19 nt, Homo sapiens
caaagaaacucaaggauga

SEQ ID NO: 1575651 - RNA, 19 nt, Homo sapiens
caagaaauguccaaguaua

SEQ ID NO: 1575652 - RNA, 19 nt, Homo sapiens
gaauuucacugccuuauau

SEQ ID NO: 1575653 - RNA, 19 nt, Homo sapiens
ccucaucucuugcuuguua

SEQ ID NO: 1575654 - RNA, 19 nt, Homo sapiens
ggaguacccuuucugauug

SEQ ID NO: 1575655 - RNA, 19 nt, Homo sapiens
gcaaggcccucacguuuau

SEQ ID NO: 1575656 - RNA, 19 nt, Homo sapiens
ggcaagaaauguccaagua

SEQ ID NO: 1575657 - RNA, 19 nt, Homo sapiens
ggaaauaauugggacauug

SEQ ID NO: 1575658 - RNA, 19 nt, Homo sapiens
gaacagaguggcaguuaaa

SEQ ID NO: 1575659 - RNA, 19 nt, Homo sapiens
acaauaagcuucugcauca

SEQ ID NO: 1575660 - RNA, 19 nt, Homo sapiens
gggcaaagcuauccagguu

SEQ ID NO: 1575661 - RNA, 19 nt, Homo sapiens
gaagucgaauuaaagauga

SEQ ID NO: 1575662 - RNA, 19 nt, Homo sapiens
gagagggaauugcauguuu

SEQ ID NO: 1575663 - RNA, 19 nt, Homo sapiens
gaaaugagucuguauggaa

SEQ ID NO: 1575664 - RNA, 19 nt, Homo sapiens
caaguuguccucucauuua

SEQ ID NO: 1575665 - RNA, 19 nt, Homo sapiens
gcgaugaggucaagucuga

SEQ ID NO: 1575666 - RNA, 19 nt, Homo sapiens
gcaguuaaaugcacacaga

SEQ ID NO: 1575667 - RNA, 19 nt, Homo sapiens
gaacaugccgugugccuuu

SEQ ID NO: 1575668 - RNA, 19 nt, Homo sapiens
ggugcaaacuguuacauuu

SEQ ID NO: 1575669 - RNA, 19 nt, Homo sapiens
gaaaucagccgcauuccaa

SEQ ID NO: 1575670 - RNA, 19 nt, Homo sapiens
gaccagcacuucccucaaa

SEQ ID NO: 1575671 - RNA, 19 nt, Homo sapiens
cagugaaacucuuagguua

SEQ ID NO: 1575672 - RNA, 19 nt, Homo sapiens
gaagaugucauguacugua

SEQ ID NO: 1575673 - RNA, 19 nt, Homo sapiens
ggaagaaugucccuaaggu

SEQ ID NO: 1575674 - RNA, 19 nt, Homo sapiens
gaagucaccuugccuuuac

SEQ ID NO: 1575675 - RNA, 19 nt, Homo sapiens
uggaugaucucaccauuaa

SEQ ID NO: 1575676 - RNA, 19 nt, Homo sapiens
uaaagaugauugcaacuga

SEQ ID NO: 1575677 - RNA, 19 nt, Homo sapiens
ggaauugcauguuuguguu

SEQ ID NO: 1575678 - RNA, 19 nt, Homo sapiens
ggaaauauaacaacugaug

SEQ ID NO: 1575679 - RNA, 19 nt, Homo sapiens
gguagaagaugaauauagu

SEQ ID NO: 1575680 - RNA, 19 nt, Homo sapiens
gaguggagcuguuugcuau

SEQ ID NO: 1575681 - RNA, 19 nt, Homo sapiens
gggauacaguuccauauug

SEQ ID NO: 1575682 - RNA, 19 nt, Homo sapiens
ggaauaacaccaaauggaa

SEQ ID NO: 1575683 - RNA, 19 nt, Homo sapiens
gacagaggcuucacuggaa

SEQ ID NO: 1575684 - RNA, 19 nt, Homo sapiens
cagaagaaguaaagacauu

SEQ ID NO: 1575685 - RNA, 19 nt, Homo sapiens
gaucaaggcacuacauuau

SEQ ID NO: 1575686 - RNA, 19 nt, Homo sapiens
gcaguggugucaguuuaua

SEQ ID NO: 1575687 - RNA, 19 nt, Homo sapiens
ucaaggcacuacauuauau

SEQ ID NO: 1575688 - RNA, 19 nt, Homo sapiens
gaauaccaauuaugccauu

SEQ ID NO: 1575689 - RNA, 19 nt, Homo sapiens
ggaaucuccucaucucuug

SEQ ID NO: 1575690 - RNA, 19 nt, Homo sapiens
gaaagaggugcauaauaaa

SEQ ID NO: 1575691 - RNA, 19 nt, Homo sapiens
ugagaggacuggcaagaaa

SEQ ID NO: 1575692 - RNA, 19 nt, Homo sapiens
gaccaggagucucuguuaa

SEQ ID NO: 1575693 - RNA, 19 nt, Homo sapiens
ggaagucaccuugccuuua

SEQ ID NO: 1575694 - RNA, 19 nt, Homo sapiens
gacccaagcuggcaugaga

SEQ ID NO: 1575695 - RNA, 19 nt, Homo sapiens
acaaugagcuugccaacau

SEQ ID NO: 1575696 - RNA, 19 nt, Homo sapiens
gaugaucucaccauuaauu

SEQ ID NO: 1575697 - RNA, 19 nt, Homo sapiens
cauacaauguggcagauuu

SEQ ID NO: 1575698 - RNA, 19 nt, Homo sapiens
ggauucagguuucauuugu

SEQ ID NO: 1575699 - RNA, 19 nt, Homo sapiens
ggaccaggagucucuguua

SEQ ID NO: 1575700 - RNA, 19 nt, Homo sapiens
gaccaaaccucuaaacacu

SEQ ID NO: 1575701 - RNA, 19 nt, Homo sapiens
cacgaaaccuucaagugua

SEQ ID NO: 1575702 - RNA, 19 nt, Homo sapiens
ggaauacuauccaguuucu

SEQ ID NO: 1575703 - RNA, 19 nt, Homo sapiens
gaacauagaauugcugcuu

SEQ ID NO: 1575704 - RNA, 19 nt, Homo sapiens
ccaaguauuugugcaauga

SEQ ID NO: 1575705 - RNA, 19 nt, Homo sapiens
gcagauccuucuagcaaga

SEQ ID NO: 1575706 - RNA, 19 nt, Homo sapiens
cagcagaccuacacccaaa

SEQ ID NO: 1575707 - RNA, 19 nt, Homo sapiens
gcauacaaccugacagaaa

SEQ ID NO: 1575708 - RNA, 19 nt, Homo sapiens
guuguccucucauuuauuu

SEQ ID NO: 1575709 - RNA, 19 nt, Homo sapiens
uaaggaaccugagagugua

SEQ ID NO: 1575710 - RNA, 19 nt, Homo sapiens
caauguguauucuguggua

SEQ ID NO: 1575711 - RNA, 19 nt, Homo sapiens
ggaaaugagucuguaugga

SEQ ID NO: 1575712 - RNA, 19 nt, Homo sapiens
acaagucugugaacaauug

SEQ ID NO: 1575713 - RNA, 19 nt, Homo sapiens
gaagaaugcguuugugaau

SEQ ID NO: 1575714 - RNA, 19 nt, Homo sapiens
ucauauaccuuacacaauc

SEQ ID NO: 1575715 - RNA, 19 nt, Homo sapiens
gaaaacauuugcaagacua

SEQ ID NO: 1575716 - RNA, 19 nt, Homo sapiens
gaugucauguacuguauau

SEQ ID NO: 1575717 - RNA, 19 nt, Homo sapiens
ccuacgaugugaauguuua

SEQ ID NO: 1575718 - RNA, 19 nt, Homo sapiens
gcacaagacccucagaauc

SEQ ID NO: 1575719 - RNA, 19 nt, Homo sapiens
aaauugcucuugcucagua

SEQ ID NO: 1575720 - RNA, 19 nt, Homo sapiens
cagaagaugucauguacug

SEQ ID NO: 1575721 - RNA, 19 nt, Homo sapiens
caaauggaaucuccucauc

SEQ ID NO: 1575722 - RNA, 19 nt, Homo sapiens
agaaagugaugaccugauu

SEQ ID NO: 1575723 - RNA, 19 nt, Homo sapiens
gcagcugacugaccuuguu

SEQ ID NO: 1575724 - RNA, 19 nt, Homo sapiens
agggaaacgucaagaauuu

SEQ ID NO: 1575725 - RNA, 19 nt, Homo sapiens
gcauguuuguguuguauau

SEQ ID NO: 1575726 - RNA, 19 nt, Homo sapiens
ccaaguuguucuuugaauu

SEQ ID NO: 1575727 - RNA, 19 nt, Homo sapiens
ccacagaagaugucaugua

SEQ ID NO: 1575728 - RNA, 19 nt, Homo sapiens
ccaaauucuugcacaugua

SEQ ID NO: 1575729 - RNA, 19 nt, Homo sapiens
acacaucucugacgaaugg

SEQ ID NO: 1575730 - RNA, 19 nt, Homo sapiens
guaaggaaccugagagugu

SEQ ID NO: 1575731 - RNA, 19 nt, Homo sapiens
ggacacagagccaacaaga

SEQ ID NO: 1575732 - RNA, 19 nt, Homo sapiens
caacugauccugaugauac

SEQ ID NO: 1575733 - RNA, 19 nt, Homo sapiens
gaaauaauugggacauugu

SEQ ID NO: 1575734 - RNA, 19 nt, Homo sapiens
cuacuuaguuacugcguuu

SEQ ID NO: 1575735 - RNA, 19 nt, Homo sapiens
uauauuaccuggugauagu

SEQ ID NO: 1575736 - RNA, 19 nt, Homo sapiens
aauuguggcuuguaaauga

SEQ ID NO: 1575737 - RNA, 19 nt, Homo sapiens
aagcaguggugucaguuua

SEQ ID NO: 1575738 - RNA, 19 nt, Homo sapiens
cauacaggauucagaagaa

SEQ ID NO: 1575739 - RNA, 19 nt, Homo sapiens
caaggcagauauuguguuc

SEQ ID NO: 1575740 - RNA, 19 nt, Homo sapiens
gugauccaauugaugaaua

SEQ ID NO: 1575741 - RNA, 19 nt, Homo sapiens
gcucguauacaucucuuua

SEQ ID NO: 1575742 - RNA, 19 nt, Homo sapiens
ugacuguaguucccguuua

SEQ ID NO: 1575743 - RNA, 19 nt, Homo sapiens
cagaggaacugguaccaau

SEQ ID NO: 1575744 - RNA, 19 nt, Homo sapiens
cugaauauguugucaaugu

SEQ ID NO: 1575745 - RNA, 19 nt, Homo sapiens
ucacaggcauggcuuugaa

SEQ ID NO: 1575746 - RNA, 19 nt, Homo sapiens
ccagagcugcuguguauuu

SEQ ID NO: 1575747 - RNA, 19 nt, Homo sapiens
caacauagguuaagagcaa

SEQ ID NO: 1575748 - RNA, 19 nt, Homo sapiens
gcacccagcuauugaauga

SEQ ID NO: 1575749 - RNA, 19 nt, Homo sapiens
guccagagcucaucacuuu

SEQ ID NO: 1575750 - RNA, 19 nt, Homo sapiens
aaacaggacugcucaaaug

SEQ ID NO: 1575751 - RNA, 19 nt, Homo sapiens
cggaguagcugagaucuua

SEQ ID NO: 1575752 - RNA, 19 nt, Homo sapiens
ggacucagaucaaagacaa

SEQ ID NO: 1575753 - RNA, 19 nt, Homo sapiens
gaaagcgcauuugguuaua

SEQ ID NO: 1575754 - RNA, 19 nt, Homo sapiens
ggacuuggauucgaggaua

SEQ ID NO: 1575755 - RNA, 19 nt, Homo sapiens
cuacagggcucgagagauu

SEQ ID NO: 1575756 - RNA, 19 nt, Homo sapiens
gcagaaagcgcauuugguu

SEQ ID NO: 1575757 - RNA, 19 nt, Homo sapiens
gaagagcguuuacgagcaa

SEQ ID NO: 1575758 - RNA, 19 nt, Homo sapiens
uaagauguccuucauguuu

SEQ ID NO: 1575759 - RNA, 19 nt, Homo sapiens
caagaucuguccaccauug

SEQ ID NO: 1575760 - RNA, 19 nt, Homo sapiens
aaacauaccucaauacacu

SEQ ID NO: 1575761 - RNA, 19 nt, Homo sapiens
gaagacaguuuaacaacag

SEQ ID NO: 1575762 - RNA, 19 nt, Homo sapiens
acaaacagguucauagaga

SEQ ID NO: 1575763 - RNA, 19 nt, Homo sapiens
gcauacagcugugcuaauc

SEQ ID NO: 1575764 - RNA, 19 nt, Homo sapiens
gaaacaaacagguucauag

SEQ ID NO: 1575765 - RNA, 19 nt, Homo sapiens
guaauggccuucugaugau

SEQ ID NO: 1575766 - RNA, 19 nt, Homo sapiens
ggaccaacccucucuaugu

SEQ ID NO: 1575767 - RNA, 19 nt, Homo sapiens
gacaaaaucugauccauau

SEQ ID NO: 1575768 - RNA, 19 nt, Homo sapiens
ggauggaccugcuggugaa

SEQ ID NO: 1575769 - RNA, 19 nt, Homo sapiens
uauggugucuguuuaugua

SEQ ID NO: 1575770 - RNA, 19 nt, Homo sapiens
gacagacgcuaggaaguaa

SEQ ID NO: 1575771 - RNA, 19 nt, Homo sapiens
ccaauauacuccuuugaug

SEQ ID NO: 1575772 - RNA, 19 nt, Homo sapiens
uaacugcgacugaaacaaa

SEQ ID NO: 1575773 - RNA, 19 nt, Homo sapiens
ggacauaaaggagaauuug

SEQ ID NO: 1575774 - RNA, 19 nt, Homo sapiens
gcuauugaaugaacccaaa

SEQ ID NO: 1575775 - RNA, 19 nt, Homo sapiens
cacaguggcuccugaaaga

SEQ ID NO: 1575776 - RNA, 19 nt, Homo sapiens
caucaugcuuuaggaauuu

SEQ ID NO: 1575777 - RNA, 19 nt, Homo sapiens
gaaacaggacugcucaaau

SEQ ID NO: 1575778 - RNA, 19 nt, Homo sapiens
gagaacaugugggaaugaa

SEQ ID NO: 1575779 - RNA, 19 nt, Homo sapiens
gugaacgcaucccaacaua

SEQ ID NO: 1575780 - RNA, 19 nt, Homo sapiens
gugaagaguugacacugaa

SEQ ID NO: 1575781 - RNA, 19 nt, Homo sapiens
ggaagcacccagcuauuga

SEQ ID NO: 1575782 - RNA, 19 nt, Homo sapiens
gcaggaggcagacggagua

SEQ ID NO: 1575783 - RNA, 19 nt, Homo sapiens
gaaccucaagggccaagua

SEQ ID NO: 1575784 - RNA, 19 nt, Homo sapiens
gaaaccuggucacagcauu

SEQ ID NO: 1575785 - RNA, 19 nt, Homo sapiens
ccaacgcucugcucgacua

SEQ ID NO: 1575786 - RNA, 19 nt, Homo sapiens
ugaucuagcuuaccugaga

SEQ ID NO: 1575787 - RNA, 19 nt, Homo sapiens
aaacaagggucuggugaga

SEQ ID NO: 1575788 - RNA, 19 nt, Homo sapiens
ccacggaggucaguucaau

SEQ ID NO: 1575789 - RNA, 19 nt, Homo sapiens
uuaguauggugucuguuua

SEQ ID NO: 1575790 - RNA, 19 nt, Homo sapiens
ggaggucaguucaauaugc

SEQ ID NO: 1575791 - RNA, 19 nt, Homo sapiens
gagauacagccuucccaua

SEQ ID NO: 1575792 - RNA, 19 nt, Homo sapiens
gcauuuggcugcucugaac

SEQ ID NO: 1575793 - RNA, 19 nt, Homo sapiens
gaacaugugggaaugaaag

SEQ ID NO: 1575794 - RNA, 19 nt, Homo sapiens
gaccaacccucucuauguc

SEQ ID NO: 1575795 - RNA, 19 nt, Homo sapiens
ccaaauaaucugaaacuag

SEQ ID NO: 1575796 - RNA, 19 nt, Homo sapiens
uguaagauguccuucaugu

SEQ ID NO: 1575797 - RNA, 19 nt, Homo sapiens
cuggugagauccugaauga

SEQ ID NO: 1575798 - RNA, 19 nt, Homo sapiens
aaacaaacagguucauaga

SEQ ID NO: 1575799 - RNA, 19 nt, Homo sapiens
gaacgcaucccaacauagg

SEQ ID NO: 1575800 - RNA, 19 nt, Homo sapiens
ugacagacgcuaggaagua

SEQ ID NO: 1575801 - RNA, 19 nt, Homo sapiens
gauacagccuucccauagu

SEQ ID NO: 1575802 - RNA, 19 nt, Homo sapiens
aauggcagcuuccuuaugu

SEQ ID NO: 1575803 - RNA, 19 nt, Homo sapiens
caaacagguucauagagau

SEQ ID NO: 1575804 - RNA, 19 nt, Homo sapiens
cuaucagacucuaauguuu

SEQ ID NO: 1575805 - RNA, 19 nt, Homo sapiens
acucaaaacugaagacaua

SEQ ID NO: 1575806 - RNA, 19 nt, Homo sapiens
auucuuaucuucccauuug

SEQ ID NO: 1575807 - RNA, 19 nt, Homo sapiens
gcauuugguuauagaagga

SEQ ID NO: 1575808 - RNA, 19 nt, Homo sapiens
ugaagacaguuuaacaaca

SEQ ID NO: 1575809 - RNA, 19 nt, Homo sapiens
caauaucacccauggauuc

SEQ ID NO: 1575810 - RNA, 19 nt, Homo sapiens
gaaacuccaaauaaucuga

SEQ ID NO: 1575811 - RNA, 19 nt, Homo sapiens
ccaucaugcuuuaggaauu

SEQ ID NO: 1575812 - RNA, 19 nt, Homo sapiens
gcuaucagacucuaauguu

SEQ ID NO: 1575813 - RNA, 19 nt, Homo sapiens
gaagccugcucugcauuug

SEQ ID NO: 1575814 - RNA, 19 nt, Homo sapiens
ugacuuccauuuggcaauu

SEQ ID NO: 1575815 - RNA, 19 nt, Homo sapiens
ucaauacacucaaaacuga

SEQ ID NO: 1575816 - RNA, 19 nt, Homo sapiens
gaaaagaauuuagcagcaa

SEQ ID NO: 1575817 - RNA, 19 nt, Homo sapiens
ggugagauccugaaugaca

SEQ ID NO: 1575818 - RNA, 19 nt, Homo sapiens
uuauugccaucaugcuuua

SEQ ID NO: 1575819 - RNA, 19 nt, Homo sapiens
gaucaaagacaaaaucuga

SEQ ID NO: 1575820 - RNA, 19 nt, Homo sapiens
guggauaacuacugugaag

SEQ ID NO: 1575821 - RNA, 19 nt, Homo sapiens
cagaaagcgcauuugguua

SEQ ID NO: 1575822 - RNA, 19 nt, Homo sapiens
ugagacacuuucugaacaa

SEQ ID NO: 1575823 - RNA, 19 nt, Homo sapiens
aguaauggccuucugauga

SEQ ID NO: 1575824 - RNA, 19 nt, Homo sapiens
agaaagcgcauuugguuau

SEQ ID NO: 1575825 - RNA, 19 nt, Homo sapiens
gacacuuucugaacaacuu

SEQ ID NO: 1575826 - RNA, 19 nt, Homo sapiens
ggagcaagagggccuaaug

SEQ ID NO: 1575827 - RNA, 19 nt, Homo sapiens
gaauuauaacugcgacuga

SEQ ID NO: 1575828 - RNA, 19 nt, Homo sapiens
ccaccaaacccuauuucaa

SEQ ID NO: 1575829 - RNA, 19 nt, Homo sapiens
uguuagagauggcuggaaa

SEQ ID NO: 1575830 - RNA, 19 nt, Homo sapiens
ggauggagccaguauugug

SEQ ID NO: 1575831 - RNA, 19 nt, Homo sapiens
gaagcacccagcuauugaa

SEQ ID NO: 1575832 - RNA, 19 nt, Homo sapiens
acaagggucuggugagauc

SEQ ID NO: 1575833 - RNA, 19 nt, Homo sapiens
gaagaguccucggcaucug

SEQ ID NO: 1575834 - RNA, 19 nt, Homo sapiens
gaguugacacugaaaucua

SEQ ID NO: 1575835 - RNA, 19 nt, Homo sapiens
uaacaucaaaggagccauu

SEQ ID NO: 1575836 - RNA, 19 nt, Homo sapiens
ccucaaggguaccaaagga

SEQ ID NO: 1575837 - RNA, 19 nt, Homo sapiens
caacugcuguucguacaca

SEQ ID NO: 1575838 - RNA, 19 nt, Homo sapiens
auagaggacucagaucaaa

SEQ ID NO: 1575839 - RNA, 19 nt, Homo sapiens
ugugaagaguugacacuga

SEQ ID NO: 1575840 - RNA, 19 nt, Homo sapiens
ggccuucugaugauucuua

SEQ ID NO: 1575841 - RNA, 19 nt, Homo sapiens
gauggucgagacauaauga

SEQ ID NO: 1575842 - RNA, 19 nt, Homo sapiens
ugaggaaagcagagagaua

SEQ ID NO: 1575843 - RNA, 19 nt, Homo sapiens
uggaugacaugcugcagaa

SEQ ID NO: 1575844 - RNA, 19 nt, Homo sapiens
uagcuuaccugagacacuu

SEQ ID NO: 1575845 - RNA, 19 nt, Homo sapiens
aguugacacugaaaucuaa

SEQ ID NO: 1575846 - RNA, 19 nt, Homo sapiens
gaagaguugacacugaaau

SEQ ID NO: 1575847 - RNA, 19 nt, Homo sapiens
gcauauaccuguaauccua

SEQ ID NO: 1575848 - RNA, 19 nt, Homo sapiens
gaacagcaccuccuuaaga

SEQ ID NO: 1575849 - RNA, 19 nt, Homo sapiens
ggagagaucugugucauug

SEQ ID NO: 1575850 - RNA, 19 nt, Homo sapiens
gaacugggauccuuaccaa

SEQ ID NO: 1575851 - RNA, 19 nt, Homo sapiens
guaagaggauugccuggua

SEQ ID NO: 1575852 - RNA, 19 nt, Homo sapiens
gcaaauggguauccacaga

SEQ ID NO: 1575853 - RNA, 19 nt, Homo sapiens
ugggagacauggugaauua

SEQ ID NO: 1575854 - RNA, 19 nt, Homo sapiens
ggaaggcccuggugggaaa

SEQ ID NO: 1575855 - RNA, 19 nt, Homo sapiens
gaggagggcugcugugaga

SEQ ID NO: 1575856 - RNA, 19 nt, Homo sapiens
gggcaagccugucucguuu

SEQ ID NO: 1575857 - RNA, 19 nt, Homo sapiens
ggacauugguauuggcauu

SEQ ID NO: 1575858 - RNA, 19 nt, Homo sapiens
gagacauggugaauuauga

SEQ ID NO: 1575859 - RNA, 19 nt, Homo sapiens
gcaggaaggacucaaauug

SEQ ID NO: 1575860 - RNA, 19 nt, Homo sapiens
gcaagccugucucguuuga

SEQ ID NO: 1575861 - RNA, 19 nt, Homo sapiens
ggcuguagcugaccucuuu

SEQ ID NO: 1575862 - RNA, 19 nt, Homo sapiens
gaaagacuccguugggaau

SEQ ID NO: 1575863 - RNA, 19 nt, Homo sapiens
caagguaacuccggugaga

SEQ ID NO: 1575864 - RNA, 19 nt, Homo sapiens
gaagacgugguaucuguuu

SEQ ID NO: 1575865 - RNA, 19 nt, Homo sapiens
gggagacccuggcuuuguu

SEQ ID NO: 1575866 - RNA, 19 nt, Homo sapiens
gaaaucaagagguucauca

SEQ ID NO: 1575867 - RNA, 19 nt, Homo sapiens
ugacacuacugcugaagaa

SEQ ID NO: 1575868 - RNA, 19 nt, Homo sapiens
gaagggugaugcugggaau

SEQ ID NO: 1575869 - RNA, 19 nt, Homo sapiens
cgacucagccucaugaaga

SEQ ID NO: 1575870 - RNA, 19 nt, Homo sapiens
caacgugacuggcuucaac

SEQ ID NO: 1575871 - RNA, 19 nt, Homo sapiens
gggaauaaauggccaaagc

SEQ ID NO: 1575872 - RNA, 19 nt, Homo sapiens
gaagggcgaccagggauuu

SEQ ID NO: 1575873 - RNA, 19 nt, Homo sapiens
caggguaccucguggagaa

SEQ ID NO: 1575874 - RNA, 19 nt, Homo sapiens
gcaaggcuggccacuguaa

SEQ ID NO: 1575875 - RNA, 19 nt, Homo sapiens
ggacucaaauuggaacaca

SEQ ID NO: 1575876 - RNA, 19 nt, Homo sapiens
gaauaaauggccaaagcuu

SEQ ID NO: 1575877 - RNA, 19 nt, Homo sapiens
gcaguacccacccaugaaa

SEQ ID NO: 1575878 - RNA, 19 nt, Homo sapiens
ggugaauuaugaugaaauc

SEQ ID NO: 1575879 - RNA, 19 nt, Homo sapiens
ucaaggagaccucaucuuc

SEQ ID NO: 1575880 - RNA, 19 nt, Homo sapiens
gggagacccuggcauccaa

SEQ ID NO: 1575881 - RNA, 19 nt, Homo sapiens
ggcaaugacuguguucgaa

SEQ ID NO: 1575882 - RNA, 19 nt, Homo sapiens
gaaagcagggauucuaugg

SEQ ID NO: 1575883 - RNA, 19 nt, Homo sapiens
gaaacacacccaccagaag

SEQ ID NO: 1575884 - RNA, 19 nt, Homo sapiens
cauggugaauuaugaugaa

SEQ ID NO: 1575885 - RNA, 19 nt, Homo sapiens
cagcaccuccuuaagagua

SEQ ID NO: 1575886 - RNA, 19 nt, Homo sapiens
gagggcugcugugagauuu

SEQ ID NO: 1575887 - RNA, 19 nt, Homo sapiens
ggaaggacucaaauuggaa

SEQ ID NO: 1575888 - RNA, 19 nt, Homo sapiens
ugugacagguugugaaugu

SEQ ID NO: 1575889 - RNA, 19 nt, Homo sapiens
aauaaauggccaaagcuua

SEQ ID NO: 1575890 - RNA, 19 nt, Homo sapiens
ggagacauggugaauuaug

SEQ ID NO: 1575891 - RNA, 19 nt, Homo sapiens
gaagggcagcgaagggauu

SEQ ID NO: 1575892 - RNA, 19 nt, Homo sapiens
ggaaagcagggauucuaug

SEQ ID NO: 1575893 - RNA, 19 nt, Homo sapiens
ucaagagguucaucagaca

SEQ ID NO: 1575894 - RNA, 19 nt, Homo sapiens
ggagggcugcugugagauu

SEQ ID NO: 1575895 - RNA, 19 nt, Homo sapiens
cgugguaucuguuucaagu

SEQ ID NO: 1575896 - RNA, 19 nt, Homo sapiens
ucagacaagagaucauuaa

SEQ ID NO: 1575897 - RNA, 19 nt, Homo sapiens
ccagaacuuuguuggacuu

SEQ ID NO: 1575898 - RNA, 19 nt, Homo sapiens
gacagcagccgaugagugu

SEQ ID NO: 1575899 - RNA, 19 nt, Homo sapiens
ucaagguccuccaggcuau

SEQ ID NO: 1575900 - RNA, 19 nt, Homo sapiens
caaugacuguguucgaauc

SEQ ID NO: 1575901 - RNA, 19 nt, Homo sapiens
aaacacacccaccagaaga

SEQ ID NO: 1575902 - RNA, 19 nt, Homo sapiens
aggaaggacucaaauugga

SEQ ID NO: 1575903 - RNA, 19 nt, Homo sapiens
uaaauggccaaagcuuaua

SEQ ID NO: 1575904 - RNA, 19 nt, Homo sapiens
aggcaaggcuggccacugu

SEQ ID NO: 1575905 - RNA, 19 nt, Homo sapiens
gggagugccuggaaacaac

SEQ ID NO: 1575906 - RNA, 19 nt, Homo sapiens
ucaagggcgugccgggaaa

SEQ ID NO: 1575907 - RNA, 19 nt, Homo sapiens
agucuaagcaacauaauga

SEQ ID NO: 1575908 - RNA, 19 nt, Homo sapiens
ugacagguugugaauguuu

SEQ ID NO: 1575909 - RNA, 19 nt, Homo sapiens
uaaucccucugacugcuuu

SEQ ID NO: 1575910 - RNA, 19 nt, Homo sapiens
ugaaaggagagaaggguaa

SEQ ID NO: 1575911 - RNA, 19 nt, Homo sapiens
ugagaucaauccacagucu

SEQ ID NO: 1575912 - RNA, 19 nt, Homo sapiens
ucaagugaccgaugcaaau

SEQ ID NO: 1575913 - RNA, 19 nt, Homo sapiens
gggagauccuggcuguguu

SEQ ID NO: 1575914 - RNA, 19 nt, Homo sapiens
ggagccuggugauccugua

SEQ ID NO: 1575915 - RNA, 19 nt, Homo sapiens
gcaaugacuguguucgaau

SEQ ID NO: 1575916 - RNA, 19 nt, Homo sapiens
aggauugccugguaccaaa

SEQ ID NO: 1575917 - RNA, 19 nt, Homo sapiens
gggcuugccaggaguaaga

SEQ ID NO: 1575918 - RNA, 19 nt, Homo sapiens
ggaccuggcaagagugguu

SEQ ID NO: 1575919 - RNA, 19 nt, Homo sapiens
gaacuuuguuggacuuccu

SEQ ID NO: 1575920 - RNA, 19 nt, Homo sapiens
ggagacagcagccgaugag

SEQ ID NO: 1575921 - RNA, 19 nt, Homo sapiens
cagcaguacccacccauga

SEQ ID NO: 1575922 - RNA, 19 nt, Homo sapiens
cggauugccuggccuucaa

SEQ ID NO: 1575923 - RNA, 19 nt, Homo sapiens
ggagauccuggcuguguug

SEQ ID NO: 1575924 - RNA, 19 nt, Homo sapiens
gggccugacuggagacaag

SEQ ID NO: 1575925 - RNA, 19 nt, Homo sapiens
ugguaucuguuucaaguga

SEQ ID NO: 1575926 - RNA, 19 nt, Homo sapiens
caucagacaagagaucauu

SEQ ID NO: 1575927 - RNA, 19 nt, Homo sapiens
agauaucccuggaagucaa

SEQ ID NO: 1575928 - RNA, 19 nt, Homo sapiens
caaauuggaacacaguagu

SEQ ID NO: 1575929 - RNA, 19 nt, Homo sapiens
cagacaagagaucauuaaa

SEQ ID NO: 1575930 - RNA, 19 nt, Homo sapiens
ggaccgggauguggguauc

SEQ ID NO: 1575931 - RNA, 19 nt, Homo sapiens
agaaacacacccaccagaa

SEQ ID NO: 1575932 - RNA, 19 nt, Homo sapiens
ugacaacagugagggagau

SEQ ID NO: 1575933 - RNA, 19 nt, Homo sapiens
ggaaagccagggcccaaag

SEQ ID NO: 1575934 - RNA, 19 nt, Homo sapiens
ggguauuucccuccuuaaa

SEQ ID NO: 1575935 - RNA, 19 nt, Homo sapiens
aagacuccguugggaauaa

SEQ ID NO: 1575936 - RNA, 19 nt, Homo sapiens
gagagaauggcuuacuaca

SEQ ID NO: 1575937 - RNA, 19 nt, Homo sapiens
cugcagaacugggauccuu

SEQ ID NO: 1575938 - RNA, 19 nt, Homo sapiens
gggcugcugugagauuuua

SEQ ID NO: 1575939 - RNA, 19 nt, Homo sapiens
caagugaccgaugcaaaug

SEQ ID NO: 1575940 - RNA, 19 nt, Homo sapiens
cugggauccuuaccaauug

SEQ ID NO: 1575941 - RNA, 19 nt, Homo sapiens
cagcugacgggaagaauca

SEQ ID NO: 1575942 - RNA, 19 nt, Homo sapiens
gccugugggccauguauuu

SEQ ID NO: 1575943 - RNA, 19 nt, Homo sapiens
augagagaauggcuuacua

SEQ ID NO: 1575944 - RNA, 19 nt, Homo sapiens
aaauuggaacacaguagua

SEQ ID NO: 1575945 - RNA, 19 nt, Homo sapiens
uugaacagcaccuccuuaa

SEQ ID NO: 1575946 - RNA, 19 nt, Homo sapiens
uaagcaacauaaugagacu

SEQ ID NO: 1575947 - RNA, 19 nt, Homo sapiens
ggaagaagcuaaugaugga

SEQ ID NO: 1575948 - RNA, 19 nt, Homo sapiens
caaccuagcuagcaacauu

SEQ ID NO: 1575949 - RNA, 19 nt, Homo sapiens
ggacagaauuggaugaugu

SEQ ID NO: 1575950 - RNA, 19 nt, Homo sapiens
ggugaaagcuggagucugu

SEQ ID NO: 1575951 - RNA, 19 nt, Homo sapiens
caacacaccugcuaagaag

SEQ ID NO: 1575952 - RNA, 19 nt, Homo sapiens
aaacaaagccugacucaug

SEQ ID NO: 1575953 - RNA, 19 nt, Homo sapiens
gaagaaguauugcugucaa

SEQ ID NO: 1575954 - RNA, 19 nt, Homo sapiens
ccacaagacuuacauccuu

SEQ ID NO: 1575955 - RNA, 19 nt, Homo sapiens
gccaggagauucagcagua

SEQ ID NO: 1575956 - RNA, 19 nt, Homo sapiens
caaacgagauggaacugaa

SEQ ID NO: 1575957 - RNA, 19 nt, Homo sapiens
ggaccucucgucuuacuua

SEQ ID NO: 1575958 - RNA, 19 nt, Homo sapiens
gugcgcagcuucauuguug

SEQ ID NO: 1575959 - RNA, 19 nt, Homo sapiens
cagcauggauagaauagaa

SEQ ID NO: 1575960 - RNA, 19 nt, Homo sapiens
gcacaaggacugcaaguuc

SEQ ID NO: 1575961 - RNA, 19 nt, Homo sapiens
gaugauaggguuucuaaug

SEQ ID NO: 1575962 - RNA, 19 nt, Homo sapiens
ggaaagccaguuacauaaa

SEQ ID NO: 1575963 - RNA, 19 nt, Homo sapiens
ggucaucgaugcucacugu

SEQ ID NO: 1575964 - RNA, 19 nt, Homo sapiens
gcaaguuccugauccuaga

SEQ ID NO: 1575965 - RNA, 19 nt, Homo sapiens
gggcgcaguuggucuuuaa

SEQ ID NO: 1575966 - RNA, 19 nt, Homo sapiens
uaggaaagccaguuacaua

SEQ ID NO: 1575967 - RNA, 19 nt, Homo sapiens
agacaaaggugaccaaguc

SEQ ID NO: 1575968 - RNA, 19 nt, Homo sapiens
ggacagcauggauagaaua

SEQ ID NO: 1575969 - RNA, 19 nt, Homo sapiens
gaauuugcaucuucuucaa

SEQ ID NO: 1575970 - RNA, 19 nt, Homo sapiens
gagcagaccuggacaaaau

SEQ ID NO: 1575971 - RNA, 19 nt, Homo sapiens
aaagcaagcugccuacaau

SEQ ID NO: 1575972 - RNA, 19 nt, Homo sapiens
gaaagccaguuacauaaaa

SEQ ID NO: 1575973 - RNA, 19 nt, Homo sapiens
gagcaaggccucccagguu

SEQ ID NO: 1575974 - RNA, 19 nt, Homo sapiens
aaauugggcugcacaguga

SEQ ID NO: 1575975 - RNA, 19 nt, Homo sapiens
gaaauucacuuccccucua

SEQ ID NO: 1575976 - RNA, 19 nt, Homo sapiens
uacauaaacucaacuggaa

SEQ ID NO: 1575977 - RNA, 19 nt, Homo sapiens
ucaaaguuguuuccaauuc

SEQ ID NO: 1575978 - RNA, 19 nt, Homo sapiens
ggacaaggaaggaauaaag

SEQ ID NO: 1575979 - RNA, 19 nt, Homo sapiens
cacaagacuuacauccuua

SEQ ID NO: 1575980 - RNA, 19 nt, Homo sapiens
gauaggguuucuaaugguu

SEQ ID NO: 1575981 - RNA, 19 nt, Homo sapiens
gaucaucaaguaccaugua

SEQ ID NO: 1575982 - RNA, 19 nt, Homo sapiens
acaguaaccacaagacuua

SEQ ID NO: 1575983 - RNA, 19 nt, Homo sapiens
ugaagucacugagagaauu

SEQ ID NO: 1575984 - RNA, 19 nt, Homo sapiens
gcuccgaggugaaguagga

SEQ ID NO: 1575985 - RNA, 19 nt, Homo sapiens
gcacugcaaauuucuagaa

SEQ ID NO: 1575986 - RNA, 19 nt, Homo sapiens
ggacacagcaucagcucaa

SEQ ID NO: 1575987 - RNA, 19 nt, Homo sapiens
guauaucacauucccauuu

SEQ ID NO: 1575988 - RNA, 19 nt, Homo sapiens
ggaguacccucggaaggaa

SEQ ID NO: 1575989 - RNA, 19 nt, Homo sapiens
gaaaggaaaacucacguua

SEQ ID NO: 1575990 - RNA, 19 nt, Homo sapiens
guauggauguaaccaagaa

SEQ ID NO: 1575991 - RNA, 19 nt, Homo sapiens
uauaucacauucccauuug

SEQ ID NO: 1575992 - RNA, 19 nt, Homo sapiens
uggaugauguuaagcguuu

SEQ ID NO: 1575993 - RNA, 19 nt, Homo sapiens
gaacuccuuggcuucuuua

SEQ ID NO: 1575994 - RNA, 19 nt, Homo sapiens
agaaggagaagaaguauug

SEQ ID NO: 1575995 - RNA, 19 nt, Homo sapiens
gaaaacaucaggagaagaa

SEQ ID NO: 1575996 - RNA, 19 nt, Homo sapiens
gcagagcgaugaccuuuug

SEQ ID NO: 1575997 - RNA, 19 nt, Homo sapiens
auacuagaguucauggaua

SEQ ID NO: 1575998 - RNA, 19 nt, Homo sapiens
gaagugacucuugcaacua

SEQ ID NO: 1575999 - RNA, 19 nt, Homo sapiens
uuacuucucugcuaucuag

SEQ ID NO: 1576000 - RNA, 19 nt, Homo sapiens
ggagccggcuggagaaaca

SEQ ID NO: 1576001 - RNA, 19 nt, Homo sapiens
ucacauucccauuugcuua

SEQ ID NO: 1576002 - RNA, 19 nt, Homo sapiens
cuggagaucuggauuacaa

SEQ ID NO: 1576003 - RNA, 19 nt, Homo sapiens
gcagaaggcggcauguaug

SEQ ID NO: 1576004 - RNA, 19 nt, Homo sapiens
gugacaguauuagaucuua

SEQ ID NO: 1576005 - RNA, 19 nt, Homo sapiens
caacaccaaugccuacucu

SEQ ID NO: 1576006 - RNA, 19 nt, Homo sapiens
agaauuggaugauguuaag

SEQ ID NO: 1576007 - RNA, 19 nt, Homo sapiens
ggccaugccuccaccucua

SEQ ID NO: 1576008 - RNA, 19 nt, Homo sapiens
ugagagaauugucacugaa

SEQ ID NO: 1576009 - RNA, 19 nt, Homo sapiens
gaagaaaacaucaggagaa

SEQ ID NO: 1576010 - RNA, 19 nt, Homo sapiens
gaugugcgcagcuucauug

SEQ ID NO: 1576011 - RNA, 19 nt, Homo sapiens
cugcagauauccacagcua

SEQ ID NO: 1576012 - RNA, 19 nt, Homo sapiens
gaccaccacugcagauauc

SEQ ID NO: 1576013 - RNA, 19 nt, Homo sapiens
ggaauuugcaucuucuuca

SEQ ID NO: 1576014 - RNA, 19 nt, Homo sapiens
ucaguuggcuaagaaguga

SEQ ID NO: 1576015 - RNA, 19 nt, Homo sapiens
cuaaauaugagcccagaaa

SEQ ID NO: 1576016 - RNA, 19 nt, Homo sapiens
ucaggagucuuagagcuuu

SEQ ID NO: 1576017 - RNA, 19 nt, Homo sapiens
caaaggugaccaagucuau

SEQ ID NO: 1576018 - RNA, 19 nt, Homo sapiens
uggaugagcuggagaggau

SEQ ID NO: 1576019 - RNA, 19 nt, Homo sapiens
gcagauauccacagcuaca

SEQ ID NO: 1576020 - RNA, 19 nt, Homo sapiens
gagagaauugucacugaaa

SEQ ID NO: 1576021 - RNA, 19 nt, Homo sapiens
gaaagucugauuguagcua

SEQ ID NO: 1576022 - RNA, 19 nt, Homo sapiens
cuagucaguuggcuaagaa

SEQ ID NO: 1576023 - RNA, 19 nt, Homo sapiens
agacuuacuucucugcuau

SEQ ID NO: 1576024 - RNA, 19 nt, Homo sapiens
caagccacguugugagcua

SEQ ID NO: 1576025 - RNA, 19 nt, Homo sapiens
gggagauccuggcauggaa

SEQ ID NO: 1576026 - RNA, 19 nt, Homo sapiens
ccacccagguccacaagga

SEQ ID NO: 1576027 - RNA, 19 nt, Homo sapiens
aagugacucuugcaacuaa

SEQ ID NO: 1576028 - RNA, 19 nt, Homo sapiens
ugaacuccuuggcuucuuu

SEQ ID NO: 1576029 - RNA, 19 nt, Homo sapiens
cggagaaggagaagaagua

SEQ ID NO: 1576030 - RNA, 19 nt, Homo sapiens
guagucgcauucucagcua

SEQ ID NO: 1576031 - RNA, 19 nt, Homo sapiens
ggaccuaucacaacaacau

SEQ ID NO: 1576032 - RNA, 19 nt, Homo sapiens
gugaugauaggguuucuaa

SEQ ID NO: 1576033 - RNA, 19 nt, Homo sapiens
gggcggagaaggagaagaa

SEQ ID NO: 1576034 - RNA, 19 nt, Homo sapiens
ggacuucuuccaaacuuau

SEQ ID NO: 1576035 - RNA, 19 nt, Homo sapiens
cugaguacaugcagaguga

SEQ ID NO: 1576036 - RNA, 19 nt, Homo sapiens
cccaggacaucaagaaguu

SEQ ID NO: 1576037 - RNA, 19 nt, Homo sapiens
caggcaagaucgugacuuc

SEQ ID NO: 1576038 - RNA, 19 nt, Homo sapiens
ugaaggcgcguguggauga

SEQ ID NO: 1576039 - RNA, 19 nt, Homo sapiens
ggacagcgggaaggucuuu

SEQ ID NO: 1576040 - RNA, 19 nt, Homo sapiens
ggcagcagcggcuacauaa

SEQ ID NO: 1576041 - RNA, 19 nt, Homo sapiens
ucauggauauguuauacug

SEQ ID NO: 1576042 - RNA, 19 nt, Homo sapiens
ugacuuugcuggagaucug

SEQ ID NO: 1576043 - RNA, 19 nt, Homo sapiens
gaucguuccuguccaacuc

SEQ ID NO: 1576044 - RNA, 19 nt, Homo sapiens
cuuagaaagucugauugua

SEQ ID NO: 1576045 - RNA, 19 nt, Homo sapiens
agaauucagucaaagauac

SEQ ID NO: 1576046 - RNA, 19 nt, Homo sapiens
gcagagugacaguauuaga

SEQ ID NO: 1576047 - RNA, 19 nt, Homo sapiens
ggaagaagcuaaugaugga

SEQ ID NO: 1576048 - RNA, 19 nt, Homo sapiens
ggacagaauuggaugaugu

SEQ ID NO: 1576049 - RNA, 19 nt, Homo sapiens
caacacaccugcuaagaag

SEQ ID NO: 1576050 - RNA, 19 nt, Homo sapiens
aaacaaagccugacucaug

SEQ ID NO: 1576051 - RNA, 19 nt, Homo sapiens
gaagaaguauugcugucaa

SEQ ID NO: 1576052 - RNA, 19 nt, Homo sapiens
ccacaagacuuacauccuu

SEQ ID NO: 1576053 - RNA, 19 nt, Homo sapiens
gccaggagauucagcagua

SEQ ID NO: 1576054 - RNA, 19 nt, Homo sapiens
caaacgagauggaacugaa

SEQ ID NO: 1576055 - RNA, 19 nt, Homo sapiens
ggaccucucgucuuacuua

SEQ ID NO: 1576056 - RNA, 19 nt, Homo sapiens
gugcgcagcuucauuguug

SEQ ID NO: 1576057 - RNA, 19 nt, Homo sapiens
cagcauggauagaauagaa

SEQ ID NO: 1576058 - RNA, 19 nt, Homo sapiens
gcacaaggacugcaaguuc

SEQ ID NO: 1576059 - RNA, 19 nt, Homo sapiens
ggucaucgaugcucacugu

SEQ ID NO: 1576060 - RNA, 19 nt, Homo sapiens
gcaaguuccugauccuaga

SEQ ID NO: 1576061 - RNA, 19 nt, Homo sapiens
gggcgcaguuggucuuuaa

SEQ ID NO: 1576062 - RNA, 19 nt, Homo sapiens
agacaaaggugaccaaguc

SEQ ID NO: 1576063 - RNA, 19 nt, Homo sapiens
ggacagcauggauagaaua

SEQ ID NO: 1576064 - RNA, 19 nt, Homo sapiens
gaauuugcaucuucuucaa

SEQ ID NO: 1576065 - RNA, 19 nt, Homo sapiens
gagcagaccuggacaaaau

SEQ ID NO: 1576066 - RNA, 19 nt, Homo sapiens
aaagcaagcugccuacaau

SEQ ID NO: 1576067 - RNA, 19 nt, Homo sapiens
gagcaaggccucccagguu

SEQ ID NO: 1576068 - RNA, 19 nt, Homo sapiens
aaauugggcugcacaguga

SEQ ID NO: 1576069 - RNA, 19 nt, Homo sapiens
uacauaaacucaacuggaa

SEQ ID NO: 1576070 - RNA, 19 nt, Homo sapiens
ucaaaguuguuuccaauuc

SEQ ID NO: 1576071 - RNA, 19 nt, Homo sapiens
ggacaaggaaggaauaaag

SEQ ID NO: 1576072 - RNA, 19 nt, Homo sapiens
cacaagacuuacauccuua

SEQ ID NO: 1576073 - RNA, 19 nt, Homo sapiens
gaucaucaaguaccaugua

SEQ ID NO: 1576074 - RNA, 19 nt, Homo sapiens
acaguaaccacaagacuua

SEQ ID NO: 1576075 - RNA, 19 nt, Homo sapiens
ugaagucacugagagaauu

SEQ ID NO: 1576076 - RNA, 19 nt, Homo sapiens
gcuccgaggugaaguagga

SEQ ID NO: 1576077 - RNA, 19 nt, Homo sapiens
gcacugcaaauuucuagaa

SEQ ID NO: 1576078 - RNA, 19 nt, Homo sapiens
ggacacagcaucagcucaa

SEQ ID NO: 1576079 - RNA, 19 nt, Homo sapiens
ggaguacccucggaaggaa

SEQ ID NO: 1576080 - RNA, 19 nt, Homo sapiens
gaaaggaaaacucacguua

SEQ ID NO: 1576081 - RNA, 19 nt, Homo sapiens
guauggauguaaccaagaa

SEQ ID NO: 1576082 - RNA, 19 nt, Homo sapiens
uggaugauguuaagcguuu

SEQ ID NO: 1576083 - RNA, 19 nt, Homo sapiens
agaaggagaagaaguauug

SEQ ID NO: 1576084 - RNA, 19 nt, Homo sapiens
gaaaacaucaggagaagaa

SEQ ID NO: 1576085 - RNA, 19 nt, Homo sapiens
gcagagcgaugaccuuuug

SEQ ID NO: 1576086 - RNA, 19 nt, Homo sapiens
auacuagaguucauggaua

SEQ ID NO: 1576087 - RNA, 19 nt, Homo sapiens
ggagccggcuggagaaaca

SEQ ID NO: 1576088 - RNA, 19 nt, Homo sapiens
cuggagaucuggauuacaa

SEQ ID NO: 1576089 - RNA, 19 nt, Homo sapiens
gcagaaggcggcauguaug

SEQ ID NO: 1576090 - RNA, 19 nt, Homo sapiens
gugacaguauuagaucuua

SEQ ID NO: 1576091 - RNA, 19 nt, Homo sapiens
ggaccaggcccauacuaga

SEQ ID NO: 1576092 - RNA, 19 nt, Homo sapiens
caacaccaaugccuacucu

SEQ ID NO: 1576093 - RNA, 19 nt, Homo sapiens
agaauuggaugauguuaag

SEQ ID NO: 1576094 - RNA, 19 nt, Homo sapiens
ggccaugccuccaccucua

SEQ ID NO: 1576095 - RNA, 19 nt, Homo sapiens
ugagagaauugucacugaa

SEQ ID NO: 1576096 - RNA, 19 nt, Homo sapiens
gaugugcgcagcuucauug

SEQ ID NO: 1576097 - RNA, 19 nt, Homo sapiens
gaagaaaacaucaggagaa

SEQ ID NO: 1576098 - RNA, 19 nt, Homo sapiens
cugcagauauccacagcua

SEQ ID NO: 1576099 - RNA, 19 nt, Homo sapiens
gaccaccacugcagauauc

SEQ ID NO: 1576100 - RNA, 19 nt, Homo sapiens
ggaauuugcaucuucuuca

SEQ ID NO: 1576101 - RNA, 19 nt, Homo sapiens
caaaggugaccaagucuau

SEQ ID NO: 1576102 - RNA, 19 nt, Homo sapiens
uggaugagcuggagaggau

SEQ ID NO: 1576103 - RNA, 19 nt, Homo sapiens
gcagauauccacagcuaca

SEQ ID NO: 1576104 - RNA, 19 nt, Homo sapiens
gagagaauugucacugaaa

SEQ ID NO: 1576105 - RNA, 19 nt, Homo sapiens
caagccacguugugagcua

SEQ ID NO: 1576106 - RNA, 19 nt, Homo sapiens
gggagauccuggcauggaa

SEQ ID NO: 1576107 - RNA, 19 nt, Homo sapiens
ccacccagguccacaagga

SEQ ID NO: 1576108 - RNA, 19 nt, Homo sapiens
cggagaaggagaagaagua

SEQ ID NO: 1576109 - RNA, 19 nt, Homo sapiens
guagucgcauucucagcua

SEQ ID NO: 1576110 - RNA, 19 nt, Homo sapiens
ggaccuaucacaacaacau

SEQ ID NO: 1576111 - RNA, 19 nt, Homo sapiens
gggcggagaaggagaagaa

SEQ ID NO: 1576112 - RNA, 19 nt, Homo sapiens
ggacuucuuccaaacuuau

SEQ ID NO: 1576113 - RNA, 19 nt, Homo sapiens
cugaguacaugcagaguga

SEQ ID NO: 1576114 - RNA, 19 nt, Homo sapiens
cccaggacaucaagaaguu

SEQ ID NO: 1576115 - RNA, 19 nt, Homo sapiens
caggcaagaucgugacuuc

SEQ ID NO: 1576116 - RNA, 19 nt, Homo sapiens
ugaaggcgcguguggauga

SEQ ID NO: 1576117 - RNA, 19 nt, Homo sapiens
ggacagcgggaaggucuuu

SEQ ID NO: 1576118 - RNA, 19 nt, Homo sapiens
ggcagcagcggcuacauaa

SEQ ID NO: 1576119 - RNA, 19 nt, Homo sapiens
ucauggauauguuauacug

SEQ ID NO: 1576120 - RNA, 19 nt, Homo sapiens
ugacuuugcuggagaucug

SEQ ID NO: 1576121 - RNA, 19 nt, Homo sapiens
gaucguuccuguccaacuc

SEQ ID NO: 1576122 - RNA, 19 nt, Homo sapiens
gcagagugacaguauuaga

SEQ ID NO: 1576123 - RNA, 19 nt, Homo sapiens
gcucuuggcauuccuagug

SEQ ID NO: 1576124 - RNA, 19 nt, Homo sapiens
cccaagaggugaacaaggu

SEQ ID NO: 1576125 - RNA, 19 nt, Homo sapiens
gcucaucccuccucaacac

SEQ ID NO: 1576126 - RNA, 19 nt, Homo sapiens
uacuagaguucauggauau

SEQ ID NO: 1576127 - RNA, 19 nt, Homo sapiens
ucagcuacaugucgaguuc

SEQ ID NO: 1576128 - RNA, 19 nt, Homo sapiens
gaagucacugagagaauug

SEQ ID NO: 1576129 - RNA, 19 nt, Homo sapiens
aaagacaacacaccugcua

SEQ ID NO: 1576130 - RNA, 19 nt, Homo sapiens
gcacauccuccucaguguu

SEQ ID NO: 1576131 - RNA, 19 nt, Homo sapiens
guucauggauauguuauac

SEQ ID NO: 1576132 - RNA, 19 nt, Homo sapiens
gagaucuggauuacaauga

SEQ ID NO: 1576133 - RNA, 19 nt, Homo sapiens
gaucagcuaccucacaagu

SEQ ID NO: 1576134 - RNA, 19 nt, Homo sapiens
gagcugaguagucgcauuc

SEQ ID NO: 1576135 - RNA, 19 nt, Homo sapiens
gucaguaccuacgucagua

SEQ ID NO: 1576136 - RNA, 19 nt, Homo sapiens
uauuagaucuuaccuaucc

SEQ ID NO: 1576137 - RNA, 19 nt, Homo sapiens
ugagggcaauggacaagga

SEQ ID NO: 1576138 - RNA, 19 nt, Homo sapiens
uccuacagcucuuccauga

SEQ ID NO: 1576139 - RNA, 19 nt, Homo sapiens
agcaguacaucucugagua

SEQ ID NO: 1576140 - RNA, 19 nt, Homo sapiens
ccagggaccucagggacuu

SEQ ID NO: 1576141 - RNA, 19 nt, Homo sapiens
gggacagcauggauagaau

SEQ ID NO: 1576142 - RNA, 19 nt, Homo sapiens
gggagucgaucggcaagug

SEQ ID NO: 1576143 - RNA, 19 nt, Homo sapiens
cagaauuggaugauguuaa

SEQ ID NO: 1576144 - RNA, 19 nt, Homo sapiens
cugagagaauugucacuga

SEQ ID NO: 1576145 - RNA, 19 nt, Homo sapiens
aggaagcccuggcccuaaa

SEQ ID NO: 1576146 - RNA, 19 nt, Homo sapiens
gaggaagcccuggcccuaa

SEQ ID NO: 1576147 - RNA, 19 nt, Homo sapiens
gaaagaaggugguggaauu

SEQ ID NO: 1576148 - RNA, 19 nt, Homo sapiens
ucuaaacgcuuacaacuua

SEQ ID NO: 1576149 - RNA, 19 nt, Homo sapiens
gcaaguaaaucuuaucguu

SEQ ID NO: 1576150 - RNA, 19 nt, Homo sapiens
caagaaacauguugugaaa

SEQ ID NO: 1576151 - RNA, 19 nt, Homo sapiens
gacaucagcugacauauga

SEQ ID NO: 1576152 - RNA, 19 nt, Homo sapiens
acauggagcucucuuaaua

SEQ ID NO: 1576153 - RNA, 19 nt, Homo sapiens
gugcauaccuauaacauuu

SEQ ID NO: 1576154 - RNA, 19 nt, Homo sapiens
gaacacaccugaagaagac

SEQ ID NO: 1576155 - RNA, 19 nt, Homo sapiens
caggauggcuuuggaaaua

SEQ ID NO: 1576156 - RNA, 19 nt, Homo sapiens
acacugggauugagaauuu

SEQ ID NO: 1576157 - RNA, 19 nt, Homo sapiens
acaagaagcagacaauuua

SEQ ID NO: 1576158 - RNA, 19 nt, Homo sapiens
ccucauagcucaagaaaca

SEQ ID NO: 1576159 - RNA, 19 nt, Homo sapiens
ugaggaaugugccuaauuu

SEQ ID NO: 1576160 - RNA, 19 nt, Homo sapiens
ccacuggcaugaauaagua

SEQ ID NO: 1576161 - RNA, 19 nt, Homo sapiens
ccaaaucccuugcaccauu

SEQ ID NO: 1576162 - RNA, 19 nt, Homo sapiens
gcaaaugcauguuaagaag

SEQ ID NO: 1576163 - RNA, 19 nt, Homo sapiens
gugcuuugcucaagaauuu

SEQ ID NO: 1576164 - RNA, 19 nt, Homo sapiens
ucaccuaucucagcaauaa

SEQ ID NO: 1576165 - RNA, 19 nt, Homo sapiens
auaaugagcuugucaccua

SEQ ID NO: 1576166 - RNA, 19 nt, Homo sapiens
ugucaugcauucuuucuua

SEQ ID NO: 1576167 - RNA, 19 nt, Homo sapiens
gcacaaacuuggcauuagu

SEQ ID NO: 1576168 - RNA, 19 nt, Homo sapiens
gaagaacugagcaaacuaa

SEQ ID NO: 1576169 - RNA, 19 nt, Homo sapiens
caagggagaagcaggauua

SEQ ID NO: 1576170 - RNA, 19 nt, Homo sapiens
guaaagaugcuggcuauuu

SEQ ID NO: 1576171 - RNA, 19 nt, Homo sapiens
auacaccacucucauauuu

SEQ ID NO: 1576172 - RNA, 19 nt, Homo sapiens
cuaaacaucucgucaacuu

SEQ ID NO: 1576173 - RNA, 19 nt, Homo sapiens
gagaggaccuguuggagau

SEQ ID NO: 1576174 - RNA, 19 nt, Homo sapiens
gaagaugaauguguagugu

SEQ ID NO: 1576175 - RNA, 19 nt, Homo sapiens
ggacauggagcucucuuaa

SEQ ID NO: 1576176 - RNA, 19 nt, Homo sapiens
gaaccaggauuagauggaa

SEQ ID NO: 1576177 - RNA, 19 nt, Homo sapiens
gcaagccuguggauauuga

SEQ ID NO: 1576178 - RNA, 19 nt, Homo sapiens
ccacagauuucuauaguag

SEQ ID NO: 1576179 - RNA, 19 nt, Homo sapiens
ccuagaagaugaaugugua

SEQ ID NO: 1576180 - RNA, 19 nt, Homo sapiens
ggcaugagcaguuuauaua

SEQ ID NO: 1576181 - RNA, 19 nt, Homo sapiens
caacaaaggagaagaagga

SEQ ID NO: 1576182 - RNA, 19 nt, Homo sapiens
gcacaguacccuuugguuu

SEQ ID NO: 1576183 - RNA, 19 nt, Homo sapiens
uagguaagauuuagccuuu

SEQ ID NO: 1576184 - RNA, 19 nt, Homo sapiens
cuacaauggugcuguguuu

SEQ ID NO: 1576185 - RNA, 19 nt, Homo sapiens
gaauaaguacugcaugaaa

SEQ ID NO: 1576186 - RNA, 19 nt, Homo sapiens
gaaauugcaucuugugacu

SEQ ID NO: 1576187 - RNA, 19 nt, Homo sapiens
gccaggagauguuggauug

SEQ ID NO: 1576188 - RNA, 19 nt, Homo sapiens
cagcaaagcaggaacuuaa

SEQ ID NO: 1576189 - RNA, 19 nt, Homo sapiens
cuacuugcuucaugaauuu

SEQ ID NO: 1576190 - RNA, 19 nt, Homo sapiens
gagcaaacuaacagaaaua

SEQ ID NO: 1576191 - RNA, 19 nt, Homo sapiens
ugacguaacuagagaaaca

SEQ ID NO: 1576192 - RNA, 19 nt, Homo sapiens
caacuuaucugccacucau

SEQ ID NO: 1576193 - RNA, 19 nt, Homo sapiens
ccaaauucauuccauaugu

SEQ ID NO: 1576194 - RNA, 19 nt, Homo sapiens
gggaaaugaugaacaugaa

SEQ ID NO: 1576195 - RNA, 19 nt, Homo sapiens
gcagaaagggcauaaagga

SEQ ID NO: 1576196 - RNA, 19 nt, Homo sapiens
gcuacuugcuucaugaauu

SEQ ID NO: 1576197 - RNA, 19 nt, Homo sapiens
ccaccuaauuuaacacaaa

SEQ ID NO: 1576198 - RNA, 19 nt, Homo sapiens
gcaugaggauguugcagaa

SEQ ID NO: 1576199 - RNA, 19 nt, Homo sapiens
cagcauagccaacuacuga

SEQ ID NO: 1576200 - RNA, 19 nt, Homo sapiens
ggaguaagccaggcauuaa

SEQ ID NO: 1576201 - RNA, 19 nt, Homo sapiens
ggaauacaccaaacucuug

SEQ ID NO: 1576202 - RNA, 19 nt, Homo sapiens
ccauugcucuuguucuuaa

SEQ ID NO: 1576203 - RNA, 19 nt, Homo sapiens
uaaaauacguugucuguga

SEQ ID NO: 1576204 - RNA, 19 nt, Homo sapiens
gcagaauauuccacagauu

SEQ ID NO: 1576205 - RNA, 19 nt, Homo sapiens
caaaauaugucaugcauuc

SEQ ID NO: 1576206 - RNA, 19 nt, Homo sapiens
ggaaagccaggaauaaaug

SEQ ID NO: 1576207 - RNA, 19 nt, Homo sapiens
gugugaauguucccaguua

SEQ ID NO: 1576208 - RNA, 19 nt, Homo sapiens
caagggaaaugaugaacau

SEQ ID NO: 1576209 - RNA, 19 nt, Homo sapiens
ggacaagacagaagaguca

SEQ ID NO: 1576210 - RNA, 19 nt, Homo sapiens
gaauuuguaucuuguaugc

SEQ ID NO: 1576211 - RNA, 19 nt, Homo sapiens
gcagugcagauuucaauuu

SEQ ID NO: 1576212 - RNA, 19 nt, Homo sapiens
caaaagcucuuaaggagaa

SEQ ID NO: 1576213 - RNA, 19 nt, Homo sapiens
gaaaagggaguaucaaauu

SEQ ID NO: 1576214 - RNA, 19 nt, Homo sapiens
gaacaugguaucccaggaa

SEQ ID NO: 1576215 - RNA, 19 nt, Homo sapiens
cuucauaucugccagcaaa

SEQ ID NO: 1576216 - RNA, 19 nt, Homo sapiens
cucaguagcugccauguuu

SEQ ID NO: 1576217 - RNA, 19 nt, Homo sapiens
gaggagaugcagaagauaa

SEQ ID NO: 1576218 - RNA, 19 nt, Homo sapiens
aagauuauaugcaggcuuu

SEQ ID NO: 1576219 - RNA, 19 nt, Homo sapiens
cauuaaggcuugacugguu

SEQ ID NO: 1576220 - RNA, 19 nt, Homo sapiens
aauugcaucuugugacuua

SEQ ID NO: 1576221 - RNA, 19 nt, Homo sapiens
gaagagaggauggcuguau

SEQ ID NO: 1576222 - RNA, 19 nt, Homo sapiens
ggagauguguugaacuaca

SEQ ID NO: 1576223 - RNA, 19 nt, Homo sapiens
ggacaucagcugacauaug

SEQ ID NO: 1576224 - RNA, 19 nt, Homo sapiens
uaucuuguaugccuaugua

SEQ ID NO: 1576225 - RNA, 19 nt, Homo sapiens
uaccaucucugcucacaaa

SEQ ID NO: 1576226 - RNA, 19 nt, Homo sapiens
gaaugugccuaauuuaagg

SEQ ID NO: 1576227 - RNA, 19 nt, Homo sapiens
cuacaucuauccuacuuau

SEQ ID NO: 1576228 - RNA, 19 nt, Homo sapiens
gugcauugcuccuguugaa

SEQ ID NO: 1576229 - RNA, 19 nt, Homo sapiens
cagaauauuccacagauuu

SEQ ID NO: 1576230 - RNA, 19 nt, Homo sapiens
uuuauuaguuggcugguua

SEQ ID NO: 1576231 - RNA, 19 nt, Homo sapiens
cacaaugucuaaacucuau

SEQ ID NO: 1576232 - RNA, 19 nt, Homo sapiens
gaacugagcaaacuaacag

SEQ ID NO: 1576233 - RNA, 19 nt, Homo sapiens
caacaaagggcagcaagaa

SEQ ID NO: 1576234 - RNA, 19 nt, Homo sapiens
ccacaggacuggauaugca

SEQ ID NO: 1576235 - RNA, 19 nt, Homo sapiens
uaucuuaccucaucaaacu

SEQ ID NO: 1576236 - RNA, 19 nt, Homo sapiens
uaaagaugcuggcuauuuu

SEQ ID NO: 1576237 - RNA, 19 nt, Homo sapiens
gugggaggcuucacuaaau

SEQ ID NO: 1576238 - RNA, 19 nt, Homo sapiens
uguuugaguuccaaucuua

SEQ ID NO: 1576239 - RNA, 19 nt, Homo sapiens
ucacccuacucuauuauuu

SEQ ID NO: 1576240 - RNA, 19 nt, Homo sapiens
ggacuucagcucuggguuu

SEQ ID NO: 1576241 - RNA, 19 nt, Homo sapiens
uaagggaggugugaauguu

SEQ ID NO: 1576242 - RNA, 19 nt, Homo sapiens
gagacacuauguauaagau

SEQ ID NO: 1576243 - RNA, 19 nt, Homo sapiens
gagcuauaauccaaacguu

SEQ ID NO: 1576244 - RNA, 19 nt, Homo sapiens
guugggaaccugugauaua

SEQ ID NO: 1576245 - RNA, 19 nt, Homo sapiens
gaguuccaaucuuacauuu

SEQ ID NO: 1576246 - RNA, 19 nt, Homo sapiens
ggaaugugccuaauuuaag

SEQ ID NO: 1576247 - RNA, 19 nt, Homo sapiens
gacaagaaguccuaucguu

SEQ ID NO: 1576248 - RNA, 19 nt, Homo sapiens
ggagaucacguuccugaaa

SEQ ID NO: 1576249 - RNA, 19 nt, Homo sapiens
ggaagcagauggagcaaac

SEQ ID NO: 1576250 - RNA, 19 nt, Homo sapiens
gagggcacguuccauguga

SEQ ID NO: 1576251 - RNA, 19 nt, Homo sapiens
ugaacacggucacggauga

SEQ ID NO: 1576252 - RNA, 19 nt, Homo sapiens
ggacagugauggcgauggu

SEQ ID NO: 1576253 - RNA, 19 nt, Homo sapiens
gcagauggagcaaacguau

SEQ ID NO: 1576254 - RNA, 19 nt, Homo sapiens
gcucagagaggacaaaaua

SEQ ID NO: 1576255 - RNA, 19 nt, Homo sapiens
cagacaaggugguagacaa

SEQ ID NO: 1576256 - RNA, 19 nt, Homo sapiens
cgaguccgcuguaucaaca

SEQ ID NO: 1576257 - RNA, 19 nt, Homo sapiens
cgacuuugaugcagacaag

SEQ ID NO: 1576258 - RNA, 19 nt, Homo sapiens
ggaacgcucuguggcauac

SEQ ID NO: 1576259 - RNA, 19 nt, Homo sapiens
ggguuacacugccuucaau

SEQ ID NO: 1576260 - RNA, 19 nt, Homo sapiens
uaugcgggcuucaucuuug

SEQ ID NO: 1576261 - RNA, 19 nt, Homo sapiens
gagaucacguuccugaaaa

SEQ ID NO: 1576262 - RNA, 19 nt, Homo sapiens
ugugagaccgggcaacaua

SEQ ID NO: 1576263 - RNA, 19 nt, Homo sapiens
cgacaccgccugcguucuu

SEQ ID NO: 1576264 - RNA, 19 nt, Homo sapiens
ggaugccugugacaacugu

SEQ ID NO: 1576265 - RNA, 19 nt, Homo sapiens
gcacugcaccgacgucaac

SEQ ID NO: 1576266 - RNA, 19 nt, Homo sapiens
gagccuggcauccaacuca

SEQ ID NO: 1576267 - RNA, 19 nt, Homo sapiens
gagaucgugcagacaauga

SEQ ID NO: 1576268 - RNA, 19 nt, Homo sapiens
ccaacuggguggugcucaa

SEQ ID NO: 1576269 - RNA, 19 nt, Homo sapiens
cgacgacgacgacgacaau

SEQ ID NO: 1576270 - RNA, 19 nt, Homo sapiens
gagggugacgcgcagauug

SEQ ID NO: 1576271 - RNA, 19 nt, Homo sapiens
gcagaugcuucgggaacug

SEQ ID NO: 1576272 - RNA, 19 nt, Homo sapiens
gcaaccaggccgacaacug

SEQ ID NO: 1576273 - RNA, 19 nt, Homo sapiens
gaagaacgacgaccaaaag

SEQ ID NO: 1576274 - RNA, 19 nt, Homo sapiens
gggagaucgugcagacaau

SEQ ID NO: 1576275 - RNA, 19 nt, Homo sapiens
ggaaggacccgcgaaacgu

SEQ ID NO: 1576276 - RNA, 19 nt, Homo sapiens
agauggagcaaacguauug

SEQ ID NO: 1576277 - RNA, 19 nt, Homo sapiens
ucaauggcguggacuucga

SEQ ID NO: 1576278 - RNA, 19 nt, Homo sapiens
cgacagcaacguggucuug

SEQ ID NO: 1576279 - RNA, 19 nt, Homo sapiens
caucagggugcgauucuau

SEQ ID NO: 1576280 - RNA, 19 nt, Homo sapiens
ggaggacucagaccacgau

SEQ ID NO: 1576281 - RNA, 19 nt, Homo sapiens
gcaacacggacgaggacaa

SEQ ID NO: 1576282 - RNA, 19 nt, Homo sapiens
acaaggugguagacaagau

SEQ ID NO: 1576283 - RNA, 19 nt, Homo sapiens
gaccagaaggacagugaug

SEQ ID NO: 1576284 - RNA, 19 nt, Homo sapiens
ccagaagaacgacgaccaa

SEQ ID NO: 1576285 - RNA, 19 nt, Homo sapiens
cguuaccgcugcaaugaca

SEQ ID NO: 1576286 - RNA, 19 nt, Homo sapiens
acucaaggcugugaagucu

SEQ ID NO: 1576287 - RNA, 19 nt, Homo sapiens
ggagaucgugcagacaaug

SEQ ID NO: 1576288 - RNA, 19 nt, Homo sapiens
acagcaacguggucuugga

SEQ ID NO: 1576289 - RNA, 19 nt, Homo sapiens
ucagggugcgauucuauga

SEQ ID NO: 1576290 - RNA, 19 nt, Homo sapiens
gugagaccgggcaacauaa

SEQ ID NO: 1576291 - RNA, 19 nt, Homo sapiens
gacaucaacgagugugaga

SEQ ID NO: 1576292 - RNA, 19 nt, Homo sapiens
ucagagaggacaaaauaaa

SEQ ID NO: 1576293 - RNA, 19 nt, Homo sapiens
gcuucuacguggucaugug

SEQ ID NO: 1576294 - RNA, 19 nt, Homo sapiens
cagaagaacgacgaccaaa

SEQ ID NO: 1576295 - RNA, 19 nt, Homo sapiens
cgacuaugcgggcuucauc

SEQ ID NO: 1576296 - RNA, 19 nt, Homo sapiens
ggagggugacgcgcagauu

SEQ ID NO: 1576297 - RNA, 19 nt, Homo sapiens
ugacggagucccugacagu

SEQ ID NO: 1576298 - RNA, 19 nt, Homo sapiens
agacggacaucaggacucu

SEQ ID NO: 1576299 - RNA, 19 nt, Homo sapiens
ucagggagaucacguuccu

SEQ ID NO: 1576300 - RNA, 19 nt, Homo sapiens
gaaacguggguuggaagga

SEQ ID NO: 1576301 - RNA, 19 nt, Homo sapiens
gggaacugcaggaaaccaa

SEQ ID NO: 1576302 - RNA, 19 nt, Homo sapiens
cuucagggccuuccagaca

SEQ ID NO: 1576303 - RNA, 19 nt, Homo sapiens
cagaccagaaggacaguga

SEQ ID NO: 1576304 - RNA, 19 nt, Homo sapiens
caacacggacgaggacaag

SEQ ID NO: 1576305 - RNA, 19 nt, Homo sapiens
ccaacuccgugugcaucaa

SEQ ID NO: 1576306 - RNA, 19 nt, Homo sapiens
caaggugguagacaagauc

SEQ ID NO: 1576307 - RNA, 19 nt, Homo sapiens
caacguggucuuggacaca

SEQ ID NO: 1576308 - RNA, 19 nt, Homo sapiens
cuaugcgggcuucaucuuu

SEQ ID NO: 1576309 - RNA, 19 nt, Homo sapiens
agacaagaucgacgugugu

SEQ ID NO: 1576310 - RNA, 19 nt, Homo sapiens
ccaggacgacuuugaugca

SEQ ID NO: 1576311 - RNA, 19 nt, Homo sapiens
gaacgugggcgacaagaaa

SEQ ID NO: 1576312 - RNA, 19 nt, Homo sapiens
gcucagaggugcuuugaag

SEQ ID NO: 1576313 - RNA, 19 nt, Homo sapiens
gaaauaacaucugcuuugc

SEQ ID NO: 1576314 - RNA, 19 nt, Homo sapiens
gaacugcaacacuggauug

SEQ ID NO: 1576315 - RNA, 19 nt, Homo sapiens
ggauuucgcuggcgugaag

SEQ ID NO: 1576316 - RNA, 19 nt, Homo sapiens
ggcuagcuauauuaucuua

SEQ ID NO: 1576317 - RNA, 19 nt, Homo sapiens
uaaccucucugaacugcaa

SEQ ID NO: 1576318 - RNA, 19 nt, Homo sapiens
agaaauaacaucugcuuug

SEQ ID NO: 1576319 - RNA, 19 nt, Homo sapiens
gaagaagaaguaugaugug

SEQ ID NO: 1576320 - RNA, 19 nt, Homo sapiens
gaucguggacgccgugauu

SEQ ID NO: 1576321 - RNA, 19 nt, Homo sapiens
ggagaaggccaucuacaag

SEQ ID NO: 1576322 - RNA, 19 nt, Homo sapiens
gcuccgggcuguguccuaa

SEQ ID NO: 1576323 - RNA, 19 nt, Homo sapiens
gggcgaggcucaucaccau

SEQ ID NO: 1576324 - RNA, 19 nt, Homo sapiens
ugaagaagaaguaugaugu

SEQ ID NO: 1576325 - RNA, 19 nt, Homo sapiens
gagaaauaacaucugcuuu

SEQ ID NO: 1576326 - RNA, 19 nt, Homo sapiens
acucaaucaugacuucuuu

SEQ ID NO: 1576327 - RNA, 19 nt, Homo sapiens
acacuggcuagcuauauua

SEQ ID NO: 1576328 - RNA, 19 nt, Homo sapiens
caugacuucuuuacuaaca

SEQ ID NO: 1576329 - RNA, 19 nt, Homo sapiens
gcacacacuaccaaucguu

SEQ ID NO: 1576330 - RNA, 19 nt, Homo sapiens
cagaaggagugggccauga

SEQ ID NO: 1576331 - RNA, 19 nt, Homo sapiens
cagaggugcuuugaagaug

SEQ ID NO: 1576332 - RNA, 19 nt, Homo sapiens
gcuguguccuaaaugcaaa

SEQ ID NO: 1576333 - RNA, 19 nt, Homo sapiens
uacuaacacuggcuagcua

SEQ ID NO: 1576334 - RNA, 19 nt, Homo sapiens
ggccuacuguggcuacuca

SEQ ID NO: 1576335 - RNA, 19 nt, Homo sapiens
aacacuggcuagcuauauu

SEQ ID NO: 1576336 - RNA, 19 nt, Homo sapiens
uaacacuggcuagcuauau

SEQ ID NO: 1576337 - RNA, 19 nt, Homo sapiens
cccagcggaugguggauuu

SEQ ID NO: 1576338 - RNA, 19 nt, Homo sapiens
gcucaucaccaucgagauc

SEQ ID NO: 1576339 - RNA, 19 nt, Homo sapiens
uggaggccauugacaccua

SEQ ID NO: 1576340 - RNA, 19 nt, Homo sapiens
gacaugcuaaccucucuga

SEQ ID NO: 1576341 - RNA, 19 nt, Homo sapiens
uggagaaggccaucuacaa

SEQ ID NO: 1576342 - RNA, 19 nt, Homo sapiens
cuggcuagcuauauuaucu

SEQ ID NO: 1576343 - RNA, 19 nt, Homo sapiens
aagacucaaucaugacuuc

SEQ ID NO: 1576344 - RNA, 19 nt, Homo sapiens
ucagaggugcuuugaagau

SEQ ID NO: 1576345 - RNA, 19 nt, Homo sapiens
cgacaagaaaggcaagauc

SEQ ID NO: 1576346 - RNA, 19 nt, Homo sapiens
agagaaauaacaucugcuu

SEQ ID NO: 1576347 - RNA, 19 nt, Homo sapiens
ccugcgcccugacaugcua

SEQ ID NO: 1576348 - RNA, 19 nt, Homo sapiens
gugcugcugcugcuucuga

SEQ ID NO: 1576349 - RNA, 19 nt, Homo sapiens
agaaggagugggccaugaa

SEQ ID NO: 1576350 - RNA, 19 nt, Homo sapiens
ccaugaacgugggcgacaa

SEQ ID NO: 1576351 - RNA, 19 nt, Homo sapiens
cuaacacuggcuagcuaua

SEQ ID NO: 1576352 - RNA, 19 nt, Homo sapiens
gaaggagugggccaugaac

SEQ ID NO: 1576353 - RNA, 19 nt, Homo sapiens
ugacuucuuuacuaacacu

SEQ ID NO: 1576354 - RNA, 19 nt, Homo sapiens
gaacgugggcgacaagaaa

SEQ ID NO: 1576355 - RNA, 19 nt, Homo sapiens
gaacugcaacacuggauug

SEQ ID NO: 1576356 - RNA, 19 nt, Homo sapiens
ggauuucgcuggcgugaag

SEQ ID NO: 1576357 - RNA, 19 nt, Homo sapiens
ggcuagcuauauuaucuua

SEQ ID NO: 1576358 - RNA, 19 nt, Homo sapiens
uaaccucucugaacugcaa

SEQ ID NO: 1576359 - RNA, 19 nt, Homo sapiens
gaagaagaaguaugaugug

SEQ ID NO: 1576360 - RNA, 19 nt, Homo sapiens
gaucguggacgccgugauu

SEQ ID NO: 1576361 - RNA, 19 nt, Homo sapiens
ggagaaggccaucuacaag

SEQ ID NO: 1576362 - RNA, 19 nt, Homo sapiens
gcuccgggcuguguccuaa

SEQ ID NO: 1576363 - RNA, 19 nt, Homo sapiens
gggcgaggcucaucaccau

SEQ ID NO: 1576364 - RNA, 19 nt, Homo sapiens
ugaagaagaaguaugaugu

SEQ ID NO: 1576365 - RNA, 19 nt, Homo sapiens
acucaaucaugacuucuuu

SEQ ID NO: 1576366 - RNA, 19 nt, Homo sapiens
acacuggcuagcuauauua

SEQ ID NO: 1576367 - RNA, 19 nt, Homo sapiens
caugacuucuuuacuaaca

SEQ ID NO: 1576368 - RNA, 19 nt, Homo sapiens
gcacacacuaccaaucguu

SEQ ID NO: 1576369 - RNA, 19 nt, Homo sapiens
cagaaggagugggccauga

SEQ ID NO: 1576370 - RNA, 19 nt, Homo sapiens
gcuguguccuaaaugcaaa

SEQ ID NO: 1576371 - RNA, 19 nt, Homo sapiens
uacuaacacuggcuagcua

SEQ ID NO: 1576372 - RNA, 19 nt, Homo sapiens
ggccuacuguggcuacuca

SEQ ID NO: 1576373 - RNA, 19 nt, Homo sapiens
aacacuggcuagcuauauu

SEQ ID NO: 1576374 - RNA, 19 nt, Homo sapiens
uaacacuggcuagcuauau

SEQ ID NO: 1576375 - RNA, 19 nt, Homo sapiens
cccagcggaugguggauuu

SEQ ID NO: 1576376 - RNA, 19 nt, Homo sapiens
gcucaucaccaucgagauc

SEQ ID NO: 1576377 - RNA, 19 nt, Homo sapiens
uggaggccauugacaccua

SEQ ID NO: 1576378 - RNA, 19 nt, Homo sapiens
gacaugcuaaccucucuga

SEQ ID NO: 1576379 - RNA, 19 nt, Homo sapiens
uggagaaggccaucuacaa

SEQ ID NO: 1576380 - RNA, 19 nt, Homo sapiens
cuggcuagcuauauuaucu

SEQ ID NO: 1576381 - RNA, 19 nt, Homo sapiens
aagacucaaucaugacuuc

SEQ ID NO: 1576382 - RNA, 19 nt, Homo sapiens
cgacaagaaaggcaagauc

SEQ ID NO: 1576383 - RNA, 19 nt, Homo sapiens
ccugcgcccugacaugcua

SEQ ID NO: 1576384 - RNA, 19 nt, Homo sapiens
gugcugcugcugcuucuga

SEQ ID NO: 1576385 - RNA, 19 nt, Homo sapiens
agaaggagugggccaugaa

SEQ ID NO: 1576386 - RNA, 19 nt, Homo sapiens
ccaugaacgugggcgacaa

SEQ ID NO: 1576387 - RNA, 19 nt, Homo sapiens
cuaacacuggcuagcuaua

SEQ ID NO: 1576388 - RNA, 19 nt, Homo sapiens
gaaggagugggccaugaac

SEQ ID NO: 1576389 - RNA, 19 nt, Homo sapiens
ugacuucuuuacuaacacu

SEQ ID NO: 1576390 - RNA, 19 nt, Homo sapiens
ggaagaagcugcccaaaga

SEQ ID NO: 1576391 - RNA, 19 nt, Homo sapiens
ggagaugacuauaagauua

SEQ ID NO: 1576392 - RNA, 19 nt, Homo sapiens
gcaaagaugugauugguuu

SEQ ID NO: 1576393 - RNA, 19 nt, Homo sapiens
ucaagaaucugaagaauga

SEQ ID NO: 1576394 - RNA, 19 nt, Homo sapiens
caagacagcugccaccuuu

SEQ ID NO: 1576395 - RNA, 19 nt, Homo sapiens
uaacagggcacaaccauua

SEQ ID NO: 1576396 - RNA, 19 nt, Homo sapiens
acucagaucugguguaaua

SEQ ID NO: 1576397 - RNA, 19 nt, Homo sapiens
gacaagaacugcugggaaa

SEQ ID NO: 1576398 - RNA, 19 nt, Homo sapiens
gcaauaugcuacacuaugu

SEQ ID NO: 1576399 - RNA, 19 nt, Homo sapiens
caacucagaucugguguaa

SEQ ID NO: 1576400 - RNA, 19 nt, Homo sapiens
gugaagaucuggcgcauga

SEQ ID NO: 1576401 - RNA, 19 nt, Homo sapiens
gaaaggagcaggauguaau

SEQ ID NO: 1576402 - RNA, 19 nt, Homo sapiens
gcauucaacugagaucaua

SEQ ID NO: 1576403 - RNA, 19 nt, Homo sapiens
ugacagagauuggcaaaga

SEQ ID NO: 1576404 - RNA, 19 nt, Homo sapiens
caaacuggaugcuuuaugu

SEQ ID NO: 1576405 - RNA, 19 nt, Homo sapiens
gcagagaccaugaucguuu

SEQ ID NO: 1576406 - RNA, 19 nt, Homo sapiens
ggagcaggauguaauaaau

SEQ ID NO: 1576407 - RNA, 19 nt, Homo sapiens
gauggacauuuguuuagua

SEQ ID NO: 1576408 - RNA, 19 nt, Homo sapiens
ccaaagcacuggaugacaa

SEQ ID NO: 1576409 - RNA, 19 nt, Homo sapiens
gaagggcuauccugaagug

SEQ ID NO: 1576410 - RNA, 19 nt, Homo sapiens
caagcaaccacaucaaaua

SEQ ID NO: 1576411 - RNA, 19 nt, Homo sapiens
gaacauucgugucaagagu

SEQ ID NO: 1576412 - RNA, 19 nt, Homo sapiens
gugaagauuucuaaaguga

SEQ ID NO: 1576413 - RNA, 19 nt, Homo sapiens
gaucaguccucugcaguuu

SEQ ID NO: 1576414 - RNA, 19 nt, Homo sapiens
gccagucuauuauugcuua

SEQ ID NO: 1576415 - RNA, 19 nt, Homo sapiens
caacagcuccaaagaugua

SEQ ID NO: 1576416 - RNA, 19 nt, Homo sapiens
caccacaguuggcaaauuu

SEQ ID NO: 1576417 - RNA, 19 nt, Homo sapiens
uacaagagcuagcaaucua

SEQ ID NO: 1576418 - RNA, 19 nt, Homo sapiens
gagcaggauguaauaaaua

SEQ ID NO: 1576419 - RNA, 19 nt, Homo sapiens
ccuaccagcucaauuauga

SEQ ID NO: 1576420 - RNA, 19 nt, Homo sapiens
ccacugaguucaaauucaa

SEQ ID NO: 1576421 - RNA, 19 nt, Homo sapiens
ugagagauguuaaccaaau

SEQ ID NO: 1576422 - RNA, 19 nt, Homo sapiens
gaagaagggcuauccugaa

SEQ ID NO: 1576423 - RNA, 19 nt, Homo sapiens
ggugaggaaugccaaacua

SEQ ID NO: 1576424 - RNA, 19 nt, Homo sapiens
gugaguacauuguggguuu

SEQ ID NO: 1576425 - RNA, 19 nt, Homo sapiens
gaacaaguccaacucagau

SEQ ID NO: 1576426 - RNA, 19 nt, Homo sapiens
ucuuaucacuggcaacuua

SEQ ID NO: 1576427 - RNA, 19 nt, Homo sapiens
cuaguuggccagucuauua

SEQ ID NO: 1576428 - RNA, 19 nt, Homo sapiens
gaucaagaaucugaagaau

SEQ ID NO: 1576429 - RNA, 19 nt, Homo sapiens
gcggagugguuccaaguuu

SEQ ID NO: 1576430 - RNA, 19 nt, Homo sapiens
ggacugggguucagacuuu

SEQ ID NO: 1576431 - RNA, 19 nt, Homo sapiens
gagagauguuaaccaaauu

SEQ ID NO: 1576432 - RNA, 19 nt, Homo sapiens
aaauuagccuggcauggua

SEQ ID NO: 1576433 - RNA, 19 nt, Homo sapiens
gcugugggccugaagcuua

SEQ ID NO: 1576434 - RNA, 19 nt, Homo sapiens
gcacucucauugacaaguu

SEQ ID NO: 1576435 - RNA, 19 nt, Homo sapiens
ggagguggcugggauguag

SEQ ID NO: 1576436 - RNA, 19 nt, Homo sapiens
ggauaccaauuggccuuua

SEQ ID NO: 1576437 - RNA, 19 nt, Homo sapiens
ugucaaggaccgauucuua

SEQ ID NO: 1576438 - RNA, 19 nt, Homo sapiens
gaucagaccauccgagugu

SEQ ID NO: 1576439 - RNA, 19 nt, Homo sapiens
uaugagagcuucuugaaaa

SEQ ID NO: 1576440 - RNA, 19 nt, Homo sapiens
guucggcuccugucuguua

SEQ ID NO: 1576441 - RNA, 19 nt, Homo sapiens
gcacacugcggguuauuga

SEQ ID NO: 1576442 - RNA, 19 nt, Homo sapiens
gagaucauaccacuucauu

SEQ ID NO: 1576443 - RNA, 19 nt, Homo sapiens
cagagaaugugucuauauc

SEQ ID NO: 1576444 - RNA, 19 nt, Homo sapiens
ggacaauaaacaagagauu

SEQ ID NO: 1576445 - RNA, 19 nt, Homo sapiens
uugcuuaucuccagaagaa

SEQ ID NO: 1576446 - RNA, 19 nt, Homo sapiens
cagaaaauaugaugaggua

SEQ ID NO: 1576447 - RNA, 19 nt, Homo sapiens
cauucgaacucuggauuua

SEQ ID NO: 1576448 - RNA, 19 nt, Homo sapiens
gcaaccacaucaaauaugc

SEQ ID NO: 1576449 - RNA, 19 nt, Homo sapiens
gugaugagaucuucuaugc

SEQ ID NO: 1576450 - RNA, 19 nt, Homo sapiens
gaguugauccucagcaauu

SEQ ID NO: 1576451 - RNA, 19 nt, Homo sapiens
gcgcaugaaugaaucaaag

SEQ ID NO: 1576452 - RNA, 19 nt, Homo sapiens
gaccuuggauccugacuag

SEQ ID NO: 1576453 - RNA, 19 nt, Homo sapiens
ccugagagauguuaaccaa

SEQ ID NO: 1576454 - RNA, 19 nt, Homo sapiens
ucucauauuucucacacua

SEQ ID NO: 1576455 - RNA, 19 nt, Homo sapiens
ggaacaaguccaacucaga

SEQ ID NO: 1576456 - RNA, 19 nt, Homo sapiens
caaaguuuccuuccuguau

SEQ ID NO: 1576457 - RNA, 19 nt, Homo sapiens
gugguaugauuguguuuaa

SEQ ID NO: 1576458 - RNA, 19 nt, Homo sapiens
caaacuaguuggccagucu

SEQ ID NO: 1576459 - RNA, 19 nt, Homo sapiens
gcagcuuucuuuccuguca

SEQ ID NO: 1576460 - RNA, 19 nt, Homo sapiens
caucauaucggcccaucua

SEQ ID NO: 1576461 - RNA, 19 nt, Homo sapiens
gagaagaaucccacagaug

SEQ ID NO: 1576462 - RNA, 19 nt, Homo sapiens
ggaugaagauggguuugug

SEQ ID NO: 1576463 - RNA, 19 nt, Homo sapiens
gcagaugaucgucaaguga

SEQ ID NO: 1576464 - RNA, 19 nt, Homo sapiens
gaaccuguguuuguguguu

SEQ ID NO: 1576465 - RNA, 19 nt, Homo sapiens
caaguuugaugaacaugau

SEQ ID NO: 1576466 - RNA, 19 nt, Homo sapiens
cagcagcucaucaccauuu

SEQ ID NO: 1576467 - RNA, 19 nt, Homo sapiens
gauaccaauuggccuuuau

SEQ ID NO: 1576468 - RNA, 19 nt, Homo sapiens
caacugugaugagaucuuc

SEQ ID NO: 1576469 - RNA, 19 nt, Homo sapiens
ccaaagauguagcugugau

SEQ ID NO: 1576470 - RNA, 19 nt, Homo sapiens
caccaacucuuaaucaucu

SEQ ID NO: 1576471 - RNA, 19 nt, Homo sapiens
ccuaaaaccuaguaucuuu

SEQ ID NO: 1576472 - RNA, 19 nt, Homo sapiens
ggcaggcucuuucgaaaca

SEQ ID NO: 1576473 - RNA, 19 nt, Homo sapiens
ggagacaaucccagacauu

SEQ ID NO: 1576474 - RNA, 19 nt, Homo sapiens
gaggaaugccaaacuaguu

SEQ ID NO: 1576475 - RNA, 19 nt, Homo sapiens
acagaagacuugguaguau

SEQ ID NO: 1576476 - RNA, 19 nt, Homo sapiens
gcauugacuuccauaagca

SEQ ID NO: 1576477 - RNA, 19 nt, Homo sapiens
gcuccuucaugaccaagua

SEQ ID NO: 1576478 - RNA, 19 nt, Homo sapiens
gaugaagauugcugagauc

SEQ ID NO: 1576479 - RNA, 19 nt, Homo sapiens
uaaccaaauucgagaccaa

SEQ ID NO: 1576480 - RNA, 19 nt, Homo sapiens
gaagaucuggcgcaugaau

SEQ ID NO: 1576481 - RNA, 19 nt, Homo sapiens
uaucggaugugcacucuca

SEQ ID NO: 1576482 - RNA, 19 nt, Homo sapiens
gacuacaguugugcucaua

SEQ ID NO: 1576483 - RNA, 19 nt, Homo sapiens
ugacauuugugcugcauca

SEQ ID NO: 1576484 - RNA, 19 nt, Homo sapiens
gcacaaccccuuugacauu

SEQ ID NO: 1576485 - RNA, 19 nt, Homo sapiens
gcuaccagcucaccacagu

SEQ ID NO: 1576486 - RNA, 19 nt, Homo sapiens
gauccugacuaguuuacau

SEQ ID NO: 1576487 - RNA, 19 nt, Homo sapiens
uggcugggauguagaagaa

SEQ ID NO: 1576488 - RNA, 19 nt, Homo sapiens
cugcugacauugacauuga

SEQ ID NO: 1576489 - RNA, 19 nt, Homo sapiens
ucccagacauugacccuaa

SEQ ID NO: 1576490 - RNA, 19 nt, Homo sapiens
gaaagaagcuggugaauua

SEQ ID NO: 1576491 - RNA, 19 nt, Homo sapiens
gaagagaaauuaucccaaa

SEQ ID NO: 1576492 - RNA, 19 nt, Homo sapiens
gaaccaccaucugaaauua

SEQ ID NO: 1576493 - RNA, 19 nt, Homo sapiens
ggaauggccuuaagucuug

SEQ ID NO: 1576494 - RNA, 19 nt, Homo sapiens
gaucuugucucuucuagaa

SEQ ID NO: 1576495 - RNA, 19 nt, Homo sapiens
gcaacuaacugcuaagaau

SEQ ID NO: 1576496 - RNA, 19 nt, Homo sapiens
gaaauugguuacugaaaug

SEQ ID NO: 1576497 - RNA, 19 nt, Homo sapiens
ccuugaagcuuuacaguua

SEQ ID NO: 1576498 - RNA, 19 nt, Homo sapiens
cauguuaucugcuaaacua

SEQ ID NO: 1576499 - RNA, 19 nt, Homo sapiens
ggauggagauuucuuuguu

SEQ ID NO: 1576500 - RNA, 19 nt, Homo sapiens
gcaugaagauacugacaaa

SEQ ID NO: 1576501 - RNA, 19 nt, Homo sapiens
ugacagaaauugugugguu

SEQ ID NO: 1576502 - RNA, 19 nt, Homo sapiens
caaaguagcaucaacagaa

SEQ ID NO: 1576503 - RNA, 19 nt, Homo sapiens
ccacaacucugaccaagau

SEQ ID NO: 1576504 - RNA, 19 nt, Homo sapiens
agacagaccucccuugaga

SEQ ID NO: 1576505 - RNA, 19 nt, Homo sapiens
ggagagaucccaauuguag

SEQ ID NO: 1576506 - RNA, 19 nt, Homo sapiens
cgacacagcuauguuagaa

SEQ ID NO: 1576507 - RNA, 19 nt, Homo sapiens
ccucaugacuucgcaaaua

SEQ ID NO: 1576508 - RNA, 19 nt, Homo sapiens
uauaaggucugucaugcua

SEQ ID NO: 1576509 - RNA, 19 nt, Homo sapiens
cuacuuacagcacauauua

SEQ ID NO: 1576510 - RNA, 19 nt, Homo sapiens
gaagacagaccucccuuga

SEQ ID NO: 1576511 - RNA, 19 nt, Homo sapiens
ugagaaugcuuauuguuga

SEQ ID NO: 1576512 - RNA, 19 nt, Homo sapiens
caucuaaacuuaacaaggu

SEQ ID NO: 1576513 - RNA, 19 nt, Homo sapiens
agaaagagcucguuuuauu

SEQ ID NO: 1576514 - RNA, 19 nt, Homo sapiens
cagaauugcuagaaccuuu

SEQ ID NO: 1576515 - RNA, 19 nt, Homo sapiens
gaaaacaaagugacaguua

SEQ ID NO: 1576516 - RNA, 19 nt, Homo sapiens
gaauugcacauuagaacua

SEQ ID NO: 1576517 - RNA, 19 nt, Homo sapiens
ugucaaggauugguuauaa

SEQ ID NO: 1576518 - RNA, 19 nt, Homo sapiens
gacugaagcuuugaagaaa

SEQ ID NO: 1576519 - RNA, 19 nt, Homo sapiens
uaauuuagguaugggcuua

SEQ ID NO: 1576520 - RNA, 19 nt, Homo sapiens
ggagagcgacaacaaugua

SEQ ID NO: 1576521 - RNA, 19 nt, Homo sapiens
cuaagaagccaauuacuga

SEQ ID NO: 1576522 - RNA, 19 nt, Homo sapiens
caagaaagaggaagacaga

SEQ ID NO: 1576523 - RNA, 19 nt, Homo sapiens
uugaagagcugguuauugu

SEQ ID NO: 1576524 - RNA, 19 nt, Homo sapiens
gcuguuaccggccauauaa

SEQ ID NO: 1576525 - RNA, 19 nt, Homo sapiens
aaaguagcaucaacagaaa

SEQ ID NO: 1576526 - RNA, 19 nt, Homo sapiens
uuaacaaggucacccaauu

SEQ ID NO: 1576527 - RNA, 19 nt, Homo sapiens
gcuauuaaaucugucaaga

SEQ ID NO: 1576528 - RNA, 19 nt, Homo sapiens
gagcacaccagacuuagaa

SEQ ID NO: 1576529 - RNA, 19 nt, Homo sapiens
uuuauucgcugcaucuaua

SEQ ID NO: 1576530 - RNA, 19 nt, Homo sapiens
agauauggcugcaaauguu

SEQ ID NO: 1576531 - RNA, 19 nt, Homo sapiens
acacagcuauguuagaaga

SEQ ID NO: 1576532 - RNA, 19 nt, Homo sapiens
cagaaaggaucuucaacau

SEQ ID NO: 1576533 - RNA, 19 nt, Homo sapiens
gcaaagagccagggaaugg

SEQ ID NO: 1576534 - RNA, 19 nt, Homo sapiens
gauggagauuucuuuguug

SEQ ID NO: 1576535 - RNA, 19 nt, Homo sapiens
gaagaagaaauaacuguag

SEQ ID NO: 1576536 - RNA, 19 nt, Homo sapiens
uaauggaauuucucaguga

SEQ ID NO: 1576537 - RNA, 19 nt, Homo sapiens
ugaagcugcugggacauua

SEQ ID NO: 1576538 - RNA, 19 nt, Homo sapiens
ggaucacacuaucaagaaa

SEQ ID NO: 1576539 - RNA, 19 nt, Homo sapiens
agaaugaaaugaacugcaa

SEQ ID NO: 1576540 - RNA, 19 nt, Homo sapiens
caucgacacagcuauguua

SEQ ID NO: 1576541 - RNA, 19 nt, Homo sapiens
uauagaaucugaguucaug

SEQ ID NO: 1576542 - RNA, 19 nt, Homo sapiens
gauaaccugagaaugcuua

SEQ ID NO: 1576543 - RNA, 19 nt, Homo sapiens
gauauggcugcaaauguua

SEQ ID NO: 1576544 - RNA, 19 nt, Homo sapiens
gguuauggauauccuaaga

SEQ ID NO: 1576545 - RNA, 19 nt, Homo sapiens
gaugugggccgaauuugaa

SEQ ID NO: 1576546 - RNA, 19 nt, Homo sapiens
gcaaggaagaucaguuuca

SEQ ID NO: 1576547 - RNA, 19 nt, Homo sapiens
aaagaggaaugugacagua

SEQ ID NO: 1576548 - RNA, 19 nt, Homo sapiens
caaauguuauuccuguguu

SEQ ID NO: 1576549 - RNA, 19 nt, Homo sapiens
gaauguucaccuuuaauga

SEQ ID NO: 1576550 - RNA, 19 nt, Homo sapiens
ugaagauacugacaaauac

SEQ ID NO: 1576551 - RNA, 19 nt, Homo sapiens
gugauacuuugcagaauug

SEQ ID NO: 1576552 - RNA, 19 nt, Homo sapiens
uaacaaggucacccaauug

SEQ ID NO: 1576553 - RNA, 19 nt, Homo sapiens
gaagacauucagaguguga

SEQ ID NO: 1576554 - RNA, 19 nt, Homo sapiens
gaggaucuacucuucguuu

SEQ ID NO: 1576555 - RNA, 19 nt, Homo sapiens
gcucaguguuacauugauu

SEQ ID NO: 1576556 - RNA, 19 nt, Homo sapiens
cagcacauauuaaagucaa

SEQ ID NO: 1576557 - RNA, 19 nt, Homo sapiens
gcaagugacagaaauugug

SEQ ID NO: 1576558 - RNA, 19 nt, Homo sapiens
gcugaugucuuggaguuug

SEQ ID NO: 1576559 - RNA, 19 nt, Homo sapiens
caaaaggaaugcauuuaug

SEQ ID NO: 1576560 - RNA, 19 nt, Homo sapiens
ucugaaugcuguccucaaa

SEQ ID NO: 1576561 - RNA, 19 nt, Homo sapiens
gagcagcaagugacagaaa

SEQ ID NO: 1576562 - RNA, 19 nt, Homo sapiens
ucucacauguuaucugcua

SEQ ID NO: 1576563 - RNA, 19 nt, Homo sapiens
gaugauguggaucgaauuu

SEQ ID NO: 1576564 - RNA, 19 nt, Homo sapiens
gaaugcuuauuguugagaa

SEQ ID NO: 1576565 - RNA, 19 nt, Homo sapiens
uaauuaacgugccaaugga

SEQ ID NO: 1576566 - RNA, 19 nt, Homo sapiens
aaggagauguaaagucaaa

SEQ ID NO: 1576567 - RNA, 19 nt, Homo sapiens
cuccugaacugauacauga

SEQ ID NO: 1576568 - RNA, 19 nt, Homo sapiens
ugaaugcuguccucaaagu

SEQ ID NO: 1576569 - RNA, 19 nt, Homo sapiens
gggaauggccuuaagucuu

SEQ ID NO: 1576570 - RNA, 19 nt, Homo sapiens
gcagaauuccgucagaugu

SEQ ID NO: 1576571 - RNA, 19 nt, Homo sapiens
gucccuuucucacauguua

SEQ ID NO: 1576572 - RNA, 19 nt, Homo sapiens
gcagacagucccuuucuca

SEQ ID NO: 1576573 - RNA, 19 nt, Homo sapiens
gaaugcagacagucccuuu

SEQ ID NO: 1576574 - RNA, 19 nt, Homo sapiens
aaaaggagauguaaaguca

SEQ ID NO: 1576575 - RNA, 19 nt, Homo sapiens
gaaauggguaccuaugcaa

SEQ ID NO: 1576576 - RNA, 19 nt, Homo sapiens
ccauucagcgcuuugauaa

SEQ ID NO: 1576577 - RNA, 19 nt, Homo sapiens
ggaucgagcuuuggauuac

SEQ ID NO: 1576578 - RNA, 19 nt, Homo sapiens
uuuauagccuuucccuuaa

SEQ ID NO: 1576579 - RNA, 19 nt, Homo sapiens
uauaagaauucgugcaaag

SEQ ID NO: 1576580 - RNA, 19 nt, Homo sapiens
agacugaagcuuugaagaa

SEQ ID NO: 1576581 - RNA, 19 nt, Homo sapiens
caugacuucgcaaauauua

SEQ ID NO: 1576582 - RNA, 19 nt, Homo sapiens
uuucucagauccuguauau

SEQ ID NO: 1576583 - RNA, 19 nt, Homo sapiens
agaagccaauuacugauga

SEQ ID NO: 1576584 - RNA, 19 nt, Homo sapiens
uggcuacuauccugcauuu

SEQ ID NO: 1576585 - RNA, 19 nt, Homo sapiens
uacaggaucugguuaugga

SEQ ID NO: 1576586 - RNA, 19 nt, Homo sapiens
ggccaucuauaccaucuau

SEQ ID NO: 1576587 - RNA, 19 nt, Homo sapiens
caacuugucacagaagaaa

SEQ ID NO: 1576588 - RNA, 19 nt, Homo sapiens
caugucaaccaauaugaua

SEQ ID NO: 1576589 - RNA, 19 nt, Homo sapiens
ucaugcaacuaacugcuaa

SEQ ID NO: 1576590 - RNA, 19 nt, Homo sapiens
gccuagagcuggaacguua

SEQ ID NO: 1576591 - RNA, 19 nt, Homo sapiens
gagaugagaugaccaccaa

SEQ ID NO: 1576592 - RNA, 19 nt, Homo sapiens
gcaggaaaguuuacaccaa

SEQ ID NO: 1576593 - RNA, 19 nt, Homo sapiens
ugcaagaagugaugaguua

SEQ ID NO: 1576594 - RNA, 19 nt, Homo sapiens
aaauugagcuccucuguca

SEQ ID NO: 1576595 - RNA, 19 nt, Homo sapiens
caggaaaguuuacaccaaa

SEQ ID NO: 1576596 - RNA, 19 nt, Homo sapiens
ugaaaggaguauaccauga

SEQ ID NO: 1576597 - RNA, 19 nt, Homo sapiens
gaagaucuguggaccaaaa

SEQ ID NO: 1576598 - RNA, 19 nt, Homo sapiens
gaggaguacuggcaacaga

SEQ ID NO: 1576599 - RNA, 19 nt, Homo sapiens
gaacugagcagggaaccuu

SEQ ID NO: 1576600 - RNA, 19 nt, Homo sapiens
gcuaaugguuggguugauu

SEQ ID NO: 1576601 - RNA, 19 nt, Homo sapiens
gcacgagaccggcuacuuc

SEQ ID NO: 1576602 - RNA, 19 nt, Homo sapiens
gagaaaagccuuacagaug

SEQ ID NO: 1576603 - RNA, 19 nt, Homo sapiens
ggaggaauccgaacugaag

SEQ ID NO: 1576604 - RNA, 19 nt, Homo sapiens
uagcaagacugcaagagau

SEQ ID NO: 1576605 - RNA, 19 nt, Homo sapiens
guauguugaggaucuauua

SEQ ID NO: 1576606 - RNA, 19 nt, Homo sapiens
gguggauccuguaggcuaa

SEQ ID NO: 1576607 - RNA, 19 nt, Homo sapiens
cagggaaccuucucaacug

SEQ ID NO: 1576608 - RNA, 19 nt, Homo sapiens
ggaauccgaacugaagaua

SEQ ID NO: 1576609 - RNA, 19 nt, Homo sapiens
gaaaggaguauaccaugag

SEQ ID NO: 1576610 - RNA, 19 nt, Homo sapiens
gauuguauguugaggaucu

SEQ ID NO: 1576611 - RNA, 19 nt, Homo sapiens
gaaggagggaugcguguuc

SEQ ID NO: 1576612 - RNA, 19 nt, Homo sapiens
gagcgagcccugcuauguu

SEQ ID NO: 1576613 - RNA, 19 nt, Homo sapiens
gaccaccaaucauuuccuu

SEQ ID NO: 1576614 - RNA, 19 nt, Homo sapiens
uguaagaaguggcauagca

SEQ ID NO: 1576615 - RNA, 19 nt, Homo sapiens
caaaagcucccacuugaaa

SEQ ID NO: 1576616 - RNA, 19 nt, Homo sapiens
gcaagaagugaugaguuaa

SEQ ID NO: 1576617 - RNA, 19 nt, Homo sapiens
gcagggaaccuucucaacu

SEQ ID NO: 1576618 - RNA, 19 nt, Homo sapiens
gccuggaguuugcaugaaa

SEQ ID NO: 1576619 - RNA, 19 nt, Homo sapiens
aauccgaacugaagauauc

SEQ ID NO: 1576620 - RNA, 19 nt, Homo sapiens
caaagagguggauccugua

SEQ ID NO: 1576621 - RNA, 19 nt, Homo sapiens
aaaggaguauaccaugaga

SEQ ID NO: 1576622 - RNA, 19 nt, Homo sapiens
uaaccaggcacuuccgaaa

SEQ ID NO: 1576623 - RNA, 19 nt, Homo sapiens
gagccuggaguuugcauga

SEQ ID NO: 1576624 - RNA, 19 nt, Homo sapiens
ugccgucucuggaggagua

SEQ ID NO: 1576625 - RNA, 19 nt, Homo sapiens
gcaacagaccugccuagag

SEQ ID NO: 1576626 - RNA, 19 nt, Homo sapiens
gaugagaugaccaccaauc

SEQ ID NO: 1576627 - RNA, 19 nt, Homo sapiens
agcgagcccugcuauguuu

SEQ ID NO: 1576628 - RNA, 19 nt, Homo sapiens
gagcaugcacacugagaau

SEQ ID NO: 1576629 - RNA, 19 nt, Homo sapiens
caccugggccugcacauga

SEQ ID NO: 1576630 - RNA, 19 nt, Homo sapiens
caaauuugacagccaggaa

SEQ ID NO: 1576631 - RNA, 19 nt, Homo sapiens
acacugagaaugcuaaugg

SEQ ID NO: 1576632 - RNA, 19 nt, Homo sapiens
gagcagggaaccuucucaa

SEQ ID NO: 1576633 - RNA, 19 nt, Homo sapiens
aggaagaucuguggaccaa

SEQ ID NO: 1576634 - RNA, 19 nt, Homo sapiens
gaucuauuacugaccguau

SEQ ID NO: 1576635 - RNA, 19 nt, Homo sapiens
guucugcaccuacccaguu

SEQ ID NO: 1576636 - RNA, 19 nt, Homo sapiens
gccaaagcaugccguucug

SEQ ID NO: 1576637 - RNA, 19 nt, Homo sapiens
ugacagcuccgaggaacuu

SEQ ID NO: 1576638 - RNA, 19 nt, Homo sapiens
gaauccgaacugaagauau

SEQ ID NO: 1576639 - RNA, 19 nt, Homo sapiens
gaguauaccaugagaugag

SEQ ID NO: 1576640 - RNA, 19 nt, Homo sapiens
ggaguauaccaugagauga

SEQ ID NO: 1576641 - RNA, 19 nt, Homo sapiens
gggccaagccuuuuaaaug

SEQ ID NO: 1576642 - RNA, 19 nt, Homo sapiens
gaugcguguuccagccaaa

SEQ ID NO: 1576643 - RNA, 19 nt, Homo sapiens
uuaaaugcucccacuguga

SEQ ID NO: 1576644 - RNA, 19 nt, Homo sapiens
guaugaugaggccaacuuu

SEQ ID NO: 1576645 - RNA, 19 nt, Homo sapiens
guugaggaucuauuacuga

SEQ ID NO: 1576646 - RNA, 19 nt, Homo sapiens
uuuaacggcugcaggaaag

SEQ ID NO: 1576647 - RNA, 19 nt, Homo sapiens
gcaugccguucugcaccua

SEQ ID NO: 1576648 - RNA, 19 nt, Homo sapiens
gaaaauugagcuccucugu

SEQ ID NO: 1576649 - RNA, 19 nt, Homo sapiens
aaggaggaauccgaacuga

SEQ ID NO: 1576650 - RNA, 19 nt, Homo sapiens
ccagagcgagcccugcuau

SEQ ID NO: 1576651 - RNA, 19 nt, Homo sapiens
ggaaggagggaugcguguu

SEQ ID NO: 1576652 - RNA, 19 nt, Homo sapiens
ggagaaaagccuuacagau

SEQ ID NO: 1576653 - RNA, 19 nt, Homo sapiens
ggucagcucgggaaaauug

SEQ ID NO: 1576654 - RNA, 19 nt, Homo sapiens
uuagcaagacugcaagaga

SEQ ID NO: 1576655 - RNA, 19 nt, Homo sapiens
augguuggguugauuguau

SEQ ID NO: 1576656 - RNA, 19 nt, Homo sapiens
caagaagugaugaguuaac

SEQ ID NO: 1576657 - RNA, 19 nt, Homo sapiens
gaggaauccgaacugaaga

SEQ ID NO: 1576658 - RNA, 19 nt, Homo sapiens
accaaaagcucccacuuga

SEQ ID NO: 1576659 - RNA, 19 nt, Homo sapiens
guuacaacuuagagaccaa

SEQ ID NO: 1576660 - RNA, 19 nt, Homo sapiens
uuggguugauuguauguug

SEQ ID NO: 1576661 - RNA, 19 nt, Homo sapiens
ccgugagcaugcacacuga

SEQ ID NO: 1576662 - RNA, 19 nt, Homo sapiens
ggccaagccuuuuaaaugc

SEQ ID NO: 1576663 - RNA, 19 nt, Homo sapiens
ucagaugucagcagcgaau

SEQ ID NO: 1576664 - RNA, 19 nt, Homo sapiens
gaccaacagccugaacuca

SEQ ID NO: 1576665 - RNA, 19 nt, Homo sapiens
guuugaauguuuuguguga

SEQ ID NO: 1576666 - RNA, 19 nt, Homo sapiens
uguugaggaucuauuacug

SEQ ID NO: 1576667 - RNA, 19 nt, Homo sapiens
uggguugauuguauguuga

SEQ ID NO: 1576668 - RNA, 19 nt, Homo sapiens
uccaggagcuccagaucgu

SEQ ID NO: 1576669 - RNA, 19 nt, Homo sapiens
gcacacugagaaugcuaau

SEQ ID NO: 1576670 - RNA, 19 nt, Homo sapiens
gugguuagcaagacugcaa

SEQ ID NO: 1576671 - RNA, 19 nt, Homo sapiens
gcucaugggaaggguguga

SEQ ID NO: 1576672 - RNA, 19 nt, Homo sapiens
uaacggcugcaggaaaguu

SEQ ID NO: 1576673 - RNA, 19 nt, Homo sapiens
ccuccacgccuccaucuuc

SEQ ID NO: 1576674 - RNA, 19 nt, Homo sapiens
ggaaauacauugugccuuu

SEQ ID NO: 1576675 - RNA, 19 nt, Homo sapiens
guaguaaccucccaaauug

SEQ ID NO: 1576676 - RNA, 19 nt, Homo sapiens
caacagagguuuaguuuac

SEQ ID NO: 1576677 - RNA, 19 nt, Homo sapiens
caauacagcuggagaaaug

SEQ ID NO: 1576678 - RNA, 19 nt, Homo sapiens
ccacuuaacacuuugauua

SEQ ID NO: 1576679 - RNA, 19 nt, Homo sapiens
cgacuugcauucccacuua

SEQ ID NO: 1576680 - RNA, 19 nt, Homo sapiens
gagacuaaauacaggcuua

SEQ ID NO: 1576681 - RNA, 19 nt, Homo sapiens
gcagagcggugguuugaga

SEQ ID NO: 1576682 - RNA, 19 nt, Homo sapiens
gagagagccugcugcguaa

SEQ ID NO: 1576683 - RNA, 19 nt, Homo sapiens
ggaaauucuugcccaacua

SEQ ID NO: 1576684 - RNA, 19 nt, Homo sapiens
gccaugaacuugccaauca

SEQ ID NO: 1576685 - RNA, 19 nt, Homo sapiens
ggagacagcagcaugauga

SEQ ID NO: 1576686 - RNA, 19 nt, Homo sapiens
guaaguaaauuuggugguu

SEQ ID NO: 1576687 - RNA, 19 nt, Homo sapiens
gaaauucuugcccaacuaa

SEQ ID NO: 1576688 - RNA, 19 nt, Homo sapiens
ccuaugaccuucuacuuug

SEQ ID NO: 1576689 - RNA, 19 nt, Homo sapiens
gaauguggaacuacuguuu

SEQ ID NO: 1576690 - RNA, 19 nt, Homo sapiens
acccagaacucaaacuuaa

SEQ ID NO: 1576691 - RNA, 19 nt, Homo sapiens
caacagaugcugagcuuuc

SEQ ID NO: 1576692 - RNA, 19 nt, Homo sapiens
ggacuugaccuggaaagaa

SEQ ID NO: 1576693 - RNA, 19 nt, Homo sapiens
caacuaaacccagaacuca

SEQ ID NO: 1576694 - RNA, 19 nt, Homo sapiens
aagcugagauucccauuuc

SEQ ID NO: 1576695 - RNA, 19 nt, Homo sapiens
gaagaaggcagugguagug

SEQ ID NO: 1576696 - RNA, 19 nt, Homo sapiens
gacuugaccuggaaagaau

SEQ ID NO: 1576697 - RNA, 19 nt, Homo sapiens
gauggcagcugagggaaau

SEQ ID NO: 1576698 - RNA, 19 nt, Homo sapiens
ucacagagcauugccauug

SEQ ID NO: 1576699 - RNA, 19 nt, Homo sapiens
ugugauacguuauaccaaa

SEQ ID NO: 1576700 - RNA, 19 nt, Homo sapiens
gacagcagcaugaugauga

SEQ ID NO: 1576701 - RNA, 19 nt, Homo sapiens
ggcaacagaugcugagcuu

SEQ ID NO: 1576702 - RNA, 19 nt, Homo sapiens
agaaauggcuggagcuuuu

SEQ ID NO: 1576703 - RNA, 19 nt, Homo sapiens
ggagaagccacccaugaga

SEQ ID NO: 1576704 - RNA, 19 nt, Homo sapiens
gaacuugcagaguguguau

SEQ ID NO: 1576705 - RNA, 19 nt, Homo sapiens
ggaggagacagcagcauga

SEQ ID NO: 1576706 - RNA, 19 nt, Homo sapiens
ggcguggccuuaucgauug

SEQ ID NO: 1576707 - RNA, 19 nt, Homo sapiens
gcaggagaaucacuugaac

SEQ ID NO: 1576708 - RNA, 19 nt, Homo sapiens
guucuugucuaauccaugu

SEQ ID NO: 1576709 - RNA, 19 nt, Homo sapiens
gagcggugguuugagacua

SEQ ID NO: 1576710 - RNA, 19 nt, Homo sapiens
aguaguaaccucccaaauu

SEQ ID NO: 1576711 - RNA, 19 nt, Homo sapiens
uugaucaucugcuuccuuu

SEQ ID NO: 1576712 - RNA, 19 nt, Homo sapiens
gcagugggaaguuguugaa

SEQ ID NO: 1576713 - RNA, 19 nt, Homo sapiens
gaucaauacagcuggagaa

SEQ ID NO: 1576714 - RNA, 19 nt, Homo sapiens
gaaaccccgucucuacuaa

SEQ ID NO: 1576715 - RNA, 19 nt, Homo sapiens
gcuaguggcuggacuugac

SEQ ID NO: 1576716 - RNA, 19 nt, Homo sapiens
ggagagagaggugcuagug

SEQ ID NO: 1576717 - RNA, 19 nt, Homo sapiens
cacagagcauugccauuga

SEQ ID NO: 1576718 - RNA, 19 nt, Homo sapiens
aauacaggcuuagaacuug

SEQ ID NO: 1576719 - RNA, 19 nt, Homo sapiens
cuagaugugauacguuaua

SEQ ID NO: 1576720 - RNA, 19 nt, Homo sapiens
uacagucucugaacuaaag

SEQ ID NO: 1576721 - RNA, 19 nt, Homo sapiens
gcucaacagagguuuaguu

SEQ ID NO: 1576722 - RNA, 19 nt, Homo sapiens
caacggguaccucugcauu

SEQ ID NO: 1576723 - RNA, 19 nt, Homo sapiens
uacuagcaauguucuauga

SEQ ID NO: 1576724 - RNA, 19 nt, Homo sapiens
gaccuucuacuuuggcuuu

SEQ ID NO: 1576725 - RNA, 19 nt, Homo sapiens
cucuagaugugauacguua

SEQ ID NO: 1576726 - RNA, 19 nt, Homo sapiens
gggaaauucuugcccaacu

SEQ ID NO: 1576727 - RNA, 19 nt, Homo sapiens
gagcauugccauugacauc

SEQ ID NO: 1576728 - RNA, 19 nt, Homo sapiens
ggaagaaggcagugguagu

SEQ ID NO: 1576729 - RNA, 19 nt, Homo sapiens
ggguuaagauucggagaga

SEQ ID NO: 1576730 - RNA, 19 nt, Homo sapiens
cuaugaaggacucaagaua

SEQ ID NO: 1576731 - RNA, 19 nt, Homo sapiens
gccuaugaccuucuacuuu

SEQ ID NO: 1576732 - RNA, 19 nt, Homo sapiens
acacuuugauuagccauga

SEQ ID NO: 1576733 - RNA, 19 nt, Homo sapiens
ucugcugacucucaacuuu

SEQ ID NO: 1576734 - RNA, 19 nt, Homo sapiens
gugcagagcggugguuuga

SEQ ID NO: 1576735 - RNA, 19 nt, Homo sapiens
caucuuagagccaaguuau

SEQ ID NO: 1576736 - RNA, 19 nt, Homo sapiens
gagaaauggcuggagcuuu

SEQ ID NO: 1576737 - RNA, 19 nt, Homo sapiens
uacuuuggcuuuaagaaug

SEQ ID NO: 1576738 - RNA, 19 nt, Homo sapiens
aaauacaggcuuagaacuu

SEQ ID NO: 1576739 - RNA, 19 nt, Homo sapiens
cauucccacuuaacacuuu

SEQ ID NO: 1576740 - RNA, 19 nt, Homo sapiens
gagccaaguuauauguucu

SEQ ID NO: 1576741 - RNA, 19 nt, Homo sapiens
ucaacagagguuuaguuua

SEQ ID NO: 1576742 - RNA, 19 nt, Homo sapiens
cauaagcuacuuccucaug

SEQ ID NO: 1576743 - RNA, 19 nt, Homo sapiens
gagaagccacccaugagau

SEQ ID NO: 1576744 - RNA, 19 nt, Homo sapiens
cauugugccuuucucuaga

SEQ ID NO: 1576745 - RNA, 19 nt, Homo sapiens
guuaagauucggagagaga

SEQ ID NO: 1576746 - RNA, 19 nt, Homo sapiens
gaucauucccaccauaugg

SEQ ID NO: 1576747 - RNA, 19 nt, Homo sapiens
cugcguaagucacaaguca

SEQ ID NO: 1576748 - RNA, 19 nt, Homo sapiens
ccaugaacuugccaaucaa

SEQ ID NO: 1576749 - RNA, 19 nt, Homo sapiens
gaugugauacguuauacca

SEQ ID NO: 1576750 - RNA, 19 nt, Homo sapiens
cagcugagggaaauucuug

SEQ ID NO: 1576751 - RNA, 19 nt, Homo sapiens
gagguuuaguuuacagucu

SEQ ID NO: 1576752 - RNA, 19 nt, Homo sapiens
gacuugcauucccacuuaa

SEQ ID NO: 1576753 - RNA, 19 nt, Homo sapiens
ggugguuugagacuaaaua

SEQ ID NO: 1576754 - RNA, 19 nt, Homo sapiens
ggcaggagaaucacuugaa

SEQ ID NO: 1576755 - RNA, 19 nt, Homo sapiens
uaacuucagccaggauuga

SEQ ID NO: 1576756 - RNA, 19 nt, Homo sapiens
ggaaagggguuaacuucag

SEQ ID NO: 1576757 - RNA, 19 nt, Homo sapiens
cagaguguguauucuugga

SEQ ID NO: 1576758 - RNA, 19 nt, Homo sapiens
ggagaaucacuugaaccua

SEQ ID NO: 1576759 - RNA, 19 nt, Homo sapiens
ccagaacucaaacuuaaca

SEQ ID NO: 1576760 - RNA, 19 nt, Homo sapiens
caagucagcauucgcuaca

SEQ ID NO: 1576761 - RNA, 19 nt, Homo sapiens
cuagcaauguucuaugaag

SEQ ID NO: 1576762 - RNA, 19 nt, Homo sapiens
caugcaaccuucucaccau

SEQ ID NO: 1576763 - RNA, 19 nt, Homo sapiens
uaugaaggacucaagauag

SEQ ID NO: 1576764 - RNA, 19 nt, Homo sapiens
ugcagaguguguauucuug

SEQ ID NO: 1576765 - RNA, 19 nt, Homo sapiens
ccuguaaucccagcacuuu

SEQ ID NO: 1576766 - RNA, 19 nt, Homo sapiens
agagccaaguuauauguuc

SEQ ID NO: 1576767 - RNA, 19 nt, Homo sapiens
ccacccaugagaugucuuu

SEQ ID NO: 1576768 - RNA, 19 nt, Homo sapiens
agauucccauuucucuuaa

SEQ ID NO: 1576769 - RNA, 19 nt, Homo sapiens
uuaagaauguggaacuacu

SEQ ID NO: 1576770 - RNA, 19 nt, Homo sapiens
guacacacacacacacaca

SEQ ID NO: 1576771 - RNA, 19 nt, Homo sapiens
agugggaaguuguugaaga

SEQ ID NO: 1576772 - RNA, 19 nt, Homo sapiens
gaaggcagugguaguggau

SEQ ID NO: 1576773 - RNA, 19 nt, Homo sapiens
ggugacggguuaagauucg

SEQ ID NO: 1576774 - RNA, 19 nt, Homo sapiens
cuaaauaccucacagauua

SEQ ID NO: 1576775 - RNA, 19 nt, Homo sapiens
caacugcccuuucuucuga

SEQ ID NO: 1576776 - RNA, 19 nt, Homo sapiens
ggcauggucuugugucuua

SEQ ID NO: 1576777 - RNA, 19 nt, Homo sapiens
ugacaaugcuucucuguga

SEQ ID NO: 1576778 - RNA, 19 nt, Homo sapiens
gaaaaucacugcuguauac

SEQ ID NO: 1576779 - RNA, 19 nt, Homo sapiens
ggacagagaccaagcuaga

SEQ ID NO: 1576780 - RNA, 19 nt, Homo sapiens
gcagcaaccuuccuucuca

SEQ ID NO: 1576781 - RNA, 19 nt, Homo sapiens
agaccaagcuagauccuuu

SEQ ID NO: 1576782 - RNA, 19 nt, Homo sapiens
guuguaagcuuugggaauu

SEQ ID NO: 1576783 - RNA, 19 nt, Homo sapiens
aaucacugcuguauacuaa

SEQ ID NO: 1576784 - RNA, 19 nt, Homo sapiens
gaaccucuucacuuuauaa

SEQ ID NO: 1576785 - RNA, 19 nt, Homo sapiens
cagcggugcuucuguuuga

SEQ ID NO: 1576786 - RNA, 19 nt, Homo sapiens
cuaccuagcuuacccacuu

SEQ ID NO: 1576787 - RNA, 19 nt, Homo sapiens
caaccaaagccauuacauu

SEQ ID NO: 1576788 - RNA, 19 nt, Homo sapiens
ccucacagauuagaugaaa

SEQ ID NO: 1576789 - RNA, 19 nt, Homo sapiens
aaccaaagccauuacauuu

SEQ ID NO: 1576790 - RNA, 19 nt, Homo sapiens
ccugaccucuucugucuuu

SEQ ID NO: 1576791 - RNA, 19 nt, Homo sapiens
ccucagcucuccugcuuug

SEQ ID NO: 1576792 - RNA, 19 nt, Homo sapiens
gcauggcccuuucgguguu

SEQ ID NO: 1576793 - RNA, 19 nt, Homo sapiens
ucacugcuguauacuaaau

SEQ ID NO: 1576794 - RNA, 19 nt, Homo sapiens
gacugaagaugcaauccaa

SEQ ID NO: 1576795 - RNA, 19 nt, Homo sapiens
gaagaugcaauccaaccaa

SEQ ID NO: 1576796 - RNA, 19 nt, Homo sapiens
aaagcugcaucuaauaaug

SEQ ID NO: 1576797 - RNA, 19 nt, Homo sapiens
aaacugcugagaccuauuu

SEQ ID NO: 1576798 - RNA, 19 nt, Homo sapiens
uuacugagcccaugacaau

SEQ ID NO: 1576799 - RNA, 19 nt, Homo sapiens
gcuucuggcuguacuguau

SEQ ID NO: 1576800 - RNA, 19 nt, Homo sapiens
ggaucauguugacaaacua

SEQ ID NO: 1576801 - RNA, 19 nt, Homo sapiens
ucagauucauucccuguug

SEQ ID NO: 1576802 - RNA, 19 nt, Homo sapiens
gaucauguugacaaacuaa

SEQ ID NO: 1576803 - RNA, 19 nt, Homo sapiens
gaucaucucgucuauggau

SEQ ID NO: 1576804 - RNA, 19 nt, Homo sapiens
cagauuagaugaaaagaug

SEQ ID NO: 1576805 - RNA, 19 nt, Homo sapiens
gcucugcugugggcuacua

SEQ ID NO: 1576806 - RNA, 19 nt, Homo sapiens
aauaagugacagcugauua

SEQ ID NO: 1576807 - RNA, 19 nt, Homo sapiens
ucaaugcccuccuuuaucc

SEQ ID NO: 1576808 - RNA, 19 nt, Homo sapiens
ugacucaaaccaggaauuu

SEQ ID NO: 1576809 - RNA, 19 nt, Homo sapiens
ggucaucggcuacuucauc

SEQ ID NO: 1576810 - RNA, 19 nt, Homo sapiens
gccagucucuaauccaugu

SEQ ID NO: 1576811 - RNA, 19 nt, Homo sapiens
aagaugcaauccaaccaaa

SEQ ID NO: 1576812 - RNA, 19 nt, Homo sapiens
aaagggagaauggagauaa

SEQ ID NO: 1576813 - RNA, 19 nt, Homo sapiens
gaauaagugacagcugauu

SEQ ID NO: 1576814 - RNA, 19 nt, Homo sapiens
cagaaacugcugagaccua

SEQ ID NO: 1576815 - RNA, 19 nt, Homo sapiens
uguaagcuuugggaauuaa

SEQ ID NO: 1576816 - RNA, 19 nt, Homo sapiens
agugacagcugauuaaagg

SEQ ID NO: 1576817 - RNA, 19 nt, Homo sapiens
caugauggauggcagaaac

SEQ ID NO: 1576818 - RNA, 19 nt, Homo sapiens
ccucaaugcccuccuuuau

SEQ ID NO: 1576819 - RNA, 19 nt, Homo sapiens
auaagugacagcugauuaa

SEQ ID NO: 1576820 - RNA, 19 nt, Homo sapiens
gauuaaaggcagagacaca

SEQ ID NO: 1576821 - RNA, 19 nt, Homo sapiens
acaggagcaucgcccauug

SEQ ID NO: 1576822 - RNA, 19 nt, Homo sapiens
gcaaagccaagcugcucaa

SEQ ID NO: 1576823 - RNA, 19 nt, Homo sapiens
aagccaagcugcucaacca

SEQ ID NO: 1576824 - RNA, 19 nt, Homo sapiens
ugagaccuauuucccuuuc

SEQ ID NO: 1576825 - RNA, 19 nt, Homo sapiens
agaaacugcugagaccuau

SEQ ID NO: 1576826 - RNA, 19 nt, Homo sapiens
guaugaaggcaucaagguu

SEQ ID NO: 1576827 - RNA, 19 nt, Homo sapiens
uauggaucauguugacaaa

SEQ ID NO: 1576828 - RNA, 19 nt, Homo sapiens
gcccaggcauggucuugug

SEQ ID NO: 1576829 - RNA, 19 nt, Homo sapiens
uaagugacagcugauuaaa

SEQ ID NO: 1576830 - RNA, 19 nt, Homo sapiens
gcuauuccuccaccuuauu

SEQ ID NO: 1576831 - RNA, 19 nt, Homo sapiens
agaccuauuucccuuucuu

SEQ ID NO: 1576832 - RNA, 19 nt, Homo sapiens
ucaccuuucugccuuugga

SEQ ID NO: 1576833 - RNA, 19 nt, Homo sapiens
caaagggagaauggagaua

SEQ ID NO: 1576834 - RNA, 19 nt, Homo sapiens
ucucgucuauggaucaugu

SEQ ID NO: 1576835 - RNA, 19 nt, Homo sapiens
gucaucggcuacuucauca

SEQ ID NO: 1576836 - RNA, 19 nt, Homo sapiens
ucaccauggcgaugcauuu

SEQ ID NO: 1576837 - RNA, 19 nt, Homo sapiens
ccucaucuuucuucuaugc

SEQ ID NO: 1576838 - RNA, 19 nt, Homo sapiens
ucuccugcuuugugccuua

SEQ ID NO: 1576839 - RNA, 19 nt, Homo sapiens
ccauggcgaugcauuucau

SEQ ID NO: 1576840 - RNA, 19 nt, Homo sapiens
uggcuauuccuccaccuua

SEQ ID NO: 1576841 - RNA, 19 nt, Homo sapiens
ccacuucucagcacagcuu

SEQ ID NO: 1576842 - RNA, 19 nt, Homo sapiens
acuaaauaccucacagauu

SEQ ID NO: 1576843 - RNA, 19 nt, Homo sapiens
cagcagaccaucgcagaga

SEQ ID NO: 1576844 - RNA, 19 nt, Homo sapiens
gcaucaagguuggcaaagc

SEQ ID NO: 1576845 - RNA, 19 nt, Homo sapiens
gcauggucuugugucuuaa

SEQ ID NO: 1576846 - RNA, 19 nt, Homo sapiens
ggcuauuccuccaccuuau

SEQ ID NO: 1576847 - RNA, 19 nt, Homo sapiens
gacacuauacuuccaacug

SEQ ID NO: 1576848 - RNA, 19 nt, Homo sapiens
gagaaaaucacugcuguau

SEQ ID NO: 1576849 - RNA, 19 nt, Homo sapiens
auccucaucuuucuucuau

SEQ ID NO: 1576850 - RNA, 19 nt, Homo sapiens
caucggcuacuucaucaug

SEQ ID NO: 1576851 - RNA, 19 nt, Homo sapiens
uuguaagcuuugggaauua

SEQ ID NO: 1576852 - RNA, 19 nt, Homo sapiens
cuggauaguugaaccucuu

SEQ ID NO: 1576853 - RNA, 19 nt, Homo sapiens
ccaaagggagaauggagau

SEQ ID NO: 1576854 - RNA, 19 nt, Homo sapiens
cggugcuucuguuugauuu

SEQ ID NO: 1576855 - RNA, 19 nt, Homo sapiens
gaaacugcugagaccuauu

SEQ ID NO: 1576856 - RNA, 19 nt, Homo sapiens
cuggaaacuuugagcugaa

SEQ ID NO: 1576857 - RNA, 19 nt, Homo sapiens
uaaauaccucacagauuag

SEQ ID NO: 1576858 - RNA, 19 nt, Homo sapiens
uggaucauguugacaaacu

SEQ ID NO: 1576859 - RNA, 19 nt, Homo sapiens
cacuuuggccagucucuaa

SEQ ID NO: 1576860 - RNA, 19 nt, Homo sapiens
aaaucacugcuguauacua

SEQ ID NO: 1576861 - RNA, 19 nt, Homo sapiens
gcggugcuucuguuugauu

SEQ ID NO: 1576862 - RNA, 19 nt, Homo sapiens
agagacacaggacugcuuu

SEQ ID NO: 1576863 - RNA, 19 nt, Homo sapiens
gaccucuucugucuuugag

SEQ ID NO: 1576864 - RNA, 19 nt, Homo sapiens
gaugaaaagaugguuguaa

SEQ ID NO: 1576865 - RNA, 19 nt, Homo sapiens
aauccaaccaaagccauua

SEQ ID NO: 1576866 - RNA, 19 nt, Homo sapiens
acccucagcucuccugcuu

SEQ ID NO: 1576867 - RNA, 19 nt, Homo sapiens
gugcuucuguuugauuucu

SEQ ID NO: 1576868 - RNA, 19 nt, Homo sapiens
caauccaaccaaagccauu

SEQ ID NO: 1576869 - RNA, 19 nt, Homo sapiens
gaccuauuucccuuucuug

SEQ ID NO: 1576870 - RNA, 19 nt, Homo sapiens
ugaccucuucugucuuuga

SEQ ID NO: 1576871 - RNA, 19 nt, Homo sapiens
ccaacugcccuuucuucug

SEQ ID NO: 1576872 - RNA, 19 nt, Homo sapiens
aaaagaugguuguaagcuu

SEQ ID NO: 1576873 - RNA, 19 nt, Homo sapiens
gccucaaugcccuccuuua

SEQ ID NO: 1576874 - RNA, 19 nt, Homo sapiens
gaagcucugucuuugauuu

SEQ ID NO: 1576875 - RNA, 19 nt, Homo sapiens
ugacgugucuugaguaauu

SEQ ID NO: 1576876 - RNA, 19 nt, Homo sapiens
gcaggaagcggcaggaaua

SEQ ID NO: 1576877 - RNA, 19 nt, Homo sapiens
gcaggaacuucuucuggaa

SEQ ID NO: 1576878 - RNA, 19 nt, Homo sapiens
gggaagcucugucuuugau

SEQ ID NO: 1576879 - RNA, 19 nt, Homo sapiens
ugacagaccugaauaaaau

SEQ ID NO: 1576880 - RNA, 19 nt, Homo sapiens
caauaaugcccaauacuga

SEQ ID NO: 1576881 - RNA, 19 nt, Homo sapiens
guaaugacagaccugaaua

SEQ ID NO: 1576882 - RNA, 19 nt, Homo sapiens
gaucuuuccucuccuccuu

SEQ ID NO: 1576883 - RNA, 19 nt, Homo sapiens
gcucugucuuugauuuaaa

SEQ ID NO: 1576884 - RNA, 19 nt, Homo sapiens
gcugggaagcucugucuuu

SEQ ID NO: 1576885 - RNA, 19 nt, Homo sapiens
aauaaaaccucacccauga

SEQ ID NO: 1576886 - RNA, 19 nt, Homo sapiens
gcacugggcuuuucuucug

SEQ ID NO: 1576887 - RNA, 19 nt, Homo sapiens
ucacgcaaguguaaugaca

SEQ ID NO: 1576888 - RNA, 19 nt, Homo sapiens
caugaaugcucacgcaagu

SEQ ID NO: 1576889 - RNA, 19 nt, Homo sapiens
ccaauaaugcccaauacug

SEQ ID NO: 1576890 - RNA, 19 nt, Homo sapiens
ccagucagcccacaagaug

SEQ ID NO: 1576891 - RNA, 19 nt, Homo sapiens
gaccuucuccuccugcaaa

SEQ ID NO: 1576892 - RNA, 19 nt, Homo sapiens
cuucugauguucauuaugg

SEQ ID NO: 1576893 - RNA, 19 nt, Homo sapiens
gcagcagggugggagagaa

SEQ ID NO: 1576894 - RNA, 19 nt, Homo sapiens
guauuaagcagcagugauc

SEQ ID NO: 1576895 - RNA, 19 nt, Homo sapiens
ggccaaacauugauuucag

SEQ ID NO: 1576896 - RNA, 19 nt, Homo sapiens
uaaugacagaccugaauaa

SEQ ID NO: 1576897 - RNA, 19 nt, Homo sapiens
cgacuggacugugcugagu

SEQ ID NO: 1576898 - RNA, 19 nt, Homo sapiens
ggaagcggcaggaauaagg

SEQ ID NO: 1576899 - RNA, 19 nt, Homo sapiens
auacugacgugucuugagu

SEQ ID NO: 1576900 - RNA, 19 nt, Homo sapiens
ccaauacugacgugucuug

SEQ ID NO: 1576901 - RNA, 19 nt, Homo sapiens
gcccaauacugacgugucu

SEQ ID NO: 1576902 - RNA, 19 nt, Homo sapiens
uuaagcagcagugaucuuu

SEQ ID NO: 1576903 - RNA, 19 nt, Homo sapiens
gacgugucuugaguaauuu

SEQ ID NO: 1576904 - RNA, 19 nt, Homo sapiens
cugggaagcucugucuuug

SEQ ID NO: 1576905 - RNA, 19 nt, Homo sapiens
acugacgugucuugaguaa

SEQ ID NO: 1576906 - RNA, 19 nt, Homo sapiens
cuucuccuccugcaaauaa

SEQ ID NO: 1576907 - RNA, 19 nt, Homo sapiens
agaaugcccugcaggaacu

SEQ ID NO: 1576908 - RNA, 19 nt, Homo sapiens
gaagcggcaggaauaagga

SEQ ID NO: 1576909 - RNA, 19 nt, Homo sapiens
ugucuugaguaauuuggaa

SEQ ID NO: 1576910 - RNA, 19 nt, Homo sapiens
ugaaugcucacgcaagugu

SEQ ID NO: 1576911 - RNA, 19 nt, Homo sapiens
acgcaaguguaaugacaga

SEQ ID NO: 1576912 - RNA, 19 nt, Homo sapiens
cgaggccaaacauugauuu

SEQ ID NO: 1576913 - RNA, 19 nt, Homo sapiens
aagcucugucuuugauuua

SEQ ID NO: 1576914 - RNA, 19 nt, Homo sapiens
gggcuuuucuucugauguu

SEQ ID NO: 1576915 - RNA, 19 nt, Homo sapiens
aaugacagaccugaauaaa

SEQ ID NO: 1576916 - RNA, 19 nt, Homo sapiens
uguaaugacagaccugaau

SEQ ID NO: 1576917 - RNA, 19 nt, Homo sapiens
gaaugcucacgcaagugua

SEQ ID NO: 1576918 - RNA, 19 nt, Homo sapiens
gccgagacagcgagcauau

SEQ ID NO: 1576919 - RNA, 19 nt, Homo sapiens
cgagacagcgagcauaugc

SEQ ID NO: 1576920 - RNA, 19 nt, Homo sapiens
gcucacgcaaguguaauga

SEQ ID NO: 1576921 - RNA, 19 nt, Homo sapiens
aaaccucacccaugaaugc

SEQ ID NO: 1576922 - RNA, 19 nt, Homo sapiens
uuuccucgcuuggugguuu

SEQ ID NO: 1576923 - RNA, 19 nt, Homo sapiens
ggaagcucugucuuugauu

SEQ ID NO: 1576924 - RNA, 19 nt, Homo sapiens
caggaagcggcaggaauaa

SEQ ID NO: 1576925 - RNA, 19 nt, Homo sapiens
cagcgagcauaugcaggaa

SEQ ID NO: 1576926 - RNA, 19 nt, Homo sapiens
ccaagucauugaaaagugu

SEQ ID NO: 1576927 - RNA, 19 nt, Homo sapiens
gcaauaagcuggacuagug

SEQ ID NO: 1576928 - RNA, 19 nt, Homo sapiens
gaacagagauuuacaugag

SEQ ID NO: 1576929 - RNA, 19 nt, Homo sapiens
ccaaauagauuccgauguu

SEQ ID NO: 1576930 - RNA, 19 nt, Homo sapiens
gcaagaggcugcugaguag

SEQ ID NO: 1576931 - RNA, 19 nt, Homo sapiens
aaaggaagcuaacgcagua

SEQ ID NO: 1576932 - RNA, 19 nt, Homo sapiens
ucacaaggauaauagagua

SEQ ID NO: 1576933 - RNA, 19 nt, Homo sapiens
gcugaaggaugccauguuu

SEQ ID NO: 1576934 - RNA, 19 nt, Homo sapiens
aaauggacguuaccaaaua

SEQ ID NO: 1576935 - RNA, 19 nt, Homo sapiens
uagaacaacuugaagauug

SEQ ID NO: 1576936 - RNA, 19 nt, Homo sapiens
gaaacuguccaucucuuua

SEQ ID NO: 1576937 - RNA, 19 nt, Homo sapiens
ggcagucucuuucuguuua

SEQ ID NO: 1576938 - RNA, 19 nt, Homo sapiens
ggucaaaucaacugaauaa

SEQ ID NO: 1576939 - RNA, 19 nt, Homo sapiens
gagcaacaguaauggagua

SEQ ID NO: 1576940 - RNA, 19 nt, Homo sapiens
ccacaggaaucuggaauuu

SEQ ID NO: 1576941 - RNA, 19 nt, Homo sapiens
gaaugugaccuuuaagaaa

SEQ ID NO: 1576942 - RNA, 19 nt, Homo sapiens
gaacaucgcagagcuguau

SEQ ID NO: 1576943 - RNA, 19 nt, Homo sapiens
gugaagagccagcaguuua

SEQ ID NO: 1576944 - RNA, 19 nt, Homo sapiens
ugacacagcuuauuuacca

SEQ ID NO: 1576945 - RNA, 19 nt, Homo sapiens
ucaaaugccuucaugaauc

SEQ ID NO: 1576946 - RNA, 19 nt, Homo sapiens
gaucgugucugcugacugu

SEQ ID NO: 1576947 - RNA, 19 nt, Homo sapiens
ggagagcuguggaccaaug

SEQ ID NO: 1576948 - RNA, 19 nt, Homo sapiens
gaagcugacuuacaggaau

SEQ ID NO: 1576949 - RNA, 19 nt, Homo sapiens
ccagaaagagcaacaguaa

SEQ ID NO: 1576950 - RNA, 19 nt, Homo sapiens
gaagaugucuauuuuccua

SEQ ID NO: 1576951 - RNA, 19 nt, Homo sapiens
gaagugacaauaaagaaga

SEQ ID NO: 1576952 - RNA, 19 nt, Homo sapiens
gcaacgcucucucuacauc

SEQ ID NO: 1576953 - RNA, 19 nt, Homo sapiens
caccaacgcuugaauaugg

SEQ ID NO: 1576954 - RNA, 19 nt, Homo sapiens
uggaagacauugcagauga

SEQ ID NO: 1576955 - RNA, 19 nt, Homo sapiens
gggaauagguagccacauc

SEQ ID NO: 1576956 - RNA, 19 nt, Homo sapiens
gaugagaaugugaccuuua

SEQ ID NO: 1576957 - RNA, 19 nt, Homo sapiens
gguaaauucugguauacau

SEQ ID NO: 1576958 - RNA, 19 nt, Homo sapiens
gaccgaagaugucuauuuu

SEQ ID NO: 1576959 - RNA, 19 nt, Homo sapiens
acaggaaucuggaauuuua

SEQ ID NO: 1576960 - RNA, 19 nt, Homo sapiens
ugaguagucuuauguaaag

SEQ ID NO: 1576961 - RNA, 19 nt, Homo sapiens
cagaauagcuguuuugugu

SEQ ID NO: 1576962 - RNA, 19 nt, Homo sapiens
gccaagagguaccaugguu

SEQ ID NO: 1576963 - RNA, 19 nt, Homo sapiens
auggcuaacugaugaauua

SEQ ID NO: 1576964 - RNA, 19 nt, Homo sapiens
gauaauagaguagccuaaa

SEQ ID NO: 1576965 - RNA, 19 nt, Homo sapiens
ggacaacgaccacaggaau

SEQ ID NO: 1576966 - RNA, 19 nt, Homo sapiens
gcacugagcacuuuaugag

SEQ ID NO: 1576967 - RNA, 19 nt, Homo sapiens
caaaugccuucaugaaucu

SEQ ID NO: 1576968 - RNA, 19 nt, Homo sapiens
caugugaagcuauuugaua

SEQ ID NO: 1576969 - RNA, 19 nt, Homo sapiens
caacaguaauggaguacau

SEQ ID NO: 1576970 - RNA, 19 nt, Homo sapiens
agaaagagcaacaguaaug

SEQ ID NO: 1576971 - RNA, 19 nt, Homo sapiens
gagaaugugaccuuuaaga

SEQ ID NO: 1576972 - RNA, 19 nt, Homo sapiens
ugaauuagaagccaucuga

SEQ ID NO: 1576973 - RNA, 19 nt, Homo sapiens
ccaaugagagaauuugaaa

SEQ ID NO: 1576974 - RNA, 19 nt, Homo sapiens
agaauggcguguaaacuga

SEQ ID NO: 1576975 - RNA, 19 nt, Homo sapiens
cacaagauauaaagacgaa

SEQ ID NO: 1576976 - RNA, 19 nt, Homo sapiens
ggaauauugguucugauuu

SEQ ID NO: 1576977 - RNA, 19 nt, Homo sapiens
ucaagguucucauuucuca

SEQ ID NO: 1576978 - RNA, 19 nt, Homo sapiens
gauauuaaaccuagcaaca

SEQ ID NO: 1576979 - RNA, 19 nt, Homo sapiens
ggacguuaccaaauagauu

SEQ ID NO: 1576980 - RNA, 19 nt, Homo sapiens
acacugcacugagcacuuu

SEQ ID NO: 1576981 - RNA, 19 nt, Homo sapiens
gacaaagcauguucucaag

SEQ ID NO: 1576982 - RNA, 19 nt, Homo sapiens
ugacaaagcauguucucaa

SEQ ID NO: 1576983 - RNA, 19 nt, Homo sapiens
gaauagcuguuuuguguau

SEQ ID NO: 1576984 - RNA, 19 nt, Homo sapiens
aagcuucccuggagagaaa

SEQ ID NO: 1576985 - RNA, 19 nt, Homo sapiens
uaaaguaugugaguagucu

SEQ ID NO: 1576986 - RNA, 19 nt, Homo sapiens
guacauaauccacaagcaa

SEQ ID NO: 1576987 - RNA, 19 nt, Homo sapiens
ggaugagaaugugaccuuu

SEQ ID NO: 1576988 - RNA, 19 nt, Homo sapiens
gaugagagagcugauagaa

SEQ ID NO: 1576989 - RNA, 19 nt, Homo sapiens
caaugugguuggucaaauc

SEQ ID NO: 1576990 - RNA, 19 nt, Homo sapiens
uauaucaaaugccuucaug

SEQ ID NO: 1576991 - RNA, 19 nt, Homo sapiens
uaucaaaugccuucaugaa

SEQ ID NO: 1576992 - RNA, 19 nt, Homo sapiens
gaccaccaacgcuugaaua

SEQ ID NO: 1576993 - RNA, 19 nt, Homo sapiens
ccuccuaccuguacauaau

SEQ ID NO: 1576994 - RNA, 19 nt, Homo sapiens
ggaacagagauuuacauga

SEQ ID NO: 1576995 - RNA, 19 nt, Homo sapiens
aagcugacuuacaggaaua

SEQ ID NO: 1576996 - RNA, 19 nt, Homo sapiens
caaauagauuccgauguuc

SEQ ID NO: 1576997 - RNA, 19 nt, Homo sapiens
augagaaugugaccuuuaa

SEQ ID NO: 1576998 - RNA, 19 nt, Homo sapiens
ccauguuugcucuaaauua

SEQ ID NO: 1576999 - RNA, 19 nt, Homo sapiens
gaugccauguuugcucuaa

SEQ ID NO: 1577000 - RNA, 19 nt, Homo sapiens
ugaccgaagaugucuauuu

SEQ ID NO: 1577001 - RNA, 19 nt, Homo sapiens
caagauauaaagacgaaga

SEQ ID NO: 1577002 - RNA, 19 nt, Homo sapiens
gcaggaauuugagaguuca

SEQ ID NO: 1577003 - RNA, 19 nt, Homo sapiens
acaggaauauugguucuga

SEQ ID NO: 1577004 - RNA, 19 nt, Homo sapiens
ggcaggaauuugagaguuc

SEQ ID NO: 1577005 - RNA, 19 nt, Homo sapiens
ggucaucacuccccaaaau

SEQ ID NO: 1577006 - RNA, 19 nt, Homo sapiens
gacagcaggccacuaguga

SEQ ID NO: 1577007 - RNA, 19 nt, Homo sapiens
gcagugugaccuccuguga

SEQ ID NO: 1577008 - RNA, 19 nt, Homo sapiens
gaacuuccugagaacauug

SEQ ID NO: 1577009 - RNA, 19 nt, Homo sapiens
ggccuaaguguucaaauga

SEQ ID NO: 1577010 - RNA, 19 nt, Homo sapiens
gagcuugaacucuguuaau

SEQ ID NO: 1577011 - RNA, 19 nt, Homo sapiens
gugaguagucuuauguaaa

SEQ ID NO: 1577012 - RNA, 19 nt, Homo sapiens
ugugaguagucuuauguaa

SEQ ID NO: 1577013 - RNA, 19 nt, Homo sapiens
ucaggugacgugauucuaa

SEQ ID NO: 1577014 - RNA, 19 nt, Homo sapiens
ggucucaagguucucauuu

SEQ ID NO: 1577015 - RNA, 19 nt, Homo sapiens
cccaagagccgcagaccua

SEQ ID NO: 1577016 - RNA, 19 nt, Homo sapiens
cccaguagaucaauuuaag

SEQ ID NO: 1577017 - RNA, 19 nt, Homo sapiens
uggaggauuugcuugcuuu

SEQ ID NO: 1577018 - RNA, 19 nt, Homo sapiens
uaugaacccagucuaauga

SEQ ID NO: 1577019 - RNA, 19 nt, Homo sapiens
gcuggcuacuucaaucuug

SEQ ID NO: 1577020 - RNA, 19 nt, Homo sapiens
cgcaagaggcugcugagua

SEQ ID NO: 1577021 - RNA, 19 nt, Homo sapiens
caaccaaagcagacaucua

SEQ ID NO: 1577022 - RNA, 19 nt, Homo sapiens
agaaaagaauggcguguaa

SEQ ID NO: 1577023 - RNA, 19 nt, Homo sapiens
gaauuugagaguucacaga

SEQ ID NO: 1577024 - RNA, 19 nt, Homo sapiens
cugagaacauugcugauuc

SEQ ID NO: 1577025 - RNA, 19 nt, Homo sapiens
uggccuaaguguucaaaug

SEQ ID NO: 1577026 - RNA, 19 nt, Homo sapiens
ggaagcugacuuacaggaa

SEQ ID NO: 1577027 - RNA, 19 nt, Homo sapiens
gcuaauaaaugaccaguuu

SEQ ID NO: 1577028 - RNA, 19 nt, Homo sapiens
gcaacuccaugccuauuua

SEQ ID NO: 1577029 - RNA, 19 nt, Homo sapiens
ggaaaccuguuaugccaaa

SEQ ID NO: 1577030 - RNA, 19 nt, Homo sapiens
ggagagcuuugcugagaug

SEQ ID NO: 1577031 - RNA, 19 nt, Homo sapiens
agaaggcacugaaggagaa

SEQ ID NO: 1577032 - RNA, 19 nt, Homo sapiens
gcucccagcuuauauggau

SEQ ID NO: 1577033 - RNA, 19 nt, Homo sapiens
aaggagagcuuugcugaga

SEQ ID NO: 1577034 - RNA, 19 nt, Homo sapiens
uguacgagcucaugaaagu

SEQ ID NO: 1577035 - RNA, 19 nt, Homo sapiens
ggcagaagcacuaugugua

SEQ ID NO: 1577036 - RNA, 19 nt, Homo sapiens
ggagguggcccaugucaag

SEQ ID NO: 1577037 - RNA, 19 nt, Homo sapiens
gcagaagcacuauguguac

SEQ ID NO: 1577038 - RNA, 19 nt, Homo sapiens
cgaguuguaucgcauuaag

SEQ ID NO: 1577039 - RNA, 19 nt, Homo sapiens
gcaauuuccaccucugugu

SEQ ID NO: 1577040 - RNA, 19 nt, Homo sapiens
caggguauuuagccuaguu

SEQ ID NO: 1577041 - RNA, 19 nt, Homo sapiens
gagcuuugcugagaugaac

SEQ ID NO: 1577042 - RNA, 19 nt, Homo sapiens
gucgaguuguaucgcauua

SEQ ID NO: 1577043 - RNA, 19 nt, Homo sapiens
ucaugaaaguguugugaag

SEQ ID NO: 1577044 - RNA, 19 nt, Homo sapiens
guucgcagcgcuacccuuu

SEQ ID NO: 1577045 - RNA, 19 nt, Homo sapiens
ccaugccuauuuacuggaa

SEQ ID NO: 1577046 - RNA, 19 nt, Homo sapiens
gagaaagucgaguuguauc

SEQ ID NO: 1577047 - RNA, 19 nt, Homo sapiens
ggcaguggcggcagaaugu

SEQ ID NO: 1577048 - RNA, 19 nt, Homo sapiens
gcucaugaaaguguuguga

SEQ ID NO: 1577049 - RNA, 19 nt, Homo sapiens
aagaguggguggccaagca

SEQ ID NO: 1577050 - RNA, 19 nt, Homo sapiens
gccagaaggcacugaagga

SEQ ID NO: 1577051 - RNA, 19 nt, Homo sapiens
ugugaagagcgaagacuuu

SEQ ID NO: 1577052 - RNA, 19 nt, Homo sapiens
ccauguucuucaucgguuu

SEQ ID NO: 1577053 - RNA, 19 nt, Homo sapiens
gagcaauuuccaccucugu

SEQ ID NO: 1577054 - RNA, 19 nt, Homo sapiens
gggcggagucuuccucgau

SEQ ID NO: 1577055 - RNA, 19 nt, Homo sapiens
gcggugccauguucuucau

SEQ ID NO: 1577056 - RNA, 19 nt, Homo sapiens
aaugaccaguuuaccugaa

SEQ ID NO: 1577057 - RNA, 19 nt, Homo sapiens
ugugggcggugccauguuc

SEQ ID NO: 1577058 - RNA, 19 nt, Homo sapiens
uguaucgcauuaaguucaa

SEQ ID NO: 1577059 - RNA, 19 nt, Homo sapiens
caugaaaguguugugaaga

SEQ ID NO: 1577060 - RNA, 19 nt, Homo sapiens
ggcagaauguuggcuacca

SEQ ID NO: 1577061 - RNA, 19 nt, Homo sapiens
uaaguucaaggagagcuuu

SEQ ID NO: 1577062 - RNA, 19 nt, Homo sapiens
guuaugccaaacaguugua

SEQ ID NO: 1577063 - RNA, 19 nt, Homo sapiens
guuggcaagcgagcaauuu

SEQ ID NO: 1577064 - RNA, 19 nt, Homo sapiens
cgcaauggcuucaagguua

SEQ ID NO: 1577065 - RNA, 19 nt, Homo sapiens
gagcaccugcacuaaauua

SEQ ID NO: 1577066 - RNA, 19 nt, Homo sapiens
agaagggacuggacccaua

SEQ ID NO: 1577067 - RNA, 19 nt, Homo sapiens
ggacuggacccauacaaug

SEQ ID NO: 1577068 - RNA, 19 nt, Homo sapiens
acacugagcaccugcacua

SEQ ID NO: 1577069 - RNA, 19 nt, Homo sapiens
gcaauggcuucaagguuac

SEQ ID NO: 1577070 - RNA, 19 nt, Homo sapiens
cugagcaccugcacuaaau

SEQ ID NO: 1577071 - RNA, 19 nt, Homo sapiens
caaaaugugcuguaaaguu

SEQ ID NO: 1577072 - RNA, 19 nt, Homo sapiens
gcuagucgcggacgcaaug

SEQ ID NO: 1577073 - RNA, 19 nt, Homo sapiens
caugcuggcugcaaagaag

SEQ ID NO: 1577074 - RNA, 19 nt, Homo sapiens
aagacuagccauugcauug

SEQ ID NO: 1577075 - RNA, 19 nt, Homo sapiens
ccaguaaagacuagccauu

SEQ ID NO: 1577076 - RNA, 19 nt, Homo sapiens
aauaguaggcugcaucugu

SEQ ID NO: 1577077 - RNA, 19 nt, Homo sapiens
caguaaagacuagccauug

SEQ ID NO: 1577078 - RNA, 19 nt, Homo sapiens
guaaagacuagccauugca

SEQ ID NO: 1577079 - RNA, 19 nt, Homo sapiens
gaagggacuggacccauac

SEQ ID NO: 1577080 - RNA, 19 nt, Homo sapiens
gacuggacccauacaaugu

SEQ ID NO: 1577081 - RNA, 19 nt, Homo sapiens
caccugcacuaaauuacuc

SEQ ID NO: 1577082 - RNA, 19 nt, Homo sapiens
gggacuggacccauacaau

SEQ ID NO: 1577083 - RNA, 19 nt, Homo sapiens
gcaccugcacuaaauuacu

SEQ ID NO: 1577084 - RNA, 19 nt, Homo sapiens
agaucaugcuggcugcaaa

SEQ ID NO: 1577085 - RNA, 19 nt, Homo sapiens
gcuguggagcccauuacaa

SEQ ID NO: 1577086 - RNA, 19 nt, Homo sapiens
aguaaagacuagccauugc

SEQ ID NO: 1577087 - RNA, 19 nt, Homo sapiens
gaucaugcuggcugcaaag

SEQ ID NO: 1577088 - RNA, 19 nt, Homo sapiens
ggagauggcuuaaauaaau

SEQ ID NO: 1577089 - RNA, 19 nt, Homo sapiens
cuacgaagaugaauaaaga

SEQ ID NO: 1577090 - RNA, 19 nt, Homo sapiens
gcacugguuuggaccguua

SEQ ID NO: 1577091 - RNA, 19 nt, Homo sapiens
ggcaggagauggcuuaaau

SEQ ID NO: 1577092 - RNA, 19 nt, Homo sapiens
aagcuaaccuucuuuacuu

SEQ ID NO: 1577093 - RNA, 19 nt, Homo sapiens
aagagaaucuggaccacua

SEQ ID NO: 1577094 - RNA, 19 nt, Homo sapiens
ccauaacccucaugugaau

SEQ ID NO: 1577095 - RNA, 19 nt, Homo sapiens
caggagauggcuuaaauaa

SEQ ID NO: 1577096 - RNA, 19 nt, Homo sapiens
gcaggagauggcuuaaaua

SEQ ID NO: 1577097 - RNA, 19 nt, Homo sapiens
aaaaguauaugggaccuua

SEQ ID NO: 1577098 - RNA, 19 nt, Homo sapiens
aaugaugacugguauacug

SEQ ID NO: 1577099 - RNA, 19 nt, Homo sapiens
cuaaccuucuuuacuugua

SEQ ID NO: 1577100 - RNA, 19 nt, Homo sapiens
gcucagcucgcauguggaa

SEQ ID NO: 1577101 - RNA, 19 nt, Homo sapiens
ccacggagagcacgagaga

SEQ ID NO: 1577102 - RNA, 19 nt, Homo sapiens
uauaugggaccuuaagcua

SEQ ID NO: 1577103 - RNA, 19 nt, Homo sapiens
ccaacuggcuacgaagaug

SEQ ID NO: 1577104 - RNA, 19 nt, Homo sapiens
accauacucuauuccauaa

SEQ ID NO: 1577105 - RNA, 19 nt, Homo sapiens
guugguguguccucgguuu

SEQ ID NO: 1577106 - RNA, 19 nt, Homo sapiens
uggcuacgaagaugaauaa

SEQ ID NO: 1577107 - RNA, 19 nt, Homo sapiens
uaaccauacucuauuccau

SEQ ID NO: 1577108 - RNA, 19 nt, Homo sapiens
cgaagaugaauaaagagaa

SEQ ID NO: 1577109 - RNA, 19 nt, Homo sapiens
caacuggcuacgaagauga

SEQ ID NO: 1577110 - RNA, 19 nt, Homo sapiens
caaaugaugacugguauac

SEQ ID NO: 1577111 - RNA, 19 nt, Homo sapiens
gcacgagagacccgaguuc

SEQ ID NO: 1577112 - RNA, 19 nt, Homo sapiens
cuuaagcuaaccuucuuua

SEQ ID NO: 1577113 - RNA, 19 nt, Homo sapiens
gaccguuacucugcacaug

SEQ ID NO: 1577114 - RNA, 19 nt, Homo sapiens
aaccauacucuauuccaua

SEQ ID NO: 1577115 - RNA, 19 nt, Homo sapiens
uaugggaccuuaagcuaac

SEQ ID NO: 1577116 - RNA, 19 nt, Homo sapiens
uuccauaacccucauguga

SEQ ID NO: 1577117 - RNA, 19 nt, Homo sapiens
cgagagacccgaguucauc

SEQ ID NO: 1577118 - RNA, 19 nt, Homo sapiens
ucaaaugaugacugguaua

SEQ ID NO: 1577119 - RNA, 19 nt, Homo sapiens
uaagcuaaccuucuuuacu

SEQ ID NO: 1577120 - RNA, 19 nt, Homo sapiens
gcuacgaagaugaauaaag

SEQ ID NO: 1577121 - RNA, 19 nt, Homo sapiens
gaccuuaagcuaaccuucu

SEQ ID NO: 1577122 - RNA, 19 nt, Homo sapiens
ccguuacucugcacaugga

SEQ ID NO: 1577123 - RNA, 19 nt, Homo sapiens
ucagcucgcauguggaaga

SEQ ID NO: 1577124 - RNA, 19 nt, Homo sapiens
auaugggaccuuaagcuaa

SEQ ID NO: 1577125 - RNA, 19 nt, Homo sapiens
uccauaacccucaugugaa

SEQ ID NO: 1577126 - RNA, 19 nt, Homo sapiens
caauaaaggugugaagcuu

SEQ ID NO: 1577127 - RNA, 19 nt, Homo sapiens
auaaaggugugaagcuuaa

SEQ ID NO: 1577128 - RNA, 19 nt, Homo sapiens
cacacucuguuccacaaua

SEQ ID NO: 1577129 - RNA, 19 nt, Homo sapiens
aauaaaggugugaagcuua

SEQ ID NO: 1577130 - RNA, 19 nt, Homo sapiens
cgaguuccgucccuaccaa

SEQ ID NO: 1577131 - RNA, 19 nt, Homo sapiens
acacucuguuccacaauag

SEQ ID NO: 1577132 - RNA, 19 nt, Homo sapiens
gauccuaaaucaugacuua

SEQ ID NO: 1577133 - RNA, 19 nt, Homo sapiens
ugacuuaccugcuaauaaa

SEQ ID NO: 1577134 - RNA, 19 nt, Homo sapiens
aaucaugacuuaccugcua

SEQ ID NO: 1577135 - RNA, 19 nt, Homo sapiens
acauugagcugcagguuga

SEQ ID NO: 1577136 - RNA, 19 nt, Homo sapiens
agaaggcaaugaccgcuaa

SEQ ID NO: 1577137 - RNA, 19 nt, Homo sapiens
ccaggauccuaaaucauga

SEQ ID NO: 1577138 - RNA, 19 nt, Homo sapiens
uaaaggaggcgauaucucu

SEQ ID NO: 1577139 - RNA, 19 nt, Homo sapiens
guccgacuguggugucuuu

SEQ ID NO: 1577140 - RNA, 19 nt, Homo sapiens
ggcaaugaccgcuaaagga

SEQ ID NO: 1577141 - RNA, 19 nt, Homo sapiens
gcagaacuaccuggacuuc

SEQ ID NO: 1577142 - RNA, 19 nt, Homo sapiens
ugaagccgcucgcaagacu

SEQ ID NO: 1577143 - RNA, 19 nt, Homo sapiens
aaccagaaccagacuagaa

SEQ ID NO: 1577144 - RNA, 19 nt, Homo sapiens
agaccaaaaucaagaacua

SEQ ID NO: 1577145 - RNA, 19 nt, Homo sapiens
cccaggauccuaaaucaug

SEQ ID NO: 1577146 - RNA, 19 nt, Homo sapiens
gcugaagccgcucgcaaga

SEQ ID NO: 1577147 - RNA, 19 nt, Homo sapiens
ucagcaccauggcggaaga

SEQ ID NO: 1577148 - RNA, 19 nt, Homo sapiens
gaaugguaccagcgugugu

SEQ ID NO: 1577149 - RNA, 19 nt, Homo sapiens
gaaggcaaugaccgcuaaa

SEQ ID NO: 1577150 - RNA, 19 nt, Homo sapiens
cgacuguggugucuuugcu

SEQ ID NO: 1577151 - RNA, 19 nt, Homo sapiens
ccacauccugggucacaga

SEQ ID NO: 1577152 - RNA, 19 nt, Homo sapiens
gcuaaaggaggcgauaucu

SEQ ID NO: 1577153 - RNA, 19 nt, Homo sapiens
ccaaccagaaccagacuag

SEQ ID NO: 1577154 - RNA, 19 nt, Homo sapiens
caugacuuaccugcuaaua

SEQ ID NO: 1577155 - RNA, 19 nt, Homo sapiens
gaggaaggcugguaucuuu

SEQ ID NO: 1577156 - RNA, 19 nt, Homo sapiens
gaaauaguuccucuugaua

SEQ ID NO: 1577157 - RNA, 19 nt, Homo sapiens
gaacuaugacacaugaaua

SEQ ID NO: 1577158 - RNA, 19 nt, Homo sapiens
ggacguugguguugagguu

SEQ ID NO: 1577159 - RNA, 19 nt, Homo sapiens
ggaaggacguugguguuga

SEQ ID NO: 1577160 - RNA, 19 nt, Homo sapiens
ucauauggcuguagcauuc

SEQ ID NO: 1577161 - RNA, 19 nt, Homo sapiens
uaccauggcucccgaaguu

SEQ ID NO: 1577162 - RNA, 19 nt, Homo sapiens
agaaauaguuccucuugau

SEQ ID NO: 1577163 - RNA, 19 nt, Homo sapiens
ccuagaaguuugucacuga

SEQ ID NO: 1577164 - RNA, 19 nt, Homo sapiens
gaauaugugggcuaagaaa

SEQ ID NO: 1577165 - RNA, 19 nt, Homo sapiens
gaaggcauacgcagauuuc

SEQ ID NO: 1577166 - RNA, 19 nt, Homo sapiens
gaaggacguugguguugag

SEQ ID NO: 1577167 - RNA, 19 nt, Homo sapiens
ccugaacuaugacacauga

SEQ ID NO: 1577168 - RNA, 19 nt, Homo sapiens
auacgcagauuucuacaga

SEQ ID NO: 1577169 - RNA, 19 nt, Homo sapiens
ggaaggcugguaucuuuca

SEQ ID NO: 1577170 - RNA, 19 nt, Homo sapiens
ucguguggcugaucaaaga

SEQ ID NO: 1577171 - RNA, 19 nt, Homo sapiens
ggguugcagcuuuguauaa

SEQ ID NO: 1577172 - RNA, 19 nt, Homo sapiens
uaugugggcuaagaaauag

SEQ ID NO: 1577173 - RNA, 19 nt, Homo sapiens
auaugugggcuaagaaaua

SEQ ID NO: 1577174 - RNA, 19 nt, Homo sapiens
gagaugaggaaggcuggua

SEQ ID NO: 1577175 - RNA, 19 nt, Homo sapiens
aaagaaggcauacgcagau

SEQ ID NO: 1577176 - RNA, 19 nt, Homo sapiens
uugcagcuuuguauaaguu

SEQ ID NO: 1577177 - RNA, 19 nt, Homo sapiens
ccaggcgucugcgaaauca

SEQ ID NO: 1577178 - RNA, 19 nt, Homo sapiens
gguugcagcuuuguauaag

SEQ ID NO: 1577179 - RNA, 19 nt, Homo sapiens
caaggacaguaacuaccau

SEQ ID NO: 1577180 - RNA, 19 nt, Homo sapiens
gcgaaaucauauggcugua

SEQ ID NO: 1577181 - RNA, 19 nt, Homo sapiens
augaauaugugggcuaaga

SEQ ID NO: 1577182 - RNA, 19 nt, Homo sapiens
gcagcuuuguauaaguuuc

SEQ ID NO: 1577183 - RNA, 19 nt, Homo sapiens
ugaaagauuuugaggagau

SEQ ID NO: 1577184 - RNA, 19 nt, Homo sapiens
caggaaggacguugguguu

SEQ ID NO: 1577185 - RNA, 19 nt, Homo sapiens
ugaacuaugacacaugaau

SEQ ID NO: 1577186 - RNA, 19 nt, Homo sapiens
aagaaggcauacgcagauu

SEQ ID NO: 1577187 - RNA, 19 nt, Homo sapiens
ggcauacgcagauuucuac

SEQ ID NO: 1577188 - RNA, 19 nt, Homo sapiens
guaucaaggacaguaacua

SEQ ID NO: 1577189 - RNA, 19 nt, Homo sapiens
gaaggcugguaucuuucag

SEQ ID NO: 1577190 - RNA, 19 nt, Homo sapiens
ggccaggcgucugcgaaau

SEQ ID NO: 1577191 - RNA, 19 nt, Homo sapiens
ugaauaugugggcuaagaa

SEQ ID NO: 1577192 - RNA, 19 nt, Homo sapiens
uaucaaggacaguaacuac

SEQ ID NO: 1577193 - RNA, 19 nt, Homo sapiens
aggcgucugcgaaaucaua

SEQ ID NO: 1577194 - RNA, 19 nt, Homo sapiens
agaaggcauacgcagauuu

SEQ ID NO: 1577195 - RNA, 19 nt, Homo sapiens
aguguaaaguaaucuugga

SEQ ID NO: 1577196 - RNA, 19 nt, Homo sapiens
gaaagauuuugaggagaug

SEQ ID NO: 1577197 - RNA, 19 nt, Homo sapiens
ucaaggacaguaacuacca

SEQ ID NO: 1577198 - RNA, 19 nt, Homo sapiens
aggcauacgcagauuucua

SEQ ID NO: 1577199 - RNA, 19 nt, Homo sapiens
gaacaagugucaauaaacg

SEQ ID NO: 1577200 - RNA, 19 nt, Homo sapiens
aauaaacgcuggccucuga

SEQ ID NO: 1577201 - RNA, 19 nt, Homo sapiens
gcucggaggugcaaucucu

SEQ ID NO: 1577202 - RNA, 19 nt, Homo sapiens
gaaccgagugcgcgagaaa

SEQ ID NO: 1577203 - RNA, 19 nt, Homo sapiens
ugcaaucucuggcugugua

SEQ ID NO: 1577204 - RNA, 19 nt, Homo sapiens
gcgcugauccgcuccuuca

SEQ ID NO: 1577205 - RNA, 19 nt, Homo sapiens
gcccggaaccgcuuucaga

SEQ ID NO: 1577206 - RNA, 19 nt, Homo sapiens
ggugggaccaagcgaaauu

SEQ ID NO: 1577207 - RNA, 19 nt, Homo sapiens
gaaauuccgagaccgaaac

SEQ ID NO: 1577208 - RNA, 19 nt, Homo sapiens
gcgagaaacagaagcucuu

SEQ ID NO: 1577209 - RNA, 19 nt, Homo sapiens
aacacggccuucugcguuu

SEQ ID NO: 1577210 - RNA, 19 nt, Homo sapiens
gaacagggaguuggaacac

SEQ ID NO: 1577211 - RNA, 19 nt, Homo sapiens
uaaacgcuggccucugaaa

SEQ ID NO: 1577212 - RNA, 19 nt, Homo sapiens
guagacagaacagggaguu

SEQ ID NO: 1577213 - RNA, 19 nt, Homo sapiens
cgaaauuccgagaccgaaa

SEQ ID NO: 1577214 - RNA, 19 nt, Homo sapiens
cgagugcgcgagaaacaga

SEQ ID NO: 1577215 - RNA, 19 nt, Homo sapiens
gacagaacagggaguugga

SEQ ID NO: 1577216 - RNA, 19 nt, Homo sapiens
ugaacaagugucaauaaac

SEQ ID NO: 1577217 - RNA, 19 nt, Homo sapiens
gaaauuccacuguaucuaa

SEQ ID NO: 1577218 - RNA, 19 nt, Homo sapiens
ccaggaggaugaugaaauu

SEQ ID NO: 1577219 - RNA, 19 nt, Homo sapiens
uaaccgagcucuucuuugg

SEQ ID NO: 1577220 - RNA, 19 nt, Homo sapiens
guauagagccaccaugauu

SEQ ID NO: 1577221 - RNA, 19 nt, Homo sapiens
gcaaucgcuugguucaguu

SEQ ID NO: 1577222 - RNA, 19 nt, Homo sapiens
gcugaugcccuccuguaua

SEQ ID NO: 1577223 - RNA, 19 nt, Homo sapiens
ggcgguugcuggucaguaa

SEQ ID NO: 1577224 - RNA, 19 nt, Homo sapiens
ucauucagcucucuaugga

SEQ ID NO: 1577225 - RNA, 19 nt, Homo sapiens
guaguaacugccaccaaua

SEQ ID NO: 1577226 - RNA, 19 nt, Homo sapiens
uguaguaacugccaccaau

SEQ ID NO: 1577227 - RNA, 19 nt, Homo sapiens
ugaugaaauuccacuguau

SEQ ID NO: 1577228 - RNA, 19 nt, Homo sapiens
caccaugauucuuacaguu

SEQ ID NO: 1577229 - RNA, 19 nt, Homo sapiens
ggaggaugaugaaauucca

SEQ ID NO: 1577230 - RNA, 19 nt, Homo sapiens
aaaauaaaguuccggagaa

SEQ ID NO: 1577231 - RNA, 19 nt, Homo sapiens
cugaugcccuccuguauag

SEQ ID NO: 1577232 - RNA, 19 nt, Homo sapiens
gggcagaggacgauaagca

SEQ ID NO: 1577233 - RNA, 19 nt, Homo sapiens
augaugaaauuccacugua

SEQ ID NO: 1577234 - RNA, 19 nt, Homo sapiens
uaguaacugccaccaauaa

SEQ ID NO: 1577235 - RNA, 19 nt, Homo sapiens
ccaagaagcaggagugacu

SEQ ID NO: 1577236 - RNA, 19 nt, Homo sapiens
ccaccaugauucuuacagu

SEQ ID NO: 1577237 - RNA, 19 nt, Homo sapiens
gaugaugaaauuccacugu

SEQ ID NO: 1577238 - RNA, 19 nt, Homo sapiens
agagccaccaugauucuua

SEQ ID NO: 1577239 - RNA, 19 nt, Homo sapiens
gaugaaauuccacuguauc

SEQ ID NO: 1577240 - RNA, 19 nt, Homo sapiens
auaaauaaccgagcucuuc

SEQ ID NO: 1577241 - RNA, 19 nt, Homo sapiens
gagccaccaugauucuuac

SEQ ID NO: 1577242 - RNA, 19 nt, Homo sapiens
aaauaaaguuccggagaag

SEQ ID NO: 1577243 - RNA, 19 nt, Homo sapiens
guaacugccaccaauaaag

SEQ ID NO: 1577244 - RNA, 19 nt, Homo sapiens
aauaaccgagcucuucuuu

SEQ ID NO: 1577245 - RNA, 19 nt, Homo sapiens
uggcuucauuucccaagaa

SEQ ID NO: 1577246 - RNA, 19 nt, Homo sapiens
aagcaggagugacuucagu

SEQ ID NO: 1577247 - RNA, 19 nt, Homo sapiens
uagcugaugcccuccugua

SEQ ID NO: 1577248 - RNA, 19 nt, Homo sapiens
gauaaauaaccgagcucuu

SEQ ID NO: 1577249 - RNA, 19 nt, Homo sapiens
gccaagaugcugcggaauc

SEQ ID NO: 1577250 - RNA, 19 nt, Homo sapiens
uaaauaaccgagcucuucu

SEQ ID NO: 1577251 - RNA, 19 nt, Homo sapiens
ucccagcaaucgcuugguu

SEQ ID NO: 1577252 - RNA, 19 nt, Homo sapiens
ugaaauuccacuguaucua

SEQ ID NO: 1577253 - RNA, 19 nt, Homo sapiens
uauagagccaccaugauuc

SEQ ID NO: 1577254 - RNA, 19 nt, Homo sapiens
gucaguaacagccaagaug

SEQ ID NO: 1577255 - RNA, 19 nt, Homo sapiens
uaacugccaccaauaaagc

SEQ ID NO: 1577256 - RNA, 19 nt, Homo sapiens
ugagcuggcuguggcuuca

SEQ ID NO: 1577257 - RNA, 19 nt, Homo sapiens
ccagcaaucgcuugguuca

SEQ ID NO: 1577258 - RNA, 19 nt, Homo sapiens
cguuggugguguucaguug

SEQ ID NO: 1577259 - RNA, 19 nt, Homo sapiens
cuuuggggaucaauauuua

SEQ ID NO: 1577260 - RNA, 19 nt, Homo sapiens
caucccagcugguguaaua

SEQ ID NO: 1577261 - RNA, 19 nt, Homo sapiens
caaauacgguaaugcugua

SEQ ID NO: 1577262 - RNA, 19 nt, Homo sapiens
gauauggcauuauugaaga

SEQ ID NO: 1577263 - RNA, 19 nt, Homo sapiens
gcucauaauugaugccaaa

SEQ ID NO: 1577264 - RNA, 19 nt, Homo sapiens
gccacuuucuguauuguua

SEQ ID NO: 1577265 - RNA, 19 nt, Homo sapiens
caacacaagucggaauaga

SEQ ID NO: 1577266 - RNA, 19 nt, Homo sapiens
ccaaaggaauggaggaauc

SEQ ID NO: 1577267 - RNA, 19 nt, Homo sapiens
ggagccacuuucuguauug

SEQ ID NO: 1577268 - RNA, 19 nt, Homo sapiens
ggaggaaucaguaaucauc

SEQ ID NO: 1577269 - RNA, 19 nt, Homo sapiens
aaacagcucauaauugaug

SEQ ID NO: 1577270 - RNA, 19 nt, Homo sapiens
ggaauggaggaaucaguaa

SEQ ID NO: 1577271 - RNA, 19 nt, Homo sapiens
cagcugguguaauaaugaa

SEQ ID NO: 1577272 - RNA, 19 nt, Homo sapiens
ccagaaacguacaccugau

SEQ ID NO: 1577273 - RNA, 19 nt, Homo sapiens
gaauggaggaaucaguaau

SEQ ID NO: 1577274 - RNA, 19 nt, Homo sapiens
acacaagucggaauagaau

SEQ ID NO: 1577275 - RNA, 19 nt, Homo sapiens
cuaaaucgucuccaaguuc

SEQ ID NO: 1577276 - RNA, 19 nt, Homo sapiens
aaggguaccugaagcgaau

SEQ ID NO: 1577277 - RNA, 19 nt, Homo sapiens
cagaaacguacaccugauu

SEQ ID NO: 1577278 - RNA, 19 nt, Homo sapiens
uggagccacuuucuguauu

SEQ ID NO: 1577279 - RNA, 19 nt, Homo sapiens
caugacaaauacgguaaug

SEQ ID NO: 1577280 - RNA, 19 nt, Homo sapiens
caaggcagagccaccagaa

SEQ ID NO: 1577281 - RNA, 19 nt, Homo sapiens
acuaaaucgucuccaaguu

SEQ ID NO: 1577282 - RNA, 19 nt, Homo sapiens
gcugguguaauaaugaauu

SEQ ID NO: 1577283 - RNA, 19 nt, Homo sapiens
caaaggaauggaggaauca

SEQ ID NO: 1577284 - RNA, 19 nt, Homo sapiens
agaaacguacaccugauuu

SEQ ID NO: 1577285 - RNA, 19 nt, Homo sapiens
aggaauggaggaaucagua

SEQ ID NO: 1577286 - RNA, 19 nt, Homo sapiens
gauguuucccuuggucaaa

SEQ ID NO: 1577287 - RNA, 19 nt, Homo sapiens
gcaguucuagcuucaccuu

SEQ ID NO: 1577288 - RNA, 19 nt, Homo sapiens
ccagcugguguaauaauga

SEQ ID NO: 1577289 - RNA, 19 nt, Homo sapiens
aaucaucccagcuggugua

SEQ ID NO: 1577290 - RNA, 19 nt, Homo sapiens
ugacaaauacgguaaugcu

SEQ ID NO: 1577291 - RNA, 19 nt, Homo sapiens
gaaacguacaccugauuuu

SEQ ID NO: 1577292 - RNA, 19 nt, Homo sapiens
guguacccauuaagauaug

SEQ ID NO: 1577293 - RNA, 19 nt, Homo sapiens
ggucaaaagcgcacuaaau

SEQ ID NO: 1577294 - RNA, 19 nt, Homo sapiens
gagccacuuucuguauugu

SEQ ID NO: 1577295 - RNA, 19 nt, Homo sapiens
cagagccaccagaaacgua

SEQ ID NO: 1577296 - RNA, 19 nt, Homo sapiens
agauauggcauuauugaag

SEQ ID NO: 1577297 - RNA, 19 nt, Homo sapiens
cuguguacccauuaagaua

SEQ ID NO: 1577298 - RNA, 19 nt, Homo sapiens
gcaacacaagucggaauag

SEQ ID NO: 1577299 - RNA, 19 nt, Homo sapiens
cgcacuaaaucgucuccaa

SEQ ID NO: 1577300 - RNA, 19 nt, Homo sapiens
aguucuagcuucaccuuca

SEQ ID NO: 1577301 - RNA, 19 nt, Homo sapiens
cagcuguauugccgcaguu

SEQ ID NO: 1577302 - RNA, 19 nt, Homo sapiens
cccagcugguguaauaaug

SEQ ID NO: 1577303 - RNA, 19 nt, Homo sapiens
ucacgauguuucccuuggu

SEQ ID NO: 1577304 - RNA, 19 nt, Homo sapiens
ggaaguggaucaaacuaga

SEQ ID NO: 1577305 - RNA, 19 nt, Homo sapiens
gaucaaacuagaacucaua

SEQ ID NO: 1577306 - RNA, 19 nt, Homo sapiens
uaacagauaugaagagcau

SEQ ID NO: 1577307 - RNA, 19 nt, Homo sapiens
uagcuaagauguguuugua

SEQ ID NO: 1577308 - RNA, 19 nt, Homo sapiens
gcuaagauguguuuguacu

SEQ ID NO: 1577309 - RNA, 19 nt, Homo sapiens
cauuucaucuguccucauu

SEQ ID NO: 1577310 - RNA, 19 nt, Homo sapiens
gggaagaauuugccauuuu

SEQ ID NO: 1577311 - RNA, 19 nt, Homo sapiens
guacuuuggaucugcauuu

SEQ ID NO: 1577312 - RNA, 19 nt, Homo sapiens
ggaagaauuugccauuuuc

SEQ ID NO: 1577313 - RNA, 19 nt, Homo sapiens
ggagggcccugggaagaau

SEQ ID NO: 1577314 - RNA, 19 nt, Homo sapiens
gaaguggaucaaacuagaa

SEQ ID NO: 1577315 - RNA, 19 nt, Homo sapiens
gaaaacaaguggucguuac

SEQ ID NO: 1577316 - RNA, 19 nt, Homo sapiens
caaacuagaacucauaugc

SEQ ID NO: 1577317 - RNA, 19 nt, Homo sapiens
guuacuagcuaagaugugu

SEQ ID NO: 1577318 - RNA, 19 nt, Homo sapiens
ggucguuacuagcuaagau

SEQ ID NO: 1577319 - RNA, 19 nt, Homo sapiens
acagauaugaagagcauuu

SEQ ID NO: 1577320 - RNA, 19 nt, Homo sapiens
ggaucaaacuagaacucau

SEQ ID NO: 1577321 - RNA, 19 nt, Homo sapiens
ugggaagaauuugccauuu

SEQ ID NO: 1577322 - RNA, 19 nt, Homo sapiens
aaacaaguggucguuacua

SEQ ID NO: 1577323 - RNA, 19 nt, Homo sapiens
uguuucaguuccuccauuu

SEQ ID NO: 1577324 - RNA, 19 nt, Homo sapiens
ccauuuaacagauaugaag

SEQ ID NO: 1577325 - RNA, 19 nt, Homo sapiens
uuucaguuccuccauuuaa

SEQ ID NO: 1577326 - RNA, 19 nt, Homo sapiens
aagauguguuuguacuuug

SEQ ID NO: 1577327 - RNA, 19 nt, Homo sapiens
ggaaaacaaguggucguua

SEQ ID NO: 1577328 - RNA, 19 nt, Homo sapiens
guuccuccauuuaacagau

SEQ ID NO: 1577329 - RNA, 19 nt, Homo sapiens
aacaaguggucguuacuag

SEQ ID NO: 1577330 - RNA, 19 nt, Homo sapiens
gugccgccauuucaucugu

SEQ ID NO: 1577331 - RNA, 19 nt, Homo sapiens
uuggugaggugccgccauu

SEQ ID NO: 1577332 - RNA, 19 nt, Homo sapiens
ggugaggugccgccauuuc

SEQ ID NO: 1577333 - RNA, 19 nt, Homo sapiens
cauaaggauguuucaguuc

SEQ ID NO: 1577334 - RNA, 19 nt, Homo sapiens
cagagcauccggagguuca

SEQ ID NO: 1577335 - RNA, 19 nt, Homo sapiens
gugaggugccgccauuuca

SEQ ID NO: 1577336 - RNA, 19 nt, Homo sapiens
uuucaucuguccucauucu

SEQ ID NO: 1577337 - RNA, 19 nt, Homo sapiens
gaggugccgccauuucauc

SEQ ID NO: 1577338 - RNA, 19 nt, Homo sapiens
caaguggucguuacuagcu

SEQ ID NO: 1577339 - RNA, 19 nt, Homo sapiens
ccaacugcuuaaaacauaa

SEQ ID NO: 1577340 - RNA, 19 nt, Homo sapiens
aguaagacaccaacugcuu

SEQ ID NO: 1577341 - RNA, 19 nt, Homo sapiens
gccagagcauccggagguu

SEQ ID NO: 1577342 - RNA, 19 nt, Homo sapiens
gcgccaagauccauucguu

SEQ ID NO: 1577343 - RNA, 19 nt, Homo sapiens
ugucacaccuggagaccua

SEQ ID NO: 1577344 - RNA, 19 nt, Homo sapiens
ccagucaccucuucugcaa

SEQ ID NO: 1577345 - RNA, 19 nt, Homo sapiens
uggaucaugucauucaauu

SEQ ID NO: 1577346 - RNA, 19 nt, Homo sapiens
gaauuggccguugggcuua

SEQ ID NO: 1577347 - RNA, 19 nt, Homo sapiens
caauuccagucaccucuuc

SEQ ID NO: 1577348 - RNA, 19 nt, Homo sapiens
gaucaugucauucaauucc

SEQ ID NO: 1577349 - RNA, 19 nt, Homo sapiens
cugcaaucaugaccucuug

SEQ ID NO: 1577350 - RNA, 19 nt, Homo sapiens
ucauguuacugcauuugug

SEQ ID NO: 1577351 - RNA, 19 nt, Homo sapiens
cuacaggaggccagaguga

SEQ ID NO: 1577352 - RNA, 19 nt, Homo sapiens
agucaccucuucugcaauc

SEQ ID NO: 1577353 - RNA, 19 nt, Homo sapiens
caccucuucugcaaucaug

SEQ ID NO: 1577354 - RNA, 19 nt, Homo sapiens
gaagauccaagaaugauua

SEQ ID NO: 1577355 - RNA, 19 nt, Homo sapiens
cuacauugauccugaauuu

SEQ ID NO: 1577356 - RNA, 19 nt, Homo sapiens
gaacuucuaaccauguuua

SEQ ID NO: 1577357 - RNA, 19 nt, Homo sapiens
caaugaaucugacaauguu

SEQ ID NO: 1577358 - RNA, 19 nt, Homo sapiens
uaacaucucuggauacagu

SEQ ID NO: 1577359 - RNA, 19 nt, Homo sapiens
ugauaacucucuugucuuu

SEQ ID NO: 1577360 - RNA, 19 nt, Homo sapiens
gaaggccugugaaacauga

SEQ ID NO: 1577361 - RNA, 19 nt, Homo sapiens
gcaacuaagucuuccuuca

SEQ ID NO: 1577362 - RNA, 19 nt, Homo sapiens
ugaagaaguuacagaagaa

SEQ ID NO: 1577363 - RNA, 19 nt, Homo sapiens
gagcuaagaauccuacuga

SEQ ID NO: 1577364 - RNA, 19 nt, Homo sapiens
ccucuaacaucucuggaua

SEQ ID NO: 1577365 - RNA, 19 nt, Homo sapiens
gcaaugaaucugacaaugu

SEQ ID NO: 1577366 - RNA, 19 nt, Homo sapiens
uaagaauccuacugacaaa

SEQ ID NO: 1577367 - RNA, 19 nt, Homo sapiens
ccuaaggacuaaguaauuu

SEQ ID NO: 1577368 - RNA, 19 nt, Homo sapiens
aaacucauaugccuagcua

SEQ ID NO: 1577369 - RNA, 19 nt, Homo sapiens
guagugagcugaucaucca

SEQ ID NO: 1577370 - RNA, 19 nt, Homo sapiens
gaucauccacuuucuucua

SEQ ID NO: 1577371 - RNA, 19 nt, Homo sapiens
guugaaaucucacgcuguu

SEQ ID NO: 1577372 - RNA, 19 nt, Homo sapiens
acaaguccaugaauguuaa

SEQ ID NO: 1577373 - RNA, 19 nt, Homo sapiens
uuagagaguuggcaccuuu

SEQ ID NO: 1577374 - RNA, 19 nt, Homo sapiens
aaacaugacacugcaguua

SEQ ID NO: 1577375 - RNA, 19 nt, Homo sapiens
uaaaugaaggcacucagua

SEQ ID NO: 1577376 - RNA, 19 nt, Homo sapiens
cagcuuguccaaagauuua

SEQ ID NO: 1577377 - RNA, 19 nt, Homo sapiens
cugaagaguuugauacuau

SEQ ID NO: 1577378 - RNA, 19 nt, Homo sapiens
acaagacgacccucacuua

SEQ ID NO: 1577379 - RNA, 19 nt, Homo sapiens
ccuaacagcuuguccaaag

SEQ ID NO: 1577380 - RNA, 19 nt, Homo sapiens
gaagaacaaaggcuuaauc

SEQ ID NO: 1577381 - RNA, 19 nt, Homo sapiens
ggucaugccucagacaaga

SEQ ID NO: 1577382 - RNA, 19 nt, Homo sapiens
gaucuuaucacucuuucuu

SEQ ID NO: 1577383 - RNA, 19 nt, Homo sapiens
uuuaaaggcugcccaaugu

SEQ ID NO: 1577384 - RNA, 19 nt, Homo sapiens
caacuaagucuuccuucaa

SEQ ID NO: 1577385 - RNA, 19 nt, Homo sapiens
uaauugaagucagcaacua

SEQ ID NO: 1577386 - RNA, 19 nt, Homo sapiens
ccaagaaugauuaaaguug

SEQ ID NO: 1577387 - RNA, 19 nt, Homo sapiens
caaagcaucaccauuacaa

SEQ ID NO: 1577388 - RNA, 19 nt, Homo sapiens
caaaggaagggcacaaguu

SEQ ID NO: 1577389 - RNA, 19 nt, Homo sapiens
ggacaccugaaauauaauu

SEQ ID NO: 1577390 - RNA, 19 nt, Homo sapiens
agccaaagcaucaccauua

SEQ ID NO: 1577391 - RNA, 19 nt, Homo sapiens
gcaaacagaaauauaugug

SEQ ID NO: 1577392 - RNA, 19 nt, Homo sapiens
gugggauugugaagauuua

SEQ ID NO: 1577393 - RNA, 19 nt, Homo sapiens
uaaaagaguugguugcuau

SEQ ID NO: 1577394 - RNA, 19 nt, Homo sapiens
uaaauugguuggccuaagg

SEQ ID NO: 1577395 - RNA, 19 nt, Homo sapiens
gaagauuuacugacaucaa

SEQ ID NO: 1577396 - RNA, 19 nt, Homo sapiens
ugacaaaccaguaauugga

SEQ ID NO: 1577397 - RNA, 19 nt, Homo sapiens
ccauguuuauugugucuaa

SEQ ID NO: 1577398 - RNA, 19 nt, Homo sapiens
aggcauggguucagcuuaa

SEQ ID NO: 1577399 - RNA, 19 nt, Homo sapiens
acaugacacugcaguuaaa

SEQ ID NO: 1577400 - RNA, 19 nt, Homo sapiens
aaauguaugcucaggguua

SEQ ID NO: 1577401 - RNA, 19 nt, Homo sapiens
cauggugccuguuaaagau

SEQ ID NO: 1577402 - RNA, 19 nt, Homo sapiens
ggagagucacagucuagua

SEQ ID NO: 1577403 - RNA, 19 nt, Homo sapiens
gagcugaucauccacuuuc

SEQ ID NO: 1577404 - RNA, 19 nt, Homo sapiens
gaggugcguuccuuucugu

SEQ ID NO: 1577405 - RNA, 19 nt, Homo sapiens
gcucaggguuauuuguuuc

SEQ ID NO: 1577406 - RNA, 19 nt, Homo sapiens
gauccaagaaugauuaaag

SEQ ID NO: 1577407 - RNA, 19 nt, Homo sapiens
cuaagaauccuacugacaa

SEQ ID NO: 1577408 - RNA, 19 nt, Homo sapiens
agacugcacuggcguuuua

SEQ ID NO: 1577409 - RNA, 19 nt, Homo sapiens
guugguagguauugucuuc

SEQ ID NO: 1577410 - RNA, 19 nt, Homo sapiens
ugacacugcaguuaaauug

SEQ ID NO: 1577411 - RNA, 19 nt, Homo sapiens
cauaauucccuuccagauu

SEQ ID NO: 1577412 - RNA, 19 nt, Homo sapiens
uauccuaucuucucaaagg

SEQ ID NO: 1577413 - RNA, 19 nt, Homo sapiens
ggauggaggugcguuccuu

SEQ ID NO: 1577414 - RNA, 19 nt, Homo sapiens
gcuguuagccaaagcauca

SEQ ID NO: 1577415 - RNA, 19 nt, Homo sapiens
cuaaaccagaggauuauaa

SEQ ID NO: 1577416 - RNA, 19 nt, Homo sapiens
caaaggagaaauauuguac

SEQ ID NO: 1577417 - RNA, 19 nt, Homo sapiens
gaagucagcaacuaagucu

SEQ ID NO: 1577418 - RNA, 19 nt, Homo sapiens
gagaggcggguggguguua

SEQ ID NO: 1577419 - RNA, 19 nt, Homo sapiens
ggaggugcguuccuuucug

SEQ ID NO: 1577420 - RNA, 19 nt, Homo sapiens
caggugggauugugaagau

SEQ ID NO: 1577421 - RNA, 19 nt, Homo sapiens
caaaguagaagaggaguca

SEQ ID NO: 1577422 - RNA, 19 nt, Homo sapiens
auaccauacugaagaguuu

SEQ ID NO: 1577423 - RNA, 19 nt, Homo sapiens
cauauauccuaucuucuca

SEQ ID NO: 1577424 - RNA, 19 nt, Homo sapiens
augaagaaguuacagaaga

SEQ ID NO: 1577425 - RNA, 19 nt, Homo sapiens
cugggaagcuggagaguca

SEQ ID NO: 1577426 - RNA, 19 nt, Homo sapiens
cuugauaacucucuugucu

SEQ ID NO: 1577427 - RNA, 19 nt, Homo sapiens
cuucuaaccauguuuauug

SEQ ID NO: 1577428 - RNA, 19 nt, Homo sapiens
augccuagcuagaauauau

SEQ ID NO: 1577429 - RNA, 19 nt, Homo sapiens
ucauaugccuagcuagaau

SEQ ID NO: 1577430 - RNA, 19 nt, Homo sapiens
aaaggaagggcacaaguug

SEQ ID NO: 1577431 - RNA, 19 nt, Homo sapiens
gcugaagauccaagaauga

SEQ ID NO: 1577432 - RNA, 19 nt, Homo sapiens
gaagcuggacaguauuuca

SEQ ID NO: 1577433 - RNA, 19 nt, Homo sapiens
gagagucacagucuaguag

SEQ ID NO: 1577434 - RNA, 19 nt, Homo sapiens
caaguucuguugaaaucuc

SEQ ID NO: 1577435 - RNA, 19 nt, Homo sapiens
gccuaaggacuaaguaauu

SEQ ID NO: 1577436 - RNA, 19 nt, Homo sapiens
ugagguggcuugggacaug

SEQ ID NO: 1577437 - RNA, 19 nt, Homo sapiens
uacaaguccaugaauguua

SEQ ID NO: 1577438 - RNA, 19 nt, Homo sapiens
cuaaccauguuuauugugu

SEQ ID NO: 1577439 - RNA, 19 nt, Homo sapiens
ggguucagcuuaauuccau

SEQ ID NO: 1577440 - RNA, 19 nt, Homo sapiens
ggguagagccguuucuuag

SEQ ID NO: 1577441 - RNA, 19 nt, Homo sapiens
ugaauuugcugaagaucca

SEQ ID NO: 1577442 - RNA, 19 nt, Homo sapiens
gaaacaugacacugcaguu

SEQ ID NO: 1577443 - RNA, 19 nt, Homo sapiens
gcggguggguguuaguuca

SEQ ID NO: 1577444 - RNA, 19 nt, Homo sapiens
gcugugugacgauuucuaa

SEQ ID NO: 1577445 - RNA, 19 nt, Homo sapiens
acauucaguuucucacauu

SEQ ID NO: 1577446 - RNA, 19 nt, Homo sapiens
accagaggauuauaaagaa

SEQ ID NO: 1577447 - RNA, 19 nt, Homo sapiens
gucaucaaauguacaacuu

SEQ ID NO: 1577448 - RNA, 19 nt, Homo sapiens
gugaagauuuacugacauc

SEQ ID NO: 1577449 - RNA, 19 nt, Homo sapiens
gccaaagcaucaccauuac

SEQ ID NO: 1577450 - RNA, 19 nt, Homo sapiens
guagaagaggagucacuaa

SEQ ID NO: 1577451 - RNA, 19 nt, Homo sapiens
aacuaagucuuccuucaaa

SEQ ID NO: 1577452 - RNA, 19 nt, Homo sapiens
guuccaggauauaauugaa

SEQ ID NO: 1577453 - RNA, 19 nt, Homo sapiens
gcuggagagucacagucua

SEQ ID NO: 1577454 - RNA, 19 nt, Homo sapiens
gaagaaaccuggccuuaua

SEQ ID NO: 1577455 - RNA, 19 nt, Homo sapiens
gaucagcccugguucuuua

SEQ ID NO: 1577456 - RNA, 19 nt, Homo sapiens
gaugguagauuggcauuua

SEQ ID NO: 1577457 - RNA, 19 nt, Homo sapiens
ugugaaagcucucaauuaa

SEQ ID NO: 1577458 - RNA, 19 nt, Homo sapiens
gagaacaucuggagagaga

SEQ ID NO: 1577459 - RNA, 19 nt, Homo sapiens
ugcaagagcugguuguuua

SEQ ID NO: 1577460 - RNA, 19 nt, Homo sapiens
ggccuuauaucauuucaua

SEQ ID NO: 1577461 - RNA, 19 nt, Homo sapiens
gcggaucccuuauguauga

SEQ ID NO: 1577462 - RNA, 19 nt, Homo sapiens
ugaaagcucucaauuaagu

SEQ ID NO: 1577463 - RNA, 19 nt, Homo sapiens
gaagaagagaucagaauga

SEQ ID NO: 1577464 - RNA, 19 nt, Homo sapiens
ggacuauacugcugaguuc

SEQ ID NO: 1577465 - RNA, 19 nt, Homo sapiens
gaacagugagccaaauaaa

SEQ ID NO: 1577466 - RNA, 19 nt, Homo sapiens
ggaagaacaucuggauuuc

SEQ ID NO: 1577467 - RNA, 19 nt, Homo sapiens
aagcagaauuccaaagaua

SEQ ID NO: 1577468 - RNA, 19 nt, Homo sapiens
ccaaagauaccagcaauuu

SEQ ID NO: 1577469 - RNA, 19 nt, Homo sapiens
ugaaguagcuuugcaaucu

SEQ ID NO: 1577470 - RNA, 19 nt, Homo sapiens
gaugaaaguugcaggaagu

SEQ ID NO: 1577471 - RNA, 19 nt, Homo sapiens
gaagcagaauuccaaagau

SEQ ID NO: 1577472 - RNA, 19 nt, Homo sapiens
gcucagccguggcaugaaa

SEQ ID NO: 1577473 - RNA, 19 nt, Homo sapiens
guaacuagguugacagagu

SEQ ID NO: 1577474 - RNA, 19 nt, Homo sapiens
caacuccaguacucuguaa

SEQ ID NO: 1577475 - RNA, 19 nt, Homo sapiens
ggauauaccuagauuccau

SEQ ID NO: 1577476 - RNA, 19 nt, Homo sapiens
gggaauaggugaaggaacu

SEQ ID NO: 1577477 - RNA, 19 nt, Homo sapiens
guaccaaauuuaagcaaga

SEQ ID NO: 1577478 - RNA, 19 nt, Homo sapiens
caauaugaaccaaguagua

SEQ ID NO: 1577479 - RNA, 19 nt, Homo sapiens
gaucucaguucucuuucaa

SEQ ID NO: 1577480 - RNA, 19 nt, Homo sapiens
gaagccgucucaugcagaa

SEQ ID NO: 1577481 - RNA, 19 nt, Homo sapiens
gcaguuugaucaccggauu

SEQ ID NO: 1577482 - RNA, 19 nt, Homo sapiens
augcugggcuuguuuauaa

SEQ ID NO: 1577483 - RNA, 19 nt, Homo sapiens
guccucagguucaauauga

SEQ ID NO: 1577484 - RNA, 19 nt, Homo sapiens
agugugacauucaguguua

SEQ ID NO: 1577485 - RNA, 19 nt, Homo sapiens
ugaaggaacuagggauauu

SEQ ID NO: 1577486 - RNA, 19 nt, Homo sapiens
gaaccaaguaguauucaug

SEQ ID NO: 1577487 - RNA, 19 nt, Homo sapiens
gcugaguucuggucuguug

SEQ ID NO: 1577488 - RNA, 19 nt, Homo sapiens
gaacuagggauauuuaacu

SEQ ID NO: 1577489 - RNA, 19 nt, Homo sapiens
gggcggaucccuuauguau

SEQ ID NO: 1577490 - RNA, 19 nt, Homo sapiens
ccaguacucuguaaguuuc

SEQ ID NO: 1577491 - RNA, 19 nt, Homo sapiens
uguuagaucuucuggguuu

SEQ ID NO: 1577492 - RNA, 19 nt, Homo sapiens
gaaggaacuagggauauuu

SEQ ID NO: 1577493 - RNA, 19 nt, Homo sapiens
caaguaguauucauguugu

SEQ ID NO: 1577494 - RNA, 19 nt, Homo sapiens
gaaaacagucccagaauga

SEQ ID NO: 1577495 - RNA, 19 nt, Homo sapiens
gggaacuaauuucaagauu

SEQ ID NO: 1577496 - RNA, 19 nt, Homo sapiens
ggauggagcaacccaauau

SEQ ID NO: 1577497 - RNA, 19 nt, Homo sapiens
gauaugacacugacagaau

SEQ ID NO: 1577498 - RNA, 19 nt, Homo sapiens
gcagaacagugagccaaau

SEQ ID NO: 1577499 - RNA, 19 nt, Homo sapiens
gagcaagauuccuguccuu

SEQ ID NO: 1577500 - RNA, 19 nt, Homo sapiens
gggaaucacuucagucacu

SEQ ID NO: 1577501 - RNA, 19 nt, Homo sapiens
ggugaucucaguucucuuu

SEQ ID NO: 1577502 - RNA, 19 nt, Homo sapiens
gaaaguugcaggaaguuag

SEQ ID NO: 1577503 - RNA, 19 nt, Homo sapiens
gagaugaagccaccuacaa

SEQ ID NO: 1577504 - RNA, 19 nt, Homo sapiens
gcaagagcugguuguuuaa

SEQ ID NO: 1577505 - RNA, 19 nt, Homo sapiens
ugaacuaggugaucucagu

SEQ ID NO: 1577506 - RNA, 19 nt, Homo sapiens
gucagcaaaucuucuguuu

SEQ ID NO: 1577507 - RNA, 19 nt, Homo sapiens
ccaaguaguauucauguug

SEQ ID NO: 1577508 - RNA, 19 nt, Homo sapiens
gcaggucugguguuccuua

SEQ ID NO: 1577509 - RNA, 19 nt, Homo sapiens
gaaguagcuuugcaaucug

SEQ ID NO: 1577510 - RNA, 19 nt, Homo sapiens
agauauugauggccacuaa

SEQ ID NO: 1577511 - RNA, 19 nt, Homo sapiens
ccgcacaaguugccugaaa

SEQ ID NO: 1577512 - RNA, 19 nt, Homo sapiens
ugacagaauucaaguucau

SEQ ID NO: 1577513 - RNA, 19 nt, Homo sapiens
uaaaugaccuaacguuucc

SEQ ID NO: 1577514 - RNA, 19 nt, Homo sapiens
cauaaaugaccuaacguuu

SEQ ID NO: 1577515 - RNA, 19 nt, Homo sapiens
caaaucucauguucaaagu

SEQ ID NO: 1577516 - RNA, 19 nt, Homo sapiens
ugauaugguuuggauguuu

SEQ ID NO: 1577517 - RNA, 19 nt, Homo sapiens
gaaguuaguuuuaguucug

SEQ ID NO: 1577518 - RNA, 19 nt, Homo sapiens
aaccuggccuuauaucauu

SEQ ID NO: 1577519 - RNA, 19 nt, Homo sapiens
gagacgauuugcucaugga

SEQ ID NO: 1577520 - RNA, 19 nt, Homo sapiens
gguagauuggcauuuaaua

SEQ ID NO: 1577521 - RNA, 19 nt, Homo sapiens
cuccaaaucucauguucaa

SEQ ID NO: 1577522 - RNA, 19 nt, Homo sapiens
aggaagaacaucuggauuu

SEQ ID NO: 1577523 - RNA, 19 nt, Homo sapiens
ggugaaggaacuagggaua

SEQ ID NO: 1577524 - RNA, 19 nt, Homo sapiens
gaaaccuggccuuauauca

SEQ ID NO: 1577525 - RNA, 19 nt, Homo sapiens
gaaggcaucagaaacaucu

SEQ ID NO: 1577526 - RNA, 19 nt, Homo sapiens
uaagccacauaucuagauu

SEQ ID NO: 1577527 - RNA, 19 nt, Homo sapiens
gauauaccuagauuccaua

SEQ ID NO: 1577528 - RNA, 19 nt, Homo sapiens
uaggguagaccaaaucaaa

SEQ ID NO: 1577529 - RNA, 19 nt, Homo sapiens
gcuguucccugucaucagu

SEQ ID NO: 1577530 - RNA, 19 nt, Homo sapiens
cagaacagugagccaaaua

SEQ ID NO: 1577531 - RNA, 19 nt, Homo sapiens
ccaaaucucauguucaaag

SEQ ID NO: 1577532 - RNA, 19 nt, Homo sapiens
cagugucccuucccucaaa

SEQ ID NO: 1577533 - RNA, 19 nt, Homo sapiens
aagaacaucuggauuucau

SEQ ID NO: 1577534 - RNA, 19 nt, Homo sapiens
cagugacucugcuggcuuu

SEQ ID NO: 1577535 - RNA, 19 nt, Homo sapiens
gcuagaugcugggcuuguu

SEQ ID NO: 1577536 - RNA, 19 nt, Homo sapiens
ggugaaaaguggacuagaa

SEQ ID NO: 1577537 - RNA, 19 nt, Homo sapiens
ggaguacucacaccgaaug

SEQ ID NO: 1577538 - RNA, 19 nt, Homo sapiens
gguccaggguuguuagauc

SEQ ID NO: 1577539 - RNA, 19 nt, Homo sapiens
ccacagagcccuggguugu

SEQ ID NO: 1577540 - RNA, 19 nt, Homo sapiens
guugggaacuaauuucaag

SEQ ID NO: 1577541 - RNA, 19 nt, Homo sapiens
gaagaacaucuggauuuca

SEQ ID NO: 1577542 - RNA, 19 nt, Homo sapiens
aacaguggcuggagcaguu

SEQ ID NO: 1577543 - RNA, 19 nt, Homo sapiens
caaaauaccccuaacauac

SEQ ID NO: 1577544 - RNA, 19 nt, Homo sapiens
ugucacagccauagucaaa

SEQ ID NO: 1577545 - RNA, 19 nt, Homo sapiens
ccauuacagugcucuacuu

SEQ ID NO: 1577546 - RNA, 19 nt, Homo sapiens
auaugacacugacagaauu

SEQ ID NO: 1577547 - RNA, 19 nt, Homo sapiens
gcgccaugcuuccuauaca

SEQ ID NO: 1577548 - RNA, 19 nt, Homo sapiens
aaucucauguucaaagugu

SEQ ID NO: 1577549 - RNA, 19 nt, Homo sapiens
gaccuguaguguaccauuc

SEQ ID NO: 1577550 - RNA, 19 nt, Homo sapiens
gaaaaguggacuagaagaa

SEQ ID NO: 1577551 - RNA, 19 nt, Homo sapiens
gggaugguauauggugaaa

SEQ ID NO: 1577552 - RNA, 19 nt, Homo sapiens
uaccagcaauuuccagaau

SEQ ID NO: 1577553 - RNA, 19 nt, Homo sapiens
caaagauaccagcaauuuc

SEQ ID NO: 1577554 - RNA, 19 nt, Homo sapiens
gaucagcccugguucuuua

SEQ ID NO: 1577555 - RNA, 19 nt, Homo sapiens
gaugguagauuggcauuua

SEQ ID NO: 1577556 - RNA, 19 nt, Homo sapiens
ccuaacagcuuuguaauaa

SEQ ID NO: 1577557 - RNA, 19 nt, Homo sapiens
ggaauggaaucgacaguau

SEQ ID NO: 1577558 - RNA, 19 nt, Homo sapiens
gauagucacuggaucaaga

SEQ ID NO: 1577559 - RNA, 19 nt, Homo sapiens
ugauaaggcuguuaacauu

SEQ ID NO: 1577560 - RNA, 19 nt, Homo sapiens
caccaugccuggcuaauuu

SEQ ID NO: 1577561 - RNA, 19 nt, Homo sapiens
gaucaagaaugcauuaagu

SEQ ID NO: 1577562 - RNA, 19 nt, Homo sapiens
gcuaaugucuucuaauauc

SEQ ID NO: 1577563 - RNA, 19 nt, Homo sapiens
caaauggucaacuuacuua

SEQ ID NO: 1577564 - RNA, 19 nt, Homo sapiens
gcacgcugcugauguaugu

SEQ ID NO: 1577565 - RNA, 19 nt, Homo sapiens
aagcagaauuccaaagaua

SEQ ID NO: 1577566 - RNA, 19 nt, Homo sapiens
gauaaggcuguuaacauua

SEQ ID NO: 1577567 - RNA, 19 nt, Homo sapiens
gaucuuaacuucacuucca

SEQ ID NO: 1577568 - RNA, 19 nt, Homo sapiens
ccaaagauaccagcaauuu

SEQ ID NO: 1577569 - RNA, 19 nt, Homo sapiens
ggaaucgacaguauaaauu

SEQ ID NO: 1577570 - RNA, 19 nt, Homo sapiens
ugaaguagcuuugcaaucu

SEQ ID NO: 1577571 - RNA, 19 nt, Homo sapiens
gaagcagaauuccaaagau

SEQ ID NO: 1577572 - RNA, 19 nt, Homo sapiens
gcucagccguggcaugaaa

SEQ ID NO: 1577573 - RNA, 19 nt, Homo sapiens
guaacuagguugacagagu

SEQ ID NO: 1577574 - RNA, 19 nt, Homo sapiens
ggugaagauugaaaggaua

SEQ ID NO: 1577575 - RNA, 19 nt, Homo sapiens
gcaguuugaucaccggauu

SEQ ID NO: 1577576 - RNA, 19 nt, Homo sapiens
augcugggcuuguuuauaa

SEQ ID NO: 1577577 - RNA, 19 nt, Homo sapiens
gaauggaaucgacaguaua

SEQ ID NO: 1577578 - RNA, 19 nt, Homo sapiens
ccuuaauucugccuaaaua

SEQ ID NO: 1577579 - RNA, 19 nt, Homo sapiens
uaacuucacuuccauuagg

SEQ ID NO: 1577580 - RNA, 19 nt, Homo sapiens
gaaucgacaguauaaauug

SEQ ID NO: 1577581 - RNA, 19 nt, Homo sapiens
cuacccagauaaacaaauu

SEQ ID NO: 1577582 - RNA, 19 nt, Homo sapiens
gguaaucgccaaauaguuc

SEQ ID NO: 1577583 - RNA, 19 nt, Homo sapiens
gauaugacacugacagaau

SEQ ID NO: 1577584 - RNA, 19 nt, Homo sapiens
ggaguacaauggcgugauc

SEQ ID NO: 1577585 - RNA, 19 nt, Homo sapiens
uugacaagcuuaaugugua

SEQ ID NO: 1577586 - RNA, 19 nt, Homo sapiens
uccauuaggugaagauuga

SEQ ID NO: 1577587 - RNA, 19 nt, Homo sapiens
ccaagugguuuccaaaugg

SEQ ID NO: 1577588 - RNA, 19 nt, Homo sapiens
gggaaucacuucagucacu

SEQ ID NO: 1577589 - RNA, 19 nt, Homo sapiens
ccaaagugcugagauuaca

SEQ ID NO: 1577590 - RNA, 19 nt, Homo sapiens
ggauugacauacccaaagu

SEQ ID NO: 1577591 - RNA, 19 nt, Homo sapiens
uaagugugguuacccuaaa

SEQ ID NO: 1577592 - RNA, 19 nt, Homo sapiens
gagaugaagccaccuacaa

SEQ ID NO: 1577593 - RNA, 19 nt, Homo sapiens
gaaaggauaggauugacau

SEQ ID NO: 1577594 - RNA, 19 nt, Homo sapiens
gguucuacguggaugauuu

SEQ ID NO: 1577595 - RNA, 19 nt, Homo sapiens
gcaggucugguguuccuua

SEQ ID NO: 1577596 - RNA, 19 nt, Homo sapiens
gaaguagcuuugcaaucug

SEQ ID NO: 1577597 - RNA, 19 nt, Homo sapiens
ugacaagcuuaauguguau

SEQ ID NO: 1577598 - RNA, 19 nt, Homo sapiens
ucagagaucauaagaacuu

SEQ ID NO: 1577599 - RNA, 19 nt, Homo sapiens
ccgcacaaguugccugaaa

SEQ ID NO: 1577600 - RNA, 19 nt, Homo sapiens
caucucggcuucccaaagu

SEQ ID NO: 1577601 - RNA, 19 nt, Homo sapiens
gagaugaccuugacauacc

SEQ ID NO: 1577602 - RNA, 19 nt, Homo sapiens
ugacagaauucaaguucau

SEQ ID NO: 1577603 - RNA, 19 nt, Homo sapiens
ggagguaaucgccaaauag

SEQ ID NO: 1577604 - RNA, 19 nt, Homo sapiens
cuacguggaugauuucuac

SEQ ID NO: 1577605 - RNA, 19 nt, Homo sapiens
gagacgauuugcucaugga

SEQ ID NO: 1577606 - RNA, 19 nt, Homo sapiens
gguagauuggcauuuaaua

SEQ ID NO: 1577607 - RNA, 19 nt, Homo sapiens
gcuaguuccucuuuugaua

SEQ ID NO: 1577608 - RNA, 19 nt, Homo sapiens
cauaagaacuugggcuuuu

SEQ ID NO: 1577609 - RNA, 19 nt, Homo sapiens
cuucagagaucauaagaac

SEQ ID NO: 1577610 - RNA, 19 nt, Homo sapiens
cagugacucugcuggcuuu

SEQ ID NO: 1577611 - RNA, 19 nt, Homo sapiens
gcuagaugcugggcuuguu

SEQ ID NO: 1577612 - RNA, 19 nt, Homo sapiens
ggugaaaaguggacuagaa

SEQ ID NO: 1577613 - RNA, 19 nt, Homo sapiens
ggaguacucacaccgaaug

SEQ ID NO: 1577614 - RNA, 19 nt, Homo sapiens
gcuguucccugucaucagu

SEQ ID NO: 1577615 - RNA, 19 nt, Homo sapiens
cagugucccuucccucaaa

SEQ ID NO: 1577616 - RNA, 19 nt, Homo sapiens
uacccuaaauguucccuuu

SEQ ID NO: 1577617 - RNA, 19 nt, Homo sapiens
ccacagagcccuggguugu

SEQ ID NO: 1577618 - RNA, 19 nt, Homo sapiens
ccaaauggucaacuuacuu

SEQ ID NO: 1577619 - RNA, 19 nt, Homo sapiens
ccauuacagugcucuacuu

SEQ ID NO: 1577620 - RNA, 19 nt, Homo sapiens
auaugacacugacagaauu

SEQ ID NO: 1577621 - RNA, 19 nt, Homo sapiens
aacaguggcuggagcaguu

SEQ ID NO: 1577622 - RNA, 19 nt, Homo sapiens
gagguaaucgccaaauagu

SEQ ID NO: 1577623 - RNA, 19 nt, Homo sapiens
aggagguaaucgccaaaua

SEQ ID NO: 1577624 - RNA, 19 nt, Homo sapiens
gugguuacccuaaauguuc

SEQ ID NO: 1577625 - RNA, 19 nt, Homo sapiens
gaaaaguggacuagaagaa

SEQ ID NO: 1577626 - RNA, 19 nt, Homo sapiens
gggaugguauauggugaaa

SEQ ID NO: 1577627 - RNA, 19 nt, Homo sapiens
uaccagcaauuuccagaau

SEQ ID NO: 1577628 - RNA, 19 nt, Homo sapiens
caaagauaccagcaauuuc

SEQ ID NO: 1577629 - RNA, 19 nt, Homo sapiens
aauggaaucgacaguauaa

SEQ ID NO: 1577630 - RNA, 19 nt, Homo sapiens
gaagggguuucaccacauu

SEQ ID NO: 1577631 - RNA, 19 nt, Homo sapiens
gauguucuccugaguccuu

SEQ ID NO: 1577632 - RNA, 19 nt, Homo sapiens
gaugcugggcuuguuuaua

SEQ ID NO: 1577633 - RNA, 19 nt, Homo sapiens
uguagugcauggacaucua

SEQ ID NO: 1577634 - RNA, 19 nt, Homo sapiens
caccaucucugaaguagcu

SEQ ID NO: 1577635 - RNA, 19 nt, Homo sapiens
ucaagaaugcauuaagugu

SEQ ID NO: 1577636 - RNA, 19 nt, Homo sapiens
cucuuuggcugaugaauga

SEQ ID NO: 1577637 - RNA, 19 nt, Homo sapiens
cagcccugguucuuuauug

SEQ ID NO: 1577638 - RNA, 19 nt, Homo sapiens
gaugguauauggugaaaag

SEQ ID NO: 1577639 - RNA, 19 nt, Homo sapiens
aauucaaguucaucuggua

SEQ ID NO: 1577640 - RNA, 19 nt, Homo sapiens
cugagaggguuuccuaaca

SEQ ID NO: 1577641 - RNA, 19 nt, Homo sapiens
ucagagagaggaauggaau

SEQ ID NO: 1577642 - RNA, 19 nt, Homo sapiens
gcuguuaacauuacaaggu

SEQ ID NO: 1577643 - RNA, 19 nt, Homo sapiens
gcccagcuaguuccucuuu

SEQ ID NO: 1577644 - RNA, 19 nt, Homo sapiens
gccauuugcugcuuaacag

SEQ ID NO: 1577645 - RNA, 19 nt, Homo sapiens
gaugaaugaacuccgaaga

SEQ ID NO: 1577646 - RNA, 19 nt, Homo sapiens
gcugauguaugucccaacu

SEQ ID NO: 1577647 - RNA, 19 nt, Homo sapiens
caggugggcuugggcauca

SEQ ID NO: 1577648 - RNA, 19 nt, Homo sapiens
caagauggcagcagugacu

SEQ ID NO: 1577649 - RNA, 19 nt, Homo sapiens
caagugguuuccaaauggu

SEQ ID NO: 1577650 - RNA, 19 nt, Homo sapiens
cagcaccaucucugaagua

SEQ ID NO: 1577651 - RNA, 19 nt, Homo sapiens
ugagaggguuuccuaacag

SEQ ID NO: 1577652 - RNA, 19 nt, Homo sapiens
guagccagcuggucuucag

SEQ ID NO: 1577653 - RNA, 19 nt, Homo sapiens
ugagauagucacuggauca

SEQ ID NO: 1577654 - RNA, 19 nt, Homo sapiens
gaaugaaucuugguacuua

SEQ ID NO: 1577655 - RNA, 19 nt, Homo sapiens
gaagucaacugguaucuga

SEQ ID NO: 1577656 - RNA, 19 nt, Homo sapiens
uaaggaagaugaagacuuu

SEQ ID NO: 1577657 - RNA, 19 nt, Homo sapiens
guacacagaugaaaccuuu

SEQ ID NO: 1577658 - RNA, 19 nt, Homo sapiens
gaaaucaucuggaacuaug

SEQ ID NO: 1577659 - RNA, 19 nt, Homo sapiens
aaacaaagaugaugaggaa

SEQ ID NO: 1577660 - RNA, 19 nt, Homo sapiens
gcaaaccucuucccucaaa

SEQ ID NO: 1577661 - RNA, 19 nt, Homo sapiens
ggaaggagauggcaauugu

SEQ ID NO: 1577662 - RNA, 19 nt, Homo sapiens
gagaugaagucaacuggua

SEQ ID NO: 1577663 - RNA, 19 nt, Homo sapiens
acagagaguucuacaguua

SEQ ID NO: 1577664 - RNA, 19 nt, Homo sapiens
guauagacaucuucacuaa

SEQ ID NO: 1577665 - RNA, 19 nt, Homo sapiens
gagaaaagcugaagaagaa

SEQ ID NO: 1577666 - RNA, 19 nt, Homo sapiens
gaugaaaccuuuaggacaa

SEQ ID NO: 1577667 - RNA, 19 nt, Homo sapiens
gaaaggaaguuuacaugca

SEQ ID NO: 1577668 - RNA, 19 nt, Homo sapiens
gagauucggucguguggua

SEQ ID NO: 1577669 - RNA, 19 nt, Homo sapiens
ggaauuugcccuucuguuu

SEQ ID NO: 1577670 - RNA, 19 nt, Homo sapiens
ggagagaggacauacuaua

SEQ ID NO: 1577671 - RNA, 19 nt, Homo sapiens
uaacaagucuucaucaaag

SEQ ID NO: 1577672 - RNA, 19 nt, Homo sapiens
ucgaagaccuuacuugaaa

SEQ ID NO: 1577673 - RNA, 19 nt, Homo sapiens
ggccauagcuuccaauaca

SEQ ID NO: 1577674 - RNA, 19 nt, Homo sapiens
ggagagaggcccugaagaa

SEQ ID NO: 1577675 - RNA, 19 nt, Homo sapiens
caucggaccuuuaauaauc

SEQ ID NO: 1577676 - RNA, 19 nt, Homo sapiens
ucaaagagcagaugacaaa

SEQ ID NO: 1577677 - RNA, 19 nt, Homo sapiens
gcaaugaaauagacuuaca

SEQ ID NO: 1577678 - RNA, 19 nt, Homo sapiens
aaaaggagcugcaucauuu

SEQ ID NO: 1577679 - RNA, 19 nt, Homo sapiens
gaauguuacuuuggaauga

SEQ ID NO: 1577680 - RNA, 19 nt, Homo sapiens
caauguaugugaaagugua

SEQ ID NO: 1577681 - RNA, 19 nt, Homo sapiens
gaacaagguaccacaagaa

SEQ ID NO: 1577682 - RNA, 19 nt, Homo sapiens
cagagaaaguugacaaaga

SEQ ID NO: 1577683 - RNA, 19 nt, Homo sapiens
ggagacaccaucagaguaa

SEQ ID NO: 1577684 - RNA, 19 nt, Homo sapiens
ggacucaucggaccuuuaa

SEQ ID NO: 1577685 - RNA, 19 nt, Homo sapiens
caggagagcaguauacaua

SEQ ID NO: 1577686 - RNA, 19 nt, Homo sapiens
gaacauaccaaacccuaga

SEQ ID NO: 1577687 - RNA, 19 nt, Homo sapiens
gggaaugggcaaugaaaua

SEQ ID NO: 1577688 - RNA, 19 nt, Homo sapiens
gaaguaggacccacuaaug

SEQ ID NO: 1577689 - RNA, 19 nt, Homo sapiens
gagcagaugacaaaguaua

SEQ ID NO: 1577690 - RNA, 19 nt, Homo sapiens
caccaaaucuggcugaaug

SEQ ID NO: 1577691 - RNA, 19 nt, Homo sapiens
cagaaacauucaccuauga

SEQ ID NO: 1577692 - RNA, 19 nt, Homo sapiens
caagguaccacaagaauug

SEQ ID NO: 1577693 - RNA, 19 nt, Homo sapiens
aagagcagaugacaaagua

SEQ ID NO: 1577694 - RNA, 19 nt, Homo sapiens
ggaagcauguuagacacua

SEQ ID NO: 1577695 - RNA, 19 nt, Homo sapiens
gaacuaccguauugacaca

SEQ ID NO: 1577696 - RNA, 19 nt, Homo sapiens
ugacuaggauuuaccauuc

SEQ ID NO: 1577697 - RNA, 19 nt, Homo sapiens
gcaauugugugacuaggau

SEQ ID NO: 1577698 - RNA, 19 nt, Homo sapiens
ggcaagcacugacuaacaa

SEQ ID NO: 1577699 - RNA, 19 nt, Homo sapiens
gagaguaacagaauguauu

SEQ ID NO: 1577700 - RNA, 19 nt, Homo sapiens
gagaauuuguggugauguu

SEQ ID NO: 1577701 - RNA, 19 nt, Homo sapiens
gaauugggagacuauauaa

SEQ ID NO: 1577702 - RNA, 19 nt, Homo sapiens
uacaguuacuccaacauua

SEQ ID NO: 1577703 - RNA, 19 nt, Homo sapiens
gauagcacauuccguguuc

SEQ ID NO: 1577704 - RNA, 19 nt, Homo sapiens
aacaagaacuaccguauug

SEQ ID NO: 1577705 - RNA, 19 nt, Homo sapiens
ggagauggcaauuguguga

SEQ ID NO: 1577706 - RNA, 19 nt, Homo sapiens
gaacaucugggaauucuag

SEQ ID NO: 1577707 - RNA, 19 nt, Homo sapiens
agaguaaccuuccauaaca

SEQ ID NO: 1577708 - RNA, 19 nt, Homo sapiens
gaauuggaggcucuuauaa

SEQ ID NO: 1577709 - RNA, 19 nt, Homo sapiens
caaagaugaugaggaauuc

SEQ ID NO: 1577710 - RNA, 19 nt, Homo sapiens
gcccuucuguuucuaguuu

SEQ ID NO: 1577711 - RNA, 19 nt, Homo sapiens
ccacaaggcccuacucaau

SEQ ID NO: 1577712 - RNA, 19 nt, Homo sapiens
gaaacgacuugggauuaug

SEQ ID NO: 1577713 - RNA, 19 nt, Homo sapiens
agaaagauguagacaagga

SEQ ID NO: 1577714 - RNA, 19 nt, Homo sapiens
acagaaagauguagacaag

SEQ ID NO: 1577715 - RNA, 19 nt, Homo sapiens
gaaucuaaaccaucugaaa

SEQ ID NO: 1577716 - RNA, 19 nt, Homo sapiens
gcaauaaaaugcaugcuau

SEQ ID NO: 1577717 - RNA, 19 nt, Homo sapiens
guaacaagucuucaucaaa

SEQ ID NO: 1577718 - RNA, 19 nt, Homo sapiens
gcacgcagcuuucuuucac

SEQ ID NO: 1577719 - RNA, 19 nt, Homo sapiens
gauauugccucaggacuca

SEQ ID NO: 1577720 - RNA, 19 nt, Homo sapiens
ccucuacaguggauuaauu

SEQ ID NO: 1577721 - RNA, 19 nt, Homo sapiens
ggaccucuacaguggauua

SEQ ID NO: 1577722 - RNA, 19 nt, Homo sapiens
ggagcugcaucauuuacaa

SEQ ID NO: 1577723 - RNA, 19 nt, Homo sapiens
gagagaggacauacuauau

SEQ ID NO: 1577724 - RNA, 19 nt, Homo sapiens
aaaggaaguuuacaugcaa

SEQ ID NO: 1577725 - RNA, 19 nt, Homo sapiens
ggaucccacuaaagauaua

SEQ ID NO: 1577726 - RNA, 19 nt, Homo sapiens
gcuaagauguauuauucug

SEQ ID NO: 1577727 - RNA, 19 nt, Homo sapiens
gaacaacgagggcacauac

SEQ ID NO: 1577728 - RNA, 19 nt, Homo sapiens
gagaggcccugaagaagag

SEQ ID NO: 1577729 - RNA, 19 nt, Homo sapiens
guuagacacuacuacauug

SEQ ID NO: 1577730 - RNA, 19 nt, Homo sapiens
ccaagaacaccuggaauuu

SEQ ID NO: 1577731 - RNA, 19 nt, Homo sapiens
gaaacucucacuuacguau

SEQ ID NO: 1577732 - RNA, 19 nt, Homo sapiens
gagcagaauguuucaaaug

SEQ ID NO: 1577733 - RNA, 19 nt, Homo sapiens
gauccugugugucuagcua

SEQ ID NO: 1577734 - RNA, 19 nt, Homo sapiens
gauuuaccauucccacauu

SEQ ID NO: 1577735 - RNA, 19 nt, Homo sapiens
uaacaagaacuaccguauu

SEQ ID NO: 1577736 - RNA, 19 nt, Homo sapiens
cacaaggcccuacucaaua

SEQ ID NO: 1577737 - RNA, 19 nt, Homo sapiens
ggagacaaagucaaaauua

SEQ ID NO: 1577738 - RNA, 19 nt, Homo sapiens
uugaaugccuuacaacuga

SEQ ID NO: 1577739 - RNA, 19 nt, Homo sapiens
guaccuagaagacaacauu

SEQ ID NO: 1577740 - RNA, 19 nt, Homo sapiens
ugaaacgacuugggauuau

SEQ ID NO: 1577741 - RNA, 19 nt, Homo sapiens
gagaggacauacuauaucg

SEQ ID NO: 1577742 - RNA, 19 nt, Homo sapiens
gaacggagagacacagcaa

SEQ ID NO: 1577743 - RNA, 19 nt, Homo sapiens
acagaaacauucaccuaug

SEQ ID NO: 1577744 - RNA, 19 nt, Homo sapiens
ccacagaaacauucaccua

SEQ ID NO: 1577745 - RNA, 19 nt, Homo sapiens
ugaacaagguaccacaaga

SEQ ID NO: 1577746 - RNA, 19 nt, Homo sapiens
caagaacaccuggaauuug

SEQ ID NO: 1577747 - RNA, 19 nt, Homo sapiens
ccgagaaaguaaacaaaga

SEQ ID NO: 1577748 - RNA, 19 nt, Homo sapiens
agaagaacaucugggaauu

SEQ ID NO: 1577749 - RNA, 19 nt, Homo sapiens
uaacagcaccuggaaguga

SEQ ID NO: 1577750 - RNA, 19 nt, Homo sapiens
gggcaaugaaauagacuua

SEQ ID NO: 1577751 - RNA, 19 nt, Homo sapiens
guacaaacagagaguucua

SEQ ID NO: 1577752 - RNA, 19 nt, Homo sapiens
gcagaauguuucaaaugca

SEQ ID NO: 1577753 - RNA, 19 nt, Homo sapiens
ggaauauacuuuucaggaa

SEQ ID NO: 1577754 - RNA, 19 nt, Homo sapiens
gaagaucacucaagacuau

SEQ ID NO: 1577755 - RNA, 19 nt, Homo sapiens
caaagaagaucacucaaga

SEQ ID NO: 1577756 - RNA, 19 nt, Homo sapiens
cuacugagcugacccuuug

SEQ ID NO: 1577757 - RNA, 19 nt, Homo sapiens
gaacugggacgcuggcuuu

SEQ ID NO: 1577758 - RNA, 19 nt, Homo sapiens
caccaacccugauggcuuu

SEQ ID NO: 1577759 - RNA, 19 nt, Homo sapiens
gcaaagaagaucacucaag

SEQ ID NO: 1577760 - RNA, 19 nt, Homo sapiens
gaacaucaaggccuucauc

SEQ ID NO: 1577761 - RNA, 19 nt, Homo sapiens
gaggucaaguccauuguag

SEQ ID NO: 1577762 - RNA, 19 nt, Homo sapiens
gguguugaguguccuguug

SEQ ID NO: 1577763 - RNA, 19 nt, Homo sapiens
gaaucucuguagccgauga

SEQ ID NO: 1577764 - RNA, 19 nt, Homo sapiens
ugacagcccuggccucucu

SEQ ID NO: 1577765 - RNA, 19 nt, Homo sapiens
gaaggaccaugggaacauc

SEQ ID NO: 1577766 - RNA, 19 nt, Homo sapiens
ggaggucaaguccauugua

SEQ ID NO: 1577767 - RNA, 19 nt, Homo sapiens
uggaggagaucuaugacuu

SEQ ID NO: 1577768 - RNA, 19 nt, Homo sapiens
acucccagcuccucaugua

SEQ ID NO: 1577769 - RNA, 19 nt, Homo sapiens
uaugaagggcgucccauuu

SEQ ID NO: 1577770 - RNA, 19 nt, Homo sapiens
cauccaggcaaccaaauaa

SEQ ID NO: 1577771 - RNA, 19 nt, Homo sapiens
gcaggcucccucuguauug

SEQ ID NO: 1577772 - RNA, 19 nt, Homo sapiens
ucagcaagauccagauugg

SEQ ID NO: 1577773 - RNA, 19 nt, Homo sapiens
gcuaugagaccaugaucga

SEQ ID NO: 1577774 - RNA, 19 nt, Homo sapiens
caucaaggcaauuuaucaa

SEQ ID NO: 1577775 - RNA, 19 nt, Homo sapiens
caucaucaaggcaauuuau

SEQ ID NO: 1577776 - RNA, 19 nt, Homo sapiens
augaagggcgucccauuua

SEQ ID NO: 1577777 - RNA, 19 nt, Homo sapiens
gaguguaccaggaacagaa

SEQ ID NO: 1577778 - RNA, 19 nt, Homo sapiens
ggcaucaggugcuccgaau

SEQ ID NO: 1577779 - RNA, 19 nt, Homo sapiens
agacguggcuggcgcuucu

SEQ ID NO: 1577780 - RNA, 19 nt, Homo sapiens
ggaggagaucuaugacuuc

SEQ ID NO: 1577781 - RNA, 19 nt, Homo sapiens
ggucugguuugcaaagaag

SEQ ID NO: 1577782 - RNA, 19 nt, Homo sapiens
ccugauggcuuugccuuca

SEQ ID NO: 1577783 - RNA, 19 nt, Homo sapiens
gcaucaucaaggcaauuua

SEQ ID NO: 1577784 - RNA, 19 nt, Homo sapiens
guaucccuauggcuacaaa

SEQ ID NO: 1577785 - RNA, 19 nt, Homo sapiens
gggucugguuugcaaagaa

SEQ ID NO: 1577786 - RNA, 19 nt, Homo sapiens
ggagaacccgcaccuuguc

SEQ ID NO: 1577787 - RNA, 19 nt, Homo sapiens
ccauccaggcaaccaaaua

SEQ ID NO: 1577788 - RNA, 19 nt, Homo sapiens
gcagcaucaucaaggcaau

SEQ ID NO: 1577789 - RNA, 19 nt, Homo sapiens
aaucgcauguggcgcaaga

SEQ ID NO: 1577790 - RNA, 19 nt, Homo sapiens
ccaggcaaccaaauaaagu

SEQ ID NO: 1577791 - RNA, 19 nt, Homo sapiens
ucaaguacuccuucaccuu

SEQ ID NO: 1577792 - RNA, 19 nt, Homo sapiens
uuccaaggcugcugugaca

SEQ ID NO: 1577793 - RNA, 19 nt, Homo sapiens
caucaggugcuccgaaucu

SEQ ID NO: 1577794 - RNA, 19 nt, Homo sapiens
ggucaaguccauuguagac

SEQ ID NO: 1577795 - RNA, 19 nt, Homo sapiens
ggcaucaaguacuccuuca

SEQ ID NO: 1577796 - RNA, 19 nt, Homo sapiens
ucaucaaggcaauuuauca

SEQ ID NO: 1577797 - RNA, 19 nt, Homo sapiens
caacuauggcagcaucauc

SEQ ID NO: 1577798 - RNA, 19 nt, Homo sapiens
ucaucuccauccacagcua

SEQ ID NO: 1577799 - RNA, 19 nt, Homo sapiens
ucaagacuaugggcaggau

SEQ ID NO: 1577800 - RNA, 19 nt, Homo sapiens
ucauggagcacacccugaa

SEQ ID NO: 1577801 - RNA, 19 nt, Homo sapiens
gaugaggcccagguacaga

SEQ ID NO: 1577802 - RNA, 19 nt, Homo sapiens
acuauugacuggaccuaca

SEQ ID NO: 1577803 - RNA, 19 nt, Homo sapiens
cauuguagacuuugugaag

SEQ ID NO: 1577804 - RNA, 19 nt, Homo sapiens
uugcaaagaagaucacuca

SEQ ID NO: 1577805 - RNA, 19 nt, Homo sapiens
caggcaaccaaauaaaguu

SEQ ID NO: 1577806 - RNA, 19 nt, Homo sapiens
gcauccaggcggucaagau

SEQ ID NO: 1577807 - RNA, 19 nt, Homo sapiens
gccagggcaucaaguacuc

SEQ ID NO: 1577808 - RNA, 19 nt, Homo sapiens
ucaaggccuucaucuccau

SEQ ID NO: 1577809 - RNA, 19 nt, Homo sapiens
gacgcuggcuuuggguugu

SEQ ID NO: 1577810 - RNA, 19 nt, Homo sapiens
cagcaggcucccucuguau

SEQ ID NO: 1577811 - RNA, 19 nt, Homo sapiens
gaucgucaccaacccugau

SEQ ID NO: 1577812 - RNA, 19 nt, Homo sapiens
gagaacccgcaccuuguca

SEQ ID NO: 1577813 - RNA, 19 nt, Homo sapiens
agaagaucacucaagacua

SEQ ID NO: 1577814 - RNA, 19 nt, Homo sapiens
gaucgacacgggcauccau

SEQ ID NO: 1577815 - RNA, 19 nt, Homo sapiens
acagccagggcaucaagua

SEQ ID NO: 1577816 - RNA, 19 nt, Homo sapiens
gcacuauugacuggaccua

SEQ ID NO: 1577817 - RNA, 19 nt, Homo sapiens
aagaagaucacucaagacu

SEQ ID NO: 1577818 - RNA, 19 nt, Homo sapiens
cagauuggcaacaccuaug

SEQ ID NO: 1577819 - RNA, 19 nt, Homo sapiens
ccagauuggcaacaccuau

SEQ ID NO: 1577820 - RNA, 19 nt, Homo sapiens
cggagaacccgcaccuugu

SEQ ID NO: 1577821 - RNA, 19 nt, Homo sapiens
ccaccgacacuuuuaacua

SEQ ID NO: 1577822 - RNA, 19 nt, Homo sapiens
caaagagaaugaagaaaug

SEQ ID NO: 1577823 - RNA, 19 nt, Homo sapiens
ggaccaaucugcucuguca

SEQ ID NO: 1577824 - RNA, 19 nt, Homo sapiens
gaacaucuccagcuugauu

SEQ ID NO: 1577825 - RNA, 19 nt, Homo sapiens
gaagaaacaagagccauua

SEQ ID NO: 1577826 - RNA, 19 nt, Homo sapiens
ggacaaagagaaugaagaa

SEQ ID NO: 1577827 - RNA, 19 nt, Homo sapiens
ucacaaacccugauggaua

SEQ ID NO: 1577828 - RNA, 19 nt, Homo sapiens
gggcauaucuacugucuag

SEQ ID NO: 1577829 - RNA, 19 nt, Homo sapiens
ggaaaggacccauccauca

SEQ ID NO: 1577830 - RNA, 19 nt, Homo sapiens
gaagagaacggagugguaa

SEQ ID NO: 1577831 - RNA, 19 nt, Homo sapiens
gaacugggaugcagguuuu

SEQ ID NO: 1577832 - RNA, 19 nt, Homo sapiens
ggauacguguucucucaaa

SEQ ID NO: 1577833 - RNA, 19 nt, Homo sapiens
ggagugguaacuucaauuu

SEQ ID NO: 1577834 - RNA, 19 nt, Homo sapiens
ggaagaaacaagagccauu

SEQ ID NO: 1577835 - RNA, 19 nt, Homo sapiens
guacucauuugccuuugaa

SEQ ID NO: 1577836 - RNA, 19 nt, Homo sapiens
aagaacaucuccagcuuga

SEQ ID NO: 1577837 - RNA, 19 nt, Homo sapiens
ucaagaacaucuccagcuu

SEQ ID NO: 1577838 - RNA, 19 nt, Homo sapiens
gaacggagugguaacuuca

SEQ ID NO: 1577839 - RNA, 19 nt, Homo sapiens
gaaacaagagccauuaaaa

SEQ ID NO: 1577840 - RNA, 19 nt, Homo sapiens
ggacagcaaauaagauugu

SEQ ID NO: 1577841 - RNA, 19 nt, Homo sapiens
caaguacucauuugccuuu

SEQ ID NO: 1577842 - RNA, 19 nt, Homo sapiens
ccuauuccaucaugauuga

SEQ ID NO: 1577843 - RNA, 19 nt, Homo sapiens
ugacugguccuaugauuau

SEQ ID NO: 1577844 - RNA, 19 nt, Homo sapiens
gagaaugaagaaaugcuuu

SEQ ID NO: 1577845 - RNA, 19 nt, Homo sapiens
aaagucaaggccuucauua

SEQ ID NO: 1577846 - RNA, 19 nt, Homo sapiens
ggaacugggaugcagguuu

SEQ ID NO: 1577847 - RNA, 19 nt, Homo sapiens
cuaugaacgugcucaaguu

SEQ ID NO: 1577848 - RNA, 19 nt, Homo sapiens
ccaaaaggcugcccaaucu

SEQ ID NO: 1577849 - RNA, 19 nt, Homo sapiens
cguguucucucaaaccaaa

SEQ ID NO: 1577850 - RNA, 19 nt, Homo sapiens
cacaaacccugauggauac

SEQ ID NO: 1577851 - RNA, 19 nt, Homo sapiens
gauuguuucugauuaugga

SEQ ID NO: 1577852 - RNA, 19 nt, Homo sapiens
guacaaagugggaccaauc

SEQ ID NO: 1577853 - RNA, 19 nt, Homo sapiens
aaucguauguggcggaaga

SEQ ID NO: 1577854 - RNA, 19 nt, Homo sapiens
ucauuugccuuugaacuga

SEQ ID NO: 1577855 - RNA, 19 nt, Homo sapiens
ggcaucaaguacucauuug

SEQ ID NO: 1577856 - RNA, 19 nt, Homo sapiens
auaguggacuucaucaaga

SEQ ID NO: 1577857 - RNA, 19 nt, Homo sapiens
gcaaauaagauuguuucug

SEQ ID NO: 1577858 - RNA, 19 nt, Homo sapiens
gcgcuacggcuuccucuug

SEQ ID NO: 1577859 - RNA, 19 nt, Homo sapiens
gcauugacugguccuauga

SEQ ID NO: 1577860 - RNA, 19 nt, Homo sapiens
acaaauguaccaaguuaga

SEQ ID NO: 1577861 - RNA, 19 nt, Homo sapiens
caacguccaggcagucaaa

SEQ ID NO: 1577862 - RNA, 19 nt, Homo sapiens
agaaacaagagccauuaaa

SEQ ID NO: 1577863 - RNA, 19 nt, Homo sapiens
ucuggaagccucuguguug

SEQ ID NO: 1577864 - RNA, 19 nt, Homo sapiens
cagcaaauaagauuguuuc

SEQ ID NO: 1577865 - RNA, 19 nt, Homo sapiens
aauauuggcucuucuuuug

SEQ ID NO: 1577866 - RNA, 19 nt, Homo sapiens
cuagugagcaaagugaaua

SEQ ID NO: 1577867 - RNA, 19 nt, Homo sapiens
aaucugcucugucaucuac

SEQ ID NO: 1577868 - RNA, 19 nt, Homo sapiens
ucauuauccuccacagcua

SEQ ID NO: 1577869 - RNA, 19 nt, Homo sapiens
caucaagagucauggaaaa

SEQ ID NO: 1577870 - RNA, 19 nt, Homo sapiens
gaaaggacccauccaucac

SEQ ID NO: 1577871 - RNA, 19 nt, Homo sapiens
gaggagacaagccagcuau

SEQ ID NO: 1577872 - RNA, 19 nt, Homo sapiens
ugagcaaagugaauauugg

SEQ ID NO: 1577873 - RNA, 19 nt, Homo sapiens
agaccuggcuuggcuugaa

SEQ ID NO: 1577874 - RNA, 19 nt, Homo sapiens
uuugagaaccggccuauga

SEQ ID NO: 1577875 - RNA, 19 nt, Homo sapiens
ugagcacccuggucuagug

SEQ ID NO: 1577876 - RNA, 19 nt, Homo sapiens
acucugaaguugaagugaa

SEQ ID NO: 1577877 - RNA, 19 nt, Homo sapiens
acaauuggaggcucaagaa

SEQ ID NO: 1577878 - RNA, 19 nt, Homo sapiens
gacagcaaauaagauuguu

SEQ ID NO: 1577879 - RNA, 19 nt, Homo sapiens
gagacaagccagcuaucug

SEQ ID NO: 1577880 - RNA, 19 nt, Homo sapiens
agaagagaacggaguggua

SEQ ID NO: 1577881 - RNA, 19 nt, Homo sapiens
ggaggagacaagccagcua

SEQ ID NO: 1577882 - RNA, 19 nt, Homo sapiens
gugagcaaagugaauauug

SEQ ID NO: 1577883 - RNA, 19 nt, Homo sapiens
ggucuagugagcaaaguga

SEQ ID NO: 1577884 - RNA, 19 nt, Homo sapiens
agaacggagugguaacuuc

SEQ ID NO: 1577885 - RNA, 19 nt, Homo sapiens
gucaaggccuucauuaucc

SEQ ID NO: 1577886 - RNA, 19 nt, Homo sapiens
guguugguguggauccuaa

SEQ ID NO: 1577887 - RNA, 19 nt, Homo sapiens
gaauauuggcucuucuuuu

SEQ ID NO: 1577888 - RNA, 19 nt, Homo sapiens
ugaauauuggcucuucuuu

SEQ ID NO: 1577889 - RNA, 19 nt, Homo sapiens
uggcaucaaguacucauuu

SEQ ID NO: 1577890 - RNA, 19 nt, Homo sapiens
ccaugagguugauccuguu

SEQ ID NO: 1577891 - RNA, 19 nt, Homo sapiens
uugaugagcugagugaagu

SEQ ID NO: 1577892 - RNA, 19 nt, Homo sapiens
agucaaggccuucauuauc

SEQ ID NO: 1577893 - RNA, 19 nt, Homo sapiens
cauaguggacuucaucaag

SEQ ID NO: 1577894 - RNA, 19 nt, Homo sapiens
accaagcaaugaagaacaa

SEQ ID NO: 1577895 - RNA, 19 nt, Homo sapiens
ggagacaagccagcuaucu

SEQ ID NO: 1577896 - RNA, 19 nt, Homo sapiens
ccaaucugcucugucaucu

SEQ ID NO: 1577897 - RNA, 19 nt, Homo sapiens
gcauggcaccaaguacaaa

SEQ ID NO: 1577898 - RNA, 19 nt, Homo sapiens
ugagugaaguggcccaaaa

SEQ ID NO: 1577899 - RNA, 19 nt, Homo sapiens
gaaguugaagugaaaucca

SEQ ID NO: 1577900 - RNA, 19 nt, Homo sapiens
ggccuaccauacccuggaa

SEQ ID NO: 1577901 - RNA, 19 nt, Homo sapiens
ugaagugaaauccauagug

SEQ ID NO: 1577902 - RNA, 19 nt, Homo sapiens
aagaaacaagagccauuaa

SEQ ID NO: 1577903 - RNA, 19 nt, Homo sapiens
gaccuggcuuggcuugaag

SEQ ID NO: 1577904 - RNA, 19 nt, Homo sapiens
gccaguggaggaagcauug

SEQ ID NO: 1577905 - RNA, 19 nt, Homo sapiens
auggauacguguucucuca

SEQ ID NO: 1577906 - RNA, 19 nt, Homo sapiens
uaccauacccuggaagaga

SEQ ID NO: 1577907 - RNA, 19 nt, Homo sapiens
gagaacggagugguaacuu

SEQ ID NO: 1577908 - RNA, 19 nt, Homo sapiens
ugacuuugaugagcugagu

SEQ ID NO: 1577909 - RNA, 19 nt, Homo sapiens
aaauguaccaaguuagaug

SEQ ID NO: 1577910 - RNA, 19 nt, Homo sapiens
caaauguaccaaguuagau

SEQ ID NO: 1577911 - RNA, 19 nt, Homo sapiens
gauacguguucucucaaac

SEQ ID NO: 1577912 - RNA, 19 nt, Homo sapiens
gagcacccuggucuaguga

SEQ ID NO: 1577913 - RNA, 19 nt, Homo sapiens
cagucaaaguguucuugga

SEQ ID NO: 1577914 - RNA, 19 nt, Homo sapiens
gacccagugccaacucuga

SEQ ID NO: 1577915 - RNA, 19 nt, Homo sapiens
gacaaagagaaugaagaaa

SEQ ID NO: 1577916 - RNA, 19 nt, Homo sapiens
gauuauggcaucaaguacu

SEQ ID NO: 1577917 - RNA, 19 nt, Homo sapiens
caagcaaugaagaacaaau

SEQ ID NO: 1577918 - RNA, 19 nt, Homo sapiens
cccaagaaauggauaaccu

SEQ ID NO: 1577919 - RNA, 19 nt, Homo sapiens
agugguaacuucaauuuug

SEQ ID NO: 1577920 - RNA, 19 nt, Homo sapiens
cucugaaguugaagugaaa

SEQ ID NO: 1577921 - RNA, 19 nt, Homo sapiens
cacaagcuacggcacuuug

SEQ ID NO: 1577922 - RNA, 19 nt, Homo sapiens
gaaauggucucucguauua

SEQ ID NO: 1577923 - RNA, 19 nt, Homo sapiens
gaaagucaaucuucaguua

SEQ ID NO: 1577924 - RNA, 19 nt, Homo sapiens
gauaucagguucuucuuua

SEQ ID NO: 1577925 - RNA, 19 nt, Homo sapiens
gcacugaccucaacaggaa

SEQ ID NO: 1577926 - RNA, 19 nt, Homo sapiens
cgaaagcugucacuaauuu

SEQ ID NO: 1577927 - RNA, 19 nt, Homo sapiens
cgaaguagcuuuaagugaa

SEQ ID NO: 1577928 - RNA, 19 nt, Homo sapiens
caugcuagcugucaaauuu

SEQ ID NO: 1577929 - RNA, 19 nt, Homo sapiens
gaaguagcuuuaagugaaa

SEQ ID NO: 1577930 - RNA, 19 nt, Homo sapiens
ucauuuaagucccauguua

SEQ ID NO: 1577931 - RNA, 19 nt, Homo sapiens
gaaagaagaaaggcuauuu

SEQ ID NO: 1577932 - RNA, 19 nt, Homo sapiens
cuacaucuauggcccaaua

SEQ ID NO: 1577933 - RNA, 19 nt, Homo sapiens
gacgaaagcugucacuaau

SEQ ID NO: 1577934 - RNA, 19 nt, Homo sapiens
ccaaugagcuugacuucug

SEQ ID NO: 1577935 - RNA, 19 nt, Homo sapiens
cuaaagaacugcccucugu

SEQ ID NO: 1577936 - RNA, 19 nt, Homo sapiens
gaagccaccugaaugaaau

SEQ ID NO: 1577937 - RNA, 19 nt, Homo sapiens
ggccaaaguugcaaagauu

SEQ ID NO: 1577938 - RNA, 19 nt, Homo sapiens
gaagauaauccacuauaug

SEQ ID NO: 1577939 - RNA, 19 nt, Homo sapiens
ccauguggcuucaucaauu

SEQ ID NO: 1577940 - RNA, 19 nt, Homo sapiens
gaacugcccucuguuugga

SEQ ID NO: 1577941 - RNA, 19 nt, Homo sapiens
aagaagagauugagaaaca

SEQ ID NO: 1577942 - RNA, 19 nt, Homo sapiens
cuaauaugaugguggauuu

SEQ ID NO: 1577943 - RNA, 19 nt, Homo sapiens
gaaacccgcuacaucuaug

SEQ ID NO: 1577944 - RNA, 19 nt, Homo sapiens
ggauauauuuggucaugga

SEQ ID NO: 1577945 - RNA, 19 nt, Homo sapiens
gaugguggauuuccgaguu

SEQ ID NO: 1577946 - RNA, 19 nt, Homo sapiens
ccaaguauauccucaagca

SEQ ID NO: 1577947 - RNA, 19 nt, Homo sapiens
gauaaaggcaaauuugguu

SEQ ID NO: 1577948 - RNA, 19 nt, Homo sapiens
gauuggcacugauguucua

SEQ ID NO: 1577949 - RNA, 19 nt, Homo sapiens
gaaaucaagguuuacauca

SEQ ID NO: 1577950 - RNA, 19 nt, Homo sapiens
gcagaaagcauuauuuuga

SEQ ID NO: 1577951 - RNA, 19 nt, Homo sapiens
ggaauaagccaauuaaucc

SEQ ID NO: 1577952 - RNA, 19 nt, Homo sapiens
ggaaaagaaugaaagaaga

SEQ ID NO: 1577953 - RNA, 19 nt, Homo sapiens
gauaauccacuauauguuc

SEQ ID NO: 1577954 - RNA, 19 nt, Homo sapiens
aagcauacuuccuaaagaa

SEQ ID NO: 1577955 - RNA, 19 nt, Homo sapiens
caagcauacuuccuaaaga

SEQ ID NO: 1577956 - RNA, 19 nt, Homo sapiens
gagcuugacuucugguauc

SEQ ID NO: 1577957 - RNA, 19 nt, Homo sapiens
aagcagacaucauaaagga

SEQ ID NO: 1577958 - RNA, 19 nt, Homo sapiens
caucaaaacugccaccuaa

SEQ ID NO: 1577959 - RNA, 19 nt, Homo sapiens
uaacaccaaugacccaugu

SEQ ID NO: 1577960 - RNA, 19 nt, Homo sapiens
ccaaaugcaucggcacuga

SEQ ID NO: 1577961 - RNA, 19 nt, Homo sapiens
cauguggcuucaucaauuu

SEQ ID NO: 1577962 - RNA, 19 nt, Homo sapiens
gcuccgagauaaaggcaaa

SEQ ID NO: 1577963 - RNA, 19 nt, Homo sapiens
gcaaagauuggcacugaug

SEQ ID NO: 1577964 - RNA, 19 nt, Homo sapiens
guagcaccauaacgaagua

SEQ ID NO: 1577965 - RNA, 19 nt, Homo sapiens
cgagauaaaggcaaauuug

SEQ ID NO: 1577966 - RNA, 19 nt, Homo sapiens
aaacacacauuugccuuug

SEQ ID NO: 1577967 - RNA, 19 nt, Homo sapiens
agacgaaagcugucacuaa

SEQ ID NO: 1577968 - RNA, 19 nt, Homo sapiens
aauggucucucguauuaaa

SEQ ID NO: 1577969 - RNA, 19 nt, Homo sapiens
ggacccagcagaaagcauu

SEQ ID NO: 1577970 - RNA, 19 nt, Homo sapiens
ccauaacgaaguagcuuua

SEQ ID NO: 1577971 - RNA, 19 nt, Homo sapiens
ccuuugagcuccgagauaa

SEQ ID NO: 1577972 - RNA, 19 nt, Homo sapiens
gggcaucaaacacacauuu

SEQ ID NO: 1577973 - RNA, 19 nt, Homo sapiens
gauguucuaucaacucgau

SEQ ID NO: 1577974 - RNA, 19 nt, Homo sapiens
aaagaacugcccucuguuu

SEQ ID NO: 1577975 - RNA, 19 nt, Homo sapiens
gccagugguuugucuauca

SEQ ID NO: 1577976 - RNA, 19 nt, Homo sapiens
gcacagaaaacaaaugaaa

SEQ ID NO: 1577977 - RNA, 19 nt, Homo sapiens
ccucaagcauacuuccuaa

SEQ ID NO: 1577978 - RNA, 19 nt, Homo sapiens
cugaaaagaugauggauaa

SEQ ID NO: 1577979 - RNA, 19 nt, Homo sapiens
ggacaaagaaccgcaugug

SEQ ID NO: 1577980 - RNA, 19 nt, Homo sapiens
aaaauuggaucuacuguug

SEQ ID NO: 1577981 - RNA, 19 nt, Homo sapiens
gauucaugaucuacaagaa

SEQ ID NO: 1577982 - RNA, 19 nt, Homo sapiens
aaguauauccucaagcaua

SEQ ID NO: 1577983 - RNA, 19 nt, Homo sapiens
aaacaagcagacaucauaa

SEQ ID NO: 1577984 - RNA, 19 nt, Homo sapiens
uaacgaaguagcuuuaagu

SEQ ID NO: 1577985 - RNA, 19 nt, Homo sapiens
uugcaaagauuggcacuga

SEQ ID NO: 1577986 - RNA, 19 nt, Homo sapiens
caucagaaagucaaucuuc

SEQ ID NO: 1577987 - RNA, 19 nt, Homo sapiens
ugaaauggucucucguauu

SEQ ID NO: 1577988 - RNA, 19 nt, Homo sapiens
gauuguggcuuggacugaa

SEQ ID NO: 1577989 - RNA, 19 nt, Homo sapiens
ucaacaauuuacccgauau

SEQ ID NO: 1577990 - RNA, 19 nt, Homo sapiens
cccaauagaaucaacaauu

SEQ ID NO: 1577991 - RNA, 19 nt, Homo sapiens
gcuauuguuucccuaugga

SEQ ID NO: 1577992 - RNA, 19 nt, Homo sapiens
cacuauauguucugaagau

SEQ ID NO: 1577993 - RNA, 19 nt, Homo sapiens
acaagaagagauugagaaa

SEQ ID NO: 1577994 - RNA, 19 nt, Homo sapiens
gagauaaaggcaaauuugg

SEQ ID NO: 1577995 - RNA, 19 nt, Homo sapiens
aaaacaagcagacaucaua

SEQ ID NO: 1577996 - RNA, 19 nt, Homo sapiens
ccaccugaaugaaaucaag

SEQ ID NO: 1577997 - RNA, 19 nt, Homo sapiens
caccagaguccgagaaaga

SEQ ID NO: 1577998 - RNA, 19 nt, Homo sapiens
uauauuuggucauggacaa

SEQ ID NO: 1577999 - RNA, 19 nt, Homo sapiens
gaagagauugagaaacagu

SEQ ID NO: 1578000 - RNA, 19 nt, Homo sapiens
uggaauaagccaauuaauc

SEQ ID NO: 1578001 - RNA, 19 nt, Homo sapiens
cgauaucagguucuucuuu

SEQ ID NO: 1578002 - RNA, 19 nt, Homo sapiens
uuagaagccaccugaauga

SEQ ID NO: 1578003 - RNA, 19 nt, Homo sapiens
uauauguucugaagauugg

SEQ ID NO: 1578004 - RNA, 19 nt, Homo sapiens
ccagcagaaagcauuauuu

SEQ ID NO: 1578005 - RNA, 19 nt, Homo sapiens
agaagccaccugaaugaaa

SEQ ID NO: 1578006 - RNA, 19 nt, Homo sapiens
uguugaagauaauccacua

SEQ ID NO: 1578007 - RNA, 19 nt, Homo sapiens
aauuggaucuacuguugaa

SEQ ID NO: 1578008 - RNA, 19 nt, Homo sapiens
gcuaauaugaugguggauu

SEQ ID NO: 1578009 - RNA, 19 nt, Homo sapiens
ccuguggguuugauugcua

SEQ ID NO: 1578010 - RNA, 19 nt, Homo sapiens
auccuucucuugcucauuu

SEQ ID NO: 1578011 - RNA, 19 nt, Homo sapiens
ugaaacccgcuacaucuau

SEQ ID NO: 1578012 - RNA, 19 nt, Homo sapiens
cauaaaggacuuggccaaa

SEQ ID NO: 1578013 - RNA, 19 nt, Homo sapiens
caucggcacugaccucaac

SEQ ID NO: 1578014 - RNA, 19 nt, Homo sapiens
gugcagagagaccaugcua

SEQ ID NO: 1578015 - RNA, 19 nt, Homo sapiens
caaauuugguuuucuccuu

SEQ ID NO: 1578016 - RNA, 19 nt, Homo sapiens
gaccucaacaggaauuuua

SEQ ID NO: 1578017 - RNA, 19 nt, Homo sapiens
guugauggauauauuuggu

SEQ ID NO: 1578018 - RNA, 19 nt, Homo sapiens
uuaacuaccuuucuuugcu

SEQ ID NO: 1578019 - RNA, 19 nt, Homo sapiens
uguuacugcuguuugcuuu

SEQ ID NO: 1578020 - RNA, 19 nt, Homo sapiens
ucaagcauacuuccuaaag

SEQ ID NO: 1578021 - RNA, 19 nt, Homo sapiens
gaccugggcaucaaacaca

SEQ ID NO: 1578022 - RNA, 19 nt, Homo sapiens
gagaagguguuccguguua

SEQ ID NO: 1578023 - RNA, 19 nt, Homo sapiens
gaacaaugcugaguugaau

SEQ ID NO: 1578024 - RNA, 19 nt, Homo sapiens
gaucuacccuuacucauau

SEQ ID NO: 1578025 - RNA, 19 nt, Homo sapiens
ccaaggcccuggcugauuu

SEQ ID NO: 1578026 - RNA, 19 nt, Homo sapiens
acaguugacuuccguguua

SEQ ID NO: 1578027 - RNA, 19 nt, Homo sapiens
gaacaccuguacuaguuga

SEQ ID NO: 1578028 - RNA, 19 nt, Homo sapiens
gcaacaaacucucuuccau

SEQ ID NO: 1578029 - RNA, 19 nt, Homo sapiens
cgacugggcuuaugaccaa

SEQ ID NO: 1578030 - RNA, 19 nt, Homo sapiens
ucaaguauguugccagcua

SEQ ID NO: 1578031 - RNA, 19 nt, Homo sapiens
gaaagcugauggccuuguu

SEQ ID NO: 1578032 - RNA, 19 nt, Homo sapiens
gauauuccuucaccuuuga

SEQ ID NO: 1578033 - RNA, 19 nt, Homo sapiens
ggcuaaagcuacugugaaa

SEQ ID NO: 1578034 - RNA, 19 nt, Homo sapiens
ugaaagaacuugccucacu

SEQ ID NO: 1578035 - RNA, 19 nt, Homo sapiens
gaaauuggagccucucgaa

SEQ ID NO: 1578036 - RNA, 19 nt, Homo sapiens
caaaucaaaccucacagua

SEQ ID NO: 1578037 - RNA, 19 nt, Homo sapiens
uggaacaccuguacuaguu

SEQ ID NO: 1578038 - RNA, 19 nt, Homo sapiens
ugagaacaaugcugaguug

SEQ ID NO: 1578039 - RNA, 19 nt, Homo sapiens
caacaagugggaaacgaua

SEQ ID NO: 1578040 - RNA, 19 nt, Homo sapiens
caaacucucuuccaucaag

SEQ ID NO: 1578041 - RNA, 19 nt, Homo sapiens
caacaggacacaguuauga

SEQ ID NO: 1578042 - RNA, 19 nt, Homo sapiens
aaaugaugaucuacccuua

SEQ ID NO: 1578043 - RNA, 19 nt, Homo sapiens
uaacauaauccgcgaguug

SEQ ID NO: 1578044 - RNA, 19 nt, Homo sapiens
gcacagaccccaacagaaa

SEQ ID NO: 1578045 - RNA, 19 nt, Homo sapiens
cauacuggaucuagcauug

SEQ ID NO: 1578046 - RNA, 19 nt, Homo sapiens
uaagcaaccugagaaaugu

SEQ ID NO: 1578047 - RNA, 19 nt, Homo sapiens
caacaagucgccacugaga

SEQ ID NO: 1578048 - RNA, 19 nt, Homo sapiens
gauagaggcuuggacucaa

SEQ ID NO: 1578049 - RNA, 19 nt, Homo sapiens
aaucaaaccucacaguaca

SEQ ID NO: 1578050 - RNA, 19 nt, Homo sapiens
gaccaaggaaucagauauu

SEQ ID NO: 1578051 - RNA, 19 nt, Homo sapiens
aagacucgcuccacccaua

SEQ ID NO: 1578052 - RNA, 19 nt, Homo sapiens
gaugcugguuggugugaaa

SEQ ID NO: 1578053 - RNA, 19 nt, Homo sapiens
caauacaagguacugauaa

SEQ ID NO: 1578054 - RNA, 19 nt, Homo sapiens
cugauggccuuguuucaaa

SEQ ID NO: 1578055 - RNA, 19 nt, Homo sapiens
uaaagcuacugugaaagaa

SEQ ID NO: 1578056 - RNA, 19 nt, Homo sapiens
caaacucggugagaacaau

SEQ ID NO: 1578057 - RNA, 19 nt, Homo sapiens
gaucuagcauuggcacaga

SEQ ID NO: 1578058 - RNA, 19 nt, Homo sapiens
ggacgugagauccaaguga

SEQ ID NO: 1578059 - RNA, 19 nt, Homo sapiens
gagaggcuguucguaccua

SEQ ID NO: 1578060 - RNA, 19 nt, Homo sapiens
ggacacaguuaugagaagu

SEQ ID NO: 1578061 - RNA, 19 nt, Homo sapiens
guguuaacguugaagauga

SEQ ID NO: 1578062 - RNA, 19 nt, Homo sapiens
cuaaagcuacugugaaaga

SEQ ID NO: 1578063 - RNA, 19 nt, Homo sapiens
aacaaacucucuuccauca

SEQ ID NO: 1578064 - RNA, 19 nt, Homo sapiens
ccucaucucucgcaguguu

SEQ ID NO: 1578065 - RNA, 19 nt, Homo sapiens
ugaucuacccuuacucaua

SEQ ID NO: 1578066 - RNA, 19 nt, Homo sapiens
ucucuuccaucaaggcaua

SEQ ID NO: 1578067 - RNA, 19 nt, Homo sapiens
gguguuccguguuaacguu

SEQ ID NO: 1578068 - RNA, 19 nt, Homo sapiens
cagaagauacugucacugu

SEQ ID NO: 1578069 - RNA, 19 nt, Homo sapiens
gaugaucuacccuuacuca

SEQ ID NO: 1578070 - RNA, 19 nt, Homo sapiens
gccagugguuuguaagaga

SEQ ID NO: 1578071 - RNA, 19 nt, Homo sapiens
uggcaaagcuggacaaaau

SEQ ID NO: 1578072 - RNA, 19 nt, Homo sapiens
ugacuuccguguuaaagca

SEQ ID NO: 1578073 - RNA, 19 nt, Homo sapiens
gcacgacccagauugacuu

SEQ ID NO: 1578074 - RNA, 19 nt, Homo sapiens
guuaugagaaguacaacaa

SEQ ID NO: 1578075 - RNA, 19 nt, Homo sapiens
acaagguacugauaagcaa

SEQ ID NO: 1578076 - RNA, 19 nt, Homo sapiens
acaauacaagguacugaua

SEQ ID NO: 1578077 - RNA, 19 nt, Homo sapiens
gcagaaugaacuacaauac

SEQ ID NO: 1578078 - RNA, 19 nt, Homo sapiens
aaagcagaaugaacuacaa

SEQ ID NO: 1578079 - RNA, 19 nt, Homo sapiens
caucaaggcauaucugaca

SEQ ID NO: 1578080 - RNA, 19 nt, Homo sapiens
gcugguuggugugaaauug

SEQ ID NO: 1578081 - RNA, 19 nt, Homo sapiens
guggauuucuccugcauuc

SEQ ID NO: 1578082 - RNA, 19 nt, Homo sapiens
ugaacuacaauacaaggua

SEQ ID NO: 1578083 - RNA, 19 nt, Homo sapiens
gcaccaaguacacauaugg

SEQ ID NO: 1578084 - RNA, 19 nt, Homo sapiens
ugaaugcccuggcuaaagc

SEQ ID NO: 1578085 - RNA, 19 nt, Homo sapiens
ggcccuggcugauuucauc

SEQ ID NO: 1578086 - RNA, 19 nt, Homo sapiens
gcaacaggacacaguuaug

SEQ ID NO: 1578087 - RNA, 19 nt, Homo sapiens
cagauauuccuucaccuuu

SEQ ID NO: 1578088 - RNA, 19 nt, Homo sapiens
cgagauacaggcagauaug

SEQ ID NO: 1578089 - RNA, 19 nt, Homo sapiens
agauauuccuucaccuuug

SEQ ID NO: 1578090 - RNA, 19 nt, Homo sapiens
caaggcauaucugacaauc

SEQ ID NO: 1578091 - RNA, 19 nt, Homo sapiens
gcaaagcuggacaaaauaa

SEQ ID NO: 1578092 - RNA, 19 nt, Homo sapiens
uaugagaaguacaacaagu

SEQ ID NO: 1578093 - RNA, 19 nt, Homo sapiens
gauaagcaaccugagaaau

SEQ ID NO: 1578094 - RNA, 19 nt, Homo sapiens
gaauccagcccucaucucu

SEQ ID NO: 1578095 - RNA, 19 nt, Homo sapiens
gugcaacaggacacaguua

SEQ ID NO: 1578096 - RNA, 19 nt, Homo sapiens
gguggaggcucaguuugau

SEQ ID NO: 1578097 - RNA, 19 nt, Homo sapiens
auaagcaaccugagaaaug

SEQ ID NO: 1578098 - RNA, 19 nt, Homo sapiens
aggcauaucugacaaucca

SEQ ID NO: 1578099 - RNA, 19 nt, Homo sapiens
caacagaaauuuugaugcu

SEQ ID NO: 1578100 - RNA, 19 nt, Homo sapiens
cagaaugaacuacaauaca

SEQ ID NO: 1578101 - RNA, 19 nt, Homo sapiens
aaaccucacaguacaguug

SEQ ID NO: 1578102 - RNA, 19 nt, Homo sapiens
gcugauggccuuguuucaa

SEQ ID NO: 1578103 - RNA, 19 nt, Homo sapiens
gcucugacgacugggcuua

SEQ ID NO: 1578104 - RNA, 19 nt, Homo sapiens
gaaugaacuacaauacaag

SEQ ID NO: 1578105 - RNA, 19 nt, Homo sapiens
ggaacaccuguacuaguug

SEQ ID NO: 1578106 - RNA, 19 nt, Homo sapiens
acacaaaucaaaccucaca

SEQ ID NO: 1578107 - RNA, 19 nt, Homo sapiens
uaaagcagaaugaacuaca

SEQ ID NO: 1578108 - RNA, 19 nt, Homo sapiens
ucacaguacaguugacuuc

SEQ ID NO: 1578109 - RNA, 19 nt, Homo sapiens
ggauuucuccugcauucug

SEQ ID NO: 1578110 - RNA, 19 nt, Homo sapiens
ucagauauuccuucaccuu

SEQ ID NO: 1578111 - RNA, 19 nt, Homo sapiens
agaacaaugcugaguugaa

SEQ ID NO: 1578112 - RNA, 19 nt, Homo sapiens
ccacucguacucccaaaug

SEQ ID NO: 1578113 - RNA, 19 nt, Homo sapiens
uguuaacguugaagaugaa

SEQ ID NO: 1578114 - RNA, 19 nt, Homo sapiens
guaagagaggcuguucgua

SEQ ID NO: 1578115 - RNA, 19 nt, Homo sapiens
acaagucgccacugagaau

SEQ ID NO: 1578116 - RNA, 19 nt, Homo sapiens
cucaacaagucgccacuga

SEQ ID NO: 1578117 - RNA, 19 nt, Homo sapiens
aauacaagguacugauaag

SEQ ID NO: 1578118 - RNA, 19 nt, Homo sapiens
caccuguacuaguugagaa

SEQ ID NO: 1578119 - RNA, 19 nt, Homo sapiens
ugaccaaggaaucagauau

SEQ ID NO: 1578120 - RNA, 19 nt, Homo sapiens
ccagcacgacccagauuga

SEQ ID NO: 1578121 - RNA, 19 nt, Homo sapiens
cuuacaaacucggugagaa

SEQ ID NO: 1578122 - RNA, 19 nt, Homo sapiens
gaacagaccugaauaggaa

SEQ ID NO: 1578123 - RNA, 19 nt, Homo sapiens
gguaacagcugaccuuauu

SEQ ID NO: 1578124 - RNA, 19 nt, Homo sapiens
gaagaaauaucaaccagau

SEQ ID NO: 1578125 - RNA, 19 nt, Homo sapiens
gcuugugccuuuagaaaua

SEQ ID NO: 1578126 - RNA, 19 nt, Homo sapiens
gaauggaucucuccugcuu

SEQ ID NO: 1578127 - RNA, 19 nt, Homo sapiens
ucaaccagauuaaagcaua

SEQ ID NO: 1578128 - RNA, 19 nt, Homo sapiens
cagcugaccuuauugugaa

SEQ ID NO: 1578129 - RNA, 19 nt, Homo sapiens
ggucagaaguacauuaaag

SEQ ID NO: 1578130 - RNA, 19 nt, Homo sapiens
ugaaggcaguggcuaguuu

SEQ ID NO: 1578131 - RNA, 19 nt, Homo sapiens
uggaagaucuuauucaaca

SEQ ID NO: 1578132 - RNA, 19 nt, Homo sapiens
gaaaccuacuguggacuuu

SEQ ID NO: 1578133 - RNA, 19 nt, Homo sapiens
ggcaucaaauauucguuua

SEQ ID NO: 1578134 - RNA, 19 nt, Homo sapiens
caguaucacucacuaaaug

SEQ ID NO: 1578135 - RNA, 19 nt, Homo sapiens
ggaauuccaugcagugucu

SEQ ID NO: 1578136 - RNA, 19 nt, Homo sapiens
ggaaggguggucagaagua

SEQ ID NO: 1578137 - RNA, 19 nt, Homo sapiens
gaggaacugucucuaguag

SEQ ID NO: 1578138 - RNA, 19 nt, Homo sapiens
ggacgguuaugacuacuca

SEQ ID NO: 1578139 - RNA, 19 nt, Homo sapiens
gggauaauagggcaauaua

SEQ ID NO: 1578140 - RNA, 19 nt, Homo sapiens
gacuaggguucaugucuuu

SEQ ID NO: 1578141 - RNA, 19 nt, Homo sapiens
ucagagaaccuaauaagug

SEQ ID NO: 1578142 - RNA, 19 nt, Homo sapiens
ggcaguggcuaguuucuug

SEQ ID NO: 1578143 - RNA, 19 nt, Homo sapiens
gaacaguaucacucacuaa

SEQ ID NO: 1578144 - RNA, 19 nt, Homo sapiens
acgauuggaucuaugauuu

SEQ ID NO: 1578145 - RNA, 19 nt, Homo sapiens
aaucgaauguggagaaaga

SEQ ID NO: 1578146 - RNA, 19 nt, Homo sapiens
gaaguacccacucuauguu

SEQ ID NO: 1578147 - RNA, 19 nt, Homo sapiens
caagcaaguuuaaucaaag

SEQ ID NO: 1578148 - RNA, 19 nt, Homo sapiens
ucauucugcuuccguauuu

SEQ ID NO: 1578149 - RNA, 19 nt, Homo sapiens
ggaacagaccugaauagga

SEQ ID NO: 1578150 - RNA, 19 nt, Homo sapiens
cacauuggauccucauuug

SEQ ID NO: 1578151 - RNA, 19 nt, Homo sapiens
gcaaagaccaugaggaacu

SEQ ID NO: 1578152 - RNA, 19 nt, Homo sapiens
ugugaaagcccauuuaaau

SEQ ID NO: 1578153 - RNA, 19 nt, Homo sapiens
acaauugaacuucgagaua

SEQ ID NO: 1578154 - RNA, 19 nt, Homo sapiens
gcaagaccaaaucauugua

SEQ ID NO: 1578155 - RNA, 19 nt, Homo sapiens
caauugaacuucgagauac

SEQ ID NO: 1578156 - RNA, 19 nt, Homo sapiens
gcuuguggauuucuauguu

SEQ ID NO: 1578157 - RNA, 19 nt, Homo sapiens
ccacauuggauccucauuu

SEQ ID NO: 1578158 - RNA, 19 nt, Homo sapiens
ugaacaguaucacucacua

SEQ ID NO: 1578159 - RNA, 19 nt, Homo sapiens
ccauuguucucuucuguga

SEQ ID NO: 1578160 - RNA, 19 nt, Homo sapiens
ugagaggcauccugauaug

SEQ ID NO: 1578161 - RNA, 19 nt, Homo sapiens
cguggaagaucuuauucaa

SEQ ID NO: 1578162 - RNA, 19 nt, Homo sapiens
ccagcaagaccaaaucauu

SEQ ID NO: 1578163 - RNA, 19 nt, Homo sapiens
cagcaagaccaaaucauug

SEQ ID NO: 1578164 - RNA, 19 nt, Homo sapiens
gggcacauacggauucuug

SEQ ID NO: 1578165 - RNA, 19 nt, Homo sapiens
gggcaucaaauauucguuu

SEQ ID NO: 1578166 - RNA, 19 nt, Homo sapiens
aagcaaagaccaugaggaa

SEQ ID NO: 1578167 - RNA, 19 nt, Homo sapiens
ugguuaauguggacgguua

SEQ ID NO: 1578168 - RNA, 19 nt, Homo sapiens
cuacagaaucuuacuacaa

SEQ ID NO: 1578169 - RNA, 19 nt, Homo sapiens
caauaaauuucugcuugug

SEQ ID NO: 1578170 - RNA, 19 nt, Homo sapiens
uaaaauagcuuggcauguc

SEQ ID NO: 1578171 - RNA, 19 nt, Homo sapiens
caaagaccaugaggaacug

SEQ ID NO: 1578172 - RNA, 19 nt, Homo sapiens
ggaaaccuacuguggacuu

SEQ ID NO: 1578173 - RNA, 19 nt, Homo sapiens
cuuguggauuucuauguua

SEQ ID NO: 1578174 - RNA, 19 nt, Homo sapiens
guucauaggccauauaacu

SEQ ID NO: 1578175 - RNA, 19 nt, Homo sapiens
aaacccaccuguagagaag

SEQ ID NO: 1578176 - RNA, 19 nt, Homo sapiens
ccauauuccuauacacgaa

SEQ ID NO: 1578177 - RNA, 19 nt, Homo sapiens
gagaaguacccacucuaug

SEQ ID NO: 1578178 - RNA, 19 nt, Homo sapiens
uacagaaucuuacuacaac

SEQ ID NO: 1578179 - RNA, 19 nt, Homo sapiens
gaaggguggucagaaguac

SEQ ID NO: 1578180 - RNA, 19 nt, Homo sapiens
gagaaccuaauaagugcua

SEQ ID NO: 1578181 - RNA, 19 nt, Homo sapiens
cagcaugucuucgcguuuc

SEQ ID NO: 1578182 - RNA, 19 nt, Homo sapiens
agaaguacccacucuaugu

SEQ ID NO: 1578183 - RNA, 19 nt, Homo sapiens
uaggcaaguucaaguucua

SEQ ID NO: 1578184 - RNA, 19 nt, Homo sapiens
caucaaacccaccuguaga

SEQ ID NO: 1578185 - RNA, 19 nt, Homo sapiens
gccggagcguuacaucaaa

SEQ ID NO: 1578186 - RNA, 19 nt, Homo sapiens
ccauggcucagaaaccuua

SEQ ID NO: 1578187 - RNA, 19 nt, Homo sapiens
uaacagcugaccuuauugu

SEQ ID NO: 1578188 - RNA, 19 nt, Homo sapiens
caagaccaaaucauuguau

SEQ ID NO: 1578189 - RNA, 19 nt, Homo sapiens
acaucagcaugcauucaua

SEQ ID NO: 1578190 - RNA, 19 nt, Homo sapiens
caaacccaccuguagagaa

SEQ ID NO: 1578191 - RNA, 19 nt, Homo sapiens
gcaguucgugcuauugaga

SEQ ID NO: 1578192 - RNA, 19 nt, Homo sapiens
cagauuaaagcauacauca

SEQ ID NO: 1578193 - RNA, 19 nt, Homo sapiens
uuaaagauuucugcuccaa

SEQ ID NO: 1578194 - RNA, 19 nt, Homo sapiens
caaguucaaguucuacaga

SEQ ID NO: 1578195 - RNA, 19 nt, Homo sapiens
gauuggaucuaugauuugg

SEQ ID NO: 1578196 - RNA, 19 nt, Homo sapiens
uccugaggcuuguggauuu

SEQ ID NO: 1578197 - RNA, 19 nt, Homo sapiens
ugagaaguacccacucuau

SEQ ID NO: 1578198 - RNA, 19 nt, Homo sapiens
gacuagccaucucaagcaa

SEQ ID NO: 1578199 - RNA, 19 nt, Homo sapiens
gacuagccaucucaagcaa

SEQ ID NO: 1578200 - RNA, 19 nt, Homo sapiens
ugaggaacugucucuagua

SEQ ID NO: 1578201 - RNA, 19 nt, Homo sapiens
gaaggugcauccaguuccu

SEQ ID NO: 1578202 - RNA, 19 nt, Homo sapiens
caucggaacagaccugaau

SEQ ID NO: 1578203 - RNA, 19 nt, Homo sapiens
agacguggaagaucuuauu

SEQ ID NO: 1578204 - RNA, 19 nt, Homo sapiens
guggucagaaguacauuaa

SEQ ID NO: 1578205 - RNA, 19 nt, Homo sapiens
gguggucagaaguacauua

SEQ ID NO: 1578206 - RNA, 19 nt, Homo sapiens
caucucacgcugaucauug

SEQ ID NO: 1578207 - RNA, 19 nt, Homo sapiens
gaaggcaguggcuaguuuc

SEQ ID NO: 1578208 - RNA, 19 nt, Homo sapiens
gauaauagggcaauauacc

SEQ ID NO: 1578209 - RNA, 19 nt, Homo sapiens
gcagacguggaagaucuua

SEQ ID NO: 1578210 - RNA, 19 nt, Homo sapiens
uggcagacguggaagaucu

SEQ ID NO: 1578211 - RNA, 19 nt, Homo sapiens
gcaaguuuaaucaaagauc

SEQ ID NO: 1578212 - RNA, 19 nt, Homo sapiens
uagcugcucuuccuagaac

SEQ ID NO: 1578213 - RNA, 19 nt, Homo sapiens
guguuuccauauuccuaua

SEQ ID NO: 1578214 - RNA, 19 nt, Homo sapiens
gcuguugggaugaagcuuu

SEQ ID NO: 1578215 - RNA, 19 nt, Homo sapiens
gcagauuuccaacgacaca

SEQ ID NO: 1578216 - RNA, 19 nt, Homo sapiens
gacgauuggaucuaugauu

SEQ ID NO: 1578217 - RNA, 19 nt, Homo sapiens
agaaucgaauguggagaaa

SEQ ID NO: 1578218 - RNA, 19 nt, Homo sapiens
uaauagggcaauauaccaa

SEQ ID NO: 1578219 - RNA, 19 nt, Homo sapiens
acugagaggcauccugaua

SEQ ID NO: 1578220 - RNA, 19 nt, Homo sapiens
gggacgauuggaucuauga

SEQ ID NO: 1578221 - RNA, 19 nt, Homo sapiens
cauucauacucccagcaua

SEQ ID NO: 1578222 - RNA, 19 nt, Homo sapiens
gaacagaccugaauaggaa

SEQ ID NO: 1578223 - RNA, 19 nt, Homo sapiens
gguaacagcugaccuuauu

SEQ ID NO: 1578224 - RNA, 19 nt, Homo sapiens
gaagaaauaucaaccagau

SEQ ID NO: 1578225 - RNA, 19 nt, Homo sapiens
gcuugugccuuuagaaaua

SEQ ID NO: 1578226 - RNA, 19 nt, Homo sapiens
gaauggaucucuccugcuu

SEQ ID NO: 1578227 - RNA, 19 nt, Homo sapiens
ucaaccagauuaaagcaua

SEQ ID NO: 1578228 - RNA, 19 nt, Homo sapiens
cagcugaccuuauugugaa

SEQ ID NO: 1578229 - RNA, 19 nt, Homo sapiens
ggucagaaguacauuaaag

SEQ ID NO: 1578230 - RNA, 19 nt, Homo sapiens
ugaaggcaguggcuaguuu

SEQ ID NO: 1578231 - RNA, 19 nt, Homo sapiens
uggaagaucuuauucaaca

SEQ ID NO: 1578232 - RNA, 19 nt, Homo sapiens
gaaaccuacuguggacuuu

SEQ ID NO: 1578233 - RNA, 19 nt, Homo sapiens
ggcaucaaauauucguuua

SEQ ID NO: 1578234 - RNA, 19 nt, Homo sapiens
caguaucacucacuaaaug

SEQ ID NO: 1578235 - RNA, 19 nt, Homo sapiens
ggaauuccaugcagugucu

SEQ ID NO: 1578236 - RNA, 19 nt, Homo sapiens
ggaaggguggucagaagua

SEQ ID NO: 1578237 - RNA, 19 nt, Homo sapiens
gaggaacugucucuaguag

SEQ ID NO: 1578238 - RNA, 19 nt, Homo sapiens
gacuaggguucaugucuuu

SEQ ID NO: 1578239 - RNA, 19 nt, Homo sapiens
ucagagaaccuaauaagug

SEQ ID NO: 1578240 - RNA, 19 nt, Homo sapiens
ggcaguggcuaguuucuug

SEQ ID NO: 1578241 - RNA, 19 nt, Homo sapiens
gaacaguaucacucacuaa

SEQ ID NO: 1578242 - RNA, 19 nt, Homo sapiens
acgauuggaucuaugauuu

SEQ ID NO: 1578243 - RNA, 19 nt, Homo sapiens
aaucgaauguggagaaaga

SEQ ID NO: 1578244 - RNA, 19 nt, Homo sapiens
gaaguacccacucuauguu

SEQ ID NO: 1578245 - RNA, 19 nt, Homo sapiens
caagcaaguuuaaucaaag

SEQ ID NO: 1578246 - RNA, 19 nt, Homo sapiens
ucauucugcuuccguauuu

SEQ ID NO: 1578247 - RNA, 19 nt, Homo sapiens
ggaacagaccugaauagga

SEQ ID NO: 1578248 - RNA, 19 nt, Homo sapiens
cacauuggauccucauuug

SEQ ID NO: 1578249 - RNA, 19 nt, Homo sapiens
gcaaagaccaugaggaacu

SEQ ID NO: 1578250 - RNA, 19 nt, Homo sapiens
ugugaaagcccauuuaaau

SEQ ID NO: 1578251 - RNA, 19 nt, Homo sapiens
gcaagaccaaaucauugua

SEQ ID NO: 1578252 - RNA, 19 nt, Homo sapiens
ccacauuggauccucauuu

SEQ ID NO: 1578253 - RNA, 19 nt, Homo sapiens
ugaacaguaucacucacua

SEQ ID NO: 1578254 - RNA, 19 nt, Homo sapiens
ccauuguucucuucuguga

SEQ ID NO: 1578255 - RNA, 19 nt, Homo sapiens
ugagaggcauccugauaug

SEQ ID NO: 1578256 - RNA, 19 nt, Homo sapiens
ccagcaagaccaaaucauu

SEQ ID NO: 1578257 - RNA, 19 nt, Homo sapiens
cagcaagaccaaaucauug

SEQ ID NO: 1578258 - RNA, 19 nt, Homo sapiens
gggcaucaaauauucguuu

SEQ ID NO: 1578259 - RNA, 19 nt, Homo sapiens
aagcaaagaccaugaggaa

SEQ ID NO: 1578260 - RNA, 19 nt, Homo sapiens
uguggaagaucuuauucaa

SEQ ID NO: 1578261 - RNA, 19 nt, Homo sapiens
cuacagaaucuuacuacaa

SEQ ID NO: 1578262 - RNA, 19 nt, Homo sapiens
caauaaauuucugcuugug

SEQ ID NO: 1578263 - RNA, 19 nt, Homo sapiens
uaaaauagcuuggcauguc

SEQ ID NO: 1578264 - RNA, 19 nt, Homo sapiens
caaagaccaugaggaacug

SEQ ID NO: 1578265 - RNA, 19 nt, Homo sapiens
ggaaaccuacuguggacuu

SEQ ID NO: 1578266 - RNA, 19 nt, Homo sapiens
aaacccaccuguagagaag

SEQ ID NO: 1578267 - RNA, 19 nt, Homo sapiens
ccauauuccuauacacgaa

SEQ ID NO: 1578268 - RNA, 19 nt, Homo sapiens
cauaaucgaauguggagaa

SEQ ID NO: 1578269 - RNA, 19 nt, Homo sapiens
gagaaguacccacucuaug

SEQ ID NO: 1578270 - RNA, 19 nt, Homo sapiens
uacagaaucuuacuacaac

SEQ ID NO: 1578271 - RNA, 19 nt, Homo sapiens
gaaggguggucagaaguac

SEQ ID NO: 1578272 - RNA, 19 nt, Homo sapiens
gagaaccuaauaagugcua

SEQ ID NO: 1578273 - RNA, 19 nt, Homo sapiens
agaaguacccacucuaugu

SEQ ID NO: 1578274 - RNA, 19 nt, Homo sapiens
cagcaugucuucgcguuuc

SEQ ID NO: 1578275 - RNA, 19 nt, Homo sapiens
caucaaacccaccuguaga

SEQ ID NO: 1578276 - RNA, 19 nt, Homo sapiens
guucauaggccauaaucga

SEQ ID NO: 1578277 - RNA, 19 nt, Homo sapiens
uaggcaaguucaaguucua

SEQ ID NO: 1578278 - RNA, 19 nt, Homo sapiens
ccauggcucagaaaccuua

SEQ ID NO: 1578279 - RNA, 19 nt, Homo sapiens
cauaggccauaaucgaaug

SEQ ID NO: 1578280 - RNA, 19 nt, Homo sapiens
uaacagcugaccuuauugu

SEQ ID NO: 1578281 - RNA, 19 nt, Homo sapiens
caagaccaaaucauuguau

SEQ ID NO: 1578282 - RNA, 19 nt, Homo sapiens
acaucagcaugcauucaua

SEQ ID NO: 1578283 - RNA, 19 nt, Homo sapiens
caaacccaccuguagagaa

SEQ ID NO: 1578284 - RNA, 19 nt, Homo sapiens
gcaguucgugcuauugaga

SEQ ID NO: 1578285 - RNA, 19 nt, Homo sapiens
cagauuaaagcauacauca

SEQ ID NO: 1578286 - RNA, 19 nt, Homo sapiens
uuaaagauuucugcuccaa

SEQ ID NO: 1578287 - RNA, 19 nt, Homo sapiens
caaguucaaguucuacaga

SEQ ID NO: 1578288 - RNA, 19 nt, Homo sapiens
gauuggaucuaugauuugg

SEQ ID NO: 1578289 - RNA, 19 nt, Homo sapiens
ugagaaguacccacucuau

SEQ ID NO: 1578290 - RNA, 19 nt, Homo sapiens
gacuagccaucucaagcaa

SEQ ID NO: 1578291 - RNA, 19 nt, Homo sapiens
gacuagccaucucaagcaa

SEQ ID NO: 1578292 - RNA, 19 nt, Homo sapiens
ugaggaacugucucuagua

SEQ ID NO: 1578293 - RNA, 19 nt, Homo sapiens
gaaggugcauccaguuccu

SEQ ID NO: 1578294 - RNA, 19 nt, Homo sapiens
caucggaacagaccugaau

SEQ ID NO: 1578295 - RNA, 19 nt, Homo sapiens
guggucagaaguacauuaa

SEQ ID NO: 1578296 - RNA, 19 nt, Homo sapiens
gguggucagaaguacauua

SEQ ID NO: 1578297 - RNA, 19 nt, Homo sapiens
caucucacgcugaucauug

SEQ ID NO: 1578298 - RNA, 19 nt, Homo sapiens
gaaggcaguggcuaguuuc

SEQ ID NO: 1578299 - RNA, 19 nt, Homo sapiens
uagcugcucuuccuagaac

SEQ ID NO: 1578300 - RNA, 19 nt, Homo sapiens
gcaaguuuaaucaaagauc

SEQ ID NO: 1578301 - RNA, 19 nt, Homo sapiens
guguuuccauauuccuaua

SEQ ID NO: 1578302 - RNA, 19 nt, Homo sapiens
gcuguugggaugaagcuuu

SEQ ID NO: 1578303 - RNA, 19 nt, Homo sapiens
gcagauuuccaacgacaca

SEQ ID NO: 1578304 - RNA, 19 nt, Homo sapiens
gcuggcagauguggaagau

SEQ ID NO: 1578305 - RNA, 19 nt, Homo sapiens
gacgauuggaucuaugauu

SEQ ID NO: 1578306 - RNA, 19 nt, Homo sapiens
acugagaggcauccugaua

SEQ ID NO: 1578307 - RNA, 19 nt, Homo sapiens
gggacgauuggaucuauga

SEQ ID NO: 1578308 - RNA, 19 nt, Homo sapiens
cauucauacucccagcaua

SEQ ID NO: 1578309 - RNA, 19 nt, Homo sapiens
caaccagauuaaagcauac

SEQ ID NO: 1578310 - RNA, 19 nt, Homo sapiens
aaccuacuguggacuuuau

SEQ ID NO: 1578311 - RNA, 19 nt, Homo sapiens
gaggaaggugcauccaguu

SEQ ID NO: 1578312 - RNA, 19 nt, Homo sapiens
gucagaaguacauuaaaga

SEQ ID NO: 1578313 - RNA, 19 nt, Homo sapiens
uagcuuggcaugucauuag

SEQ ID NO: 1578314 - RNA, 19 nt, Homo sapiens
ucagaguggccaaguucua

SEQ ID NO: 1578315 - RNA, 19 nt, Homo sapiens
auccugauaugcuuacaaa

SEQ ID NO: 1578316 - RNA, 19 nt, Homo sapiens
aaggaaggguggucagaag

SEQ ID NO: 1578317 - RNA, 19 nt, Homo sapiens
cucagaaaccuuauaccua

SEQ ID NO: 1578318 - RNA, 19 nt, Homo sapiens
gcucagaaaccuuauaccu

SEQ ID NO: 1578319 - RNA, 19 nt, Homo sapiens
aacagcagauuuccaacga

SEQ ID NO: 1578320 - RNA, 19 nt, Homo sapiens
ggaagaucuuauucaacag

SEQ ID NO: 1578321 - RNA, 19 nt, Homo sapiens
cuagccaucucaagcaagu

SEQ ID NO: 1578322 - RNA, 19 nt, Homo sapiens
gaagaaaucucucccaaua

SEQ ID NO: 1578323 - RNA, 19 nt, Homo sapiens
gaagagaacugcuguugaa

SEQ ID NO: 1578324 - RNA, 19 nt, Homo sapiens
gcaagaauauguauccuaa

SEQ ID NO: 1578325 - RNA, 19 nt, Homo sapiens
gcaaguaaguaucauagua

SEQ ID NO: 1578326 - RNA, 19 nt, Homo sapiens
guaaugaacuauccacaua

SEQ ID NO: 1578327 - RNA, 19 nt, Homo sapiens
gcucuuaucuucucaaauu

SEQ ID NO: 1578328 - RNA, 19 nt, Homo sapiens
gauacagacuucacaaaua

SEQ ID NO: 1578329 - RNA, 19 nt, Homo sapiens
ggagaacacugcauuaaga

SEQ ID NO: 1578330 - RNA, 19 nt, Homo sapiens
ggaaggagauucaauaagu

SEQ ID NO: 1578331 - RNA, 19 nt, Homo sapiens
gaaaguagguuaccauuuu

SEQ ID NO: 1578332 - RNA, 19 nt, Homo sapiens
gcaaagaccggaaagauuu

SEQ ID NO: 1578333 - RNA, 19 nt, Homo sapiens
gaacuucccuuccuuaaag

SEQ ID NO: 1578334 - RNA, 19 nt, Homo sapiens
gaucggaacugguagacua

SEQ ID NO: 1578335 - RNA, 19 nt, Homo sapiens
gaagaucacuaauccaguu

SEQ ID NO: 1578336 - RNA, 19 nt, Homo sapiens
guaaacagaucuacuaauc

SEQ ID NO: 1578337 - RNA, 19 nt, Homo sapiens
ggcaaugaauucuguaaua

SEQ ID NO: 1578338 - RNA, 19 nt, Homo sapiens
gaggucaugucauuuguua

SEQ ID NO: 1578339 - RNA, 19 nt, Homo sapiens
agagagagcucaagagaaa

SEQ ID NO: 1578340 - RNA, 19 nt, Homo sapiens
agaaagagcugccaaacuu

SEQ ID NO: 1578341 - RNA, 19 nt, Homo sapiens
guaaugagcuggaugaagu

SEQ ID NO: 1578342 - RNA, 19 nt, Homo sapiens
caagggaguucauggauuu

SEQ ID NO: 1578343 - RNA, 19 nt, Homo sapiens
ucacagauuugguucauaa

SEQ ID NO: 1578344 - RNA, 19 nt, Homo sapiens
uaggauaccugacuacuaa

SEQ ID NO: 1578345 - RNA, 19 nt, Homo sapiens
guaaugagguccuuucugu

SEQ ID NO: 1578346 - RNA, 19 nt, Homo sapiens
caaagugucugccugugua

SEQ ID NO: 1578347 - RNA, 19 nt, Homo sapiens
ccaaugauguaacgguuua

SEQ ID NO: 1578348 - RNA, 19 nt, Homo sapiens
gagaaagacuguacuucaa

SEQ ID NO: 1578349 - RNA, 19 nt, Homo sapiens
ggacuaggauugugauugu

SEQ ID NO: 1578350 - RNA, 19 nt, Homo sapiens
gaaaugaacauacacauag

SEQ ID NO: 1578351 - RNA, 19 nt, Homo sapiens
gaucugaauucuacugaaa

SEQ ID NO: 1578352 - RNA, 19 nt, Homo sapiens
ccuaacagcuugcauuauu

SEQ ID NO: 1578353 - RNA, 19 nt, Homo sapiens
gaaguccuauccauuugua

SEQ ID NO: 1578354 - RNA, 19 nt, Homo sapiens
caagagaacuuuaugugau

SEQ ID NO: 1578355 - RNA, 19 nt, Homo sapiens
ggagugaaaggauuuguua

SEQ ID NO: 1578356 - RNA, 19 nt, Homo sapiens
gaaauucgcaugaugucua

SEQ ID NO: 1578357 - RNA, 19 nt, Homo sapiens
ggacuugccacauauagua

SEQ ID NO: 1578358 - RNA, 19 nt, Homo sapiens
ugauuugggucuuugauua

SEQ ID NO: 1578359 - RNA, 19 nt, Homo sapiens
gggauuugcugaauuaaug

SEQ ID NO: 1578360 - RNA, 19 nt, Homo sapiens
guacuucucucuuggauca

SEQ ID NO: 1578361 - RNA, 19 nt, Homo sapiens
guaugcaucuuaccaauga

SEQ ID NO: 1578362 - RNA, 19 nt, Homo sapiens
ggagcuaguugguauaaug

SEQ ID NO: 1578363 - RNA, 19 nt, Homo sapiens
gaugaaguccuauccauuu

SEQ ID NO: 1578364 - RNA, 19 nt, Homo sapiens
uauaugccauugacuguua

SEQ ID NO: 1578365 - RNA, 19 nt, Homo sapiens
ugaacuagguugugugaaa

SEQ ID NO: 1578366 - RNA, 19 nt, Homo sapiens
gaacauaaggccacuggaa

SEQ ID NO: 1578367 - RNA, 19 nt, Homo sapiens
gcaaugaauucuguaauag

SEQ ID NO: 1578368 - RNA, 19 nt, Homo sapiens
ugacacagauaaccggaua

SEQ ID NO: 1578369 - RNA, 19 nt, Homo sapiens
ccaaauaaaucagaugaga

SEQ ID NO: 1578370 - RNA, 19 nt, Homo sapiens
cauuagaacugucuuguug

SEQ ID NO: 1578371 - RNA, 19 nt, Homo sapiens
gcuccuccauuuccauuua

SEQ ID NO: 1578372 - RNA, 19 nt, Homo sapiens
gaaagacccuucaguuuug

SEQ ID NO: 1578373 - RNA, 19 nt, Homo sapiens
gcaaagugauugaguaggu

SEQ ID NO: 1578374 - RNA, 19 nt, Homo sapiens
ugaagugacuauugaacua

SEQ ID NO: 1578375 - RNA, 19 nt, Homo sapiens
gaaggagauucaauaagug

SEQ ID NO: 1578376 - RNA, 19 nt, Homo sapiens
gaaauaugcauggaaauga

SEQ ID NO: 1578377 - RNA, 19 nt, Homo sapiens
ggagugauuugguucuuug

SEQ ID NO: 1578378 - RNA, 19 nt, Homo sapiens
caacagauucaaacaauga

SEQ ID NO: 1578379 - RNA, 19 nt, Homo sapiens
gaacuagguugugugaaau

SEQ ID NO: 1578380 - RNA, 19 nt, Homo sapiens
ugagaggacuuguaaugaa

SEQ ID NO: 1578381 - RNA, 19 nt, Homo sapiens
gaaauauccacuugagaaa

SEQ ID NO: 1578382 - RNA, 19 nt, Homo sapiens
gcauggaaaugaagugguu

SEQ ID NO: 1578383 - RNA, 19 nt, Homo sapiens
ugagaagguuugccaauga

SEQ ID NO: 1578384 - RNA, 19 nt, Homo sapiens
aaugggauuugcugaauua

SEQ ID NO: 1578385 - RNA, 19 nt, Homo sapiens
gaagaugaaauucgcauga

SEQ ID NO: 1578386 - RNA, 19 nt, Homo sapiens
gaaugggauuugcugaauu

SEQ ID NO: 1578387 - RNA, 19 nt, Homo sapiens
gaacacugcauuaagaaga

SEQ ID NO: 1578388 - RNA, 19 nt, Homo sapiens
ucacuaauccaguuuauga

SEQ ID NO: 1578389 - RNA, 19 nt, Homo sapiens
gguagaccuugcaagaaua

SEQ ID NO: 1578390 - RNA, 19 nt, Homo sapiens
gaacaaucgugagucuuug

SEQ ID NO: 1578391 - RNA, 19 nt, Homo sapiens
aaagcaaagugauugagua

SEQ ID NO: 1578392 - RNA, 19 nt, Homo sapiens
gggagaacuuacuaacuuu

SEQ ID NO: 1578393 - RNA, 19 nt, Homo sapiens
uugcauaucucccagcaua

SEQ ID NO: 1578394 - RNA, 19 nt, Homo sapiens
ggaauaaagguacaaacaa

SEQ ID NO: 1578395 - RNA, 19 nt, Homo sapiens
gaccaaagccaucauugaa

SEQ ID NO: 1578396 - RNA, 19 nt, Homo sapiens
ggaacagaaucgaagauca

SEQ ID NO: 1578397 - RNA, 19 nt, Homo sapiens
gaaccagaauuuaaguaca

SEQ ID NO: 1578398 - RNA, 19 nt, Homo sapiens
gaagguuugccaaugaaua

SEQ ID NO: 1578399 - RNA, 19 nt, Homo sapiens
gagaagguuugccaaugaa

SEQ ID NO: 1578400 - RNA, 19 nt, Homo sapiens
uaaggauggugguguauug

SEQ ID NO: 1578401 - RNA, 19 nt, Homo sapiens
acuagaggauguuguauuu

SEQ ID NO: 1578402 - RNA, 19 nt, Homo sapiens
gauugucccuucucuaaau

SEQ ID NO: 1578403 - RNA, 19 nt, Homo sapiens
uaacaugaguguacuaacu

SEQ ID NO: 1578404 - RNA, 19 nt, Homo sapiens
cuagaagcgugaauguaua

SEQ ID NO: 1578405 - RNA, 19 nt, Homo sapiens
uaaauucugccaccucaua

SEQ ID NO: 1578406 - RNA, 19 nt, Homo sapiens
ugucugagcuuauuguguu

SEQ ID NO: 1578407 - RNA, 19 nt, Homo sapiens
cuucccagcuccuuaauaa

SEQ ID NO: 1578408 - RNA, 19 nt, Homo sapiens
uaaaugcccacuugaauga

SEQ ID NO: 1578409 - RNA, 19 nt, Homo sapiens
ggagaacuuacuaacuuua

SEQ ID NO: 1578410 - RNA, 19 nt, Homo sapiens
ggaaaucacaguauacaca

SEQ ID NO: 1578411 - RNA, 19 nt, Homo sapiens
gacuggaacuauuuacaaa

SEQ ID NO: 1578412 - RNA, 19 nt, Homo sapiens
uguugaaccucauagaaua

SEQ ID NO: 1578413 - RNA, 19 nt, Homo sapiens
gauuugacagcauacauua

SEQ ID NO: 1578414 - RNA, 19 nt, Homo sapiens
gcauuuagcuggaaaacaa

SEQ ID NO: 1578415 - RNA, 19 nt, Homo sapiens
gcaagugaaacaaaguuaa

SEQ ID NO: 1578416 - RNA, 19 nt, Homo sapiens
ggacagagcacugaauauc

SEQ ID NO: 1578417 - RNA, 19 nt, Homo sapiens
ugaaauauccacuugagaa

SEQ ID NO: 1578418 - RNA, 19 nt, Homo sapiens
gcaacaacuuugaccugaa

SEQ ID NO: 1578419 - RNA, 19 nt, Homo sapiens
ccaggaaggagauucaaua

SEQ ID NO: 1578420 - RNA, 19 nt, Homo sapiens
gcacaguugcuauaccuaa

SEQ ID NO: 1578421 - RNA, 19 nt, Homo sapiens
ggagaacaaucgugagucu

SEQ ID NO: 1578422 - RNA, 19 nt, Homo sapiens
gaaagaaggugguccaaau

SEQ ID NO: 1578423 - RNA, 19 nt, Homo sapiens
uaaauagccucuuagguaa

SEQ ID NO: 1578424 - RNA, 19 nt, Homo sapiens
cuaguuagcugcuuuaaau

SEQ ID NO: 1578425 - RNA, 19 nt, Homo sapiens
ccuggaaacuauaaacuua

SEQ ID NO: 1578426 - RNA, 19 nt, Homo sapiens
gcuuauaccuggaaacuau

SEQ ID NO: 1578427 - RNA, 19 nt, Homo sapiens
auaaauagccucuuaggua

SEQ ID NO: 1578428 - RNA, 19 nt, Homo sapiens
ggaauagaccacgauguua

SEQ ID NO: 1578429 - RNA, 19 nt, Homo sapiens
ccaauuauccauaugauga

SEQ ID NO: 1578430 - RNA, 19 nt, Homo sapiens
ccaaggcugucauucauug

SEQ ID NO: 1578431 - RNA, 19 nt, Homo sapiens
ggaaagaagaggagaagga

SEQ ID NO: 1578432 - RNA, 19 nt, Homo sapiens
cugcaagacuuaaauaguu

SEQ ID NO: 1578433 - RNA, 19 nt, Homo sapiens
gaaagaagaggagaaggaa

SEQ ID NO: 1578434 - RNA, 19 nt, Homo sapiens
ggaugcaagacuucaauua

SEQ ID NO: 1578435 - RNA, 19 nt, Homo sapiens
gaccaaggcugucauucau

SEQ ID NO: 1578436 - RNA, 19 nt, Homo sapiens
gcagauacaccgaggaguu

SEQ ID NO: 1578437 - RNA, 19 nt, Homo sapiens
gagaccuuguggccaauua

SEQ ID NO: 1578438 - RNA, 19 nt, Homo sapiens
guacgugaaugagaaagaa

SEQ ID NO: 1578439 - RNA, 19 nt, Homo sapiens
gaacccagauggcuuugag

SEQ ID NO: 1578440 - RNA, 19 nt, Homo sapiens
gacagcagcuuuguagaug

SEQ ID NO: 1578441 - RNA, 19 nt, Homo sapiens
gaugagacgcggaguggua

SEQ ID NO: 1578442 - RNA, 19 nt, Homo sapiens
ucaauuaccuuagcagcaa

SEQ ID NO: 1578443 - RNA, 19 nt, Homo sapiens
gaucugaaccggaacuuuc

SEQ ID NO: 1578444 - RNA, 19 nt, Homo sapiens
gaaggaagaauugauggaa

SEQ ID NO: 1578445 - RNA, 19 nt, Homo sapiens
ggagaaggaagaauugaug

SEQ ID NO: 1578446 - RNA, 19 nt, Homo sapiens
gaagaaaagguacauguuu

SEQ ID NO: 1578447 - RNA, 19 nt, Homo sapiens
gaaaguggcaguuccuuac

SEQ ID NO: 1578448 - RNA, 19 nt, Homo sapiens
ccgaggaguuaaaggauuu

SEQ ID NO: 1578449 - RNA, 19 nt, Homo sapiens
gaaggugguccaaauaauc

SEQ ID NO: 1578450 - RNA, 19 nt, Homo sapiens
ggaauaugcaugggaauga

SEQ ID NO: 1578451 - RNA, 19 nt, Homo sapiens
gcacucuacugcaagacuu

SEQ ID NO: 1578452 - RNA, 19 nt, Homo sapiens
aaagaaggugguccaaaua

SEQ ID NO: 1578453 - RNA, 19 nt, Homo sapiens
guuagcugcuuuaaaucua

SEQ ID NO: 1578454 - RNA, 19 nt, Homo sapiens
gagccugaauuuaaauaca

SEQ ID NO: 1578455 - RNA, 19 nt, Homo sapiens
aggcuuaaaugcaauauuc

SEQ ID NO: 1578456 - RNA, 19 nt, Homo sapiens
gaugacagcagcuuuguag

SEQ ID NO: 1578457 - RNA, 19 nt, Homo sapiens
cgacaacccuggcguccau

SEQ ID NO: 1578458 - RNA, 19 nt, Homo sapiens
guagaguggcccagaauug

SEQ ID NO: 1578459 - RNA, 19 nt, Homo sapiens
gaauagaccacgauguuac

SEQ ID NO: 1578460 - RNA, 19 nt, Homo sapiens
cagauacaccgaggaguua

SEQ ID NO: 1578461 - RNA, 19 nt, Homo sapiens
ccgcaaaggauggugauua

SEQ ID NO: 1578462 - RNA, 19 nt, Homo sapiens
gagaucaccguggagcuua

SEQ ID NO: 1578463 - RNA, 19 nt, Homo sapiens
ccaaauaaucaucuguuga

SEQ ID NO: 1578464 - RNA, 19 nt, Homo sapiens
cuggugagccugaauuuaa

SEQ ID NO: 1578465 - RNA, 19 nt, Homo sapiens
caucaugccuucccugaac

SEQ ID NO: 1578466 - RNA, 19 nt, Homo sapiens
gaugaugacagcagcuuug

SEQ ID NO: 1578467 - RNA, 19 nt, Homo sapiens
acauauaggagcaauacua

SEQ ID NO: 1578468 - RNA, 19 nt, Homo sapiens
cuucuugcuuguacauaua

SEQ ID NO: 1578469 - RNA, 19 nt, Homo sapiens
cuauaagcaugaucuuguu

SEQ ID NO: 1578470 - RNA, 19 nt, Homo sapiens
caaaggauggugauuacug

SEQ ID NO: 1578471 - RNA, 19 nt, Homo sapiens
gaguaauucuagcuuucaa

SEQ ID NO: 1578472 - RNA, 19 nt, Homo sapiens
caagacuucaauuaccuua

SEQ ID NO: 1578473 - RNA, 19 nt, Homo sapiens
caccaugucgcaagaauga

SEQ ID NO: 1578474 - RNA, 19 nt, Homo sapiens
gaacucaaggacugguuug

SEQ ID NO: 1578475 - RNA, 19 nt, Homo sapiens
gaaguucccaccugaagag

SEQ ID NO: 1578476 - RNA, 19 nt, Homo sapiens
agaaggugguccaaauaau

SEQ ID NO: 1578477 - RNA, 19 nt, Homo sapiens
gaauaugcaugggaaugag

SEQ ID NO: 1578478 - RNA, 19 nt, Homo sapiens
cuacugcaagacuuaaaua

SEQ ID NO: 1578479 - RNA, 19 nt, Homo sapiens
aggaagaauugauggaaug

SEQ ID NO: 1578480 - RNA, 19 nt, Homo sapiens
agaaaguggcaguuccuua

SEQ ID NO: 1578481 - RNA, 19 nt, Homo sapiens
ggcauacucuucuuucaac

SEQ ID NO: 1578482 - RNA, 19 nt, Homo sapiens
aagaaggugguccaaauaa

SEQ ID NO: 1578483 - RNA, 19 nt, Homo sapiens
guacauauaggagcaauac

SEQ ID NO: 1578484 - RNA, 19 nt, Homo sapiens
ugacuaacuauaagcauga

SEQ ID NO: 1578485 - RNA, 19 nt, Homo sapiens
cagcagcuuuguagaugga

SEQ ID NO: 1578486 - RNA, 19 nt, Homo sapiens
gggcauacucuucuuucaa

SEQ ID NO: 1578487 - RNA, 19 nt, Homo sapiens
gaagcaaugcccagggaau

SEQ ID NO: 1578488 - RNA, 19 nt, Homo sapiens
gaacuggagucauuuucug

SEQ ID NO: 1578489 - RNA, 19 nt, Homo sapiens
gaugcaagacuucaauuac

SEQ ID NO: 1578490 - RNA, 19 nt, Homo sapiens
ggauuauggauauuccuuu

SEQ ID NO: 1578491 - RNA, 19 nt, Homo sapiens
gaagaaaauuguggaucaa

SEQ ID NO: 1578492 - RNA, 19 nt, Homo sapiens
uaguguacgugaaugagaa

SEQ ID NO: 1578493 - RNA, 19 nt, Homo sapiens
ggauaguguacgugaauga

SEQ ID NO: 1578494 - RNA, 19 nt, Homo sapiens
gauccacaguacccgcauu

SEQ ID NO: 1578495 - RNA, 19 nt, Homo sapiens
cuacugggaggauaacaaa

SEQ ID NO: 1578496 - RNA, 19 nt, Homo sapiens
ugacagcagcuuuguagau

SEQ ID NO: 1578497 - RNA, 19 nt, Homo sapiens
gcugucauucauuggauua

SEQ ID NO: 1578498 - RNA, 19 nt, Homo sapiens
ugaagaaaauuguggauca

SEQ ID NO: 1578499 - RNA, 19 nt, Homo sapiens
gcaaugcccagggaauaga

SEQ ID NO: 1578500 - RNA, 19 nt, Homo sapiens
ugugagcacucuacugcaa

SEQ ID NO: 1578501 - RNA, 19 nt, Homo sapiens
uggugagccugaauuuaaa

SEQ ID NO: 1578502 - RNA, 19 nt, Homo sapiens
aagaggagaaggaagaauu

SEQ ID NO: 1578503 - RNA, 19 nt, Homo sapiens
aagaagaggagaaggaaga

SEQ ID NO: 1578504 - RNA, 19 nt, Homo sapiens
uagcuaccuugagcagaua

SEQ ID NO: 1578505 - RNA, 19 nt, Homo sapiens
gagaaguucccaccugaag

SEQ ID NO: 1578506 - RNA, 19 nt, Homo sapiens
gcuucuaguuagcugcuuu

SEQ ID NO: 1578507 - RNA, 19 nt, Homo sapiens
ggaaaaugaugucagaaac

SEQ ID NO: 1578508 - RNA, 19 nt, Homo sapiens
ggugauuacuggagauugc

SEQ ID NO: 1578509 - RNA, 19 nt, Homo sapiens
aggaauagaccacgauguu

SEQ ID NO: 1578510 - RNA, 19 nt, Homo sapiens
gauuacuggagauugcuua

SEQ ID NO: 1578511 - RNA, 19 nt, Homo sapiens
cgcaaaggauggugauuac

SEQ ID NO: 1578512 - RNA, 19 nt, Homo sapiens
ggaaggaauagaccacgau

SEQ ID NO: 1578513 - RNA, 19 nt, Homo sapiens
uuagcuaccuugagcagau

SEQ ID NO: 1578514 - RNA, 19 nt, Homo sapiens
ggccaauuauccauaugau

SEQ ID NO: 1578515 - RNA, 19 nt, Homo sapiens
aaauugacuucuugcuugu

SEQ ID NO: 1578516 - RNA, 19 nt, Homo sapiens
ugagcacucuacugcaaga

SEQ ID NO: 1578517 - RNA, 19 nt, Homo sapiens
uccaaauaaucaucuguug

SEQ ID NO: 1578518 - RNA, 19 nt, Homo sapiens
aagcaaugcccagggaaua

SEQ ID NO: 1578519 - RNA, 19 nt, Homo sapiens
guuguagaguggcccagaa

SEQ ID NO: 1578520 - RNA, 19 nt, Homo sapiens
gugaaguucuuuuacugua

SEQ ID NO: 1578521 - RNA, 19 nt, Homo sapiens
aaggaagaauugauggaau

SEQ ID NO: 1578522 - RNA, 19 nt, Homo sapiens
gaacuggucugcucacacu

SEQ ID NO: 1578523 - RNA, 19 nt, Homo sapiens
ccaacugccuggaggauga

SEQ ID NO: 1578524 - RNA, 19 nt, Homo sapiens
caucaggacuggcuuuauc

SEQ ID NO: 1578525 - RNA, 19 nt, Homo sapiens
gggcgaaggugcuguaaac

SEQ ID NO: 1578526 - RNA, 19 nt, Homo sapiens
caacaucauccaagacuuc

SEQ ID NO: 1578527 - RNA, 19 nt, Homo sapiens
ggcuuuaucuccugacuca

SEQ ID NO: 1578528 - RNA, 19 nt, Homo sapiens
gcacagacaagccuuacuc

SEQ ID NO: 1578529 - RNA, 19 nt, Homo sapiens
guuccucucugcuuuguuc

SEQ ID NO: 1578530 - RNA, 19 nt, Homo sapiens
cauccaagacuucuacaau

SEQ ID NO: 1578531 - RNA, 19 nt, Homo sapiens
gggagggccuauggaugaa

SEQ ID NO: 1578532 - RNA, 19 nt, Homo sapiens
ugggagggccuauggauga

SEQ ID NO: 1578533 - RNA, 19 nt, Homo sapiens
ggacggcccacaacaucau

SEQ ID NO: 1578534 - RNA, 19 nt, Homo sapiens
ggacagcuucacccuugga

SEQ ID NO: 1578535 - RNA, 19 nt, Homo sapiens
ccacggcuccacucuguuc

SEQ ID NO: 1578536 - RNA, 19 nt, Homo sapiens
cccacaacaucauccaaga

SEQ ID NO: 1578537 - RNA, 19 nt, Homo sapiens
ugccacggcuccacucugu

SEQ ID NO: 1578538 - RNA, 19 nt, Homo sapiens
gccaaggccaagaccauga

SEQ ID NO: 1578539 - RNA, 19 nt, Homo sapiens
ggugcacucugcgaacguu

SEQ ID NO: 1578540 - RNA, 19 nt, Homo sapiens
cuuccaaggacacuaauga

SEQ ID NO: 1578541 - RNA, 19 nt, Homo sapiens
agacugagccaggcaggaa

SEQ ID NO: 1578542 - RNA, 19 nt, Homo sapiens
gcgcaucaggacuggcuuu

SEQ ID NO: 1578543 - RNA, 19 nt, Homo sapiens
ugccagcaacuacguguaa

SEQ ID NO: 1578544 - RNA, 19 nt, Homo sapiens
gggcgugguguuccuguug

SEQ ID NO: 1578545 - RNA, 19 nt, Homo sapiens
ccacccuccucuggauauu

SEQ ID NO: 1578546 - RNA, 19 nt, Homo sapiens
gaaagcgccaaggccaaga

SEQ ID NO: 1578547 - RNA, 19 nt, Homo sapiens
gggacugggcagagacuga

SEQ ID NO: 1578548 - RNA, 19 nt, Homo sapiens
ccucucugcuuuguucuuc

SEQ ID NO: 1578549 - RNA, 19 nt, Homo sapiens
auccaagacuucuacaauc

SEQ ID NO: 1578550 - RNA, 19 nt, Homo sapiens
cuugcuggcuugcgcauca

SEQ ID NO: 1578551 - RNA, 19 nt, Homo sapiens
gcaucaggacuggcuuuau

SEQ ID NO: 1578552 - RNA, 19 nt, Homo sapiens
gagggccuauggaugaacu

SEQ ID NO: 1578553 - RNA, 19 nt, Homo sapiens
cuucaucggcagcaacauu

SEQ ID NO: 1578554 - RNA, 19 nt, Homo sapiens
gaagugcagaguggaugga

SEQ ID NO: 1578555 - RNA, 19 nt, Homo sapiens
ggguaggccuugauaucac

SEQ ID NO: 1578556 - RNA, 19 nt, Homo sapiens
gggagggacggaagugaca

SEQ ID NO: 1578557 - RNA, 19 nt, Homo sapiens
acaacaucauccaagacuu

SEQ ID NO: 1578558 - RNA, 19 nt, Homo sapiens
caaccugcauggacuguga

SEQ ID NO: 1578559 - RNA, 19 nt, Homo sapiens
guauggagccgagccguua

SEQ ID NO: 1578560 - RNA, 19 nt, Homo sapiens
ccgcaaggacuacgucuaa

SEQ ID NO: 1578561 - RNA, 19 nt, Homo sapiens
ccaccaaggucgucuacuc

SEQ ID NO: 1578562 - RNA, 19 nt, Homo sapiens
gggagggccuguggaugaa

SEQ ID NO: 1578563 - RNA, 19 nt, Homo sapiens
ggaaggggcacuugauauu

SEQ ID NO: 1578564 - RNA, 19 nt, Homo sapiens
gcuacgaccgcaaggacua

SEQ ID NO: 1578565 - RNA, 19 nt, Homo sapiens
ggugaccgccaauacuuga

SEQ ID NO: 1578566 - RNA, 19 nt, Homo sapiens
gcaaggacuacgucuaagg

SEQ ID NO: 1578567 - RNA, 19 nt, Homo sapiens
ugggagggccuguggauga

SEQ ID NO: 1578568 - RNA, 19 nt, Homo sapiens
gaaggggcacuugauauuu

SEQ ID NO: 1578569 - RNA, 19 nt, Homo sapiens
agaaguacacggccaccaa

SEQ ID NO: 1578570 - RNA, 19 nt, Homo sapiens
aaggggcacuugauauuuu

SEQ ID NO: 1578571 - RNA, 19 nt, Homo sapiens
ggucggccaacaccauuau

SEQ ID NO: 1578572 - RNA, 19 nt, Homo sapiens
cuaccaacauuaaguauga

SEQ ID NO: 1578573 - RNA, 19 nt, Homo sapiens
gggcggaaauggccaauuc

SEQ ID NO: 1578574 - RNA, 19 nt, Homo sapiens
guaguuuggugacaagauu

SEQ ID NO: 1578575 - RNA, 19 nt, Homo sapiens
gccaucagauugucacaga

SEQ ID NO: 1578576 - RNA, 19 nt, Homo sapiens
ggaccuacagcccaggaua

SEQ ID NO: 1578577 - RNA, 19 nt, Homo sapiens
cuacagcccaggauacuuu

SEQ ID NO: 1578578 - RNA, 19 nt, Homo sapiens
gcacugcucuccuguuccu

SEQ ID NO: 1578579 - RNA, 19 nt, Homo sapiens
ucccugcacuccauguaua

SEQ ID NO: 1578580 - RNA, 19 nt, Homo sapiens
gugcacugcucuccuguuc

SEQ ID NO: 1578581 - RNA, 19 nt, Homo sapiens
gcauucaccuggcccaaac

SEQ ID NO: 1578582 - RNA, 19 nt, Homo sapiens
gugacaagauuugcauuca

SEQ ID NO: 1578583 - RNA, 19 nt, Homo sapiens
guagcuugcuccugguaug

SEQ ID NO: 1578584 - RNA, 19 nt, Homo sapiens
caggauacuuugggacuug

SEQ ID NO: 1578585 - RNA, 19 nt, Homo sapiens
ccaagugucguuuguuuua

SEQ ID NO: 1578586 - RNA, 19 nt, Homo sapiens
agccauggguggaggcaua

SEQ ID NO: 1578587 - RNA, 19 nt, Homo sapiens
uuugaucccuaccaacauu

SEQ ID NO: 1578588 - RNA, 19 nt, Homo sapiens
gugaagaaggcccguauag

SEQ ID NO: 1578589 - RNA, 19 nt, Homo sapiens
gagacgacaaagugaagaa

SEQ ID NO: 1578590 - RNA, 19 nt, Homo sapiens
gguauggccaucagauugu

SEQ ID NO: 1578591 - RNA, 19 nt, Homo sapiens
ccaauucgggccugcaguu

SEQ ID NO: 1578592 - RNA, 19 nt, Homo sapiens
gcuaugggagugucuagau

SEQ ID NO: 1578593 - RNA, 19 nt, Homo sapiens
cgauuuguguguaguuugg

SEQ ID NO: 1578594 - RNA, 19 nt, Homo sapiens
gcccugccaucuuuauugg

SEQ ID NO: 1578595 - RNA, 19 nt, Homo sapiens
ggugacaagauuugcauuc

SEQ ID NO: 1578596 - RNA, 19 nt, Homo sapiens
cuaugggagugucuagaug

SEQ ID NO: 1578597 - RNA, 19 nt, Homo sapiens
ucagauugucacagacuuu

SEQ ID NO: 1578598 - RNA, 19 nt, Homo sapiens
ccaggauacuuugggacuu

SEQ ID NO: 1578599 - RNA, 19 nt, Homo sapiens
ggcccugccaucuuuauug

SEQ ID NO: 1578600 - RNA, 19 nt, Homo sapiens
gucgauuuguguguaguuu

SEQ ID NO: 1578601 - RNA, 19 nt, Homo sapiens
gggcuuccuggccauguuu

SEQ ID NO: 1578602 - RNA, 19 nt, Homo sapiens
gugucuagaugccugaaag

SEQ ID NO: 1578603 - RNA, 19 nt, Homo sapiens
augaugagcugcaaaaugu

SEQ ID NO: 1578604 - RNA, 19 nt, Homo sapiens
ugacaagauuugcauucac

SEQ ID NO: 1578605 - RNA, 19 nt, Homo sapiens
ccaccaauuuugucuggaa

SEQ ID NO: 1578606 - RNA, 19 nt, Homo sapiens
ggagacgacaaagugaaga

SEQ ID NO: 1578607 - RNA, 19 nt, Homo sapiens
gaugaugagcugcaaaaug

SEQ ID NO: 1578608 - RNA, 19 nt, Homo sapiens
ggaaaacuccaccucaagu

SEQ ID NO: 1578609 - RNA, 19 nt, Homo sapiens
gggagacgacaaagugaag

SEQ ID NO: 1578610 - RNA, 19 nt, Homo sapiens
ccacgaugggcaugaagug

SEQ ID NO: 1578611 - RNA, 19 nt, Homo sapiens
caacaaauauggagaguau

SEQ ID NO: 1578612 - RNA, 19 nt, Homo sapiens
gaacuucagugcucuuaaa

SEQ ID NO: 1578613 - RNA, 19 nt, Homo sapiens
ucacaaaucugaucaauag

SEQ ID NO: 1578614 - RNA, 19 nt, Homo sapiens
ucaaauacguggcaaauau

SEQ ID NO: 1578615 - RNA, 19 nt, Homo sapiens
ggaagacacuuaccuaaca

SEQ ID NO: 1578616 - RNA, 19 nt, Homo sapiens
gaacccagauggauuugaa

SEQ ID NO: 1578617 - RNA, 19 nt, Homo sapiens
gaaacccugucucuacuaa

SEQ ID NO: 1578618 - RNA, 19 nt, Homo sapiens
auacaagacuucaccauaa

SEQ ID NO: 1578619 - RNA, 19 nt, Homo sapiens
caagaaaucccaacaugaa

SEQ ID NO: 1578620 - RNA, 19 nt, Homo sapiens
caaagacccugaaaucaca

SEQ ID NO: 1578621 - RNA, 19 nt, Homo sapiens
ggagaagcuuccauccuuu

SEQ ID NO: 1578622 - RNA, 19 nt, Homo sapiens
uaacaaguacugcucauuu

SEQ ID NO: 1578623 - RNA, 19 nt, Homo sapiens
gaaaggagacgaguguaaa

SEQ ID NO: 1578624 - RNA, 19 nt, Homo sapiens
gaacuuuccuaaugguguu

SEQ ID NO: 1578625 - RNA, 19 nt, Homo sapiens
gaagaaaggagacgagugu

SEQ ID NO: 1578626 - RNA, 19 nt, Homo sapiens
gagaaccggaugaauauaa

SEQ ID NO: 1578627 - RNA, 19 nt, Homo sapiens
gaagacacuuaccuaacaa

SEQ ID NO: 1578628 - RNA, 19 nt, Homo sapiens
aaacauaucugccccuaua

SEQ ID NO: 1578629 - RNA, 19 nt, Homo sapiens
acagagaaccggaugaaua

SEQ ID NO: 1578630 - RNA, 19 nt, Homo sapiens
aacaaagccucauuaauug

SEQ ID NO: 1578631 - RNA, 19 nt, Homo sapiens
ccacucagcugcaacaaag

SEQ ID NO: 1578632 - RNA, 19 nt, Homo sapiens
ggaugaauauaagcaauga

SEQ ID NO: 1578633 - RNA, 19 nt, Homo sapiens
aacaaguacugcucauuua

SEQ ID NO: 1578634 - RNA, 19 nt, Homo sapiens
uaagcaauauguggugaua

SEQ ID NO: 1578635 - RNA, 19 nt, Homo sapiens
gcccaaugauuccucuaua

SEQ ID NO: 1578636 - RNA, 19 nt, Homo sapiens
gaucaauaguacccggaua

SEQ ID NO: 1578637 - RNA, 19 nt, Homo sapiens
ccaguuacccauuugauaa

SEQ ID NO: 1578638 - RNA, 19 nt, Homo sapiens
ggagaaaucccagaacuuc

SEQ ID NO: 1578639 - RNA, 19 nt, Homo sapiens
gaccuacaaucaaacaaga

SEQ ID NO: 1578640 - RNA, 19 nt, Homo sapiens
gagccgagauagugccauu

SEQ ID NO: 1578641 - RNA, 19 nt, Homo sapiens
ugacuugaaucgaaauuuc

SEQ ID NO: 1578642 - RNA, 19 nt, Homo sapiens
aagguggaaugcaagauua

SEQ ID NO: 1578643 - RNA, 19 nt, Homo sapiens
gcagugagccgagauagug

SEQ ID NO: 1578644 - RNA, 19 nt, Homo sapiens
gaaguagucuuaaaaugug

SEQ ID NO: 1578645 - RNA, 19 nt, Homo sapiens
gagcugucaugcuguaaau

SEQ ID NO: 1578646 - RNA, 19 nt, Homo sapiens
cuuaugaccuacaaucaaa

SEQ ID NO: 1578647 - RNA, 19 nt, Homo sapiens
gaaaucccaacaugaagaa

SEQ ID NO: 1578648 - RNA, 19 nt, Homo sapiens
caguaugacuugaaucgaa

SEQ ID NO: 1578649 - RNA, 19 nt, Homo sapiens
cauacaagacuucaccaua

SEQ ID NO: 1578650 - RNA, 19 nt, Homo sapiens
cagagaaccggaugaauau

SEQ ID NO: 1578651 - RNA, 19 nt, Homo sapiens
gaaugcaagauuacaacua

SEQ ID NO: 1578652 - RNA, 19 nt, Homo sapiens
uagcugcgcuggauuucaa

SEQ ID NO: 1578653 - RNA, 19 nt, Homo sapiens
gcuuaacgccugaugauga

SEQ ID NO: 1578654 - RNA, 19 nt, Homo sapiens
uaaccaguaugacuugaau

SEQ ID NO: 1578655 - RNA, 19 nt, Homo sapiens
gacaggacccuuucuggaa

SEQ ID NO: 1578656 - RNA, 19 nt, Homo sapiens
ccuauagaaccaacaaaua

SEQ ID NO: 1578657 - RNA, 19 nt, Homo sapiens
gcauggagaugagacuguu

SEQ ID NO: 1578658 - RNA, 19 nt, Homo sapiens
ccaaaggaacacagaauug

SEQ ID NO: 1578659 - RNA, 19 nt, Homo sapiens
gcagugcucacgccuugua

SEQ ID NO: 1578660 - RNA, 19 nt, Homo sapiens
caauauguggugauaauga

SEQ ID NO: 1578661 - RNA, 19 nt, Homo sapiens
caaaucugaucaauaguac

SEQ ID NO: 1578662 - RNA, 19 nt, Homo sapiens
gcaaagacccugaaaucac

SEQ ID NO: 1578663 - RNA, 19 nt, Homo sapiens
gaccuugacuggagaaacu

SEQ ID NO: 1578664 - RNA, 19 nt, Homo sapiens
gcaaauaugcauggagaug

SEQ ID NO: 1578665 - RNA, 19 nt, Homo sapiens
caagggcaauuggauucua

SEQ ID NO: 1578666 - RNA, 19 nt, Homo sapiens
cuaaugguguuacaaaugg

SEQ ID NO: 1578667 - RNA, 19 nt, Homo sapiens
gucacucacuuacacagua

SEQ ID NO: 1578668 - RNA, 19 nt, Homo sapiens
caaagccucauuaauugaa

SEQ ID NO: 1578669 - RNA, 19 nt, Homo sapiens
caagguggaaugcaagauu

SEQ ID NO: 1578670 - RNA, 19 nt, Homo sapiens
ucaagaaaucccaacauga

SEQ ID NO: 1578671 - RNA, 19 nt, Homo sapiens
caugaacccagauggauuu

SEQ ID NO: 1578672 - RNA, 19 nt, Homo sapiens
ccugaaaucacaaaucuga

SEQ ID NO: 1578673 - RNA, 19 nt, Homo sapiens
gaagaagagaaauggaugu

SEQ ID NO: 1578674 - RNA, 19 nt, Homo sapiens
caaacaagaacauggacuu

SEQ ID NO: 1578675 - RNA, 19 nt, Homo sapiens
gguguaaagggucaaguuu

SEQ ID NO: 1578676 - RNA, 19 nt, Homo sapiens
caaauggauacucuuggua

SEQ ID NO: 1578677 - RNA, 19 nt, Homo sapiens
caaauaugcauggagauga

SEQ ID NO: 1578678 - RNA, 19 nt, Homo sapiens
ggauuccagaguucaaaua

SEQ ID NO: 1578679 - RNA, 19 nt, Homo sapiens
gccaguuacccauuugaua

SEQ ID NO: 1578680 - RNA, 19 nt, Homo sapiens
ugaaguggcugaaaacaga

SEQ ID NO: 1578681 - RNA, 19 nt, Homo sapiens
ggugaaacccugucucuac

SEQ ID NO: 1578682 - RNA, 19 nt, Homo sapiens
aaugauuccucuauacaga

SEQ ID NO: 1578683 - RNA, 19 nt, Homo sapiens
uaccuaugcuucaagaaau

SEQ ID NO: 1578684 - RNA, 19 nt, Homo sapiens
gauaaugguguucaagcaa

SEQ ID NO: 1578685 - RNA, 19 nt, Homo sapiens
cugauugacuaucucguaa

SEQ ID NO: 1578686 - RNA, 19 nt, Homo sapiens
caaauacguggcaaauaug

SEQ ID NO: 1578687 - RNA, 19 nt, Homo sapiens
aguauuaucuccuucucuu

SEQ ID NO: 1578688 - RNA, 19 nt, Homo sapiens
gcugucaugcuguaaauau

SEQ ID NO: 1578689 - RNA, 19 nt, Homo sapiens
guuuccaaauuccacaaua

SEQ ID NO: 1578690 - RNA, 19 nt, Homo sapiens
aaaugaacuuuccuaaugg

SEQ ID NO: 1578691 - RNA, 19 nt, Homo sapiens
agaaaggagacgaguguaa

SEQ ID NO: 1578692 - RNA, 19 nt, Homo sapiens
ucaagcaacuggggcauua

SEQ ID NO: 1578693 - RNA, 19 nt, Homo sapiens
caacuaccaccgccaggaa

SEQ ID NO: 1578694 - RNA, 19 nt, Homo sapiens
ggugaauggaagacacuua

SEQ ID NO: 1578695 - RNA, 19 nt, Homo sapiens
ggaagggauggaagcguuu

SEQ ID NO: 1578696 - RNA, 19 nt, Homo sapiens
acaaauggauacucuuggu

SEQ ID NO: 1578697 - RNA, 19 nt, Homo sapiens
gaaauuuccccgaugcuuu

SEQ ID NO: 1578698 - RNA, 19 nt, Homo sapiens
ucacucacuuacacaguau

SEQ ID NO: 1578699 - RNA, 19 nt, Homo sapiens
caaauuccacaauaagcaa

SEQ ID NO: 1578700 - RNA, 19 nt, Homo sapiens
aagccuaguuuguucuuau

SEQ ID NO: 1578701 - RNA, 19 nt, Homo sapiens
ugauuccucuauacagaaa

SEQ ID NO: 1578702 - RNA, 19 nt, Homo sapiens
uucaauaucuugcacauac

SEQ ID NO: 1578703 - RNA, 19 nt, Homo sapiens
gaagcuuaacgccugauga

SEQ ID NO: 1578704 - RNA, 19 nt, Homo sapiens
uggcaaagacccugaaauc

SEQ ID NO: 1578705 - RNA, 19 nt, Homo sapiens
agcaauauguggugauaau

SEQ ID NO: 1578706 - RNA, 19 nt, Homo sapiens
gagaaacuccacgaucuuc

SEQ ID NO: 1578707 - RNA, 19 nt, Homo sapiens
cguaaccagugauggcaaa

SEQ ID NO: 1578708 - RNA, 19 nt, Homo sapiens
ccgagauagugccauugua

SEQ ID NO: 1578709 - RNA, 19 nt, Homo sapiens
ggagcugucaugcuguaaa

SEQ ID NO: 1578710 - RNA, 19 nt, Homo sapiens
acaggacccuuucuggaau

SEQ ID NO: 1578711 - RNA, 19 nt, Homo sapiens
ccagguaucuacacuguua

SEQ ID NO: 1578712 - RNA, 19 nt, Homo sapiens
gaucaagcauucuuucuau

SEQ ID NO: 1578713 - RNA, 19 nt, Homo sapiens
caacuucccugaucucaau

SEQ ID NO: 1578714 - RNA, 19 nt, Homo sapiens
gaauggugcuugaugagaa

SEQ ID NO: 1578715 - RNA, 19 nt, Homo sapiens
gggcggugguggccaauua

SEQ ID NO: 1578716 - RNA, 19 nt, Homo sapiens
ggagauuacuucccagaug

SEQ ID NO: 1578717 - RNA, 19 nt, Homo sapiens
gaacaugcacggcaacgaa

SEQ ID NO: 1578718 - RNA, 19 nt, Homo sapiens
gcaagggaaugcaagacuu

SEQ ID NO: 1578719 - RNA, 19 nt, Homo sapiens
aaacaagccuggguaucua

SEQ ID NO: 1578720 - RNA, 19 nt, Homo sapiens
gaagaggcuagguuguuua

SEQ ID NO: 1578721 - RNA, 19 nt, Homo sapiens
ucagugggauuaaccauga

SEQ ID NO: 1578722 - RNA, 19 nt, Homo sapiens
ugaagaggcuagguuguuu

SEQ ID NO: 1578723 - RNA, 19 nt, Homo sapiens
gaacugcggagauuacuuc

SEQ ID NO: 1578724 - RNA, 19 nt, Homo sapiens
gggaagcccuaauccaguu

SEQ ID NO: 1578725 - RNA, 19 nt, Homo sapiens
caaauggaguggaccugaa

SEQ ID NO: 1578726 - RNA, 19 nt, Homo sapiens
acaauaaucucgccaaugc

SEQ ID NO: 1578727 - RNA, 19 nt, Homo sapiens
aaccagaggucaaguaugu

SEQ ID NO: 1578728 - RNA, 19 nt, Homo sapiens
ggaaugcaagacuuuaauu

SEQ ID NO: 1578729 - RNA, 19 nt, Homo sapiens
ccaauuacccguaugacaa

SEQ ID NO: 1578730 - RNA, 19 nt, Homo sapiens
agaagcaucccucaaguaa

SEQ ID NO: 1578731 - RNA, 19 nt, Homo sapiens
gaggcuagguuguuuaagg

SEQ ID NO: 1578732 - RNA, 19 nt, Homo sapiens
cauaccaacugcuuugaga

SEQ ID NO: 1578733 - RNA, 19 nt, Homo sapiens
gaugcacuccuucaacuuu

SEQ ID NO: 1578734 - RNA, 19 nt, Homo sapiens
agaaagaaauggagaugag

SEQ ID NO: 1578735 - RNA, 19 nt, Homo sapiens
gaaagaaagaaauggagau

SEQ ID NO: 1578736 - RNA, 19 nt, Homo sapiens
ccacagcaccuggguauga

SEQ ID NO: 1578737 - RNA, 19 nt, Homo sapiens
ucccugaucucaauaccua

SEQ ID NO: 1578738 - RNA, 19 nt, Homo sapiens
gcacggagucagagccaaa

SEQ ID NO: 1578739 - RNA, 19 nt, Homo sapiens
ugucagaccugcucucagu

SEQ ID NO: 1578740 - RNA, 19 nt, Homo sapiens
caagggaaugcaagacuuu

SEQ ID NO: 1578741 - RNA, 19 nt, Homo sapiens
acgacaagcucuuccagaa

SEQ ID NO: 1578742 - RNA, 19 nt, Homo sapiens
ggaaccagaggucaaguau

SEQ ID NO: 1578743 - RNA, 19 nt, Homo sapiens
caauuuggacugguguuua

SEQ ID NO: 1578744 - RNA, 19 nt, Homo sapiens
gguuggaacugcggagauu

SEQ ID NO: 1578745 - RNA, 19 nt, Homo sapiens
caaacaagccuggguaucu

SEQ ID NO: 1578746 - RNA, 19 nt, Homo sapiens
ccaggcaacccuucagaaa

SEQ ID NO: 1578747 - RNA, 19 nt, Homo sapiens
aaagaagcaucccucaagu

SEQ ID NO: 1578748 - RNA, 19 nt, Homo sapiens
caggaacaaugcaaaugga

SEQ ID NO: 1578749 - RNA, 19 nt, Homo sapiens
caacguugguuaacuucca

SEQ ID NO: 1578750 - RNA, 19 nt, Homo sapiens
uaaccaugaugucacuuca

SEQ ID NO: 1578751 - RNA, 19 nt, Homo sapiens
gccaaggucuacuccuaug

SEQ ID NO: 1578752 - RNA, 19 nt, Homo sapiens
cagaacgacauaaagaauu

SEQ ID NO: 1578753 - RNA, 19 nt, Homo sapiens
gcaggaacaaugcaaaugg

SEQ ID NO: 1578754 - RNA, 19 nt, Homo sapiens
caggugaccauggugauua

SEQ ID NO: 1578755 - RNA, 19 nt, Homo sapiens
uggccaaggucuacuccua

SEQ ID NO: 1578756 - RNA, 19 nt, Homo sapiens
gcaagacuuuaauuaucuc

SEQ ID NO: 1578757 - RNA, 19 nt, Homo sapiens
ugaccauggugauuacuuc

SEQ ID NO: 1578758 - RNA, 19 nt, Homo sapiens
ggaauggugcuugaugaga

SEQ ID NO: 1578759 - RNA, 19 nt, Homo sapiens
gauuaaccaugaugucacu

SEQ ID NO: 1578760 - RNA, 19 nt, Homo sapiens
gggaguggcuggguaaucg

SEQ ID NO: 1578761 - RNA, 19 nt, Homo sapiens
ccagaacgacauaaagaau

SEQ ID NO: 1578762 - RNA, 19 nt, Homo sapiens
ggagagaugaguggcuauu

SEQ ID NO: 1578763 - RNA, 19 nt, Homo sapiens
ccaccgcuaugaugaucuu

SEQ ID NO: 1578764 - RNA, 19 nt, Homo sapiens
ccagaaagaaagaaaugga

SEQ ID NO: 1578765 - RNA, 19 nt, Homo sapiens
gcuauuccagaacgacaua

SEQ ID NO: 1578766 - RNA, 19 nt, Homo sapiens
ggaccugaaccgcaacuuc

SEQ ID NO: 1578767 - RNA, 19 nt, Homo sapiens
aagcaucccucaaguaagc

SEQ ID NO: 1578768 - RNA, 19 nt, Homo sapiens
gugaagaggcuagguuguu

SEQ ID NO: 1578769 - RNA, 19 nt, Homo sapiens
gaaccagaggucaaguaug

SEQ ID NO: 1578770 - RNA, 19 nt, Homo sapiens
gggaaugcaagacuuuaau

SEQ ID NO: 1578771 - RNA, 19 nt, Homo sapiens
aagaagcaucccucaagua

SEQ ID NO: 1578772 - RNA, 19 nt, Homo sapiens
gggauuaaccaugauguca

SEQ ID NO: 1578773 - RNA, 19 nt, Homo sapiens
uuacaauaaucucgccaau

SEQ ID NO: 1578774 - RNA, 19 nt, Homo sapiens
gagaucacgcuggaacuga

SEQ ID NO: 1578775 - RNA, 19 nt, Homo sapiens
cuucaacuuuguucuuuca

SEQ ID NO: 1578776 - RNA, 19 nt, Homo sapiens
ggacagcugggaacgucuu

SEQ ID NO: 1578777 - RNA, 19 nt, Homo sapiens
gguaugacccagagacagu

SEQ ID NO: 1578778 - RNA, 19 nt, Homo sapiens
caagccagaaagaaagaaa

SEQ ID NO: 1578779 - RNA, 19 nt, Homo sapiens
cagaaggcacggagucaga

SEQ ID NO: 1578780 - RNA, 19 nt, Homo sapiens
agggaauggugcuugauga

SEQ ID NO: 1578781 - RNA, 19 nt, Homo sapiens
caauggggcuuccugguau

SEQ ID NO: 1578782 - RNA, 19 nt, Homo sapiens
cguaugacaaguccuuuga

SEQ ID NO: 1578783 - RNA, 19 nt, Homo sapiens
gaaccgcaacuucccugau

SEQ ID NO: 1578784 - RNA, 19 nt, Homo sapiens
agaucaagcauucuuucua

SEQ ID NO: 1578785 - RNA, 19 nt, Homo sapiens
aggcuagguuguuuaagga

SEQ ID NO: 1578786 - RNA, 19 nt, Homo sapiens
cuacuccuaugcacaugga

SEQ ID NO: 1578787 - RNA, 19 nt, Homo sapiens
gguggccaauuacccguau

SEQ ID NO: 1578788 - RNA, 19 nt, Homo sapiens
cuaguuggcaggaacaaug

SEQ ID NO: 1578789 - RNA, 19 nt, Homo sapiens
aagccuggguaucuaguug

SEQ ID NO: 1578790 - RNA, 19 nt, Homo sapiens
augaguggcuauuccagaa

SEQ ID NO: 1578791 - RNA, 19 nt, Homo sapiens
ggucuacuccuaugcacau

SEQ ID NO: 1578792 - RNA, 19 nt, Homo sapiens
uaucuacuauaacgagaag

SEQ ID NO: 1578793 - RNA, 19 nt, Homo sapiens
gcaacuucccugaucucaa

SEQ ID NO: 1578794 - RNA, 19 nt, Homo sapiens
ccgcuaugaugaucuugug

SEQ ID NO: 1578795 - RNA, 19 nt, Homo sapiens
aaagaaagaaauggagaug

SEQ ID NO: 1578796 - RNA, 19 nt, Homo sapiens
gaucucaauaccuauaucu

SEQ ID NO: 1578797 - RNA, 19 nt, Homo sapiens
ccugaucucaauaccuaua

SEQ ID NO: 1578798 - RNA, 19 nt, Homo sapiens
ggacacgcgcauucacauc

SEQ ID NO: 1578799 - RNA, 19 nt, Homo sapiens
acgcgggucuacagcauug

SEQ ID NO: 1578800 - RNA, 19 nt, Homo sapiens
gaacgacauaaagaauuuc

SEQ ID NO: 1578801 - RNA, 19 nt, Homo sapiens
ggccaaggucuacuccuau

SEQ ID NO: 1578802 - RNA, 19 nt, Homo sapiens
gguuaacuuccaccucaaa

SEQ ID NO: 1578803 - RNA, 19 nt, Homo sapiens
aagaggcuagguuguuuaa

SEQ ID NO: 1578804 - RNA, 19 nt, Homo sapiens
gaugucagaccugcucuca

SEQ ID NO: 1578805 - RNA, 19 nt, Homo sapiens
gcacuccuucaacuuuguu

SEQ ID NO: 1578806 - RNA, 19 nt, Homo sapiens
ucacgcgggucuacagcau

SEQ ID NO: 1578807 - RNA, 19 nt, Homo sapiens
gaagcaucccucaaguaag

SEQ ID NO: 1578808 - RNA, 19 nt, Homo sapiens
gguaaucgggaagcccuaa

SEQ ID NO: 1578809 - RNA, 19 nt, Homo sapiens
ggaugcacuccuucaacuu

SEQ ID NO: 1578810 - RNA, 19 nt, Homo sapiens
aaccgcaacuucccugauc

SEQ ID NO: 1578811 - RNA, 19 nt, Homo sapiens
caagagaucugcuaauaaa

SEQ ID NO: 1578812 - RNA, 19 nt, Homo sapiens
ggaaaucucucaucuuguu

SEQ ID NO: 1578813 - RNA, 19 nt, Homo sapiens
gaaaguaucuugaugucuu

SEQ ID NO: 1578814 - RNA, 19 nt, Homo sapiens
gaaugcaacuugaagguaa

SEQ ID NO: 1578815 - RNA, 19 nt, Homo sapiens
caacaggauucuuaaugua

SEQ ID NO: 1578816 - RNA, 19 nt, Homo sapiens
gacuaaagaugguaaauug

SEQ ID NO: 1578817 - RNA, 19 nt, Homo sapiens
gaaaaguucugaagacuaa

SEQ ID NO: 1578818 - RNA, 19 nt, Homo sapiens
caggaaaucucucaucuug

SEQ ID NO: 1578819 - RNA, 19 nt, Homo sapiens
uacaagagaucugcuaaua

SEQ ID NO: 1578820 - RNA, 19 nt, Homo sapiens
gaagagcaucucauacaua

SEQ ID NO: 1578821 - RNA, 19 nt, Homo sapiens
gggcggagauguugccuaa

SEQ ID NO: 1578822 - RNA, 19 nt, Homo sapiens
gacauugaguuuccaagua

SEQ ID NO: 1578823 - RNA, 19 nt, Homo sapiens
cuagggaugucaugaauuu

SEQ ID NO: 1578824 - RNA, 19 nt, Homo sapiens
guggaaccauuguuuguua

SEQ ID NO: 1578825 - RNA, 19 nt, Homo sapiens
gggcauuggugguaucuuu

SEQ ID NO: 1578826 - RNA, 19 nt, Homo sapiens
gaaguugagacuaagaaua

SEQ ID NO: 1578827 - RNA, 19 nt, Homo sapiens
gcggagauguugccuaaga

SEQ ID NO: 1578828 - RNA, 19 nt, Homo sapiens
gacgguauguagaauuuaa

SEQ ID NO: 1578829 - RNA, 19 nt, Homo sapiens
gggcuguaguuccuucuua

SEQ ID NO: 1578830 - RNA, 19 nt, Homo sapiens
uaaggaagagcaucucaua

SEQ ID NO: 1578831 - RNA, 19 nt, Homo sapiens
ggagguguuucgcuuugua

SEQ ID NO: 1578832 - RNA, 19 nt, Homo sapiens
gagcaucucauacauauca

SEQ ID NO: 1578833 - RNA, 19 nt, Homo sapiens
ggaagagcaucucauacau

SEQ ID NO: 1578834 - RNA, 19 nt, Homo sapiens
gauccagaauugaaaguau

SEQ ID NO: 1578835 - RNA, 19 nt, Homo sapiens
ugaagucucugcuguaauc

SEQ ID NO: 1578836 - RNA, 19 nt, Homo sapiens
caaaugagaagcagaggaa

SEQ ID NO: 1578837 - RNA, 19 nt, Homo sapiens
aagcuuauaucccugaauu

SEQ ID NO: 1578838 - RNA, 19 nt, Homo sapiens
gaggagguguuucgcuuug

SEQ ID NO: 1578839 - RNA, 19 nt, Homo sapiens
gaagaggacgguauguaga

SEQ ID NO: 1578840 - RNA, 19 nt, Homo sapiens
aagagcaucucauacauau

SEQ ID NO: 1578841 - RNA, 19 nt, Homo sapiens
cugcagcucuuugcucuua

SEQ ID NO: 1578842 - RNA, 19 nt, Homo sapiens
uuauaucccugaauucuga

SEQ ID NO: 1578843 - RNA, 19 nt, Homo sapiens
gagcauuucuguuguucau

SEQ ID NO: 1578844 - RNA, 19 nt, Homo sapiens
gagcaaaucacaacaggau

SEQ ID NO: 1578845 - RNA, 19 nt, Homo sapiens
acaacaggauucuuaaugu

SEQ ID NO: 1578846 - RNA, 19 nt, Homo sapiens
ccagagaacauaauauugu

SEQ ID NO: 1578847 - RNA, 19 nt, Homo sapiens
ugagaaacuuggaggcauu

SEQ ID NO: 1578848 - RNA, 19 nt, Homo sapiens
ccugaauucugauacuuaa

SEQ ID NO: 1578849 - RNA, 19 nt, Homo sapiens
agagaugucuaaguuguaa

SEQ ID NO: 1578850 - RNA, 19 nt, Homo sapiens
ugucagagucaauugauua

SEQ ID NO: 1578851 - RNA, 19 nt, Homo sapiens
gauggcagauugucagagu

SEQ ID NO: 1578852 - RNA, 19 nt, Homo sapiens
guguggaaguugagacuaa

SEQ ID NO: 1578853 - RNA, 19 nt, Homo sapiens
caucagcuguguacuucaa

SEQ ID NO: 1578854 - RNA, 19 nt, Homo sapiens
guaguuccuucuuacauuc

SEQ ID NO: 1578855 - RNA, 19 nt, Homo sapiens
gcuguaauccuuauauauc

SEQ ID NO: 1578856 - RNA, 19 nt, Homo sapiens
auacacacguuucuuagga

SEQ ID NO: 1578857 - RNA, 19 nt, Homo sapiens
gaauuuaggcaauguuucu

SEQ ID NO: 1578858 - RNA, 19 nt, Homo sapiens
gaaagcuuauaucccugaa

SEQ ID NO: 1578859 - RNA, 19 nt, Homo sapiens
acauugaguuuccaaguau

SEQ ID NO: 1578860 - RNA, 19 nt, Homo sapiens
ccucagagaauuccaaaga

SEQ ID NO: 1578861 - RNA, 19 nt, Homo sapiens
ggcaucagcuguguacuuc

SEQ ID NO: 1578862 - RNA, 19 nt, Homo sapiens
gaaguucuacgccauccaa

SEQ ID NO: 1578863 - RNA, 19 nt, Homo sapiens
ucagagaauuccaaagaag

SEQ ID NO: 1578864 - RNA, 19 nt, Homo sapiens
ggugagcauuucuguuguu

SEQ ID NO: 1578865 - RNA, 19 nt, Homo sapiens
gaauucuucaacugucuua

SEQ ID NO: 1578866 - RNA, 19 nt, Homo sapiens
gaauuuaaucugcuguaug

SEQ ID NO: 1578867 - RNA, 19 nt, Homo sapiens
caacuacagauacuuugaa

SEQ ID NO: 1578868 - RNA, 19 nt, Homo sapiens
acaagagaucugcuaauaa

SEQ ID NO: 1578869 - RNA, 19 nt, Homo sapiens
cagagucaauugauuaaac

SEQ ID NO: 1578870 - RNA, 19 nt, Homo sapiens
gugugaugauuacuucuuu

SEQ ID NO: 1578871 - RNA, 19 nt, Homo sapiens
guauuuagaagcacuugaa

SEQ ID NO: 1578872 - RNA, 19 nt, Homo sapiens
ggacauugaguuuccaagu

SEQ ID NO: 1578873 - RNA, 19 nt, Homo sapiens
caaaauaggacauugaguu

SEQ ID NO: 1578874 - RNA, 19 nt, Homo sapiens
agauggagcugcugauucu

SEQ ID NO: 1578875 - RNA, 19 nt, Homo sapiens
uguaaacucuaaagugaca

SEQ ID NO: 1578876 - RNA, 19 nt, Homo sapiens
cagagaacauaauauuguc

SEQ ID NO: 1578877 - RNA, 19 nt, Homo sapiens
guugagacuucauaguaau

SEQ ID NO: 1578878 - RNA, 19 nt, Homo sapiens
aguugagacuucauaguaa

SEQ ID NO: 1578879 - RNA, 19 nt, Homo sapiens
gaaaucucucaucuuguuu

SEQ ID NO: 1578880 - RNA, 19 nt, Homo sapiens
cuugaugucuuuaccucua

SEQ ID NO: 1578881 - RNA, 19 nt, Homo sapiens
cagaagaggacgguaugua

SEQ ID NO: 1578882 - RNA, 19 nt, Homo sapiens
gcuggaaaauguaugaauu

SEQ ID NO: 1578883 - RNA, 19 nt, Homo sapiens
gggauucucugcacuuuug

SEQ ID NO: 1578884 - RNA, 19 nt, Homo sapiens
cugcuguaauccuuauaua

SEQ ID NO: 1578885 - RNA, 19 nt, Homo sapiens
aggacgguauguagaauuu

SEQ ID NO: 1578886 - RNA, 19 nt, Homo sapiens
ggaggagguguuucgcuuu

SEQ ID NO: 1578887 - RNA, 19 nt, Homo sapiens
ugaccucacuccaacauac

SEQ ID NO: 1578888 - RNA, 19 nt, Homo sapiens
cugcauguguuacaauuca

SEQ ID NO: 1578889 - RNA, 19 nt, Homo sapiens
acugaagucucugcuguaa

SEQ ID NO: 1578890 - RNA, 19 nt, Homo sapiens
aaucugucguggaauauau

SEQ ID NO: 1578891 - RNA, 19 nt, Homo sapiens
aagcugaaauucuggaagu

SEQ ID NO: 1578892 - RNA, 19 nt, Homo sapiens
caagauggagcugcugauu

SEQ ID NO: 1578893 - RNA, 19 nt, Homo sapiens
caggauucuuaauguauga

SEQ ID NO: 1578894 - RNA, 19 nt, Homo sapiens
agaggaagcugcaaaacaa

SEQ ID NO: 1578895 - RNA, 19 nt, Homo sapiens
ugucaugaauuuaggcaau

SEQ ID NO: 1578896 - RNA, 19 nt, Homo sapiens
ggacgguauguagaauuua

SEQ ID NO: 1578897 - RNA, 19 nt, Homo sapiens
gaagacuaaagaugguaaa

SEQ ID NO: 1578898 - RNA, 19 nt, Homo sapiens
cacaacaggauucuuaaug

SEQ ID NO: 1578899 - RNA, 19 nt, Homo sapiens
gaauucugauacuuaagag

SEQ ID NO: 1578900 - RNA, 19 nt, Homo sapiens
acuccaggauccagaauug

SEQ ID NO: 1578901 - RNA, 19 nt, Homo sapiens
gcucagaagaggacgguau

SEQ ID NO: 1578902 - RNA, 19 nt, Homo sapiens
acaggauucuuaauguaug

SEQ ID NO: 1578903 - RNA, 19 nt, Homo sapiens
gagacuaagaauaauccua

SEQ ID NO: 1578904 - RNA, 19 nt, Homo sapiens
uggaaccauuguuuguuaa

SEQ ID NO: 1578905 - RNA, 19 nt, Homo sapiens
gugauucuguguggccuuu

SEQ ID NO: 1578906 - RNA, 19 nt, Homo sapiens
gagaaacuuggaggcauuu

SEQ ID NO: 1578907 - RNA, 19 nt, Homo sapiens
gaugggaguacaugcauuc

SEQ ID NO: 1578908 - RNA, 19 nt, Homo sapiens
aaagcacugugaugacuca

SEQ ID NO: 1578909 - RNA, 19 nt, Homo sapiens
cuacuauccauuucaacua

SEQ ID NO: 1578910 - RNA, 19 nt, Homo sapiens
gaaugugaaagcuuauauc

SEQ ID NO: 1578911 - RNA, 19 nt, Homo sapiens
gaacuaagaugaaagguua

SEQ ID NO: 1578912 - RNA, 19 nt, Homo sapiens
caaaggaaaugaugucuug

SEQ ID NO: 1578913 - RNA, 19 nt, Homo sapiens
gaacccagcucuugcagaa

SEQ ID NO: 1578914 - RNA, 19 nt, Homo sapiens
ugaaagggcucaacaguga

SEQ ID NO: 1578915 - RNA, 19 nt, Homo sapiens
gcauugaccuagugauuaa

SEQ ID NO: 1578916 - RNA, 19 nt, Homo sapiens
gaaucaagguuucagguuu

SEQ ID NO: 1578917 - RNA, 19 nt, Homo sapiens
uaaaggaacugauucacaa

SEQ ID NO: 1578918 - RNA, 19 nt, Homo sapiens
caaggaauauggugugaaa

SEQ ID NO: 1578919 - RNA, 19 nt, Homo sapiens
gagagaauguugaugagaa

SEQ ID NO: 1578920 - RNA, 19 nt, Homo sapiens
caagggagcugagguuaaa

SEQ ID NO: 1578921 - RNA, 19 nt, Homo sapiens
gaggugugcucaaggaaua

SEQ ID NO: 1578922 - RNA, 19 nt, Homo sapiens
agaaacaucuuccaacauu

SEQ ID NO: 1578923 - RNA, 19 nt, Homo sapiens
ucaccaagauggaguauga

SEQ ID NO: 1578924 - RNA, 19 nt, Homo sapiens
gaaugaagcacuggaauuu

SEQ ID NO: 1578925 - RNA, 19 nt, Homo sapiens
gaagauggaacuaagauga

SEQ ID NO: 1578926 - RNA, 19 nt, Homo sapiens
gauuagagauggcagcauu

SEQ ID NO: 1578927 - RNA, 19 nt, Homo sapiens
ucacauacauugacaagug

SEQ ID NO: 1578928 - RNA, 19 nt, Homo sapiens
ccaaggaugucaaagugua

SEQ ID NO: 1578929 - RNA, 19 nt, Homo sapiens
ggaacugauucacaacuuu

SEQ ID NO: 1578930 - RNA, 19 nt, Homo sapiens
acacaagaaugcugacuaa

SEQ ID NO: 1578931 - RNA, 19 nt, Homo sapiens
gaggacagcuguugauagu

SEQ ID NO: 1578932 - RNA, 19 nt, Homo sapiens
gcugggaucuugaccguuu

SEQ ID NO: 1578933 - RNA, 19 nt, Homo sapiens
gguagacaguguuuaugua

SEQ ID NO: 1578934 - RNA, 19 nt, Homo sapiens
gauggauucuguugaacua

SEQ ID NO: 1578935 - RNA, 19 nt, Homo sapiens
gcagaauacccaucaguaa

SEQ ID NO: 1578936 - RNA, 19 nt, Homo sapiens
gaacugggacuuagcaaau

SEQ ID NO: 1578937 - RNA, 19 nt, Homo sapiens
caaacuaucucuauguuac

SEQ ID NO: 1578938 - RNA, 19 nt, Homo sapiens
ccaaugaggugggcuuaaa

SEQ ID NO: 1578939 - RNA, 19 nt, Homo sapiens
gaaucccucuccucacuaa

SEQ ID NO: 1578940 - RNA, 19 nt, Homo sapiens
ugguguggcugaacaauua

SEQ ID NO: 1578941 - RNA, 19 nt, Homo sapiens
gcuguagacugugggauua

SEQ ID NO: 1578942 - RNA, 19 nt, Homo sapiens
gcacagacagcacacauug

SEQ ID NO: 1578943 - RNA, 19 nt, Homo sapiens
gggcagccuuuguuacuuu

SEQ ID NO: 1578944 - RNA, 19 nt, Homo sapiens
uaacuuggcccgagugaaa

SEQ ID NO: 1578945 - RNA, 19 nt, Homo sapiens
gcucugcucuggccucaaa

SEQ ID NO: 1578946 - RNA, 19 nt, Homo sapiens
guaauccgccugcuaguaa

SEQ ID NO: 1578947 - RNA, 19 nt, Homo sapiens
gaagaggcgacuagaguuu

SEQ ID NO: 1578948 - RNA, 19 nt, Homo sapiens
cagauaagcagauuucaaa

SEQ ID NO: 1578949 - RNA, 19 nt, Homo sapiens
gucccacacugcacuauua

SEQ ID NO: 1578950 - RNA, 19 nt, Homo sapiens
gacgauggauucuguugaa

SEQ ID NO: 1578951 - RNA, 19 nt, Homo sapiens
ccagaaaggcauccugaua

SEQ ID NO: 1578952 - RNA, 19 nt, Homo sapiens
guaacaaacuaucucuaug

SEQ ID NO: 1578953 - RNA, 19 nt, Homo sapiens
gagcugagguuaaagaaaa

SEQ ID NO: 1578954 - RNA, 19 nt, Homo sapiens
aauuaaggcucccauguuu

SEQ ID NO: 1578955 - RNA, 19 nt, Homo sapiens
gagaagcucacauacauug

SEQ ID NO: 1578956 - RNA, 19 nt, Homo sapiens
acacuaaauuuguccauga

SEQ ID NO: 1578957 - RNA, 19 nt, Homo sapiens
gaaacaucuuccaacauug

SEQ ID NO: 1578958 - RNA, 19 nt, Homo sapiens
gaguguaacuugagagcuu

SEQ ID NO: 1578959 - RNA, 19 nt, Homo sapiens
gcagcaguguggaauuuga

SEQ ID NO: 1578960 - RNA, 19 nt, Homo sapiens
aagaauggccaucuaauuu

SEQ ID NO: 1578961 - RNA, 19 nt, Homo sapiens
gaaggcagcagacaccauu

SEQ ID NO: 1578962 - RNA, 19 nt, Homo sapiens
caaacaggcuuucauuacu

SEQ ID NO: 1578963 - RNA, 19 nt, Homo sapiens
caaccugagccacauguua

SEQ ID NO: 1578964 - RNA, 19 nt, Homo sapiens
gcugaacaauuacacaaug

SEQ ID NO: 1578965 - RNA, 19 nt, Homo sapiens
gaggaucgcuccaucuucu

SEQ ID NO: 1578966 - RNA, 19 nt, Homo sapiens
guacuucaaucaauguugu

SEQ ID NO: 1578967 - RNA, 19 nt, Homo sapiens
gcaaggagccauuguuugg

SEQ ID NO: 1578968 - RNA, 19 nt, Homo sapiens
cagaaugucagaaagauuu

SEQ ID NO: 1578969 - RNA, 19 nt, Homo sapiens
ggcaauggcuacaggaaga

SEQ ID NO: 1578970 - RNA, 19 nt, Homo sapiens
ugauuaaccuucccaacaa

SEQ ID NO: 1578971 - RNA, 19 nt, Homo sapiens
agaauggccaucuaauuua

SEQ ID NO: 1578972 - RNA, 19 nt, Homo sapiens
gauacugucuacuuucuuc

SEQ ID NO: 1578973 - RNA, 19 nt, Homo sapiens
gaauuugauugcugagguu

SEQ ID NO: 1578974 - RNA, 19 nt, Homo sapiens
ggacagauucucacaaugg

SEQ ID NO: 1578975 - RNA, 19 nt, Homo sapiens
caagugcucuaauugugaa

SEQ ID NO: 1578976 - RNA, 19 nt, Homo sapiens
gacagaggcauuuagagua

SEQ ID NO: 1578977 - RNA, 19 nt, Homo sapiens
uuacaguccuuccuaaguu

SEQ ID NO: 1578978 - RNA, 19 nt, Homo sapiens
ugagaaacaucuuccaaca

SEQ ID NO: 1578979 - RNA, 19 nt, Homo sapiens
caagaauggugucaagauc

SEQ ID NO: 1578980 - RNA, 19 nt, Homo sapiens
gaaccuagccuggauuaca

SEQ ID NO: 1578981 - RNA, 19 nt, Homo sapiens
caacagagagacuuugaug

SEQ ID NO: 1578982 - RNA, 19 nt, Homo sapiens
gcaucaggcuccuuucugu

SEQ ID NO: 1578983 - RNA, 19 nt, Homo sapiens
aaacaaacaggcuuucauu

SEQ ID NO: 1578984 - RNA, 19 nt, Homo sapiens
gcacuggaauuugcaaagu

SEQ ID NO: 1578985 - RNA, 19 nt, Homo sapiens
caagagaggugugcucaag

SEQ ID NO: 1578986 - RNA, 19 nt, Homo sapiens
gcagaaccacuaauucaga

SEQ ID NO: 1578987 - RNA, 19 nt, Homo sapiens
gauggaguaugaugggauu

SEQ ID NO: 1578988 - RNA, 19 nt, Homo sapiens
gaacaaagaauggccaucu

SEQ ID NO: 1578989 - RNA, 19 nt, Homo sapiens
uaggagaggucauggcuau

SEQ ID NO: 1578990 - RNA, 19 nt, Homo sapiens
uuucagauguugagacgua

SEQ ID NO: 1578991 - RNA, 19 nt, Homo sapiens
gaugauccguuccgccuau

SEQ ID NO: 1578992 - RNA, 19 nt, Homo sapiens
guaccuguuugauuccuuu

SEQ ID NO: 1578993 - RNA, 19 nt, Homo sapiens
gcuaggcugugguccauau

SEQ ID NO: 1578994 - RNA, 19 nt, Homo sapiens
ugucaacgaucaaacaaau

SEQ ID NO: 1578995 - RNA, 19 nt, Homo sapiens
ggauaaggguaccaugcuu

SEQ ID NO: 1578996 - RNA, 19 nt, Homo sapiens
caagaaugcugacuaaaau

SEQ ID NO: 1578997 - RNA, 19 nt, Homo sapiens
aaagguuccugcaauuuau

SEQ ID NO: 1578998 - RNA, 19 nt, Homo sapiens
caccauuccuucuacauau

SEQ ID NO: 1578999 - RNA, 19 nt, Homo sapiens
ccacacugcacuauuaauu

SEQ ID NO: 1579000 - RNA, 19 nt, Homo sapiens
acagaggcauuuagaguau

SEQ ID NO: 1579001 - RNA, 19 nt, Homo sapiens
ggccauccauccucuguug

SEQ ID NO: 1579002 - RNA, 19 nt, Homo sapiens
gcaaugcuuuccacaggau

SEQ ID NO: 1579003 - RNA, 19 nt, Homo sapiens
guugaggccuuccuauguu

SEQ ID NO: 1579004 - RNA, 19 nt, Homo sapiens
gaggccagauuccaaacaa

SEQ ID NO: 1579005 - RNA, 19 nt, Homo sapiens
gagacguacuucaaucaau

SEQ ID NO: 1579006 - RNA, 19 nt, Homo sapiens
cagaaccacuaauucagaa

SEQ ID NO: 1579007 - RNA, 19 nt, Homo sapiens
gaugguagacaguguuuau

SEQ ID NO: 1579008 - RNA, 19 nt, Homo sapiens
ugagccacauguuaucuaa

SEQ ID NO: 1579009 - RNA, 19 nt, Homo sapiens
gcaauuaaggcucccaugu

SEQ ID NO: 1579010 - RNA, 19 nt, Homo sapiens
gaauacccaucaguaacaa

SEQ ID NO: 1579011 - RNA, 19 nt, Homo sapiens
gagagaaccucaucaauuu

SEQ ID NO: 1579012 - RNA, 19 nt, Homo sapiens
guaaaggaaucaucaagaa

SEQ ID NO: 1579013 - RNA, 19 nt, Homo sapiens
ggagagaaccucaucaauu

SEQ ID NO: 1579014 - RNA, 19 nt, Homo sapiens
gaagaaggauacagaagug

SEQ ID NO: 1579015 - RNA, 19 nt, Homo sapiens
ugacugacaucaucacuuu

SEQ ID NO: 1579016 - RNA, 19 nt, Homo sapiens
gaacagaggcugaaguugu

SEQ ID NO: 1579017 - RNA, 19 nt, Homo sapiens
gagcggauguuuaauacuu

SEQ ID NO: 1579018 - RNA, 19 nt, Homo sapiens
gcaagcacaucgucgugua

SEQ ID NO: 1579019 - RNA, 19 nt, Homo sapiens
ccauggaucugcuguauau

SEQ ID NO: 1579020 - RNA, 19 nt, Homo sapiens
ugaaagugcugcucuccua

SEQ ID NO: 1579021 - RNA, 19 nt, Homo sapiens
ccgcaaaucuucuggcaaa

SEQ ID NO: 1579022 - RNA, 19 nt, Homo sapiens
ccacauuucuuccaaguuc

SEQ ID NO: 1579023 - RNA, 19 nt, Homo sapiens
ccaugaagcucuuagacaa

SEQ ID NO: 1579024 - RNA, 19 nt, Homo sapiens
gacguuagaugaaacugaa

SEQ ID NO: 1579025 - RNA, 19 nt, Homo sapiens
cgacaucaauccgaacauu

SEQ ID NO: 1579026 - RNA, 19 nt, Homo sapiens
ucaccaagcuguggccuuu

SEQ ID NO: 1579027 - RNA, 19 nt, Homo sapiens
ccucaucaauuuccacauu

SEQ ID NO: 1579028 - RNA, 19 nt, Homo sapiens
gaacacuccugggcagaug

SEQ ID NO: 1579029 - RNA, 19 nt, Homo sapiens
gaggaaaucaaaccaauuc

SEQ ID NO: 1579030 - RNA, 19 nt, Homo sapiens
gggaggaaaucaaaccaau

SEQ ID NO: 1579031 - RNA, 19 nt, Homo sapiens
acagugguauuugaaguua

SEQ ID NO: 1579032 - RNA, 19 nt, Homo sapiens
agaugaaacugaagaagga

SEQ ID NO: 1579033 - RNA, 19 nt, Homo sapiens
ugaaagaagcaaugacuga

SEQ ID NO: 1579034 - RNA, 19 nt, Homo sapiens
caucaucacuggcguguac

SEQ ID NO: 1579035 - RNA, 19 nt, Homo sapiens
cgucaccucuucugccuuu

SEQ ID NO: 1579036 - RNA, 19 nt, Homo sapiens
ugacaagucguucacguuu

SEQ ID NO: 1579037 - RNA, 19 nt, Homo sapiens
ggacagcuacgccaaaucu

SEQ ID NO: 1579038 - RNA, 19 nt, Homo sapiens
cagaggauccuggacaaua

SEQ ID NO: 1579039 - RNA, 19 nt, Homo sapiens
ggugaggccucuuaugaag

SEQ ID NO: 1579040 - RNA, 19 nt, Homo sapiens
ggaaggcaccugaaagaag

SEQ ID NO: 1579041 - RNA, 19 nt, Homo sapiens
caaaucuucuggcaaacga

SEQ ID NO: 1579042 - RNA, 19 nt, Homo sapiens
ccuggugggcuacaaauua

SEQ ID NO: 1579043 - RNA, 19 nt, Homo sapiens
gacggauucucaucgcuuu

SEQ ID NO: 1579044 - RNA, 19 nt, Homo sapiens
gccuuuacguggugucuaa

SEQ ID NO: 1579045 - RNA, 19 nt, Homo sapiens
gguaaaggaaucaucaaga

SEQ ID NO: 1579046 - RNA, 19 nt, Homo sapiens
caagauuacagugguauuu

SEQ ID NO: 1579047 - RNA, 19 nt, Homo sapiens
ggauggguauggucaagau

SEQ ID NO: 1579048 - RNA, 19 nt, Homo sapiens
gggagcggauguuuaauac

SEQ ID NO: 1579049 - RNA, 19 nt, Homo sapiens
caacuauuaugccauggau

SEQ ID NO: 1579050 - RNA, 19 nt, Homo sapiens
gacaagucguucacguuug

SEQ ID NO: 1579051 - RNA, 19 nt, Homo sapiens
aauaagcagucucuugaug

SEQ ID NO: 1579052 - RNA, 19 nt, Homo sapiens
ggaggaaaucaaaccaauu

SEQ ID NO: 1579053 - RNA, 19 nt, Homo sapiens
ggaccgggaggaaaucaaa

SEQ ID NO: 1579054 - RNA, 19 nt, Homo sapiens
gaucgaucgucaccucuuc

SEQ ID NO: 1579055 - RNA, 19 nt, Homo sapiens
ccuuggagauuaucaacaa

SEQ ID NO: 1579056 - RNA, 19 nt, Homo sapiens
acaaggacaugggcaaguu

SEQ ID NO: 1579057 - RNA, 19 nt, Homo sapiens
gaacaccgcaaaucuucug

SEQ ID NO: 1579058 - RNA, 19 nt, Homo sapiens
auagagaccucccugaaca

SEQ ID NO: 1579059 - RNA, 19 nt, Homo sapiens
gcuguggccuuucaguuca

SEQ ID NO: 1579060 - RNA, 19 nt, Homo sapiens
uguuugacuuggagaauaa

SEQ ID NO: 1579061 - RNA, 19 nt, Homo sapiens
gggaguacgucauguccau

SEQ ID NO: 1579062 - RNA, 19 nt, Homo sapiens
ugaggccucuuaugaagga

SEQ ID NO: 1579063 - RNA, 19 nt, Homo sapiens
gcuauggugugucguacau

SEQ ID NO: 1579064 - RNA, 19 nt, Homo sapiens
agaagcaucagcauaugua

SEQ ID NO: 1579065 - RNA, 19 nt, Homo sapiens
gugaacagguaucuacagu

SEQ ID NO: 1579066 - RNA, 19 nt, Homo sapiens
ugacaucaucacuuuguuu

SEQ ID NO: 1579067 - RNA, 19 nt, Homo sapiens
gaugacggcuauggugugu

SEQ ID NO: 1579068 - RNA, 19 nt, Homo sapiens
agauuacagugguauuuga

SEQ ID NO: 1579069 - RNA, 19 nt, Homo sapiens
caucaucacuuuguuuggu

SEQ ID NO: 1579070 - RNA, 19 nt, Homo sapiens
gacaucaucacuuuguuug

SEQ ID NO: 1579071 - RNA, 19 nt, Homo sapiens
gaagugaagacccggauac

SEQ ID NO: 1579072 - RNA, 19 nt, Homo sapiens
ggaaugucaagagguuaua

SEQ ID NO: 1579073 - RNA, 19 nt, Homo sapiens
auacgucaauggacagcua

SEQ ID NO: 1579074 - RNA, 19 nt, Homo sapiens
caagaucgaccccucguua

SEQ ID NO: 1579075 - RNA, 19 nt, Homo sapiens
ucucaguucuaauuccaaa

SEQ ID NO: 1579076 - RNA, 19 nt, Homo sapiens
ugggagcggauguuuaaua

SEQ ID NO: 1579077 - RNA, 19 nt, Homo sapiens
uccaugccauccugcuuua

SEQ ID NO: 1579078 - RNA, 19 nt, Homo sapiens
gagaagcaucagcauaugu

SEQ ID NO: 1579079 - RNA, 19 nt, Homo sapiens
ugagaagcaucagcauaug

SEQ ID NO: 1579080 - RNA, 19 nt, Homo sapiens
gugaacagcaacuauuaug

SEQ ID NO: 1579081 - RNA, 19 nt, Homo sapiens
caaguuggcgucugagaag

SEQ ID NO: 1579082 - RNA, 19 nt, Homo sapiens
ggaaucaucaagaaauguc

SEQ ID NO: 1579083 - RNA, 19 nt, Homo sapiens
aaggaaucaucaagaaaug

SEQ ID NO: 1579084 - RNA, 19 nt, Homo sapiens
ucacguuuguugucuucaa

SEQ ID NO: 1579085 - RNA, 19 nt, Homo sapiens
ugaagaaggauacagaagu

SEQ ID NO: 1579086 - RNA, 19 nt, Homo sapiens
ggugggaggaguacaucua

SEQ ID NO: 1579087 - RNA, 19 nt, Homo sapiens
gaaacggccaacugcaugu

SEQ ID NO: 1579088 - RNA, 19 nt, Homo sapiens
gaaggauacagaagugaag

SEQ ID NO: 1579089 - RNA, 19 nt, Homo sapiens
uguauauccuuccaacuca

SEQ ID NO: 1579090 - RNA, 19 nt, Homo sapiens
ggucucaguucuaauucca

SEQ ID NO: 1579091 - RNA, 19 nt, Homo sapiens
uggcaaacgacguggauuu

SEQ ID NO: 1579092 - RNA, 19 nt, Homo sapiens
guucacguuuguugucuuc

SEQ ID NO: 1579093 - RNA, 19 nt, Homo sapiens
cagcuacgccaaaucucua

SEQ ID NO: 1579094 - RNA, 19 nt, Homo sapiens
ggugucgucaggccuauuu

SEQ ID NO: 1579095 - RNA, 19 nt, Homo sapiens
ucggugaggccucuuauga

SEQ ID NO: 1579096 - RNA, 19 nt, Homo sapiens
gcaccugaaagaagcaaug

SEQ ID NO: 1579097 - RNA, 19 nt, Homo sapiens
caaggacaugggcaaguuu

SEQ ID NO: 1579098 - RNA, 19 nt, Homo sapiens
gggaaugucaagagguuau

SEQ ID NO: 1579099 - RNA, 19 nt, Homo sapiens
cgccaaaucucuacuacac

SEQ ID NO: 1579100 - RNA, 19 nt, Homo sapiens
aaaauaagcagucucuuga

SEQ ID NO: 1579101 - RNA, 19 nt, Homo sapiens
ggagauggagcagcagaug

SEQ ID NO: 1579102 - RNA, 19 nt, Homo sapiens
agugggagcggauguuuaa

SEQ ID NO: 1579103 - RNA, 19 nt, Homo sapiens
ggaaaucaaaccaauucgu

SEQ ID NO: 1579104 - RNA, 19 nt, Homo sapiens
gauuacagugguauuugaa

SEQ ID NO: 1579105 - RNA, 19 nt, Homo sapiens
gaaaacccauguuguacag

SEQ ID NO: 1579106 - RNA, 19 nt, Homo sapiens
ggugaacagcaacuauuau

SEQ ID NO: 1579107 - RNA, 19 nt, Homo sapiens
uggugaacagcaacuauua

SEQ ID NO: 1579108 - RNA, 19 nt, Homo sapiens
uuacagugguauuugaagu

SEQ ID NO: 1579109 - RNA, 19 nt, Homo sapiens
gaagcaaugacugacauca

SEQ ID NO: 1579110 - RNA, 19 nt, Homo sapiens
caugaagcucuuagacaaa

SEQ ID NO: 1579111 - RNA, 19 nt, Homo sapiens
gcaaaggccucaucaagaa

SEQ ID NO: 1579112 - RNA, 19 nt, Homo sapiens
gaugauggcuauggaguuu

SEQ ID NO: 1579113 - RNA, 19 nt, Homo sapiens
gaagaaaucaagccuguga

SEQ ID NO: 1579114 - RNA, 19 nt, Homo sapiens
gaucauguaucgccguaaa

SEQ ID NO: 1579115 - RNA, 19 nt, Homo sapiens
gaccagcccugaugccuuu

SEQ ID NO: 1579116 - RNA, 19 nt, Homo sapiens
gcaaagcccugcuggacau

SEQ ID NO: 1579117 - RNA, 19 nt, Homo sapiens
ugacguaggcucugagaua

SEQ ID NO: 1579118 - RNA, 19 nt, Homo sapiens
ccagaaggcugcuaagaag

SEQ ID NO: 1579119 - RNA, 19 nt, Homo sapiens
ggaagggaauuuugauuuu

SEQ ID NO: 1579120 - RNA, 19 nt, Homo sapiens
ggaguuuccuacaugauug

SEQ ID NO: 1579121 - RNA, 19 nt, Homo sapiens
cuaagaagcaccagaauau

SEQ ID NO: 1579122 - RNA, 19 nt, Homo sapiens
gcuaagaagcaccagaaua

SEQ ID NO: 1579123 - RNA, 19 nt, Homo sapiens
agaaauaccuggugcucaa

SEQ ID NO: 1579124 - RNA, 19 nt, Homo sapiens
ccaaagaauuccaggacaa

SEQ ID NO: 1579125 - RNA, 19 nt, Homo sapiens
gggaucaacuccuggaaga

SEQ ID NO: 1579126 - RNA, 19 nt, Homo sapiens
ggacuugugugaccugcuu

SEQ ID NO: 1579127 - RNA, 19 nt, Homo sapiens
gacaaauccuucacucuca

SEQ ID NO: 1579128 - RNA, 19 nt, Homo sapiens
cagcaacuauuaugucaug

SEQ ID NO: 1579129 - RNA, 19 nt, Homo sapiens
gaacagcaacuauuauguc

SEQ ID NO: 1579130 - RNA, 19 nt, Homo sapiens
gcugaagguuggagaaaug

SEQ ID NO: 1579131 - RNA, 19 nt, Homo sapiens
ggacauugcugaucuuuuc

SEQ ID NO: 1579132 - RNA, 19 nt, Homo sapiens
gaucaacuccuggaagaaa

SEQ ID NO: 1579133 - RNA, 19 nt, Homo sapiens
ugugugaccugcuuugaaa

SEQ ID NO: 1579134 - RNA, 19 nt, Homo sapiens
gcuggaagacuguucauga

SEQ ID NO: 1579135 - RNA, 19 nt, Homo sapiens
cagacgacguggaguugua

SEQ ID NO: 1579136 - RNA, 19 nt, Homo sapiens
uggaugaugaggaauauua

SEQ ID NO: 1579137 - RNA, 19 nt, Homo sapiens
auaaauacuugccucagaa

SEQ ID NO: 1579138 - RNA, 19 nt, Homo sapiens
aauaaauacuugccucaga

SEQ ID NO: 1579139 - RNA, 19 nt, Homo sapiens
ggcaaaggccucaucaaga

SEQ ID NO: 1579140 - RNA, 19 nt, Homo sapiens
uaaacuggaccgugaagaa

SEQ ID NO: 1579141 - RNA, 19 nt, Homo sapiens
gagcaugcgugggcagaug

SEQ ID NO: 1579142 - RNA, 19 nt, Homo sapiens
uaccauggguggauguuug

SEQ ID NO: 1579143 - RNA, 19 nt, Homo sapiens
gcuauggaguuuccuacau

SEQ ID NO: 1579144 - RNA, 19 nt, Homo sapiens
gcacgccaggccuucuuua

SEQ ID NO: 1579145 - RNA, 19 nt, Homo sapiens
gacguaggcucugagauag

SEQ ID NO: 1579146 - RNA, 19 nt, Homo sapiens
ccacaucuccagcaaguuc

SEQ ID NO: 1579147 - RNA, 19 nt, Homo sapiens
ugcgagaucucuuccagaa

SEQ ID NO: 1579148 - RNA, 19 nt, Homo sapiens
caaguaacuaugugaguga

SEQ ID NO: 1579149 - RNA, 19 nt, Homo sapiens
uggaguugcuggccaaaga

SEQ ID NO: 1579150 - RNA, 19 nt, Homo sapiens
gaucugggcuauguguauc

SEQ ID NO: 1579151 - RNA, 19 nt, Homo sapiens
gaccugcuuugaaaugugu

SEQ ID NO: 1579152 - RNA, 19 nt, Homo sapiens
gcccuuagguaccuguguu

SEQ ID NO: 1579153 - RNA, 19 nt, Homo sapiens
gaaaugccagcugcccuuu

SEQ ID NO: 1579154 - RNA, 19 nt, Homo sapiens
agaagcaccagaauaugua

SEQ ID NO: 1579155 - RNA, 19 nt, Homo sapiens
cuucaagaauggccaguug

SEQ ID NO: 1579156 - RNA, 19 nt, Homo sapiens
ggagcccucucauggugaa

SEQ ID NO: 1579157 - RNA, 19 nt, Homo sapiens
uacaacaggugguuugaca

SEQ ID NO: 1579158 - RNA, 19 nt, Homo sapiens
cauggcaacugcuacaaca

SEQ ID NO: 1579159 - RNA, 19 nt, Homo sapiens
ugacgggcaucuucuucuu

SEQ ID NO: 1579160 - RNA, 19 nt, Homo sapiens
cuauggaguuuccuacaug

SEQ ID NO: 1579161 - RNA, 19 nt, Homo sapiens
agacaucucugcccaagcu

SEQ ID NO: 1579162 - RNA, 19 nt, Homo sapiens
ggaaaccacauccgcaaag

SEQ ID NO: 1579163 - RNA, 19 nt, Homo sapiens
gggcaccucugggaguuug

SEQ ID NO: 1579164 - RNA, 19 nt, Homo sapiens
ccaguugggucucaaugca

SEQ ID NO: 1579165 - RNA, 19 nt, Homo sapiens
ccacaagggacgcuucuuc

SEQ ID NO: 1579166 - RNA, 19 nt, Homo sapiens
aaacuggaccgugaagaaa

SEQ ID NO: 1579167 - RNA, 19 nt, Homo sapiens
gcucaagccucaggaucug

SEQ ID NO: 1579168 - RNA, 19 nt, Homo sapiens
ggaagaguacaucuaccuu

SEQ ID NO: 1579169 - RNA, 19 nt, Homo sapiens
gaaacacgucuaccugucu

SEQ ID NO: 1579170 - RNA, 19 nt, Homo sapiens
ccacguguuugcuuggaau

SEQ ID NO: 1579171 - RNA, 19 nt, Homo sapiens
agucagcucuccuuuccuu

SEQ ID NO: 1579172 - RNA, 19 nt, Homo sapiens
gugaacagcaacuauuaug

SEQ ID NO: 1579173 - RNA, 19 nt, Homo sapiens
cguguuugcuuggaauaaa

SEQ ID NO: 1579174 - RNA, 19 nt, Homo sapiens
gacgaacgcccagcgcuuu

SEQ ID NO: 1579175 - RNA, 19 nt, Homo sapiens
uauggaguuuccuacauga

SEQ ID NO: 1579176 - RNA, 19 nt, Homo sapiens
ggaucugggcuauguguau

SEQ ID NO: 1579177 - RNA, 19 nt, Homo sapiens
gaaaccacauccgcaaagc

SEQ ID NO: 1579178 - RNA, 19 nt, Homo sapiens
gaagcuggaagacuguuca

SEQ ID NO: 1579179 - RNA, 19 nt, Homo sapiens
ggcaaggcccugcuacaug

SEQ ID NO: 1579180 - RNA, 19 nt, Homo sapiens
caagggacgcuucuucaag

SEQ ID NO: 1579181 - RNA, 19 nt, Homo sapiens
cuacagcaccucucagaca

SEQ ID NO: 1579182 - RNA, 19 nt, Homo sapiens
gcaacuauuaugucaugga

SEQ ID NO: 1579183 - RNA, 19 nt, Homo sapiens
gagacugugcguuccugua

SEQ ID NO: 1579184 - RNA, 19 nt, Homo sapiens
aauauuaccgcauggaguu

SEQ ID NO: 1579185 - RNA, 19 nt, Homo sapiens
caauucagcgguaccuaga

SEQ ID NO: 1579186 - RNA, 19 nt, Homo sapiens
ugagugacguaggcucuga

SEQ ID NO: 1579187 - RNA, 19 nt, Homo sapiens
aagaagcaccagaauaugu

SEQ ID NO: 1579188 - RNA, 19 nt, Homo sapiens
aacagcaacuauuauguca

SEQ ID NO: 1579189 - RNA, 19 nt, Homo sapiens
ggugaacagcaacuauuau

SEQ ID NO: 1579190 - RNA, 19 nt, Homo sapiens
uggugaacagcaacuauua

SEQ ID NO: 1579191 - RNA, 19 nt, Homo sapiens
guuggaugaugaggaauau

SEQ ID NO: 1579192 - RNA, 19 nt, Homo sapiens
cuuguuggaugaugaggaa

SEQ ID NO: 1579193 - RNA, 19 nt, Homo sapiens
caacaguggguuccuccuu

SEQ ID NO: 1579194 - RNA, 19 nt, Homo sapiens
ggaguugcuggccaaagaa

SEQ ID NO: 1579195 - RNA, 19 nt, Homo sapiens
ggugggaagaguacaucua

SEQ ID NO: 1579196 - RNA, 19 nt, Homo sapiens
uaagaagcaccagaauaug

SEQ ID NO: 1579197 - RNA, 19 nt, Homo sapiens
cagcgaguccacagccuuu

SEQ ID NO: 1579198 - RNA, 19 nt, Homo sapiens
gccguggccuuccaguuca

SEQ ID NO: 1579199 - RNA, 19 nt, Homo sapiens
gcaggagcccucucauggu

SEQ ID NO: 1579200 - RNA, 19 nt, Homo sapiens
gcuggacauugcugaucuu

SEQ ID NO: 1579201 - RNA, 19 nt, Homo sapiens
gaucgacaggcaccucuuc

SEQ ID NO: 1579202 - RNA, 19 nt, Homo sapiens
uccagaaggcugcuaagaa

SEQ ID NO: 1579203 - RNA, 19 nt, Homo sapiens
caaauccuucacucucauu

SEQ ID NO: 1579204 - RNA, 19 nt, Homo sapiens
ucauggaccuugugcucau

SEQ ID NO: 1579205 - RNA, 19 nt, Homo sapiens
gaacgcccagcgcuuugga

SEQ ID NO: 1579206 - RNA, 19 nt, Homo sapiens
guguuugcuuggaauaaau

SEQ ID NO: 1579207 - RNA, 19 nt, Homo sapiens
ugaccugcuuugaaaugug

SEQ ID NO: 1579208 - RNA, 19 nt, Homo sapiens
ccucuucugccuuuacuug

SEQ ID NO: 1579209 - RNA, 19 nt, Homo sapiens
ggaggggucccacacaaaa

SEQ ID NO: 1579210 - RNA, 19 nt, Homo sapiens
uggcaaaggccucaucaag

SEQ ID NO: 1579211 - RNA, 19 nt, Homo sapiens
gcaaaggccucaucaagaa

SEQ ID NO: 1579212 - RNA, 19 nt, Homo sapiens
gaugauggcuauggaguuu

SEQ ID NO: 1579213 - RNA, 19 nt, Homo sapiens
gaagaaaucaagccuguga

SEQ ID NO: 1579214 - RNA, 19 nt, Homo sapiens
gaucauguaucgccguaaa

SEQ ID NO: 1579215 - RNA, 19 nt, Homo sapiens
gaccagcccugaugccuuu

SEQ ID NO: 1579216 - RNA, 19 nt, Homo sapiens
gcaaagcccugcuggacau

SEQ ID NO: 1579217 - RNA, 19 nt, Homo sapiens
ugacguaggcucugagaua

SEQ ID NO: 1579218 - RNA, 19 nt, Homo sapiens
ccagaaggcugcuaagaag

SEQ ID NO: 1579219 - RNA, 19 nt, Homo sapiens
ggaagggaauuuugauuuu

SEQ ID NO: 1579220 - RNA, 19 nt, Homo sapiens
ggaguuuccuacaugauug

SEQ ID NO: 1579221 - RNA, 19 nt, Homo sapiens
cuaagaagcaccagaauau

SEQ ID NO: 1579222 - RNA, 19 nt, Homo sapiens
gcuaagaagcaccagaaua

SEQ ID NO: 1579223 - RNA, 19 nt, Homo sapiens
agaaauaccuggugcucaa

SEQ ID NO: 1579224 - RNA, 19 nt, Homo sapiens
ccaaagaauuccaggacaa

SEQ ID NO: 1579225 - RNA, 19 nt, Homo sapiens
gggaucaacuccuggaaga

SEQ ID NO: 1579226 - RNA, 19 nt, Homo sapiens
ggacuugugugaccugcuu

SEQ ID NO: 1579227 - RNA, 19 nt, Homo sapiens
gacaaauccuucacucuca

SEQ ID NO: 1579228 - RNA, 19 nt, Homo sapiens
cagcaacuauuaugucaug

SEQ ID NO: 1579229 - RNA, 19 nt, Homo sapiens
gaacagcaacuauuauguc

SEQ ID NO: 1579230 - RNA, 19 nt, Homo sapiens
gcugaagguuggagaaaug

SEQ ID NO: 1579231 - RNA, 19 nt, Homo sapiens
ggacauugcugaucuuuuc

SEQ ID NO: 1579232 - RNA, 19 nt, Homo sapiens
gaucaacuccuggaagaaa

SEQ ID NO: 1579233 - RNA, 19 nt, Homo sapiens
ugugugaccugcuuugaaa

SEQ ID NO: 1579234 - RNA, 19 nt, Homo sapiens
gcuggaagacuguucauga

SEQ ID NO: 1579235 - RNA, 19 nt, Homo sapiens
cagacgacguggaguugua

SEQ ID NO: 1579236 - RNA, 19 nt, Homo sapiens
uggaugaugaggaauauua

SEQ ID NO: 1579237 - RNA, 19 nt, Homo sapiens
auaaauacuugccucagaa

SEQ ID NO: 1579238 - RNA, 19 nt, Homo sapiens
aauaaauacuugccucaga

SEQ ID NO: 1579239 - RNA, 19 nt, Homo sapiens
ggcaaaggccucaucaaga

SEQ ID NO: 1579240 - RNA, 19 nt, Homo sapiens
uaaacuggaccgugaagaa

SEQ ID NO: 1579241 - RNA, 19 nt, Homo sapiens
gagcaugcgugggcagaug

SEQ ID NO: 1579242 - RNA, 19 nt, Homo sapiens
uaccauggguggauguuug

SEQ ID NO: 1579243 - RNA, 19 nt, Homo sapiens
gcuauggaguuuccuacau

SEQ ID NO: 1579244 - RNA, 19 nt, Homo sapiens
gcacgccaggccuucuuua

SEQ ID NO: 1579245 - RNA, 19 nt, Homo sapiens
gacguaggcucugagauag

SEQ ID NO: 1579246 - RNA, 19 nt, Homo sapiens
ccacaucuccagcaaguuc

SEQ ID NO: 1579247 - RNA, 19 nt, Homo sapiens
ugcgagaucucuuccagaa

SEQ ID NO: 1579248 - RNA, 19 nt, Homo sapiens
caaguaacuaugugaguga

SEQ ID NO: 1579249 - RNA, 19 nt, Homo sapiens
uggaguugcuggccaaaga

SEQ ID NO: 1579250 - RNA, 19 nt, Homo sapiens
gaucugggcuauguguauc

SEQ ID NO: 1579251 - RNA, 19 nt, Homo sapiens
gaccugcuuugaaaugugu

SEQ ID NO: 1579252 - RNA, 19 nt, Homo sapiens
gcccuuagguaccuguguu

SEQ ID NO: 1579253 - RNA, 19 nt, Homo sapiens
gaaaugccagcugcccuuu

SEQ ID NO: 1579254 - RNA, 19 nt, Homo sapiens
agaagcaccagaauaugua

SEQ ID NO: 1579255 - RNA, 19 nt, Homo sapiens
cuucaagaauggccaguug

SEQ ID NO: 1579256 - RNA, 19 nt, Homo sapiens
ggagcccucucauggugaa

SEQ ID NO: 1579257 - RNA, 19 nt, Homo sapiens
uacaacaggugguuugaca

SEQ ID NO: 1579258 - RNA, 19 nt, Homo sapiens
cauggcaacugcuacaaca

SEQ ID NO: 1579259 - RNA, 19 nt, Homo sapiens
ugacgggcaucuucuucuu

SEQ ID NO: 1579260 - RNA, 19 nt, Homo sapiens
cuauggaguuuccuacaug

SEQ ID NO: 1579261 - RNA, 19 nt, Homo sapiens
agacaucucugcccaagcu

SEQ ID NO: 1579262 - RNA, 19 nt, Homo sapiens
ggaaaccacauccgcaaag

SEQ ID NO: 1579263 - RNA, 19 nt, Homo sapiens
gggcaccucugggaguuug

SEQ ID NO: 1579264 - RNA, 19 nt, Homo sapiens
ccaguugggucucaaugca

SEQ ID NO: 1579265 - RNA, 19 nt, Homo sapiens
ccacaagggacgcuucuuc

SEQ ID NO: 1579266 - RNA, 19 nt, Homo sapiens
aaacuggaccgugaagaaa

SEQ ID NO: 1579267 - RNA, 19 nt, Homo sapiens
gaaacacgucuaccugucu

SEQ ID NO: 1579268 - RNA, 19 nt, Homo sapiens
gcucaagccucaggaucug

SEQ ID NO: 1579269 - RNA, 19 nt, Homo sapiens
ggaagaguacaucuaccuu

SEQ ID NO: 1579270 - RNA, 19 nt, Homo sapiens
ccacguguuugcuuggaau

SEQ ID NO: 1579271 - RNA, 19 nt, Homo sapiens
agucagcucuccuuuccuu

SEQ ID NO: 1579272 - RNA, 19 nt, Homo sapiens
gugaacagcaacuauuaug

SEQ ID NO: 1579273 - RNA, 19 nt, Homo sapiens
cguguuugcuuggaauaaa

SEQ ID NO: 1579274 - RNA, 19 nt, Homo sapiens
gacgaacgcccagcgcuuu

SEQ ID NO: 1579275 - RNA, 19 nt, Homo sapiens
uauggaguuuccuacauga

SEQ ID NO: 1579276 - RNA, 19 nt, Homo sapiens
ggaucugggcuauguguau

SEQ ID NO: 1579277 - RNA, 19 nt, Homo sapiens
gaaaccacauccgcaaagc

SEQ ID NO: 1579278 - RNA, 19 nt, Homo sapiens
gaagcuggaagacuguuca

SEQ ID NO: 1579279 - RNA, 19 nt, Homo sapiens
ggcaaggcccugcuacaug

SEQ ID NO: 1579280 - RNA, 19 nt, Homo sapiens
caagggacgcuucuucaag

SEQ ID NO: 1579281 - RNA, 19 nt, Homo sapiens
cuacagcaccucucagaca

SEQ ID NO: 1579282 - RNA, 19 nt, Homo sapiens
gcaacuauuaugucaugga

SEQ ID NO: 1579283 - RNA, 19 nt, Homo sapiens
gagacugugcguuccugua

SEQ ID NO: 1579284 - RNA, 19 nt, Homo sapiens
aauauuaccgcauggaguu

SEQ ID NO: 1579285 - RNA, 19 nt, Homo sapiens
caauucagcgguaccuaga

SEQ ID NO: 1579286 - RNA, 19 nt, Homo sapiens
ugagugacguaggcucuga

SEQ ID NO: 1579287 - RNA, 19 nt, Homo sapiens
aagaagcaccagaauaugu

SEQ ID NO: 1579288 - RNA, 19 nt, Homo sapiens
caacaguggguuccuccuu

SEQ ID NO: 1579289 - RNA, 19 nt, Homo sapiens
aacagcaacuauuauguca

SEQ ID NO: 1579290 - RNA, 19 nt, Homo sapiens
ggugaacagcaacuauuau

SEQ ID NO: 1579291 - RNA, 19 nt, Homo sapiens
uggugaacagcaacuauua

SEQ ID NO: 1579292 - RNA, 19 nt, Homo sapiens
guuggaugaugaggaauau

SEQ ID NO: 1579293 - RNA, 19 nt, Homo sapiens
cuuguuggaugaugaggaa

SEQ ID NO: 1579294 - RNA, 19 nt, Homo sapiens
ggaguugcuggccaaagaa

SEQ ID NO: 1579295 - RNA, 19 nt, Homo sapiens
ggugggaagaguacaucua

SEQ ID NO: 1579296 - RNA, 19 nt, Homo sapiens
uaagaagcaccagaauaug

SEQ ID NO: 1579297 - RNA, 19 nt, Homo sapiens
cagcgaguccacagccuuu

SEQ ID NO: 1579298 - RNA, 19 nt, Homo sapiens
gccguggccuuccaguuca

SEQ ID NO: 1579299 - RNA, 19 nt, Homo sapiens
gcaggagcccucucauggu

SEQ ID NO: 1579300 - RNA, 19 nt, Homo sapiens
gcuggacauugcugaucuu

SEQ ID NO: 1579301 - RNA, 19 nt, Homo sapiens
gaucgacaggcaccucuuc

SEQ ID NO: 1579302 - RNA, 19 nt, Homo sapiens
uccagaaggcugcuaagaa

SEQ ID NO: 1579303 - RNA, 19 nt, Homo sapiens
caaauccuucacucucauu

SEQ ID NO: 1579304 - RNA, 19 nt, Homo sapiens
ucauggaccuugugcucau

SEQ ID NO: 1579305 - RNA, 19 nt, Homo sapiens
gaacgcccagcgcuuugga

SEQ ID NO: 1579306 - RNA, 19 nt, Homo sapiens
guguuugcuuggaauaaau

SEQ ID NO: 1579307 - RNA, 19 nt, Homo sapiens
ugaccugcuuugaaaugug

SEQ ID NO: 1579308 - RNA, 19 nt, Homo sapiens
ccucuucugccuuuacuug

SEQ ID NO: 1579309 - RNA, 19 nt, Homo sapiens
ggaggggucccacacaaaa

SEQ ID NO: 1579310 - RNA, 19 nt, Homo sapiens
uggcaaaggccucaucaag

SEQ ID NO: 1579311 - RNA, 19 nt, Homo sapiens
gcaaaggccucaucaagaa

SEQ ID NO: 1579312 - RNA, 19 nt, Homo sapiens
gaugauggcuauggaguuu

SEQ ID NO: 1579313 - RNA, 19 nt, Homo sapiens
gaagaaaucaagccuguga

SEQ ID NO: 1579314 - RNA, 19 nt, Homo sapiens
gaucauguaucgccguaaa

SEQ ID NO: 1579315 - RNA, 19 nt, Homo sapiens
gaccagcccugaugccuuu

SEQ ID NO: 1579316 - RNA, 19 nt, Homo sapiens
gcaaagcccugcuggacau

SEQ ID NO: 1579317 - RNA, 19 nt, Homo sapiens
ugacguaggcucugagaua

SEQ ID NO: 1579318 - RNA, 19 nt, Homo sapiens
ccagaaggcugcuaagaag

SEQ ID NO: 1579319 - RNA, 19 nt, Homo sapiens
ggaguuuccuacaugauug

SEQ ID NO: 1579320 - RNA, 19 nt, Homo sapiens
cuaagaagcaccagaauau

SEQ ID NO: 1579321 - RNA, 19 nt, Homo sapiens
gcuaagaagcaccagaaua

SEQ ID NO: 1579322 - RNA, 19 nt, Homo sapiens
agaaauaccuggugcucaa

SEQ ID NO: 1579323 - RNA, 19 nt, Homo sapiens
ccaaagaauuccaggacaa

SEQ ID NO: 1579324 - RNA, 19 nt, Homo sapiens
gggaucaacuccuggaaga

SEQ ID NO: 1579325 - RNA, 19 nt, Homo sapiens
ggacuugugugaccugcuu

SEQ ID NO: 1579326 - RNA, 19 nt, Homo sapiens
gacaaauccuucacucuca

SEQ ID NO: 1579327 - RNA, 19 nt, Homo sapiens
cagcaacuauuaugucaug

SEQ ID NO: 1579328 - RNA, 19 nt, Homo sapiens
gaacagcaacuauuauguc

SEQ ID NO: 1579329 - RNA, 19 nt, Homo sapiens
ggacauugcugaucuuuuc

SEQ ID NO: 1579330 - RNA, 19 nt, Homo sapiens
gaucaacuccuggaagaaa

SEQ ID NO: 1579331 - RNA, 19 nt, Homo sapiens
ugugugaccugcuuugaaa

SEQ ID NO: 1579332 - RNA, 19 nt, Homo sapiens
gcuggaagacuguucauga

SEQ ID NO: 1579333 - RNA, 19 nt, Homo sapiens
cagacgacguggaguugua

SEQ ID NO: 1579334 - RNA, 19 nt, Homo sapiens
uggaugaugaggaauauua

SEQ ID NO: 1579335 - RNA, 19 nt, Homo sapiens
auaaauacuugccucagaa

SEQ ID NO: 1579336 - RNA, 19 nt, Homo sapiens
aauaaauacuugccucaga

SEQ ID NO: 1579337 - RNA, 19 nt, Homo sapiens
ggcaaaggccucaucaaga

SEQ ID NO: 1579338 - RNA, 19 nt, Homo sapiens
uaaacuggaccgugaagaa

SEQ ID NO: 1579339 - RNA, 19 nt, Homo sapiens
gagcaugcgugggcagaug

SEQ ID NO: 1579340 - RNA, 19 nt, Homo sapiens
uaccauggguggauguuug

SEQ ID NO: 1579341 - RNA, 19 nt, Homo sapiens
gcuauggaguuuccuacau

SEQ ID NO: 1579342 - RNA, 19 nt, Homo sapiens
gcacgccaggccuucuuua

SEQ ID NO: 1579343 - RNA, 19 nt, Homo sapiens
gacguaggcucugagauag

SEQ ID NO: 1579344 - RNA, 19 nt, Homo sapiens
ccacaucuccagcaaguuc

SEQ ID NO: 1579345 - RNA, 19 nt, Homo sapiens
ugcgagaucucuuccagaa

SEQ ID NO: 1579346 - RNA, 19 nt, Homo sapiens
caaguaacuaugugaguga

SEQ ID NO: 1579347 - RNA, 19 nt, Homo sapiens
uggaguugcuggccaaaga

SEQ ID NO: 1579348 - RNA, 19 nt, Homo sapiens
gaucugggcuauguguauc

SEQ ID NO: 1579349 - RNA, 19 nt, Homo sapiens
gaccugcuuugaaaugugu

SEQ ID NO: 1579350 - RNA, 19 nt, Homo sapiens
gcccuuagguaccuguguu

SEQ ID NO: 1579351 - RNA, 19 nt, Homo sapiens
agaagcaccagaauaugua

SEQ ID NO: 1579352 - RNA, 19 nt, Homo sapiens
cuucaagaauggccaguug

SEQ ID NO: 1579353 - RNA, 19 nt, Homo sapiens
ggagcccucucauggugaa

SEQ ID NO: 1579354 - RNA, 19 nt, Homo sapiens
uacaacaggugguuugaca

SEQ ID NO: 1579355 - RNA, 19 nt, Homo sapiens
cauggcaacugcuacaaca

SEQ ID NO: 1579356 - RNA, 19 nt, Homo sapiens
ugacgggcaucuucuucuu

SEQ ID NO: 1579357 - RNA, 19 nt, Homo sapiens
cuauggaguuuccuacaug

SEQ ID NO: 1579358 - RNA, 19 nt, Homo sapiens
agacaucucugcccaagcu

SEQ ID NO: 1579359 - RNA, 19 nt, Homo sapiens
ggaaaccacauccgcaaag

SEQ ID NO: 1579360 - RNA, 19 nt, Homo sapiens
gggcaccucugggaguuug

SEQ ID NO: 1579361 - RNA, 19 nt, Homo sapiens
ccaguugggucucaaugca

SEQ ID NO: 1579362 - RNA, 19 nt, Homo sapiens
ccacaagggacgcuucuuc

SEQ ID NO: 1579363 - RNA, 19 nt, Homo sapiens
aaacuggaccgugaagaaa

SEQ ID NO: 1579364 - RNA, 19 nt, Homo sapiens
gaaacacgucuaccugucu

SEQ ID NO: 1579365 - RNA, 19 nt, Homo sapiens
gcucaagccucaggaucug

SEQ ID NO: 1579366 - RNA, 19 nt, Homo sapiens
ggaagaguacaucuaccuu

SEQ ID NO: 1579367 - RNA, 19 nt, Homo sapiens
ccacguguuugcuuggaau

SEQ ID NO: 1579368 - RNA, 19 nt, Homo sapiens
agucagcucuccuuuccuu

SEQ ID NO: 1579369 - RNA, 19 nt, Homo sapiens
gugaacagcaacuauuaug

SEQ ID NO: 1579370 - RNA, 19 nt, Homo sapiens
cguguuugcuuggaauaaa

SEQ ID NO: 1579371 - RNA, 19 nt, Homo sapiens
gacgaacgcccagcgcuuu

SEQ ID NO: 1579372 - RNA, 19 nt, Homo sapiens
uauggaguuuccuacauga

SEQ ID NO: 1579373 - RNA, 19 nt, Homo sapiens
ggaucugggcuauguguau

SEQ ID NO: 1579374 - RNA, 19 nt, Homo sapiens
gaaaccacauccgcaaagc

SEQ ID NO: 1579375 - RNA, 19 nt, Homo sapiens
gaagcuggaagacuguuca

SEQ ID NO: 1579376 - RNA, 19 nt, Homo sapiens
ggcaaggcccugcuacaug

SEQ ID NO: 1579377 - RNA, 19 nt, Homo sapiens
caagggacgcuucuucaag

SEQ ID NO: 1579378 - RNA, 19 nt, Homo sapiens
cuacagcaccucucagaca

SEQ ID NO: 1579379 - RNA, 19 nt, Homo sapiens
gcaacuauuaugucaugga

SEQ ID NO: 1579380 - RNA, 19 nt, Homo sapiens
gagacugugcguuccugua

SEQ ID NO: 1579381 - RNA, 19 nt, Homo sapiens
aauauuaccgcauggaguu

SEQ ID NO: 1579382 - RNA, 19 nt, Homo sapiens
caauucagcgguaccuaga

SEQ ID NO: 1579383 - RNA, 19 nt, Homo sapiens
ugagugacguaggcucuga

SEQ ID NO: 1579384 - RNA, 19 nt, Homo sapiens
aagaagcaccagaauaugu

SEQ ID NO: 1579385 - RNA, 19 nt, Homo sapiens
caacaguggguuccuccuu

SEQ ID NO: 1579386 - RNA, 19 nt, Homo sapiens
aacagcaacuauuauguca

SEQ ID NO: 1579387 - RNA, 19 nt, Homo sapiens
ggugaacagcaacuauuau

SEQ ID NO: 1579388 - RNA, 19 nt, Homo sapiens
uggugaacagcaacuauua

SEQ ID NO: 1579389 - RNA, 19 nt, Homo sapiens
guuggaugaugaggaauau

SEQ ID NO: 1579390 - RNA, 19 nt, Homo sapiens
cuuguuggaugaugaggaa

SEQ ID NO: 1579391 - RNA, 19 nt, Homo sapiens
ggaguugcuggccaaagaa

SEQ ID NO: 1579392 - RNA, 19 nt, Homo sapiens
ggugggaagaguacaucua

SEQ ID NO: 1579393 - RNA, 19 nt, Homo sapiens
uaagaagcaccagaauaug

SEQ ID NO: 1579394 - RNA, 19 nt, Homo sapiens
cagcgaguccacagccuuu

SEQ ID NO: 1579395 - RNA, 19 nt, Homo sapiens
gccguggccuuccaguuca

SEQ ID NO: 1579396 - RNA, 19 nt, Homo sapiens
gcaggagcccucucauggu

SEQ ID NO: 1579397 - RNA, 19 nt, Homo sapiens
gcuggacauugcugaucuu

SEQ ID NO: 1579398 - RNA, 19 nt, Homo sapiens
gaucgacaggcaccucuuc

SEQ ID NO: 1579399 - RNA, 19 nt, Homo sapiens
uccagaaggcugcuaagaa

SEQ ID NO: 1579400 - RNA, 19 nt, Homo sapiens
caaauccuucacucucauu

SEQ ID NO: 1579401 - RNA, 19 nt, Homo sapiens
ucauggaccuugugcucau

SEQ ID NO: 1579402 - RNA, 19 nt, Homo sapiens
gaacgcccagcgcuuugga

SEQ ID NO: 1579403 - RNA, 19 nt, Homo sapiens
guguuugcuuggaauaaau

SEQ ID NO: 1579404 - RNA, 19 nt, Homo sapiens
ugaccugcuuugaaaugug

SEQ ID NO: 1579405 - RNA, 19 nt, Homo sapiens
ccucuucugccuuuacuug

SEQ ID NO: 1579406 - RNA, 19 nt, Homo sapiens
ccagcaacuugaccaggau

SEQ ID NO: 1579407 - RNA, 19 nt, Homo sapiens
ggaggggucccacacaaaa

SEQ ID NO: 1579408 - RNA, 19 nt, Homo sapiens
uggcaaaggccucaucaag

SEQ ID NO: 1579409 - RNA, 19 nt, Homo sapiens
ucacucucauuuccuucaa

SEQ ID NO: 1579410 - RNA, 19 nt, Homo sapiens
auacuugccucagaaccuu

SEQ ID NO: 1579411 - RNA, 19 nt, Homo sapiens
gcaaaggccucaucaagaa

SEQ ID NO: 1579412 - RNA, 19 nt, Homo sapiens
ggaauggccuuucuacaaa

SEQ ID NO: 1579413 - RNA, 19 nt, Homo sapiens
ggaagaagauuugcuggua

SEQ ID NO: 1579414 - RNA, 19 nt, Homo sapiens
gaacagcaguugcauuuua

SEQ ID NO: 1579415 - RNA, 19 nt, Homo sapiens
gugaguggguuuaugauua

SEQ ID NO: 1579416 - RNA, 19 nt, Homo sapiens
ccacgaagauggcgcaauu

SEQ ID NO: 1579417 - RNA, 19 nt, Homo sapiens
gaugauggcuauggaguuu

SEQ ID NO: 1579418 - RNA, 19 nt, Homo sapiens
gaagaaaucaagccuguga

SEQ ID NO: 1579419 - RNA, 19 nt, Homo sapiens
gaucauguaucgccguaaa

SEQ ID NO: 1579420 - RNA, 19 nt, Homo sapiens
gaccagcccugaugccuuu

SEQ ID NO: 1579421 - RNA, 19 nt, Homo sapiens
gcaaagcccugcuggacau

SEQ ID NO: 1579422 - RNA, 19 nt, Homo sapiens
ugacguaggcucugagaua

SEQ ID NO: 1579423 - RNA, 19 nt, Homo sapiens
ccgaggagcugaggguuua

SEQ ID NO: 1579424 - RNA, 19 nt, Homo sapiens
ccagaaggcugcuaagaag

SEQ ID NO: 1579425 - RNA, 19 nt, Homo sapiens
cauagaauuugguuacuug

SEQ ID NO: 1579426 - RNA, 19 nt, Homo sapiens
ggaguuuccuacaugauug

SEQ ID NO: 1579427 - RNA, 19 nt, Homo sapiens
cuaagaagcaccagaauau

SEQ ID NO: 1579428 - RNA, 19 nt, Homo sapiens
gcuaagaagcaccagaaua

SEQ ID NO: 1579429 - RNA, 19 nt, Homo sapiens
agaaauaccuggugcucaa

SEQ ID NO: 1579430 - RNA, 19 nt, Homo sapiens
ccaaagaauuccaggacaa

SEQ ID NO: 1579431 - RNA, 19 nt, Homo sapiens
gggaucaacuccuggaaga

SEQ ID NO: 1579432 - RNA, 19 nt, Homo sapiens
ggacuugugugaccugcuu

SEQ ID NO: 1579433 - RNA, 19 nt, Homo sapiens
gacaaauccuucacucuca

SEQ ID NO: 1579434 - RNA, 19 nt, Homo sapiens
cagcaacuauuaugucaug

SEQ ID NO: 1579435 - RNA, 19 nt, Homo sapiens
gaacagcaacuauuauguc

SEQ ID NO: 1579436 - RNA, 19 nt, Homo sapiens
gcugaagguuggagaaaug

SEQ ID NO: 1579437 - RNA, 19 nt, Homo sapiens
ggacauugcugaucuuuuc

SEQ ID NO: 1579438 - RNA, 19 nt, Homo sapiens
caacuggccucccugagau

SEQ ID NO: 1579439 - RNA, 19 nt, Homo sapiens
gaucaacuccuggaagaaa

SEQ ID NO: 1579440 - RNA, 19 nt, Homo sapiens
gaagauggcgcaauuucau

SEQ ID NO: 1579441 - RNA, 19 nt, Homo sapiens
ugugugaccugcuuugaaa

SEQ ID NO: 1579442 - RNA, 19 nt, Homo sapiens
gcuggaagacuguucauga

SEQ ID NO: 1579443 - RNA, 19 nt, Homo sapiens
cagacgacguggaguugua

SEQ ID NO: 1579444 - RNA, 19 nt, Homo sapiens
uggaugaugaggaauauua

SEQ ID NO: 1579445 - RNA, 19 nt, Homo sapiens
aagaacagcaguugcauuu

SEQ ID NO: 1579446 - RNA, 19 nt, Homo sapiens
ugaguggguuuaugauuau

SEQ ID NO: 1579447 - RNA, 19 nt, Homo sapiens
auaaauacuugccucagaa

SEQ ID NO: 1579448 - RNA, 19 nt, Homo sapiens
gaacaguacaucccaaguc

SEQ ID NO: 1579449 - RNA, 19 nt, Homo sapiens
aauaaauacuugccucaga

SEQ ID NO: 1579450 - RNA, 19 nt, Homo sapiens
ggcaaaggccucaucaaga

SEQ ID NO: 1579451 - RNA, 19 nt, Homo sapiens
gguaggagaaggcaucuga

SEQ ID NO: 1579452 - RNA, 19 nt, Homo sapiens
cagcagccauugccacgaa

SEQ ID NO: 1579453 - RNA, 19 nt, Homo sapiens
ggagaaggcaucugagucu

SEQ ID NO: 1579454 - RNA, 19 nt, Homo sapiens
uaaacuggaccgugaagaa

SEQ ID NO: 1579455 - RNA, 19 nt, Homo sapiens
ugaaccugcuggagaugua

SEQ ID NO: 1579456 - RNA, 19 nt, Homo sapiens
gagcaugcgugggcagaug

SEQ ID NO: 1579457 - RNA, 19 nt, Homo sapiens
uaccauggguggauguuug

SEQ ID NO: 1579458 - RNA, 19 nt, Homo sapiens
gcuauggaguuuccuacau

SEQ ID NO: 1579459 - RNA, 19 nt, Homo sapiens
gcacgccaggccuucuuua

SEQ ID NO: 1579460 - RNA, 19 nt, Homo sapiens
gagguucacggucugagua

SEQ ID NO: 1579461 - RNA, 19 nt, Homo sapiens
gacguaggcucugagauag

SEQ ID NO: 1579462 - RNA, 19 nt, Homo sapiens
ccacaucuccagcaaguuc

SEQ ID NO: 1579463 - RNA, 19 nt, Homo sapiens
ugcgagaucucuuccagaa

SEQ ID NO: 1579464 - RNA, 19 nt, Homo sapiens
caaguaacuaugugaguga

SEQ ID NO: 1579465 - RNA, 19 nt, Homo sapiens
uggaguugcuggccaaaga

SEQ ID NO: 1579466 - RNA, 19 nt, Homo sapiens
gaucugggcuauguguauc

SEQ ID NO: 1579467 - RNA, 19 nt, Homo sapiens
ggaggaacaacgagcagaa

SEQ ID NO: 1579468 - RNA, 19 nt, Homo sapiens
aagcaaggcccacagacua

SEQ ID NO: 1579469 - RNA, 19 nt, Homo sapiens
gaccugcuuugaaaugugu

SEQ ID NO: 1579470 - RNA, 19 nt, Homo sapiens
gcccuuagguaccuguguu

SEQ ID NO: 1579471 - RNA, 19 nt, Homo sapiens
gaaaugccagcugcccuuu

SEQ ID NO: 1579472 - RNA, 19 nt, Homo sapiens
agaagcaccagaauaugua

SEQ ID NO: 1579473 - RNA, 19 nt, Homo sapiens
cuucaagaauggccaguug

SEQ ID NO: 1579474 - RNA, 19 nt, Homo sapiens
ggagcccucucauggugaa

SEQ ID NO: 1579475 - RNA, 19 nt, Homo sapiens
aagaagauuugcugguaga

SEQ ID NO: 1579476 - RNA, 19 nt, Homo sapiens
ggcgagcccucaugugugu

SEQ ID NO: 1579477 - RNA, 19 nt, Homo sapiens
uacaacaggugguuugaca

SEQ ID NO: 1579478 - RNA, 19 nt, Homo sapiens
cauggcaacugcuacaaca

SEQ ID NO: 1579479 - RNA, 19 nt, Homo sapiens
ugacgggcaucuucuucuu

SEQ ID NO: 1579480 - RNA, 19 nt, Homo sapiens
ccauagaauuugguuacuu

SEQ ID NO: 1579481 - RNA, 19 nt, Homo sapiens
agagaaaacuggaagaaga

SEQ ID NO: 1579482 - RNA, 19 nt, Homo sapiens
ggaaggcgagcccucaugu

SEQ ID NO: 1579483 - RNA, 19 nt, Homo sapiens
cuauggaguuuccuacaug

SEQ ID NO: 1579484 - RNA, 19 nt, Homo sapiens
agacaucucugcccaagcu

SEQ ID NO: 1579485 - RNA, 19 nt, Homo sapiens
uguacagccugaaggauga

SEQ ID NO: 1579486 - RNA, 19 nt, Homo sapiens
ccaggcaauuggaucagaa

SEQ ID NO: 1579487 - RNA, 19 nt, Homo sapiens
ggaaaccacauccgcaaag

SEQ ID NO: 1579488 - RNA, 19 nt, Homo sapiens
gggcaccucugggaguuug

SEQ ID NO: 1579489 - RNA, 19 nt, Homo sapiens
ccaguugggucucaaugca

SEQ ID NO: 1579490 - RNA, 19 nt, Homo sapiens
ccacaagggacgcuucuuc

SEQ ID NO: 1579491 - RNA, 19 nt, Homo sapiens
aaacuggaccgugaagaaa

SEQ ID NO: 1579492 - RNA, 19 nt, Homo sapiens
ccaacuggccucccugaga

SEQ ID NO: 1579493 - RNA, 19 nt, Homo sapiens
gcucaagccucaggaucug

SEQ ID NO: 1579494 - RNA, 19 nt, Homo sapiens
cggagagacccgaguauga

SEQ ID NO: 1579495 - RNA, 19 nt, Homo sapiens
ggaagaguacaucuaccuu

SEQ ID NO: 1579496 - RNA, 19 nt, Homo sapiens
gaaacacgucuaccugucu

SEQ ID NO: 1579497 - RNA, 19 nt, Homo sapiens
caagaacagcaguugcauu

SEQ ID NO: 1579498 - RNA, 19 nt, Homo sapiens
ccauggagcgguaccuaaa

SEQ ID NO: 1579499 - RNA, 19 nt, Homo sapiens
ccacguguuugcuuggaau

SEQ ID NO: 1579500 - RNA, 19 nt, Homo sapiens
agucagcucuccuuuccuu

SEQ ID NO: 1579501 - RNA, 19 nt, Homo sapiens
gugaacagcaacuauuaug

SEQ ID NO: 1579502 - RNA, 19 nt, Homo sapiens
gcauccauguccaccauag

SEQ ID NO: 1579503 - RNA, 19 nt, Homo sapiens
gcucuggcaucccauuucu

SEQ ID NO: 1579504 - RNA, 19 nt, Homo sapiens
aagauuugcugguagaagu

SEQ ID NO: 1579505 - RNA, 19 nt, Homo sapiens
aggaauggccuuucuacaa

SEQ ID NO: 1579506 - RNA, 19 nt, Homo sapiens
ugauuauacucacgaggaa

SEQ ID NO: 1579507 - RNA, 19 nt, Homo sapiens
cguguuugcuuggaauaaa

SEQ ID NO: 1579508 - RNA, 19 nt, Homo sapiens
gacgaacgcccagcgcuuu

SEQ ID NO: 1579509 - RNA, 19 nt, Homo sapiens
uauggaguuuccuacauga

SEQ ID NO: 1579510 - RNA, 19 nt, Homo sapiens
ggaucugggcuauguguau

SEQ ID NO: 1579511 - RNA, 19 nt, Homo sapiens
gcaaagaauuccugaagaa

SEQ ID NO: 1579512 - RNA, 19 nt, Homo sapiens
gcaaauccaucaaaaguua

SEQ ID NO: 1579513 - RNA, 19 nt, Homo sapiens
gcuacaggcuugagcuuua

SEQ ID NO: 1579514 - RNA, 19 nt, Homo sapiens
caucacagcugcuaaggaa

SEQ ID NO: 1579515 - RNA, 19 nt, Homo sapiens
gggacuagaucacaacuga

SEQ ID NO: 1579516 - RNA, 19 nt, Homo sapiens
gggcagagcucaggcagaa

SEQ ID NO: 1579517 - RNA, 19 nt, Homo sapiens
gaucacaacugaagauaac

SEQ ID NO: 1579518 - RNA, 19 nt, Homo sapiens
gcacagaagccucucuuga

SEQ ID NO: 1579519 - RNA, 19 nt, Homo sapiens
guagguacuuugaaucauu

SEQ ID NO: 1579520 - RNA, 19 nt, Homo sapiens
gaaaccuugucucuacuaa

SEQ ID NO: 1579521 - RNA, 19 nt, Homo sapiens
ggcagaagcugaugaguag

SEQ ID NO: 1579522 - RNA, 19 nt, Homo sapiens
ugaaguacauucucucaga

SEQ ID NO: 1579523 - RNA, 19 nt, Homo sapiens
uggcauaccugaccaguga

SEQ ID NO: 1579524 - RNA, 19 nt, Homo sapiens
gugaggaaauagagguuua

SEQ ID NO: 1579525 - RNA, 19 nt, Homo sapiens
ggugaaaccuugucucuac

SEQ ID NO: 1579526 - RNA, 19 nt, Homo sapiens
cgagcugacugaugccuua

SEQ ID NO: 1579527 - RNA, 19 nt, Homo sapiens
agaagccucucuugaauga

SEQ ID NO: 1579528 - RNA, 19 nt, Homo sapiens
cuucuuaggugaggaaaua

SEQ ID NO: 1579529 - RNA, 19 nt, Homo sapiens
ccacagagccagccagcua

SEQ ID NO: 1579530 - RNA, 19 nt, Homo sapiens
gauggagccuggaucaaau

SEQ ID NO: 1579531 - RNA, 19 nt, Homo sapiens
ggcuugagcuuuaaauuca

SEQ ID NO: 1579532 - RNA, 19 nt, Homo sapiens
gagaggaggcaaagaauuc

SEQ ID NO: 1579533 - RNA, 19 nt, Homo sapiens
ggaucaagaugggaacauu

SEQ ID NO: 1579534 - RNA, 19 nt, Homo sapiens
gaggagagccugaggaaag

SEQ ID NO: 1579535 - RNA, 19 nt, Homo sapiens
gcugagcccugacgcaguu

SEQ ID NO: 1579536 - RNA, 19 nt, Homo sapiens
ggcaaagaauuccugaaga

SEQ ID NO: 1579537 - RNA, 19 nt, Homo sapiens
gaagacaccauuaggagau

SEQ ID NO: 1579538 - RNA, 19 nt, Homo sapiens
gaaggcaaauccaucaaaa

SEQ ID NO: 1579539 - RNA, 19 nt, Homo sapiens
gacccugguuugauaugua

SEQ ID NO: 1579540 - RNA, 19 nt, Homo sapiens
ggauggagccuggaucaaa

SEQ ID NO: 1579541 - RNA, 19 nt, Homo sapiens
cuagaugacuuccccauua

SEQ ID NO: 1579542 - RNA, 19 nt, Homo sapiens
acagaagccucucuugaau

SEQ ID NO: 1579543 - RNA, 19 nt, Homo sapiens
ggagaaggccuuagaagac

SEQ ID NO: 1579544 - RNA, 19 nt, Homo sapiens
uaaacguaauuuccacuug

SEQ ID NO: 1579545 - RNA, 19 nt, Homo sapiens
gcuauucugugaaacuaau

SEQ ID NO: 1579546 - RNA, 19 nt, Homo sapiens
gcagauaaaccacaauguc

SEQ ID NO: 1579547 - RNA, 19 nt, Homo sapiens
gaggugcucugaggccuuu

SEQ ID NO: 1579548 - RNA, 19 nt, Homo sapiens
ugaaaacccucacuauuga

SEQ ID NO: 1579549 - RNA, 19 nt, Homo sapiens
uaccaucacuuccucauca

SEQ ID NO: 1579550 - RNA, 19 nt, Homo sapiens
gguaugcuguucaugacaa

SEQ ID NO: 1579551 - RNA, 19 nt, Homo sapiens
gaccaaagaagcagcaaug

SEQ ID NO: 1579552 - RNA, 19 nt, Homo sapiens
gaaauccaggcacaucuga

SEQ ID NO: 1579553 - RNA, 19 nt, Homo sapiens
ggacaaacagaauaaacau

SEQ ID NO: 1579554 - RNA, 19 nt, Homo sapiens
gcugcaaugucucuuccua

SEQ ID NO: 1579555 - RNA, 19 nt, Homo sapiens
ucgggacccugguuugaua

SEQ ID NO: 1579556 - RNA, 19 nt, Homo sapiens
ucagagaggaggcaaagaa

SEQ ID NO: 1579557 - RNA, 19 nt, Homo sapiens
cacagaagccucucuugaa

SEQ ID NO: 1579558 - RNA, 19 nt, Homo sapiens
aaacuugaagacaccauua

SEQ ID NO: 1579559 - RNA, 19 nt, Homo sapiens
cuacaggcuugagcuuuaa

SEQ ID NO: 1579560 - RNA, 19 nt, Homo sapiens
caagaugggaacauuguga

SEQ ID NO: 1579561 - RNA, 19 nt, Homo sapiens
caagagacucauacgcuuu

SEQ ID NO: 1579562 - RNA, 19 nt, Homo sapiens
ggagguugaagcagaauug

SEQ ID NO: 1579563 - RNA, 19 nt, Homo sapiens
gggccuaccuggucaaugc

SEQ ID NO: 1579564 - RNA, 19 nt, Homo sapiens
gagacuccguuguucugaa

SEQ ID NO: 1579565 - RNA, 19 nt, Homo sapiens
gaacaauuuugcaagaguu

SEQ ID NO: 1579566 - RNA, 19 nt, Homo sapiens
ucugauggcuuugguguug

SEQ ID NO: 1579567 - RNA, 19 nt, Homo sapiens
gcacaucugaaguacauuc

SEQ ID NO: 1579568 - RNA, 19 nt, Homo sapiens
gcucgagacuccguuguuc

SEQ ID NO: 1579569 - RNA, 19 nt, Homo sapiens
gugcuauucugugaaacua

SEQ ID NO: 1579570 - RNA, 19 nt, Homo sapiens
gaucaagaugggaacauug

SEQ ID NO: 1579571 - RNA, 19 nt, Homo sapiens
gcugguugcucuggacaaa

SEQ ID NO: 1579572 - RNA, 19 nt, Homo sapiens
caacugaagauaacaagag

SEQ ID NO: 1579573 - RNA, 19 nt, Homo sapiens
gaaaagcuaccaucacuuc

SEQ ID NO: 1579574 - RNA, 19 nt, Homo sapiens
uguggucucugauggcuuu

SEQ ID NO: 1579575 - RNA, 19 nt, Homo sapiens
cuuaaagacuggcaucaca

SEQ ID NO: 1579576 - RNA, 19 nt, Homo sapiens
agaccaaccuggccaacau

SEQ ID NO: 1579577 - RNA, 19 nt, Homo sapiens
caucugaaguacauucucu

SEQ ID NO: 1579578 - RNA, 19 nt, Homo sapiens
gccauccgguuucugaaga

SEQ ID NO: 1579579 - RNA, 19 nt, Homo sapiens
ccaaucacguuucuuagcu

SEQ ID NO: 1579580 - RNA, 19 nt, Homo sapiens
uggauaggcugcaaugucu

SEQ ID NO: 1579581 - RNA, 19 nt, Homo sapiens
gcaaugggccagggcuuug

SEQ ID NO: 1579582 - RNA, 19 nt, Homo sapiens
aaucacguuucuuagcuuu

SEQ ID NO: 1579583 - RNA, 19 nt, Homo sapiens
ggcagacaguggccaccua

SEQ ID NO: 1579584 - RNA, 19 nt, Homo sapiens
aagaauuccugaagaagca

SEQ ID NO: 1579585 - RNA, 19 nt, Homo sapiens
gacacuaucaccuucaaga

SEQ ID NO: 1579586 - RNA, 19 nt, Homo sapiens
ggacccugguuugauaugu

SEQ ID NO: 1579587 - RNA, 19 nt, Homo sapiens
caggaaaacagaacaauuu

SEQ ID NO: 1579588 - RNA, 19 nt, Homo sapiens
aagccucucuugaaugaug

SEQ ID NO: 1579589 - RNA, 19 nt, Homo sapiens
gucaggaguuugagaccaa

SEQ ID NO: 1579590 - RNA, 19 nt, Homo sapiens
cacuugaggucaggaguuu

SEQ ID NO: 1579591 - RNA, 19 nt, Homo sapiens
cuggugagcuucagcagau

SEQ ID NO: 1579592 - RNA, 19 nt, Homo sapiens
gcugacugaugccuuaaag

SEQ ID NO: 1579593 - RNA, 19 nt, Homo sapiens
aggcacaucugaaguacau

SEQ ID NO: 1579594 - RNA, 19 nt, Homo sapiens
cuuccucucuguccuggua

SEQ ID NO: 1579595 - RNA, 19 nt, Homo sapiens
caaucacguuucuuagcuu

SEQ ID NO: 1579596 - RNA, 19 nt, Homo sapiens
gaggaaauagagguuuaaa

SEQ ID NO: 1579597 - RNA, 19 nt, Homo sapiens
aggcagaagcugaugagua

SEQ ID NO: 1579598 - RNA, 19 nt, Homo sapiens
ggaaauccaggcacaucug

SEQ ID NO: 1579599 - RNA, 19 nt, Homo sapiens
cgaucuaucuacuucuuag

SEQ ID NO: 1579600 - RNA, 19 nt, Homo sapiens
aaaguggacucggcagugu

SEQ ID NO: 1579601 - RNA, 19 nt, Homo sapiens
ugggugcuauucugugaaa

SEQ ID NO: 1579602 - RNA, 19 nt, Homo sapiens
gggcagauaaaccacaaug

SEQ ID NO: 1579603 - RNA, 19 nt, Homo sapiens
gcugaugaguaguggcaau

SEQ ID NO: 1579604 - RNA, 19 nt, Homo sapiens
cugaagauaacaagagauu

SEQ ID NO: 1579605 - RNA, 19 nt, Homo sapiens
gccagugggugcuauucug

SEQ ID NO: 1579606 - RNA, 19 nt, Homo sapiens
uggagaaggccuuagaaga

SEQ ID NO: 1579607 - RNA, 19 nt, Homo sapiens
gggcuuugaccgacacuug

SEQ ID NO: 1579608 - RNA, 19 nt, Homo sapiens
cggccuccgucuauacaaa

SEQ ID NO: 1579609 - RNA, 19 nt, Homo sapiens
guacuuugaaucauuacga

SEQ ID NO: 1579610 - RNA, 19 nt, Homo sapiens
ugcagaaacucaacuucga

SEQ ID NO: 1579611 - RNA, 19 nt, Homo sapiens
gaggacggcuuacauguuu

SEQ ID NO: 1579612 - RNA, 19 nt, Homo sapiens
gcccugaccuucucucuga

SEQ ID NO: 1579613 - RNA, 19 nt, Homo sapiens
ggaggacggcuuacauguu

SEQ ID NO: 1579614 - RNA, 19 nt, Homo sapiens
cggcuuacauguuuguuuc

SEQ ID NO: 1579615 - RNA, 19 nt, Homo sapiens
cagcagcuuucccuguuga

SEQ ID NO: 1579616 - RNA, 19 nt, Homo sapiens
caacugcagcucuccauca

SEQ ID NO: 1579617 - RNA, 19 nt, Homo sapiens
guaccgagaauacgagaau

SEQ ID NO: 1579618 - RNA, 19 nt, Homo sapiens
gaggaggacggcuuacaug

SEQ ID NO: 1579619 - RNA, 19 nt, Homo sapiens
ggaggaggacggcuuacau

SEQ ID NO: 1579620 - RNA, 19 nt, Homo sapiens
gcuggaggaggacggcuua

SEQ ID NO: 1579621 - RNA, 19 nt, Homo sapiens
cagcacgaguggccaguuc

SEQ ID NO: 1579622 - RNA, 19 nt, Homo sapiens
cugaauggaugcugcagau

SEQ ID NO: 1579623 - RNA, 19 nt, Homo sapiens
gagagccgccugcuugagu

SEQ ID NO: 1579624 - RNA, 19 nt, Homo sapiens
uccagcagcuuucccuguu

SEQ ID NO: 1579625 - RNA, 19 nt, Homo sapiens
ggacggcuuacauguuugu

SEQ ID NO: 1579626 - RNA, 19 nt, Homo sapiens
ccagcagcuuucccuguug

SEQ ID NO: 1579627 - RNA, 19 nt, Homo sapiens
uaccgagaauacgagaaua

SEQ ID NO: 1579628 - RNA, 19 nt, Homo sapiens
cgaguggccaguucauugu

SEQ ID NO: 1579629 - RNA, 19 nt, Homo sapiens
cacuguguccggcaacaua

SEQ ID NO: 1579630 - RNA, 19 nt, Homo sapiens
cagcuuucccuguugaugu

SEQ ID NO: 1579631 - RNA, 19 nt, Homo sapiens
ccggcaacauacugacuau

SEQ ID NO: 1579632 - RNA, 19 nt, Homo sapiens
aaauaaaacugagcuacga

SEQ ID NO: 1579633 - RNA, 19 nt, Homo sapiens
gcuuacauguuuguuucug

SEQ ID NO: 1579634 - RNA, 19 nt, Homo sapiens
acgaguggccaguucauug

SEQ ID NO: 1579635 - RNA, 19 nt, Homo sapiens
agagccgccugcuugaguu

SEQ ID NO: 1579636 - RNA, 19 nt, Homo sapiens
gcacgaguggccaguucau

SEQ ID NO: 1579637 - RNA, 19 nt, Homo sapiens
gccgccugcuugaguucua

SEQ ID NO: 1579638 - RNA, 19 nt, Homo sapiens
gaggacggcuuacauguuu

SEQ ID NO: 1579639 - RNA, 19 nt, Homo sapiens
gcccugaccuucucucuga

SEQ ID NO: 1579640 - RNA, 19 nt, Homo sapiens
ggaggacggcuuacauguu

SEQ ID NO: 1579641 - RNA, 19 nt, Homo sapiens
cggcuuacauguuuguuuc

SEQ ID NO: 1579642 - RNA, 19 nt, Homo sapiens
cagcagcuuucccuguuga

SEQ ID NO: 1579643 - RNA, 19 nt, Homo sapiens
caacugcagcucuccauca

SEQ ID NO: 1579644 - RNA, 19 nt, Homo sapiens
gaggaggacggcuuacaug

SEQ ID NO: 1579645 - RNA, 19 nt, Homo sapiens
ggaggaggacggcuuacau

SEQ ID NO: 1579646 - RNA, 19 nt, Homo sapiens
gcuggaggaggacggcuua

SEQ ID NO: 1579647 - RNA, 19 nt, Homo sapiens
cagcacgaguggccaguuc

SEQ ID NO: 1579648 - RNA, 19 nt, Homo sapiens
cugaauggaugcugcagau

SEQ ID NO: 1579649 - RNA, 19 nt, Homo sapiens
gagagccgccugcuugagu

SEQ ID NO: 1579650 - RNA, 19 nt, Homo sapiens
uccagcagcuuucccuguu

SEQ ID NO: 1579651 - RNA, 19 nt, Homo sapiens
ggacggcuuacauguuugu

SEQ ID NO: 1579652 - RNA, 19 nt, Homo sapiens
ccagcagcuuucccuguug

SEQ ID NO: 1579653 - RNA, 19 nt, Homo sapiens
cgaguggccaguucauugu

SEQ ID NO: 1579654 - RNA, 19 nt, Homo sapiens
cacuguguccggcaacaua

SEQ ID NO: 1579655 - RNA, 19 nt, Homo sapiens
cagcuuucccuguugaugu

SEQ ID NO: 1579656 - RNA, 19 nt, Homo sapiens
ccggcaacauacugacuau

SEQ ID NO: 1579657 - RNA, 19 nt, Homo sapiens
aaauaaaacugagcuacga

SEQ ID NO: 1579658 - RNA, 19 nt, Homo sapiens
gcuuacauguuuguuucug

SEQ ID NO: 1579659 - RNA, 19 nt, Homo sapiens
agagccgccugcuugaguu

SEQ ID NO: 1579660 - RNA, 19 nt, Homo sapiens
acgaguggccaguucauug

SEQ ID NO: 1579661 - RNA, 19 nt, Homo sapiens
gcacgaguggccaguucau

SEQ ID NO: 1579662 - RNA, 19 nt, Homo sapiens
gccgccugcuugaguucua

SEQ ID NO: 1579663 - RNA, 19 nt, Homo sapiens
gaucaaggcuucagaguuu

SEQ ID NO: 1579664 - RNA, 19 nt, Homo sapiens
caaaguaacucaucuaaga

SEQ ID NO: 1579665 - RNA, 19 nt, Homo sapiens
caaggaaugugauguauuu

SEQ ID NO: 1579666 - RNA, 19 nt, Homo sapiens
gaacuuggauguuaacuuc

SEQ ID NO: 1579667 - RNA, 19 nt, Homo sapiens
gaaaguggaucauaucuuc

SEQ ID NO: 1579668 - RNA, 19 nt, Homo sapiens
ggaauuagguacaguaaau

SEQ ID NO: 1579669 - RNA, 19 nt, Homo sapiens
gaagaugacucuccugaau

SEQ ID NO: 1579670 - RNA, 19 nt, Homo sapiens
gaagauaccacauauaaga

SEQ ID NO: 1579671 - RNA, 19 nt, Homo sapiens
gaaagaagacuuaagcauu

SEQ ID NO: 1579672 - RNA, 19 nt, Homo sapiens
gcaagucucuguccucuga

SEQ ID NO: 1579673 - RNA, 19 nt, Homo sapiens
ucagaugccucuacaauaa

SEQ ID NO: 1579674 - RNA, 19 nt, Homo sapiens
guaaagaugguacagauua

SEQ ID NO: 1579675 - RNA, 19 nt, Homo sapiens
gaaaaugcaugaucguuua

SEQ ID NO: 1579676 - RNA, 19 nt, Homo sapiens
gcacugguaucauaucuga

SEQ ID NO: 1579677 - RNA, 19 nt, Homo sapiens
gagagaauuugucuuacua

SEQ ID NO: 1579678 - RNA, 19 nt, Homo sapiens
gaaagguagcuaugaaaua

SEQ ID NO: 1579679 - RNA, 19 nt, Homo sapiens
gaagaugacuaugcugaaa

SEQ ID NO: 1579680 - RNA, 19 nt, Homo sapiens
gauguuaacuuccaugaau

SEQ ID NO: 1579681 - RNA, 19 nt, Homo sapiens
gugaaaugcuugaguauga

SEQ ID NO: 1579682 - RNA, 19 nt, Homo sapiens
cagacuggcugcagcauua

SEQ ID NO: 1579683 - RNA, 19 nt, Homo sapiens
gagcauaacuacucuugga

SEQ ID NO: 1579684 - RNA, 19 nt, Homo sapiens
ggacuaugcaccuguaaua

SEQ ID NO: 1579685 - RNA, 19 nt, Homo sapiens
gaaaagaagucccgaaguu

SEQ ID NO: 1579686 - RNA, 19 nt, Homo sapiens
gcacugaauucguuucuuc

SEQ ID NO: 1579687 - RNA, 19 nt, Homo sapiens
aaucacagcuucuucguuu

SEQ ID NO: 1579688 - RNA, 19 nt, Homo sapiens
cagaagauaccacauauaa

SEQ ID NO: 1579689 - RNA, 19 nt, Homo sapiens
ugaagacucugaugauauu

SEQ ID NO: 1579690 - RNA, 19 nt, Homo sapiens
aaacaucucuucccacaga

SEQ ID NO: 1579691 - RNA, 19 nt, Homo sapiens
guacaaagggaaacagaua

SEQ ID NO: 1579692 - RNA, 19 nt, Homo sapiens
agacacagcuguuaacaau

SEQ ID NO: 1579693 - RNA, 19 nt, Homo sapiens
cagcagaauuugccucuaa

SEQ ID NO: 1579694 - RNA, 19 nt, Homo sapiens
gcugugauauuuacuagaa

SEQ ID NO: 1579695 - RNA, 19 nt, Homo sapiens
gaauuugccucuaaaccuu

SEQ ID NO: 1579696 - RNA, 19 nt, Homo sapiens
ggaauucuugguccuauua

SEQ ID NO: 1579697 - RNA, 19 nt, Homo sapiens
aaagaagacuuaagcauuc

SEQ ID NO: 1579698 - RNA, 19 nt, Homo sapiens
ccaaucauuuccagguuua

SEQ ID NO: 1579699 - RNA, 19 nt, Homo sapiens
caugagagaauuugucuua

SEQ ID NO: 1579700 - RNA, 19 nt, Homo sapiens
gaauuuaauccacugguua

SEQ ID NO: 1579701 - RNA, 19 nt, Homo sapiens
acacagcuguuaacaauug

SEQ ID NO: 1579702 - RNA, 19 nt, Homo sapiens
ucaagacccugaucaaaug

SEQ ID NO: 1579703 - RNA, 19 nt, Homo sapiens
gagggaaaguggaucauau

SEQ ID NO: 1579704 - RNA, 19 nt, Homo sapiens
gagcugaaguggaugaugu

SEQ ID NO: 1579705 - RNA, 19 nt, Homo sapiens
ucagugaaaugcuugagua

SEQ ID NO: 1579706 - RNA, 19 nt, Homo sapiens
gagcagaggcggcacauga

SEQ ID NO: 1579707 - RNA, 19 nt, Homo sapiens
acuaagcacugguaucaua

SEQ ID NO: 1579708 - RNA, 19 nt, Homo sapiens
caauaaacagcaccaguua

SEQ ID NO: 1579709 - RNA, 19 nt, Homo sapiens
gcaauaaacagcaccaguu

SEQ ID NO: 1579710 - RNA, 19 nt, Homo sapiens
aagaagagcugguacuaug

SEQ ID NO: 1579711 - RNA, 19 nt, Homo sapiens
ggaaacagauauugaagac

SEQ ID NO: 1579712 - RNA, 19 nt, Homo sapiens
uuacauugcugcugaagaa

SEQ ID NO: 1579713 - RNA, 19 nt, Homo sapiens
ggaacacuaucaaacauuc

SEQ ID NO: 1579714 - RNA, 19 nt, Homo sapiens
gaaauucagggauguuaaa

SEQ ID NO: 1579715 - RNA, 19 nt, Homo sapiens
ggacacagaagacguuuga

SEQ ID NO: 1579716 - RNA, 19 nt, Homo sapiens
gaaagaagaugggauuuug

SEQ ID NO: 1579717 - RNA, 19 nt, Homo sapiens
gagaauacaccuaugaaug

SEQ ID NO: 1579718 - RNA, 19 nt, Homo sapiens
caaacgccauuucuuauca

SEQ ID NO: 1579719 - RNA, 19 nt, Homo sapiens
ggaauuuaauccacugguu

SEQ ID NO: 1579720 - RNA, 19 nt, Homo sapiens
ggaaagaguagacugaaga

SEQ ID NO: 1579721 - RNA, 19 nt, Homo sapiens
ggacuaagcacugguauca

SEQ ID NO: 1579722 - RNA, 19 nt, Homo sapiens
ugagaaagguagcuaugaa

SEQ ID NO: 1579723 - RNA, 19 nt, Homo sapiens
uaacagaccuacccuucga

SEQ ID NO: 1579724 - RNA, 19 nt, Homo sapiens
aaaccacaaucuaccauuu

SEQ ID NO: 1579725 - RNA, 19 nt, Homo sapiens
aaacugauguuaggacaaa

SEQ ID NO: 1579726 - RNA, 19 nt, Homo sapiens
gcagaucucagucaaauuc

SEQ ID NO: 1579727 - RNA, 19 nt, Homo sapiens
gcuaugaaauaauccaaga

SEQ ID NO: 1579728 - RNA, 19 nt, Homo sapiens
uuaaauguaucccagauga

SEQ ID NO: 1579729 - RNA, 19 nt, Homo sapiens
ucagggauguuaaauguau

SEQ ID NO: 1579730 - RNA, 19 nt, Homo sapiens
uaacuuccaugaauucuag

SEQ ID NO: 1579731 - RNA, 19 nt, Homo sapiens
gcuacuauuugcuguguuu

SEQ ID NO: 1579732 - RNA, 19 nt, Homo sapiens
gauauucacucaggcuuga

SEQ ID NO: 1579733 - RNA, 19 nt, Homo sapiens
ggucucagcauuuggauaa

SEQ ID NO: 1579734 - RNA, 19 nt, Homo sapiens
aaacaaugguggaucuuau

SEQ ID NO: 1579735 - RNA, 19 nt, Homo sapiens
ccauacaacccuuucuuua

SEQ ID NO: 1579736 - RNA, 19 nt, Homo sapiens
gcuaauaggacuacuucua

SEQ ID NO: 1579737 - RNA, 19 nt, Homo sapiens
gaucgaggauuucaacucu

SEQ ID NO: 1579738 - RNA, 19 nt, Homo sapiens
uaaggaagauaaugcuguu

SEQ ID NO: 1579739 - RNA, 19 nt, Homo sapiens
gagcaucucggaauucuug

SEQ ID NO: 1579740 - RNA, 19 nt, Homo sapiens
auacaacccuuucuuuaga

SEQ ID NO: 1579741 - RNA, 19 nt, Homo sapiens
agacauaaaucucuacaag

SEQ ID NO: 1579742 - RNA, 19 nt, Homo sapiens
ggacaacaucaacaaguuu

SEQ ID NO: 1579743 - RNA, 19 nt, Homo sapiens
gcauuuggauaauuucuca

SEQ ID NO: 1579744 - RNA, 19 nt, Homo sapiens
gaaauaauccaagauacug

SEQ ID NO: 1579745 - RNA, 19 nt, Homo sapiens
gaacaacaccaugaucaga

SEQ ID NO: 1579746 - RNA, 19 nt, Homo sapiens
uuuaagaccucaaaccauu

SEQ ID NO: 1579747 - RNA, 19 nt, Homo sapiens
uaacggcaauuauaacaca

SEQ ID NO: 1579748 - RNA, 19 nt, Homo sapiens
cagcuugccuggccugaaa

SEQ ID NO: 1579749 - RNA, 19 nt, Homo sapiens
ugaagagcaucucggaauu

SEQ ID NO: 1579750 - RNA, 19 nt, Homo sapiens
cagcaacaauggaaacaga

SEQ ID NO: 1579751 - RNA, 19 nt, Homo sapiens
guaaguucacugucaauaa

SEQ ID NO: 1579752 - RNA, 19 nt, Homo sapiens
cuaauaggacuacuucuaa

SEQ ID NO: 1579753 - RNA, 19 nt, Homo sapiens
ggucagagacacacucaaa

SEQ ID NO: 1579754 - RNA, 19 nt, Homo sapiens
ccaaaggacaugugaagaa

SEQ ID NO: 1579755 - RNA, 19 nt, Homo sapiens
ccucugaaauguauguaaa

SEQ ID NO: 1579756 - RNA, 19 nt, Homo sapiens
gaggaacacuaucaaacau

SEQ ID NO: 1579757 - RNA, 19 nt, Homo sapiens
aaucagaauuccucaaaug

SEQ ID NO: 1579758 - RNA, 19 nt, Homo sapiens
gaugaagacacagcuguua

SEQ ID NO: 1579759 - RNA, 19 nt, Homo sapiens
gcugguaccuugaggacaa

SEQ ID NO: 1579760 - RNA, 19 nt, Homo sapiens
aggcuuacauugacauuaa

SEQ ID NO: 1579761 - RNA, 19 nt, Homo sapiens
gaagacguuugacaagcaa

SEQ ID NO: 1579762 - RNA, 19 nt, Homo sapiens
ugaaguggaugauguuauc

SEQ ID NO: 1579763 - RNA, 19 nt, Homo sapiens
guagguaccuggaaacuug

SEQ ID NO: 1579764 - RNA, 19 nt, Homo sapiens
aaacuugucuccagugaaa

SEQ ID NO: 1579765 - RNA, 19 nt, Homo sapiens
ggacugaaguucgcauuga

SEQ ID NO: 1579766 - RNA, 19 nt, Homo sapiens
gcauugaacucuacaacau

SEQ ID NO: 1579767 - RNA, 19 nt, Homo sapiens
gaaaugggauggaaaauca

SEQ ID NO: 1579768 - RNA, 19 nt, Homo sapiens
caagagcaccauaaccuua

SEQ ID NO: 1579769 - RNA, 19 nt, Homo sapiens
gggaugugaucaccauuaa

SEQ ID NO: 1579770 - RNA, 19 nt, Homo sapiens
ggaaacuugucuccaguga

SEQ ID NO: 1579771 - RNA, 19 nt, Homo sapiens
gaugugaucaccauuaaau

SEQ ID NO: 1579772 - RNA, 19 nt, Homo sapiens
gaaagucaagagcaccaua

SEQ ID NO: 1579773 - RNA, 19 nt, Homo sapiens
ggccaaaccuaacaugauc

SEQ ID NO: 1579774 - RNA, 19 nt, Homo sapiens
cuagaaaacucacaaaaug

SEQ ID NO: 1579775 - RNA, 19 nt, Homo sapiens
gugcagaaaugggauggaa

SEQ ID NO: 1579776 - RNA, 19 nt, Homo sapiens
ugauuuagcaagcaaguaa

SEQ ID NO: 1579777 - RNA, 19 nt, Homo sapiens
gacugaaguucgcauugaa

SEQ ID NO: 1579778 - RNA, 19 nt, Homo sapiens
ugguuacguugguuaaaua

SEQ ID NO: 1579779 - RNA, 19 nt, Homo sapiens
gguggaaugcgucaugaaa

SEQ ID NO: 1579780 - RNA, 19 nt, Homo sapiens
gaucaccauuaaaucugaa

SEQ ID NO: 1579781 - RNA, 19 nt, Homo sapiens
ccaggaauuugacgaaguc

SEQ ID NO: 1579782 - RNA, 19 nt, Homo sapiens
auacugagauuuccuucau

SEQ ID NO: 1579783 - RNA, 19 nt, Homo sapiens
gaaaacgagaggaugauaa

SEQ ID NO: 1579784 - RNA, 19 nt, Homo sapiens
ugaucaccauuaaaucuga

SEQ ID NO: 1579785 - RNA, 19 nt, Homo sapiens
caauaugguuacguugguu

SEQ ID NO: 1579786 - RNA, 19 nt, Homo sapiens
gaaguaggagugggcuuug

SEQ ID NO: 1579787 - RNA, 19 nt, Homo sapiens
ucaauaugguuacguuggu

SEQ ID NO: 1579788 - RNA, 19 nt, Homo sapiens
aaagucaagagcaccauaa

SEQ ID NO: 1579789 - RNA, 19 nt, Homo sapiens
gaaacuugucuccagugaa

SEQ ID NO: 1579790 - RNA, 19 nt, Homo sapiens
gcagaaaugggauggaaaa

SEQ ID NO: 1579791 - RNA, 19 nt, Homo sapiens
gccaggaauuugacgaagu

SEQ ID NO: 1579792 - RNA, 19 nt, Homo sapiens
gaacucuacaacauucugu

SEQ ID NO: 1579793 - RNA, 19 nt, Homo sapiens
ccugguacaugugcagaaa

SEQ ID NO: 1579794 - RNA, 19 nt, Homo sapiens
caacauucugugggauaua

SEQ ID NO: 1579795 - RNA, 19 nt, Homo sapiens
auaaacuggugguggaaug

SEQ ID NO: 1579796 - RNA, 19 nt, Homo sapiens
acgagaggaugauaaacug

SEQ ID NO: 1579797 - RNA, 19 nt, Homo sapiens
ugguacaugugcagaaaug

SEQ ID NO: 1579798 - RNA, 19 nt, Homo sapiens
uggaaugcgucaugaaagg

SEQ ID NO: 1579799 - RNA, 19 nt, Homo sapiens
ucugugggauauauuguuc

SEQ ID NO: 1579800 - RNA, 19 nt, Homo sapiens
cacugcagaugacaggaaa

SEQ ID NO: 1579801 - RNA, 19 nt, Homo sapiens
ugagauuuccuucauacug

SEQ ID NO: 1579802 - RNA, 19 nt, Homo sapiens
uacugagauuuccuucaua

SEQ ID NO: 1579803 - RNA, 19 nt, Homo sapiens
aacauucugugggauauau

SEQ ID NO: 1579804 - RNA, 19 nt, Homo sapiens
acaacauucugugggauau

SEQ ID NO: 1579805 - RNA, 19 nt, Homo sapiens
ggaugugaucaccauuaaa

SEQ ID NO: 1579806 - RNA, 19 nt, Homo sapiens
gggcuuugccaccaggaaa

SEQ ID NO: 1579807 - RNA, 19 nt, Homo sapiens
agaaguaggagugggcuuu

SEQ ID NO: 1579808 - RNA, 19 nt, Homo sapiens
gguuacguugguuaaauaa

SEQ ID NO: 1579809 - RNA, 19 nt, Homo sapiens
uacaacauucugugggaua

SEQ ID NO: 1579810 - RNA, 19 nt, Homo sapiens
ucaagagcaccauaaccuu

SEQ ID NO: 1579811 - RNA, 19 nt, Homo sapiens
ugugggauauauuguucaa

SEQ ID NO: 1579812 - RNA, 19 nt, Homo sapiens
cauugaacucuacaacauu

SEQ ID NO: 1579813 - RNA, 19 nt, Homo sapiens
gugguggaaugcgucauga

SEQ ID NO: 1579814 - RNA, 19 nt, Homo sapiens
auugaacucuacaacauuc

SEQ ID NO: 1579815 - RNA, 19 nt, Homo sapiens
aauaugguuacguugguua

SEQ ID NO: 1579816 - RNA, 19 nt, Homo sapiens
gaauaauccuagaaaacuc

SEQ ID NO: 1579817 - RNA, 19 nt, Homo sapiens
ucacugcagaugacaggaa

SEQ ID NO: 1579818 - RNA, 19 nt, Homo sapiens
gggccaggaauuugacgaa

SEQ ID NO: 1579819 - RNA, 19 nt, Homo sapiens
acugagauuuccuucauac

SEQ ID NO: 1579820 - RNA, 19 nt, Homo sapiens
gauaaacuggugguggaau

SEQ ID NO: 1579821 - RNA, 19 nt, Homo sapiens
cuugaagaauaauccuaga

SEQ ID NO: 1579822 - RNA, 19 nt, Homo sapiens
ggugguggaaugcgucaug

SEQ ID NO: 1579823 - RNA, 19 nt, Homo sapiens
gcggaucucuggccucauu

SEQ ID NO: 1579824 - RNA, 19 nt, Homo sapiens
ggaaaaggcuuaggcaaag

SEQ ID NO: 1579825 - RNA, 19 nt, Homo sapiens
gcggugugcugaagguguu

SEQ ID NO: 1579826 - RNA, 19 nt, Homo sapiens
ggaucucuggccucauuua

SEQ ID NO: 1579827 - RNA, 19 nt, Homo sapiens
gcuccagcuuugcacguuu

SEQ ID NO: 1579828 - RNA, 19 nt, Homo sapiens
ugaagguguuccuggagaa

SEQ ID NO: 1579829 - RNA, 19 nt, Homo sapiens
ucucuggccucauuuacga

SEQ ID NO: 1579830 - RNA, 19 nt, Homo sapiens
gaagguguuccuggagaau

SEQ ID NO: 1579831 - RNA, 19 nt, Homo sapiens
ucaccaagccugccauucg

SEQ ID NO: 1579832 - RNA, 19 nt, Homo sapiens
gagcacgccaagcgcaaga

SEQ ID NO: 1579833 - RNA, 19 nt, Homo sapiens
gcagaggaaagggcggaaa

SEQ ID NO: 1579834 - RNA, 19 nt, Homo sapiens
gcacguuucgaucccaaag

SEQ ID NO: 1579835 - RNA, 19 nt, Homo sapiens
gagaagcaguggauaaaua

SEQ ID NO: 1579836 - RNA, 19 nt, Homo sapiens
gaccauagcugagaacuaa

SEQ ID NO: 1579837 - RNA, 19 nt, Homo sapiens
gagauaaacuuccugaaug

SEQ ID NO: 1579838 - RNA, 19 nt, Homo sapiens
gagauaaacuuccugaaug

SEQ ID NO: 1579839 - RNA, 19 nt, Homo sapiens
gcaaugaugucacggauau

SEQ ID NO: 1579840 - RNA, 19 nt, Homo sapiens
gauaagaugugguuugaag

SEQ ID NO: 1579841 - RNA, 19 nt, Homo sapiens
aagaagcaguggauaaaua

SEQ ID NO: 1579842 - RNA, 19 nt, Homo sapiens
gauaagaagcaguggauaa

SEQ ID NO: 1579843 - RNA, 19 nt, Homo sapiens
gcgauaagaugugguuuga

SEQ ID NO: 1579844 - RNA, 19 nt, Homo sapiens
ucacggauaucgcagauga

SEQ ID NO: 1579845 - RNA, 19 nt, Homo sapiens
ggagauaaacuuccugaau

SEQ ID NO: 1579846 - RNA, 19 nt, Homo sapiens
ggagauaaacuuccugaau

SEQ ID NO: 1579847 - RNA, 19 nt, Homo sapiens
gugccacgcugaucaauga

SEQ ID NO: 1579848 - RNA, 19 nt, Homo sapiens
agaaggagauggaguauac

SEQ ID NO: 1579849 - RNA, 19 nt, Homo sapiens
cggaagcccuugccugaaa

SEQ ID NO: 1579850 - RNA, 19 nt, Homo sapiens
cgacugggaucuuaagcuu

SEQ ID NO: 1579851 - RNA, 19 nt, Homo sapiens
gaccaagaccaaugcauaa

SEQ ID NO: 1579852 - RNA, 19 nt, Homo sapiens
aaauaaggcuguuggagau

SEQ ID NO: 1579853 - RNA, 19 nt, Homo sapiens
aaauaaggcuguuggagau

SEQ ID NO: 1579854 - RNA, 19 nt, Homo sapiens
gauggaguauacaccuuaa

SEQ ID NO: 1579855 - RNA, 19 nt, Homo sapiens
gagauggaguguacaccuu

SEQ ID NO: 1579856 - RNA, 19 nt, Homo sapiens
gcaguggacucaggcaaug

SEQ ID NO: 1579857 - RNA, 19 nt, Homo sapiens
guaugcgacugggaucuua

SEQ ID NO: 1579858 - RNA, 19 nt, Homo sapiens
ugaccaagaccaaugcaua

SEQ ID NO: 1579859 - RNA, 19 nt, Homo sapiens
gcugaucaaugaacaaugg

SEQ ID NO: 1579860 - RNA, 19 nt, Homo sapiens
gauggaguguacaccuuaa

SEQ ID NO: 1579861 - RNA, 19 nt, Homo sapiens
ucaucaaacucaaacagaa

SEQ ID NO: 1579862 - RNA, 19 nt, Homo sapiens
agaaggagauggaguguac

SEQ ID NO: 1579863 - RNA, 19 nt, Homo sapiens
uaaauuuacugaccaucug

SEQ ID NO: 1579864 - RNA, 19 nt, Homo sapiens
gcaagaccaaccaagauga

SEQ ID NO: 1579865 - RNA, 19 nt, Homo sapiens
gcugugcuguggcugagua

SEQ ID NO: 1579866 - RNA, 19 nt, Homo sapiens
uaaacuuccugaaugugaa

SEQ ID NO: 1579867 - RNA, 19 nt, Homo sapiens
uaaacuuccugaaugugaa

SEQ ID NO: 1579868 - RNA, 19 nt, Homo sapiens
gagauggaguauacaccuu

SEQ ID NO: 1579869 - RNA, 19 nt, Homo sapiens
agauaaacuuccugaaugu

SEQ ID NO: 1579870 - RNA, 19 nt, Homo sapiens
agauaaacuuccugaaugu

SEQ ID NO: 1579871 - RNA, 19 nt, Homo sapiens
agaagcaguggauaaauaa

SEQ ID NO: 1579872 - RNA, 19 nt, Homo sapiens
agaagcaguggauaaauaa

SEQ ID NO: 1579873 - RNA, 19 nt, Homo sapiens
cugagucaaucaauaaaga

SEQ ID NO: 1579874 - RNA, 19 nt, Homo sapiens
ccaagaagacaccugcuau

SEQ ID NO: 1579875 - RNA, 19 nt, Homo sapiens
gaaaagaagacaccgaaga

SEQ ID NO: 1579876 - RNA, 19 nt, Homo sapiens
gacaggaguggaugcgaua

SEQ ID NO: 1579877 - RNA, 19 nt, Homo sapiens
gaaugaacacaccuucugu

SEQ ID NO: 1579878 - RNA, 19 nt, Homo sapiens
acugggaucuuaagcuuug

SEQ ID NO: 1579879 - RNA, 19 nt, Homo sapiens
gaggcaagaccaaccaaga

SEQ ID NO: 1579880 - RNA, 19 nt, Homo sapiens
gcagugccuuugccguuca

SEQ ID NO: 1579881 - RNA, 19 nt, Homo sapiens
caagaagacaccugcuaug

SEQ ID NO: 1579882 - RNA, 19 nt, Homo sapiens
uaaggcuguuggagauaaa

SEQ ID NO: 1579883 - RNA, 19 nt, Homo sapiens
uaaggcuguuggagauaaa

SEQ ID NO: 1579884 - RNA, 19 nt, Homo sapiens
auaaggcuguuggagauaa

SEQ ID NO: 1579885 - RNA, 19 nt, Homo sapiens
auaaggcuguuggagauaa

SEQ ID NO: 1579886 - RNA, 19 nt, Homo sapiens
cacagaaggagauggagua

SEQ ID NO: 1579887 - RNA, 19 nt, Homo sapiens
agaagaccauagcugagaa

SEQ ID NO: 1579888 - RNA, 19 nt, Homo sapiens
ggaagcccuugccugaaag

SEQ ID NO: 1579889 - RNA, 19 nt, Homo sapiens
gggcguguggguuauguuu

SEQ ID NO: 1579890 - RNA, 19 nt, Homo sapiens
gaguaugguguguauguga

SEQ ID NO: 1579891 - RNA, 19 nt, Homo sapiens
ccacgcugaucaaugaaca

SEQ ID NO: 1579892 - RNA, 19 nt, Homo sapiens
auaagaagcaguggauaaa

SEQ ID NO: 1579893 - RNA, 19 nt, Homo sapiens
gaguggaugcgauaagaug

SEQ ID NO: 1579894 - RNA, 19 nt, Homo sapiens
cagaagaccauagcugaga

SEQ ID NO: 1579895 - RNA, 19 nt, Homo sapiens
ggaggaggacaccugguau

SEQ ID NO: 1579896 - RNA, 19 nt, Homo sapiens
ggacucaggcaaugauguc

SEQ ID NO: 1579897 - RNA, 19 nt, Homo sapiens
cugaccaucugaaguaugu

SEQ ID NO: 1579898 - RNA, 19 nt, Homo sapiens
aaugagaagcaguggauaa

SEQ ID NO: 1579899 - RNA, 19 nt, Homo sapiens
ucgguucgcuaccagugua

SEQ ID NO: 1579900 - RNA, 19 nt, Homo sapiens
ucgguucgcuaccagugua

SEQ ID NO: 1579901 - RNA, 19 nt, Homo sapiens
cgagauugcacauggcuau

SEQ ID NO: 1579902 - RNA, 19 nt, Homo sapiens
gcacaguccccgaaaagaa

SEQ ID NO: 1579903 - RNA, 19 nt, Homo sapiens
cgagauugcacauggcuau

SEQ ID NO: 1579904 - RNA, 19 nt, Homo sapiens
gucaaucaauaaagagcuu

SEQ ID NO: 1579905 - RNA, 19 nt, Homo sapiens
agaaggugucuguuaauga

SEQ ID NO: 1579906 - RNA, 19 nt, Homo sapiens
ggcaagaccaaccaagaug

SEQ ID NO: 1579907 - RNA, 19 nt, Homo sapiens
agauggaguauacaccuua

SEQ ID NO: 1579908 - RNA, 19 nt, Homo sapiens
gaggaggacaccugguaug

SEQ ID NO: 1579909 - RNA, 19 nt, Homo sapiens
ugaaugaacacaccuucug

SEQ ID NO: 1579910 - RNA, 19 nt, Homo sapiens
gcguguggguuauguuucu

SEQ ID NO: 1579911 - RNA, 19 nt, Homo sapiens
aaguagggcguguggguua

SEQ ID NO: 1579912 - RNA, 19 nt, Homo sapiens
uugcugagucaaucaauaa

SEQ ID NO: 1579913 - RNA, 19 nt, Homo sapiens
gaugugguuugaagcugau

SEQ ID NO: 1579914 - RNA, 19 nt, Homo sapiens
gauaaauaaggcuguugga

SEQ ID NO: 1579915 - RNA, 19 nt, Homo sapiens
ggaguggacaggaguggau

SEQ ID NO: 1579916 - RNA, 19 nt, Homo sapiens
uagcugagaacuaaugcaa

SEQ ID NO: 1579917 - RNA, 19 nt, Homo sapiens
gcgcacagaaggagaugga

SEQ ID NO: 1579918 - RNA, 19 nt, Homo sapiens
gugcagcccauacugaaug

SEQ ID NO: 1579919 - RNA, 19 nt, Homo sapiens
gauaaauaaggcuguugga

SEQ ID NO: 1579920 - RNA, 19 nt, Homo sapiens
gcgcacagaaggagaugga

SEQ ID NO: 1579921 - RNA, 19 nt, Homo sapiens
gcaugucuaaguaccaaga

SEQ ID NO: 1579922 - RNA, 19 nt, Homo sapiens
gcuaccaguguaagaacua

SEQ ID NO: 1579923 - RNA, 19 nt, Homo sapiens
agauggaguguacaccuua

SEQ ID NO: 1579924 - RNA, 19 nt, Homo sapiens
gcuaccaguguaagaacua

SEQ ID NO: 1579925 - RNA, 19 nt, Homo sapiens
gaugcgauaagaugugguu

SEQ ID NO: 1579926 - RNA, 19 nt, Homo sapiens
ggcugaguaugguguguau

SEQ ID NO: 1579927 - RNA, 19 nt, Homo sapiens
guggauaaauaaggcuguu

SEQ ID NO: 1579928 - RNA, 19 nt, Homo sapiens
gcccugcauugcugaguca

SEQ ID NO: 1579929 - RNA, 19 nt, Homo sapiens
aggaguggaugcgauaaga

SEQ ID NO: 1579930 - RNA, 19 nt, Homo sapiens
ccauagcugagaacuaaug

SEQ ID NO: 1579931 - RNA, 19 nt, Homo sapiens
ggaucuuaagcuuugauaa

SEQ ID NO: 1579932 - RNA, 19 nt, Homo sapiens
uaagaagcaguggauaaau

SEQ ID NO: 1579933 - RNA, 19 nt, Homo sapiens
uggaggaggacaccuggua

SEQ ID NO: 1579934 - RNA, 19 nt, Homo sapiens
auaaacuuccugaauguga

SEQ ID NO: 1579935 - RNA, 19 nt, Homo sapiens
acaagaagcuuaagaagaa

SEQ ID NO: 1579936 - RNA, 19 nt, Homo sapiens
gaagagacacaguuacuuu

SEQ ID NO: 1579937 - RNA, 19 nt, Homo sapiens
ggagguggauuauagcaaa

SEQ ID NO: 1579938 - RNA, 19 nt, Homo sapiens
caaaucagcugcagagaag

SEQ ID NO: 1579939 - RNA, 19 nt, Homo sapiens
ggaagaagauuagugcaau

SEQ ID NO: 1579940 - RNA, 19 nt, Homo sapiens
gaagaagccagaagacaaa

SEQ ID NO: 1579941 - RNA, 19 nt, Homo sapiens
gaagaaaccgagcuuauca

SEQ ID NO: 1579942 - RNA, 19 nt, Homo sapiens
gagauggagugaacaaaga

SEQ ID NO: 1579943 - RNA, 19 nt, Homo sapiens
gcgaguauaugaacaacaa

SEQ ID NO: 1579944 - RNA, 19 nt, Homo sapiens
gcacagaaucgcugaagaa

SEQ ID NO: 1579945 - RNA, 19 nt, Homo sapiens
ugacccagauccuuucaua

SEQ ID NO: 1579946 - RNA, 19 nt, Homo sapiens
gcaaagauaaggaggaaga

SEQ ID NO: 1579947 - RNA, 19 nt, Homo sapiens
ggaaaccaaugacaaagca

SEQ ID NO: 1579948 - RNA, 19 nt, Homo sapiens
agacuacacugaccacaaa

SEQ ID NO: 1579949 - RNA, 19 nt, Homo sapiens
gaagaggaacugauggaaa

SEQ ID NO: 1579950 - RNA, 19 nt, Homo sapiens
gagaagagaagacaguuga

SEQ ID NO: 1579951 - RNA, 19 nt, Homo sapiens
agagagagcuagcagagaa

SEQ ID NO: 1579952 - RNA, 19 nt, Homo sapiens
gcaaagcaguguggguuga

SEQ ID NO: 1579953 - RNA, 19 nt, Homo sapiens
gaaagaaaccaagaaagau

SEQ ID NO: 1579954 - RNA, 19 nt, Homo sapiens
caaggaaaccaaugacaaa

SEQ ID NO: 1579955 - RNA, 19 nt, Homo sapiens
acaaggagcgggagagaua

SEQ ID NO: 1579956 - RNA, 19 nt, Homo sapiens
ggacuuugauacccaggaa

SEQ ID NO: 1579957 - RNA, 19 nt, Homo sapiens
ccaaggaguugaucaaguc

SEQ ID NO: 1579958 - RNA, 19 nt, Homo sapiens
agaaagaaaccaagaaaga

SEQ ID NO: 1579959 - RNA, 19 nt, Homo sapiens
gugaugaggagguggauua

SEQ ID NO: 1579960 - RNA, 19 nt, Homo sapiens
gaucaaguccaucaaugaa

SEQ ID NO: 1579961 - RNA, 19 nt, Homo sapiens
guaacaagaagcuuaagaa

SEQ ID NO: 1579962 - RNA, 19 nt, Homo sapiens
ggagauuucuuuggcaugu

SEQ ID NO: 1579963 - RNA, 19 nt, Homo sapiens
aagggaagcuggaagagaa

SEQ ID NO: 1579964 - RNA, 19 nt, Homo sapiens
aaucaaaacucaccaauga

SEQ ID NO: 1579965 - RNA, 19 nt, Homo sapiens
gcgaaagaacgauaacaaa

SEQ ID NO: 1579966 - RNA, 19 nt, Homo sapiens
cagcaaagauaaggaggaa

SEQ ID NO: 1579967 - RNA, 19 nt, Homo sapiens
ugacauggcuguggauagu

SEQ ID NO: 1579968 - RNA, 19 nt, Homo sapiens
guuggagacucgauuguug

SEQ ID NO: 1579969 - RNA, 19 nt, Homo sapiens
ccgcauggccuauguggua

SEQ ID NO: 1579970 - RNA, 19 nt, Homo sapiens
cauaugagcggaaugaguu

SEQ ID NO: 1579971 - RNA, 19 nt, Homo sapiens
ggaggaagaggaacugaug

SEQ ID NO: 1579972 - RNA, 19 nt, Homo sapiens
gaacggagagauggaguga

SEQ ID NO: 1579973 - RNA, 19 nt, Homo sapiens
ggaguacaaugaggaugaa

SEQ ID NO: 1579974 - RNA, 19 nt, Homo sapiens
gaggcugacaugaauauuu

SEQ ID NO: 1579975 - RNA, 19 nt, Homo sapiens
aacaagaaauugagagaga

SEQ ID NO: 1579976 - RNA, 19 nt, Homo sapiens
ugguagaccuggaugauga

SEQ ID NO: 1579977 - RNA, 19 nt, Homo sapiens
ccagaaagaaaccaagaaa

SEQ ID NO: 1579978 - RNA, 19 nt, Homo sapiens
gaucgccaguggaagaaga

SEQ ID NO: 1579979 - RNA, 19 nt, Homo sapiens
gcagggaacccguaacaag

SEQ ID NO: 1579980 - RNA, 19 nt, Homo sapiens
gaaaagccccagaaagaaa

SEQ ID NO: 1579981 - RNA, 19 nt, Homo sapiens
agacacaguuacuuugaga

SEQ ID NO: 1579982 - RNA, 19 nt, Homo sapiens
agaccuggaugaugaguau

SEQ ID NO: 1579983 - RNA, 19 nt, Homo sapiens
ggaccaggguaacaagaag

SEQ ID NO: 1579984 - RNA, 19 nt, Homo sapiens
gcagcugggagauuucuuu

SEQ ID NO: 1579985 - RNA, 19 nt, Homo sapiens
ugaagaagccagaagacaa

SEQ ID NO: 1579986 - RNA, 19 nt, Homo sapiens
gaaagaugaggauccugaa

SEQ ID NO: 1579987 - RNA, 19 nt, Homo sapiens
gaaaagaagagacacaguu

SEQ ID NO: 1579988 - RNA, 19 nt, Homo sapiens
caagacaccucgggacaag

SEQ ID NO: 1579989 - RNA, 19 nt, Homo sapiens
gcaccacagcuaacuauag

SEQ ID NO: 1579990 - RNA, 19 nt, Homo sapiens
caguguggguugauucuga

SEQ ID NO: 1579991 - RNA, 19 nt, Homo sapiens
ggagagauggagugaacaa

SEQ ID NO: 1579992 - RNA, 19 nt, Homo sapiens
caagcuacgccaacaagaa

SEQ ID NO: 1579993 - RNA, 19 nt, Homo sapiens
aaaagcagcugggagauuu

SEQ ID NO: 1579994 - RNA, 19 nt, Homo sapiens
caaagcauaugagcggaau

SEQ ID NO: 1579995 - RNA, 19 nt, Homo sapiens
aaagaaaccaagaaagaug

SEQ ID NO: 1579996 - RNA, 19 nt, Homo sapiens
gaagagaagacaguugauc

SEQ ID NO: 1579997 - RNA, 19 nt, Homo sapiens
gcagagaagagaagacagu

SEQ ID NO: 1579998 - RNA, 19 nt, Homo sapiens
gggaguacaaugaggauga

SEQ ID NO: 1579999 - RNA, 19 nt, Homo sapiens
ugaguaugcugacacagau

SEQ ID NO: 1580000 - RNA, 19 nt, Homo sapiens
ugacagcgaaagaacgaua

SEQ ID NO: 1580001 - RNA, 19 nt, Homo sapiens
ucaggaaacuucucaugac

SEQ ID NO: 1580002 - RNA, 19 nt, Homo sapiens
ucaaggaaaccaaugacaa

SEQ ID NO: 1580003 - RNA, 19 nt, Homo sapiens
uuagcaagcugacccagau

SEQ ID NO: 1580004 - RNA, 19 nt, Homo sapiens
augaggagguggauuauag

SEQ ID NO: 1580005 - RNA, 19 nt, Homo sapiens
gaugaggagguggauuaua

SEQ ID NO: 1580006 - RNA, 19 nt, Homo sapiens
ggacaaggagcgggagaga

SEQ ID NO: 1580007 - RNA, 19 nt, Homo sapiens
caagaaagaugaggauccu

SEQ ID NO: 1580008 - RNA, 19 nt, Homo sapiens
ggaagaggaacugauggaa

SEQ ID NO: 1580009 - RNA, 19 nt, Homo sapiens
gauccaggaguccaaauuc

SEQ ID NO: 1580010 - RNA, 19 nt, Homo sapiens
gcuugucgcugcgguguug

SEQ ID NO: 1580011 - RNA, 19 nt, Homo sapiens
gaagcuggaagagaagaaa

SEQ ID NO: 1580012 - RNA, 19 nt, Homo sapiens
cagggaacccguaacaaga

SEQ ID NO: 1580013 - RNA, 19 nt, Homo sapiens
cuacacugaccacaaauga

SEQ ID NO: 1580014 - RNA, 19 nt, Homo sapiens
gagugaacaaagauuauga

SEQ ID NO: 1580015 - RNA, 19 nt, Homo sapiens
gagacacaguuacuuugag

SEQ ID NO: 1580016 - RNA, 19 nt, Homo sapiens
ggagcgugaucgggaaaga

SEQ ID NO: 1580017 - RNA, 19 nt, Homo sapiens
uaacaagaagcuuaagaag

SEQ ID NO: 1580018 - RNA, 19 nt, Homo sapiens
aagaggaacugauggaaaa

SEQ ID NO: 1580019 - RNA, 19 nt, Homo sapiens
aaagguacgacuugagauu

SEQ ID NO: 1580020 - RNA, 19 nt, Homo sapiens
ccaggaguccaaauucuug

SEQ ID NO: 1580021 - RNA, 19 nt, Homo sapiens
caccacagcuaacuauagg

SEQ ID NO: 1580022 - RNA, 19 nt, Homo sapiens
ggagugaacaaagauuaug

SEQ ID NO: 1580023 - RNA, 19 nt, Homo sapiens
cuaagucacgucaccauga

SEQ ID NO: 1580024 - RNA, 19 nt, Homo sapiens
aaaagaagagacacaguua

SEQ ID NO: 1580025 - RNA, 19 nt, Homo sapiens
acaaaucagcugcagagaa

SEQ ID NO: 1580026 - RNA, 19 nt, Homo sapiens
ccaaggcugcauuccagua

SEQ ID NO: 1580027 - RNA, 19 nt, Homo sapiens
ucaaguccaucaaugaaaa

SEQ ID NO: 1580028 - RNA, 19 nt, Homo sapiens
gugaaaggcuuggauuuug

SEQ ID NO: 1580029 - RNA, 19 nt, Homo sapiens
caaagauuaugaagaaacc

SEQ ID NO: 1580030 - RNA, 19 nt, Homo sapiens
ugagagagagagagagcua

SEQ ID NO: 1580031 - RNA, 19 nt, Homo sapiens
caagaaauugagagagaga

SEQ ID NO: 1580032 - RNA, 19 nt, Homo sapiens
cgaaagaacgauaacaaaa

SEQ ID NO: 1580033 - RNA, 19 nt, Homo sapiens
gaggugcacugugggaaag

SEQ ID NO: 1580034 - RNA, 19 nt, Homo sapiens
ccgcaauguuuaccgaaug

SEQ ID NO: 1580035 - RNA, 19 nt, Homo sapiens
gaauguagcuugaguaaau

SEQ ID NO: 1580036 - RNA, 19 nt, Homo sapiens
gaacuugcuuugauguaua

SEQ ID NO: 1580037 - RNA, 19 nt, Homo sapiens
ggaaccaggugucugaaua

SEQ ID NO: 1580038 - RNA, 19 nt, Homo sapiens
gcaaauagcagcucaggaa

SEQ ID NO: 1580039 - RNA, 19 nt, Homo sapiens
caacugauaugucuaaaca

SEQ ID NO: 1580040 - RNA, 19 nt, Homo sapiens
gaaagagaccuccuaaaga

SEQ ID NO: 1580041 - RNA, 19 nt, Homo sapiens
gaagaaaguuacaaguuca

SEQ ID NO: 1580042 - RNA, 19 nt, Homo sapiens
caacacaaauucagaacuu

SEQ ID NO: 1580043 - RNA, 19 nt, Homo sapiens
ggaauuagacugguguuua

SEQ ID NO: 1580044 - RNA, 19 nt, Homo sapiens
caaaggcgaugucgagaaa

SEQ ID NO: 1580045 - RNA, 19 nt, Homo sapiens
ugaacucacugacuaauaa

SEQ ID NO: 1580046 - RNA, 19 nt, Homo sapiens
uaaccuacaugaugacuuu

SEQ ID NO: 1580047 - RNA, 19 nt, Homo sapiens
ggagagggcugaagcuguu

SEQ ID NO: 1580048 - RNA, 19 nt, Homo sapiens
ugacugaacucacugacua

SEQ ID NO: 1580049 - RNA, 19 nt, Homo sapiens
ucagugagauggcuucuaa

SEQ ID NO: 1580050 - RNA, 19 nt, Homo sapiens
ggcaauauccuucacuuua

SEQ ID NO: 1580051 - RNA, 19 nt, Homo sapiens
gaagaugguuauugacaug

SEQ ID NO: 1580052 - RNA, 19 nt, Homo sapiens
ggaaagagaccuccuaaag

SEQ ID NO: 1580053 - RNA, 19 nt, Homo sapiens
gaauuagacugguguuuag

SEQ ID NO: 1580054 - RNA, 19 nt, Homo sapiens
ucaggaagaugguuauuga

SEQ ID NO: 1580055 - RNA, 19 nt, Homo sapiens
cgaagaaaguuacaaguuc

SEQ ID NO: 1580056 - RNA, 19 nt, Homo sapiens
ggcgaugacuugauuguaa

SEQ ID NO: 1580057 - RNA, 19 nt, Homo sapiens
ggugauggcugaugauaau

SEQ ID NO: 1580058 - RNA, 19 nt, Homo sapiens
uaaguggagugaagaaauu

SEQ ID NO: 1580059 - RNA, 19 nt, Homo sapiens
caucauguaugcuauauuc

SEQ ID NO: 1580060 - RNA, 19 nt, Homo sapiens
uggaagaccugaacaaaug

SEQ ID NO: 1580061 - RNA, 19 nt, Homo sapiens
gagaaacaacuucacuaua

SEQ ID NO: 1580062 - RNA, 19 nt, Homo sapiens
ccaccuggccuuucaguua

SEQ ID NO: 1580063 - RNA, 19 nt, Homo sapiens
ccaggugucugaauacauu

SEQ ID NO: 1580064 - RNA, 19 nt, Homo sapiens
gaagaacacugugacaucu

SEQ ID NO: 1580065 - RNA, 19 nt, Homo sapiens
agaaacaacuucacuauac

SEQ ID NO: 1580066 - RNA, 19 nt, Homo sapiens
aaucucaucugacacauuu

SEQ ID NO: 1580067 - RNA, 19 nt, Homo sapiens
gaucagacagcgacuauga

SEQ ID NO: 1580068 - RNA, 19 nt, Homo sapiens
gcauagaacucagcagugu

SEQ ID NO: 1580069 - RNA, 19 nt, Homo sapiens
gcaauauccuucacuuuac

SEQ ID NO: 1580070 - RNA, 19 nt, Homo sapiens
guagaaacgaagaaaguua

SEQ ID NO: 1580071 - RNA, 19 nt, Homo sapiens
ucaugaaucucaccaagaa

SEQ ID NO: 1580072 - RNA, 19 nt, Homo sapiens
uggaaacgcuggaggaauu

SEQ ID NO: 1580073 - RNA, 19 nt, Homo sapiens
ugaggaagauucugaagga

SEQ ID NO: 1580074 - RNA, 19 nt, Homo sapiens
caacuucacuauacugaca

SEQ ID NO: 1580075 - RNA, 19 nt, Homo sapiens
ugagauggcuucuaacaag

SEQ ID NO: 1580076 - RNA, 19 nt, Homo sapiens
caaacugcauugaauaaca

SEQ ID NO: 1580077 - RNA, 19 nt, Homo sapiens
ggacagaccgcaucaugga

SEQ ID NO: 1580078 - RNA, 19 nt, Homo sapiens
ggacauucucgauaccuua

SEQ ID NO: 1580079 - RNA, 19 nt, Homo sapiens
ucaaacugcugcaagaaga

SEQ ID NO: 1580080 - RNA, 19 nt, Homo sapiens
gaaacaacuucacuauacu

SEQ ID NO: 1580081 - RNA, 19 nt, Homo sapiens
aaagagaccuccuaaagac

SEQ ID NO: 1580082 - RNA, 19 nt, Homo sapiens
acacggcgaugacuugauu

SEQ ID NO: 1580083 - RNA, 19 nt, Homo sapiens
uuaugaaucuucucacuug

SEQ ID NO: 1580084 - RNA, 19 nt, Homo sapiens
ggaagaugguuauugacau

SEQ ID NO: 1580085 - RNA, 19 nt, Homo sapiens
gagagaucauucugcacua

SEQ ID NO: 1580086 - RNA, 19 nt, Homo sapiens
uggcagaccugaagacaau

SEQ ID NO: 1580087 - RNA, 19 nt, Homo sapiens
ccagauaaguggagugaag

SEQ ID NO: 1580088 - RNA, 19 nt, Homo sapiens
gcauugcuauuacaacugu

SEQ ID NO: 1580089 - RNA, 19 nt, Homo sapiens
gcucaggacauucucgaua

SEQ ID NO: 1580090 - RNA, 19 nt, Homo sapiens
ccaaucaguuucucaucaa

SEQ ID NO: 1580091 - RNA, 19 nt, Homo sapiens
caugguacaucuaacaaga

SEQ ID NO: 1580092 - RNA, 19 nt, Homo sapiens
ggagugcuuugauguggaa

SEQ ID NO: 1580093 - RNA, 19 nt, Homo sapiens
caaacagacagaaaggaua

SEQ ID NO: 1580094 - RNA, 19 nt, Homo sapiens
gaaaauggaagacacaaaa

SEQ ID NO: 1580095 - RNA, 19 nt, Homo sapiens
uggagaaguuucaguuuga

SEQ ID NO: 1580096 - RNA, 19 nt, Homo sapiens
gacaugggcagauuuggua

SEQ ID NO: 1580097 - RNA, 19 nt, Homo sapiens
ucagcaaacugcauugaau

SEQ ID NO: 1580098 - RNA, 19 nt, Homo sapiens
gaauggaaauuagcccaau

SEQ ID NO: 1580099 - RNA, 19 nt, Homo sapiens
guucaagccuaaacaauac

SEQ ID NO: 1580100 - RNA, 19 nt, Homo sapiens
gcaaacagacagaaaggau

SEQ ID NO: 1580101 - RNA, 19 nt, Homo sapiens
uaauguggcuggauauucu

SEQ ID NO: 1580102 - RNA, 19 nt, Homo sapiens
gcaacacggcgaugacuug

SEQ ID NO: 1580103 - RNA, 19 nt, Homo sapiens
uugaauaccuggaguuuag

SEQ ID NO: 1580104 - RNA, 19 nt, Homo sapiens
uaaaaugccuguugaauac

SEQ ID NO: 1580105 - RNA, 19 nt, Homo sapiens
cagcaaacugcauugaaua

SEQ ID NO: 1580106 - RNA, 19 nt, Homo sapiens
ugacggugauggcugauga

SEQ ID NO: 1580107 - RNA, 19 nt, Homo sapiens
acauagacauugcaacaga

SEQ ID NO: 1580108 - RNA, 19 nt, Homo sapiens
gaaaauagucuuccuucuu

SEQ ID NO: 1580109 - RNA, 19 nt, Homo sapiens
acacagauaagcuuucaaa

SEQ ID NO: 1580110 - RNA, 19 nt, Homo sapiens
gagagggacacagcuauuu

SEQ ID NO: 1580111 - RNA, 19 nt, Homo sapiens
gccagggucugauggagaa

SEQ ID NO: 1580112 - RNA, 19 nt, Homo sapiens
ggaaacgcuggaggaauua

SEQ ID NO: 1580113 - RNA, 19 nt, Homo sapiens
ccaccucuauaaugaagaa

SEQ ID NO: 1580114 - RNA, 19 nt, Homo sapiens
aacaggaacugguaucaga

SEQ ID NO: 1580115 - RNA, 19 nt, Homo sapiens
ggaaauuagcccaaugugu

SEQ ID NO: 1580116 - RNA, 19 nt, Homo sapiens
agacagcgacuaugacuug

SEQ ID NO: 1580117 - RNA, 19 nt, Homo sapiens
ggagagggacacagcuauu

SEQ ID NO: 1580118 - RNA, 19 nt, Homo sapiens
cucgauaccuuagaagaua

SEQ ID NO: 1580119 - RNA, 19 nt, Homo sapiens
ggagacaugggcagauuug

SEQ ID NO: 1580120 - RNA, 19 nt, Homo sapiens
caacuauaccgaucgcauu

SEQ ID NO: 1580121 - RNA, 19 nt, Homo sapiens
guuagcaacugauaugucu

SEQ ID NO: 1580122 - RNA, 19 nt, Homo sapiens
gagggcagccugagguauu

SEQ ID NO: 1580123 - RNA, 19 nt, Homo sapiens
gcagaaugauguggagauc

SEQ ID NO: 1580124 - RNA, 19 nt, Homo sapiens
caggaaaucccacgguuga

SEQ ID NO: 1580125 - RNA, 19 nt, Homo sapiens
uagaagaccauuaccauuc

SEQ ID NO: 1580126 - RNA, 19 nt, Homo sapiens
caugaugacuuuagaagac

SEQ ID NO: 1580127 - RNA, 19 nt, Homo sapiens
augcauaguucaagccuaa

SEQ ID NO: 1580128 - RNA, 19 nt, Homo sapiens
gaauaccuggaguuuagua

SEQ ID NO: 1580129 - RNA, 19 nt, Homo sapiens
ugacauagacauugcaaca

SEQ ID NO: 1580130 - RNA, 19 nt, Homo sapiens
gauggcugaugauaauguu

SEQ ID NO: 1580131 - RNA, 19 nt, Homo sapiens
gauggagaaguuucaguuu

SEQ ID NO: 1580132 - RNA, 19 nt, Homo sapiens
agacaaugguagaaacgaa

SEQ ID NO: 1580133 - RNA, 19 nt, Homo sapiens
ugaugaaucuguguuggaa

SEQ ID NO: 1580134 - RNA, 19 nt, Homo sapiens
gagauggcuucuaacaagu

SEQ ID NO: 1580135 - RNA, 19 nt, Homo sapiens
gaacuuaaaugaagauguc

SEQ ID NO: 1580136 - RNA, 19 nt, Homo sapiens
caucauagcucuaacuuca

SEQ ID NO: 1580137 - RNA, 19 nt, Homo sapiens
gcucagaacuuaaaugaag

SEQ ID NO: 1580138 - RNA, 19 nt, Homo sapiens
gacaggaagugaauaagaa

SEQ ID NO: 1580139 - RNA, 19 nt, Homo sapiens
gcaagaugcuguugauucu

SEQ ID NO: 1580140 - RNA, 19 nt, Homo sapiens
gagagugauucaaaugauu

SEQ ID NO: 1580141 - RNA, 19 nt, Homo sapiens
gaaucucccucccuaauag

SEQ ID NO: 1580142 - RNA, 19 nt, Homo sapiens
ggagacaagucccaaaguc

SEQ ID NO: 1580143 - RNA, 19 nt, Homo sapiens
ggagacaagucccgaaguc

SEQ ID NO: 1580144 - RNA, 19 nt, Homo sapiens
ggaagugaauaagaagaug

SEQ ID NO: 1580145 - RNA, 19 nt, Homo sapiens
caucuaggauucaaugaca

SEQ ID NO: 1580146 - RNA, 19 nt, Homo sapiens
gcucagcucagaacuuaaa

SEQ ID NO: 1580147 - RNA, 19 nt, Homo sapiens
gaagugaauaagaagauga

SEQ ID NO: 1580148 - RNA, 19 nt, Homo sapiens
gaagaaucucccucccuaa

SEQ ID NO: 1580149 - RNA, 19 nt, Homo sapiens
cagcucagaacuuaaauga

SEQ ID NO: 1580150 - RNA, 19 nt, Homo sapiens
gaugagagugauucaaaug

SEQ ID NO: 1580151 - RNA, 19 nt, Homo sapiens
ucauagcucuaacuucaau

SEQ ID NO: 1580152 - RNA, 19 nt, Homo sapiens
gcacaaggaggcagcaagu

SEQ ID NO: 1580153 - RNA, 19 nt, Homo sapiens
ugagagugauucaaaugau

SEQ ID NO: 1580154 - RNA, 19 nt, Homo sapiens
ugacaggaagugaauaaga

SEQ ID NO: 1580155 - RNA, 19 nt, Homo sapiens
aagaugagagugauucaaa

SEQ ID NO: 1580156 - RNA, 19 nt, Homo sapiens
caacaagaaggcaacaauc

SEQ ID NO: 1580157 - RNA, 19 nt, Homo sapiens
aauaagaagaugagaguga

SEQ ID NO: 1580158 - RNA, 19 nt, Homo sapiens
ggaggcagcaagucccaaa

SEQ ID NO: 1580159 - RNA, 19 nt, Homo sapiens
ugaauaagaagaugagagu

SEQ ID NO: 1580160 - RNA, 19 nt, Homo sapiens
agaaucucccucccuaaua

SEQ ID NO: 1580161 - RNA, 19 nt, Homo sapiens
ggcagcaagucccaaagug

SEQ ID NO: 1580162 - RNA, 19 nt, Homo sapiens
gaagaugagagugauucaa

SEQ ID NO: 1580163 - RNA, 19 nt, Homo sapiens
ccaacaagaaggcaacaau

SEQ ID NO: 1580164 - RNA, 19 nt, Homo sapiens
ccaacaaggaggcaacaga

SEQ ID NO: 1580165 - RNA, 19 nt, Homo sapiens
ucaaugacaggaagugaau

SEQ ID NO: 1580166 - RNA, 19 nt, Homo sapiens
gaaggcaacaauccucaag

SEQ ID NO: 1580167 - RNA, 19 nt, Homo sapiens
aaugacaggaagugaauaa

SEQ ID NO: 1580168 - RNA, 19 nt, Homo sapiens
ugauucaaauuccaugaca

SEQ ID NO: 1580169 - RNA, 19 nt, Homo sapiens
ccagucaucuaggauucaa

SEQ ID NO: 1580170 - RNA, 19 nt, Homo sapiens
agaugagagugauucaaau

SEQ ID NO: 1580171 - RNA, 19 nt, Homo sapiens
caaggagacaagucccaaa

SEQ ID NO: 1580172 - RNA, 19 nt, Homo sapiens
auaagaagaugagagugau

SEQ ID NO: 1580173 - RNA, 19 nt, Homo sapiens
ccuaauagcaggaaaucca

SEQ ID NO: 1580174 - RNA, 19 nt, Homo sapiens
ccugcaagaugcuguugau

SEQ ID NO: 1580175 - RNA, 19 nt, Homo sapiens
gcucuaacuucaauauacc

SEQ ID NO: 1580176 - RNA, 19 nt, Homo sapiens
uccagagccuccugcaaga

SEQ ID NO: 1580177 - RNA, 19 nt, Homo sapiens
gauucaaauuccaugacau

SEQ ID NO: 1580178 - RNA, 19 nt, Homo sapiens
uaagaagaugagagugauu

SEQ ID NO: 1580179 - RNA, 19 nt, Homo sapiens
gaugucagccaggaagaau

SEQ ID NO: 1580180 - RNA, 19 nt, Homo sapiens
ccacaaggaggcaacaaac

SEQ ID NO: 1580181 - RNA, 19 nt, Homo sapiens
ccacaaggaggcaacaaac

SEQ ID NO: 1580182 - RNA, 19 nt, Homo sapiens
agcaggaaauccacaagga

SEQ ID NO: 1580183 - RNA, 19 nt, Homo sapiens
ccacaaggaggcaacaaac

SEQ ID NO: 1580184 - RNA, 19 nt, Homo sapiens
aagaaucucccucccuaau

SEQ ID NO: 1580185 - RNA, 19 nt, Homo sapiens
ucaaauuccaugacauugg

SEQ ID NO: 1580186 - RNA, 19 nt, Homo sapiens
acaaggaccacccgcacaa

SEQ ID NO: 1580187 - RNA, 19 nt, Homo sapiens
ugcaagaugcuguugauuc

SEQ ID NO: 1580188 - RNA, 19 nt, Homo sapiens
aggcaacaauccucaaggu

SEQ ID NO: 1580189 - RNA, 19 nt, Homo sapiens
cagagccuccugcaagaug

SEQ ID NO: 1580190 - RNA, 19 nt, Homo sapiens
gcuguugauucugcuguca

SEQ ID NO: 1580191 - RNA, 19 nt, Homo sapiens
ggucauagcucuaccuuua

SEQ ID NO: 1580192 - RNA, 19 nt, Homo sapiens
gacaggaagugaacaagaa

SEQ ID NO: 1580193 - RNA, 19 nt, Homo sapiens
gaagugaacaagaagauga

SEQ ID NO: 1580194 - RNA, 19 nt, Homo sapiens
ggaagaagguggucauagc

SEQ ID NO: 1580195 - RNA, 19 nt, Homo sapiens
gagcuuaaaugaagauguc

SEQ ID NO: 1580196 - RNA, 19 nt, Homo sapiens
gaaucucccuccguaauau

SEQ ID NO: 1580197 - RNA, 19 nt, Homo sapiens
gcaagaugcuacugauucu

SEQ ID NO: 1580198 - RNA, 19 nt, Homo sapiens
gacagugauucaaaugauu

SEQ ID NO: 1580199 - RNA, 19 nt, Homo sapiens
ugacagugauucaaaugau

SEQ ID NO: 1580200 - RNA, 19 nt, Homo sapiens
acaagaagaugacagugau

SEQ ID NO: 1580201 - RNA, 19 nt, Homo sapiens
uaaucaagguucaaugaca

SEQ ID NO: 1580202 - RNA, 19 nt, Homo sapiens
gaagaugacagugauucaa

SEQ ID NO: 1580203 - RNA, 19 nt, Homo sapiens
gaagaaucucccuccguaa

SEQ ID NO: 1580204 - RNA, 19 nt, Homo sapiens
ucauagcucuaccuuuaau

SEQ ID NO: 1580205 - RNA, 19 nt, Homo sapiens
gaagguggucauagcucua

SEQ ID NO: 1580206 - RNA, 19 nt, Homo sapiens
agaaucucccuccguaaua

SEQ ID NO: 1580207 - RNA, 19 nt, Homo sapiens
gaugacagugauucaaaug

SEQ ID NO: 1580208 - RNA, 19 nt, Homo sapiens
gggaaagccagaaggacaa

SEQ ID NO: 1580209 - RNA, 19 nt, Homo sapiens
ugacaggaagugaacaaga

SEQ ID NO: 1580210 - RNA, 19 nt, Homo sapiens
gaagaagguggucauagcu

SEQ ID NO: 1580211 - RNA, 19 nt, Homo sapiens
aagaugacagugauucaaa

SEQ ID NO: 1580212 - RNA, 19 nt, Homo sapiens
ggaagugaacaagaagaug

SEQ ID NO: 1580213 - RNA, 19 nt, Homo sapiens
agaugacagugauucaaau

SEQ ID NO: 1580214 - RNA, 19 nt, Homo sapiens
caagaagaugacagugauu

SEQ ID NO: 1580215 - RNA, 19 nt, Homo sapiens
gccaugacauuggaagaag

SEQ ID NO: 1580216 - RNA, 19 nt, Homo sapiens
ugauucaaaugccaugaca

SEQ ID NO: 1580217 - RNA, 19 nt, Homo sapiens
aguaaucaagguucaauga

SEQ ID NO: 1580218 - RNA, 19 nt, Homo sapiens
aacaagaagaugacaguga

SEQ ID NO: 1580219 - RNA, 19 nt, Homo sapiens
uccagagccuccagcaaga

SEQ ID NO: 1580220 - RNA, 19 nt, Homo sapiens
gaaggcaacaaaccucaac

SEQ ID NO: 1580221 - RNA, 19 nt, Homo sapiens
ugaacaagaagaugacagu

SEQ ID NO: 1580222 - RNA, 19 nt, Homo sapiens
gaugucagccaggaagaau

SEQ ID NO: 1580223 - RNA, 19 nt, Homo sapiens
aagaaucucccuccguaau

SEQ ID NO: 1580224 - RNA, 19 nt, Homo sapiens
gucauagcucuaccuuuaa

SEQ ID NO: 1580225 - RNA, 19 nt, Homo sapiens
ucacaaggaggcaacaaac

SEQ ID NO: 1580226 - RNA, 19 nt, Homo sapiens
caagguucaaugacaggaa

SEQ ID NO: 1580227 - RNA, 19 nt, Homo sapiens
ccacaagaaggcaacaaac

SEQ ID NO: 1580228 - RNA, 19 nt, Homo sapiens
gaaucucucuuccuaauau

SEQ ID NO: 1580229 - RNA, 19 nt, Homo sapiens
caaaugccuugaaacauaa

SEQ ID NO: 1580230 - RNA, 19 nt, Homo sapiens
ggaaaccagucccaaggua

SEQ ID NO: 1580231 - RNA, 19 nt, Homo sapiens
ggaaacaagucccgaagug

SEQ ID NO: 1580232 - RNA, 19 nt, Homo sapiens
gacaggaagugaauaagaa

SEQ ID NO: 1580233 - RNA, 19 nt, Homo sapiens
auaagaagaugacaguguu

SEQ ID NO: 1580234 - RNA, 19 nt, Homo sapiens
ggaagugaauaagaagaug

SEQ ID NO: 1580235 - RNA, 19 nt, Homo sapiens
gaagugaauaagaagauga

SEQ ID NO: 1580236 - RNA, 19 nt, Homo sapiens
gcgagaugcuguugauucu

SEQ ID NO: 1580237 - RNA, 19 nt, Homo sapiens
gaagaugacaguguuucaa

SEQ ID NO: 1580238 - RNA, 19 nt, Homo sapiens
gaugacaguguuucaaaug

SEQ ID NO: 1580239 - RNA, 19 nt, Homo sapiens
cagcugagaguucaaguga

SEQ ID NO: 1580240 - RNA, 19 nt, Homo sapiens
ugacaggaagugaauaaga

SEQ ID NO: 1580241 - RNA, 19 nt, Homo sapiens
gaaggacgacgcccacaag

SEQ ID NO: 1580242 - RNA, 19 nt, Homo sapiens
gaucaugcucuaacuucaa

SEQ ID NO: 1580243 - RNA, 19 nt, Homo sapiens
ugaauaagaagaugacagu

SEQ ID NO: 1580244 - RNA, 19 nt, Homo sapiens
auaaugugaucaugcucua

SEQ ID NO: 1580245 - RNA, 19 nt, Homo sapiens
gacaacagccuccccagua

SEQ ID NO: 1580246 - RNA, 19 nt, Homo sapiens
ucaaugacaggaagugaau

SEQ ID NO: 1580247 - RNA, 19 nt, Homo sapiens
uaagaagaugacaguguuu

SEQ ID NO: 1580248 - RNA, 19 nt, Homo sapiens
aaugacaggaagugaauaa

SEQ ID NO: 1580249 - RNA, 19 nt, Homo sapiens
aagaugacaguguuucaaa

SEQ ID NO: 1580250 - RNA, 19 nt, Homo sapiens
ggacccuccugcuggaaag

SEQ ID NO: 1580251 - RNA, 19 nt, Homo sapiens
agaugacaguguuucaaau

SEQ ID NO: 1580252 - RNA, 19 nt, Homo sapiens
aauaagaagaugacagugu

SEQ ID NO: 1580253 - RNA, 19 nt, Homo sapiens
gcucuaacuucaauauacc

SEQ ID NO: 1580254 - RNA, 19 nt, Homo sapiens
ugaucaugcucuaacuuca

SEQ ID NO: 1580255 - RNA, 19 nt, Homo sapiens
ccaacaagaaggcaacaag

SEQ ID NO: 1580256 - RNA, 19 nt, Homo sapiens
ccacaggaaggaaacaagu

SEQ ID NO: 1580257 - RNA, 19 nt, Homo sapiens
gugaucaugcucuaacuuc

SEQ ID NO: 1580258 - RNA, 19 nt, Homo sapiens
gaugucagccaggaagaau

SEQ ID NO: 1580259 - RNA, 19 nt, Homo sapiens
agaaucucucuuccuaaua

SEQ ID NO: 1580260 - RNA, 19 nt, Homo sapiens
acaacagccuccccaguaa

SEQ ID NO: 1580261 - RNA, 19 nt, Homo sapiens
gcuguugauucugcuguca

SEQ ID NO: 1580262 - RNA, 19 nt, Homo sapiens
ggaaaugucugcagaguug

SEQ ID NO: 1580263 - RNA, 19 nt, Homo sapiens
ucucuaaccucuccuauua

SEQ ID NO: 1580264 - RNA, 19 nt, Homo sapiens
gaacgaaaguaaagauguu

SEQ ID NO: 1580265 - RNA, 19 nt, Homo sapiens
ggacuuauggguaauguua

SEQ ID NO: 1580266 - RNA, 19 nt, Homo sapiens
ugaaaggacuuauggguaa

SEQ ID NO: 1580267 - RNA, 19 nt, Homo sapiens
gaucagaguucacuuucuu

SEQ ID NO: 1580268 - RNA, 19 nt, Homo sapiens
caucaacacugccucaauu

SEQ ID NO: 1580269 - RNA, 19 nt, Homo sapiens
uaaccaagauggaugcaaa

SEQ ID NO: 1580270 - RNA, 19 nt, Homo sapiens
ggaauuacccaguuuguug

SEQ ID NO: 1580271 - RNA, 19 nt, Homo sapiens
gaaauuugacccagaacua

SEQ ID NO: 1580272 - RNA, 19 nt, Homo sapiens
gauaauugauggagagaug

SEQ ID NO: 1580273 - RNA, 19 nt, Homo sapiens
caaaugagauuguggaaaa

SEQ ID NO: 1580274 - RNA, 19 nt, Homo sapiens
gcuaugagguuaaugaagu

SEQ ID NO: 1580275 - RNA, 19 nt, Homo sapiens
gcacuucacgcaucaguuu

SEQ ID NO: 1580276 - RNA, 19 nt, Homo sapiens
guaguucucagcaauaaua

SEQ ID NO: 1580277 - RNA, 19 nt, Homo sapiens
gagagacuauuaagauugu

SEQ ID NO: 1580278 - RNA, 19 nt, Homo sapiens
acagugcacuacauacuua

SEQ ID NO: 1580279 - RNA, 19 nt, Homo sapiens
gauugaagauuaugugcaa

SEQ ID NO: 1580280 - RNA, 19 nt, Homo sapiens
ucuaaccucuccuauuaua

SEQ ID NO: 1580281 - RNA, 19 nt, Homo sapiens
ggagaaaggagucauacuu

SEQ ID NO: 1580282 - RNA, 19 nt, Homo sapiens
gaauuuggguuguguaugc

SEQ ID NO: 1580283 - RNA, 19 nt, Homo sapiens
gaccagagcaggcagauga

SEQ ID NO: 1580284 - RNA, 19 nt, Homo sapiens
gaucuacccuccucaaguc

SEQ ID NO: 1580285 - RNA, 19 nt, Homo sapiens
gaaacccacuccaaacaca

SEQ ID NO: 1580286 - RNA, 19 nt, Homo sapiens
aaacgcugauuacagauaa

SEQ ID NO: 1580287 - RNA, 19 nt, Homo sapiens
gagaaaggagucauacuug

SEQ ID NO: 1580288 - RNA, 19 nt, Homo sapiens
ucaaauucaugaccagaaa

SEQ ID NO: 1580289 - RNA, 19 nt, Homo sapiens
acauugaucugcugacaaa

SEQ ID NO: 1580290 - RNA, 19 nt, Homo sapiens
caugauguuugcauucuuu

SEQ ID NO: 1580291 - RNA, 19 nt, Homo sapiens
guggaugcuucguuaauuu

SEQ ID NO: 1580292 - RNA, 19 nt, Homo sapiens
ccugacaccuuucaaauuc

SEQ ID NO: 1580293 - RNA, 19 nt, Homo sapiens
gcaaacgcuuuaugcugaa

SEQ ID NO: 1580294 - RNA, 19 nt, Homo sapiens
gcaggcagaugaaauacca

SEQ ID NO: 1580295 - RNA, 19 nt, Homo sapiens
ggagagacuauuaagauug

SEQ ID NO: 1580296 - RNA, 19 nt, Homo sapiens
gaugauguaugccacaauc

SEQ ID NO: 1580297 - RNA, 19 nt, Homo sapiens
ccauaagacugaccuuuua

SEQ ID NO: 1580298 - RNA, 19 nt, Homo sapiens
gaaaggagucauacuugug

SEQ ID NO: 1580299 - RNA, 19 nt, Homo sapiens
ugauaucaaucccacagua

SEQ ID NO: 1580300 - RNA, 19 nt, Homo sapiens
aaaccgagguguauguaug

SEQ ID NO: 1580301 - RNA, 19 nt, Homo sapiens
caacuuacaaugcugacua

SEQ ID NO: 1580302 - RNA, 19 nt, Homo sapiens
gaaugugccauaagacuga

SEQ ID NO: 1580303 - RNA, 19 nt, Homo sapiens
gguugaauguuuguccuua

SEQ ID NO: 1580304 - RNA, 19 nt, Homo sapiens
caugaugcauuagaaguaa

SEQ ID NO: 1580305 - RNA, 19 nt, Homo sapiens
ggcuaucacuucaaacuga

SEQ ID NO: 1580306 - RNA, 19 nt, Homo sapiens
aaacacagugcacuacaua

SEQ ID NO: 1580307 - RNA, 19 nt, Homo sapiens
ucacuucguuucuccuauu

SEQ ID NO: 1580308 - RNA, 19 nt, Homo sapiens
uuauauggcugguaacaug

SEQ ID NO: 1580309 - RNA, 19 nt, Homo sapiens
agguaucagugcauuauua

SEQ ID NO: 1580310 - RNA, 19 nt, Homo sapiens
ucguauugcugcugaauuu

SEQ ID NO: 1580311 - RNA, 19 nt, Homo sapiens
gggguuaccucucugaaua

SEQ ID NO: 1580312 - RNA, 19 nt, Homo sapiens
cuuaacaucuucuguaaca

SEQ ID NO: 1580313 - RNA, 19 nt, Homo sapiens
gugaaacucuggcuagaca

SEQ ID NO: 1580314 - RNA, 19 nt, Homo sapiens
gaaguggguuuucaaauca

SEQ ID NO: 1580315 - RNA, 19 nt, Homo sapiens
gaaauacaacuaucaacag

SEQ ID NO: 1580316 - RNA, 19 nt, Homo sapiens
cuaaguaguucucagcaau

SEQ ID NO: 1580317 - RNA, 19 nt, Homo sapiens
uaagaucagaguucacuuu

SEQ ID NO: 1580318 - RNA, 19 nt, Homo sapiens
aaacagguaucagugcauu

SEQ ID NO: 1580319 - RNA, 19 nt, Homo sapiens
gaaaggacuuauggguaau

SEQ ID NO: 1580320 - RNA, 19 nt, Homo sapiens
gaauuacccaguuuguuga

SEQ ID NO: 1580321 - RNA, 19 nt, Homo sapiens
gaccagaaauacaacuauc

SEQ ID NO: 1580322 - RNA, 19 nt, Homo sapiens
gcagcuuccugauucaaau

SEQ ID NO: 1580323 - RNA, 19 nt, Homo sapiens
uuuggaacguugugaauaa

SEQ ID NO: 1580324 - RNA, 19 nt, Homo sapiens
gcaccauucuccuugaaag

SEQ ID NO: 1580325 - RNA, 19 nt, Homo sapiens
gagcaccauucuccuugaa

SEQ ID NO: 1580326 - RNA, 19 nt, Homo sapiens
gcugaagcccuaugaauca

SEQ ID NO: 1580327 - RNA, 19 nt, Homo sapiens
caacaaacaauuccaguac

SEQ ID NO: 1580328 - RNA, 19 nt, Homo sapiens
gcaauuaugaguuaugucu

SEQ ID NO: 1580329 - RNA, 19 nt, Homo sapiens
caaacgcugauuacagaua

SEQ ID NO: 1580330 - RNA, 19 nt, Homo sapiens
agacugaccuuuuaaaaug

SEQ ID NO: 1580331 - RNA, 19 nt, Homo sapiens
ucaagucccugagcaucua

SEQ ID NO: 1580332 - RNA, 19 nt, Homo sapiens
guuuaagccuacaaucauu

SEQ ID NO: 1580333 - RNA, 19 nt, Homo sapiens
caguauaagugcgauugua

SEQ ID NO: 1580334 - RNA, 19 nt, Homo sapiens
gcuagugccucagagagaa

SEQ ID NO: 1580335 - RNA, 19 nt, Homo sapiens
gguaucagugcauuauuaa

SEQ ID NO: 1580336 - RNA, 19 nt, Homo sapiens
ugauuggcauauugagaua

SEQ ID NO: 1580337 - RNA, 19 nt, Homo sapiens
uaaguaguucucagcaaua

SEQ ID NO: 1580338 - RNA, 19 nt, Homo sapiens
agaaaggagucauacuugu

SEQ ID NO: 1580339 - RNA, 19 nt, Homo sapiens
ugaagaacuuacaggagaa

SEQ ID NO: 1580340 - RNA, 19 nt, Homo sapiens
uaucacaggcuuccauuga

SEQ ID NO: 1580341 - RNA, 19 nt, Homo sapiens
gcucagccauacagcaaau

SEQ ID NO: 1580342 - RNA, 19 nt, Homo sapiens
caacagaguaugcgaugug

SEQ ID NO: 1580343 - RNA, 19 nt, Homo sapiens
cuacauacuuacccacuuc

SEQ ID NO: 1580344 - RNA, 19 nt, Homo sapiens
uaacauugaucugcugaca

SEQ ID NO: 1580345 - RNA, 19 nt, Homo sapiens
caaacacagugcacuacau

SEQ ID NO: 1580346 - RNA, 19 nt, Homo sapiens
aaaguuacguucccauucu

SEQ ID NO: 1580347 - RNA, 19 nt, Homo sapiens
agaguucacuuucuuugga

SEQ ID NO: 1580348 - RNA, 19 nt, Homo sapiens
gaauuuaacacccucuauc

SEQ ID NO: 1580349 - RNA, 19 nt, Homo sapiens
gggguggacuuaaaucaua

SEQ ID NO: 1580350 - RNA, 19 nt, Homo sapiens
gggucuaccuuuaaaauaa

SEQ ID NO: 1580351 - RNA, 19 nt, Homo sapiens
guauugcugcugaauuuaa

SEQ ID NO: 1580352 - RNA, 19 nt, Homo sapiens
aagauuaugugcaacacuu

SEQ ID NO: 1580353 - RNA, 19 nt, Homo sapiens
cgaaaugcaauuaugaguu

SEQ ID NO: 1580354 - RNA, 19 nt, Homo sapiens
gaacguugugaauaacauu

SEQ ID NO: 1580355 - RNA, 19 nt, Homo sapiens
uaggagagacuauuaagau

SEQ ID NO: 1580356 - RNA, 19 nt, Homo sapiens
acaagcaggcuaauacuga

SEQ ID NO: 1580357 - RNA, 19 nt, Homo sapiens
ggaacguugugaauaacau

SEQ ID NO: 1580358 - RNA, 19 nt, Homo sapiens
uacguucccauucuaauua

SEQ ID NO: 1580359 - RNA, 19 nt, Homo sapiens
cuaugagguuaaugaagua

SEQ ID NO: 1580360 - RNA, 19 nt, Homo sapiens
ugucacuacucuaaagauu

SEQ ID NO: 1580361 - RNA, 19 nt, Homo sapiens
uaaaagaacguucgacuga

SEQ ID NO: 1580362 - RNA, 19 nt, Homo sapiens
gaaaugugcugcccuauga

SEQ ID NO: 1580363 - RNA, 19 nt, Homo sapiens
ucacagaucuccagaauga

SEQ ID NO: 1580364 - RNA, 19 nt, Homo sapiens
ccaaaucagucuucuauaa

SEQ ID NO: 1580365 - RNA, 19 nt, Homo sapiens
gaaugaaggucgugucuca

SEQ ID NO: 1580366 - RNA, 19 nt, Homo sapiens
ggagaaagacggaguaaau

SEQ ID NO: 1580367 - RNA, 19 nt, Homo sapiens
ggagaaagacggaguaaau

SEQ ID NO: 1580368 - RNA, 19 nt, Homo sapiens
guacugacaucacccuaaa

SEQ ID NO: 1580369 - RNA, 19 nt, Homo sapiens
ggaaugacguagccaguuc

SEQ ID NO: 1580370 - RNA, 19 nt, Homo sapiens
gagaaagacggaguaaaua

SEQ ID NO: 1580371 - RNA, 19 nt, Homo sapiens
gagaaagacggaguaaaua

SEQ ID NO: 1580372 - RNA, 19 nt, Homo sapiens
agaaggaagucccguauga

SEQ ID NO: 1580373 - RNA, 19 nt, Homo sapiens
ggucacagaucuccagaau

SEQ ID NO: 1580374 - RNA, 19 nt, Homo sapiens
ccaaugaggucacagaucu

SEQ ID NO: 1580375 - RNA, 19 nt, Homo sapiens
ucagggaucuggucuuuag

SEQ ID NO: 1580376 - RNA, 19 nt, Homo sapiens
gaacccggguguuuguaug

SEQ ID NO: 1580377 - RNA, 19 nt, Homo sapiens
gaacccggguguuuguaug

SEQ ID NO: 1580378 - RNA, 19 nt, Homo sapiens
ccaagaaccgcuacagaaa

SEQ ID NO: 1580379 - RNA, 19 nt, Homo sapiens
gaaugaaacucagacuaag

SEQ ID NO: 1580380 - RNA, 19 nt, Homo sapiens
agaaugaaacucagacuaa

SEQ ID NO: 1580381 - RNA, 19 nt, Homo sapiens
gaauuugggucuggaguuc

SEQ ID NO: 1580382 - RNA, 19 nt, Homo sapiens
ccacagaacucgaccuacu

SEQ ID NO: 1580383 - RNA, 19 nt, Homo sapiens
ucacagaacuccaacuacu

SEQ ID NO: 1580384 - RNA, 19 nt, Homo sapiens
gugaggaagugauggagaa

SEQ ID NO: 1580385 - RNA, 19 nt, Homo sapiens
ugacaucacccuaaaggaa

SEQ ID NO: 1580386 - RNA, 19 nt, Homo sapiens
gcacaacagagacucgaaa

SEQ ID NO: 1580387 - RNA, 19 nt, Homo sapiens
gccaagaaccgcuacagaa

SEQ ID NO: 1580388 - RNA, 19 nt, Homo sapiens
ggucauugccggagccuuu

SEQ ID NO: 1580389 - RNA, 19 nt, Homo sapiens
gcccauacccucaggacua

SEQ ID NO: 1580390 - RNA, 19 nt, Homo sapiens
ggagauugguaacuaguac

SEQ ID NO: 1580391 - RNA, 19 nt, Homo sapiens
gcacagacccacagaacuc

SEQ ID NO: 1580392 - RNA, 19 nt, Homo sapiens
ggaaagaauggaaucaaca

SEQ ID NO: 1580393 - RNA, 19 nt, Homo sapiens
aagaaccgcuacagaaaug

SEQ ID NO: 1580394 - RNA, 19 nt, Homo sapiens
cuacgaggccuuugaguug

SEQ ID NO: 1580395 - RNA, 19 nt, Homo sapiens
caacaucaccguggauaga

SEQ ID NO: 1580396 - RNA, 19 nt, Homo sapiens
gaacagagacucgaaacac

SEQ ID NO: 1580397 - RNA, 19 nt, Homo sapiens
caggacagaucuucaugug

SEQ ID NO: 1580398 - RNA, 19 nt, Homo sapiens
gggaaagaauggaaucaac

SEQ ID NO: 1580399 - RNA, 19 nt, Homo sapiens
guaaggaagaugagagaga

SEQ ID NO: 1580400 - RNA, 19 nt, Homo sapiens
gaugguggcuucggcuuca

SEQ ID NO: 1580401 - RNA, 19 nt, Homo sapiens
ccuucuaucccauaauuua

SEQ ID NO: 1580402 - RNA, 19 nt, Homo sapiens
caagaaccgcuacagaaau

SEQ ID NO: 1580403 - RNA, 19 nt, Homo sapiens
ugaagaggaggaauaagaa

SEQ ID NO: 1580404 - RNA, 19 nt, Homo sapiens
gcagaacagagacucgaaa

SEQ ID NO: 1580405 - RNA, 19 nt, Homo sapiens
ccacauacccagacacagu

SEQ ID NO: 1580406 - RNA, 19 nt, Homo sapiens
ugacaagccucagcaagca

SEQ ID NO: 1580407 - RNA, 19 nt, Homo sapiens
gaugguggcagaacagaga

SEQ ID NO: 1580408 - RNA, 19 nt, Homo sapiens
gaaaccaaaucagucuucu

SEQ ID NO: 1580409 - RNA, 19 nt, Homo sapiens
ggaagucccguaugaggau

SEQ ID NO: 1580410 - RNA, 19 nt, Homo sapiens
gggugaagugugagcauua

SEQ ID NO: 1580411 - RNA, 19 nt, Homo sapiens
ccaaugagacgugguacaa

SEQ ID NO: 1580412 - RNA, 19 nt, Homo sapiens
caccguggauggacuugaa

SEQ ID NO: 1580413 - RNA, 19 nt, Homo sapiens
ggaauuugggucuggaguu

SEQ ID NO: 1580414 - RNA, 19 nt, Homo sapiens
gccaggcucugacuacauc

SEQ ID NO: 1580415 - RNA, 19 nt, Homo sapiens
acucagggaucuggucuuu

SEQ ID NO: 1580416 - RNA, 19 nt, Homo sapiens
acucucaguuguacguaua

SEQ ID NO: 1580417 - RNA, 19 nt, Homo sapiens
aagcaggacuggaccaaca

SEQ ID NO: 1580418 - RNA, 19 nt, Homo sapiens
gugagaaaccuccauaugg

SEQ ID NO: 1580419 - RNA, 19 nt, Homo sapiens
gaaagaauggaaucaacag

SEQ ID NO: 1580420 - RNA, 19 nt, Homo sapiens
ggaggaauaagaagaagca

SEQ ID NO: 1580421 - RNA, 19 nt, Homo sapiens
gggaggcugugucuguguu

SEQ ID NO: 1580422 - RNA, 19 nt, Homo sapiens
gcuacgaggccuuugaguu

SEQ ID NO: 1580423 - RNA, 19 nt, Homo sapiens
cgagaggaaugaggucaga

SEQ ID NO: 1580424 - RNA, 19 nt, Homo sapiens
ccagugagaaaccuccaua

SEQ ID NO: 1580425 - RNA, 19 nt, Homo sapiens
ccaccauccacauguauuu

SEQ ID NO: 1580426 - RNA, 19 nt, Homo sapiens
ggacaucccagcugaagac

SEQ ID NO: 1580427 - RNA, 19 nt, Homo sapiens
gaaagacggaguaaauagc

SEQ ID NO: 1580428 - RNA, 19 nt, Homo sapiens
acagagacccgaaacacaa

SEQ ID NO: 1580429 - RNA, 19 nt, Homo sapiens
gaaagacggaguaaauagc

SEQ ID NO: 1580430 - RNA, 19 nt, Homo sapiens
uagcuuggauucccuaggu

SEQ ID NO: 1580431 - RNA, 19 nt, Homo sapiens
caaguuggaggucuaagug

SEQ ID NO: 1580432 - RNA, 19 nt, Homo sapiens
cauccaggcccacaaguug

SEQ ID NO: 1580433 - RNA, 19 nt, Homo sapiens
acagaucuccagaaugaaa

SEQ ID NO: 1580434 - RNA, 19 nt, Homo sapiens
gcacaggaacccucauugc

SEQ ID NO: 1580435 - RNA, 19 nt, Homo sapiens
acccgaaacacaacaaaua

SEQ ID NO: 1580436 - RNA, 19 nt, Homo sapiens
ccaugugggugggaaagaa

SEQ ID NO: 1580437 - RNA, 19 nt, Homo sapiens
aaccaaaucagucuucuau

SEQ ID NO: 1580438 - RNA, 19 nt, Homo sapiens
gggaugauagcuuggauuc

SEQ ID NO: 1580439 - RNA, 19 nt, Homo sapiens
cugaagaggaggaauaaga

SEQ ID NO: 1580440 - RNA, 19 nt, Homo sapiens
aaugagacgugguacaaag

SEQ ID NO: 1580441 - RNA, 19 nt, Homo sapiens
cagaaugaaacucagacua

SEQ ID NO: 1580442 - RNA, 19 nt, Homo sapiens
cgagugcacuggagauggu

SEQ ID NO: 1580443 - RNA, 19 nt, Homo sapiens
cagagaacaacgccaagaa

SEQ ID NO: 1580444 - RNA, 19 nt, Homo sapiens
gaagaggaggaauaagaag

SEQ ID NO: 1580445 - RNA, 19 nt, Homo sapiens
ccggaaccuuguacacauu

SEQ ID NO: 1580446 - RNA, 19 nt, Homo sapiens
gcacagagacccgaaacac

SEQ ID NO: 1580447 - RNA, 19 nt, Homo sapiens
caccguggauagacuugaa

SEQ ID NO: 1580448 - RNA, 19 nt, Homo sapiens
ugaguacacuggagauggu

SEQ ID NO: 1580449 - RNA, 19 nt, Homo sapiens
ugaguacacuggagauggu

SEQ ID NO: 1580450 - RNA, 19 nt, Homo sapiens
ggccacagccagucucaga

SEQ ID NO: 1580451 - RNA, 19 nt, Homo sapiens
gguacugacaucacccuaa

SEQ ID NO: 1580452 - RNA, 19 nt, Homo sapiens
caacagagacucgaaacac

SEQ ID NO: 1580453 - RNA, 19 nt, Homo sapiens
gaaacacaacagccaccaa

SEQ ID NO: 1580454 - RNA, 19 nt, Homo sapiens
gggcugguaucccaaacuc

SEQ ID NO: 1580455 - RNA, 19 nt, Homo sapiens
caucaaugccagcuucaug

SEQ ID NO: 1580456 - RNA, 19 nt, Homo sapiens
gaaccgcuacagaaaugug

SEQ ID NO: 1580457 - RNA, 19 nt, Homo sapiens
agaaagacggaguaaauag

SEQ ID NO: 1580458 - RNA, 19 nt, Homo sapiens
aaacucagacuaagaacuc

SEQ ID NO: 1580459 - RNA, 19 nt, Homo sapiens
gaggucagaggcuauaaca

SEQ ID NO: 1580460 - RNA, 19 nt, Homo sapiens
agaaagacggaguaaauag

SEQ ID NO: 1580461 - RNA, 19 nt, Homo sapiens
gagaaggaagucccguaug

SEQ ID NO: 1580462 - RNA, 19 nt, Homo sapiens
gaaauccaguacacagaua

SEQ ID NO: 1580463 - RNA, 19 nt, Homo sapiens
gaauuugacuccuucgaaa

SEQ ID NO: 1580464 - RNA, 19 nt, Homo sapiens
gaccauaaauacaagauga

SEQ ID NO: 1580465 - RNA, 19 nt, Homo sapiens
gaccauaaauacaagauga

SEQ ID NO: 1580466 - RNA, 19 nt, Homo sapiens
gaccauaaauacaagauga

SEQ ID NO: 1580467 - RNA, 19 nt, Homo sapiens
ccacauccaugaauacuug

SEQ ID NO: 1580468 - RNA, 19 nt, Homo sapiens
gaaaugaagcugagaccaa

SEQ ID NO: 1580469 - RNA, 19 nt, Homo sapiens
gguacaagcugcugcucua

SEQ ID NO: 1580470 - RNA, 19 nt, Homo sapiens
gacaacaaguacaagauga

SEQ ID NO: 1580471 - RNA, 19 nt, Homo sapiens
gaccggaaguauaagauga

SEQ ID NO: 1580472 - RNA, 19 nt, Homo sapiens
gagaacggcguguguguuu

SEQ ID NO: 1580473 - RNA, 19 nt, Homo sapiens
ggacaaggaugaggagaag

SEQ ID NO: 1580474 - RNA, 19 nt, Homo sapiens
gaccacaaguacaagauga

SEQ ID NO: 1580475 - RNA, 19 nt, Homo sapiens
gaccacaaguacaagauga

SEQ ID NO: 1580476 - RNA, 19 nt, Homo sapiens
gggaagaaacggaaacuga

SEQ ID NO: 1580477 - RNA, 19 nt, Homo sapiens
cguaugagcugucacuuca

SEQ ID NO: 1580478 - RNA, 19 nt, Homo sapiens
uagaauauguggugacugu

SEQ ID NO: 1580479 - RNA, 19 nt, Homo sapiens
ccagaugacugcaaugauc

SEQ ID NO: 1580480 - RNA, 19 nt, Homo sapiens
gcaauaaaggagaaacuga

SEQ ID NO: 1580481 - RNA, 19 nt, Homo sapiens
gcggacagcuucaaagucu

SEQ ID NO: 1580482 - RNA, 19 nt, Homo sapiens
gaagaaacggaaacugaga

SEQ ID NO: 1580483 - RNA, 19 nt, Homo sapiens
guacagauuccuccucuau

SEQ ID NO: 1580484 - RNA, 19 nt, Homo sapiens
gcacaggucagacagaugu

SEQ ID NO: 1580485 - RNA, 19 nt, Homo sapiens
uaaaggagaaacugaggua

SEQ ID NO: 1580486 - RNA, 19 nt, Homo sapiens
gaacuugaccgagggauuc

SEQ ID NO: 1580487 - RNA, 19 nt, Homo sapiens
ccacagaacccagcacuga

SEQ ID NO: 1580488 - RNA, 19 nt, Homo sapiens
ggagugcuauggaugauac

SEQ ID NO: 1580489 - RNA, 19 nt, Homo sapiens
gcugagaccaagaaacuuu

SEQ ID NO: 1580490 - RNA, 19 nt, Homo sapiens
gcauguagguccuguccau

SEQ ID NO: 1580491 - RNA, 19 nt, Homo sapiens
cauaggaggugaccggaau

SEQ ID NO: 1580492 - RNA, 19 nt, Homo sapiens
gagcugacagugacggaua

SEQ ID NO: 1580493 - RNA, 19 nt, Homo sapiens
caggagggaucacaucuca

SEQ ID NO: 1580494 - RNA, 19 nt, Homo sapiens
gagcugaccaugacagaug

SEQ ID NO: 1580495 - RNA, 19 nt, Homo sapiens
gggagaagcaggugguauu

SEQ ID NO: 1580496 - RNA, 19 nt, Homo sapiens
aguauaagaugaaccucua

SEQ ID NO: 1580497 - RNA, 19 nt, Homo sapiens
gaccacaaguacagauuca

SEQ ID NO: 1580498 - RNA, 19 nt, Homo sapiens
gagaguggccgcugcaugu

SEQ ID NO: 1580499 - RNA, 19 nt, Homo sapiens
gagcugaccgugacagaug

SEQ ID NO: 1580500 - RNA, 19 nt, Homo sapiens
gagcugaccgugacagaug

SEQ ID NO: 1580501 - RNA, 19 nt, Homo sapiens
gagcugaccgugacagaug

SEQ ID NO: 1580502 - RNA, 19 nt, Homo sapiens
gagcugaccgugacagaug

SEQ ID NO: 1580503 - RNA, 19 nt, Homo sapiens
gauggugacugagggagaa

SEQ ID NO: 1580504 - RNA, 19 nt, Homo sapiens
gaaugaugccagcccagua

SEQ ID NO: 1580505 - RNA, 19 nt, Homo sapiens
guauucacccaccgcauua

SEQ ID NO: 1580506 - RNA, 19 nt, Homo sapiens
ugacagcuccaaaggauga

SEQ ID NO: 1580507 - RNA, 19 nt, Homo sapiens
ggagcacaguggaccauca

SEQ ID NO: 1580508 - RNA, 19 nt, Homo sapiens
ccaguuugacuccuucaua

SEQ ID NO: 1580509 - RNA, 19 nt, Homo sapiens
cgugucugcuguugguuua

SEQ ID NO: 1580510 - RNA, 19 nt, Homo sapiens
ggaugauacuggaacaaag

SEQ ID NO: 1580511 - RNA, 19 nt, Homo sapiens
gaggacggcgaaugcauuu

SEQ ID NO: 1580512 - RNA, 19 nt, Homo sapiens
gagaagagccaggguccuu

SEQ ID NO: 1580513 - RNA, 19 nt, Homo sapiens
gaagaggaguccccugaug

SEQ ID NO: 1580514 - RNA, 19 nt, Homo sapiens
ccaaaugguccgcauagga

SEQ ID NO: 1580515 - RNA, 19 nt, Homo sapiens
gcacggccuuugcgaggau

SEQ ID NO: 1580516 - RNA, 19 nt, Homo sapiens
guacuaccgccuccacuug

SEQ ID NO: 1580517 - RNA, 19 nt, Homo sapiens
cagccaaggucaacuggau

SEQ ID NO: 1580518 - RNA, 19 nt, Homo sapiens
gguauucacccaccgcauu

SEQ ID NO: 1580519 - RNA, 19 nt, Homo sapiens
ccuggagccuggcaagaaa

SEQ ID NO: 1580520 - RNA, 19 nt, Homo sapiens
guacaaguuccugcucuuu

SEQ ID NO: 1580521 - RNA, 19 nt, Homo sapiens
guacaaguuccugcucuuu

SEQ ID NO: 1580522 - RNA, 19 nt, Homo sapiens
gaugccaggcguagaauau

SEQ ID NO: 1580523 - RNA, 19 nt, Homo sapiens
ggugacgacuguggcauga

SEQ ID NO: 1580524 - RNA, 19 nt, Homo sapiens
cccaacagcuugcucaucu

SEQ ID NO: 1580525 - RNA, 19 nt, Homo sapiens
ccgcauggauggacagaca

SEQ ID NO: 1580526 - RNA, 19 nt, Homo sapiens
ugugacagcuccaaaggau

SEQ ID NO: 1580527 - RNA, 19 nt, Homo sapiens
ggaggugaccggaaugaca

SEQ ID NO: 1580528 - RNA, 19 nt, Homo sapiens
ugacugagggagaauuuga

SEQ ID NO: 1580529 - RNA, 19 nt, Homo sapiens
gagcugacagugacagaug

SEQ ID NO: 1580530 - RNA, 19 nt, Homo sapiens
ggaggacuaugcccauggu

SEQ ID NO: 1580531 - RNA, 19 nt, Homo sapiens
gaggguccgucuagagauc

SEQ ID NO: 1580532 - RNA, 19 nt, Homo sapiens
gaacguguuuugcgacaug

SEQ ID NO: 1580533 - RNA, 19 nt, Homo sapiens
ccacagaacccagcaugga

SEQ ID NO: 1580534 - RNA, 19 nt, Homo sapiens
gaucccgaccggaaguaua

SEQ ID NO: 1580535 - RNA, 19 nt, Homo sapiens
gcugcugacugaccugaug

SEQ ID NO: 1580536 - RNA, 19 nt, Homo sapiens
aauacaaguuucugcucua

SEQ ID NO: 1580537 - RNA, 19 nt, Homo sapiens
guacaaggauaaggauggu

SEQ ID NO: 1580538 - RNA, 19 nt, Homo sapiens
ggagccagaccauaaauac

SEQ ID NO: 1580539 - RNA, 19 nt, Homo sapiens
ggagccagaccauaaauac

SEQ ID NO: 1580540 - RNA, 19 nt, Homo sapiens
ggagccagaccauaaauac

SEQ ID NO: 1580541 - RNA, 19 nt, Homo sapiens
gauaccuggugacccugua

SEQ ID NO: 1580542 - RNA, 19 nt, Homo sapiens
acagauuccuccucuaugg

SEQ ID NO: 1580543 - RNA, 19 nt, Homo sapiens
caguuugacuccuucauag

SEQ ID NO: 1580544 - RNA, 19 nt, Homo sapiens
gcccgagcguucauuuguu

SEQ ID NO: 1580545 - RNA, 19 nt, Homo sapiens
ggccgcaaguacaaauuug

SEQ ID NO: 1580546 - RNA, 19 nt, Homo sapiens
ggaauccgaccacagauac

SEQ ID NO: 1580547 - RNA, 19 nt, Homo sapiens
cagacucccuccucacugu

SEQ ID NO: 1580548 - RNA, 19 nt, Homo sapiens
gggccaguuugacuccuuu

SEQ ID NO: 1580549 - RNA, 19 nt, Homo sapiens
caucaucuaccaaggcauu

SEQ ID NO: 1580550 - RNA, 19 nt, Homo sapiens
ugacaccuuugccuacuuc

SEQ ID NO: 1580551 - RNA, 19 nt, Homo sapiens
aggcugagguggaccgauu

SEQ ID NO: 1580552 - RNA, 19 nt, Homo sapiens
agaauccuguggacaccua

SEQ ID NO: 1580553 - RNA, 19 nt, Homo sapiens
guacaggaacugccacuac

SEQ ID NO: 1580554 - RNA, 19 nt, Homo sapiens
ggacuaugcccaugguuuu

SEQ ID NO: 1580555 - RNA, 19 nt, Homo sapiens
ccagcuccuuggccucuuu

SEQ ID NO: 1580556 - RNA, 19 nt, Homo sapiens
ccaguuugaccauuucuug

SEQ ID NO: 1580557 - RNA, 19 nt, Homo sapiens
ugacagaacccagcaugga

SEQ ID NO: 1580558 - RNA, 19 nt, Homo sapiens
acgggacgcugcugacuga

SEQ ID NO: 1580559 - RNA, 19 nt, Homo sapiens
ccaagaccaucaccaccau

SEQ ID NO: 1580560 - RNA, 19 nt, Homo sapiens
ccacagcggcagugucuuc

SEQ ID NO: 1580561 - RNA, 19 nt, Homo sapiens
ucuccuggauggugacuga

SEQ ID NO: 1580562 - RNA, 19 nt, Homo sapiens
gaacaucacuggaaaacaa

SEQ ID NO: 1580563 - RNA, 19 nt, Homo sapiens
gaaaugaagcugagaccaa

SEQ ID NO: 1580564 - RNA, 19 nt, Homo sapiens
aaacugagguacccggaaa

SEQ ID NO: 1580565 - RNA, 19 nt, Homo sapiens
gcaauaaaggagaaacuga

SEQ ID NO: 1580566 - RNA, 19 nt, Homo sapiens
gcggacagcuucaaagucu

SEQ ID NO: 1580567 - RNA, 19 nt, Homo sapiens
gaagcgagcaccugacuca

SEQ ID NO: 1580568 - RNA, 19 nt, Homo sapiens
uaaaggagaaacugaggua

SEQ ID NO: 1580569 - RNA, 19 nt, Homo sapiens
gaacuugaccgagggauuc

SEQ ID NO: 1580570 - RNA, 19 nt, Homo sapiens
gcugagaccaagaaacuuu

SEQ ID NO: 1580571 - RNA, 19 nt, Homo sapiens
caggagggaucacaucuca

SEQ ID NO: 1580572 - RNA, 19 nt, Homo sapiens
agaggaacaucacuggaaa

SEQ ID NO: 1580573 - RNA, 19 nt, Homo sapiens
ggaugagucaggagcauuu

SEQ ID NO: 1580574 - RNA, 19 nt, Homo sapiens
gacugggccuggaccuaua

SEQ ID NO: 1580575 - RNA, 19 nt, Homo sapiens
ggccagagccugugauauc

SEQ ID NO: 1580576 - RNA, 19 nt, Homo sapiens
gcaccacacuccucaagcu

SEQ ID NO: 1580577 - RNA, 19 nt, Homo sapiens
ggagcacaguggaccauca

SEQ ID NO: 1580578 - RNA, 19 nt, Homo sapiens
gagaagagccaggguccuu

SEQ ID NO: 1580579 - RNA, 19 nt, Homo sapiens
gggcugaagacaaagauga

SEQ ID NO: 1580580 - RNA, 19 nt, Homo sapiens
guacuaccgccuccacuug

SEQ ID NO: 1580581 - RNA, 19 nt, Homo sapiens
cagccaaggucaacuggau

SEQ ID NO: 1580582 - RNA, 19 nt, Homo sapiens
cccaacagcuugcucaucu

SEQ ID NO: 1580583 - RNA, 19 nt, Homo sapiens
ccgcauggauggacagaca

SEQ ID NO: 1580584 - RNA, 19 nt, Homo sapiens
ggaggacuaugcccauggu

SEQ ID NO: 1580585 - RNA, 19 nt, Homo sapiens
gaacguguuuugcgacaug

SEQ ID NO: 1580586 - RNA, 19 nt, Homo sapiens
agaauccuguggacaccua

SEQ ID NO: 1580587 - RNA, 19 nt, Homo sapiens
gcauuugggcugaagacaa

SEQ ID NO: 1580588 - RNA, 19 nt, Homo sapiens
ggguggccuuguccagaua

SEQ ID NO: 1580589 - RNA, 19 nt, Homo sapiens
ccacagcgacuucauuguc

SEQ ID NO: 1580590 - RNA, 19 nt, Homo sapiens
guacaggaacugccacuac

SEQ ID NO: 1580591 - RNA, 19 nt, Homo sapiens
ggacuaugcccaugguuuu

SEQ ID NO: 1580592 - RNA, 19 nt, Homo sapiens
ccagcuccuuggccucuuu

SEQ ID NO: 1580593 - RNA, 19 nt, Homo sapiens
gccuggaccuauaaacuuc

SEQ ID NO: 1580594 - RNA, 19 nt, Homo sapiens
aaaccucccugccguggau

SEQ ID NO: 1580595 - RNA, 19 nt, Homo sapiens
ccacagcggcagugucuuc

SEQ ID NO: 1580596 - RNA, 19 nt, Homo sapiens
ggccacagcgacuucauug

SEQ ID NO: 1580597 - RNA, 19 nt, Homo sapiens
caagcucagugaauguauc

SEQ ID NO: 1580598 - RNA, 19 nt, Homo sapiens
gguacaggcuccucuucca

SEQ ID NO: 1580599 - RNA, 19 nt, Homo sapiens
ggccuggaccuauaaacuu

SEQ ID NO: 1580600 - RNA, 19 nt, Homo sapiens
acccucagcuucucucaga

SEQ ID NO: 1580601 - RNA, 19 nt, Homo sapiens
ggagggacugggaggacua

SEQ ID NO: 1580602 - RNA, 19 nt, Homo sapiens
gggaggggcucucuaaucu

SEQ ID NO: 1580603 - RNA, 19 nt, Homo sapiens
gccagagccugugauaucu

SEQ ID NO: 1580604 - RNA, 19 nt, Homo sapiens
aagaggaacaucacuggaa

SEQ ID NO: 1580605 - RNA, 19 nt, Homo sapiens
ucggugcccuucacggaaa

SEQ ID NO: 1580606 - RNA, 19 nt, Homo sapiens
gaucccaggcgcucgcuau

SEQ ID NO: 1580607 - RNA, 19 nt, Homo sapiens
cagcggcagugucuucucu

SEQ ID NO: 1580608 - RNA, 19 nt, Homo sapiens
acagguuccuccucuaugg

SEQ ID NO: 1580609 - RNA, 19 nt, Homo sapiens
cuacagguuccuccucuau

SEQ ID NO: 1580610 - RNA, 19 nt, Homo sapiens
ucgcagcacuguguuuaca

SEQ ID NO: 1580611 - RNA, 19 nt, Homo sapiens
ugacugggccuggaccuau

SEQ ID NO: 1580612 - RNA, 19 nt, Homo sapiens
gcacggcuggugggauuug

SEQ ID NO: 1580613 - RNA, 19 nt, Homo sapiens
ucucgcagcacuguguuua

SEQ ID NO: 1580614 - RNA, 19 nt, Homo sapiens
gggcggacagcuucaaagu

SEQ ID NO: 1580615 - RNA, 19 nt, Homo sapiens
gagcaccacacuccucaag

SEQ ID NO: 1580616 - RNA, 19 nt, Homo sapiens
cacagcgacuucauugucu

SEQ ID NO: 1580617 - RNA, 19 nt, Homo sapiens
ccacuacgccaaccucaac

SEQ ID NO: 1580618 - RNA, 19 nt, Homo sapiens
ugacacaggcaggugacua

SEQ ID NO: 1580619 - RNA, 19 nt, Homo sapiens
gcauggauggacagacaga

SEQ ID NO: 1580620 - RNA, 19 nt, Homo sapiens
aagcugagaccaagaaacu

SEQ ID NO: 1580621 - RNA, 19 nt, Homo sapiens
ggauggacagacagacuuc

SEQ ID NO: 1580622 - RNA, 19 nt, Homo sapiens
gagcaauaaaggagaaacu

SEQ ID NO: 1580623 - RNA, 19 nt, Homo sapiens
ugucuucucugcccgugau

SEQ ID NO: 1580624 - RNA, 19 nt, Homo sapiens
ccagcaccaucuuccucaa

SEQ ID NO: 1580625 - RNA, 19 nt, Homo sapiens
ccuacagguuccuccucua

SEQ ID NO: 1580626 - RNA, 19 nt, Homo sapiens
ccaacuacaccgccacagu

SEQ ID NO: 1580627 - RNA, 19 nt, Homo sapiens
uuugcgacauggagacuga

SEQ ID NO: 1580628 - RNA, 19 nt, Homo sapiens
ugacggucccacacaguug

SEQ ID NO: 1580629 - RNA, 19 nt, Homo sapiens
gcuucaaagucuccuacca

SEQ ID NO: 1580630 - RNA, 19 nt, Homo sapiens
ugacgugaccaccaguuca

SEQ ID NO: 1580631 - RNA, 19 nt, Homo sapiens
caggagcauuuucuuaaga

SEQ ID NO: 1580632 - RNA, 19 nt, Homo sapiens
aguaauagcugaaccuguu

SEQ ID NO: 1580633 - RNA, 19 nt, Homo sapiens
uaauaaagguuucguugca

SEQ ID NO: 1580634 - RNA, 19 nt, Homo sapiens
ggacgugguuggugauugg

SEQ ID NO: 1580635 - RNA, 19 nt, Homo sapiens
gcuguuaauucuucaguca

SEQ ID NO: 1580636 - RNA, 19 nt, Homo sapiens
cagcagaggcucaucuuug

SEQ ID NO: 1580637 - RNA, 19 nt, Homo sapiens
cagcagaggcucaucuuug

SEQ ID NO: 1580638 - RNA, 19 nt, Homo sapiens
cagcagaggcucaucuuug

SEQ ID NO: 1580639 - RNA, 19 nt, Homo sapiens
ugggugagcuuguuugugu

SEQ ID NO: 1580640 - RNA, 19 nt, Homo sapiens
guaugcagaucuucgugaa

SEQ ID NO: 1580641 - RNA, 19 nt, Homo sapiens
guaugcagaucuucgugaa

SEQ ID NO: 1580642 - RNA, 19 nt, Homo sapiens
gaggugguaugcagaucuu

SEQ ID NO: 1580643 - RNA, 19 nt, Homo sapiens
gaggugguaugcagaucuu

SEQ ID NO: 1580644 - RNA, 19 nt, Homo sapiens
aaaugcagaucuucgugaa

SEQ ID NO: 1580645 - RNA, 19 nt, Homo sapiens
ggguggcuguuaauucuuc

SEQ ID NO: 1580646 - RNA, 19 nt, Homo sapiens
uguuaauucuucagucaug

SEQ ID NO: 1580647 - RNA, 19 nt, Homo sapiens
acuacaacauccagaagga

SEQ ID NO: 1580648 - RNA, 19 nt, Homo sapiens
gcuaacaggucaaaaugca

SEQ ID NO: 1580649 - RNA, 19 nt, Homo sapiens
aagguuucguugcauggua

SEQ ID NO: 1580650 - RNA, 19 nt, Homo sapiens
caccugguccugcgucuga

SEQ ID NO: 1580651 - RNA, 19 nt, Homo sapiens
caccugguccugcgucuga

SEQ ID NO: 1580652 - RNA, 19 nt, Homo sapiens
gcccagugauggcauuacu

SEQ ID NO: 1580653 - RNA, 19 nt, Homo sapiens
caggcaagcagcuggaaga

SEQ ID NO: 1580654 - RNA, 19 nt, Homo sapiens
caggcaagcagcuggaaga

SEQ ID NO: 1580655 - RNA, 19 nt, Homo sapiens
caggcaagcagcuggaaga

SEQ ID NO: 1580656 - RNA, 19 nt, Homo sapiens
gagaggugguaugcagauc

SEQ ID NO: 1580657 - RNA, 19 nt, Homo sapiens
gagaggugguaugcagauc

SEQ ID NO: 1580658 - RNA, 19 nt, Homo sapiens
ccagcagaggcucaucuuu

SEQ ID NO: 1580659 - RNA, 19 nt, Homo sapiens
ccagcagaggcucaucuuu

SEQ ID NO: 1580660 - RNA, 19 nt, Homo sapiens
ccagcagaggcucaucuuu

SEQ ID NO: 1580661 - RNA, 19 nt, Homo sapiens
cgccagcccggagcauuua

SEQ ID NO: 1580662 - RNA, 19 nt, Homo sapiens
cauucgcagugcccaguga

SEQ ID NO: 1580663 - RNA, 19 nt, Homo sapiens
auucuucagucauggcauu

SEQ ID NO: 1580664 - RNA, 19 nt, Homo sapiens
gcacuuuccuuucaauaaa

SEQ ID NO: 1580665 - RNA, 19 nt, Homo sapiens
caauaaaguuguugcauuc

SEQ ID NO: 1580666 - RNA, 19 nt, Homo sapiens
cagcagagguugaucuuug

SEQ ID NO: 1580667 - RNA, 19 nt, Homo sapiens
cagcagagguugaucuuug

SEQ ID NO: 1580668 - RNA, 19 nt, Homo sapiens
cagcagagguugaucuuug

SEQ ID NO: 1580669 - RNA, 19 nt, Homo sapiens
cagcagagguugaucuuug

SEQ ID NO: 1580670 - RNA, 19 nt, Homo sapiens
aggcaaagauccaagauaa

SEQ ID NO: 1580671 - RNA, 19 nt, Homo sapiens
ugaagacucugacugguaa

SEQ ID NO: 1580672 - RNA, 19 nt, Homo sapiens
guaaucauuugggucaaua

SEQ ID NO: 1580673 - RNA, 19 nt, Homo sapiens
ucauuugggucaauaugua

SEQ ID NO: 1580674 - RNA, 19 nt, Homo sapiens
ggaugcagaucuucgugaa

SEQ ID NO: 1580675 - RNA, 19 nt, Homo sapiens
ggaugcagaucuucgugaa

SEQ ID NO: 1580676 - RNA, 19 nt, Homo sapiens
ggaugcagaucuucgugaa

SEQ ID NO: 1580677 - RNA, 19 nt, Homo sapiens
ggaugcagaucuucgugaa

SEQ ID NO: 1580678 - RNA, 19 nt, Homo sapiens
ggaugcagaucuucgugaa

SEQ ID NO: 1580679 - RNA, 19 nt, Homo sapiens
ggaugcagaucuucgugaa

SEQ ID NO: 1580680 - RNA, 19 nt, Homo sapiens
caaauuucauugcacuuuc

SEQ ID NO: 1580681 - RNA, 19 nt, Homo sapiens
gaggugggaugcaaaucuu

SEQ ID NO: 1580682 - RNA, 19 nt, Homo sapiens
gaggugggaugcaaaucuu

SEQ ID NO: 1580683 - RNA, 19 nt, Homo sapiens
caaugcagaucuucgugaa

SEQ ID NO: 1580684 - RNA, 19 nt, Homo sapiens
cuaguaaauuguccgcuaa

SEQ ID NO: 1580685 - RNA, 19 nt, Homo sapiens
gaggugggaugcagaucuu

SEQ ID NO: 1580686 - RNA, 19 nt, Homo sapiens
gaggugggaugcagaucuu

SEQ ID NO: 1580687 - RNA, 19 nt, Homo sapiens
gaggugggaugcagaucuu

SEQ ID NO: 1580688 - RNA, 19 nt, Homo sapiens
gaggugggaugcagaucuu

SEQ ID NO: 1580689 - RNA, 19 nt, Homo sapiens
gaggugggaugcagaucuu

SEQ ID NO: 1580690 - RNA, 19 nt, Homo sapiens
gaggugggaugcagaucuu

SEQ ID NO: 1580691 - RNA, 19 nt, Homo sapiens
guuguugcauucccaauug

SEQ ID NO: 1580692 - RNA, 19 nt, Homo sapiens
gcaaagauccaagauaagg

SEQ ID NO: 1580693 - RNA, 19 nt, Homo sapiens
ggaugcaaaucuucgugaa

SEQ ID NO: 1580694 - RNA, 19 nt, Homo sapiens
gcaaagauccaagauaagg

SEQ ID NO: 1580695 - RNA, 19 nt, Homo sapiens
ggaugcaaaucuucgugaa

SEQ ID NO: 1580696 - RNA, 19 nt, Homo sapiens
gcaaagauccaagauaagg

SEQ ID NO: 1580697 - RNA, 19 nt, Homo sapiens
guguuagacuaguaaauug

SEQ ID NO: 1580698 - RNA, 19 nt, Homo sapiens
ucauugcacuuuccuuuca

SEQ ID NO: 1580699 - RNA, 19 nt, Homo sapiens
gugaagacucugacuggua

SEQ ID NO: 1580700 - RNA, 19 nt, Homo sapiens
ggcggacccugucugacua

SEQ ID NO: 1580701 - RNA, 19 nt, Homo sapiens
acuacaacauucagaaaga

SEQ ID NO: 1580702 - RNA, 19 nt, Homo sapiens
guuagacaaugcagaucuu

SEQ ID NO: 1580703 - RNA, 19 nt, Homo sapiens
gcuaaauucuggccguuuu

SEQ ID NO: 1580704 - RNA, 19 nt, Homo sapiens
acuacaacauccagaaaga

SEQ ID NO: 1580705 - RNA, 19 nt, Homo sapiens
acuacaacauccagaaaga

SEQ ID NO: 1580706 - RNA, 19 nt, Homo sapiens
gagaaugucaaggcaaaga

SEQ ID NO: 1580707 - RNA, 19 nt, Homo sapiens
acuacaacauccagaaaga

SEQ ID NO: 1580708 - RNA, 19 nt, Homo sapiens
acuacaacauccagaaaga

SEQ ID NO: 1580709 - RNA, 19 nt, Homo sapiens
acuacaacauccagaaaga

SEQ ID NO: 1580710 - RNA, 19 nt, Homo sapiens
acuacaacauccagaaaga

SEQ ID NO: 1580711 - RNA, 19 nt, Homo sapiens
acuacaacauccagaaaga

SEQ ID NO: 1580712 - RNA, 19 nt, Homo sapiens
acuacaacauccagaaaga

SEQ ID NO: 1580713 - RNA, 19 nt, Homo sapiens
ugacuacaacauucagaaa

SEQ ID NO: 1580714 - RNA, 19 nt, Homo sapiens
ucucagaggugggaugcaa

SEQ ID NO: 1580715 - RNA, 19 nt, Homo sapiens
ugacuacaacauccagaaa

SEQ ID NO: 1580716 - RNA, 19 nt, Homo sapiens
aaagauccaagauaaggaa

SEQ ID NO: 1580717 - RNA, 19 nt, Homo sapiens
ugacuacaacauccagaaa

SEQ ID NO: 1580718 - RNA, 19 nt, Homo sapiens
aaagauccaagauaaggaa

SEQ ID NO: 1580719 - RNA, 19 nt, Homo sapiens
ugacuacaacauccagaaa

SEQ ID NO: 1580720 - RNA, 19 nt, Homo sapiens
ugacuacaacauccagaaa

SEQ ID NO: 1580721 - RNA, 19 nt, Homo sapiens
ugacuacaacauccagaaa

SEQ ID NO: 1580722 - RNA, 19 nt, Homo sapiens
ugacuacaacauccagaaa

SEQ ID NO: 1580723 - RNA, 19 nt, Homo sapiens
ugacuacaacauccagaaa

SEQ ID NO: 1580724 - RNA, 19 nt, Homo sapiens
aaagauccaagauaaggaa

SEQ ID NO: 1580725 - RNA, 19 nt, Homo sapiens
ugacuacaacauccagaaa

SEQ ID NO: 1580726 - RNA, 19 nt, Homo sapiens
uuucaguguuagacuagua

SEQ ID NO: 1580727 - RNA, 19 nt, Homo sapiens
caaagauccaagauaagga

SEQ ID NO: 1580728 - RNA, 19 nt, Homo sapiens
gacccugucugacuacaac

SEQ ID NO: 1580729 - RNA, 19 nt, Homo sapiens
caaagauccaagauaagga

SEQ ID NO: 1580730 - RNA, 19 nt, Homo sapiens
caaagauccaagauaagga

SEQ ID NO: 1580731 - RNA, 19 nt, Homo sapiens
ggcgcacccugucugacua

SEQ ID NO: 1580732 - RNA, 19 nt, Homo sapiens
gaaugucaaggcaaagauc

SEQ ID NO: 1580733 - RNA, 19 nt, Homo sapiens
cuacaacauucagaaagag

SEQ ID NO: 1580734 - RNA, 19 nt, Homo sapiens
ucaaggcaaagauccaaga

SEQ ID NO: 1580735 - RNA, 19 nt, Homo sapiens
uuucauugcacuuuccuuu

SEQ ID NO: 1580736 - RNA, 19 nt, Homo sapiens
ugucuaaguuuccccuuuu

SEQ ID NO: 1580737 - RNA, 19 nt, Homo sapiens
uuaggcaccuuuugaaaug

SEQ ID NO: 1580738 - RNA, 19 nt, Homo sapiens
gaguguguuuugugaguuu

SEQ ID NO: 1580739 - RNA, 19 nt, Homo sapiens
cauuugggucaauauguaa

SEQ ID NO: 1580740 - RNA, 19 nt, Homo sapiens
uguaaucauuugggucaau

SEQ ID NO: 1580741 - RNA, 19 nt, Homo sapiens
ugcacuuuccuuucaauaa

SEQ ID NO: 1580742 - RNA, 19 nt, Homo sapiens
gacuacaacauucagaaag

SEQ ID NO: 1580743 - RNA, 19 nt, Homo sapiens
aaggcaaagauccaagaua

SEQ ID NO: 1580744 - RNA, 19 nt, Homo sapiens
uggagaagcucaucagaaa

SEQ ID NO: 1580745 - RNA, 19 nt, Homo sapiens
gcaaauaaaccuccuaaaa

SEQ ID NO: 1580746 - RNA, 19 nt, Homo sapiens
ggacggaaccacguacuuu

SEQ ID NO: 1580747 - RNA, 19 nt, Homo sapiens
cagcagggcuccacacaca

SEQ ID NO: 1580748 - RNA, 19 nt, Homo sapiens
aaaccugccucccauucua

SEQ ID NO: 1580749 - RNA, 19 nt, Homo sapiens
ccacguaucaccucuggaa

SEQ ID NO: 1580750 - RNA, 19 nt, Homo sapiens
gcaaaccugccucccauuc

SEQ ID NO: 1580751 - RNA, 19 nt, Homo sapiens
ccaacaggcucguccaaac

SEQ ID NO: 1580752 - RNA, 19 nt, Homo sapiens
gagaagcucaucagaaacu

SEQ ID NO: 1580753 - RNA, 19 nt, Homo sapiens
aaagaaggccacuguuugu

SEQ ID NO: 1580754 - RNA, 19 nt, Homo sapiens
caaaagaaggccacuguuu

SEQ ID NO: 1580755 - RNA, 19 nt, Homo sapiens
ucaaagucaucccucuguu

SEQ ID NO: 1580756 - RNA, 19 nt, Homo sapiens
gagaacuggucagggcaaa

SEQ ID NO: 1580757 - RNA, 19 nt, Homo sapiens
gccagucccuccaggugaa

SEQ ID NO: 1580758 - RNA, 19 nt, Homo sapiens
ccgugcagcuccuugugua

SEQ ID NO: 1580759 - RNA, 19 nt, Homo sapiens
ggacgaggacgugcuguuc

SEQ ID NO: 1580760 - RNA, 19 nt, Homo sapiens
ccaacgcgcucuccuucuc

SEQ ID NO: 1580761 - RNA, 19 nt, Homo sapiens
ggaugcauguucugauugc

SEQ ID NO: 1580762 - RNA, 19 nt, Homo sapiens
agagauggaugcauguucu

SEQ ID NO: 1580763 - RNA, 19 nt, Homo sapiens
caaagucaucccucuguuc

SEQ ID NO: 1580764 - RNA, 19 nt, Homo sapiens
ugucucacgucucccuaaa

SEQ ID NO: 1580765 - RNA, 19 nt, Homo sapiens
caucagaaacucaaaagaa

SEQ ID NO: 1580766 - RNA, 19 nt, Homo sapiens
aaagucaucccucuguuca

SEQ ID NO: 1580767 - RNA, 19 nt, Homo sapiens
auggaugcauguucugauu

SEQ ID NO: 1580768 - RNA, 19 nt, Homo sapiens
uggcaaauaaaccuccuaa

SEQ ID NO: 1580769 - RNA, 19 nt, Homo sapiens
gaagcucaucagaaacuca

SEQ ID NO: 1580770 - RNA, 19 nt, Homo sapiens
aaaagaaggccacuguuug

SEQ ID NO: 1580771 - RNA, 19 nt, Homo sapiens
ggagaagugaucccaacag

SEQ ID NO: 1580772 - RNA, 19 nt, Homo sapiens
agucaucccucuguucaca

SEQ ID NO: 1580773 - RNA, 19 nt, Homo sapiens
gacgaggacgugcuguuca

SEQ ID NO: 1580774 - RNA, 19 nt, Homo sapiens
cagcuucucugaggcuucu

SEQ ID NO: 1580775 - RNA, 19 nt, Homo sapiens
gauugccucuuuggagaag

SEQ ID NO: 1580776 - RNA, 19 nt, Homo sapiens
uggagaagcucaucagaaa

SEQ ID NO: 1580777 - RNA, 19 nt, Homo sapiens
gcaaauaaaccuccuaaaa

SEQ ID NO: 1580778 - RNA, 19 nt, Homo sapiens
ggacggaaccacguacuuu

SEQ ID NO: 1580779 - RNA, 19 nt, Homo sapiens
cagcagggcuccacacaca

SEQ ID NO: 1580780 - RNA, 19 nt, Homo sapiens
aaaccugccucccauucua

SEQ ID NO: 1580781 - RNA, 19 nt, Homo sapiens
ccacguaucaccucuggaa

SEQ ID NO: 1580782 - RNA, 19 nt, Homo sapiens
gcaaaccugccucccauuc

SEQ ID NO: 1580783 - RNA, 19 nt, Homo sapiens
ccaacaggcucguccaaac

SEQ ID NO: 1580784 - RNA, 19 nt, Homo sapiens
gagaagcucaucagaaacu

SEQ ID NO: 1580785 - RNA, 19 nt, Homo sapiens
aaagaaggccacuguuugu

SEQ ID NO: 1580786 - RNA, 19 nt, Homo sapiens
caaaagaaggccacuguuu

SEQ ID NO: 1580787 - RNA, 19 nt, Homo sapiens
ucaaagucaucccucuguu

SEQ ID NO: 1580788 - RNA, 19 nt, Homo sapiens
gagaacuggucagggcaaa

SEQ ID NO: 1580789 - RNA, 19 nt, Homo sapiens
gccagucccuccaggugaa

SEQ ID NO: 1580790 - RNA, 19 nt, Homo sapiens
ccgugcagcuccuugugua

SEQ ID NO: 1580791 - RNA, 19 nt, Homo sapiens
ggacgaggacgugcuguuc

SEQ ID NO: 1580792 - RNA, 19 nt, Homo sapiens
ccaacgcgcucuccuucuc

SEQ ID NO: 1580793 - RNA, 19 nt, Homo sapiens
ggaugcauguucugauugc

SEQ ID NO: 1580794 - RNA, 19 nt, Homo sapiens
agagauggaugcauguucu

SEQ ID NO: 1580795 - RNA, 19 nt, Homo sapiens
caaagucaucccucuguuc

SEQ ID NO: 1580796 - RNA, 19 nt, Homo sapiens
ugucucacgucucccuaaa

SEQ ID NO: 1580797 - RNA, 19 nt, Homo sapiens
caucagaaacucaaaagaa

SEQ ID NO: 1580798 - RNA, 19 nt, Homo sapiens
aaagucaucccucuguuca

SEQ ID NO: 1580799 - RNA, 19 nt, Homo sapiens
auggaugcauguucugauu

SEQ ID NO: 1580800 - RNA, 19 nt, Homo sapiens
uggcaaauaaaccuccuaa

SEQ ID NO: 1580801 - RNA, 19 nt, Homo sapiens
gaagcucaucagaaacuca

SEQ ID NO: 1580802 - RNA, 19 nt, Homo sapiens
aaaagaaggccacuguuug

SEQ ID NO: 1580803 - RNA, 19 nt, Homo sapiens
ggagaagugaucccaacag

SEQ ID NO: 1580804 - RNA, 19 nt, Homo sapiens
agucaucccucuguucaca

SEQ ID NO: 1580805 - RNA, 19 nt, Homo sapiens
gacgaggacgugcuguuca

SEQ ID NO: 1580806 - RNA, 19 nt, Homo sapiens
cagcuucucugaggcuucu

SEQ ID NO: 1580807 - RNA, 19 nt, Homo sapiens
gauugccucuuuggagaag

SEQ ID NO: 1580808 - RNA, 19 nt, Homo sapiens
uggagaagcucaucagaaa

SEQ ID NO: 1580809 - RNA, 19 nt, Homo sapiens
gcaaauaaaccuccuaaaa

SEQ ID NO: 1580810 - RNA, 19 nt, Homo sapiens
ggacggaaccacguacuuu

SEQ ID NO: 1580811 - RNA, 19 nt, Homo sapiens
aaaccugccucccauucua

SEQ ID NO: 1580812 - RNA, 19 nt, Homo sapiens
ccacguaucaccucuggaa

SEQ ID NO: 1580813 - RNA, 19 nt, Homo sapiens
gcaaaccugccucccauuc

SEQ ID NO: 1580814 - RNA, 19 nt, Homo sapiens
gagaagcucaucagaaacu

SEQ ID NO: 1580815 - RNA, 19 nt, Homo sapiens
aaagaaggccacuguuugu

SEQ ID NO: 1580816 - RNA, 19 nt, Homo sapiens
caaaagaaggccacuguuu

SEQ ID NO: 1580817 - RNA, 19 nt, Homo sapiens
ucaaagucaucccucuguu

SEQ ID NO: 1580818 - RNA, 19 nt, Homo sapiens
gagaacuggucagggcaaa

SEQ ID NO: 1580819 - RNA, 19 nt, Homo sapiens
gccagucccuccaggugaa

SEQ ID NO: 1580820 - RNA, 19 nt, Homo sapiens
ccgugcagcuccuugugua

SEQ ID NO: 1580821 - RNA, 19 nt, Homo sapiens
ggacgaggacgugcuguuc

SEQ ID NO: 1580822 - RNA, 19 nt, Homo sapiens
ggaugcauguucugauugc

SEQ ID NO: 1580823 - RNA, 19 nt, Homo sapiens
agagauggaugcauguucu

SEQ ID NO: 1580824 - RNA, 19 nt, Homo sapiens
ccaacgcgcucuccuucuc

SEQ ID NO: 1580825 - RNA, 19 nt, Homo sapiens
caaagucaucccucuguuc

SEQ ID NO: 1580826 - RNA, 19 nt, Homo sapiens
ugucucacgucucccuaaa

SEQ ID NO: 1580827 - RNA, 19 nt, Homo sapiens
caucagaaacucaaaagaa

SEQ ID NO: 1580828 - RNA, 19 nt, Homo sapiens
aaagucaucccucuguuca

SEQ ID NO: 1580829 - RNA, 19 nt, Homo sapiens
auggaugcauguucugauu

SEQ ID NO: 1580830 - RNA, 19 nt, Homo sapiens
uggcaaauaaaccuccuaa

SEQ ID NO: 1580831 - RNA, 19 nt, Homo sapiens
gaagcucaucagaaacuca

SEQ ID NO: 1580832 - RNA, 19 nt, Homo sapiens
aaaagaaggccacuguuug

SEQ ID NO: 1580833 - RNA, 19 nt, Homo sapiens
agucaucccucuguucaca

SEQ ID NO: 1580834 - RNA, 19 nt, Homo sapiens
gacgaggacgugcuguuca

SEQ ID NO: 1580835 - RNA, 19 nt, Homo sapiens
cagcuucucugaggcuucu

SEQ ID NO: 1580836 - RNA, 19 nt, Homo sapiens
gauugccucuuuggagaag

SEQ ID NO: 1580837 - RNA, 19 nt, Homo sapiens
ggaaagggauuauguagga

SEQ ID NO: 1580838 - RNA, 19 nt, Homo sapiens
ggaaagggauuauguagga

SEQ ID NO: 1580839 - RNA, 19 nt, Homo sapiens
ugagguggcuuccuaguua

SEQ ID NO: 1580840 - RNA, 19 nt, Homo sapiens
gaagaaagcugcacaugcu

SEQ ID NO: 1580841 - RNA, 19 nt, Homo sapiens
ggaauaauguuuggacuug

SEQ ID NO: 1580842 - RNA, 19 nt, Homo sapiens
ggaauaauguuuggacuug

SEQ ID NO: 1580843 - RNA, 19 nt, Homo sapiens
ccagguaucuaacuuguuu

SEQ ID NO: 1580844 - RNA, 19 nt, Homo sapiens
uagaguaccuuuggauuua

SEQ ID NO: 1580845 - RNA, 19 nt, Homo sapiens
gcauauaggucaggaaaga

SEQ ID NO: 1580846 - RNA, 19 nt, Homo sapiens
gcauauaggucaggaaaga

SEQ ID NO: 1580847 - RNA, 19 nt, Homo sapiens
gaagaucgcuugugaaacc

SEQ ID NO: 1580848 - RNA, 19 nt, Homo sapiens
gaaagcggcugggcucuug

SEQ ID NO: 1580849 - RNA, 19 nt, Homo sapiens
gacaaugacuuccucaaug

SEQ ID NO: 1580850 - RNA, 19 nt, Homo sapiens
gaaauaccaccaguuuaua

SEQ ID NO: 1580851 - RNA, 19 nt, Homo sapiens
ucaaugagcugagcaaugu

SEQ ID NO: 1580852 - RNA, 19 nt, Homo sapiens
gcuccagguuugcuauuua

SEQ ID NO: 1580853 - RNA, 19 nt, Homo sapiens
gagaugacuucguggguuu

SEQ ID NO: 1580854 - RNA, 19 nt, Homo sapiens
ccaagaaggagguguauuu

SEQ ID NO: 1580855 - RNA, 19 nt, Homo sapiens
ggacaaucaucucuucaau

SEQ ID NO: 1580856 - RNA, 19 nt, Homo sapiens
ucaggacccucauguuuaa

SEQ ID NO: 1580857 - RNA, 19 nt, Homo sapiens
ucaguucccuucaauuaaa

SEQ ID NO: 1580858 - RNA, 19 nt, Homo sapiens
gaacuagaguaccuuugga

SEQ ID NO: 1580859 - RNA, 19 nt, Homo sapiens
ccaacuggcucauggagaa

SEQ ID NO: 1580860 - RNA, 19 nt, Homo sapiens
ccaacuggcucauggagaa

SEQ ID NO: 1580861 - RNA, 19 nt, Homo sapiens
acaaugacuuccucaauga

SEQ ID NO: 1580862 - RNA, 19 nt, Homo sapiens
aaagaaauaccaccaguuu

SEQ ID NO: 1580863 - RNA, 19 nt, Homo sapiens
ggaauaaguucauccucau

SEQ ID NO: 1580864 - RNA, 19 nt, Homo sapiens
gaucaggauuaccagaauu

SEQ ID NO: 1580865 - RNA, 19 nt, Homo sapiens
ugacgucuaugccaugaaa

SEQ ID NO: 1580866 - RNA, 19 nt, Homo sapiens
uuaaagagauacccaguag

SEQ ID NO: 1580867 - RNA, 19 nt, Homo sapiens
gacaaucaucucuucaaua

SEQ ID NO: 1580868 - RNA, 19 nt, Homo sapiens
gcuccgggaugaccuugua

SEQ ID NO: 1580869 - RNA, 19 nt, Homo sapiens
gaugagauauggucagacu

SEQ ID NO: 1580870 - RNA, 19 nt, Homo sapiens
uagcagagacaccucguua

SEQ ID NO: 1580871 - RNA, 19 nt, Homo sapiens
uaucaggacccucauguuu

SEQ ID NO: 1580872 - RNA, 19 nt, Homo sapiens
gccagaaagugaagcuauu

SEQ ID NO: 1580873 - RNA, 19 nt, Homo sapiens
ucucaguucccuucaauua

SEQ ID NO: 1580874 - RNA, 19 nt, Homo sapiens
gaccguggaugguguggaa

SEQ ID NO: 1580875 - RNA, 19 nt, Homo sapiens
agaaauaccaccaguuuau

SEQ ID NO: 1580876 - RNA, 19 nt, Homo sapiens
cccagccgcuuuaaguuua

SEQ ID NO: 1580877 - RNA, 19 nt, Homo sapiens
gugaagaucgcuugugaaa

SEQ ID NO: 1580878 - RNA, 19 nt, Homo sapiens
ccucauguuuaaaugguua

SEQ ID NO: 1580879 - RNA, 19 nt, Homo sapiens
gcucuugucuggauuaacu

SEQ ID NO: 1580880 - RNA, 19 nt, Homo sapiens
ggacuugccaacauucaaa

SEQ ID NO: 1580881 - RNA, 19 nt, Homo sapiens
ggagagguuuggaauugau

SEQ ID NO: 1580882 - RNA, 19 nt, Homo sapiens
gaauaauguuuggacuuga

SEQ ID NO: 1580883 - RNA, 19 nt, Homo sapiens
gaaagggauuauguaggaa

SEQ ID NO: 1580884 - RNA, 19 nt, Homo sapiens
gaauaauguuuggacuuga

SEQ ID NO: 1580885 - RNA, 19 nt, Homo sapiens
gaaagggauuauguaggaa

SEQ ID NO: 1580886 - RNA, 19 nt, Homo sapiens
cgggagagguuuggaauug

SEQ ID NO: 1580887 - RNA, 19 nt, Homo sapiens
uuagggaacuugaaaccaa

SEQ ID NO: 1580888 - RNA, 19 nt, Homo sapiens
caagaccacuacaugacuu

SEQ ID NO: 1580889 - RNA, 19 nt, Homo sapiens
gugccugacucacagcaua

SEQ ID NO: 1580890 - RNA, 19 nt, Homo sapiens
uuagggaacuugaaaccaa

SEQ ID NO: 1580891 - RNA, 19 nt, Homo sapiens
caagaccacuacaugacuu

SEQ ID NO: 1580892 - RNA, 19 nt, Homo sapiens
gugccugacucacagcaua

SEQ ID NO: 1580893 - RNA, 19 nt, Homo sapiens
guacauuccugcaucuucu

SEQ ID NO: 1580894 - RNA, 19 nt, Homo sapiens
ccaacauccugacguaguu

SEQ ID NO: 1580895 - RNA, 19 nt, Homo sapiens
aaucaucucuucaauaagg

SEQ ID NO: 1580896 - RNA, 19 nt, Homo sapiens
gcaagaccaagaccaagaa

SEQ ID NO: 1580897 - RNA, 19 nt, Homo sapiens
gaaaacuguugcauuauuc

SEQ ID NO: 1580898 - RNA, 19 nt, Homo sapiens
agaaggagguguauuucau

SEQ ID NO: 1580899 - RNA, 19 nt, Homo sapiens
gggaugagauauggucaga

SEQ ID NO: 1580900 - RNA, 19 nt, Homo sapiens
agugaaaacuguugcauua

SEQ ID NO: 1580901 - RNA, 19 nt, Homo sapiens
gcucucaguucccuucaau

SEQ ID NO: 1580902 - RNA, 19 nt, Homo sapiens
ucaacgaguuuauguccaa

SEQ ID NO: 1580903 - RNA, 19 nt, Homo sapiens
guucuacgguugccagaga

SEQ ID NO: 1580904 - RNA, 19 nt, Homo sapiens
gaaccugcccagccgcuuu

SEQ ID NO: 1580905 - RNA, 19 nt, Homo sapiens
gcucuguuguucugcauug

SEQ ID NO: 1580906 - RNA, 19 nt, Homo sapiens
gcagagacaccucguuaag

SEQ ID NO: 1580907 - RNA, 19 nt, Homo sapiens
ggacccucauguuuaaaug

SEQ ID NO: 1580908 - RNA, 19 nt, Homo sapiens
ugggagggcuuuagcaaug

SEQ ID NO: 1580909 - RNA, 19 nt, Homo sapiens
ggucagacuuguagauaac

SEQ ID NO: 1580910 - RNA, 19 nt, Homo sapiens
ugacuucguggguuuauuu

SEQ ID NO: 1580911 - RNA, 19 nt, Homo sapiens
gaaggagguguauuucaug

SEQ ID NO: 1580912 - RNA, 19 nt, Homo sapiens
uaacacauucuuacugguu

SEQ ID NO: 1580913 - RNA, 19 nt, Homo sapiens
gaauggaaguuuggaucug

SEQ ID NO: 1580914 - RNA, 19 nt, Homo sapiens
gcugagcaauguuccuguu

SEQ ID NO: 1580915 - RNA, 19 nt, Homo sapiens
gaauggaaguuuggaucug

SEQ ID NO: 1580916 - RNA, 19 nt, Homo sapiens
ccagguuugcuauuuauaa

SEQ ID NO: 1580917 - RNA, 19 nt, Homo sapiens
ggacgaggagugugagaau

SEQ ID NO: 1580918 - RNA, 19 nt, Homo sapiens
gagaagcgagcgacaagga

SEQ ID NO: 1580919 - RNA, 19 nt, Homo sapiens
gggagagguuuggaauuga

SEQ ID NO: 1580920 - RNA, 19 nt, Homo sapiens
uaauguguauggaaagugu

SEQ ID NO: 1580921 - RNA, 19 nt, Homo sapiens
gaugggaaaccuucuggaa

SEQ ID NO: 1580922 - RNA, 19 nt, Homo sapiens
gaugggaaaccuucuggaa

SEQ ID NO: 1580923 - RNA, 19 nt, Homo sapiens
ucagagaacccugugauga

SEQ ID NO: 1580924 - RNA, 19 nt, Homo sapiens
gaucgggaguuagggagaa

SEQ ID NO: 1580925 - RNA, 19 nt, Homo sapiens
ccaaacgcuucaacgaguu

SEQ ID NO: 1580926 - RNA, 19 nt, Homo sapiens
gguggacaaucaucucuuc

SEQ ID NO: 1580927 - RNA, 19 nt, Homo sapiens
ugacuuagggaacuugaaa

SEQ ID NO: 1580928 - RNA, 19 nt, Homo sapiens
cugaacaacugccgcaaga

SEQ ID NO: 1580929 - RNA, 19 nt, Homo sapiens
gaaccagcacugucucugu

SEQ ID NO: 1580930 - RNA, 19 nt, Homo sapiens
ugacuuagggaacuugaaa

SEQ ID NO: 1580931 - RNA, 19 nt, Homo sapiens
cugaacaacugccgcaaga

SEQ ID NO: 1580932 - RNA, 19 nt, Homo sapiens
gaaccagcacugucucugu

SEQ ID NO: 1580933 - RNA, 19 nt, Homo sapiens
gauauggucagacuuguag

SEQ ID NO: 1580934 - RNA, 19 nt, Homo sapiens
gcuaaugccagaugacuuc

SEQ ID NO: 1580935 - RNA, 19 nt, Homo sapiens
cuagaguaccuuuggauuu

SEQ ID NO: 1580936 - RNA, 19 nt, Homo sapiens
cagcuuuccucgguucuuu

SEQ ID NO: 1580937 - RNA, 19 nt, Homo sapiens
gaaugaaacuccaucucaa

SEQ ID NO: 1580938 - RNA, 19 nt, Homo sapiens
gacaaugacuuccucaaug

SEQ ID NO: 1580939 - RNA, 19 nt, Homo sapiens
ggcaacauguuaugaauga

SEQ ID NO: 1580940 - RNA, 19 nt, Homo sapiens
gaaauaccaccaguuuaua

SEQ ID NO: 1580941 - RNA, 19 nt, Homo sapiens
ucaaugagcugagcaaugu

SEQ ID NO: 1580942 - RNA, 19 nt, Homo sapiens
ggacaaucaucucuucaau

SEQ ID NO: 1580943 - RNA, 19 nt, Homo sapiens
acaaugacuuccucaauga

SEQ ID NO: 1580944 - RNA, 19 nt, Homo sapiens
aaagaaauaccaccaguuu

SEQ ID NO: 1580945 - RNA, 19 nt, Homo sapiens
gaucaggauuaccagaauu

SEQ ID NO: 1580946 - RNA, 19 nt, Homo sapiens
gacaaucaucucuucaaua

SEQ ID NO: 1580947 - RNA, 19 nt, Homo sapiens
gaccguggaugguguggaa

SEQ ID NO: 1580948 - RNA, 19 nt, Homo sapiens
agaaauaccaccaguuuau

SEQ ID NO: 1580949 - RNA, 19 nt, Homo sapiens
cccagccgcuuuaaguuua

SEQ ID NO: 1580950 - RNA, 19 nt, Homo sapiens
gccagaaagugaagcuauu

SEQ ID NO: 1580951 - RNA, 19 nt, Homo sapiens
ggacuugccaacauucaaa

SEQ ID NO: 1580952 - RNA, 19 nt, Homo sapiens
ggagagguuuggaauugau

SEQ ID NO: 1580953 - RNA, 19 nt, Homo sapiens
cgggagagguuuggaauug

SEQ ID NO: 1580954 - RNA, 19 nt, Homo sapiens
aaucaucucuucaauaagg

SEQ ID NO: 1580955 - RNA, 19 nt, Homo sapiens
cagcuugggcaacauguua

SEQ ID NO: 1580956 - RNA, 19 nt, Homo sapiens
gcaagaccaagaccaagaa

SEQ ID NO: 1580957 - RNA, 19 nt, Homo sapiens
guucuacgguugccagaga

SEQ ID NO: 1580958 - RNA, 19 nt, Homo sapiens
gaaccugcccagccgcuuu

SEQ ID NO: 1580959 - RNA, 19 nt, Homo sapiens
gagaagcgagcgacaagga

SEQ ID NO: 1580960 - RNA, 19 nt, Homo sapiens
gggagagguuuggaauuga

SEQ ID NO: 1580961 - RNA, 19 nt, Homo sapiens
gcugagcaauguuccuguu

SEQ ID NO: 1580962 - RNA, 19 nt, Homo sapiens
ugaaugaaacuccaucuca

SEQ ID NO: 1580963 - RNA, 19 nt, Homo sapiens
gguggacaaucaucucuuc

SEQ ID NO: 1580964 - RNA, 19 nt, Homo sapiens
gcuaaugccagaugacuuc

SEQ ID NO: 1580965 - RNA, 19 nt, Homo sapiens
agaccaagaagaagcauuu

SEQ ID NO: 1580966 - RNA, 19 nt, Homo sapiens
agaccaagaccaagaagaa

SEQ ID NO: 1580967 - RNA, 19 nt, Homo sapiens
gcccagccgcuuuaaguuu

SEQ ID NO: 1580968 - RNA, 19 nt, Homo sapiens
agaucaagguggacaauca

SEQ ID NO: 1580969 - RNA, 19 nt, Homo sapiens
uaaagaaauaccaccaguu

SEQ ID NO: 1580970 - RNA, 19 nt, Homo sapiens
aagaaauaccaccaguuua

SEQ ID NO: 1580971 - RNA, 19 nt, Homo sapiens
aaugccagaugacuucaaa

SEQ ID NO: 1580972 - RNA, 19 nt, Homo sapiens
ugaaccacacgaucaauga

SEQ ID NO: 1580973 - RNA, 19 nt, Homo sapiens
uggcggagaugcacaacau

SEQ ID NO: 1580974 - RNA, 19 nt, Homo sapiens
uggaugguguggaaaccua

SEQ ID NO: 1580975 - RNA, 19 nt, Homo sapiens
gcaacauguuaugaaugaa

SEQ ID NO: 1580976 - RNA, 19 nt, Homo sapiens
acaaggagaaggccaagga

SEQ ID NO: 1580977 - RNA, 19 nt, Homo sapiens
ucacugugcaucgcaagua

SEQ ID NO: 1580978 - RNA, 19 nt, Homo sapiens
ugaucaggauuaccagaau

SEQ ID NO: 1580979 - RNA, 19 nt, Homo sapiens
aaugaaacuccaucucaaa

SEQ ID NO: 1580980 - RNA, 19 nt, Homo sapiens
gcgggacguugaggagauu

SEQ ID NO: 1580981 - RNA, 19 nt, Homo sapiens
agacaaugacuuccucaau

SEQ ID NO: 1580982 - RNA, 19 nt, Homo sapiens
aaaagaacuuccuggagaa

SEQ ID NO: 1580983 - RNA, 19 nt, Homo sapiens
ucgcaaguaugaccucaag

SEQ ID NO: 1580984 - RNA, 19 nt, Homo sapiens
ccagcaagaccaagaccaa

SEQ ID NO: 1580985 - RNA, 19 nt, Homo sapiens
gggcaacauguuaugaaug

SEQ ID NO: 1580986 - RNA, 19 nt, Homo sapiens
cacaguuccugggcaugua

SEQ ID NO: 1580987 - RNA, 19 nt, Homo sapiens
ugucauggcaacacgcuuu

SEQ ID NO: 1580988 - RNA, 19 nt, Homo sapiens
gaucaagguggacaaucau

SEQ ID NO: 1580989 - RNA, 19 nt, Homo sapiens
gaaccacacgaucaaugag

SEQ ID NO: 1580990 - RNA, 19 nt, Homo sapiens
ccaagaagaagcauuucgu

SEQ ID NO: 1580991 - RNA, 19 nt, Homo sapiens
ugggcaacauguuaugaau

SEQ ID NO: 1580992 - RNA, 19 nt, Homo sapiens
gcuggagaaucgcuugaac

SEQ ID NO: 1580993 - RNA, 19 nt, Homo sapiens
gaaacugaagcgggacguu

SEQ ID NO: 1580994 - RNA, 19 nt, Homo sapiens
aaauaccaccaguuuauag

SEQ ID NO: 1580995 - RNA, 19 nt, Homo sapiens
gcaagaucaagguggacaa

SEQ ID NO: 1580996 - RNA, 19 nt, Homo sapiens
caaugacuuccucaaugaa

SEQ ID NO: 1580997 - RNA, 19 nt, Homo sapiens
gagcaauguuccuguuccu

SEQ ID NO: 1580998 - RNA, 19 nt, Homo sapiens
ccagaaagugaagcuauuc

SEQ ID NO: 1580999 - RNA, 19 nt, Homo sapiens
cagagaagcgagcgacaag

SEQ ID NO: 1581000 - RNA, 19 nt, Homo sapiens
gugaaccacacgaucaaug

SEQ ID NO: 1581001 - RNA, 19 nt, Homo sapiens
gcuuugucaucaagacugu

SEQ ID NO: 1581002 - RNA, 19 nt, Homo sapiens
uucaaagccuacagcaaga

SEQ ID NO: 1581003 - RNA, 19 nt, Homo sapiens
gaacuuccuggagaaacug

SEQ ID NO: 1581004 - RNA, 19 nt, Homo sapiens
agaacuuccuggagaaacu

SEQ ID NO: 1581005 - RNA, 19 nt, Homo sapiens
aaagaacuuccuggagaaa

SEQ ID NO: 1581006 - RNA, 19 nt, Homo sapiens
caagaucaagguggacaau

SEQ ID NO: 1581007 - RNA, 19 nt, Homo sapiens
auucaaagacaaugacuuc

SEQ ID NO: 1581008 - RNA, 19 nt, Homo sapiens
ccagagaagcgagcgacaa

SEQ ID NO: 1581009 - RNA, 19 nt, Homo sapiens
cacugugcaucgcaaguau

SEQ ID NO: 1581010 - RNA, 19 nt, Homo sapiens
ccacaguuccugggcaugu

SEQ ID NO: 1581011 - RNA, 19 nt, Homo sapiens
ugccaacauucaaagacaa

SEQ ID NO: 1581012 - RNA, 19 nt, Homo sapiens
ccaagaccaagaagaagca

SEQ ID NO: 1581013 - RNA, 19 nt, Homo sapiens
ugagguuucuuaaagcuua

SEQ ID NO: 1581014 - RNA, 19 nt, Homo sapiens
caggacaucuccaucaaga

SEQ ID NO: 1581015 - RNA, 19 nt, Homo sapiens
ucaucgacuuuguggcuuu

SEQ ID NO: 1581016 - RNA, 19 nt, Homo sapiens
gagguuucuuaaagcuuau

SEQ ID NO: 1581017 - RNA, 19 nt, Homo sapiens
aaaugagguuucuuaaagc

SEQ ID NO: 1581018 - RNA, 19 nt, Homo sapiens
uccaggacaucuccaucaa

SEQ ID NO: 1581019 - RNA, 19 nt, Homo sapiens
accaggagcugaggagugu

SEQ ID NO: 1581020 - RNA, 19 nt, Homo sapiens
uggcagaaacacccaccua

SEQ ID NO: 1581021 - RNA, 19 nt, Homo sapiens
gcaccccacuugcacugaa

SEQ ID NO: 1581022 - RNA, 19 nt, Homo sapiens
caggagcugaggaguguga

SEQ ID NO: 1581023 - RNA, 19 nt, Homo sapiens
ggacagggcucucuaauaa

SEQ ID NO: 1581024 - RNA, 19 nt, Homo sapiens
gaacccacccaacagaaua

SEQ ID NO: 1581025 - RNA, 19 nt, Homo sapiens
gaucugggccugccucuga

SEQ ID NO: 1581026 - RNA, 19 nt, Homo sapiens
gcacagguucagcauguuu

SEQ ID NO: 1581027 - RNA, 19 nt, Homo sapiens
ggacgaggcuguggcuauc

SEQ ID NO: 1581028 - RNA, 19 nt, Homo sapiens
caggguguaugacaacuuu

SEQ ID NO: 1581029 - RNA, 19 nt, Homo sapiens
gggacagggcucucuaaua

SEQ ID NO: 1581030 - RNA, 19 nt, Homo sapiens
gcccaguucuuccguguug

SEQ ID NO: 1581031 - RNA, 19 nt, Homo sapiens
gggccaagcucuucauggu

SEQ ID NO: 1581032 - RNA, 19 nt, Homo sapiens
gggaagacccagagcaaga

SEQ ID NO: 1581033 - RNA, 19 nt, Homo sapiens
ggacagggccaagcucuuc

SEQ ID NO: 1581034 - RNA, 19 nt, Homo sapiens
caagaacccacccaacaga

SEQ ID NO: 1581035 - RNA, 19 nt, Homo sapiens
gaucucguccuuccuuaga

SEQ ID NO: 1581036 - RNA, 19 nt, Homo sapiens
gggcacguguccacuuuua

SEQ ID NO: 1581037 - RNA, 19 nt, Homo sapiens
caagaucucguccuuccuu

SEQ ID NO: 1581038 - RNA, 19 nt, Homo sapiens
acaaggugcuggcuguguu

SEQ ID NO: 1581039 - RNA, 19 nt, Homo sapiens
ccaaggcuucuaccaguuu

SEQ ID NO: 1581040 - RNA, 19 nt, Homo sapiens
cuucaggccucuaggaugu

SEQ ID NO: 1581041 - RNA, 19 nt, Homo sapiens
gccaagaacccacccaaca

SEQ ID NO: 1581042 - RNA, 19 nt, Homo sapiens
cugcacagguucagcaugu

SEQ ID NO: 1581043 - RNA, 19 nt, Homo sapiens
agagcaagaucucguccuu

SEQ ID NO: 1581044 - RNA, 19 nt, Homo sapiens
gaggagggaggaagaagau

SEQ ID NO: 1581045 - RNA, 19 nt, Homo sapiens
gccuguguguggaguauga

SEQ ID NO: 1581046 - RNA, 19 nt, Homo sapiens
caaggcuucuaccaguuug

SEQ ID NO: 1581047 - RNA, 19 nt, Homo sapiens
cuacaaggguuccgaugac

SEQ ID NO: 1581048 - RNA, 19 nt, Homo sapiens
caacuuuggccaugucauc

SEQ ID NO: 1581049 - RNA, 19 nt, Homo sapiens
agaugagggucuucacuuc

SEQ ID NO: 1581050 - RNA, 19 nt, Homo sapiens
gagaagcccugagcuaccu

SEQ ID NO: 1581051 - RNA, 19 nt, Homo sapiens
ggaagacccagagcaagau

SEQ ID NO: 1581052 - RNA, 19 nt, Homo sapiens
caaggguuccgaugacuuc

SEQ ID NO: 1581053 - RNA, 19 nt, Homo sapiens
gacagggcucucuaauaaa

SEQ ID NO: 1581054 - RNA, 19 nt, Homo sapiens
ggaagcagagcgucaugca

SEQ ID NO: 1581055 - RNA, 19 nt, Homo sapiens
aagaucucguccuuccuua

SEQ ID NO: 1581056 - RNA, 19 nt, Homo sapiens
cagaugagggucuucacuu

SEQ ID NO: 1581057 - RNA, 19 nt, Homo sapiens
gggacgaggcuguggcuau

SEQ ID NO: 1581058 - RNA, 19 nt, Homo sapiens
accauaagcagcaguuuga

SEQ ID NO: 1581059 - RNA, 19 nt, Homo sapiens
ccaggaaagcuaagagucu

SEQ ID NO: 1581060 - RNA, 19 nt, Homo sapiens
cugcaaagccagaggacuu

SEQ ID NO: 1581061 - RNA, 19 nt, Homo sapiens
ccaagaacccacccaacag

SEQ ID NO: 1581062 - RNA, 19 nt, Homo sapiens
caccauaagcagcaguuug

SEQ ID NO: 1581063 - RNA, 19 nt, Homo sapiens
agacguggcccaguucuuc

SEQ ID NO: 1581064 - RNA, 19 nt, Homo sapiens
ugacagccuauaagcaaga

SEQ ID NO: 1581065 - RNA, 19 nt, Homo sapiens
cgaggagggaggaagaaga

SEQ ID NO: 1581066 - RNA, 19 nt, Homo sapiens
ucugagaagcccugagcua

SEQ ID NO: 1581067 - RNA, 19 nt, Homo sapiens
cacccaacguggcuugauc

SEQ ID NO: 1581068 - RNA, 19 nt, Homo sapiens
gaagacccagagcaagauc

SEQ ID NO: 1581069 - RNA, 19 nt, Homo sapiens
gcagaugagggucuucacu

SEQ ID NO: 1581070 - RNA, 19 nt, Homo sapiens
uccgagacguggcccaguu

SEQ ID NO: 1581071 - RNA, 19 nt, Homo sapiens
gcacguguccacuuuuaau

SEQ ID NO: 1581072 - RNA, 19 nt, Homo sapiens
cagugugcguggagaagau

SEQ ID NO: 1581073 - RNA, 19 nt, Homo sapiens
caaggugcuggcuguguug

SEQ ID NO: 1581074 - RNA, 19 nt, Homo sapiens
gaaagugcuuccccagaac

SEQ ID NO: 1581075 - RNA, 19 nt, Homo sapiens
uccaaggcuucuaccaguu

SEQ ID NO: 1581076 - RNA, 19 nt, Homo sapiens
cccugucccuccugucuga

SEQ ID NO: 1581077 - RNA, 19 nt, Homo sapiens
ggacagggcucucuaauaa

SEQ ID NO: 1581078 - RNA, 19 nt, Homo sapiens
gcaagucgcuccugucauu

SEQ ID NO: 1581079 - RNA, 19 nt, Homo sapiens
gcagcaagccgacaucaua

SEQ ID NO: 1581080 - RNA, 19 nt, Homo sapiens
ggacagucgugaucuuuga

SEQ ID NO: 1581081 - RNA, 19 nt, Homo sapiens
gagggaaggugcugagcua

SEQ ID NO: 1581082 - RNA, 19 nt, Homo sapiens
gaagaugugugaagaaucg

SEQ ID NO: 1581083 - RNA, 19 nt, Homo sapiens
gaacccacccaacagaaua

SEQ ID NO: 1581084 - RNA, 19 nt, Homo sapiens
gagaagaugugugaagaau

SEQ ID NO: 1581085 - RNA, 19 nt, Homo sapiens
gaccaucagugcuuacuau

SEQ ID NO: 1581086 - RNA, 19 nt, Homo sapiens
ccagggagcuacaucuuug

SEQ ID NO: 1581087 - RNA, 19 nt, Homo sapiens
gaauggccguggugugauu

SEQ ID NO: 1581088 - RNA, 19 nt, Homo sapiens
gaucugggccugccucuga

SEQ ID NO: 1581089 - RNA, 19 nt, Homo sapiens
gcagagcacacaacauuga

SEQ ID NO: 1581090 - RNA, 19 nt, Homo sapiens
ucacacaggucaucaacga

SEQ ID NO: 1581091 - RNA, 19 nt, Homo sapiens
gagaguaaccaucuacaga

SEQ ID NO: 1581092 - RNA, 19 nt, Homo sapiens
ccauagggauucucgaaga

SEQ ID NO: 1581093 - RNA, 19 nt, Homo sapiens
ugaagaaacaagagaguaa

SEQ ID NO: 1581094 - RNA, 19 nt, Homo sapiens
gaagagaacagcguugugu

SEQ ID NO: 1581095 - RNA, 19 nt, Homo sapiens
gcacagguucagcauguuu

SEQ ID NO: 1581096 - RNA, 19 nt, Homo sapiens
ggacgaggcuguggcuauc

SEQ ID NO: 1581097 - RNA, 19 nt, Homo sapiens
caggguguaugacaacuuu

SEQ ID NO: 1581098 - RNA, 19 nt, Homo sapiens
gggacagggcucucuaaua

SEQ ID NO: 1581099 - RNA, 19 nt, Homo sapiens
uugcaaagcugaagaugau

SEQ ID NO: 1581100 - RNA, 19 nt, Homo sapiens
ugaagaaucggcauccuuu

SEQ ID NO: 1581101 - RNA, 19 nt, Homo sapiens
ggaaggugcugagcuacug

SEQ ID NO: 1581102 - RNA, 19 nt, Homo sapiens
gcccaguucuuccguguug

SEQ ID NO: 1581103 - RNA, 19 nt, Homo sapiens
ggaaggcucugggcaacau

SEQ ID NO: 1581104 - RNA, 19 nt, Homo sapiens
ccgcagagcacacaacauu

SEQ ID NO: 1581105 - RNA, 19 nt, Homo sapiens
gggccaagcucuucauggu

SEQ ID NO: 1581106 - RNA, 19 nt, Homo sapiens
gggcuggacuucucagaca

SEQ ID NO: 1581107 - RNA, 19 nt, Homo sapiens
caucagugcuuacuaugca

SEQ ID NO: 1581108 - RNA, 19 nt, Homo sapiens
cuacaucuuugagcuguuu

SEQ ID NO: 1581109 - RNA, 19 nt, Homo sapiens
ggacaucccaaagauuauu

SEQ ID NO: 1581110 - RNA, 19 nt, Homo sapiens
acacggacaucccaaagau

SEQ ID NO: 1581111 - RNA, 19 nt, Homo sapiens
gggaagacccagagcaaga

SEQ ID NO: 1581112 - RNA, 19 nt, Homo sapiens
gaccacagguucgccuuug

SEQ ID NO: 1581113 - RNA, 19 nt, Homo sapiens
ggacagggccaagcucuuc

SEQ ID NO: 1581114 - RNA, 19 nt, Homo sapiens
ccuaugggcuccugaucuu

SEQ ID NO: 1581115 - RNA, 19 nt, Homo sapiens
gcaagccgacaucauauuc

SEQ ID NO: 1581116 - RNA, 19 nt, Homo sapiens
ggacuacggagcugucuuc

SEQ ID NO: 1581117 - RNA, 19 nt, Homo sapiens
gacauuauccagauugugu

SEQ ID NO: 1581118 - RNA, 19 nt, Homo sapiens
acagggcucucuaauaaag

SEQ ID NO: 1581119 - RNA, 19 nt, Homo sapiens
caagaacccacccaacaga

SEQ ID NO: 1581120 - RNA, 19 nt, Homo sapiens
gagcugucuuccucuguga

SEQ ID NO: 1581121 - RNA, 19 nt, Homo sapiens
ggagaagaugugugaagaa

SEQ ID NO: 1581122 - RNA, 19 nt, Homo sapiens
ggacuucucagacacgaau

SEQ ID NO: 1581123 - RNA, 19 nt, Homo sapiens
ggagaacccacacaucauc

SEQ ID NO: 1581124 - RNA, 19 nt, Homo sapiens
acggacaucccaaagauua

SEQ ID NO: 1581125 - RNA, 19 nt, Homo sapiens
gaucucguccuuccuuaga

SEQ ID NO: 1581126 - RNA, 19 nt, Homo sapiens
ugaauggugugaccguaga

SEQ ID NO: 1581127 - RNA, 19 nt, Homo sapiens
gaagcuggcggacauuauc

SEQ ID NO: 1581128 - RNA, 19 nt, Homo sapiens
gcccagaucacguuucaga

SEQ ID NO: 1581129 - RNA, 19 nt, Homo sapiens
acaagagaguaaccaucua

SEQ ID NO: 1581130 - RNA, 19 nt, Homo sapiens
gggcacguguccacuuuua

SEQ ID NO: 1581131 - RNA, 19 nt, Homo sapiens
caagaucucguccuuccuu

SEQ ID NO: 1581132 - RNA, 19 nt, Homo sapiens
gcugauaugcccaagauag

SEQ ID NO: 1581133 - RNA, 19 nt, Homo sapiens
acaaggugcuggcuguguu

SEQ ID NO: 1581134 - RNA, 19 nt, Homo sapiens
ccaaggcuucuaccaguuu

SEQ ID NO: 1581135 - RNA, 19 nt, Homo sapiens
gaccguagacuucccuuuc

SEQ ID NO: 1581136 - RNA, 19 nt, Homo sapiens
ccaagauaguccugaaugg

SEQ ID NO: 1581137 - RNA, 19 nt, Homo sapiens
gaagaaucggcauccuuug

SEQ ID NO: 1581138 - RNA, 19 nt, Homo sapiens
uggagaagaugugugaaga

SEQ ID NO: 1581139 - RNA, 19 nt, Homo sapiens
gaaacaagagaguaaccau

SEQ ID NO: 1581140 - RNA, 19 nt, Homo sapiens
ccaagguccuggaaugucu

SEQ ID NO: 1581141 - RNA, 19 nt, Homo sapiens
gccaagaacccacccaaca

SEQ ID NO: 1581142 - RNA, 19 nt, Homo sapiens
ccgagaccaucagugcuua

SEQ ID NO: 1581143 - RNA, 19 nt, Homo sapiens
gagcuccgcguuugacaga

SEQ ID NO: 1581144 - RNA, 19 nt, Homo sapiens
uauucaugccguacaauua

SEQ ID NO: 1581145 - RNA, 19 nt, Homo sapiens
cugcacagguucagcaugu

SEQ ID NO: 1581146 - RNA, 19 nt, Homo sapiens
caguugagcuccgcguuug

SEQ ID NO: 1581147 - RNA, 19 nt, Homo sapiens
acauggagcuggaagacau

SEQ ID NO: 1581148 - RNA, 19 nt, Homo sapiens
acaaaugccaacaggagua

SEQ ID NO: 1581149 - RNA, 19 nt, Homo sapiens
agagcaagaucucguccuu

SEQ ID NO: 1581150 - RNA, 19 nt, Homo sapiens
ggccaucgaugcuguugag

SEQ ID NO: 1581151 - RNA, 19 nt, Homo sapiens
gcucugugcccuucugaga

SEQ ID NO: 1581152 - RNA, 19 nt, Homo sapiens
gaggagggaggaagaagau

SEQ ID NO: 1581153 - RNA, 19 nt, Homo sapiens
gccuguguguggaguauga

SEQ ID NO: 1581154 - RNA, 19 nt, Homo sapiens
caaggcuucuaccaguuug

SEQ ID NO: 1581155 - RNA, 19 nt, Homo sapiens
cuacaaggguuccgaugac

SEQ ID NO: 1581156 - RNA, 19 nt, Homo sapiens
caacuuuggccaugucauc

SEQ ID NO: 1581157 - RNA, 19 nt, Homo sapiens
gcgcugaagccgcuguuug

SEQ ID NO: 1581158 - RNA, 19 nt, Homo sapiens
ccuauaaggugcacaucca

SEQ ID NO: 1581159 - RNA, 19 nt, Homo sapiens
gaacauggagcuggaagac

SEQ ID NO: 1581160 - RNA, 19 nt, Homo sapiens
acacaacauugaccugaag

SEQ ID NO: 1581161 - RNA, 19 nt, Homo sapiens
gagaagcccugagcuaccu

SEQ ID NO: 1581162 - RNA, 19 nt, Homo sapiens
gggccuuacaguccuauaa

SEQ ID NO: 1581163 - RNA, 19 nt, Homo sapiens
cagaagcuggcggacauua

SEQ ID NO: 1581164 - RNA, 19 nt, Homo sapiens
gccagggagcuacaucuuu

SEQ ID NO: 1581165 - RNA, 19 nt, Homo sapiens
ggagagcccuacggguaca

SEQ ID NO: 1581166 - RNA, 19 nt, Homo sapiens
gugaagaaacaagagagua

SEQ ID NO: 1581167 - RNA, 19 nt, Homo sapiens
ggaagacccagagcaagau

SEQ ID NO: 1581168 - RNA, 19 nt, Homo sapiens
caaggguuccgaugacuuc

SEQ ID NO: 1581169 - RNA, 19 nt, Homo sapiens
agaugcaguuccuggauga

SEQ ID NO: 1581170 - RNA, 19 nt, Homo sapiens
gaucuucuucccuuccuau

SEQ ID NO: 1581171 - RNA, 19 nt, Homo sapiens
gcaccacugcagccagaaa

SEQ ID NO: 1581172 - RNA, 19 nt, Homo sapiens
gaucgggccuugucauccu

SEQ ID NO: 1581173 - RNA, 19 nt, Homo sapiens
gugcuggaguguucaccaa

SEQ ID NO: 1581174 - RNA, 19 nt, Homo sapiens
uggaagacauugcaaagcu

SEQ ID NO: 1581175 - RNA, 19 nt, Homo sapiens
cacacaacauugaccugaa

SEQ ID NO: 1581176 - RNA, 19 nt, Homo sapiens
ucauauucaugccguacaa

SEQ ID NO: 1581177 - RNA, 19 nt, Homo sapiens
ugagguuucuuaaagcuua

SEQ ID NO: 1581178 - RNA, 19 nt, Homo sapiens
caggacaucuccaucaaga

SEQ ID NO: 1581179 - RNA, 19 nt, Homo sapiens
gcacagguucagcauguuu

SEQ ID NO: 1581180 - RNA, 19 nt, Homo sapiens
gggaagacccagagcaaga

SEQ ID NO: 1581181 - RNA, 19 nt, Homo sapiens
gaucucguccuuccuuaga

SEQ ID NO: 1581182 - RNA, 19 nt, Homo sapiens
caagaucucguccuuccuu

SEQ ID NO: 1581183 - RNA, 19 nt, Homo sapiens
cugcacagguucagcaugu

SEQ ID NO: 1581184 - RNA, 19 nt, Homo sapiens
agagcaagaucucguccuu

SEQ ID NO: 1581185 - RNA, 19 nt, Homo sapiens
ggaagacccagagcaagau

SEQ ID NO: 1581186 - RNA, 19 nt, Homo sapiens
ucaucgacuuuguggcuuu

SEQ ID NO: 1581187 - RNA, 19 nt, Homo sapiens
ggaagcagagcgucaugca

SEQ ID NO: 1581188 - RNA, 19 nt, Homo sapiens
aagaucucguccuuccuua

SEQ ID NO: 1581189 - RNA, 19 nt, Homo sapiens
gagguuucuuaaagcuuau

SEQ ID NO: 1581190 - RNA, 19 nt, Homo sapiens
cugcaaagccagaggacuu

SEQ ID NO: 1581191 - RNA, 19 nt, Homo sapiens
aaaugagguuucuuaaagc

SEQ ID NO: 1581192 - RNA, 19 nt, Homo sapiens
uccaggacaucuccaucaa

SEQ ID NO: 1581193 - RNA, 19 nt, Homo sapiens
accaggagcugaggagugu

SEQ ID NO: 1581194 - RNA, 19 nt, Homo sapiens
gaagacccagagcaagauc

SEQ ID NO: 1581195 - RNA, 19 nt, Homo sapiens
uggcagaaacacccaccua

SEQ ID NO: 1581196 - RNA, 19 nt, Homo sapiens
gcaccccacuugcacugaa

SEQ ID NO: 1581197 - RNA, 19 nt, Homo sapiens
caggagcugaggaguguga

SEQ ID NO: 1581198 - RNA, 19 nt, Homo sapiens
gcaagucgcuccugucauu

SEQ ID NO: 1581199 - RNA, 19 nt, Homo sapiens
gcagcaagccgacaucaua

SEQ ID NO: 1581200 - RNA, 19 nt, Homo sapiens
ggacagucgugaucuuuga

SEQ ID NO: 1581201 - RNA, 19 nt, Homo sapiens
gagggaaggugcugagcua

SEQ ID NO: 1581202 - RNA, 19 nt, Homo sapiens
gaagaugugugaagaaucg

SEQ ID NO: 1581203 - RNA, 19 nt, Homo sapiens
ugagguuucuuaaagcuua

SEQ ID NO: 1581204 - RNA, 19 nt, Homo sapiens
gagaagaugugugaagaau

SEQ ID NO: 1581205 - RNA, 19 nt, Homo sapiens
gaccaucagugcuuacuau

SEQ ID NO: 1581206 - RNA, 19 nt, Homo sapiens
ccagggagcuacaucuuug

SEQ ID NO: 1581207 - RNA, 19 nt, Homo sapiens
gaauggccguggugugauu

SEQ ID NO: 1581208 - RNA, 19 nt, Homo sapiens
gcagagcacacaacauuga

SEQ ID NO: 1581209 - RNA, 19 nt, Homo sapiens
ucacacaggucaucaacga

SEQ ID NO: 1581210 - RNA, 19 nt, Homo sapiens
caggacaucuccaucaaga

SEQ ID NO: 1581211 - RNA, 19 nt, Homo sapiens
gagaguaaccaucuacaga

SEQ ID NO: 1581212 - RNA, 19 nt, Homo sapiens
ccauagggauucucgaaga

SEQ ID NO: 1581213 - RNA, 19 nt, Homo sapiens
ugaagaaacaagagaguaa

SEQ ID NO: 1581214 - RNA, 19 nt, Homo sapiens
gaagagaacagcguugugu

SEQ ID NO: 1581215 - RNA, 19 nt, Homo sapiens
gcacagguucagcauguuu

SEQ ID NO: 1581216 - RNA, 19 nt, Homo sapiens
ggacgaggcuguggcuauc

SEQ ID NO: 1581217 - RNA, 19 nt, Homo sapiens
caggguguaugacaacuuu

SEQ ID NO: 1581218 - RNA, 19 nt, Homo sapiens
uugcaaagcugaagaugau

SEQ ID NO: 1581219 - RNA, 19 nt, Homo sapiens
ugaagaaucggcauccuuu

SEQ ID NO: 1581220 - RNA, 19 nt, Homo sapiens
ggaaggugcugagcuacug

SEQ ID NO: 1581221 - RNA, 19 nt, Homo sapiens
gcccaguucuuccguguug

SEQ ID NO: 1581222 - RNA, 19 nt, Homo sapiens
ggaaggcucugggcaacau

SEQ ID NO: 1581223 - RNA, 19 nt, Homo sapiens
ccgcagagcacacaacauu

SEQ ID NO: 1581224 - RNA, 19 nt, Homo sapiens
gggccaagcucuucauggu

SEQ ID NO: 1581225 - RNA, 19 nt, Homo sapiens
gggcuggacuucucagaca

SEQ ID NO: 1581226 - RNA, 19 nt, Homo sapiens
caucagugcuuacuaugca

SEQ ID NO: 1581227 - RNA, 19 nt, Homo sapiens
cuacaucuuugagcuguuu

SEQ ID NO: 1581228 - RNA, 19 nt, Homo sapiens
ggacaucccaaagauuauu

SEQ ID NO: 1581229 - RNA, 19 nt, Homo sapiens
acacggacaucccaaagau

SEQ ID NO: 1581230 - RNA, 19 nt, Homo sapiens
gggaagacccagagcaaga

SEQ ID NO: 1581231 - RNA, 19 nt, Homo sapiens
gaccacagguucgccuuug

SEQ ID NO: 1581232 - RNA, 19 nt, Homo sapiens
ggacagggccaagcucuuc

SEQ ID NO: 1581233 - RNA, 19 nt, Homo sapiens
ccuaugggcuccugaucuu

SEQ ID NO: 1581234 - RNA, 19 nt, Homo sapiens
gcaagccgacaucauauuc

SEQ ID NO: 1581235 - RNA, 19 nt, Homo sapiens
ggacuacggagcugucuuc

SEQ ID NO: 1581236 - RNA, 19 nt, Homo sapiens
gacauuauccagauugugu

SEQ ID NO: 1581237 - RNA, 19 nt, Homo sapiens
gagcugucuuccucuguga

SEQ ID NO: 1581238 - RNA, 19 nt, Homo sapiens
ggagaagaugugugaagaa

SEQ ID NO: 1581239 - RNA, 19 nt, Homo sapiens
ggacuucucagacacgaau

SEQ ID NO: 1581240 - RNA, 19 nt, Homo sapiens
ggagaacccacacaucauc

SEQ ID NO: 1581241 - RNA, 19 nt, Homo sapiens
acggacaucccaaagauua

SEQ ID NO: 1581242 - RNA, 19 nt, Homo sapiens
gaucucguccuuccuuaga

SEQ ID NO: 1581243 - RNA, 19 nt, Homo sapiens
gaagcuggcggacauuauc

SEQ ID NO: 1581244 - RNA, 19 nt, Homo sapiens
ugaauggugugaccguaga

SEQ ID NO: 1581245 - RNA, 19 nt, Homo sapiens
gcccagaucacguuucaga

SEQ ID NO: 1581246 - RNA, 19 nt, Homo sapiens
acaagagaguaaccaucua

SEQ ID NO: 1581247 - RNA, 19 nt, Homo sapiens
caagaucucguccuuccuu

SEQ ID NO: 1581248 - RNA, 19 nt, Homo sapiens
gaccguagacuucccuuuc

SEQ ID NO: 1581249 - RNA, 19 nt, Homo sapiens
acaaggugcuggcuguguu

SEQ ID NO: 1581250 - RNA, 19 nt, Homo sapiens
ccaaggcuucuaccaguuu

SEQ ID NO: 1581251 - RNA, 19 nt, Homo sapiens
gcugauaugcccaagauag

SEQ ID NO: 1581252 - RNA, 19 nt, Homo sapiens
ccaagauaguccugaaugg

SEQ ID NO: 1581253 - RNA, 19 nt, Homo sapiens
cuucaggccucuaggaugu

SEQ ID NO: 1581254 - RNA, 19 nt, Homo sapiens
gaagaaucggcauccuuug

SEQ ID NO: 1581255 - RNA, 19 nt, Homo sapiens
uggagaagaugugugaaga

SEQ ID NO: 1581256 - RNA, 19 nt, Homo sapiens
gaaacaagagaguaaccau

SEQ ID NO: 1581257 - RNA, 19 nt, Homo sapiens
ccaagguccuggaaugucu

SEQ ID NO: 1581258 - RNA, 19 nt, Homo sapiens
ccgagaccaucagugcuua

SEQ ID NO: 1581259 - RNA, 19 nt, Homo sapiens
gagcuccgcguuugacaga

SEQ ID NO: 1581260 - RNA, 19 nt, Homo sapiens
uauucaugccguacaauua

SEQ ID NO: 1581261 - RNA, 19 nt, Homo sapiens
cugcacagguucagcaugu

SEQ ID NO: 1581262 - RNA, 19 nt, Homo sapiens
acaaaugccaacaggagua

SEQ ID NO: 1581263 - RNA, 19 nt, Homo sapiens
caguugagcuccgcguuug

SEQ ID NO: 1581264 - RNA, 19 nt, Homo sapiens
acauggagcuggaagacau

SEQ ID NO: 1581265 - RNA, 19 nt, Homo sapiens
agagcaagaucucguccuu

SEQ ID NO: 1581266 - RNA, 19 nt, Homo sapiens
gcucugugcccuucugaga

SEQ ID NO: 1581267 - RNA, 19 nt, Homo sapiens
ggccaucgaugcuguugag

SEQ ID NO: 1581268 - RNA, 19 nt, Homo sapiens
gaggagggaggaagaagau

SEQ ID NO: 1581269 - RNA, 19 nt, Homo sapiens
gccuguguguggaguauga

SEQ ID NO: 1581270 - RNA, 19 nt, Homo sapiens
caaggcuucuaccaguuug

SEQ ID NO: 1581271 - RNA, 19 nt, Homo sapiens
cuacaaggguuccgaugac

SEQ ID NO: 1581272 - RNA, 19 nt, Homo sapiens
caacuuuggccaugucauc

SEQ ID NO: 1581273 - RNA, 19 nt, Homo sapiens
gcgcugaagccgcuguuug

SEQ ID NO: 1581274 - RNA, 19 nt, Homo sapiens
ccuauaaggugcacaucca

SEQ ID NO: 1581275 - RNA, 19 nt, Homo sapiens
gaacauggagcuggaagac

SEQ ID NO: 1581276 - RNA, 19 nt, Homo sapiens
acacaacauugaccugaag

SEQ ID NO: 1581277 - RNA, 19 nt, Homo sapiens
ggagagcccuacggguaca

SEQ ID NO: 1581278 - RNA, 19 nt, Homo sapiens
gggccuuacaguccuauaa

SEQ ID NO: 1581279 - RNA, 19 nt, Homo sapiens
cagaagcuggcggacauua

SEQ ID NO: 1581280 - RNA, 19 nt, Homo sapiens
gccagggagcuacaucuuu

SEQ ID NO: 1581281 - RNA, 19 nt, Homo sapiens
gugaagaaacaagagagua

SEQ ID NO: 1581282 - RNA, 19 nt, Homo sapiens
ggaagacccagagcaagau

SEQ ID NO: 1581283 - RNA, 19 nt, Homo sapiens
caaggguuccgaugacuuc

SEQ ID NO: 1581284 - RNA, 19 nt, Homo sapiens
gaucgggccuugucauccu

SEQ ID NO: 1581285 - RNA, 19 nt, Homo sapiens
agaugcaguuccuggauga

SEQ ID NO: 1581286 - RNA, 19 nt, Homo sapiens
gaucuucuucccuuccuau

SEQ ID NO: 1581287 - RNA, 19 nt, Homo sapiens
gcaccacugcagccagaaa

SEQ ID NO: 1581288 - RNA, 19 nt, Homo sapiens
gugcuggaguguucaccaa

SEQ ID NO: 1581289 - RNA, 19 nt, Homo sapiens
uggaagacauugcaaagcu

SEQ ID NO: 1581290 - RNA, 19 nt, Homo sapiens
cacacaacauugaccugaa

SEQ ID NO: 1581291 - RNA, 19 nt, Homo sapiens
ucauauucaugccguacaa

SEQ ID NO: 1581292 - RNA, 19 nt, Homo sapiens
ucaucgacuuuguggcuuu

SEQ ID NO: 1581293 - RNA, 19 nt, Homo sapiens
ggaagcagagcgucaugca

SEQ ID NO: 1581294 - RNA, 19 nt, Homo sapiens
aagaucucguccuuccuua

SEQ ID NO: 1581295 - RNA, 19 nt, Homo sapiens
ggagaagagccuggaguuc

SEQ ID NO: 1581296 - RNA, 19 nt, Homo sapiens
uaagauguucggagugguu

SEQ ID NO: 1581297 - RNA, 19 nt, Homo sapiens
aggcugauaugcccaagau

SEQ ID NO: 1581298 - RNA, 19 nt, Homo sapiens
gaacuucacugucacugua

SEQ ID NO: 1581299 - RNA, 19 nt, Homo sapiens
gaacuucacugucacugua

SEQ ID NO: 1581300 - RNA, 19 nt, Homo sapiens
gaacuucacugucacugua

SEQ ID NO: 1581301 - RNA, 19 nt, Homo sapiens
ccacaaagcugaccuacaa

SEQ ID NO: 1581302 - RNA, 19 nt, Homo sapiens
gaacgaagauuuccugaag

SEQ ID NO: 1581303 - RNA, 19 nt, Homo sapiens
gcaaggcucuggcuuccua

SEQ ID NO: 1581304 - RNA, 19 nt, Homo sapiens
gcaaggcucuggcuuccua

SEQ ID NO: 1581305 - RNA, 19 nt, Homo sapiens
gcaaggcucuggcuuccua

SEQ ID NO: 1581306 - RNA, 19 nt, Homo sapiens
gaagaacuuugcccacuga

SEQ ID NO: 1581307 - RNA, 19 nt, Homo sapiens
caacuggagugacgacuuu

SEQ ID NO: 1581308 - RNA, 19 nt, Homo sapiens
gagaucaccugcccagaaa

SEQ ID NO: 1581309 - RNA, 19 nt, Homo sapiens
gagaucaccugcccagaaa

SEQ ID NO: 1581310 - RNA, 19 nt, Homo sapiens
gagaucaccugcccagaaa

SEQ ID NO: 1581311 - RNA, 19 nt, Homo sapiens
gcugagaacuucacuguca

SEQ ID NO: 1581312 - RNA, 19 nt, Homo sapiens
cgacgcggguuucguguua

SEQ ID NO: 1581313 - RNA, 19 nt, Homo sapiens
guucagauguugugauuga

SEQ ID NO: 1581314 - RNA, 19 nt, Homo sapiens
gcugagaacuucacuguca

SEQ ID NO: 1581315 - RNA, 19 nt, Homo sapiens
cgacgcggguuucguguua

SEQ ID NO: 1581316 - RNA, 19 nt, Homo sapiens
guucagauguugugauuga

SEQ ID NO: 1581317 - RNA, 19 nt, Homo sapiens
gcugagaacuucacuguca

SEQ ID NO: 1581318 - RNA, 19 nt, Homo sapiens
cgacgcggguuucguguua

SEQ ID NO: 1581319 - RNA, 19 nt, Homo sapiens
guucagauguugugauuga

SEQ ID NO: 1581320 - RNA, 19 nt, Homo sapiens
gauuguggcugcacccaua

SEQ ID NO: 1581321 - RNA, 19 nt, Homo sapiens
ccacaauggugucuacuau

SEQ ID NO: 1581322 - RNA, 19 nt, Homo sapiens
ccacaauggugucuacuau

SEQ ID NO: 1581323 - RNA, 19 nt, Homo sapiens
gaagauuuccugaagaaga

SEQ ID NO: 1581324 - RNA, 19 nt, Homo sapiens
gggaacagcuggcaagaag

SEQ ID NO: 1581325 - RNA, 19 nt, Homo sapiens
ccacaauggugccuacuau

SEQ ID NO: 1581326 - RNA, 19 nt, Homo sapiens
acaauggugucuacuauga

SEQ ID NO: 1581327 - RNA, 19 nt, Homo sapiens
gcggugagguguccuguga

SEQ ID NO: 1581328 - RNA, 19 nt, Homo sapiens
gcggugagguguccuguga

SEQ ID NO: 1581329 - RNA, 19 nt, Homo sapiens
acaauggugucuacuauga

SEQ ID NO: 1581330 - RNA, 19 nt, Homo sapiens
gacgaccgcuuccugcuuu

SEQ ID NO: 1581331 - RNA, 19 nt, Homo sapiens
gcagauguguggccugugu

SEQ ID NO: 1581332 - RNA, 19 nt, Homo sapiens
ccaggcaggugauguggua

SEQ ID NO: 1581333 - RNA, 19 nt, Homo sapiens
ggcaagugcugguggauga

SEQ ID NO: 1581334 - RNA, 19 nt, Homo sapiens
gcagacaacaccucaaaga

SEQ ID NO: 1581335 - RNA, 19 nt, Homo sapiens
gaagguggcugugauuguc

SEQ ID NO: 1581336 - RNA, 19 nt, Homo sapiens
gcagugaguucucguaugc

SEQ ID NO: 1581337 - RNA, 19 nt, Homo sapiens
gcugaaggaugcaucaugu

SEQ ID NO: 1581338 - RNA, 19 nt, Homo sapiens
ccuacgaccuuguguacua

SEQ ID NO: 1581339 - RNA, 19 nt, Homo sapiens
ccuacgaccuuguguacua

SEQ ID NO: 1581340 - RNA, 19 nt, Homo sapiens
ccuacgaccuuguguacua

SEQ ID NO: 1581341 - RNA, 19 nt, Homo sapiens
ggugauccauucugacuau

SEQ ID NO: 1581342 - RNA, 19 nt, Homo sapiens
ccaggaaugucaaggaguu

SEQ ID NO: 1581343 - RNA, 19 nt, Homo sapiens
gaaugcagcuggacaucuc

SEQ ID NO: 1581344 - RNA, 19 nt, Homo sapiens
gaaugaguguggaauccuu

SEQ ID NO: 1581345 - RNA, 19 nt, Homo sapiens
gagcagacaguccucauug

SEQ ID NO: 1581346 - RNA, 19 nt, Homo sapiens
gagcagacaguccucauug

SEQ ID NO: 1581347 - RNA, 19 nt, Homo sapiens
gagcagacaguccucauug

SEQ ID NO: 1581348 - RNA, 19 nt, Homo sapiens
ggaaugcccucagaacagu

SEQ ID NO: 1581349 - RNA, 19 nt, Homo sapiens
ggaaugcccucagaacagu

SEQ ID NO: 1581350 - RNA, 19 nt, Homo sapiens
gcacuggccuuugggaaca

SEQ ID NO: 1581351 - RNA, 19 nt, Homo sapiens
gugagagcauugaauaaau

SEQ ID NO: 1581352 - RNA, 19 nt, Homo sapiens
gcugguggcugacuuugga

SEQ ID NO: 1581353 - RNA, 19 nt, Homo sapiens
gcugguggcugacuuugga

SEQ ID NO: 1581354 - RNA, 19 nt, Homo sapiens
gcugguggcugacuuugga

SEQ ID NO: 1581355 - RNA, 19 nt, Homo sapiens
cggcacagcugacaugauc

SEQ ID NO: 1581356 - RNA, 19 nt, Homo sapiens
uggaugacguccuucagua

SEQ ID NO: 1581357 - RNA, 19 nt, Homo sapiens
ugccaaggcugagaugaua

SEQ ID NO: 1581358 - RNA, 19 nt, Homo sapiens
cacacuggcucccuccaua

SEQ ID NO: 1581359 - RNA, 19 nt, Homo sapiens
cacacuggcucccuccaua

SEQ ID NO: 1581360 - RNA, 19 nt, Homo sapiens
gaugggcaccgauucaauu

SEQ ID NO: 1581361 - RNA, 19 nt, Homo sapiens
cacacuggcucccuccaua

SEQ ID NO: 1581362 - RNA, 19 nt, Homo sapiens
caggugaugugguagaguu

SEQ ID NO: 1581363 - RNA, 19 nt, Homo sapiens
acgaagauuuccugaagaa

SEQ ID NO: 1581364 - RNA, 19 nt, Homo sapiens
caaugaccaugcugggaaa

SEQ ID NO: 1581365 - RNA, 19 nt, Homo sapiens
agacaguccucauugacaa

SEQ ID NO: 1581366 - RNA, 19 nt, Homo sapiens
cagcaugguucagauguug

SEQ ID NO: 1581367 - RNA, 19 nt, Homo sapiens
agacaguccucauugacaa

SEQ ID NO: 1581368 - RNA, 19 nt, Homo sapiens
cagcaugguucagauguug

SEQ ID NO: 1581369 - RNA, 19 nt, Homo sapiens
gcgugugccugcccaacua

SEQ ID NO: 1581370 - RNA, 19 nt, Homo sapiens
agacaguccucauugacaa

SEQ ID NO: 1581371 - RNA, 19 nt, Homo sapiens
cagcaugguucagauguug

SEQ ID NO: 1581372 - RNA, 19 nt, Homo sapiens
gaacagcuggcaagaagag

SEQ ID NO: 1581373 - RNA, 19 nt, Homo sapiens
gcaccaacaucuccaucca

SEQ ID NO: 1581374 - RNA, 19 nt, Homo sapiens
gcaccaacaucuccaucca

SEQ ID NO: 1581375 - RNA, 19 nt, Homo sapiens
ucacagccuuccugcagaa

SEQ ID NO: 1581376 - RNA, 19 nt, Homo sapiens
gcaccaacaucuccaucca

SEQ ID NO: 1581377 - RNA, 19 nt, Homo sapiens
ucaaaggucacagcuagua

SEQ ID NO: 1581378 - RNA, 19 nt, Homo sapiens
gcccaggacuacagaauac

SEQ ID NO: 1581379 - RNA, 19 nt, Homo sapiens
gaugcuggcuucguacuca

SEQ ID NO: 1581380 - RNA, 19 nt, Homo sapiens
gagaugauaggcagcaaga

SEQ ID NO: 1581381 - RNA, 19 nt, Homo sapiens
gcuguggaguucgcaagua

SEQ ID NO: 1581382 - RNA, 19 nt, Homo sapiens
cuauggagcugguggauac

SEQ ID NO: 1581383 - RNA, 19 nt, Homo sapiens
gacguugacuccaaacaag

SEQ ID NO: 1581384 - RNA, 19 nt, Homo sapiens
ggccgauacuugccgguaa

SEQ ID NO: 1581385 - RNA, 19 nt, Homo sapiens
caacaucuccauccacaag

SEQ ID NO: 1581386 - RNA, 19 nt, Homo sapiens
gggcaacccugcuguaucc

SEQ ID NO: 1581387 - RNA, 19 nt, Homo sapiens
guggagcccuggaggaaug

SEQ ID NO: 1581388 - RNA, 19 nt, Homo sapiens
gcugauguguggccugugu

SEQ ID NO: 1581389 - RNA, 19 nt, Homo sapiens
caacaucuccauccacaag

SEQ ID NO: 1581390 - RNA, 19 nt, Homo sapiens
gggcaacccugcuguaucc

SEQ ID NO: 1581391 - RNA, 19 nt, Homo sapiens
guggagcccuggaggaaug

SEQ ID NO: 1581392 - RNA, 19 nt, Homo sapiens
gcugauguguggccugugu

SEQ ID NO: 1581393 - RNA, 19 nt, Homo sapiens
caacaucuccauccacaag

SEQ ID NO: 1581394 - RNA, 19 nt, Homo sapiens
gaugauaggcagcaagauc

SEQ ID NO: 1581395 - RNA, 19 nt, Homo sapiens
ggucacagaggccaaaugu

SEQ ID NO: 1581396 - RNA, 19 nt, Homo sapiens
uguuauggcugaucaguca

SEQ ID NO: 1581397 - RNA, 19 nt, Homo sapiens
ccaucgugcuugagaagaa

SEQ ID NO: 1581398 - RNA, 19 nt, Homo sapiens
gcaagaaacccaagaagaa

SEQ ID NO: 1581399 - RNA, 19 nt, Homo sapiens
gaaacugccuauucagaaa

SEQ ID NO: 1581400 - RNA, 19 nt, Homo sapiens
gaaggacguucccauggua

SEQ ID NO: 1581401 - RNA, 19 nt, Homo sapiens
gaagaaggcugugcugauc

SEQ ID NO: 1581402 - RNA, 19 nt, Homo sapiens
gcaagaagaaguccaagaa

SEQ ID NO: 1581403 - RNA, 19 nt, Homo sapiens
gcgagaaacugccuauuca

SEQ ID NO: 1581404 - RNA, 19 nt, Homo sapiens
ggaaggagaaggagaagaa

SEQ ID NO: 1581405 - RNA, 19 nt, Homo sapiens
ggcagaagcuggagaagga

SEQ ID NO: 1581406 - RNA, 19 nt, Homo sapiens
gcacaggacugacccuucu

SEQ ID NO: 1581407 - RNA, 19 nt, Homo sapiens
ucugcaagcugacguauuu

SEQ ID NO: 1581408 - RNA, 19 nt, Homo sapiens
cuacagggcucuggauauu

SEQ ID NO: 1581409 - RNA, 19 nt, Homo sapiens
cagaggagaugccugagaa

SEQ ID NO: 1581410 - RNA, 19 nt, Homo sapiens
ccaugucucuccucuauga

SEQ ID NO: 1581411 - RNA, 19 nt, Homo sapiens
gaccugggcuguucugugu

SEQ ID NO: 1581412 - RNA, 19 nt, Homo sapiens
ugauggagaucgugaagaa

SEQ ID NO: 1581413 - RNA, 19 nt, Homo sapiens
ggacuccgaucagaacuug

SEQ ID NO: 1581414 - RNA, 19 nt, Homo sapiens
acaagaaucugcaggacuu

SEQ ID NO: 1581415 - RNA, 19 nt, Homo sapiens
guauaaagagagagacaua

SEQ ID NO: 1581416 - RNA, 19 nt, Homo sapiens
gcugaaaauuccuauguua

SEQ ID NO: 1581417 - RNA, 19 nt, Homo sapiens
agaagaaccugauggagau

SEQ ID NO: 1581418 - RNA, 19 nt, Homo sapiens
gugucaagaugauccaaua

SEQ ID NO: 1581419 - RNA, 19 nt, Homo sapiens
auacauaucucagugcauu

SEQ ID NO: 1581420 - RNA, 19 nt, Homo sapiens
aagccugaguguuaauuua

SEQ ID NO: 1581421 - RNA, 19 nt, Homo sapiens
caagaaacccaagaagaaa

SEQ ID NO: 1581422 - RNA, 19 nt, Homo sapiens
aagccugaguguuaauuua

SEQ ID NO: 1581423 - RNA, 19 nt, Homo sapiens
uacccaagccugaguguua

SEQ ID NO: 1581424 - RNA, 19 nt, Homo sapiens
agaaaucucccaagccuaa

SEQ ID NO: 1581425 - RNA, 19 nt, Homo sapiens
gagaaacugccuauucaga

SEQ ID NO: 1581426 - RNA, 19 nt, Homo sapiens
ucacgcugcugucaugauu

SEQ ID NO: 1581427 - RNA, 19 nt, Homo sapiens
acagggcucuggauauuga

SEQ ID NO: 1581428 - RNA, 19 nt, Homo sapiens
ggucauuuguugcguugaa

SEQ ID NO: 1581429 - RNA, 19 nt, Homo sapiens
gagacaaggagaagaagaa

SEQ ID NO: 1581430 - RNA, 19 nt, Homo sapiens
ccaaucagauccguaagga

SEQ ID NO: 1581431 - RNA, 19 nt, Homo sapiens
ggucauuuguugcguugaa

SEQ ID NO: 1581432 - RNA, 19 nt, Homo sapiens
ucaagaugauccaauaaag

SEQ ID NO: 1581433 - RNA, 19 nt, Homo sapiens
caacgaagcccaguaugug

SEQ ID NO: 1581434 - RNA, 19 nt, Homo sapiens
ggaccaaaggcaagaagaa

SEQ ID NO: 1581435 - RNA, 19 nt, Homo sapiens
ggaggucagcgcucucuuu

SEQ ID NO: 1581436 - RNA, 19 nt, Homo sapiens
gggaugguguccaagaaga

SEQ ID NO: 1581437 - RNA, 19 nt, Homo sapiens
acaagguguuccugaagua

SEQ ID NO: 1581438 - RNA, 19 nt, Homo sapiens
ggaagaaggcugugcugau

SEQ ID NO: 1581439 - RNA, 19 nt, Homo sapiens
gugcuggacucacucaaug

SEQ ID NO: 1581440 - RNA, 19 nt, Homo sapiens
ggucagcgcucucuuugcu

SEQ ID NO: 1581441 - RNA, 19 nt, Homo sapiens
gaaacaccgagaccucaaa

SEQ ID NO: 1581442 - RNA, 19 nt, Homo sapiens
gcuuuguguucagaaauua

SEQ ID NO: 1581443 - RNA, 19 nt, Homo sapiens
ugacguauuuacagauguu

SEQ ID NO: 1581444 - RNA, 19 nt, Homo sapiens
ucaccaagaucauugacau

SEQ ID NO: 1581445 - RNA, 19 nt, Homo sapiens
ugacgggucuguccugcuu

SEQ ID NO: 1581446 - RNA, 19 nt, Homo sapiens
ccaccaaucagauccguaa

SEQ ID NO: 1581447 - RNA, 19 nt, Homo sapiens
gaugagugccuccaaguuc

SEQ ID NO: 1581448 - RNA, 19 nt, Homo sapiens
gcuguucuguguugaagga

SEQ ID NO: 1581449 - RNA, 19 nt, Homo sapiens
gcugacguauuuacagaug

SEQ ID NO: 1581450 - RNA, 19 nt, Homo sapiens
cgacgaggaugacaaagac

SEQ ID NO: 1581451 - RNA, 19 nt, Homo sapiens
gacgcaacccuaagaacua

SEQ ID NO: 1581452 - RNA, 19 nt, Homo sapiens
agaaggagaaggagaagaa

SEQ ID NO: 1581453 - RNA, 19 nt, Homo sapiens
uaaagagagagacauauca

SEQ ID NO: 1581454 - RNA, 19 nt, Homo sapiens
ugaauuaucugaccauccu

SEQ ID NO: 1581455 - RNA, 19 nt, Homo sapiens
ugaauuaucugaccauccu

SEQ ID NO: 1581456 - RNA, 19 nt, Homo sapiens
ugccaugucucuccucuau

SEQ ID NO: 1581457 - RNA, 19 nt, Homo sapiens
aggcugugcugaucaugua

SEQ ID NO: 1581458 - RNA, 19 nt, Homo sapiens
ggacgaggcaaaauacaua

SEQ ID NO: 1581459 - RNA, 19 nt, Homo sapiens
caagaugauccaauaaagu

SEQ ID NO: 1581460 - RNA, 19 nt, Homo sapiens
gcuacugagcaacuuguua

SEQ ID NO: 1581461 - RNA, 19 nt, Homo sapiens
ccaagaagaaccugaugga

SEQ ID NO: 1581462 - RNA, 19 nt, Homo sapiens
gcauccagcuuuguguuca

SEQ ID NO: 1581463 - RNA, 19 nt, Homo sapiens
ucggugcucuuacuccuuu

SEQ ID NO: 1581464 - RNA, 19 nt, Homo sapiens
acacaaagagaaagagaga

SEQ ID NO: 1581465 - RNA, 19 nt, Homo sapiens
gaggucagcgcucucuuug

SEQ ID NO: 1581466 - RNA, 19 nt, Homo sapiens
aagcugacguauuuacaga

SEQ ID NO: 1581467 - RNA, 19 nt, Homo sapiens
ugagcaacuuguuagaaga

SEQ ID NO: 1581468 - RNA, 19 nt, Homo sapiens
agaaggagaagaagaaauc

SEQ ID NO: 1581469 - RNA, 19 nt, Homo sapiens
ggagaaggagaagaagaaa

SEQ ID NO: 1581470 - RNA, 19 nt, Homo sapiens
acaaagagaaagagagaga

SEQ ID NO: 1581471 - RNA, 19 nt, Homo sapiens
ggagaugccugagaaugcu

SEQ ID NO: 1581472 - RNA, 19 nt, Homo sapiens
ggaaccacaccacacuuug

SEQ ID NO: 1581473 - RNA, 19 nt, Homo sapiens
gcaccgacgucaucaugcu

SEQ ID NO: 1581474 - RNA, 19 nt, Homo sapiens
ggauguccuuccagaaucu

SEQ ID NO: 1581475 - RNA, 19 nt, Homo sapiens
agaagaaggagaaggagaa

SEQ ID NO: 1581476 - RNA, 19 nt, Homo sapiens
agaagaagaaggagaagga

SEQ ID NO: 1581477 - RNA, 19 nt, Homo sapiens
acaaggagaagaagaagga

SEQ ID NO: 1581478 - RNA, 19 nt, Homo sapiens
gcgacgaggaugacaaaga

SEQ ID NO: 1581479 - RNA, 19 nt, Homo sapiens
gaaccacaccacacuuugg

SEQ ID NO: 1581480 - RNA, 19 nt, Homo sapiens
ugaaggccauccgcaaguu

SEQ ID NO: 1581481 - RNA, 19 nt, Homo sapiens
cagcaucgaccgcauguuc

SEQ ID NO: 1581482 - RNA, 19 nt, Homo sapiens
gucaagaugauccaauaaa

SEQ ID NO: 1581483 - RNA, 19 nt, Homo sapiens
gcagugauuccaggauuug

SEQ ID NO: 1581484 - RNA, 19 nt, Homo sapiens
ugacgccuuugcuaaguug

SEQ ID NO: 1581485 - RNA, 19 nt, Homo sapiens
ccaacgaagcccaguaugu

SEQ ID NO: 1581486 - RNA, 19 nt, Homo sapiens
agaaagagagagacaagga

SEQ ID NO: 1581487 - RNA, 19 nt, Homo sapiens
uauguuguccgccguguaa

SEQ ID NO: 1581488 - RNA, 19 nt, Homo sapiens
agaaacugccuauucagaa

SEQ ID NO: 1581489 - RNA, 19 nt, Homo sapiens
cagcacgucugccaugucu

SEQ ID NO: 1581490 - RNA, 19 nt, Homo sapiens
uguacaagguguuccugaa

SEQ ID NO: 1581491 - RNA, 19 nt, Homo sapiens
cauuuguugcguugaauua

SEQ ID NO: 1581492 - RNA, 19 nt, Homo sapiens
ccagcuuuguguucagaaa

SEQ ID NO: 1581493 - RNA, 19 nt, Homo sapiens
cauuuguugcguugaauua

SEQ ID NO: 1581494 - RNA, 19 nt, Homo sapiens
ucaagaucaucaagcuguu

SEQ ID NO: 1581495 - RNA, 19 nt, Homo sapiens
gcaacuuguuagaagagau

SEQ ID NO: 1581496 - RNA, 19 nt, Homo sapiens
agagagacaaggagaagaa

SEQ ID NO: 1581497 - RNA, 19 nt, Homo sapiens
caaaauccccugagaagga

SEQ ID NO: 1581498 - RNA, 19 nt, Homo sapiens
ggaagcagcuggccaccaa

SEQ ID NO: 1581499 - RNA, 19 nt, Homo sapiens
ggccggagguuccaucgua

SEQ ID NO: 1581500 - RNA, 19 nt, Homo sapiens
gccaagcgcgugaccauua

SEQ ID NO: 1581501 - RNA, 19 nt, Homo sapiens
gagguuccaucguauccaa

SEQ ID NO: 1581502 - RNA, 19 nt, Homo sapiens
guggagagcgggcuuaaga

SEQ ID NO: 1581503 - RNA, 19 nt, Homo sapiens
ccaagcgcgugaccauuau

SEQ ID NO: 1581504 - RNA, 19 nt, Homo sapiens
agagcgggcuuaagaagug

SEQ ID NO: 1581505 - RNA, 19 nt, Homo sapiens
cgagaucgcgcaggacuuu

SEQ ID NO: 1581506 - RNA, 19 nt, Homo sapiens
ggagagcgggcuuaagaag

SEQ ID NO: 1581507 - RNA, 19 nt, Homo sapiens
gagagcgggcuuaagaagu

SEQ ID NO: 1581508 - RNA, 19 nt, Homo sapiens
ugaccauuaugcccaagga

SEQ ID NO: 1581509 - RNA, 19 nt, Homo sapiens
gccggagguuccaucguau

SEQ ID NO: 1581510 - RNA, 19 nt, Homo sapiens
guaagccuguguuuugguu

SEQ ID NO: 1581511 - RNA, 19 nt, Homo sapiens
gagaucgcgcaggacuuua

SEQ ID NO: 1581512 - RNA, 19 nt, Homo sapiens
gcuauggcccguacuaagc

SEQ ID NO: 1581513 - RNA, 19 nt, Homo sapiens
agaucgcgcaggacuuuaa

SEQ ID NO: 1581514 - RNA, 19 nt, Homo sapiens
ggaauuaacugcauacguu

SEQ ID NO: 1581515 - RNA, 19 nt, Homo sapiens
caaauaagauucugaggaa

SEQ ID NO: 1581516 - RNA, 19 nt, Homo sapiens
gcacuugcaucguuauuaa

SEQ ID NO: 1581517 - RNA, 19 nt, Homo sapiens
gcaauagaaucguucaaga

SEQ ID NO: 1581518 - RNA, 19 nt, Homo sapiens
gugauaaucuggugacaaa

SEQ ID NO: 1581519 - RNA, 19 nt, Homo sapiens
gcaagaugauguaauggaa

SEQ ID NO: 1581520 - RNA, 19 nt, Homo sapiens
gagguagugugaauauuaa

SEQ ID NO: 1581521 - RNA, 19 nt, Homo sapiens
ugagugcacuaaacaaaua

SEQ ID NO: 1581522 - RNA, 19 nt, Homo sapiens
gauaaucuggugacaaaua

SEQ ID NO: 1581523 - RNA, 19 nt, Homo sapiens
ugacaaauauucucucugu

SEQ ID NO: 1581524 - RNA, 19 nt, Homo sapiens
ggaauuggaccuaauaaau

SEQ ID NO: 1581525 - RNA, 19 nt, Homo sapiens
gaacaugaacuaugccuau

SEQ ID NO: 1581526 - RNA, 19 nt, Homo sapiens
cacaagaccuagccuaauu

SEQ ID NO: 1581527 - RNA, 19 nt, Homo sapiens
uaaccagucucucaaguga

SEQ ID NO: 1581528 - RNA, 19 nt, Homo sapiens
gauguaaugggaagaaaua

SEQ ID NO: 1581529 - RNA, 19 nt, Homo sapiens
uaacaacugcucuuacuuu

SEQ ID NO: 1581530 - RNA, 19 nt, Homo sapiens
uaccaaggaugaauucuuu

SEQ ID NO: 1581531 - RNA, 19 nt, Homo sapiens
gaagagguagugugaauau

SEQ ID NO: 1581532 - RNA, 19 nt, Homo sapiens
ccucagagcucuugcuguu

SEQ ID NO: 1581533 - RNA, 19 nt, Homo sapiens
ggauaucaguuaccaaaca

SEQ ID NO: 1581534 - RNA, 19 nt, Homo sapiens
uguaagcggugguuuguaa

SEQ ID NO: 1581535 - RNA, 19 nt, Homo sapiens
ggaaacagaccaauagaca

SEQ ID NO: 1581536 - RNA, 19 nt, Homo sapiens
ggugcuaucuguucaguga

SEQ ID NO: 1581537 - RNA, 19 nt, Homo sapiens
ugaccaaagugauaaauuc

SEQ ID NO: 1581538 - RNA, 19 nt, Homo sapiens
cacaaucccuguacucuga

SEQ ID NO: 1581539 - RNA, 19 nt, Homo sapiens
ccacauacauagaucuuca

SEQ ID NO: 1581540 - RNA, 19 nt, Homo sapiens
ugagcaagaugauguaaug

SEQ ID NO: 1581541 - RNA, 19 nt, Homo sapiens
caugaacuaugccuaugua

SEQ ID NO: 1581542 - RNA, 19 nt, Homo sapiens
gcuuauugcuucaucugua

SEQ ID NO: 1581543 - RNA, 19 nt, Homo sapiens
gaagaagucacugaacaaa

SEQ ID NO: 1581544 - RNA, 19 nt, Homo sapiens
aauaagguguggucuguuu

SEQ ID NO: 1581545 - RNA, 19 nt, Homo sapiens
uagaagagguagugugaau

SEQ ID NO: 1581546 - RNA, 19 nt, Homo sapiens
aaacagaccaauagacauu

SEQ ID NO: 1581547 - RNA, 19 nt, Homo sapiens
agagguagugugaauauua

SEQ ID NO: 1581548 - RNA, 19 nt, Homo sapiens
gaguauggcccgaugcuuu

SEQ ID NO: 1581549 - RNA, 19 nt, Homo sapiens
caagaccuagccuaauuua

SEQ ID NO: 1581550 - RNA, 19 nt, Homo sapiens
cauuaggaccuuagaauuu

SEQ ID NO: 1581551 - RNA, 19 nt, Homo sapiens
ggaaaugguacuucauaau

SEQ ID NO: 1581552 - RNA, 19 nt, Homo sapiens
ggugcgauauuucuucuug

SEQ ID NO: 1581553 - RNA, 19 nt, Homo sapiens
uauagcacuugcaucguua

SEQ ID NO: 1581554 - RNA, 19 nt, Homo sapiens
gcauuuggcugcuguaagc

SEQ ID NO: 1581555 - RNA, 19 nt, Homo sapiens
agaaugcuauuucacuuga

SEQ ID NO: 1581556 - RNA, 19 nt, Homo sapiens
cuaaagccaagaagaauuu

SEQ ID NO: 1581557 - RNA, 19 nt, Homo sapiens
gagaauauaugcuuuugga

SEQ ID NO: 1581558 - RNA, 19 nt, Homo sapiens
gugaugagacagugaagua

SEQ ID NO: 1581559 - RNA, 19 nt, Homo sapiens
ccagugagauagaauacau

SEQ ID NO: 1581560 - RNA, 19 nt, Homo sapiens
gaaaggguguuggcauugg

SEQ ID NO: 1581561 - RNA, 19 nt, Homo sapiens
caauagaaucguucaagaa

SEQ ID NO: 1581562 - RNA, 19 nt, Homo sapiens
gaauuaacugcauacguuu

SEQ ID NO: 1581563 - RNA, 19 nt, Homo sapiens
gacaaauauucucucugua

SEQ ID NO: 1581564 - RNA, 19 nt, Homo sapiens
uagacuuucuggagugaua

SEQ ID NO: 1581565 - RNA, 19 nt, Homo sapiens
ccauauugaugaagauguu

SEQ ID NO: 1581566 - RNA, 19 nt, Homo sapiens
uuccaaaccugagaauaua

SEQ ID NO: 1581567 - RNA, 19 nt, Homo sapiens
cagccacugugucuuauga

SEQ ID NO: 1581568 - RNA, 19 nt, Homo sapiens
gauaguuaguuuggaaaug

SEQ ID NO: 1581569 - RNA, 19 nt, Homo sapiens
ucagagcucuugcuguuag

SEQ ID NO: 1581570 - RNA, 19 nt, Homo sapiens
gaugagacagugaaguaaa

SEQ ID NO: 1581571 - RNA, 19 nt, Homo sapiens
acacguaccuucaugugau

SEQ ID NO: 1581572 - RNA, 19 nt, Homo sapiens
cuaauaagguguggucugu

SEQ ID NO: 1581573 - RNA, 19 nt, Homo sapiens
uaccacaccuggaaacaga

SEQ ID NO: 1581574 - RNA, 19 nt, Homo sapiens
ggagugauagcaaucuuug

SEQ ID NO: 1581575 - RNA, 19 nt, Homo sapiens
gauaucaguuaccaaacau

SEQ ID NO: 1581576 - RNA, 19 nt, Homo sapiens
uggaaaugguacuucauaa

SEQ ID NO: 1581577 - RNA, 19 nt, Homo sapiens
uaggauaguuaguuuggaa

SEQ ID NO: 1581578 - RNA, 19 nt, Homo sapiens
ucaaucaccgucuguguuu

SEQ ID NO: 1581579 - RNA, 19 nt, Homo sapiens
gaccuggauuugagucuug

SEQ ID NO: 1581580 - RNA, 19 nt, Homo sapiens
ugaugaagauguuuauugg

SEQ ID NO: 1581581 - RNA, 19 nt, Homo sapiens
aaauggguuucuugccuua

SEQ ID NO: 1581582 - RNA, 19 nt, Homo sapiens
uggaaaggguguuggcauu

SEQ ID NO: 1581583 - RNA, 19 nt, Homo sapiens
guugauacuagcauacuua

SEQ ID NO: 1581584 - RNA, 19 nt, Homo sapiens
ugaaguguaugaagugcuu

SEQ ID NO: 1581585 - RNA, 19 nt, Homo sapiens
gauccagugagauagaaua

SEQ ID NO: 1581586 - RNA, 19 nt, Homo sapiens
cuacacacauaccuucaug

SEQ ID NO: 1581587 - RNA, 19 nt, Homo sapiens
ggcaugaaguguaugaagu

SEQ ID NO: 1581588 - RNA, 19 nt, Homo sapiens
caaaaugaccaacgaaauu

SEQ ID NO: 1581589 - RNA, 19 nt, Homo sapiens
cugcuaggauaguuaguuu

SEQ ID NO: 1581590 - RNA, 19 nt, Homo sapiens
guucagugaugcccucaga

SEQ ID NO: 1581591 - RNA, 19 nt, Homo sapiens
guuagaagagguaguguga

SEQ ID NO: 1581592 - RNA, 19 nt, Homo sapiens
gcacucuuguuugcuuuga

SEQ ID NO: 1581593 - RNA, 19 nt, Homo sapiens
agugauaaauuccuguuga

SEQ ID NO: 1581594 - RNA, 19 nt, Homo sapiens
uuauagcacuugcaucguu

SEQ ID NO: 1581595 - RNA, 19 nt, Homo sapiens
ugaggaauuggaccuaaua

SEQ ID NO: 1581596 - RNA, 19 nt, Homo sapiens
ggaaagacuacgugugaca

SEQ ID NO: 1581597 - RNA, 19 nt, Homo sapiens
gagauagaauacauguaag

SEQ ID NO: 1581598 - RNA, 19 nt, Homo sapiens
acagaaugcuauuucacuu

SEQ ID NO: 1581599 - RNA, 19 nt, Homo sapiens
cuacacacguaccuucaug

SEQ ID NO: 1581600 - RNA, 19 nt, Homo sapiens
caauauaggagggaagauu

SEQ ID NO: 1581601 - RNA, 19 nt, Homo sapiens
cgggaaagacuacguguga

SEQ ID NO: 1581602 - RNA, 19 nt, Homo sapiens
caccaaggcccuauccaaa

SEQ ID NO: 1581603 - RNA, 19 nt, Homo sapiens
guggauaucaguuaccaaa

SEQ ID NO: 1581604 - RNA, 19 nt, Homo sapiens
ggaaaggguguuggcauug

SEQ ID NO: 1581605 - RNA, 19 nt, Homo sapiens
uuugugcucuguuccauuu

SEQ ID NO: 1581606 - RNA, 19 nt, Homo sapiens
cuaccagucuauuuccauu

SEQ ID NO: 1581607 - RNA, 19 nt, Homo sapiens
agaauucuaugacccuaug

SEQ ID NO: 1581608 - RNA, 19 nt, Homo sapiens
cuuauugcuucaucuguaa

SEQ ID NO: 1581609 - RNA, 19 nt, Homo sapiens
cagucuauuuccauucuuu

SEQ ID NO: 1581610 - RNA, 19 nt, Homo sapiens
acccauagcacucuuguuu

SEQ ID NO: 1581611 - RNA, 19 nt, Homo sapiens
auaaauuccuguugaccuu

SEQ ID NO: 1581612 - RNA, 19 nt, Homo sapiens
ggcaaaucuuucugcauga

SEQ ID NO: 1581613 - RNA, 19 nt, Homo sapiens
ggugcuccuuaaauauaua

SEQ ID NO: 1581614 - RNA, 19 nt, Homo sapiens
gaacagaauuucagucuug

SEQ ID NO: 1581615 - RNA, 19 nt, Homo sapiens
gaaagaagcuauaaguaca

SEQ ID NO: 1581616 - RNA, 19 nt, Homo sapiens
gaugagcucggcauuauua

SEQ ID NO: 1581617 - RNA, 19 nt, Homo sapiens
ccagaaaggaucaguguua

SEQ ID NO: 1581618 - RNA, 19 nt, Homo sapiens
gcucagaccuaagcuaauu

SEQ ID NO: 1581619 - RNA, 19 nt, Homo sapiens
caaccaaaguggacaaguu

SEQ ID NO: 1581620 - RNA, 19 nt, Homo sapiens
gauuaaagcuuaucgaacu

SEQ ID NO: 1581621 - RNA, 19 nt, Homo sapiens
gaaaggaucaguguuagaa

SEQ ID NO: 1581622 - RNA, 19 nt, Homo sapiens
guuaacaccucaccaaguu

SEQ ID NO: 1581623 - RNA, 19 nt, Homo sapiens
aaaugacgcugacuuugua

SEQ ID NO: 1581624 - RNA, 19 nt, Homo sapiens
gaagcuauaaguacaagua

SEQ ID NO: 1581625 - RNA, 19 nt, Homo sapiens
gagcucggcauuauuauuu

SEQ ID NO: 1581626 - RNA, 19 nt, Homo sapiens
guaaagaacaggaagcaaa

SEQ ID NO: 1581627 - RNA, 19 nt, Homo sapiens
cauuauagcucagaccuaa

SEQ ID NO: 1581628 - RNA, 19 nt, Homo sapiens
uuagaaagcuggaugauac

SEQ ID NO: 1581629 - RNA, 19 nt, Homo sapiens
gcagaagcaucaauuaaaa

SEQ ID NO: 1581630 - RNA, 19 nt, Homo sapiens
gaagaucgacagcaaccua

SEQ ID NO: 1581631 - RNA, 19 nt, Homo sapiens
caagauggaccaagauuug

SEQ ID NO: 1581632 - RNA, 19 nt, Homo sapiens
cgaacuagacauuuguuua

SEQ ID NO: 1581633 - RNA, 19 nt, Homo sapiens
guacuucccuuuacagucu

SEQ ID NO: 1581634 - RNA, 19 nt, Homo sapiens
caaaagaaaucaugcagaa

SEQ ID NO: 1581635 - RNA, 19 nt, Homo sapiens
ggaccaagauuugaagauc

SEQ ID NO: 1581636 - RNA, 19 nt, Homo sapiens
caugugaccuuugccauuu

SEQ ID NO: 1581637 - RNA, 19 nt, Homo sapiens
ggaaagaugggaacagaau

SEQ ID NO: 1581638 - RNA, 19 nt, Homo sapiens
uagaugagcucggcauuau

SEQ ID NO: 1581639 - RNA, 19 nt, Homo sapiens
ugagauaggucacuuaaaa

SEQ ID NO: 1581640 - RNA, 19 nt, Homo sapiens
caauagaguuugugggaau

SEQ ID NO: 1581641 - RNA, 19 nt, Homo sapiens
ucuaacaccuuccauguau

SEQ ID NO: 1581642 - RNA, 19 nt, Homo sapiens
uaucuugggcguuugauua

SEQ ID NO: 1581643 - RNA, 19 nt, Homo sapiens
cagagaagaugguggacaa

SEQ ID NO: 1581644 - RNA, 19 nt, Homo sapiens
gauuuccacucuauuguga

SEQ ID NO: 1581645 - RNA, 19 nt, Homo sapiens
gcuggucaauuacuucaaa

SEQ ID NO: 1581646 - RNA, 19 nt, Homo sapiens
ggacuggcacucuauaaau

SEQ ID NO: 1581647 - RNA, 19 nt, Homo sapiens
agaguugcauuucucauuu

SEQ ID NO: 1581648 - RNA, 19 nt, Homo sapiens
gaaauagagugugccaucu

SEQ ID NO: 1581649 - RNA, 19 nt, Homo sapiens
gcaaaaugcuuauuagagu

SEQ ID NO: 1581650 - RNA, 19 nt, Homo sapiens
guacugaugcuuacccaaa

SEQ ID NO: 1581651 - RNA, 19 nt, Homo sapiens
gaccaagauuugaagauca

SEQ ID NO: 1581652 - RNA, 19 nt, Homo sapiens
aaggaaaccuccacaagug

SEQ ID NO: 1581653 - RNA, 19 nt, Homo sapiens
gagccucuauuucucauuc

SEQ ID NO: 1581654 - RNA, 19 nt, Homo sapiens
ugauuaccaugcuggaaua

SEQ ID NO: 1581655 - RNA, 19 nt, Homo sapiens
gacuggcacucuauaaaug

SEQ ID NO: 1581656 - RNA, 19 nt, Homo sapiens
ggaacagaauuucagucuu

SEQ ID NO: 1581657 - RNA, 19 nt, Homo sapiens
uauaaacaguggugucuca

SEQ ID NO: 1581658 - RNA, 19 nt, Homo sapiens
gaagaugguggacaagaug

SEQ ID NO: 1581659 - RNA, 19 nt, Homo sapiens
acauaacacucaacccaaa

SEQ ID NO: 1581660 - RNA, 19 nt, Homo sapiens
gaaagaugggaacagaauu

SEQ ID NO: 1581661 - RNA, 19 nt, Homo sapiens
uaacagugccuuugaccuu

SEQ ID NO: 1581662 - RNA, 19 nt, Homo sapiens
uaaaugacgcugacuuugu

SEQ ID NO: 1581663 - RNA, 19 nt, Homo sapiens
aaagaugggaacagaauuu

SEQ ID NO: 1581664 - RNA, 19 nt, Homo sapiens
agacggauuuccacucuau

SEQ ID NO: 1581665 - RNA, 19 nt, Homo sapiens
aaacaguggugucucaaag

SEQ ID NO: 1581666 - RNA, 19 nt, Homo sapiens
uuaccaugcuggaauaaga

SEQ ID NO: 1581667 - RNA, 19 nt, Homo sapiens
cugcauaucuugggcguuu

SEQ ID NO: 1581668 - RNA, 19 nt, Homo sapiens
ucguggagauuagucauua

SEQ ID NO: 1581669 - RNA, 19 nt, Homo sapiens
ggaaauguguggggaauug

SEQ ID NO: 1581670 - RNA, 19 nt, Homo sapiens
ggugugagggccugauuaa

SEQ ID NO: 1581671 - RNA, 19 nt, Homo sapiens
uauaaaugacgcugacuuu

SEQ ID NO: 1581672 - RNA, 19 nt, Homo sapiens
gaagacagacggauuucca

SEQ ID NO: 1581673 - RNA, 19 nt, Homo sapiens
ugaaagaagcuauaaguac

SEQ ID NO: 1581674 - RNA, 19 nt, Homo sapiens
caacaacagauugaaagaa

SEQ ID NO: 1581675 - RNA, 19 nt, Homo sapiens
caaaggaaaccuccacaag

SEQ ID NO: 1581676 - RNA, 19 nt, Homo sapiens
gcaaaggaaaccuccacaa

SEQ ID NO: 1581677 - RNA, 19 nt, Homo sapiens
ggaaguguuugucccacau

SEQ ID NO: 1581678 - RNA, 19 nt, Homo sapiens
gaaauugaggagcaagaug

SEQ ID NO: 1581679 - RNA, 19 nt, Homo sapiens
uaaaggccacugccacauu

SEQ ID NO: 1581680 - RNA, 19 nt, Homo sapiens
aaccaaaguggacaaguua

SEQ ID NO: 1581681 - RNA, 19 nt, Homo sapiens
cuucaaauccaaaccagua

SEQ ID NO: 1581682 - RNA, 19 nt, Homo sapiens
cauagacucguggagauua

SEQ ID NO: 1581683 - RNA, 19 nt, Homo sapiens
agaaacacaucaauagcau

SEQ ID NO: 1581684 - RNA, 19 nt, Homo sapiens
ccucugggaaucaccauua

SEQ ID NO: 1581685 - RNA, 19 nt, Homo sapiens
aauagagugugccaucuug

SEQ ID NO: 1581686 - RNA, 19 nt, Homo sapiens
ggaugcagacagaaauuga

SEQ ID NO: 1581687 - RNA, 19 nt, Homo sapiens
gccagaaacacaucaauag

SEQ ID NO: 1581688 - RNA, 19 nt, Homo sapiens
uggugaaagugacugauuu

SEQ ID NO: 1581689 - RNA, 19 nt, Homo sapiens
cagaaaggaucaguguuag

SEQ ID NO: 1581690 - RNA, 19 nt, Homo sapiens
gaaagcuggaugauacaga

SEQ ID NO: 1581691 - RNA, 19 nt, Homo sapiens
aaaggccacugccacauuc

SEQ ID NO: 1581692 - RNA, 19 nt, Homo sapiens
ggagauuagucauuauagc

SEQ ID NO: 1581693 - RNA, 19 nt, Homo sapiens
ggcauagacucguggagau

SEQ ID NO: 1581694 - RNA, 19 nt, Homo sapiens
aacagugccuuugaccuua

SEQ ID NO: 1581695 - RNA, 19 nt, Homo sapiens
gccaugagccucuauuucu

SEQ ID NO: 1581696 - RNA, 19 nt, Homo sapiens
gacaagauggaccaagauu

SEQ ID NO: 1581697 - RNA, 19 nt, Homo sapiens
gaauaagaagaguugcauu

SEQ ID NO: 1581698 - RNA, 19 nt, Homo sapiens
uggacaagauggaccaaga

SEQ ID NO: 1581699 - RNA, 19 nt, Homo sapiens
guggagauuagucauuaua

SEQ ID NO: 1581700 - RNA, 19 nt, Homo sapiens
gaaacacaucaauagcauu

SEQ ID NO: 1581701 - RNA, 19 nt, Homo sapiens
uuccauguaugucaacuuu

SEQ ID NO: 1581702 - RNA, 19 nt, Homo sapiens
uaauguguguuugcaaaug

SEQ ID NO: 1581703 - RNA, 19 nt, Homo sapiens
gagccuaucaccagaagau

SEQ ID NO: 1581704 - RNA, 19 nt, Homo sapiens
ccaugaguacugaugcuua

SEQ ID NO: 1581705 - RNA, 19 nt, Homo sapiens
gcuauaaguacaaguaaag

SEQ ID NO: 1581706 - RNA, 19 nt, Homo sapiens
acgcugacuuuguauagaa

SEQ ID NO: 1581707 - RNA, 19 nt, Homo sapiens
ggacaagauggaccaagau

SEQ ID NO: 1581708 - RNA, 19 nt, Homo sapiens
acacaucaauagcauuaag

SEQ ID NO: 1581709 - RNA, 19 nt, Homo sapiens
aaggaucaguguuagaaug

SEQ ID NO: 1581710 - RNA, 19 nt, Homo sapiens
uuaaugagcauauggaaag

SEQ ID NO: 1581711 - RNA, 19 nt, Homo sapiens
gagaagaugguggacaaga

SEQ ID NO: 1581712 - RNA, 19 nt, Homo sapiens
agaagaugguggacaagau

SEQ ID NO: 1581713 - RNA, 19 nt, Homo sapiens
ggacaggcagcaguacuug

SEQ ID NO: 1581714 - RNA, 19 nt, Homo sapiens
gaaagcggcugcucaaaga

SEQ ID NO: 1581715 - RNA, 19 nt, Homo sapiens
ggaugaagcugaugaaaug

SEQ ID NO: 1581716 - RNA, 19 nt, Homo sapiens
gaauaaagguuucaaagag

SEQ ID NO: 1581717 - RNA, 19 nt, Homo sapiens
gaacguugcugaucuuauc

SEQ ID NO: 1581718 - RNA, 19 nt, Homo sapiens
ggaaggguguggccauuaa

SEQ ID NO: 1581719 - RNA, 19 nt, Homo sapiens
ggugaaacgugaugaauug

SEQ ID NO: 1581720 - RNA, 19 nt, Homo sapiens
acuaugaucucccuaauaa

SEQ ID NO: 1581721 - RNA, 19 nt, Homo sapiens
ucagagauaucgagcagua

SEQ ID NO: 1581722 - RNA, 19 nt, Homo sapiens
gagcgggaguccaucauga

SEQ ID NO: 1581723 - RNA, 19 nt, Homo sapiens
ggacuuucuucucauaaau

SEQ ID NO: 1581724 - RNA, 19 nt, Homo sapiens
ucaaagagcagauuuacga

SEQ ID NO: 1581725 - RNA, 19 nt, Homo sapiens
agacaugacuaaaguggaa

SEQ ID NO: 1581726 - RNA, 19 nt, Homo sapiens
uauauggacuuucuucuca

SEQ ID NO: 1581727 - RNA, 19 nt, Homo sapiens
guauuuagauccagauucu

SEQ ID NO: 1581728 - RNA, 19 nt, Homo sapiens
gaugaacguugcugaucuu

SEQ ID NO: 1581729 - RNA, 19 nt, Homo sapiens
gagcagauuuacgauguau

SEQ ID NO: 1581730 - RNA, 19 nt, Homo sapiens
gggaagaguggaaauuuga

SEQ ID NO: 1581731 - RNA, 19 nt, Homo sapiens
gagggaagaguggaaauuu

SEQ ID NO: 1581732 - RNA, 19 nt, Homo sapiens
gaaacgugaugaauugacu

SEQ ID NO: 1581733 - RNA, 19 nt, Homo sapiens
gcucaaagaggaagacaug

SEQ ID NO: 1581734 - RNA, 19 nt, Homo sapiens
ggagaugaccaacaaguuc

SEQ ID NO: 1581735 - RNA, 19 nt, Homo sapiens
uaacuaugaucucccuaau

SEQ ID NO: 1581736 - RNA, 19 nt, Homo sapiens
ugacuaaaguggaauucga

SEQ ID NO: 1581737 - RNA, 19 nt, Homo sapiens
gggaguccaucaugaagga

SEQ ID NO: 1581738 - RNA, 19 nt, Homo sapiens
gcugaugaaauguugaaua

SEQ ID NO: 1581739 - RNA, 19 nt, Homo sapiens
ucucaguccuccaguguuu

SEQ ID NO: 1581740 - RNA, 19 nt, Homo sapiens
ucaagcagaucaucaaagg

SEQ ID NO: 1581741 - RNA, 19 nt, Homo sapiens
gugcuuauuucuacagaug

SEQ ID NO: 1581742 - RNA, 19 nt, Homo sapiens
ugaagcugaugaaauguug

SEQ ID NO: 1581743 - RNA, 19 nt, Homo sapiens
uggaaggcaucaagcaauu

SEQ ID NO: 1581744 - RNA, 19 nt, Homo sapiens
gauaugauucgucgcagaa

SEQ ID NO: 1581745 - RNA, 19 nt, Homo sapiens
gauccagauucuacuuaau

SEQ ID NO: 1581746 - RNA, 19 nt, Homo sapiens
aaacagccaccuucaguau

SEQ ID NO: 1581747 - RNA, 19 nt, Homo sapiens
gcggucaucuucugcaaca

SEQ ID NO: 1581748 - RNA, 19 nt, Homo sapiens
aagagcagauuuacgaugu

SEQ ID NO: 1581749 - RNA, 19 nt, Homo sapiens
aggaagacaugacuaaagu

SEQ ID NO: 1581750 - RNA, 19 nt, Homo sapiens
caucuacgcuuacgguuuu

SEQ ID NO: 1581751 - RNA, 19 nt, Homo sapiens
gcaaucaagcagaucauca

SEQ ID NO: 1581752 - RNA, 19 nt, Homo sapiens
aaggacacgugcuaucaaa

SEQ ID NO: 1581753 - RNA, 19 nt, Homo sapiens
gaggaagacaugacuaaag

SEQ ID NO: 1581754 - RNA, 19 nt, Homo sapiens
uugaugagaugccgaugaa

SEQ ID NO: 1581755 - RNA, 19 nt, Homo sapiens
guacuauuccacucagauu

SEQ ID NO: 1581756 - RNA, 19 nt, Homo sapiens
caggugucccucaucauua

SEQ ID NO: 1581757 - RNA, 19 nt, Homo sapiens
gcagauuuacgauguauac

SEQ ID NO: 1581758 - RNA, 19 nt, Homo sapiens
gccgagugcuuauuucuac

SEQ ID NO: 1581759 - RNA, 19 nt, Homo sapiens
ggaaggcaucaagcaauuu

SEQ ID NO: 1581760 - RNA, 19 nt, Homo sapiens
gcaucuacgcuuacgguuu

SEQ ID NO: 1581761 - RNA, 19 nt, Homo sapiens
agauccagauucuacuuaa

SEQ ID NO: 1581762 - RNA, 19 nt, Homo sapiens
acacagaauugggagauca

SEQ ID NO: 1581763 - RNA, 19 nt, Homo sapiens
ggguguggccauuaacuuu

SEQ ID NO: 1581764 - RNA, 19 nt, Homo sapiens
ucaggugucccucaucauu

SEQ ID NO: 1581765 - RNA, 19 nt, Homo sapiens
ccucaggugucccucauca

SEQ ID NO: 1581766 - RNA, 19 nt, Homo sapiens
gagaugaccaacaaguuca

SEQ ID NO: 1581767 - RNA, 19 nt, Homo sapiens
ggguuuauauggacuuucu

SEQ ID NO: 1581768 - RNA, 19 nt, Homo sapiens
cagcagaucagugggauga

SEQ ID NO: 1581769 - RNA, 19 nt, Homo sapiens
uguaaagaaugacgacauc

SEQ ID NO: 1581770 - RNA, 19 nt, Homo sapiens
uaugaucucccuaauaaca

SEQ ID NO: 1581771 - RNA, 19 nt, Homo sapiens
cgaaagcggcugcucaaag

SEQ ID NO: 1581772 - RNA, 19 nt, Homo sapiens
uugcugaucuuaucugaag

SEQ ID NO: 1581773 - RNA, 19 nt, Homo sapiens
ucgugaaacucaagcuuug

SEQ ID NO: 1581774 - RNA, 19 nt, Homo sapiens
caaucaagcagaucaucaa

SEQ ID NO: 1581775 - RNA, 19 nt, Homo sapiens
cgaugaacguugcugaucu

SEQ ID NO: 1581776 - RNA, 19 nt, Homo sapiens
gaagaguggaaauuugaca

SEQ ID NO: 1581777 - RNA, 19 nt, Homo sapiens
ggagagggaagaguggaaa

SEQ ID NO: 1581778 - RNA, 19 nt, Homo sapiens
uggacuuucuucucauaaa

SEQ ID NO: 1581779 - RNA, 19 nt, Homo sapiens
aagaggaagacaugacuaa

SEQ ID NO: 1581780 - RNA, 19 nt, Homo sapiens
cacacgagauucuggagau

SEQ ID NO: 1581781 - RNA, 19 nt, Homo sapiens
gagauaucgagcaguacua

SEQ ID NO: 1581782 - RNA, 19 nt, Homo sapiens
aggugucccucaucauuaa

SEQ ID NO: 1581783 - RNA, 19 nt, Homo sapiens
agaaagagcgggaguccau

SEQ ID NO: 1581784 - RNA, 19 nt, Homo sapiens
agggaagaguggaaauuug

SEQ ID NO: 1581785 - RNA, 19 nt, Homo sapiens
gcucuuccgcggacucuga

SEQ ID NO: 1581786 - RNA, 19 nt, Homo sapiens
gaaggcaucaagcaauuuu

SEQ ID NO: 1581787 - RNA, 19 nt, Homo sapiens
guucaugaccgacccaauc

SEQ ID NO: 1581788 - RNA, 19 nt, Homo sapiens
agagcagauuuacgaugua

SEQ ID NO: 1581789 - RNA, 19 nt, Homo sapiens
gcuguguacuccuguuugg

SEQ ID NO: 1581790 - RNA, 19 nt, Homo sapiens
gccagccgagugcuuauuu

SEQ ID NO: 1581791 - RNA, 19 nt, Homo sapiens
agaguuggcugugcagauc

SEQ ID NO: 1581792 - RNA, 19 nt, Homo sapiens
cgacauccgcauccucaga

SEQ ID NO: 1581793 - RNA, 19 nt, Homo sapiens
ccuaauaacagagaauugu

SEQ ID NO: 1581794 - RNA, 19 nt, Homo sapiens
acagccaccuucaguaucu

SEQ ID NO: 1581795 - RNA, 19 nt, Homo sapiens
uuuacgauguauacaggua

SEQ ID NO: 1581796 - RNA, 19 nt, Homo sapiens
gggaugagggagacuguuc

SEQ ID NO: 1581797 - RNA, 19 nt, Homo sapiens
ugaucucccuaauaacaga

SEQ ID NO: 1581798 - RNA, 19 nt, Homo sapiens
caaagaggaagacaugacu

SEQ ID NO: 1581799 - RNA, 19 nt, Homo sapiens
uaaggacacgugcuaucaa

SEQ ID NO: 1581800 - RNA, 19 nt, Homo sapiens
guguuuggauauucagguu

SEQ ID NO: 1581801 - RNA, 19 nt, Homo sapiens
auucugcucucuuuucuua

SEQ ID NO: 1581802 - RNA, 19 nt, Homo sapiens
gguguggccauuaacuuug

SEQ ID NO: 1581803 - RNA, 19 nt, Homo sapiens
ggaagacaugacuaaagug

SEQ ID NO: 1581804 - RNA, 19 nt, Homo sapiens
gagugcuuauuucuacaga

SEQ ID NO: 1581805 - RNA, 19 nt, Homo sapiens
ucacucaggcggucaucuu

SEQ ID NO: 1581806 - RNA, 19 nt, Homo sapiens
guuucaaagagcagauuua

SEQ ID NO: 1581807 - RNA, 19 nt, Homo sapiens
gauuacggacagcauguug

SEQ ID NO: 1581808 - RNA, 19 nt, Homo sapiens
gauaucgagcaguacuauu

SEQ ID NO: 1581809 - RNA, 19 nt, Homo sapiens
uuaacuaugaucucccuaa

SEQ ID NO: 1581810 - RNA, 19 nt, Homo sapiens
cuaaggacacgugcuauca

SEQ ID NO: 1581811 - RNA, 19 nt, Homo sapiens
guuuggaaguauuuagauc

SEQ ID NO: 1581812 - RNA, 19 nt, Homo sapiens
gagaguuggcugugcagau

SEQ ID NO: 1581813 - RNA, 19 nt, Homo sapiens
acaggugguucucaucagu

SEQ ID NO: 1581814 - RNA, 19 nt, Homo sapiens
ccagggagcuccucacuaa

SEQ ID NO: 1581815 - RNA, 19 nt, Homo sapiens
gguaaaggauuguuaaugu

SEQ ID NO: 1581816 - RNA, 19 nt, Homo sapiens
gcaguuaaauaguggguaa

SEQ ID NO: 1581817 - RNA, 19 nt, Homo sapiens
gaaagcccgugaguucaua

SEQ ID NO: 1581818 - RNA, 19 nt, Homo sapiens
uuacaaggaugcuuugaaa

SEQ ID NO: 1581819 - RNA, 19 nt, Homo sapiens
ugaaggaccugaggcauuu

SEQ ID NO: 1581820 - RNA, 19 nt, Homo sapiens
aaagauacauaccugguuu

SEQ ID NO: 1581821 - RNA, 19 nt, Homo sapiens
uuaaauagcuucagaaucc

SEQ ID NO: 1581822 - RNA, 19 nt, Homo sapiens
cagcuucucuucugaguga

SEQ ID NO: 1581823 - RNA, 19 nt, Homo sapiens
cauuagaccucaccucuga

SEQ ID NO: 1581824 - RNA, 19 nt, Homo sapiens
uccaagagcucauucagaa

SEQ ID NO: 1581825 - RNA, 19 nt, Homo sapiens
gcaggaacauuaccuagag

SEQ ID NO: 1581826 - RNA, 19 nt, Homo sapiens
gaggaaaguaguagaguuu

SEQ ID NO: 1581827 - RNA, 19 nt, Homo sapiens
gcacauguauugcuguuuu

SEQ ID NO: 1581828 - RNA, 19 nt, Homo sapiens
ucagacaccuugcuagaga

SEQ ID NO: 1581829 - RNA, 19 nt, Homo sapiens
auacauaccugguuugcuu

SEQ ID NO: 1581830 - RNA, 19 nt, Homo sapiens
ugaagcagccuaucacaaa

SEQ ID NO: 1581831 - RNA, 19 nt, Homo sapiens
guaagaaaguagaagaaag

SEQ ID NO: 1581832 - RNA, 19 nt, Homo sapiens
gcagagaugcugacgaaug

SEQ ID NO: 1581833 - RNA, 19 nt, Homo sapiens
gaggagacuuauagaccua

SEQ ID NO: 1581834 - RNA, 19 nt, Homo sapiens
ccagaaagcaggaguugaa

SEQ ID NO: 1581835 - RNA, 19 nt, Homo sapiens
cagagaugcugacgaaugu

SEQ ID NO: 1581836 - RNA, 19 nt, Homo sapiens
acacagugcuauuugcauu

SEQ ID NO: 1581837 - RNA, 19 nt, Homo sapiens
ugacuccuaugucuuugua

SEQ ID NO: 1581838 - RNA, 19 nt, Homo sapiens
gcgagcccuuguucacuua

SEQ ID NO: 1581839 - RNA, 19 nt, Homo sapiens
ggagggaggagacuuauag

SEQ ID NO: 1581840 - RNA, 19 nt, Homo sapiens
gcauuucuguuccauaugg

SEQ ID NO: 1581841 - RNA, 19 nt, Homo sapiens
gguuucuucuccucaaaua

SEQ ID NO: 1581842 - RNA, 19 nt, Homo sapiens
gaagcagccuaucacaaag

SEQ ID NO: 1581843 - RNA, 19 nt, Homo sapiens
ccucaaauaucaagugaag

SEQ ID NO: 1581844 - RNA, 19 nt, Homo sapiens
gagcaccaccuuaagagaa

SEQ ID NO: 1581845 - RNA, 19 nt, Homo sapiens
gagaacacagugcuauuug

SEQ ID NO: 1581846 - RNA, 19 nt, Homo sapiens
uaaagaauaccgucccuau

SEQ ID NO: 1581847 - RNA, 19 nt, Homo sapiens
caggaaagcccgugaguuc

SEQ ID NO: 1581848 - RNA, 19 nt, Homo sapiens
gggaggaauuccagucuuc

SEQ ID NO: 1581849 - RNA, 19 nt, Homo sapiens
gagcuccucacuaaaguuu

SEQ ID NO: 1581850 - RNA, 19 nt, Homo sapiens
aggcagagaugcugacgaa

SEQ ID NO: 1581851 - RNA, 19 nt, Homo sapiens
agacagcgaguccuugaua

SEQ ID NO: 1581852 - RNA, 19 nt, Homo sapiens
gcagcccaguagaugaaua

SEQ ID NO: 1581853 - RNA, 19 nt, Homo sapiens
gguuuaagaguaacaguuu

SEQ ID NO: 1581854 - RNA, 19 nt, Homo sapiens
cagaagucauuaagaggaa

SEQ ID NO: 1581855 - RNA, 19 nt, Homo sapiens
uuaaugugguguuacugua

SEQ ID NO: 1581856 - RNA, 19 nt, Homo sapiens
gcuucagaauccuaguuua

SEQ ID NO: 1581857 - RNA, 19 nt, Homo sapiens
gaacacagugcuauuugca

SEQ ID NO: 1581858 - RNA, 19 nt, Homo sapiens
gagcccuuguucacuuaua

SEQ ID NO: 1581859 - RNA, 19 nt, Homo sapiens
ggagagaacacagugcuau

SEQ ID NO: 1581860 - RNA, 19 nt, Homo sapiens
aauaguggguaaaggauug

SEQ ID NO: 1581861 - RNA, 19 nt, Homo sapiens
gagcccaggccauaauuga

SEQ ID NO: 1581862 - RNA, 19 nt, Homo sapiens
agagagagcccaggccaua

SEQ ID NO: 1581863 - RNA, 19 nt, Homo sapiens
gagagaacacagugcuauu

SEQ ID NO: 1581864 - RNA, 19 nt, Homo sapiens
uaauugacaccacagauga

SEQ ID NO: 1581865 - RNA, 19 nt, Homo sapiens
gaaagauguggaagagaga

SEQ ID NO: 1581866 - RNA, 19 nt, Homo sapiens
ucacuuauacacuggauga

SEQ ID NO: 1581867 - RNA, 19 nt, Homo sapiens
cccaguagaugaauauaca

SEQ ID NO: 1581868 - RNA, 19 nt, Homo sapiens
ucccagaguucuccuguga

SEQ ID NO: 1581869 - RNA, 19 nt, Homo sapiens
cuucuccucugcuuuauug

SEQ ID NO: 1581870 - RNA, 19 nt, Homo sapiens
cugaguaucaucuucauaa

SEQ ID NO: 1581871 - RNA, 19 nt, Homo sapiens
gagaaguggacccugauga

SEQ ID NO: 1581872 - RNA, 19 nt, Homo sapiens
gaaagcaggaguugaagac

SEQ ID NO: 1581873 - RNA, 19 nt, Homo sapiens
caugucuccucucuacuuu

SEQ ID NO: 1581874 - RNA, 19 nt, Homo sapiens
ccuaucuccucacuacuuu

SEQ ID NO: 1581875 - RNA, 19 nt, Homo sapiens
ugaugacuccuaugucuuu

SEQ ID NO: 1581876 - RNA, 19 nt, Homo sapiens
ggacccugaugacuccuau

SEQ ID NO: 1581877 - RNA, 19 nt, Homo sapiens
ggaaagcccgugaguucau

SEQ ID NO: 1581878 - RNA, 19 nt, Homo sapiens
caagugaagcagccuauca

SEQ ID NO: 1581879 - RNA, 19 nt, Homo sapiens
cuucuucuccuacacuuua

SEQ ID NO: 1581880 - RNA, 19 nt, Homo sapiens
agaggaaaguaguagaguu

SEQ ID NO: 1581881 - RNA, 19 nt, Homo sapiens
gcccgugaguucauagaga

SEQ ID NO: 1581882 - RNA, 19 nt, Homo sapiens
cgaaugucaucagcaggua

SEQ ID NO: 1581883 - RNA, 19 nt, Homo sapiens
ucaaauaucaagugaagca

SEQ ID NO: 1581884 - RNA, 19 nt, Homo sapiens
uaccgucccuauuaccuuu

SEQ ID NO: 1581885 - RNA, 19 nt, Homo sapiens
caagagcucauucagaagu

SEQ ID NO: 1581886 - RNA, 19 nt, Homo sapiens
gagggacacauacauccua

SEQ ID NO: 1581887 - RNA, 19 nt, Homo sapiens
gcauuucccugagagaagu

SEQ ID NO: 1581888 - RNA, 19 nt, Homo sapiens
uagcgagucuucuccaaag

SEQ ID NO: 1581889 - RNA, 19 nt, Homo sapiens
ccagucuccucuccagauu

SEQ ID NO: 1581890 - RNA, 19 nt, Homo sapiens
ccagucuccucuccagauu

SEQ ID NO: 1581891 - RNA, 19 nt, Homo sapiens
ccagucuccucuccagauu

SEQ ID NO: 1581892 - RNA, 19 nt, Homo sapiens
ccagucuccucuccagauu

SEQ ID NO: 1581893 - RNA, 19 nt, Homo sapiens
ccagucuccucuccagauu

SEQ ID NO: 1581894 - RNA, 19 nt, Homo sapiens
ccagucuccucuccagauu

SEQ ID NO: 1581895 - RNA, 19 nt, Homo sapiens
ccagucuccucuccagauu

SEQ ID NO: 1581896 - RNA, 19 nt, Homo sapiens
ccagucuccucuccagauu

SEQ ID NO: 1581897 - RNA, 19 nt, Homo sapiens
uuaaauaguggguaaagga

SEQ ID NO: 1581898 - RNA, 19 nt, Homo sapiens
acagguuaaugugguguua

SEQ ID NO: 1581899 - RNA, 19 nt, Homo sapiens
uugcauuucuguuccauau

SEQ ID NO: 1581900 - RNA, 19 nt, Homo sapiens
gcuauuugcauuucuguuc

SEQ ID NO: 1581901 - RNA, 19 nt, Homo sapiens
gagucaagguucccagaag

SEQ ID NO: 1581902 - RNA, 19 nt, Homo sapiens
cagaaccgccuccugauuc

SEQ ID NO: 1581903 - RNA, 19 nt, Homo sapiens
uaagagaagaagagcugua

SEQ ID NO: 1581904 - RNA, 19 nt, Homo sapiens
ggacacauacauccuaaaa

SEQ ID NO: 1581905 - RNA, 19 nt, Homo sapiens
acaccuugcuagagaguga

SEQ ID NO: 1581906 - RNA, 19 nt, Homo sapiens
cuucuucuccucugcuuua

SEQ ID NO: 1581907 - RNA, 19 nt, Homo sapiens
guagaagaaaguaaacugu

SEQ ID NO: 1581908 - RNA, 19 nt, Homo sapiens
ggacaaggauaugccuacu

SEQ ID NO: 1581909 - RNA, 19 nt, Homo sapiens
gagcgacgacacccuguau

SEQ ID NO: 1581910 - RNA, 19 nt, Homo sapiens
gagggagcacuuugccuuu

SEQ ID NO: 1581911 - RNA, 19 nt, Homo sapiens
uaaagauacauaccugguu

SEQ ID NO: 1581912 - RNA, 19 nt, Homo sapiens
ucaaggugcuccagaaagc

SEQ ID NO: 1581913 - RNA, 19 nt, Homo sapiens
agagaacacagugcuauuu

SEQ ID NO: 1581914 - RNA, 19 nt, Homo sapiens
gaagaggcaugacugcuuu

SEQ ID NO: 1581915 - RNA, 19 nt, Homo sapiens
caagaaggcugccaccauu

SEQ ID NO: 1581916 - RNA, 19 nt, Homo sapiens
cagcagagucuaauuuaua

SEQ ID NO: 1581917 - RNA, 19 nt, Homo sapiens
acacugagcgccugauuua

SEQ ID NO: 1581918 - RNA, 19 nt, Homo sapiens
gaaccucccugacgauauc

SEQ ID NO: 1581919 - RNA, 19 nt, Homo sapiens
ggaaauaaagacucaaaga

SEQ ID NO: 1581920 - RNA, 19 nt, Homo sapiens
ucagaacacugugaccuua

SEQ ID NO: 1581921 - RNA, 19 nt, Homo sapiens
gaucuagccugggugagua

SEQ ID NO: 1581922 - RNA, 19 nt, Homo sapiens
ccaaggaaauaaagacuca

SEQ ID NO: 1581923 - RNA, 19 nt, Homo sapiens
ccacagcagagucuaauuu

SEQ ID NO: 1581924 - RNA, 19 nt, Homo sapiens
ggucuagccugggugagua

SEQ ID NO: 1581925 - RNA, 19 nt, Homo sapiens
ggucuagccugggugagua

SEQ ID NO: 1581926 - RNA, 19 nt, Homo sapiens
caagagggcugggcauucu

SEQ ID NO: 1581927 - RNA, 19 nt, Homo sapiens
ggucuagccugggugugua

SEQ ID NO: 1581928 - RNA, 19 nt, Homo sapiens
ggucuagccugggugugua

SEQ ID NO: 1581929 - RNA, 19 nt, Homo sapiens
ggucuagccugggugugua

SEQ ID NO: 1581930 - RNA, 19 nt, Homo sapiens
ggucuagccugggugugua

SEQ ID NO: 1581931 - RNA, 19 nt, Homo sapiens
cacagcagagucuaauuua

SEQ ID NO: 1581932 - RNA, 19 nt, Homo sapiens
gcaacaacaacgucaccua

SEQ ID NO: 1581933 - RNA, 19 nt, Homo sapiens
caucauccccuguuauuua

SEQ ID NO: 1581934 - RNA, 19 nt, Homo sapiens
ggcauucucugcugguaau

SEQ ID NO: 1581935 - RNA, 19 nt, Homo sapiens
ccacugccuucccugcaaa

SEQ ID NO: 1581936 - RNA, 19 nt, Homo sapiens
uuagggcccuucucuagga

SEQ ID NO: 1581937 - RNA, 19 nt, Homo sapiens
ggacacugagcgccugauu

SEQ ID NO: 1581938 - RNA, 19 nt, Homo sapiens
ggacaacacggaggauauc

SEQ ID NO: 1581939 - RNA, 19 nt, Homo sapiens
gaggacaacacggaggaua

SEQ ID NO: 1581940 - RNA, 19 nt, Homo sapiens
cgccaagacucacgcaugu

SEQ ID NO: 1581941 - RNA, 19 nt, Homo sapiens
caagccaggcccuucauga

SEQ ID NO: 1581942 - RNA, 19 nt, Homo sapiens
ugccuucccugcaaagauu

SEQ ID NO: 1581943 - RNA, 19 nt, Homo sapiens
cagaagaggaagagaacuu

SEQ ID NO: 1581944 - RNA, 19 nt, Homo sapiens
ccucuagucugggugugua

SEQ ID NO: 1581945 - RNA, 19 nt, Homo sapiens
caacaacgucaccuacauc

SEQ ID NO: 1581946 - RNA, 19 nt, Homo sapiens
gcugguaauuccugaagag

SEQ ID NO: 1581947 - RNA, 19 nt, Homo sapiens
acagcagagucuaauuuau

SEQ ID NO: 1581948 - RNA, 19 nt, Homo sapiens
uacggagggucuagucuga

SEQ ID NO: 1581949 - RNA, 19 nt, Homo sapiens
ggggauaaaccuauuaauu

SEQ ID NO: 1581950 - RNA, 19 nt, Homo sapiens
acaacaacgucaccuacau

SEQ ID NO: 1581951 - RNA, 19 nt, Homo sapiens
ugaagaggcaugacugcuu

SEQ ID NO: 1581952 - RNA, 19 nt, Homo sapiens
ccaagacucacgcaugugu

SEQ ID NO: 1581953 - RNA, 19 nt, Homo sapiens
ccaagaaggcugccaccau

SEQ ID NO: 1581954 - RNA, 19 nt, Homo sapiens
ugugaaggccauugagaaa

SEQ ID NO: 1581955 - RNA, 19 nt, Homo sapiens
gacacugagcgccugauuu

SEQ ID NO: 1581956 - RNA, 19 nt, Homo sapiens
ccacggacacuccuuagag

SEQ ID NO: 1581957 - RNA, 19 nt, Homo sapiens
uaccuguggugcccagaaa

SEQ ID NO: 1581958 - RNA, 19 nt, Homo sapiens
gauuuagggcccuucucua

SEQ ID NO: 1581959 - RNA, 19 nt, Homo sapiens
cagaaccucccugacgaua

SEQ ID NO: 1581960 - RNA, 19 nt, Homo sapiens
uaccugugccugcguguaa

SEQ ID NO: 1581961 - RNA, 19 nt, Homo sapiens
ggaccucagaacacuguga

SEQ ID NO: 1581962 - RNA, 19 nt, Homo sapiens
caaccuccucggcuucuug

SEQ ID NO: 1581963 - RNA, 19 nt, Homo sapiens
ggaccugagcgucauguac

SEQ ID NO: 1581964 - RNA, 19 nt, Homo sapiens
gggcauucucugcugguaa

SEQ ID NO: 1581965 - RNA, 19 nt, Homo sapiens
gcaagccaggcccuucaug

SEQ ID NO: 1581966 - RNA, 19 nt, Homo sapiens
auugagaaaugcccagugu

SEQ ID NO: 1581967 - RNA, 19 nt, Homo sapiens
ggaucuagccugggugagu

SEQ ID NO: 1581968 - RNA, 19 nt, Homo sapiens
cggagggucuagucugagu

SEQ ID NO: 1581969 - RNA, 19 nt, Homo sapiens
guggugagucugcagaaga

SEQ ID NO: 1581970 - RNA, 19 nt, Homo sapiens
aagccaggcccuucaugaa

SEQ ID NO: 1581971 - RNA, 19 nt, Homo sapiens
cugcguugaugcucagaau

SEQ ID NO: 1581972 - RNA, 19 nt, Homo sapiens
cagcaagccaggcccuuca

SEQ ID NO: 1581973 - RNA, 19 nt, Homo sapiens
gcagagucuaauuuauaug

SEQ ID NO: 1581974 - RNA, 19 nt, Homo sapiens
ggaaagggaugguguuuau

SEQ ID NO: 1581975 - RNA, 19 nt, Homo sapiens
gacauaaacuguacagaaa

SEQ ID NO: 1581976 - RNA, 19 nt, Homo sapiens
gcggagacauuuacgaaua

SEQ ID NO: 1581977 - RNA, 19 nt, Homo sapiens
caagggagcuguugcaaau

SEQ ID NO: 1581978 - RNA, 19 nt, Homo sapiens
gaaagacacaucaaugaaa

SEQ ID NO: 1581979 - RNA, 19 nt, Homo sapiens
caaagacggugcccgauga

SEQ ID NO: 1581980 - RNA, 19 nt, Homo sapiens
agaaguaucugagacauaa

SEQ ID NO: 1581981 - RNA, 19 nt, Homo sapiens
gaacaagugugacgaucug

SEQ ID NO: 1581982 - RNA, 19 nt, Homo sapiens
gagaauaucaugaaacaga

SEQ ID NO: 1581983 - RNA, 19 nt, Homo sapiens
cagcaaagauuuacaaagg

SEQ ID NO: 1581984 - RNA, 19 nt, Homo sapiens
cgacaucccucccucauca

SEQ ID NO: 1581985 - RNA, 19 nt, Homo sapiens
gacauauccugcucucuaa

SEQ ID NO: 1581986 - RNA, 19 nt, Homo sapiens
ggaauuuauugcuaucuug

SEQ ID NO: 1581987 - RNA, 19 nt, Homo sapiens
ggaaagacacaucaaugaa

SEQ ID NO: 1581988 - RNA, 19 nt, Homo sapiens
gaagagagaccagagaguu

SEQ ID NO: 1581989 - RNA, 19 nt, Homo sapiens
caaagcccguggagaauga

SEQ ID NO: 1581990 - RNA, 19 nt, Homo sapiens
agacacagcuauugagaga

SEQ ID NO: 1581991 - RNA, 19 nt, Homo sapiens
ggagacauuuacgaauaua

SEQ ID NO: 1581992 - RNA, 19 nt, Homo sapiens
ggagcuggauggaugacua

SEQ ID NO: 1581993 - RNA, 19 nt, Homo sapiens
gaacucauccuccacaaca

SEQ ID NO: 1581994 - RNA, 19 nt, Homo sapiens
gcacagcaguggacaaggu

SEQ ID NO: 1581995 - RNA, 19 nt, Homo sapiens
ggauggaugacuacgauua

SEQ ID NO: 1581996 - RNA, 19 nt, Homo sapiens
acacagaguccaucuaauu

SEQ ID NO: 1581997 - RNA, 19 nt, Homo sapiens
gcaacaaagucaugaacuc

SEQ ID NO: 1581998 - RNA, 19 nt, Homo sapiens
gcacacagcaaguuuguca

SEQ ID NO: 1581999 - RNA, 19 nt, Homo sapiens
cuaagggaauuuauugcua

SEQ ID NO: 1582000 - RNA, 19 nt, Homo sapiens
ugagagacagcuacaauaa

SEQ ID NO: 1582001 - RNA, 19 nt, Homo sapiens
uuacaaagcccguggagaa

SEQ ID NO: 1582002 - RNA, 19 nt, Homo sapiens
ccacaaccaucaacaccaa

SEQ ID NO: 1582003 - RNA, 19 nt, Homo sapiens
gaucuggaccgguuuguga

SEQ ID NO: 1582004 - RNA, 19 nt, Homo sapiens
uaaaggcucucgggacuug

SEQ ID NO: 1582005 - RNA, 19 nt, Homo sapiens
gaacuggccagguccuuga

SEQ ID NO: 1582006 - RNA, 19 nt, Homo sapiens
uagcaugacuuauucuugu

SEQ ID NO: 1582007 - RNA, 19 nt, Homo sapiens
agaaagagcuauuggaaaa

SEQ ID NO: 1582008 - RNA, 19 nt, Homo sapiens
gaacgacgcauaugauguc

SEQ ID NO: 1582009 - RNA, 19 nt, Homo sapiens
agaaugacaucucgaagug

SEQ ID NO: 1582010 - RNA, 19 nt, Homo sapiens
gacaggccauggcuacgua

SEQ ID NO: 1582011 - RNA, 19 nt, Homo sapiens
caacagaagcucuaucaag

SEQ ID NO: 1582012 - RNA, 19 nt, Homo sapiens
gaaaugcccagcuguucaa

SEQ ID NO: 1582013 - RNA, 19 nt, Homo sapiens
ucaaaccagccaugacuua

SEQ ID NO: 1582014 - RNA, 19 nt, Homo sapiens
gagagacagcuacaauaaa

SEQ ID NO: 1582015 - RNA, 19 nt, Homo sapiens
ccacggcccugcaggaaau

SEQ ID NO: 1582016 - RNA, 19 nt, Homo sapiens
agacauauccugcucucua

SEQ ID NO: 1582017 - RNA, 19 nt, Homo sapiens
auccaagucucgauaguua

SEQ ID NO: 1582018 - RNA, 19 nt, Homo sapiens
ccaagcagcucaccacaac

SEQ ID NO: 1582019 - RNA, 19 nt, Homo sapiens
cugccgaaaugaaguauaa

SEQ ID NO: 1582020 - RNA, 19 nt, Homo sapiens
caccagauccugagucaaa

SEQ ID NO: 1582021 - RNA, 19 nt, Homo sapiens
gggaugguguuuaugaugu

SEQ ID NO: 1582022 - RNA, 19 nt, Homo sapiens
gaugguggcugugcucguu

SEQ ID NO: 1582023 - RNA, 19 nt, Homo sapiens
cuacacagaguccaucuaa

SEQ ID NO: 1582024 - RNA, 19 nt, Homo sapiens
ucauggaacuauagagcua

SEQ ID NO: 1582025 - RNA, 19 nt, Homo sapiens
gaauauauauguggaucca

SEQ ID NO: 1582026 - RNA, 19 nt, Homo sapiens
ggcauagcaugacuuauuc

SEQ ID NO: 1582027 - RNA, 19 nt, Homo sapiens
agacauaaacuguacagaa

SEQ ID NO: 1582028 - RNA, 19 nt, Homo sapiens
guucuuauguauacacaga

SEQ ID NO: 1582029 - RNA, 19 nt, Homo sapiens
ccuggcagcuugcaucuga

SEQ ID NO: 1582030 - RNA, 19 nt, Homo sapiens
gggugaagcuucugauugg

SEQ ID NO: 1582031 - RNA, 19 nt, Homo sapiens
aaacugaccaucuuaaaca

SEQ ID NO: 1582032 - RNA, 19 nt, Homo sapiens
uggaaauacugucugguuu

SEQ ID NO: 1582033 - RNA, 19 nt, Homo sapiens
gggaauuuauugcuaucuu

SEQ ID NO: 1582034 - RNA, 19 nt, Homo sapiens
ugucuuaacuaguguagga

SEQ ID NO: 1582035 - RNA, 19 nt, Homo sapiens
ugggaagcauaguuuauuu

SEQ ID NO: 1582036 - RNA, 19 nt, Homo sapiens
aacagaagcucuaucaagu

SEQ ID NO: 1582037 - RNA, 19 nt, Homo sapiens
acaaaggcguaucagacua

SEQ ID NO: 1582038 - RNA, 19 nt, Homo sapiens
gaacaagagauuacaaagc

SEQ ID NO: 1582039 - RNA, 19 nt, Homo sapiens
gcuggucccugaauaucuu

SEQ ID NO: 1582040 - RNA, 19 nt, Homo sapiens
caaaauaggggaaugguuu

SEQ ID NO: 1582041 - RNA, 19 nt, Homo sapiens
ccagcugguuauaauauug

SEQ ID NO: 1582042 - RNA, 19 nt, Homo sapiens
aaauacaacugugacauuc

SEQ ID NO: 1582043 - RNA, 19 nt, Homo sapiens
gcaaguagaggccuuucug

SEQ ID NO: 1582044 - RNA, 19 nt, Homo sapiens
uguucaaucuucugcauuu

SEQ ID NO: 1582045 - RNA, 19 nt, Homo sapiens
aggcauagcaugacuuauu

SEQ ID NO: 1582046 - RNA, 19 nt, Homo sapiens
ccaggacauucgcaacaaa

SEQ ID NO: 1582047 - RNA, 19 nt, Homo sapiens
aaagggaugguguuuauga

SEQ ID NO: 1582048 - RNA, 19 nt, Homo sapiens
agagacagcuacaauaaaa

SEQ ID NO: 1582049 - RNA, 19 nt, Homo sapiens
ugaauuacgaagcaccuua

SEQ ID NO: 1582050 - RNA, 19 nt, Homo sapiens
ugucugaugcauuucauua

SEQ ID NO: 1582051 - RNA, 19 nt, Homo sapiens
ugaguguucuuauguauac

SEQ ID NO: 1582052 - RNA, 19 nt, Homo sapiens
cggagacauuuacgaauau

SEQ ID NO: 1582053 - RNA, 19 nt, Homo sapiens
ggagauggcaacguucuga

SEQ ID NO: 1582054 - RNA, 19 nt, Homo sapiens
cugaauaucuuggccauca

SEQ ID NO: 1582055 - RNA, 19 nt, Homo sapiens
cacagaguccaucuaauuu

SEQ ID NO: 1582056 - RNA, 19 nt, Homo sapiens
aauauucacuuuggugcua

SEQ ID NO: 1582057 - RNA, 19 nt, Homo sapiens
guguucaccuuccaaauca

SEQ ID NO: 1582058 - RNA, 19 nt, Homo sapiens
gaagcauaguuuauuugca

SEQ ID NO: 1582059 - RNA, 19 nt, Homo sapiens
gcuugcaucugaagaaugg

SEQ ID NO: 1582060 - RNA, 19 nt, Homo sapiens
ggaucaaccgauugucuuu

SEQ ID NO: 1582061 - RNA, 19 nt, Homo sapiens
gauaucccuccuucucaua

SEQ ID NO: 1582062 - RNA, 19 nt, Homo sapiens
uaucuugcaccuucuuuaa

SEQ ID NO: 1582063 - RNA, 19 nt, Homo sapiens
caaaggcguaucagacuau

SEQ ID NO: 1582064 - RNA, 19 nt, Homo sapiens
gaggccaggaccacaguua

SEQ ID NO: 1582065 - RNA, 19 nt, Homo sapiens
agagagaccagagaguuua

SEQ ID NO: 1582066 - RNA, 19 nt, Homo sapiens
ugugagacccauuucauuu

SEQ ID NO: 1582067 - RNA, 19 nt, Homo sapiens
cagaaagagcuauuggaaa

SEQ ID NO: 1582068 - RNA, 19 nt, Homo sapiens
acagaaagagcuauuggaa

SEQ ID NO: 1582069 - RNA, 19 nt, Homo sapiens
uggaaagacacaucaauga

SEQ ID NO: 1582070 - RNA, 19 nt, Homo sapiens
gcucucagaacgacgcaua

SEQ ID NO: 1582071 - RNA, 19 nt, Homo sapiens
ccacggcacccaagaacaa

SEQ ID NO: 1582072 - RNA, 19 nt, Homo sapiens
cuauagagcuaccagacau

SEQ ID NO: 1582073 - RNA, 19 nt, Homo sapiens
ugaggcauagcaugacuua

SEQ ID NO: 1582074 - RNA, 19 nt, Homo sapiens
gaugggauaucucaaguuu

SEQ ID NO: 1582075 - RNA, 19 nt, Homo sapiens
gaucuacguugauaaggaa

SEQ ID NO: 1582076 - RNA, 19 nt, Homo sapiens
ugacgccuauccagaaaua

SEQ ID NO: 1582077 - RNA, 19 nt, Homo sapiens
caacagagcuacagaaaag

SEQ ID NO: 1582078 - RNA, 19 nt, Homo sapiens
gaugacgccuauccagaaa

SEQ ID NO: 1582079 - RNA, 19 nt, Homo sapiens
gaccuucaaucaaagcauu

SEQ ID NO: 1582080 - RNA, 19 nt, Homo sapiens
gucuagaccuucaaucaaa

SEQ ID NO: 1582081 - RNA, 19 nt, Homo sapiens
ugggauaucucaaguuuua

SEQ ID NO: 1582082 - RNA, 19 nt, Homo sapiens
gcagucuccuucaagcauu

SEQ ID NO: 1582083 - RNA, 19 nt, Homo sapiens
acucugaucuacguugaua

SEQ ID NO: 1582084 - RNA, 19 nt, Homo sapiens
caaagcauuagaugggaua

SEQ ID NO: 1582085 - RNA, 19 nt, Homo sapiens
ccaaggaugugcugaagcu

SEQ ID NO: 1582086 - RNA, 19 nt, Homo sapiens
gagucuagaccuucaauca

SEQ ID NO: 1582087 - RNA, 19 nt, Homo sapiens
uaaggaaauuggagaacca

SEQ ID NO: 1582088 - RNA, 19 nt, Homo sapiens
ugucgacccuggauguuga

SEQ ID NO: 1582089 - RNA, 19 nt, Homo sapiens
ugaccgagaagacuguuaa

SEQ ID NO: 1582090 - RNA, 19 nt, Homo sapiens
cuacguugauaaggaaauu

SEQ ID NO: 1582091 - RNA, 19 nt, Homo sapiens
ugaucuacguugauaagga

SEQ ID NO: 1582092 - RNA, 19 nt, Homo sapiens
gaggagggagagcuugaaa

SEQ ID NO: 1582093 - RNA, 19 nt, Homo sapiens
cuacucugaucuacguuga

SEQ ID NO: 1582094 - RNA, 19 nt, Homo sapiens
cuucaaucuucuagacuuu

SEQ ID NO: 1582095 - RNA, 19 nt, Homo sapiens
ccaugggaaugcaaucugu

SEQ ID NO: 1582096 - RNA, 19 nt, Homo sapiens
ccaucagccuuaccuaaag

SEQ ID NO: 1582097 - RNA, 19 nt, Homo sapiens
uaccuaaagcuaccagaaa

SEQ ID NO: 1582098 - RNA, 19 nt, Homo sapiens
uggagugccucucaugauc

SEQ ID NO: 1582099 - RNA, 19 nt, Homo sapiens
gucaacagagcuacagaaa

SEQ ID NO: 1582100 - RNA, 19 nt, Homo sapiens
ucaaucaaagcauuagaug

SEQ ID NO: 1582101 - RNA, 19 nt, Homo sapiens
cuucuagacuuugagaguu

SEQ ID NO: 1582102 - RNA, 19 nt, Homo sapiens
ccuucaaucuucuagacuu

SEQ ID NO: 1582103 - RNA, 19 nt, Homo sapiens
agaugacgccuauccagaa

SEQ ID NO: 1582104 - RNA, 19 nt, Homo sapiens
acagaaaagucaguaaaga

SEQ ID NO: 1582105 - RNA, 19 nt, Homo sapiens
uccaucagccuuaccuaaa

SEQ ID NO: 1582106 - RNA, 19 nt, Homo sapiens
ugccucagaugacgccuau

SEQ ID NO: 1582107 - RNA, 19 nt, Homo sapiens
uucuagacuuugagaguuu

SEQ ID NO: 1582108 - RNA, 19 nt, Homo sapiens
gaccgagaagacuguuaaa

SEQ ID NO: 1582109 - RNA, 19 nt, Homo sapiens
gaguggagugccucucaug

SEQ ID NO: 1582110 - RNA, 19 nt, Homo sapiens
ccugaagagcgccagauug

SEQ ID NO: 1582111 - RNA, 19 nt, Homo sapiens
ugauaaggaaauuggagaa

SEQ ID NO: 1582112 - RNA, 19 nt, Homo sapiens
caaagcagauccucaauaa

SEQ ID NO: 1582113 - RNA, 19 nt, Homo sapiens
gaaggugccugucuaacuu

SEQ ID NO: 1582114 - RNA, 19 nt, Homo sapiens
gacauucccugcuaauaaa

SEQ ID NO: 1582115 - RNA, 19 nt, Homo sapiens
gagcugcuuucgccaauuu

SEQ ID NO: 1582116 - RNA, 19 nt, Homo sapiens
ggacaagacaugacuguga

SEQ ID NO: 1582117 - RNA, 19 nt, Homo sapiens
caaacagucucccuuccua

SEQ ID NO: 1582118 - RNA, 19 nt, Homo sapiens
gcaaagaguauauguagga

SEQ ID NO: 1582119 - RNA, 19 nt, Homo sapiens
gcacaaagcagauccucaa

SEQ ID NO: 1582120 - RNA, 19 nt, Homo sapiens
ggauaucacuuccaugaca

SEQ ID NO: 1582121 - RNA, 19 nt, Homo sapiens
guggaugggugcuuaguaa

SEQ ID NO: 1582122 - RNA, 19 nt, Homo sapiens
ggagagcauucaaacaguu

SEQ ID NO: 1582123 - RNA, 19 nt, Homo sapiens
cagacuuucuucucuauuu

SEQ ID NO: 1582124 - RNA, 19 nt, Homo sapiens
ugacauucccugcuaauaa

SEQ ID NO: 1582125 - RNA, 19 nt, Homo sapiens
ugaccuggaugcagaaauu

SEQ ID NO: 1582126 - RNA, 19 nt, Homo sapiens
gaaggcagcagaauauugu

SEQ ID NO: 1582127 - RNA, 19 nt, Homo sapiens
gagggaugcuuggauguaa

SEQ ID NO: 1582128 - RNA, 19 nt, Homo sapiens
ugacauaagugcuauugca

SEQ ID NO: 1582129 - RNA, 19 nt, Homo sapiens
acuauaaccuuguuccaaa

SEQ ID NO: 1582130 - RNA, 19 nt, Homo sapiens
uagcaaggcugugcaucua

SEQ ID NO: 1582131 - RNA, 19 nt, Homo sapiens
gugaugacauucccugcua

SEQ ID NO: 1582132 - RNA, 19 nt, Homo sapiens
gauguacuauccaaucugu

SEQ ID NO: 1582133 - RNA, 19 nt, Homo sapiens
gacaagacaugacugugau

SEQ ID NO: 1582134 - RNA, 19 nt, Homo sapiens
ucaaacaguuggacguaga

SEQ ID NO: 1582135 - RNA, 19 nt, Homo sapiens
gauacagugucugacuaua

SEQ ID NO: 1582136 - RNA, 19 nt, Homo sapiens
gcuguucacuggacacuuc

SEQ ID NO: 1582137 - RNA, 19 nt, Homo sapiens
uacaagcucugaaugucua

SEQ ID NO: 1582138 - RNA, 19 nt, Homo sapiens
ggccaagaauuccacuuug

SEQ ID NO: 1582139 - RNA, 19 nt, Homo sapiens
guaaggugcaucuguuuga

SEQ ID NO: 1582140 - RNA, 19 nt, Homo sapiens
ggcaguggaugggugcuua

SEQ ID NO: 1582141 - RNA, 19 nt, Homo sapiens
caugaaggcagcagaauau

SEQ ID NO: 1582142 - RNA, 19 nt, Homo sapiens
gcaaaccuuuacuucugaa

SEQ ID NO: 1582143 - RNA, 19 nt, Homo sapiens
gaaauucuacaagcucuga

SEQ ID NO: 1582144 - RNA, 19 nt, Homo sapiens
agaagcagcucugaccaaa

SEQ ID NO: 1582145 - RNA, 19 nt, Homo sapiens
gaaagacacuaugcaagcu

SEQ ID NO: 1582146 - RNA, 19 nt, Homo sapiens
gauccucaauaaacauuuc

SEQ ID NO: 1582147 - RNA, 19 nt, Homo sapiens
ccaggauuauugucaaaga

SEQ ID NO: 1582148 - RNA, 19 nt, Homo sapiens
caauuuaacaccaagaaga

SEQ ID NO: 1582149 - RNA, 19 nt, Homo sapiens
cuaaagauacagugucuga

SEQ ID NO: 1582150 - RNA, 19 nt, Homo sapiens
aaaucacacugucuucuga

SEQ ID NO: 1582151 - RNA, 19 nt, Homo sapiens
gagacugagagaugaauuu

SEQ ID NO: 1582152 - RNA, 19 nt, Homo sapiens
acacgagacugagagauga

SEQ ID NO: 1582153 - RNA, 19 nt, Homo sapiens
uuaauaaacuguggugcuu

SEQ ID NO: 1582154 - RNA, 19 nt, Homo sapiens
gggccaagaauuccacuuu

SEQ ID NO: 1582155 - RNA, 19 nt, Homo sapiens
ucccuaaucuuccacuuga

SEQ ID NO: 1582156 - RNA, 19 nt, Homo sapiens
acaaagcagauccucaaua

SEQ ID NO: 1582157 - RNA, 19 nt, Homo sapiens
ucacaauccuugccacagu

SEQ ID NO: 1582158 - RNA, 19 nt, Homo sapiens
caauagaacaguugaaguc

SEQ ID NO: 1582159 - RNA, 19 nt, Homo sapiens
uuugugagacuguaaguua

SEQ ID NO: 1582160 - RNA, 19 nt, Homo sapiens
gugaagagucuacagagaa

SEQ ID NO: 1582161 - RNA, 19 nt, Homo sapiens
cugcaaaccuuuacuucug

SEQ ID NO: 1582162 - RNA, 19 nt, Homo sapiens
ccacagcuaugccucugau

SEQ ID NO: 1582163 - RNA, 19 nt, Homo sapiens
ggcgacagccucucaaaug

SEQ ID NO: 1582164 - RNA, 19 nt, Homo sapiens
aagauacagugucugacua

SEQ ID NO: 1582165 - RNA, 19 nt, Homo sapiens
gccugucuuuggauuguua

SEQ ID NO: 1582166 - RNA, 19 nt, Homo sapiens
ugaagagucuacagagaag

SEQ ID NO: 1582167 - RNA, 19 nt, Homo sapiens
ggaugaaugcccagugaga

SEQ ID NO: 1582168 - RNA, 19 nt, Homo sapiens
gcccaggauuauugucaaa

SEQ ID NO: 1582169 - RNA, 19 nt, Homo sapiens
ucucuacucuggccaacaa

SEQ ID NO: 1582170 - RNA, 19 nt, Homo sapiens
gauaucacuuccaugacau

SEQ ID NO: 1582171 - RNA, 19 nt, Homo sapiens
ggaggugggauaucacuuc

SEQ ID NO: 1582172 - RNA, 19 nt, Homo sapiens
uguaggaggugggauauca

SEQ ID NO: 1582173 - RNA, 19 nt, Homo sapiens
uccaaucugugaugacauu

SEQ ID NO: 1582174 - RNA, 19 nt, Homo sapiens
uaaggugcaucuguuugaa

SEQ ID NO: 1582175 - RNA, 19 nt, Homo sapiens
caggauuauugucaaagaa

SEQ ID NO: 1582176 - RNA, 19 nt, Homo sapiens
ggaggaaggccaggaggaa

SEQ ID NO: 1582177 - RNA, 19 nt, Homo sapiens
aaaccuaggcaaagaguau

SEQ ID NO: 1582178 - RNA, 19 nt, Homo sapiens
ggcagacuuucuucucuau

SEQ ID NO: 1582179 - RNA, 19 nt, Homo sapiens
uggcagacuuucuucucua

SEQ ID NO: 1582180 - RNA, 19 nt, Homo sapiens
ccuagucauucuucccuaa

SEQ ID NO: 1582181 - RNA, 19 nt, Homo sapiens
ggauuauugucaaagaagu

SEQ ID NO: 1582182 - RNA, 19 nt, Homo sapiens
cacaggcgguuucugcuau

SEQ ID NO: 1582183 - RNA, 19 nt, Homo sapiens
ggugggauaucacuuccau

SEQ ID NO: 1582184 - RNA, 19 nt, Homo sapiens
auacagugucugacuauaa

SEQ ID NO: 1582185 - RNA, 19 nt, Homo sapiens
aagcagauccucaauaaac

SEQ ID NO: 1582186 - RNA, 19 nt, Homo sapiens
acucugaagucauucucua

SEQ ID NO: 1582187 - RNA, 19 nt, Homo sapiens
gcgacagccucucaaaugc

SEQ ID NO: 1582188 - RNA, 19 nt, Homo sapiens
aaccuuuacuucugaaaug

SEQ ID NO: 1582189 - RNA, 19 nt, Homo sapiens
ggugaaggugccugucuaa

SEQ ID NO: 1582190 - RNA, 19 nt, Homo sapiens
ugaaggcagcagaauauug

SEQ ID NO: 1582191 - RNA, 19 nt, Homo sapiens
gaaggugccucuggaugcu

SEQ ID NO: 1582192 - RNA, 19 nt, Homo sapiens
cugcaaagccuguggacuu

SEQ ID NO: 1582193 - RNA, 19 nt, Homo sapiens
ugggauaucacuuccauga

SEQ ID NO: 1582194 - RNA, 19 nt, Homo sapiens
acaugaaggcagcagaaua

SEQ ID NO: 1582195 - RNA, 19 nt, Homo sapiens
ugugaagagucuacagaga

SEQ ID NO: 1582196 - RNA, 19 nt, Homo sapiens
ugagagcuguuaccuuguc

SEQ ID NO: 1582197 - RNA, 19 nt, Homo sapiens
ugcaaaccuuuacuucuga

SEQ ID NO: 1582198 - RNA, 19 nt, Homo sapiens
uauccaaucugugaugaca

SEQ ID NO: 1582199 - RNA, 19 nt, Homo sapiens
ugaagucauucucuacucu

SEQ ID NO: 1582200 - RNA, 19 nt, Homo sapiens
gaacuuuguggucgacauc

SEQ ID NO: 1582201 - RNA, 19 nt, Homo sapiens
aaagacaacauaacucaag

SEQ ID NO: 1582202 - RNA, 19 nt, Homo sapiens
ugaugacauucccugcuaa

SEQ ID NO: 1582203 - RNA, 19 nt, Homo sapiens
caagacaugacugugauga

SEQ ID NO: 1582204 - RNA, 19 nt, Homo sapiens
gagagcauucaaacaguug

SEQ ID NO: 1582205 - RNA, 19 nt, Homo sapiens
ggagcugcuuucgccaauu

SEQ ID NO: 1582206 - RNA, 19 nt, Homo sapiens
gaggaacacgagacugaga

SEQ ID NO: 1582207 - RNA, 19 nt, Homo sapiens
gguaaggugcaucuguuug

SEQ ID NO: 1582208 - RNA, 19 nt, Homo sapiens
cacacugucuucugauauc

SEQ ID NO: 1582209 - RNA, 19 nt, Homo sapiens
aagcagcucugaccaaagc

SEQ ID NO: 1582210 - RNA, 19 nt, Homo sapiens
cuaccacaauagaacaguu

SEQ ID NO: 1582211 - RNA, 19 nt, Homo sapiens
ggaacacgagacugagaga

SEQ ID NO: 1582212 - RNA, 19 nt, Homo sapiens
gaagaucgcucugaauuug

SEQ ID NO: 1582213 - RNA, 19 nt, Homo sapiens
gagaagaucgcucugaauu

SEQ ID NO: 1582214 - RNA, 19 nt, Homo sapiens
gaacugcgcagccacaaca

SEQ ID NO: 1582215 - RNA, 19 nt, Homo sapiens
guagguaucggcacaacua

SEQ ID NO: 1582216 - RNA, 19 nt, Homo sapiens
cgagggacauguguaggua

SEQ ID NO: 1582217 - RNA, 19 nt, Homo sapiens
gagcacagaacuaccagaa

SEQ ID NO: 1582218 - RNA, 19 nt, Homo sapiens
gaaaugagauccgcuuccu

SEQ ID NO: 1582219 - RNA, 19 nt, Homo sapiens
cccaacggcuguuucauug

SEQ ID NO: 1582220 - RNA, 19 nt, Homo sapiens
gcacaacuauccggaucug

SEQ ID NO: 1582221 - RNA, 19 nt, Homo sapiens
ucagggaggucgagguguu

SEQ ID NO: 1582222 - RNA, 19 nt, Homo sapiens
caacggcuguuucauugag

SEQ ID NO: 1582223 - RNA, 19 nt, Homo sapiens
acgcagagguggagucuuc

SEQ ID NO: 1582224 - RNA, 19 nt, Homo sapiens
ccaaagagagcaagaagag

SEQ ID NO: 1582225 - RNA, 19 nt, Homo sapiens
ccaagucugggaagccuua

SEQ ID NO: 1582226 - RNA, 19 nt, Homo sapiens
uggagaagaucgcucugaa

SEQ ID NO: 1582227 - RNA, 19 nt, Homo sapiens
gcccaacggcuguuucauu

SEQ ID NO: 1582228 - RNA, 19 nt, Homo sapiens
agagugcccuggacuacuu

SEQ ID NO: 1582229 - RNA, 19 nt, Homo sapiens
ggacaaucacuccuacauc

SEQ ID NO: 1582230 - RNA, 19 nt, Homo sapiens
gaaugacaggguccagaaa

SEQ ID NO: 1582231 - RNA, 19 nt, Homo sapiens
ggagaagaucgcucugaau

SEQ ID NO: 1582232 - RNA, 19 nt, Homo sapiens
gcccuggacuacuucaugu

SEQ ID NO: 1582233 - RNA, 19 nt, Homo sapiens
ggagucuucugccaagucu

SEQ ID NO: 1582234 - RNA, 19 nt, Homo sapiens
agaagaucgcucugaauuu

SEQ ID NO: 1582235 - RNA, 19 nt, Homo sapiens
ucacacgcauccucaaguc

SEQ ID NO: 1582236 - RNA, 19 nt, Homo sapiens
ggaggucgagguguuuaaa

SEQ ID NO: 1582237 - RNA, 19 nt, Homo sapiens
aagacaagcugcggagguu

SEQ ID NO: 1582238 - RNA, 19 nt, Homo sapiens
gaagguggaggaggaagga

SEQ ID NO: 1582239 - RNA, 19 nt, Homo sapiens
caacaaccuccgcaucaca

SEQ ID NO: 1582240 - RNA, 19 nt, Homo sapiens
ugggaagccuuaaggaaag

SEQ ID NO: 1582241 - RNA, 19 nt, Homo sapiens
cacaacaaccuccgcauca

SEQ ID NO: 1582242 - RNA, 19 nt, Homo sapiens
cugggaagccuuaaggaaa

SEQ ID NO: 1582243 - RNA, 19 nt, Homo sapiens
ccacgagggacauguguag

SEQ ID NO: 1582244 - RNA, 19 nt, Homo sapiens
gcuguuuccucugcgagaa

SEQ ID NO: 1582245 - RNA, 19 nt, Homo sapiens
cgugacccgugacccauga

SEQ ID NO: 1582246 - RNA, 19 nt, Homo sapiens
gcagagugcccuggacuac

SEQ ID NO: 1582247 - RNA, 19 nt, Homo sapiens
agaaugacaggguccagaa

SEQ ID NO: 1582248 - RNA, 19 nt, Homo sapiens
gacaagcugcggagguuca

SEQ ID NO: 1582249 - RNA, 19 nt, Homo sapiens
ggacacgccaaaccugagu

SEQ ID NO: 1582250 - RNA, 19 nt, Homo sapiens
gauaggccggagcccuuaa

SEQ ID NO: 1582251 - RNA, 19 nt, Homo sapiens
cuacauccaguggcuguuu

SEQ ID NO: 1582252 - RNA, 19 nt, Homo sapiens
caacuaugaccuccuugag

SEQ ID NO: 1582253 - RNA, 19 nt, Homo sapiens
agaucgcucugaauuugga

SEQ ID NO: 1582254 - RNA, 19 nt, Homo sapiens
gggaggucgagguguuuaa

SEQ ID NO: 1582255 - RNA, 19 nt, Homo sapiens
gcgagaaccaggagugaac

SEQ ID NO: 1582256 - RNA, 19 nt, Homo sapiens
ggguugaggaggacacaga

SEQ ID NO: 1582257 - RNA, 19 nt, Homo sapiens
ccaaggcuggacacaguga

SEQ ID NO: 1582258 - RNA, 19 nt, Homo sapiens
ggaggaggacgaggaggau

SEQ ID NO: 1582259 - RNA, 19 nt, Homo sapiens
ucauugaggacauucuuca

SEQ ID NO: 1582260 - RNA, 19 nt, Homo sapiens
gagaagagauggcaagaaa

SEQ ID NO: 1582261 - RNA, 19 nt, Homo sapiens
caacaaaggugucauagga

SEQ ID NO: 1582262 - RNA, 19 nt, Homo sapiens
gaucaaagcuuaccgagau

SEQ ID NO: 1582263 - RNA, 19 nt, Homo sapiens
gaagggagcccaagcuuug

SEQ ID NO: 1582264 - RNA, 19 nt, Homo sapiens
gaaauccugucuguacuaa

SEQ ID NO: 1582265 - RNA, 19 nt, Homo sapiens
gaccaaggaggacaaauua

SEQ ID NO: 1582266 - RNA, 19 nt, Homo sapiens
gggcaaugcuggcacgaua

SEQ ID NO: 1582267 - RNA, 19 nt, Homo sapiens
gaagagauggcaagaaaga

SEQ ID NO: 1582268 - RNA, 19 nt, Homo sapiens
gaagugacauuuagcuaca

SEQ ID NO: 1582269 - RNA, 19 nt, Homo sapiens
caaauaaucccagcacuuu

SEQ ID NO: 1582270 - RNA, 19 nt, Homo sapiens
gagagggacuucagagaug

SEQ ID NO: 1582271 - RNA, 19 nt, Homo sapiens
uuacugaccucaaauaauc

SEQ ID NO: 1582272 - RNA, 19 nt, Homo sapiens
ucaaagugcugguauuaca

SEQ ID NO: 1582273 - RNA, 19 nt, Homo sapiens
gaaguuacaguggaaauga

SEQ ID NO: 1582274 - RNA, 19 nt, Homo sapiens
ccaaggaggacaaauuaaa

SEQ ID NO: 1582275 - RNA, 19 nt, Homo sapiens
ggaagggagcccaagcuuu

SEQ ID NO: 1582276 - RNA, 19 nt, Homo sapiens
gcuacgccuucaucgaaua

SEQ ID NO: 1582277 - RNA, 19 nt, Homo sapiens
uaacauauuucagcauugg

SEQ ID NO: 1582278 - RNA, 19 nt, Homo sapiens
gaaggaaagaggcaaguag

SEQ ID NO: 1582279 - RNA, 19 nt, Homo sapiens
ugaccagcaugagauauuu

SEQ ID NO: 1582280 - RNA, 19 nt, Homo sapiens
gcugauggccugguuauug

SEQ ID NO: 1582281 - RNA, 19 nt, Homo sapiens
gggcuacgccuucaucgaa

SEQ ID NO: 1582282 - RNA, 19 nt, Homo sapiens
ccaaagugcugggauuaca

SEQ ID NO: 1582283 - RNA, 19 nt, Homo sapiens
uaagaauccugaagcucaa

SEQ ID NO: 1582284 - RNA, 19 nt, Homo sapiens
cuagugaagugacauuuag

SEQ ID NO: 1582285 - RNA, 19 nt, Homo sapiens
gacaagggaucgagaccau

SEQ ID NO: 1582286 - RNA, 19 nt, Homo sapiens
gugccgugaucaaagcuua

SEQ ID NO: 1582287 - RNA, 19 nt, Homo sapiens
cagcgugagucuaaugguu

SEQ ID NO: 1582288 - RNA, 19 nt, Homo sapiens
gacaccauaugaucuaauc

SEQ ID NO: 1582289 - RNA, 19 nt, Homo sapiens
ugagucuaaugguugaaua

SEQ ID NO: 1582290 - RNA, 19 nt, Homo sapiens
caagggaucgagaccauga

SEQ ID NO: 1582291 - RNA, 19 nt, Homo sapiens
cugauggccugguuauuga

SEQ ID NO: 1582292 - RNA, 19 nt, Homo sapiens
guaacauauuucagcauug

SEQ ID NO: 1582293 - RNA, 19 nt, Homo sapiens
ggugaaauccugucuguac

SEQ ID NO: 1582294 - RNA, 19 nt, Homo sapiens
cgaaucugcugcuaccaau

SEQ ID NO: 1582295 - RNA, 19 nt, Homo sapiens
gggacuuggucacagguuu

SEQ ID NO: 1582296 - RNA, 19 nt, Homo sapiens
ucucaaagugcugguauua

SEQ ID NO: 1582297 - RNA, 19 nt, Homo sapiens
gagaccagcuuggccaaca

SEQ ID NO: 1582298 - RNA, 19 nt, Homo sapiens
ggaggacaaauuaaaggaa

SEQ ID NO: 1582299 - RNA, 19 nt, Homo sapiens
cuacagcguugcagaacau

SEQ ID NO: 1582300 - RNA, 19 nt, Homo sapiens
ggagggagaagaaggaaag

SEQ ID NO: 1582301 - RNA, 19 nt, Homo sapiens
ggguguggcccgacaauga

SEQ ID NO: 1582302 - RNA, 19 nt, Homo sapiens
gcauugauggcaccgauga

SEQ ID NO: 1582303 - RNA, 19 nt, Homo sapiens
ugcagaacaugaacgauug

SEQ ID NO: 1582304 - RNA, 19 nt, Homo sapiens
caauaagaauccugaagcu

SEQ ID NO: 1582305 - RNA, 19 nt, Homo sapiens
gcaaguagaggcccaacag

SEQ ID NO: 1582306 - RNA, 19 nt, Homo sapiens
gagagagggacuucagaga

SEQ ID NO: 1582307 - RNA, 19 nt, Homo sapiens
gcaaugcuggcacgauaug

SEQ ID NO: 1582308 - RNA, 19 nt, Homo sapiens
ccuagugaagugacauuua

SEQ ID NO: 1582309 - RNA, 19 nt, Homo sapiens
agaccaaggaggacaaauu

SEQ ID NO: 1582310 - RNA, 19 nt, Homo sapiens
gacuaaacuugcagaccaa

SEQ ID NO: 1582311 - RNA, 19 nt, Homo sapiens
caaggaggacaaauuaaag

SEQ ID NO: 1582312 - RNA, 19 nt, Homo sapiens
ucaaauaaucccagcacuu

SEQ ID NO: 1582313 - RNA, 19 nt, Homo sapiens
gcgugagucuaaugguuga

SEQ ID NO: 1582314 - RNA, 19 nt, Homo sapiens
ugaaauccugucuguacua

SEQ ID NO: 1582315 - RNA, 19 nt, Homo sapiens
gagucuaaugguugaauaa

SEQ ID NO: 1582316 - RNA, 19 nt, Homo sapiens
ggagaagagauggcaagaa

SEQ ID NO: 1582317 - RNA, 19 nt, Homo sapiens
ucgaaaaccuauuaacuug

SEQ ID NO: 1582318 - RNA, 19 nt, Homo sapiens
cauaugaucuaaucuucac

SEQ ID NO: 1582319 - RNA, 19 nt, Homo sapiens
uccugaagcucaaaauuua

SEQ ID NO: 1582320 - RNA, 19 nt, Homo sapiens
gguggugugugucuguaau

SEQ ID NO: 1582321 - RNA, 19 nt, Homo sapiens
ggagagagagagggacuuc

SEQ ID NO: 1582322 - RNA, 19 nt, Homo sapiens
ucacugcagcgucgacauu

SEQ ID NO: 1582323 - RNA, 19 nt, Homo sapiens
acucaaagcgggcagcauu

SEQ ID NO: 1582324 - RNA, 19 nt, Homo sapiens
gagagagagggacuucaga

SEQ ID NO: 1582325 - RNA, 19 nt, Homo sapiens
ugagauauuuguggacuac

SEQ ID NO: 1582326 - RNA, 19 nt, Homo sapiens
gcucuacagcguugcagaa

SEQ ID NO: 1582327 - RNA, 19 nt, Homo sapiens
cagcagaaccccaaaguga

SEQ ID NO: 1582328 - RNA, 19 nt, Homo sapiens
agagggacuucagagauga

SEQ ID NO: 1582329 - RNA, 19 nt, Homo sapiens
aaaggagucugggcaacug

SEQ ID NO: 1582330 - RNA, 19 nt, Homo sapiens
uggccaacauggugaaauc

SEQ ID NO: 1582331 - RNA, 19 nt, Homo sapiens
agagauggcaagaaagaga

SEQ ID NO: 1582332 - RNA, 19 nt, Homo sapiens
gagcuggaaaggacucuca

SEQ ID NO: 1582333 - RNA, 19 nt, Homo sapiens
gagcgugccgugaucaaag

SEQ ID NO: 1582334 - RNA, 19 nt, Homo sapiens
ggagcgugccgugaucaaa

SEQ ID NO: 1582335 - RNA, 19 nt, Homo sapiens
gugaagugacauuuagcua

SEQ ID NO: 1582336 - RNA, 19 nt, Homo sapiens
guuauugaccagcaugaga

SEQ ID NO: 1582337 - RNA, 19 nt, Homo sapiens
caccauaugaucuaaucuu

SEQ ID NO: 1582338 - RNA, 19 nt, Homo sapiens
ggacaaauuaaaggaaguc

SEQ ID NO: 1582339 - RNA, 19 nt, Homo sapiens
gacauuuagcuacauuuca

SEQ ID NO: 1582340 - RNA, 19 nt, Homo sapiens
uugcagaacaugaacgauu

SEQ ID NO: 1582341 - RNA, 19 nt, Homo sapiens
cgacaaugacugggagaga

SEQ ID NO: 1582342 - RNA, 19 nt, Homo sapiens
ugacauuuagcuacauuuc

SEQ ID NO: 1582343 - RNA, 19 nt, Homo sapiens
cagcguugcagaacaugaa

SEQ ID NO: 1582344 - RNA, 19 nt, Homo sapiens
cuacucggccucccaaagu

SEQ ID NO: 1582345 - RNA, 19 nt, Homo sapiens
aauccugucuguacuaaaa

SEQ ID NO: 1582346 - RNA, 19 nt, Homo sapiens
gugaaauccugucuguacu

SEQ ID NO: 1582347 - RNA, 19 nt, Homo sapiens
gcuggaaaggacucucaaa

SEQ ID NO: 1582348 - RNA, 19 nt, Homo sapiens
gcccaucgccaaggaguau

SEQ ID NO: 1582349 - RNA, 19 nt, Homo sapiens
cccaagcuuugcagagaga

SEQ ID NO: 1582350 - RNA, 19 nt, Homo sapiens
gcagaccaaggaggacaaa

SEQ ID NO: 1582351 - RNA, 19 nt, Homo sapiens
ugacaucaggaguuugaga

SEQ ID NO: 1582352 - RNA, 19 nt, Homo sapiens
agagagggacuucagagau

SEQ ID NO: 1582353 - RNA, 19 nt, Homo sapiens
acauuuagcuacauuucac

SEQ ID NO: 1582354 - RNA, 19 nt, Homo sapiens
guggaucccucggcgacuu

SEQ ID NO: 1582355 - RNA, 19 nt, Homo sapiens
ggacuacgagcuggaaagg

SEQ ID NO: 1582356 - RNA, 19 nt, Homo sapiens
ggucagggacuuggucaca

SEQ ID NO: 1582357 - RNA, 19 nt, Homo sapiens
aagugaaguuacaguggaa

SEQ ID NO: 1582358 - RNA, 19 nt, Homo sapiens
aaggaaagaggcaaguaga

SEQ ID NO: 1582359 - RNA, 19 nt, Homo sapiens
agaaggaaagaggcaagua

SEQ ID NO: 1582360 - RNA, 19 nt, Homo sapiens
gagaagagauggcaagaaa

SEQ ID NO: 1582361 - RNA, 19 nt, Homo sapiens
caacaaaggugucauagga

SEQ ID NO: 1582362 - RNA, 19 nt, Homo sapiens
gaucaaagcuuaccgagau

SEQ ID NO: 1582363 - RNA, 19 nt, Homo sapiens
gaagggagcccaagcuuug

SEQ ID NO: 1582364 - RNA, 19 nt, Homo sapiens
gaccaaggaggacaaauua

SEQ ID NO: 1582365 - RNA, 19 nt, Homo sapiens
gggcaaugcuggcacgaua

SEQ ID NO: 1582366 - RNA, 19 nt, Homo sapiens
gaagagauggcaagaaaga

SEQ ID NO: 1582367 - RNA, 19 nt, Homo sapiens
gagagggacuucagagaug

SEQ ID NO: 1582368 - RNA, 19 nt, Homo sapiens
gcagagaacaugaacgauu

SEQ ID NO: 1582369 - RNA, 19 nt, Homo sapiens
cagagaacaugaacgauug

SEQ ID NO: 1582370 - RNA, 19 nt, Homo sapiens
gaaguuacaguggaaauga

SEQ ID NO: 1582371 - RNA, 19 nt, Homo sapiens
ccaaggaggacaaauuaaa

SEQ ID NO: 1582372 - RNA, 19 nt, Homo sapiens
ggaagggagcccaagcuuu

SEQ ID NO: 1582373 - RNA, 19 nt, Homo sapiens
gcuacgccuucaucgaaua

SEQ ID NO: 1582374 - RNA, 19 nt, Homo sapiens
gaaggaaagaggcaaguag

SEQ ID NO: 1582375 - RNA, 19 nt, Homo sapiens
ugaccagcaugagauauuu

SEQ ID NO: 1582376 - RNA, 19 nt, Homo sapiens
gcugauggccugguuauug

SEQ ID NO: 1582377 - RNA, 19 nt, Homo sapiens
gggcuacgccuucaucgaa

SEQ ID NO: 1582378 - RNA, 19 nt, Homo sapiens
gacaagggaucgagaccau

SEQ ID NO: 1582379 - RNA, 19 nt, Homo sapiens
gugccgugaucaaagcuua

SEQ ID NO: 1582380 - RNA, 19 nt, Homo sapiens
cagcgugagucuaaugguu

SEQ ID NO: 1582381 - RNA, 19 nt, Homo sapiens
ugagucuaaugguugaaua

SEQ ID NO: 1582382 - RNA, 19 nt, Homo sapiens
caagggaucgagaccauga

SEQ ID NO: 1582383 - RNA, 19 nt, Homo sapiens
cugauggccugguuauuga

SEQ ID NO: 1582384 - RNA, 19 nt, Homo sapiens
cgaaucugcugcuaccaau

SEQ ID NO: 1582385 - RNA, 19 nt, Homo sapiens
gggacuuggucacagguuu

SEQ ID NO: 1582386 - RNA, 19 nt, Homo sapiens
ggaggacaaauuaaaggaa

SEQ ID NO: 1582387 - RNA, 19 nt, Homo sapiens
ggagggagaagaaggaaag

SEQ ID NO: 1582388 - RNA, 19 nt, Homo sapiens
ggguguggcccgacaauga

SEQ ID NO: 1582389 - RNA, 19 nt, Homo sapiens
gcauugauggcaccgauga

SEQ ID NO: 1582390 - RNA, 19 nt, Homo sapiens
gcaaguagaggcccaacag

SEQ ID NO: 1582391 - RNA, 19 nt, Homo sapiens
gagagagggacuucagaga

SEQ ID NO: 1582392 - RNA, 19 nt, Homo sapiens
gcccaagcuuugcagagaa

SEQ ID NO: 1582393 - RNA, 19 nt, Homo sapiens
gcaaugcuggcacgauaug

SEQ ID NO: 1582394 - RNA, 19 nt, Homo sapiens
agaccaaggaggacaaauu

SEQ ID NO: 1582395 - RNA, 19 nt, Homo sapiens
gacuaaacuugcagaccaa

SEQ ID NO: 1582396 - RNA, 19 nt, Homo sapiens
caaggaggacaaauuaaag

SEQ ID NO: 1582397 - RNA, 19 nt, Homo sapiens
gcgugagucuaaugguuga

SEQ ID NO: 1582398 - RNA, 19 nt, Homo sapiens
gagucuaaugguugaauaa

SEQ ID NO: 1582399 - RNA, 19 nt, Homo sapiens
ggagaagagauggcaagaa

SEQ ID NO: 1582400 - RNA, 19 nt, Homo sapiens
ucgaaaaccuauuaacuug

SEQ ID NO: 1582401 - RNA, 19 nt, Homo sapiens
ggagagagagagggacuuc

SEQ ID NO: 1582402 - RNA, 19 nt, Homo sapiens
acucaaagcgggcagcauu

SEQ ID NO: 1582403 - RNA, 19 nt, Homo sapiens
gagagagagggacuucaga

SEQ ID NO: 1582404 - RNA, 19 nt, Homo sapiens
ugagauauuuguggacuac

SEQ ID NO: 1582405 - RNA, 19 nt, Homo sapiens
cagcagaaccccaaaguga

SEQ ID NO: 1582406 - RNA, 19 nt, Homo sapiens
agagggacuucagagauga

SEQ ID NO: 1582407 - RNA, 19 nt, Homo sapiens
aaaggagucugggcaacug

SEQ ID NO: 1582408 - RNA, 19 nt, Homo sapiens
agagauggcaagaaagaga

SEQ ID NO: 1582409 - RNA, 19 nt, Homo sapiens
gagcuggaaaggacucuca

SEQ ID NO: 1582410 - RNA, 19 nt, Homo sapiens
gagcgugccgugaucaaag

SEQ ID NO: 1582411 - RNA, 19 nt, Homo sapiens
ggagcgugccgugaucaaa

SEQ ID NO: 1582412 - RNA, 19 nt, Homo sapiens
guuauugaccagcaugaga

SEQ ID NO: 1582413 - RNA, 19 nt, Homo sapiens
ggacaaauuaaaggaaguc

SEQ ID NO: 1582414 - RNA, 19 nt, Homo sapiens
cgacaaugacugggagaga

SEQ ID NO: 1582415 - RNA, 19 nt, Homo sapiens
gcccaucgccaaggaguau

SEQ ID NO: 1582416 - RNA, 19 nt, Homo sapiens
gcuggaaaggacucucaaa

SEQ ID NO: 1582417 - RNA, 19 nt, Homo sapiens
gcagaccaaggaggacaaa

SEQ ID NO: 1582418 - RNA, 19 nt, Homo sapiens
agagagggacuucagagau

SEQ ID NO: 1582419 - RNA, 19 nt, Homo sapiens
guggaucccucggcgacuu

SEQ ID NO: 1582420 - RNA, 19 nt, Homo sapiens
ggacuacgagcuggaaagg

SEQ ID NO: 1582421 - RNA, 19 nt, Homo sapiens
ggucagggacuuggucaca

SEQ ID NO: 1582422 - RNA, 19 nt, Homo sapiens
aagugaaguuacaguggaa

SEQ ID NO: 1582423 - RNA, 19 nt, Homo sapiens
aaggaaagaggcaaguaga

SEQ ID NO: 1582424 - RNA, 19 nt, Homo sapiens
agaaggaaagaggcaagua

SEQ ID NO: 1582425 - RNA, 19 nt, Homo sapiens
cgacuuggaggcggucuug

SEQ ID NO: 1582426 - RNA, 19 nt, Homo sapiens
aaagcgggcagcauugaug

SEQ ID NO: 1582427 - RNA, 19 nt, Homo sapiens
gaccagcaugagauauuug

SEQ ID NO: 1582428 - RNA, 19 nt, Homo sapiens
gaugcugauggccugguua

SEQ ID NO: 1582429 - RNA, 19 nt, Homo sapiens
gaaaggcgggagcgaucuc

SEQ ID NO: 1582430 - RNA, 19 nt, Homo sapiens
agauauuuguggacuacga

SEQ ID NO: 1582431 - RNA, 19 nt, Homo sapiens
ggcuacgccuucaucgaau

SEQ ID NO: 1582432 - RNA, 19 nt, Homo sapiens
caaagcgggcagcauugau

SEQ ID NO: 1582433 - RNA, 19 nt, Homo sapiens
aaucugcugcuaccaaugu

SEQ ID NO: 1582434 - RNA, 19 nt, Homo sapiens
gagaacacauggagucuua

SEQ ID NO: 1582435 - RNA, 19 nt, Homo sapiens
caaaugcacuaauguauuc

SEQ ID NO: 1582436 - RNA, 19 nt, Homo sapiens
gaacuuggagcugcauuua

SEQ ID NO: 1582437 - RNA, 19 nt, Homo sapiens
gcaagaaggugaggcauca

SEQ ID NO: 1582438 - RNA, 19 nt, Homo sapiens
gcaaaugcacuaauguauu

SEQ ID NO: 1582439 - RNA, 19 nt, Homo sapiens
uaugagcacuguagacaaa

SEQ ID NO: 1582440 - RNA, 19 nt, Homo sapiens
gacaagcaauuacccaguu

SEQ ID NO: 1582441 - RNA, 19 nt, Homo sapiens
caaagcccauguucuguga

SEQ ID NO: 1582442 - RNA, 19 nt, Homo sapiens
caacuuacuuaacaucugu

SEQ ID NO: 1582443 - RNA, 19 nt, Homo sapiens
ggugauccaugaacucuga

SEQ ID NO: 1582444 - RNA, 19 nt, Homo sapiens
gcaauuacccaguuuccuu

SEQ ID NO: 1582445 - RNA, 19 nt, Homo sapiens
gaggagaggaggaagauug

SEQ ID NO: 1582446 - RNA, 19 nt, Homo sapiens
gaauugcgcaugugaacuu

SEQ ID NO: 1582447 - RNA, 19 nt, Homo sapiens
cuaagaagcuggacuuuug

SEQ ID NO: 1582448 - RNA, 19 nt, Homo sapiens
caauuacccaguuuccuua

SEQ ID NO: 1582449 - RNA, 19 nt, Homo sapiens
gagauagaauguaaaccau

SEQ ID NO: 1582450 - RNA, 19 nt, Homo sapiens
ggagauagaauguaaacca

SEQ ID NO: 1582451 - RNA, 19 nt, Homo sapiens
gcaacuuacuuaacaucug

SEQ ID NO: 1582452 - RNA, 19 nt, Homo sapiens
gaggagauguuaccaaucc

SEQ ID NO: 1582453 - RNA, 19 nt, Homo sapiens
cagggcaucuggagucuga

SEQ ID NO: 1582454 - RNA, 19 nt, Homo sapiens
gcacuguagacaaauguuu

SEQ ID NO: 1582455 - RNA, 19 nt, Homo sapiens
ucugugagcugucagucua

SEQ ID NO: 1582456 - RNA, 19 nt, Homo sapiens
caucuguguuccucaguuu

SEQ ID NO: 1582457 - RNA, 19 nt, Homo sapiens
guaaaggcuucuguagaga

SEQ ID NO: 1582458 - RNA, 19 nt, Homo sapiens
uagcaaaugcacuaaugua

SEQ ID NO: 1582459 - RNA, 19 nt, Homo sapiens
gcacucugcuggcuacaac

SEQ ID NO: 1582460 - RNA, 19 nt, Homo sapiens
aguaaaggcuucuguagag

SEQ ID NO: 1582461 - RNA, 19 nt, Homo sapiens
gaugagggccaagauagaa

SEQ ID NO: 1582462 - RNA, 19 nt, Homo sapiens
cauggagucuuagcaaaug

SEQ ID NO: 1582463 - RNA, 19 nt, Homo sapiens
acaagcaauuacccaguuu

SEQ ID NO: 1582464 - RNA, 19 nt, Homo sapiens
cuugggcaguucacaguua

SEQ ID NO: 1582465 - RNA, 19 nt, Homo sapiens
gacccuugcuggcugauca

SEQ ID NO: 1582466 - RNA, 19 nt, Homo sapiens
gagcugucagucuagguua

SEQ ID NO: 1582467 - RNA, 19 nt, Homo sapiens
cacauggagucuuagcaaa

SEQ ID NO: 1582468 - RNA, 19 nt, Homo sapiens
ccucaaagcccauguucug

SEQ ID NO: 1582469 - RNA, 19 nt, Homo sapiens
cugaguagcuaccaucauc

SEQ ID NO: 1582470 - RNA, 19 nt, Homo sapiens
gaucaccuugagcaacuua

SEQ ID NO: 1582471 - RNA, 19 nt, Homo sapiens
acuuggagcugcauuuaug

SEQ ID NO: 1582472 - RNA, 19 nt, Homo sapiens
cugcuacgguggacuguga

SEQ ID NO: 1582473 - RNA, 19 nt, Homo sapiens
uugagcaacuuacuuaaca

SEQ ID NO: 1582474 - RNA, 19 nt, Homo sapiens
agucuagguuauucucuuu

SEQ ID NO: 1582475 - RNA, 19 nt, Homo sapiens
ggacugaucagaggugaag

SEQ ID NO: 1582476 - RNA, 19 nt, Homo sapiens
caugaugagggccaagaua

SEQ ID NO: 1582477 - RNA, 19 nt, Homo sapiens
gcauuuaugagcacuguag

SEQ ID NO: 1582478 - RNA, 19 nt, Homo sapiens
gaccuaagaagcuggacuu

SEQ ID NO: 1582479 - RNA, 19 nt, Homo sapiens
ugucuucuguuaagugugu

SEQ ID NO: 1582480 - RNA, 19 nt, Homo sapiens
ccaaucccguucgcucuga

SEQ ID NO: 1582481 - RNA, 19 nt, Homo sapiens
ugacguguaccgcauauag

SEQ ID NO: 1582482 - RNA, 19 nt, Homo sapiens
cauggguaauauagggaua

SEQ ID NO: 1582483 - RNA, 19 nt, Homo sapiens
caguaaaggcuucuguaga

SEQ ID NO: 1582484 - RNA, 19 nt, Homo sapiens
agacaucaccgcacguuuc

SEQ ID NO: 1582485 - RNA, 19 nt, Homo sapiens
gagaggagaggaggaagau

SEQ ID NO: 1582486 - RNA, 19 nt, Homo sapiens
gcccaucugcccacaauuc

SEQ ID NO: 1582487 - RNA, 19 nt, Homo sapiens
ggaagucaagauguccuaa

SEQ ID NO: 1582488 - RNA, 19 nt, Homo sapiens
gagcaacuuacuuaacauc

SEQ ID NO: 1582489 - RNA, 19 nt, Homo sapiens
ugagcacuguagacaaaug

SEQ ID NO: 1582490 - RNA, 19 nt, Homo sapiens
gacaucaccgcacguuuca

SEQ ID NO: 1582491 - RNA, 19 nt, Homo sapiens
acacauggagucuuagcaa

SEQ ID NO: 1582492 - RNA, 19 nt, Homo sapiens
cagagggaccugccaagga

SEQ ID NO: 1582493 - RNA, 19 nt, Homo sapiens
cagucuagguuauucucuu

SEQ ID NO: 1582494 - RNA, 19 nt, Homo sapiens
cuccuagccuggaugacua

SEQ ID NO: 1582495 - RNA, 19 nt, Homo sapiens
gaagucaagauguccuaag

SEQ ID NO: 1582496 - RNA, 19 nt, Homo sapiens
ggugagagcagggcacugu

SEQ ID NO: 1582497 - RNA, 19 nt, Homo sapiens
augaggagauguuaccaau

SEQ ID NO: 1582498 - RNA, 19 nt, Homo sapiens
uuacccaguuuccuuaucu

SEQ ID NO: 1582499 - RNA, 19 nt, Homo sapiens
cucuggagauagaauguaa

SEQ ID NO: 1582500 - RNA, 19 nt, Homo sapiens
ccaguaaaggcuucuguag

SEQ ID NO: 1582501 - RNA, 19 nt, Homo sapiens
agucuuagcaaaugcacua

SEQ ID NO: 1582502 - RNA, 19 nt, Homo sapiens
cucaguuucucauggguaa

SEQ ID NO: 1582503 - RNA, 19 nt, Homo sapiens
caucagcaauguucuucac

SEQ ID NO: 1582504 - RNA, 19 nt, Homo sapiens
gaacacauggagucuuagc

SEQ ID NO: 1582505 - RNA, 19 nt, Homo sapiens
caguuucucauggguaaua

SEQ ID NO: 1582506 - RNA, 19 nt, Homo sapiens
acacugcccauggcugaua

SEQ ID NO: 1582507 - RNA, 19 nt, Homo sapiens
gagcacuguagacaaaugu

SEQ ID NO: 1582508 - RNA, 19 nt, Homo sapiens
gggaagucaagauguccua

SEQ ID NO: 1582509 - RNA, 19 nt, Homo sapiens
gagacaucaccgcacguuu

SEQ ID NO: 1582510 - RNA, 19 nt, Homo sapiens
ugaacuuggagcugcauuu

SEQ ID NO: 1582511 - RNA, 19 nt, Homo sapiens
cccaguuuccuuaucuaua

SEQ ID NO: 1582512 - RNA, 19 nt, Homo sapiens
gccaccuccuucucuguga

SEQ ID NO: 1582513 - RNA, 19 nt, Homo sapiens
caucagggaacgggaauca

SEQ ID NO: 1582514 - RNA, 19 nt, Homo sapiens
gcaucuggagucugaagga

SEQ ID NO: 1582515 - RNA, 19 nt, Homo sapiens
caucaccgcacguuucagu

SEQ ID NO: 1582516 - RNA, 19 nt, Homo sapiens
uggcccaucugcccacaau

SEQ ID NO: 1582517 - RNA, 19 nt, Homo sapiens
gggaauugcgcaugugaac

SEQ ID NO: 1582518 - RNA, 19 nt, Homo sapiens
uacgugaggucuauaucuc

SEQ ID NO: 1582519 - RNA, 19 nt, Homo sapiens
ggagaccacggaggagaug

SEQ ID NO: 1582520 - RNA, 19 nt, Homo sapiens
cccacuggcugaguagcua

SEQ ID NO: 1582521 - RNA, 19 nt, Homo sapiens
ugaugagggccaagauaga

SEQ ID NO: 1582522 - RNA, 19 nt, Homo sapiens
ucugugaggcccaagagaa

SEQ ID NO: 1582523 - RNA, 19 nt, Homo sapiens
gcugucagucuagguuauu

SEQ ID NO: 1582524 - RNA, 19 nt, Homo sapiens
gaugacuacgugaggucua

SEQ ID NO: 1582525 - RNA, 19 nt, Homo sapiens
ugagcaacuuacuuaacau

SEQ ID NO: 1582526 - RNA, 19 nt, Homo sapiens
guaccuggcuguauuaugc

SEQ ID NO: 1582527 - RNA, 19 nt, Homo sapiens
ggaguaucccgcuuucuuu

SEQ ID NO: 1582528 - RNA, 19 nt, Homo sapiens
gagcaaugccuaccuauac

SEQ ID NO: 1582529 - RNA, 19 nt, Homo sapiens
ggugagcaaugccuaccua

SEQ ID NO: 1582530 - RNA, 19 nt, Homo sapiens
gaacagugggcaccugaga

SEQ ID NO: 1582531 - RNA, 19 nt, Homo sapiens
ggaaaccaccgcaucagau

SEQ ID NO: 1582532 - RNA, 19 nt, Homo sapiens
ggaggaaaccaccgcauca

SEQ ID NO: 1582533 - RNA, 19 nt, Homo sapiens
ccugguaccuggcuguauu

SEQ ID NO: 1582534 - RNA, 19 nt, Homo sapiens
ggcaaagcccaccugguua

SEQ ID NO: 1582535 - RNA, 19 nt, Homo sapiens
caagaggauccaaccauga

SEQ ID NO: 1582536 - RNA, 19 nt, Homo sapiens
uggcaaagcccaccugguu

SEQ ID NO: 1582537 - RNA, 19 nt, Homo sapiens
gaaaccaccgcaucagauc

SEQ ID NO: 1582538 - RNA, 19 nt, Homo sapiens
cuagggaccuguugaacuc

SEQ ID NO: 1582539 - RNA, 19 nt, Homo sapiens
ggaggcccgugugugaauu

SEQ ID NO: 1582540 - RNA, 19 nt, Homo sapiens
gcaaagcccaccugguuac

SEQ ID NO: 1582541 - RNA, 19 nt, Homo sapiens
caaagagcagcuuggcaaa

SEQ ID NO: 1582542 - RNA, 19 nt, Homo sapiens
uguacuguauguucagaaa

SEQ ID NO: 1582543 - RNA, 19 nt, Homo sapiens
gcuauaccaugcuacuucu

SEQ ID NO: 1582544 - RNA, 19 nt, Homo sapiens
guaucccgcuuucuuugga

SEQ ID NO: 1582545 - RNA, 19 nt, Homo sapiens
gcuuaugucuuuggcuuuc

SEQ ID NO: 1582546 - RNA, 19 nt, Homo sapiens
acccggugcuuaugucuuu

SEQ ID NO: 1582547 - RNA, 19 nt, Homo sapiens
gaguaucccgcuuucuuug

SEQ ID NO: 1582548 - RNA, 19 nt, Homo sapiens
ugagcaaugccuaccuaua

SEQ ID NO: 1582549 - RNA, 19 nt, Homo sapiens
gcuuucuccuuccugauga

SEQ ID NO: 1582550 - RNA, 19 nt, Homo sapiens
ggacaguugggcauuugga

SEQ ID NO: 1582551 - RNA, 19 nt, Homo sapiens
gauccaaccaugagcucuu

SEQ ID NO: 1582552 - RNA, 19 nt, Homo sapiens
ggagaccgagucacacauc

SEQ ID NO: 1582553 - RNA, 19 nt, Homo sapiens
ggcccacgcuacuaugcuu

SEQ ID NO: 1582554 - RNA, 19 nt, Homo sapiens
cggaguaucccgcuuucuu

SEQ ID NO: 1582555 - RNA, 19 nt, Homo sapiens
gcacucccucucacggaaa

SEQ ID NO: 1582556 - RNA, 19 nt, Homo sapiens
gcccuguccucaccagcuu

SEQ ID NO: 1582557 - RNA, 19 nt, Homo sapiens
ccgaggcacuacugguguu

SEQ ID NO: 1582558 - RNA, 19 nt, Homo sapiens
gagaccgagucacacaucu

SEQ ID NO: 1582559 - RNA, 19 nt, Homo sapiens
aagacugccucuccugcaa

SEQ ID NO: 1582560 - RNA, 19 nt, Homo sapiens
gugaauuccugcuccucau

SEQ ID NO: 1582561 - RNA, 19 nt, Homo sapiens
ucacuggugcagccuggua

SEQ ID NO: 1582562 - RNA, 19 nt, Homo sapiens
gaggaacauaggcaucaug

SEQ ID NO: 1582563 - RNA, 19 nt, Homo sapiens
cagaggaacauaggcauca

SEQ ID NO: 1582564 - RNA, 19 nt, Homo sapiens
ccugggcuuuaccaucuuu

SEQ ID NO: 1582565 - RNA, 19 nt, Homo sapiens
gcccggaguaucccgcuuu

SEQ ID NO: 1582566 - RNA, 19 nt, Homo sapiens
ggauuugccccuccaugua

SEQ ID NO: 1582567 - RNA, 19 nt, Homo sapiens
cucaagcuauaccaugcua

SEQ ID NO: 1582568 - RNA, 19 nt, Homo sapiens
ugaaccaggugagcaaugc

SEQ ID NO: 1582569 - RNA, 19 nt, Homo sapiens
gaccgagucacacaucuac

SEQ ID NO: 1582570 - RNA, 19 nt, Homo sapiens
ugggacaguugggcauuug

SEQ ID NO: 1582571 - RNA, 19 nt, Homo sapiens
ggguagugccagccucuug

SEQ ID NO: 1582572 - RNA, 19 nt, Homo sapiens
gaugaccgaggcacuacug

SEQ ID NO: 1582573 - RNA, 19 nt, Homo sapiens
gcggagaccgagucacaca

SEQ ID NO: 1582574 - RNA, 19 nt, Homo sapiens
ugacagagcugcacagaaa

SEQ ID NO: 1582575 - RNA, 19 nt, Homo sapiens
ggaaaugugugauggagaa

SEQ ID NO: 1582576 - RNA, 19 nt, Homo sapiens
caagaaagcacaaagauga

SEQ ID NO: 1582577 - RNA, 19 nt, Homo sapiens
acaaauagaugaaggagaa

SEQ ID NO: 1582578 - RNA, 19 nt, Homo sapiens
gcaguuagcucucccaaag

SEQ ID NO: 1582579 - RNA, 19 nt, Homo sapiens
ggacuccugugcaaacaua

SEQ ID NO: 1582580 - RNA, 19 nt, Homo sapiens
ugacaagagugauguauug

SEQ ID NO: 1582581 - RNA, 19 nt, Homo sapiens
gggcauggcuggagcagaa

SEQ ID NO: 1582582 - RNA, 19 nt, Homo sapiens
cagaagaaaugcccaaguu

SEQ ID NO: 1582583 - RNA, 19 nt, Homo sapiens
ccaaguuacugccuuauga

SEQ ID NO: 1582584 - RNA, 19 nt, Homo sapiens
ggucacaucuggaagcauu

SEQ ID NO: 1582585 - RNA, 19 nt, Homo sapiens
gaagauagacccagauuac

SEQ ID NO: 1582586 - RNA, 19 nt, Homo sapiens
caacauuuauuacccagaa

SEQ ID NO: 1582587 - RNA, 19 nt, Homo sapiens
acagagaccuuugaucuaa

SEQ ID NO: 1582588 - RNA, 19 nt, Homo sapiens
gaaggagaaucagaagaaa

SEQ ID NO: 1582589 - RNA, 19 nt, Homo sapiens
ggaguguccuguaaacuug

SEQ ID NO: 1582590 - RNA, 19 nt, Homo sapiens
gauggccuauccugauuua

SEQ ID NO: 1582591 - RNA, 19 nt, Homo sapiens
ggaaacaaaugggaacaau

SEQ ID NO: 1582592 - RNA, 19 nt, Homo sapiens
ugaaauggaugauauagca

SEQ ID NO: 1582593 - RNA, 19 nt, Homo sapiens
gaaagucuauugcuguucu

SEQ ID NO: 1582594 - RNA, 19 nt, Homo sapiens
ggaacccgcuucacucaga

SEQ ID NO: 1582595 - RNA, 19 nt, Homo sapiens
ccaagauuccauacuauua

SEQ ID NO: 1582596 - RNA, 19 nt, Homo sapiens
aaacaaaugggaacaauug

SEQ ID NO: 1582597 - RNA, 19 nt, Homo sapiens
caagagugauguauugugu

SEQ ID NO: 1582598 - RNA, 19 nt, Homo sapiens
gaucaagagcuucaagaaa

SEQ ID NO: 1582599 - RNA, 19 nt, Homo sapiens
gaaugaagaaggagaauca

SEQ ID NO: 1582600 - RNA, 19 nt, Homo sapiens
ucaaggaaguguuugcuau

SEQ ID NO: 1582601 - RNA, 19 nt, Homo sapiens
caaaggaggccaugcaaga

SEQ ID NO: 1582602 - RNA, 19 nt, Homo sapiens
uacagaagcuuccagaaug

SEQ ID NO: 1582603 - RNA, 19 nt, Homo sapiens
aagaauacguuacaggaaa

SEQ ID NO: 1582604 - RNA, 19 nt, Homo sapiens
gagcggagcaaucagcaua

SEQ ID NO: 1582605 - RNA, 19 nt, Homo sapiens
ccaagucacuaaugaagga

SEQ ID NO: 1582606 - RNA, 19 nt, Homo sapiens
ccaagucacuaaugaagga

SEQ ID NO: 1582607 - RNA, 19 nt, Homo sapiens
acaauugacuggauuagug

SEQ ID NO: 1582608 - RNA, 19 nt, Homo sapiens
gaaagcaacgggaugauag

SEQ ID NO: 1582609 - RNA, 19 nt, Homo sapiens
acacucaccucuccaaaug

SEQ ID NO: 1582610 - RNA, 19 nt, Homo sapiens
ugagaagaauuucaaggaa

SEQ ID NO: 1582611 - RNA, 19 nt, Homo sapiens
gagcccaugugguuggaua

SEQ ID NO: 1582612 - RNA, 19 nt, Homo sapiens
gaaacaaaugggaacaauu

SEQ ID NO: 1582613 - RNA, 19 nt, Homo sapiens
agaaaugugugauggagaa

SEQ ID NO: 1582614 - RNA, 19 nt, Homo sapiens
ugaaggagcccaugugguu

SEQ ID NO: 1582615 - RNA, 19 nt, Homo sapiens
gaggaacaguugaaaugug

SEQ ID NO: 1582616 - RNA, 19 nt, Homo sapiens
gaaucuuggugaaguguau

SEQ ID NO: 1582617 - RNA, 19 nt, Homo sapiens
gaauuucaaggaaguguuu

SEQ ID NO: 1582618 - RNA, 19 nt, Homo sapiens
gagaaguguuccuguguca

SEQ ID NO: 1582619 - RNA, 19 nt, Homo sapiens
gaagaaaugcccaaguuac

SEQ ID NO: 1582620 - RNA, 19 nt, Homo sapiens
ggaacaauugacuggauua

SEQ ID NO: 1582621 - RNA, 19 nt, Homo sapiens
gggaacaauugacuggauu

SEQ ID NO: 1582622 - RNA, 19 nt, Homo sapiens
gaaaaucacccaaugaaug

SEQ ID NO: 1582623 - RNA, 19 nt, Homo sapiens
gcaauaacaaggccauuuc

SEQ ID NO: 1582624 - RNA, 19 nt, Homo sapiens
gaggggagcuguucuguug

SEQ ID NO: 1582625 - RNA, 19 nt, Homo sapiens
agacagcaaucucaacuuc

SEQ ID NO: 1582626 - RNA, 19 nt, Homo sapiens
ugaaguguauacagacuga

SEQ ID NO: 1582627 - RNA, 19 nt, Homo sapiens
cagguggucuccagugaaa

SEQ ID NO: 1582628 - RNA, 19 nt, Homo sapiens
ugaaggagaaucagaagaa

SEQ ID NO: 1582629 - RNA, 19 nt, Homo sapiens
gaaaagaguccgaucaaga

SEQ ID NO: 1582630 - RNA, 19 nt, Homo sapiens
gagaagagggcagugauga

SEQ ID NO: 1582631 - RNA, 19 nt, Homo sapiens
gagaagagggcagugauga

SEQ ID NO: 1582632 - RNA, 19 nt, Homo sapiens
gaacguagagggucagaac

SEQ ID NO: 1582633 - RNA, 19 nt, Homo sapiens
gaacgugaaucugaaagac

SEQ ID NO: 1582634 - RNA, 19 nt, Homo sapiens
gaaguguuccugugucaug

SEQ ID NO: 1582635 - RNA, 19 nt, Homo sapiens
gcauuguucagcaggauua

SEQ ID NO: 1582636 - RNA, 19 nt, Homo sapiens
ucaguugacccuuguauga

SEQ ID NO: 1582637 - RNA, 19 nt, Homo sapiens
uacgauggcugauggagaa

SEQ ID NO: 1582638 - RNA, 19 nt, Homo sapiens
gugggucaguuucuuguuu

SEQ ID NO: 1582639 - RNA, 19 nt, Homo sapiens
gcaggaacagucccagaaa

SEQ ID NO: 1582640 - RNA, 19 nt, Homo sapiens
gaacuggagaagacauuug

SEQ ID NO: 1582641 - RNA, 19 nt, Homo sapiens
gcagcgacaccaucccaua

SEQ ID NO: 1582642 - RNA, 19 nt, Homo sapiens
ccaaagacaaauccucaaa

SEQ ID NO: 1582643 - RNA, 19 nt, Homo sapiens
ccacagggccucuuacaag

SEQ ID NO: 1582644 - RNA, 19 nt, Homo sapiens
ggagcaaucagcauaugaa

SEQ ID NO: 1582645 - RNA, 19 nt, Homo sapiens
ccugcuauaugauaaugua

SEQ ID NO: 1582646 - RNA, 19 nt, Homo sapiens
agugaugacuguucagaaa

SEQ ID NO: 1582647 - RNA, 19 nt, Homo sapiens
gaaaaccagccaagcuuua

SEQ ID NO: 1582648 - RNA, 19 nt, Homo sapiens
guuccugugucauguguuu

SEQ ID NO: 1582649 - RNA, 19 nt, Homo sapiens
cgagaccgcuccuucaucu

SEQ ID NO: 1582650 - RNA, 19 nt, Homo sapiens
aggaacaguugaaauguga

SEQ ID NO: 1582651 - RNA, 19 nt, Homo sapiens
ugaagaaggagaaucagaa

SEQ ID NO: 1582652 - RNA, 19 nt, Homo sapiens
gaagagacaaagagaccuu

SEQ ID NO: 1582653 - RNA, 19 nt, Homo sapiens
agaagaaaugcccaaguua

SEQ ID NO: 1582654 - RNA, 19 nt, Homo sapiens
gaacacucaccucuccaaa

SEQ ID NO: 1582655 - RNA, 19 nt, Homo sapiens
cuccagacaacauuuauua

SEQ ID NO: 1582656 - RNA, 19 nt, Homo sapiens
gcaaauggcacccuaaaau

SEQ ID NO: 1582657 - RNA, 19 nt, Homo sapiens
aagaugaaacuguggauuu

SEQ ID NO: 1582658 - RNA, 19 nt, Homo sapiens
caauggauacuguggauau

SEQ ID NO: 1582659 - RNA, 19 nt, Homo sapiens
uggaggagaugcugaagau

SEQ ID NO: 1582660 - RNA, 19 nt, Homo sapiens
gggaggggcuuuucucuga

SEQ ID NO: 1582661 - RNA, 19 nt, Homo sapiens
aggcugaguuugagaagaa

SEQ ID NO: 1582662 - RNA, 19 nt, Homo sapiens
uugccaagauuccauacua

SEQ ID NO: 1582663 - RNA, 19 nt, Homo sapiens
gcaagaugugggucaguuu

SEQ ID NO: 1582664 - RNA, 19 nt, Homo sapiens
gaaaccaagacaaggagaa

SEQ ID NO: 1582665 - RNA, 19 nt, Homo sapiens
caaugccugucaugaaaug

SEQ ID NO: 1582666 - RNA, 19 nt, Homo sapiens
ccagauuacuaccauaugg

SEQ ID NO: 1582667 - RNA, 19 nt, Homo sapiens
caaauggcacccuaaaaua

SEQ ID NO: 1582668 - RNA, 19 nt, Homo sapiens
caaggaaguguuugcuauu

SEQ ID NO: 1582669 - RNA, 19 nt, Homo sapiens
gcaaucagcauaugaaaau

SEQ ID NO: 1582670 - RNA, 19 nt, Homo sapiens
gaagaaggagaaucagaag

SEQ ID NO: 1582671 - RNA, 19 nt, Homo sapiens
cuacagagaccuuugaucu

SEQ ID NO: 1582672 - RNA, 19 nt, Homo sapiens
gggaguguccuguaaacuu

SEQ ID NO: 1582673 - RNA, 19 nt, Homo sapiens
gccauuuccuuuccuuaug

SEQ ID NO: 1582674 - RNA, 19 nt, Homo sapiens
ucacaaugcugaaaucuua

SEQ ID NO: 1582675 - RNA, 19 nt, Homo sapiens
gaaagagacugaaacagaa

SEQ ID NO: 1582676 - RNA, 19 nt, Homo sapiens
gcaguaagguuucaaggua

SEQ ID NO: 1582677 - RNA, 19 nt, Homo sapiens
gaacaacuguguaucuuug

SEQ ID NO: 1582678 - RNA, 19 nt, Homo sapiens
ggacuguuaucuccauuua

SEQ ID NO: 1582679 - RNA, 19 nt, Homo sapiens
guaaagagccuaacugcua

SEQ ID NO: 1582680 - RNA, 19 nt, Homo sapiens
gcaaaggaauaguaaguga

SEQ ID NO: 1582681 - RNA, 19 nt, Homo sapiens
gaacuuagggaaacaaauu

SEQ ID NO: 1582682 - RNA, 19 nt, Homo sapiens
cagacaggcuuccacauua

SEQ ID NO: 1582683 - RNA, 19 nt, Homo sapiens
cagcaaacaugaaugauga

SEQ ID NO: 1582684 - RNA, 19 nt, Homo sapiens
ggaacuguauaaagacaua

SEQ ID NO: 1582685 - RNA, 19 nt, Homo sapiens
gcucaugccuguaauccua

SEQ ID NO: 1582686 - RNA, 19 nt, Homo sapiens
caaggaacauuuagagcua

SEQ ID NO: 1582687 - RNA, 19 nt, Homo sapiens
gcauauuacuguacugauu

SEQ ID NO: 1582688 - RNA, 19 nt, Homo sapiens
ggaacaaucucuuuucuaa

SEQ ID NO: 1582689 - RNA, 19 nt, Homo sapiens
caucuaaucuucaacauca

SEQ ID NO: 1582690 - RNA, 19 nt, Homo sapiens
gaucagagacuuugcuauu

SEQ ID NO: 1582691 - RNA, 19 nt, Homo sapiens
gcaagaugcucaaguccaa

SEQ ID NO: 1582692 - RNA, 19 nt, Homo sapiens
ucucagaacugcuaaauuc

SEQ ID NO: 1582693 - RNA, 19 nt, Homo sapiens
gguaauaagugugaucauu

SEQ ID NO: 1582694 - RNA, 19 nt, Homo sapiens
ccaccaggauguacugaua

SEQ ID NO: 1582695 - RNA, 19 nt, Homo sapiens
ggacggagaauuauuguug

SEQ ID NO: 1582696 - RNA, 19 nt, Homo sapiens
uaaagagccuaacugcuaa

SEQ ID NO: 1582697 - RNA, 19 nt, Homo sapiens
caaauuccaugguugaaga

SEQ ID NO: 1582698 - RNA, 19 nt, Homo sapiens
gcacucagcucugucacaa

SEQ ID NO: 1582699 - RNA, 19 nt, Homo sapiens
gauaguauuuccaaacugu

SEQ ID NO: 1582700 - RNA, 19 nt, Homo sapiens
uaaaucagcagguauacua

SEQ ID NO: 1582701 - RNA, 19 nt, Homo sapiens
gggauaggguugccuuaaa

SEQ ID NO: 1582702 - RNA, 19 nt, Homo sapiens
ggagguugguguucauauu

SEQ ID NO: 1582703 - RNA, 19 nt, Homo sapiens
gaaggacggagaauuauug

SEQ ID NO: 1582704 - RNA, 19 nt, Homo sapiens
gugaagugcuagaacauuu

SEQ ID NO: 1582705 - RNA, 19 nt, Homo sapiens
gagaaaagccugccaagua

SEQ ID NO: 1582706 - RNA, 19 nt, Homo sapiens
gcccagaaauuccagauau

SEQ ID NO: 1582707 - RNA, 19 nt, Homo sapiens
ugaagaagauguggagaaa

SEQ ID NO: 1582708 - RNA, 19 nt, Homo sapiens
gcuaaugacaggaaugaua

SEQ ID NO: 1582709 - RNA, 19 nt, Homo sapiens
ccaaguaaaucagcaggua

SEQ ID NO: 1582710 - RNA, 19 nt, Homo sapiens
gaacaggaccaaggaacua

SEQ ID NO: 1582711 - RNA, 19 nt, Homo sapiens
acacaaaccuagaugguau

SEQ ID NO: 1582712 - RNA, 19 nt, Homo sapiens
gcagccaggucaaggaauu

SEQ ID NO: 1582713 - RNA, 19 nt, Homo sapiens
ggagaauuauuguugcuau

SEQ ID NO: 1582714 - RNA, 19 nt, Homo sapiens
cuacuucccuugcuaauca

SEQ ID NO: 1582715 - RNA, 19 nt, Homo sapiens
ccacagauaccaggaauaa

SEQ ID NO: 1582716 - RNA, 19 nt, Homo sapiens
aaaccaaacccacagcuua

SEQ ID NO: 1582717 - RNA, 19 nt, Homo sapiens
acacaagcuugcagauaua

SEQ ID NO: 1582718 - RNA, 19 nt, Homo sapiens
ugacaugguuccagaguug

SEQ ID NO: 1582719 - RNA, 19 nt, Homo sapiens
uuagaaggacggagaauua

SEQ ID NO: 1582720 - RNA, 19 nt, Homo sapiens
gauaagagaaucccucgaa

SEQ ID NO: 1582721 - RNA, 19 nt, Homo sapiens
aagaagauguggagaaaga

SEQ ID NO: 1582722 - RNA, 19 nt, Homo sapiens
cagguuacguggaauauau

SEQ ID NO: 1582723 - RNA, 19 nt, Homo sapiens
ggccugauuuguuaaguuu

SEQ ID NO: 1582724 - RNA, 19 nt, Homo sapiens
guaaggagccauauacaau

SEQ ID NO: 1582725 - RNA, 19 nt, Homo sapiens
acccacagcuuauuuauga

SEQ ID NO: 1582726 - RNA, 19 nt, Homo sapiens
guacuucuguucuggaaug

SEQ ID NO: 1582727 - RNA, 19 nt, Homo sapiens
gaugugagccauuuuauua

SEQ ID NO: 1582728 - RNA, 19 nt, Homo sapiens
gaaagaagaagagacagaa

SEQ ID NO: 1582729 - RNA, 19 nt, Homo sapiens
ugaagaagggaaugaaaua

SEQ ID NO: 1582730 - RNA, 19 nt, Homo sapiens
cagugucucuccagaauaa

SEQ ID NO: 1582731 - RNA, 19 nt, Homo sapiens
guucuggaauggauaauga

SEQ ID NO: 1582732 - RNA, 19 nt, Homo sapiens
uacagggacuuaaacauuu

SEQ ID NO: 1582733 - RNA, 19 nt, Homo sapiens
gcuauggucuguauugcaa

SEQ ID NO: 1582734 - RNA, 19 nt, Homo sapiens
gagauacccucacuuaaaa

SEQ ID NO: 1582735 - RNA, 19 nt, Homo sapiens
gagaagaccugaggcaucu

SEQ ID NO: 1582736 - RNA, 19 nt, Homo sapiens
gagcaucuucccuuaagua

SEQ ID NO: 1582737 - RNA, 19 nt, Homo sapiens
aaacaaagagaaagccaua

SEQ ID NO: 1582738 - RNA, 19 nt, Homo sapiens
gaugaugucacuaguacua

SEQ ID NO: 1582739 - RNA, 19 nt, Homo sapiens
cuaaagcacuuacguugug

SEQ ID NO: 1582740 - RNA, 19 nt, Homo sapiens
gaacaugcucugcuucgaa

SEQ ID NO: 1582741 - RNA, 19 nt, Homo sapiens
ccacaucccuacccacguu

SEQ ID NO: 1582742 - RNA, 19 nt, Homo sapiens
ggaucaucaucguauauuu

SEQ ID NO: 1582743 - RNA, 19 nt, Homo sapiens
guaagugguuagugaaugu

SEQ ID NO: 1582744 - RNA, 19 nt, Homo sapiens
guaacacagugcuaaguau

SEQ ID NO: 1582745 - RNA, 19 nt, Homo sapiens
guaauaagugugaucauug

SEQ ID NO: 1582746 - RNA, 19 nt, Homo sapiens
gaugcaagcuguguacuuc

SEQ ID NO: 1582747 - RNA, 19 nt, Homo sapiens
ggaaaugaaucacaaugcu

SEQ ID NO: 1582748 - RNA, 19 nt, Homo sapiens
gaucaagaaucagccagaa

SEQ ID NO: 1582749 - RNA, 19 nt, Homo sapiens
ggaauuggagaccauauug

SEQ ID NO: 1582750 - RNA, 19 nt, Homo sapiens
agaagggaaugaaauagaa

SEQ ID NO: 1582751 - RNA, 19 nt, Homo sapiens
uagaucgucuugcuuguuu

SEQ ID NO: 1582752 - RNA, 19 nt, Homo sapiens
ucacuggaacuaagaauuu

SEQ ID NO: 1582753 - RNA, 19 nt, Homo sapiens
acacagagccauaccauau

SEQ ID NO: 1582754 - RNA, 19 nt, Homo sapiens
ggaaaugccagacgcuuau

SEQ ID NO: 1582755 - RNA, 19 nt, Homo sapiens
ccuaaguucuauuccauaa

SEQ ID NO: 1582756 - RNA, 19 nt, Homo sapiens
agucauaugucacuuaaug

SEQ ID NO: 1582757 - RNA, 19 nt, Homo sapiens
uaaggagccauauacaaua

SEQ ID NO: 1582758 - RNA, 19 nt, Homo sapiens
cuucaaacauggaccuuaa

SEQ ID NO: 1582759 - RNA, 19 nt, Homo sapiens
agaaagagacugaaacaga

SEQ ID NO: 1582760 - RNA, 19 nt, Homo sapiens
gcugcaaguuaucuucaua

SEQ ID NO: 1582761 - RNA, 19 nt, Homo sapiens
cagcuccauuguaaucuua

SEQ ID NO: 1582762 - RNA, 19 nt, Homo sapiens
gaagaggaacaacugugua

SEQ ID NO: 1582763 - RNA, 19 nt, Homo sapiens
ggagaaagaagaagagaca

SEQ ID NO: 1582764 - RNA, 19 nt, Homo sapiens
uccgagaugugacuaauaa

SEQ ID NO: 1582765 - RNA, 19 nt, Homo sapiens
agagaaagccauagaagaa

SEQ ID NO: 1582766 - RNA, 19 nt, Homo sapiens
uagagaaaccuauguagaa

SEQ ID NO: 1582767 - RNA, 19 nt, Homo sapiens
ucauugacccuguaagaua

SEQ ID NO: 1582768 - RNA, 19 nt, Homo sapiens
guuaguguguugaagauga

SEQ ID NO: 1582769 - RNA, 19 nt, Homo sapiens
gauaagucccaauugagua

SEQ ID NO: 1582770 - RNA, 19 nt, Homo sapiens
gaaguagggcagugcauga

SEQ ID NO: 1582771 - RNA, 19 nt, Homo sapiens
gaucaucaucguauauuug

SEQ ID NO: 1582772 - RNA, 19 nt, Homo sapiens
uaagugugaucauuguuga

SEQ ID NO: 1582773 - RNA, 19 nt, Homo sapiens
ggguugaacagaauuauuu

SEQ ID NO: 1582774 - RNA, 19 nt, Homo sapiens
gaaagggccugaagucuug

SEQ ID NO: 1582775 - RNA, 19 nt, Homo sapiens
gaaagggccugaagucuug

SEQ ID NO: 1582776 - RNA, 19 nt, Homo sapiens
ggaggaugcuguacacauu

SEQ ID NO: 1582777 - RNA, 19 nt, Homo sapiens
ugacauggaugaaauugaa

SEQ ID NO: 1582778 - RNA, 19 nt, Homo sapiens
ugacauggaugaaauugaa

SEQ ID NO: 1582779 - RNA, 19 nt, Homo sapiens
cagcacauuucacucauua

SEQ ID NO: 1582780 - RNA, 19 nt, Homo sapiens
gcagugcuguuuacucauu

SEQ ID NO: 1582781 - RNA, 19 nt, Homo sapiens
gcagugcuguuuacucauu

SEQ ID NO: 1582782 - RNA, 19 nt, Homo sapiens
cugcauggcuguugacaua

SEQ ID NO: 1582783 - RNA, 19 nt, Homo sapiens
ccacaaaucacacaacaaa

SEQ ID NO: 1582784 - RNA, 19 nt, Homo sapiens
ugacaacgaugacgaugaa

SEQ ID NO: 1582785 - RNA, 19 nt, Homo sapiens
gccaucacuuguucaaaua

SEQ ID NO: 1582786 - RNA, 19 nt, Homo sapiens
ggagucauauucccacaau

SEQ ID NO: 1582787 - RNA, 19 nt, Homo sapiens
ggauagauguuauucaacu

SEQ ID NO: 1582788 - RNA, 19 nt, Homo sapiens
ggauagauguuauucaacu

SEQ ID NO: 1582789 - RNA, 19 nt, Homo sapiens
ggauagauguuauucaacu

SEQ ID NO: 1582790 - RNA, 19 nt, Homo sapiens
ggauagauguuauucaacu

SEQ ID NO: 1582791 - RNA, 19 nt, Homo sapiens
ugaaagugaugaugaggaa

SEQ ID NO: 1582792 - RNA, 19 nt, Homo sapiens
gaggagcucaggcaauaua

SEQ ID NO: 1582793 - RNA, 19 nt, Homo sapiens
ggaaugagcgacaguucaa

SEQ ID NO: 1582794 - RNA, 19 nt, Homo sapiens
gcagaaggcugaagaaaag

SEQ ID NO: 1582795 - RNA, 19 nt, Homo sapiens
gaucaaagaaggaaagaag

SEQ ID NO: 1582796 - RNA, 19 nt, Homo sapiens
gaucaaagaaggaaagaag

SEQ ID NO: 1582797 - RNA, 19 nt, Homo sapiens
gcacauuucacucauuaga

SEQ ID NO: 1582798 - RNA, 19 nt, Homo sapiens
gcacagcaccuuguccaaa

SEQ ID NO: 1582799 - RNA, 19 nt, Homo sapiens
uaaccugaguuucauagga

SEQ ID NO: 1582800 - RNA, 19 nt, Homo sapiens
gcaugucucugagcuucua

SEQ ID NO: 1582801 - RNA, 19 nt, Homo sapiens
gcagcacauuucacucauu

SEQ ID NO: 1582802 - RNA, 19 nt, Homo sapiens
gaggaugcuguacacauua

SEQ ID NO: 1582803 - RNA, 19 nt, Homo sapiens
uggcuuggcuguuaacaug

SEQ ID NO: 1582804 - RNA, 19 nt, Homo sapiens
caaauagccauggcccuua

SEQ ID NO: 1582805 - RNA, 19 nt, Homo sapiens
ggaggaaugugccaucacu

SEQ ID NO: 1582806 - RNA, 19 nt, Homo sapiens
aacgagagcugacccaguu

SEQ ID NO: 1582807 - RNA, 19 nt, Homo sapiens
uugcaggacucacuggaua

SEQ ID NO: 1582808 - RNA, 19 nt, Homo sapiens
uugcaggacucacuggaua

SEQ ID NO: 1582809 - RNA, 19 nt, Homo sapiens
uugcaggacucacuggaua

SEQ ID NO: 1582810 - RNA, 19 nt, Homo sapiens
ggcaggaccuccaagaaca

SEQ ID NO: 1582811 - RNA, 19 nt, Homo sapiens
ggacccacguuagguguga

SEQ ID NO: 1582812 - RNA, 19 nt, Homo sapiens
cgaugacgaugaagauguu

SEQ ID NO: 1582813 - RNA, 19 nt, Homo sapiens
gaagaagaucaaagaagga

SEQ ID NO: 1582814 - RNA, 19 nt, Homo sapiens
cuggauagauguuauucaa

SEQ ID NO: 1582815 - RNA, 19 nt, Homo sapiens
uggcuuggcuguugacaug

SEQ ID NO: 1582816 - RNA, 19 nt, Homo sapiens
uggcuuggcuguugacaug

SEQ ID NO: 1582817 - RNA, 19 nt, Homo sapiens
cuggauagauguuauucaa

SEQ ID NO: 1582818 - RNA, 19 nt, Homo sapiens
gaagaagaucaaagaagga

SEQ ID NO: 1582819 - RNA, 19 nt, Homo sapiens
cuggauagauguuauucaa

SEQ ID NO: 1582820 - RNA, 19 nt, Homo sapiens
cuggauagauguuauucaa

SEQ ID NO: 1582821 - RNA, 19 nt, Homo sapiens
gaagaucaaagaaggaaag

SEQ ID NO: 1582822 - RNA, 19 nt, Homo sapiens
aaucuaugcugaggaauga

SEQ ID NO: 1582823 - RNA, 19 nt, Homo sapiens
gaagaucaaagaaggaaag

SEQ ID NO: 1582824 - RNA, 19 nt, Homo sapiens
ucaaagaaggaaagaagaa

SEQ ID NO: 1582825 - RNA, 19 nt, Homo sapiens
ucaaagaaggaaagaagaa

SEQ ID NO: 1582826 - RNA, 19 nt, Homo sapiens
ggaaucugcaggagucuga

SEQ ID NO: 1582827 - RNA, 19 nt, Homo sapiens
aaagucgacucaacucuca

SEQ ID NO: 1582828 - RNA, 19 nt, Homo sapiens
gaaugugccaucacuuguu

SEQ ID NO: 1582829 - RNA, 19 nt, Homo sapiens
acagcuagauggacaaaca

SEQ ID NO: 1582830 - RNA, 19 nt, Homo sapiens
ggaccaagaagaggaagaa

SEQ ID NO: 1582831 - RNA, 19 nt, Homo sapiens
uaaaaucuaugcugaggaa

SEQ ID NO: 1582832 - RNA, 19 nt, Homo sapiens
ggaccaagaagaggaagaa

SEQ ID NO: 1582833 - RNA, 19 nt, Homo sapiens
gaaguguguuuuacucauu

SEQ ID NO: 1582834 - RNA, 19 nt, Homo sapiens
gaaaagaaggggaagaaga

SEQ ID NO: 1582835 - RNA, 19 nt, Homo sapiens
gaaaagaaggggaagaaga

SEQ ID NO: 1582836 - RNA, 19 nt, Homo sapiens
gaaaagaaggggaagaaga

SEQ ID NO: 1582837 - RNA, 19 nt, Homo sapiens
gaaaagaaggggaagaaga

SEQ ID NO: 1582838 - RNA, 19 nt, Homo sapiens
aauauaaaguccugguuca

SEQ ID NO: 1582839 - RNA, 19 nt, Homo sapiens
ugagguggcugagaaagug

SEQ ID NO: 1582840 - RNA, 19 nt, Homo sapiens
ccagaugggagucauauuc

SEQ ID NO: 1582841 - RNA, 19 nt, Homo sapiens
aguagagccugaagucuug

SEQ ID NO: 1582842 - RNA, 19 nt, Homo sapiens
aguagagccugaagucuug

SEQ ID NO: 1582843 - RNA, 19 nt, Homo sapiens
uaugagcaaugccauguuc

SEQ ID NO: 1582844 - RNA, 19 nt, Homo sapiens
caaagguguuacccugguu

SEQ ID NO: 1582845 - RNA, 19 nt, Homo sapiens
ggaagacaaagucgacuca

SEQ ID NO: 1582846 - RNA, 19 nt, Homo sapiens
ugccaucacuuguucaaau

SEQ ID NO: 1582847 - RNA, 19 nt, Homo sapiens
gagcaaugccauguucuug

SEQ ID NO: 1582848 - RNA, 19 nt, Homo sapiens
gaaguuccuuuuaugcauu

SEQ ID NO: 1582849 - RNA, 19 nt, Homo sapiens
gaaguuccuuuuaugcauu

SEQ ID NO: 1582850 - RNA, 19 nt, Homo sapiens
gaagguuauucgacucucu

SEQ ID NO: 1582851 - RNA, 19 nt, Homo sapiens
caacgaugacgaugaagau

SEQ ID NO: 1582852 - RNA, 19 nt, Homo sapiens
gagcucaggcaauauaaag

SEQ ID NO: 1582853 - RNA, 19 nt, Homo sapiens
aaauagccauggcccuuau

SEQ ID NO: 1582854 - RNA, 19 nt, Homo sapiens
ggaaugugccaucacuugu

SEQ ID NO: 1582855 - RNA, 19 nt, Homo sapiens
caccacaaaucacacaaca

SEQ ID NO: 1582856 - RNA, 19 nt, Homo sapiens
uaccuuggcuuggcucuug

SEQ ID NO: 1582857 - RNA, 19 nt, Homo sapiens
uugcaggagucacuggaua

SEQ ID NO: 1582858 - RNA, 19 nt, Homo sapiens
uaccuuggcuuggcucuug

SEQ ID NO: 1582859 - RNA, 19 nt, Homo sapiens
ucggugggaucaagugaaa

SEQ ID NO: 1582860 - RNA, 19 nt, Homo sapiens
cugagaaagugcagaaauc

SEQ ID NO: 1582861 - RNA, 19 nt, Homo sapiens
ucucugagcuucuauaccu

SEQ ID NO: 1582862 - RNA, 19 nt, Homo sapiens
cauguuggcuuuucucuug

SEQ ID NO: 1582863 - RNA, 19 nt, Homo sapiens
agaaagggccugaagucuu

SEQ ID NO: 1582864 - RNA, 19 nt, Homo sapiens
cauguuggcuuuucucuug

SEQ ID NO: 1582865 - RNA, 19 nt, Homo sapiens
agaaagggccugaagucuu

SEQ ID NO: 1582866 - RNA, 19 nt, Homo sapiens
caaccagccacauaggaaa

SEQ ID NO: 1582867 - RNA, 19 nt, Homo sapiens
accaagaaguggaagaaga

SEQ ID NO: 1582868 - RNA, 19 nt, Homo sapiens
guaccaagaaguggaagaa

SEQ ID NO: 1582869 - RNA, 19 nt, Homo sapiens
accaagaaguggaagaaga

SEQ ID NO: 1582870 - RNA, 19 nt, Homo sapiens
guaccaagaaguggaagaa

SEQ ID NO: 1582871 - RNA, 19 nt, Homo sapiens
gcaauauaaaguccugguu

SEQ ID NO: 1582872 - RNA, 19 nt, Homo sapiens
accaagaaguggaagaaga

SEQ ID NO: 1582873 - RNA, 19 nt, Homo sapiens
guaccaagaaguggaagaa

SEQ ID NO: 1582874 - RNA, 19 nt, Homo sapiens
ggaaucaucuguagcgaaa

SEQ ID NO: 1582875 - RNA, 19 nt, Homo sapiens
gagaguguguguauguaua

SEQ ID NO: 1582876 - RNA, 19 nt, Homo sapiens
ccaaggguguugaugaaua

SEQ ID NO: 1582877 - RNA, 19 nt, Homo sapiens
gcaauuacauuacacuaca

SEQ ID NO: 1582878 - RNA, 19 nt, Homo sapiens
ugucuuaccuguuaacuuu

SEQ ID NO: 1582879 - RNA, 19 nt, Homo sapiens
guggaaguaugaacauuua

SEQ ID NO: 1582880 - RNA, 19 nt, Homo sapiens
cuaaagagguagaaauguu

SEQ ID NO: 1582881 - RNA, 19 nt, Homo sapiens
gcgcaggauuucuauaauu

SEQ ID NO: 1582882 - RNA, 19 nt, Homo sapiens
uaacaaacaugaggaacuu

SEQ ID NO: 1582883 - RNA, 19 nt, Homo sapiens
ugaauaauauggcuuagug

SEQ ID NO: 1582884 - RNA, 19 nt, Homo sapiens
gcaccaaggcgcaggauuu

SEQ ID NO: 1582885 - RNA, 19 nt, Homo sapiens
gaacacugcccaucagcua

SEQ ID NO: 1582886 - RNA, 19 nt, Homo sapiens
ccagauacuugcacucaaa

SEQ ID NO: 1582887 - RNA, 19 nt, Homo sapiens
uaacauacuuggaaaggau

SEQ ID NO: 1582888 - RNA, 19 nt, Homo sapiens
gaagaggaaguacagaauu

SEQ ID NO: 1582889 - RNA, 19 nt, Homo sapiens
gaagguguguggaaguaug

SEQ ID NO: 1582890 - RNA, 19 nt, Homo sapiens
caucaaucauguauccaua

SEQ ID NO: 1582891 - RNA, 19 nt, Homo sapiens
gaaauggacaguacacuag

SEQ ID NO: 1582892 - RNA, 19 nt, Homo sapiens
gaugaauccuuugaugaaa

SEQ ID NO: 1582893 - RNA, 19 nt, Homo sapiens
uaaauggacuugcugucaa

SEQ ID NO: 1582894 - RNA, 19 nt, Homo sapiens
ccacgaaguuuauguuugg

SEQ ID NO: 1582895 - RNA, 19 nt, Homo sapiens
gaaaggauuuaccguucug

SEQ ID NO: 1582896 - RNA, 19 nt, Homo sapiens
gacagcaacugaacaaugg

SEQ ID NO: 1582897 - RNA, 19 nt, Homo sapiens
gauggugucucacaaugga

SEQ ID NO: 1582898 - RNA, 19 nt, Homo sapiens
gauuauaccucauauuagc

SEQ ID NO: 1582899 - RNA, 19 nt, Homo sapiens
cagaauauuucacaugcuu

SEQ ID NO: 1582900 - RNA, 19 nt, Homo sapiens
ugaagggaaucauaggaaa

SEQ ID NO: 1582901 - RNA, 19 nt, Homo sapiens
gaaguacagaauucaguuu

SEQ ID NO: 1582902 - RNA, 19 nt, Homo sapiens
gaacauaagagcagauugc

SEQ ID NO: 1582903 - RNA, 19 nt, Homo sapiens
cauaggcucuugcuuaucu

SEQ ID NO: 1582904 - RNA, 19 nt, Homo sapiens
ggaaaggauuuaccguucu

SEQ ID NO: 1582905 - RNA, 19 nt, Homo sapiens
ucacacaagccauuuacua

SEQ ID NO: 1582906 - RNA, 19 nt, Homo sapiens
gugaaaggaaugaugauuu

SEQ ID NO: 1582907 - RNA, 19 nt, Homo sapiens
cgaaguuuauguuuggauu

SEQ ID NO: 1582908 - RNA, 19 nt, Homo sapiens
gaaacuaggaucaguaugc

SEQ ID NO: 1582909 - RNA, 19 nt, Homo sapiens
gcacgugugagauuauuug

SEQ ID NO: 1582910 - RNA, 19 nt, Homo sapiens
agacaagaauguacagcaa

SEQ ID NO: 1582911 - RNA, 19 nt, Homo sapiens
ucacaauccucaucagaca

SEQ ID NO: 1582912 - RNA, 19 nt, Homo sapiens
gcaacugaacaauggauuu

SEQ ID NO: 1582913 - RNA, 19 nt, Homo sapiens
gauacuugcacucaaauga

SEQ ID NO: 1582914 - RNA, 19 nt, Homo sapiens
caccuucccuguacuguau

SEQ ID NO: 1582915 - RNA, 19 nt, Homo sapiens
caaggguguugaugaauag

SEQ ID NO: 1582916 - RNA, 19 nt, Homo sapiens
ggaaguacagaauucaguu

SEQ ID NO: 1582917 - RNA, 19 nt, Homo sapiens
ugucaucgguuuacuaagu

SEQ ID NO: 1582918 - RNA, 19 nt, Homo sapiens
cgugugagauuauuugcaa

SEQ ID NO: 1582919 - RNA, 19 nt, Homo sapiens
uugcauaggcucuugcuua

SEQ ID NO: 1582920 - RNA, 19 nt, Homo sapiens
agacaaacccaucuguaaa

SEQ ID NO: 1582921 - RNA, 19 nt, Homo sapiens
ccaaggcgcaggauuucua

SEQ ID NO: 1582922 - RNA, 19 nt, Homo sapiens
caaacuacuuuagcugaga

SEQ ID NO: 1582923 - RNA, 19 nt, Homo sapiens
cgcaggauuucuauaauug

SEQ ID NO: 1582924 - RNA, 19 nt, Homo sapiens
guccaaggauaaccugauu

SEQ ID NO: 1582925 - RNA, 19 nt, Homo sapiens
cauaaaggaaucaucugua

SEQ ID NO: 1582926 - RNA, 19 nt, Homo sapiens
ucauuucccuuaaccuuau

SEQ ID NO: 1582927 - RNA, 19 nt, Homo sapiens
cauacaggaugaucacaau

SEQ ID NO: 1582928 - RNA, 19 nt, Homo sapiens
cacacaagccauuuacuaa

SEQ ID NO: 1582929 - RNA, 19 nt, Homo sapiens
ugaaauggacaguacacua

SEQ ID NO: 1582930 - RNA, 19 nt, Homo sapiens
acaauuugauguccaagga

SEQ ID NO: 1582931 - RNA, 19 nt, Homo sapiens
cguaggauuuacagaauau

SEQ ID NO: 1582932 - RNA, 19 nt, Homo sapiens
aaauggacuugcugucaaa

SEQ ID NO: 1582933 - RNA, 19 nt, Homo sapiens
caguguagcuguucucucu

SEQ ID NO: 1582934 - RNA, 19 nt, Homo sapiens
ucaguaugccguaggauuu

SEQ ID NO: 1582935 - RNA, 19 nt, Homo sapiens
auaaaggaaucaucuguag

SEQ ID NO: 1582936 - RNA, 19 nt, Homo sapiens
ugaauccuuugaugaaaug

SEQ ID NO: 1582937 - RNA, 19 nt, Homo sapiens
agggagagcuugagguuuc

SEQ ID NO: 1582938 - RNA, 19 nt, Homo sapiens
gaucacaauccucaucaga

SEQ ID NO: 1582939 - RNA, 19 nt, Homo sapiens
aagaggaaguacagaauuc

SEQ ID NO: 1582940 - RNA, 19 nt, Homo sapiens
aauuugauguccaaggaua

SEQ ID NO: 1582941 - RNA, 19 nt, Homo sapiens
gcauaaaggaaucaucugu

SEQ ID NO: 1582942 - RNA, 19 nt, Homo sapiens
uuggugaucuggcugagua

SEQ ID NO: 1582943 - RNA, 19 nt, Homo sapiens
cccaucagcuacagucauu

SEQ ID NO: 1582944 - RNA, 19 nt, Homo sapiens
cggcagauauuugaugaau

SEQ ID NO: 1582945 - RNA, 19 nt, Homo sapiens
uaauggcacuauaaaccaa

SEQ ID NO: 1582946 - RNA, 19 nt, Homo sapiens
cagcuaggcagcauuaaau

SEQ ID NO: 1582947 - RNA, 19 nt, Homo sapiens
aaccuuaucuucaaacuac

SEQ ID NO: 1582948 - RNA, 19 nt, Homo sapiens
caucaucggcagauauuug

SEQ ID NO: 1582949 - RNA, 19 nt, Homo sapiens
gccguaggauuuacagaau

SEQ ID NO: 1582950 - RNA, 19 nt, Homo sapiens
uagauggugucucacaaug

SEQ ID NO: 1582951 - RNA, 19 nt, Homo sapiens
ccaaugguaaugguaauuu

SEQ ID NO: 1582952 - RNA, 19 nt, Homo sapiens
gguggcuuauaccuauuua

SEQ ID NO: 1582953 - RNA, 19 nt, Homo sapiens
aaacuacuuuagcugagaa

SEQ ID NO: 1582954 - RNA, 19 nt, Homo sapiens
ugaugaauccuuugaugaa

SEQ ID NO: 1582955 - RNA, 19 nt, Homo sapiens
ccguaggauuuacagaaua

SEQ ID NO: 1582956 - RNA, 19 nt, Homo sapiens
uagcuguucucucuagaug

SEQ ID NO: 1582957 - RNA, 19 nt, Homo sapiens
gugguaagaaugauugaaa

SEQ ID NO: 1582958 - RNA, 19 nt, Homo sapiens
ccugaugaauccuuugaug

SEQ ID NO: 1582959 - RNA, 19 nt, Homo sapiens
ggaaguaugaacauuuaag

SEQ ID NO: 1582960 - RNA, 19 nt, Homo sapiens
uuacugugcuacauaaagu

SEQ ID NO: 1582961 - RNA, 19 nt, Homo sapiens
ggaucaguaugccguagga

SEQ ID NO: 1582962 - RNA, 19 nt, Homo sapiens
ugacagcaacugaacaaug

SEQ ID NO: 1582963 - RNA, 19 nt, Homo sapiens
gacaagaauguacagcaaa

SEQ ID NO: 1582964 - RNA, 19 nt, Homo sapiens
ccaaacugauuguaaugag

SEQ ID NO: 1582965 - RNA, 19 nt, Homo sapiens
auaaagcacuggaggucuu

SEQ ID NO: 1582966 - RNA, 19 nt, Homo sapiens
gguaagaaugauugaaaug

SEQ ID NO: 1582967 - RNA, 19 nt, Homo sapiens
ugcauaggcucuugcuuau

SEQ ID NO: 1582968 - RNA, 19 nt, Homo sapiens
gcgaaacuaggaucaguau

SEQ ID NO: 1582969 - RNA, 19 nt, Homo sapiens
cagcaggguuagcauaaag

SEQ ID NO: 1582970 - RNA, 19 nt, Homo sapiens
ucaaaugacagcaacugaa

SEQ ID NO: 1582971 - RNA, 19 nt, Homo sapiens
cauaaaacaucuccaaaag

SEQ ID NO: 1582972 - RNA, 19 nt, Homo sapiens
ucacaauggauuucuguug

SEQ ID NO: 1582973 - RNA, 19 nt, Homo sapiens
gcuguucucucuagauggu

SEQ ID NO: 1582974 - RNA, 19 nt, Homo sapiens
gaagaagaguccaaauuua

SEQ ID NO: 1582975 - RNA, 19 nt, Homo sapiens
caacaagacugcuuuaaau

SEQ ID NO: 1582976 - RNA, 19 nt, Homo sapiens
ggacagaccuuaucuccaa

SEQ ID NO: 1582977 - RNA, 19 nt, Homo sapiens
acaaagaccuaccaacuua

SEQ ID NO: 1582978 - RNA, 19 nt, Homo sapiens
ggaaggaacucccaggaaa

SEQ ID NO: 1582979 - RNA, 19 nt, Homo sapiens
gcaaaugaauuacuuggaa

SEQ ID NO: 1582980 - RNA, 19 nt, Homo sapiens
gaagaucauuucagaagaa

SEQ ID NO: 1582981 - RNA, 19 nt, Homo sapiens
gaaaugaauuccuguauac

SEQ ID NO: 1582982 - RNA, 19 nt, Homo sapiens
gcccagaaguguuccauua

SEQ ID NO: 1582983 - RNA, 19 nt, Homo sapiens
gagaacccaucacuaauuu

SEQ ID NO: 1582984 - RNA, 19 nt, Homo sapiens
cgaaauagcagccagcuua

SEQ ID NO: 1582985 - RNA, 19 nt, Homo sapiens
gcugagagauuaagaguug

SEQ ID NO: 1582986 - RNA, 19 nt, Homo sapiens
gaaauuccagcaacaguua

SEQ ID NO: 1582987 - RNA, 19 nt, Homo sapiens
cgaaguauaugggauguua

SEQ ID NO: 1582988 - RNA, 19 nt, Homo sapiens
ucaguuaccucacuacuaa

SEQ ID NO: 1582989 - RNA, 19 nt, Homo sapiens
gaacaggcacugcaaauga

SEQ ID NO: 1582990 - RNA, 19 nt, Homo sapiens
caaauuaccugcauucuac

SEQ ID NO: 1582991 - RNA, 19 nt, Homo sapiens
ggaaauagcaguccagguu

SEQ ID NO: 1582992 - RNA, 19 nt, Homo sapiens
gaccagaaguccuaugaaa

SEQ ID NO: 1582993 - RNA, 19 nt, Homo sapiens
ggacgaggauuuacuguca

SEQ ID NO: 1582994 - RNA, 19 nt, Homo sapiens
gaauggccuucaucacuua

SEQ ID NO: 1582995 - RNA, 19 nt, Homo sapiens
gacuacagcuucucgguua

SEQ ID NO: 1582996 - RNA, 19 nt, Homo sapiens
ucaacagccugaauaauuu

SEQ ID NO: 1582997 - RNA, 19 nt, Homo sapiens
gaacaacauugacaucauc

SEQ ID NO: 1582998 - RNA, 19 nt, Homo sapiens
ggaaagaccacuauauuca

SEQ ID NO: 1582999 - RNA, 19 nt, Homo sapiens
gaagagcaauggccucaug

SEQ ID NO: 1583000 - RNA, 19 nt, Homo sapiens
caauagagagggcaauuua

SEQ ID NO: 1583001 - RNA, 19 nt, Homo sapiens
ggaagaacauuuguauuuc

SEQ ID NO: 1583002 - RNA, 19 nt, Homo sapiens
ggaauggccuucaucacuu

SEQ ID NO: 1583003 - RNA, 19 nt, Homo sapiens
ccagugaucuacaguguuu

SEQ ID NO: 1583004 - RNA, 19 nt, Homo sapiens
gaucauggcuauacucauc

SEQ ID NO: 1583005 - RNA, 19 nt, Homo sapiens
gauuauagcuguaaacaac

SEQ ID NO: 1583006 - RNA, 19 nt, Homo sapiens
gaacaaaacugccagaaca

SEQ ID NO: 1583007 - RNA, 19 nt, Homo sapiens
gcagugggcacaauguuua

SEQ ID NO: 1583008 - RNA, 19 nt, Homo sapiens
gaagccaccucaagaugaa

SEQ ID NO: 1583009 - RNA, 19 nt, Homo sapiens
caacaguuauccagagauu

SEQ ID NO: 1583010 - RNA, 19 nt, Homo sapiens
ugagacagcuggcggaauu

SEQ ID NO: 1583011 - RNA, 19 nt, Homo sapiens
gcacuugucucagcaaugu

SEQ ID NO: 1583012 - RNA, 19 nt, Homo sapiens
ugaagaagaucauggcuau

SEQ ID NO: 1583013 - RNA, 19 nt, Homo sapiens
gaagaggaaguuaucuaua

SEQ ID NO: 1583014 - RNA, 19 nt, Homo sapiens
gcaauggccucauguuuac

SEQ ID NO: 1583015 - RNA, 19 nt, Homo sapiens
gccaugagcuaucuuauca

SEQ ID NO: 1583016 - RNA, 19 nt, Homo sapiens
guaaauauuuccucuugug

SEQ ID NO: 1583017 - RNA, 19 nt, Homo sapiens
ugaccgaacuucuuuguga

SEQ ID NO: 1583018 - RNA, 19 nt, Homo sapiens
gacaauagaugaggaugaa

SEQ ID NO: 1583019 - RNA, 19 nt, Homo sapiens
gcaagcagacaacauaauu

SEQ ID NO: 1583020 - RNA, 19 nt, Homo sapiens
ucucacagcucauuaguug

SEQ ID NO: 1583021 - RNA, 19 nt, Homo sapiens
ggagaacccaucacuaauu

SEQ ID NO: 1583022 - RNA, 19 nt, Homo sapiens
gaacacaccacaaggauca

SEQ ID NO: 1583023 - RNA, 19 nt, Homo sapiens
gagcauagaugucuuuuau

SEQ ID NO: 1583024 - RNA, 19 nt, Homo sapiens
gauccgacuuuagaacuua

SEQ ID NO: 1583025 - RNA, 19 nt, Homo sapiens
ccacaaggaucauuuagca

SEQ ID NO: 1583026 - RNA, 19 nt, Homo sapiens
gauggagucuuaacacuuc

SEQ ID NO: 1583027 - RNA, 19 nt, Homo sapiens
gaucauuucagaagaagua

SEQ ID NO: 1583028 - RNA, 19 nt, Homo sapiens
ggaagaucauuucagaaga

SEQ ID NO: 1583029 - RNA, 19 nt, Homo sapiens
ggcauuaauuccauuguuu

SEQ ID NO: 1583030 - RNA, 19 nt, Homo sapiens
caacaggacuauugacaag

SEQ ID NO: 1583031 - RNA, 19 nt, Homo sapiens
cagccaagguuccacuaua

SEQ ID NO: 1583032 - RNA, 19 nt, Homo sapiens
gagaaugaguugagcuaug

SEQ ID NO: 1583033 - RNA, 19 nt, Homo sapiens
uugaagagcugaaagaaga

SEQ ID NO: 1583034 - RNA, 19 nt, Homo sapiens
ggccagagguucaccagaa

SEQ ID NO: 1583035 - RNA, 19 nt, Homo sapiens
ucaggugacuccgauaaua

SEQ ID NO: 1583036 - RNA, 19 nt, Homo sapiens
guaaacaacaucagcauug

SEQ ID NO: 1583037 - RNA, 19 nt, Homo sapiens
caucccagguaauuuauaa

SEQ ID NO: 1583038 - RNA, 19 nt, Homo sapiens
gaacaaucauucugucaac

SEQ ID NO: 1583039 - RNA, 19 nt, Homo sapiens
ggaauuaccacugaauauu

SEQ ID NO: 1583040 - RNA, 19 nt, Homo sapiens
ucagaaacccucauauuug

SEQ ID NO: 1583041 - RNA, 19 nt, Homo sapiens
gaacagacagccuucuaug

SEQ ID NO: 1583042 - RNA, 19 nt, Homo sapiens
agaagaagaguccaaauuu

SEQ ID NO: 1583043 - RNA, 19 nt, Homo sapiens
cuacaucauugccuucuuu

SEQ ID NO: 1583044 - RNA, 19 nt, Homo sapiens
gcacauaaagagcagguuu

SEQ ID NO: 1583045 - RNA, 19 nt, Homo sapiens
gaaagaccacuauauucaa

SEQ ID NO: 1583046 - RNA, 19 nt, Homo sapiens
gaacagggcauuggucuuc

SEQ ID NO: 1583047 - RNA, 19 nt, Homo sapiens
gaguugagcuauguauuga

SEQ ID NO: 1583048 - RNA, 19 nt, Homo sapiens
caguaaauauuuccucuug

SEQ ID NO: 1583049 - RNA, 19 nt, Homo sapiens
gaugcccucuuaaauauau

SEQ ID NO: 1583050 - RNA, 19 nt, Homo sapiens
guauguguguguaucuaua

SEQ ID NO: 1583051 - RNA, 19 nt, Homo sapiens
ccaaagaccagaaguccua

SEQ ID NO: 1583052 - RNA, 19 nt, Homo sapiens
gaacaugggagucuguaug

SEQ ID NO: 1583053 - RNA, 19 nt, Homo sapiens
cauguuaacugggcuguuu

SEQ ID NO: 1583054 - RNA, 19 nt, Homo sapiens
uauagagaguguuggauuu

SEQ ID NO: 1583055 - RNA, 19 nt, Homo sapiens
uaucaccacucccaaacua

SEQ ID NO: 1583056 - RNA, 19 nt, Homo sapiens
uaacgcauguguggaauga

SEQ ID NO: 1583057 - RNA, 19 nt, Homo sapiens
ggaggagucgcaaacauuu

SEQ ID NO: 1583058 - RNA, 19 nt, Homo sapiens
cagaagaaguacagaacaa

SEQ ID NO: 1583059 - RNA, 19 nt, Homo sapiens
uagaugaccugguaacugu

SEQ ID NO: 1583060 - RNA, 19 nt, Homo sapiens
gcugggcucuuccaugaaa

SEQ ID NO: 1583061 - RNA, 19 nt, Homo sapiens
gaacaccagugaucuacag

SEQ ID NO: 1583062 - RNA, 19 nt, Homo sapiens
gaacuggaaaggucucauu

SEQ ID NO: 1583063 - RNA, 19 nt, Homo sapiens
gagcaauggccucauguuu

SEQ ID NO: 1583064 - RNA, 19 nt, Homo sapiens
caccaucucccaagcauua

SEQ ID NO: 1583065 - RNA, 19 nt, Homo sapiens
acuagaagaugcaaugaaa

SEQ ID NO: 1583066 - RNA, 19 nt, Homo sapiens
uuacaacuguguuagacua

SEQ ID NO: 1583067 - RNA, 19 nt, Homo sapiens
ucaggaagaugccuuagau

SEQ ID NO: 1583068 - RNA, 19 nt, Homo sapiens
ggaguggaauacccaaaug

SEQ ID NO: 1583069 - RNA, 19 nt, Homo sapiens
gaucaaggguaguaauuuu

SEQ ID NO: 1583070 - RNA, 19 nt, Homo sapiens
cuauauagccaucgucaua

SEQ ID NO: 1583071 - RNA, 19 nt, Homo sapiens
uaaccagugucucuuauuc

SEQ ID NO: 1583072 - RNA, 19 nt, Homo sapiens
ugagaucccugaagcaaau

SEQ ID NO: 1583073 - RNA, 19 nt, Homo sapiens
gcacacauccgcugcuaga

SEQ ID NO: 1583074 - RNA, 19 nt, Homo sapiens
gaagaagaguccaaauuua

SEQ ID NO: 1583075 - RNA, 19 nt, Homo sapiens
caacaagacugcuuuaaau

SEQ ID NO: 1583076 - RNA, 19 nt, Homo sapiens
ggacagaccuuaucuccaa

SEQ ID NO: 1583077 - RNA, 19 nt, Homo sapiens
acaaagaccuaccaacuua

SEQ ID NO: 1583078 - RNA, 19 nt, Homo sapiens
ggaaggaacucccaggaaa

SEQ ID NO: 1583079 - RNA, 19 nt, Homo sapiens
gcaaaugaauuacuuggaa

SEQ ID NO: 1583080 - RNA, 19 nt, Homo sapiens
gaagaucauuucagaagaa

SEQ ID NO: 1583081 - RNA, 19 nt, Homo sapiens
gaaaugaauuccuguauac

SEQ ID NO: 1583082 - RNA, 19 nt, Homo sapiens
gcccagaaguguuccauua

SEQ ID NO: 1583083 - RNA, 19 nt, Homo sapiens
gagaacccaucacuaauuu

SEQ ID NO: 1583084 - RNA, 19 nt, Homo sapiens
cgaaauagcagccagcuua

SEQ ID NO: 1583085 - RNA, 19 nt, Homo sapiens
gaacauauacuuucaaugg

SEQ ID NO: 1583086 - RNA, 19 nt, Homo sapiens
gcugagagauuaagaguug

SEQ ID NO: 1583087 - RNA, 19 nt, Homo sapiens
gaaauuccagcaacaguua

SEQ ID NO: 1583088 - RNA, 19 nt, Homo sapiens
cgaaguauaugggauguua

SEQ ID NO: 1583089 - RNA, 19 nt, Homo sapiens
ucaguuaccucacuacuaa

SEQ ID NO: 1583090 - RNA, 19 nt, Homo sapiens
gaacaggcacugcaaauga

SEQ ID NO: 1583091 - RNA, 19 nt, Homo sapiens
ggacagcaguuuaucauuc

SEQ ID NO: 1583092 - RNA, 19 nt, Homo sapiens
caaauuaccugcauucuac

SEQ ID NO: 1583093 - RNA, 19 nt, Homo sapiens
ggaaauagcaguccagguu

SEQ ID NO: 1583094 - RNA, 19 nt, Homo sapiens
gaccagaaguccuaugaaa

SEQ ID NO: 1583095 - RNA, 19 nt, Homo sapiens
ggacgaggauuuacuguca

SEQ ID NO: 1583096 - RNA, 19 nt, Homo sapiens
gaauggccuucaucacuua

SEQ ID NO: 1583097 - RNA, 19 nt, Homo sapiens
gacuacagcuucucgguua

SEQ ID NO: 1583098 - RNA, 19 nt, Homo sapiens
caaggugacuccgauaaua

SEQ ID NO: 1583099 - RNA, 19 nt, Homo sapiens
ucaacagccugaauaauuu

SEQ ID NO: 1583100 - RNA, 19 nt, Homo sapiens
gaacaacauugacaucauc

SEQ ID NO: 1583101 - RNA, 19 nt, Homo sapiens
gggcaucaguucuucauuu

SEQ ID NO: 1583102 - RNA, 19 nt, Homo sapiens
ggaaagaccacuauauuca

SEQ ID NO: 1583103 - RNA, 19 nt, Homo sapiens
gaagagcaauggccucaug

SEQ ID NO: 1583104 - RNA, 19 nt, Homo sapiens
gagaagugccucuugguua

SEQ ID NO: 1583105 - RNA, 19 nt, Homo sapiens
caauagagagggcaauuua

SEQ ID NO: 1583106 - RNA, 19 nt, Homo sapiens
ggaagaacauuuguauuuc

SEQ ID NO: 1583107 - RNA, 19 nt, Homo sapiens
ggaauggccuucaucacuu

SEQ ID NO: 1583108 - RNA, 19 nt, Homo sapiens
ccagugaucuacaguguuu

SEQ ID NO: 1583109 - RNA, 19 nt, Homo sapiens
gaucauggcuauacucauc

SEQ ID NO: 1583110 - RNA, 19 nt, Homo sapiens
caaauguguuucagaauga

SEQ ID NO: 1583111 - RNA, 19 nt, Homo sapiens
gauuauagcuguaaacaac

SEQ ID NO: 1583112 - RNA, 19 nt, Homo sapiens
gaacaaaacugccagaaca

SEQ ID NO: 1583113 - RNA, 19 nt, Homo sapiens
gcagugggcacaauguuua

SEQ ID NO: 1583114 - RNA, 19 nt, Homo sapiens
gaagccaccucaagaugaa

SEQ ID NO: 1583115 - RNA, 19 nt, Homo sapiens
caacaguuauccagagauu

SEQ ID NO: 1583116 - RNA, 19 nt, Homo sapiens
ugagacagcuggcggaauu

SEQ ID NO: 1583117 - RNA, 19 nt, Homo sapiens
gcacuugucucagcaaugu

SEQ ID NO: 1583118 - RNA, 19 nt, Homo sapiens
ugaagaagaucauggcuau

SEQ ID NO: 1583119 - RNA, 19 nt, Homo sapiens
gaagaggaaguuaucuaua

SEQ ID NO: 1583120 - RNA, 19 nt, Homo sapiens
gcaauggccucauguuuac

SEQ ID NO: 1583121 - RNA, 19 nt, Homo sapiens
gccaugagcuaucuuauca

SEQ ID NO: 1583122 - RNA, 19 nt, Homo sapiens
guaaauauuuccucuugug

SEQ ID NO: 1583123 - RNA, 19 nt, Homo sapiens
ugaccgaacuucuuuguga

SEQ ID NO: 1583124 - RNA, 19 nt, Homo sapiens
gaaaggaauugaugaugca

SEQ ID NO: 1583125 - RNA, 19 nt, Homo sapiens
gacaauagaugaggaugaa

SEQ ID NO: 1583126 - RNA, 19 nt, Homo sapiens
ccaaauguguuucagaaug

SEQ ID NO: 1583127 - RNA, 19 nt, Homo sapiens
gcaagcagacaacauaauu

SEQ ID NO: 1583128 - RNA, 19 nt, Homo sapiens
ucucacagcucauuaguug

SEQ ID NO: 1583129 - RNA, 19 nt, Homo sapiens
ggagaacccaucacuaauu

SEQ ID NO: 1583130 - RNA, 19 nt, Homo sapiens
gaacacaccacaaggauca

SEQ ID NO: 1583131 - RNA, 19 nt, Homo sapiens
gaagauaguguuucaggaa

SEQ ID NO: 1583132 - RNA, 19 nt, Homo sapiens
gauccgacuuuagaacuua

SEQ ID NO: 1583133 - RNA, 19 nt, Homo sapiens
ccacaaggaucauuuagca

SEQ ID NO: 1583134 - RNA, 19 nt, Homo sapiens
gauggagucuuaacacuuc

SEQ ID NO: 1583135 - RNA, 19 nt, Homo sapiens
caggauacauuguggauga

SEQ ID NO: 1583136 - RNA, 19 nt, Homo sapiens
gaaaagcuguuaaagcaaa

SEQ ID NO: 1583137 - RNA, 19 nt, Homo sapiens
gaucauuucagaagaagua

SEQ ID NO: 1583138 - RNA, 19 nt, Homo sapiens
ggaagaucauuucagaaga

SEQ ID NO: 1583139 - RNA, 19 nt, Homo sapiens
ggcauuaauuccauuguuu

SEQ ID NO: 1583140 - RNA, 19 nt, Homo sapiens
caacaggacuauugacaag

SEQ ID NO: 1583141 - RNA, 19 nt, Homo sapiens
gaugaugccuucucuugga

SEQ ID NO: 1583142 - RNA, 19 nt, Homo sapiens
aaggauggcuucccuguuu

SEQ ID NO: 1583143 - RNA, 19 nt, Homo sapiens
cagccaagguuccacuaua

SEQ ID NO: 1583144 - RNA, 19 nt, Homo sapiens
gagaaugaguugagcuaug

SEQ ID NO: 1583145 - RNA, 19 nt, Homo sapiens
uugaagagcugaaagaaga

SEQ ID NO: 1583146 - RNA, 19 nt, Homo sapiens
ggccagagguucaccagaa

SEQ ID NO: 1583147 - RNA, 19 nt, Homo sapiens
guaaacaacaucagcauug

SEQ ID NO: 1583148 - RNA, 19 nt, Homo sapiens
caucccagguaauuuauaa

SEQ ID NO: 1583149 - RNA, 19 nt, Homo sapiens
gaacaaucauucugucaac

SEQ ID NO: 1583150 - RNA, 19 nt, Homo sapiens
ggaauuaccacugaauauu

SEQ ID NO: 1583151 - RNA, 19 nt, Homo sapiens
agaagugccucuugguuaa

SEQ ID NO: 1583152 - RNA, 19 nt, Homo sapiens
guacugauacacugacaua

SEQ ID NO: 1583153 - RNA, 19 nt, Homo sapiens
ucagaaacccucauauuug

SEQ ID NO: 1583154 - RNA, 19 nt, Homo sapiens
gaacagacagccuucuaug

SEQ ID NO: 1583155 - RNA, 19 nt, Homo sapiens
agaagaagaguccaaauuu

SEQ ID NO: 1583156 - RNA, 19 nt, Homo sapiens
cuacaucauugccuucuuu

SEQ ID NO: 1583157 - RNA, 19 nt, Homo sapiens
gcacauaaagagcagguuu

SEQ ID NO: 1583158 - RNA, 19 nt, Homo sapiens
gaaagaccacuauauucaa

SEQ ID NO: 1583159 - RNA, 19 nt, Homo sapiens
gaacagggcauuggucuuc

SEQ ID NO: 1583160 - RNA, 19 nt, Homo sapiens
gaguugagcuauguauuga

SEQ ID NO: 1583161 - RNA, 19 nt, Homo sapiens
caguaaauauuuccucuug

SEQ ID NO: 1583162 - RNA, 19 nt, Homo sapiens
gaugcccucuuaaauauau

SEQ ID NO: 1583163 - RNA, 19 nt, Homo sapiens
guauguguguguaucuaua

SEQ ID NO: 1583164 - RNA, 19 nt, Homo sapiens
ccaaagaccagaaguccua

SEQ ID NO: 1583165 - RNA, 19 nt, Homo sapiens
gaacaugggagucuguaug

SEQ ID NO: 1583166 - RNA, 19 nt, Homo sapiens
cauguuaacugggcuguuu

SEQ ID NO: 1583167 - RNA, 19 nt, Homo sapiens
uauagagaguguuggauuu

SEQ ID NO: 1583168 - RNA, 19 nt, Homo sapiens
uaucaccacucccaaacua

SEQ ID NO: 1583169 - RNA, 19 nt, Homo sapiens
ggauaaggacagcaguuua

SEQ ID NO: 1583170 - RNA, 19 nt, Homo sapiens
ggaggagucgcaaacauuu

SEQ ID NO: 1583171 - RNA, 19 nt, Homo sapiens
cagaagaaguacagaacaa

SEQ ID NO: 1583172 - RNA, 19 nt, Homo sapiens
uagaugaccugguaacugu

SEQ ID NO: 1583173 - RNA, 19 nt, Homo sapiens
gcugggcucuuccaugaaa

SEQ ID NO: 1583174 - RNA, 19 nt, Homo sapiens
cuaccaagguggccaagaa

SEQ ID NO: 1583175 - RNA, 19 nt, Homo sapiens
gaagaacuaccgagugugu

SEQ ID NO: 1583176 - RNA, 19 nt, Homo sapiens
ccagugacccgaagaagaa

SEQ ID NO: 1583177 - RNA, 19 nt, Homo sapiens
ugaauguguugcaaauuga

SEQ ID NO: 1583178 - RNA, 19 nt, Homo sapiens
uggaagaacuaccgagugu

SEQ ID NO: 1583179 - RNA, 19 nt, Homo sapiens
augaauguguugcaaauug

SEQ ID NO: 1583180 - RNA, 19 nt, Homo sapiens
cgaagaagaagacuaccaa

SEQ ID NO: 1583181 - RNA, 19 nt, Homo sapiens
gaaaggggcugcgacaaag

SEQ ID NO: 1583182 - RNA, 19 nt, Homo sapiens
agaagaagacuaccaaggu

SEQ ID NO: 1583183 - RNA, 19 nt, Homo sapiens
gagcgagauggaagaacua

SEQ ID NO: 1583184 - RNA, 19 nt, Homo sapiens
gaauguguugcaaauugaa

SEQ ID NO: 1583185 - RNA, 19 nt, Homo sapiens
ggagagcgagauggaagaa

SEQ ID NO: 1583186 - RNA, 19 nt, Homo sapiens
guugagcugcggaagauga

SEQ ID NO: 1583187 - RNA, 19 nt, Homo sapiens
gggagacgcgggaagaaag

SEQ ID NO: 1583188 - RNA, 19 nt, Homo sapiens
gggaaaagcaguucguaga

SEQ ID NO: 1583189 - RNA, 19 nt, Homo sapiens
agagcgagauggaagaacu

SEQ ID NO: 1583190 - RNA, 19 nt, Homo sapiens
ggagagccagguggaggaa

SEQ ID NO: 1583191 - RNA, 19 nt, Homo sapiens
ggagagccagguggaggaa

SEQ ID NO: 1583192 - RNA, 19 nt, Homo sapiens
ggagagccagguggaggaa

SEQ ID NO: 1583193 - RNA, 19 nt, Homo sapiens
ggagagccagguggaggaa

SEQ ID NO: 1583194 - RNA, 19 nt, Homo sapiens
gagggagacgcgggaagaa

SEQ ID NO: 1583195 - RNA, 19 nt, Homo sapiens
gcaaauggccacaguguua

SEQ ID NO: 1583196 - RNA, 19 nt, Homo sapiens
uaaaggaagcgaucaauua

SEQ ID NO: 1583197 - RNA, 19 nt, Homo sapiens
aaacagggauugccaagaa

SEQ ID NO: 1583198 - RNA, 19 nt, Homo sapiens
gaacugaagggauaauaaa

SEQ ID NO: 1583199 - RNA, 19 nt, Homo sapiens
gcuagcagcugcaggaauu

SEQ ID NO: 1583200 - RNA, 19 nt, Homo sapiens
gacuguagaugaaaucgua

SEQ ID NO: 1583201 - RNA, 19 nt, Homo sapiens
gcucgugacuguagaugaa

SEQ ID NO: 1583202 - RNA, 19 nt, Homo sapiens
ccacugaccucuugaguac

SEQ ID NO: 1583203 - RNA, 19 nt, Homo sapiens
agucaaagcccaaggauuu

SEQ ID NO: 1583204 - RNA, 19 nt, Homo sapiens
ggaacugaagggauaauaa

SEQ ID NO: 1583205 - RNA, 19 nt, Homo sapiens
ggcagagaaugcaggcuua

SEQ ID NO: 1583206 - RNA, 19 nt, Homo sapiens
aggaagcgaucaauuacua

SEQ ID NO: 1583207 - RNA, 19 nt, Homo sapiens
ccaagacccaguuccuuua

SEQ ID NO: 1583208 - RNA, 19 nt, Homo sapiens
ugugggaacugaagggaua

SEQ ID NO: 1583209 - RNA, 19 nt, Homo sapiens
ggagaucauuuaccugagu

SEQ ID NO: 1583210 - RNA, 19 nt, Homo sapiens
gcugaucuagcucaauuua

SEQ ID NO: 1583211 - RNA, 19 nt, Homo sapiens
cuagugauacccucaauaa

SEQ ID NO: 1583212 - RNA, 19 nt, Homo sapiens
gcaagugccagaggguuua

SEQ ID NO: 1583213 - RNA, 19 nt, Homo sapiens
guaaaggaagcgaucaauu

SEQ ID NO: 1583214 - RNA, 19 nt, Homo sapiens
gggaagcucugugggcaaa

SEQ ID NO: 1583215 - RNA, 19 nt, Homo sapiens
gaacuagacggcagcuuca

SEQ ID NO: 1583216 - RNA, 19 nt, Homo sapiens
ggacaaacccaggcagaga

SEQ ID NO: 1583217 - RNA, 19 nt, Homo sapiens
ccaagaagacaaagaaaca

SEQ ID NO: 1583218 - RNA, 19 nt, Homo sapiens
gaagcucugugggcaaaug

SEQ ID NO: 1583219 - RNA, 19 nt, Homo sapiens
ggauggagaucauuuaccu

SEQ ID NO: 1583220 - RNA, 19 nt, Homo sapiens
gaucuagcucaauuuagua

SEQ ID NO: 1583221 - RNA, 19 nt, Homo sapiens
ugaucuagcucaauuuagu

SEQ ID NO: 1583222 - RNA, 19 nt, Homo sapiens
caagaucccagacugauuc

SEQ ID NO: 1583223 - RNA, 19 nt, Homo sapiens
guauuugaaugggaaugua

SEQ ID NO: 1583224 - RNA, 19 nt, Homo sapiens
cugcugaucuagcucaauu

SEQ ID NO: 1583225 - RNA, 19 nt, Homo sapiens
cugaagggauaauaaaugu

SEQ ID NO: 1583226 - RNA, 19 nt, Homo sapiens
uaaaggaagcagauuggaa

SEQ ID NO: 1583227 - RNA, 19 nt, Homo sapiens
gguccgugcugaugucuuc

SEQ ID NO: 1583228 - RNA, 19 nt, Homo sapiens
gcacagccuucgugguucu

SEQ ID NO: 1583229 - RNA, 19 nt, Homo sapiens
ggucuuggauggagaucau

SEQ ID NO: 1583230 - RNA, 19 nt, Homo sapiens
gaagcgaucaauuacuaga

SEQ ID NO: 1583231 - RNA, 19 nt, Homo sapiens
gauaaaggaagcagauugg

SEQ ID NO: 1583232 - RNA, 19 nt, Homo sapiens
gcaaguaggccagcuagca

SEQ ID NO: 1583233 - RNA, 19 nt, Homo sapiens
caaauggccacaguguuaa

SEQ ID NO: 1583234 - RNA, 19 nt, Homo sapiens
ugguuuggcugugguauuu

SEQ ID NO: 1583235 - RNA, 19 nt, Homo sapiens
ggaauccugacuccaagaa

SEQ ID NO: 1583236 - RNA, 19 nt, Homo sapiens
gugcagagcaggccgucua

SEQ ID NO: 1583237 - RNA, 19 nt, Homo sapiens
gacaaacccaggcagagaa

SEQ ID NO: 1583238 - RNA, 19 nt, Homo sapiens
gccaagaagggaacaauca

SEQ ID NO: 1583239 - RNA, 19 nt, Homo sapiens
ucacacuggcggacaagua

SEQ ID NO: 1583240 - RNA, 19 nt, Homo sapiens
uggauugaauaacuaguga

SEQ ID NO: 1583241 - RNA, 19 nt, Homo sapiens
aauccugacuccaagaaga

SEQ ID NO: 1583242 - RNA, 19 nt, Homo sapiens
ggugggaaccuccuaaugg

SEQ ID NO: 1583243 - RNA, 19 nt, Homo sapiens
gcacaccugcccucacugu

SEQ ID NO: 1583244 - RNA, 19 nt, Homo sapiens
cggcacagccuucgugguu

SEQ ID NO: 1583245 - RNA, 19 nt, Homo sapiens
cagugggccugcauuccua

SEQ ID NO: 1583246 - RNA, 19 nt, Homo sapiens
ccaguuccuuuacagaauc

SEQ ID NO: 1583247 - RNA, 19 nt, Homo sapiens
gggcaaauggccacagugu

SEQ ID NO: 1583248 - RNA, 19 nt, Homo sapiens
cugcugggcuaucaaggaa

SEQ ID NO: 1583249 - RNA, 19 nt, Homo sapiens
gacggaagccuugcuggaa

SEQ ID NO: 1583250 - RNA, 19 nt, Homo sapiens
guuuggcugugguauuuga

SEQ ID NO: 1583251 - RNA, 19 nt, Homo sapiens
caccuccuguggaaacaaa

SEQ ID NO: 1583252 - RNA, 19 nt, Homo sapiens
uaaugggugugggaacuga

SEQ ID NO: 1583253 - RNA, 19 nt, Homo sapiens
ugauaaaggaagcagauug

SEQ ID NO: 1583254 - RNA, 19 nt, Homo sapiens
ggacacccuaauagucaaa

SEQ ID NO: 1583255 - RNA, 19 nt, Homo sapiens
gggaacugaagggauaaua

SEQ ID NO: 1583256 - RNA, 19 nt, Homo sapiens
cuucagauaccaaucaaug

SEQ ID NO: 1583257 - RNA, 19 nt, Homo sapiens
gcagcugcaggaauuaaug

SEQ ID NO: 1583258 - RNA, 19 nt, Homo sapiens
cccaagacccaguuccuuu

SEQ ID NO: 1583259 - RNA, 19 nt, Homo sapiens
gaccaugaaaggagaaaca

SEQ ID NO: 1583260 - RNA, 19 nt, Homo sapiens
gggacacccuaauagucaa

SEQ ID NO: 1583261 - RNA, 19 nt, Homo sapiens
ggccugcauuccuagcauu

SEQ ID NO: 1583262 - RNA, 19 nt, Homo sapiens
agcgaucaauuacuagaaa

SEQ ID NO: 1583263 - RNA, 19 nt, Homo sapiens
aaaggaagcgaucaauuac

SEQ ID NO: 1583264 - RNA, 19 nt, Homo sapiens
ccacacaucaggagaucug

SEQ ID NO: 1583265 - RNA, 19 nt, Homo sapiens
caagaaaagucccacacau

SEQ ID NO: 1583266 - RNA, 19 nt, Homo sapiens
gaaaucguaguggccaaga

SEQ ID NO: 1583267 - RNA, 19 nt, Homo sapiens
uggcugagguggugcuaca

SEQ ID NO: 1583268 - RNA, 19 nt, Homo sapiens
cagacgugauggcagaaau

SEQ ID NO: 1583269 - RNA, 19 nt, Homo sapiens
ccugggcccugaaguaucu

SEQ ID NO: 1583270 - RNA, 19 nt, Homo sapiens
ccugggcccuccauucugu

SEQ ID NO: 1583271 - RNA, 19 nt, Homo sapiens
ucaagaucccagacugauu

SEQ ID NO: 1583272 - RNA, 19 nt, Homo sapiens
ugaugccuauuuccagcua

SEQ ID NO: 1583273 - RNA, 19 nt, Homo sapiens
ggagcugggagaugguuug

SEQ ID NO: 1583274 - RNA, 19 nt, Homo sapiens
acugaccucuugaguacuu

SEQ ID NO: 1583275 - RNA, 19 nt, Homo sapiens
cuuuaggacugggcucuuu

SEQ ID NO: 1583276 - RNA, 19 nt, Homo sapiens
ggcccuccauucugugaug

SEQ ID NO: 1583277 - RNA, 19 nt, Homo sapiens
aaucguaguggccaagaaa

SEQ ID NO: 1583278 - RNA, 19 nt, Homo sapiens
gacgugauggcagaaauga

SEQ ID NO: 1583279 - RNA, 19 nt, Homo sapiens
cccaguuccuuuacagaau

SEQ ID NO: 1583280 - RNA, 19 nt, Homo sapiens
caggguggcucucuuugcu

SEQ ID NO: 1583281 - RNA, 19 nt, Homo sapiens
gguggccucuccucucucu

SEQ ID NO: 1583282 - RNA, 19 nt, Homo sapiens
gguccugcccauccaaaug

SEQ ID NO: 1583283 - RNA, 19 nt, Homo sapiens
uaauguggcagugguguug

SEQ ID NO: 1583284 - RNA, 19 nt, Homo sapiens
aaacccaggcagagaauag

SEQ ID NO: 1583285 - RNA, 19 nt, Homo sapiens
ggaagcgaucaauuacuag

SEQ ID NO: 1583286 - RNA, 19 nt, Homo sapiens
gcugggcuaucaaggaacu

SEQ ID NO: 1583287 - RNA, 19 nt, Homo sapiens
cggaagccuugcuggaaca

SEQ ID NO: 1583288 - RNA, 19 nt, Homo sapiens
uaacuagugauacccucaa

SEQ ID NO: 1583289 - RNA, 19 nt, Homo sapiens
ugggacacccuaauaguca

SEQ ID NO: 1583290 - RNA, 19 nt, Homo sapiens
gcugguccgugcugauguc

SEQ ID NO: 1583291 - RNA, 19 nt, Homo sapiens
cuucaagccugagcguguu

SEQ ID NO: 1583292 - RNA, 19 nt, Homo sapiens
ccauggaccacuugaccaa

SEQ ID NO: 1583293 - RNA, 19 nt, Homo sapiens
aaaucguaguggccaagaa

SEQ ID NO: 1583294 - RNA, 19 nt, Homo sapiens
acugaagggauaauaaaug

SEQ ID NO: 1583295 - RNA, 19 nt, Homo sapiens
caacagauaucaucgugua

SEQ ID NO: 1583296 - RNA, 19 nt, Homo sapiens
aaacaugucugcccucaaa

SEQ ID NO: 1583297 - RNA, 19 nt, Homo sapiens
caaccuaacuggcuuacuu

SEQ ID NO: 1583298 - RNA, 19 nt, Homo sapiens
ggaggacucugaugaacaa

SEQ ID NO: 1583299 - RNA, 19 nt, Homo sapiens
ggaaacccuucaaauaguu

SEQ ID NO: 1583300 - RNA, 19 nt, Homo sapiens
gcacagagaagggaaguuu

SEQ ID NO: 1583301 - RNA, 19 nt, Homo sapiens
acaggaaacccuucaaaua

SEQ ID NO: 1583302 - RNA, 19 nt, Homo sapiens
ucacaggucuauaugagaa

SEQ ID NO: 1583303 - RNA, 19 nt, Homo sapiens
cuaacuggcuuacuuccua

SEQ ID NO: 1583304 - RNA, 19 nt, Homo sapiens
gcagggaacagaacaguga

SEQ ID NO: 1583305 - RNA, 19 nt, Homo sapiens
ggugacauaugcacaguug

SEQ ID NO: 1583306 - RNA, 19 nt, Homo sapiens
ggagagagcgugaccuugu

SEQ ID NO: 1583307 - RNA, 19 nt, Homo sapiens
gaacucacaauuccaaaca

SEQ ID NO: 1583308 - RNA, 19 nt, Homo sapiens
gcccaccucuccaaccuaa

SEQ ID NO: 1583309 - RNA, 19 nt, Homo sapiens
caggaaacccuucaaauag

SEQ ID NO: 1583310 - RNA, 19 nt, Homo sapiens
gagaagggaaguuuaagga

SEQ ID NO: 1583311 - RNA, 19 nt, Homo sapiens
acucacaauuccaaacaua

SEQ ID NO: 1583312 - RNA, 19 nt, Homo sapiens
gaacagggaggacucugau

SEQ ID NO: 1583313 - RNA, 19 nt, Homo sapiens
caucacaggucuauaugag

SEQ ID NO: 1583314 - RNA, 19 nt, Homo sapiens
gcugagcccugauccaaag

SEQ ID NO: 1583315 - RNA, 19 nt, Homo sapiens
gaacauuccaggccgacuu

SEQ ID NO: 1583316 - RNA, 19 nt, Homo sapiens
ggaggaaccuacagaugcu

SEQ ID NO: 1583317 - RNA, 19 nt, Homo sapiens
acagagaagggaaguuuaa

SEQ ID NO: 1583318 - RNA, 19 nt, Homo sapiens
ugacauaugcacaguugaa

SEQ ID NO: 1583319 - RNA, 19 nt, Homo sapiens
gagcccugauccaaaguug

SEQ ID NO: 1583320 - RNA, 19 nt, Homo sapiens
acaccugcauguucugauu

SEQ ID NO: 1583321 - RNA, 19 nt, Homo sapiens
gcagggaccuacagaugcu

SEQ ID NO: 1583322 - RNA, 19 nt, Homo sapiens
ccucuuaacacggcacuua

SEQ ID NO: 1583323 - RNA, 19 nt, Homo sapiens
ggacucugaugaacaagac

SEQ ID NO: 1583324 - RNA, 19 nt, Homo sapiens
uaugacauguaccaucuau

SEQ ID NO: 1583325 - RNA, 19 nt, Homo sapiens
ggugaaaucagaagagaca

SEQ ID NO: 1583326 - RNA, 19 nt, Homo sapiens
gagcuccuaugacauguac

SEQ ID NO: 1583327 - RNA, 19 nt, Homo sapiens
gagagagcgugaccuuguc

SEQ ID NO: 1583328 - RNA, 19 nt, Homo sapiens
ucaaauaguuggccuucac

SEQ ID NO: 1583329 - RNA, 19 nt, Homo sapiens
aggaaacccuucaaauagu

SEQ ID NO: 1583330 - RNA, 19 nt, Homo sapiens
ucacaggaaacccuucaaa

SEQ ID NO: 1583331 - RNA, 19 nt, Homo sapiens
ccuaugacauguaccaucu

SEQ ID NO: 1583332 - RNA, 19 nt, Homo sapiens
agacagucauccugcaaug

SEQ ID NO: 1583333 - RNA, 19 nt, Homo sapiens
ccauacaccugcauguucu

SEQ ID NO: 1583334 - RNA, 19 nt, Homo sapiens
caccuucccucaugcuguu

SEQ ID NO: 1583335 - RNA, 19 nt, Homo sapiens
ccucacaccacaaaucuga

SEQ ID NO: 1583336 - RNA, 19 nt, Homo sapiens
caaggucaacggaacauuc

SEQ ID NO: 1583337 - RNA, 19 nt, Homo sapiens
ucccggagcuccuaugaca

SEQ ID NO: 1583338 - RNA, 19 nt, Homo sapiens
ccacaauucuccauuucac

SEQ ID NO: 1583339 - RNA, 19 nt, Homo sapiens
gaaacccuucaaauaguug

SEQ ID NO: 1583340 - RNA, 19 nt, Homo sapiens
gcaaucacacugaggaacu

SEQ ID NO: 1583341 - RNA, 19 nt, Homo sapiens
acagaugcuucggcucuuu

SEQ ID NO: 1583342 - RNA, 19 nt, Homo sapiens
uggcuuacuuccuagucua

SEQ ID NO: 1583343 - RNA, 19 nt, Homo sapiens
ccacggaggaaccuacaga

SEQ ID NO: 1583344 - RNA, 19 nt, Homo sapiens
caauguuggucagauguca

SEQ ID NO: 1583345 - RNA, 19 nt, Homo sapiens
uuggucagaugucagguuu

SEQ ID NO: 1583346 - RNA, 19 nt, Homo sapiens
acagggaggacucugauga

SEQ ID NO: 1583347 - RNA, 19 nt, Homo sapiens
acagucauccugcaauguu

SEQ ID NO: 1583348 - RNA, 19 nt, Homo sapiens
gaggugacauaugcacagu

SEQ ID NO: 1583349 - RNA, 19 nt, Homo sapiens
cacagagaagggaaguuua

SEQ ID NO: 1583350 - RNA, 19 nt, Homo sapiens
ucacaauuccaaacauaca

SEQ ID NO: 1583351 - RNA, 19 nt, Homo sapiens
acaauucuccauuucacuu

SEQ ID NO: 1583352 - RNA, 19 nt, Homo sapiens
caaaugcugagcccugauc

SEQ ID NO: 1583353 - RNA, 19 nt, Homo sapiens
ggucaucauccucuucauc

SEQ ID NO: 1583354 - RNA, 19 nt, Homo sapiens
caugagggaguccacagaa

SEQ ID NO: 1583355 - RNA, 19 nt, Homo sapiens
cacaggaaacccuucaaau

SEQ ID NO: 1583356 - RNA, 19 nt, Homo sapiens
ggagcuccuaugacaugua

SEQ ID NO: 1583357 - RNA, 19 nt, Homo sapiens
cagggaggacucugaugaa

SEQ ID NO: 1583358 - RNA, 19 nt, Homo sapiens
ugaacagggaggacucuga

SEQ ID NO: 1583359 - RNA, 19 nt, Homo sapiens
caggagagagcgugaccuu

SEQ ID NO: 1583360 - RNA, 19 nt, Homo sapiens
cuacagaugcuacgguucu

SEQ ID NO: 1583361 - RNA, 19 nt, Homo sapiens
cagucauccugcaauguug

SEQ ID NO: 1583362 - RNA, 19 nt, Homo sapiens
gggaggacucugaugaaca

SEQ ID NO: 1583363 - RNA, 19 nt, Homo sapiens
aaaaugcuguuguaaugga

SEQ ID NO: 1583364 - RNA, 19 nt, Homo sapiens
ggacacuuugcgccucauu

SEQ ID NO: 1583365 - RNA, 19 nt, Homo sapiens
gagacagucauccugcaau

SEQ ID NO: 1583366 - RNA, 19 nt, Homo sapiens
ccggagcuccuaugacaug

SEQ ID NO: 1583367 - RNA, 19 nt, Homo sapiens
cccaugagcaccacaguca

SEQ ID NO: 1583368 - RNA, 19 nt, Homo sapiens
cucaggaggugacauaugc

SEQ ID NO: 1583369 - RNA, 19 nt, Homo sapiens
cugcaauguuggucagaug

SEQ ID NO: 1583370 - RNA, 19 nt, Homo sapiens
gugacccacugcuuguuuc

SEQ ID NO: 1583371 - RNA, 19 nt, Homo sapiens
ugacauguaccaucuaucc

SEQ ID NO: 1583372 - RNA, 19 nt, Homo sapiens
augagggaguccacagaaa

SEQ ID NO: 1583373 - RNA, 19 nt, Homo sapiens
cauccuccuccucuucuuu

SEQ ID NO: 1583374 - RNA, 19 nt, Homo sapiens
gaggcugcaaucacacuga

SEQ ID NO: 1583375 - RNA, 19 nt, Homo sapiens
caauucuccauuucacuug

SEQ ID NO: 1583376 - RNA, 19 nt, Homo sapiens
gggaacagaacagugaaca

SEQ ID NO: 1583377 - RNA, 19 nt, Homo sapiens
cuaccaagguggccaagaa

SEQ ID NO: 1583378 - RNA, 19 nt, Homo sapiens
ccagugacccgaagaagaa

SEQ ID NO: 1583379 - RNA, 19 nt, Homo sapiens
ugaauguguugcaaauuga

SEQ ID NO: 1583380 - RNA, 19 nt, Homo sapiens
augaauguguugcaaauug

SEQ ID NO: 1583381 - RNA, 19 nt, Homo sapiens
cgaagaagaagacuaccaa

SEQ ID NO: 1583382 - RNA, 19 nt, Homo sapiens
gaaaggggcugcgacaaag

SEQ ID NO: 1583383 - RNA, 19 nt, Homo sapiens
agaagaagacuaccaaggu

SEQ ID NO: 1583384 - RNA, 19 nt, Homo sapiens
gaauguguugcaaauugaa

SEQ ID NO: 1583385 - RNA, 19 nt, Homo sapiens
ggagagcgagauggaagaa

SEQ ID NO: 1583386 - RNA, 19 nt, Homo sapiens
ggagagccagguggaagaa

SEQ ID NO: 1583387 - RNA, 19 nt, Homo sapiens
uggaagaaccacugaguca

SEQ ID NO: 1583388 - RNA, 19 nt, Homo sapiens
gggagacgcgggaagaaag

SEQ ID NO: 1583389 - RNA, 19 nt, Homo sapiens
gggaaaagcaguucguaga

SEQ ID NO: 1583390 - RNA, 19 nt, Homo sapiens
ggagagccagguggaggaa

SEQ ID NO: 1583391 - RNA, 19 nt, Homo sapiens
ggagagccagguggaggaa

SEQ ID NO: 1583392 - RNA, 19 nt, Homo sapiens
gagggagacgcgggaagaa

SEQ ID NO: 1583393 - RNA, 19 nt, Homo sapiens
acaaagagcuggcugauga

SEQ ID NO: 1583394 - RNA, 19 nt, Homo sapiens
gaugaucaauggacuuuaa

SEQ ID NO: 1583395 - RNA, 19 nt, Homo sapiens
ccaacgagcugguggauga

SEQ ID NO: 1583396 - RNA, 19 nt, Homo sapiens
ggaagagucugccuaugug

SEQ ID NO: 1583397 - RNA, 19 nt, Homo sapiens
cagccaagauguucaugua

SEQ ID NO: 1583398 - RNA, 19 nt, Homo sapiens
caaagagcauggagcugua

SEQ ID NO: 1583399 - RNA, 19 nt, Homo sapiens
ccauagcucuggguucuua

SEQ ID NO: 1583400 - RNA, 19 nt, Homo sapiens
ccaagauguucauguagua

SEQ ID NO: 1583401 - RNA, 19 nt, Homo sapiens
gcugguggaugaucucuuu

SEQ ID NO: 1583402 - RNA, 19 nt, Homo sapiens
aaucagagccuaccacaaa

SEQ ID NO: 1583403 - RNA, 19 nt, Homo sapiens
gaagacauugugaccauuu

SEQ ID NO: 1583404 - RNA, 19 nt, Homo sapiens
gaucaauggacuuuaauga

SEQ ID NO: 1583405 - RNA, 19 nt, Homo sapiens
gaucuugguuggacguuug

SEQ ID NO: 1583406 - RNA, 19 nt, Homo sapiens
ggaggcuggugcagaaauu

SEQ ID NO: 1583407 - RNA, 19 nt, Homo sapiens
ccacaaacauccaaauucg

SEQ ID NO: 1583408 - RNA, 19 nt, Homo sapiens
agccagcucuuccaucuua

SEQ ID NO: 1583409 - RNA, 19 nt, Homo sapiens
gguggaugaucucuuuaaa

SEQ ID NO: 1583410 - RNA, 19 nt, Homo sapiens
ggacaggugaacuuggaua

SEQ ID NO: 1583411 - RNA, 19 nt, Homo sapiens
gaagccaaccugcucaaug

SEQ ID NO: 1583412 - RNA, 19 nt, Homo sapiens
gaaguggacagcagauugu

SEQ ID NO: 1583413 - RNA, 19 nt, Homo sapiens
gaacaaagagcuggcugau

SEQ ID NO: 1583414 - RNA, 19 nt, Homo sapiens
ggacgaggacuuugugaag

SEQ ID NO: 1583415 - RNA, 19 nt, Homo sapiens
gauaauggagaacucagaa

SEQ ID NO: 1583416 - RNA, 19 nt, Homo sapiens
uggaugaucucuuuaaagg

SEQ ID NO: 1583417 - RNA, 19 nt, Homo sapiens
gccaagauguucauguagu

SEQ ID NO: 1583418 - RNA, 19 nt, Homo sapiens
ggauucagccuggauaaug

SEQ ID NO: 1583419 - RNA, 19 nt, Homo sapiens
ugaccaagaugaagaugag

SEQ ID NO: 1583420 - RNA, 19 nt, Homo sapiens
ugacuacuuucccgaacaa

SEQ ID NO: 1583421 - RNA, 19 nt, Homo sapiens
gcucuuccaucuuaaucga

SEQ ID NO: 1583422 - RNA, 19 nt, Homo sapiens
caggugaacuuggauaugg

SEQ ID NO: 1583423 - RNA, 19 nt, Homo sapiens
guggacaggugaacuugga

SEQ ID NO: 1583424 - RNA, 19 nt, Homo sapiens
gcucuggguucuuagaucu

SEQ ID NO: 1583425 - RNA, 19 nt, Homo sapiens
aaagccagcucuuccaucu

SEQ ID NO: 1583426 - RNA, 19 nt, Homo sapiens
gauucagccuggauaaugg

SEQ ID NO: 1583427 - RNA, 19 nt, Homo sapiens
guauugaaacucuggaaga

SEQ ID NO: 1583428 - RNA, 19 nt, Homo sapiens
gugcaacgucuccuccaua

SEQ ID NO: 1583429 - RNA, 19 nt, Homo sapiens
uggccucccuccuguguuu

SEQ ID NO: 1583430 - RNA, 19 nt, Homo sapiens
caucuuaaucgacgaauca

SEQ ID NO: 1583431 - RNA, 19 nt, Homo sapiens
gaggaagagucugccuaug

SEQ ID NO: 1583432 - RNA, 19 nt, Homo sapiens
cagccuggauaauggagaa

SEQ ID NO: 1583433 - RNA, 19 nt, Homo sapiens
caguaaaccgagaccauuu

SEQ ID NO: 1583434 - RNA, 19 nt, Homo sapiens
ccaguaaaccgagaccauu

SEQ ID NO: 1583435 - RNA, 19 nt, Homo sapiens
cauguaguauugaaacucu

SEQ ID NO: 1583436 - RNA, 19 nt, Homo sapiens
agauguucauguaguauug

SEQ ID NO: 1583437 - RNA, 19 nt, Homo sapiens
gggcagcaccagaggaaga

SEQ ID NO: 1583438 - RNA, 19 nt, Homo sapiens
caacgucuccuccauagcu

SEQ ID NO: 1583439 - RNA, 19 nt, Homo sapiens
gauaauagagugacauccu

SEQ ID NO: 1583440 - RNA, 19 nt, Homo sapiens
auaauagagugacauccuu

SEQ ID NO: 1583441 - RNA, 19 nt, Homo sapiens
ggauaauggagaacucaga

SEQ ID NO: 1583442 - RNA, 19 nt, Homo sapiens
agaugaagaugaggaggaa

SEQ ID NO: 1583443 - RNA, 19 nt, Homo sapiens
ugaagacauugugaccauu

SEQ ID NO: 1583444 - RNA, 19 nt, Homo sapiens
gagaaaagaggcagcauuc

SEQ ID NO: 1583445 - RNA, 19 nt, Homo sapiens
ggaggugccagcagagcuu

SEQ ID NO: 1583446 - RNA, 19 nt, Homo sapiens
agaaguggacagcagauug

SEQ ID NO: 1583447 - RNA, 19 nt, Homo sapiens
gagaaguggacagcagauu

SEQ ID NO: 1583448 - RNA, 19 nt, Homo sapiens
uaccacaaacauccaaauu

SEQ ID NO: 1583449 - RNA, 19 nt, Homo sapiens
uaccaagacccauccaaug

SEQ ID NO: 1583450 - RNA, 19 nt, Homo sapiens
cccauccaaugcccaguuu

SEQ ID NO: 1583451 - RNA, 19 nt, Homo sapiens
auggagaacucagaagcua

SEQ ID NO: 1583452 - RNA, 19 nt, Homo sapiens
gcuuuauccucaugacuac

SEQ ID NO: 1583453 - RNA, 19 nt, Homo sapiens
ggcagaaaaugaagccaaa

SEQ ID NO: 1583454 - RNA, 19 nt, Homo sapiens
aggaagagucugccuaugu

SEQ ID NO: 1583455 - RNA, 19 nt, Homo sapiens
cgacauccgacucuucauc

SEQ ID NO: 1583456 - RNA, 19 nt, Homo sapiens
gaaucagagccuaccacaa

SEQ ID NO: 1583457 - RNA, 19 nt, Homo sapiens
gacaggugaacuuggauau

SEQ ID NO: 1583458 - RNA, 19 nt, Homo sapiens
uagagugacauccuucaga

SEQ ID NO: 1583459 - RNA, 19 nt, Homo sapiens
gacguuuguuuucuccuua

SEQ ID NO: 1583460 - RNA, 19 nt, Homo sapiens
ggacguuuguuuucuccuu

SEQ ID NO: 1583461 - RNA, 19 nt, Homo sapiens
caccagcuuuauccucaug

SEQ ID NO: 1583462 - RNA, 19 nt, Homo sapiens
gaggaaggccagagguuuu

SEQ ID NO: 1583463 - RNA, 19 nt, Homo sapiens
gggacgaggacuuugugaa

SEQ ID NO: 1583464 - RNA, 19 nt, Homo sapiens
cuaccaagacccauccaau

SEQ ID NO: 1583465 - RNA, 19 nt, Homo sapiens
gaaaagaggcagcauucca

SEQ ID NO: 1583466 - RNA, 19 nt, Homo sapiens
agaggaaggccagagguuu

SEQ ID NO: 1583467 - RNA, 19 nt, Homo sapiens
ugcaacgucuccuccauag

SEQ ID NO: 1583468 - RNA, 19 nt, Homo sapiens
gagccagacccugaaggaa

SEQ ID NO: 1583469 - RNA, 19 nt, Homo sapiens
caagauguucauguaguau

SEQ ID NO: 1583470 - RNA, 19 nt, Homo sapiens
agaggaagagucugccuau

SEQ ID NO: 1583471 - RNA, 19 nt, Homo sapiens
ucgugcagcgguuaacaua

SEQ ID NO: 1583472 - RNA, 19 nt, Homo sapiens
gcauuccagccaagauguu

SEQ ID NO: 1583473 - RNA, 19 nt, Homo sapiens
ggagaaaagaggcagcauu

SEQ ID NO: 1583474 - RNA, 19 nt, Homo sapiens
aggaggcgcugagggaguu

SEQ ID NO: 1583475 - RNA, 19 nt, Homo sapiens
aggcuggugcagaaauuua

SEQ ID NO: 1583476 - RNA, 19 nt, Homo sapiens
cagcauuccagccaagaug

SEQ ID NO: 1583477 - RNA, 19 nt, Homo sapiens
uaaaggugccaaagagcau

SEQ ID NO: 1583478 - RNA, 19 nt, Homo sapiens
ggaagccaaccugcucaau

SEQ ID NO: 1583479 - RNA, 19 nt, Homo sapiens
augaagacauugugaccau

SEQ ID NO: 1583480 - RNA, 19 nt, Homo sapiens
ggcuggugcagaaauuuaa

SEQ ID NO: 1583481 - RNA, 19 nt, Homo sapiens
gaggcuggugcagaaauuu

SEQ ID NO: 1583482 - RNA, 19 nt, Homo sapiens
cggaggggaugaagacauu

SEQ ID NO: 1583483 - RNA, 19 nt, Homo sapiens
cuucagagaccucauucau

SEQ ID NO: 1583484 - RNA, 19 nt, Homo sapiens
ggaaagaggauggcuauuu

SEQ ID NO: 1583485 - RNA, 19 nt, Homo sapiens
gaugaugucuuguccaaug

SEQ ID NO: 1583486 - RNA, 19 nt, Homo sapiens
gaagccaaguggaaagauu

SEQ ID NO: 1583487 - RNA, 19 nt, Homo sapiens
gagcaagguuaaccauuug

SEQ ID NO: 1583488 - RNA, 19 nt, Homo sapiens
cagaauaaguggacugaau

SEQ ID NO: 1583489 - RNA, 19 nt, Homo sapiens
agagcaagguuaaccauuu

SEQ ID NO: 1583490 - RNA, 19 nt, Homo sapiens
gcagcuaaauaaaugaaug

SEQ ID NO: 1583491 - RNA, 19 nt, Homo sapiens
gcuuaugucuuuaaucuca

SEQ ID NO: 1583492 - RNA, 19 nt, Homo sapiens
gaauaaguggacugaauaa

SEQ ID NO: 1583493 - RNA, 19 nt, Homo sapiens
uacaugagcagcuaaauaa

SEQ ID NO: 1583494 - RNA, 19 nt, Homo sapiens
gaggaagaauacaaggaaa

SEQ ID NO: 1583495 - RNA, 19 nt, Homo sapiens
uaaguggacugaauaaagg

SEQ ID NO: 1583496 - RNA, 19 nt, Homo sapiens
ccacuuacaugagcagcua

SEQ ID NO: 1583497 - RNA, 19 nt, Homo sapiens
ucuauugucucuuucugua

SEQ ID NO: 1583498 - RNA, 19 nt, Homo sapiens
gaaugucugugugugugua

SEQ ID NO: 1583499 - RNA, 19 nt, Homo sapiens
agaccaaccuggauaauac

SEQ ID NO: 1583500 - RNA, 19 nt, Homo sapiens
agaauaaguggacugaaua

SEQ ID NO: 1583501 - RNA, 19 nt, Homo sapiens
uaagcaacgaugaguguua

SEQ ID NO: 1583502 - RNA, 19 nt, Homo sapiens
caggcaagauggcuuaugu

SEQ ID NO: 1583503 - RNA, 19 nt, Homo sapiens
guuaggcuguuuauucaga

SEQ ID NO: 1583504 - RNA, 19 nt, Homo sapiens
uuacaugagcagcuaaaua

SEQ ID NO: 1583505 - RNA, 19 nt, Homo sapiens
guguuaggcuguuuauuca

SEQ ID NO: 1583506 - RNA, 19 nt, Homo sapiens
uaagugaauugguaugucu

SEQ ID NO: 1583507 - RNA, 19 nt, Homo sapiens
auaaaggaaugaugcguau

SEQ ID NO: 1583508 - RNA, 19 nt, Homo sapiens
auacuaggcuucuauuguc

SEQ ID NO: 1583509 - RNA, 19 nt, Homo sapiens
aggcuucuauugucucuuu

SEQ ID NO: 1583510 - RNA, 19 nt, Homo sapiens
gccaggaguucaagaccaa

SEQ ID NO: 1583511 - RNA, 19 nt, Homo sapiens
uggcuuaugucuuuaaucu

SEQ ID NO: 1583512 - RNA, 19 nt, Homo sapiens
gcuauuucauccacuaaag

SEQ ID NO: 1583513 - RNA, 19 nt, Homo sapiens
ucuuuaaucucagcuguuu

SEQ ID NO: 1583514 - RNA, 19 nt, Homo sapiens
guguguaccugagauaaga

SEQ ID NO: 1583515 - RNA, 19 nt, Homo sapiens
gcgaguagaggaagaauac

SEQ ID NO: 1583516 - RNA, 19 nt, Homo sapiens
gcagaagcgaguagaggaa

SEQ ID NO: 1583517 - RNA, 19 nt, Homo sapiens
gaugaguguuaggcuguuu

SEQ ID NO: 1583518 - RNA, 19 nt, Homo sapiens
ggacugaauaaaggaauga

SEQ ID NO: 1583519 - RNA, 19 nt, Homo sapiens
gagcagcuaaauaaaugaa

SEQ ID NO: 1583520 - RNA, 19 nt, Homo sapiens
augagcagcuaaauaaaug

SEQ ID NO: 1583521 - RNA, 19 nt, Homo sapiens
gaguagaggaagaauacaa

SEQ ID NO: 1583522 - RNA, 19 nt, Homo sapiens
caugagcagcuaaauaaau

SEQ ID NO: 1583523 - RNA, 19 nt, Homo sapiens
ucaagaccaaccuggauaa

SEQ ID NO: 1583524 - RNA, 19 nt, Homo sapiens
gagagcaagguuaaccauu

SEQ ID NO: 1583525 - RNA, 19 nt, Homo sapiens
gacuguauguggagagcaa

SEQ ID NO: 1583526 - RNA, 19 nt, Homo sapiens
gaagcgaguagaggaagaa

SEQ ID NO: 1583527 - RNA, 19 nt, Homo sapiens
ccacuaaagguguacacuu

SEQ ID NO: 1583528 - RNA, 19 nt, Homo sapiens
gauggcuuaugucuuuaau

SEQ ID NO: 1583529 - RNA, 19 nt, Homo sapiens
ggagugaaugucugugugu

SEQ ID NO: 1583530 - RNA, 19 nt, Homo sapiens
agaggaagaauacaaggaa

SEQ ID NO: 1583531 - RNA, 19 nt, Homo sapiens
aaacauggccaggcaagau

SEQ ID NO: 1583532 - RNA, 19 nt, Homo sapiens
gagagaauugggccugaug

SEQ ID NO: 1583533 - RNA, 19 nt, Homo sapiens
gaaacauggccaggcaaga

SEQ ID NO: 1583534 - RNA, 19 nt, Homo sapiens
guggaaagaggauggcuau

SEQ ID NO: 1583535 - RNA, 19 nt, Homo sapiens
gccugaugcugaaggagaa

SEQ ID NO: 1583536 - RNA, 19 nt, Homo sapiens
uaccugagauaagaugaug

SEQ ID NO: 1583537 - RNA, 19 nt, Homo sapiens
cugcaugagugaauaagca

SEQ ID NO: 1583538 - RNA, 19 nt, Homo sapiens
gcaccugaagcuuguuuua

SEQ ID NO: 1583539 - RNA, 19 nt, Homo sapiens
aagaccaaccuggauaaua

SEQ ID NO: 1583540 - RNA, 19 nt, Homo sapiens
aguguuaggcuguuuauuc

SEQ ID NO: 1583541 - RNA, 19 nt, Homo sapiens
aagcaacgaugaguguuag

SEQ ID NO: 1583542 - RNA, 19 nt, Homo sapiens
uaggcuguuuauucagaua

SEQ ID NO: 1583543 - RNA, 19 nt, Homo sapiens
auaaguggacugaauaaag

SEQ ID NO: 1583544 - RNA, 19 nt, Homo sapiens
gaggagugaaugucugugu

SEQ ID NO: 1583545 - RNA, 19 nt, Homo sapiens
gcaagguuaaccauuugug

SEQ ID NO: 1583546 - RNA, 19 nt, Homo sapiens
ggagagcaagguuaaccau

SEQ ID NO: 1583547 - RNA, 19 nt, Homo sapiens
gaagcuuguuuuaguuuuc

SEQ ID NO: 1583548 - RNA, 19 nt, Homo sapiens
caaugcugguuuccaccuu

SEQ ID NO: 1583549 - RNA, 19 nt, Homo sapiens
cugggcagcuuuccugauc

SEQ ID NO: 1583550 - RNA, 19 nt, Homo sapiens
aauaagcaacgaugagugu

SEQ ID NO: 1583551 - RNA, 19 nt, Homo sapiens
agaagcgaguagaggaaga

SEQ ID NO: 1583552 - RNA, 19 nt, Homo sapiens
gggcagcuuuccugaucca

SEQ ID NO: 1583553 - RNA, 19 nt, Homo sapiens
uauguggagagcaagguua

SEQ ID NO: 1583554 - RNA, 19 nt, Homo sapiens
ccaaguggaaagauugcuu

SEQ ID NO: 1583555 - RNA, 19 nt, Homo sapiens
gggaagccaaguggaaaga

SEQ ID NO: 1583556 - RNA, 19 nt, Homo sapiens
ugaauaagcaacgaugagu

SEQ ID NO: 1583557 - RNA, 19 nt, Homo sapiens
ggcaagauggcuuaugucu

SEQ ID NO: 1583558 - RNA, 19 nt, Homo sapiens
guucaagaccaaccuggau

SEQ ID NO: 1583559 - RNA, 19 nt, Homo sapiens
ugacccugaagcagaauaa

SEQ ID NO: 1583560 - RNA, 19 nt, Homo sapiens
aauugggccugaugcugaa

SEQ ID NO: 1583561 - RNA, 19 nt, Homo sapiens
gcacaaaucuccacugaug

SEQ ID NO: 1583562 - RNA, 19 nt, Homo sapiens
ggaccgaccugaccaaauu

SEQ ID NO: 1583563 - RNA, 19 nt, Homo sapiens
gggaagagauuauagcaaa

SEQ ID NO: 1583564 - RNA, 19 nt, Homo sapiens
ggagugguaugacaaauau

SEQ ID NO: 1583565 - RNA, 19 nt, Homo sapiens
gcaucuuucuggauaauuu

SEQ ID NO: 1583566 - RNA, 19 nt, Homo sapiens
gcgaagaaauggcaucaau

SEQ ID NO: 1583567 - RNA, 19 nt, Homo sapiens
gaucauugcugccacuguu

SEQ ID NO: 1583568 - RNA, 19 nt, Homo sapiens
acacugaucuggagaacaa

SEQ ID NO: 1583569 - RNA, 19 nt, Homo sapiens
ggacacaagcgaagaaaug

SEQ ID NO: 1583570 - RNA, 19 nt, Homo sapiens
ggugaaaguuaaauaagga

SEQ ID NO: 1583571 - RNA, 19 nt, Homo sapiens
ggacgagauucaagcaaga

SEQ ID NO: 1583572 - RNA, 19 nt, Homo sapiens
cuaggcaucuuucuggaua

SEQ ID NO: 1583573 - RNA, 19 nt, Homo sapiens
gaagaaauggcaucaaucu

SEQ ID NO: 1583574 - RNA, 19 nt, Homo sapiens
gcagagcgcaucacuacaa

SEQ ID NO: 1583575 - RNA, 19 nt, Homo sapiens
ggaggugaccguagaaaug

SEQ ID NO: 1583576 - RNA, 19 nt, Homo sapiens
ggaagagauuauagcaaau

SEQ ID NO: 1583577 - RNA, 19 nt, Homo sapiens
gaaauucaaacgcagauca

SEQ ID NO: 1583578 - RNA, 19 nt, Homo sapiens
gaggaggaaaugaagaaua

SEQ ID NO: 1583579 - RNA, 19 nt, Homo sapiens
gaacuuccagaucaacaaa

SEQ ID NO: 1583580 - RNA, 19 nt, Homo sapiens
gcaagguugucucgucuca

SEQ ID NO: 1583581 - RNA, 19 nt, Homo sapiens
gaacgcagaguacaagcaa

SEQ ID NO: 1583582 - RNA, 19 nt, Homo sapiens
ccaaauuacugaaugacau

SEQ ID NO: 1583583 - RNA, 19 nt, Homo sapiens
gcucagcugucagaaauuc

SEQ ID NO: 1583584 - RNA, 19 nt, Homo sapiens
ugaccaaauuacugaauga

SEQ ID NO: 1583585 - RNA, 19 nt, Homo sapiens
aggaggaaaugaagaauau

SEQ ID NO: 1583586 - RNA, 19 nt, Homo sapiens
agaugcagauugagaguuu

SEQ ID NO: 1583587 - RNA, 19 nt, Homo sapiens
gcucugaccuggagaugca

SEQ ID NO: 1583588 - RNA, 19 nt, Homo sapiens
ggaggaggcuaacacugau

SEQ ID NO: 1583589 - RNA, 19 nt, Homo sapiens
aagcacaaaucuccacuga

SEQ ID NO: 1583590 - RNA, 19 nt, Homo sapiens
gaaggacacaagcgaagaa

SEQ ID NO: 1583591 - RNA, 19 nt, Homo sapiens
gcaagacuagagugacuaa

SEQ ID NO: 1583592 - RNA, 19 nt, Homo sapiens
ugacuaagacuaucguaga

SEQ ID NO: 1583593 - RNA, 19 nt, Homo sapiens
gucaucaccucuccuauuc

SEQ ID NO: 1583594 - RNA, 19 nt, Homo sapiens
ucucaagucagcaguauuu

SEQ ID NO: 1583595 - RNA, 19 nt, Homo sapiens
uggcucagcugucagaaau

SEQ ID NO: 1583596 - RNA, 19 nt, Homo sapiens
ugcaagcccuggaaauuga

SEQ ID NO: 1583597 - RNA, 19 nt, Homo sapiens
gaggugaccguagaaauga

SEQ ID NO: 1583598 - RNA, 19 nt, Homo sapiens
agaaauggcaucaaucuag

SEQ ID NO: 1583599 - RNA, 19 nt, Homo sapiens
gguagaaacucaggaucug

SEQ ID NO: 1583600 - RNA, 19 nt, Homo sapiens
ccaagaaugagauaacaga

SEQ ID NO: 1583601 - RNA, 19 nt, Homo sapiens
gcaggagcaccaugucuug

SEQ ID NO: 1583602 - RNA, 19 nt, Homo sapiens
gaccugaccaaauuacuga

SEQ ID NO: 1583603 - RNA, 19 nt, Homo sapiens
ggaaaugaagaauaugcaa

SEQ ID NO: 1583604 - RNA, 19 nt, Homo sapiens
cuacguggcucagcuguca

SEQ ID NO: 1583605 - RNA, 19 nt, Homo sapiens
gaagaaccacgaggaggaa

SEQ ID NO: 1583606 - RNA, 19 nt, Homo sapiens
ucugguaucuggugacuca

SEQ ID NO: 1583607 - RNA, 19 nt, Homo sapiens
uagccuaccugaggaagaa

SEQ ID NO: 1583608 - RNA, 19 nt, Homo sapiens
cguggaggcugacaucaau

SEQ ID NO: 1583609 - RNA, 19 nt, Homo sapiens
aagcuucaguccagaaaug

SEQ ID NO: 1583610 - RNA, 19 nt, Homo sapiens
agaaugagauaacagaacu

SEQ ID NO: 1583611 - RNA, 19 nt, Homo sapiens
gguaucuggugacucaaga

SEQ ID NO: 1583612 - RNA, 19 nt, Homo sapiens
cucaggaucuguaaacaug

SEQ ID NO: 1583613 - RNA, 19 nt, Homo sapiens
guugguggauggcaagguu

SEQ ID NO: 1583614 - RNA, 19 nt, Homo sapiens
uagaaacucaggaucugua

SEQ ID NO: 1583615 - RNA, 19 nt, Homo sapiens
gaaccacgaggaggaaaug

SEQ ID NO: 1583616 - RNA, 19 nt, Homo sapiens
ggaggugguucuaguuuug

SEQ ID NO: 1583617 - RNA, 19 nt, Homo sapiens
uuugguagcugcucaguag

SEQ ID NO: 1583618 - RNA, 19 nt, Homo sapiens
ucaauggccugcggaaagu

SEQ ID NO: 1583619 - RNA, 19 nt, Homo sapiens
cagauuggcugcugaugac

SEQ ID NO: 1583620 - RNA, 19 nt, Homo sapiens
ccagauuggcugcugauga

SEQ ID NO: 1583621 - RNA, 19 nt, Homo sapiens
caaggagugguaugacaaa

SEQ ID NO: 1583622 - RNA, 19 nt, Homo sapiens
gaaacucaggaucuguaaa

SEQ ID NO: 1583623 - RNA, 19 nt, Homo sapiens
caagucagcaguauuucug

SEQ ID NO: 1583624 - RNA, 19 nt, Homo sapiens
caaauuacugaaugacaug

SEQ ID NO: 1583625 - RNA, 19 nt, Homo sapiens
cgucaucaccucuccuauu

SEQ ID NO: 1583626 - RNA, 19 nt, Homo sapiens
agaaugcucuugaaauagc

SEQ ID NO: 1583627 - RNA, 19 nt, Homo sapiens
ggagagggaggugguucua

SEQ ID NO: 1583628 - RNA, 19 nt, Homo sapiens
uggaggaggcuaacacuga

SEQ ID NO: 1583629 - RNA, 19 nt, Homo sapiens
gcaucaaucuaggcaucuu

SEQ ID NO: 1583630 - RNA, 19 nt, Homo sapiens
gacuaagacuaucguagag

SEQ ID NO: 1583631 - RNA, 19 nt, Homo sapiens
gaccgaccugaccaaauua

SEQ ID NO: 1583632 - RNA, 19 nt, Homo sapiens
aaugaccgcuuggccaauu

SEQ ID NO: 1583633 - RNA, 19 nt, Homo sapiens
gaggugaaaguuaaauaag

SEQ ID NO: 1583634 - RNA, 19 nt, Homo sapiens
gagauucaagcaagacuag

SEQ ID NO: 1583635 - RNA, 19 nt, Homo sapiens
agagggaggugguucuagu

SEQ ID NO: 1583636 - RNA, 19 nt, Homo sapiens
caagaaugagauaacagaa

SEQ ID NO: 1583637 - RNA, 19 nt, Homo sapiens
uggacaagcucauguuugc

SEQ ID NO: 1583638 - RNA, 19 nt, Homo sapiens
ugugggaguucuagauuca

SEQ ID NO: 1583639 - RNA, 19 nt, Homo sapiens
cuucuuauuuccucauuag

SEQ ID NO: 1583640 - RNA, 19 nt, Homo sapiens
cagcuaugguggugguaug

SEQ ID NO: 1583641 - RNA, 19 nt, Homo sapiens
aagcuguucuggucaagga

SEQ ID NO: 1583642 - RNA, 19 nt, Homo sapiens
gaaugagauaacagaacua

SEQ ID NO: 1583643 - RNA, 19 nt, Homo sapiens
gagcgcaucacuacaagca

SEQ ID NO: 1583644 - RNA, 19 nt, Homo sapiens
cuggaugaccugacuauga

SEQ ID NO: 1583645 - RNA, 19 nt, Homo sapiens
ccaugcagaaccucaauga

SEQ ID NO: 1583646 - RNA, 19 nt, Homo sapiens
ggaggcuucuacagcuaug

SEQ ID NO: 1583647 - RNA, 19 nt, Homo sapiens
cuagagugacuaagacuau

SEQ ID NO: 1583648 - RNA, 19 nt, Homo sapiens
ucaagcaagacuagaguga

SEQ ID NO: 1583649 - RNA, 19 nt, Homo sapiens
gaacccuggcugacacaga

SEQ ID NO: 1583650 - RNA, 19 nt, Homo sapiens
aacccuggcugacacagaa

SEQ ID NO: 1583651 - RNA, 19 nt, Homo sapiens
aagcagagcgcaucacuac

SEQ ID NO: 1583652 - RNA, 19 nt, Homo sapiens
caacaagcagagcgcauca

SEQ ID NO: 1583653 - RNA, 19 nt, Homo sapiens
ggucaaggacgagauucaa

SEQ ID NO: 1583654 - RNA, 19 nt, Homo sapiens
gaucgggaagagauuauag

SEQ ID NO: 1583655 - RNA, 19 nt, Homo sapiens
ccgcuuggccaauuaccua

SEQ ID NO: 1583656 - RNA, 19 nt, Homo sapiens
agacuagagugacuaagac

SEQ ID NO: 1583657 - RNA, 19 nt, Homo sapiens
agaauuuggugguagaaac

SEQ ID NO: 1583658 - RNA, 19 nt, Homo sapiens
gagggaggugguucuaguu

SEQ ID NO: 1583659 - RNA, 19 nt, Homo sapiens
gaggaaaugaagaauaugc

SEQ ID NO: 1583660 - RNA, 19 nt, Homo sapiens
ggaucgggaagagauuaua

SEQ ID NO: 1583661 - RNA, 19 nt, Homo sapiens
gaggauggauggcaaauaa

SEQ ID NO: 1583662 - RNA, 19 nt, Homo sapiens
caacaacccugcaaauaga

SEQ ID NO: 1583663 - RNA, 19 nt, Homo sapiens
gaaagaaucgggacaggaa

SEQ ID NO: 1583664 - RNA, 19 nt, Homo sapiens
gagccgagaucauugcauu

SEQ ID NO: 1583665 - RNA, 19 nt, Homo sapiens
ggauggauggcaaauaaua

SEQ ID NO: 1583666 - RNA, 19 nt, Homo sapiens
gcagugagccgagaucauu

SEQ ID NO: 1583667 - RNA, 19 nt, Homo sapiens
gcauugcacuccagcuuga

SEQ ID NO: 1583668 - RNA, 19 nt, Homo sapiens
agaauuagguaacuuguuc

SEQ ID NO: 1583669 - RNA, 19 nt, Homo sapiens
ggacccagguguuccucua

SEQ ID NO: 1583670 - RNA, 19 nt, Homo sapiens
gggaguaggugggcgcaua

SEQ ID NO: 1583671 - RNA, 19 nt, Homo sapiens
gcacgagaaucgcuugagu

SEQ ID NO: 1583672 - RNA, 19 nt, Homo sapiens
cgacugaaggguuaauuaa

SEQ ID NO: 1583673 - RNA, 19 nt, Homo sapiens
gaaccuggaggcagagauu

SEQ ID NO: 1583674 - RNA, 19 nt, Homo sapiens
ccaacaacccugcaaauag

SEQ ID NO: 1583675 - RNA, 19 nt, Homo sapiens
guagaucacuugaggucau

SEQ ID NO: 1583676 - RNA, 19 nt, Homo sapiens
cgaggaagguagaucacuu

SEQ ID NO: 1583677 - RNA, 19 nt, Homo sapiens
gcacccguauucccagcua

SEQ ID NO: 1583678 - RNA, 19 nt, Homo sapiens
cuacugcacuugacuaguc

SEQ ID NO: 1583679 - RNA, 19 nt, Homo sapiens
gagcuuguccucagagaau

SEQ ID NO: 1583680 - RNA, 19 nt, Homo sapiens
cagauuaauugaacaccuu

SEQ ID NO: 1583681 - RNA, 19 nt, Homo sapiens
acugaaggguuaauuaaug

SEQ ID NO: 1583682 - RNA, 19 nt, Homo sapiens
gcgacugaaggguuaauua

SEQ ID NO: 1583683 - RNA, 19 nt, Homo sapiens
ggucagaagcaacagauau

SEQ ID NO: 1583684 - RNA, 19 nt, Homo sapiens
cugaaggguuaauuaauga

SEQ ID NO: 1583685 - RNA, 19 nt, Homo sapiens
gcagaacgcacccauaacu

SEQ ID NO: 1583686 - RNA, 19 nt, Homo sapiens
gauauaacuccuugcucua

SEQ ID NO: 1583687 - RNA, 19 nt, Homo sapiens
gucagaagcaacagauaua

SEQ ID NO: 1583688 - RNA, 19 nt, Homo sapiens
gagaggagaaauacucgaa

SEQ ID NO: 1583689 - RNA, 19 nt, Homo sapiens
acacucaugaugucacuua

SEQ ID NO: 1583690 - RNA, 19 nt, Homo sapiens
gauugcagauuaauugaac

SEQ ID NO: 1583691 - RNA, 19 nt, Homo sapiens
uggcagaacgcacccauaa

SEQ ID NO: 1583692 - RNA, 19 nt, Homo sapiens
gaaaccccaucgcuacuaa

SEQ ID NO: 1583693 - RNA, 19 nt, Homo sapiens
cagacuggauguuaagcaa

SEQ ID NO: 1583694 - RNA, 19 nt, Homo sapiens
uugaacaccuuccguaauc

SEQ ID NO: 1583695 - RNA, 19 nt, Homo sapiens
ggaggauggauggcaaaua

SEQ ID NO: 1583696 - RNA, 19 nt, Homo sapiens
gaggaagguagaucacuug

SEQ ID NO: 1583697 - RNA, 19 nt, Homo sapiens
acugguagaucuucacaga

SEQ ID NO: 1583698 - RNA, 19 nt, Homo sapiens
gaucguggccacugcaauc

SEQ ID NO: 1583699 - RNA, 19 nt, Homo sapiens
guguaacagugacccguuu

SEQ ID NO: 1583700 - RNA, 19 nt, Homo sapiens
acuccuugcucuacucuuu

SEQ ID NO: 1583701 - RNA, 19 nt, Homo sapiens
cucaugaugucacuuauuc

SEQ ID NO: 1583702 - RNA, 19 nt, Homo sapiens
cuucacagacuggauguua

SEQ ID NO: 1583703 - RNA, 19 nt, Homo sapiens
gagaauuagguaacuuguu

SEQ ID NO: 1583704 - RNA, 19 nt, Homo sapiens
gagcagaaucggcuuaagg

SEQ ID NO: 1583705 - RNA, 19 nt, Homo sapiens
cacuugaggucaugaguuc

SEQ ID NO: 1583706 - RNA, 19 nt, Homo sapiens
cccaacaacccugcaaaua

SEQ ID NO: 1583707 - RNA, 19 nt, Homo sapiens
ucagaagcaacagauauaa

SEQ ID NO: 1583708 - RNA, 19 nt, Homo sapiens
auaacugucucucccauuc

SEQ ID NO: 1583709 - RNA, 19 nt, Homo sapiens
gacuggauguuaagcaagu

SEQ ID NO: 1583710 - RNA, 19 nt, Homo sapiens
ucagagaauuagguaacuu

SEQ ID NO: 1583711 - RNA, 19 nt, Homo sapiens
caacccugcaaauagauaa

SEQ ID NO: 1583712 - RNA, 19 nt, Homo sapiens
gaccagccuuggccaacau

SEQ ID NO: 1583713 - RNA, 19 nt, Homo sapiens
uguccguccugcucuuuaa

SEQ ID NO: 1583714 - RNA, 19 nt, Homo sapiens
ccagaacccggguguaaca

SEQ ID NO: 1583715 - RNA, 19 nt, Homo sapiens
cagagaauuagguaacuug

SEQ ID NO: 1583716 - RNA, 19 nt, Homo sapiens
agaacgcacccauaacuug

SEQ ID NO: 1583717 - RNA, 19 nt, Homo sapiens
ccuguaaucccagcacuuu

SEQ ID NO: 1583718 - RNA, 19 nt, Homo sapiens
ccuguaaucccagcacuuu

SEQ ID NO: 1583719 - RNA, 19 nt, Homo sapiens
gauaacugucucucccauu

SEQ ID NO: 1583720 - RNA, 19 nt, Homo sapiens
accagcgacugaaggguua

SEQ ID NO: 1583721 - RNA, 19 nt, Homo sapiens
agaccagccugaccaacau

SEQ ID NO: 1583722 - RNA, 19 nt, Homo sapiens
gcuuguccucagagaauua

SEQ ID NO: 1583723 - RNA, 19 nt, Homo sapiens
gacugaaggguuaauuaau

SEQ ID NO: 1583724 - RNA, 19 nt, Homo sapiens
gauguuaagcaaguggaaa

SEQ ID NO: 1583725 - RNA, 19 nt, Homo sapiens
caacagagggacacuucgu

SEQ ID NO: 1583726 - RNA, 19 nt, Homo sapiens
ucacuacugcacuugacua

SEQ ID NO: 1583727 - RNA, 19 nt, Homo sapiens
ggcacacacucaugauguc

SEQ ID NO: 1583728 - RNA, 19 nt, Homo sapiens
gcaggaaaaucgcuugaac

SEQ ID NO: 1583729 - RNA, 19 nt, Homo sapiens
gaagcaacagauauaacuc

SEQ ID NO: 1583730 - RNA, 19 nt, Homo sapiens
ugguagaucuucacagacu

SEQ ID NO: 1583731 - RNA, 19 nt, Homo sapiens
ucacuuauuccucccaaca

SEQ ID NO: 1583732 - RNA, 19 nt, Homo sapiens
gcacacacucaugauguca

SEQ ID NO: 1583733 - RNA, 19 nt, Homo sapiens
ucacuugaggucaugaguu

SEQ ID NO: 1583734 - RNA, 19 nt, Homo sapiens
ggccaaggaaggcagauca

SEQ ID NO: 1583735 - RNA, 19 nt, Homo sapiens
caccagagugugagcagaa

SEQ ID NO: 1583736 - RNA, 19 nt, Homo sapiens
gaacaccuuccguaaucag

SEQ ID NO: 1583737 - RNA, 19 nt, Homo sapiens
aaauaauaccagcgacuga

SEQ ID NO: 1583738 - RNA, 19 nt, Homo sapiens
gcgccuggcccuuaaagag

SEQ ID NO: 1583739 - RNA, 19 nt, Homo sapiens
ccugggcgauagagugaga

SEQ ID NO: 1583740 - RNA, 19 nt, Homo sapiens
ggaguaggugggcgcauag

SEQ ID NO: 1583741 - RNA, 19 nt, Homo sapiens
uucacagacuggauguuaa

SEQ ID NO: 1583742 - RNA, 19 nt, Homo sapiens
gaauuagguaacuuguuca

SEQ ID NO: 1583743 - RNA, 19 nt, Homo sapiens
gggaccaagacgcgcguua

SEQ ID NO: 1583744 - RNA, 19 nt, Homo sapiens
ugaacaccuuccguaauca

SEQ ID NO: 1583745 - RNA, 19 nt, Homo sapiens
cagaacgcacccauaacuu

SEQ ID NO: 1583746 - RNA, 19 nt, Homo sapiens
gcaacagauauaacuccuu

SEQ ID NO: 1583747 - RNA, 19 nt, Homo sapiens
ucacagacuggauguuaag

SEQ ID NO: 1583748 - RNA, 19 nt, Homo sapiens
gauggauggcaaauaauac

SEQ ID NO: 1583749 - RNA, 19 nt, Homo sapiens
ggcgauagagugagacuac

SEQ ID NO: 1583750 - RNA, 19 nt, Homo sapiens
agaagcaacagauauaacu

SEQ ID NO: 1583751 - RNA, 19 nt, Homo sapiens
ugguagcgcacgccuguaa

SEQ ID NO: 1583752 - RNA, 19 nt, Homo sapiens
ggaccaagacgcgcguuac

SEQ ID NO: 1583753 - RNA, 19 nt, Homo sapiens
ggaggccgaggaagguaga

SEQ ID NO: 1583754 - RNA, 19 nt, Homo sapiens
aauugaacaccuuccguaa

SEQ ID NO: 1583755 - RNA, 19 nt, Homo sapiens
caaguggaaaggcagaaca

SEQ ID NO: 1583756 - RNA, 19 nt, Homo sapiens
aauaauaccagcgacugaa

SEQ ID NO: 1583757 - RNA, 19 nt, Homo sapiens
gaacaggguugaagauuug

SEQ ID NO: 1583758 - RNA, 19 nt, Homo sapiens
ggaacaggguugaagauuu

SEQ ID NO: 1583759 - RNA, 19 nt, Homo sapiens
gcaagacccugucccuaaa

SEQ ID NO: 1583760 - RNA, 19 nt, Homo sapiens
gggaacagcuucagaguca

SEQ ID NO: 1583761 - RNA, 19 nt, Homo sapiens
gcucacaccuguaauccua

SEQ ID NO: 1583762 - RNA, 19 nt, Homo sapiens
gaucauaccacugcacuua

SEQ ID NO: 1583763 - RNA, 19 nt, Homo sapiens
gcagugagcucaugaucau

SEQ ID NO: 1583764 - RNA, 19 nt, Homo sapiens
gagcaagacuguuuugaaa

SEQ ID NO: 1583765 - RNA, 19 nt, Homo sapiens
gguugaagauuugaaguuu

SEQ ID NO: 1583766 - RNA, 19 nt, Homo sapiens
gcacuuaacuuggcaacag

SEQ ID NO: 1583767 - RNA, 19 nt, Homo sapiens
gaaaacccgucucuacaaa

SEQ ID NO: 1583768 - RNA, 19 nt, Homo sapiens
ggaggaagcaggacuaugg

SEQ ID NO: 1583769 - RNA, 19 nt, Homo sapiens
ggaggaagaagccgaguug

SEQ ID NO: 1583770 - RNA, 19 nt, Homo sapiens
gaaaugaggagcacagaac

SEQ ID NO: 1583771 - RNA, 19 nt, Homo sapiens
ccuguaauccuaacacuuu

SEQ ID NO: 1583772 - RNA, 19 nt, Homo sapiens
ggaaacagaagcuaaagac

SEQ ID NO: 1583773 - RNA, 19 nt, Homo sapiens
cagccugacucaugcuuga

SEQ ID NO: 1583774 - RNA, 19 nt, Homo sapiens
gaggugggcggaucacuug

SEQ ID NO: 1583775 - RNA, 19 nt, Homo sapiens
gcuccagacuugacugauc

SEQ ID NO: 1583776 - RNA, 19 nt, Homo sapiens
ggagcugucggcugaguuu

SEQ ID NO: 1583777 - RNA, 19 nt, Homo sapiens
gggaucauuugagcuuaaa

SEQ ID NO: 1583778 - RNA, 19 nt, Homo sapiens
gggcucaggugggaggauu

SEQ ID NO: 1583779 - RNA, 19 nt, Homo sapiens
ggagggcagggaaaucuga

SEQ ID NO: 1583780 - RNA, 19 nt, Homo sapiens
cuccuuggcuccagacuug

SEQ ID NO: 1583781 - RNA, 19 nt, Homo sapiens
ccaccgugcuguccaugug

SEQ ID NO: 1583782 - RNA, 19 nt, Homo sapiens
uaacuuggcaacagagcaa

SEQ ID NO: 1583783 - RNA, 19 nt, Homo sapiens
aggcuaaggugggagaauu

SEQ ID NO: 1583784 - RNA, 19 nt, Homo sapiens
gcuguuaacaaguaggaaa

SEQ ID NO: 1583785 - RNA, 19 nt, Homo sapiens
gggaacaggguugaagauu

SEQ ID NO: 1583786 - RNA, 19 nt, Homo sapiens
ugggaucauuugagcuuaa

SEQ ID NO: 1583787 - RNA, 19 nt, Homo sapiens
ccuguaauccgaguacuuu

SEQ ID NO: 1583788 - RNA, 19 nt, Homo sapiens
ggagguggccauccccuua

SEQ ID NO: 1583789 - RNA, 19 nt, Homo sapiens
cagcuacucgggaggcuaa

SEQ ID NO: 1583790 - RNA, 19 nt, Homo sapiens
agcaagacccugucccuaa

SEQ ID NO: 1583791 - RNA, 19 nt, Homo sapiens
gggaauguguuggauuagg

SEQ ID NO: 1583792 - RNA, 19 nt, Homo sapiens
uggggaauguguuggauua

SEQ ID NO: 1583793 - RNA, 19 nt, Homo sapiens
ggguugaagauuugaaguu

SEQ ID NO: 1583794 - RNA, 19 nt, Homo sapiens
ccagggaagacccguguga

SEQ ID NO: 1583795 - RNA, 19 nt, Homo sapiens
gcaggacuauggccccaaa

SEQ ID NO: 1583796 - RNA, 19 nt, Homo sapiens
gaggagggcagggaaaucu

SEQ ID NO: 1583797 - RNA, 19 nt, Homo sapiens
caggagugaugcugaucga

SEQ ID NO: 1583798 - RNA, 19 nt, Homo sapiens
gacccugucccuaaaauaa

SEQ ID NO: 1583799 - RNA, 19 nt, Homo sapiens
uaaggugggagaauugcuu

SEQ ID NO: 1583800 - RNA, 19 nt, Homo sapiens
ucauaccacugcacuuaac

SEQ ID NO: 1583801 - RNA, 19 nt, Homo sapiens
gcugaucgaggacuuugug

SEQ ID NO: 1583802 - RNA, 19 nt, Homo sapiens
ucaccuuuauuaugcaucu

SEQ ID NO: 1583803 - RNA, 19 nt, Homo sapiens
ugaaaugaggagcacagaa

SEQ ID NO: 1583804 - RNA, 19 nt, Homo sapiens
cacuuaacuuggcaacaga

SEQ ID NO: 1583805 - RNA, 19 nt, Homo sapiens
gaggcgggaggauggcuuu

SEQ ID NO: 1583806 - RNA, 19 nt, Homo sapiens
ggaucgcccucuccuucca

SEQ ID NO: 1583807 - RNA, 19 nt, Homo sapiens
gaaaucugagagccuccuu

SEQ ID NO: 1583808 - RNA, 19 nt, Homo sapiens
ggugggagaauugcuugaa

SEQ ID NO: 1583809 - RNA, 19 nt, Homo sapiens
gacggaggaagcaggacua

SEQ ID NO: 1583810 - RNA, 19 nt, Homo sapiens
caguggcucacaccuguaa

SEQ ID NO: 1583811 - RNA, 19 nt, Homo sapiens
gaagauuugaaguuuagac

SEQ ID NO: 1583812 - RNA, 19 nt, Homo sapiens
aacauaccguuucauuuac

SEQ ID NO: 1583813 - RNA, 19 nt, Homo sapiens
ucacgggguuucaagagaa

SEQ ID NO: 1583814 - RNA, 19 nt, Homo sapiens
gguagaauguugcugguuu

SEQ ID NO: 1583815 - RNA, 19 nt, Homo sapiens
ggacgugacucccacaugu

SEQ ID NO: 1583816 - RNA, 19 nt, Homo sapiens
ggaguguucuaaucaguuu

SEQ ID NO: 1583817 - RNA, 19 nt, Homo sapiens
ggauguugcucugcuugua

SEQ ID NO: 1583818 - RNA, 19 nt, Homo sapiens
caacucuccucccuagcua

SEQ ID NO: 1583819 - RNA, 19 nt, Homo sapiens
ccaacaaccugcaacucaa

SEQ ID NO: 1583820 - RNA, 19 nt, Homo sapiens
ggagaaagggacagaggaa

SEQ ID NO: 1583821 - RNA, 19 nt, Homo sapiens
gggaggcucuggagaacga

SEQ ID NO: 1583822 - RNA, 19 nt, Homo sapiens
ggaagagaccgagaacguu

SEQ ID NO: 1583823 - RNA, 19 nt, Homo sapiens
gacguacucuggagguguu

SEQ ID NO: 1583824 - RNA, 19 nt, Homo sapiens
caacucaagauccgucuga

SEQ ID NO: 1583825 - RNA, 19 nt, Homo sapiens
ggguucagguagaauguug

SEQ ID NO: 1583826 - RNA, 19 nt, Homo sapiens
ccacauguaaucaggagaa

SEQ ID NO: 1583827 - RNA, 19 nt, Homo sapiens
gcgaugcuguggacuccuu

SEQ ID NO: 1583828 - RNA, 19 nt, Homo sapiens
gccaacaaccugcaacuca

SEQ ID NO: 1583829 - RNA, 19 nt, Homo sapiens
guuguggaguguucuaauc

SEQ ID NO: 1583830 - RNA, 19 nt, Homo sapiens
ucacugcucucaggguuca

SEQ ID NO: 1583831 - RNA, 19 nt, Homo sapiens
ccucuggcccucuaccaua

SEQ ID NO: 1583832 - RNA, 19 nt, Homo sapiens
ucucaggguucagguagaa

SEQ ID NO: 1583833 - RNA, 19 nt, Homo sapiens
gacgugacucccacaugua

SEQ ID NO: 1583834 - RNA, 19 nt, Homo sapiens
gcaggacccuaaggacucu

SEQ ID NO: 1583835 - RNA, 19 nt, Homo sapiens
gauguugcucugcuuguau

SEQ ID NO: 1583836 - RNA, 19 nt, Homo sapiens
guagaauguugcugguuuu

SEQ ID NO: 1583837 - RNA, 19 nt, Homo sapiens
gggaggaagagaccgagaa

SEQ ID NO: 1583838 - RNA, 19 nt, Homo sapiens
ggcuuuaggucugcuugaa

SEQ ID NO: 1583839 - RNA, 19 nt, Homo sapiens
gagcaucaagggcauguac

SEQ ID NO: 1583840 - RNA, 19 nt, Homo sapiens
ggagagccuucugcuucug

SEQ ID NO: 1583841 - RNA, 19 nt, Homo sapiens
guauucaguuggccaucug

SEQ ID NO: 1583842 - RNA, 19 nt, Homo sapiens
gaaaggugaggacgugacu

SEQ ID NO: 1583843 - RNA, 19 nt, Homo sapiens
gugaagccguggacaugag

SEQ ID NO: 1583844 - RNA, 19 nt, Homo sapiens
gcuuuaggucugcuugaaa

SEQ ID NO: 1583845 - RNA, 19 nt, Homo sapiens
cggcgaccuuacccacuuu

SEQ ID NO: 1583846 - RNA, 19 nt, Homo sapiens
caacaaccugcaacucaag

SEQ ID NO: 1583847 - RNA, 19 nt, Homo sapiens
ucuaaucaguuuuggcuuu

SEQ ID NO: 1583848 - RNA, 19 nt, Homo sapiens
gaauguugcugguuuugag

SEQ ID NO: 1583849 - RNA, 19 nt, Homo sapiens
ggugaagccguggacauga

SEQ ID NO: 1583850 - RNA, 19 nt, Homo sapiens
gauggagagccuucugcuu

SEQ ID NO: 1583851 - RNA, 19 nt, Homo sapiens
cauguaaucaggagaaagg

SEQ ID NO: 1583852 - RNA, 19 nt, Homo sapiens
uggguugcauccagaccua

SEQ ID NO: 1583853 - RNA, 19 nt, Homo sapiens
guggaguguucuaaucagu

SEQ ID NO: 1583854 - RNA, 19 nt, Homo sapiens
cacauguaaucaggagaaa

SEQ ID NO: 1583855 - RNA, 19 nt, Homo sapiens
ggaggaagagaccgagaac

SEQ ID NO: 1583856 - RNA, 19 nt, Homo sapiens
gcaggaggaggaagacaac

SEQ ID NO: 1583857 - RNA, 19 nt, Homo sapiens
caccuguuguggaguguuc

SEQ ID NO: 1583858 - RNA, 19 nt, Homo sapiens
uggagagccuucugcuucu

SEQ ID NO: 1583859 - RNA, 19 nt, Homo sapiens
gcucugcuuguauucaguu

SEQ ID NO: 1583860 - RNA, 19 nt, Homo sapiens
cgggauauccgacguacuc

SEQ ID NO: 1583861 - RNA, 19 nt, Homo sapiens
gcaaguaccuguagucuca

SEQ ID NO: 1583862 - RNA, 19 nt, Homo sapiens
gcaagaaccugugucuaaa

SEQ ID NO: 1583863 - RNA, 19 nt, Homo sapiens
gcucacgccuauuaucuua

SEQ ID NO: 1583864 - RNA, 19 nt, Homo sapiens
ggcaagaaccugugucuaa

SEQ ID NO: 1583865 - RNA, 19 nt, Homo sapiens
ccuauuaucuuagcacuuu

SEQ ID NO: 1583866 - RNA, 19 nt, Homo sapiens
gcugagacccuaucccuaa

SEQ ID NO: 1583867 - RNA, 19 nt, Homo sapiens
ggaagagacuaugcuguuc

SEQ ID NO: 1583868 - RNA, 19 nt, Homo sapiens
caacuccacuucugagcuu

SEQ ID NO: 1583869 - RNA, 19 nt, Homo sapiens
ccaccuuccuaauuccuua

SEQ ID NO: 1583870 - RNA, 19 nt, Homo sapiens
gcagugagcaaugaucgua

SEQ ID NO: 1583871 - RNA, 19 nt, Homo sapiens
caaaggcacucagguuagu

SEQ ID NO: 1583872 - RNA, 19 nt, Homo sapiens
gcagggcuuugcagacaga

SEQ ID NO: 1583873 - RNA, 19 nt, Homo sapiens
cuuaugagcuucagugucu

SEQ ID NO: 1583874 - RNA, 19 nt, Homo sapiens
gaagagacuaugcuguuca

SEQ ID NO: 1583875 - RNA, 19 nt, Homo sapiens
uaugguggcucacgccuau

SEQ ID NO: 1583876 - RNA, 19 nt, Homo sapiens
agacuaugcuguucacucu

SEQ ID NO: 1583877 - RNA, 19 nt, Homo sapiens
cagcuaaaccugccucugu

SEQ ID NO: 1583878 - RNA, 19 nt, Homo sapiens
ccuguagucucagcuauug

SEQ ID NO: 1583879 - RNA, 19 nt, Homo sapiens
ucaugggacuugaugugaa

SEQ ID NO: 1583880 - RNA, 19 nt, Homo sapiens
ucaugcaccugcugcuuau

SEQ ID NO: 1583881 - RNA, 19 nt, Homo sapiens
ccacucaccagccauccua

SEQ ID NO: 1583882 - RNA, 19 nt, Homo sapiens
ggacaucugcaagcuccua

SEQ ID NO: 1583883 - RNA, 19 nt, Homo sapiens
ugacggcucugcuggacau

SEQ ID NO: 1583884 - RNA, 19 nt, Homo sapiens
ggggaaaguuacaaaagaa

SEQ ID NO: 1583885 - RNA, 19 nt, Homo sapiens
acuaugcuguucacucuga

SEQ ID NO: 1583886 - RNA, 19 nt, Homo sapiens
caccugugcccuccuaauu

SEQ ID NO: 1583887 - RNA, 19 nt, Homo sapiens
ugagugagccugggaguuc

SEQ ID NO: 1583888 - RNA, 19 nt, Homo sapiens
cagacagcauccucaguca

SEQ ID NO: 1583889 - RNA, 19 nt, Homo sapiens
uucaaaggcacucagguua

SEQ ID NO: 1583890 - RNA, 19 nt, Homo sapiens
gcacuccuccugccaacuc

SEQ ID NO: 1583891 - RNA, 19 nt, Homo sapiens
aggaagagacuaugcuguu

SEQ ID NO: 1583892 - RNA, 19 nt, Homo sapiens
caccaccugugcccuccua

SEQ ID NO: 1583893 - RNA, 19 nt, Homo sapiens
cugagacccuaucccuaaa

SEQ ID NO: 1583894 - RNA, 19 nt, Homo sapiens
ucaaaggcacucagguuag

SEQ ID NO: 1583895 - RNA, 19 nt, Homo sapiens
guaccuguagucucagcua

SEQ ID NO: 1583896 - RNA, 19 nt, Homo sapiens
ucggccaccuuccuaauuc

SEQ ID NO: 1583897 - RNA, 19 nt, Homo sapiens
uaccuccucuggccaugaa

SEQ ID NO: 1583898 - RNA, 19 nt, Homo sapiens
gggaggcugaggcaagaaa

SEQ ID NO: 1583899 - RNA, 19 nt, Homo sapiens
gcuccuagaggcugucugu

SEQ ID NO: 1583900 - RNA, 19 nt, Homo sapiens
cucaugcaccugcugcuua

SEQ ID NO: 1583901 - RNA, 19 nt, Homo sapiens
cuugaggccaggaguuuaa

SEQ ID NO: 1583902 - RNA, 19 nt, Homo sapiens
ugguggcucacgccuauua

SEQ ID NO: 1583903 - RNA, 19 nt, Homo sapiens
cauccucagucacgagaag

SEQ ID NO: 1583904 - RNA, 19 nt, Homo sapiens
ccugucaucucuccuugca

SEQ ID NO: 1583905 - RNA, 19 nt, Homo sapiens
gggcaagaaccugugucua

SEQ ID NO: 1583906 - RNA, 19 nt, Homo sapiens
caguggcucucaaaucaac

SEQ ID NO: 1583907 - RNA, 19 nt, Homo sapiens
aggcugcagugagcaauga

SEQ ID NO: 1583908 - RNA, 19 nt, Homo sapiens
caugggacuugaugugaac

SEQ ID NO: 1583909 - RNA, 19 nt, Homo sapiens
ccaggacccaggaguguuc

SEQ ID NO: 1583910 - RNA, 19 nt, Homo sapiens
ccucugaucaugggacuug

SEQ ID NO: 1583911 - RNA, 19 nt, Homo sapiens
gcagacagagcuccaugcu

SEQ ID NO: 1583912 - RNA, 19 nt, Homo sapiens
gggaggcugaggauggaaa

SEQ ID NO: 1583913 - RNA, 19 nt, Homo sapiens
gaaaguuacaaaagaagga

SEQ ID NO: 1583914 - RNA, 19 nt, Homo sapiens
ggugauggacuguauauuu

SEQ ID NO: 1583915 - RNA, 19 nt, Homo sapiens
ggaaagacaaacaaagaaa

SEQ ID NO: 1583916 - RNA, 19 nt, Homo sapiens
gugauggacuguauauuug

SEQ ID NO: 1583917 - RNA, 19 nt, Homo sapiens
ccaccgagguccaaacuau

SEQ ID NO: 1583918 - RNA, 19 nt, Homo sapiens
gaggaaagacaaacaaaga

SEQ ID NO: 1583919 - RNA, 19 nt, Homo sapiens
gaagcaguaugaccaguuc

SEQ ID NO: 1583920 - RNA, 19 nt, Homo sapiens
ggaaggagaagcagcagaa

SEQ ID NO: 1583921 - RNA, 19 nt, Homo sapiens
ggaauguggaagaugauua

SEQ ID NO: 1583922 - RNA, 19 nt, Homo sapiens
ccaaggugauggacuguau

SEQ ID NO: 1583923 - RNA, 19 nt, Homo sapiens
gucaagcaauguaaagauu

SEQ ID NO: 1583924 - RNA, 19 nt, Homo sapiens
gaauguggaagaugauuau

SEQ ID NO: 1583925 - RNA, 19 nt, Homo sapiens
gcacugagccaaggugaug

SEQ ID NO: 1583926 - RNA, 19 nt, Homo sapiens
ccacagagcacagaagaug

SEQ ID NO: 1583927 - RNA, 19 nt, Homo sapiens
guaccgggcacgcuacuuu

SEQ ID NO: 1583928 - RNA, 19 nt, Homo sapiens
gcagacuggcccucaaauu

SEQ ID NO: 1583929 - RNA, 19 nt, Homo sapiens
gaaggaaggcuugcuguac

SEQ ID NO: 1583930 - RNA, 19 nt, Homo sapiens
gaagcugagcgcuguauca

SEQ ID NO: 1583931 - RNA, 19 nt, Homo sapiens
gaaagacaaacaaagaaac

SEQ ID NO: 1583932 - RNA, 19 nt, Homo sapiens
uguggaagaugauuauauc

SEQ ID NO: 1583933 - RNA, 19 nt, Homo sapiens
ggaagcaguaugaccaguu

SEQ ID NO: 1583934 - RNA, 19 nt, Homo sapiens
gagaagaggaagcaguaug

SEQ ID NO: 1583935 - RNA, 19 nt, Homo sapiens
agaagaggaagcaguauga

SEQ ID NO: 1583936 - RNA, 19 nt, Homo sapiens
cagacuggcccucaaauuc

SEQ ID NO: 1583937 - RNA, 19 nt, Homo sapiens
ucaaggccauccagagcaa

SEQ ID NO: 1583938 - RNA, 19 nt, Homo sapiens
gacuguauauuugaggaaa

SEQ ID NO: 1583939 - RNA, 19 nt, Homo sapiens
cauaugcgguacucagcaa

SEQ ID NO: 1583940 - RNA, 19 nt, Homo sapiens
ugaaaagggucaagcaaug

SEQ ID NO: 1583941 - RNA, 19 nt, Homo sapiens
cggagaagaggaagcagua

SEQ ID NO: 1583942 - RNA, 19 nt, Homo sapiens
gaggagagagcaccaaagg

SEQ ID NO: 1583943 - RNA, 19 nt, Homo sapiens
caaaggcuacacugcagaa

SEQ ID NO: 1583944 - RNA, 19 nt, Homo sapiens
caaauuccacccagacaag

SEQ ID NO: 1583945 - RNA, 19 nt, Homo sapiens
ggucaagcaauguaaagau

SEQ ID NO: 1583946 - RNA, 19 nt, Homo sapiens
caaggugauggacuguaua

SEQ ID NO: 1583947 - RNA, 19 nt, Homo sapiens
cggaugaggaccugaagaa

SEQ ID NO: 1583948 - RNA, 19 nt, Homo sapiens
gauggacuguauauuugag

SEQ ID NO: 1583949 - RNA, 19 nt, Homo sapiens
aggccucccugcauggaua

SEQ ID NO: 1583950 - RNA, 19 nt, Homo sapiens
agaaggaaggcuugcugua

SEQ ID NO: 1583951 - RNA, 19 nt, Homo sapiens
cgcuauaccuaccagcaaa

SEQ ID NO: 1583952 - RNA, 19 nt, Homo sapiens
ggacuguauauuugaggaa

SEQ ID NO: 1583953 - RNA, 19 nt, Homo sapiens
uaugaaaucccuggagaau

SEQ ID NO: 1583954 - RNA, 19 nt, Homo sapiens
ggagaagcagcagaaggaa

SEQ ID NO: 1583955 - RNA, 19 nt, Homo sapiens
gcaacccggagaagaggaa

SEQ ID NO: 1583956 - RNA, 19 nt, Homo sapiens
cauccugauucucguguca

SEQ ID NO: 1583957 - RNA, 19 nt, Homo sapiens
aggagaagcagcagaagga

SEQ ID NO: 1583958 - RNA, 19 nt, Homo sapiens
agcggaauguggaagauga

SEQ ID NO: 1583959 - RNA, 19 nt, Homo sapiens
ucaaauuccacccagacaa

SEQ ID NO: 1583960 - RNA, 19 nt, Homo sapiens
gguccaaacuaugaaaucc

SEQ ID NO: 1583961 - RNA, 19 nt, Homo sapiens
gcgcuauaccuaccagcaa

SEQ ID NO: 1583962 - RNA, 19 nt, Homo sapiens
cuacacugcagaacagguu

SEQ ID NO: 1583963 - RNA, 19 nt, Homo sapiens
aaagggucaagcaauguaa

SEQ ID NO: 1583964 - RNA, 19 nt, Homo sapiens
ggagaagaggaagcaguau

SEQ ID NO: 1583965 - RNA, 19 nt, Homo sapiens
aggaaagacaaacaaagaa

SEQ ID NO: 1583966 - RNA, 19 nt, Homo sapiens
ucgccaaccuccggaacaa

SEQ ID NO: 1583967 - RNA, 19 nt, Homo sapiens
ccaguucggcgaugacaag

SEQ ID NO: 1583968 - RNA, 19 nt, Homo sapiens
ugauggacuguauauuuga

SEQ ID NO: 1583969 - RNA, 19 nt, Homo sapiens
aguccacccuacagucuga

SEQ ID NO: 1583970 - RNA, 19 nt, Homo sapiens
cuguauauuugaggaaaga

SEQ ID NO: 1583971 - RNA, 19 nt, Homo sapiens
gaaaagggucaagcaaugu

SEQ ID NO: 1583972 - RNA, 19 nt, Homo sapiens
cgagguccaaacuaugaaa

SEQ ID NO: 1583973 - RNA, 19 nt, Homo sapiens
uaccacagagcacagaaga

SEQ ID NO: 1583974 - RNA, 19 nt, Homo sapiens
gaucaaagcuacagcaaga

SEQ ID NO: 1583975 - RNA, 19 nt, Homo sapiens
ggaaagagauagacacaau

SEQ ID NO: 1583976 - RNA, 19 nt, Homo sapiens
ggacagcgauguaucaaga

SEQ ID NO: 1583977 - RNA, 19 nt, Homo sapiens
ccacucggaucaucuauua

SEQ ID NO: 1583978 - RNA, 19 nt, Homo sapiens
gaacagaccaaaccucuaa

SEQ ID NO: 1583979 - RNA, 19 nt, Homo sapiens
caaauaggcaguucucuua

SEQ ID NO: 1583980 - RNA, 19 nt, Homo sapiens
ggacaacaguuacauagug

SEQ ID NO: 1583981 - RNA, 19 nt, Homo sapiens
ggaaggagcuagggaaaga

SEQ ID NO: 1583982 - RNA, 19 nt, Homo sapiens
guccaaaucucauaaacua

SEQ ID NO: 1583983 - RNA, 19 nt, Homo sapiens
ccgcaucccucuagucuua

SEQ ID NO: 1583984 - RNA, 19 nt, Homo sapiens
gauaauacuuugugaaugg

SEQ ID NO: 1583985 - RNA, 19 nt, Homo sapiens
ggauaaagaucaugacagu

SEQ ID NO: 1583986 - RNA, 19 nt, Homo sapiens
ucaagaagcucacagacaa

SEQ ID NO: 1583987 - RNA, 19 nt, Homo sapiens
gaccaaacauuuaaagugu

SEQ ID NO: 1583988 - RNA, 19 nt, Homo sapiens
caaacaaucuacuucaguu

SEQ ID NO: 1583989 - RNA, 19 nt, Homo sapiens
gcacauccacuaccaauug

SEQ ID NO: 1583990 - RNA, 19 nt, Homo sapiens
gaacuaauagcaauucgaa

SEQ ID NO: 1583991 - RNA, 19 nt, Homo sapiens
aaucagaggucucaaaguu

SEQ ID NO: 1583992 - RNA, 19 nt, Homo sapiens
ugaaugaagucccagauga

SEQ ID NO: 1583993 - RNA, 19 nt, Homo sapiens
caaagggaguugcucuaaa

SEQ ID NO: 1583994 - RNA, 19 nt, Homo sapiens
agauaacacugccaugaua

SEQ ID NO: 1583995 - RNA, 19 nt, Homo sapiens
ggaaggcagucauguguca

SEQ ID NO: 1583996 - RNA, 19 nt, Homo sapiens
cauagaaacuuaacuuugg

SEQ ID NO: 1583997 - RNA, 19 nt, Homo sapiens
gagaugggauuccuuucuu

SEQ ID NO: 1583998 - RNA, 19 nt, Homo sapiens
aaacagauguaaugcaugu

SEQ ID NO: 1583999 - RNA, 19 nt, Homo sapiens
cuacuucaguucaguguaa

SEQ ID NO: 1584000 - RNA, 19 nt, Homo sapiens
guacaguagcucaauauuu

SEQ ID NO: 1584001 - RNA, 19 nt, Homo sapiens
gaaaauaccgaguuuguaa

SEQ ID NO: 1584002 - RNA, 19 nt, Homo sapiens
guacacagcacauccacua

SEQ ID NO: 1584003 - RNA, 19 nt, Homo sapiens
cuuaauagauucuggauuc

SEQ ID NO: 1584004 - RNA, 19 nt, Homo sapiens
gaagagaagauuauuccuu

SEQ ID NO: 1584005 - RNA, 19 nt, Homo sapiens
ggguuucuauggaauauuu

SEQ ID NO: 1584006 - RNA, 19 nt, Homo sapiens
ggaauaugaugcucaacau

SEQ ID NO: 1584007 - RNA, 19 nt, Homo sapiens
cuaaagcgagcaucaguua

SEQ ID NO: 1584008 - RNA, 19 nt, Homo sapiens
gugcaaauccaccaugaua

SEQ ID NO: 1584009 - RNA, 19 nt, Homo sapiens
ggaccugacuaacaugguu

SEQ ID NO: 1584010 - RNA, 19 nt, Homo sapiens
aaucagacuuccacaauga

SEQ ID NO: 1584011 - RNA, 19 nt, Homo sapiens
ggguaaagaccaaacauuu

SEQ ID NO: 1584012 - RNA, 19 nt, Homo sapiens
uagaugagauuucaguaug

SEQ ID NO: 1584013 - RNA, 19 nt, Homo sapiens
cgaggccuguugcucauua

SEQ ID NO: 1584014 - RNA, 19 nt, Homo sapiens
gcugcugugugguuuguua

SEQ ID NO: 1584015 - RNA, 19 nt, Homo sapiens
gcacugaaucuauacuuug

SEQ ID NO: 1584016 - RNA, 19 nt, Homo sapiens
gagcaucaguuaaaaugua

SEQ ID NO: 1584017 - RNA, 19 nt, Homo sapiens
ggagauaacacugccauga

SEQ ID NO: 1584018 - RNA, 19 nt, Homo sapiens
caucugaguuugacuuuua

SEQ ID NO: 1584019 - RNA, 19 nt, Homo sapiens
ggaaagacaccaguauaug

SEQ ID NO: 1584020 - RNA, 19 nt, Homo sapiens
gaagauuaccggccaggaa

SEQ ID NO: 1584021 - RNA, 19 nt, Homo sapiens
gaaacaauguagggaagau

SEQ ID NO: 1584022 - RNA, 19 nt, Homo sapiens
gggauaggguugauaugga

SEQ ID NO: 1584023 - RNA, 19 nt, Homo sapiens
cggaauaguugcacugaau

SEQ ID NO: 1584024 - RNA, 19 nt, Homo sapiens
ggccagaacuaauagcaau

SEQ ID NO: 1584025 - RNA, 19 nt, Homo sapiens
guggacagaugaaacgaaa

SEQ ID NO: 1584026 - RNA, 19 nt, Homo sapiens
ucauugaguucauguguga

SEQ ID NO: 1584027 - RNA, 19 nt, Homo sapiens
caagacaccuucccuccau

SEQ ID NO: 1584028 - RNA, 19 nt, Homo sapiens
caaaaucccagcaauauaa

SEQ ID NO: 1584029 - RNA, 19 nt, Homo sapiens
gcccagaguuuacugacuu

SEQ ID NO: 1584030 - RNA, 19 nt, Homo sapiens
gaaggguuucuauggaaua

SEQ ID NO: 1584031 - RNA, 19 nt, Homo sapiens
caaacccuuuccaaucuuu

SEQ ID NO: 1584032 - RNA, 19 nt, Homo sapiens
gaaagacaccaguauaugc

SEQ ID NO: 1584033 - RNA, 19 nt, Homo sapiens
gaaaucagaggucucaaag

SEQ ID NO: 1584034 - RNA, 19 nt, Homo sapiens
gcaauauaaagcacuguuu

SEQ ID NO: 1584035 - RNA, 19 nt, Homo sapiens
gauaacacugccaugauaa

SEQ ID NO: 1584036 - RNA, 19 nt, Homo sapiens
ggugaaacguguuggagau

SEQ ID NO: 1584037 - RNA, 19 nt, Homo sapiens
caauauggaggccggaaua

SEQ ID NO: 1584038 - RNA, 19 nt, Homo sapiens
gaccugauccauaccuuaa

SEQ ID NO: 1584039 - RNA, 19 nt, Homo sapiens
gcuauggaauguacaguag

SEQ ID NO: 1584040 - RNA, 19 nt, Homo sapiens
ggagcuagggaaagagaua

SEQ ID NO: 1584041 - RNA, 19 nt, Homo sapiens
gacaacaguuacauagugu

SEQ ID NO: 1584042 - RNA, 19 nt, Homo sapiens
aaagggaguugcucuaaag

SEQ ID NO: 1584043 - RNA, 19 nt, Homo sapiens
auaggcaguucucuuauuu

SEQ ID NO: 1584044 - RNA, 19 nt, Homo sapiens
uaguugcacugaaucuaua

SEQ ID NO: 1584045 - RNA, 19 nt, Homo sapiens
gaugaacuccagcuacuga

SEQ ID NO: 1584046 - RNA, 19 nt, Homo sapiens
guguggagccuauguuuaa

SEQ ID NO: 1584047 - RNA, 19 nt, Homo sapiens
gcaccaaugcugcaauaug

SEQ ID NO: 1584048 - RNA, 19 nt, Homo sapiens
ggaccugauccauaccuua

SEQ ID NO: 1584049 - RNA, 19 nt, Homo sapiens
gauaguaccaucacacauc

SEQ ID NO: 1584050 - RNA, 19 nt, Homo sapiens
caaucagacuuccacaaug

SEQ ID NO: 1584051 - RNA, 19 nt, Homo sapiens
caacagggagguaguagau

SEQ ID NO: 1584052 - RNA, 19 nt, Homo sapiens
acagguagcuuggccagaa

SEQ ID NO: 1584053 - RNA, 19 nt, Homo sapiens
caccaaugcugcaauaugg

SEQ ID NO: 1584054 - RNA, 19 nt, Homo sapiens
gcagggaggucugguuugg

SEQ ID NO: 1584055 - RNA, 19 nt, Homo sapiens
gcacuucaagaugcaaaua

SEQ ID NO: 1584056 - RNA, 19 nt, Homo sapiens
gaaagagauagacacaaug

SEQ ID NO: 1584057 - RNA, 19 nt, Homo sapiens
acaguuacauagugucuug

SEQ ID NO: 1584058 - RNA, 19 nt, Homo sapiens
uaacucacacgacuacuug

SEQ ID NO: 1584059 - RNA, 19 nt, Homo sapiens
cgaaaggcauguauuagcu

SEQ ID NO: 1584060 - RNA, 19 nt, Homo sapiens
gaauaugaugcucaacauu

SEQ ID NO: 1584061 - RNA, 19 nt, Homo sapiens
ggagguaguagauacaaug

SEQ ID NO: 1584062 - RNA, 19 nt, Homo sapiens
aaagcgagcaucaguuaaa

SEQ ID NO: 1584063 - RNA, 19 nt, Homo sapiens
aaauguacuugguggguuu

SEQ ID NO: 1584064 - RNA, 19 nt, Homo sapiens
uuccggagaucaagcguua

SEQ ID NO: 1584065 - RNA, 19 nt, Homo sapiens
caaauccacacgcuucaaa

SEQ ID NO: 1584066 - RNA, 19 nt, Homo sapiens
ucacugaccagcugcguaa

SEQ ID NO: 1584067 - RNA, 19 nt, Homo sapiens
ucacuaugauguggauauu

SEQ ID NO: 1584068 - RNA, 19 nt, Homo sapiens
gaugagauuucaguaugau

SEQ ID NO: 1584069 - RNA, 19 nt, Homo sapiens
gcaggacagcgauguauca

SEQ ID NO: 1584070 - RNA, 19 nt, Homo sapiens
gaccugccauguggaauau

SEQ ID NO: 1584071 - RNA, 19 nt, Homo sapiens
gacuucagguggucuucua

SEQ ID NO: 1584072 - RNA, 19 nt, Homo sapiens
gcagauagugggaugaaag

SEQ ID NO: 1584073 - RNA, 19 nt, Homo sapiens
uaaacuagccuucucaaaa

SEQ ID NO: 1584074 - RNA, 19 nt, Homo sapiens
gcaccacccuuguuaauug

SEQ ID NO: 1584075 - RNA, 19 nt, Homo sapiens
ugaaguagauggagaaguu

SEQ ID NO: 1584076 - RNA, 19 nt, Homo sapiens
gaaugagccuuuccuguug

SEQ ID NO: 1584077 - RNA, 19 nt, Homo sapiens
ggauggagcuuucguggau

SEQ ID NO: 1584078 - RNA, 19 nt, Homo sapiens
caucacagcucuuaucagu

SEQ ID NO: 1584079 - RNA, 19 nt, Homo sapiens
ugaggcagguggaucauuu

SEQ ID NO: 1584080 - RNA, 19 nt, Homo sapiens
gcacggaucucagcuggau

SEQ ID NO: 1584081 - RNA, 19 nt, Homo sapiens
agagggagauucuugacua

SEQ ID NO: 1584082 - RNA, 19 nt, Homo sapiens
ggucaaugcugaugccaau

SEQ ID NO: 1584083 - RNA, 19 nt, Homo sapiens
gaucuuguauucagaaggu

SEQ ID NO: 1584084 - RNA, 19 nt, Homo sapiens
gcugacaguuuaagggaaa

SEQ ID NO: 1584085 - RNA, 19 nt, Homo sapiens
ugaaugagccuuuccuguu

SEQ ID NO: 1584086 - RNA, 19 nt, Homo sapiens
ggauuggucucuagguuca

SEQ ID NO: 1584087 - RNA, 19 nt, Homo sapiens
ccgaguagcuggcauuaca

SEQ ID NO: 1584088 - RNA, 19 nt, Homo sapiens
ggaguacaauggcaugauc

SEQ ID NO: 1584089 - RNA, 19 nt, Homo sapiens
gcacuuccaugggagaguu

SEQ ID NO: 1584090 - RNA, 19 nt, Homo sapiens
gaaaggauugccuccaaga

SEQ ID NO: 1584091 - RNA, 19 nt, Homo sapiens
gggaggggcuuguuuguuu

SEQ ID NO: 1584092 - RNA, 19 nt, Homo sapiens
ggaagauucuagccucauc

SEQ ID NO: 1584093 - RNA, 19 nt, Homo sapiens
ccuguaagcuugaggacuu

SEQ ID NO: 1584094 - RNA, 19 nt, Homo sapiens
ggagaagugaauucaguuu

SEQ ID NO: 1584095 - RNA, 19 nt, Homo sapiens
gguuugagcugcugaagag

SEQ ID NO: 1584096 - RNA, 19 nt, Homo sapiens
guaugagugugcauuucua

SEQ ID NO: 1584097 - RNA, 19 nt, Homo sapiens
cagaggugcugaugacuuc

SEQ ID NO: 1584098 - RNA, 19 nt, Homo sapiens
caugugagcucuuugaaaa

SEQ ID NO: 1584099 - RNA, 19 nt, Homo sapiens
ccacuuuguuucaugaaug

SEQ ID NO: 1584100 - RNA, 19 nt, Homo sapiens
ugacguccaucauguuaau

SEQ ID NO: 1584101 - RNA, 19 nt, Homo sapiens
gguggaagcccuuggaguu

SEQ ID NO: 1584102 - RNA, 19 nt, Homo sapiens
ggacggaaccacagaagca

SEQ ID NO: 1584103 - RNA, 19 nt, Homo sapiens
ccucuuugcuguggcuuua

SEQ ID NO: 1584104 - RNA, 19 nt, Homo sapiens
guagauggagaaguuguua

SEQ ID NO: 1584105 - RNA, 19 nt, Homo sapiens
gauuuagucuucccaaagg

SEQ ID NO: 1584106 - RNA, 19 nt, Homo sapiens
ccucuuugaucuuguauuc

SEQ ID NO: 1584107 - RNA, 19 nt, Homo sapiens
gcuggauucugcccuguga

SEQ ID NO: 1584108 - RNA, 19 nt, Homo sapiens
cgccgcagaugguguaauu

SEQ ID NO: 1584109 - RNA, 19 nt, Homo sapiens
guagcagugagaauaaaua

SEQ ID NO: 1584110 - RNA, 19 nt, Homo sapiens
gaagugcugggauuacaga

SEQ ID NO: 1584111 - RNA, 19 nt, Homo sapiens
gguuacaugugagcucuuu

SEQ ID NO: 1584112 - RNA, 19 nt, Homo sapiens
cagagcugcuugugaugaa

SEQ ID NO: 1584113 - RNA, 19 nt, Homo sapiens
ugacuagggccaaggcuaa

SEQ ID NO: 1584114 - RNA, 19 nt, Homo sapiens
gaacaggccacugcuccaa

SEQ ID NO: 1584115 - RNA, 19 nt, Homo sapiens
ccagagauccaaccacuca

SEQ ID NO: 1584116 - RNA, 19 nt, Homo sapiens
ggauucgacuuggcucuug

SEQ ID NO: 1584117 - RNA, 19 nt, Homo sapiens
gaaaccccgucucuucuaa

SEQ ID NO: 1584118 - RNA, 19 nt, Homo sapiens
gacccacuuuguuucauga

SEQ ID NO: 1584119 - RNA, 19 nt, Homo sapiens
gcuauagcauccaccagau

SEQ ID NO: 1584120 - RNA, 19 nt, Homo sapiens
gguguacccuggagguguu

SEQ ID NO: 1584121 - RNA, 19 nt, Homo sapiens
gaagguaugagugugcauu

SEQ ID NO: 1584122 - RNA, 19 nt, Homo sapiens
guuguaagccauuucaguu

SEQ ID NO: 1584123 - RNA, 19 nt, Homo sapiens
ucaagcagggcccauguuu

SEQ ID NO: 1584124 - RNA, 19 nt, Homo sapiens
uuaaauaacccugcaggaa

SEQ ID NO: 1584125 - RNA, 19 nt, Homo sapiens
ccucauccuucacacacua

SEQ ID NO: 1584126 - RNA, 19 nt, Homo sapiens
gagggagauucuugacuag

SEQ ID NO: 1584127 - RNA, 19 nt, Homo sapiens
uccaaccacucaauccuaa

SEQ ID NO: 1584128 - RNA, 19 nt, Homo sapiens
gguguuuccugucucucua

SEQ ID NO: 1584129 - RNA, 19 nt, Homo sapiens
gugcugggauuacagaagu

SEQ ID NO: 1584130 - RNA, 19 nt, Homo sapiens
uggagaaguuguuauugga

SEQ ID NO: 1584131 - RNA, 19 nt, Homo sapiens
gccagcaccucauccuuca

SEQ ID NO: 1584132 - RNA, 19 nt, Homo sapiens
gaaucagagcugcuuguga

SEQ ID NO: 1584133 - RNA, 19 nt, Homo sapiens
cagccucuuugaucuugua

SEQ ID NO: 1584134 - RNA, 19 nt, Homo sapiens
ccaaaacgcuauagacauc

SEQ ID NO: 1584135 - RNA, 19 nt, Homo sapiens
ucaguagcagugagaauaa

SEQ ID NO: 1584136 - RNA, 19 nt, Homo sapiens
ccgcaguguuugcaaguga

SEQ ID NO: 1584137 - RNA, 19 nt, Homo sapiens
ggagguguuuccugucucu

SEQ ID NO: 1584138 - RNA, 19 nt, Homo sapiens
guugagcaccuucccguuu

SEQ ID NO: 1584139 - RNA, 19 nt, Homo sapiens
uaagggaaauaagcucugu

SEQ ID NO: 1584140 - RNA, 19 nt, Homo sapiens
cugaaaggauugccuccaa

SEQ ID NO: 1584141 - RNA, 19 nt, Homo sapiens
gcgucugucuggcaucuug

SEQ ID NO: 1584142 - RNA, 19 nt, Homo sapiens
ggaguucgagaccaaccua

SEQ ID NO: 1584143 - RNA, 19 nt, Homo sapiens
ggucuaacgagaagguuga

SEQ ID NO: 1584144 - RNA, 19 nt, Homo sapiens
caauauaaagaacgacuuc

SEQ ID NO: 1584145 - RNA, 19 nt, Homo sapiens
cccagaugcugaaaggauu

SEQ ID NO: 1584146 - RNA, 19 nt, Homo sapiens
gggcaggcuucauggcaau

SEQ ID NO: 1584147 - RNA, 19 nt, Homo sapiens
uggcauuucuggcucucua

SEQ ID NO: 1584148 - RNA, 19 nt, Homo sapiens
uaagccauuucaguuacua

SEQ ID NO: 1584149 - RNA, 19 nt, Homo sapiens
gcauccagccucugucugu

SEQ ID NO: 1584150 - RNA, 19 nt, Homo sapiens
caaaggcaggcacauggaa

SEQ ID NO: 1584151 - RNA, 19 nt, Homo sapiens
gcuagagggagauucuuga

SEQ ID NO: 1584152 - RNA, 19 nt, Homo sapiens
ugaauucaguuuuggcuuu

SEQ ID NO: 1584153 - RNA, 19 nt, Homo sapiens
gacccugcauggagaagug

SEQ ID NO: 1584154 - RNA, 19 nt, Homo sapiens
caguagcagugagaauaaa

SEQ ID NO: 1584155 - RNA, 19 nt, Homo sapiens
ucuucaugcugacaguuua

SEQ ID NO: 1584156 - RNA, 19 nt, Homo sapiens
agaccaaccuagccaacau

SEQ ID NO: 1584157 - RNA, 19 nt, Homo sapiens
gucaggaguucgagaccaa

SEQ ID NO: 1584158 - RNA, 19 nt, Homo sapiens
cauuugaggucaggaguuc

SEQ ID NO: 1584159 - RNA, 19 nt, Homo sapiens
gccauuucaguuacuauaa

SEQ ID NO: 1584160 - RNA, 19 nt, Homo sapiens
gcgcaaggcccagaaugga

SEQ ID NO: 1584161 - RNA, 19 nt, Homo sapiens
ugacccacuuuguuucaug

SEQ ID NO: 1584162 - RNA, 19 nt, Homo sapiens
ccacugcuccaacgaggaa

SEQ ID NO: 1584163 - RNA, 19 nt, Homo sapiens
caggagggcugugguguac

SEQ ID NO: 1584164 - RNA, 19 nt, Homo sapiens
uguaaucccagcacuuuga

SEQ ID NO: 1584165 - RNA, 19 nt, Homo sapiens
gcacagccucuaggguuga

SEQ ID NO: 1584166 - RNA, 19 nt, Homo sapiens
gacaucacagcucuuauca

SEQ ID NO: 1584167 - RNA, 19 nt, Homo sapiens
ugagugagcaucaauucug

SEQ ID NO: 1584168 - RNA, 19 nt, Homo sapiens
gggugugugugcauguuug

SEQ ID NO: 1584169 - RNA, 19 nt, Homo sapiens
guguggaggagaugagaua

SEQ ID NO: 1584170 - RNA, 19 nt, Homo sapiens
ccuguaaucccagcacuuu

SEQ ID NO: 1584171 - RNA, 19 nt, Homo sapiens
uuacaugugagcucuuuga

SEQ ID NO: 1584172 - RNA, 19 nt, Homo sapiens
gcauggagaagugaauuca

SEQ ID NO: 1584173 - RNA, 19 nt, Homo sapiens
gauggagaaguuguuauug

SEQ ID NO: 1584174 - RNA, 19 nt, Homo sapiens
ggacagcauugcccuauua

SEQ ID NO: 1584175 - RNA, 19 nt, Homo sapiens
gaagccaaaucguaacuua

SEQ ID NO: 1584176 - RNA, 19 nt, Homo sapiens
gcacucagcucuucaugaa

SEQ ID NO: 1584177 - RNA, 19 nt, Homo sapiens
ggacagauauguugaaguc

SEQ ID NO: 1584178 - RNA, 19 nt, Homo sapiens
gagaugaacuuuguguuaa

SEQ ID NO: 1584179 - RNA, 19 nt, Homo sapiens
ggaaucagaugucuccauu

SEQ ID NO: 1584180 - RNA, 19 nt, Homo sapiens
gagagugaauuacaaguuu

SEQ ID NO: 1584181 - RNA, 19 nt, Homo sapiens
ggagaugaacuuuguguua

SEQ ID NO: 1584182 - RNA, 19 nt, Homo sapiens
gagaagcucugguuagguu

SEQ ID NO: 1584183 - RNA, 19 nt, Homo sapiens
gcacagaagugucauaaaa

SEQ ID NO: 1584184 - RNA, 19 nt, Homo sapiens
cagcauaccuggcucuuug

SEQ ID NO: 1584185 - RNA, 19 nt, Homo sapiens
gcagcaagauggaacuuau

SEQ ID NO: 1584186 - RNA, 19 nt, Homo sapiens
cuacagaagcugccauuua

SEQ ID NO: 1584187 - RNA, 19 nt, Homo sapiens
gcuaaguaauucaagcaua

SEQ ID NO: 1584188 - RNA, 19 nt, Homo sapiens
caaacgggccugugccuua

SEQ ID NO: 1584189 - RNA, 19 nt, Homo sapiens
gaacggagaagcucugguu

SEQ ID NO: 1584190 - RNA, 19 nt, Homo sapiens
aaucaugccuucuugcuaa

SEQ ID NO: 1584191 - RNA, 19 nt, Homo sapiens
guaguucagucucucgaua

SEQ ID NO: 1584192 - RNA, 19 nt, Homo sapiens
ucagaugucuccauuacuu

SEQ ID NO: 1584193 - RNA, 19 nt, Homo sapiens
ggccacagcugaagaagug

SEQ ID NO: 1584194 - RNA, 19 nt, Homo sapiens
caugaacucuguuaaggaa

SEQ ID NO: 1584195 - RNA, 19 nt, Homo sapiens
agauggaacuuauugauga

SEQ ID NO: 1584196 - RNA, 19 nt, Homo sapiens
ccacagauauucguacuca

SEQ ID NO: 1584197 - RNA, 19 nt, Homo sapiens
gaaggcauccucuuuguca

SEQ ID NO: 1584198 - RNA, 19 nt, Homo sapiens
ccaaugagguagcccaguu

SEQ ID NO: 1584199 - RNA, 19 nt, Homo sapiens
caguuaaaguggcaucaua

SEQ ID NO: 1584200 - RNA, 19 nt, Homo sapiens
ggaaguuugucuacacuca

SEQ ID NO: 1584201 - RNA, 19 nt, Homo sapiens
gaggaagcauaaagacuug

SEQ ID NO: 1584202 - RNA, 19 nt, Homo sapiens
agcauaagaucuuggaaua

SEQ ID NO: 1584203 - RNA, 19 nt, Homo sapiens
ggaguucgccacagauauu

SEQ ID NO: 1584204 - RNA, 19 nt, Homo sapiens
gcaccgagaccuagcacua

SEQ ID NO: 1584205 - RNA, 19 nt, Homo sapiens
auaaagacuuguuggguaa

SEQ ID NO: 1584206 - RNA, 19 nt, Homo sapiens
ccacaaugacagaguauuu

SEQ ID NO: 1584207 - RNA, 19 nt, Homo sapiens
ggaaauucuuaacuucuuc

SEQ ID NO: 1584208 - RNA, 19 nt, Homo sapiens
ucaaaggacucaauauugc

SEQ ID NO: 1584209 - RNA, 19 nt, Homo sapiens
gauguauggugaucuugaa

SEQ ID NO: 1584210 - RNA, 19 nt, Homo sapiens
cagauauguugaagucuuu

SEQ ID NO: 1584211 - RNA, 19 nt, Homo sapiens
gaacuacacagcguacuau

SEQ ID NO: 1584212 - RNA, 19 nt, Homo sapiens
gaugaacuuuguguuaaug

SEQ ID NO: 1584213 - RNA, 19 nt, Homo sapiens
ugaggaauaugcacagaau

SEQ ID NO: 1584214 - RNA, 19 nt, Homo sapiens
uuucagagccuuauaauca

SEQ ID NO: 1584215 - RNA, 19 nt, Homo sapiens
cagagagagugaauuacaa

SEQ ID NO: 1584216 - RNA, 19 nt, Homo sapiens
gaaaacuucuagcaaauuc

SEQ ID NO: 1584217 - RNA, 19 nt, Homo sapiens
uacagaagcugccauuuac

SEQ ID NO: 1584218 - RNA, 19 nt, Homo sapiens
caaggaaaaucaagucauu

SEQ ID NO: 1584219 - RNA, 19 nt, Homo sapiens
cccgguauauugagguuua

SEQ ID NO: 1584220 - RNA, 19 nt, Homo sapiens
gaaggacagauauguugaa

SEQ ID NO: 1584221 - RNA, 19 nt, Homo sapiens
uauggagccucucaaguug

SEQ ID NO: 1584222 - RNA, 19 nt, Homo sapiens
ccaugaugauaucuuauga

SEQ ID NO: 1584223 - RNA, 19 nt, Homo sapiens
uggccaugaugauaucuua

SEQ ID NO: 1584224 - RNA, 19 nt, Homo sapiens
gcauaagaucuuggaauaa

SEQ ID NO: 1584225 - RNA, 19 nt, Homo sapiens
acagauauguugaagucuu

SEQ ID NO: 1584226 - RNA, 19 nt, Homo sapiens
cacucaggcugcaguauuu

SEQ ID NO: 1584227 - RNA, 19 nt, Homo sapiens
cuacaauacuggaguuaag

SEQ ID NO: 1584228 - RNA, 19 nt, Homo sapiens
cuaauagucuuggcuacuu

SEQ ID NO: 1584229 - RNA, 19 nt, Homo sapiens
uaccagcccucugugauuu

SEQ ID NO: 1584230 - RNA, 19 nt, Homo sapiens
aguacuaccucagcaauuu

SEQ ID NO: 1584231 - RNA, 19 nt, Homo sapiens
aaucagaugucuccauuac

SEQ ID NO: 1584232 - RNA, 19 nt, Homo sapiens
caaagcaacaggugaagau

SEQ ID NO: 1584233 - RNA, 19 nt, Homo sapiens
gaaucagaugucuccauua

SEQ ID NO: 1584234 - RNA, 19 nt, Homo sapiens
cugaggagaugaacuuugu

SEQ ID NO: 1584235 - RNA, 19 nt, Homo sapiens
gagaugccuuuauccagau

SEQ ID NO: 1584236 - RNA, 19 nt, Homo sapiens
cacaaugacagaguauuua

SEQ ID NO: 1584237 - RNA, 19 nt, Homo sapiens
aaacaugaaggacagauau

SEQ ID NO: 1584238 - RNA, 19 nt, Homo sapiens
gcagcacuuugucugaaug

SEQ ID NO: 1584239 - RNA, 19 nt, Homo sapiens
caagauggaacuuauugau

SEQ ID NO: 1584240 - RNA, 19 nt, Homo sapiens
gcaagauggaacuuauuga

SEQ ID NO: 1584241 - RNA, 19 nt, Homo sapiens
cuagugaagccaaaucgua

SEQ ID NO: 1584242 - RNA, 19 nt, Homo sapiens
ugaaagauguauggugauc

SEQ ID NO: 1584243 - RNA, 19 nt, Homo sapiens
ugaggaagcauaaagacuu

SEQ ID NO: 1584244 - RNA, 19 nt, Homo sapiens
gagaagaguaguucagucu

SEQ ID NO: 1584245 - RNA, 19 nt, Homo sapiens
gaugauaacaccguaguca

SEQ ID NO: 1584246 - RNA, 19 nt, Homo sapiens
gauggaacuuauugaugau

SEQ ID NO: 1584247 - RNA, 19 nt, Homo sapiens
ccagagagagugaauuaca

SEQ ID NO: 1584248 - RNA, 19 nt, Homo sapiens
aaacgggccugugccuuau

SEQ ID NO: 1584249 - RNA, 19 nt, Homo sapiens
aggugaagauuuccuuaaa

SEQ ID NO: 1584250 - RNA, 19 nt, Homo sapiens
ucuaccaucuccaccauga

SEQ ID NO: 1584251 - RNA, 19 nt, Homo sapiens
gaaauguugcccugguuca

SEQ ID NO: 1584252 - RNA, 19 nt, Homo sapiens
cuugaaaccuccagacaca

SEQ ID NO: 1584253 - RNA, 19 nt, Homo sapiens
cuucaaaggacucaauauu

SEQ ID NO: 1584254 - RNA, 19 nt, Homo sapiens
caccugauauugacaaacu

SEQ ID NO: 1584255 - RNA, 19 nt, Homo sapiens
ggacguugccacaaugaca

SEQ ID NO: 1584256 - RNA, 19 nt, Homo sapiens
gaaaaucaagucauuguuc

SEQ ID NO: 1584257 - RNA, 19 nt, Homo sapiens
agucagggcacgagguuua

SEQ ID NO: 1584258 - RNA, 19 nt, Homo sapiens
gcaguuauuccuacagaag

SEQ ID NO: 1584259 - RNA, 19 nt, Homo sapiens
ggaagcauaaagacuuguu

SEQ ID NO: 1584260 - RNA, 19 nt, Homo sapiens
uuacaaagcaacaggugaa

SEQ ID NO: 1584261 - RNA, 19 nt, Homo sapiens
caugccuucuugcuaagua

SEQ ID NO: 1584262 - RNA, 19 nt, Homo sapiens
uccauuacuuccaguuaaa

SEQ ID NO: 1584263 - RNA, 19 nt, Homo sapiens
cuccauuacuuccaguuaa

SEQ ID NO: 1584264 - RNA, 19 nt, Homo sapiens
auacuggaguuaaggaaau

SEQ ID NO: 1584265 - RNA, 19 nt, Homo sapiens
ucaagauauugcaagauuc

SEQ ID NO: 1584266 - RNA, 19 nt, Homo sapiens
uagugaagccaaaucguaa

SEQ ID NO: 1584267 - RNA, 19 nt, Homo sapiens
caagguuaccaguguuuga

SEQ ID NO: 1584268 - RNA, 19 nt, Homo sapiens
cagcugaggagaugaacuu

SEQ ID NO: 1584269 - RNA, 19 nt, Homo sapiens
cagcauugcccuauuacug

SEQ ID NO: 1584270 - RNA, 19 nt, Homo sapiens
ggugaagauuuccuuaaaa

SEQ ID NO: 1584271 - RNA, 19 nt, Homo sapiens
cuacagaggcacaaacauc

SEQ ID NO: 1584272 - RNA, 19 nt, Homo sapiens
guaauucaagcauaagauc

SEQ ID NO: 1584273 - RNA, 19 nt, Homo sapiens
agagugaauuacaaguuug

SEQ ID NO: 1584274 - RNA, 19 nt, Homo sapiens
ggaccaagauguuccuuua

SEQ ID NO: 1584275 - RNA, 19 nt, Homo sapiens
gaagagaucggucuaaauu

SEQ ID NO: 1584276 - RNA, 19 nt, Homo sapiens
ggacaaauguugccuuuca

SEQ ID NO: 1584277 - RNA, 19 nt, Homo sapiens
gaaaucagcauucuaauca

SEQ ID NO: 1584278 - RNA, 19 nt, Homo sapiens
caagauagauuugggaauu

SEQ ID NO: 1584279 - RNA, 19 nt, Homo sapiens
gaagaaacucuguacauuu

SEQ ID NO: 1584280 - RNA, 19 nt, Homo sapiens
ugauaaagccugaagauua

SEQ ID NO: 1584281 - RNA, 19 nt, Homo sapiens
ggacuuugcuuccuacaug

SEQ ID NO: 1584282 - RNA, 19 nt, Homo sapiens
gaaauaugguggcaucuca

SEQ ID NO: 1584283 - RNA, 19 nt, Homo sapiens
gagcuacaauuaucaagaa

SEQ ID NO: 1584284 - RNA, 19 nt, Homo sapiens
gagaagagaucggucuaaa

SEQ ID NO: 1584285 - RNA, 19 nt, Homo sapiens
ggacucaguuaucauuaaa

SEQ ID NO: 1584286 - RNA, 19 nt, Homo sapiens
gaagugagccgcaccuuau

SEQ ID NO: 1584287 - RNA, 19 nt, Homo sapiens
gagaacaucuacucuuuca

SEQ ID NO: 1584288 - RNA, 19 nt, Homo sapiens
guacuuagccuucuguuau

SEQ ID NO: 1584289 - RNA, 19 nt, Homo sapiens
gaacaagagaaaugacuaa

SEQ ID NO: 1584290 - RNA, 19 nt, Homo sapiens
ggaauuuaauggugucuau

SEQ ID NO: 1584291 - RNA, 19 nt, Homo sapiens
gugcacagcuaaucuaaug

SEQ ID NO: 1584292 - RNA, 19 nt, Homo sapiens
gaucaggguucuagacuuc

SEQ ID NO: 1584293 - RNA, 19 nt, Homo sapiens
caacugauauuuguagaug

SEQ ID NO: 1584294 - RNA, 19 nt, Homo sapiens
ccaauuaaaugguuguguu

SEQ ID NO: 1584295 - RNA, 19 nt, Homo sapiens
aaugauggcucuggaaaua

SEQ ID NO: 1584296 - RNA, 19 nt, Homo sapiens
gcaaccaggacaucuguua

SEQ ID NO: 1584297 - RNA, 19 nt, Homo sapiens
gagcaauuaugggacaaua

SEQ ID NO: 1584298 - RNA, 19 nt, Homo sapiens
caagagaaaugacuaacca

SEQ ID NO: 1584299 - RNA, 19 nt, Homo sapiens
agaagaaacucuguacauu

SEQ ID NO: 1584300 - RNA, 19 nt, Homo sapiens
ggacaucuguuacuacaac

SEQ ID NO: 1584301 - RNA, 19 nt, Homo sapiens
ccaaagugcuggaauuuac

SEQ ID NO: 1584302 - RNA, 19 nt, Homo sapiens
ccgagaacaucuacucuuu

SEQ ID NO: 1584303 - RNA, 19 nt, Homo sapiens
uaccaugucugcccuaauu

SEQ ID NO: 1584304 - RNA, 19 nt, Homo sapiens
uaugugaaauccagucuuu

SEQ ID NO: 1584305 - RNA, 19 nt, Homo sapiens
caagucaacucaccaucuu

SEQ ID NO: 1584306 - RNA, 19 nt, Homo sapiens
aauguugccuuucacuuua

SEQ ID NO: 1584307 - RNA, 19 nt, Homo sapiens
gaaaugacuaaccauacua

SEQ ID NO: 1584308 - RNA, 19 nt, Homo sapiens
gauuuaaaccugcaagaaa

SEQ ID NO: 1584309 - RNA, 19 nt, Homo sapiens
ccaaagacguggacucagu

SEQ ID NO: 1584310 - RNA, 19 nt, Homo sapiens
cagaggagcuacaauuauc

SEQ ID NO: 1584311 - RNA, 19 nt, Homo sapiens
gcaauuaugggacaauaga

SEQ ID NO: 1584312 - RNA, 19 nt, Homo sapiens
aaauuaaagucaccucuug

SEQ ID NO: 1584313 - RNA, 19 nt, Homo sapiens
caacaacauucucagcaau

SEQ ID NO: 1584314 - RNA, 19 nt, Homo sapiens
gcaccgggcuuuggaagga

SEQ ID NO: 1584315 - RNA, 19 nt, Homo sapiens
ccagacaggccucaccuua

SEQ ID NO: 1584316 - RNA, 19 nt, Homo sapiens
gaaauuaaagucaccucuu

SEQ ID NO: 1584317 - RNA, 19 nt, Homo sapiens
gaacaucuacucuuucaac

SEQ ID NO: 1584318 - RNA, 19 nt, Homo sapiens
gugcuggaauuuacaggua

SEQ ID NO: 1584319 - RNA, 19 nt, Homo sapiens
gcacagcuaaucuaauguu

SEQ ID NO: 1584320 - RNA, 19 nt, Homo sapiens
gaaugcugcugcacacuuc

SEQ ID NO: 1584321 - RNA, 19 nt, Homo sapiens
ucauuaaaguggugucuga

SEQ ID NO: 1584322 - RNA, 19 nt, Homo sapiens
uauacaaguuucccaaaga

SEQ ID NO: 1584323 - RNA, 19 nt, Homo sapiens
uuaccaagcugaagcacuu

SEQ ID NO: 1584324 - RNA, 19 nt, Homo sapiens
ggaacaagagaaaugacua

SEQ ID NO: 1584325 - RNA, 19 nt, Homo sapiens
cgaccucuauauauggaua

SEQ ID NO: 1584326 - RNA, 19 nt, Homo sapiens
gguggcaucucaucccauu

SEQ ID NO: 1584327 - RNA, 19 nt, Homo sapiens
gcuuauccauguucuguug

SEQ ID NO: 1584328 - RNA, 19 nt, Homo sapiens
caucuacucuuucaacuac

SEQ ID NO: 1584329 - RNA, 19 nt, Homo sapiens
gaaggccaccaauuaaaug

SEQ ID NO: 1584330 - RNA, 19 nt, Homo sapiens
acauuccucuuaacaagua

SEQ ID NO: 1584331 - RNA, 19 nt, Homo sapiens
ugucacacauuccucuuaa

SEQ ID NO: 1584332 - RNA, 19 nt, Homo sapiens
uagccgaccucuauauaug

SEQ ID NO: 1584333 - RNA, 19 nt, Homo sapiens
ccucucaaccucaguauuu

SEQ ID NO: 1584334 - RNA, 19 nt, Homo sapiens
aaacauugauuuggucguu

SEQ ID NO: 1584335 - RNA, 19 nt, Homo sapiens
gcagcucugugucugagaa

SEQ ID NO: 1584336 - RNA, 19 nt, Homo sapiens
caucaccauugcuguguuu

SEQ ID NO: 1584337 - RNA, 19 nt, Homo sapiens
cauugucccuuccauuaaa

SEQ ID NO: 1584338 - RNA, 19 nt, Homo sapiens
gagcaguucuucgugguau

SEQ ID NO: 1584339 - RNA, 19 nt, Homo sapiens
auaugaaggccaccaauua

SEQ ID NO: 1584340 - RNA, 19 nt, Homo sapiens
gcacacuucccuccaguug

SEQ ID NO: 1584341 - RNA, 19 nt, Homo sapiens
ccagggacuuugcuuccua

SEQ ID NO: 1584342 - RNA, 19 nt, Homo sapiens
gggcugccaugguguucua

SEQ ID NO: 1584343 - RNA, 19 nt, Homo sapiens
ucagcacccagauauauua

SEQ ID NO: 1584344 - RNA, 19 nt, Homo sapiens
cuacaauuaucaagaagug

SEQ ID NO: 1584345 - RNA, 19 nt, Homo sapiens
uaugaaggccaccaauuaa

SEQ ID NO: 1584346 - RNA, 19 nt, Homo sapiens
cagcuaaucuaauguuguc

SEQ ID NO: 1584347 - RNA, 19 nt, Homo sapiens
gcucagugcuugcuaccau

SEQ ID NO: 1584348 - RNA, 19 nt, Homo sapiens
ucaacaacauucucagcaa

SEQ ID NO: 1584349 - RNA, 19 nt, Homo sapiens
uguaugaucucgaccacaa

SEQ ID NO: 1584350 - RNA, 19 nt, Homo sapiens
gaucauucguuagagaaau

SEQ ID NO: 1584351 - RNA, 19 nt, Homo sapiens
cgucaucugucacuuuaug

SEQ ID NO: 1584352 - RNA, 19 nt, Homo sapiens
agacaggccucaccuuaag

SEQ ID NO: 1584353 - RNA, 19 nt, Homo sapiens
gcaggaacaagagaaauga

SEQ ID NO: 1584354 - RNA, 19 nt, Homo sapiens
uggaggaucuuucuucauc

SEQ ID NO: 1584355 - RNA, 19 nt, Homo sapiens
uuaaaguggugucugaaau

SEQ ID NO: 1584356 - RNA, 19 nt, Homo sapiens
gguaggaccaccacacuug

SEQ ID NO: 1584357 - RNA, 19 nt, Homo sapiens
gcaaauucagcagagcuua

SEQ ID NO: 1584358 - RNA, 19 nt, Homo sapiens
ggaagccaaggacaucuuu

SEQ ID NO: 1584359 - RNA, 19 nt, Homo sapiens
ugccagacauugagaguga

SEQ ID NO: 1584360 - RNA, 19 nt, Homo sapiens
caccuuaugucccucagaa

SEQ ID NO: 1584361 - RNA, 19 nt, Homo sapiens
guauguauuugcuugugaa

SEQ ID NO: 1584362 - RNA, 19 nt, Homo sapiens
gacauucucuccccaguaa

SEQ ID NO: 1584363 - RNA, 19 nt, Homo sapiens
gcgaguccgucaucuguca

SEQ ID NO: 1584364 - RNA, 19 nt, Homo sapiens
acacauuccucuuaacaag

SEQ ID NO: 1584365 - RNA, 19 nt, Homo sapiens
cuagucaccucccagaaga

SEQ ID NO: 1584366 - RNA, 19 nt, Homo sapiens
gcccugcccuacugggaua

SEQ ID NO: 1584367 - RNA, 19 nt, Homo sapiens
gcauucugcuggauuucuu

SEQ ID NO: 1584368 - RNA, 19 nt, Homo sapiens
gauguuccuuuaccuguca

SEQ ID NO: 1584369 - RNA, 19 nt, Homo sapiens
ggaguaugacguaaucaga

SEQ ID NO: 1584370 - RNA, 19 nt, Homo sapiens
agagaaaugacuaaccaua

SEQ ID NO: 1584371 - RNA, 19 nt, Homo sapiens
ggagggagcgaucaaucuu

SEQ ID NO: 1584372 - RNA, 19 nt, Homo sapiens
caggacaucuguuacuaca

SEQ ID NO: 1584373 - RNA, 19 nt, Homo sapiens
ccaucacgcuacagaagaa

SEQ ID NO: 1584374 - RNA, 19 nt, Homo sapiens
gaaguauucuugcagauua

SEQ ID NO: 1584375 - RNA, 19 nt, Homo sapiens
gaugaaaggucucacauaa

SEQ ID NO: 1584376 - RNA, 19 nt, Homo sapiens
gcaaguaauuggagaagua

SEQ ID NO: 1584377 - RNA, 19 nt, Homo sapiens
ccacguaguucaaggauua

SEQ ID NO: 1584378 - RNA, 19 nt, Homo sapiens
ggaaguaucuauucacugu

SEQ ID NO: 1584379 - RNA, 19 nt, Homo sapiens
ugaaaggucucacauaaau

SEQ ID NO: 1584380 - RNA, 19 nt, Homo sapiens
gagugaagcgguuuaguua

SEQ ID NO: 1584381 - RNA, 19 nt, Homo sapiens
gaucuagagcuguguguua

SEQ ID NO: 1584382 - RNA, 19 nt, Homo sapiens
ggauguggauagcuuguuu

SEQ ID NO: 1584383 - RNA, 19 nt, Homo sapiens
gaaggaagacugacacugu

SEQ ID NO: 1584384 - RNA, 19 nt, Homo sapiens
ggagaugggugaagacaag

SEQ ID NO: 1584385 - RNA, 19 nt, Homo sapiens
guggauagcuuguuuagca

SEQ ID NO: 1584386 - RNA, 19 nt, Homo sapiens
guucaaggauuaugugaga

SEQ ID NO: 1584387 - RNA, 19 nt, Homo sapiens
aagaagagcugaaggaaca

SEQ ID NO: 1584388 - RNA, 19 nt, Homo sapiens
caaagaagccacugggaaa

SEQ ID NO: 1584389 - RNA, 19 nt, Homo sapiens
gaaccggccaugcaaguaa

SEQ ID NO: 1584390 - RNA, 19 nt, Homo sapiens
gugaagcgguuuaguuaga

SEQ ID NO: 1584391 - RNA, 19 nt, Homo sapiens
ugaagaggaugauggcaaa

SEQ ID NO: 1584392 - RNA, 19 nt, Homo sapiens
cgaauacaaccagaaauua

SEQ ID NO: 1584393 - RNA, 19 nt, Homo sapiens
ggagugaagcgguuuaguu

SEQ ID NO: 1584394 - RNA, 19 nt, Homo sapiens
gaagggagcagauaaacuc

SEQ ID NO: 1584395 - RNA, 19 nt, Homo sapiens
cagaagcccugauugacuu

SEQ ID NO: 1584396 - RNA, 19 nt, Homo sapiens
cagauaaacucgucacucu

SEQ ID NO: 1584397 - RNA, 19 nt, Homo sapiens
gggaaaagaucauuaagga

SEQ ID NO: 1584398 - RNA, 19 nt, Homo sapiens
gaacauuugagccacugua

SEQ ID NO: 1584399 - RNA, 19 nt, Homo sapiens
gauaaacucgucacucuag

SEQ ID NO: 1584400 - RNA, 19 nt, Homo sapiens
ccaagcugcugucauuguu

SEQ ID NO: 1584401 - RNA, 19 nt, Homo sapiens
ugaugaagcacauaguaua

SEQ ID NO: 1584402 - RNA, 19 nt, Homo sapiens
gagcugauacagacagaaa

SEQ ID NO: 1584403 - RNA, 19 nt, Homo sapiens
ggaagaagagcugaaggaa

SEQ ID NO: 1584404 - RNA, 19 nt, Homo sapiens
uuagagcucugcagcgauu

SEQ ID NO: 1584405 - RNA, 19 nt, Homo sapiens
gaauacaaccagaaauuac

SEQ ID NO: 1584406 - RNA, 19 nt, Homo sapiens
gaggaaguaucuauucacu

SEQ ID NO: 1584407 - RNA, 19 nt, Homo sapiens
ucaaggauuaugugagaua

SEQ ID NO: 1584408 - RNA, 19 nt, Homo sapiens
gcuuugcauucccuuuaua

SEQ ID NO: 1584409 - RNA, 19 nt, Homo sapiens
gggaauggccuacaacucu

SEQ ID NO: 1584410 - RNA, 19 nt, Homo sapiens
gaaaaggauuaucucaaug

SEQ ID NO: 1584411 - RNA, 19 nt, Homo sapiens
cugcauggccgucuucuuu

SEQ ID NO: 1584412 - RNA, 19 nt, Homo sapiens
ggucucacauaaauccuau

SEQ ID NO: 1584413 - RNA, 19 nt, Homo sapiens
ccgaauacaaccagaaauu

SEQ ID NO: 1584414 - RNA, 19 nt, Homo sapiens
auacuggaguccuaugaaa

SEQ ID NO: 1584415 - RNA, 19 nt, Homo sapiens
uauccaguccuuaaaguaa

SEQ ID NO: 1584416 - RNA, 19 nt, Homo sapiens
gagcugaaggaacauuuga

SEQ ID NO: 1584417 - RNA, 19 nt, Homo sapiens
ccacuggaagauauuuaua

SEQ ID NO: 1584418 - RNA, 19 nt, Homo sapiens
gauuaaagggccacuggaa

SEQ ID NO: 1584419 - RNA, 19 nt, Homo sapiens
agucaggccuuguuaaagu

SEQ ID NO: 1584420 - RNA, 19 nt, Homo sapiens
ugaggcaccuuagcaauca

SEQ ID NO: 1584421 - RNA, 19 nt, Homo sapiens
aggauuaucucaaugaucu

SEQ ID NO: 1584422 - RNA, 19 nt, Homo sapiens
caugaugaagcacauagua

SEQ ID NO: 1584423 - RNA, 19 nt, Homo sapiens
caaccagaaauuacaagaa

SEQ ID NO: 1584424 - RNA, 19 nt, Homo sapiens
gaccgaauacaaccagaaa

SEQ ID NO: 1584425 - RNA, 19 nt, Homo sapiens
uaauauggagcccaaagaa

SEQ ID NO: 1584426 - RNA, 19 nt, Homo sapiens
guaaggccuuuucaaauga

SEQ ID NO: 1584427 - RNA, 19 nt, Homo sapiens
guuagaagggagcagauaa

SEQ ID NO: 1584428 - RNA, 19 nt, Homo sapiens
gcuugucuuugccuaauau

SEQ ID NO: 1584429 - RNA, 19 nt, Homo sapiens
uaaacucgucacucuagua

SEQ ID NO: 1584430 - RNA, 19 nt, Homo sapiens
ggaaccggccaugcaagua

SEQ ID NO: 1584431 - RNA, 19 nt, Homo sapiens
gauguggauagcuuguuua

SEQ ID NO: 1584432 - RNA, 19 nt, Homo sapiens
ugaagcacauaguauacug

SEQ ID NO: 1584433 - RNA, 19 nt, Homo sapiens
uuaaagggccacuggaaga

SEQ ID NO: 1584434 - RNA, 19 nt, Homo sapiens
ugaagcgguuuaguuagaa

SEQ ID NO: 1584435 - RNA, 19 nt, Homo sapiens
agaagccacugggaaagaa

SEQ ID NO: 1584436 - RNA, 19 nt, Homo sapiens
uggaagaggccacaacaga

SEQ ID NO: 1584437 - RNA, 19 nt, Homo sapiens
gaagacugacacugugguu

SEQ ID NO: 1584438 - RNA, 19 nt, Homo sapiens
gagcacauggguuaaugga

SEQ ID NO: 1584439 - RNA, 19 nt, Homo sapiens
guauccaguccuuaaagua

SEQ ID NO: 1584440 - RNA, 19 nt, Homo sapiens
gaagagcugaaggaacauu

SEQ ID NO: 1584441 - RNA, 19 nt, Homo sapiens
aaucugacaggaccgaaua

SEQ ID NO: 1584442 - RNA, 19 nt, Homo sapiens
gaagcgguuuaguuagaag

SEQ ID NO: 1584443 - RNA, 19 nt, Homo sapiens
cacuggagcacauggguua

SEQ ID NO: 1584444 - RNA, 19 nt, Homo sapiens
gcugggagcucugcuuugc

SEQ ID NO: 1584445 - RNA, 19 nt, Homo sapiens
ggaccgaauacaaccagaa

SEQ ID NO: 1584446 - RNA, 19 nt, Homo sapiens
agacugacacugugguuga

SEQ ID NO: 1584447 - RNA, 19 nt, Homo sapiens
gaaaggucucacauaaauc

SEQ ID NO: 1584448 - RNA, 19 nt, Homo sapiens
gaugaagcacauaguauac

SEQ ID NO: 1584449 - RNA, 19 nt, Homo sapiens
gagagaaggaagacugaca

SEQ ID NO: 1584450 - RNA, 19 nt, Homo sapiens
auaguauacuggaguccua

SEQ ID NO: 1584451 - RNA, 19 nt, Homo sapiens
gucaggccuuguuaaaguu

SEQ ID NO: 1584452 - RNA, 19 nt, Homo sapiens
ucuauaugcuggagagaag

SEQ ID NO: 1584453 - RNA, 19 nt, Homo sapiens
aaauggauguagaugaaag

SEQ ID NO: 1584454 - RNA, 19 nt, Homo sapiens
cagggugaguguucuguag

SEQ ID NO: 1584455 - RNA, 19 nt, Homo sapiens
ugacaggaccgaauacaac

SEQ ID NO: 1584456 - RNA, 19 nt, Homo sapiens
gaagccacugggaaagaaa

SEQ ID NO: 1584457 - RNA, 19 nt, Homo sapiens
gaaaagccucuucuuaaag

SEQ ID NO: 1584458 - RNA, 19 nt, Homo sapiens
ggagcucugcuuugcauuc

SEQ ID NO: 1584459 - RNA, 19 nt, Homo sapiens
agaugaaaggucucacaua

SEQ ID NO: 1584460 - RNA, 19 nt, Homo sapiens
uuagaagggagcagauaaa

SEQ ID NO: 1584461 - RNA, 19 nt, Homo sapiens
cacauggguuaauggaguu

SEQ ID NO: 1584462 - RNA, 19 nt, Homo sapiens
aagggccacuggaagauau

SEQ ID NO: 1584463 - RNA, 19 nt, Homo sapiens
uucuguagcugagaccuua

SEQ ID NO: 1584464 - RNA, 19 nt, Homo sapiens
caaguaauuggagaaguau

SEQ ID NO: 1584465 - RNA, 19 nt, Homo sapiens
ugaggaggagccaaucuga

SEQ ID NO: 1584466 - RNA, 19 nt, Homo sapiens
cuuccuuucucaucccuaa

SEQ ID NO: 1584467 - RNA, 19 nt, Homo sapiens
caugaccacuggagcacau

SEQ ID NO: 1584468 - RNA, 19 nt, Homo sapiens
cugcuuugcauucccuuua

SEQ ID NO: 1584469 - RNA, 19 nt, Homo sapiens
guagaugaaaggucucaca

SEQ ID NO: 1584470 - RNA, 19 nt, Homo sapiens
aaagggccacuggaagaua

SEQ ID NO: 1584471 - RNA, 19 nt, Homo sapiens
ccagaagcccugauugacu

SEQ ID NO: 1584472 - RNA, 19 nt, Homo sapiens
aguaaggccuuuucaaaug

SEQ ID NO: 1584473 - RNA, 19 nt, Homo sapiens
guauacuggaguccuauga

SEQ ID NO: 1584474 - RNA, 19 nt, Homo sapiens
gaacaaaggucugugaaau

SEQ ID NO: 1584475 - RNA, 19 nt, Homo sapiens
ggaaugaauugaaucuuga

SEQ ID NO: 1584476 - RNA, 19 nt, Homo sapiens
ggucacaaguuuacuguuu

SEQ ID NO: 1584477 - RNA, 19 nt, Homo sapiens
ggacaaagccauccauguu

SEQ ID NO: 1584478 - RNA, 19 nt, Homo sapiens
ggcagaagcucauuacugu

SEQ ID NO: 1584479 - RNA, 19 nt, Homo sapiens
ccaucuaccucuucaauug

SEQ ID NO: 1584480 - RNA, 19 nt, Homo sapiens
ccucguacccucuuuauaa

SEQ ID NO: 1584481 - RNA, 19 nt, Homo sapiens
gagcuguggugguggauga

SEQ ID NO: 1584482 - RNA, 19 nt, Homo sapiens
cuuggcaucuucaacauua

SEQ ID NO: 1584483 - RNA, 19 nt, Homo sapiens
ccaaggagcucuggucauc

SEQ ID NO: 1584484 - RNA, 19 nt, Homo sapiens
ccaagucgccagccgcuua

SEQ ID NO: 1584485 - RNA, 19 nt, Homo sapiens
gagccacaguuccuccuuu

SEQ ID NO: 1584486 - RNA, 19 nt, Homo sapiens
gagcagggccaacuggaaa

SEQ ID NO: 1584487 - RNA, 19 nt, Homo sapiens
ccugagagcugaaucuauc

SEQ ID NO: 1584488 - RNA, 19 nt, Homo sapiens
ggaaaggaagguuggaaug

SEQ ID NO: 1584489 - RNA, 19 nt, Homo sapiens
ggccacaagugaccgcuuu

SEQ ID NO: 1584490 - RNA, 19 nt, Homo sapiens
caacuggaaagacguguuu

SEQ ID NO: 1584491 - RNA, 19 nt, Homo sapiens
caucagggcugugaacauc

SEQ ID NO: 1584492 - RNA, 19 nt, Homo sapiens
aggaaugaauugaaucuug

SEQ ID NO: 1584493 - RNA, 19 nt, Homo sapiens
caaagucgcgggugcguau

SEQ ID NO: 1584494 - RNA, 19 nt, Homo sapiens
acaaaggucugugaaaugg

SEQ ID NO: 1584495 - RNA, 19 nt, Homo sapiens
aggcgacgcuuucgaauuc

SEQ ID NO: 1584496 - RNA, 19 nt, Homo sapiens
gguggacgcuggagacaag

SEQ ID NO: 1584497 - RNA, 19 nt, Homo sapiens
gaaggaaugaauugaaucu

SEQ ID NO: 1584498 - RNA, 19 nt, Homo sapiens
gaaaggaagguuggaaugg

SEQ ID NO: 1584499 - RNA, 19 nt, Homo sapiens
ggugcgagcugaauuugag

SEQ ID NO: 1584500 - RNA, 19 nt, Homo sapiens
gugaggcgaugugaacaaa

SEQ ID NO: 1584501 - RNA, 19 nt, Homo sapiens
gauaugaggcaacaugaag

SEQ ID NO: 1584502 - RNA, 19 nt, Homo sapiens
gaggcaacaugaagaguac

SEQ ID NO: 1584503 - RNA, 19 nt, Homo sapiens
guacagacacagcauccuu

SEQ ID NO: 1584504 - RNA, 19 nt, Homo sapiens
gggcagaagcucauuacug

SEQ ID NO: 1584505 - RNA, 19 nt, Homo sapiens
gacaaagccauccauguuc

SEQ ID NO: 1584506 - RNA, 19 nt, Homo sapiens
guauaaauccggguaguuc

SEQ ID NO: 1584507 - RNA, 19 nt, Homo sapiens
gagcuguggccuucucuga

SEQ ID NO: 1584508 - RNA, 19 nt, Homo sapiens
ugacugaaggaaugaauug

SEQ ID NO: 1584509 - RNA, 19 nt, Homo sapiens
gaggcgaugugaacaaagg

SEQ ID NO: 1584510 - RNA, 19 nt, Homo sapiens
cugaaggaaugaauugaau

SEQ ID NO: 1584511 - RNA, 19 nt, Homo sapiens
gaugggcagaagcucauua

SEQ ID NO: 1584512 - RNA, 19 nt, Homo sapiens
gcugguggaugagaauguu

SEQ ID NO: 1584513 - RNA, 19 nt, Homo sapiens
cgucaacgcucagcucaca

SEQ ID NO: 1584514 - RNA, 19 nt, Homo sapiens
gcuaugcucaguauaaagu

SEQ ID NO: 1584515 - RNA, 19 nt, Homo sapiens
uguacuggcuccacugaug

SEQ ID NO: 1584516 - RNA, 19 nt, Homo sapiens
ugaggcaacaugaagagua

SEQ ID NO: 1584517 - RNA, 19 nt, Homo sapiens
ggauaugaggcaacaugaa

SEQ ID NO: 1584518 - RNA, 19 nt, Homo sapiens
gccagccgcuuaccucaca

SEQ ID NO: 1584519 - RNA, 19 nt, Homo sapiens
cagcugagagggaaaggaa

SEQ ID NO: 1584520 - RNA, 19 nt, Homo sapiens
ggagcagggccaacuggaa

SEQ ID NO: 1584521 - RNA, 19 nt, Homo sapiens
ucauuacugucuccaagga

SEQ ID NO: 1584522 - RNA, 19 nt, Homo sapiens
ugaacaaaggucugugaaa

SEQ ID NO: 1584523 - RNA, 19 nt, Homo sapiens
cuccauggcucaggaagaa

SEQ ID NO: 1584524 - RNA, 19 nt, Homo sapiens
acaaagccauccauguucu

SEQ ID NO: 1584525 - RNA, 19 nt, Homo sapiens
ccucagggucacaaguuua

SEQ ID NO: 1584526 - RNA, 19 nt, Homo sapiens
cguacccucuuuauaacuu

SEQ ID NO: 1584527 - RNA, 19 nt, Homo sapiens
ggagucaucagggcuguga

SEQ ID NO: 1584528 - RNA, 19 nt, Homo sapiens
ccagugaagguaccaucua

SEQ ID NO: 1584529 - RNA, 19 nt, Homo sapiens
gaccagcgccucaaguuuu

SEQ ID NO: 1584530 - RNA, 19 nt, Homo sapiens
ccgagagucugcuguguac

SEQ ID NO: 1584531 - RNA, 19 nt, Homo sapiens
uaauggauaugaggcaaca

SEQ ID NO: 1584532 - RNA, 19 nt, Homo sapiens
gggaaaggaagguuggaau

SEQ ID NO: 1584533 - RNA, 19 nt, Homo sapiens
guucgcaguuucugacagu

SEQ ID NO: 1584534 - RNA, 19 nt, Homo sapiens
caaagccauccauguucua

SEQ ID NO: 1584535 - RNA, 19 nt, Homo sapiens
gagagucugcuguguacug

SEQ ID NO: 1584536 - RNA, 19 nt, Homo sapiens
agacauggcucuggaucca

SEQ ID NO: 1584537 - RNA, 19 nt, Homo sapiens
gggcuaggcaucacugaca

SEQ ID NO: 1584538 - RNA, 19 nt, Homo sapiens
cugggugguuggcauaauu

SEQ ID NO: 1584539 - RNA, 19 nt, Homo sapiens
ucgcaggacugagggaaga

SEQ ID NO: 1584540 - RNA, 19 nt, Homo sapiens
gguauaaauccggguaguu

SEQ ID NO: 1584541 - RNA, 19 nt, Homo sapiens
cagcagccguacagacaca

SEQ ID NO: 1584542 - RNA, 19 nt, Homo sapiens
agacuuggagcaccgauga

SEQ ID NO: 1584543 - RNA, 19 nt, Homo sapiens
ugacuaccgucggcgcaaa

SEQ ID NO: 1584544 - RNA, 19 nt, Homo sapiens
ugaccagcgccucaaguuu

SEQ ID NO: 1584545 - RNA, 19 nt, Homo sapiens
gaaccucagggucacaagu

SEQ ID NO: 1584546 - RNA, 19 nt, Homo sapiens
uugcuaugcucaguauaaa

SEQ ID NO: 1584547 - RNA, 19 nt, Homo sapiens
aagaguacaucgcagacau

SEQ ID NO: 1584548 - RNA, 19 nt, Homo sapiens
ggucagcacaacccagaug

SEQ ID NO: 1584549 - RNA, 19 nt, Homo sapiens
gaagaguacaucgcagaca

SEQ ID NO: 1584550 - RNA, 19 nt, Homo sapiens
cagaagcucauuacugucu

SEQ ID NO: 1584551 - RNA, 19 nt, Homo sapiens
ccggguaguucgcaguuuc

SEQ ID NO: 1584552 - RNA, 19 nt, Homo sapiens
cagcagaccacaggagguu

SEQ ID NO: 1584553 - RNA, 19 nt, Homo sapiens
cagugaagguaccaucuac

SEQ ID NO: 1584554 - RNA, 19 nt, Homo sapiens
ccuccugggccuuguauga

SEQ ID NO: 1584555 - RNA, 19 nt, Homo sapiens
cuugcuaugcucaguauaa

SEQ ID NO: 1584556 - RNA, 19 nt, Homo sapiens
gccuguggcuccagugaag

SEQ ID NO: 1584557 - RNA, 19 nt, Homo sapiens
gagcacagacuggacuaag

SEQ ID NO: 1584558 - RNA, 19 nt, Homo sapiens
guacccucuuuauaacuuc

SEQ ID NO: 1584559 - RNA, 19 nt, Homo sapiens
ugaccgcuuugcccugaga

SEQ ID NO: 1584560 - RNA, 19 nt, Homo sapiens
caucaggucaccaucucaa

SEQ ID NO: 1584561 - RNA, 19 nt, Homo sapiens
aacaaaggucugugaaaug

SEQ ID NO: 1584562 - RNA, 19 nt, Homo sapiens
cacuugcuaugcucaguau

SEQ ID NO: 1584563 - RNA, 19 nt, Homo sapiens
uuaagaggcgucgguuuga

SEQ ID NO: 1584564 - RNA, 19 nt, Homo sapiens
gccaagagggagaaaccaa

SEQ ID NO: 1584565 - RNA, 19 nt, Homo sapiens
acgcucagcucacacuucu

SEQ ID NO: 1584566 - RNA, 19 nt, Homo sapiens
cagguccuaugcccaaaca

SEQ ID NO: 1584567 - RNA, 19 nt, Homo sapiens
uaagaggcgucgguuugag

SEQ ID NO: 1584568 - RNA, 19 nt, Homo sapiens
ggagcacagacuggacuaa

SEQ ID NO: 1584569 - RNA, 19 nt, Homo sapiens
ggguauaaauccggguagu

SEQ ID NO: 1584570 - RNA, 19 nt, Homo sapiens
gcagggccaacuggaaaga

SEQ ID NO: 1584571 - RNA, 19 nt, Homo sapiens
gaugugaacaaaggucugu

SEQ ID NO: 1584572 - RNA, 19 nt, Homo sapiens
ggugaggcgaugugaacaa

SEQ ID NO: 1584573 - RNA, 19 nt, Homo sapiens
caggcgacgcuuucgaauu

SEQ ID NO: 1584574 - RNA, 19 nt, Homo sapiens
gaagacagaucccaaggua

SEQ ID NO: 1584575 - RNA, 19 nt, Homo sapiens
gaagaaagauuccaagucu

SEQ ID NO: 1584576 - RNA, 19 nt, Homo sapiens
gaagagugcagaagaaaua

SEQ ID NO: 1584577 - RNA, 19 nt, Homo sapiens
gauccugacugaaaugaua

SEQ ID NO: 1584578 - RNA, 19 nt, Homo sapiens
ggagaaggaugcaaaggaa

SEQ ID NO: 1584579 - RNA, 19 nt, Homo sapiens
gaaaagagacuacugcuua

SEQ ID NO: 1584580 - RNA, 19 nt, Homo sapiens
gagcagucaucuccaauuu

SEQ ID NO: 1584581 - RNA, 19 nt, Homo sapiens
gacaagagcugcugguguu

SEQ ID NO: 1584582 - RNA, 19 nt, Homo sapiens
gagcaggagugguaaagaa

SEQ ID NO: 1584583 - RNA, 19 nt, Homo sapiens
gcacagaacaaacuuuauu

SEQ ID NO: 1584584 - RNA, 19 nt, Homo sapiens
ucaaguagaucuucaggaa

SEQ ID NO: 1584585 - RNA, 19 nt, Homo sapiens
gaaguaauaagacuggaua

SEQ ID NO: 1584586 - RNA, 19 nt, Homo sapiens
gaacaagacuaugaucagu

SEQ ID NO: 1584587 - RNA, 19 nt, Homo sapiens
gcacgaauaguuaucauga

SEQ ID NO: 1584588 - RNA, 19 nt, Homo sapiens
cuagcuaucugcacgaaua

SEQ ID NO: 1584589 - RNA, 19 nt, Homo sapiens
gaaaugaugcaguugaaga

SEQ ID NO: 1584590 - RNA, 19 nt, Homo sapiens
cacaauggauuuaguauca

SEQ ID NO: 1584591 - RNA, 19 nt, Homo sapiens
cacaauggaugcugauaaa

SEQ ID NO: 1584592 - RNA, 19 nt, Homo sapiens
cagaagaaauaaacucaga

SEQ ID NO: 1584593 - RNA, 19 nt, Homo sapiens
agagaaagauuugcagaaa

SEQ ID NO: 1584594 - RNA, 19 nt, Homo sapiens
gaaggugccugucuuuacu

SEQ ID NO: 1584595 - RNA, 19 nt, Homo sapiens
uggaagcgcuggugucauu

SEQ ID NO: 1584596 - RNA, 19 nt, Homo sapiens
gaagaaauggucugugugu

SEQ ID NO: 1584597 - RNA, 19 nt, Homo sapiens
gaacuacagugugucuaga

SEQ ID NO: 1584598 - RNA, 19 nt, Homo sapiens
ugaaagugcuguacaccaa

SEQ ID NO: 1584599 - RNA, 19 nt, Homo sapiens
gauuuaguaucaucaguga

SEQ ID NO: 1584600 - RNA, 19 nt, Homo sapiens
gaacgagccaagagaagaa

SEQ ID NO: 1584601 - RNA, 19 nt, Homo sapiens
agaaggcacugguggauug

SEQ ID NO: 1584602 - RNA, 19 nt, Homo sapiens
gcgcuggugucauuucuug

SEQ ID NO: 1584603 - RNA, 19 nt, Homo sapiens
agacuuggcucuggaagaa

SEQ ID NO: 1584604 - RNA, 19 nt, Homo sapiens
ugaaggcaauuaugaaaca

SEQ ID NO: 1584605 - RNA, 19 nt, Homo sapiens
gaucaguccuccacaaacu

SEQ ID NO: 1584606 - RNA, 19 nt, Homo sapiens
ucaugaagcucgggaagaa

SEQ ID NO: 1584607 - RNA, 19 nt, Homo sapiens
guucugagccggacccuuu

SEQ ID NO: 1584608 - RNA, 19 nt, Homo sapiens
gcagaaggugccugucuuu

SEQ ID NO: 1584609 - RNA, 19 nt, Homo sapiens
gugcacagaacaaacuuua

SEQ ID NO: 1584610 - RNA, 19 nt, Homo sapiens
uuaagcaacugguccaaga

SEQ ID NO: 1584611 - RNA, 19 nt, Homo sapiens
gaauucugaugacccaguu

SEQ ID NO: 1584612 - RNA, 19 nt, Homo sapiens
caauggaugcugauaaaga

SEQ ID NO: 1584613 - RNA, 19 nt, Homo sapiens
gagacugcaucacguuaug

SEQ ID NO: 1584614 - RNA, 19 nt, Homo sapiens
ggagaugaauucugaugac

SEQ ID NO: 1584615 - RNA, 19 nt, Homo sapiens
gugcaaagcaguuaagcaa

SEQ ID NO: 1584616 - RNA, 19 nt, Homo sapiens
gcucucaagugugaugaaa

SEQ ID NO: 1584617 - RNA, 19 nt, Homo sapiens
gcaauuaugaaacagcuau

SEQ ID NO: 1584618 - RNA, 19 nt, Homo sapiens
gggaagaaguaauaagacu

SEQ ID NO: 1584619 - RNA, 19 nt, Homo sapiens
auaugaaacuugaggacua

SEQ ID NO: 1584620 - RNA, 19 nt, Homo sapiens
gcugaaggcaauuaugaaa

SEQ ID NO: 1584621 - RNA, 19 nt, Homo sapiens
gaauaguuaucaugaagcu

SEQ ID NO: 1584622 - RNA, 19 nt, Homo sapiens
ucagagagguuaucuacac

SEQ ID NO: 1584623 - RNA, 19 nt, Homo sapiens
ucuagagaguguuauaaga

SEQ ID NO: 1584624 - RNA, 19 nt, Homo sapiens
gcauggaggugcccaacgu

SEQ ID NO: 1584625 - RNA, 19 nt, Homo sapiens
ucacaauggaugcugauaa

SEQ ID NO: 1584626 - RNA, 19 nt, Homo sapiens
ggauuccgguucacaaugg

SEQ ID NO: 1584627 - RNA, 19 nt, Homo sapiens
gauaaaugagugcacagaa

SEQ ID NO: 1584628 - RNA, 19 nt, Homo sapiens
cugaagaacuacagugugu

SEQ ID NO: 1584629 - RNA, 19 nt, Homo sapiens
ggaacgagccaagagaaga

SEQ ID NO: 1584630 - RNA, 19 nt, Homo sapiens
gcaacugguccaagaucua

SEQ ID NO: 1584631 - RNA, 19 nt, Homo sapiens
acaacgaggucauaagaag

SEQ ID NO: 1584632 - RNA, 19 nt, Homo sapiens
aagcagaccuucaagaaaa

SEQ ID NO: 1584633 - RNA, 19 nt, Homo sapiens
aggcuuauaugaaacuuga

SEQ ID NO: 1584634 - RNA, 19 nt, Homo sapiens
cccaugcgauucauccuuu

SEQ ID NO: 1584635 - RNA, 19 nt, Homo sapiens
cagaaugcacaauggauuu

SEQ ID NO: 1584636 - RNA, 19 nt, Homo sapiens
aaaggaagcccacgaacug

SEQ ID NO: 1584637 - RNA, 19 nt, Homo sapiens
cuagagaguguuauaagaa

SEQ ID NO: 1584638 - RNA, 19 nt, Homo sapiens
gaagcugaaggacaugaaa

SEQ ID NO: 1584639 - RNA, 19 nt, Homo sapiens
uggagaagcugaaggacau

SEQ ID NO: 1584640 - RNA, 19 nt, Homo sapiens
gcaaaggaacgagccaaga

SEQ ID NO: 1584641 - RNA, 19 nt, Homo sapiens
ugaugcaguugaagaaaug

SEQ ID NO: 1584642 - RNA, 19 nt, Homo sapiens
gaacugcuggauucaggaa

SEQ ID NO: 1584643 - RNA, 19 nt, Homo sapiens
gccaagagaagaagggaaa

SEQ ID NO: 1584644 - RNA, 19 nt, Homo sapiens
ggaugcugauaaagagaaa

SEQ ID NO: 1584645 - RNA, 19 nt, Homo sapiens
ugaggaaacugaggugcaa

SEQ ID NO: 1584646 - RNA, 19 nt, Homo sapiens
ggugucauuucuugauuuc

SEQ ID NO: 1584647 - RNA, 19 nt, Homo sapiens
gcugauaaagagaaagauu

SEQ ID NO: 1584648 - RNA, 19 nt, Homo sapiens
uugaagaaauggucugugu

SEQ ID NO: 1584649 - RNA, 19 nt, Homo sapiens
gaagaacuacagugugucu

SEQ ID NO: 1584650 - RNA, 19 nt, Homo sapiens
gcaggaccaccuugaacaa

SEQ ID NO: 1584651 - RNA, 19 nt, Homo sapiens
gaaugcaggaccaccuuga

SEQ ID NO: 1584652 - RNA, 19 nt, Homo sapiens
gcacaauggauuuaguauc

SEQ ID NO: 1584653 - RNA, 19 nt, Homo sapiens
aaacucagaggccuucuug

SEQ ID NO: 1584654 - RNA, 19 nt, Homo sapiens
caauggauuuaguaucauc

SEQ ID NO: 1584655 - RNA, 19 nt, Homo sapiens
acacagccgugaccaccaa

SEQ ID NO: 1584656 - RNA, 19 nt, Homo sapiens
ccacaaacugcucugaaga

SEQ ID NO: 1584657 - RNA, 19 nt, Homo sapiens
gcaggugaacgcaggcauu

SEQ ID NO: 1584658 - RNA, 19 nt, Homo sapiens
gcugcccucugccuuggua

SEQ ID NO: 1584659 - RNA, 19 nt, Homo sapiens
gaagacaggaggugagacu

SEQ ID NO: 1584660 - RNA, 19 nt, Homo sapiens
cagaaggugccugucuuua

SEQ ID NO: 1584661 - RNA, 19 nt, Homo sapiens
uaaaugagugcacagaaca

SEQ ID NO: 1584662 - RNA, 19 nt, Homo sapiens
aaagcagaccuucaagaaa

SEQ ID NO: 1584663 - RNA, 19 nt, Homo sapiens
uagagaguguuauaagaag

SEQ ID NO: 1584664 - RNA, 19 nt, Homo sapiens
uaugaaacuugaggacuau

SEQ ID NO: 1584665 - RNA, 19 nt, Homo sapiens
ucacaggcguucugaagac

SEQ ID NO: 1584666 - RNA, 19 nt, Homo sapiens
ugaccugaccagauuauug

SEQ ID NO: 1584667 - RNA, 19 nt, Homo sapiens
uggcaucuguggagaagga

SEQ ID NO: 1584668 - RNA, 19 nt, Homo sapiens
ccagcgccaucuuucagaa

SEQ ID NO: 1584669 - RNA, 19 nt, Homo sapiens
ccagugcauugccaucaug

SEQ ID NO: 1584670 - RNA, 19 nt, Homo sapiens
agacagaucccaagguaag

SEQ ID NO: 1584671 - RNA, 19 nt, Homo sapiens
aggaaaugaugcaguugaa

SEQ ID NO: 1584672 - RNA, 19 nt, Homo sapiens
uaugaucaguccuccacaa

SEQ ID NO: 1584673 - RNA, 19 nt, Homo sapiens
guucagagagguuaucuac

SEQ ID NO: 1584674 - RNA, 19 nt, Homo sapiens
gcaaugagcuguucaaaug

SEQ ID NO: 1584675 - RNA, 19 nt, Homo sapiens
agacacaucugccuucuuu

SEQ ID NO: 1584676 - RNA, 19 nt, Homo sapiens
gaaacccugucucuacuaa

SEQ ID NO: 1584677 - RNA, 19 nt, Homo sapiens
gaacuuagguagguuaugg

SEQ ID NO: 1584678 - RNA, 19 nt, Homo sapiens
gcuggaagauuacgacaaa

SEQ ID NO: 1584679 - RNA, 19 nt, Homo sapiens
gcacgagacuugcuugaac

SEQ ID NO: 1584680 - RNA, 19 nt, Homo sapiens
guucagcucuugcaacguu

SEQ ID NO: 1584681 - RNA, 19 nt, Homo sapiens
gaagagaagggcacugaga

SEQ ID NO: 1584682 - RNA, 19 nt, Homo sapiens
gggagagacugaccucaug

SEQ ID NO: 1584683 - RNA, 19 nt, Homo sapiens
acagaggcauccaaaggua

SEQ ID NO: 1584684 - RNA, 19 nt, Homo sapiens
guucaaauguggagacuac

SEQ ID NO: 1584685 - RNA, 19 nt, Homo sapiens
gcucuugccuggagacagu

SEQ ID NO: 1584686 - RNA, 19 nt, Homo sapiens
ggaguggagaggcugguua

SEQ ID NO: 1584687 - RNA, 19 nt, Homo sapiens
gagaaggugcgauacaugu

SEQ ID NO: 1584688 - RNA, 19 nt, Homo sapiens
gagccaagcccuagagaag

SEQ ID NO: 1584689 - RNA, 19 nt, Homo sapiens
acaucugccuucuuucuuu

SEQ ID NO: 1584690 - RNA, 19 nt, Homo sapiens
ugacagagcgagacuaucu

SEQ ID NO: 1584691 - RNA, 19 nt, Homo sapiens
accucaagcuggaagauua

SEQ ID NO: 1584692 - RNA, 19 nt, Homo sapiens
gcgaaacccugucucuacu

SEQ ID NO: 1584693 - RNA, 19 nt, Homo sapiens
ggagggcaaugagcuguuc

SEQ ID NO: 1584694 - RNA, 19 nt, Homo sapiens
aaagaacuuagguagguua

SEQ ID NO: 1584695 - RNA, 19 nt, Homo sapiens
ggagaaggugcgauacaug

SEQ ID NO: 1584696 - RNA, 19 nt, Homo sapiens
ugaggcagguggaucacuu

SEQ ID NO: 1584697 - RNA, 19 nt, Homo sapiens
caggaggccuugcggaaca

SEQ ID NO: 1584698 - RNA, 19 nt, Homo sapiens
aaacagaggcauccaaagg

SEQ ID NO: 1584699 - RNA, 19 nt, Homo sapiens
gcccugguguggagcugua

SEQ ID NO: 1584700 - RNA, 19 nt, Homo sapiens
agaaacagaggcauccaaa

SEQ ID NO: 1584701 - RNA, 19 nt, Homo sapiens
guacgcugguuggcauuug

SEQ ID NO: 1584702 - RNA, 19 nt, Homo sapiens
cagaagagaagggcacuga

SEQ ID NO: 1584703 - RNA, 19 nt, Homo sapiens
ggugacagagcgagacuau

SEQ ID NO: 1584704 - RNA, 19 nt, Homo sapiens
ggaagauuacgacaaagca

SEQ ID NO: 1584705 - RNA, 19 nt, Homo sapiens
acaaggagauacauguaac

SEQ ID NO: 1584706 - RNA, 19 nt, Homo sapiens
caucugccuucuuucuuuc

SEQ ID NO: 1584707 - RNA, 19 nt, Homo sapiens
guagugcacgccuguaauc

SEQ ID NO: 1584708 - RNA, 19 nt, Homo sapiens
gcucagccauugaaaagga

SEQ ID NO: 1584709 - RNA, 19 nt, Homo sapiens
aaugagcuguucaaaugug

SEQ ID NO: 1584710 - RNA, 19 nt, Homo sapiens
gaaacagaggcauccaaag

SEQ ID NO: 1584711 - RNA, 19 nt, Homo sapiens
ccuguaaucccagcacuuu

SEQ ID NO: 1584712 - RNA, 19 nt, Homo sapiens
ggcaaugagcuguucaaau

SEQ ID NO: 1584713 - RNA, 19 nt, Homo sapiens
ggccuuuccucgagaucuu

SEQ ID NO: 1584714 - RNA, 19 nt, Homo sapiens
agagaagggcacugagaaa

SEQ ID NO: 1584715 - RNA, 19 nt, Homo sapiens
uggagcagcugcggaagga

SEQ ID NO: 1584716 - RNA, 19 nt, Homo sapiens
ggcgaaacccugucucuac

SEQ ID NO: 1584717 - RNA, 19 nt, Homo sapiens
cagcuucagucccuuuguc

SEQ ID NO: 1584718 - RNA, 19 nt, Homo sapiens
gagcccaagaacaaaguuu

SEQ ID NO: 1584719 - RNA, 19 nt, Homo sapiens
ggagccaagcccuagagaa

SEQ ID NO: 1584720 - RNA, 19 nt, Homo sapiens
cccaggagguggagguugu

SEQ ID NO: 1584721 - RNA, 19 nt, Homo sapiens
cgaaacccugucucuacua

SEQ ID NO: 1584722 - RNA, 19 nt, Homo sapiens
gaccugcagagauguguga

SEQ ID NO: 1584723 - RNA, 19 nt, Homo sapiens
gcagcuacccucaccuuuu

SEQ ID NO: 1584724 - RNA, 19 nt, Homo sapiens
gccaagcccuagagaagcu

SEQ ID NO: 1584725 - RNA, 19 nt, Homo sapiens
aagagaagggcacugagaa

SEQ ID NO: 1584726 - RNA, 19 nt, Homo sapiens
ccccuuaccuuauucuaaa

SEQ ID NO: 1584727 - RNA, 19 nt, Homo sapiens
guaaugggguucagcucuu

SEQ ID NO: 1584728 - RNA, 19 nt, Homo sapiens
uggagacaguggccucaug

SEQ ID NO: 1584729 - RNA, 19 nt, Homo sapiens
cgucacauucuccuccuuu

SEQ ID NO: 1584730 - RNA, 19 nt, Homo sapiens
gagaagggcacugagaaaa

SEQ ID NO: 1584731 - RNA, 19 nt, Homo sapiens
gggcaaugagcuguucaaa

SEQ ID NO: 1584732 - RNA, 19 nt, Homo sapiens
caaggagauacauguaaca

SEQ ID NO: 1584733 - RNA, 19 nt, Homo sapiens
agagaugugugagcuugga

SEQ ID NO: 1584734 - RNA, 19 nt, Homo sapiens
cagcuacccucaccuuuuc

SEQ ID NO: 1584735 - RNA, 19 nt, Homo sapiens
cagaguacaaggagauaca

SEQ ID NO: 1584736 - RNA, 19 nt, Homo sapiens
ucacuugaggucaggaguu

SEQ ID NO: 1584737 - RNA, 19 nt, Homo sapiens
acacaucugccuucuuucu

SEQ ID NO: 1584738 - RNA, 19 nt, Homo sapiens
uccuugaccugcagagaug

SEQ ID NO: 1584739 - RNA, 19 nt, Homo sapiens
ccgcugcaccgucacauuc

SEQ ID NO: 1584740 - RNA, 19 nt, Homo sapiens
gucacauucuccuccuuug

SEQ ID NO: 1584741 - RNA, 19 nt, Homo sapiens
cagaaacagaggcauccaa

SEQ ID NO: 1584742 - RNA, 19 nt, Homo sapiens
gguagugcacgccuguaau

SEQ ID NO: 1584743 - RNA, 19 nt, Homo sapiens
cacuugaggucaggaguuc

SEQ ID NO: 1584744 - RNA, 19 nt, Homo sapiens
gacggaugccaaaguggaa

SEQ ID NO: 1584745 - RNA, 19 nt, Homo sapiens
gaauaaagccucaugaaau

SEQ ID NO: 1584746 - RNA, 19 nt, Homo sapiens
gcacagccacugaguauuu

SEQ ID NO: 1584747 - RNA, 19 nt, Homo sapiens
cagcagagauggagaguga

SEQ ID NO: 1584748 - RNA, 19 nt, Homo sapiens
gguaucagcugccucagaa

SEQ ID NO: 1584749 - RNA, 19 nt, Homo sapiens
gcagaggccuccuuucaag

SEQ ID NO: 1584750 - RNA, 19 nt, Homo sapiens
aauaaagccucaugaaauc

SEQ ID NO: 1584751 - RNA, 19 nt, Homo sapiens
ccacaccauucauucaauu

SEQ ID NO: 1584752 - RNA, 19 nt, Homo sapiens
ugaauaaagccucaugaaa

SEQ ID NO: 1584753 - RNA, 19 nt, Homo sapiens
gggcagaggccuccuuuca

SEQ ID NO: 1584754 - RNA, 19 nt, Homo sapiens
ggaugcggcugcuucuuuc

SEQ ID NO: 1584755 - RNA, 19 nt, Homo sapiens
gggaugcggcugcuucuuu

SEQ ID NO: 1584756 - RNA, 19 nt, Homo sapiens
gaggaaagaagacuaccuu

SEQ ID NO: 1584757 - RNA, 19 nt, Homo sapiens
gcagcuggguuaccuguac

SEQ ID NO: 1584758 - RNA, 19 nt, Homo sapiens
ccauuuagcacagaaguuu

SEQ ID NO: 1584759 - RNA, 19 nt, Homo sapiens
gcagaaggcaggcgaggau

SEQ ID NO: 1584760 - RNA, 19 nt, Homo sapiens
ggugaacggcguccuuuga

SEQ ID NO: 1584761 - RNA, 19 nt, Homo sapiens
ugacagauguguuguuuuc

SEQ ID NO: 1584762 - RNA, 19 nt, Homo sapiens
caagacacuuugggaggaa

SEQ ID NO: 1584763 - RNA, 19 nt, Homo sapiens
gcgcaugacccauuuagca

SEQ ID NO: 1584764 - RNA, 19 nt, Homo sapiens
ccucagaacaggcgcauga

SEQ ID NO: 1584765 - RNA, 19 nt, Homo sapiens
uggccaccauccucuauuu

SEQ ID NO: 1584766 - RNA, 19 nt, Homo sapiens
agugacagauguguuguuu

SEQ ID NO: 1584767 - RNA, 19 nt, Homo sapiens
gcuccuccgugaucuacuu

SEQ ID NO: 1584768 - RNA, 19 nt, Homo sapiens
ccucugggaucucagugaa

SEQ ID NO: 1584769 - RNA, 19 nt, Homo sapiens
acaagugacagauguguug

SEQ ID NO: 1584770 - RNA, 19 nt, Homo sapiens
cgugggcacugcucgacua

SEQ ID NO: 1584771 - RNA, 19 nt, Homo sapiens
acaggcgcaugacccauuu

SEQ ID NO: 1584772 - RNA, 19 nt, Homo sapiens
gggcacugcucgacuacca

SEQ ID NO: 1584773 - RNA, 19 nt, Homo sapiens
gaggcugcuucgccaguga

SEQ ID NO: 1584774 - RNA, 19 nt, Homo sapiens
ucaaggggcugcuuuucaa

SEQ ID NO: 1584775 - RNA, 19 nt, Homo sapiens
ggcagaggccuccuuucaa

SEQ ID NO: 1584776 - RNA, 19 nt, Homo sapiens
gaaggcaggcgaggauaag

SEQ ID NO: 1584777 - RNA, 19 nt, Homo sapiens
gugaacggcguccuuugaa

SEQ ID NO: 1584778 - RNA, 19 nt, Homo sapiens
gaaccucugggaucucagu

SEQ ID NO: 1584779 - RNA, 19 nt, Homo sapiens
ggaacaagaccagcuacca

SEQ ID NO: 1584780 - RNA, 19 nt, Homo sapiens
gcucuucgagaccuucuug

SEQ ID NO: 1584781 - RNA, 19 nt, Homo sapiens
agaaggcaggcgaggauaa

SEQ ID NO: 1584782 - RNA, 19 nt, Homo sapiens
ugaacggcguccuuugaag

SEQ ID NO: 1584783 - RNA, 19 nt, Homo sapiens
uaugugagaggaagagaau

SEQ ID NO: 1584784 - RNA, 19 nt, Homo sapiens
ccuccuaccucagucuaug

SEQ ID NO: 1584785 - RNA, 19 nt, Homo sapiens
acagugaacaagaugagaa

SEQ ID NO: 1584786 - RNA, 19 nt, Homo sapiens
gcgaggauaagcuaacgau

SEQ ID NO: 1584787 - RNA, 19 nt, Homo sapiens
ccuccugagugacagcauu

SEQ ID NO: 1584788 - RNA, 19 nt, Homo sapiens
ugacccauuuagcacagaa

SEQ ID NO: 1584789 - RNA, 19 nt, Homo sapiens
ccaccauccucuauuucuc

SEQ ID NO: 1584790 - RNA, 19 nt, Homo sapiens
ggcaggcgaggauaagcua

SEQ ID NO: 1584791 - RNA, 19 nt, Homo sapiens
uugcacagccacugaguau

SEQ ID NO: 1584792 - RNA, 19 nt, Homo sapiens
aggauaagcuaacgaugcu

SEQ ID NO: 1584793 - RNA, 19 nt, Homo sapiens
gcagagauggagagugacu

SEQ ID NO: 1584794 - RNA, 19 nt, Homo sapiens
ucgccuuccuccugaguga

SEQ ID NO: 1584795 - RNA, 19 nt, Homo sapiens
gcaggcgaggauaagcuaa

SEQ ID NO: 1584796 - RNA, 19 nt, Homo sapiens
ucagggcacagacuucaug

SEQ ID NO: 1584797 - RNA, 19 nt, Homo sapiens
uaucagcugccucagaaca

SEQ ID NO: 1584798 - RNA, 19 nt, Homo sapiens
gggcagaacuggacguuug

SEQ ID NO: 1584799 - RNA, 19 nt, Homo sapiens
gcagagugcuccuagauca

SEQ ID NO: 1584800 - RNA, 19 nt, Homo sapiens
gcuccuagaucaccauaaa

SEQ ID NO: 1584801 - RNA, 19 nt, Homo sapiens
cgacaucacuugccagaca

SEQ ID NO: 1584802 - RNA, 19 nt, Homo sapiens
agagucugcugaaacguua

SEQ ID NO: 1584803 - RNA, 19 nt, Homo sapiens
gaccaaccaugcauacauc

SEQ ID NO: 1584804 - RNA, 19 nt, Homo sapiens
ccaccaaugugcuccuuau

SEQ ID NO: 1584805 - RNA, 19 nt, Homo sapiens
ccuauucacugucacuuug

SEQ ID NO: 1584806 - RNA, 19 nt, Homo sapiens
acacagagcaggcuucaga

SEQ ID NO: 1584807 - RNA, 19 nt, Homo sapiens
gguuucagauggaccuauu

SEQ ID NO: 1584808 - RNA, 19 nt, Homo sapiens
gaacuggacguuugcuuuu

SEQ ID NO: 1584809 - RNA, 19 nt, Homo sapiens
ccaggccucucuccaagug

SEQ ID NO: 1584810 - RNA, 19 nt, Homo sapiens
ccaaugugcuccuuaugcu

SEQ ID NO: 1584811 - RNA, 19 nt, Homo sapiens
ucacuugccauugagauuu

SEQ ID NO: 1584812 - RNA, 19 nt, Homo sapiens
gagggcgaguguccuaauc

SEQ ID NO: 1584813 - RNA, 19 nt, Homo sapiens
agauggaccuauucacugu

SEQ ID NO: 1584814 - RNA, 19 nt, Homo sapiens
gcuuagagcgguuucagau

SEQ ID NO: 1584815 - RNA, 19 nt, Homo sapiens
ccgagucccuuccacuugu

SEQ ID NO: 1584816 - RNA, 19 nt, Homo sapiens
ggauggggcuccuggauca

SEQ ID NO: 1584817 - RNA, 19 nt, Homo sapiens
agaacuggacguuugcuuu

SEQ ID NO: 1584818 - RNA, 19 nt, Homo sapiens
gacaugaucguggaagaau

SEQ ID NO: 1584819 - RNA, 19 nt, Homo sapiens
cgaguguccuaauccuguu

SEQ ID NO: 1584820 - RNA, 19 nt, Homo sapiens
agccaaagcccgacacaga

SEQ ID NO: 1584821 - RNA, 19 nt, Homo sapiens
cgaccaaccaugcauacau

SEQ ID NO: 1584822 - RNA, 19 nt, Homo sapiens
ugaccaggccucucuccaa

SEQ ID NO: 1584823 - RNA, 19 nt, Homo sapiens
ccgcugagcaugcuguaug

SEQ ID NO: 1584824 - RNA, 19 nt, Homo sapiens
caugaucguggaagaaugu

SEQ ID NO: 1584825 - RNA, 19 nt, Homo sapiens
cuagaucaccauaaagaca

SEQ ID NO: 1584826 - RNA, 19 nt, Homo sapiens
cgagucccuuccacuuguu

SEQ ID NO: 1584827 - RNA, 19 nt, Homo sapiens
aagacaugaucguggaaga

SEQ ID NO: 1584828 - RNA, 19 nt, Homo sapiens
gacguuugcuuuugacuuc

SEQ ID NO: 1584829 - RNA, 19 nt, Homo sapiens
gagcaugcuguauguggau

SEQ ID NO: 1584830 - RNA, 19 nt, Homo sapiens
augcauacauccagagucu

SEQ ID NO: 1584831 - RNA, 19 nt, Homo sapiens
ucagauggaccuauucacu

SEQ ID NO: 1584832 - RNA, 19 nt, Homo sapiens
uagagcgguuucagaugga

SEQ ID NO: 1584833 - RNA, 19 nt, Homo sapiens
gcaccgucgacaucacuug

SEQ ID NO: 1584834 - RNA, 19 nt, Homo sapiens
caagaggcaccgucgacau

SEQ ID NO: 1584835 - RNA, 19 nt, Homo sapiens
agggcucacuugccauuga

SEQ ID NO: 1584836 - RNA, 19 nt, Homo sapiens
agaccaagccgcugagcau

SEQ ID NO: 1584837 - RNA, 19 nt, Homo sapiens
gcaugcuguauguggauaa

SEQ ID NO: 1584838 - RNA, 19 nt, Homo sapiens
ggcuucagacagcugcuua

SEQ ID NO: 1584839 - RNA, 19 nt, Homo sapiens
gagcagagcuuacuucauu

SEQ ID NO: 1584840 - RNA, 19 nt, Homo sapiens
aaacugcgcucuaauaaga

SEQ ID NO: 1584841 - RNA, 19 nt, Homo sapiens
gcacgaggcuguccacaca

SEQ ID NO: 1584842 - RNA, 19 nt, Homo sapiens
ggaagucacagaacaguaa

SEQ ID NO: 1584843 - RNA, 19 nt, Homo sapiens
acacagagccuuuggauga

SEQ ID NO: 1584844 - RNA, 19 nt, Homo sapiens
aaucaaggaucacaaacua

SEQ ID NO: 1584845 - RNA, 19 nt, Homo sapiens
uuaagagacucaucagauu

SEQ ID NO: 1584846 - RNA, 19 nt, Homo sapiens
caacuugacaucaugcuuu

SEQ ID NO: 1584847 - RNA, 19 nt, Homo sapiens
gagaccaaaugcaggguaa

SEQ ID NO: 1584848 - RNA, 19 nt, Homo sapiens
gaagcaaaguuaagagacu

SEQ ID NO: 1584849 - RNA, 19 nt, Homo sapiens
ccagcgggcuccucaauuc

SEQ ID NO: 1584850 - RNA, 19 nt, Homo sapiens
gagaaaagcaucugcaaaa

SEQ ID NO: 1584851 - RNA, 19 nt, Homo sapiens
gacaggaaucaaaguguua

SEQ ID NO: 1584852 - RNA, 19 nt, Homo sapiens
acacuugguuccucacaaa

SEQ ID NO: 1584853 - RNA, 19 nt, Homo sapiens
aaacguguguaucaaguau

SEQ ID NO: 1584854 - RNA, 19 nt, Homo sapiens
cagccuguguuuguaaaua

SEQ ID NO: 1584855 - RNA, 19 nt, Homo sapiens
ggaaucaaaguguuaggaa

SEQ ID NO: 1584856 - RNA, 19 nt, Homo sapiens
cacaaacugcgcucuaaua

SEQ ID NO: 1584857 - RNA, 19 nt, Homo sapiens
agacaggaaucaaaguguu

SEQ ID NO: 1584858 - RNA, 19 nt, Homo sapiens
ccacaucccuggacacacu

SEQ ID NO: 1584859 - RNA, 19 nt, Homo sapiens
gaucaggaaaguuugagaa

SEQ ID NO: 1584860 - RNA, 19 nt, Homo sapiens
gaagacaggaagcguuuca

SEQ ID NO: 1584861 - RNA, 19 nt, Homo sapiens
acaaacugcgcucuaauaa

SEQ ID NO: 1584862 - RNA, 19 nt, Homo sapiens
gaacaguaauacgcuagca

SEQ ID NO: 1584863 - RNA, 19 nt, Homo sapiens
guuaagagacucaucagau

SEQ ID NO: 1584864 - RNA, 19 nt, Homo sapiens
gaagaacagaagacaggaa

SEQ ID NO: 1584865 - RNA, 19 nt, Homo sapiens
gaauguuuggagaauguua

SEQ ID NO: 1584866 - RNA, 19 nt, Homo sapiens
cagaagacaggaagcguuu

SEQ ID NO: 1584867 - RNA, 19 nt, Homo sapiens
gagcugcugcgggauauuu

SEQ ID NO: 1584868 - RNA, 19 nt, Homo sapiens
gaaaacguguguaucaagu

SEQ ID NO: 1584869 - RNA, 19 nt, Homo sapiens
uugcugacgugcuguauug

SEQ ID NO: 1584870 - RNA, 19 nt, Homo sapiens
ucacagggaagucacagaa

SEQ ID NO: 1584871 - RNA, 19 nt, Homo sapiens
uggaauguuuggagaaugu

SEQ ID NO: 1584872 - RNA, 19 nt, Homo sapiens
caagacaggaaucaaagug

SEQ ID NO: 1584873 - RNA, 19 nt, Homo sapiens
acagggaagucacagaaca

SEQ ID NO: 1584874 - RNA, 19 nt, Homo sapiens
gacaucaugcuuucuggaa

SEQ ID NO: 1584875 - RNA, 19 nt, Homo sapiens
cuguaggacucacacauga

SEQ ID NO: 1584876 - RNA, 19 nt, Homo sapiens
gaaucaaggaucacaaacu

SEQ ID NO: 1584877 - RNA, 19 nt, Homo sapiens
uaagagacucaucagauuc

SEQ ID NO: 1584878 - RNA, 19 nt, Homo sapiens
ucaaggaucacaaacuaca

SEQ ID NO: 1584879 - RNA, 19 nt, Homo sapiens
gucccuaacucccucacuu

SEQ ID NO: 1584880 - RNA, 19 nt, Homo sapiens
ccacacagagccuuuggau

SEQ ID NO: 1584881 - RNA, 19 nt, Homo sapiens
uuaggaacauggcagaaag

SEQ ID NO: 1584882 - RNA, 19 nt, Homo sapiens
aaaguuaagagacucauca

SEQ ID NO: 1584883 - RNA, 19 nt, Homo sapiens
agccuguguuuguaaauaa

SEQ ID NO: 1584884 - RNA, 19 nt, Homo sapiens
aagcugaaccucacacugu

SEQ ID NO: 1584885 - RNA, 19 nt, Homo sapiens
gccuguguuuguaaauaaa

SEQ ID NO: 1584886 - RNA, 19 nt, Homo sapiens
gggaagucacagaacagua

SEQ ID NO: 1584887 - RNA, 19 nt, Homo sapiens
guuaggaacauggcagaaa

SEQ ID NO: 1584888 - RNA, 19 nt, Homo sapiens
ccuccaacuugacaucaug

SEQ ID NO: 1584889 - RNA, 19 nt, Homo sapiens
gaagucacagaacaguaau

SEQ ID NO: 1584890 - RNA, 19 nt, Homo sapiens
aaaugcaggguaaggagua

SEQ ID NO: 1584891 - RNA, 19 nt, Homo sapiens
uagaagcaaaguuaagaga

SEQ ID NO: 1584892 - RNA, 19 nt, Homo sapiens
gagaugugccagcuguuca

SEQ ID NO: 1584893 - RNA, 19 nt, Homo sapiens
caggaaaguuugagaaaag

SEQ ID NO: 1584894 - RNA, 19 nt, Homo sapiens
gcgcugcucgaaaggguuu

SEQ ID NO: 1584895 - RNA, 19 nt, Homo sapiens
caaaugaaaacguguguau

SEQ ID NO: 1584896 - RNA, 19 nt, Homo sapiens
uuucaagacaggaaucaaa

SEQ ID NO: 1584897 - RNA, 19 nt, Homo sapiens
acguguguaucaaguauga

SEQ ID NO: 1584898 - RNA, 19 nt, Homo sapiens
caaacugcgcucuaauaag

SEQ ID NO: 1584899 - RNA, 19 nt, Homo sapiens
ccacaaacugcgcucuaau

SEQ ID NO: 1584900 - RNA, 19 nt, Homo sapiens
aaagagcagagcuuacuuc

SEQ ID NO: 1584901 - RNA, 19 nt, Homo sapiens
accacaaacugcgcucuaa

SEQ ID NO: 1584902 - RNA, 19 nt, Homo sapiens
uaaagagcagagcuuacuu

SEQ ID NO: 1584903 - RNA, 19 nt, Homo sapiens
agacaggaagcguuucaga

SEQ ID NO: 1584904 - RNA, 19 nt, Homo sapiens
gcuguucaccaccgagcua

SEQ ID NO: 1584905 - RNA, 19 nt, Homo sapiens
gcaggaucaggaaaguuug

SEQ ID NO: 1584906 - RNA, 19 nt, Homo sapiens
gcagaggucacagggaagu

SEQ ID NO: 1584907 - RNA, 19 nt, Homo sapiens
caacguggacacacuuggu

SEQ ID NO: 1584908 - RNA, 19 nt, Homo sapiens
ucaggaaaguuugagaaaa

SEQ ID NO: 1584909 - RNA, 19 nt, Homo sapiens
agcugaaccucacacugua

SEQ ID NO: 1584910 - RNA, 19 nt, Homo sapiens
cugaaucaaggaucacaaa

SEQ ID NO: 1584911 - RNA, 19 nt, Homo sapiens
caccacugccuucauuuca

SEQ ID NO: 1584912 - RNA, 19 nt, Homo sapiens
gagcagagcuuacuucauu

SEQ ID NO: 1584913 - RNA, 19 nt, Homo sapiens
aaacugcgcucuaauaaga

SEQ ID NO: 1584914 - RNA, 19 nt, Homo sapiens
cagaagacgugcuguauug

SEQ ID NO: 1584915 - RNA, 19 nt, Homo sapiens
ggaagucacagaacaguaa

SEQ ID NO: 1584916 - RNA, 19 nt, Homo sapiens
aaucaaggaucacaaacua

SEQ ID NO: 1584917 - RNA, 19 nt, Homo sapiens
uuaagagacucaucagauu

SEQ ID NO: 1584918 - RNA, 19 nt, Homo sapiens
caacuugacaucaugcuuu

SEQ ID NO: 1584919 - RNA, 19 nt, Homo sapiens
gagaccaaaugcaggguaa

SEQ ID NO: 1584920 - RNA, 19 nt, Homo sapiens
gaagcaaaguuaagagacu

SEQ ID NO: 1584921 - RNA, 19 nt, Homo sapiens
ccagcgggcuccucaauuc

SEQ ID NO: 1584922 - RNA, 19 nt, Homo sapiens
gagaaaagcaucugcaaaa

SEQ ID NO: 1584923 - RNA, 19 nt, Homo sapiens
gcagaagacgugcuguauu

SEQ ID NO: 1584924 - RNA, 19 nt, Homo sapiens
gacaggaaucaaaguguua

SEQ ID NO: 1584925 - RNA, 19 nt, Homo sapiens
acacuugguuccucacaaa

SEQ ID NO: 1584926 - RNA, 19 nt, Homo sapiens
aaacguguguaucaaguau

SEQ ID NO: 1584927 - RNA, 19 nt, Homo sapiens
cagccuguguuuguaaaua

SEQ ID NO: 1584928 - RNA, 19 nt, Homo sapiens
ggaaucaaaguguuaggaa

SEQ ID NO: 1584929 - RNA, 19 nt, Homo sapiens
cacaaacugcgcucuaaua

SEQ ID NO: 1584930 - RNA, 19 nt, Homo sapiens
agacaggaaucaaaguguu

SEQ ID NO: 1584931 - RNA, 19 nt, Homo sapiens
ccacaucccuggacacacu

SEQ ID NO: 1584932 - RNA, 19 nt, Homo sapiens
ccacaucccuggacacacu

SEQ ID NO: 1584933 - RNA, 19 nt, Homo sapiens
ccacaucccuggacacacu

SEQ ID NO: 1584934 - RNA, 19 nt, Homo sapiens
gaucaggaaaguuugagaa

SEQ ID NO: 1584935 - RNA, 19 nt, Homo sapiens
gaagacaggaagcguuuca

SEQ ID NO: 1584936 - RNA, 19 nt, Homo sapiens
acaaacugcgcucuaauaa

SEQ ID NO: 1584937 - RNA, 19 nt, Homo sapiens
gaacaguaauacgcuagca

SEQ ID NO: 1584938 - RNA, 19 nt, Homo sapiens
guuaagagacucaucagau

SEQ ID NO: 1584939 - RNA, 19 nt, Homo sapiens
gaagaacagaagacaggaa

SEQ ID NO: 1584940 - RNA, 19 nt, Homo sapiens
cagaagacaggaagcguuu

SEQ ID NO: 1584941 - RNA, 19 nt, Homo sapiens
gagcugcugcgggauauuu

SEQ ID NO: 1584942 - RNA, 19 nt, Homo sapiens
acacucgguuccucacaaa

SEQ ID NO: 1584943 - RNA, 19 nt, Homo sapiens
ucacagggaagucacagaa

SEQ ID NO: 1584944 - RNA, 19 nt, Homo sapiens
caagacaggaaucaaagug

SEQ ID NO: 1584945 - RNA, 19 nt, Homo sapiens
acagggaagucacagaaca

SEQ ID NO: 1584946 - RNA, 19 nt, Homo sapiens
gacaucaugcuuucuggaa

SEQ ID NO: 1584947 - RNA, 19 nt, Homo sapiens
cuguaggacucacacauga

SEQ ID NO: 1584948 - RNA, 19 nt, Homo sapiens
gaaucaaggaucacaaacu

SEQ ID NO: 1584949 - RNA, 19 nt, Homo sapiens
uaagagacucaucagauuc

SEQ ID NO: 1584950 - RNA, 19 nt, Homo sapiens
ucaaggaucacaaacuaca

SEQ ID NO: 1584951 - RNA, 19 nt, Homo sapiens
uuaggaacauggcagaaag

SEQ ID NO: 1584952 - RNA, 19 nt, Homo sapiens
aaaguuaagagacucauca

SEQ ID NO: 1584953 - RNA, 19 nt, Homo sapiens
agccuguguuuguaaauaa

SEQ ID NO: 1584954 - RNA, 19 nt, Homo sapiens
aagcugaaccucacacugu

SEQ ID NO: 1584955 - RNA, 19 nt, Homo sapiens
gccuguguuuguaaauaaa

SEQ ID NO: 1584956 - RNA, 19 nt, Homo sapiens
gggaagucacagaacagua

SEQ ID NO: 1584957 - RNA, 19 nt, Homo sapiens
guuaggaacauggcagaaa
